United States Patent 12,551,560 (COMPOSITIONS AND METHODS FOR USE IN IMMUNOTHERAPY) - sequence listing, part 2

SEQ ID NO: 7997 - RNA, 20 nt, Artificial Sequence
  TRAC targeting sequence
ucugauuaaagacucaaagg

SEQ ID NO: 7998 - RNA, 20 nt, Artificial Sequence
  TRAC targeting sequence
gauuaaagacucaaaggaaa

SEQ ID NO: 7999 - RNA, 20 nt, Artificial Sequence
  TRAC targeting sequence
gaggauaacaaugaucauuu

SEQ ID NO: 8000 - RNA, 20 nt, Artificial Sequence
  TRAC targeting sequence
uuaaucagaggauaacaaug

SEQ ID NO: 8001 - RNA, 20 nt, Artificial Sequence
  TRAC targeting sequence
aaggaaacuauacaguaguc

SEQ ID NO: 8002 - RNA, 20 nt, Artificial Sequence
  TRAC targeting sequence
uuugagucuuuaaucagagg

SEQ ID NO: 8003 - RNA, 20 nt, Artificial Sequence
  TRAC targeting sequence
guccccuacagaagaaugag

SEQ ID NO: 8004 - RNA, 20 nt, Artificial Sequence
  TRAC targeting sequence
ccuacagaagaaugaguauu

SEQ ID NO: 8005 - RNA, 20 nt, Artificial Sequence
  TRAC targeting sequence
guaggggacugacuacugua

SEQ ID NO: 8006 - RNA, 20 nt, Artificial Sequence
  TRAC targeting sequence
ucuguaggggacugacuacu

SEQ ID NO: 8007 - RNA, 20 nt, Artificial Sequence
  TRAC targeting sequence
uucuucuguaggggacugac

SEQ ID NO: 8008 - RNA, 20 nt, Artificial Sequence
  TRAC targeting sequence
guggcuuuuuucuuuuucuu

SEQ ID NO: 8009 - RNA, 20 nt, Artificial Sequence
  TRAC targeting sequence
aaacccagaugauccagaaa

SEQ ID NO: 8010 - RNA, 20 nt, Artificial Sequence
  TRAC targeting sequence
auuaucuguggcuuuuuucu

SEQ ID NO: 8011 - RNA, 20 nt, Artificial Sequence
  TRAC targeting sequence
ggguuucgauuaucuguggc

SEQ ID NO: 8012 - RNA, 20 nt, Artificial Sequence
  TRAC targeting sequence
ucuggguuucgauuaucugu

SEQ ID NO: 8013 - RNA, 20 nt, Artificial Sequence
  TRAC targeting sequence
agaaacuucuuuguaguugu

SEQ ID NO: 8014 - RNA, 20 nt, Artificial Sequence
  TRAC targeting sequence
ggaucaucuggguuucgauu

SEQ ID NO: 8015 - RNA, 20 nt, Artificial Sequence
  TRAC targeting sequence
uuguaguugucauuuuccau

SEQ ID NO: 8016 - RNA, 20 nt, Artificial Sequence
  TRAC targeting sequence
uuuuccaucugugcuuccag

SEQ ID NO: 8017 - RNA, 20 nt, Artificial Sequence
  TRAC targeting sequence
aucugugcuuccagcccuau

SEQ ID NO: 8018 - RNA, 20 nt, Artificial Sequence
  TRAC targeting sequence
gugcuuccagcccuaucucc

SEQ ID NO: 8019 - RNA, 20 nt, Artificial Sequence
  TRAC targeting sequence
agcccuaucuccuagcagcu

SEQ ID NO: 8020 - RNA, 20 nt, Artificial Sequence
  TRAC targeting sequence
ccuagcagcuccuaacugga

SEQ ID NO: 8021 - RNA, 20 nt, Artificial Sequence
  TRAC targeting sequence
uagcagcuccuaacuggaag

SEQ ID NO: 8022 - RNA, 20 nt, Artificial Sequence
  TRAC targeting sequence
uaacuggaagucaaacuuac

SEQ ID NO: 8023 - RNA, 20 nt, Artificial Sequence
  TRAC targeting sequence
aguuaggagcugcuaggaga

SEQ ID NO: 8024 - RNA, 20 nt, Artificial Sequence
  TRAC targeting sequence
aacuuacugccuuucauuuc

SEQ ID NO: 8025 - RNA, 20 nt, Artificial Sequence
  TRAC targeting sequence
uuucugcuccccuugccugu

SEQ ID NO: 8026 - RNA, 20 nt, Artificial Sequence
  TRAC targeting sequence
gcuccccuugccuguccuuu

SEQ ID NO: 8027 - RNA, 20 nt, Artificial Sequence
  TRAC targeting sequence
ccuugccuguccuuucacag

SEQ ID NO: 8028 - RNA, 20 nt, Artificial Sequence
  TRAC targeting sequence
uuucacagaggugguaauaa

SEQ ID NO: 8029 - RNA, 20 nt, Artificial Sequence
  TRAC targeting sequence
cagaggugguaauaagccca

SEQ ID NO: 8030 - RNA, 20 nt, Artificial Sequence
  TRAC targeting sequence
gugaaaggacaggcaagggg

SEQ ID NO: 8031 - RNA, 20 nt, Artificial Sequence
  TRAC targeting sequence
caacuuuguggggguuaaac

SEQ ID NO: 8032 - RNA, 20 nt, Artificial Sequence
  TRAC targeting sequence
ucucaccuaauaaguugauu

SEQ ID NO: 8033 - RNA, 20 nt, Artificial Sequence
  TRAC targeting sequence
caccuaauaaguugauuaua

SEQ ID NO: 8034 - RNA, 20 nt, Artificial Sequence
  TRAC targeting sequence
ccuaauaaguugauuauauu

SEQ ID NO: 8035 - RNA, 20 nt, Artificial Sequence
  TRAC targeting sequence
acuuauuaggugagaugauu

SEQ ID NO: 8036 - RNA, 20 nt, Artificial Sequence
  TRAC targeting sequence
ugcaaauauaaucaacuuau

SEQ ID NO: 8037 - RNA, 20 nt, Artificial Sequence
  TRAC targeting sequence
gccucauaccaaaccauccg

SEQ ID NO: 8038 - RNA, 20 nt, Artificial Sequence
  TRAC targeting sequence
uaccaaaccauccguuuuug

SEQ ID NO: 8039 - RNA, 20 nt, Artificial Sequence
  TRAC targeting sequence
guuuuugucaugaaaaaugg

SEQ ID NO: 8040 - RNA, 20 nt, Artificial Sequence
  TRAC targeting sequence
ugaaaaauggaacaaauguc

SEQ ID NO: 8041 - RNA, 20 nt, Artificial Sequence
  TRAC targeting sequence
ugacaaaaacggaugguuug

SEQ ID NO: 8042 - RNA, 20 nt, Artificial Sequence
  TRAC targeting sequence
auuuuucaugacaaaaacgg

SEQ ID NO: 8043 - RNA, 20 nt, Artificial Sequence
  TRAC targeting sequence
cuugucuggugaaggaauuc

SEQ ID NO: 8044 - RNA, 20 nt, Artificial Sequence
  TRAC targeting sequence
ggugaaggaauucuacccca

SEQ ID NO: 8045 - RNA, 20 nt, Artificial Sequence
  TRAC targeting sequence
ccagacaagcgacauuuguu

SEQ ID NO: 8046 - RNA, 20 nt, Artificial Sequence
  TRAC targeting sequence
uucaccagacaagcgacauu

SEQ ID NO: 8047 - RNA, 20 nt, Artificial Sequence
  TRAC targeting sequence
accccaaggauauaagaaua

SEQ ID NO: 8048 - RNA, 20 nt, Artificial Sequence
  TRAC targeting sequence
uugggguagaauuccuucac

SEQ ID NO: 8049 - RNA, 20 nt, Artificial Sequence
  TRAC targeting sequence
uauauccuugggguagaauu

SEQ ID NO: 8050 - RNA, 20 nt, Artificial Sequence
  TRAC targeting sequence
cgugucauccaagaagauaa

SEQ ID NO: 8051 - RNA, 20 nt, Artificial Sequence
  TRAC targeting sequence
ugucauccaagaagauaaca

SEQ ID NO: 8052 - RNA, 20 nt, Artificial Sequence
  TRAC targeting sequence
uccaagaagauaacagaguu

SEQ ID NO: 8053 - RNA, 20 nt, Artificial Sequence
  TRAC targeting sequence
aagaagauaacagaguuuga

SEQ ID NO: 8054 - RNA, 20 nt, Artificial Sequence
  TRAC targeting sequence
uggaugacacgagauuuauu

SEQ ID NO: 8055 - RNA, 20 nt, Artificial Sequence
  TRAC targeting sequence
ucuuggaugacacgagauuu

SEQ ID NO: 8056 - RNA, 20 nt, Artificial Sequence
  TRAC targeting sequence
guuaucuucuuggaugacac

SEQ ID NO: 8057 - RNA, 20 nt, Artificial Sequence
  TRAC targeting sequence
aacucuguuaucuucuugga

SEQ ID NO: 8058 - RNA, 20 nt, Artificial Sequence
  TRAC targeting sequence
ugcuauugucaucucuccca

SEQ ID NO: 8059 - RNA, 20 nt, Artificial Sequence
  TRAC targeting sequence
ucucucccagugggaaguac

SEQ ID NO: 8060 - RNA, 20 nt, Artificial Sequence
  TRAC targeting sequence
cucccagugggaaguacaau

SEQ ID NO: 8061 - RNA, 20 nt, Artificial Sequence
  TRAC targeting sequence
cccagugggaaguacaaugc

SEQ ID NO: 8062 - RNA, 20 nt, Artificial Sequence
  TRAC targeting sequence
cagugggaaguacaaugcug

SEQ ID NO: 8063 - RNA, 20 nt, Artificial Sequence
  TRAC targeting sequence
cacugggagagaugacaaua

SEQ ID NO: 8064 - RNA, 20 nt, Artificial Sequence
  TRAC targeting sequence
agcuugguaaauaugaagau

SEQ ID NO: 8065 - RNA, 20 nt, Artificial Sequence
  TRAC targeting sequence
uauuuaccaagcuugacagc

SEQ ID NO: 8066 - RNA, 20 nt, Artificial Sequence
  TRAC targeting sequence
ucauauuuaccaagcuugac

SEQ ID NO: 8067 - RNA, 20 nt, Artificial Sequence
  TRAC targeting sequence
aauucagugacauguucagu

SEQ ID NO: 8068 - RNA, 20 nt, Artificial Sequence
  TRAC targeting sequence
gugacauguucaguucaaca

SEQ ID NO: 8069 - RNA, 20 nt, Artificial Sequence
  TRAC targeting sequence
cugaauuugaaucuucauau

SEQ ID NO: 8070 - RNA, 20 nt, Artificial Sequence
  TRAC targeting sequence
guucaacacgacaauaaaac

SEQ ID NO: 8071 - RNA, 20 nt, Artificial Sequence
  TRAC targeting sequence
acacgacaauaaaacugugc

SEQ ID NO: 8072 - RNA, 20 nt, Artificial Sequence
  TRAC targeting sequence
uguugaacugaacaugucac

SEQ ID NO: 8073 - RNA, 20 nt, Artificial Sequence
  TRAC targeting sequence
acugacuuugaagugaagac

SEQ ID NO: 8074 - RNA, 20 nt, Artificial Sequence
  TRAC targeting sequence
guggagugcacaguuuuauu

SEQ ID NO: 8075 - RNA, 20 nt, Artificial Sequence
  TRAC targeting sequence
aagucaguggagugcacagu

SEQ ID NO: 8076 - RNA, 20 nt, Artificial Sequence
  TRAC targeting sequence
cuucaaagucaguggagugc

SEQ ID NO: 8077 - RNA, 20 nt, Artificial Sequence
  TRAC targeting sequence
ucacuucaaagucaguggag

SEQ ID NO: 8078 - RNA, 20 nt, Artificial Sequence
  TRAC targeting sequence
gucuucacuucaaagucagu

SEQ ID NO: 8079 - RNA, 20 nt, Artificial Sequence
  TRAC targeting sequence
acagguaggccauuucuagc

SEQ ID NO: 8080 - RNA, 20 nt, Artificial Sequence
  TRAC targeting sequence
agcuucaaggagcuggagau

SEQ ID NO: 8081 - RNA, 20 nt, Artificial Sequence
  TRAC targeting sequence
aggagcuggagauuaugggg

SEQ ID NO: 8082 - RNA, 20 nt, Artificial Sequence
  TRAC targeting sequence
uugaagcuagaaauggccua

SEQ ID NO: 8083 - RNA, 20 nt, Artificial Sequence
  TRAC targeting sequence
agcuccuugaagcuagaaau

SEQ ID NO: 8084 - RNA, 20 nt, Artificial Sequence
  TRAC targeting sequence
ccagcuccuugaagcuagaa

SEQ ID NO: 8085 - RNA, 20 nt, Artificial Sequence
  TRAC targeting sequence
agccuuuuucauuguaccau

SEQ ID NO: 8086 - RNA, 20 nt, Artificial Sequence
  TRAC targeting sequence
cauucuagccuuuuucauug

SEQ ID NO: 8087 - RNA, 20 nt, Artificial Sequence
  TRAC targeting sequence
cauagcuaauuauacaacau

SEQ ID NO: 8088 - RNA, 20 nt, Artificial Sequence
  TRAC targeting sequence
ccaagucacauccucugguc

SEQ ID NO: 8089 - RNA, 20 nt, Artificial Sequence
  TRAC targeting sequence
cauccucugguccucaguuc

SEQ ID NO: 8090 - RNA, 20 nt, Artificial Sequence
  TRAC targeting sequence
ucugguccucaguucacuca

SEQ ID NO: 8091 - RNA, 20 nt, Artificial Sequence
  TRAC targeting sequence
gguccucaguucacucaccc

SEQ ID NO: 8092 - RNA, 20 nt, Artificial Sequence
  TRAC targeting sequence
ucaguucacucacccaaagu

SEQ ID NO: 8093 - RNA, 20 nt, Artificial Sequence
  TRAC targeting sequence
guucacucacccaaagucuc

SEQ ID NO: 8094 - RNA, 20 nt, Artificial Sequence
  TRAC targeting sequence
cucacccaaagucuccucca

SEQ ID NO: 8095 - RNA, 20 nt, Artificial Sequence
  TRAC targeting sequence
cccaaagucuccuccaguuu

SEQ ID NO: 8096 - RNA, 20 nt, Artificial Sequence
  TRAC targeting sequence
ccuccaguuuuaaaagccua

SEQ ID NO: 8097 - RNA, 20 nt, Artificial Sequence
  TRAC targeting sequence
uccaguuuuaaaagccuaca

SEQ ID NO: 8098 - RNA, 20 nt, Artificial Sequence
  TRAC targeting sequence
aguuuuaaaagccuacaauc

SEQ ID NO: 8099 - RNA, 20 nt, Artificial Sequence
  TRAC targeting sequence
ugugagccucuucauuccca

SEQ ID NO: 8100 - RNA, 20 nt, Artificial Sequence
  TRAC targeting sequence
caggauuguaggcuuuuaaa

SEQ ID NO: 8101 - RNA, 20 nt, Artificial Sequence
  TRAC targeting sequence
ucauucccaauguaacccug

SEQ ID NO: 8102 - RNA, 20 nt, Artificial Sequence
  TRAC targeting sequence
uucccaauguaacccugacc

SEQ ID NO: 8103 - RNA, 20 nt, Artificial Sequence
  TRAC targeting sequence
caauguaacccugaccacug

SEQ ID NO: 8104 - RNA, 20 nt, Artificial Sequence
  TRAC targeting sequence
ggguuacauugggaaugaag

SEQ ID NO: 8105 - RNA, 20 nt, Artificial Sequence
  TRAC targeting sequence
agaucacguaaaaccaaagg

SEQ ID NO: 8106 - RNA, 20 nt, Artificial Sequence
  TRAC targeting sequence
ggaacaaacagcagugguca

SEQ ID NO: 8107 - RNA, 20 nt, Artificial Sequence
  TRAC targeting sequence
cguaaaaccaaaggaaacug

SEQ ID NO: 8108 - RNA, 20 nt, Artificial Sequence
  TRAC targeting sequence
uuugguuuuacgugaucugg

SEQ ID NO: 8109 - RNA, 20 nt, Artificial Sequence
  TRAC targeting sequence
guuuccuuugguuuuacgug

SEQ ID NO: 8110 - RNA, 20 nt, Artificial Sequence
  TRAC targeting sequence
aagagcugccauaaacccaa

SEQ ID NO: 8111 - RNA, 20 nt, Artificial Sequence
  TRAC targeting sequence
uugaagguugcuuuguguuu

SEQ ID NO: 8112 - RNA, 20 nt, Artificial Sequence
  TRAC targeting sequence
aaucaaagggccaacuucag

SEQ ID NO: 8113 - RNA, 20 nt, Artificial Sequence
  TRAC targeting sequence
aagggccaacuucagaauca

SEQ ID NO: 8114 - RNA, 20 nt, Artificial Sequence
  TRAC targeting sequence
gaaucaaggguuaaagcaaa

SEQ ID NO: 8115 - RNA, 20 nt, Artificial Sequence
  TRAC targeting sequence
gaaguuggcccuuugauuug

SEQ ID NO: 8116 - RNA, 20 nt, Artificial Sequence
  TRAC targeting sequence
aggguuaaagcaaacucugu

SEQ ID NO: 8117 - RNA, 20 nt, Artificial Sequence
  TRAC targeting sequence
guaauuguccacuggggcca

SEQ ID NO: 8118 - RNA, 20 nt, Artificial Sequence
  TRAC targeting sequence
acuggggccaaaauguauca

SEQ ID NO: 8119 - RNA, 20 nt, Artificial Sequence
  TRAC targeting sequence
gauuucaaaagaaaacacaa

SEQ ID NO: 8120 - RNA, 20 nt, Artificial Sequence
  TRAC targeting sequence
gauacauuuuggccccagug

SEQ ID NO: 8121 - RNA, 20 nt, Artificial Sequence
  TRAC targeting sequence
aaagaaaacacaaaccaugc

SEQ ID NO: 8122 - RNA, 20 nt, Artificial Sequence
  TRAC targeting sequence
uuugaaaucugauacauuuu

SEQ ID NO: 8123 - RNA, 20 nt, Artificial Sequence
  TRAC targeting sequence
gcaugguuuguguuuucuuu

SEQ ID NO: 8124 - RNA, 20 nt, Artificial Sequence
  TRAC targeting sequence
gcagagccucugacucuccc

SEQ ID NO: 8125 - RNA, 20 nt, Artificial Sequence
  TRAC targeting sequence
gcagaaccaacugggcucag

SEQ ID NO: 8126 - RNA, 20 nt, Artificial Sequence
  TRAC targeting sequence
ucacucuuuuucagccauag

SEQ ID NO: 8127 - RNA, 20 nt, Artificial Sequence
  TRAC targeting sequence
cucuuuuucagccauaguuc

SEQ ID NO: 8128 - RNA, 20 nt, Artificial Sequence
  TRAC targeting sequence
uuuucagccauaguucauac

SEQ ID NO: 8129 - RNA, 20 nt, Artificial Sequence
  TRAC targeting sequence
gccauaguucauaccgagaa

SEQ ID NO: 8130 - RNA, 20 nt, Artificial Sequence
  TRAC targeting sequence
uaccgagaaggugaacauga

SEQ ID NO: 8131 - RNA, 20 nt, Artificial Sequence
  TRAC targeting sequence
guaugaacuauggcugaaaa

SEQ ID NO: 8132 - RNA, 20 nt, Artificial Sequence
  TRAC targeting sequence
cgguaugaacuauggcugaa

SEQ ID NO: 8133 - RNA, 20 nt, Artificial Sequence
  TRAC targeting sequence
ccuucucgguaugaacuaug

SEQ ID NO: 8134 - RNA, 20 nt, Artificial Sequence
  TRAC targeting sequence
uguucaccuucucgguauga

SEQ ID NO: 8135 - RNA, 20 nt, Artificial Sequence
  TRAC targeting sequence
cucacagugcuugggcuacg

SEQ ID NO: 8136 - RNA, 20 nt, Artificial Sequence
  TRAC targeting sequence
cagugcuugggcuacgaaug

SEQ ID NO: 8137 - RNA, 20 nt, Artificial Sequence
  TRAC targeting sequence
uagcccaagcacugugaggg

SEQ ID NO: 8138 - RNA, 20 nt, Artificial Sequence
  TRAC targeting sequence
uugcaaacagcauucguagc

SEQ ID NO: 8139 - RNA, 20 nt, Artificial Sequence
  TRAC targeting sequence
auuuucucuugacugccaag

SEQ ID NO: 8140 - RNA, 20 nt, Artificial Sequence
  TRAC targeting sequence
cuugacugccaaguuauuuu

SEQ ID NO: 8141 - RNA, 20 nt, Artificial Sequence
  TRAC targeting sequence
ugacugccaaguuauuuuuc

SEQ ID NO: 8142 - RNA, 20 nt, Artificial Sequence
  TRAC targeting sequence
agagaaaauugacggcaaca

SEQ ID NO: 8143 - RNA, 20 nt, Artificial Sequence
  TRAC targeting sequence
uguaagguaagaauuagccg

SEQ ID NO: 8144 - RNA, 20 nt, Artificial Sequence
  TRAC targeting sequence
uaccuuacaagaaaaauaac

SEQ ID NO: 8145 - RNA, 20 nt, Artificial Sequence
  TRAC targeting sequence
uauuccuaucucuacccaca

SEQ ID NO: 8146 - RNA, 20 nt, Artificial Sequence
  TRAC targeting sequence
uaucucuacccacaccaugc

SEQ ID NO: 8147 - RNA, 20 nt, Artificial Sequence
  TRAC targeting sequence
cuacccacaccaugcugcac

SEQ ID NO: 8148 - RNA, 20 nt, Artificial Sequence
  TRAC targeting sequence
acccacaccaugcugcacau

SEQ ID NO: 8149 - RNA, 20 nt, Artificial Sequence
  TRAC targeting sequence
ccaugugcagcauggugugg

SEQ ID NO: 8150 - RNA, 20 nt, Artificial Sequence
  TRAC targeting sequence
ccuuuccccaugugcagcau

SEQ ID NO: 8151 - RNA, 20 nt, Artificial Sequence
  TRAC targeting sequence
aaauccccuuuccccaugug

SEQ ID NO: 8152 - RNA, 20 nt, Artificial Sequence
  TRAC targeting sequence
uagccauuucuaaauccccu

SEQ ID NO: 8153 - RNA, 20 nt, Artificial Sequence
  TRAC targeting sequence
ugguuucuuagccauuucua

SEQ ID NO: 8154 - RNA, 20 nt, Artificial Sequence
  TRAC targeting sequence
aaugcuucuugguuucuuag

SEQ ID NO: 8155 - RNA, 20 nt, Artificial Sequence
  TRAC targeting sequence
cuuuccaaugcuucuugguu

SEQ ID NO: 8156 - RNA, 20 nt, Artificial Sequence
  TRAC targeting sequence
gcaaaacagcaccccauuuc

SEQ ID NO: 8157 - RNA, 20 nt, Artificial Sequence
  TRAC targeting sequence
uguuauccuuucauuuugag

SEQ ID NO: 8158 - RNA, 20 nt, Artificial Sequence
  TRAC targeting sequence
uuucauuuugagucagacug

SEQ ID NO: 8159 - RNA, 20 nt, Artificial Sequence
  TRAC targeting sequence
uuuugagucagacugaaacc

SEQ ID NO: 8160 - RNA, 20 nt, Artificial Sequence
  TRAC targeting sequence
aaaugaaaggauaacaggaa

SEQ ID NO: 8161 - RNA, 20 nt, Artificial Sequence
  TRAC targeting sequence
gacugaaacccauuagguag

SEQ ID NO: 8162 - RNA, 20 nt, Artificial Sequence
  TRAC targeting sequence
gacucaaaaugaaaggauaa

SEQ ID NO: 8163 - RNA, 20 nt, Artificial Sequence
  TRAC targeting sequence
gucugacucaaaaugaaagg

SEQ ID NO: 8164 - RNA, 20 nt, Artificial Sequence
  TRAC targeting sequence
cuuucacuccagggagaaaa

SEQ ID NO: 8165 - RNA, 20 nt, Artificial Sequence
  TRAC targeting sequence
cuccagggagaaaacugaag

SEQ ID NO: 8166 - RNA, 20 nt, Artificial Sequence
  TRAC targeting sequence
agggagaaaacugaagauaa

SEQ ID NO: 8167 - RNA, 20 nt, Artificial Sequence
  TRAC targeting sequence
cuggagugaaagugaggguu

SEQ ID NO: 8168 - RNA, 20 nt, Artificial Sequence
  TRAC targeting sequence
cccuggagugaaagugaggg

SEQ ID NO: 8169 - RNA, 20 nt, Artificial Sequence
  TRAC targeting sequence
guuuucucccuggagugaaa

SEQ ID NO: 8170 - RNA, 20 nt, Artificial Sequence
  TRAC targeting sequence
ucaguuuucucccuggagug

SEQ ID NO: 8171 - RNA, 20 nt, Artificial Sequence
  TRAC targeting sequence
uuauuuaucuucaguuuucu

SEQ ID NO: 8172 - RNA, 20 nt, Artificial Sequence
  TRAC targeting sequence
ccuuauuuaucuucaguuuu

SEQ ID NO: 8173 - RNA, 20 nt, Artificial Sequence
  TRAC targeting sequence
ucuucuuuacugcuauuuug

SEQ ID NO: 8174 - RNA, 20 nt, Artificial Sequence
  TRAC targeting sequence
ucuuuacugcuauuuuguuc

SEQ ID NO: 8175 - RNA, 20 nt, Artificial Sequence
  TRAC targeting sequence
uuacugcuauuuuguucauc

SEQ ID NO: 8176 - RNA, 20 nt, Artificial Sequence
  TRAC targeting sequence
ucgaccaagagaccaugggu

SEQ ID NO: 8177 - RNA, 20 nt, Artificial Sequence
  TRAC targeting sequence
accaagagaccauggguuau

SEQ ID NO: 8178 - RNA, 20 nt, Artificial Sequence
  TRAC targeting sequence
augaacaaaauagcaguaaa

SEQ ID NO: 8179 - RNA, 20 nt, Artificial Sequence
  TRAC targeting sequence
ggcaaagcuuuacuuauggc

SEQ ID NO: 8180 - RNA, 20 nt, Artificial Sequence
  TRAC targeting sequence
ucaggcaaagcuuuacuuau

SEQ ID NO: 8181 - RNA, 20 nt, Artificial Sequence
  TRAC targeting sequence
agaggaagcagaaccuaucu

SEQ ID NO: 8182 - RNA, 20 nt, Artificial Sequence
  TRAC targeting sequence
ggauagucuucaggcaaagc

SEQ ID NO: 8183 - RNA, 20 nt, Artificial Sequence
  TRAC targeting sequence
ucuggauagucuucaggcaa

SEQ ID NO: 8184 - RNA, 20 nt, Artificial Sequence
  TRAC targeting sequence
gcuuccucuggauagucuuc

SEQ ID NO: 8185 - RNA, 20 nt, Artificial Sequence
  TRAC targeting sequence
uuguccugauaaagggaaug

SEQ ID NO: 8186 - RNA, 20 nt, Artificial Sequence
  TRAC targeting sequence
ugauaaagggaaugccagcu

SEQ ID NO: 8187 - RNA, 20 nt, Artificial Sequence
  TRAC targeting sequence
ggacaaagauagguucugcu

SEQ ID NO: 8188 - RNA, 20 nt, Artificial Sequence
  TRAC targeting sequence
uaguauagcucucuuuuuac

SEQ ID NO: 8189 - RNA, 20 nt, Artificial Sequence
  TRAC targeting sequence
gaagaucuggguuuuauccu

SEQ ID NO: 8190 - RNA, 20 nt, Artificial Sequence
  TRAC targeting sequence
gacucuuaguauagcucucu

SEQ ID NO: 8191 - RNA, 20 nt, Artificial Sequence
  TRAC targeting sequence
ucugacucuuaguauagcuc

SEQ ID NO: 8192 - RNA, 20 nt, Artificial Sequence
  TRAC targeting sequence
ggguuuuauccugauuuuga

SEQ ID NO: 8193 - RNA, 20 nt, Artificial Sequence
  TRAC targeting sequence
ugauuuugacacuaacuuac

SEQ ID NO: 8194 - RNA, 20 nt, Artificial Sequence
  TRAC targeting sequence
ggauaaaacccagaucuucu

SEQ ID NO: 8195 - RNA, 20 nt, Artificial Sequence
  TRAC targeting sequence
aaaucaggauaaaacccaga

SEQ ID NO: 8196 - RNA, 20 nt, Artificial Sequence
  TRAC targeting sequence
ucaucucucugggccugggu

SEQ ID NO: 8197 - RNA, 20 nt, Artificial Sequence
  TRAC targeting sequence
ucucucugggccuggguuuu

SEQ ID NO: 8198 - RNA, 20 nt, Artificial Sequence
  TRAC targeting sequence
auguacacauggcaauagcu

SEQ ID NO: 8199 - RNA, 20 nt, Artificial Sequence
  TRAC targeting sequence
cuuuccauguacacauggca

SEQ ID NO: 8200 - RNA, 20 nt, Artificial Sequence
  TRAC targeting sequence
auuguggcucacuuuccaug

SEQ ID NO: 8201 - RNA, 20 nt, Artificial Sequence
  TRAC targeting sequence
cuaaucuauuguggcucacu

SEQ ID NO: 8202 - RNA, 20 nt, Artificial Sequence
  TRAC targeting sequence
gcaaugguacaguauagcaa

SEQ ID NO: 8203 - RNA, 20 nt, Artificial Sequence
  TRAC targeting sequence
agcacuggcagucuauucua

SEQ ID NO: 8204 - RNA, 20 nt, Artificial Sequence
  TRAC targeting sequence
auucuauaacaacuuucuuc

SEQ ID NO: 8205 - RNA, 20 nt, Artificial Sequence
  TRAC targeting sequence
auaacaacuuucuucacugc

SEQ ID NO: 8206 - RNA, 20 nt, Artificial Sequence
  TRAC targeting sequence
ucacugcaggcugacuggca

SEQ ID NO: 8207 - RNA, 20 nt, Artificial Sequence
  TRAC targeting sequence
cugcaggcugacuggcauga

SEQ ID NO: 8208 - RNA, 20 nt, Artificial Sequence
  TRAC targeting sequence
gccugcagugaagaaaguug

SEQ ID NO: 8209 - RNA, 20 nt, Artificial Sequence
  TRAC targeting sequence
ugccagucagccugcaguga

SEQ ID NO: 8210 - RNA, 20 nt, Artificial Sequence
  TRAC targeting sequence
ucaugccagucagccugcag

SEQ ID NO: 8211 - RNA, 20 nt, Artificial Sequence
  TRAC targeting sequence
ugaagaaaccaaaggcuuac

SEQ ID NO: 8212 - RNA, 20 nt, Artificial Sequence
  TRAC targeting sequence
ggaguguagcuuccucaugc

SEQ ID NO: 8213 - RNA, 20 nt, Artificial Sequence
  TRAC targeting sequence
ucaggaguguagcuuccuca

SEQ ID NO: 8214 - RNA, 20 nt, Artificial Sequence
  TRAC targeting sequence
ccuuggcuucugacuucuuu

SEQ ID NO: 8215 - RNA, 20 nt, Artificial Sequence
  TRAC targeting sequence
uuggcuucugacuucuuugu

SEQ ID NO: 8216 - RNA, 20 nt, Artificial Sequence
  TRAC targeting sequence
gacuucuuugugauucaagu

SEQ ID NO: 8217 - RNA, 20 nt, Artificial Sequence
  TRAC targeting sequence
gaagccaaggagaugcauuu

SEQ ID NO: 8218 - RNA, 20 nt, Artificial Sequence
  TRAC targeting sequence
uugugauucaaguugaccug

SEQ ID NO: 8219 - RNA, 20 nt, Artificial Sequence
  TRAC targeting sequence
caaagaagucagaagccaag

SEQ ID NO: 8220 - RNA, 20 nt, Artificial Sequence
  TRAC targeting sequence
aguugaccugucauagccuu

SEQ ID NO: 8221 - RNA, 20 nt, Artificial Sequence
  TRAC targeting sequence
acuugaaucacaaagaaguc

SEQ ID NO: 8222 - RNA, 20 nt, Artificial Sequence
  TRAC targeting sequence
uagccuuguuaaaauggcug

SEQ ID NO: 8223 - RNA, 20 nt, Artificial Sequence
  TRAC targeting sequence
uauaucuuuuuauauccuuc

SEQ ID NO: 8224 - RNA, 20 nt, Artificial Sequence
  TRAC targeting sequence
uuuuuuacuccuacaaguga

SEQ ID NO: 8225 - RNA, 20 nt, Artificial Sequence
  TRAC targeting sequence
uacaagugauacacuuugaa

SEQ ID NO: 8226 - RNA, 20 nt, Artificial Sequence
  TRAC targeting sequence
cuuguaggaguaaaaaaaga

SEQ ID NO: 8227 - RNA, 20 nt, Artificial Sequence
  TRAC targeting sequence
aaguguaucacuuguaggag

SEQ ID NO: 8228 - RNA, 20 nt, Artificial Sequence
  TRAC targeting sequence
uuuucaaaguguaucacuug

SEQ ID NO: 8229 - RNA, 20 nt, Artificial Sequence
  TRAC targeting sequence
uuuugacuuucuuuaccuuu

SEQ ID NO: 8230 - RNA, 20 nt, Artificial Sequence
  TRAC targeting sequence
aaaggaacaaaacaucauuu

SEQ ID NO: 8231 - RNA, 20 nt, Artificial Sequence
  TRAC targeting sequence
uuaccuuuugaaguagaaag

SEQ ID NO: 8232 - RNA, 20 nt, Artificial Sequence
  TRAC targeting sequence
aaagguaaagaaagucaaaa

SEQ ID NO: 8233 - RNA, 20 nt, Artificial Sequence
  TRAC targeting sequence
acuucaaaagguaaagaaag

SEQ ID NO: 8234 - RNA, 20 nt, Artificial Sequence
  TRAC targeting sequence
cacuuucuacuucaaaaggu

SEQ ID NO: 8235 - RNA, 20 nt, Artificial Sequence
  TRAC targeting sequence
uccuccacgccaugcagaau

SEQ ID NO: 8236 - RNA, 20 nt, Artificial Sequence
  TRAC targeting sequence
gcacuuucugccucuccuaa

SEQ ID NO: 8237 - RNA, 20 nt, Artificial Sequence
  TRAC targeting sequence
gccucuccuaauacuuuaca

SEQ ID NO: 8238 - RNA, 20 nt, Artificial Sequence
  TRAC targeting sequence
ccuaauacuuuacaaaugag

SEQ ID NO: 8239 - RNA, 20 nt, Artificial Sequence
  TRAC targeting sequence
uaauacuuuacaaaugagau

SEQ ID NO: 8240 - RNA, 20 nt, Artificial Sequence
  TRAC targeting sequence
uuuguaaaguauuaggagag

SEQ ID NO: 8241 - RNA, 20 nt, Artificial Sequence
  TRAC targeting sequence
cauuuguaaaguauuaggag

SEQ ID NO: 8242 - RNA, 20 nt, Artificial Sequence
  TRAC targeting sequence
aauguaaucucauuuguaaa

SEQ ID NO: 8243 - RNA, 20 nt, Artificial Sequence
  TRAC targeting sequence
uaaaguauuagcaaauucaa

SEQ ID NO: 8244 - RNA, 20 nt, Artificial Sequence
  TRAC targeting sequence
uugccugcucauaaaguauu

SEQ ID NO: 8245 - RNA, 20 nt, Artificial Sequence
  TRAC targeting sequence
aaaaucucaucuaaauacuc

SEQ ID NO: 8246 - RNA, 20 nt, Artificial Sequence
  TRAC targeting sequence
caucuaaauacucuccaauc

SEQ ID NO: 8247 - RNA, 20 nt, Artificial Sequence
  TRAC targeting sequence
ucuaaauacucuccaaucua

SEQ ID NO: 8248 - RNA, 20 nt, Artificial Sequence
  TRAC targeting sequence
aaauacucuccaaucuauua

SEQ ID NO: 8249 - RNA, 20 nt, Artificial Sequence
  TRAC targeting sequence
ccaaucuauuagcaaaaauc

SEQ ID NO: 8250 - RNA, 20 nt, Artificial Sequence
  TRAC targeting sequence
aaucuauuagcaaaaaucag

SEQ ID NO: 8251 - RNA, 20 nt, Artificial Sequence
  TRAC targeting sequence
auuagcaaaaaucagaguaa

SEQ ID NO: 8252 - RNA, 20 nt, Artificial Sequence
  TRAC targeting sequence
gaguaaaauacagaggaaag

SEQ ID NO: 8253 - RNA, 20 nt, Artificial Sequence
  TRAC targeting sequence
gauuuuugcuaauagauugg

SEQ ID NO: 8254 - RNA, 20 nt, Artificial Sequence
  TRAC targeting sequence
guauuuuacucugauuuuug

SEQ ID NO: 8255 - RNA, 20 nt, Artificial Sequence
  TRAC targeting sequence
ucuguauuuuacucugauuu

SEQ ID NO: 8256 - RNA, 20 nt, Artificial Sequence
  TRAC targeting sequence
guuaauugauuuaacaugca

SEQ ID NO: 8257 - RNA, 20 nt, Artificial Sequence
  TRAC targeting sequence
augccaaagucccaggccag

SEQ ID NO: 8258 - RNA, 20 nt, Artificial Sequence
  TRAC targeting sequence
gccuuucuucucagccucug

SEQ ID NO: 8259 - RNA, 20 nt, Artificial Sequence
  TRAC targeting sequence
ucucagccucugccucuauu

SEQ ID NO: 8260 - RNA, 20 nt, Artificial Sequence
  TRAC targeting sequence
cagccucugccucuauugca

SEQ ID NO: 8261 - RNA, 20 nt, Artificial Sequence
  TRAC targeting sequence
gccucugccucuauugcauu

SEQ ID NO: 8262 - RNA, 20 nt, Artificial Sequence
  TRAC targeting sequence
gccucuauugcauuuauuaa

SEQ ID NO: 8263 - RNA, 20 nt, Artificial Sequence
  TRAC targeting sequence
auugcauuuauuaaacugca

SEQ ID NO: 8264 - RNA, 20 nt, Artificial Sequence
  TRAC targeting sequence
ccucuggcuuuacucuuugc

SEQ ID NO: 8265 - RNA, 20 nt, Artificial Sequence
  TRAC targeting sequence
ggcuuuacucuuugcagauc

SEQ ID NO: 8266 - RNA, 20 nt, Artificial Sequence
  TRAC targeting sequence
uugcagaucaccacaggggg

SEQ ID NO: 8267 - RNA, 20 nt, Artificial Sequence
  TRAC targeting sequence
auuuggcuuuuggcugacua

SEQ ID NO: 8268 - RNA, 20 nt, Artificial Sequence
  TRAC targeting sequence
cacugcacuuuccugagccc

SEQ ID NO: 8269 - RNA, 20 nt, Artificial Sequence
  TRAC targeting sequence
ugagccccaagccuacagag

SEQ ID NO: 8270 - RNA, 20 nt, Artificial Sequence
  TRAC targeting sequence
ggaaagugcagugugaccca

SEQ ID NO: 8271 - RNA, 20 nt, Artificial Sequence
  TRAC targeting sequence
guaggcuuggggcucaggaa

SEQ ID NO: 8272 - RNA, 20 nt, Artificial Sequence
  TRAC targeting sequence
aaggcagggccucuguaggc

SEQ ID NO: 8273 - RNA, 20 nt, Artificial Sequence
  TRAC targeting sequence
ccaaggcagggccucuguag

SEQ ID NO: 8274 - RNA, 20 nt, Artificial Sequence
  TRAC targeting sequence
gguuuccugcugccucugcu

SEQ ID NO: 8275 - RNA, 20 nt, Artificial Sequence
  TRAC targeting sequence
ugcugccucugcugaugccg

SEQ ID NO: 8276 - RNA, 20 nt, Artificial Sequence
  TRAC targeting sequence
gcugaugccgcuguuacagc

SEQ ID NO: 8277 - RNA, 20 nt, Artificial Sequence
  TRAC targeting sequence
gcagaggcagcaggaaaccc

SEQ ID NO: 8278 - RNA, 20 nt, Artificial Sequence
  TRAC targeting sequence
ugcuguaacagcggcaucag

SEQ ID NO: 8279 - RNA, 20 nt, Artificial Sequence
  TRAC targeting sequence
cuggccacgcugcaggugcu

SEQ ID NO: 8280 - RNA, 20 nt, Artificial Sequence
  TRAC targeting sequence
gcuacugccacccaggaagg

SEQ ID NO: 8281 - RNA, 20 nt, Artificial Sequence
  TRAC targeting sequence
uggguggcaguagcagaggu

SEQ ID NO: 8282 - RNA, 20 nt, Artificial Sequence
  TRAC targeting sequence
aggagcacugcucaggugca

SEQ ID NO: 8283 - RNA, 20 nt, Artificial Sequence
  TRAC targeting sequence
uggaaaaggcuguggccuuc

SEQ ID NO: 8284 - RNA, 20 nt, Artificial Sequence
  TRAC targeting sequence
ggugcagagcccuagcaacc

SEQ ID NO: 8285 - RNA, 20 nt, Artificial Sequence
  TRAC targeting sequence
gcaccugagcagugcuccug

SEQ ID NO: 8286 - RNA, 20 nt, Artificial Sequence
  TRAC targeting sequence
cucagcaccuauguggagca

SEQ ID NO: 8287 - RNA, 20 nt, Artificial Sequence
  TRAC targeting sequence
cagcaccuauguggagcauc

SEQ ID NO: 8288 - RNA, 20 nt, Artificial Sequence
  TRAC targeting sequence
gcaccuauguggagcaucaa

SEQ ID NO: 8289 - RNA, 20 nt, Artificial Sequence
  TRAC targeting sequence
acauaggugcugagagaacc

SEQ ID NO: 8290 - RNA, 20 nt, Artificial Sequence
  TRAC targeting sequence
gaaguuguuaggaacaaaaa

SEQ ID NO: 8291 - RNA, 20 nt, Artificial Sequence
  TRAC targeting sequence
gaggaaacacccuaauauua

SEQ ID NO: 8292 - RNA, 20 nt, Artificial Sequence
  TRAC targeting sequence
uaacaacuucagaggaaaca

SEQ ID NO: 8293 - RNA, 20 nt, Artificial Sequence
  TRAC targeting sequence
uuuuguuccuaacaacuuca

SEQ ID NO: 8294 - RNA, 20 nt, Artificial Sequence
  TRAC targeting sequence
uauucucauuuuucagauaa

SEQ ID NO: 8295 - RNA, 20 nt, Artificial Sequence
  TRAC targeting sequence
cauuuuucagauaaaacaaa

SEQ ID NO: 8296 - RNA, 20 nt, Artificial Sequence
  TRAC targeting sequence
uuuuucagauaaaacaaaaa

SEQ ID NO: 8297 - RNA, 20 nt, Artificial Sequence
  TRAC targeting sequence
gauaaaacaaaaaugcccuc

SEQ ID NO: 8298 - RNA, 20 nt, Artificial Sequence
  TRAC targeting sequence
gaaaaaugagaauaugaucu

SEQ ID NO: 8299 - RNA, 20 nt, Artificial Sequence
  TRAC targeting sequence
ccucaaaaaaguauguauca

SEQ ID NO: 8300 - RNA, 20 nt, Artificial Sequence
  TRAC targeting sequence
ucaaaaaaguauguaucaug

SEQ ID NO: 8301 - RNA, 20 nt, Artificial Sequence
  TRAC targeting sequence
aaaaaguauguaucaugucc

SEQ ID NO: 8302 - RNA, 20 nt, Artificial Sequence
  TRAC targeting sequence
guggugucuccggcagagaa

SEQ ID NO: 8303 - RNA, 20 nt, Artificial Sequence
  TRAC targeting sequence
aacucagggacuuggcagcu

SEQ ID NO: 8304 - RNA, 20 nt, Artificial Sequence
  TRAC targeting sequence
gggacuuggcagcuggaauu

SEQ ID NO: 8305 - RNA, 20 nt, Artificial Sequence
  TRAC targeting sequence
cugaguuugaagcucagugg

SEQ ID NO: 8306 - RNA, 20 nt, Artificial Sequence
  TRAC targeting sequence
agcugccaagucccugaguu

SEQ ID NO: 8307 - RNA, 20 nt, Artificial Sequence
  TRAC targeting sequence
ggaagucacaacuuuccagg

SEQ ID NO: 8308 - RNA, 20 nt, Artificial Sequence
  TRAC targeting sequence
agaauuccagcugccaaguc

SEQ ID NO: 8309 - RNA, 20 nt, Artificial Sequence
  TRAC targeting sequence
caacuuuccaggagugccuc

SEQ ID NO: 8310 - RNA, 20 nt, Artificial Sequence
  TRAC targeting sequence
aggagugccucagugcucug

SEQ ID NO: 8311 - RNA, 20 nt, Artificial Sequence
  TRAC targeting sequence
uggaaaguugugacuuccag

SEQ ID NO: 8312 - RNA, 20 nt, Artificial Sequence
  TRAC targeting sequence
gugcucugcagugaaaaaaa

SEQ ID NO: 8313 - RNA, 20 nt, Artificial Sequence
  TRAC targeting sequence
gcagugaaaaaaaagaaaau

SEQ ID NO: 8314 - RNA, 20 nt, Artificial Sequence
  TRAC targeting sequence
cgcaucuuuuuauauccagc

SEQ ID NO: 8315 - RNA, 20 nt, Artificial Sequence
  TRAC targeting sequence
ccaauuuacuuuuuuuuucc

SEQ ID NO: 8316 - RNA, 20 nt, Artificial Sequence
  TRAC targeting sequence
uuuaaguaaauaacuuugug

SEQ ID NO: 8317 - RNA, 20 nt, Artificial Sequence
  TRAC targeting sequence
aacuuaauuuuuuuuuuuuu

SEQ ID NO: 8318 - RNA, 20 nt, Artificial Sequence
  TRAC targeting sequence
uaauaauggauaaauggugg

SEQ ID NO: 8319 - RNA, 20 nt, Artificial Sequence
  TRAC targeting sequence
auuauuaugaauugaucugu

SEQ ID NO: 8320 - RNA, 20 nt, Artificial Sequence
  TRAC targeting sequence
ccaccaccauuuauccauua

SEQ ID NO: 8321 - RNA, 20 nt, Artificial Sequence
  TRAC targeting sequence
uuauuuuagucaccaccacc

SEQ ID NO: 8322 - RNA, 20 nt, Artificial Sequence
  TRAC targeting sequence
gccgugucuuuauuuuaguc

SEQ ID NO: 8323 - RNA, 20 nt, Artificial Sequence
  TRAC targeting sequence
ccuuagaugggcccuuuacc

SEQ ID NO: 8324 - RNA, 20 nt, Artificial Sequence
  TRAC targeting sequence
aaggcgaggccgucagccgu

SEQ ID NO: 8325 - RNA, 20 nt, Artificial Sequence
  TRAC targeting sequence
cagaagacacuuuaggucac

SEQ ID NO: 8326 - RNA, 20 nt, Artificial Sequence
  TRAC targeting sequence
gaagacacuuuaggucacuu

SEQ ID NO: 8327 - RNA, 20 nt, Artificial Sequence
  TRAC targeting sequence
gagaaauaaauggccugguc

SEQ ID NO: 8328 - RNA, 20 nt, Artificial Sequence
  TRAC targeting sequence
ucugagaaauaaauggccug

SEQ ID NO: 8329 - RNA, 20 nt, Artificial Sequence
  TRAC targeting sequence
cuucuaaaggccaggcugga

SEQ ID NO: 8330 - RNA, 20 nt, Artificial Sequence
  TRAC targeting sequence
aaaggccaggcuggaaccca

SEQ ID NO: 8331 - RNA, 20 nt, Artificial Sequence
  TRAC targeting sequence
agccuggccuuuagaaguga

SEQ ID NO: 8332 - RNA, 20 nt, Artificial Sequence
  TRAC targeting sequence
uagccauuuuggguuccagc

SEQ ID NO: 8333 - RNA, 20 nt, Artificial Sequence
  TRAC targeting sequence
cuuagccauuuuggguucca

SEQ ID NO: 8334 - RNA, 20 nt, Artificial Sequence
  TRAC targeting sequence
uucucuuagccauuuugggu

SEQ ID NO: 8335 - RNA, 20 nt, Artificial Sequence
  TRAC targeting sequence
cagacaugaccugcccuaag

SEQ ID NO: 8336 - RNA, 20 nt, Artificial Sequence
  TRAC targeting sequence
gggacuuggcauccuucucu

SEQ ID NO: 8337 - RNA, 20 nt, Artificial Sequence
  TRAC targeting sequence
ugucugggacuuggcauccu

SEQ ID NO: 8338 - RNA, 20 nt, Artificial Sequence
  TRAC targeting sequence
uagggcaggucaugucuggg

SEQ ID NO: 8339 - RNA, 20 nt, Artificial Sequence
  TRAC targeting sequence
gcugagcugugccccaggag

SEQ ID NO: 8340 - RNA, 20 nt, Artificial Sequence
  TRAC targeting sequence
gcagagcugccucuuagggc

SEQ ID NO: 8341 - RNA, 20 nt, Artificial Sequence
  TRAC targeting sequence
uggggcacagcucagcagag

SEQ ID NO: 8342 - RNA, 20 nt, Artificial Sequence
  TRAC targeting sequence
uaacacaaacuccuggggca

SEQ ID NO: 8343 - RNA, 20 nt, Artificial Sequence
  TRAC targeting sequence
ugggcaccugcaucauagug

SEQ ID NO: 8344 - RNA, 20 nt, Artificial Sequence
  TRAC targeting sequence
uagugcuaaaggcacaguag

SEQ ID NO: 8345 - RNA, 20 nt, Artificial Sequence
  TRAC targeting sequence
ucaguccuuacuggagagau

SEQ ID NO: 8346 - RNA, 20 nt, Artificial Sequence
  TRAC targeting sequence
guccuuacuggagagaucac

SEQ ID NO: 8347 - RNA, 20 nt, Artificial Sequence
  TRAC targeting sequence
uuacuggagagaucaccaag

SEQ ID NO: 8348 - RNA, 20 nt, Artificial Sequence
  TRAC targeting sequence
aguaaggacugaagacagug

SEQ ID NO: 8349 - RNA, 20 nt, Artificial Sequence
  TRAC targeting sequence
ccaguaaggacugaagacag

SEQ ID NO: 8350 - RNA, 20 nt, Artificial Sequence
  TRAC targeting sequence
cuccaguaaggacugaagac

SEQ ID NO: 8351 - RNA, 20 nt, Artificial Sequence
  TRAC targeting sequence
ccaagugaaaggcuuucugg

SEQ ID NO: 8352 - RNA, 20 nt, Artificial Sequence
  TRAC targeting sequence
cuuggugaucucuccaguaa

SEQ ID NO: 8353 - RNA, 20 nt, Artificial Sequence
  TRAC targeting sequence
gggucagaauguguuucaca

SEQ ID NO: 8354 - RNA, 20 nt, Artificial Sequence
  TRAC targeting sequence
gaauguguuucacagaaaac

SEQ ID NO: 8355 - RNA, 20 nt, Artificial Sequence
  TRAC targeting sequence
gacccagaaagccuuucacu

SEQ ID NO: 8356 - RNA, 20 nt, Artificial Sequence
  TRAC targeting sequence
cagaaaaccguccuugagua

SEQ ID NO: 8357 - RNA, 20 nt, Artificial Sequence
  TRAC targeting sequence
gugaaacacauucugaccca

SEQ ID NO: 8358 - RNA, 20 nt, Artificial Sequence
  TRAC targeting sequence
uugaguaaaaucugcaccuu

SEQ ID NO: 8359 - RNA, 20 nt, Artificial Sequence
  TRAC targeting sequence
aggacgguuuucugugaaac

SEQ ID NO: 8360 - RNA, 20 nt, Artificial Sequence
  TRAC targeting sequence
gcaccuucugaucugcuguu

SEQ ID NO: 8361 - RNA, 20 nt, Artificial Sequence
  TRAC targeting sequence
gaucugcuguuauccccaua

SEQ ID NO: 8362 - RNA, 20 nt, Artificial Sequence
  TRAC targeting sequence
gaaggugcagauuuuacuca

SEQ ID NO: 8363 - RNA, 20 nt, Artificial Sequence
  TRAC targeting sequence
gcuguuauccccauaaaaga

SEQ ID NO: 8364 - RNA, 20 nt, Artificial Sequence
  TRAC targeting sequence
ccauaaaagacaaacugaaa

SEQ ID NO: 8365 - RNA, 20 nt, Artificial Sequence
  TRAC targeting sequence
uuuauggggauaacagcaga

SEQ ID NO: 8366 - RNA, 20 nt, Artificial Sequence
  TRAC targeting sequence
guuugucuuuuauggggaua

SEQ ID NO: 8367 - RNA, 20 nt, Artificial Sequence
  TRAC targeting sequence
uuucaguuugucuuuuaugg

SEQ ID NO: 8368 - RNA, 20 nt, Artificial Sequence
  TRAC targeting sequence
ggccuuauccgguaccagaa

SEQ ID NO: 8369 - RNA, 20 nt, Artificial Sequence
  TRAC targeting sequence
gguaccagaauaaaucugga

SEQ ID NO: 8370 - RNA, 20 nt, Artificial Sequence
  TRAC targeting sequence
gguaccggauaaggccagau

SEQ ID NO: 8371 - RNA, 20 nt, Artificial Sequence
  TRAC targeting sequence
ggauuugaauauacaguguc

SEQ ID NO: 8372 - RNA, 20 nt, Artificial Sequence
  TRAC targeting sequence
agauuuauucugguaccgga

SEQ ID NO: 8373 - RNA, 20 nt, Artificial Sequence
  TRAC targeting sequence
aauccagauuuauucuggua

SEQ ID NO: 8374 - RNA, 20 nt, Artificial Sequence
  TRAC targeting sequence
uaagugcagagcaguaccac

SEQ ID NO: 8375 - RNA, 20 nt, Artificial Sequence
  TRAC targeting sequence
gcacuuacgacacuguauau

SEQ ID NO: 8376 - RNA, 20 nt, Artificial Sequence
  TRAC targeting sequence
cugccacucgccaccgucug

SEQ ID NO: 8377 - RNA, 20 nt, Artificial Sequence
  TRAC targeting sequence
ccaccgucugguccggggaa

SEQ ID NO: 8378 - RNA, 20 nt, Artificial Sequence
  TRAC targeting sequence
gguccggggaacucuggguu

SEQ ID NO: 8379 - RNA, 20 nt, Artificial Sequence
  TRAC targeting sequence
ggggaacucuggguuacuuu

SEQ ID NO: 8380 - RNA, 20 nt, Artificial Sequence
  TRAC targeting sequence
ccggaccagacgguggcgag

SEQ ID NO: 8381 - RNA, 20 nt, Artificial Sequence
  TRAC targeting sequence
ggguuacuuugucacacagc

SEQ ID NO: 8382 - RNA, 20 nt, Artificial Sequence
  TRAC targeting sequence
cacagcgugccccugucugg

SEQ ID NO: 8383 - RNA, 20 nt, Artificial Sequence
  TRAC targeting sequence
gggaaaaagacaaugaggaa

SEQ ID NO: 8384 - RNA, 20 nt, Artificial Sequence
  TRAC targeting sequence
cagacaggggcacgcugugu

SEQ ID NO: 8385 - RNA, 20 nt, Artificial Sequence
  TRAC targeting sequence
uuuucccagacaggggcacg

SEQ ID NO: 8386 - RNA, 20 nt, Artificial Sequence
  TRAC targeting sequence
uugucuuuuucccagacagg

SEQ ID NO: 8387 - RNA, 20 nt, Artificial Sequence
  TRAC targeting sequence
ucauugucuuuuucccagac

SEQ ID NO: 8388 - RNA, 20 nt, Artificial Sequence
  TRAC targeting sequence
cuauuuccucauugucuuuu

SEQ ID NO: 8389 - RNA, 20 nt, Artificial Sequence
  TRAC targeting sequence
gcaccccccagacagugagu

SEQ ID NO: 8390 - RNA, 20 nt, Artificial Sequence
  TRAC targeting sequence
auaaccccauuucuccuucu

SEQ ID NO: 8391 - RNA, 20 nt, Artificial Sequence
  TRAC targeting sequence
acuugcucuauaaccccauu

SEQ ID NO: 8392 - RNA, 20 nt, Artificial Sequence
  TRAC targeting sequence
uuuguuuacauuccacuugc

SEQ ID NO: 8393 - RNA, 20 nt, Artificial Sequence
  TRAC targeting sequence
guaaguaguuucauuuguuu

SEQ ID NO: 8394 - RNA, 20 nt, Artificial Sequence
  TRAC targeting sequence
uacugugggcuuuagcuuuu

SEQ ID NO: 8395 - RNA, 20 nt, Artificial Sequence
  TRAC targeting sequence
ucuuuucuucauaucagggc

SEQ ID NO: 8396 - RNA, 20 nt, Artificial Sequence
  TRAC targeting sequence
uuucuucauaucagggcaga

SEQ ID NO: 8397 - RNA, 20 nt, Artificial Sequence
  TRAC targeting sequence
ucauaucagggcagaggaua

SEQ ID NO: 8398 - RNA, 20 nt, Artificial Sequence
  TRAC targeting sequence
uaucagggcagaggauauac

SEQ ID NO: 8399 - RNA, 20 nt, Artificial Sequence
  TRAC targeting sequence
gggcagaggauauacaacaa

SEQ ID NO: 8400 - RNA, 20 nt, Artificial Sequence
  TRAC targeting sequence
gcccugauaugaagaaaaga

SEQ ID NO: 8401 - RNA, 20 nt, Artificial Sequence
  TRAC targeting sequence
ucugcccugauaugaagaaa

SEQ ID NO: 8402 - RNA, 20 nt, Artificial Sequence
  TRAC targeting sequence
gagaucuuaggaacccuguu

SEQ ID NO: 8403 - RNA, 20 nt, Artificial Sequence
  TRAC targeting sequence
cugagaucuuaggaacccug

SEQ ID NO: 8404 - RNA, 20 nt, Artificial Sequence
  TRAC targeting sequence
gacgguucuaaugaaagaag

SEQ ID NO: 8405 - RNA, 20 nt, Artificial Sequence
  TRAC targeting sequence
gauagucucugagaucuuag

SEQ ID NO: 8406 - RNA, 20 nt, Artificial Sequence
  TRAC targeting sequence
aaugaaagaagacgggagga

SEQ ID NO: 8407 - RNA, 20 nt, Artificial Sequence
  TRAC targeting sequence
uuagaaccgucagauagucu

SEQ ID NO: 8408 - RNA, 20 nt, Artificial Sequence
  TRAC targeting sequence
uucauuagaaccgucagaua

SEQ ID NO: 8409 - RNA, 20 nt, Artificial Sequence
  TRAC targeting sequence
ucuuucauuagaaccgucag

SEQ ID NO: 8410 - RNA, 20 nt, Artificial Sequence
  TRAC targeting sequence
cgucuucuuucauuagaacc

SEQ ID NO: 8411 - RNA, 20 nt, Artificial Sequence
  TRAC targeting sequence
ucccgucuucuuucauuaga

SEQ ID NO: 8412 - RNA, 20 nt, Artificial Sequence
  TRAC targeting sequence
uguuuuccucccgucuucuu

SEQ ID NO: 8413 - RNA, 20 nt, Artificial Sequence
  TRAC targeting sequence
ucuuguuuuccucccgucuu

SEQ ID NO: 8414 - RNA, 20 nt, Artificial Sequence
  TRAC targeting sequence
ccucuuguuuuccucccguc

SEQ ID NO: 8415 - RNA, 20 nt, Artificial Sequence
  TRAC targeting sequence
gcgcugccagucuccucuug

SEQ ID NO: 8416 - RNA, 20 nt, Artificial Sequence
  TRAC targeting sequence
ugugacugauucagcuguga

SEQ ID NO: 8417 - RNA, 20 nt, Artificial Sequence
  TRAC targeting sequence
caugaccgucagcgcugcca

SEQ ID NO: 8418 - RNA, 20 nt, Artificial Sequence
  TRAC targeting sequence
gucacaugaccgucagcgcu

SEQ ID NO: 8419 - RNA, 20 nt, Artificial Sequence
  TRAC targeting sequence
gcugugacuucuagaggcaa

SEQ ID NO: 8420 - RNA, 20 nt, Artificial Sequence
  TRAC targeting sequence
cagcugaaucagucacauga

SEQ ID NO: 8421 - RNA, 20 nt, Artificial Sequence
  TRAC targeting sequence
agaggcaaaugcgcucagcc

SEQ ID NO: 8422 - RNA, 20 nt, Artificial Sequence
  TRAC targeting sequence
agaagucacagcugaaucag

SEQ ID NO: 8423 - RNA, 20 nt, Artificial Sequence
  TRAC targeting sequence
cuguucuuauuuucccucac

SEQ ID NO: 8424 - RNA, 20 nt, Artificial Sequence
  TRAC targeting sequence
guucuuauuuucccucacau

SEQ ID NO: 8425 - RNA, 20 nt, Artificial Sequence
  TRAC targeting sequence
uauuuucccucacaucacua

SEQ ID NO: 8426 - RNA, 20 nt, Artificial Sequence
  TRAC targeting sequence
cucacaucacuaucugaaau

SEQ ID NO: 8427 - RNA, 20 nt, Artificial Sequence
  TRAC targeting sequence
caucacuaucugaaaucauc

SEQ ID NO: 8428 - RNA, 20 nt, Artificial Sequence
  TRAC targeting sequence
cuaucugaaaucaucagauu

SEQ ID NO: 8429 - RNA, 20 nt, Artificial Sequence
  TRAC targeting sequence
gaaaucaucagauucauaca

SEQ ID NO: 8430 - RNA, 20 nt, Artificial Sequence
  TRAC targeting sequence
gauagugaugugagggaaaa

SEQ ID NO: 8431 - RNA, 20 nt, Artificial Sequence
  TRAC targeting sequence
ucagauucauacauguuuau

SEQ ID NO: 8432 - RNA, 20 nt, Artificial Sequence
  TRAC targeting sequence
gauucauacauguuuauuuu

SEQ ID NO: 8433 - RNA, 20 nt, Artificial Sequence
  TRAC targeting sequence
gaugauuucagauagugaug

SEQ ID NO: 8434 - RNA, 20 nt, Artificial Sequence
  TRAC targeting sequence
uacauguuuauuuuaugucu

SEQ ID NO: 8435 - RNA, 20 nt, Artificial Sequence
  TRAC targeting sequence
cucccaucucaccucucccc

SEQ ID NO: 8436 - RNA, 20 nt, Artificial Sequence
  TRAC targeting sequence
cccaucucaccucuccccua

SEQ ID NO: 8437 - RNA, 20 nt, Artificial Sequence
  TRAC targeting sequence
caucucaccucuccccuaca

SEQ ID NO: 8438 - RNA, 20 nt, Artificial Sequence
  TRAC targeting sequence
caccucuccccuacacacac

SEQ ID NO: 8439 - RNA, 20 nt, Artificial Sequence
  TRAC targeting sequence
ccucuccccuacacacacac

SEQ ID NO: 8440 - RNA, 20 nt, Artificial Sequence
  TRAC targeting sequence
ccccuacacacacacacaca

SEQ ID NO: 8441 - RNA, 20 nt, Artificial Sequence
  TRAC targeting sequence
ccuacacacacacacacaca

SEQ ID NO: 8442 - RNA, 20 nt, Artificial Sequence
  TRAC targeting sequence
ugugugugugugugugugug

SEQ ID NO: 8443 - RNA, 20 nt, Artificial Sequence
  TRAC targeting sequence
cuuaaaaacucaccauucac

SEQ ID NO: 8444 - RNA, 20 nt, Artificial Sequence
  TRAC targeting sequence
ccauucaccuagauuuagga

SEQ ID NO: 8445 - RNA, 20 nt, Artificial Sequence
  TRAC targeting sequence
ccuagauuuaggaaauaaaa

SEQ ID NO: 8446 - RNA, 20 nt, Artificial Sequence
  TRAC targeting sequence
aggugaauggugaguuuuua

SEQ ID NO: 8447 - RNA, 20 nt, Artificial Sequence
  TRAC targeting sequence
uaaaucuaggugaaugguga

SEQ ID NO: 8448 - RNA, 20 nt, Artificial Sequence
  TRAC targeting sequence
uguauuuuuauuuccuaaau

SEQ ID NO: 8449 - RNA, 20 nt, Artificial Sequence
  TRAC targeting sequence
aauaaacaacaaaaauuuca

SEQ ID NO: 8450 - RNA, 20 nt, Artificial Sequence
  TRAC targeting sequence
guaauacggguagcugggac

SEQ ID NO: 8451 - RNA, 20 nt, Artificial Sequence
  TRAC targeting sequence
cagcuacccguauuacugaa

SEQ ID NO: 8452 - RNA, 20 nt, Artificial Sequence
  TRAC targeting sequence
aaauauggcaugucccagcu

SEQ ID NO: 8453 - RNA, 20 nt, Artificial Sequence
  TRAC targeting sequence
uuguuuaucugaaauucaaa

SEQ ID NO: 8454 - RNA, 20 nt, Artificial Sequence
  TRAC targeting sequence
gaaauucaaauuccacuggg

SEQ ID NO: 8455 - RNA, 20 nt, Artificial Sequence
  TRAC targeting sequence
gauaaacaaugaauacuuuu

SEQ ID NO: 8456 - RNA, 20 nt, Artificial Sequence
  TRAC targeting sequence
aauuccacugggcauccugu

SEQ ID NO: 8457 - RNA, 20 nt, Artificial Sequence
  TRAC targeting sequence
acugggcauccuguguuuua

SEQ ID NO: 8458 - RNA, 20 nt, Artificial Sequence
  TRAC targeting sequence
aguccacgagacccagcucc

SEQ ID NO: 8459 - RNA, 20 nt, Artificial Sequence
  TRAC targeting sequence
acgagacccagcucccugcu

SEQ ID NO: 8460 - RNA, 20 nt, Artificial Sequence
  TRAC targeting sequence
uggacuggaccccugccggc

SEQ ID NO: 8461 - RNA, 20 nt, Artificial Sequence
  TRAC targeting sequence
cguggacuggaccccugccg

SEQ ID NO: 8462 - RNA, 20 nt, Artificial Sequence
  TRAC targeting sequence
ccauuuugcagauggagcaa

SEQ ID NO: 8463 - RNA, 20 nt, Artificial Sequence
  TRAC targeting sequence
cacaggacuauuggaaaauu

SEQ ID NO: 8464 - RNA, 20 nt, Artificial Sequence
  TRAC targeting sequence
caggacuauuggaaaauuua

SEQ ID NO: 8465 - RNA, 20 nt, Artificial Sequence
  TRAC targeting sequence
ugugagaaaagcuauuacua

SEQ ID NO: 8466 - RNA, 20 nt, Artificial Sequence
  TRAC targeting sequence
aauaguccugugagaaaagc

SEQ ID NO: 8467 - RNA, 20 nt, Artificial Sequence
  TRAC targeting sequence
cuaaauuuuccaauaguccu

SEQ ID NO: 8468 - RNA, 20 nt, Artificial Sequence
  TRAC targeting sequence
cacaugcaauacacccagca

SEQ ID NO: 8469 - RNA, 20 nt, Artificial Sequence
  TRAC targeting sequence
gcuggguguauugcaugugu

SEQ ID NO: 8470 - RNA, 20 nt, Artificial Sequence
  TRAC targeting sequence
uuuaucugcuggguguauug

SEQ ID NO: 8471 - RNA, 20 nt, Artificial Sequence
  TRAC targeting sequence
auucauaugucuauuuaaua

SEQ ID NO: 8472 - RNA, 20 nt, Artificial Sequence
  TRAC targeting sequence
uaagaguguuacucucauca

SEQ ID NO: 8473 - RNA, 20 nt, Artificial Sequence
  TRAC targeting sequence
uaggaacucuauucauaugu

SEQ ID NO: 8474 - RNA, 20 nt, Artificial Sequence
  TRAC targeting sequence
caucaaugcugcucagggaa

SEQ ID NO: 8475 - RNA, 20 nt, Artificial Sequence
  TRAC targeting sequence
ucaaugcugcucagggaaaa

SEQ ID NO: 8476 - RNA, 20 nt, Artificial Sequence
  TRAC targeting sequence
augcugcucagggaaaagau

SEQ ID NO: 8477 - RNA, 20 nt, Artificial Sequence
  TRAC targeting sequence
gggaaaagaugcugaguaaa

SEQ ID NO: 8478 - RNA, 20 nt, Artificial Sequence
  TRAC targeting sequence
cugagcagcauugaugagag

SEQ ID NO: 8479 - RNA, 20 nt, Artificial Sequence
  TRAC targeting sequence
uuucccugagcagcauugau

SEQ ID NO: 8480 - RNA, 20 nt, Artificial Sequence
  TRAC targeting sequence
gcaucuuuucccugagcagc

SEQ ID NO: 8481 - RNA, 20 nt, Artificial Sequence
  TRAC targeting sequence
aaauuuuaaaguugcaaaau

SEQ ID NO: 8482 - RNA, 20 nt, Artificial Sequence
  TRAC targeting sequence
agcaaaagauuguugauaug

SEQ ID NO: 8483 - RNA, 20 nt, Artificial Sequence
  TRAC targeting sequence
uuugcuagauuuugcaacuu

SEQ ID NO: 8484 - RNA, 20 nt, Artificial Sequence
  TRAC targeting sequence
acaaucuuuugcuagauuuu

SEQ ID NO: 8485 - RNA, 20 nt, Artificial Sequence
  TRAC targeting sequence
aucaaugguuaaaaaaaaaa

SEQ ID NO: 8486 - RNA, 20 nt, Artificial Sequence
  TRAC targeting sequence
augguuaaaaaaaaaagacu

SEQ ID NO: 8487 - RNA, 20 nt, Artificial Sequence
  TRAC targeting sequence
uuuuuuuuuaaccauugauu

SEQ ID NO: 8488 - RNA, 20 nt, Artificial Sequence
  TRAC targeting sequence
gucuuuuuuuuuuaaccauu

SEQ ID NO: 8489 - RNA, 20 nt, Artificial Sequence
  TRAC targeting sequence
uuaauuugcuuucagugcug

SEQ ID NO: 8490 - RNA, 20 nt, Artificial Sequence
  TRAC targeting sequence
gugcugcaagcauguccuag

SEQ ID NO: 8491 - RNA, 20 nt, Artificial Sequence
  TRAC targeting sequence
uagagcuccgugauccccug

SEQ ID NO: 8492 - RNA, 20 nt, Artificial Sequence
  TRAC targeting sequence
aggacaugcuugcagcacug

SEQ ID NO: 8493 - RNA, 20 nt, Artificial Sequence
  TRAC targeting sequence
gugauccccugagaccugug

SEQ ID NO: 8494 - RNA, 20 nt, Artificial Sequence
  TRAC targeting sequence
cggagcucuaggacaugcuu

SEQ ID NO: 8495 - RNA, 20 nt, Artificial Sequence
  TRAC targeting sequence
ccugagaccugugauccucu

SEQ ID NO: 8496 - RNA, 20 nt, Artificial Sequence
  TRAC targeting sequence
ggggaucacggagcucuagg

SEQ ID NO: 8497 - RNA, 20 nt, Artificial Sequence
  TRAC targeting sequence
caggggaucacggagcucua

SEQ ID NO: 8498 - RNA, 20 nt, Artificial Sequence
  TRAC targeting sequence
caggucucaggggaucacgg

SEQ ID NO: 8499 - RNA, 20 nt, Artificial Sequence
  TRAC targeting sequence
ucugagacaugagccagcug

SEQ ID NO: 8500 - RNA, 20 nt, Artificial Sequence
  TRAC targeting sequence
gagacaugagccagcugugc

SEQ ID NO: 8501 - RNA, 20 nt, Artificial Sequence
  TRAC targeting sequence
gaggaucacaggucucaggg

SEQ ID NO: 8502 - RNA, 20 nt, Artificial Sequence
  TRAC targeting sequence
cagaggaucacaggucucag

SEQ ID NO: 8503 - RNA, 20 nt, Artificial Sequence
  TRAC targeting sequence
ugucucagaggaucacaggu

SEQ ID NO: 8504 - RNA, 20 nt, Artificial Sequence
  TRAC targeting sequence
ccccaagucccuaagagcau

SEQ ID NO: 8505 - RNA, 20 nt, Artificial Sequence
  TRAC targeting sequence
ccaagucccuaagagcauua

SEQ ID NO: 8506 - RNA, 20 nt, Artificial Sequence
  TRAC targeting sequence
cuaagagcauuaggagcaug

SEQ ID NO: 8507 - RNA, 20 nt, Artificial Sequence
  TRAC targeting sequence
uagggacuuggggagagcac

SEQ ID NO: 8508 - RNA, 20 nt, Artificial Sequence
  TRAC targeting sequence
uaaugcucuuagggacuugg

SEQ ID NO: 8509 - RNA, 20 nt, Artificial Sequence
  TRAC targeting sequence
ugcuccuaaugcucuuaggg

SEQ ID NO: 8510 - RNA, 20 nt, Artificial Sequence
  TRAC targeting sequence
caugcuccuaaugcucuuag

SEQ ID NO: 8511 - RNA, 20 nt, Artificial Sequence
  TRAC targeting sequence
cuucucaugcuccuaaugcu

SEQ ID NO: 8512 - RNA, 20 nt, Artificial Sequence
  TRAC targeting sequence
agccccuuguucuuaugucu

SEQ ID NO: 8513 - RNA, 20 nt, Artificial Sequence
  TRAC targeting sequence
uaugucuuccaaacauugua

SEQ ID NO: 8514 - RNA, 20 nt, Artificial Sequence
  TRAC targeting sequence
uccaaacauuguaacaggcu

SEQ ID NO: 8515 - RNA, 20 nt, Artificial Sequence
  TRAC targeting sequence
aaacauuguaacaggcuugu

SEQ ID NO: 8516 - RNA, 20 nt, Artificial Sequence
  TRAC targeting sequence
ugagaggccacaaugcauga

SEQ ID NO: 8517 - RNA, 20 nt, Artificial Sequence
  TRAC targeting sequence
ugaacaagccuguuacaaug

SEQ ID NO: 8518 - RNA, 20 nt, Artificial Sequence
  TRAC targeting sequence
caugaacaagccuguuacaa

SEQ ID NO: 8519 - RNA, 20 nt, Artificial Sequence
  TRAC targeting sequence
ugcauuguggccucucauga

SEQ ID NO: 8520 - RNA, 20 nt, Artificial Sequence
  TRAC targeting sequence
agugaccccaccacugagga

SEQ ID NO: 8521 - RNA, 20 nt, Artificial Sequence
  TRAC targeting sequence
cuugaucaugcauuguggcc

SEQ ID NO: 8522 - RNA, 20 nt, Artificial Sequence
  TRAC targeting sequence
gugguggggucacuugauca

SEQ ID NO: 8523 - RNA, 20 nt, Artificial Sequence
  TRAC targeting sequence
ucagugguggggucacuuga

SEQ ID NO: 8524 - RNA, 20 nt, Artificial Sequence
  TRAC targeting sequence
uauuccucaguggugggguc

SEQ ID NO: 8525 - RNA, 20 nt, Artificial Sequence
  TRAC targeting sequence
ccuauuccucaguggugggg

SEQ ID NO: 8526 - RNA, 20 nt, Artificial Sequence
  TRAC targeting sequence
agauucaguggcccacuaag

SEQ ID NO: 8527 - RNA, 20 nt, Artificial Sequence
  TRAC targeting sequence
ugaggcuuucuccuauuccu

SEQ ID NO: 8528 - RNA, 20 nt, Artificial Sequence
  TRAC targeting sequence
guggcccacuaaggacguau

SEQ ID NO: 8529 - RNA, 20 nt, Artificial Sequence
  TRAC targeting sequence
uuagugggccacugaaucuu

SEQ ID NO: 8530 - RNA, 20 nt, Artificial Sequence
  TRAC targeting sequence
ccaacccaucuuccuauugg

SEQ ID NO: 8531 - RNA, 20 nt, Artificial Sequence
  TRAC targeting sequence
aacccaucuuccuauuggca

SEQ ID NO: 8532 - RNA, 20 nt, Artificial Sequence
  TRAC targeting sequence
uccuauuggcaucuggagac

SEQ ID NO: 8533 - RNA, 20 nt, Artificial Sequence
  TRAC targeting sequence
uauuggcaucuggagacuau

SEQ ID NO: 8534 - RNA, 20 nt, Artificial Sequence
  TRAC targeting sequence
ggagacuaugccucuuccca

SEQ ID NO: 8535 - RNA, 20 nt, Artificial Sequence
  TRAC targeting sequence
agaugccaauaggaagaugg

SEQ ID NO: 8536 - RNA, 20 nt, Artificial Sequence
  TRAC targeting sequence
ccagaugccaauaggaagau

SEQ ID NO: 8537 - RNA, 20 nt, Artificial Sequence
  TRAC targeting sequence
ucccaaggugcugagggugc

SEQ ID NO: 8538 - RNA, 20 nt, Artificial Sequence
  TRAC targeting sequence
caaggugcugagggugcugc

SEQ ID NO: 8539 - RNA, 20 nt, Artificial Sequence
  TRAC targeting sequence
gcaccuugggaagaggcaua

SEQ ID NO: 8540 - RNA, 20 nt, Artificial Sequence
  TRAC targeting sequence
gcagcacccucagcaccuug

SEQ ID NO: 8541 - RNA, 20 nt, Artificial Sequence
  TRAC targeting sequence
cuggugggcggguggggccu

SEQ ID NO: 8542 - RNA, 20 nt, Artificial Sequence
  TRAC targeting sequence
ucgcuggugggcgggugggg

SEQ ID NO: 8543 - RNA, 20 nt, Artificial Sequence
  TRAC targeting sequence
uuagcccaaaacugccacuc

SEQ ID NO: 8544 - RNA, 20 nt, Artificial Sequence
  TRAC targeting sequence
agagggguccucagacaagg

SEQ ID NO: 8545 - RNA, 20 nt, Artificial Sequence
  TRAC targeting sequence
ugaguggcaguuuugggcua

SEQ ID NO: 8546 - RNA, 20 nt, Artificial Sequence
  TRAC targeting sequence
ucagacaaggugggagccaa

SEQ ID NO: 8547 - RNA, 20 nt, Artificial Sequence
  TRAC targeting sequence
gacaaggugggagccaagag

SEQ ID NO: 8548 - RNA, 20 nt, Artificial Sequence
  TRAC targeting sequence
gaggaccccucuugaguggc

SEQ ID NO: 8549 - RNA, 20 nt, Artificial Sequence
  TRAC targeting sequence
caccuugucugaggaccccu

SEQ ID NO: 8550 - RNA, 20 nt, Artificial Sequence
  TRAC targeting sequence
uggcucccaccuugucugag

SEQ ID NO: 8551 - RNA, 20 nt, Artificial Sequence
  TRAC targeting sequence
cuuggcucccaccuugucug

SEQ ID NO: 8552 - RNA, 20 nt, Artificial Sequence
  TRAC targeting sequence
ccaaaucucuuggcucccac

SEQ ID NO: 8553 - RNA, 20 nt, Artificial Sequence
  TRAC targeting sequence
cccuugucccacagcuugga

SEQ ID NO: 8554 - RNA, 20 nt, Artificial Sequence
  TRAC targeting sequence
cacagcuuggaucuugauca

SEQ ID NO: 8555 - RNA, 20 nt, Artificial Sequence
  TRAC targeting sequence
aagcugugggacaaggguga

SEQ ID NO: 8556 - RNA, 20 nt, Artificial Sequence
  TRAC targeting sequence
ugaucacucauaucacucag

SEQ ID NO: 8557 - RNA, 20 nt, Artificial Sequence
  TRAC targeting sequence
agauccaagcugugggacaa

SEQ ID NO: 8558 - RNA, 20 nt, Artificial Sequence
  TRAC targeting sequence
cucauaucacucagaagagg

SEQ ID NO: 8559 - RNA, 20 nt, Artificial Sequence
  TRAC targeting sequence
uaucacucagaagagggacu

SEQ ID NO: 8560 - RNA, 20 nt, Artificial Sequence
  TRAC targeting sequence
cucagaagagggacuuuucu

SEQ ID NO: 8561 - RNA, 20 nt, Artificial Sequence
  TRAC targeting sequence
gaagagggacuuuucucucu

SEQ ID NO: 8562 - RNA, 20 nt, Artificial Sequence
  TRAC targeting sequence
gagugauaugagugaucaag

SEQ ID NO: 8563 - RNA, 20 nt, Artificial Sequence
  TRAC targeting sequence
ucugagugauaugagugauc

SEQ ID NO: 8564 - RNA, 20 nt, Artificial Sequence
  TRAC targeting sequence
cucuucugagugauaugagu

SEQ ID NO: 8565 - RNA, 20 nt, Artificial Sequence
  TRAC targeting sequence
cucuuguuuccuuugaggug

SEQ ID NO: 8566 - RNA, 20 nt, Artificial Sequence
  TRAC targeting sequence
cuuguuuccuuugagguggg

SEQ ID NO: 8567 - RNA, 20 nt, Artificial Sequence
  TRAC targeting sequence
uguuuccuuugaggugggcg

SEQ ID NO: 8568 - RNA, 20 nt, Artificial Sequence
  TRAC targeting sequence
uuugaggugggcggcuuugu

SEQ ID NO: 8569 - RNA, 20 nt, Artificial Sequence
  TRAC targeting sequence
aaggaaacaagagagaaaag

SEQ ID NO: 8570 - RNA, 20 nt, Artificial Sequence
  TRAC targeting sequence
aaaacaaagccgcccaccuc

SEQ ID NO: 8571 - RNA, 20 nt, Artificial Sequence
  TRAC targeting sequence
gcugcuacuaauuaucgcau

SEQ ID NO: 8572 - RNA, 20 nt, Artificial Sequence
  TRAC targeting sequence
caucuccauaaauaggucau

SEQ ID NO: 8573 - RNA, 20 nt, Artificial Sequence
  TRAC targeting sequence
ccauaaauaggucauacugg

SEQ ID NO: 8574 - RNA, 20 nt, Artificial Sequence
  TRAC targeting sequence
auaaauaggucauacuggag

SEQ ID NO: 8575 - RNA, 20 nt, Artificial Sequence
  TRAC targeting sequence
uacuggagguugauagaaaa

SEQ ID NO: 8576 - RNA, 20 nt, Artificial Sequence
  TRAC targeting sequence
aguaugaccuauuuauggag

SEQ ID NO: 8577 - RNA, 20 nt, Artificial Sequence
  TRAC targeting sequence
accuccaguaugaccuauuu

SEQ ID NO: 8578 - RNA, 20 nt, Artificial Sequence
  TRAC targeting sequence
aucaaccuccaguaugaccu

SEQ ID NO: 8579 - RNA, 20 nt, Artificial Sequence
  TRAC targeting sequence
auuuucuaucaaccuccagu

SEQ ID NO: 8580 - RNA, 20 nt, Artificial Sequence
  TRAC targeting sequence
gggaaggaaaacauucuuug

SEQ ID NO: 8581 - RNA, 20 nt, Artificial Sequence
  TRAC targeting sequence
cugaucuauuuucuaucaac

SEQ ID NO: 8582 - RNA, 20 nt, Artificial Sequence
  TRAC targeting sequence
uucccugaucuauuuucuau

SEQ ID NO: 8583 - RNA, 20 nt, Artificial Sequence
  TRAC targeting sequence
uuguucacaauucaagucaa

SEQ ID NO: 8584 - RNA, 20 nt, Artificial Sequence
  TRAC targeting sequence
caauucaagucaaagcugcu

SEQ ID NO: 8585 - RNA, 20 nt, Artificial Sequence
  TRAC targeting sequence
agucaaagcugcugcuucug

SEQ ID NO: 8586 - RNA, 20 nt, Artificial Sequence
  TRAC targeting sequence
aagcugcugcuucugucucc

SEQ ID NO: 8587 - RNA, 20 nt, Artificial Sequence
  TRAC targeting sequence
gucuccauucccuuuucaac

SEQ ID NO: 8588 - RNA, 20 nt, Artificial Sequence
  TRAC targeting sequence
ccauucccuuuucaacucug

SEQ ID NO: 8589 - RNA, 20 nt, Artificial Sequence
  TRAC targeting sequence
auucccuuuucaacucugag

SEQ ID NO: 8590 - RNA, 20 nt, Artificial Sequence
  TRAC targeting sequence
cuuuucaacucugagacugg

SEQ ID NO: 8591 - RNA, 20 nt, Artificial Sequence
  TRAC targeting sequence
acucugagacuggcagcugc

SEQ ID NO: 8592 - RNA, 20 nt, Artificial Sequence
  TRAC targeting sequence
gagacuggcagcugcuucuc

SEQ ID NO: 8593 - RNA, 20 nt, Artificial Sequence
  TRAC targeting sequence
gaguugaaaagggaauggag

SEQ ID NO: 8594 - RNA, 20 nt, Artificial Sequence
  TRAC targeting sequence
cagaguugaaaagggaaugg

SEQ ID NO: 8595 - RNA, 20 nt, Artificial Sequence
  TRAC targeting sequence
cuguuggcccaaagggacua

SEQ ID NO: 8596 - RNA, 20 nt, Artificial Sequence
  TRAC targeting sequence
guuggcccaaagggacuauc

SEQ ID NO: 8597 - RNA, 20 nt, Artificial Sequence
  TRAC targeting sequence
cuuugggccaacagagaagc

SEQ ID NO: 8598 - RNA, 20 nt, Artificial Sequence
  TRAC targeting sequence
uccaccagucacccaaagag

SEQ ID NO: 8599 - RNA, 20 nt, Artificial Sequence
  TRAC targeting sequence
accagucacccaaagaggac

SEQ ID NO: 8600 - RNA, 20 nt, Artificial Sequence
  TRAC targeting sequence
cccaaagaggacugucuuua

SEQ ID NO: 8601 - RNA, 20 nt, Artificial Sequence
  TRAC targeting sequence
uugggugacugguggaggau

SEQ ID NO: 8602 - RNA, 20 nt, Artificial Sequence
  TRAC targeting sequence
ucuuugggugacugguggag

SEQ ID NO: 8603 - RNA, 20 nt, Artificial Sequence
  TRAC targeting sequence
uuaaggauaugagauagcac

SEQ ID NO: 8604 - RNA, 20 nt, Artificial Sequence
  TRAC targeting sequence
uuaaagacaguccucuuugg

SEQ ID NO: 8605 - RNA, 20 nt, Artificial Sequence
  TRAC targeting sequence
uauccuuaaagacaguccuc

SEQ ID NO: 8606 - RNA, 20 nt, Artificial Sequence
  TRAC targeting sequence
cauauccuuaaagacagucc

SEQ ID NO: 8607 - RNA, 20 nt, Artificial Sequence
  TRAC targeting sequence
uagggugcuaucucauaucc

SEQ ID NO: 8608 - RNA, 20 nt, Artificial Sequence
  TRAC targeting sequence
ucuuagggugcuaucucaua

SEQ ID NO: 8609 - RNA, 20 nt, Artificial Sequence
  TRAC targeting sequence
auuuauccucuuagggugcu

SEQ ID NO: 8610 - RNA, 20 nt, Artificial Sequence
  TRAC targeting sequence
ugucuacaaaaagccuaaug

SEQ ID NO: 8611 - RNA, 20 nt, Artificial Sequence
  TRAC targeting sequence
acaaaaagccuaaugcaaca

SEQ ID NO: 8612 - RNA, 20 nt, Artificial Sequence
  TRAC targeting sequence
acuguugcauuaggcuuuuu

SEQ ID NO: 8613 - RNA, 20 nt, Artificial Sequence
  TRAC targeting sequence
ucuacuguugcauuaggcuu

SEQ ID NO: 8614 - RNA, 20 nt, Artificial Sequence
  TRAC targeting sequence
cuauguccucuacuguugca

SEQ ID NO: 8615 - RNA, 20 nt, Artificial Sequence
  TRAC targeting sequence
uuggauggauagagacaagu

SEQ ID NO: 8616 - RNA, 20 nt, Artificial Sequence
  TRAC targeting sequence
aaagaaauuucccuaugucc

SEQ ID NO: 8617 - RNA, 20 nt, Artificial Sequence
  TRAC targeting sequence
auccaaagaaauuucccuau

SEQ ID NO: 8618 - RNA, 20 nt, Artificial Sequence
  TRAC targeting sequence
auccauccaaagaaauuucc

SEQ ID NO: 8619 - RNA, 20 nt, Artificial Sequence
  TRAC targeting sequence
cuauccauccaaagaaauuu

SEQ ID NO: 8620 - RNA, 20 nt, Artificial Sequence
  TRAC targeting sequence
cuuucuuacgaaagaauaga

SEQ ID NO: 8621 - RNA, 20 nt, Artificial Sequence
  TRAC targeting sequence
uucuuacgaaagaauagaaa

SEQ ID NO: 8622 - RNA, 20 nt, Artificial Sequence
  TRAC targeting sequence
uacgaaagaauagaaaugug

SEQ ID NO: 8623 - RNA, 20 nt, Artificial Sequence
  TRAC targeting sequence
uaagaaagagaugcacuugu

SEQ ID NO: 8624 - RNA, 20 nt, Artificial Sequence
  TRAC targeting sequence
uucguaagaaagagaugcac

SEQ ID NO: 8625 - RNA, 20 nt, Artificial Sequence
  TRAC targeting sequence
auucuuucguaagaaagaga

SEQ ID NO: 8626 - RNA, 20 nt, Artificial Sequence
  TRAC targeting sequence
cauuucuauucuuucguaag

SEQ ID NO: 8627 - RNA, 20 nt, Artificial Sequence
  TRAC targeting sequence
uuuuuaaucacauuucuauu

SEQ ID NO: 8628 - RNA, 20 nt, Artificial Sequence
  TRAC targeting sequence
aggcuuuuccuuuuuaauca

SEQ ID NO: 8629 - RNA, 20 nt, Artificial Sequence
  TRAC targeting sequence
gaacguguggaaaugggggu

SEQ ID NO: 8630 - RNA, 20 nt, Artificial Sequence
  TRAC targeting sequence
gauguuucuaggcuuuuccu

SEQ ID NO: 8631 - RNA, 20 nt, Artificial Sequence
  TRAC targeting sequence
acacguucagauguuucuag

SEQ ID NO: 8632 - RNA, 20 nt, Artificial Sequence
  TRAC targeting sequence
cccccauuuccacacguuca

SEQ ID NO: 8633 - RNA, 20 nt, Artificial Sequence
  TRAC targeting sequence
agcccacucacccccauuuc

SEQ ID NO: 8634 - RNA, 20 nt, Artificial Sequence
  TRAC targeting sequence
cuagcccacucacccccauu

SEQ ID NO: 8635 - RNA, 20 nt, Artificial Sequence
  TRAC targeting sequence
uuucucuagcccacucaccc

SEQ ID NO: 8636 - RNA, 20 nt, Artificial Sequence
  TRAC targeting sequence
gcaucacuuucuuccuguag

SEQ ID NO: 8637 - RNA, 20 nt, Artificial Sequence
  TRAC targeting sequence
cuuucuuccuguagcaauuc

SEQ ID NO: 8638 - RNA, 20 nt, Artificial Sequence
  TRAC targeting sequence
uccuguagcaauuccauccg

SEQ ID NO: 8639 - RNA, 20 nt, Artificial Sequence
  TRAC targeting sequence
uguagcaauuccauccgaga

SEQ ID NO: 8640 - RNA, 20 nt, Artificial Sequence
  TRAC targeting sequence
auccgagaucccugggacag

SEQ ID NO: 8641 - RNA, 20 nt, Artificial Sequence
  TRAC targeting sequence
gagaucccugggacagaccu

SEQ ID NO: 8642 - RNA, 20 nt, Artificial Sequence
  TRAC targeting sequence
gauggaauugcuacaggaag

SEQ ID NO: 8643 - RNA, 20 nt, Artificial Sequence
  TRAC targeting sequence
cggauggaauugcuacagga

SEQ ID NO: 8644 - RNA, 20 nt, Artificial Sequence
  TRAC targeting sequence
cugggacagaccuggccuga

SEQ ID NO: 8645 - RNA, 20 nt, Artificial Sequence
  TRAC targeting sequence
cagggaucucggauggaauu

SEQ ID NO: 8646 - RNA, 20 nt, Artificial Sequence
  TRAC targeting sequence
gucccagggaucucggaugg

SEQ ID NO: 8647 - RNA, 20 nt, Artificial Sequence
  TRAC targeting sequence
ggccaggucugucccaggga

SEQ ID NO: 8648 - RNA, 20 nt, Artificial Sequence
  TRAC targeting sequence
ucaggccaggucugucccag

SEQ ID NO: 8649 - RNA, 20 nt, Artificial Sequence
  TRAC targeting sequence
ugcuauucaucaggccaggu

SEQ ID NO: 8650 - RNA, 20 nt, Artificial Sequence
  TRAC targeting sequence
cuggugugcuuccugcuauu

SEQ ID NO: 8651 - RNA, 20 nt, Artificial Sequence
  TRAC targeting sequence
cucccuggugugcuuccugc

SEQ ID NO: 8652 - RNA, 20 nt, Artificial Sequence
  TRAC targeting sequence
ugcagacaaccuucaccacc

SEQ ID NO: 8653 - RNA, 20 nt, Artificial Sequence
  TRAC targeting sequence
gcaggaccuugucccucccu

SEQ ID NO: 8654 - RNA, 20 nt, Artificial Sequence
  TRAC targeting sequence
ccaccaggcugggacagcgc

SEQ ID NO: 8655 - RNA, 20 nt, Artificial Sequence
  TRAC targeting sequence
cagccugguggugaagguug

SEQ ID NO: 8656 - RNA, 20 nt, Artificial Sequence
  TRAC targeting sequence
ccauggcgcugucccagccu

SEQ ID NO: 8657 - RNA, 20 nt, Artificial Sequence
  TRAC targeting sequence
gcuuuggggaaagaccuugc

SEQ ID NO: 8658 - RNA, 20 nt, Artificial Sequence
  TRAC targeting sequence
ccaaagcagaggcccugggu

SEQ ID NO: 8659 - RNA, 20 nt, Artificial Sequence
  TRAC targeting sequence
uuccccaaagcagaggcccu

SEQ ID NO: 8660 - RNA, 20 nt, Artificial Sequence
  TRAC targeting sequence
gcaaggucuuuccccaaagc

SEQ ID NO: 8661 - RNA, 20 nt, Artificial Sequence
  TRAC targeting sequence
ugcccauggggcccucagca

SEQ ID NO: 8662 - RNA, 20 nt, Artificial Sequence
  TRAC targeting sequence
cacuuguucuugcccauggg

SEQ ID NO: 8663 - RNA, 20 nt, Artificial Sequence
  TRAC targeting sequence
ucacacuuguucuugcccau

SEQ ID NO: 8664 - RNA, 20 nt, Artificial Sequence
  TRAC targeting sequence
acaaagccagcguuugaagg

SEQ ID NO: 8665 - RNA, 20 nt, Artificial Sequence
  TRAC targeting sequence
aacgcuggcuuuguggaggg

SEQ ID NO: 8666 - RNA, 20 nt, Artificial Sequence
  TRAC targeting sequence
uucaaacgcuggcuuugugg

SEQ ID NO: 8667 - RNA, 20 nt, Artificial Sequence
  TRAC targeting sequence
caguuuuccuucaaacgcug

SEQ ID NO: 8668 - RNA, 20 nt, Artificial Sequence
  TRAC targeting sequence
ucacaguuuuccuucaaacg

SEQ ID NO: 8669 - RNA, 20 nt, Artificial Sequence
  TRAC targeting sequence
uccucacaguuuuccuucaa

SEQ ID NO: 8670 - RNA, 20 nt, Artificial Sequence
  TRAC targeting sequence
cuucuuccucacaguuuucc

SEQ ID NO: 8671 - RNA, 20 nt, Artificial Sequence
  TRAC targeting sequence
augguguuguuguugccacc

SEQ ID NO: 8672 - RNA, 20 nt, Artificial Sequence
  TRAC targeting sequence
agcgguggcaacaacaacac

SEQ ID NO: 8673 - RNA, 20 nt, Artificial Sequence
  TRAC targeting sequence
ugcuacaggcugcuccagcg

SEQ ID NO: 8674 - RNA, 20 nt, Artificial Sequence
  TRAC targeting sequence
ugguccaaccaggucaguga

SEQ ID NO: 8675 - RNA, 20 nt, Artificial Sequence
  TRAC targeting sequence
aaccaggucagugauacuuu

SEQ ID NO: 8676 - RNA, 20 nt, Artificial Sequence
  TRAC targeting sequence
gugauacuuuuuaugauggg

SEQ ID NO: 8677 - RNA, 20 nt, Artificial Sequence
  TRAC targeting sequence
cugaccugguuggaccaaga

SEQ ID NO: 8678 - RNA, 20 nt, Artificial Sequence
  TRAC targeting sequence
uaaaaaguaucacugaccug

SEQ ID NO: 8679 - RNA, 20 nt, Artificial Sequence
  TRAC targeting sequence
cacacagccccaucauaaaa

SEQ ID NO: 8680 - RNA, 20 nt, Artificial Sequence
  TRAC targeting sequence
ggucccacacagccccauca

SEQ ID NO: 8681 - RNA, 20 nt, Artificial Sequence
  TRAC targeting sequence
ggucaggucccacacagccc

SEQ ID NO: 8682 - RNA, 20 nt, Artificial Sequence
  TRAC targeting sequence
ugcuaaccagauuucuaaag

SEQ ID NO: 8683 - RNA, 20 nt, Artificial Sequence
  TRAC targeting sequence
gguuagcaagagucagguca

SEQ ID NO: 8684 - RNA, 20 nt, Artificial Sequence
  TRAC targeting sequence
aaagccaucugcagggucuu

SEQ ID NO: 8685 - RNA, 20 nt, Artificial Sequence
  TRAC targeting sequence
gcagggucuuuucuccuauu

SEQ ID NO: 8686 - RNA, 20 nt, Artificial Sequence
  TRAC targeting sequence
uuucuccuauuauuccccag

SEQ ID NO: 8687 - RNA, 20 nt, Artificial Sequence
  TRAC targeting sequence
ccuauuauuccccagggcag

SEQ ID NO: 8688 - RNA, 20 nt, Artificial Sequence
  TRAC targeting sequence
uauuauuccccagggcaggg

SEQ ID NO: 8689 - RNA, 20 nt, Artificial Sequence
  TRAC targeting sequence
ccagggcagggagggcaaac

SEQ ID NO: 8690 - RNA, 20 nt, Artificial Sequence
  TRAC targeting sequence
cugcccuggggaauaauagg

SEQ ID NO: 8691 - RNA, 20 nt, Artificial Sequence
  TRAC targeting sequence
guuugcccucccugcccugg

SEQ ID NO: 8692 - RNA, 20 nt, Artificial Sequence
  TRAC targeting sequence
ccauuaucaagagcuaacaa

SEQ ID NO: 8693 - RNA, 20 nt, Artificial Sequence
  TRAC targeting sequence
auuaucaagagcuaacaauu

SEQ ID NO: 8694 - RNA, 20 nt, Artificial Sequence
  TRAC targeting sequence
agagcuaacaauugguagag

SEQ ID NO: 8695 - RNA, 20 nt, Artificial Sequence
  TRAC targeting sequence
ugauaauggagauauaaucu

SEQ ID NO: 8696 - RNA, 20 nt, Artificial Sequence
  TRAC targeting sequence
accaauuguuagcucuugau

SEQ ID NO: 8697 - RNA, 20 nt, Artificial Sequence
  TRAC targeting sequence
cuaccaauuguuagcucuug

SEQ ID NO: 8698 - RNA, 20 nt, Artificial Sequence
  TRAC targeting sequence
gcauagucucuaccaauugu

SEQ ID NO: 8699 - RNA, 20 nt, Artificial Sequence
  TRAC targeting sequence
uaccagcaugcuccgcauag

SEQ ID NO: 8700 - RNA, 20 nt, Artificial Sequence
  TRAC targeting sequence
uucuuaccagcaugcuccgc

SEQ ID NO: 8701 - RNA, 20 nt, Artificial Sequence
  TRAC targeting sequence
gaggccacaucuauacucag

SEQ ID NO: 8702 - RNA, 20 nt, Artificial Sequence
  TRAC targeting sequence
gaaucuuucuuaccagcaug

SEQ ID NO: 8703 - RNA, 20 nt, Artificial Sequence
  TRAC targeting sequence
auacucagaggaagagagug

SEQ ID NO: 8704 - RNA, 20 nt, Artificial Sequence
  TRAC targeting sequence
gaggaagagagugauguguu

SEQ ID NO: 8705 - RNA, 20 nt, Artificial Sequence
  TRAC targeting sequence
gaguauagauguggccucag

SEQ ID NO: 8706 - RNA, 20 nt, Artificial Sequence
  TRAC targeting sequence
ucugaguauagauguggccu

SEQ ID NO: 8707 - RNA, 20 nt, Artificial Sequence
  TRAC targeting sequence
uccucugaguauagaugugg

SEQ ID NO: 8708 - RNA, 20 nt, Artificial Sequence
  TRAC targeting sequence
cuuccucugaguauagaugu

SEQ ID NO: 8709 - RNA, 20 nt, Artificial Sequence
  TRAC targeting sequence
cucucuuccucugaguauag

SEQ ID NO: 8710 - RNA, 20 nt, Artificial Sequence
  TRAC targeting sequence
cuugguaaauauugcuaaua

SEQ ID NO: 8711 - RNA, 20 nt, Artificial Sequence
  TRAC targeting sequence
gcucccuugguaaauauugc

SEQ ID NO: 8712 - RNA, 20 nt, Artificial Sequence
  TRAC targeting sequence
ugcuucugcucccuugguaa

SEQ ID NO: 8713 - RNA, 20 nt, Artificial Sequence
  TRAC targeting sequence
cauuccugcucucgauguca

SEQ ID NO: 8714 - RNA, 20 nt, Artificial Sequence
  TRAC targeting sequence
ugcucucgaugucauucccu

SEQ ID NO: 8715 - RNA, 20 nt, Artificial Sequence
  TRAC targeting sequence
cgaugucauucccugaaaug

SEQ ID NO: 8716 - RNA, 20 nt, Artificial Sequence
  TRAC targeting sequence
augucauucccugaaaugag

SEQ ID NO: 8717 - RNA, 20 nt, Artificial Sequence
  TRAC targeting sequence
agagcaggaaugggaaauac

SEQ ID NO: 8718 - RNA, 20 nt, Artificial Sequence
  TRAC targeting sequence
uucccugaaaugaguccugc

SEQ ID NO: 8719 - RNA, 20 nt, Artificial Sequence
  TRAC targeting sequence
cugaaaugaguccugcagag

SEQ ID NO: 8720 - RNA, 20 nt, Artificial Sequence
  TRAC targeting sequence
gggaaugacaucgagagcag

SEQ ID NO: 8721 - RNA, 20 nt, Artificial Sequence
  TRAC targeting sequence
uuucagggaaugacaucgag

SEQ ID NO: 8722 - RNA, 20 nt, Artificial Sequence
  TRAC targeting sequence
ugcagagaaagaauaaucag

SEQ ID NO: 8723 - RNA, 20 nt, Artificial Sequence
  TRAC targeting sequence
gcaggacucauuucagggaa

SEQ ID NO: 8724 - RNA, 20 nt, Artificial Sequence
  TRAC targeting sequence
cugcaggacucauuucaggg

SEQ ID NO: 8725 - RNA, 20 nt, Artificial Sequence
  TRAC targeting sequence
uucucugcaggacucauuuc

SEQ ID NO: 8726 - RNA, 20 nt, Artificial Sequence
  TRAC targeting sequence
gagccaauucuccauuggau

SEQ ID NO: 8727 - RNA, 20 nt, Artificial Sequence
  TRAC targeting sequence
gauuauucuuucucugcagg

SEQ ID NO: 8728 - RNA, 20 nt, Artificial Sequence
  TRAC targeting sequence
ccauuggauuguccuuuugg

SEQ ID NO: 8729 - RNA, 20 nt, Artificial Sequence
  TRAC targeting sequence
auuggauuguccuuuuggua

SEQ ID NO: 8730 - RNA, 20 nt, Artificial Sequence
  TRAC targeting sequence
aauggagaauuggcucugau

SEQ ID NO: 8731 - RNA, 20 nt, Artificial Sequence
  TRAC targeting sequence
uuuugguaaagggcaaauuu

SEQ ID NO: 8732 - RNA, 20 nt, Artificial Sequence
  TRAC targeting sequence
auuucugucuuuuccaugga

SEQ ID NO: 8733 - RNA, 20 nt, Artificial Sequence
  TRAC targeting sequence
gucuuuuccauggaccauuu

SEQ ID NO: 8734 - RNA, 20 nt, Artificial Sequence
  TRAC targeting sequence
uuuccauggaccauuucccc

SEQ ID NO: 8735 - RNA, 20 nt, Artificial Sequence
  TRAC targeting sequence
auggaccauuuccccugcua

SEQ ID NO: 8736 - RNA, 20 nt, Artificial Sequence
  TRAC targeting sequence
auggaaaagacagaaaugga

SEQ ID NO: 8737 - RNA, 20 nt, Artificial Sequence
  TRAC targeting sequence
ccugcuaucaauugcuguug

SEQ ID NO: 8738 - RNA, 20 nt, Artificial Sequence
  TRAC targeting sequence
auugcuguugccugcagccu

SEQ ID NO: 8739 - RNA, 20 nt, Artificial Sequence
  TRAC targeting sequence
uaggcugcaggcaacagcaa

SEQ ID NO: 8740 - RNA, 20 nt, Artificial Sequence
  TRAC targeting sequence
uuuauuuaaaaauuuuauuu

SEQ ID NO: 8741 - RNA, 20 nt, Artificial Sequence
  TRAC targeting sequence
cauuuauuuaaaaauuuuau

SEQ ID NO: 8742 - RNA, 20 nt, Artificial Sequence
  TRAC targeting sequence
auaauucucucuaaaaucau

SEQ ID NO: 8743 - RNA, 20 nt, Artificial Sequence
  TRAC targeting sequence
cucuaaaaucauaaacaaug

SEQ ID NO: 8744 - RNA, 20 nt, Artificial Sequence
  TRAC targeting sequence
cuaaaaucauaaacaaugug

SEQ ID NO: 8745 - RNA, 20 nt, Artificial Sequence
  TRAC targeting sequence
aaaaucauaaacaauguguc

SEQ ID NO: 8746 - RNA, 20 nt, Artificial Sequence
  TRAC targeting sequence
uaaacaaugugucaaggcca

SEQ ID NO: 8747 - RNA, 20 nt, Artificial Sequence
  TRAC targeting sequence
aggccaaacacuucccuggu

SEQ ID NO: 8748 - RNA, 20 nt, Artificial Sequence
  TRAC targeting sequence
cuggugugauuuauuccuau

SEQ ID NO: 8749 - RNA, 20 nt, Artificial Sequence
  TRAC targeting sequence
caccagggaaguguuuggcc

SEQ ID NO: 8750 - RNA, 20 nt, Artificial Sequence
  TRAC targeting sequence
uauguggacucauccuugua

SEQ ID NO: 8751 - RNA, 20 nt, Artificial Sequence
  TRAC targeting sequence
acauaggaauaaaucacacc

SEQ ID NO: 8752 - RNA, 20 nt, Artificial Sequence
  TRAC targeting sequence
uccuuguauaauuagcagga

SEQ ID NO: 8753 - RNA, 20 nt, Artificial Sequence
  TRAC targeting sequence
uuguauaauuagcaggaaua

SEQ ID NO: 8754 - RNA, 20 nt, Artificial Sequence
  TRAC targeting sequence
ugcuaauuauacaaggauga

SEQ ID NO: 8755 - RNA, 20 nt, Artificial Sequence
  TRAC targeting sequence
cacccugagccagcuggcag

SEQ ID NO: 8756 - RNA, 20 nt, Artificial Sequence
  TRAC targeting sequence
gggugugauuauuccugcua

SEQ ID NO: 8757 - RNA, 20 nt, Artificial Sequence
  TRAC targeting sequence
gccagcuggcucagggugug

SEQ ID NO: 8758 - RNA, 20 nt, Artificial Sequence
  TRAC targeting sequence
ccaggggcucugccagcugg

SEQ ID NO: 8759 - RNA, 20 nt, Artificial Sequence
  TRAC targeting sequence
guccccaggggcucugccag

SEQ ID NO: 8760 - RNA, 20 nt, Artificial Sequence
  TRAC targeting sequence
cuguccccaggggcucugcc

SEQ ID NO: 8761 - RNA, 20 nt, Artificial Sequence
  TRAC targeting sequence
uuggguggucucugucccca

SEQ ID NO: 8762 - RNA, 20 nt, Artificial Sequence
  TRAC targeting sequence
uuguucuccugagucacaua

SEQ ID NO: 8763 - RNA, 20 nt, Artificial Sequence
  TRAC targeting sequence
ccugagucacauaaagggag

SEQ ID NO: 8764 - RNA, 20 nt, Artificial Sequence
  TRAC targeting sequence
ugagucacauaaagggaguc

SEQ ID NO: 8765 - RNA, 20 nt, Artificial Sequence
  TRAC targeting sequence
ggagaacaaggaccuucuuu

SEQ ID NO: 8766 - RNA, 20 nt, Artificial Sequence
  TRAC targeting sequence
cauaaagggagucacacaag

SEQ ID NO: 8767 - RNA, 20 nt, Artificial Sequence
  TRAC targeting sequence
cuuuaugugacucaggagaa

SEQ ID NO: 8768 - RNA, 20 nt, Artificial Sequence
  TRAC targeting sequence
cacaaggcgggaguggaacu

SEQ ID NO: 8769 - RNA, 20 nt, Artificial Sequence
  TRAC targeting sequence
cgccuugugugacucccuuu

SEQ ID NO: 8770 - RNA, 20 nt, Artificial Sequence
  TRAC targeting sequence
acucccgccuugugugacuc

SEQ ID NO: 8771 - RNA, 20 nt, Artificial Sequence
  TRAC targeting sequence
gguguccggaguucuagucc

SEQ ID NO: 8772 - RNA, 20 nt, Artificial Sequence
  TRAC targeting sequence
ggaguucuagucccagcucu

SEQ ID NO: 8773 - RNA, 20 nt, Artificial Sequence
  TRAC targeting sequence
ggacaccugaguuccacucc

SEQ ID NO: 8774 - RNA, 20 nt, Artificial Sequence
  TRAC targeting sequence
agucccagcucugcuucuac

SEQ ID NO: 8775 - RNA, 20 nt, Artificial Sequence
  TRAC targeting sequence
cagcucugcuucuaccuauc

SEQ ID NO: 8776 - RNA, 20 nt, Artificial Sequence
  TRAC targeting sequence
gcuucuaccuaucuacauga

SEQ ID NO: 8777 - RNA, 20 nt, Artificial Sequence
  TRAC targeting sequence
accuaucuacaugaccuuga

SEQ ID NO: 8778 - RNA, 20 nt, Artificial Sequence
  TRAC targeting sequence
acaugaccuugagcaaauuu

SEQ ID NO: 8779 - RNA, 20 nt, Artificial Sequence
  TRAC targeting sequence
uguagauagguagaagcaga

SEQ ID NO: 8780 - RNA, 20 nt, Artificial Sequence
  TRAC targeting sequence
aggucauguagauagguaga

SEQ ID NO: 8781 - RNA, 20 nt, Artificial Sequence
  TRAC targeting sequence
cgcagagcuucagcauuuuc

SEQ ID NO: 8782 - RNA, 20 nt, Artificial Sequence
  TRAC targeting sequence
gcgggauaaauuugcucaag

SEQ ID NO: 8783 - RNA, 20 nt, Artificial Sequence
  TRAC targeting sequence
gcauuuucaucucuaaaaug

SEQ ID NO: 8784 - RNA, 20 nt, Artificial Sequence
  TRAC targeting sequence
ucucuaaaaugagggcauug

SEQ ID NO: 8785 - RNA, 20 nt, Artificial Sequence
  TRAC targeting sequence
cuaaaaugagggcauuggcc

SEQ ID NO: 8786 - RNA, 20 nt, Artificial Sequence
  TRAC targeting sequence
aaaaugagggcauuggccca

SEQ ID NO: 8787 - RNA, 20 nt, Artificial Sequence
  TRAC targeting sequence
uuuuagagaugaaaaugcug

SEQ ID NO: 8788 - RNA, 20 nt, Artificial Sequence
  TRAC targeting sequence
uuccaagucucacauucuag

SEQ ID NO: 8789 - RNA, 20 nt, Artificial Sequence
  TRAC targeting sequence
aagucucacauucuaggaug

SEQ ID NO: 8790 - RNA, 20 nt, Artificial Sequence
  TRAC targeting sequence
cacauucuaggaugcuaaug

SEQ ID NO: 8791 - RNA, 20 nt, Artificial Sequence
  TRAC targeting sequence
cauucuaggaugcuaaugug

SEQ ID NO: 8792 - RNA, 20 nt, Artificial Sequence
  TRAC targeting sequence
aggaugcuaauguguaaaau

SEQ ID NO: 8793 - RNA, 20 nt, Artificial Sequence
  TRAC targeting sequence
uagaaugugagacuuggaag

SEQ ID NO: 8794 - RNA, 20 nt, Artificial Sequence
  TRAC targeting sequence
auaauuuuacacauuagcau

SEQ ID NO: 8795 - RNA, 20 nt, Artificial Sequence
  TRAC targeting sequence
guucuauaauuuuacacauu

SEQ ID NO: 8796 - RNA, 20 nt, Artificial Sequence
  TRAC targeting sequence
ugggucaguucuauaauuuu

SEQ ID NO: 8797 - RNA, 20 nt, Artificial Sequence
  TRAC targeting sequence
uaucccccugugcauguugc

SEQ ID NO: 8798 - RNA, 20 nt, Artificial Sequence
  TRAC targeting sequence
cccugugcauguugcuugaa

SEQ ID NO: 8799 - RNA, 20 nt, Artificial Sequence
  TRAC targeting sequence
agcaacaugcacagggggau

SEQ ID NO: 8800 - RNA, 20 nt, Artificial Sequence
  TRAC targeting sequence
ucauugcccagcaggaggaa

SEQ ID NO: 8801 - RNA, 20 nt, Artificial Sequence
  TRAC targeting sequence
uugcccagcaggaggaaaag

SEQ ID NO: 8802 - RNA, 20 nt, Artificial Sequence
  TRAC targeting sequence
ugcugggcaaugaggaguuc

SEQ ID NO: 8803 - RNA, 20 nt, Artificial Sequence
  TRAC targeting sequence
uccugcugggcaaugaggag

SEQ ID NO: 8804 - RNA, 20 nt, Artificial Sequence
  TRAC targeting sequence
cuuuuccuccugcugggcaa

SEQ ID NO: 8805 - RNA, 20 nt, Artificial Sequence
  TRAC targeting sequence
ucauugggggguagcauaau

SEQ ID NO: 8806 - RNA, 20 nt, Artificial Sequence
  TRAC targeting sequence
uugggggguagcauaauuuc

SEQ ID NO: 8807 - RNA, 20 nt, Artificial Sequence
  TRAC targeting sequence
ugguugacuaugugugacuc

SEQ ID NO: 8808 - RNA, 20 nt, Artificial Sequence
  TRAC targeting sequence
accaggaaauuaugcuaccc

SEQ ID NO: 8809 - RNA, 20 nt, Artificial Sequence
  TRAC targeting sequence
cacauagucaaccaggaaau

SEQ ID NO: 8810 - RNA, 20 nt, Artificial Sequence
  TRAC targeting sequence
ucagagccuggcgguccaag

SEQ ID NO: 8811 - RNA, 20 nt, Artificial Sequence
  TRAC targeting sequence
gagccuggcgguccaagccc

SEQ ID NO: 8812 - RNA, 20 nt, Artificial Sequence
  TRAC targeting sequence
gaugagucacacauagucaa

SEQ ID NO: 8813 - RNA, 20 nt, Artificial Sequence
  TRAC targeting sequence
aagcccauaugccauuugaa

SEQ ID NO: 8814 - RNA, 20 nt, Artificial Sequence
  TRAC targeting sequence
aauggcauaugggcuuggac

SEQ ID NO: 8815 - RNA, 20 nt, Artificial Sequence
  TRAC targeting sequence
gguuauuauuacaucuggga

SEQ ID NO: 8816 - RNA, 20 nt, Artificial Sequence
  TRAC targeting sequence
gggagagagaaaagugcuga

SEQ ID NO: 8817 - RNA, 20 nt, Artificial Sequence
  TRAC targeting sequence
cagauguaauaauaaccgga

SEQ ID NO: 8818 - RNA, 20 nt, Artificial Sequence
  TRAC targeting sequence
cccagauguaauaauaaccg

SEQ ID NO: 8819 - RNA, 20 nt, Artificial Sequence
  TRAC targeting sequence
cucccagauguaauaauaac

SEQ ID NO: 8820 - RNA, 20 nt, Artificial Sequence
  TRAC targeting sequence
cucucccagauguaauaaua

SEQ ID NO: 8821 - RNA, 20 nt, Artificial Sequence
  TRAC targeting sequence
gcacuuuucucucucccaga

SEQ ID NO: 8822 - RNA, 20 nt, Artificial Sequence
  TRAC targeting sequence
caaaggcuguuuucagcacu

SEQ ID NO: 8823 - RNA, 20 nt, Artificial Sequence
  TRAC targeting sequence
auuuggccaaaaaaaaaaga

SEQ ID NO: 8824 - RNA, 20 nt, Artificial Sequence
  TRAC targeting sequence
auagugucccaaaggcuguu

SEQ ID NO: 8825 - RNA, 20 nt, Artificial Sequence
  TRAC targeting sequence
uuuuuuuuuggccaaaucga

SEQ ID NO: 8826 - RNA, 20 nt, Artificial Sequence
  TRAC targeting sequence
ucuuuuuuuuuuggccaaau

SEQ ID NO: 8827 - RNA, 20 nt, Artificial Sequence
  TRAC targeting sequence
ucuucuuuuuuuuuuggcca

SEQ ID NO: 8828 - RNA, 20 nt, Artificial Sequence
  TRAC targeting sequence
ucuucuucuuuuuuuuuugg

SEQ ID NO: 8829 - RNA, 20 nt, Artificial Sequence
  TRAC targeting sequence
ucuucuucuucuuuuuuuuu

SEQ ID NO: 8830 - RNA, 20 nt, Artificial Sequence
  TRAC targeting sequence
gucuagugugauaacauuuu

SEQ ID NO: 8831 - RNA, 20 nt, Artificial Sequence
  TRAC targeting sequence
agugugauaacauuuuguua

SEQ ID NO: 8832 - RNA, 20 nt, Artificial Sequence
  TRAC targeting sequence
cacuagacagagccuucuuc

SEQ ID NO: 8833 - RNA, 20 nt, Artificial Sequence
  TRAC targeting sequence
uauucauugucuucaucccu

SEQ ID NO: 8834 - RNA, 20 nt, Artificial Sequence
  TRAC targeting sequence
uugucuucaucccugaaaua

SEQ ID NO: 8835 - RNA, 20 nt, Artificial Sequence
  TRAC targeting sequence
ucaucccugaaauacacucu

SEQ ID NO: 8836 - RNA, 20 nt, Artificial Sequence
  TRAC targeting sequence
ucccugaaauacacucugcu

SEQ ID NO: 8837 - RNA, 20 nt, Artificial Sequence
  TRAC targeting sequence
cugaaauacacucugcucuc

SEQ ID NO: 8838 - RNA, 20 nt, Artificial Sequence
  TRAC targeting sequence
gggaugaagacaaugaauaa

SEQ ID NO: 8839 - RNA, 20 nt, Artificial Sequence
  TRAC targeting sequence
gcucucuccuaucucugcuc

SEQ ID NO: 8840 - RNA, 20 nt, Artificial Sequence
  TRAC targeting sequence
cuccuaucucugcucugaaa

SEQ ID NO: 8841 - RNA, 20 nt, Artificial Sequence
  TRAC targeting sequence
ccuaucucugcucugaaagg

SEQ ID NO: 8842 - RNA, 20 nt, Artificial Sequence
  TRAC targeting sequence
uaucucugcucugaaaggca

SEQ ID NO: 8843 - RNA, 20 nt, Artificial Sequence
  TRAC targeting sequence
cugcucugaaaggcagaaag

SEQ ID NO: 8844 - RNA, 20 nt, Artificial Sequence
  TRAC targeting sequence
gcucugaaaggcagaaagag

SEQ ID NO: 8845 - RNA, 20 nt, Artificial Sequence
  TRAC targeting sequence
gaaaggcagaaagagggcag

SEQ ID NO: 8846 - RNA, 20 nt, Artificial Sequence
  TRAC targeting sequence
gagcagagauaggagagagc

SEQ ID NO: 8847 - RNA, 20 nt, Artificial Sequence
  TRAC targeting sequence
gccuuucagagcagagauag

SEQ ID NO: 8848 - RNA, 20 nt, Artificial Sequence
  TRAC targeting sequence
uucugccuuucagagcagag

SEQ ID NO: 8849 - RNA, 20 nt, Artificial Sequence
  TRAC targeting sequence
ccaaggcaaaauggggcucc

SEQ ID NO: 8850 - RNA, 20 nt, Artificial Sequence
  TRAC targeting sequence
aaggcaaaauggggcuccug

SEQ ID NO: 8851 - RNA, 20 nt, Artificial Sequence
  TRAC targeting sequence
uguggggaacagaggggugc

SEQ ID NO: 8852 - RNA, 20 nt, Artificial Sequence
  TRAC targeting sequence
ccacaggagccccauuuugc

SEQ ID NO: 8853 - RNA, 20 nt, Artificial Sequence
  TRAC targeting sequence
guuccccacaggagccccau

SEQ ID NO: 8854 - RNA, 20 nt, Artificial Sequence
  TRAC targeting sequence
gucaacaaaggugaugccac

SEQ ID NO: 8855 - RNA, 20 nt, Artificial Sequence
  TRAC targeting sequence
acaaaggugaugccacaucc

SEQ ID NO: 8856 - RNA, 20 nt, Artificial Sequence
  TRAC targeting sequence
ccuuuguugacagaggcacc

SEQ ID NO: 8857 - RNA, 20 nt, Artificial Sequence
  TRAC targeting sequence
cuuucaaccaugcugacacc

SEQ ID NO: 8858 - RNA, 20 nt, Artificial Sequence
  TRAC targeting sequence
accaugcugacaccucuggu

SEQ ID NO: 8859 - RNA, 20 nt, Artificial Sequence
  TRAC targeting sequence
gcaugguugaaagggaugug

SEQ ID NO: 8860 - RNA, 20 nt, Artificial Sequence
  TRAC targeting sequence
gguuuuuguaaaggugccca

SEQ ID NO: 8861 - RNA, 20 nt, Artificial Sequence
  TRAC targeting sequence
uguggguaccggguuaauag

SEQ ID NO: 8862 - RNA, 20 nt, Artificial Sequence
  TRAC targeting sequence
uauuaacccgguacccacag

SEQ ID NO: 8863 - RNA, 20 nt, Artificial Sequence
  TRAC targeting sequence
guuuccuauuaacccgguac

SEQ ID NO: 8864 - RNA, 20 nt, Artificial Sequence
  TRAC targeting sequence
aaaugucaguuuccuauuaa

SEQ ID NO: 8865 - RNA, 20 nt, Artificial Sequence
  TRAC targeting sequence
aguguuggcuccaaauguca

SEQ ID NO: 8866 - RNA, 20 nt, Artificial Sequence
  TRAC targeting sequence
ucuaguguuggcuccaaaug

SEQ ID NO: 8867 - RNA, 20 nt, Artificial Sequence
  TRAC targeting sequence
ugaaacucagcaaguaauau

SEQ ID NO: 8868 - RNA, 20 nt, Artificial Sequence
  TRAC targeting sequence
ugauuccucuaguguuggcu

SEQ ID NO: 8869 - RNA, 20 nt, Artificial Sequence
  TRAC targeting sequence
gcaaguaauauuuggcagaa

SEQ ID NO: 8870 - RNA, 20 nt, Artificial Sequence
  TRAC targeting sequence
gccaaauauuacuugcugag

SEQ ID NO: 8871 - RNA, 20 nt, Artificial Sequence
  TRAC targeting sequence
aucugaaaauuaucagugag

SEQ ID NO: 8872 - RNA, 20 nt, Artificial Sequence
  TRAC targeting sequence
gaaaauuaucagugagagau

SEQ ID NO: 8873 - RNA, 20 nt, Artificial Sequence
  TRAC targeting sequence
gauagaaaaaaaaauucugc

SEQ ID NO: 8874 - RNA, 20 nt, Artificial Sequence
  TRAC targeting sequence
gugagagauucuaaugugcc

SEQ ID NO: 8875 - RNA, 20 nt, Artificial Sequence
  TRAC targeting sequence
cugauaauuuucagauagaa

SEQ ID NO: 8876 - RNA, 20 nt, Artificial Sequence
  TRAC targeting sequence
cacugauaauuuucagauag

SEQ ID NO: 8877 - RNA, 20 nt, Artificial Sequence
  TRAC targeting sequence
cucacugauaauuuucagau

SEQ ID NO: 8878 - RNA, 20 nt, Artificial Sequence
  TRAC targeting sequence
aaugugccuuaacaaacagg

SEQ ID NO: 8879 - RNA, 20 nt, Artificial Sequence
  TRAC targeting sequence
uguuuguuaaggcacauuag

SEQ ID NO: 8880 - RNA, 20 nt, Artificial Sequence
  TRAC targeting sequence
uuuguuccuguuuguuaagg

SEQ ID NO: 8881 - RNA, 20 nt, Artificial Sequence
  TRAC targeting sequence
ucuuuuguuccuguuuguua

SEQ ID NO: 8882 - RNA, 20 nt, Artificial Sequence
  TRAC targeting sequence
auuuaacaaauauuuauuaa

SEQ ID NO: 8883 - RNA, 20 nt, Artificial Sequence
  TRAC targeting sequence
uaauaaauauuuguuaaauu

SEQ ID NO: 8884 - RNA, 20 nt, Artificial Sequence
  TRAC targeting sequence
cauggaucaucugagucagu

SEQ ID NO: 8885 - RNA, 20 nt, Artificial Sequence
  TRAC targeting sequence
augggaauaacuguaggcuc

SEQ ID NO: 8886 - RNA, 20 nt, Artificial Sequence
  TRAC targeting sequence
ucugagucaguuuccgagga

SEQ ID NO: 8887 - RNA, 20 nt, Artificial Sequence
  TRAC targeting sequence
gagucaguuuccgaggaaac

SEQ ID NO: 8888 - RNA, 20 nt, Artificial Sequence
  TRAC targeting sequence
gaugauccaugggaauaacu

SEQ ID NO: 8889 - RNA, 20 nt, Artificial Sequence
  TRAC targeting sequence
guuuccgaggaaacauuauc

SEQ ID NO: 8890 - RNA, 20 nt, Artificial Sequence
  TRAC targeting sequence
gaggaaacauuaucguugcc

SEQ ID NO: 8891 - RNA, 20 nt, Artificial Sequence
  TRAC targeting sequence
gaaacugacucagaugaucc

SEQ ID NO: 8892 - RNA, 20 nt, Artificial Sequence
  TRAC targeting sequence
ucggaaacugacucagauga

SEQ ID NO: 8893 - RNA, 20 nt, Artificial Sequence
  TRAC targeting sequence
uugccuuaagggagcugggg

SEQ ID NO: 8894 - RNA, 20 nt, Artificial Sequence
  TRAC targeting sequence
cuuaaggcaacgauaauguu

SEQ ID NO: 8895 - RNA, 20 nt, Artificial Sequence
  TRAC targeting sequence
acgggccagaggugggauga

SEQ ID NO: 8896 - RNA, 20 nt, Artificial Sequence
  TRAC targeting sequence
ggcccguugacaacccccca

SEQ ID NO: 8897 - RNA, 20 nt, Artificial Sequence
  TRAC targeting sequence
caccucuggcccguugacaa

SEQ ID NO: 8898 - RNA, 20 nt, Artificial Sequence
  TRAC targeting sequence
ucccaccucuggcccguuga

SEQ ID NO: 8899 - RNA, 20 nt, Artificial Sequence
  TRAC targeting sequence
uuuuucaucccaccucuggc

SEQ ID NO: 8900 - RNA, 20 nt, Artificial Sequence
  TRAC targeting sequence
guugucauuuuucaucccac

SEQ ID NO: 8901 - RNA, 20 nt, Artificial Sequence
  TRAC targeting sequence
gggaccgggacaugguuaac

SEQ ID NO: 8902 - RNA, 20 nt, Artificial Sequence
  TRAC targeting sequence
cagagguaaaucuguuguca

SEQ ID NO: 8903 - RNA, 20 nt, Artificial Sequence
  TRAC targeting sequence
cggucccagagguaaaucug

SEQ ID NO: 8904 - RNA, 20 nt, Artificial Sequence
  TRAC targeting sequence
gaagaaaaugugcccaacag

SEQ ID NO: 8905 - RNA, 20 nt, Artificial Sequence
  TRAC targeting sequence
gaagcuaagcuacuuaccca

SEQ ID NO: 8906 - RNA, 20 nt, Artificial Sequence
  TRAC targeting sequence
ucugaagcuaagcuacuuac

SEQ ID NO: 8907 - RNA, 20 nt, Artificial Sequence
  TRAC targeting sequence
aaauauucuuuuaugauugg

SEQ ID NO: 8908 - RNA, 20 nt, Artificial Sequence
  TRAC targeting sequence
uuuaugauuggcuuuagcau

SEQ ID NO: 8909 - RNA, 20 nt, Artificial Sequence
  TRAC targeting sequence
uaaaagaauauuuggauugc

SEQ ID NO: 8910 - RNA, 20 nt, Artificial Sequence
  TRAC targeting sequence
uuuguagggcagguuuaucu

SEQ ID NO: 8911 - RNA, 20 nt, Artificial Sequence
  TRAC targeting sequence
caccaauuauauauuuucuu

SEQ ID NO: 8912 - RNA, 20 nt, Artificial Sequence
  TRAC targeting sequence
ccaauuauauauuuucuuaa

SEQ ID NO: 8913 - RNA, 20 nt, Artificial Sequence
  TRAC targeting sequence
uaacugaccuguaaaaucua

SEQ ID NO: 8914 - RNA, 20 nt, Artificial Sequence
  TRAC targeting sequence
guuaagaaaauauauaauug

SEQ ID NO: 8915 - RNA, 20 nt, Artificial Sequence
  TRAC targeting sequence
acaggggaaaaguauuuuaa

SEQ ID NO: 8916 - RNA, 20 nt, Artificial Sequence
  TRAC targeting sequence
ccuguagauuuuacagguca

SEQ ID NO: 8917 - RNA, 20 nt, Artificial Sequence
  TRAC targeting sequence
uaaaauacuuuuccccugua

SEQ ID NO: 8918 - RNA, 20 nt, Artificial Sequence
  TRAC targeting sequence
gcaauuaggcucccagcagu

SEQ ID NO: 8919 - RNA, 20 nt, Artificial Sequence
  TRAC targeting sequence
cagcagucaacaaagaagug

SEQ ID NO: 8920 - RNA, 20 nt, Artificial Sequence
  TRAC targeting sequence
acaaagaagugguacuuuuu

SEQ ID NO: 8921 - RNA, 20 nt, Artificial Sequence
  TRAC targeting sequence
uuguugacugcugggagccu

SEQ ID NO: 8922 - RNA, 20 nt, Artificial Sequence
  TRAC targeting sequence
uuccagugaugaaaaaggga

SEQ ID NO: 8923 - RNA, 20 nt, Artificial Sequence
  TRAC targeting sequence
agugaugaaaaagggaaccu

SEQ ID NO: 8924 - RNA, 20 nt, Artificial Sequence
  TRAC targeting sequence
cuggaaagacaaaaaguacc

SEQ ID NO: 8925 - RNA, 20 nt, Artificial Sequence
  TRAC targeting sequence
ucacuggaaagacaaaaagu

SEQ ID NO: 8926 - RNA, 20 nt, Artificial Sequence
  TRAC targeting sequence
cuuuuucaucacuggaaaga

SEQ ID NO: 8927 - RNA, 20 nt, Artificial Sequence
  TRAC targeting sequence
cugguggcccaccagcgucu

SEQ ID NO: 8928 - RNA, 20 nt, Artificial Sequence
  TRAC targeting sequence
ccuucccuggccuaggucag

SEQ ID NO: 8929 - RNA, 20 nt, Artificial Sequence
  TRAC targeting sequence
uucccuggccuaggucagaa

SEQ ID NO: 8930 - RNA, 20 nt, Artificial Sequence
  TRAC targeting sequence
cuggccuaggucagaacaag

SEQ ID NO: 8931 - RNA, 20 nt, Artificial Sequence
  TRAC targeting sequence
gaacaagccguaaaucagca

SEQ ID NO: 8932 - RNA, 20 nt, Artificial Sequence
  TRAC targeting sequence
gaccuaggccagggaaggag

SEQ ID NO: 8933 - RNA, 20 nt, Artificial Sequence
  TRAC targeting sequence
gcaggccguuaucuucuuau

SEQ ID NO: 8934 - RNA, 20 nt, Artificial Sequence
  TRAC targeting sequence
ucuuauaaaucuguagagca

SEQ ID NO: 8935 - RNA, 20 nt, Artificial Sequence
  TRAC targeting sequence
uauaaaucuguagagcaggg

SEQ ID NO: 8936 - RNA, 20 nt, Artificial Sequence
  TRAC targeting sequence
guagagcaggguggacaaca

SEQ ID NO: 8937 - RNA, 20 nt, Artificial Sequence
  TRAC targeting sequence
acagauuuauaagaagauaa

SEQ ID NO: 8938 - RNA, 20 nt, Artificial Sequence
  TRAC targeting sequence
acccugcucuacagauuuau

SEQ ID NO: 8939 - RNA, 20 nt, Artificial Sequence
  TRAC targeting sequence
gaacaugaguuccuugugua

SEQ ID NO: 8940 - RNA, 20 nt, Artificial Sequence
  TRAC targeting sequence
gaaaaccuagcaggcugccu

SEQ ID NO: 8941 - RNA, 20 nt, Artificial Sequence
  TRAC targeting sequence
uguucugaaaaccuagcagg

SEQ ID NO: 8942 - RNA, 20 nt, Artificial Sequence
  TRAC targeting sequence
uuguguagccagagaaccug

SEQ ID NO: 8943 - RNA, 20 nt, Artificial Sequence
  TRAC targeting sequence
ggcuacacaaggaacucaug

SEQ ID NO: 8944 - RNA, 20 nt, Artificial Sequence
  TRAC targeting sequence
cuggcuacacaaggaacuca

SEQ ID NO: 8945 - RNA, 20 nt, Artificial Sequence
  TRAC targeting sequence
cagguucucuggcuacacaa

SEQ ID NO: 8946 - RNA, 20 nt, Artificial Sequence
  TRAC targeting sequence
ugacguggcugguccugcug

SEQ ID NO: 8947 - RNA, 20 nt, Artificial Sequence
  TRAC targeting sequence
ggauggucccagguucucug

SEQ ID NO: 8948 - RNA, 20 nt, Artificial Sequence
  TRAC targeting sequence
ugcuguccucacagccugaa

SEQ ID NO: 8949 - RNA, 20 nt, Artificial Sequence
  TRAC targeting sequence
ucacagccugaaucccaggc

SEQ ID NO: 8950 - RNA, 20 nt, Artificial Sequence
  TRAC targeting sequence
cagccugaaucccaggcugu

SEQ ID NO: 8951 - RNA, 20 nt, Artificial Sequence
  TRAC targeting sequence
ggcugugaggacagcaggac

SEQ ID NO: 8952 - RNA, 20 nt, Artificial Sequence
  TRAC targeting sequence
caggcuguaugaauaggaga

SEQ ID NO: 8953 - RNA, 20 nt, Artificial Sequence
  TRAC targeting sequence
uacagccugggauucaggcu

SEQ ID NO: 8954 - RNA, 20 nt, Artificial Sequence
  TRAC targeting sequence
uauucauacagccugggauu

SEQ ID NO: 8955 - RNA, 20 nt, Artificial Sequence
  TRAC targeting sequence
ccuauucauacagccuggga

SEQ ID NO: 8956 - RNA, 20 nt, Artificial Sequence
  TRAC targeting sequence
aguccagaugacuguucacg

SEQ ID NO: 8957 - RNA, 20 nt, Artificial Sequence
  TRAC targeting sequence
agaugacuguucacgaugcu

SEQ ID NO: 8958 - RNA, 20 nt, Artificial Sequence
  TRAC targeting sequence
ggacuugaaccucuccuauu

SEQ ID NO: 8959 - RNA, 20 nt, Artificial Sequence
  TRAC targeting sequence
ucuggacuugaaccucuccu

SEQ ID NO: 8960 - RNA, 20 nt, Artificial Sequence
  TRAC targeting sequence
cgaugcuggucccccuugca

SEQ ID NO: 8961 - RNA, 20 nt, Artificial Sequence
  TRAC targeting sequence
ugaacagucaucuggacuug

SEQ ID NO: 8962 - RNA, 20 nt, Artificial Sequence
  TRAC targeting sequence
cccuugcaucccuaaucaug

SEQ ID NO: 8963 - RNA, 20 nt, Artificial Sequence
  TRAC targeting sequence
cuaaucaugcuagagacaug

SEQ ID NO: 8964 - RNA, 20 nt, Artificial Sequence
  TRAC targeting sequence
ugcuagagacaugaccaggg

SEQ ID NO: 8965 - RNA, 20 nt, Artificial Sequence
  TRAC targeting sequence
agcaugauuagggaugcaag

SEQ ID NO: 8966 - RNA, 20 nt, Artificial Sequence
  TRAC targeting sequence
cuagcaugauuagggaugca

SEQ ID NO: 8967 - RNA, 20 nt, Artificial Sequence
  TRAC targeting sequence
ugucucuagcaugauuaggg

SEQ ID NO: 8968 - RNA, 20 nt, Artificial Sequence
  TRAC targeting sequence
gagaggaggaaguuacagca

SEQ ID NO: 8969 - RNA, 20 nt, Artificial Sequence
  TRAC targeting sequence
gacccuggucaugucucuag

SEQ ID NO: 8970 - RNA, 20 nt, Artificial Sequence
  TRAC targeting sequence
cagacccuggucaugucucu

SEQ ID NO: 8971 - RNA, 20 nt, Artificial Sequence
  TRAC targeting sequence
ucucagacccuggucauguc

SEQ ID NO: 8972 - RNA, 20 nt, Artificial Sequence
  TRAC targeting sequence
uccucucagacccuggucau

SEQ ID NO: 8973 - RNA, 20 nt, Artificial Sequence
  TRAC targeting sequence
cauagugcccaggcccuuua

SEQ ID NO: 8974 - RNA, 20 nt, Artificial Sequence
  TRAC targeting sequence
ucacauagugcccaggcccu

SEQ ID NO: 8975 - RNA, 20 nt, Artificial Sequence
  TRAC targeting sequence
ccuagaugcucaacuuuggg

SEQ ID NO: 8976 - RNA, 20 nt, Artificial Sequence
  TRAC targeting sequence
aggugaucuucacauagugc

SEQ ID NO: 8977 - RNA, 20 nt, Artificial Sequence
  TRAC targeting sequence
acuuugggaaggggacugag

SEQ ID NO: 8978 - RNA, 20 nt, Artificial Sequence
  TRAC targeting sequence
caaaguugagcaucuaggug

SEQ ID NO: 8979 - RNA, 20 nt, Artificial Sequence
  TRAC targeting sequence
ccuucccaaaguugagcauc

SEQ ID NO: 8980 - RNA, 20 nt, Artificial Sequence
  TRAC targeting sequence
guccccuucccaaaguugag

SEQ ID NO: 8981 - RNA, 20 nt, Artificial Sequence
  TRAC targeting sequence
caauuaacucaguccccuuc

SEQ ID NO: 8982 - RNA, 20 nt, Artificial Sequence
  TRAC targeting sequence
cccaggcucacaauuaacuc

SEQ ID NO: 8983 - RNA, 20 nt, Artificial Sequence
  TRAC targeting sequence
acuccagagguagcuuuagc

SEQ ID NO: 8984 - RNA, 20 nt, Artificial Sequence
  TRAC targeting sequence
agagguagcuuuagcggaac

SEQ ID NO: 8985 - RNA, 20 nt, Artificial Sequence
  TRAC targeting sequence
ggaguugagguacucaccca

SEQ ID NO: 8986 - RNA, 20 nt, Artificial Sequence
  TRAC targeting sequence
gcuaaagcuaccucuggagu

SEQ ID NO: 8987 - RNA, 20 nt, Artificial Sequence
  TRAC targeting sequence
auaccuaacaccuggcaauc

SEQ ID NO: 8988 - RNA, 20 nt, Artificial Sequence
  TRAC targeting sequence
gagggcugaaacacuuggcc

SEQ ID NO: 8989 - RNA, 20 nt, Artificial Sequence
  TRAC targeting sequence
gauugccagguguuagguau

SEQ ID NO: 8990 - RNA, 20 nt, Artificial Sequence
  TRAC targeting sequence
gcccucugauugccaggugu

SEQ ID NO: 8991 - RNA, 20 nt, Artificial Sequence
  TRAC targeting sequence
ggccaaguguuucagcccuc

SEQ ID NO: 8992 - RNA, 20 nt, Artificial Sequence
  TRAC targeting sequence
uuaucuggccaaguguuuca

SEQ ID NO: 8993 - RNA, 20 nt, Artificial Sequence
  TRAC targeting sequence
cuuauccggugggaaaaggc

SEQ ID NO: 8994 - RNA, 20 nt, Artificial Sequence
  TRAC targeting sequence
uauccggugggaaaaggcug

SEQ ID NO: 8995 - RNA, 20 nt, Artificial Sequence
  TRAC targeting sequence
ggugggaaaaggcuguaaag

SEQ ID NO: 8996 - RNA, 20 nt, Artificial Sequence
  TRAC targeting sequence
caccggauaagagaauucau

SEQ ID NO: 8997 - RNA, 20 nt, Artificial Sequence
  TRAC targeting sequence
uuacagccuuuucccaccgg

SEQ ID NO: 8998 - RNA, 20 nt, Artificial Sequence
  TRAC targeting sequence
aaccaccuuuccuaugggua

SEQ ID NO: 8999 - RNA, 20 nt, Artificial Sequence
  TRAC targeting sequence
uauggguaagcaagagucug

SEQ ID NO: 9000 - RNA, 20 nt, Artificial Sequence
  TRAC targeting sequence
ugcuuacccauaggaaaggu

SEQ ID NO: 9001 - RNA, 20 nt, Artificial Sequence
  TRAC targeting sequence
guaguuuauguaaaggcagc

SEQ ID NO: 9002 - RNA, 20 nt, Artificial Sequence
  TRAC targeting sequence
ugugggaaggaaggaaacag

SEQ ID NO: 9003 - RNA, 20 nt, Artificial Sequence
  TRAC targeting sequence
cacaggagcugcugccuuua

SEQ ID NO: 9004 - RNA, 20 nt, Artificial Sequence
  TRAC targeting sequence
uucccacaggagcugcugcc

SEQ ID NO: 9005 - RNA, 20 nt, Artificial Sequence
  TRAC targeting sequence
uuccuucccacaggagcugc

SEQ ID NO: 9006 - RNA, 20 nt, Artificial Sequence
  TRAC targeting sequence
uguuuccuuccuucccacag

SEQ ID NO: 9007 - RNA, 20 nt, Artificial Sequence
  TRAC targeting sequence
aaauguaaauuuccuguuuc

SEQ ID NO: 9008 - RNA, 20 nt, Artificial Sequence
  TRAC targeting sequence
ccauuccaaauguaaauuuc

SEQ ID NO: 9009 - RNA, 20 nt, Artificial Sequence
  TRAC targeting sequence
cuugcguccccauuccaaau

SEQ ID NO: 9010 - RNA, 20 nt, Artificial Sequence
  TRAC targeting sequence
cacuugcguccccauuccaa

SEQ ID NO: 9011 - RNA, 20 nt, Artificial Sequence
  TRAC targeting sequence
cucucacuugcguccccauu

SEQ ID NO: 9012 - RNA, 20 nt, Artificial Sequence
  TRAC targeting sequence
uuaaaccaaaggugucaggu

SEQ ID NO: 9013 - RNA, 20 nt, Artificial Sequence
  TRAC targeting sequence
gguuauuugguuugguuuuu

SEQ ID NO: 9014 - RNA, 20 nt, Artificial Sequence
  TRAC targeting sequence
aaaaccaaaccaaauaaccu

SEQ ID NO: 9015 - RNA, 20 nt, Artificial Sequence
  TRAC targeting sequence
ggaaguuccaaagaaagaac

SEQ ID NO: 9016 - RNA, 20 nt, Artificial Sequence
  TRAC targeting sequence
agauaauucaaaaaccaaac

SEQ ID NO: 9017 - RNA, 20 nt, Artificial Sequence
  TRAC targeting sequence
aaagaaagaacacuucuccc

SEQ ID NO: 9018 - RNA, 20 nt, Artificial Sequence
  TRAC targeting sequence
uuggaacuuccagauaauuc

SEQ ID NO: 9019 - RNA, 20 nt, Artificial Sequence
  TRAC targeting sequence
uucuuuggaacuuccagaua

SEQ ID NO: 9020 - RNA, 20 nt, Artificial Sequence
  TRAC targeting sequence
cccugaggauuugauugcaa

SEQ ID NO: 9021 - RNA, 20 nt, Artificial Sequence
  TRAC targeting sequence
cugaggauuugauugcaaaa

SEQ ID NO: 9022 - RNA, 20 nt, Artificial Sequence
  TRAC targeting sequence
gggagaaguguucuuucuuu

SEQ ID NO: 9023 - RNA, 20 nt, Artificial Sequence
  TRAC targeting sequence
ucagggagaaguguucuuuc

SEQ ID NO: 9024 - RNA, 20 nt, Artificial Sequence
  TRAC targeting sequence
aauccucagggagaaguguu

SEQ ID NO: 9025 - RNA, 20 nt, Artificial Sequence
  TRAC targeting sequence
gacuucaaacuucuaaaaag

SEQ ID NO: 9026 - RNA, 20 nt, Artificial Sequence
  TRAC targeting sequence
gaauuuugcaaucaaauccu

SEQ ID NO: 9027 - RNA, 20 nt, Artificial Sequence
  TRAC targeting sequence
aacuucuaaaaagaucaaau

SEQ ID NO: 9028 - RNA, 20 nt, Artificial Sequence
  TRAC targeting sequence
aaaaagaucaaauguuaaau

SEQ ID NO: 9029 - RNA, 20 nt, Artificial Sequence
  TRAC targeting sequence
uuuuagaaguuugaagucag

SEQ ID NO: 9030 - RNA, 20 nt, Artificial Sequence
  TRAC targeting sequence
aauguuaaaucagauaguag

SEQ ID NO: 9031 - RNA, 20 nt, Artificial Sequence
  TRAC targeting sequence
gauaguaggcuuggaaaacu

SEQ ID NO: 9032 - RNA, 20 nt, Artificial Sequence
  TRAC targeting sequence
gauuuaacauuugaucuuuu

SEQ ID NO: 9033 - RNA, 20 nt, Artificial Sequence
  TRAC targeting sequence
aagccuacuaucugauuuaa

SEQ ID NO: 9034 - RNA, 20 nt, Artificial Sequence
  TRAC targeting sequence
auuucucuauguaaaaagua

SEQ ID NO: 9035 - RNA, 20 nt, Artificial Sequence
  TRAC targeting sequence
cuauguaaaaaguagagaac

SEQ ID NO: 9036 - RNA, 20 nt, Artificial Sequence
  TRAC targeting sequence
auguaaaaaguagagaacua

SEQ ID NO: 9037 - RNA, 20 nt, Artificial Sequence
  TRAC targeting sequence
acuuuuuacauagagaaaua

SEQ ID NO: 9038 - RNA, 20 nt, Artificial Sequence
  TRAC targeting sequence
cuacuuuuuacauagagaaa

SEQ ID NO: 9039 - RNA, 20 nt, Artificial Sequence
  TRAC targeting sequence
uuuguuugaucauuuuauuu

SEQ ID NO: 9040 - RNA, 20 nt, Artificial Sequence
  TRAC targeting sequence
aacaaaagaaaaguaguucu

SEQ ID NO: 9041 - RNA, 20 nt, Artificial Sequence
  TRAC targeting sequence
uuuuauuuuguuuaggaaau

SEQ ID NO: 9042 - RNA, 20 nt, Artificial Sequence
  TRAC targeting sequence
uaaacaaaauaaaaugauca

SEQ ID NO: 9043 - RNA, 20 nt, Artificial Sequence
  TRAC targeting sequence
uauuuccuaaacaaaauaaa

SEQ ID NO: 9044 - RNA, 20 nt, Artificial Sequence
  TRAC targeting sequence
ucuuauuuccuaaacaaaau

SEQ ID NO: 9045 - RNA, 20 nt, Artificial Sequence
  TRAC targeting sequence
aauccucuuauuuccuaaac

SEQ ID NO: 9046 - RNA, 20 nt, Artificial Sequence
  TRAC targeting sequence
ccaccaggguaucuaauccu

SEQ ID NO: 9047 - RNA, 20 nt, Artificial Sequence
  TRAC targeting sequence
ccacucaccaccaggguauc

SEQ ID NO: 9048 - RNA, 20 nt, Artificial Sequence
  TRAC targeting sequence
cugcccuccccacucaccac

SEQ ID NO: 9049 - RNA, 20 nt, Artificial Sequence
  TRAC targeting sequence
ggauaaauuagauccaaaua

SEQ ID NO: 9050 - RNA, 20 nt, Artificial Sequence
  TRAC targeting sequence
agaaaugcugugcaaauguc

SEQ ID NO: 9051 - RNA, 20 nt, Artificial Sequence
  TRAC targeting sequence
aauuuauccagaaaugcugu

SEQ ID NO: 9052 - RNA, 20 nt, Artificial Sequence
  TRAC targeting sequence
aaauaaucaaaucaaagacu

SEQ ID NO: 9053 - RNA, 20 nt, Artificial Sequence
  TRAC targeting sequence
aaucaaagacucucagcuca

SEQ ID NO: 9054 - RNA, 20 nt, Artificial Sequence
  TRAC targeting sequence
aagacucucagcucagaaag

SEQ ID NO: 9055 - RNA, 20 nt, Artificial Sequence
  TRAC targeting sequence
uugauuugauuauuuggauc

SEQ ID NO: 9056 - RNA, 20 nt, Artificial Sequence
  TRAC targeting sequence
cagcucagaaaguaauuaaa

SEQ ID NO: 9057 - RNA, 20 nt, Artificial Sequence
  TRAC targeting sequence
gcucagaaaguaauuaaaga

SEQ ID NO: 9058 - RNA, 20 nt, Artificial Sequence
  TRAC targeting sequence
gaaaguaauuaaagaucucc

SEQ ID NO: 9059 - RNA, 20 nt, Artificial Sequence
  TRAC targeting sequence
gagcugagagucuuugauuu

SEQ ID NO: 9060 - RNA, 20 nt, Artificial Sequence
  TRAC targeting sequence
uuaauuacuuucugagcuga

SEQ ID NO: 9061 - RNA, 20 nt, Artificial Sequence
  TRAC targeting sequence
ccucacccaccucuuuaauu

SEQ ID NO: 9062 - RNA, 20 nt, Artificial Sequence
  TRAC targeting sequence
ucacccaccucuuuaauuuu

SEQ ID NO: 9063 - RNA, 20 nt, Artificial Sequence
  TRAC targeting sequence
cccaccucuuuaauuuugca

SEQ ID NO: 9064 - RNA, 20 nt, Artificial Sequence
  TRAC targeting sequence
uuaauuuugcaaaugaagac

SEQ ID NO: 9065 - RNA, 20 nt, Artificial Sequence
  TRAC targeting sequence
uuugcaaaauuaaagaggug

SEQ ID NO: 9066 - RNA, 20 nt, Artificial Sequence
  TRAC targeting sequence
ucauuugcaaaauuaaagag

SEQ ID NO: 9067 - RNA, 20 nt, Artificial Sequence
  TRAC targeting sequence
cugucuucauuugcaaaauu

SEQ ID NO: 9068 - RNA, 20 nt, Artificial Sequence
  TRAC targeting sequence
gagagguuaugaacuugcuc

SEQ ID NO: 9069 - RNA, 20 nt, Artificial Sequence
  TRAC targeting sequence
gaguuucacugucuucauuu

SEQ ID NO: 9070 - RNA, 20 nt, Artificial Sequence
  TRAC targeting sequence
cugaguuucacugucuucau

SEQ ID NO: 9071 - RNA, 20 nt, Artificial Sequence
  TRAC targeting sequence
uaaccucucugaguuucacu

SEQ ID NO: 9072 - RNA, 20 nt, Artificial Sequence
  TRAC targeting sequence
aggucacacaacugauccug

SEQ ID NO: 9073 - RNA, 20 nt, Artificial Sequence
  TRAC targeting sequence
cacaacugauccugauauca

SEQ ID NO: 9074 - RNA, 20 nt, Artificial Sequence
  TRAC targeting sequence
guugugugaccuugagcaag

SEQ ID NO: 9075 - RNA, 20 nt, Artificial Sequence
  TRAC targeting sequence
ugauaucaagguccagggca

SEQ ID NO: 9076 - RNA, 20 nt, Artificial Sequence
  TRAC targeting sequence
ggaucaguugugugaccuug

SEQ ID NO: 9077 - RNA, 20 nt, Artificial Sequence
  TRAC targeting sequence
agguccagggcaaagccaag

SEQ ID NO: 9078 - RNA, 20 nt, Artificial Sequence
  TRAC targeting sequence
agggcaaagccaagacagcu

SEQ ID NO: 9079 - RNA, 20 nt, Artificial Sequence
  TRAC targeting sequence
uggcuuugcccuggaccuug

SEQ ID NO: 9080 - RNA, 20 nt, Artificial Sequence
  TRAC targeting sequence
uaguucucaccagcccagac

SEQ ID NO: 9081 - RNA, 20 nt, Artificial Sequence
  TRAC targeting sequence
caccagcccagacccaaggg

SEQ ID NO: 9082 - RNA, 20 nt, Artificial Sequence
  TRAC targeting sequence
ccagcccagacccaagggag

SEQ ID NO: 9083 - RNA, 20 nt, Artificial Sequence
  TRAC targeting sequence
gggcuggugagaacuaugag

SEQ ID NO: 9084 - RNA, 20 nt, Artificial Sequence
  TRAC targeting sequence
cuugggucugggcuggugag

SEQ ID NO: 9085 - RNA, 20 nt, Artificial Sequence
  TRAC targeting sequence
cccuugggucugggcuggug

SEQ ID NO: 9086 - RNA, 20 nt, Artificial Sequence
  TRAC targeting sequence
uaguccuuggccacggcagc

SEQ ID NO: 9087 - RNA, 20 nt, Artificial Sequence
  TRAC targeting sequence
uuggccacggcagcaucauu

SEQ ID NO: 9088 - RNA, 20 nt, Artificial Sequence
  TRAC targeting sequence
uuugcaucccaaacauucuu

SEQ ID NO: 9089 - RNA, 20 nt, Artificial Sequence
  TRAC targeting sequence
caaacauucuuuacccaaga

SEQ ID NO: 9090 - RNA, 20 nt, Artificial Sequence
  TRAC targeting sequence
uuacccaagacuuaaugaac

SEQ ID NO: 9091 - RNA, 20 nt, Artificial Sequence
  TRAC targeting sequence
uggguaaagaauguuuggga

SEQ ID NO: 9092 - RNA, 20 nt, Artificial Sequence
  TRAC targeting sequence
uuaagucuuggguaaagaau

SEQ ID NO: 9093 - RNA, 20 nt, Artificial Sequence
  TRAC targeting sequence
aaaagaaauccugaguucca

SEQ ID NO: 9094 - RNA, 20 nt, Artificial Sequence
  TRAC targeting sequence
uuuugaguucauuaagucuu

SEQ ID NO: 9095 - RNA, 20 nt, Artificial Sequence
  TRAC targeting sequence
ugaguuccaaagggaaauaa

SEQ ID NO: 9096 - RNA, 20 nt, Artificial Sequence
  TRAC targeting sequence
ggauuucuuuuugaguucau

SEQ ID NO: 9097 - RNA, 20 nt, Artificial Sequence
  TRAC targeting sequence
aaagggaaauaaaaucauuc

SEQ ID NO: 9098 - RNA, 20 nt, Artificial Sequence
  TRAC targeting sequence
cuuuggaacucaggauuucu

SEQ ID NO: 9099 - RNA, 20 nt, Artificial Sequence
  TRAC targeting sequence
uucugcgucuguugaaaaaa

SEQ ID NO: 9100 - RNA, 20 nt, Artificial Sequence
  TRAC targeting sequence
gcgucuguugaaaaaaaaag

SEQ ID NO: 9101 - RNA, 20 nt, Artificial Sequence
  TRAC targeting sequence
guugaaaaaaaaagcaagcu

SEQ ID NO: 9102 - RNA, 20 nt, Artificial Sequence
  TRAC targeting sequence
acagacgcagaaugauuuua

SEQ ID NO: 9103 - RNA, 20 nt, Artificial Sequence
  TRAC targeting sequence
acuuuagcuugcuuuuuuuu

SEQ ID NO: 9104 - RNA, 20 nt, Artificial Sequence
  TRAC targeting sequence
auuauuguuccacuuuagcu

SEQ ID NO: 9105 - RNA, 20 nt, Artificial Sequence
  TRAC targeting sequence
aguucaauuauuguuccacu

SEQ ID NO: 9106 - RNA, 20 nt, Artificial Sequence
  TRAC targeting sequence
ccuaauaucaaguucaauua

SEQ ID NO: 9107 - RNA, 20 nt, Artificial Sequence
  TRAC targeting sequence
gcagacugagagaaggguga

SEQ ID NO: 9108 - RNA, 20 nt, Artificial Sequence
  TRAC targeting sequence
gcagauggcugcaccuuucc

SEQ ID NO: 9109 - RNA, 20 nt, Artificial Sequence
  TRAC targeting sequence
gucugcagauggcugcaccu

SEQ ID NO: 9110 - RNA, 20 nt, Artificial Sequence
  TRAC targeting sequence
cagucugcagauggcugcac

SEQ ID NO: 9111 - RNA, 20 nt, Artificial Sequence
  TRAC targeting sequence
cucagucugcagauggcugc

SEQ ID NO: 9112 - RNA, 20 nt, Artificial Sequence
  TRAC targeting sequence
cccuucucucagucugcaga

SEQ ID NO: 9113 - RNA, 20 nt, Artificial Sequence
  TRAC targeting sequence
uuuuguuuuuuucacccuuc

SEQ ID NO: 9114 - RNA, 20 nt, Artificial Sequence
  TRAC targeting sequence
uguguucagacaaugauuau

SEQ ID NO: 9115 - RNA, 20 nt, Artificial Sequence
  TRAC targeting sequence
gacaaugauuaugaccauag

SEQ ID NO: 9116 - RNA, 20 nt, Artificial Sequence
  TRAC targeting sequence
gaacacaagacuagcauuuu

SEQ ID NO: 9117 - RNA, 20 nt, Artificial Sequence
  TRAC targeting sequence
uugucugaacacaagacuag

SEQ ID NO: 9118 - RNA, 20 nt, Artificial Sequence
  TRAC targeting sequence
uaaucauugucugaacacaa

SEQ ID NO: 9119 - RNA, 20 nt, Artificial Sequence
  TRAC targeting sequence
auggucauaaucauugucug

SEQ ID NO: 9120 - RNA, 20 nt, Artificial Sequence
  TRAC targeting sequence
guagagcuaauuucuuuccc

SEQ ID NO: 9121 - RNA, 20 nt, Artificial Sequence
  TRAC targeting sequence
acagaacuuauagguagugu

SEQ ID NO: 9122 - RNA, 20 nt, Artificial Sequence
  TRAC targeting sequence
uucccagugggguugauauu

SEQ ID NO: 9123 - RNA, 20 nt, Artificial Sequence
  TRAC targeting sequence
cagugggguugauauucuau

SEQ ID NO: 9124 - RNA, 20 nt, Artificial Sequence
  TRAC targeting sequence
accccacugggaaagaaauu

SEQ ID NO: 9125 - RNA, 20 nt, Artificial Sequence
  TRAC targeting sequence
augauagauugcaucagcgg

SEQ ID NO: 9126 - RNA, 20 nt, Artificial Sequence
  TRAC targeting sequence
uagaauaucaaccccacugg

SEQ ID NO: 9127 - RNA, 20 nt, Artificial Sequence
  TRAC targeting sequence
aucauagaauaucaacccca

SEQ ID NO: 9128 - RNA, 20 nt, Artificial Sequence
  TRAC targeting sequence
gcggugugauuguuuuggac

SEQ ID NO: 9129 - RNA, 20 nt, Artificial Sequence
  TRAC targeting sequence
caccgcugaugcaaucuauc

SEQ ID NO: 9130 - RNA, 20 nt, Artificial Sequence
  TRAC targeting sequence
aaaacaaucacaccgcugau

SEQ ID NO: 9131 - RNA, 20 nt, Artificial Sequence
  TRAC targeting sequence
augguccaaaacaaucacac

SEQ ID NO: 9132 - RNA, 20 nt, Artificial Sequence
  TRAC targeting sequence
guauacguauucuauggucc

SEQ ID NO: 9133 - RNA, 20 nt, Artificial Sequence
  TRAC targeting sequence
acaagccaauucuguauacg

SEQ ID NO: 9134 - RNA, 20 nt, Artificial Sequence
  TRAC targeting sequence
ggugucuugaagugaaaauc

SEQ ID NO: 9135 - RNA, 20 nt, Artificial Sequence
  TRAC targeting sequence
ugaagugaaaaucauaucuc

SEQ ID NO: 9136 - RNA, 20 nt, Artificial Sequence
  TRAC targeting sequence
agacaccagaaggcucaaca

SEQ ID NO: 9137 - RNA, 20 nt, Artificial Sequence
  TRAC targeting sequence
cuucaagacaccagaaggcu

SEQ ID NO: 9138 - RNA, 20 nt, Artificial Sequence
  TRAC targeting sequence
uaucucuggacauaucuguc

SEQ ID NO: 9139 - RNA, 20 nt, Artificial Sequence
  TRAC targeting sequence
cuggacauaucugucaggcc

SEQ ID NO: 9140 - RNA, 20 nt, Artificial Sequence
  TRAC targeting sequence
ggacauaucugucaggccug

SEQ ID NO: 9141 - RNA, 20 nt, Artificial Sequence
  TRAC targeting sequence
agagauaugauuuucacuuc

SEQ ID NO: 9142 - RNA, 20 nt, Artificial Sequence
  TRAC targeting sequence
gucaggccugaagcccuagg

SEQ ID NO: 9143 - RNA, 20 nt, Artificial Sequence
  TRAC targeting sequence
ggccugaagcccuaggcuac

SEQ ID NO: 9144 - RNA, 20 nt, Artificial Sequence
  TRAC targeting sequence
ggccugacagauauguccag

SEQ ID NO: 9145 - RNA, 20 nt, Artificial Sequence
  TRAC targeting sequence
aguagccuagggcuucaggc

SEQ ID NO: 9146 - RNA, 20 nt, Artificial Sequence
  TRAC targeting sequence
uuccaguagccuagggcuuc

SEQ ID NO: 9147 - RNA, 20 nt, Artificial Sequence
  TRAC targeting sequence
uucuuuccaguagccuaggg

SEQ ID NO: 9148 - RNA, 20 nt, Artificial Sequence
  TRAC targeting sequence
ugguaucuuucuuuccagua

SEQ ID NO: 9149 - RNA, 20 nt, Artificial Sequence
  TRAC targeting sequence
uuccucuaaagcuuagaagu

SEQ ID NO: 9150 - RNA, 20 nt, Artificial Sequence
  TRAC targeting sequence
ucuaaagcuuagaaguugga

SEQ ID NO: 9151 - RNA, 20 nt, Artificial Sequence
  TRAC targeting sequence
aaagcuuagaaguuggagaa

SEQ ID NO: 9152 - RNA, 20 nt, Artificial Sequence
  TRAC targeting sequence
aagcuuuagaggaaggauaa

SEQ ID NO: 9153 - RNA, 20 nt, Artificial Sequence
  TRAC targeting sequence
aacuucuaagcuuuagagga

SEQ ID NO: 9154 - RNA, 20 nt, Artificial Sequence
  TRAC targeting sequence
ccaacuucuaagcuuuagag

SEQ ID NO: 9155 - RNA, 20 nt, Artificial Sequence
  TRAC targeting sequence
aguucuugggaagcucugca

SEQ ID NO: 9156 - RNA, 20 nt, Artificial Sequence
  TRAC targeting sequence
ugggaagcucugcaaagcag

SEQ ID NO: 9157 - RNA, 20 nt, Artificial Sequence
  TRAC targeting sequence
caagaacuagaauuuuucuc

SEQ ID NO: 9158 - RNA, 20 nt, Artificial Sequence
  TRAC targeting sequence
gcaaagcaggguucguuaag

SEQ ID NO: 9159 - RNA, 20 nt, Artificial Sequence
  TRAC targeting sequence
uuaagcugaugccacagguu

SEQ ID NO: 9160 - RNA, 20 nt, Artificial Sequence
  TRAC targeting sequence
gcuuaacgaacccugcuuug

SEQ ID NO: 9161 - RNA, 20 nt, Artificial Sequence
  TRAC targeting sequence
gcacaguguuuaagaaacca

SEQ ID NO: 9162 - RNA, 20 nt, Artificial Sequence
  TRAC targeting sequence
uaaacacugugcugaggggc

SEQ ID NO: 9163 - RNA, 20 nt, Artificial Sequence
  TRAC targeting sequence
agguugaccuuuggggaagg

SEQ ID NO: 9164 - RNA, 20 nt, Artificial Sequence
  TRAC targeting sequence
accuagagccacugguuucu

SEQ ID NO: 9165 - RNA, 20 nt, Artificial Sequence
  TRAC targeting sequence
ccaaaggucaaccuagagcc

SEQ ID NO: 9166 - RNA, 20 nt, Artificial Sequence
  TRAC targeting sequence
uuccccaaaggucaaccuag

SEQ ID NO: 9167 - RNA, 20 nt, Artificial Sequence
  TRAC targeting sequence
cagugaauccugguaagugg

SEQ ID NO: 9168 - RNA, 20 nt, Artificial Sequence
  TRAC targeting sequence
cugugagcuguguuccuucc

SEQ ID NO: 9169 - RNA, 20 nt, Artificial Sequence
  TRAC targeting sequence
ugguaaguggaggggagcau

SEQ ID NO: 9170 - RNA, 20 nt, Artificial Sequence
  TRAC targeting sequence
acuuaccaggauucacugug

SEQ ID NO: 9171 - RNA, 20 nt, Artificial Sequence
  TRAC targeting sequence
ccuccacuuaccaggauuca

SEQ ID NO: 9172 - RNA, 20 nt, Artificial Sequence
  TRAC targeting sequence
augcuccccuccacuuacca

SEQ ID NO: 9173 - RNA, 20 nt, Artificial Sequence
  TRAC targeting sequence
ucugccugaauguauccauu

SEQ ID NO: 9174 - RNA, 20 nt, Artificial Sequence
  TRAC targeting sequence
gccugaauguauccauuuua

SEQ ID NO: 9175 - RNA, 20 nt, Artificial Sequence
  TRAC targeting sequence
ggcagaggauucaaugcucc

SEQ ID NO: 9176 - RNA, 20 nt, Artificial Sequence
  TRAC targeting sequence
auuuuaugccaaugaauuga

SEQ ID NO: 9177 - RNA, 20 nt, Artificial Sequence
  TRAC targeting sequence
uuggcauaaaauggauacau

SEQ ID NO: 9178 - RNA, 20 nt, Artificial Sequence
  TRAC targeting sequence
auucauuggcauaaaaugga

SEQ ID NO: 9179 - RNA, 20 nt, Artificial Sequence
  TRAC targeting sequence
caauucauuggcauaaaaug

SEQ ID NO: 9180 - RNA, 20 nt, Artificial Sequence
  TRAC targeting sequence
ugccccaucucugccacauu

SEQ ID NO: 9181 - RNA, 20 nt, Artificial Sequence
  TRAC targeting sequence
cugccacauucaaguccugc

SEQ ID NO: 9182 - RNA, 20 nt, Artificial Sequence
  TRAC targeting sequence
gccacauucaaguccugcuu

SEQ ID NO: 9183 - RNA, 20 nt, Artificial Sequence
  TRAC targeting sequence
aguccugcuuggcuaaacaa

SEQ ID NO: 9184 - RNA, 20 nt, Artificial Sequence
  TRAC targeting sequence
ugcuuggcuaaacaaugcuc

SEQ ID NO: 9185 - RNA, 20 nt, Artificial Sequence
  TRAC targeting sequence
cggaugugcacgugugcagu

SEQ ID NO: 9186 - RNA, 20 nt, Artificial Sequence
  TRAC targeting sequence
gugagcauuguuuagccaag

SEQ ID NO: 9187 - RNA, 20 nt, Artificial Sequence
  TRAC targeting sequence
cacugcacacgugcacaucc

SEQ ID NO: 9188 - RNA, 20 nt, Artificial Sequence
  TRAC targeting sequence
aaccucucacaaaaucacgc

SEQ ID NO: 9189 - RNA, 20 nt, Artificial Sequence
  TRAC targeting sequence
cacaaaaucacgcaaccccu

SEQ ID NO: 9190 - RNA, 20 nt, Artificial Sequence
  TRAC targeting sequence
caaaaucacgcaaccccuuc

SEQ ID NO: 9191 - RNA, 20 nt, Artificial Sequence
  TRAC targeting sequence
cgcaaccccuucaccaaacu

SEQ ID NO: 9192 - RNA, 20 nt, Artificial Sequence
  TRAC targeting sequence
ccaaacugcuugguggcucu

SEQ ID NO: 9193 - RNA, 20 nt, Artificial Sequence
  TRAC targeting sequence
ucugugcccucacagcccuu

SEQ ID NO: 9194 - RNA, 20 nt, Artificial Sequence
  TRAC targeting sequence
gugcccucacagcccuucua

SEQ ID NO: 9195 - RNA, 20 nt, Artificial Sequence
  TRAC targeting sequence
cagcccuucuaguuuagcag

SEQ ID NO: 9196 - RNA, 20 nt, Artificial Sequence
  TRAC targeting sequence
aguuuagcaguuagaggaag

SEQ ID NO: 9197 - RNA, 20 nt, Artificial Sequence
  TRAC targeting sequence
aacugcuaaacuagaagggc

SEQ ID NO: 9198 - RNA, 20 nt, Artificial Sequence
  TRAC targeting sequence
ucuaacugcuaaacuagaag

SEQ ID NO: 9199 - RNA, 20 nt, Artificial Sequence
  TRAC targeting sequence
uccucuaacugcuaaacuag

SEQ ID NO: 9200 - RNA, 20 nt, Artificial Sequence
  TRAC targeting sequence
cauuuuuaggucauugugga

SEQ ID NO: 9201 - RNA, 20 nt, Artificial Sequence
  TRAC targeting sequence
uuuuuaggucauuguggaaa

SEQ ID NO: 9202 - RNA, 20 nt, Artificial Sequence
  TRAC targeting sequence
uuguggaaagaggaacguug

SEQ ID NO: 9203 - RNA, 20 nt, Artificial Sequence
  TRAC targeting sequence
acaaugaccuaaaaaugaga

SEQ ID NO: 9204 - RNA, 20 nt, Artificial Sequence
  TRAC targeting sequence
uuccacaaugaccuaaaaau

SEQ ID NO: 9205 - RNA, 20 nt, Artificial Sequence
  TRAC targeting sequence
ucuuuccacaaugaccuaaa

SEQ ID NO: 9206 - RNA, 20 nt, Artificial Sequence
  TRAC targeting sequence
ccaacguuccucuuuccaca

SEQ ID NO: 9207 - RNA, 20 nt, Artificial Sequence
  TRAC targeting sequence
caagcaggcaaacauaucac

SEQ ID NO: 9208 - RNA, 20 nt, Artificial Sequence
  TRAC targeting sequence
ucccaagcaggcaaacauau

SEQ ID NO: 9209 - RNA, 20 nt, Artificial Sequence
  TRAC targeting sequence
uuauuauuuuccucccaagc

SEQ ID NO: 9210 - RNA, 20 nt, Artificial Sequence
  TRAC targeting sequence
ucauuauuauuuuccuccca

SEQ ID NO: 9211 - RNA, 20 nt, Artificial Sequence
  TRAC targeting sequence
uugguuucuauaugcuaguu

SEQ ID NO: 9212 - RNA, 20 nt, Artificial Sequence
  TRAC targeting sequence
auaugcuaguugaugugcug

SEQ ID NO: 9213 - RNA, 20 nt, Artificial Sequence
  TRAC targeting sequence
acuagcauauagaaaccaau

SEQ ID NO: 9214 - RNA, 20 nt, Artificial Sequence
  TRAC targeting sequence
uucucuuaucacauuuaauc

SEQ ID NO: 9215 - RNA, 20 nt, Artificial Sequence
  TRAC targeting sequence
cuuaucacauuuaauccuua

SEQ ID NO: 9216 - RNA, 20 nt, Artificial Sequence
  TRAC targeting sequence
uaucacauuuaauccuuaua

SEQ ID NO: 9217 - RNA, 20 nt, Artificial Sequence
  TRAC targeting sequence
cauuuaauccuuauaccagg

SEQ ID NO: 9218 - RNA, 20 nt, Artificial Sequence
  TRAC targeting sequence
uuauaccaggucugugaguu

SEQ ID NO: 9219 - RNA, 20 nt, Artificial Sequence
  TRAC targeting sequence
gugaguuaggugcuauuauu

SEQ ID NO: 9220 - RNA, 20 nt, Artificial Sequence
  TRAC targeting sequence
cagaccugguauaaggauua

SEQ ID NO: 9221 - RNA, 20 nt, Artificial Sequence
  TRAC targeting sequence
ucauuuuauagaagagauau

SEQ ID NO: 9222 - RNA, 20 nt, Artificial Sequence
  TRAC targeting sequence
uuuuauagaagagauauauu

SEQ ID NO: 9223 - RNA, 20 nt, Artificial Sequence
  TRAC targeting sequence
auaaaaugaggauaauaaua

SEQ ID NO: 9224 - RNA, 20 nt, Artificial Sequence
  TRAC targeting sequence
ucuauaaaaugaggauaaua

SEQ ID NO: 9225 - RNA, 20 nt, Artificial Sequence
  TRAC targeting sequence
cuucuauaaaaugaggauaa

SEQ ID NO: 9226 - RNA, 20 nt, Artificial Sequence
  TRAC targeting sequence
auagaagcacagagauguug

SEQ ID NO: 9227 - RNA, 20 nt, Artificial Sequence
  TRAC targeting sequence
auagaaauauaaaauauaaa

SEQ ID NO: 9228 - RNA, 20 nt, Artificial Sequence
  TRAC targeting sequence
gugcuucuauagaaauauaa

SEQ ID NO: 9229 - RNA, 20 nt, Artificial Sequence
  TRAC targeting sequence
cugugcuucuauagaaauau

SEQ ID NO: 9230 - RNA, 20 nt, Artificial Sequence
  TRAC targeting sequence
acaucucugugcuucuauag

SEQ ID NO: 9231 - RNA, 20 nt, Artificial Sequence
  TRAC targeting sequence
agccgaugaaguaagaaaga

SEQ ID NO: 9232 - RNA, 20 nt, Artificial Sequence
  TRAC targeting sequence
gcuugaacaaguuauucaac

SEQ ID NO: 9233 - RNA, 20 nt, Artificial Sequence
  TRAC targeting sequence
ucggcuugaacaaguuauuc

SEQ ID NO: 9234 - RNA, 20 nt, Artificial Sequence
  TRAC targeting sequence
uacuucaucggcuugaacaa

SEQ ID NO: 9235 - RNA, 20 nt, Artificial Sequence
  TRAC targeting sequence
uucuuacuucaucggcuuga

SEQ ID NO: 9236 - RNA, 20 nt, Artificial Sequence
  TRAC targeting sequence
cuuucuuacuucaucggcuu

SEQ ID NO: 9237 - RNA, 20 nt, Artificial Sequence
  TRAC targeting sequence
agguucucuuucuuacuuca

SEQ ID NO: 9238 - RNA, 20 nt, Artificial Sequence
  TRAC targeting sequence
uggcacucagauuccagagc

SEQ ID NO: 9239 - RNA, 20 nt, Artificial Sequence
  TRAC targeting sequence
gauuccagagcuaaaagcuu

SEQ ID NO: 9240 - RNA, 20 nt, Artificial Sequence
  TRAC targeting sequence
gagugccaagaauuaaacuc

SEQ ID NO: 9241 - RNA, 20 nt, Artificial Sequence
  TRAC targeting sequence
agagcuaaaagcuuuucagu

SEQ ID NO: 9242 - RNA, 20 nt, Artificial Sequence
  TRAC targeting sequence
ggaaucugagugccaagaau

SEQ ID NO: 9243 - RNA, 20 nt, Artificial Sequence
  TRAC targeting sequence
gugaggggauuaugucuaga

SEQ ID NO: 9244 - RNA, 20 nt, Artificial Sequence
  TRAC targeting sequence
cugaaaagcuuuuagcucug

SEQ ID NO: 9245 - RNA, 20 nt, Artificial Sequence
  TRAC targeting sequence
ccucacugaaaagcuuuuag

SEQ ID NO: 9246 - RNA, 20 nt, Artificial Sequence
  TRAC targeting sequence
agagggaaugucccugaugc

SEQ ID NO: 9247 - RNA, 20 nt, Artificial Sequence
  TRAC targeting sequence
agacauaauccccucacuga

SEQ ID NO: 9248 - RNA, 20 nt, Artificial Sequence
  TRAC targeting sequence
cucuagacauaauccccuca

SEQ ID NO: 9249 - RNA, 20 nt, Artificial Sequence
  TRAC targeting sequence
cugaugcucuagucucuaag

SEQ ID NO: 9250 - RNA, 20 nt, Artificial Sequence
  TRAC targeting sequence
gggacauucccucuagacau

SEQ ID NO: 9251 - RNA, 20 nt, Artificial Sequence
  TRAC targeting sequence
agucucuaagguugcuaaga

SEQ ID NO: 9252 - RNA, 20 nt, Artificial Sequence
  TRAC targeting sequence
cuaagguugcuaagauaauc

SEQ ID NO: 9253 - RNA, 20 nt, Artificial Sequence
  TRAC targeting sequence
aagguugcuaagauaaucgc

SEQ ID NO: 9254 - RNA, 20 nt, Artificial Sequence
  TRAC targeting sequence
uagcaaccuuagagacuaga

SEQ ID NO: 9255 - RNA, 20 nt, Artificial Sequence
  TRAC targeting sequence
cuaaagaacugcgcucucag

SEQ ID NO: 9256 - RNA, 20 nt, Artificial Sequence
  TRAC targeting sequence
uuagcgauuaucuuagcaac

SEQ ID NO: 9257 - RNA, 20 nt, Artificial Sequence
  TRAC targeting sequence
cagcaaguaaagccaggggu

SEQ ID NO: 9258 - RNA, 20 nt, Artificial Sequence
  TRAC targeting sequence
gcaaguaaagccagggguug

SEQ ID NO: 9259 - RNA, 20 nt, Artificial Sequence
  TRAC targeting sequence
acaggaccacggugacccag

SEQ ID NO: 9260 - RNA, 20 nt, Artificial Sequence
  TRAC targeting sequence
uguugaccaaccccuggcuu

SEQ ID NO: 9261 - RNA, 20 nt, Artificial Sequence
  TRAC targeting sequence
ccgugguccuguugaccaac

SEQ ID NO: 9262 - RNA, 20 nt, Artificial Sequence
  TRAC targeting sequence
uaauccuuacaacaucauca

SEQ ID NO: 9263 - RNA, 20 nt, Artificial Sequence
  TRAC targeting sequence
uuacaacaucaucaagcagu

SEQ ID NO: 9264 - RNA, 20 nt, Artificial Sequence
  TRAC targeting sequence
ucaagcaguugcuguuuucc

SEQ ID NO: 9265 - RNA, 20 nt, Artificial Sequence
  TRAC targeting sequence
agcaguugcuguuuucccca

SEQ ID NO: 9266 - RNA, 20 nt, Artificial Sequence
  TRAC targeting sequence
ccacuuuacaagugaggaaa

SEQ ID NO: 9267 - RNA, 20 nt, Artificial Sequence
  TRAC targeting sequence
cuuguaaaguggggaaaaca

SEQ ID NO: 9268 - RNA, 20 nt, Artificial Sequence
  TRAC targeting sequence
ucacuuguaaaguggggaaa

SEQ ID NO: 9269 - RNA, 20 nt, Artificial Sequence
  TRAC targeting sequence
guuuccucacuuguaaagug

SEQ ID NO: 9270 - RNA, 20 nt, Artificial Sequence
  TRAC targeting sequence
uaacuugcuacaccucaguu

SEQ ID NO: 9271 - RNA, 20 nt, Artificial Sequence
  TRAC targeting sequence
ugaguuuuaaacucaagccu

SEQ ID NO: 9272 - RNA, 20 nt, Artificial Sequence
  TRAC targeting sequence
ggacaaguuuccuaacuugc

SEQ ID NO: 9273 - RNA, 20 nt, Artificial Sequence
  TRAC targeting sequence
agccuaccugccccaaagcc

SEQ ID NO: 9274 - RNA, 20 nt, Artificial Sequence
  TRAC targeting sequence
ggcuuuggggcagguaggcu

SEQ ID NO: 9275 - RNA, 20 nt, Artificial Sequence
  TRAC targeting sequence
uuuaaauuaacugcaacugc

SEQ ID NO: 9276 - RNA, 20 nt, Artificial Sequence
  TRAC targeting sequence
gcaguugcaguuaauuuaaa

SEQ ID NO: 9277 - RNA, 20 nt, Artificial Sequence
  TRAC targeting sequence
aacuggucagcaguugcagu

SEQ ID NO: 9278 - RNA, 20 nt, Artificial Sequence
  TRAC targeting sequence
uauuaauuaaguaauuaguu

SEQ ID NO: 9279 - RNA, 20 nt, Artificial Sequence
  TRAC targeting sequence
gauuuguucuauaggucccc

SEQ ID NO: 9280 - RNA, 20 nt, Artificial Sequence
  TRAC targeting sequence
gauuacuuuuuuaccuuaca

SEQ ID NO: 9281 - RNA, 20 nt, Artificial Sequence
  TRAC targeting sequence
auagguccccucccuuuucg

SEQ ID NO: 9282 - RNA, 20 nt, Artificial Sequence
  TRAC targeting sequence
ccucccuuuucgggaauagc

SEQ ID NO: 9283 - RNA, 20 nt, Artificial Sequence
  TRAC targeting sequence
cuuuucgggaauagcuauac

SEQ ID NO: 9284 - RNA, 20 nt, Artificial Sequence
  TRAC targeting sequence
ggaauagcuauacaauugua

SEQ ID NO: 9285 - RNA, 20 nt, Artificial Sequence
  TRAC targeting sequence
cgaaaagggaggggaccuau

SEQ ID NO: 9286 - RNA, 20 nt, Artificial Sequence
  TRAC targeting sequence
ccugggagaguggguggagc

SEQ ID NO: 9287 - RNA, 20 nt, Artificial Sequence
  TRAC targeting sequence
caggggaagcauaaaauuau

SEQ ID NO: 9288 - RNA, 20 nt, Artificial Sequence
  TRAC targeting sequence
cccaggggaagcauaaaauu

SEQ ID NO: 9289 - RNA, 20 nt, Artificial Sequence
  TRAC targeting sequence
acccacucucccaggggaag

SEQ ID NO: 9290 - RNA, 20 nt, Artificial Sequence
  TRAC targeting sequence
cagcccaugauggaaggguc

SEQ ID NO: 9291 - RNA, 20 nt, Artificial Sequence
  TRAC targeting sequence
ugggcugggagccagggcuc

SEQ ID NO: 9292 - RNA, 20 nt, Artificial Sequence
  TRAC targeting sequence
aucaugggcugggagccagg

SEQ ID NO: 9293 - RNA, 20 nt, Artificial Sequence
  TRAC targeting sequence
uggcaguauuuguaaagcag

SEQ ID NO: 9294 - RNA, 20 nt, Artificial Sequence
  TRAC targeting sequence
guggggguguaacucagggc

SEQ ID NO: 9295 - RNA, 20 nt, Artificial Sequence
  TRAC targeting sequence
gggcggaucugaaaagcugg

SEQ ID NO: 9296 - RNA, 20 nt, Artificial Sequence
  TRAC targeting sequence
gcccugaguuacacccccac

SEQ ID NO: 9297 - RNA, 20 nt, Artificial Sequence
  TRAC targeting sequence
gaaaagcuggucuuuggaaa

SEQ ID NO: 9298 - RNA, 20 nt, Artificial Sequence
  TRAC targeting sequence
gauccgcccugaguuacacc

SEQ ID NO: 9299 - RNA, 20 nt, Artificial Sequence
  TRAC targeting sequence
uuggaaagggaacgaaacug

SEQ ID NO: 9300 - RNA, 20 nt, Artificial Sequence
  TRAC targeting sequence
aaagaccagcuuuucagauc

SEQ ID NO: 9301 - RNA, 20 nt, Artificial Sequence
  TRAC targeting sequence
cuuuccaaagaccagcuuuu

SEQ ID NO: 9302 - RNA, 20 nt, Artificial Sequence
  TRAC targeting sequence
uucccuuuccaaagaccagc

SEQ ID NO: 9303 - RNA, 20 nt, Artificial Sequence
  TRAC targeting sequence
guuucguucccuuuccaaag

SEQ ID NO: 9304 - RNA, 20 nt, Artificial Sequence
  TRAC targeting sequence
gaauaaugcuuccaaauuuc

SEQ ID NO: 9305 - RNA, 20 nt, Artificial Sequence
  TRAC targeting sequence
gacuuacauggguuuacugu

SEQ ID NO: 9306 - RNA, 20 nt, Artificial Sequence
  TRAC targeting sequence
aaauuucucccuggaacccu

SEQ ID NO: 9307 - RNA, 20 nt, Artificial Sequence
  TRAC targeting sequence
cccuggaacccugauuucca

SEQ ID NO: 9308 - RNA, 20 nt, Artificial Sequence
  TRAC targeting sequence
cuggaacccugauuuccaaa

SEQ ID NO: 9309 - RNA, 20 nt, Artificial Sequence
  TRAC targeting sequence
agggagaaauuuggaagcau

SEQ ID NO: 9310 - RNA, 20 nt, Artificial Sequence
  TRAC targeting sequence
ggguuccagggagaaauuug

SEQ ID NO: 9311 - RNA, 20 nt, Artificial Sequence
  TRAC targeting sequence
aaauuuuccauucuguuuua

SEQ ID NO: 9312 - RNA, 20 nt, Artificial Sequence
  TRAC targeting sequence
auucuguuuuauaacccagg

SEQ ID NO: 9313 - RNA, 20 nt, Artificial Sequence
  TRAC targeting sequence
guuuuauaacccagguccaa

SEQ ID NO: 9314 - RNA, 20 nt, Artificial Sequence
  TRAC targeting sequence
aaaccacagcagucccauua

SEQ ID NO: 9315 - RNA, 20 nt, Artificial Sequence
  TRAC targeting sequence
cauuaauggauuccagugca

SEQ ID NO: 9316 - RNA, 20 nt, Artificial Sequence
  TRAC targeting sequence
auuaaugggacugcuguggu

SEQ ID NO: 9317 - RNA, 20 nt, Artificial Sequence
  TRAC targeting sequence
agugcaaaacaacugcuggu

SEQ ID NO: 9318 - RNA, 20 nt, Artificial Sequence
  TRAC targeting sequence
uacuacacgcaggucucugu

SEQ ID NO: 9319 - RNA, 20 nt, Artificial Sequence
  TRAC targeting sequence
cuguuguuugcccucaugug

SEQ ID NO: 9320 - RNA, 20 nt, Artificial Sequence
  TRAC targeting sequence
guuguuugcccucaugugcu

SEQ ID NO: 9321 - RNA, 20 nt, Artificial Sequence
  TRAC targeting sequence
ugugcuauuuuaucuaauag

SEQ ID NO: 9322 - RNA, 20 nt, Artificial Sequence
  TRAC targeting sequence
aauagcugagaaugacagua

SEQ ID NO: 9323 - RNA, 20 nt, Artificial Sequence
  TRAC targeting sequence
gcuauuagauaaaauagcac

SEQ ID NO: 9324 - RNA, 20 nt, Artificial Sequence
  TRAC targeting sequence
cagcuauuagauaaaauagc

SEQ ID NO: 9325 - RNA, 20 nt, Artificial Sequence
  TRAC targeting sequence
uucucagcuauuagauaaaa

SEQ ID NO: 9326 - RNA, 20 nt, Artificial Sequence
  TRAC targeting sequence
auugguacugucauucucag

SEQ ID NO: 9327 - RNA, 20 nt, Artificial Sequence
  TRAC targeting sequence
gugcuccauugguacuguca

SEQ ID NO: 9328 - RNA, 20 nt, Artificial Sequence
  TRAC targeting sequence
uuaacucagugcuccauugg

SEQ ID NO: 9329 - RNA, 20 nt, Artificial Sequence
  TRAC targeting sequence
gacuguucgaaggcuucauu

SEQ ID NO: 9330 - RNA, 20 nt, Artificial Sequence
  TRAC targeting sequence
gacuccuuaacucagugcuc

SEQ ID NO: 9331 - RNA, 20 nt, Artificial Sequence
  TRAC targeting sequence
aaggcuucauucuucguuau

SEQ ID NO: 9332 - RNA, 20 nt, Artificial Sequence
  TRAC targeting sequence
aacagucugacuccuuaacu

SEQ ID NO: 9333 - RNA, 20 nt, Artificial Sequence
  TRAC targeting sequence
uucuucguuauaauugguga

SEQ ID NO: 9334 - RNA, 20 nt, Artificial Sequence
  TRAC targeting sequence
ucguuauaauuggugagauu

SEQ ID NO: 9335 - RNA, 20 nt, Artificial Sequence
  TRAC targeting sequence
uuauaauuggugagauuuuc

SEQ ID NO: 9336 - RNA, 20 nt, Artificial Sequence
  TRAC targeting sequence
ccaauuauaacgaagaauga

SEQ ID NO: 9337 - RNA, 20 nt, Artificial Sequence
  TRAC targeting sequence
caccaauuauaacgaagaau

SEQ ID NO: 9338 - RNA, 20 nt, Artificial Sequence
  TRAC targeting sequence
augggacuaagagaaaauug

SEQ ID NO: 9339 - RNA, 20 nt, Artificial Sequence
  TRAC targeting sequence
cauggaaaaucucaccaauu

SEQ ID NO: 9340 - RNA, 20 nt, Artificial Sequence
  TRAC targeting sequence
uagucccauggaaaaucuca

SEQ ID NO: 9341 - RNA, 20 nt, Artificial Sequence
  TRAC targeting sequence
cuuagucccauggaaaaucu

SEQ ID NO: 9342 - RNA, 20 nt, Artificial Sequence
  TRAC targeting sequence
auuuucucuuagucccaugg

SEQ ID NO: 9343 - RNA, 20 nt, Artificial Sequence
  TRAC targeting sequence
cugagccucuauuuuccucc

SEQ ID NO: 9344 - RNA, 20 nt, Artificial Sequence
  TRAC targeting sequence
gagccucuauuuuccuccuc

SEQ ID NO: 9345 - RNA, 20 nt, Artificial Sequence
  TRAC targeting sequence
gagaguuaaucaauuuucuc

SEQ ID NO: 9346 - RNA, 20 nt, Artificial Sequence
  TRAC targeting sequence
auuuuccuccucuguagaau

SEQ ID NO: 9347 - RNA, 20 nt, Artificial Sequence
  TRAC targeting sequence
uccucuguagaaugggggag

SEQ ID NO: 9348 - RNA, 20 nt, Artificial Sequence
  TRAC targeting sequence
ucuguagaaugggggaggca

SEQ ID NO: 9349 - RNA, 20 nt, Artificial Sequence
  TRAC targeting sequence
guagaaugggggaggcaguu

SEQ ID NO: 9350 - RNA, 20 nt, Artificial Sequence
  TRAC targeting sequence
acagaggaggaaaauagagg

SEQ ID NO: 9351 - RNA, 20 nt, Artificial Sequence
  TRAC targeting sequence
cccauucuacagaggaggaa

SEQ ID NO: 9352 - RNA, 20 nt, Artificial Sequence
  TRAC targeting sequence
uguucccauuuuaccacagc

SEQ ID NO: 9353 - RNA, 20 nt, Artificial Sequence
  TRAC targeting sequence
cauuuuaccacagccggcgu

SEQ ID NO: 9354 - RNA, 20 nt, Artificial Sequence
  TRAC targeting sequence
cagcacgccggcugugguaa

SEQ ID NO: 9355 - RNA, 20 nt, Artificial Sequence
  TRAC targeting sequence
ccucacagcacgccggcugu

SEQ ID NO: 9356 - RNA, 20 nt, Artificial Sequence
  TRAC targeting sequence
aauaaggggacaaugagugu

SEQ ID NO: 9357 - RNA, 20 nt, Artificial Sequence
  TRAC targeting sequence
ccuuauuggaaauguaccaa

SEQ ID NO: 9358 - RNA, 20 nt, Artificial Sequence
  TRAC targeting sequence
uuguccccuuauuggaaaug

SEQ ID NO: 9359 - RNA, 20 nt, Artificial Sequence
  TRAC targeting sequence
cacucauuguccccuuauug

SEQ ID NO: 9360 - RNA, 20 nt, Artificial Sequence
  TRAC targeting sequence
ucacacucauuguccccuua

SEQ ID NO: 9361 - RNA, 20 nt, Artificial Sequence
  TRAC targeting sequence
cuucacacucauuguccccu

SEQ ID NO: 9362 - RNA, 20 nt, Artificial Sequence
  TRAC targeting sequence
uuucucuucacacucauugu

SEQ ID NO: 9363 - RNA, 20 nt, Artificial Sequence
  TRAC targeting sequence
guaaacucuuccaccagucc

SEQ ID NO: 9364 - RNA, 20 nt, Artificial Sequence
  TRAC targeting sequence
uccaccagucccacacuaua

SEQ ID NO: 9365 - RNA, 20 nt, Artificial Sequence
  TRAC targeting sequence
accagucccacacuauaaac

SEQ ID NO: 9366 - RNA, 20 nt, Artificial Sequence
  TRAC targeting sequence
cacacuauaaacagcugguu

SEQ ID NO: 9367 - RNA, 20 nt, Artificial Sequence
  TRAC targeting sequence
gggggauucuuggaugacaa

SEQ ID NO: 9368 - RNA, 20 nt, Artificial Sequence
  TRAC targeting sequence
cccugauaaaaccagcuguu

SEQ ID NO: 9369 - RNA, 20 nt, Artificial Sequence
  TRAC targeting sequence
uggaugacaaguaagcacuu

SEQ ID NO: 9370 - RNA, 20 nt, Artificial Sequence
  TRAC targeting sequence
aagaaucccccugauaaaac

SEQ ID NO: 9371 - RNA, 20 nt, Artificial Sequence
  TRAC targeting sequence
uccaagaaucccccugauaa

SEQ ID NO: 9372 - RNA, 20 nt, Artificial Sequence
  TRAC targeting sequence
aggggagucugggcaacuga

SEQ ID NO: 9373 - RNA, 20 nt, Artificial Sequence
  TRAC targeting sequence
ccuugauauuuacuuaagug

SEQ ID NO: 9374 - RNA, 20 nt, Artificial Sequence
  TRAC targeting sequence
gggcaacugaguuuuuguag

SEQ ID NO: 9375 - RNA, 20 nt, Artificial Sequence
  TRAC targeting sequence
guugcccagacuccccuuga

SEQ ID NO: 9376 - RNA, 20 nt, Artificial Sequence
  TRAC targeting sequence
acaaaaacucaguugcccag

SEQ ID NO: 9377 - RNA, 20 nt, Artificial Sequence
  TRAC targeting sequence
ucgugucauuguguuauacu

SEQ ID NO: 9378 - RNA, 20 nt, Artificial Sequence
  TRAC targeting sequence
ugucauuguguuauacugga

SEQ ID NO: 9379 - RNA, 20 nt, Artificial Sequence
  TRAC targeting sequence
uuguguuauacuggagccaa

SEQ ID NO: 9380 - RNA, 20 nt, Artificial Sequence
  TRAC targeting sequence
aguauaacacaaugacacga

SEQ ID NO: 9381 - RNA, 20 nt, Artificial Sequence
  TRAC targeting sequence
gcuuacuauuggcuccagua

SEQ ID NO: 9382 - RNA, 20 nt, Artificial Sequence
  TRAC targeting sequence
aaaugucagcuuacuauugg

SEQ ID NO: 9383 - RNA, 20 nt, Artificial Sequence
  TRAC targeting sequence
uuuuccaaaugucagcuuac

SEQ ID NO: 9384 - RNA, 20 nt, Artificial Sequence
  TRAC targeting sequence
gaguguuagaccagguaugu

SEQ ID NO: 9385 - RNA, 20 nt, Artificial Sequence
  TRAC targeting sequence
gaguuauuccuuuuccaaau

SEQ ID NO: 9386 - RNA, 20 nt, Artificial Sequence
  TRAC targeting sequence
aacacucagaguuauuccuu

SEQ ID NO: 9387 - RNA, 20 nt, Artificial Sequence
  TRAC targeting sequence
uuaaaacauaccuggucuaa

SEQ ID NO: 9388 - RNA, 20 nt, Artificial Sequence
  TRAC targeting sequence
aaacauaagccaccauccuu

SEQ ID NO: 9389 - RNA, 20 nt, Artificial Sequence
  TRAC targeting sequence
uuagaaauucagugaaagau

SEQ ID NO: 9390 - RNA, 20 nt, Artificial Sequence
  TRAC targeting sequence
aaggaugguggcuuauguuu

SEQ ID NO: 9391 - RNA, 20 nt, Artificial Sequence
  TRAC targeting sequence
gugaaagauaaccgaaucuc

SEQ ID NO: 9392 - RNA, 20 nt, Artificial Sequence
  TRAC targeting sequence
cugaauuucuaaggauggug

SEQ ID NO: 9393 - RNA, 20 nt, Artificial Sequence
  TRAC targeting sequence
uucacugaauuucuaaggau

SEQ ID NO: 9394 - RNA, 20 nt, Artificial Sequence
  TRAC targeting sequence
guuaucuuucacugaauuuc

SEQ ID NO: 9395 - RNA, 20 nt, Artificial Sequence
  TRAC targeting sequence
ccugcccaguuauuagcauc

SEQ ID NO: 9396 - RNA, 20 nt, Artificial Sequence
  TRAC targeting sequence
ugcccaguuauuagcaucuu

SEQ ID NO: 9397 - RNA, 20 nt, Artificial Sequence
  TRAC targeting sequence
uucaccaugggucuuucugg

SEQ ID NO: 9398 - RNA, 20 nt, Artificial Sequence
  TRAC targeting sequence
ccaugggucuuucuggagaa

SEQ ID NO: 9399 - RNA, 20 nt, Artificial Sequence
  TRAC targeting sequence
uucuggagaaaaugacaaug

SEQ ID NO: 9400 - RNA, 20 nt, Artificial Sequence
  TRAC targeting sequence
ggagaaaaugacaauguggg

SEQ ID NO: 9401 - RNA, 20 nt, Artificial Sequence
  TRAC targeting sequence
agaaagacccauggugaaag

SEQ ID NO: 9402 - RNA, 20 nt, Artificial Sequence
  TRAC targeting sequence
ccagaaagacccauggugaa

SEQ ID NO: 9403 - RNA, 20 nt, Artificial Sequence
  TRAC targeting sequence
uuuucuccagaaagacccau

SEQ ID NO: 9404 - RNA, 20 nt, Artificial Sequence
  TRAC targeting sequence
ggggcugcccacauugucau

SEQ ID NO: 9405 - RNA, 20 nt, Artificial Sequence
  TRAC targeting sequence
caaaggggcugcagucaggg

SEQ ID NO: 9406 - RNA, 20 nt, Artificial Sequence
  TRAC targeting sequence
uuaacaccuuuaaguacuug

SEQ ID NO: 9407 - RNA, 20 nt, Artificial Sequence
  TRAC targeting sequence
caaguacuuaaagguguuaa

SEQ ID NO: 9408 - RNA, 20 nt, Artificial Sequence
  TRAC targeting sequence
guguguuuuuguuaauguug

SEQ ID NO: 9409 - RNA, 20 nt, Artificial Sequence
  TRAC targeting sequence
aacauuaacaaaaacacacu

SEQ ID NO: 9410 - RNA, 20 nt, Artificial Sequence
  TRAC targeting sequence
ccaacauuaacaaaaacaca

SEQ ID NO: 9411 - RNA, 20 nt, Artificial Sequence
  TRAC targeting sequence
gacaaauggaaucugaauug

SEQ ID NO: 9412 - RNA, 20 nt, Artificial Sequence
  TRAC targeting sequence
gacacauaucuccaacauua

SEQ ID NO: 9413 - RNA, 20 nt, Artificial Sequence
  TRAC targeting sequence
auuugucagacacauaucuc

SEQ ID NO: 9414 - RNA, 20 nt, Artificial Sequence
  TRAC targeting sequence
gaauugaaguuuuagugugu

SEQ ID NO: 9415 - RNA, 20 nt, Artificial Sequence
  TRAC targeting sequence
gauuccauuugucagacaca

SEQ ID NO: 9416 - RNA, 20 nt, Artificial Sequence
  TRAC targeting sequence
auucagauuccauuugucag

SEQ ID NO: 9417 - RNA, 20 nt, Artificial Sequence
  TRAC targeting sequence
gccccuacacacuaaaacuu

SEQ ID NO: 9418 - RNA, 20 nt, Artificial Sequence
  TRAC targeting sequence
aaaugcuuucugccccuaca

SEQ ID NO: 9419 - RNA, 20 nt, Artificial Sequence
  TRAC targeting sequence
uuucuaaaugcuuucugccc

SEQ ID NO: 9420 - RNA, 20 nt, Artificial Sequence
  TRAC targeting sequence
uuuguccuuucuaaaugcuu

SEQ ID NO: 9421 - RNA, 20 nt, Artificial Sequence
  TRAC targeting sequence
uucuuuuguccuuucuaaau

SEQ ID NO: 9422 - RNA, 20 nt, Artificial Sequence
  TRAC targeting sequence
guccuucuuuuguccuuucu

SEQ ID NO: 9423 - RNA, 20 nt, Artificial Sequence
  TRAC targeting sequence
aaucuguccuucuuuugucc

SEQ ID NO: 9424 - RNA, 20 nt, Artificial Sequence
  TRAC targeting sequence
cagccauugguauguauuuu

SEQ ID NO: 9425 - RNA, 20 nt, Artificial Sequence
  TRAC targeting sequence
aaaaggaaacagugagaugu

SEQ ID NO: 9426 - RNA, 20 nt, Artificial Sequence
  TRAC targeting sequence
uuuuggauuggguugcauug

SEQ ID NO: 9427 - RNA, 20 nt, Artificial Sequence
  TRAC targeting sequence
cuguuuccuuuuggauuggg

SEQ ID NO: 9428 - RNA, 20 nt, Artificial Sequence
  TRAC targeting sequence
cacuguuuccuuuuggauug

SEQ ID NO: 9429 - RNA, 20 nt, Artificial Sequence
  TRAC targeting sequence
gcaggcuacaucucacuguu

SEQ ID NO: 9430 - RNA, 20 nt, Artificial Sequence
  TRAC targeting sequence
guuguuuaaucagcaggcua

SEQ ID NO: 9431 - RNA, 20 nt, Artificial Sequence
  TRAC targeting sequence
gugucagcugacuugucuuc

SEQ ID NO: 9432 - RNA, 20 nt, Artificial Sequence
  TRAC targeting sequence
gcugacuugucuucccaaag

SEQ ID NO: 9433 - RNA, 20 nt, Artificial Sequence
  TRAC targeting sequence
gcugacacggagugcuggcu

SEQ ID NO: 9434 - RNA, 20 nt, Artificial Sequence
  TRAC targeting sequence
ucccaaagcuuccauguugg

SEQ ID NO: 9435 - RNA, 20 nt, Artificial Sequence
  TRAC targeting sequence
caaagcuuccauguuggugc

SEQ ID NO: 9436 - RNA, 20 nt, Artificial Sequence
  TRAC targeting sequence
auguuggugcaauuaggaaa

SEQ ID NO: 9437 - RNA, 20 nt, Artificial Sequence
  TRAC targeting sequence
uaauugcaccaacauggaag

SEQ ID NO: 9438 - RNA, 20 nt, Artificial Sequence
  TRAC targeting sequence
uuuccuaauugcaccaacau

SEQ ID NO: 9439 - RNA, 20 nt, Artificial Sequence
  TRAC targeting sequence
aauccccauaacucaaaauc

SEQ ID NO: 9440 - RNA, 20 nt, Artificial Sequence
  TRAC targeting sequence
ccauaacucaaaaucuugga

SEQ ID NO: 9441 - RNA, 20 nt, Artificial Sequence
  TRAC targeting sequence
aaaucuuggagccaagcuaa

SEQ ID NO: 9442 - RNA, 20 nt, Artificial Sequence
  TRAC targeting sequence
uggagccaagcuaaauuggg

SEQ ID NO: 9443 - RNA, 20 nt, Artificial Sequence
  TRAC targeting sequence
aagauuuugaguuaugggga

SEQ ID NO: 9444 - RNA, 20 nt, Artificial Sequence
  TRAC targeting sequence
uacacggcuuuacccaauuu

SEQ ID NO: 9445 - RNA, 20 nt, Artificial Sequence
  TRAC targeting sequence
gguacugacacugacuacaa

SEQ ID NO: 9446 - RNA, 20 nt, Artificial Sequence
  TRAC targeting sequence
guaccagaaaaucuuacacg

SEQ ID NO: 9447 - RNA, 20 nt, Artificial Sequence
  TRAC targeting sequence
gugucaguaccagaaaaucu

SEQ ID NO: 9448 - RNA, 20 nt, Artificial Sequence
  TRAC targeting sequence
gcuuguagucagugucagua

SEQ ID NO: 9449 - RNA, 20 nt, Artificial Sequence
  TRAC targeting sequence
cuaaauaucagcuuguaguc

SEQ ID NO: 9450 - RNA, 20 nt, Artificial Sequence
  TRAC targeting sequence
uaacuuuucccuaaauauca

SEQ ID NO: 9451 - RNA, 20 nt, Artificial Sequence
  TRAC targeting sequence
aucuuaacuuuucccuaaau

SEQ ID NO: 9452 - RNA, 20 nt, Artificial Sequence
  TRAC targeting sequence
aauuagucagaaagaccacg

SEQ ID NO: 9453 - RNA, 20 nt, Artificial Sequence
  TRAC targeting sequence
gaaagaccacgaacuucuga

SEQ ID NO: 9454 - RNA, 20 nt, Artificial Sequence
  TRAC targeting sequence
gacuaauuugaauauuugcu

SEQ ID NO: 9455 - RNA, 20 nt, Artificial Sequence
  TRAC targeting sequence
uucugacuaauuugaauauu

SEQ ID NO: 9456 - RNA, 20 nt, Artificial Sequence
  TRAC targeting sequence
uggucuuucugacuaauuug

SEQ ID NO: 9457 - RNA, 20 nt, Artificial Sequence
  TRAC targeting sequence
gaaaacaagccccagggugc

SEQ ID NO: 9458 - RNA, 20 nt, Artificial Sequence
  TRAC targeting sequence
gaaguucguggucuuucuga

SEQ ID NO: 9459 - RNA, 20 nt, Artificial Sequence
  TRAC targeting sequence
aauuggguccucauggaaca

SEQ ID NO: 9460 - RNA, 20 nt, Artificial Sequence
  TRAC targeting sequence
ucauggaacauuuucaucuc

SEQ ID NO: 9461 - RNA, 20 nt, Artificial Sequence
  TRAC targeting sequence
uggaacauuuucaucucugc

SEQ ID NO: 9462 - RNA, 20 nt, Artificial Sequence
  TRAC targeting sequence
augaggacccaauuagaaau

SEQ ID NO: 9463 - RNA, 20 nt, Artificial Sequence
  TRAC targeting sequence
ucucugccuugucugagcuu

SEQ ID NO: 9464 - RNA, 20 nt, Artificial Sequence
  TRAC targeting sequence
cugccuugucugagcuuucu

SEQ ID NO: 9465 - RNA, 20 nt, Artificial Sequence
  TRAC targeting sequence
gccuugucugagcuuucugc

SEQ ID NO: 9466 - RNA, 20 nt, Artificial Sequence
  TRAC targeting sequence
gagcuuucugcaccagagaa

SEQ ID NO: 9467 - RNA, 20 nt, Artificial Sequence
  TRAC targeting sequence
gacaaggcagagaugaaaau

SEQ ID NO: 9468 - RNA, 20 nt, Artificial Sequence
  TRAC targeting sequence
gcaccagagaagccccuuuu

SEQ ID NO: 9469 - RNA, 20 nt, Artificial Sequence
  TRAC targeting sequence
ggugcagaaagcucagacaa

SEQ ID NO: 9470 - RNA, 20 nt, Artificial Sequence
  TRAC targeting sequence
cuggugcagaaagcucagac

SEQ ID NO: 9471 - RNA, 20 nt, Artificial Sequence
  TRAC targeting sequence
aaaggggcuucucuggugca

SEQ ID NO: 9472 - RNA, 20 nt, Artificial Sequence
  TRAC targeting sequence
cuucugagucccucauugaa

SEQ ID NO: 9473 - RNA, 20 nt, Artificial Sequence
  TRAC targeting sequence
gagucccucauugaaaaggu

SEQ ID NO: 9474 - RNA, 20 nt, Artificial Sequence
  TRAC targeting sequence
gaagugaguggguaucaaaa

SEQ ID NO: 9475 - RNA, 20 nt, Artificial Sequence
  TRAC targeting sequence
cucauugaaaagguggcaac

SEQ ID NO: 9476 - RNA, 20 nt, Artificial Sequence
  TRAC targeting sequence
uugaaaagguggcaacuaag

SEQ ID NO: 9477 - RNA, 20 nt, Artificial Sequence
  TRAC targeting sequence
augagggacucagaagugag

SEQ ID NO: 9478 - RNA, 20 nt, Artificial Sequence
  TRAC targeting sequence
aagcuuaguugccaccuuuu

SEQ ID NO: 9479 - RNA, 20 nt, Artificial Sequence
  TRAC targeting sequence
cuaagcuuaguugccaccuu

SEQ ID NO: 9480 - RNA, 20 nt, Artificial Sequence
  TRAC targeting sequence
uucucuaagcuuaguugcca

SEQ ID NO: 9481 - RNA, 20 nt, Artificial Sequence
  TRAC targeting sequence
cuaauccaaaugcaauacuu

SEQ ID NO: 9482 - RNA, 20 nt, Artificial Sequence
  TRAC targeting sequence
aaaugcaauacuugggggaa

SEQ ID NO: 9483 - RNA, 20 nt, Artificial Sequence
  TRAC targeting sequence
cccaaguauugcauuuggau

SEQ ID NO: 9484 - RNA, 20 nt, Artificial Sequence
  TRAC targeting sequence
aaauauucccccaaguauug

SEQ ID NO: 9485 - RNA, 20 nt, Artificial Sequence
  TRAC targeting sequence
accauucucaaaacaaaccu

SEQ ID NO: 9486 - RNA, 20 nt, Artificial Sequence
  TRAC targeting sequence
caaaacaaaccuaauuucag

SEQ ID NO: 9487 - RNA, 20 nt, Artificial Sequence
  TRAC targeting sequence
aaacaaaccuaauuucaguu

SEQ ID NO: 9488 - RNA, 20 nt, Artificial Sequence
  TRAC targeting sequence
guuaacuugaauguagcuga

SEQ ID NO: 9489 - RNA, 20 nt, Artificial Sequence
  TRAC targeting sequence
aguuaacugaaauuagguuu

SEQ ID NO: 9490 - RNA, 20 nt, Artificial Sequence
  TRAC targeting sequence
gcuacauucaaguuaacuga

SEQ ID NO: 9491 - RNA, 20 nt, Artificial Sequence
  TRAC targeting sequence
augagggaaucucugcuuuc

SEQ ID NO: 9492 - RNA, 20 nt, Artificial Sequence
  TRAC targeting sequence
uggaacaaaauuucagcuac

SEQ ID NO: 9493 - RNA, 20 nt, Artificial Sequence
  TRAC targeting sequence
cucauggaacaaaauuucag

SEQ ID NO: 9494 - RNA, 20 nt, Artificial Sequence
  TRAC targeting sequence
cugcuuucuaugauaaugca

SEQ ID NO: 9495 - RNA, 20 nt, Artificial Sequence
  TRAC targeting sequence
gcuuucuaugauaaugcaag

SEQ ID NO: 9496 - RNA, 20 nt, Artificial Sequence
  TRAC targeting sequence
augauaaugcaagcucauuu

SEQ ID NO: 9497 - RNA, 20 nt, Artificial Sequence
  TRAC targeting sequence
uagaaagcagagauucccuc

SEQ ID NO: 9498 - RNA, 20 nt, Artificial Sequence
  TRAC targeting sequence
uuucaaacaauuguuuggga

SEQ ID NO: 9499 - RNA, 20 nt, Artificial Sequence
  TRAC targeting sequence
aacaauuguuugggauuuaa

SEQ ID NO: 9500 - RNA, 20 nt, Artificial Sequence
  TRAC targeting sequence
caaacaauuguuugaaauga

SEQ ID NO: 9501 - RNA, 20 nt, Artificial Sequence
  TRAC targeting sequence
uaauucccaaaagauaccaa

SEQ ID NO: 9502 - RNA, 20 nt, Artificial Sequence
  TRAC targeting sequence
caaaagauaccaacuauuca

SEQ ID NO: 9503 - RNA, 20 nt, Artificial Sequence
  TRAC targeting sequence
uuugggaauuaugagcaaaa

SEQ ID NO: 9504 - RNA, 20 nt, Artificial Sequence
  TRAC targeting sequence
augaguaucuuaaaauaaaa

SEQ ID NO: 9505 - RNA, 20 nt, Artificial Sequence
  TRAC targeting sequence
uugaauaguugguaucuuuu

SEQ ID NO: 9506 - RNA, 20 nt, Artificial Sequence
  TRAC targeting sequence
uaaaauaaaacuacuuuuau

SEQ ID NO: 9507 - RNA, 20 nt, Artificial Sequence
  TRAC targeting sequence
uaaaaguaguuuuauuuuaa

SEQ ID NO: 9508 - RNA, 20 nt, Artificial Sequence
  TRAC targeting sequence
ccauuagaauggcuagaauc

SEQ ID NO: 9509 - RNA, 20 nt, Artificial Sequence
  TRAC targeting sequence
aauggggauaauaauuuggu

SEQ ID NO: 9510 - RNA, 20 nt, Artificial Sequence
  TRAC targeting sequence
agccauucuaauggggauaa

SEQ ID NO: 9511 - RNA, 20 nt, Artificial Sequence
  TRAC targeting sequence
gaauguccuaguauguauua

SEQ ID NO: 9512 - RNA, 20 nt, Artificial Sequence
  TRAC targeting sequence
gauucuagccauucuaaugg

SEQ ID NO: 9513 - RNA, 20 nt, Artificial Sequence
  TRAC targeting sequence
uaguauguauuaugugaacc

SEQ ID NO: 9514 - RNA, 20 nt, Artificial Sequence
  TRAC targeting sequence
cauaauacauacuaggacau

SEQ ID NO: 9515 - RNA, 20 nt, Artificial Sequence
  TRAC targeting sequence
caugggguucacauaauaca

SEQ ID NO: 9516 - RNA, 20 nt, Artificial Sequence
  TRAC targeting sequence
uaaaguuucuuaugccuaaa

SEQ ID NO: 9517 - RNA, 20 nt, Artificial Sequence
  TRAC targeting sequence
uaugccuaaaacagcauaag

SEQ ID NO: 9518 - RNA, 20 nt, Artificial Sequence
  TRAC targeting sequence
uaugcuguuuuaggcauaag

SEQ ID NO: 9519 - RNA, 20 nt, Artificial Sequence
  TRAC targeting sequence
cuuaugcuguuuuaggcaua

SEQ ID NO: 9520 - RNA, 20 nt, Artificial Sequence
  TRAC targeting sequence
cucuuaugcuguuuuaggca

SEQ ID NO: 9521 - RNA, 20 nt, Artificial Sequence
  TRAC targeting sequence
acgcuaaccuguguguucac

SEQ ID NO: 9522 - RNA, 20 nt, Artificial Sequence
  TRAC targeting sequence
cugguuaacaaaggucuaaa

SEQ ID NO: 9523 - RNA, 20 nt, Artificial Sequence
  TRAC targeting sequence
aaagagcaggugagucagcu

SEQ ID NO: 9524 - RNA, 20 nt, Artificial Sequence
  TRAC targeting sequence
uuagaccuuuguuaaccagu

SEQ ID NO: 9525 - RNA, 20 nt, Artificial Sequence
  TRAC targeting sequence
ccugcucuuuagaccuuugu

SEQ ID NO: 9526 - RNA, 20 nt, Artificial Sequence
  TRAC targeting sequence
gcugcuccauuuccaaacug

SEQ ID NO: 9527 - RNA, 20 nt, Artificial Sequence
  TRAC targeting sequence
auuuccaaacuggacuggac

SEQ ID NO: 9528 - RNA, 20 nt, Artificial Sequence
  TRAC targeting sequence
aaacuggacuggacauuuac

SEQ ID NO: 9529 - RNA, 20 nt, Artificial Sequence
  TRAC targeting sequence
aguuuggaaauggagcagcu

SEQ ID NO: 9530 - RNA, 20 nt, Artificial Sequence
  TRAC targeting sequence
aguccaguuuggaaauggag

SEQ ID NO: 9531 - RNA, 20 nt, Artificial Sequence
  TRAC targeting sequence
ugcagauacuaaaaaugaua

SEQ ID NO: 9532 - RNA, 20 nt, Artificial Sequence
  TRAC targeting sequence
gcaggacuguaaauguccag

SEQ ID NO: 9533 - RNA, 20 nt, Artificial Sequence
  TRAC targeting sequence
uuuuuaguaucugcaggacu

SEQ ID NO: 9534 - RNA, 20 nt, Artificial Sequence
  TRAC targeting sequence
ggaaaagcacacacaauucu

SEQ ID NO: 9535 - RNA, 20 nt, Artificial Sequence
  TRAC targeting sequence
ugauuaucauuuuuaguauc

SEQ ID NO: 9536 - RNA, 20 nt, Artificial Sequence
  TRAC targeting sequence
acuuuuucuuauaauuccca

SEQ ID NO: 9537 - RNA, 20 nt, Artificial Sequence
  TRAC targeting sequence
uauaauucccaucuuuccca

SEQ ID NO: 9538 - RNA, 20 nt, Artificial Sequence
  TRAC targeting sequence
caucuuucccaaagaacugu

SEQ ID NO: 9539 - RNA, 20 nt, Artificial Sequence
  TRAC targeting sequence
uucccaaagaacuguuauaa

SEQ ID NO: 9540 - RNA, 20 nt, Artificial Sequence
  TRAC targeting sequence
caaagaacuguuauaaauuc

SEQ ID NO: 9541 - RNA, 20 nt, Artificial Sequence
  TRAC targeting sequence
uugggaaagaugggaauuau

SEQ ID NO: 9542 - RNA, 20 nt, Artificial Sequence
  TRAC targeting sequence
cucccaaagguguuauauuc

SEQ ID NO: 9543 - RNA, 20 nt, Artificial Sequence
  TRAC targeting sequence
cccaaagguguuauauucau

SEQ ID NO: 9544 - RNA, 20 nt, Artificial Sequence
  TRAC targeting sequence
caaagguguuauauucaucc

SEQ ID NO: 9545 - RNA, 20 nt, Artificial Sequence
  TRAC targeting sequence
uccuucuuuuguugccucua

SEQ ID NO: 9546 - RNA, 20 nt, Artificial Sequence
  TRAC targeting sequence
uucuuuuguugccucuauuu

SEQ ID NO: 9547 - RNA, 20 nt, Artificial Sequence
  TRAC targeting sequence
uuuguugccucuauuuguga

SEQ ID NO: 9548 - RNA, 20 nt, Artificial Sequence
  TRAC targeting sequence
auuugugauguguacugagg

SEQ ID NO: 9549 - RNA, 20 nt, Artificial Sequence
  TRAC targeting sequence
caaauagaggcaacaaaaga

SEQ ID NO: 9550 - RNA, 20 nt, Artificial Sequence
  TRAC targeting sequence
guacacaucacaaauagagg

SEQ ID NO: 9551 - RNA, 20 nt, Artificial Sequence
  TRAC targeting sequence
ccucaguacacaucacaaau

SEQ ID NO: 9552 - RNA, 20 nt, Artificial Sequence
  TRAC targeting sequence
acaaauauuucaccucagua

SEQ ID NO: 9553 - RNA, 20 nt, Artificial Sequence
  TRAC targeting sequence
caacaaauauuucaccucag

SEQ ID NO: 9554 - RNA, 20 nt, Artificial Sequence
  TRAC targeting sequence
aaaaccccaugagauuuaac

SEQ ID NO: 9555 - RNA, 20 nt, Artificial Sequence
  TRAC targeting sequence
ugggguuuuugaaucucaac

SEQ ID NO: 9556 - RNA, 20 nt, Artificial Sequence
  TRAC targeting sequence
caugggguuuuugaaucuca

SEQ ID NO: 9557 - RNA, 20 nt, Artificial Sequence
  TRAC targeting sequence
cugucagagagauucuaaga

SEQ ID NO: 9558 - RNA, 20 nt, Artificial Sequence
  TRAC targeting sequence
gagagauucuaagagcuaaa

SEQ ID NO: 9559 - RNA, 20 nt, Artificial Sequence
  TRAC targeting sequence
gacagggaaagcuuaaguua

SEQ ID NO: 9560 - RNA, 20 nt, Artificial Sequence
  TRAC targeting sequence
cugacagggaaagcuuaagu

SEQ ID NO: 9561 - RNA, 20 nt, Artificial Sequence
  TRAC targeting sequence
cucugacagggaaagcuuaa

SEQ ID NO: 9562 - RNA, 20 nt, Artificial Sequence
  TRAC targeting sequence
aagagcuaaaagaugggaag

SEQ ID NO: 9563 - RNA, 20 nt, Artificial Sequence
  TRAC targeting sequence
uagaaucucucugacaggga

SEQ ID NO: 9564 - RNA, 20 nt, Artificial Sequence
  TRAC targeting sequence
uuuagcucuuagaaucucuc

SEQ ID NO: 9565 - RNA, 20 nt, Artificial Sequence
  TRAC targeting sequence
caucuuuuagcucuuagaau

SEQ ID NO: 9566 - RNA, 20 nt, Artificial Sequence
  TRAC targeting sequence
caaauaccagcuucccaucu

SEQ ID NO: 9567 - RNA, 20 nt, Artificial Sequence
  TRAC targeting sequence
aguucccaaauaccagcuuc

SEQ ID NO: 9568 - RNA, 20 nt, Artificial Sequence
  TRAC targeting sequence
uuuuaaucuaguucccaaau

SEQ ID NO: 9569 - RNA, 20 nt, Artificial Sequence
  TRAC targeting sequence
aaauuaaucccaaggagcaa

SEQ ID NO: 9570 - RNA, 20 nt, Artificial Sequence
  TRAC targeting sequence
caaggagcaaggcucaauag

SEQ ID NO: 9571 - RNA, 20 nt, Artificial Sequence
  TRAC targeting sequence
uugggauuaauuuggauuuu

SEQ ID NO: 9572 - RNA, 20 nt, Artificial Sequence
  TRAC targeting sequence
auagauaguuauuuagacau

SEQ ID NO: 9573 - RNA, 20 nt, Artificial Sequence
  TRAC targeting sequence
auugagccuugcuccuuggg

SEQ ID NO: 9574 - RNA, 20 nt, Artificial Sequence
  TRAC targeting sequence
aaauaacuaucuauugagcc

SEQ ID NO: 9575 - RNA, 20 nt, Artificial Sequence
  TRAC targeting sequence
acccugcaagccuaguugcu

SEQ ID NO: 9576 - RNA, 20 nt, Artificial Sequence
  TRAC targeting sequence
guugacugggcugccccuau

SEQ ID NO: 9577 - RNA, 20 nt, Artificial Sequence
  TRAC targeting sequence
acugagcaacuaggcuugca

SEQ ID NO: 9578 - RNA, 20 nt, Artificial Sequence
  TRAC targeting sequence
uagucuugccuggaagagaa

SEQ ID NO: 9579 - RNA, 20 nt, Artificial Sequence
  TRAC targeting sequence
ugccuggaagagaaauaagu

SEQ ID NO: 9580 - RNA, 20 nt, Artificial Sequence
  TRAC targeting sequence
aggcaagacuaagauagggg

SEQ ID NO: 9581 - RNA, 20 nt, Artificial Sequence
  TRAC targeting sequence
uccaggcaagacuaagauag

SEQ ID NO: 9582 - RNA, 20 nt, Artificial Sequence
  TRAC targeting sequence
cuuccaggcaagacuaagau

SEQ ID NO: 9583 - RNA, 20 nt, Artificial Sequence
  TRAC targeting sequence
ugagaaaugucagccuccag

SEQ ID NO: 9584 - RNA, 20 nt, Artificial Sequence
  TRAC targeting sequence
agacagguauggggcaaaca

SEQ ID NO: 9585 - RNA, 20 nt, Artificial Sequence
  TRAC targeting sequence
caagacagguauggggcaaa

SEQ ID NO: 9586 - RNA, 20 nt, Artificial Sequence
  TRAC targeting sequence
gccuccagaccugaaagcuu

SEQ ID NO: 9587 - RNA, 20 nt, Artificial Sequence
  TRAC targeting sequence
agaccugaaagcuucuugug

SEQ ID NO: 9588 - RNA, 20 nt, Artificial Sequence
  TRAC targeting sequence
ggaggcugacauuucucaag

SEQ ID NO: 9589 - RNA, 20 nt, Artificial Sequence
  TRAC targeting sequence
ggucuggaggcugacauuuc

SEQ ID NO: 9590 - RNA, 20 nt, Artificial Sequence
  TRAC targeting sequence
ugugauuugguuuauuucug

SEQ ID NO: 9591 - RNA, 20 nt, Artificial Sequence
  TRAC targeting sequence
caagaagcuuucaggucugg

SEQ ID NO: 9592 - RNA, 20 nt, Artificial Sequence
  TRAC targeting sequence
guagaguuuauuauuauaca

SEQ ID NO: 9593 - RNA, 20 nt, Artificial Sequence
  TRAC targeting sequence
acagaaauaaaccaaaucac

SEQ ID NO: 9594 - RNA, 20 nt, Artificial Sequence
  TRAC targeting sequence
ugaaguaauagagaagugca

SEQ ID NO: 9595 - RNA, 20 nt, Artificial Sequence
  TRAC targeting sequence
agaacacuguguauaauaau

SEQ ID NO: 9596 - RNA, 20 nt, Artificial Sequence
  TRAC targeting sequence
auuacuucaagaacacugug

SEQ ID NO: 9597 - RNA, 20 nt, Artificial Sequence
  TRAC targeting sequence
cuauuacuucaagaacacug

SEQ ID NO: 9598 - RNA, 20 nt, Artificial Sequence
  TRAC targeting sequence
aaugcacuucucuauuacuu

SEQ ID NO: 9599 - RNA, 20 nt, Artificial Sequence
  TRAC targeting sequence
ugcaaauggaaaugaaaugu

SEQ ID NO: 9600 - RNA, 20 nt, Artificial Sequence
  TRAC targeting sequence
auuugcaggagcuucuaaug

SEQ ID NO: 9601 - RNA, 20 nt, Artificial Sequence
  TRAC targeting sequence
uuuccauuugcaggagcuuc

SEQ ID NO: 9602 - RNA, 20 nt, Artificial Sequence
  TRAC targeting sequence
aaauuuacauuucauuucca

SEQ ID NO: 9603 - RNA, 20 nt, Artificial Sequence
  TRAC targeting sequence
uguauuuacaaucuaaauuu

SEQ ID NO: 9604 - RNA, 20 nt, Artificial Sequence
  TRAC targeting sequence
auuuaccgcagucauguauu

SEQ ID NO: 9605 - RNA, 20 nt, Artificial Sequence
  TRAC targeting sequence
ugcuaucuauuuaccgcagu

SEQ ID NO: 9606 - RNA, 20 nt, Artificial Sequence
  TRAC targeting sequence
uuuuucuugcuaucuauuua

SEQ ID NO: 9607 - RNA, 20 nt, Artificial Sequence
  TRAC targeting sequence
uccuuuuucuugcuaucuau

SEQ ID NO: 9608 - RNA, 20 nt, Artificial Sequence
  TRAC targeting sequence
ucauccuuuuucuugcuauc

SEQ ID NO: 9609 - RNA, 20 nt, Artificial Sequence
  TRAC targeting sequence
cuucauccuuuuucuugcua

SEQ ID NO: 9610 - RNA, 20 nt, Artificial Sequence
  TRAC targeting sequence
aaucucuucauccuuuuucu

SEQ ID NO: 9611 - RNA, 20 nt, Artificial Sequence
  TRAC targeting sequence
cuaacccuaaagggauguuu

SEQ ID NO: 9612 - RNA, 20 nt, Artificial Sequence
  TRAC targeting sequence
aacccuaaagggauguuucu

SEQ ID NO: 9613 - RNA, 20 nt, Artificial Sequence
  TRAC targeting sequence
cuuuaggguuagagaaaugu

SEQ ID NO: 9614 - RNA, 20 nt, Artificial Sequence
  TRAC targeting sequence
auaaauaguuuaaaacuguu

SEQ ID NO: 9615 - RNA, 20 nt, Artificial Sequence
  TRAC targeting sequence
acaguuuuaaacuauuuaua

SEQ ID NO: 9616 - RNA, 20 nt, Artificial Sequence
  TRAC targeting sequence
ucaacaguuuuaaacuauuu

SEQ ID NO: 9617 - RNA, 20 nt, Artificial Sequence
  TRAC targeting sequence
ucuucaacaguuuuaaacua

SEQ ID NO: 9618 - RNA, 20 nt, Artificial Sequence
  TRAC targeting sequence
cccuucgucuucaacaguuu

SEQ ID NO: 9619 - RNA, 20 nt, Artificial Sequence
  TRAC targeting sequence
ucccccuucgucuucaacag

SEQ ID NO: 9620 - RNA, 20 nt, Artificial Sequence
  TRAC targeting sequence
uccucccccuucgucuucaa

SEQ ID NO: 9621 - RNA, 20 nt, Artificial Sequence
  TRAC targeting sequence
uuccuccucccccuucgucu

SEQ ID NO: 9622 - RNA, 20 nt, Artificial Sequence
  TRAC targeting sequence
ccuuccuccucccccuucgu

SEQ ID NO: 9623 - RNA, 20 nt, Artificial Sequence
  TRAC targeting sequence
guucuccuuccuccuccccc

SEQ ID NO: 9624 - RNA, 20 nt, Artificial Sequence
  TRAC targeting sequence
guuugccucuguucuccuuc

SEQ ID NO: 9625 - RNA, 20 nt, Artificial Sequence
  TRAC targeting sequence
ccuaauccuuuccauuuggc

SEQ ID NO: 9626 - RNA, 20 nt, Artificial Sequence
  TRAC targeting sequence
uaauccuuuccauuuggcaa

SEQ ID NO: 9627 - RNA, 20 nt, Artificial Sequence
  TRAC targeting sequence
uuuccauuuggcaaaauuag

SEQ ID NO: 9628 - RNA, 20 nt, Artificial Sequence
  TRAC targeting sequence
auuuggcaaaauuagaaaug

SEQ ID NO: 9629 - RNA, 20 nt, Artificial Sequence
  TRAC targeting sequence
aauuuugccaaauggaaagg

SEQ ID NO: 9630 - RNA, 20 nt, Artificial Sequence
  TRAC targeting sequence
auuaaauuucccugagcaga

SEQ ID NO: 9631 - RNA, 20 nt, Artificial Sequence
  TRAC targeting sequence
cugagcagaggaagaaacca

SEQ ID NO: 9632 - RNA, 20 nt, Artificial Sequence
  TRAC targeting sequence
gggaaauuuaauugaaaaac

SEQ ID NO: 9633 - RNA, 20 nt, Artificial Sequence
  TRAC targeting sequence
gcucagggaaauuuaauuga

SEQ ID NO: 9634 - RNA, 20 nt, Artificial Sequence
  TRAC targeting sequence
ucugcucagggaaauuuaau

SEQ ID NO: 9635 - RNA, 20 nt, Artificial Sequence
  TRAC targeting sequence
uccucugcucagggaaauuu

SEQ ID NO: 9636 - RNA, 20 nt, Artificial Sequence
  TRAC targeting sequence
guuuccacacuaaaauuccu

SEQ ID NO: 9637 - RNA, 20 nt, Artificial Sequence
  TRAC targeting sequence
acacuaaaauuccugugggu

SEQ ID NO: 9638 - RNA, 20 nt, Artificial Sequence
  TRAC targeting sequence
ugugggugggagucucuaga

SEQ ID NO: 9639 - RNA, 20 nt, Artificial Sequence
  TRAC targeting sequence
cacccacaggaauuuuagug

SEQ ID NO: 9640 - RNA, 20 nt, Artificial Sequence
  TRAC targeting sequence
cuagaguugauuuggaggau

SEQ ID NO: 9641 - RNA, 20 nt, Artificial Sequence
  TRAC targeting sequence
agaguugauuuggaggaugg

SEQ ID NO: 9642 - RNA, 20 nt, Artificial Sequence
  TRAC targeting sequence
agagacucccacccacagga

SEQ ID NO: 9643 - RNA, 20 nt, Artificial Sequence
  TRAC targeting sequence
acucuagagacucccaccca

SEQ ID NO: 9644 - RNA, 20 nt, Artificial Sequence
  TRAC targeting sequence
aaaucaacucuagagacucc

SEQ ID NO: 9645 - RNA, 20 nt, Artificial Sequence
  TRAC targeting sequence
uccaaaucaacucuagagac

SEQ ID NO: 9646 - RNA, 20 nt, Artificial Sequence
  TRAC targeting sequence
auccuccaaaucaacucuag

SEQ ID NO: 9647 - RNA, 20 nt, Artificial Sequence
  TRAC targeting sequence
cuguuagugacaagugcugg

SEQ ID NO: 9648 - RNA, 20 nt, Artificial Sequence
  TRAC targeting sequence
cuaacagggauccauccucc

SEQ ID NO: 9649 - RNA, 20 nt, Artificial Sequence
  TRAC targeting sequence
uguuggggaaaggggaugag

SEQ ID NO: 9650 - RNA, 20 nt, Artificial Sequence
  TRAC targeting sequence
ccaacaggagcauuaccagc

SEQ ID NO: 9651 - RNA, 20 nt, Artificial Sequence
  TRAC targeting sequence
ccuuuccccaacaggagcau

SEQ ID NO: 9652 - RNA, 20 nt, Artificial Sequence
  TRAC targeting sequence
uccccuuuccccaacaggag

SEQ ID NO: 9653 - RNA, 20 nt, Artificial Sequence
  TRAC targeting sequence
aaguaaguguggagggacaa

SEQ ID NO: 9654 - RNA, 20 nt, Artificial Sequence
  TRAC targeting sequence
acacuuacuuggauuuauuu

SEQ ID NO: 9655 - RNA, 20 nt, Artificial Sequence
  TRAC targeting sequence
cuccacacuuacuuggauuu

SEQ ID NO: 9656 - RNA, 20 nt, Artificial Sequence
  TRAC targeting sequence
ugucccuccacacuuacuug

SEQ ID NO: 9657 - RNA, 20 nt, Artificial Sequence
  TRAC targeting sequence
ucuugucccuccacacuuac

SEQ ID NO: 9658 - RNA, 20 nt, Artificial Sequence
  TRAC targeting sequence
cacagugcaggauuuccccu

SEQ ID NO: 9659 - RNA, 20 nt, Artificial Sequence
  TRAC targeting sequence
cagugcaggauuuccccugg

SEQ ID NO: 9660 - RNA, 20 nt, Artificial Sequence
  TRAC targeting sequence
ugcacugugagaucuucuug

SEQ ID NO: 9661 - RNA, 20 nt, Artificial Sequence
  TRAC targeting sequence
ccuggauuuucugcauugcc

SEQ ID NO: 9662 - RNA, 20 nt, Artificial Sequence
  TRAC targeting sequence
aggggaaauccugcacugug

SEQ ID NO: 9663 - RNA, 20 nt, Artificial Sequence
  TRAC targeting sequence
gcauugccuuuucaccuuuc

SEQ ID NO: 9664 - RNA, 20 nt, Artificial Sequence
  TRAC targeting sequence
ccuuuccugucuuagcacga

SEQ ID NO: 9665 - RNA, 20 nt, Artificial Sequence
  TRAC targeting sequence
ugucuuagcacgacaaauua

SEQ ID NO: 9666 - RNA, 20 nt, Artificial Sequence
  TRAC targeting sequence
uagcacgacaaauuaggucc

SEQ ID NO: 9667 - RNA, 20 nt, Artificial Sequence
  TRAC targeting sequence
ugcuaagacaggaaagguga

SEQ ID NO: 9668 - RNA, 20 nt, Artificial Sequence
  TRAC targeting sequence
cagaugagcaggcccucgca

SEQ ID NO: 9669 - RNA, 20 nt, Artificial Sequence
  TRAC targeting sequence
gggaccuaauuugucgugcu

SEQ ID NO: 9670 - RNA, 20 nt, Artificial Sequence
  TRAC targeting sequence
ucugggaccuaauuugucgu

SEQ ID NO: 9671 - RNA, 20 nt, Artificial Sequence
  TRAC targeting sequence
cauucaaaccggaaauuuua

SEQ ID NO: 9672 - RNA, 20 nt, Artificial Sequence
  TRAC targeting sequence
aaccggaaauuuuaaggagg

SEQ ID NO: 9673 - RNA, 20 nt, Artificial Sequence
  TRAC targeting sequence
gguuugaaugcgagggccug

SEQ ID NO: 9674 - RNA, 20 nt, Artificial Sequence
  TRAC targeting sequence
uuaaaauuuccgguuugaau

SEQ ID NO: 9675 - RNA, 20 nt, Artificial Sequence
  TRAC targeting sequence
uccuuaaaauuuccgguuug

SEQ ID NO: 9676 - RNA, 20 nt, Artificial Sequence
  TRAC targeting sequence
ggcuuccuccuuaaaauuuc

SEQ ID NO: 9677 - RNA, 20 nt, Artificial Sequence
  TRAC targeting sequence
ggagaccuaguagacucuga

SEQ ID NO: 9678 - RNA, 20 nt, Artificial Sequence
  TRAC targeting sequence
cgaguaaaguuaaucuggcu

SEQ ID NO: 9679 - RNA, 20 nt, Artificial Sequence
  TRAC targeting sequence
cccgaguaaaguuaaucugg

SEQ ID NO: 9680 - RNA, 20 nt, Artificial Sequence
  TRAC targeting sequence
acuaggucucccgaguaaag

SEQ ID NO: 9681 - RNA, 20 nt, Artificial Sequence
  TRAC targeting sequence
gacuuuaaagauucuuuuaa

SEQ ID NO: 9682 - RNA, 20 nt, Artificial Sequence
  TRAC targeting sequence
gagucuacuaggucucccga

SEQ ID NO: 9683 - RNA, 20 nt, Artificial Sequence
  TRAC targeting sequence
uuaaagucagagucuacuag

SEQ ID NO: 9684 - RNA, 20 nt, Artificial Sequence
  TRAC targeting sequence
uuuaauccagcuguuuuuag

SEQ ID NO: 9685 - RNA, 20 nt, Artificial Sequence
  TRAC targeting sequence
agcuguuuuuagggagagcu

SEQ ID NO: 9686 - RNA, 20 nt, Artificial Sequence
  TRAC targeting sequence
cuaaaaacagcuggauuaaa

SEQ ID NO: 9687 - RNA, 20 nt, Artificial Sequence
  TRAC targeting sequence
cccuaaaaacagcuggauua

SEQ ID NO: 9688 - RNA, 20 nt, Artificial Sequence
  TRAC targeting sequence
guaaaagaugaaagaaaugu

SEQ ID NO: 9689 - RNA, 20 nt, Artificial Sequence
  TRAC targeting sequence
uuuacagagcucucccuaaa

SEQ ID NO: 9690 - RNA, 20 nt, Artificial Sequence
  TRAC targeting sequence
ucuuuuacagagcucucccu

SEQ ID NO: 9691 - RNA, 20 nt, Artificial Sequence
  TRAC targeting sequence
uucaucuuuuacagagcucu

SEQ ID NO: 9692 - RNA, 20 nt, Artificial Sequence
  TRAC targeting sequence
guggggugaaaacaaagaug

SEQ ID NO: 9693 - RNA, 20 nt, Artificial Sequence
  TRAC targeting sequence
ccccacagaauuuuaauuuu

SEQ ID NO: 9694 - RNA, 20 nt, Artificial Sequence
  TRAC targeting sequence
uuguuuucaccccacagaau

SEQ ID NO: 9695 - RNA, 20 nt, Artificial Sequence
  TRAC targeting sequence
aauauuuaacaucuuuguuu

SEQ ID NO: 9696 - RNA, 20 nt, Artificial Sequence
  TRAC targeting sequence
aguugccuugccaaucaaau

SEQ ID NO: 9697 - RNA, 20 nt, Artificial Sequence
  TRAC targeting sequence
ggaccaugucuacaacugcu

SEQ ID NO: 9698 - RNA, 20 nt, Artificial Sequence
  TRAC targeting sequence
agauuuuccaguugccuugc

SEQ ID NO: 9699 - RNA, 20 nt, Artificial Sequence
  TRAC targeting sequence
acaacugcuaaaggaggcuu

SEQ ID NO: 9700 - RNA, 20 nt, Artificial Sequence
  TRAC targeting sequence
uuuagcaguuguagacaugg

SEQ ID NO: 9701 - RNA, 20 nt, Artificial Sequence
  TRAC targeting sequence
caaagccuccuuuagcaguu

SEQ ID NO: 9702 - RNA, 20 nt, Artificial Sequence
  TRAC targeting sequence
uucacaaagccuccuuuagc

SEQ ID NO: 9703 - RNA, 20 nt, Artificial Sequence
  TRAC targeting sequence
cuuucacaaagccuccuuua

SEQ ID NO: 9704 - RNA, 20 nt, Artificial Sequence
  TRAC targeting sequence
uuuucucuuucacaaagccu

SEQ ID NO: 9705 - RNA, 20 nt, Artificial Sequence
  TRAC targeting sequence
uugggcugcucauuuucucu

SEQ ID NO: 9706 - RNA, 20 nt, Artificial Sequence
  TRAC targeting sequence
ccuugggcugcucauuuucu

SEQ ID NO: 9707 - RNA, 20 nt, Artificial Sequence
  TRAC targeting sequence
uguccuaaacuucucuggcc

SEQ ID NO: 9708 - RNA, 20 nt, Artificial Sequence
  TRAC targeting sequence
uaaacuucucuggccaguga

SEQ ID NO: 9709 - RNA, 20 nt, Artificial Sequence
  TRAC targeting sequence
cuggccagugaaauucgggc

SEQ ID NO: 9710 - RNA, 20 nt, Artificial Sequence
  TRAC targeting sequence
ggccagugaaauucgggcca

SEQ ID NO: 9711 - RNA, 20 nt, Artificial Sequence
  TRAC targeting sequence
cuggccagagaaguuuagga

SEQ ID NO: 9712 - RNA, 20 nt, Artificial Sequence
  TRAC targeting sequence
ggccauucucugccacagcc

SEQ ID NO: 9713 - RNA, 20 nt, Artificial Sequence
  TRAC targeting sequence
cugccacagcccuggacugc

SEQ ID NO: 9714 - RNA, 20 nt, Artificial Sequence
  TRAC targeting sequence
gccacagcccuggacugcua

SEQ ID NO: 9715 - RNA, 20 nt, Artificial Sequence
  TRAC targeting sequence
agggcuguggcagagaaugg

SEQ ID NO: 9716 - RNA, 20 nt, Artificial Sequence
  TRAC targeting sequence
uagcaguccagggcuguggc

SEQ ID NO: 9717 - RNA, 20 nt, Artificial Sequence
  TRAC targeting sequence
gcccuccuagcaguccaggg

SEQ ID NO: 9718 - RNA, 20 nt, Artificial Sequence
  TRAC targeting sequence
uaugucuuccucagugggga

SEQ ID NO: 9719 - RNA, 20 nt, Artificial Sequence
  TRAC targeting sequence
uccucaguggggagaggugg

SEQ ID NO: 9720 - RNA, 20 nt, Artificial Sequence
  TRAC targeting sequence
ucaguggggagaggugggcc

SEQ ID NO: 9721 - RNA, 20 nt, Artificial Sequence
  TRAC targeting sequence
guggggagaggugggcccuc

SEQ ID NO: 9722 - RNA, 20 nt, Artificial Sequence
  TRAC targeting sequence
ccacugaggaagacauauga

SEQ ID NO: 9723 - RNA, 20 nt, Artificial Sequence
  TRAC targeting sequence
ccccacugaggaagacauau

SEQ ID NO: 9724 - RNA, 20 nt, Artificial Sequence
  TRAC targeting sequence
cuggcaguuucuguaaagcc

SEQ ID NO: 9725 - RNA, 20 nt, Artificial Sequence
  TRAC targeting sequence
guaaagccucgugcuguggu

SEQ ID NO: 9726 - RNA, 20 nt, Artificial Sequence
  TRAC targeting sequence
ugcugugguguaauucaggg

SEQ ID NO: 9727 - RNA, 20 nt, Artificial Sequence
  TRAC targeting sequence
gggagcccagaagcugguau

SEQ ID NO: 9728 - RNA, 20 nt, Artificial Sequence
  TRAC targeting sequence
cugaauuacaccacagcacg

SEQ ID NO: 9729 - RNA, 20 nt, Artificial Sequence
  TRAC targeting sequence
gggcucccugaauuacacca

SEQ ID NO: 9730 - RNA, 20 nt, Artificial Sequence
  TRAC targeting sequence
uuggccaaauaccagcuucu

SEQ ID NO: 9731 - RNA, 20 nt, Artificial Sequence
  TRAC targeting sequence
gccugguuccuuggccaaau

SEQ ID NO: 9732 - RNA, 20 nt, Artificial Sequence
  TRAC targeting sequence
acccaaguaaguaugacagg

SEQ ID NO: 9733 - RNA, 20 nt, Artificial Sequence
  TRAC targeting sequence
uacuuacuuggguugauagu

SEQ ID NO: 9734 - RNA, 20 nt, Artificial Sequence
  TRAC targeting sequence
cccugucauacuuacuuggg

SEQ ID NO: 9735 - RNA, 20 nt, Artificial Sequence
  TRAC targeting sequence
gcugcauguagcuucacccu

SEQ ID NO: 9736 - RNA, 20 nt, Artificial Sequence
  TRAC targeting sequence
uuuccuuucuagaccguguc

SEQ ID NO: 9737 - RNA, 20 nt, Artificial Sequence
  TRAC targeting sequence
uuucuagaccguguccugca

SEQ ID NO: 9738 - RNA, 20 nt, Artificial Sequence
  TRAC targeting sequence
agaccguguccugcaagcuc

SEQ ID NO: 9739 - RNA, 20 nt, Artificial Sequence
  TRAC targeting sequence
agaaaggaaaagacuguacu

SEQ ID NO: 9740 - RNA, 20 nt, Artificial Sequence
  TRAC targeting sequence
ugcaagcucuccuugaggga

SEQ ID NO: 9741 - RNA, 20 nt, Artificial Sequence
  TRAC targeting sequence
ccuugagggacguauacuca

SEQ ID NO: 9742 - RNA, 20 nt, Artificial Sequence
  TRAC targeting sequence
uugagggacguauacucauu

SEQ ID NO: 9743 - RNA, 20 nt, Artificial Sequence
  TRAC targeting sequence
aggagagcuugcaggacacg

SEQ ID NO: 9744 - RNA, 20 nt, Artificial Sequence
  TRAC targeting sequence
cucaaggagagcuugcagga

SEQ ID NO: 9745 - RNA, 20 nt, Artificial Sequence
  TRAC targeting sequence
uuuugcauuguccuuuguag

SEQ ID NO: 9746 - RNA, 20 nt, Artificial Sequence
  TRAC targeting sequence
uuuguagagaagcagaccag

SEQ ID NO: 9747 - RNA, 20 nt, Artificial Sequence
  TRAC targeting sequence
acaaaggacaaugcaaaaug

SEQ ID NO: 9748 - RNA, 20 nt, Artificial Sequence
  TRAC targeting sequence
cuacaaaggacaaugcaaaa

SEQ ID NO: 9749 - RNA, 20 nt, Artificial Sequence
  TRAC targeting sequence
gcuucucuacaaaggacaau

SEQ ID NO: 9750 - RNA, 20 nt, Artificial Sequence
  TRAC targeting sequence
uggucugcuucucuacaaag

SEQ ID NO: 9751 - RNA, 20 nt, Artificial Sequence
  TRAC targeting sequence
uuccuggucugcuucucuac

SEQ ID NO: 9752 - RNA, 20 nt, Artificial Sequence
  TRAC targeting sequence
ugucuuuccuggucugcuuc

SEQ ID NO: 9753 - RNA, 20 nt, Artificial Sequence
  TRAC targeting sequence
aauuuccacuuuuaaacacc

SEQ ID NO: 9754 - RNA, 20 nt, Artificial Sequence
  TRAC targeting sequence
acuuuuaaacaccucccugu

SEQ ID NO: 9755 - RNA, 20 nt, Artificial Sequence
  TRAC targeting sequence
cuguaaaaacugucucgcuu

SEQ ID NO: 9756 - RNA, 20 nt, Artificial Sequence
  TRAC targeting sequence
cgcuucccuccccuucuaca

SEQ ID NO: 9757 - RNA, 20 nt, Artificial Sequence
  TRAC targeting sequence
cuucccuccccuucuacaau

SEQ ID NO: 9758 - RNA, 20 nt, Artificial Sequence
  TRAC targeting sequence
cuccccuucuacaaucaguu

SEQ ID NO: 9759 - RNA, 20 nt, Artificial Sequence
  TRAC targeting sequence
ccuucuacaaucaguuucua

SEQ ID NO: 9760 - RNA, 20 nt, Artificial Sequence
  TRAC targeting sequence
acaaucaguuucuaguaaau

SEQ ID NO: 9761 - RNA, 20 nt, Artificial Sequence
  TRAC targeting sequence
guuucuaguaaaucagaauc

SEQ ID NO: 9762 - RNA, 20 nt, Artificial Sequence
  TRAC targeting sequence
aguaaaucagaauccgguga

SEQ ID NO: 9763 - RNA, 20 nt, Artificial Sequence
  TRAC targeting sequence
gaauccggugaauugauaug

SEQ ID NO: 9764 - RNA, 20 nt, Artificial Sequence
  TRAC targeting sequence
gauuuacuagaaacugauug

SEQ ID NO: 9765 - RNA, 20 nt, Artificial Sequence
  TRAC targeting sequence
ggugaauugauaugcaauuu

SEQ ID NO: 9766 - RNA, 20 nt, Artificial Sequence
  TRAC targeting sequence
ccggauucugauuuacuaga

SEQ ID NO: 9767 - RNA, 20 nt, Artificial Sequence
  TRAC targeting sequence
auucaccggauucugauuua

SEQ ID NO: 9768 - RNA, 20 nt, Artificial Sequence
  TRAC targeting sequence
acgaaaaaaaaagcagagaa

SEQ ID NO: 9769 - RNA, 20 nt, Artificial Sequence
  TRAC targeting sequence
uugaaauugcauaucaauuc

SEQ ID NO: 9770 - RNA, 20 nt, Artificial Sequence
  TRAC targeting sequence
gcuuuuuuuuucguugaaau

SEQ ID NO: 9771 - RNA, 20 nt, Artificial Sequence
  TRAC targeting sequence
cugcuuuuuuuuucguugaa

SEQ ID NO: 9772 - RNA, 20 nt, Artificial Sequence
  TRAC targeting sequence
acuuuuugcacuuguugggg

SEQ ID NO: 9773 - RNA, 20 nt, Artificial Sequence
  TRAC targeting sequence
gaguaccagccaagggaaga

SEQ ID NO: 9774 - RNA, 20 nt, Artificial Sequence
  TRAC targeting sequence
gauaguuucuacuuuuugca

SEQ ID NO: 9775 - RNA, 20 nt, Artificial Sequence
  TRAC targeting sequence
cuuggcugguacucagauag

SEQ ID NO: 9776 - RNA, 20 nt, Artificial Sequence
  TRAC targeting sequence
ucccuuggcugguacucaga

SEQ ID NO: 9777 - RNA, 20 nt, Artificial Sequence
  TRAC targeting sequence
uaauuaucuucccuuggcug

SEQ ID NO: 9778 - RNA, 20 nt, Artificial Sequence
  TRAC targeting sequence
uuccuaauuaucuucccuug

SEQ ID NO: 9779 - RNA, 20 nt, Artificial Sequence
  TRAC targeting sequence
uuuuuuuucuuuccuaauua

SEQ ID NO: 9780 - RNA, 20 nt, Artificial Sequence
  TRAC targeting sequence
uucuuuuuuuuucuuuccua

SEQ ID NO: 9781 - RNA, 20 nt, Artificial Sequence
  TRAC targeting sequence
auuucuuucuuuuuuuuucu

SEQ ID NO: 9782 - RNA, 20 nt, Artificial Sequence
  TRAC targeting sequence
aguaauccauuucuuucuuu

SEQ ID NO: 9783 - RNA, 20 nt, Artificial Sequence
  TRAC targeting sequence
ugguuccaguaauccauuuc

SEQ ID NO: 9784 - RNA, 20 nt, Artificial Sequence
  TRAC targeting sequence
caaagaaaaugauaaaaaaa

SEQ ID NO: 9785 - RNA, 20 nt, Artificial Sequence
  TRAC targeting sequence
uugugacuaagcugccauca

SEQ ID NO: 9786 - RNA, 20 nt, Artificial Sequence
  TRAC targeting sequence
uuuucuuugugacuaagcug

SEQ ID NO: 9787 - RNA, 20 nt, Artificial Sequence
  TRAC targeting sequence
aaaacuuuaaagauauauac

SEQ ID NO: 9788 - RNA, 20 nt, Artificial Sequence
  TRAC targeting sequence
uuaaaguuuuugaaauuuaa

SEQ ID NO: 9789 - RNA, 20 nt, Artificial Sequence
  TRAC targeting sequence
auauauauaugauauauugu

SEQ ID NO: 9790 - RNA, 20 nt, Artificial Sequence
  TRAC targeting sequence
uauauauauagauauauaua

SEQ ID NO: 9791 - RNA, 20 nt, Artificial Sequence
  TRAC targeting sequence
ucuggaacuccagcacucac

SEQ ID NO: 9792 - RNA, 20 nt, Artificial Sequence
  TRAC targeting sequence
ggaacuccagcacucaccua

SEQ ID NO: 9793 - RNA, 20 nt, Artificial Sequence
  TRAC targeting sequence
agaggacaauauaucauaua

SEQ ID NO: 9794 - RNA, 20 nt, Artificial Sequence
  TRAC targeting sequence
agcacucaccuacagcagcu

SEQ ID NO: 9795 - RNA, 20 nt, Artificial Sequence
  TRAC targeting sequence
ccuacagcagcugcauucug

SEQ ID NO: 9796 - RNA, 20 nt, Artificial Sequence
  TRAC targeting sequence
ggacuuauuaucaaauaacc

SEQ ID NO: 9797 - RNA, 20 nt, Artificial Sequence
  TRAC targeting sequence
agaaugcagcugcuguaggu

SEQ ID NO: 9798 - RNA, 20 nt, Artificial Sequence
  TRAC targeting sequence
aauaaccuauaaaccuguag

SEQ ID NO: 9799 - RNA, 20 nt, Artificial Sequence
  TRAC targeting sequence
uuaagcuacagguuuauagg

SEQ ID NO: 9800 - RNA, 20 nt, Artificial Sequence
  TRAC targeting sequence
ucauuaagcuacagguuuau

SEQ ID NO: 9801 - RNA, 20 nt, Artificial Sequence
  TRAC targeting sequence
acucuucauuaagcuacagg

SEQ ID NO: 9802 - RNA, 20 nt, Artificial Sequence
  TRAC targeting sequence
ugacuauauugacccccagg

SEQ ID NO: 9803 - RNA, 20 nt, Artificial Sequence
  TRAC targeting sequence
cgauugcucaacucuucauu

SEQ ID NO: 9804 - RNA, 20 nt, Artificial Sequence
  TRAC targeting sequence
auauagucacgauugcucaa

SEQ ID NO: 9805 - RNA, 20 nt, Artificial Sequence
  TRAC targeting sequence
ugggggucaauauagucacg

SEQ ID NO: 9806 - RNA, 20 nt, Artificial Sequence
  TRAC targeting sequence
gcaaagagcagcuucuguuc

SEQ ID NO: 9807 - RNA, 20 nt, Artificial Sequence
  TRAC targeting sequence
uugcagaaggguccuggggg

SEQ ID NO: 9808 - RNA, 20 nt, Artificial Sequence
  TRAC targeting sequence
guuccuguuucuguaaagcc

SEQ ID NO: 9809 - RNA, 20 nt, Artificial Sequence
  TRAC targeting sequence
uguuucuguaaagccuucug

SEQ ID NO: 9810 - RNA, 20 nt, Artificial Sequence
  TRAC targeting sequence
guaaagccuucuguggcugu

SEQ ID NO: 9811 - RNA, 20 nt, Artificial Sequence
  TRAC targeting sequence
guggcugugagaauagugga

SEQ ID NO: 9812 - RNA, 20 nt, Artificial Sequence
  TRAC targeting sequence
cagccacagaaggcuuuaca

SEQ ID NO: 9813 - RNA, 20 nt, Artificial Sequence
  TRAC targeting sequence
cacagccacagaaggcuuua

SEQ ID NO: 9814 - RNA, 20 nt, Artificial Sequence
  TRAC targeting sequence
acuauucucacagccacaga

SEQ ID NO: 9815 - RNA, 20 nt, Artificial Sequence
  TRAC targeting sequence
guuuauaguugcuaccucca

SEQ ID NO: 9816 - RNA, 20 nt, Artificial Sequence
  TRAC targeting sequence
aaaugucaguuuauaguugc

SEQ ID NO: 9817 - RNA, 20 nt, Artificial Sequence
  TRAC targeting sequence
uuuuccaaaugucaguuuau

SEQ ID NO: 9818 - RNA, 20 nt, Artificial Sequence
  TRAC targeting sequence
cuuaaccgugaauccaagua

SEQ ID NO: 9819 - RNA, 20 nt, Artificial Sequence
  TRAC targeting sequence
uaaccgugaauccaaguaag

SEQ ID NO: 9820 - RNA, 20 nt, Artificial Sequence
  TRAC targeting sequence
cgguuaagagaguuccuuuu

SEQ ID NO: 9821 - RNA, 20 nt, Artificial Sequence
  TRAC targeting sequence
aaguaaguuugaagggagug

SEQ ID NO: 9822 - RNA, 20 nt, Artificial Sequence
  TRAC targeting sequence
aacuuacuuggauucacggu

SEQ ID NO: 9823 - RNA, 20 nt, Artificial Sequence
  TRAC targeting sequence
cuucaaacuuacuuggauuc

SEQ ID NO: 9824 - RNA, 20 nt, Artificial Sequence
  TRAC targeting sequence
cccacucccuucaaacuuac

SEQ ID NO: 9825 - RNA, 20 nt, Artificial Sequence
  TRAC targeting sequence
cccuucccccacucccuuca

SEQ ID NO: 9826 - RNA, 20 nt, Artificial Sequence
  TRAC targeting sequence
aacacuucugauuuaauuac

SEQ ID NO: 9827 - RNA, 20 nt, Artificial Sequence
  TRAC targeting sequence
gauuuaauuacuugccccuc

SEQ ID NO: 9828 - RNA, 20 nt, Artificial Sequence
  TRAC targeting sequence
gaaguguuugaauucccccu

SEQ ID NO: 9829 - RNA, 20 nt, Artificial Sequence
  TRAC targeting sequence
aaaacauuccagcuuagguu

SEQ ID NO: 9830 - RNA, 20 nt, Artificial Sequence
  TRAC targeting sequence
agcuuagguuccaaaucuaa

SEQ ID NO: 9831 - RNA, 20 nt, Artificial Sequence
  TRAC targeting sequence
aaaucuaauguuugugcugg

SEQ ID NO: 9832 - RNA, 20 nt, Artificial Sequence
  TRAC targeting sequence
aauguuugugcuggggggau

SEQ ID NO: 9833 - RNA, 20 nt, Artificial Sequence
  TRAC targeting sequence
ccccagcacaaacauuagau

SEQ ID NO: 9834 - RNA, 20 nt, Artificial Sequence
  TRAC targeting sequence
gagggauuagaacuccacug

SEQ ID NO: 9835 - RNA, 20 nt, Artificial Sequence
  TRAC targeting sequence
gaugggcaccauaucccccc

SEQ ID NO: 9836 - RNA, 20 nt, Artificial Sequence
  TRAC targeting sequence
cucugaugggcaccauaucc

SEQ ID NO: 9837 - RNA, 20 nt, Artificial Sequence
  TRAC targeting sequence
aaucccucugaugggcacca

SEQ ID NO: 9838 - RNA, 20 nt, Artificial Sequence
  TRAC targeting sequence
acuguacaaagacuaaauua

SEQ ID NO: 9839 - RNA, 20 nt, Artificial Sequence
  TRAC targeting sequence
uuguacaguggaguucuaau

SEQ ID NO: 9840 - RNA, 20 nt, Artificial Sequence
  TRAC targeting sequence
gcccaaaacauuccuaucau

SEQ ID NO: 9841 - RNA, 20 nt, Artificial Sequence
  TRAC targeting sequence
uaucauucaucuuaaacaag

SEQ ID NO: 9842 - RNA, 20 nt, Artificial Sequence
  TRAC targeting sequence
uucaucuuaaacaagauuau

SEQ ID NO: 9843 - RNA, 20 nt, Artificial Sequence
  TRAC targeting sequence
ucuuaaacaagauuauuggu

SEQ ID NO: 9844 - RNA, 20 nt, Artificial Sequence
  TRAC targeting sequence
uaaacaagauuauuggugca

SEQ ID NO: 9845 - RNA, 20 nt, Artificial Sequence
  TRAC targeting sequence
uguuuaagaugaaugauagg

SEQ ID NO: 9846 - RNA, 20 nt, Artificial Sequence
  TRAC targeting sequence
uugcaccaauaaucuuguuu

SEQ ID NO: 9847 - RNA, 20 nt, Artificial Sequence
  TRAC targeting sequence
ccuugcaccaauaaucuugu

SEQ ID NO: 9848 - RNA, 20 nt, Artificial Sequence
  TRAC targeting sequence
guuuuucuccuugcaccaau

SEQ ID NO: 9849 - RNA, 20 nt, Artificial Sequence
  TRAC targeting sequence
guauucaguuuuucuccuug

SEQ ID NO: 9850 - RNA, 20 nt, Artificial Sequence
  TRAC targeting sequence
ugagggauccagcuaagggu

SEQ ID NO: 9851 - RNA, 20 nt, Artificial Sequence
  TRAC targeting sequence
ggauucuguauucaguuuuu

SEQ ID NO: 9852 - RNA, 20 nt, Artificial Sequence
  TRAC targeting sequence
cucaggauucuguauucagu

SEQ ID NO: 9853 - RNA, 20 nt, Artificial Sequence
  TRAC targeting sequence
agcuaagggucaggaaaugu

SEQ ID NO: 9854 - RNA, 20 nt, Artificial Sequence
  TRAC targeting sequence
ggaaauguuugccgaaaaga

SEQ ID NO: 9855 - RNA, 20 nt, Artificial Sequence
  TRAC targeting sequence
ugacccuuagcuggaucccu

SEQ ID NO: 9856 - RNA, 20 nt, Artificial Sequence
  TRAC targeting sequence
gcaaacauuuccugacccuu

SEQ ID NO: 9857 - RNA, 20 nt, Artificial Sequence
  TRAC targeting sequence
uuucggcaaacauuuccuga

SEQ ID NO: 9858 - RNA, 20 nt, Artificial Sequence
  TRAC targeting sequence
uuaucuuuucggcaaacauu

SEQ ID NO: 9859 - RNA, 20 nt, Artificial Sequence
  TRAC targeting sequence
ucuuuaucuuuucggcaaac

SEQ ID NO: 9860 - RNA, 20 nt, Artificial Sequence
  TRAC targeting sequence
ugacuacgcaaaugcaguag

SEQ ID NO: 9861 - RNA, 20 nt, Artificial Sequence
  TRAC targeting sequence
cgauaugccaauuuccucuu

SEQ ID NO: 9862 - RNA, 20 nt, Artificial Sequence
  TRAC targeting sequence
acugcauuugcguagucacg

SEQ ID NO: 9863 - RNA, 20 nt, Artificial Sequence
  TRAC targeting sequence
ugacuuagauacuaacacuc

SEQ ID NO: 9864 - RNA, 20 nt, Artificial Sequence
  TRAC targeting sequence
ggacaauuuauauuuggucu

SEQ ID NO: 9865 - RNA, 20 nt, Artificial Sequence
  TRAC targeting sequence
aagucaggacaauuuauauu

SEQ ID NO: 9866 - RNA, 20 nt, Artificial Sequence
  TRAC targeting sequence
ucuuaaauuuaucgccugaa

SEQ ID NO: 9867 - RNA, 20 nt, Artificial Sequence
  TRAC targeting sequence
uaaauuuaucgccugaaaua

SEQ ID NO: 9868 - RNA, 20 nt, Artificial Sequence
  TRAC targeting sequence
ccugaaauaauggaacccug

SEQ ID NO: 9869 - RNA, 20 nt, Artificial Sequence
  TRAC targeting sequence
ggcgauaaauuuaagaggag

SEQ ID NO: 9870 - RNA, 20 nt, Artificial Sequence
  TRAC targeting sequence
auuauuucaggcgauaaauu

SEQ ID NO: 9871 - RNA, 20 nt, Artificial Sequence
  TRAC targeting sequence
uuaacuaaugcugaaaauuc

SEQ ID NO: 9872 - RNA, 20 nt, Artificial Sequence
  TRAC targeting sequence
gcauuaguuaaugaaguugc

SEQ ID NO: 9873 - RNA, 20 nt, Artificial Sequence
  TRAC targeting sequence
auaagcaggcuccuuuucuu

SEQ ID NO: 9874 - RNA, 20 nt, Artificial Sequence
  TRAC targeting sequence
uuuucuucuuuuaccuucac

SEQ ID NO: 9875 - RNA, 20 nt, Artificial Sequence
  TRAC targeting sequence
ucuuuuaccuucacuuuacc

SEQ ID NO: 9876 - RNA, 20 nt, Artificial Sequence
  TRAC targeting sequence
uuuaccuucacuuuaccucu

SEQ ID NO: 9877 - RNA, 20 nt, Artificial Sequence
  TRAC targeting sequence
cuuuaccucucugaaaagaa

SEQ ID NO: 9878 - RNA, 20 nt, Artificial Sequence
  TRAC targeting sequence
cugaaaagaacuguucucaa

SEQ ID NO: 9879 - RNA, 20 nt, Artificial Sequence
  TRAC targeting sequence
gaaaagaacuguucucaauc

SEQ ID NO: 9880 - RNA, 20 nt, Artificial Sequence
  TRAC targeting sequence
gagagguaaagugaagguaa

SEQ ID NO: 9881 - RNA, 20 nt, Artificial Sequence
  TRAC targeting sequence
uuucagagagguaaagugaa

SEQ ID NO: 9882 - RNA, 20 nt, Artificial Sequence
  TRAC targeting sequence
caauccccagucugguaacu

SEQ ID NO: 9883 - RNA, 20 nt, Artificial Sequence
  TRAC targeting sequence
auccccagucugguaacuga

SEQ ID NO: 9884 - RNA, 20 nt, Artificial Sequence
  TRAC targeting sequence
ccagucugguaacugagguc

SEQ ID NO: 9885 - RNA, 20 nt, Artificial Sequence
  TRAC targeting sequence
gguaacugagguccagucag

SEQ ID NO: 9886 - RNA, 20 nt, Artificial Sequence
  TRAC targeting sequence
guuaccagacuggggauuga

SEQ ID NO: 9887 - RNA, 20 nt, Artificial Sequence
  TRAC targeting sequence
agucaguuaacugucugguu

SEQ ID NO: 9888 - RNA, 20 nt, Artificial Sequence
  TRAC targeting sequence
guuaacugucugguuaacuc

SEQ ID NO: 9889 - RNA, 20 nt, Artificial Sequence
  TRAC targeting sequence
gguuaacucaggcagagcau

SEQ ID NO: 9890 - RNA, 20 nt, Artificial Sequence
  TRAC targeting sequence
ggcagagcauuuaaccccac

SEQ ID NO: 9891 - RNA, 20 nt, Artificial Sequence
  TRAC targeting sequence
gccugaguuaaccagacagu

SEQ ID NO: 9892 - RNA, 20 nt, Artificial Sequence
  TRAC targeting sequence
uugguuaccaaaauagugga

SEQ ID NO: 9893 - RNA, 20 nt, Artificial Sequence
  TRAC targeting sequence
acuauuuugguaaccaaaga

SEQ ID NO: 9894 - RNA, 20 nt, Artificial Sequence
  TRAC targeting sequence
gccuccacuuuacuuaguuc

SEQ ID NO: 9895 - RNA, 20 nt, Artificial Sequence
  TRAC targeting sequence
acuuuacuuaguucaccuga

SEQ ID NO: 9896 - RNA, 20 nt, Artificial Sequence
  TRAC targeting sequence
ccugagaaggggaaaauuca

SEQ ID NO: 9897 - RNA, 20 nt, Artificial Sequence
  TRAC targeting sequence
ggugaacuaaguaaagugga

SEQ ID NO: 9898 - RNA, 20 nt, Artificial Sequence
  TRAC targeting sequence
caggugaacuaaguaaagug

SEQ ID NO: 9899 - RNA, 20 nt, Artificial Sequence
  TRAC targeting sequence
ccuucucaggugaacuaagu

SEQ ID NO: 9900 - RNA, 20 nt, Artificial Sequence
  TRAC targeting sequence
ucuguccucugagucgugag

SEQ ID NO: 9901 - RNA, 20 nt, Artificial Sequence
  TRAC targeting sequence
guccucugagucgugagaau

SEQ ID NO: 9902 - RNA, 20 nt, Artificial Sequence
  TRAC targeting sequence
ucugagucgugagaauagag

SEQ ID NO: 9903 - RNA, 20 nt, Artificial Sequence
  TRAC targeting sequence
gagucgugagaauagagcag

SEQ ID NO: 9904 - RNA, 20 nt, Artificial Sequence
  TRAC targeting sequence
gaggacagaugaauuuuccc

SEQ ID NO: 9905 - RNA, 20 nt, Artificial Sequence
  TRAC targeting sequence
ugagaauagagcaguacauu

SEQ ID NO: 9906 - RNA, 20 nt, Artificial Sequence
  TRAC targeting sequence
cgacucagaggacagaugaa

SEQ ID NO: 9907 - RNA, 20 nt, Artificial Sequence
  TRAC targeting sequence
cacgacucagaggacagaug

SEQ ID NO: 9908 - RNA, 20 nt, Artificial Sequence
  TRAC targeting sequence
auucucacgacucagaggac

SEQ ID NO: 9909 - RNA, 20 nt, Artificial Sequence
  TRAC targeting sequence
cuccuucaaauauacaccca

SEQ ID NO: 9910 - RNA, 20 nt, Artificial Sequence
  TRAC targeting sequence
ccuucaaauauacacccacc

SEQ ID NO: 9911 - RNA, 20 nt, Artificial Sequence
  TRAC targeting sequence
uucaaauauacacccacccu

SEQ ID NO: 9912 - RNA, 20 nt, Artificial Sequence
  TRAC targeting sequence
aauauacacccacccuuccc

SEQ ID NO: 9913 - RNA, 20 nt, Artificial Sequence
  TRAC targeting sequence
cuaaugguaaugugugagua

SEQ ID NO: 9914 - RNA, 20 nt, Artificial Sequence
  TRAC targeting sequence
cacauuaccauuagggaagg

SEQ ID NO: 9915 - RNA, 20 nt, Artificial Sequence
  TRAC targeting sequence
aaguacucacacauuaccau

SEQ ID NO: 9916 - RNA, 20 nt, Artificial Sequence
  TRAC targeting sequence
aacauuuaaaaacuuuucua

SEQ ID NO: 9917 - RNA, 20 nt, Artificial Sequence
  TRAC targeting sequence
ugaaaaucugcgcugcuggu

SEQ ID NO: 9918 - RNA, 20 nt, Artificial Sequence
  TRAC targeting sequence
agaagugccauuagcaacca

SEQ ID NO: 9919 - RNA, 20 nt, Artificial Sequence
  TRAC targeting sequence
gcgcugcugguggacuucug

SEQ ID NO: 9920 - RNA, 20 nt, Artificial Sequence
  TRAC targeting sequence
accagcagcgcagauuuuca

SEQ ID NO: 9921 - RNA, 20 nt, Artificial Sequence
  TRAC targeting sequence
gaaaguggugcuuauaaacu

SEQ ID NO: 9922 - RNA, 20 nt, Artificial Sequence
  TRAC targeting sequence
gaaguccaccagcagcgcag

SEQ ID NO: 9923 - RNA, 20 nt, Artificial Sequence
  TRAC targeting sequence
agccuuaguuuauaagcacc

SEQ ID NO: 9924 - RNA, 20 nt, Artificial Sequence
  TRAC targeting sequence
ccagccuuaguuuauaagca

SEQ ID NO: 9925 - RNA, 20 nt, Artificial Sequence
  TRAC targeting sequence
ucuccagccuuaguuuauaa

SEQ ID NO: 9926 - RNA, 20 nt, Artificial Sequence
  TRAC targeting sequence
gucuucuccagccuuaguuu

SEQ ID NO: 9927 - RNA, 20 nt, Artificial Sequence
  TRAC targeting sequence
gauaaaaugaaaaugggaaa

SEQ ID NO: 9928 - RNA, 20 nt, Artificial Sequence
  TRAC targeting sequence
gaauuuuacaagucagucuu

SEQ ID NO: 9929 - RNA, 20 nt, Artificial Sequence
  TRAC targeting sequence
uuuuaucugaauuuuacaag

SEQ ID NO: 9930 - RNA, 20 nt, Artificial Sequence
  TRAC targeting sequence
cauuuucauuuuaucugaau

SEQ ID NO: 9931 - RNA, 20 nt, Artificial Sequence
  TRAC targeting sequence
aagggccccggucuccuaag

SEQ ID NO: 9932 - RNA, 20 nt, Artificial Sequence
  TRAC targeting sequence
ccuaagugcccugauguuga

SEQ ID NO: 9933 - RNA, 20 nt, Artificial Sequence
  TRAC targeting sequence
uaagugcccugauguugagu

SEQ ID NO: 9934 - RNA, 20 nt, Artificial Sequence
  TRAC targeting sequence
gggcacuuaggagaccgggg

SEQ ID NO: 9935 - RNA, 20 nt, Artificial Sequence
  TRAC targeting sequence
acaucagggcacuuaggaga

SEQ ID NO: 9936 - RNA, 20 nt, Artificial Sequence
  TRAC targeting sequence
gaucugcuuucugugauuaa

SEQ ID NO: 9937 - RNA, 20 nt, Artificial Sequence
  TRAC targeting sequence
gaguaaguaaaacuggggca

SEQ ID NO: 9938 - RNA, 20 nt, Artificial Sequence
  TRAC targeting sequence
gcuuucugugauuaagaaga

SEQ ID NO: 9939 - RNA, 20 nt, Artificial Sequence
  TRAC targeting sequence
gugauuaagaagagaugcac

SEQ ID NO: 9940 - RNA, 20 nt, Artificial Sequence
  TRAC targeting sequence
cagaaagcagaucugaguaa

SEQ ID NO: 9941 - RNA, 20 nt, Artificial Sequence
  TRAC targeting sequence
uaaucacagaaagcagaucu

SEQ ID NO: 9942 - RNA, 20 nt, Artificial Sequence
  TRAC targeting sequence
ucuuaaucacagaaagcaga

SEQ ID NO: 9943 - RNA, 20 nt, Artificial Sequence
  TRAC targeting sequence
cuucuuaaucacagaaagca

SEQ ID NO: 9944 - RNA, 20 nt, Artificial Sequence
  TRAC targeting sequence
agugugcaucucuucuuaau

SEQ ID NO: 9945 - RNA, 20 nt, Artificial Sequence
  TRAC targeting sequence
cuagugugcaucucuucuua

SEQ ID NO: 9946 - RNA, 20 nt, Artificial Sequence
  TRAC targeting sequence
cucuagugugcaucucuucu

SEQ ID NO: 9947 - RNA, 20 nt, Artificial Sequence
  TRAC targeting sequence
aagugccucucucuagugug

SEQ ID NO: 9948 - RNA, 20 nt, Artificial Sequence
  TRAC targeting sequence
uaaaaagacuggcucuggug

SEQ ID NO: 9949 - RNA, 20 nt, Artificial Sequence
  TRAC targeting sequence
uuuuaagaauuuugccuggg

SEQ ID NO: 9950 - RNA, 20 nt, Artificial Sequence
  TRAC targeting sequence
gguggcggggcgggugguga

SEQ ID NO: 9951 - RNA, 20 nt, Artificial Sequence
  TRAC targeting sequence
ccacccgccccgccaccaga

SEQ ID NO: 9952 - RNA, 20 nt, Artificial Sequence
  TRAC targeting sequence
uucaccacccgccccgccac

SEQ ID NO: 9953 - RNA, 20 nt, Artificial Sequence
  TRAC targeting sequence
gggacaccgugcaugcagca

SEQ ID NO: 9954 - RNA, 20 nt, Artificial Sequence
  TRAC targeting sequence
cugaguccuucaccacccgc

SEQ ID NO: 9955 - RNA, 20 nt, Artificial Sequence
  TRAC targeting sequence
augcugcaugcacggugucc

SEQ ID NO: 9956 - RNA, 20 nt, Artificial Sequence
  TRAC targeting sequence
cucaaugcugcaugcacggu

SEQ ID NO: 9957 - RNA, 20 nt, Artificial Sequence
  TRAC targeting sequence
gcauuaacucccucaaugcu

SEQ ID NO: 9958 - RNA, 20 nt, Artificial Sequence
  TRAC targeting sequence
gcuagcaagucugcauuaac

SEQ ID NO: 9959 - RNA, 20 nt, Artificial Sequence
  TRAC targeting sequence
aagcugucugcuagcaaguc

SEQ ID NO: 9960 - RNA, 20 nt, Artificial Sequence
  TRAC targeting sequence
gggauaggcccugccugaag

SEQ ID NO: 9961 - RNA, 20 nt, Artificial Sequence
  TRAC targeting sequence
cagaacguuccaagcugucu

SEQ ID NO: 9962 - RNA, 20 nt, Artificial Sequence
  TRAC targeting sequence
ggcagggccuaucccagaac

SEQ ID NO: 9963 - RNA, 20 nt, Artificial Sequence
  TRAC targeting sequence
ucaggcagggccuaucccag

SEQ ID NO: 9964 - RNA, 20 nt, Artificial Sequence
  TRAC targeting sequence
aguucccaugugcagaagug

SEQ ID NO: 9965 - RNA, 20 nt, Artificial Sequence
  TRAC targeting sequence
caugugcagaagugccuugc

SEQ ID NO: 9966 - RNA, 20 nt, Artificial Sequence
  TRAC targeting sequence
gcacaugggaacuugauggc

SEQ ID NO: 9967 - RNA, 20 nt, Artificial Sequence
  TRAC targeting sequence
gcaggggcaaaaucagcacg

SEQ ID NO: 9968 - RNA, 20 nt, Artificial Sequence
  TRAC targeting sequence
gcacgucuguggcaacagca

SEQ ID NO: 9969 - RNA, 20 nt, Artificial Sequence
  TRAC targeting sequence
guggcaacagcaacaaugaa

SEQ ID NO: 9970 - RNA, 20 nt, Artificial Sequence
  TRAC targeting sequence
uuguugcuguugccacagac

SEQ ID NO: 9971 - RNA, 20 nt, Artificial Sequence
  TRAC targeting sequence
uauauuauucauuguugcug

SEQ ID NO: 9972 - RNA, 20 nt, Artificial Sequence
  TRAC targeting sequence
cagggguucagcagucucca

SEQ ID NO: 9973 - RNA, 20 nt, Artificial Sequence
  TRAC targeting sequence
gcagucuccacugaggucuu

SEQ ID NO: 9974 - RNA, 20 nt, Artificial Sequence
  TRAC targeting sequence
ccacugaggucuuaucaaau

SEQ ID NO: 9975 - RNA, 20 nt, Artificial Sequence
  TRAC targeting sequence
acugaggucuuaucaaauua

SEQ ID NO: 9976 - RNA, 20 nt, Artificial Sequence
  TRAC targeting sequence
guggagacugcugaaccccu

SEQ ID NO: 9977 - RNA, 20 nt, Artificial Sequence
  TRAC targeting sequence
uaucaaauuaaagcuucaag

SEQ ID NO: 9978 - RNA, 20 nt, Artificial Sequence
  TRAC targeting sequence
aauuaaagcuucaaggggau

SEQ ID NO: 9979 - RNA, 20 nt, Artificial Sequence
  TRAC targeting sequence
aggggauucauaugaacauc

SEQ ID NO: 9980 - RNA, 20 nt, Artificial Sequence
  TRAC targeting sequence
ccuugaagcuuuaauuugau

SEQ ID NO: 9981 - RNA, 20 nt, Artificial Sequence
  TRAC targeting sequence
uaugaacaucccaggagacu

SEQ ID NO: 9982 - RNA, 20 nt, Artificial Sequence
  TRAC targeting sequence
uaugaauccccuugaagcuu

SEQ ID NO: 9983 - RNA, 20 nt, Artificial Sequence
  TRAC targeting sequence
caggagacucaaggacucag

SEQ ID NO: 9984 - RNA, 20 nt, Artificial Sequence
  TRAC targeting sequence
ugggauguucauaugaaucc

SEQ ID NO: 9985 - RNA, 20 nt, Artificial Sequence
  TRAC targeting sequence
ccugggauguucauaugaau

SEQ ID NO: 9986 - RNA, 20 nt, Artificial Sequence
  TRAC targeting sequence
aggacucagucgcuuuucag

SEQ ID NO: 9987 - RNA, 20 nt, Artificial Sequence
  TRAC targeting sequence
uugagucuccugggauguuc

SEQ ID NO: 9988 - RNA, 20 nt, Artificial Sequence
  TRAC targeting sequence
gucgcuuuucagaggguggg

SEQ ID NO: 9989 - RNA, 20 nt, Artificial Sequence
  TRAC targeting sequence
cuuuucagagggugggcagc

SEQ ID NO: 9990 - RNA, 20 nt, Artificial Sequence
  TRAC targeting sequence
gagggugggcagccaaugcu

SEQ ID NO: 9991 - RNA, 20 nt, Artificial Sequence
  TRAC targeting sequence
gaaaagcgacugaguccuug

SEQ ID NO: 9992 - RNA, 20 nt, Artificial Sequence
  TRAC targeting sequence
cuagcauuggcugcccaccc

SEQ ID NO: 9993 - RNA, 20 nt, Artificial Sequence
  TRAC targeting sequence
ggucccuagcauuggcugcc

SEQ ID NO: 9994 - RNA, 20 nt, Artificial Sequence
  TRAC targeting sequence
uugguuucuuaccggaagca

SEQ ID NO: 9995 - RNA, 20 nt, Artificial Sequence
  TRAC targeting sequence
uaccggaagcacacuagggc

SEQ ID NO: 9996 - RNA, 20 nt, Artificial Sequence
  TRAC targeting sequence
gguaagaaaccaaagaaaaa

SEQ ID NO: 9997 - RNA, 20 nt, Artificial Sequence
  TRAC targeting sequence
gcgguggguuuuccagaaug

SEQ ID NO: 9998 - RNA, 20 nt, Artificial Sequence
  TRAC targeting sequence
agaaugcagagaagcuggga

SEQ ID NO: 9999 - RNA, 20 nt, Artificial Sequence
  TRAC targeting sequence
ggaaaacccaccgcagagcc

SEQ ID NO: 10000 - RNA, 20 nt, Artificial Sequence
  TRAC targeting sequence
gcauucuggaaaacccaccg

SEQ ID NO: 10001 - RNA, 20 nt, Artificial Sequence
  TRAC targeting sequence
cugcauucuggaaaacccac

SEQ ID NO: 10002 - RNA, 20 nt, Artificial Sequence
  TRAC targeting sequence
cagcuucucugcauucugga

SEQ ID NO: 10003 - RNA, 20 nt, Artificial Sequence
  TRAC targeting sequence
cagcacuuggucagccucuu

SEQ ID NO: 10004 - RNA, 20 nt, Artificial Sequence
  TRAC targeting sequence
gcacuuggucagccucuuag

SEQ ID NO: 10005 - RNA, 20 nt, Artificial Sequence
  TRAC targeting sequence
gccucuuaggggacugagaa

SEQ ID NO: 10006 - RNA, 20 nt, Artificial Sequence
  TRAC targeting sequence
uaggggacugagaacuguaa

SEQ ID NO: 10007 - RNA, 20 nt, Artificial Sequence
  TRAC targeting sequence
ccuaagaggcugaccaagug

SEQ ID NO: 10008 - RNA, 20 nt, Artificial Sequence
  TRAC targeting sequence
guccccuaagaggcugacca

SEQ ID NO: 10009 - RNA, 20 nt, Artificial Sequence
  TRAC targeting sequence
caguccccuaagaggcugac

SEQ ID NO: 10010 - RNA, 20 nt, Artificial Sequence
  TRAC targeting sequence
uaccuuuuaaaacauugacg

SEQ ID NO: 10011 - RNA, 20 nt, Artificial Sequence
  TRAC targeting sequence
auguuuuaaaagguaggagu

SEQ ID NO: 10012 - RNA, 20 nt, Artificial Sequence
  TRAC targeting sequence
ucaauguuuuaaaagguagg

SEQ ID NO: 10013 - RNA, 20 nt, Artificial Sequence
  TRAC targeting sequence
ggguguuugacagccuaacc

SEQ ID NO: 10014 - RNA, 20 nt, Artificial Sequence
  TRAC targeting sequence
aacacccugaccucgucaau

SEQ ID NO: 10015 - RNA, 20 nt, Artificial Sequence
  TRAC targeting sequence
uugccugguuaggcugucaa

SEQ ID NO: 10016 - RNA, 20 nt, Artificial Sequence
  TRAC targeting sequence
gugcaaggcuagcauucuuc

SEQ ID NO: 10017 - RNA, 20 nt, Artificial Sequence
  TRAC targeting sequence
uccagagcucuggacaguaa

SEQ ID NO: 10018 - RNA, 20 nt, Artificial Sequence
  TRAC targeting sequence
agagcucuggacaguaaucg

SEQ ID NO: 10019 - RNA, 20 nt, Artificial Sequence
  TRAC targeting sequence
ggaagaaugcuagccuugca

SEQ ID NO: 10020 - RNA, 20 nt, Artificial Sequence
  TRAC targeting sequence
ggacaguaaucguaugccag

SEQ ID NO: 10021 - RNA, 20 nt, Artificial Sequence
  TRAC targeting sequence
agagcucuggaagaaugcua

SEQ ID NO: 10022 - RNA, 20 nt, Artificial Sequence
  TRAC targeting sequence
uaugccagauuuuccaugca

SEQ ID NO: 10023 - RNA, 20 nt, Artificial Sequence
  TRAC targeting sequence
ggcauacgauuacuguccag

SEQ ID NO: 10024 - RNA, 20 nt, Artificial Sequence
  TRAC targeting sequence
augcaguggauucuagcugc

SEQ ID NO: 10025 - RNA, 20 nt, Artificial Sequence
  TRAC targeting sequence
acugcauggaaaaucuggca

SEQ ID NO: 10026 - RNA, 20 nt, Artificial Sequence
  TRAC targeting sequence
agcugcaggaacuauauggc

SEQ ID NO: 10027 - RNA, 20 nt, Artificial Sequence
  TRAC targeting sequence
ugcagcuagaauccacugca

SEQ ID NO: 10028 - RNA, 20 nt, Artificial Sequence
  TRAC targeting sequence
agccuugccauauaguuccu

SEQ ID NO: 10029 - RNA, 20 nt, Artificial Sequence
  TRAC targeting sequence
aaggaacccaugauuaaauu

SEQ ID NO: 10030 - RNA, 20 nt, Artificial Sequence
  TRAC targeting sequence
uuggacuccagccuugccau

SEQ ID NO: 10031 - RNA, 20 nt, Artificial Sequence
  TRAC targeting sequence
uggguuccuuggacuccagc

SEQ ID NO: 10032 - RNA, 20 nt, Artificial Sequence
  TRAC targeting sequence
guuuuccugcaguaagugga

SEQ ID NO: 10033 - RNA, 20 nt, Artificial Sequence
  TRAC targeting sequence
ugcaguaaguggaacacaga

SEQ ID NO: 10034 - RNA, 20 nt, Artificial Sequence
  TRAC targeting sequence
acuuacugcaggaaaacaga

SEQ ID NO: 10035 - RNA, 20 nt, Artificial Sequence
  TRAC targeting sequence
guguuccacuuacugcagga

SEQ ID NO: 10036 - RNA, 20 nt, Artificial Sequence
  TRAC targeting sequence
cuguguuccacuuacugcag

SEQ ID NO: 10037 - RNA, 20 nt, Artificial Sequence
  TRAC targeting sequence
guuugaggaccucagcugag

SEQ ID NO: 10038 - RNA, 20 nt, Artificial Sequence
  TRAC targeting sequence
aacagacaggcacccaaagu

SEQ ID NO: 10039 - RNA, 20 nt, Artificial Sequence
  TRAC targeting sequence
ucaaacagacaggcacccaa

SEQ ID NO: 10040 - RNA, 20 nt, Artificial Sequence
  TRAC targeting sequence
gcugagggcaggcaucuggu

SEQ ID NO: 10041 - RNA, 20 nt, Artificial Sequence
  TRAC targeting sequence
gcugagguccucaaacagac

SEQ ID NO: 10042 - RNA, 20 nt, Artificial Sequence
  TRAC targeting sequence
gguuuugcuuauguccugcg

SEQ ID NO: 10043 - RNA, 20 nt, Artificial Sequence
  TRAC targeting sequence
ugcggaggcugaagagaggg

SEQ ID NO: 10044 - RNA, 20 nt, Artificial Sequence
  TRAC targeting sequence
gcaggacauaagcaaaacca

SEQ ID NO: 10045 - RNA, 20 nt, Artificial Sequence
  TRAC targeting sequence
gccuccgcaggacauaagca

SEQ ID NO: 10046 - RNA, 20 nt, Artificial Sequence
  TRAC targeting sequence
ucagccuccgcaggacauaa

SEQ ID NO: 10047 - RNA, 20 nt, Artificial Sequence
  TRAC targeting sequence
cuucagccuccgcaggacau

SEQ ID NO: 10048 - RNA, 20 nt, Artificial Sequence
  TRAC targeting sequence
cacccucucuucagccuccg

SEQ ID NO: 10049 - RNA, 20 nt, Artificial Sequence
  TRAC targeting sequence
aaagggcuucccacccucuc

SEQ ID NO: 10050 - RNA, 20 nt, Artificial Sequence
  TRAC targeting sequence
cugucuaaagggcuucccac

SEQ ID NO: 10051 - RNA, 20 nt, Artificial Sequence
  TRAC targeting sequence
caguauucacugucuaaagg

SEQ ID NO: 10052 - RNA, 20 nt, Artificial Sequence
  TRAC targeting sequence
cuauuucacaguauucacug

SEQ ID NO: 10053 - RNA, 20 nt, Artificial Sequence
  TRAC targeting sequence
ucacuauuucacaguauuca

SEQ ID NO: 10054 - RNA, 20 nt, Artificial Sequence
  TRAC targeting sequence
cuucacuauuucacaguauu

SEQ ID NO: 10055 - RNA, 20 nt, Artificial Sequence
  TRAC targeting sequence
caucucuucacuauuucaca

SEQ ID NO: 10056 - RNA, 20 nt, Artificial Sequence
  TRAC targeting sequence
uuugaaucccugacugcugu

SEQ ID NO: 10057 - RNA, 20 nt, Artificial Sequence
  TRAC targeting sequence
aacgacccuucccaucucuu

SEQ ID NO: 10058 - RNA, 20 nt, Artificial Sequence
  TRAC targeting sequence
cugacugcuguccuuaaaaa

SEQ ID NO: 10059 - RNA, 20 nt, Artificial Sequence
  TRAC targeting sequence
gggauucaaacgacccuucc

SEQ ID NO: 10060 - RNA, 20 nt, Artificial Sequence
  TRAC targeting sequence
uuaaaaaaaauggauacguc

SEQ ID NO: 10061 - RNA, 20 nt, Artificial Sequence
  TRAC targeting sequence
auuuuuuuuaaggacagcag

SEQ ID NO: 10062 - RNA, 20 nt, Artificial Sequence
  TRAC targeting sequence
ucuuagcuaaauaauagccu

SEQ ID NO: 10063 - RNA, 20 nt, Artificial Sequence
  TRAC targeting sequence
uagcuaaauaauagccuuuu

SEQ ID NO: 10064 - RNA, 20 nt, Artificial Sequence
  TRAC targeting sequence
cucacccuuuucaugauagu

SEQ ID NO: 10065 - RNA, 20 nt, Artificial Sequence
  TRAC targeting sequence
cacccuuuucaugauaguaa

SEQ ID NO: 10066 - RNA, 20 nt, Artificial Sequence
  TRAC targeting sequence
cccuuuucaugauaguaagc

SEQ ID NO: 10067 - RNA, 20 nt, Artificial Sequence
  TRAC targeting sequence
ugauaguaagcaagcuaaaa

SEQ ID NO: 10068 - RNA, 20 nt, Artificial Sequence
  TRAC targeting sequence
ugaaaagggugagagaaaaa

SEQ ID NO: 10069 - RNA, 20 nt, Artificial Sequence
  TRAC targeting sequence
agcaaccacuuguuacaaag

SEQ ID NO: 10070 - RNA, 20 nt, Artificial Sequence
  TRAC targeting sequence
ucaagcaaccacuuguuaca

SEQ ID NO: 10071 - RNA, 20 nt, Artificial Sequence
  TRAC targeting sequence
ugucuucaagcaaccacuug

SEQ ID NO: 10072 - RNA, 20 nt, Artificial Sequence
  TRAC targeting sequence
gcccaaaaaaagucugaguu

SEQ ID NO: 10073 - RNA, 20 nt, Artificial Sequence
  TRAC targeting sequence
gaguuaagaaaacuaaauuc

SEQ ID NO: 10074 - RNA, 20 nt, Artificial Sequence
  TRAC targeting sequence
gacuuuuuuugggcugaauu

SEQ ID NO: 10075 - RNA, 20 nt, Artificial Sequence
  TRAC targeting sequence
uaacucagacuuuuuuuggg

SEQ ID NO: 10076 - RNA, 20 nt, Artificial Sequence
  TRAC targeting sequence
auuaaagaggugucuguuuu

SEQ ID NO: 10077 - RNA, 20 nt, Artificial Sequence
  TRAC targeting sequence
uuaauagaauuuaguuuucu

SEQ ID NO: 10078 - RNA, 20 nt, Artificial Sequence
  TRAC targeting sequence
guuuuucacaccccuggggg

SEQ ID NO: 10079 - RNA, 20 nt, Artificial Sequence
  TRAC targeting sequence
caccccugggggacaggguu

SEQ ID NO: 10080 - RNA, 20 nt, Artificial Sequence
  TRAC targeting sequence
cccaggggugugaaaaacag

SEQ ID NO: 10081 - RNA, 20 nt, Artificial Sequence
  TRAC targeting sequence
aacccugucccccaggggug

SEQ ID NO: 10082 - RNA, 20 nt, Artificial Sequence
  TRAC targeting sequence
ucaccacaucaugaaacugc

SEQ ID NO: 10083 - RNA, 20 nt, Artificial Sequence
  TRAC targeting sequence
ccacaucaugaaacugccug

SEQ ID NO: 10084 - RNA, 20 nt, Artificial Sequence
  TRAC targeting sequence
ugaaacugccuggauuuugc

SEQ ID NO: 10085 - RNA, 20 nt, Artificial Sequence
  TRAC targeting sequence
ugauguggugaugaucaaac

SEQ ID NO: 10086 - RNA, 20 nt, Artificial Sequence
  TRAC targeting sequence
aggcaguuucaugauguggu

SEQ ID NO: 10087 - RNA, 20 nt, Artificial Sequence
  TRAC targeting sequence
ucacauuuuuugugacaucc

SEQ ID NO: 10088 - RNA, 20 nt, Artificial Sequence
  TRAC targeting sequence
cauuuuuugugacauccaga

SEQ ID NO: 10089 - RNA, 20 nt, Artificial Sequence
  TRAC targeting sequence
caaaaaaugugaagagcaaa

SEQ ID NO: 10090 - RNA, 20 nt, Artificial Sequence
  TRAC targeting sequence
agacacagccagggugacuc

SEQ ID NO: 10091 - RNA, 20 nt, Artificial Sequence
  TRAC targeting sequence
ggaugucacaaaaaauguga

SEQ ID NO: 10092 - RNA, 20 nt, Artificial Sequence
  TRAC targeting sequence
cccuggcugugucuggaugu

SEQ ID NO: 10093 - RNA, 20 nt, Artificial Sequence
  TRAC targeting sequence
caggauuccugugguugugu

SEQ ID NO: 10094 - RNA, 20 nt, Artificial Sequence
  TRAC targeting sequence
ugggagucacccuggcugug

SEQ ID NO: 10095 - RNA, 20 nt, Artificial Sequence
  TRAC targeting sequence
ugugguugugucuguuggca

SEQ ID NO: 10096 - RNA, 20 nt, Artificial Sequence
  TRAC targeting sequence
guuggcaacagaagcauuau

SEQ ID NO: 10097 - RNA, 20 nt, Artificial Sequence
  TRAC targeting sequence
guugccaacagacacaacca

SEQ ID NO: 10098 - RNA, 20 nt, Artificial Sequence
  TRAC targeting sequence
agggaugaaauuuacaggaa

SEQ ID NO: 10099 - RNA, 20 nt, Artificial Sequence
  TRAC targeting sequence
cuugaccaaauaaugcuucu

SEQ ID NO: 10100 - RNA, 20 nt, Artificial Sequence
  TRAC targeting sequence
ucccuugaccaaauaaugcu

SEQ ID NO: 10101 - RNA, 20 nt, Artificial Sequence
  TRAC targeting sequence
uguaaauuucaucccuugac

SEQ ID NO: 10102 - RNA, 20 nt, Artificial Sequence
  TRAC targeting sequence
auuaggggcaggcuuuugca

SEQ ID NO: 10103 - RNA, 20 nt, Artificial Sequence
  TRAC targeting sequence
cuauuaggggcaggcuuuug

SEQ ID NO: 10104 - RNA, 20 nt, Artificial Sequence
  TRAC targeting sequence
cuuaacccuaccacuguggu

SEQ ID NO: 10105 - RNA, 20 nt, Artificial Sequence
  TRAC targeting sequence
ccgggcugcucugugagguc

SEQ ID NO: 10106 - RNA, 20 nt, Artificial Sequence
  TRAC targeting sequence
gugaggucagaacaccucag

SEQ ID NO: 10107 - RNA, 20 nt, Artificial Sequence
  TRAC targeting sequence
cagagcagcccggugaccac

SEQ ID NO: 10108 - RNA, 20 nt, Artificial Sequence
  TRAC targeting sequence
gaacaccucaggugagacug

SEQ ID NO: 10109 - RNA, 20 nt, Artificial Sequence
  TRAC targeting sequence
gaccucacagagcagcccgg

SEQ ID NO: 10110 - RNA, 20 nt, Artificial Sequence
  TRAC targeting sequence
ggugagacuguggaguaacc

SEQ ID NO: 10111 - RNA, 20 nt, Artificial Sequence
  TRAC targeting sequence
ccugagguguucugaccuca

SEQ ID NO: 10112 - RNA, 20 nt, Artificial Sequence
  TRAC targeting sequence
caccugagguguucugaccu

SEQ ID NO: 10113 - RNA, 20 nt, Artificial Sequence
  TRAC targeting sequence
acagucucaccugagguguu

SEQ ID NO: 10114 - RNA, 20 nt, Artificial Sequence
  TRAC targeting sequence
gguuacuccacagucucacc

SEQ ID NO: 10115 - RNA, 20 nt, Artificial Sequence
  TRAC targeting sequence
ugguuuuccuggguuucagg

SEQ ID NO: 10116 - RNA, 20 nt, Artificial Sequence
  TRAC targeting sequence
uggguuucagggguuuucca

SEQ ID NO: 10117 - RNA, 20 nt, Artificial Sequence
  TRAC targeting sequence
gggguuuuccaggacaaagg

SEQ ID NO: 10118 - RNA, 20 nt, Artificial Sequence
  TRAC targeting sequence
aggacaaaggucauucuuug

SEQ ID NO: 10119 - RNA, 20 nt, Artificial Sequence
  TRAC targeting sequence
uggaaaaccccugaaaccca

SEQ ID NO: 10120 - RNA, 20 nt, Artificial Sequence
  TRAC targeting sequence
uucuuugcuaagcccagaau

SEQ ID NO: 10121 - RNA, 20 nt, Artificial Sequence
  TRAC targeting sequence
uugcuaagcccagaaugauc

SEQ ID NO: 10122 - RNA, 20 nt, Artificial Sequence
  TRAC targeting sequence
gggcuuagcaaagaaugacc

SEQ ID NO: 10123 - RNA, 20 nt, Artificial Sequence
  TRAC targeting sequence
uucugggcuuagcaaagaau

SEQ ID NO: 10124 - RNA, 20 nt, Artificial Sequence
  TRAC targeting sequence
ccaggauaguuaaucaccgu

SEQ ID NO: 10125 - RNA, 20 nt, Artificial Sequence
  TRAC targeting sequence
uggggaucauucugggcuua

SEQ ID NO: 10126 - RNA, 20 nt, Artificial Sequence
  TRAC targeting sequence
ccguaagaaggcacagauaa

SEQ ID NO: 10127 - RNA, 20 nt, Artificial Sequence
  TRAC targeting sequence
uacggugauuaacuauccug

SEQ ID NO: 10128 - RNA, 20 nt, Artificial Sequence
  TRAC targeting sequence
gugccuucuuacggugauua

SEQ ID NO: 10129 - RNA, 20 nt, Artificial Sequence
  TRAC targeting sequence
gugagcuacuacuuacauuu

SEQ ID NO: 10130 - RNA, 20 nt, Artificial Sequence
  TRAC targeting sequence
cagaaaaaaguuuuuaucug

SEQ ID NO: 10131 - RNA, 20 nt, Artificial Sequence
  TRAC targeting sequence
ccaaauucaagacugacaaa

SEQ ID NO: 10132 - RNA, 20 nt, Artificial Sequence
  TRAC targeting sequence
agacugacaaaaaaacuacg

SEQ ID NO: 10133 - RNA, 20 nt, Artificial Sequence
  TRAC targeting sequence
ugaauuuggugaaauguaag

SEQ ID NO: 10134 - RNA, 20 nt, Artificial Sequence
  TRAC targeting sequence
gucuugaauuuggugaaaug

SEQ ID NO: 10135 - RNA, 20 nt, Artificial Sequence
  TRAC targeting sequence
cacaacguaguuuuuuuguc

SEQ ID NO: 10136 - RNA, 20 nt, Artificial Sequence
  TRAC targeting sequence
guuacaugugcccaucauuu

SEQ ID NO: 10137 - RNA, 20 nt, Artificial Sequence
  TRAC targeting sequence
uuuuuauuucuuaugcuagg

SEQ ID NO: 10138 - RNA, 20 nt, Artificial Sequence
  TRAC targeting sequence
uaugcuagggcaugaaggga

SEQ ID NO: 10139 - RNA, 20 nt, Artificial Sequence
  TRAC targeting sequence
ugcccuagcauaagaaauaa

SEQ ID NO: 10140 - RNA, 20 nt, Artificial Sequence
  TRAC targeting sequence
cuucaugcccuagcauaaga

SEQ ID NO: 10141 - RNA, 20 nt, Artificial Sequence
  TRAC targeting sequence
ggagauccuguuucaugagg

SEQ ID NO: 10142 - RNA, 20 nt, Artificial Sequence
  TRAC targeting sequence
ugagcuucccuucaugcccu

SEQ ID NO: 10143 - RNA, 20 nt, Artificial Sequence
  TRAC targeting sequence
ccugagcuucccuucaugcc

SEQ ID NO: 10144 - RNA, 20 nt, Artificial Sequence
  TRAC targeting sequence
uguuucaugaggcuacaguc

SEQ ID NO: 10145 - RNA, 20 nt, Artificial Sequence
  TRAC targeting sequence
ugaggcuacagucuaaaucu

SEQ ID NO: 10146 - RNA, 20 nt, Artificial Sequence
  TRAC targeting sequence
ugaaacaggaucuccugagc

SEQ ID NO: 10147 - RNA, 20 nt, Artificial Sequence
  TRAC targeting sequence
aaaucucaucuaauucuagu

SEQ ID NO: 10148 - RNA, 20 nt, Artificial Sequence
  TRAC targeting sequence
caucuaauucuagucauucu

SEQ ID NO: 10149 - RNA, 20 nt, Artificial Sequence
  TRAC targeting sequence
ucuaauucuagucauucucc

SEQ ID NO: 10150 - RNA, 20 nt, Artificial Sequence
  TRAC targeting sequence
aauucuagucauucuccaaa

SEQ ID NO: 10151 - RNA, 20 nt, Artificial Sequence
  TRAC targeting sequence
agucauucuccaaaaagcug

SEQ ID NO: 10152 - RNA, 20 nt, Artificial Sequence
  TRAC targeting sequence
uucuccaaaaagcugaacac

SEQ ID NO: 10153 - RNA, 20 nt, Artificial Sequence
  TRAC targeting sequence
ccaaaaagcugaacacucuc

SEQ ID NO: 10154 - RNA, 20 nt, Artificial Sequence
  TRAC targeting sequence
aaaaagcugaacacucuccu

SEQ ID NO: 10155 - RNA, 20 nt, Artificial Sequence
  TRAC targeting sequence
gcuuuuuggagaaugacuag

SEQ ID NO: 10156 - RNA, 20 nt, Artificial Sequence
  TRAC targeting sequence
ccucuugucuccuuguaauc

SEQ ID NO: 10157 - RNA, 20 nt, Artificial Sequence
  TRAC targeting sequence
ucuugucuccuuguaaucaa

SEQ ID NO: 10158 - RNA, 20 nt, Artificial Sequence
  TRAC targeting sequence
ugucuccuuguaaucaauuc

SEQ ID NO: 10159 - RNA, 20 nt, Artificial Sequence
  TRAC targeting sequence
ccuuguaaucaauucauugu

SEQ ID NO: 10160 - RNA, 20 nt, Artificial Sequence
  TRAC targeting sequence
uuguaaucaauucauuguca

SEQ ID NO: 10161 - RNA, 20 nt, Artificial Sequence
  TRAC targeting sequence
auucauugucaucagaaaug

SEQ ID NO: 10162 - RNA, 20 nt, Artificial Sequence
  TRAC targeting sequence
uugucaucagaaauguguga

SEQ ID NO: 10163 - RNA, 20 nt, Artificial Sequence
  TRAC targeting sequence
ucagaaaugugugacaccuc

SEQ ID NO: 10164 - RNA, 20 nt, Artificial Sequence
  TRAC targeting sequence
gaaaugugugacaccucgag

SEQ ID NO: 10165 - RNA, 20 nt, Artificial Sequence
  TRAC targeting sequence
gaugacaaugaauugauuac

SEQ ID NO: 10166 - RNA, 20 nt, Artificial Sequence
  TRAC targeting sequence
cacauuucugaugacaauga

SEQ ID NO: 10167 - RNA, 20 nt, Artificial Sequence
  TRAC targeting sequence
aggggaggggaggacguguc

SEQ ID NO: 10168 - RNA, 20 nt, Artificial Sequence
  TRAC targeting sequence
aggugucacacauuucugau

SEQ ID NO: 10169 - RNA, 20 nt, Artificial Sequence
  TRAC targeting sequence
ccucgaggugucacacauuu

SEQ ID NO: 10170 - RNA, 20 nt, Artificial Sequence
  TRAC targeting sequence
ccuccccucgaggugucaca

SEQ ID NO: 10171 - RNA, 20 nt, Artificial Sequence
  TRAC targeting sequence
uccccuccccucgagguguc

SEQ ID NO: 10172 - RNA, 20 nt, Artificial Sequence
  TRAC targeting sequence
ugaaaacugaucagagaaau

SEQ ID NO: 10173 - RNA, 20 nt, Artificial Sequence
  TRAC targeting sequence
agacacguccuccccucccc

SEQ ID NO: 10174 - RNA, 20 nt, Artificial Sequence
  TRAC targeting sequence
guuuucaagacacguccucc

SEQ ID NO: 10175 - RNA, 20 nt, Artificial Sequence
  TRAC targeting sequence
gagaaauuguccugaaaaug

SEQ ID NO: 10176 - RNA, 20 nt, Artificial Sequence
  TRAC targeting sequence
gaucaguuuucaagacacgu

SEQ ID NO: 10177 - RNA, 20 nt, Artificial Sequence
  TRAC targeting sequence
cugaucaguuuucaagacac

SEQ ID NO: 10178 - RNA, 20 nt, Artificial Sequence
  TRAC targeting sequence
ugaaaaugaugcuguaaaau

SEQ ID NO: 10179 - RNA, 20 nt, Artificial Sequence
  TRAC targeting sequence
ggacaauuucucugaucagu

SEQ ID NO: 10180 - RNA, 20 nt, Artificial Sequence
  TRAC targeting sequence
uuuucaggacaauuucucug

SEQ ID NO: 10181 - RNA, 20 nt, Artificial Sequence
  TRAC targeting sequence
auuuuacagcaucauuuuca

SEQ ID NO: 10182 - RNA, 20 nt, Artificial Sequence
  TRAC targeting sequence
uuuccauuuuacagcaucau

SEQ ID NO: 10183 - RNA, 20 nt, Artificial Sequence
  TRAC targeting sequence
cauuuccauuuuacagcauc

SEQ ID NO: 10184 - RNA, 20 nt, Artificial Sequence
  TRAC targeting sequence
aaaggucucauuuccauuuu

SEQ ID NO: 10185 - RNA, 20 nt, Artificial Sequence
  TRAC targeting sequence
uucuaaaggucucauuucca

SEQ ID NO: 10186 - RNA, 20 nt, Artificial Sequence
  TRAC targeting sequence
cuuucuaaaggucucauuuc

SEQ ID NO: 10187 - RNA, 20 nt, Artificial Sequence
  TRAC targeting sequence
cucuuucuaaaggucucauu

SEQ ID NO: 10188 - RNA, 20 nt, Artificial Sequence
  TRAC targeting sequence
gcaucucucuuucuaaaggu

SEQ ID NO: 10189 - RNA, 20 nt, Artificial Sequence
  TRAC targeting sequence
uguucagcaucucucuuucu

SEQ ID NO: 10190 - RNA, 20 nt, Artificial Sequence
  TRAC targeting sequence
cauguucagcaucucucuuu

SEQ ID NO: 10191 - RNA, 20 nt, Artificial Sequence
  TRAC targeting sequence
guaagccucaagacaaaaac

SEQ ID NO: 10192 - RNA, 20 nt, Artificial Sequence
  TRAC targeting sequence
agacaaaaaccagaggaaau

SEQ ID NO: 10193 - RNA, 20 nt, Artificial Sequence
  TRAC targeting sequence
ugaggcuuacugauuucuca

SEQ ID NO: 10194 - RNA, 20 nt, Artificial Sequence
  TRAC targeting sequence
gguuuuugucuugaggcuua

SEQ ID NO: 10195 - RNA, 20 nt, Artificial Sequence
  TRAC targeting sequence
ucugguuuuugucuugaggc

SEQ ID NO: 10196 - RNA, 20 nt, Artificial Sequence
  TRAC targeting sequence
auuuccucugguuuuugucu

SEQ ID NO: 10197 - RNA, 20 nt, Artificial Sequence
  TRAC targeting sequence
ccauuuccucugguuuuugu

SEQ ID NO: 10198 - RNA, 20 nt, Artificial Sequence
  TRAC targeting sequence
cuccauuuccucugguuuuu

SEQ ID NO: 10199 - RNA, 20 nt, Artificial Sequence
  TRAC targeting sequence
cucuccauuuccucugguuu

SEQ ID NO: 10200 - RNA, 20 nt, Artificial Sequence
  TRAC targeting sequence
caucucucuccauuuccucu

SEQ ID NO: 10201 - RNA, 20 nt, Artificial Sequence
  TRAC targeting sequence
ugccucccaucucucuccau

SEQ ID NO: 10202 - RNA, 20 nt, Artificial Sequence
  TRAC targeting sequence
ggcuuccugccucccaucuc

SEQ ID NO: 10203 - RNA, 20 nt, Artificial Sequence
  TRAC targeting sequence
ggggacgcagcaggucagug

SEQ ID NO: 10204 - RNA, 20 nt, Artificial Sequence
  TRAC targeting sequence
cccgagguccggcuuccugc

SEQ ID NO: 10205 - RNA, 20 nt, Artificial Sequence
  TRAC targeting sequence
gugucccaggaccagaggug

SEQ ID NO: 10206 - RNA, 20 nt, Artificial Sequence
  TRAC targeting sequence
caggaccagagguggaaaug

SEQ ID NO: 10207 - RNA, 20 nt, Artificial Sequence
  TRAC targeting sequence
ugggacacugaccugcugcg

SEQ ID NO: 10208 - RNA, 20 nt, Artificial Sequence
  TRAC targeting sequence
gguccugggacacugaccug

SEQ ID NO: 10209 - RNA, 20 nt, Artificial Sequence
  TRAC targeting sequence
accucugguccugggacacu

SEQ ID NO: 10210 - RNA, 20 nt, Artificial Sequence
  TRAC targeting sequence
uccagccuuuggugggauga

SEQ ID NO: 10211 - RNA, 20 nt, Artificial Sequence
  TRAC targeting sequence
agccuuuggugggaugaaac

SEQ ID NO: 10212 - RNA, 20 nt, Artificial Sequence
  TRAC targeting sequence
caccaaaggcuggaagacca

SEQ ID NO: 10213 - RNA, 20 nt, Artificial Sequence
  TRAC targeting sequence
ucccaccaaaggcuggaaga

SEQ ID NO: 10214 - RNA, 20 nt, Artificial Sequence
  TRAC targeting sequence
guuucaucccaccaaaggcu

SEQ ID NO: 10215 - RNA, 20 nt, Artificial Sequence
  TRAC targeting sequence
cagacccaggccccuuuggg

SEQ ID NO: 10216 - RNA, 20 nt, Artificial Sequence
  TRAC targeting sequence
gugaggcucaguuucauccc

SEQ ID NO: 10217 - RNA, 20 nt, Artificial Sequence
  TRAC targeting sequence
cccaaaggggccugggucug

SEQ ID NO: 10218 - RNA, 20 nt, Artificial Sequence
  TRAC targeting sequence
ccccagaauuaaaagaggag

SEQ ID NO: 10219 - RNA, 20 nt, Artificial Sequence
  TRAC targeting sequence
ccagaauuaaaagaggagga

SEQ ID NO: 10220 - RNA, 20 nt, Artificial Sequence
  TRAC targeting sequence
ggggagaauaaacucaccca

SEQ ID NO: 10221 - RNA, 20 nt, Artificial Sequence
  TRAC targeting sequence
uuuaauucuggggagaauaa

SEQ ID NO: 10222 - RNA, 20 nt, Artificial Sequence
  TRAC targeting sequence
ucuuuuaauucuggggagaa

SEQ ID NO: 10223 - RNA, 20 nt, Artificial Sequence
  TRAC targeting sequence
uccucuuuuaauucugggga

SEQ ID NO: 10224 - RNA, 20 nt, Artificial Sequence
  TRAC targeting sequence
gcgagcuucagaaguccccc

SEQ ID NO: 10225 - RNA, 20 nt, Artificial Sequence
  TRAC targeting sequence
cagacuuccuccucuuuuaa

SEQ ID NO: 10226 - RNA, 20 nt, Artificial Sequence
  TRAC targeting sequence
gaagucccccuaggguucuu

SEQ ID NO: 10227 - RNA, 20 nt, Artificial Sequence
  TRAC targeting sequence
gaagcucgcagacuuccucc

SEQ ID NO: 10228 - RNA, 20 nt, Artificial Sequence
  TRAC targeting sequence
cccuaggguucuuguaaagg

SEQ ID NO: 10229 - RNA, 20 nt, Artificial Sequence
  TRAC targeting sequence
uguaaaggccuccagugcag

SEQ ID NO: 10230 - RNA, 20 nt, Artificial Sequence
  TRAC targeting sequence
agugcagugcuaaugcuggu

SEQ ID NO: 10231 - RNA, 20 nt, Artificial Sequence
  TRAC targeting sequence
auagcuaguaccaccagcau

SEQ ID NO: 10232 - RNA, 20 nt, Artificial Sequence
  TRAC targeting sequence
gcuuuccauagcuaguacca

SEQ ID NO: 10233 - RNA, 20 nt, Artificial Sequence
  TRAC targeting sequence
aaaugucagcuuuccauagc

SEQ ID NO: 10234 - RNA, 20 nt, Artificial Sequence
  TRAC targeting sequence
cuuguccaaaugucagcuuu

SEQ ID NO: 10235 - RNA, 20 nt, Artificial Sequence
  TRAC targeting sequence
ugacuguccauccaaguaag

SEQ ID NO: 10236 - RNA, 20 nt, Artificial Sequence
  TRAC targeting sequence
agauggucccuuguccaaau

SEQ ID NO: 10237 - RNA, 20 nt, Artificial Sequence
  TRAC targeting sequence
auccaaguaaguguaacaag

SEQ ID NO: 10238 - RNA, 20 nt, Artificial Sequence
  TRAC targeting sequence
aaguaaguguaacaagacac

SEQ ID NO: 10239 - RNA, 20 nt, Artificial Sequence
  TRAC targeting sequence
uguuacacuuacuuggaugg

SEQ ID NO: 10240 - RNA, 20 nt, Artificial Sequence
  TRAC targeting sequence
aguauacugcugugucuugu

SEQ ID NO: 10241 - RNA, 20 nt, Artificial Sequence
  TRAC targeting sequence
ggaaugucaccccaguguca

SEQ ID NO: 10242 - RNA, 20 nt, Artificial Sequence
  TRAC targeting sequence
agaauuuccaguauacugcu

SEQ ID NO: 10243 - RNA, 20 nt, Artificial Sequence
  TRAC targeting sequence
ccccagugucagguuuuaaa

SEQ ID NO: 10244 - RNA, 20 nt, Artificial Sequence
  TRAC targeting sequence
gguuuuaaagaaccagauau

SEQ ID NO: 10245 - RNA, 20 nt, Artificial Sequence
  TRAC targeting sequence
uuaaaaccugacacuggggu

SEQ ID NO: 10246 - RNA, 20 nt, Artificial Sequence
  TRAC targeting sequence
gguucuuuaaaaccugacac

SEQ ID NO: 10247 - RNA, 20 nt, Artificial Sequence
  TRAC targeting sequence
ucugagguccuuucucuucu

SEQ ID NO: 10248 - RNA, 20 nt, Artificial Sequence
  TRAC targeting sequence
gagguccuuucucuucuuua

SEQ ID NO: 10249 - RNA, 20 nt, Artificial Sequence
  TRAC targeting sequence
gaggacaccacuuaacuuua

SEQ ID NO: 10250 - RNA, 20 nt, Artificial Sequence
  TRAC targeting sequence
uuucucuucuuuaaccucaa

SEQ ID NO: 10251 - RNA, 20 nt, Artificial Sequence
  TRAC targeting sequence
cuucuuuaaccucaauauuc

SEQ ID NO: 10252 - RNA, 20 nt, Artificial Sequence
  TRAC targeting sequence
ucuuuaaccucaauauucac

SEQ ID NO: 10253 - RNA, 20 nt, Artificial Sequence
  TRAC targeting sequence
uuaaccucaauauucacaga

SEQ ID NO: 10254 - RNA, 20 nt, Artificial Sequence
  TRAC targeting sequence
auauucacagauuuucuuuu

SEQ ID NO: 10255 - RNA, 20 nt, Artificial Sequence
  TRAC targeting sequence
cagauuuucuuuuggacccu

SEQ ID NO: 10256 - RNA, 20 nt, Artificial Sequence
  TRAC targeting sequence
gugaauauugagguuaaaga

SEQ ID NO: 10257 - RNA, 20 nt, Artificial Sequence
  TRAC targeting sequence
uuuggacccugaguuguuag

SEQ ID NO: 10258 - RNA, 20 nt, Artificial Sequence
  TRAC targeting sequence
aaaagaaaaucugugaauau

SEQ ID NO: 10259 - RNA, 20 nt, Artificial Sequence
  TRAC targeting sequence
ggguccaaaagaaaaucugu

SEQ ID NO: 10260 - RNA, 20 nt, Artificial Sequence
  TRAC targeting sequence
gucucccugcugcguguaca

SEQ ID NO: 10261 - RNA, 20 nt, Artificial Sequence
  TRAC targeting sequence
cccugcugcguguacagcug

SEQ ID NO: 10262 - RNA, 20 nt, Artificial Sequence
  TRAC targeting sequence
cugcugcguguacagcugac

SEQ ID NO: 10263 - RNA, 20 nt, Artificial Sequence
  TRAC targeting sequence
gcuguacacgcagcagggag

SEQ ID NO: 10264 - RNA, 20 nt, Artificial Sequence
  TRAC targeting sequence
aggucagcuguacacgcagc

SEQ ID NO: 10265 - RNA, 20 nt, Artificial Sequence
  TRAC targeting sequence
agggucaaggucagcuguac

SEQ ID NO: 10266 - RNA, 20 nt, Artificial Sequence
  TRAC targeting sequence
gaaucuuuccugcuuucagu

SEQ ID NO: 10267 - RNA, 20 nt, Artificial Sequence
  TRAC targeting sequence
gacuuuccagggucaagguc

SEQ ID NO: 10268 - RNA, 20 nt, Artificial Sequence
  TRAC targeting sequence
uuccugcuuucagugucuuc

SEQ ID NO: 10269 - RNA, 20 nt, Artificial Sequence
  TRAC targeting sequence
ugcuuucagugucuucucug

SEQ ID NO: 10270 - RNA, 20 nt, Artificial Sequence
  TRAC targeting sequence
gugucuucucuggaggugau

SEQ ID NO: 10271 - RNA, 20 nt, Artificial Sequence
  TRAC targeting sequence
ucucuggaggugaugcccua

SEQ ID NO: 10272 - RNA, 20 nt, Artificial Sequence
  TRAC targeting sequence
cuggaggugaugcccuaacu

SEQ ID NO: 10273 - RNA, 20 nt, Artificial Sequence
  TRAC targeting sequence
ggaggugaugcccuaacuuu

SEQ ID NO: 10274 - RNA, 20 nt, Artificial Sequence
  TRAC targeting sequence
agagaagacacugaaagcag

SEQ ID NO: 10275 - RNA, 20 nt, Artificial Sequence
  TRAC targeting sequence
ccuccagagaagacacugaa

SEQ ID NO: 10276 - RNA, 20 nt, Artificial Sequence
  TRAC targeting sequence
aaaaaguuagggcaucaccu

SEQ ID NO: 10277 - RNA, 20 nt, Artificial Sequence
  TRAC targeting sequence
cccucaaaaaaguuagggca

SEQ ID NO: 10278 - RNA, 20 nt, Artificial Sequence
  TRAC targeting sequence
uccuuuccaaaugacucccc

SEQ ID NO: 10279 - RNA, 20 nt, Artificial Sequence
  TRAC targeting sequence
uuuccaaaugacuccccuga

SEQ ID NO: 10280 - RNA, 20 nt, Artificial Sequence
  TRAC targeting sequence
aaaugacuccccugaguaac

SEQ ID NO: 10281 - RNA, 20 nt, Artificial Sequence
  TRAC targeting sequence
uuuggaaaggaugaccuccc

SEQ ID NO: 10282 - RNA, 20 nt, Artificial Sequence
  TRAC targeting sequence
ccugaguaaccuguucuaau

SEQ ID NO: 10283 - RNA, 20 nt, Artificial Sequence
  TRAC targeting sequence
ggggagucauuuggaaagga

SEQ ID NO: 10284 - RNA, 20 nt, Artificial Sequence
  TRAC targeting sequence
aauguuuaguagcauucccu

SEQ ID NO: 10285 - RNA, 20 nt, Artificial Sequence
  TRAC targeting sequence
cugucagaaguccuuccuua

SEQ ID NO: 10286 - RNA, 20 nt, Artificial Sequence
  TRAC targeting sequence
gaaguccuuccuuaccucaa

SEQ ID NO: 10287 - RNA, 20 nt, Artificial Sequence
  TRAC targeting sequence
gacagggaaugcuacuaaac

SEQ ID NO: 10288 - RNA, 20 nt, Artificial Sequence
  TRAC targeting sequence
uuccuuaccucaaucuuaaa

SEQ ID NO: 10289 - RNA, 20 nt, Artificial Sequence
  TRAC targeting sequence
uuaccucaaucuuaaauuau

SEQ ID NO: 10290 - RNA, 20 nt, Artificial Sequence
  TRAC targeting sequence
aucuuaaauuauucuuggua

SEQ ID NO: 10291 - RNA, 20 nt, Artificial Sequence
  TRAC targeting sequence
uaaauuauucuugguauagc

SEQ ID NO: 10292 - RNA, 20 nt, Artificial Sequence
  TRAC targeting sequence
ugguauagccgaggccguuu

SEQ ID NO: 10293 - RNA, 20 nt, Artificial Sequence
  TRAC targeting sequence
gcuauaccaagaauaauuua

SEQ ID NO: 10294 - RNA, 20 nt, Artificial Sequence
  TRAC targeting sequence
accagcaucauccacaauaa

SEQ ID NO: 10295 - RNA, 20 nt, Artificial Sequence
  TRAC targeting sequence
uccacaauaaagaggaaaau

SEQ ID NO: 10296 - RNA, 20 nt, Artificial Sequence
  TRAC targeting sequence
acaauaaagaggaaaauuga

SEQ ID NO: 10297 - RNA, 20 nt, Artificial Sequence
  TRAC targeting sequence
uuauuguggaugaugcuggu

SEQ ID NO: 10298 - RNA, 20 nt, Artificial Sequence
  TRAC targeting sequence
ucuuuauuguggaugaugcu

SEQ ID NO: 10299 - RNA, 20 nt, Artificial Sequence
  TRAC targeting sequence
auuuuccucuuuauugugga

SEQ ID NO: 10300 - RNA, 20 nt, Artificial Sequence
  TRAC targeting sequence
caauuuuccucuuuauugug

SEQ ID NO: 10301 - RNA, 20 nt, Artificial Sequence
  TRAC targeting sequence
gcucucaauuuuccucuuua

SEQ ID NO: 10302 - RNA, 20 nt, Artificial Sequence
  TRAC targeting sequence
aacuccgcucucaauuuucc

SEQ ID NO: 10303 - RNA, 20 nt, Artificial Sequence
  TRAC targeting sequence
gaauggguuuuaaaugaaag

SEQ ID NO: 10304 - RNA, 20 nt, Artificial Sequence
  TRAC targeting sequence
gaaccaaauaccacauaccu

SEQ ID NO: 10305 - RNA, 20 nt, Artificial Sequence
  TRAC targeting sequence
uuuaaaacccauucugaacc

SEQ ID NO: 10306 - RNA, 20 nt, Artificial Sequence
  TRAC targeting sequence
acuuucauuuaaaacccauu

SEQ ID NO: 10307 - RNA, 20 nt, Artificial Sequence
  TRAC targeting sequence
ccacuuucauuuaaaaccca

SEQ ID NO: 10308 - RNA, 20 nt, Artificial Sequence
  TRAC targeting sequence
cucuccacuuucauuuaaaa

SEQ ID NO: 10309 - RNA, 20 nt, Artificial Sequence
  TRAC targeting sequence
uuuuuucccucuccacuuuc

SEQ ID NO: 10310 - RNA, 20 nt, Artificial Sequence
  TRAC targeting sequence
gguuucauuuuuucccucuc

SEQ ID NO: 10311 - RNA, 20 nt, Artificial Sequence
  TRAC targeting sequence
cauucagguuucauuuuuuc

SEQ ID NO: 10312 - RNA, 20 nt, Artificial Sequence
  TRAC targeting sequence
gaggucuuauuucaaauccc

SEQ ID NO: 10313 - RNA, 20 nt, Artificial Sequence
  TRAC targeting sequence
gauucccauucagguuucau

SEQ ID NO: 10314 - RNA, 20 nt, Artificial Sequence
  TRAC targeting sequence
uauuucaaaucccucucugu

SEQ ID NO: 10315 - RNA, 20 nt, Artificial Sequence
  TRAC targeting sequence
aaucccucucuguuuccugu

SEQ ID NO: 10316 - RNA, 20 nt, Artificial Sequence
  TRAC targeting sequence
cucucuguuuccugucuguc

SEQ ID NO: 10317 - RNA, 20 nt, Artificial Sequence
  TRAC targeting sequence
cuguuuccugucugucaucu

SEQ ID NO: 10318 - RNA, 20 nt, Artificial Sequence
  TRAC targeting sequence
guuuccugucugucaucucc

SEQ ID NO: 10319 - RNA, 20 nt, Artificial Sequence
  TRAC targeting sequence
ugucugucaucuccuuuugc

SEQ ID NO: 10320 - RNA, 20 nt, Artificial Sequence
  TRAC targeting sequence
gucaucuccuuuugcuucua

SEQ ID NO: 10321 - RNA, 20 nt, Artificial Sequence
  TRAC targeting sequence
ucuccuuuugcuucuauaga

SEQ ID NO: 10322 - RNA, 20 nt, Artificial Sequence
  TRAC targeting sequence
ccuuuugcuucuauagaugc

SEQ ID NO: 10323 - RNA, 20 nt, Artificial Sequence
  TRAC targeting sequence
uuuugcuucuauagaugcaa

SEQ ID NO: 10324 - RNA, 20 nt, Artificial Sequence
  TRAC targeting sequence
auagaugcaaaacuacagag

SEQ ID NO: 10325 - RNA, 20 nt, Artificial Sequence
  TRAC targeting sequence
auagaagcaaaaggagauga

SEQ ID NO: 10326 - RNA, 20 nt, Artificial Sequence
  TRAC targeting sequence
guaguuuugcaucuauagaa

SEQ ID NO: 10327 - RNA, 20 nt, Artificial Sequence
  TRAC targeting sequence
cuguaguuuugcaucuauag

SEQ ID NO: 10328 - RNA, 20 nt, Artificial Sequence
  TRAC targeting sequence
cucuguaguuuugcaucuau

SEQ ID NO: 10329 - RNA, 20 nt, Artificial Sequence
  TRAC targeting sequence
cucucuguaguuuugcaucu

SEQ ID NO: 10330 - RNA, 20 nt, Artificial Sequence
  TRAC targeting sequence
ccgccucucucucuguaguu

SEQ ID NO: 10331 - RNA, 20 nt, Artificial Sequence
  TRAC targeting sequence
ccccgccucucucucuguag

SEQ ID NO: 10332 - RNA, 20 nt, Artificial Sequence
  TRAC targeting sequence
cuccccgccucucucucugu

SEQ ID NO: 10333 - RNA, 20 nt, Artificial Sequence
  TRAC targeting sequence
uuucucuccccgccucucuc

SEQ ID NO: 10334 - RNA, 20 nt, Artificial Sequence
  TRAC targeting sequence
auccuuucucuccccgccuc

SEQ ID NO: 10335 - RNA, 20 nt, Artificial Sequence
  TRAC targeting sequence
gucuauccuuucucuccccg

SEQ ID NO: 10336 - RNA, 20 nt, Artificial Sequence
  TRAC targeting sequence
acuguguccauucccuguca

SEQ ID NO: 10337 - RNA, 20 nt, Artificial Sequence
  TRAC targeting sequence
auucccugucacugaaacca

SEQ ID NO: 10338 - RNA, 20 nt, Artificial Sequence
  TRAC targeting sequence
cugucacugaaaccaccagg

SEQ ID NO: 10339 - RNA, 20 nt, Artificial Sequence
  TRAC targeting sequence
cugaaaccaccaggcaaggg

SEQ ID NO: 10340 - RNA, 20 nt, Artificial Sequence
  TRAC targeting sequence
gugacagggaauggacacag

SEQ ID NO: 10341 - RNA, 20 nt, Artificial Sequence
  TRAC targeting sequence
cuugccuggugguuucagug

SEQ ID NO: 10342 - RNA, 20 nt, Artificial Sequence
  TRAC targeting sequence
aaagaguuucagauacacgg

SEQ ID NO: 10343 - RNA, 20 nt, Artificial Sequence
  TRAC targeting sequence
uuggaauuaauuguaauccc

SEQ ID NO: 10344 - RNA, 20 nt, Artificial Sequence
  TRAC targeting sequence
gauacacggcuuaauaccuu

SEQ ID NO: 10345 - RNA, 20 nt, Artificial Sequence
  TRAC targeting sequence
gaaacucuuuggaauuaauu

SEQ ID NO: 10346 - RNA, 20 nt, Artificial Sequence
  TRAC targeting sequence
ccuuguggugacuuguaucc

SEQ ID NO: 10347 - RNA, 20 nt, Artificial Sequence
  TRAC targeting sequence
uuguggugacuuguauccug

SEQ ID NO: 10348 - RNA, 20 nt, Artificial Sequence
  TRAC targeting sequence
ccacaaggagaaagguauua

SEQ ID NO: 10349 - RNA, 20 nt, Artificial Sequence
  TRAC targeting sequence
uggcugauaauuagagcaga

SEQ ID NO: 10350 - RNA, 20 nt, Artificial Sequence
  TRAC targeting sequence
gccaggauacaagucaccac

SEQ ID NO: 10351 - RNA, 20 nt, Artificial Sequence
  TRAC targeting sequence
aauuaucagccaggauacaa

SEQ ID NO: 10352 - RNA, 20 nt, Artificial Sequence
  TRAC targeting sequence
gcucuaauuaucagccagga

SEQ ID NO: 10353 - RNA, 20 nt, Artificial Sequence
  TRAC targeting sequence
aucugcucuaauuaucagcc

SEQ ID NO: 10354 - RNA, 20 nt, Artificial Sequence
  TRAC targeting sequence
uucuaucugcucuaauuauc

SEQ ID NO: 10355 - RNA, 20 nt, Artificial Sequence
  TRAC targeting sequence
cagcggggugcagcggcaaa

SEQ ID NO: 10356 - RNA, 20 nt, Artificial Sequence
  TRAC targeting sequence
ucccagcggggugcagcggc

SEQ ID NO: 10357 - RNA, 20 nt, Artificial Sequence
  TRAC targeting sequence
cuucccagcggggugcagcg

SEQ ID NO: 10358 - RNA, 20 nt, Artificial Sequence
  TRAC targeting sequence
gucucuucccagcggggugc

SEQ ID NO: 10359 - RNA, 20 nt, Artificial Sequence
  TRAC targeting sequence
aguuucugucucuucccagc

SEQ ID NO: 10360 - RNA, 20 nt, Artificial Sequence
  TRAC targeting sequence
uaaaaaacagucaaguuucu

SEQ ID NO: 10361 - RNA, 20 nt, Artificial Sequence
  TRAC targeting sequence
uaaaguuccuucugucaguc

SEQ ID NO: 10362 - RNA, 20 nt, Artificial Sequence
  TRAC targeting sequence
uucugucagucguuguaaaa

SEQ ID NO: 10363 - RNA, 20 nt, Artificial Sequence
  TRAC targeting sequence
gucagucguuguaaaacucc

SEQ ID NO: 10364 - RNA, 20 nt, Artificial Sequence
  TRAC targeting sequence
gucguuguaaaacucccuga

SEQ ID NO: 10365 - RNA, 20 nt, Artificial Sequence
  TRAC targeting sequence
uuguaaaacucccugaagca

SEQ ID NO: 10366 - RNA, 20 nt, Artificial Sequence
  TRAC targeting sequence
cugaagcagggagaugcgug

SEQ ID NO: 10367 - RNA, 20 nt, Artificial Sequence
  TRAC targeting sequence
gggaguuuuacaacgacuga

SEQ ID NO: 10368 - RNA, 20 nt, Artificial Sequence
  TRAC targeting sequence
cugcuucagggaguuuuaca

SEQ ID NO: 10369 - RNA, 20 nt, Artificial Sequence
  TRAC targeting sequence
cccugcuucagggaguuuua

SEQ ID NO: 10370 - RNA, 20 nt, Artificial Sequence
  TRAC targeting sequence
cgcaucucccugcuucaggg

SEQ ID NO: 10371 - RNA, 20 nt, Artificial Sequence
  TRAC targeting sequence
uagcugucacgcaucucccu

SEQ ID NO: 10372 - RNA, 20 nt, Artificial Sequence
  TRAC targeting sequence
cauagcugucacgcaucucc

SEQ ID NO: 10373 - RNA, 20 nt, Artificial Sequence
  TRAC targeting sequence
gcuucucauagcugucacgc

SEQ ID NO: 10374 - RNA, 20 nt, Artificial Sequence
  TRAC targeting sequence
aaauaucagcuucucauagc

SEQ ID NO: 10375 - RNA, 20 nt, Artificial Sequence
  TRAC targeting sequence
uuuccaaauaucagcuucuc

SEQ ID NO: 10376 - RNA, 20 nt, Artificial Sequence
  TRAC targeting sequence
ccuuuccaaauaucagcuuc

SEQ ID NO: 10377 - RNA, 20 nt, Artificial Sequence
  TRAC targeting sequence
ugucuccuuuccaaauauca

SEQ ID NO: 10378 - RNA, 20 nt, Artificial Sequence
  TRAC targeting sequence
caguuagucaugucuccuuu

SEQ ID NO: 10379 - RNA, 20 nt, Artificial Sequence
  TRAC targeting sequence
agcuugcuuggcuucacagu

SEQ ID NO: 10380 - RNA, 20 nt, Artificial Sequence
  TRAC targeting sequence
uuccagcuugcuuggcuuca

SEQ ID NO: 10381 - RNA, 20 nt, Artificial Sequence
  TRAC targeting sequence
caguguuccuuauguacuuu

SEQ ID NO: 10382 - RNA, 20 nt, Artificial Sequence
  TRAC targeting sequence
uuauguacuuuugcucccuu

SEQ ID NO: 10383 - RNA, 20 nt, Artificial Sequence
  TRAC targeting sequence
cuuccccguuucaggccuuu

SEQ ID NO: 10384 - RNA, 20 nt, Artificial Sequence
  TRAC targeting sequence
ccguuucaggccuuuuggcu

SEQ ID NO: 10385 - RNA, 20 nt, Artificial Sequence
  TRAC targeting sequence
ggccuuuuggcuguuuccug

SEQ ID NO: 10386 - RNA, 20 nt, Artificial Sequence
  TRAC targeting sequence
uguagggauucuaagagagu

SEQ ID NO: 10387 - RNA, 20 nt, Artificial Sequence
  TRAC targeting sequence
cuacaggaaacagccaaaag

SEQ ID NO: 10388 - RNA, 20 nt, Artificial Sequence
  TRAC targeting sequence
aagagagucaaauggaaaug

SEQ ID NO: 10389 - RNA, 20 nt, Artificial Sequence
  TRAC targeting sequence
uagaaucccuacaggaaaca

SEQ ID NO: 10390 - RNA, 20 nt, Artificial Sequence
  TRAC targeting sequence
cuuagaaucccuacaggaaa

SEQ ID NO: 10391 - RNA, 20 nt, Artificial Sequence
  TRAC targeting sequence
aauggaaauggauugaagag

SEQ ID NO: 10392 - RNA, 20 nt, Artificial Sequence
  TRAC targeting sequence
auuugacucucuuagaaucc

SEQ ID NO: 10393 - RNA, 20 nt, Artificial Sequence
  TRAC targeting sequence
auuuccauuugacucucuua

SEQ ID NO: 10394 - RNA, 20 nt, Artificial Sequence
  TRAC targeting sequence
auccauuuccauuugacucu

SEQ ID NO: 10395 - RNA, 20 nt, Artificial Sequence
  TRAC targeting sequence
ucaauccauuuccauuugac

SEQ ID NO: 10396 - RNA, 20 nt, Artificial Sequence
  TRAC targeting sequence
cuucaauccauuuccauuug

SEQ ID NO: 10397 - RNA, 20 nt, Artificial Sequence
  TRAC targeting sequence
gaagccccgugggugcucag

SEQ ID NO: 10398 - RNA, 20 nt, Artificial Sequence
  TRAC targeting sequence
gacucucuucaauccauuuc

SEQ ID NO: 10399 - RNA, 20 nt, Artificial Sequence
  TRAC targeting sequence
gaaaugauaaaugaaaggaa

SEQ ID NO: 10400 - RNA, 20 nt, Artificial Sequence
  TRAC targeting sequence
gagcacccacggggcuucag

SEQ ID NO: 10401 - RNA, 20 nt, Artificial Sequence
  TRAC targeting sequence
uuucugagcacccacggggc

SEQ ID NO: 10402 - RNA, 20 nt, Artificial Sequence
  TRAC targeting sequence
uuuaucauuucugagcaccc

SEQ ID NO: 10403 - RNA, 20 nt, Artificial Sequence
  TRAC targeting sequence
uuucauuuaucauuucugag

SEQ ID NO: 10404 - RNA, 20 nt, Artificial Sequence
  TRAC targeting sequence
uauuccuuucauuuaucauu

SEQ ID NO: 10405 - RNA, 20 nt, Artificial Sequence
  TRAC targeting sequence
cuuauuccuuucauuuauca

SEQ ID NO: 10406 - RNA, 20 nt, Artificial Sequence
  TRAC targeting sequence
gucucuuauuccuuucauuu

SEQ ID NO: 10407 - RNA, 20 nt, Artificial Sequence
  TRAC targeting sequence
cuuucugucucuuauuccuu

SEQ ID NO: 10408 - RNA, 20 nt, Artificial Sequence
  TRAC targeting sequence
acuuuguuucccuuucuguc

SEQ ID NO: 10409 - RNA, 20 nt, Artificial Sequence
  TRAC targeting sequence
ugcuuuucaacuuuguuucc

SEQ ID NO: 10410 - RNA, 20 nt, Artificial Sequence
  TRAC targeting sequence
uucacugcagcuugauaaga

SEQ ID NO: 10411 - RNA, 20 nt, Artificial Sequence
  TRAC targeting sequence
cugcagcuugauaagacuga

SEQ ID NO: 10412 - RNA, 20 nt, Artificial Sequence
  TRAC targeting sequence
agcugcagugaaagacauau

SEQ ID NO: 10413 - RNA, 20 nt, Artificial Sequence
  TRAC targeting sequence
uaucaagcugcagugaaaga

SEQ ID NO: 10414 - RNA, 20 nt, Artificial Sequence
  TRAC targeting sequence
gucuuaucaagcugcaguga

SEQ ID NO: 10415 - RNA, 20 nt, Artificial Sequence
  TRAC targeting sequence
cagucuuaucaagcugcagu

SEQ ID NO: 10416 - RNA, 20 nt, Artificial Sequence
  TRAC targeting sequence
caucucagucuuaucaagcu

SEQ ID NO: 10417 - RNA, 20 nt, Artificial Sequence
  TRAC targeting sequence
gagaagggcaugaucgcucc

SEQ ID NO: 10418 - RNA, 20 nt, Artificial Sequence
  TRAC targeting sequence
gacacccaccucacaucuca

SEQ ID NO: 10419 - RNA, 20 nt, Artificial Sequence
  TRAC targeting sequence
cugacacccaccucacaucu

SEQ ID NO: 10420 - RNA, 20 nt, Artificial Sequence
  TRAC targeting sequence
ugcccuucucugacacccac

SEQ ID NO: 10421 - RNA, 20 nt, Artificial Sequence
  TRAC targeting sequence
cuccagcugcuauugcagaa

SEQ ID NO: 10422 - RNA, 20 nt, Artificial Sequence
  TRAC targeting sequence
agcugcuauugcagaacacu

SEQ ID NO: 10423 - RNA, 20 nt, Artificial Sequence
  TRAC targeting sequence
gcaauagcagcuggagcgau

SEQ ID NO: 10424 - RNA, 20 nt, Artificial Sequence
  TRAC targeting sequence
guuuuccuaggaucucuauc

SEQ ID NO: 10425 - RNA, 20 nt, Artificial Sequence
  TRAC targeting sequence
uaggaucucuaucaagggca

SEQ ID NO: 10426 - RNA, 20 nt, Artificial Sequence
  TRAC targeting sequence
uaggaaaacagaguguucug

SEQ ID NO: 10427 - RNA, 20 nt, Artificial Sequence
  TRAC targeting sequence
cuaucaagggcaguguccuc

SEQ ID NO: 10428 - RNA, 20 nt, Artificial Sequence
  TRAC targeting sequence
aucaagggcaguguccucuu

SEQ ID NO: 10429 - RNA, 20 nt, Artificial Sequence
  TRAC targeting sequence
agggcaguguccucuuaugc

SEQ ID NO: 10430 - RNA, 20 nt, Artificial Sequence
  TRAC targeting sequence
ucuuaugccaaagggaugag

SEQ ID NO: 10431 - RNA, 20 nt, Artificial Sequence
  TRAC targeting sequence
uaugccaaagggaugaguca

SEQ ID NO: 10432 - RNA, 20 nt, Artificial Sequence
  TRAC targeting sequence
cuuuggcauaagaggacacu

SEQ ID NO: 10433 - RNA, 20 nt, Artificial Sequence
  TRAC targeting sequence
ucccuuuggcauaagaggac

SEQ ID NO: 10434 - RNA, 20 nt, Artificial Sequence
  TRAC targeting sequence
agucccuauauuucuggagu

SEQ ID NO: 10435 - RNA, 20 nt, Artificial Sequence
  TRAC targeting sequence
cuauauuucuggaguagcug

SEQ ID NO: 10436 - RNA, 20 nt, Artificial Sequence
  TRAC targeting sequence
ggaguagcugcccuugugca

SEQ ID NO: 10437 - RNA, 20 nt, Artificial Sequence
  TRAC targeting sequence
agaaauauagggacuugacu

SEQ ID NO: 10438 - RNA, 20 nt, Artificial Sequence
  TRAC targeting sequence
ggcagacagcacaaucccag

SEQ ID NO: 10439 - RNA, 20 nt, Artificial Sequence
  TRAC targeting sequence
gccugaccaacuaugccugc

SEQ ID NO: 10440 - RNA, 20 nt, Artificial Sequence
  TRAC targeting sequence
cagcucaguguguauggagg

SEQ ID NO: 10441 - RNA, 20 nt, Artificial Sequence
  TRAC targeting sequence
guguguauggaggaggccac

SEQ ID NO: 10442 - RNA, 20 nt, Artificial Sequence
  TRAC targeting sequence
auacacacugagcugggauu

SEQ ID NO: 10443 - RNA, 20 nt, Artificial Sequence
  TRAC targeting sequence
uccauacacacugagcuggg

SEQ ID NO: 10444 - RNA, 20 nt, Artificial Sequence
  TRAC targeting sequence
gguggccuccuccauacaca

SEQ ID NO: 10445 - RNA, 20 nt, Artificial Sequence
  TRAC targeting sequence
gcuccauucaguggcagcau

SEQ ID NO: 10446 - RNA, 20 nt, Artificial Sequence
  TRAC targeting sequence
auucaguggcagcauaaauc

SEQ ID NO: 10447 - RNA, 20 nt, Artificial Sequence
  TRAC targeting sequence
guggcagcauaaauccauac

SEQ ID NO: 10448 - RNA, 20 nt, Artificial Sequence
  TRAC targeting sequence
auaccagguggguguggauu

SEQ ID NO: 10449 - RNA, 20 nt, Artificial Sequence
  TRAC targeting sequence
acacccaccugguauggauu

SEQ ID NO: 10450 - RNA, 20 nt, Artificial Sequence
  TRAC targeting sequence
aaauccacacccaccuggua

SEQ ID NO: 10451 - RNA, 20 nt, Artificial Sequence
  TRAC targeting sequence
gccuuguaguggcacuggca

SEQ ID NO: 10452 - RNA, 20 nt, Artificial Sequence
  TRAC targeting sequence
acauucagccuuguaguggc

SEQ ID NO: 10453 - RNA, 20 nt, Artificial Sequence
  TRAC targeting sequence
caacaacucaacauucagcc

SEQ ID NO: 10454 - RNA, 20 nt, Artificial Sequence
  TRAC targeting sequence
ucuugaaugugugagaugcc

SEQ ID NO: 10455 - RNA, 20 nt, Artificial Sequence
  TRAC targeting sequence
ugaaugugugagaugccucc

SEQ ID NO: 10456 - RNA, 20 nt, Artificial Sequence
  TRAC targeting sequence
agaugaucacaacaacucaa

SEQ ID NO: 10457 - RNA, 20 nt, Artificial Sequence
  TRAC targeting sequence
cacauucaagaugaucacaa

SEQ ID NO: 10458 - RNA, 20 nt, Artificial Sequence
  TRAC targeting sequence
cacacauucaagaugaucac

SEQ ID NO: 10459 - RNA, 20 nt, Artificial Sequence
  TRAC targeting sequence
aagugaagucugguucuaau

SEQ ID NO: 10460 - RNA, 20 nt, Artificial Sequence
  TRAC targeting sequence
cuuggaggcaucucacacau

SEQ ID NO: 10461 - RNA, 20 nt, Artificial Sequence
  TRAC targeting sequence
gguucuaaugagcagggugc

SEQ ID NO: 10462 - RNA, 20 nt, Artificial Sequence
  TRAC targeting sequence
aaugagcagggugcagguug

SEQ ID NO: 10463 - RNA, 20 nt, Artificial Sequence
  TRAC targeting sequence
uuagaaccagacuucacuug

SEQ ID NO: 10464 - RNA, 20 nt, Artificial Sequence
  TRAC targeting sequence
aaccugcacccugcucauua

SEQ ID NO: 10465 - RNA, 20 nt, Artificial Sequence
  TRAC targeting sequence
guugaguuucuccaagccca

SEQ ID NO: 10466 - RNA, 20 nt, Artificial Sequence
  TRAC targeting sequence
acagaaaaugggcaauauug

SEQ ID NO: 10467 - RNA, 20 nt, Artificial Sequence
  TRAC targeting sequence
ccaagcccaguaguguggga

SEQ ID NO: 10468 - RNA, 20 nt, Artificial Sequence
  TRAC targeting sequence
aagcccaguagugugggagc

SEQ ID NO: 10469 - RNA, 20 nt, Artificial Sequence
  TRAC targeting sequence
cacacuacugggcuuggaga

SEQ ID NO: 10470 - RNA, 20 nt, Artificial Sequence
  TRAC targeting sequence
auguuggcucccacacuacu

SEQ ID NO: 10471 - RNA, 20 nt, Artificial Sequence
  TRAC targeting sequence
caauguuggcucccacacua

SEQ ID NO: 10472 - RNA, 20 nt, Artificial Sequence
  TRAC targeting sequence
cucaauguuggcucccacac

SEQ ID NO: 10473 - RNA, 20 nt, Artificial Sequence
  TRAC targeting sequence
gucucucaauguuggcuccc

SEQ ID NO: 10474 - RNA, 20 nt, Artificial Sequence
  TRAC targeting sequence
aaugucagucucucaauguu

SEQ ID NO: 10475 - RNA, 20 nt, Artificial Sequence
  TRAC targeting sequence
cuagcucaaaugucagucuc

SEQ ID NO: 10476 - RNA, 20 nt, Artificial Sequence
  TRAC targeting sequence
uauugacugaaauaugccaa

SEQ ID NO: 10477 - RNA, 20 nt, Artificial Sequence
  TRAC targeting sequence
auaggaucccuagcucaaau

SEQ ID NO: 10478 - RNA, 20 nt, Artificial Sequence
  TRAC targeting sequence
gucaauaggaucccuagcuc

SEQ ID NO: 10479 - RNA, 20 nt, Artificial Sequence
  TRAC targeting sequence
cuuuggcauauuucagucaa

SEQ ID NO: 10480 - RNA, 20 nt, Artificial Sequence
  TRAC targeting sequence
gaaaggucaaaacugccuuc

SEQ ID NO: 10481 - RNA, 20 nt, Artificial Sequence
  TRAC targeting sequence
gaucccuuuggcauauuuca

SEQ ID NO: 10482 - RNA, 20 nt, Artificial Sequence
  TRAC targeting sequence
aaacugccuucagagcucag

SEQ ID NO: 10483 - RNA, 20 nt, Artificial Sequence
  TRAC targeting sequence
gagcucagccuuuguuguua

SEQ ID NO: 10484 - RNA, 20 nt, Artificial Sequence
  TRAC targeting sequence
gaaggcaguuuugaccuuuc

SEQ ID NO: 10485 - RNA, 20 nt, Artificial Sequence
  TRAC targeting sequence
gccuuuguuguuaucucucu

SEQ ID NO: 10486 - RNA, 20 nt, Artificial Sequence
  TRAC targeting sequence
cucuggcaguugucauuuca

SEQ ID NO: 10487 - RNA, 20 nt, Artificial Sequence
  TRAC targeting sequence
cuggcaguugucauuucagc

SEQ ID NO: 10488 - RNA, 20 nt, Artificial Sequence
  TRAC targeting sequence
ggcaguugucauuucagcaa

SEQ ID NO: 10489 - RNA, 20 nt, Artificial Sequence
  TRAC targeting sequence
uuucagcaaaaugcauccac

SEQ ID NO: 10490 - RNA, 20 nt, Artificial Sequence
  TRAC targeting sequence
gcaaaaugcauccacuuaga

SEQ ID NO: 10491 - RNA, 20 nt, Artificial Sequence
  TRAC targeting sequence
acuuagaaagcucagcucuu

SEQ ID NO: 10492 - RNA, 20 nt, Artificial Sequence
  TRAC targeting sequence
aaguggaugcauuuugcuga

SEQ ID NO: 10493 - RNA, 20 nt, Artificial Sequence
  TRAC targeting sequence
gcucuucauuaggcagacaa

SEQ ID NO: 10494 - RNA, 20 nt, Artificial Sequence
  TRAC targeting sequence
ucauuaggcagacaaaugag

SEQ ID NO: 10495 - RNA, 20 nt, Artificial Sequence
  TRAC targeting sequence
uuaggcagacaaaugagaac

SEQ ID NO: 10496 - RNA, 20 nt, Artificial Sequence
  TRAC targeting sequence
gccuaaugaagagcugagcu

SEQ ID NO: 10497 - RNA, 20 nt, Artificial Sequence
  TRAC targeting sequence
uuugucugccuaaugaagag

SEQ ID NO: 10498 - RNA, 20 nt, Artificial Sequence
  TRAC targeting sequence
cauuugucugccuaaugaag

SEQ ID NO: 10499 - RNA, 20 nt, Artificial Sequence
  TRAC targeting sequence
auauguuguucucauuuguc

SEQ ID NO: 10500 - RNA, 20 nt, Artificial Sequence
  TRAC targeting sequence
ggucaauauguuguucucau

SEQ ID NO: 10501 - RNA, 20 nt, Artificial Sequence
  TRAC targeting sequence
cuggucaauauguuguucuc

SEQ ID NO: 10502 - RNA, 20 nt, Artificial Sequence
  TRAC targeting sequence
uuaucucuggucaauauguu

SEQ ID NO: 10503 - RNA, 20 nt, Artificial Sequence
  TRAC targeting sequence
caacuccuuaucucugguca

SEQ ID NO: 10504 - RNA, 20 nt, Artificial Sequence
  TRAC targeting sequence
gggcucccaacuccuuaucu

SEQ ID NO: 10505 - RNA, 20 nt, Artificial Sequence
  TRAC targeting sequence
cagccucugagagccuggca

SEQ ID NO: 10506 - RNA, 20 nt, Artificial Sequence
  TRAC targeting sequence
gccucugagagccuggcauu

SEQ ID NO: 10507 - RNA, 20 nt, Artificial Sequence
  TRAC targeting sequence
gagagccuggcauuuccagu

SEQ ID NO: 10508 - RNA, 20 nt, Artificial Sequence
  TRAC targeting sequence
gaggcugagaucugggcucc

SEQ ID NO: 10509 - RNA, 20 nt, Artificial Sequence
  TRAC targeting sequence
cagaggcugagaucugggcu

SEQ ID NO: 10510 - RNA, 20 nt, Artificial Sequence
  TRAC targeting sequence
aguucuuuaaucacgugagc

SEQ ID NO: 10511 - RNA, 20 nt, Artificial Sequence
  TRAC targeting sequence
uuaaucacgugagccaguga

SEQ ID NO: 10512 - RNA, 20 nt, Artificial Sequence
  TRAC targeting sequence
cgugagccagugagcauaug

SEQ ID NO: 10513 - RNA, 20 nt, Artificial Sequence
  TRAC targeting sequence
cgugauuaaagaacuggaaa

SEQ ID NO: 10514 - RNA, 20 nt, Artificial Sequence
  TRAC targeting sequence
cuggcucacgugauuaaaga

SEQ ID NO: 10515 - RNA, 20 nt, Artificial Sequence
  TRAC targeting sequence
cagagaaagcagaucaaugg

SEQ ID NO: 10516 - RNA, 20 nt, Artificial Sequence
  TRAC targeting sequence
gagaaagcagaucaauggug

SEQ ID NO: 10517 - RNA, 20 nt, Artificial Sequence
  TRAC targeting sequence
gagauagcauaugcucacug

SEQ ID NO: 10518 - RNA, 20 nt, Artificial Sequence
  TRAC targeting sequence
cugagauagcauaugcucac

SEQ ID NO: 10519 - RNA, 20 nt, Artificial Sequence
  TRAC targeting sequence
gcuuucucugagauagcaua

SEQ ID NO: 10520 - RNA, 20 nt, Artificial Sequence
  TRAC targeting sequence
auggugccugaggaccuggu

SEQ ID NO: 10521 - RNA, 20 nt, Artificial Sequence
  TRAC targeting sequence
ggcaccauugaucugcuuuc

SEQ ID NO: 10522 - RNA, 20 nt, Artificial Sequence
  TRAC targeting sequence
ucaggcaccauugaucugcu

SEQ ID NO: 10523 - RNA, 20 nt, Artificial Sequence
  TRAC targeting sequence
ccaagcuagggcuuagagac

SEQ ID NO: 10524 - RNA, 20 nt, Artificial Sequence
  TRAC targeting sequence
aagcccuagcuuggugacac

SEQ ID NO: 10525 - RNA, 20 nt, Artificial Sequence
  TRAC targeting sequence
cuaagcccuagcuuggugac

SEQ ID NO: 10526 - RNA, 20 nt, Artificial Sequence
  TRAC targeting sequence
gucucuaagcccuagcuugg

SEQ ID NO: 10527 - RNA, 20 nt, Artificial Sequence
  TRAC targeting sequence
uuucugucucuaagcccuag

SEQ ID NO: 10528 - RNA, 20 nt, Artificial Sequence
  TRAC targeting sequence
cauuucugucucuaagcccu

SEQ ID NO: 10529 - RNA, 20 nt, Artificial Sequence
  TRAC targeting sequence
gcaucucauuucugucucua

SEQ ID NO: 10530 - RNA, 20 nt, Artificial Sequence
  TRAC targeting sequence
ccaucugcaucucauuucug

SEQ ID NO: 10531 - RNA, 20 nt, Artificial Sequence
  TRAC targeting sequence
cacaacauccccaucugcau

SEQ ID NO: 10532 - RNA, 20 nt, Artificial Sequence
  TRAC targeting sequence
ccaauucacacaacaucccc

SEQ ID NO: 10533 - RNA, 20 nt, Artificial Sequence
  TRAC targeting sequence
auuauuccccaauucacaca

SEQ ID NO: 10534 - RNA, 20 nt, Artificial Sequence
  TRAC targeting sequence
cuauuauuccccaauucaca

SEQ ID NO: 10535 - RNA, 20 nt, Artificial Sequence
  TRAC targeting sequence
cuucucuauuauuccccaau

SEQ ID NO: 10536 - RNA, 20 nt, Artificial Sequence
  TRAC targeting sequence
ucacuucucuauuauucccc

SEQ ID NO: 10537 - RNA, 20 nt, Artificial Sequence
  TRAC targeting sequence
uccucacuucucuauuauuc

SEQ ID NO: 10538 - RNA, 20 nt, Artificial Sequence
  TRAC targeting sequence
ccuccucacuucucuauuau

SEQ ID NO: 10539 - RNA, 20 nt, Artificial Sequence
  TRAC targeting sequence
cugucuccuccucacuucuc

SEQ ID NO: 10540 - RNA, 20 nt, Artificial Sequence
  TRAC targeting sequence
augaugcuuuuuaaaaccag

SEQ ID NO: 10541 - RNA, 20 nt, Artificial Sequence
  TRAC targeting sequence
uugaacucccugucuccucc

SEQ ID NO: 10542 - RNA, 20 nt, Artificial Sequence
  TRAC targeting sequence
caugcugcugguuuuaaaaa

SEQ ID NO: 10543 - RNA, 20 nt, Artificial Sequence
  TRAC targeting sequence
cacaugcugcugguuuuaaa

SEQ ID NO: 10544 - RNA, 20 nt, Artificial Sequence
  TRAC targeting sequence
uuacaauuucucacaugcug

SEQ ID NO: 10545 - RNA, 20 nt, Artificial Sequence
  TRAC targeting sequence
ccuuugugucauuacaauuu

SEQ ID NO: 10546 - RNA, 20 nt, Artificial Sequence
  TRAC targeting sequence
ucaccuuugugucauuacaa

SEQ ID NO: 10547 - RNA, 20 nt, Artificial Sequence
  TRAC targeting sequence
uagcaaguuuccuaccauuc

SEQ ID NO: 10548 - RNA, 20 nt, Artificial Sequence
  TRAC targeting sequence
uaccauucccaacagaaucu

SEQ ID NO: 10549 - RNA, 20 nt, Artificial Sequence
  TRAC targeting sequence
caacagaaucuagccucacu

SEQ ID NO: 10550 - RNA, 20 nt, Artificial Sequence
  TRAC targeting sequence
guugggaaugguaggaaacu

SEQ ID NO: 10551 - RNA, 20 nt, Artificial Sequence
  TRAC targeting sequence
agccucacuguggcuccaac

SEQ ID NO: 10552 - RNA, 20 nt, Artificial Sequence
  TRAC targeting sequence
cuguggcuccaacucacaga

SEQ ID NO: 10553 - RNA, 20 nt, Artificial Sequence
  TRAC targeting sequence
aacucacagauccuauaggu

SEQ ID NO: 10554 - RNA, 20 nt, Artificial Sequence
  TRAC targeting sequence
cagauccuauagguaaugcu

SEQ ID NO: 10555 - RNA, 20 nt, Artificial Sequence
  TRAC targeting sequence
gugaguuggagccacaguga

SEQ ID NO: 10556 - RNA, 20 nt, Artificial Sequence
  TRAC targeting sequence
uauagguaaugcugaaucuu

SEQ ID NO: 10557 - RNA, 20 nt, Artificial Sequence
  TRAC targeting sequence
gcauuaccuauaggaucugu

SEQ ID NO: 10558 - RNA, 20 nt, Artificial Sequence
  TRAC targeting sequence
uaccugagaugccuuuugaa

SEQ ID NO: 10559 - RNA, 20 nt, Artificial Sequence
  TRAC targeting sequence
gguaagauucagcauuaccu

SEQ ID NO: 10560 - RNA, 20 nt, Artificial Sequence
  TRAC targeting sequence
cagguaagauucagcauuac

SEQ ID NO: 10561 - RNA, 20 nt, Artificial Sequence
  TRAC targeting sequence
aaaggcaucucagguaagau

SEQ ID NO: 10562 - RNA, 20 nt, Artificial Sequence
  TRAC targeting sequence
agacugggcucuaaaaucuu

SEQ ID NO: 10563 - RNA, 20 nt, Artificial Sequence
  TRAC targeting sequence
ugaugccacuucaaaaggca

SEQ ID NO: 10564 - RNA, 20 nt, Artificial Sequence
  TRAC targeting sequence
aaaaucuuuaagagucaccu

SEQ ID NO: 10565 - RNA, 20 nt, Artificial Sequence
  TRAC targeting sequence
uuaagagucaccugucaguu

SEQ ID NO: 10566 - RNA, 20 nt, Artificial Sequence
  TRAC targeting sequence
uaaagauuuuagagcccagu

SEQ ID NO: 10567 - RNA, 20 nt, Artificial Sequence
  TRAC targeting sequence
ccugucaguuauuguaaagg

SEQ ID NO: 10568 - RNA, 20 nt, Artificial Sequence
  TRAC targeting sequence
guuauuguaaagguuuggau

SEQ ID NO: 10569 - RNA, 20 nt, Artificial Sequence
  TRAC targeting sequence
aaaccuuuacaauaacugac

SEQ ID NO: 10570 - RNA, 20 nt, Artificial Sequence
  TRAC targeting sequence
cacagccauccaaaccuuua

SEQ ID NO: 10571 - RNA, 20 nt, Artificial Sequence
  TRAC targeting sequence
uacgacaaggugauauuugg

SEQ ID NO: 10572 - RNA, 20 nt, Artificial Sequence
  TRAC targeting sequence
uaggagguuuucacacagcc

SEQ ID NO: 10573 - RNA, 20 nt, Artificial Sequence
  TRAC targeting sequence
ccuugucguaggagguuuuc

SEQ ID NO: 10574 - RNA, 20 nt, Artificial Sequence
  TRAC targeting sequence
cuggcccaaauaucaccuug

SEQ ID NO: 10575 - RNA, 20 nt, Artificial Sequence
  TRAC targeting sequence
gucauuccaaguaagugucc

SEQ ID NO: 10576 - RNA, 20 nt, Artificial Sequence
  TRAC targeting sequence
uuccaaguaagugucccugg

SEQ ID NO: 10577 - RNA, 20 nt, Artificial Sequence
  TRAC targeting sequence
aaguaagugucccuggggug

SEQ ID NO: 10578 - RNA, 20 nt, Artificial Sequence
  TRAC targeting sequence
cuggggugcugccuguggag

SEQ ID NO: 10579 - RNA, 20 nt, Artificial Sequence
  TRAC targeting sequence
acaggcagcaccccagggac

SEQ ID NO: 10580 - RNA, 20 nt, Artificial Sequence
  TRAC targeting sequence
cauacauuagggcuuaaaug

SEQ ID NO: 10581 - RNA, 20 nt, Artificial Sequence
  TRAC targeting sequence
uacauuagggcuuaaaugac

SEQ ID NO: 10582 - RNA, 20 nt, Artificial Sequence
  TRAC targeting sequence
uuuaagcccuaauguaugag

SEQ ID NO: 10583 - RNA, 20 nt, Artificial Sequence
  TRAC targeting sequence
gcacagucauuuaagcccua

SEQ ID NO: 10584 - RNA, 20 nt, Artificial Sequence
  TRAC targeting sequence
ugguugaggacacaaaacug

SEQ ID NO: 10585 - RNA, 20 nt, Artificial Sequence
  TRAC targeting sequence
accacgaugccaucugcaca

SEQ ID NO: 10586 - RNA, 20 nt, Artificial Sequence
  TRAC targeting sequence
ucaaccacgaugccaucugc

SEQ ID NO: 10587 - RNA, 20 nt, Artificial Sequence
  TRAC targeting sequence
guuuuguguccucaaccacg

SEQ ID NO: 10588 - RNA, 20 nt, Artificial Sequence
  TRAC targeting sequence
caguuuuguguccucaacca

SEQ ID NO: 10589 - RNA, 20 nt, Artificial Sequence
  TRAC targeting sequence
cucaguuuuguguccucaac

SEQ ID NO: 10590 - RNA, 20 nt, Artificial Sequence
  TRAC targeting sequence
agauacauugacucugauca

SEQ ID NO: 10591 - RNA, 20 nt, Artificial Sequence
  TRAC targeting sequence
auucucucaguuuugugucc

SEQ ID NO: 10592 - RNA, 20 nt, Artificial Sequence
  TRAC targeting sequence
cgauucucucaguuuugugu

SEQ ID NO: 10593 - RNA, 20 nt, Artificial Sequence
  TRAC targeting sequence
auguaucucgauucucucag

SEQ ID NO: 10594 - RNA, 20 nt, Artificial Sequence
  TRAC targeting sequence
gaucagaaaaaaaggucacg

SEQ ID NO: 10595 - RNA, 20 nt, Artificial Sequence
  TRAC targeting sequence
gagucaauguaucucgauuc

SEQ ID NO: 10596 - RNA, 20 nt, Artificial Sequence
  TRAC targeting sequence
gaaaaaaaggucacggaaua

SEQ ID NO: 10597 - RNA, 20 nt, Artificial Sequence
  TRAC targeting sequence
gaucagagucaauguaucuc

SEQ ID NO: 10598 - RNA, 20 nt, Artificial Sequence
  TRAC targeting sequence
cggaauagcaaacauagguu

SEQ ID NO: 10599 - RNA, 20 nt, Artificial Sequence
  TRAC targeting sequence
gugaccuuuuuuucugauca

SEQ ID NO: 10600 - RNA, 20 nt, Artificial Sequence
  TRAC targeting sequence
uuaaaagguagcauagauaa

SEQ ID NO: 10601 - RNA, 20 nt, Artificial Sequence
  TRAC targeting sequence
augcuaccuuuuaaggacua

SEQ ID NO: 10602 - RNA, 20 nt, Artificial Sequence
  TRAC targeting sequence
cauguuaucuaugcuaccuu

SEQ ID NO: 10603 - RNA, 20 nt, Artificial Sequence
  TRAC targeting sequence
agucccauguuaucuaugcu

SEQ ID NO: 10604 - RNA, 20 nt, Artificial Sequence
  TRAC targeting sequence
aauugccacguucaaguccc

SEQ ID NO: 10605 - RNA, 20 nt, Artificial Sequence
  TRAC targeting sequence
aucagcacguucucacugca

SEQ ID NO: 10606 - RNA, 20 nt, Artificial Sequence
  TRAC targeting sequence
gcacguucucacugcacacg

SEQ ID NO: 10607 - RNA, 20 nt, Artificial Sequence
  TRAC targeting sequence
cacugcacacgggggauaaa

SEQ ID NO: 10608 - RNA, 20 nt, Artificial Sequence
  TRAC targeting sequence
cugcacacgggggauaaaca

SEQ ID NO: 10609 - RNA, 20 nt, Artificial Sequence
  TRAC targeting sequence
cccgugugcagugagaacgu

SEQ ID NO: 10610 - RNA, 20 nt, Artificial Sequence
  TRAC targeting sequence
cccaccccuguuuauccccc

SEQ ID NO: 10611 - RNA, 20 nt, Artificial Sequence
  TRAC targeting sequence
auugcuuauucccccacccc

SEQ ID NO: 10612 - RNA, 20 nt, Artificial Sequence
  TRAC targeting sequence
ugcaauguccauugcuuauu

SEQ ID NO: 10613 - RNA, 20 nt, Artificial Sequence
  TRAC targeting sequence
cuagcaccccuaucaugcaa

SEQ ID NO: 10614 - RNA, 20 nt, Artificial Sequence
  TRAC targeting sequence
uuucccuagcaccccuauca

SEQ ID NO: 10615 - RNA, 20 nt, Artificial Sequence
  TRAC targeting sequence
ggaagaaggaaggugaucag

SEQ ID NO: 10616 - RNA, 20 nt, Artificial Sequence
  TRAC targeting sequence
ugaccugccucauuucccua

SEQ ID NO: 10617 - RNA, 20 nt, Artificial Sequence
  TRAC targeting sequence
uccugaccugccucauuucc

SEQ ID NO: 10618 - RNA, 20 nt, Artificial Sequence
  TRAC targeting sequence
uucuuccugaccugccucau

SEQ ID NO: 10619 - RNA, 20 nt, Artificial Sequence
  TRAC targeting sequence
ccuuccuucuuccugaccug

SEQ ID NO: 10620 - RNA, 20 nt, Artificial Sequence
  TRAC targeting sequence
gagccucauacggaguuaau

SEQ ID NO: 10621 - RNA, 20 nt, Artificial Sequence
  TRAC targeting sequence
gaucaccuuccuucuuccug

SEQ ID NO: 10622 - RNA, 20 nt, Artificial Sequence
  TRAC targeting sequence
uacggaguuaaucuagagaa

SEQ ID NO: 10623 - RNA, 20 nt, Artificial Sequence
  TRAC targeting sequence
guaugaggcucugaucaccu

SEQ ID NO: 10624 - RNA, 20 nt, Artificial Sequence
  TRAC targeting sequence
agagaagaugaauuguucca

SEQ ID NO: 10625 - RNA, 20 nt, Artificial Sequence
  TRAC targeting sequence
agauuaacuccguaugaggc

SEQ ID NO: 10626 - RNA, 20 nt, Artificial Sequence
  TRAC targeting sequence
cuagauuaacuccguaugag

SEQ ID NO: 10627 - RNA, 20 nt, Artificial Sequence
  TRAC targeting sequence
ucucuagauuaacuccguau

SEQ ID NO: 10628 - RNA, 20 nt, Artificial Sequence
  TRAC targeting sequence
ucuucucuagauuaacuccg

SEQ ID NO: 10629 - RNA, 20 nt, Artificial Sequence
  TRAC targeting sequence
auaaguuucacaaagaaaua

SEQ ID NO: 10630 - RNA, 20 nt, Artificial Sequence
  TRAC targeting sequence
caaagaaauaaaguccaaag

SEQ ID NO: 10631 - RNA, 20 nt, Artificial Sequence
  TRAC targeting sequence
uugugaaacuuauggaacaa

SEQ ID NO: 10632 - RNA, 20 nt, Artificial Sequence
  TRAC targeting sequence
aaagauauaauaagaagucc

SEQ ID NO: 10633 - RNA, 20 nt, Artificial Sequence
  TRAC targeting sequence
uuggacuuuauuucuuugug

SEQ ID NO: 10634 - RNA, 20 nt, Artificial Sequence
  TRAC targeting sequence
uauuauaucuuuggacuuua

SEQ ID NO: 10635 - RNA, 20 nt, Artificial Sequence
  TRAC targeting sequence
ugauuaaaauccacuucaga

SEQ ID NO: 10636 - RNA, 20 nt, Artificial Sequence
  TRAC targeting sequence
ggacuucuuauuauaucuuu

SEQ ID NO: 10637 - RNA, 20 nt, Artificial Sequence
  TRAC targeting sequence
acuucagaaucauaugauca

SEQ ID NO: 10638 - RNA, 20 nt, Artificial Sequence
  TRAC targeting sequence
gaaucauaugaucaucagga

SEQ ID NO: 10639 - RNA, 20 nt, Artificial Sequence
  TRAC targeting sequence
gaaguggauuuuaaucagga

SEQ ID NO: 10640 - RNA, 20 nt, Artificial Sequence
  TRAC targeting sequence
uaugaucaucaggagagaaa

SEQ ID NO: 10641 - RNA, 20 nt, Artificial Sequence
  TRAC targeting sequence
uaugauucugaaguggauuu

SEQ ID NO: 10642 - RNA, 20 nt, Artificial Sequence
  TRAC targeting sequence
ucaggagagaaauuaagucu

SEQ ID NO: 10643 - RNA, 20 nt, Artificial Sequence
  TRAC targeting sequence
ggagagaaauuaagucuuaa

SEQ ID NO: 10644 - RNA, 20 nt, Artificial Sequence
  TRAC targeting sequence
ugaugaucauaugauucuga

SEQ ID NO: 10645 - RNA, 20 nt, Artificial Sequence
  TRAC targeting sequence
ccugaugaucauaugauucu

SEQ ID NO: 10646 - RNA, 20 nt, Artificial Sequence
  TRAC targeting sequence
cuccugaugaucauaugauu

SEQ ID NO: 10647 - RNA, 20 nt, Artificial Sequence
  TRAC targeting sequence
uaaaagaaaaagaaguuuuu

SEQ ID NO: 10648 - RNA, 20 nt, Artificial Sequence
  TRAC targeting sequence
uuuaagacuuaauuucucuc

SEQ ID NO: 10649 - RNA, 20 nt, Artificial Sequence
  TRAC targeting sequence
uuuucuuuuaagacuuaauu

SEQ ID NO: 10650 - RNA, 20 nt, Artificial Sequence
  TRAC targeting sequence
auaaaacaaauggaccuaca

SEQ ID NO: 10651 - RNA, 20 nt, Artificial Sequence
  TRAC targeting sequence
auuuguuuuauggaccuaca

SEQ ID NO: 10652 - RNA, 20 nt, Artificial Sequence
  TRAC targeting sequence
aauuaaagguguagguccau

SEQ ID NO: 10653 - RNA, 20 nt, Artificial Sequence
  TRAC targeting sequence
ugugcugcuugcugucuaau

SEQ ID NO: 10654 - RNA, 20 nt, Artificial Sequence
  TRAC targeting sequence
uuuuaauccccucucaggag

SEQ ID NO: 10655 - RNA, 20 nt, Artificial Sequence
  TRAC targeting sequence
ccucucaggaggaaucaguc

SEQ ID NO: 10656 - RNA, 20 nt, Artificial Sequence
  TRAC targeting sequence
caggaggaaucagucccucc

SEQ ID NO: 10657 - RNA, 20 nt, Artificial Sequence
  TRAC targeting sequence
ggaggaaucagucccuccag

SEQ ID NO: 10658 - RNA, 20 nt, Artificial Sequence
  TRAC targeting sequence
ugagaggggauuaaaaggaa

SEQ ID NO: 10659 - RNA, 20 nt, Artificial Sequence
  TRAC targeting sequence
uccugagaggggauuaaaag

SEQ ID NO: 10660 - RNA, 20 nt, Artificial Sequence
  TRAC targeting sequence
gucccuccagcugcacaugg

SEQ ID NO: 10661 - RNA, 20 nt, Artificial Sequence
  TRAC targeting sequence
cuccagcugcacauggucac

SEQ ID NO: 10662 - RNA, 20 nt, Artificial Sequence
  TRAC targeting sequence
agcugcacauggucacagcu

SEQ ID NO: 10663 - RNA, 20 nt, Artificial Sequence
  TRAC targeting sequence
cagcugcucuaagcccugga

SEQ ID NO: 10664 - RNA, 20 nt, Artificial Sequence
  TRAC targeting sequence
aagcccuggagcuccuuccc

SEQ ID NO: 10665 - RNA, 20 nt, Artificial Sequence
  TRAC targeting sequence
agggcuuagagcagcuguga

SEQ ID NO: 10666 - RNA, 20 nt, Artificial Sequence
  TRAC targeting sequence
uucccaguaauacccuugcu

SEQ ID NO: 10667 - RNA, 20 nt, Artificial Sequence
  TRAC targeting sequence
caguaauacccuugcuccug

SEQ ID NO: 10668 - RNA, 20 nt, Artificial Sequence
  TRAC targeting sequence
ugugccugcacagggaaagg

SEQ ID NO: 10669 - RNA, 20 nt, Artificial Sequence
  TRAC targeting sequence
cugugcaggcacaggagcaa

SEQ ID NO: 10670 - RNA, 20 nt, Artificial Sequence
  TRAC targeting sequence
uuucccugugcaggcacagg

SEQ ID NO: 10671 - RNA, 20 nt, Artificial Sequence
  TRAC targeting sequence
ccuuucccugugcaggcaca

SEQ ID NO: 10672 - RNA, 20 nt, Artificial Sequence
  TRAC targeting sequence
gccuuuugguccgccgcuug

SEQ ID NO: 10673 - RNA, 20 nt, Artificial Sequence
  TRAC targeting sequence
gccgcuugguggggccccag

SEQ ID NO: 10674 - RNA, 20 nt, Artificial Sequence
  TRAC targeting sequence
ggcugucucuucugccuggu

SEQ ID NO: 10675 - RNA, 20 nt, Artificial Sequence
  TRAC targeting sequence
cuucugccugguuuuuguug

SEQ ID NO: 10676 - RNA, 20 nt, Artificial Sequence
  TRAC targeting sequence
ucugccugguuuuuguugag

SEQ ID NO: 10677 - RNA, 20 nt, Artificial Sequence
  TRAC targeting sequence
gccugguuuuuguugagcuu

SEQ ID NO: 10678 - RNA, 20 nt, Artificial Sequence
  TRAC targeting sequence
acaaaaaccaggcagaagag

SEQ ID NO: 10679 - RNA, 20 nt, Artificial Sequence
  TRAC targeting sequence
uaucacaguggaacaccggu

SEQ ID NO: 10680 - RNA, 20 nt, Artificial Sequence
  TRAC targeting sequence
caguggaacaccgguaacca

SEQ ID NO: 10681 - RNA, 20 nt, Artificial Sequence
  TRAC targeting sequence
acugugauaggaagcucaac

SEQ ID NO: 10682 - RNA, 20 nt, Artificial Sequence
  TRAC targeting sequence
auuuugggacagggacaagu

SEQ ID NO: 10683 - RNA, 20 nt, Artificial Sequence
  TRAC targeting sequence
caaaauagaacugguuaccg

SEQ ID NO: 10684 - RNA, 20 nt, Artificial Sequence
  TRAC targeting sequence
cugucccaaaauagaacugg

SEQ ID NO: 10685 - RNA, 20 nt, Artificial Sequence
  TRAC targeting sequence
aacuugucccugucccaaaa

SEQ ID NO: 10686 - RNA, 20 nt, Artificial Sequence
  TRAC targeting sequence
uuccaaguaagucaaagaaa

SEQ ID NO: 10687 - RNA, 20 nt, Artificial Sequence
  TRAC targeting sequence
aaguaagucaaagaaaauuu

SEQ ID NO: 10688 - RNA, 20 nt, Artificial Sequence
  TRAC targeting sequence
aagaaaauuuuccaucacca

SEQ ID NO: 10689 - RNA, 20 nt, Artificial Sequence
  TRAC targeting sequence
uugacuuacuuggaaugacc

SEQ ID NO: 10690 - RNA, 20 nt, Artificial Sequence
  TRAC targeting sequence
aucaccauuguguugagcaa

SEQ ID NO: 10691 - RNA, 20 nt, Artificial Sequence
  TRAC targeting sequence
ccauuguguugagcaaaccc

SEQ ID NO: 10692 - RNA, 20 nt, Artificial Sequence
  TRAC targeting sequence
acacaauggugauggaaaau

SEQ ID NO: 10693 - RNA, 20 nt, Artificial Sequence
  TRAC targeting sequence
gcaguuuaaaggguuugcuc

SEQ ID NO: 10694 - RNA, 20 nt, Artificial Sequence
  TRAC targeting sequence
uucugcaguuuaaaggguuu

SEQ ID NO: 10695 - RNA, 20 nt, Artificial Sequence
  TRAC targeting sequence
aagucugcuacucuauuucu

SEQ ID NO: 10696 - RNA, 20 nt, Artificial Sequence
  TRAC targeting sequence
gcuacucuauuucucugcuu

SEQ ID NO: 10697 - RNA, 20 nt, Artificial Sequence
  TRAC targeting sequence
auuucucugcuucuagguau

SEQ ID NO: 10698 - RNA, 20 nt, Artificial Sequence
  TRAC targeting sequence
cugcuucuagguauaacuuu

SEQ ID NO: 10699 - RNA, 20 nt, Artificial Sequence
  TRAC targeting sequence
gcuucuagguauaacuuuau

SEQ ID NO: 10700 - RNA, 20 nt, Artificial Sequence
  TRAC targeting sequence
agguauaacuuuaucuggac

SEQ ID NO: 10701 - RNA, 20 nt, Artificial Sequence
  TRAC targeting sequence
ggaccagaguaaagaggccc

SEQ ID NO: 10702 - RNA, 20 nt, Artificial Sequence
  TRAC targeting sequence
agauaaaguuauaccuagaa

SEQ ID NO: 10703 - RNA, 20 nt, Artificial Sequence
  TRAC targeting sequence
gguccagauaaaguuauacc

SEQ ID NO: 10704 - RNA, 20 nt, Artificial Sequence
  TRAC targeting sequence
uuacucugguccagauaaag

SEQ ID NO: 10705 - RNA, 20 nt, Artificial Sequence
  TRAC targeting sequence
ggggccucuuuacucugguc

SEQ ID NO: 10706 - RNA, 20 nt, Artificial Sequence
  TRAC targeting sequence
gggugggucgggggccucuu

SEQ ID NO: 10707 - RNA, 20 nt, Artificial Sequence
  TRAC targeting sequence
cggggugggucgggggccuc

SEQ ID NO: 10708 - RNA, 20 nt, Artificial Sequence
  TRAC targeting sequence
uucucggggugggucggggg

SEQ ID NO: 10709 - RNA, 20 nt, Artificial Sequence
  TRAC targeting sequence
aagcauaaaucauucucggg

SEQ ID NO: 10710 - RNA, 20 nt, Artificial Sequence
  TRAC targeting sequence
uuauuucauuccuugaacua

SEQ ID NO: 10711 - RNA, 20 nt, Artificial Sequence
  TRAC targeting sequence
uuccuugaacuaucuaucug

SEQ ID NO: 10712 - RNA, 20 nt, Artificial Sequence
  TRAC targeting sequence
uugaacuaucuaucugucua

SEQ ID NO: 10713 - RNA, 20 nt, Artificial Sequence
  TRAC targeting sequence
aggaaugaaauaaagaccug

SEQ ID NO: 10714 - RNA, 20 nt, Artificial Sequence
  TRAC targeting sequence
aucugucuaucuaucuaucc

SEQ ID NO: 10715 - RNA, 20 nt, Artificial Sequence
  TRAC targeting sequence
gucuaucuaucuauccagcu

SEQ ID NO: 10716 - RNA, 20 nt, Artificial Sequence
  TRAC targeting sequence
aucuaucuauccagcuaucu

SEQ ID NO: 10717 - RNA, 20 nt, Artificial Sequence
  TRAC targeting sequence
aucuauccagcuaucuaugu

SEQ ID NO: 10718 - RNA, 20 nt, Artificial Sequence
  TRAC targeting sequence
auccagcuaucuauguaucu

SEQ ID NO: 10719 - RNA, 20 nt, Artificial Sequence
  TRAC targeting sequence
agcuaucuauguaucuaucu

SEQ ID NO: 10720 - RNA, 20 nt, Artificial Sequence
  TRAC targeting sequence
auguaucuaucuaucuauca

SEQ ID NO: 10721 - RNA, 20 nt, Artificial Sequence
  TRAC targeting sequence
aucuaucuaucaucuaucuc

SEQ ID NO: 10722 - RNA, 20 nt, Artificial Sequence
  TRAC targeting sequence
aucuaucaucuaucucagaa

SEQ ID NO: 10723 - RNA, 20 nt, Artificial Sequence
  TRAC targeting sequence
aucaucuaucucagaaauag

SEQ ID NO: 10724 - RNA, 20 nt, Artificial Sequence
  TRAC targeting sequence
ucuaucucagaaauaguugu

SEQ ID NO: 10725 - RNA, 20 nt, Artificial Sequence
  TRAC targeting sequence
aucucagaaauaguuguuuu

SEQ ID NO: 10726 - RNA, 20 nt, Artificial Sequence
  TRAC targeting sequence
cagaaauaguuguuuuuaac

SEQ ID NO: 10727 - RNA, 20 nt, Artificial Sequence
  TRAC targeting sequence
gaaauaguuguuuuuaacag

SEQ ID NO: 10728 - RNA, 20 nt, Artificial Sequence
  TRAC targeting sequence
gagauagaugauagauagau

SEQ ID NO: 10729 - RNA, 20 nt, Artificial Sequence
  TRAC targeting sequence
acuguuaaaaacaacuauuu

SEQ ID NO: 10730 - RNA, 20 nt, Artificial Sequence
  TRAC targeting sequence
gugccucacccaaauuguca

SEQ ID NO: 10731 - RNA, 20 nt, Artificial Sequence
  TRAC targeting sequence
cccaaauugucauuaacuaa

SEQ ID NO: 10732 - RNA, 20 nt, Artificial Sequence
  TRAC targeting sequence
uuaacuaaaugcagaugugc

SEQ ID NO: 10733 - RNA, 20 nt, Artificial Sequence
  TRAC targeting sequence
gcauuuaguuaaugacaauu

SEQ ID NO: 10734 - RNA, 20 nt, Artificial Sequence
  TRAC targeting sequence
guguggcagcacaucugcau

SEQ ID NO: 10735 - RNA, 20 nt, Artificial Sequence
  TRAC targeting sequence
uuggaaaaaaagaaaaaacc

SEQ ID NO: 10736 - RNA, 20 nt, Artificial Sequence
  TRAC targeting sequence
aaugaaguuuaucagugugg

SEQ ID NO: 10737 - RNA, 20 nt, Artificial Sequence
  TRAC targeting sequence
uuuuuuccaaugaaguuuau

SEQ ID NO: 10738 - RNA, 20 nt, Artificial Sequence
  TRAC targeting sequence
ggguuugguuuuuucuuuuu

SEQ ID NO: 10739 - RNA, 20 nt, Artificial Sequence
  TRAC targeting sequence
cuggguuugguuuuuucuuu

SEQ ID NO: 10740 - RNA, 20 nt, Artificial Sequence
  TRAC targeting sequence
uugaacauuccugaaguggg

SEQ ID NO: 10741 - RNA, 20 nt, Artificial Sequence
  TRAC targeting sequence
aggaacauucucuggguuug

SEQ ID NO: 10742 - RNA, 20 nt, Artificial Sequence
  TRAC targeting sequence
ugaagugggggggcaggcga

SEQ ID NO: 10743 - RNA, 20 nt, Artificial Sequence
  TRAC targeting sequence
ggaauguucaaggaacauuc

SEQ ID NO: 10744 - RNA, 20 nt, Artificial Sequence
  TRAC targeting sequence
ccugcccccccacuucagga

SEQ ID NO: 10745 - RNA, 20 nt, Artificial Sequence
  TRAC targeting sequence
cuugcagugacagcuggccu

SEQ ID NO: 10746 - RNA, 20 nt, Artificial Sequence
  TRAC targeting sequence
cugcaagugacaucgccugc

SEQ ID NO: 10747 - RNA, 20 nt, Artificial Sequence
  TRAC targeting sequence
cuagcucacccccacaucug

SEQ ID NO: 10748 - RNA, 20 nt, Artificial Sequence
  TRAC targeting sequence
agcucacccccacaucugug

SEQ ID NO: 10749 - RNA, 20 nt, Artificial Sequence
  TRAC targeting sequence
cccccacaucugugccaacc

SEQ ID NO: 10750 - RNA, 20 nt, Artificial Sequence
  TRAC targeting sequence
gugccaaccagagaagcugg

SEQ ID NO: 10751 - RNA, 20 nt, Artificial Sequence
  TRAC targeting sequence
gguuggcacagauguggggg

SEQ ID NO: 10752 - RNA, 20 nt, Artificial Sequence
  TRAC targeting sequence
cugguuggcacagauguggg

SEQ ID NO: 10753 - RNA, 20 nt, Artificial Sequence
  TRAC targeting sequence
ggagcagagaauggagggac

SEQ ID NO: 10754 - RNA, 20 nt, Artificial Sequence
  TRAC targeting sequence
ugaggcuugugcuacaaagg

SEQ ID NO: 10755 - RNA, 20 nt, Artificial Sequence
  TRAC targeting sequence
gcuccugaggcuugugcuac

SEQ ID NO: 10756 - RNA, 20 nt, Artificial Sequence
  TRAC targeting sequence
cugcuccugaggcuugugcu

SEQ ID NO: 10757 - RNA, 20 nt, Artificial Sequence
  TRAC targeting sequence
auucucugcuccugaggcuu

SEQ ID NO: 10758 - RNA, 20 nt, Artificial Sequence
  TRAC targeting sequence
cuccauucucugcuccugag

SEQ ID NO: 10759 - RNA, 20 nt, Artificial Sequence
  TRAC targeting sequence
caacugagaggagagggacu

SEQ ID NO: 10760 - RNA, 20 nt, Artificial Sequence
  TRAC targeting sequence
acugagaggagagggacuag

SEQ ID NO: 10761 - RNA, 20 nt, Artificial Sequence
  TRAC targeting sequence
guugagaaugucccuccauu

SEQ ID NO: 10762 - RNA, 20 nt, Artificial Sequence
  TRAC targeting sequence
caguugagaaugucccucca

SEQ ID NO: 10763 - RNA, 20 nt, Artificial Sequence
  TRAC targeting sequence
ucucaguugagaaugucccu

SEQ ID NO: 10764 - RNA, 20 nt, Artificial Sequence
  TRAC targeting sequence
ccucucaguugagaaugucc

SEQ ID NO: 10765 - RNA, 20 nt, Artificial Sequence
  TRAC targeting sequence
cucuccucucaguugagaau

SEQ ID NO: 10766 - RNA, 20 nt, Artificial Sequence
  TRAC targeting sequence
uagucccucuccucucaguu

SEQ ID NO: 10767 - RNA, 20 nt, Artificial Sequence
  TRAC targeting sequence
agccuccuagucccucuccu

SEQ ID NO: 10768 - RNA, 20 nt, Artificial Sequence
  TRAC targeting sequence
caucuagccuccuagucccu

SEQ ID NO: 10769 - RNA, 20 nt, Artificial Sequence
  TRAC targeting sequence
uuucccaucuagccuccuag

SEQ ID NO: 10770 - RNA, 20 nt, Artificial Sequence
  TRAC targeting sequence
ccucauuucccaucuagccu

SEQ ID NO: 10771 - RNA, 20 nt, Artificial Sequence
  TRAC targeting sequence
acagaaaaucgaauauggga

SEQ ID NO: 10772 - RNA, 20 nt, Artificial Sequence
  TRAC targeting sequence
guagagucaccucauuuccc

SEQ ID NO: 10773 - RNA, 20 nt, Artificial Sequence
  TRAC targeting sequence
aauaugggaugguauaaaag

SEQ ID NO: 10774 - RNA, 20 nt, Artificial Sequence
  TRAC targeting sequence
auuuucuguagagucaccuc

SEQ ID NO: 10775 - RNA, 20 nt, Artificial Sequence
  TRAC targeting sequence
cauauucgauuuucuguaga

SEQ ID NO: 10776 - RNA, 20 nt, Artificial Sequence
  TRAC targeting sequence
uuuuauaccaucccauauuc

SEQ ID NO: 10777 - RNA, 20 nt, Artificial Sequence
  TRAC targeting sequence
uccuuuuauaccaucccaua

SEQ ID NO: 10778 - RNA, 20 nt, Artificial Sequence
  TRAC targeting sequence
cauccuuuuauaccauccca

SEQ ID NO: 10779 - RNA, 20 nt, Artificial Sequence
  TRAC targeting sequence
uucucauccuuuuauaccau

SEQ ID NO: 10780 - RNA, 20 nt, Artificial Sequence
  TRAC targeting sequence
acgaucgcucuuguauuuag

SEQ ID NO: 10781 - RNA, 20 nt, Artificial Sequence
  TRAC targeting sequence
uggacccccugccaucuuuc

SEQ ID NO: 10782 - RNA, 20 nt, Artificial Sequence
  TRAC targeting sequence
cucuuguauuuagaccuggg

SEQ ID NO: 10783 - RNA, 20 nt, Artificial Sequence
  TRAC targeting sequence
uguauuuagaccugggggau

SEQ ID NO: 10784 - RNA, 20 nt, Artificial Sequence
  TRAC targeting sequence
aaauacaagagcgaucgugg

SEQ ID NO: 10785 - RNA, 20 nt, Artificial Sequence
  TRAC targeting sequence
cccaggucuaaauacaagag

SEQ ID NO: 10786 - RNA, 20 nt, Artificial Sequence
  TRAC targeting sequence
gugcaucccccaggucuaaa

SEQ ID NO: 10787 - RNA, 20 nt, Artificial Sequence
  TRAC targeting sequence
aucagugcaucccccagguc

SEQ ID NO: 10788 - RNA, 20 nt, Artificial Sequence
  TRAC targeting sequence
aggugguaucuaucagugca

SEQ ID NO: 10789 - RNA, 20 nt, Artificial Sequence
  TRAC targeting sequence
ccaggugguaucuaucagug

SEQ ID NO: 10790 - RNA, 20 nt, Artificial Sequence
  TRAC targeting sequence
cuccaggugguaucuaucag

SEQ ID NO: 10791 - RNA, 20 nt, Artificial Sequence
  TRAC targeting sequence
cucuccaggugguaucuauc

SEQ ID NO: 10792 - RNA, 20 nt, Artificial Sequence
  TRAC targeting sequence
uucucucuccaggugguauc

SEQ ID NO: 10793 - RNA, 20 nt, Artificial Sequence
  TRAC targeting sequence
ucuuucucucuccagguggu

SEQ ID NO: 10794 - RNA, 20 nt, Artificial Sequence
  TRAC targeting sequence
guuucccucugaagaaaaau

SEQ ID NO: 10795 - RNA, 20 nt, Artificial Sequence
  TRAC targeting sequence
cucugaagaaaaauguggca

SEQ ID NO: 10796 - RNA, 20 nt, Artificial Sequence
  TRAC targeting sequence
gaagaaaaauguggcagaaa

SEQ ID NO: 10797 - RNA, 20 nt, Artificial Sequence
  TRAC targeting sequence
gagggaaacagaaauccucu

SEQ ID NO: 10798 - RNA, 20 nt, Artificial Sequence
  TRAC targeting sequence
ucagagggaaacagaaaucc

SEQ ID NO: 10799 - RNA, 20 nt, Artificial Sequence
  TRAC targeting sequence
gccacauuuuucuucagagg

SEQ ID NO: 10800 - RNA, 20 nt, Artificial Sequence
  TRAC targeting sequence
aaacagaucgcacaugucaa

SEQ ID NO: 10801 - RNA, 20 nt, Artificial Sequence
  TRAC targeting sequence
guuuugauuuuucugccaca

SEQ ID NO: 10802 - RNA, 20 nt, Artificial Sequence
  TRAC targeting sequence
cacaugucaagccucuccua

SEQ ID NO: 10803 - RNA, 20 nt, Artificial Sequence
  TRAC targeting sequence
agccucuccuaauuacagcc

SEQ ID NO: 10804 - RNA, 20 nt, Artificial Sequence
  TRAC targeting sequence
ccuaauuacagccuuucauu

SEQ ID NO: 10805 - RNA, 20 nt, Artificial Sequence
  TRAC targeting sequence
uaauuacagccuuucauucu

SEQ ID NO: 10806 - RNA, 20 nt, Artificial Sequence
  TRAC targeting sequence
uucugguuucucucagcugu

SEQ ID NO: 10807 - RNA, 20 nt, Artificial Sequence
  TRAC targeting sequence
gguuucucucagcuguucca

SEQ ID NO: 10808 - RNA, 20 nt, Artificial Sequence
  TRAC targeting sequence
cucagcuguuccagcaggaa

SEQ ID NO: 10809 - RNA, 20 nt, Artificial Sequence
  TRAC targeting sequence
cagcuguuccagcaggaaau

SEQ ID NO: 10810 - RNA, 20 nt, Artificial Sequence
  TRAC targeting sequence
gcuguuccagcaggaaaugg

SEQ ID NO: 10811 - RNA, 20 nt, Artificial Sequence
  TRAC targeting sequence
agcaggaaaugguaggaaag

SEQ ID NO: 10812 - RNA, 20 nt, Artificial Sequence
  TRAC targeting sequence
ugcuggaacagcugagagaa

SEQ ID NO: 10813 - RNA, 20 nt, Artificial Sequence
  TRAC targeting sequence
uaccauuuccugcuggaaca

SEQ ID NO: 10814 - RNA, 20 nt, Artificial Sequence
  TRAC targeting sequence
uuggugccuuugauguugug

SEQ ID NO: 10815 - RNA, 20 nt, Artificial Sequence
  TRAC targeting sequence
aaggcaccaaugacccuuuc

SEQ ID NO: 10816 - RNA, 20 nt, Artificial Sequence
  TRAC targeting sequence
acaacaucaaaggcaccaau

SEQ ID NO: 10817 - RNA, 20 nt, Artificial Sequence
  TRAC targeting sequence
ugcaaugcuuccacaacauc

SEQ ID NO: 10818 - RNA, 20 nt, Artificial Sequence
  TRAC targeting sequence
uuccugcaaugcuuccacaa

SEQ ID NO: 10819 - RNA, 20 nt, Artificial Sequence
  TRAC targeting sequence
ccuuccugcaaugcuuccac

SEQ ID NO: 10820 - RNA, 20 nt, Artificial Sequence
  TRAC targeting sequence
ugcaaaucuccuuccugcaa

SEQ ID NO: 10821 - RNA, 20 nt, Artificial Sequence
  TRAC targeting sequence
acugcaagccccugccccgu

SEQ ID NO: 10822 - RNA, 20 nt, Artificial Sequence
  TRAC targeting sequence
ggagaguuuagaaugauggu

SEQ ID NO: 10823 - RNA, 20 nt, Artificial Sequence
  TRAC targeting sequence
agacucuacugcaagccccu

SEQ ID NO: 10824 - RNA, 20 nt, Artificial Sequence
  TRAC targeting sequence
ccagacucuacugcaagccc

SEQ ID NO: 10825 - RNA, 20 nt, Artificial Sequence
  TRAC targeting sequence
aaacucuccagacucuacug

SEQ ID NO: 10826 - RNA, 20 nt, Artificial Sequence
  TRAC targeting sequence
uucuaaacucuccagacucu

SEQ ID NO: 10827 - RNA, 20 nt, Artificial Sequence
  TRAC targeting sequence
uugcaaaaaccaucauucua

SEQ ID NO: 10828 - RNA, 20 nt, Artificial Sequence
  TRAC targeting sequence
aagucauugcaaaaaccauc

SEQ ID NO: 10829 - RNA, 20 nt, Artificial Sequence
  TRAC targeting sequence
aacuuuggaaaugagaaauu

SEQ ID NO: 10830 - RNA, 20 nt, Artificial Sequence
  TRAC targeting sequence
aaaguuagauacacaguguu

SEQ ID NO: 10831 - RNA, 20 nt, Artificial Sequence
  TRAC targeting sequence
uuuccaaaguuagauacaca

SEQ ID NO: 10832 - RNA, 20 nt, Artificial Sequence
  TRAC targeting sequence
cauuuccaaaguuagauaca

SEQ ID NO: 10833 - RNA, 20 nt, Artificial Sequence
  TRAC targeting sequence
caaagguuaauuucucauuu

SEQ ID NO: 10834 - RNA, 20 nt, Artificial Sequence
  TRAC targeting sequence
agucccaaagguuaauuucu

SEQ ID NO: 10835 - RNA, 20 nt, Artificial Sequence
  TRAC targeting sequence
uguuccagucccaaagguua

SEQ ID NO: 10836 - RNA, 20 nt, Artificial Sequence
  TRAC targeting sequence
ccaucauacccaguaaguuc

SEQ ID NO: 10837 - RNA, 20 nt, Artificial Sequence
  TRAC targeting sequence
uacccaguaaguucuucauc

SEQ ID NO: 10838 - RNA, 20 nt, Artificial Sequence
  TRAC targeting sequence
ucauccuuggucaggaaauc

SEQ ID NO: 10839 - RNA, 20 nt, Artificial Sequence
  TRAC targeting sequence
uccuuggucaggaaaucagc

SEQ ID NO: 10840 - RNA, 20 nt, Artificial Sequence
  TRAC targeting sequence
uuggucaggaaaucagccug

SEQ ID NO: 10841 - RNA, 20 nt, Artificial Sequence
  TRAC targeting sequence
ggaaaucagccugcauaaga

SEQ ID NO: 10842 - RNA, 20 nt, Artificial Sequence
  TRAC targeting sequence
ugaccaaggaugaagaacuu

SEQ ID NO: 10843 - RNA, 20 nt, Artificial Sequence
  TRAC targeting sequence
gccugcauaagauucugggg

SEQ ID NO: 10844 - RNA, 20 nt, Artificial Sequence
  TRAC targeting sequence
uaugcaggcugauuuccuga

SEQ ID NO: 10845 - RNA, 20 nt, Artificial Sequence
  TRAC targeting sequence
ggggaucauaguagagaugc

SEQ ID NO: 10846 - RNA, 20 nt, Artificial Sequence
  TRAC targeting sequence
ccagaaucuuaugcaggcug

SEQ ID NO: 10847 - RNA, 20 nt, Artificial Sequence
  TRAC targeting sequence
uaguagagaugcaggcuuag

SEQ ID NO: 10848 - RNA, 20 nt, Artificial Sequence
  TRAC targeting sequence
acuaugauccccagaaucuu

SEQ ID NO: 10849 - RNA, 20 nt, Artificial Sequence
  TRAC targeting sequence
cuacuaugauccccagaauc

SEQ ID NO: 10850 - RNA, 20 nt, Artificial Sequence
  TRAC targeting sequence
aagccugcaucucuacuaug

SEQ ID NO: 10851 - RNA, 20 nt, Artificial Sequence
  TRAC targeting sequence
cuaagccugcaucucuacua

SEQ ID NO: 10852 - RNA, 20 nt, Artificial Sequence
  TRAC targeting sequence
ucuguccuuguucauaacug

SEQ ID NO: 10853 - RNA, 20 nt, Artificial Sequence
  TRAC targeting sequence
guccuuguucauaacuggua

SEQ ID NO: 10854 - RNA, 20 nt, Artificial Sequence
  TRAC targeting sequence
uuguucauaacugguagaga

SEQ ID NO: 10855 - RNA, 20 nt, Artificial Sequence
  TRAC targeting sequence
uaacugguagagacaggugg

SEQ ID NO: 10856 - RNA, 20 nt, Artificial Sequence
  TRAC targeting sequence
accaguuaugaacaaggaca

SEQ ID NO: 10857 - RNA, 20 nt, Artificial Sequence
  TRAC targeting sequence
cuaccaguuaugaacaagga

SEQ ID NO: 10858 - RNA, 20 nt, Artificial Sequence
  TRAC targeting sequence
gaguuuuccgggggaacucc

SEQ ID NO: 10859 - RNA, 20 nt, Artificial Sequence
  TRAC targeting sequence
gauauuuggcugccaccugu

SEQ ID NO: 10860 - RNA, 20 nt, Artificial Sequence
  TRAC targeting sequence
gggggaacuccaguccugac

SEQ ID NO: 10861 - RNA, 20 nt, Artificial Sequence
  TRAC targeting sequence
cccggaaaacucagauauuu

SEQ ID NO: 10862 - RNA, 20 nt, Artificial Sequence
  TRAC targeting sequence
aguccugacuauuuaauuca

SEQ ID NO: 10863 - RNA, 20 nt, Artificial Sequence
  TRAC targeting sequence
ugacuauuuaauucaaaacu

SEQ ID NO: 10864 - RNA, 20 nt, Artificial Sequence
  TRAC targeting sequence
ggacuggaguucccccggaa

SEQ ID NO: 10865 - RNA, 20 nt, Artificial Sequence
  TRAC targeting sequence
aaacuagaaaauaugauuca

SEQ ID NO: 10866 - RNA, 20 nt, Artificial Sequence
  TRAC targeting sequence
aguuuugaauuaaauaguca

SEQ ID NO: 10867 - RNA, 20 nt, Artificial Sequence
  TRAC targeting sequence
uauuuucuaguuuugaauua

SEQ ID NO: 10868 - RNA, 20 nt, Artificial Sequence
  TRAC targeting sequence
caauucuguuuuugcugcug

SEQ ID NO: 10869 - RNA, 20 nt, Artificial Sequence
  TRAC targeting sequence
guuuuugcugcugccgucaa

SEQ ID NO: 10870 - RNA, 20 nt, Artificial Sequence
  TRAC targeting sequence
agugcuaauguggcauguga

SEQ ID NO: 10871 - RNA, 20 nt, Artificial Sequence
  TRAC targeting sequence
caugccacauuagcacuuga

SEQ ID NO: 10872 - RNA, 20 nt, Artificial Sequence
  TRAC targeting sequence
ucacaugccacauuagcacu

SEQ ID NO: 10873 - RNA, 20 nt, Artificial Sequence
  TRAC targeting sequence
cuucacaugccacauuagca

SEQ ID NO: 10874 - RNA, 20 nt, Artificial Sequence
  TRAC targeting sequence
ggcagaaugacugcaucuuc

SEQ ID NO: 10875 - RNA, 20 nt, Artificial Sequence
  TRAC targeting sequence
gccugaauucucuucacaug

SEQ ID NO: 10876 - RNA, 20 nt, Artificial Sequence
  TRAC targeting sequence
uucugccugaauucucuuca

SEQ ID NO: 10877 - RNA, 20 nt, Artificial Sequence
  TRAC targeting sequence
ucacuuucaucuugugugau

SEQ ID NO: 10878 - RNA, 20 nt, Artificial Sequence
  TRAC targeting sequence
cuuucaucuugugugauaau

SEQ ID NO: 10879 - RNA, 20 nt, Artificial Sequence
  TRAC targeting sequence
ucuugugugauaauuuuagc

SEQ ID NO: 10880 - RNA, 20 nt, Artificial Sequence
  TRAC targeting sequence
ugugugauaauuuuagcuuu

SEQ ID NO: 10881 - RNA, 20 nt, Artificial Sequence
  TRAC targeting sequence
cacaagaugaaagugaagau

SEQ ID NO: 10882 - RNA, 20 nt, Artificial Sequence
  TRAC targeting sequence
aagcuaaaauuaucacacaa

SEQ ID NO: 10883 - RNA, 20 nt, Artificial Sequence
  TRAC targeting sequence
caaacacuugcaguacucaa

SEQ ID NO: 10884 - RNA, 20 nt, Artificial Sequence
  TRAC targeting sequence
cccaaacacuugcaguacuc

SEQ ID NO: 10885 - RNA, 20 nt, Artificial Sequence
  TRAC targeting sequence
accauuucucccaaacacuu

SEQ ID NO: 10886 - RNA, 20 nt, Artificial Sequence
  TRAC targeting sequence
auguuucuaccauuucuccc

SEQ ID NO: 10887 - RNA, 20 nt, Artificial Sequence
  TRAC targeting sequence
aagagacaagcaaaccaaga

SEQ ID NO: 10888 - RNA, 20 nt, Artificial Sequence
  TRAC targeting sequence
uugauauucuauguuucuac

SEQ ID NO: 10889 - RNA, 20 nt, Artificial Sequence
  TRAC targeting sequence
cuuugauauucuauguuucu

SEQ ID NO: 10890 - RNA, 20 nt, Artificial Sequence
  TRAC targeting sequence
ugguuugcuugucucuuuga

SEQ ID NO: 10891 - RNA, 20 nt, Artificial Sequence
  TRAC targeting sequence
cuugguuugcuugucucuuu

SEQ ID NO: 10892 - RNA, 20 nt, Artificial Sequence
  TRAC targeting sequence
gggucucuugguuugcuugu

SEQ ID NO: 10893 - RNA, 20 nt, Artificial Sequence
  TRAC targeting sequence
cugggucucuugguuugcuu

SEQ ID NO: 10894 - RNA, 20 nt, Artificial Sequence
  TRAC targeting sequence
gccugccucucugggucucu

SEQ ID NO: 10895 - RNA, 20 nt, Artificial Sequence
  TRAC targeting sequence
gucugccugccucucugggu

SEQ ID NO: 10896 - RNA, 20 nt, Artificial Sequence
  TRAC targeting sequence
ggcaguauaauuuuacaaaa

SEQ ID NO: 10897 - RNA, 20 nt, Artificial Sequence
  TRAC targeting sequence
guguugugucucucucugca

SEQ ID NO: 10898 - RNA, 20 nt, Artificial Sequence
  TRAC targeting sequence
cucucugcaaauggcaaggu

SEQ ID NO: 10899 - RNA, 20 nt, Artificial Sequence
  TRAC targeting sequence
cucugcaaauggcaagguau

SEQ ID NO: 10900 - RNA, 20 nt, Artificial Sequence
  TRAC targeting sequence
cugcaaauggcaagguaucg

SEQ ID NO: 10901 - RNA, 20 nt, Artificial Sequence
  TRAC targeting sequence
gcaaauggcaagguaucggg

SEQ ID NO: 10902 - RNA, 20 nt, Artificial Sequence
  TRAC targeting sequence
ggaaaggugcuaagagcuag

SEQ ID NO: 10903 - RNA, 20 nt, Artificial Sequence
  TRAC targeting sequence
cgauaccuugccauuugcag

SEQ ID NO: 10904 - RNA, 20 nt, Artificial Sequence
  TRAC targeting sequence
uagcaccuuucccgauaccu

SEQ ID NO: 10905 - RNA, 20 nt, Artificial Sequence
  TRAC targeting sequence
ggguggggcaggauuaucua

SEQ ID NO: 10906 - RNA, 20 nt, Artificial Sequence
  TRAC targeting sequence
ugccccacccggagcacuag

SEQ ID NO: 10907 - RNA, 20 nt, Artificial Sequence
  TRAC targeting sequence
aaauagaaaacuaagcacug

SEQ ID NO: 10908 - RNA, 20 nt, Artificial Sequence
  TRAC targeting sequence
auuuagauaauccugcccca

SEQ ID NO: 10909 - RNA, 20 nt, Artificial Sequence
  TRAC targeting sequence
gugcuuaguuuucuauuuag

SEQ ID NO: 10910 - RNA, 20 nt, Artificial Sequence
  TRAC targeting sequence
cagggggaaaguuuaaacuu

SEQ ID NO: 10911 - RNA, 20 nt, Artificial Sequence
  TRAC targeting sequence
gggggaaaguuuaaacuugg

SEQ ID NO: 10912 - RNA, 20 nt, Artificial Sequence
  TRAC targeting sequence
cccugagaucagugcuuagu

SEQ ID NO: 10913 - RNA, 20 nt, Artificial Sequence
  TRAC targeting sequence
aaguuuaaacuuucccccug

SEQ ID NO: 10914 - RNA, 20 nt, Artificial Sequence
  TRAC targeting sequence
cuggguuugguuuuuuguuu

SEQ ID NO: 10915 - RNA, 20 nt, Artificial Sequence
  TRAC targeting sequence
ggguuugguuuuuuguuuuu

SEQ ID NO: 10916 - RNA, 20 nt, Artificial Sequence
  TRAC targeting sequence
aaugaaguuuaucagugugg

SEQ ID NO: 10917 - RNA, 20 nt, Artificial Sequence
  TRAC targeting sequence
uuggaaaaaaacaaaaaacc

SEQ ID NO: 10918 - RNA, 20 nt, Artificial Sequence
  TRAC targeting sequence
guguggcagcacaucugcau

SEQ ID NO: 10919 - RNA, 20 nt, Artificial Sequence
  TRAC targeting sequence
gcauuuaauuaaugacaauu

SEQ ID NO: 10920 - RNA, 20 nt, Artificial Sequence
  TRAC targeting sequence
uuaauuaaaugcagaugugc

SEQ ID NO: 10921 - RNA, 20 nt, Artificial Sequence
  TRAC targeting sequence
cccaaauugucauuaauuaa

SEQ ID NO: 10922 - RNA, 20 nt, Artificial Sequence
  TRAC targeting sequence
gugccucacccaaauuguca

SEQ ID NO: 10923 - RNA, 20 nt, Artificial Sequence
  TRAC targeting sequence
augcagccauaaaaaaugau

SEQ ID NO: 10924 - RNA, 20 nt, Artificial Sequence
  TRAC targeting sequence
uuuuuuauggcugcauagaa

SEQ ID NO: 10925 - RNA, 20 nt, Artificial Sequence
  TRAC targeting sequence
ucauuuuuuauggcugcaua

SEQ ID NO: 10926 - RNA, 20 nt, Artificial Sequence
  TRAC targeting sequence
uguccuuuguagggacaugg

SEQ ID NO: 10927 - RNA, 20 nt, Artificial Sequence
  TRAC targeting sequence
uuuguagggacauggaugaa

SEQ ID NO: 10928 - RNA, 20 nt, Artificial Sequence
  TRAC targeting sequence
cuacaaaggacaugaacuca

SEQ ID NO: 10929 - RNA, 20 nt, Artificial Sequence
  TRAC targeting sequence
augucccuacaaaggacaug

SEQ ID NO: 10930 - RNA, 20 nt, Artificial Sequence
  TRAC targeting sequence
uccaugucccuacaaaggac

SEQ ID NO: 10931 - RNA, 20 nt, Artificial Sequence
  TRAC targeting sequence
aguuucauccaugucccuac

SEQ ID NO: 10932 - RNA, 20 nt, Artificial Sequence
  TRAC targeting sequence
ucauucucaguaaacuaucg

SEQ ID NO: 10933 - RNA, 20 nt, Artificial Sequence
  TRAC targeting sequence
uucucaguaaacuaucgcaa

SEQ ID NO: 10934 - RNA, 20 nt, Artificial Sequence
  TRAC targeting sequence
caguaaacuaucgcaagaac

SEQ ID NO: 10935 - RNA, 20 nt, Artificial Sequence
  TRAC targeting sequence
guaaacuaucgcaagaacaa

SEQ ID NO: 10936 - RNA, 20 nt, Artificial Sequence
  TRAC targeting sequence
caagaacaaaaaaccaaaca

SEQ ID NO: 10937 - RNA, 20 nt, Artificial Sequence
  TRAC targeting sequence
ugcgauaguuuacugagaau

SEQ ID NO: 10938 - RNA, 20 nt, Artificial Sequence
  TRAC targeting sequence
cacucauaggugggaauuga

SEQ ID NO: 10939 - RNA, 20 nt, Artificial Sequence
  TRAC targeting sequence
cucauaggugggaauugaac

SEQ ID NO: 10940 - RNA, 20 nt, Artificial Sequence
  TRAC targeting sequence
uaggugggaauugaacaaug

SEQ ID NO: 10941 - RNA, 20 nt, Artificial Sequence
  TRAC targeting sequence
caccuaugagugagaauaug

SEQ ID NO: 10942 - RNA, 20 nt, Artificial Sequence
  TRAC targeting sequence
auucccaccuaugagugaga

SEQ ID NO: 10943 - RNA, 20 nt, Artificial Sequence
  TRAC targeting sequence
uuguucaauucccaccuaug

SEQ ID NO: 10944 - RNA, 20 nt, Artificial Sequence
  TRAC targeting sequence
cauuguucaauucccaccua

SEQ ID NO: 10945 - RNA, 20 nt, Artificial Sequence
  TRAC targeting sequence
cauggacacaggaaggggaa

SEQ ID NO: 10946 - RNA, 20 nt, Artificial Sequence
  TRAC targeting sequence
augugaucucauuguucaau

SEQ ID NO: 10947 - RNA, 20 nt, Artificial Sequence
  TRAC targeting sequence
uguguccaugugaucucauu

SEQ ID NO: 10948 - RNA, 20 nt, Artificial Sequence
  TRAC targeting sequence
ccuuccuguguccaugugau

SEQ ID NO: 10949 - RNA, 20 nt, Artificial Sequence
  TRAC targeting sequence
cacucuggggacuguugcgg

SEQ ID NO: 10950 - RNA, 20 nt, Artificial Sequence
  TRAC targeting sequence
ggggacuguugcgggguggg

SEQ ID NO: 10951 - RNA, 20 nt, Artificial Sequence
  TRAC targeting sequence
ccagagugugauguuccccu

SEQ ID NO: 10952 - RNA, 20 nt, Artificial Sequence
  TRAC targeting sequence
ccccaccccgcaacaguccc

SEQ ID NO: 10953 - RNA, 20 nt, Artificial Sequence
  TRAC targeting sequence
ccacuccccccaccccgcaa

SEQ ID NO: 10954 - RNA, 20 nt, Artificial Sequence
  TRAC targeting sequence
cuccccacuccccccacccc

SEQ ID NO: 10955 - RNA, 20 nt, Artificial Sequence
  TRAC targeting sequence
caaugcuaucccuccccacu

SEQ ID NO: 10956 - RNA, 20 nt, Artificial Sequence
  TRAC targeting sequence
cccaaugcuaucccucccca

SEQ ID NO: 10957 - RNA, 20 nt, Artificial Sequence
  TRAC targeting sequence
uuuagcauuagguauaucuc

SEQ ID NO: 10958 - RNA, 20 nt, Artificial Sequence
  TRAC targeting sequence
ucauuuagcauuagguauau

SEQ ID NO: 10959 - RNA, 20 nt, Artificial Sequence
  TRAC targeting sequence
gagauagauaaaugauagag

SEQ ID NO: 10960 - RNA, 20 nt, Artificial Sequence
  TRAC targeting sequence
gaaauaguuguuuuuuuuua

SEQ ID NO: 10961 - RNA, 20 nt, Artificial Sequence
  TRAC targeting sequence
cagaaauaguuguuuuuuuu

SEQ ID NO: 10962 - RNA, 20 nt, Artificial Sequence
  TRAC targeting sequence
aucucagaaauaguuguuuu

SEQ ID NO: 10963 - RNA, 20 nt, Artificial Sequence
  TRAC targeting sequence
uuuaucuaucucagaaauag

SEQ ID NO: 10964 - RNA, 20 nt, Artificial Sequence
  TRAC targeting sequence
aucauuuaucuaucucagaa

SEQ ID NO: 10965 - RNA, 20 nt, Artificial Sequence
  TRAC targeting sequence
cuaucauuuaucuaucucag

SEQ ID NO: 10966 - RNA, 20 nt, Artificial Sequence
  TRAC targeting sequence
cucuaucauuuaucuaucuc

SEQ ID NO: 10967 - RNA, 20 nt, Artificial Sequence
  TRAC targeting sequence
cucucucuaucauuuaucua

SEQ ID NO: 10968 - RNA, 20 nt, Artificial Sequence
  TRAC targeting sequence
cccucucucuaucauuuauc

SEQ ID NO: 10969 - RNA, 20 nt, Artificial Sequence
  TRAC targeting sequence
aguaucucccucucucuauc

SEQ ID NO: 10970 - RNA, 20 nt, Artificial Sequence
  TRAC targeting sequence
uuaacuguguauauauaucc

SEQ ID NO: 10971 - RNA, 20 nt, Artificial Sequence
  TRAC targeting sequence
cccaaauugucauuaacugu

SEQ ID NO: 10972 - RNA, 20 nt, Artificial Sequence
  TRAC targeting sequence
gugccucacccaaauuguca

SEQ ID NO: 10973 - RNA, 20 nt, Artificial Sequence
  TRAC targeting sequence
gagauagagagaaagagaga

SEQ ID NO: 10974 - RNA, 20 nt, Artificial Sequence
  TRAC targeting sequence
gaaauaguuguuuuuaacag

SEQ ID NO: 10975 - RNA, 20 nt, Artificial Sequence
  TRAC targeting sequence
cagaaauaguuguuuuuaac

SEQ ID NO: 10976 - RNA, 20 nt, Artificial Sequence
  TRAC targeting sequence
aucucagaaauaguuguuuu

SEQ ID NO: 10977 - RNA, 20 nt, Artificial Sequence
  TRAC targeting sequence
cuaucucagaaauaguuguu

SEQ ID NO: 10978 - RNA, 20 nt, Artificial Sequence
  TRAC targeting sequence
cucuaucucagaaauaguug

SEQ ID NO: 10979 - RNA, 20 nt, Artificial Sequence
  TRAC targeting sequence
uucucucuaucucagaaaua

SEQ ID NO: 10980 - RNA, 20 nt, Artificial Sequence
  TRAC targeting sequence
cuuucucucuaucucagaaa

SEQ ID NO: 10981 - RNA, 20 nt, Artificial Sequence
  TRAC targeting sequence
cucuuucucucuaucucaga

SEQ ID NO: 10982 - RNA, 20 nt, Artificial Sequence
  TRAC targeting sequence
cucucuuucucucuaucuca

SEQ ID NO: 10983 - RNA, 20 nt, Artificial Sequence
  TRAC targeting sequence
aguaucucucucuuucucuc

SEQ ID NO: 10984 - RNA, 20 nt, Artificial Sequence
  TRAC targeting sequence
acccuguguauauauaucca

SEQ ID NO: 10985 - RNA, 20 nt, Artificial Sequence
  TRAC targeting sequence
ucuacccuguguauauauau

SEQ ID NO: 10986 - RNA, 20 nt, Artificial Sequence
  TRAC targeting sequence
acauucuucuacccugugua

SEQ ID NO: 10987 - RNA, 20 nt, Artificial Sequence
  TRAC targeting sequence
cuacauucuucuacccugug

SEQ ID NO: 10988 - RNA, 20 nt, Artificial Sequence
  TRAC targeting sequence
cucuacauucuucuacccug

SEQ ID NO: 10989 - RNA, 20 nt, Artificial Sequence
  TRAC targeting sequence
uuugcaccuacaauuaaaag

SEQ ID NO: 10990 - RNA, 20 nt, Artificial Sequence
  TRAC targeting sequence
acagcuuuuaauuguaggug

SEQ ID NO: 10991 - RNA, 20 nt, Artificial Sequence
  TRAC targeting sequence
aauuuuccacagcuuuuaau

SEQ ID NO: 10992 - RNA, 20 nt, Artificial Sequence
  TRAC targeting sequence
cuuuguaaccaaagacaacc

SEQ ID NO: 10993 - RNA, 20 nt, Artificial Sequence
  TRAC targeting sequence
uugguuacaaagugaacaua

SEQ ID NO: 10994 - RNA, 20 nt, Artificial Sequence
  TRAC targeting sequence
auuuugugugguugucuuug

SEQ ID NO: 10995 - RNA, 20 nt, Artificial Sequence
  TRAC targeting sequence
guuccauuuugugugguugu

SEQ ID NO: 10996 - RNA, 20 nt, Artificial Sequence
  TRAC targeting sequence
cuguugcaagcaugcuuucc

SEQ ID NO: 10997 - RNA, 20 nt, Artificial Sequence
  TRAC targeting sequence
cgcuguugcaagcaugcuuu

SEQ ID NO: 10998 - RNA, 20 nt, Artificial Sequence
  TRAC targeting sequence
aguucucgcuguugcaagca

SEQ ID NO: 10999 - RNA, 20 nt, Artificial Sequence
  TRAC targeting sequence
auacuuccaguucucgcugu

SEQ ID NO: 11000 - RNA, 20 nt, Artificial Sequence
  TRAC targeting sequence
gucuuaaccacucaguugcc

SEQ ID NO: 11001 - RNA, 20 nt, Artificial Sequence
  TRAC targeting sequence
uaaccacucaguugccuaga

SEQ ID NO: 11002 - RNA, 20 nt, Artificial Sequence
  TRAC targeting sequence
guugccuagaagaaucuuuu

SEQ ID NO: 11003 - RNA, 20 nt, Artificial Sequence
  TRAC targeting sequence
aggcaacugagugguuaaga

SEQ ID NO: 11004 - RNA, 20 nt, Artificial Sequence
  TRAC targeting sequence
ucuaggcaacugagugguua

SEQ ID NO: 11005 - RNA, 20 nt, Artificial Sequence
  TRAC targeting sequence
uuuuucuauuuugcugcauu

SEQ ID NO: 11006 - RNA, 20 nt, Artificial Sequence
  TRAC targeting sequence
auuuugcugcauuagaaauu

SEQ ID NO: 11007 - RNA, 20 nt, Artificial Sequence
  TRAC targeting sequence
aaugcagcaaaauagaaaaa

SEQ ID NO: 11008 - RNA, 20 nt, Artificial Sequence
  TRAC targeting sequence
ugccuuuaauuucuaaugca

SEQ ID NO: 11009 - RNA, 20 nt, Artificial Sequence
  TRAC targeting sequence
auacucaugccuuuaauuuc

SEQ ID NO: 11010 - RNA, 20 nt, Artificial Sequence
  TRAC targeting sequence
ucaauacucaugccuuuaau

SEQ ID NO: 11011 - RNA, 20 nt, Artificial Sequence
  TRAC targeting sequence
gacuuuuauagugacaauca

SEQ ID NO: 11012 - RNA, 20 nt, Artificial Sequence
  TRAC targeting sequence
gaccuacccaaauccucaau

SEQ ID NO: 11013 - RNA, 20 nt, Artificial Sequence
  TRAC targeting sequence
cuauaaaagucugaccuacc

SEQ ID NO: 11014 - RNA, 20 nt, Artificial Sequence
  TRAC targeting sequence
cauuacaaagcaccucuuag

SEQ ID NO: 11015 - RNA, 20 nt, Artificial Sequence
  TRAC targeting sequence
uagcuagguuggauaaagca

SEQ ID NO: 11016 - RNA, 20 nt, Artificial Sequence
  TRAC targeting sequence
aaccuagcuaagaggugcuu

SEQ ID NO: 11017 - RNA, 20 nt, Artificial Sequence
  TRAC targeting sequence
aagucuuuuucuucuuucug

SEQ ID NO: 11018 - RNA, 20 nt, Artificial Sequence
  TRAC targeting sequence
uuuucuucuuucuggaugag

SEQ ID NO: 11019 - RNA, 20 nt, Artificial Sequence
  TRAC targeting sequence
ucuuucuggaugagauagaa

SEQ ID NO: 11020 - RNA, 20 nt, Artificial Sequence
  TRAC targeting sequence
uucuggaugagauagaaaaa

SEQ ID NO: 11021 - RNA, 20 nt, Artificial Sequence
  TRAC targeting sequence
ggaugagauagaaaaauggu

SEQ ID NO: 11022 - RNA, 20 nt, Artificial Sequence
  TRAC targeting sequence
agaaagaagaaaaagacuuu

SEQ ID NO: 11023 - RNA, 20 nt, Artificial Sequence
  TRAC targeting sequence
uccagaaagaagaaaaagac

SEQ ID NO: 11024 - RNA, 20 nt, Artificial Sequence
  TRAC targeting sequence
cauccagaaagaagaaaaag

SEQ ID NO: 11025 - RNA, 20 nt, Artificial Sequence
  TRAC targeting sequence
aucucauccagaaagaagaa

SEQ ID NO: 11026 - RNA, 20 nt, Artificial Sequence
  TRAC targeting sequence
cuccucacucuguaucuaag

SEQ ID NO: 11027 - RNA, 20 nt, Artificial Sequence
  TRAC targeting sequence
ccucacucuguaucuaagga

SEQ ID NO: 11028 - RNA, 20 nt, Artificial Sequence
  TRAC targeting sequence
ucacucuguaucuaaggaca

SEQ ID NO: 11029 - RNA, 20 nt, Artificial Sequence
  TRAC targeting sequence
cucuguaucuaaggacaggg

SEQ ID NO: 11030 - RNA, 20 nt, Artificial Sequence
  TRAC targeting sequence
guaucuaaggacagggggcu

SEQ ID NO: 11031 - RNA, 20 nt, Artificial Sequence
  TRAC targeting sequence
aaggacagggggcucagaga

SEQ ID NO: 11032 - RNA, 20 nt, Artificial Sequence
  TRAC targeting sequence
uuagauacagagugaggaga

SEQ ID NO: 11033 - RNA, 20 nt, Artificial Sequence
  TRAC targeting sequence
gagaguuccagacuuacaaa

SEQ ID NO: 11034 - RNA, 20 nt, Artificial Sequence
  TRAC targeting sequence
gagcccccuguccuuagaua

SEQ ID NO: 11035 - RNA, 20 nt, Artificial Sequence
  TRAC targeting sequence
cugagcccccuguccuuaga

SEQ ID NO: 11036 - RNA, 20 nt, Artificial Sequence
  TRAC targeting sequence
agacuuacaaagugagacug

SEQ ID NO: 11037 - RNA, 20 nt, Artificial Sequence
  TRAC targeting sequence
ggaacucucugagcccccug

SEQ ID NO: 11038 - RNA, 20 nt, Artificial Sequence
  TRAC targeting sequence
cuuuguaagucuggaacucu

SEQ ID NO: 11039 - RNA, 20 nt, Artificial Sequence
  TRAC targeting sequence
cacuuuguaagucuggaacu

SEQ ID NO: 11040 - RNA, 20 nt, Artificial Sequence
  TRAC targeting sequence
gcugcagucucacuuuguaa

SEQ ID NO: 11041 - RNA, 20 nt, Artificial Sequence
  TRAC targeting sequence
gcucugcugcagucucacuu

SEQ ID NO: 11042 - RNA, 20 nt, Artificial Sequence
  TRAC targeting sequence
cauggcucagcucugcugca

SEQ ID NO: 11043 - RNA, 20 nt, Artificial Sequence
  TRAC targeting sequence
aggucccauggcucagcucu

SEQ ID NO: 11044 - RNA, 20 nt, Artificial Sequence
  TRAC targeting sequence
cuccaggucccauggcucag

SEQ ID NO: 11045 - RNA, 20 nt, Artificial Sequence
  TRAC targeting sequence
cugggucccuccagguccca

SEQ ID NO: 11046 - RNA, 20 nt, Artificial Sequence
  TRAC targeting sequence
gcucccucccacgggugcua

SEQ ID NO: 11047 - RNA, 20 nt, Artificial Sequence
  TRAC targeting sequence
cucccacgggugcuauagua

SEQ ID NO: 11048 - RNA, 20 nt, Artificial Sequence
  TRAC targeting sequence
cacgggugcuauaguagcca

SEQ ID NO: 11049 - RNA, 20 nt, Artificial Sequence
  TRAC targeting sequence
ggaaaccguccccaggugag

SEQ ID NO: 11050 - RNA, 20 nt, Artificial Sequence
  TRAC targeting sequence
ugaacgguuguggcuacuau

SEQ ID NO: 11051 - RNA, 20 nt, Artificial Sequence
  TRAC targeting sequence
ccaggugagaacguaacaca

SEQ ID NO: 11052 - RNA, 20 nt, Artificial Sequence
  TRAC targeting sequence
ccuggggacgguuuccugaa

SEQ ID NO: 11053 - RNA, 20 nt, Artificial Sequence
  TRAC targeting sequence
caccuggggacgguuuccug

SEQ ID NO: 11054 - RNA, 20 nt, Artificial Sequence
  TRAC targeting sequence
cugcguguguuacguucuca

SEQ ID NO: 11055 - RNA, 20 nt, Artificial Sequence
  TRAC targeting sequence
cacugcuacuaagagcaacu

SEQ ID NO: 11056 - RNA, 20 nt, Artificial Sequence
  TRAC targeting sequence
uaguagcagugggauuuucc

SEQ ID NO: 11057 - RNA, 20 nt, Artificial Sequence
  TRAC targeting sequence
gcauaagaaugcauuaccca

SEQ ID NO: 11058 - RNA, 20 nt, Artificial Sequence
  TRAC targeting sequence
uaugcugaguugcucuuagu

SEQ ID NO: 11059 - RNA, 20 nt, Artificial Sequence
  TRAC targeting sequence
cuugcuggguaaugcauucu

SEQ ID NO: 11060 - RNA, 20 nt, Artificial Sequence
  TRAC targeting sequence
gaggggcucuaaaccagagc

SEQ ID NO: 11061 - RNA, 20 nt, Artificial Sequence
  TRAC targeting sequence
gacugucccuugcuggguaa

SEQ ID NO: 11062 - RNA, 20 nt, Artificial Sequence
  TRAC targeting sequence
aaaccagagccccaaauauu

SEQ ID NO: 11063 - RNA, 20 nt, Artificial Sequence
  TRAC targeting sequence
gguuuagagccccucugacu

SEQ ID NO: 11064 - RNA, 20 nt, Artificial Sequence
  TRAC targeting sequence
aauauuuggggcucugguuu

SEQ ID NO: 11065 - RNA, 20 nt, Artificial Sequence
  TRAC targeting sequence
acauaaaguuuucaaauauu

SEQ ID NO: 11066 - RNA, 20 nt, Artificial Sequence
  TRAC targeting sequence
uuuuccaagccgugcuucca

SEQ ID NO: 11067 - RNA, 20 nt, Artificial Sequence
  TRAC targeting sequence
aagccgugcuuccagaagcu

SEQ ID NO: 11068 - RNA, 20 nt, Artificial Sequence
  TRAC targeting sequence
agaagcuguuagugguuggu

SEQ ID NO: 11069 - RNA, 20 nt, Artificial Sequence
  TRAC targeting sequence
ggaagcacggcuuggaaaac

SEQ ID NO: 11070 - RNA, 20 nt, Artificial Sequence
  TRAC targeting sequence
aaacccuuagcaacuaccaa

SEQ ID NO: 11071 - RNA, 20 nt, Artificial Sequence
  TRAC targeting sequence
aguuucaaaacccuuagcaa

SEQ ID NO: 11072 - RNA, 20 nt, Artificial Sequence
  TRAC targeting sequence
uccaguuucaaaacccuuag

SEQ ID NO: 11073 - RNA, 20 nt, Artificial Sequence
  TRAC targeting sequence
uagcagaguggaauuauuug

SEQ ID NO: 11074 - RNA, 20 nt, Artificial Sequence
  TRAC targeting sequence
gcuaugauguccuccaguuu

SEQ ID NO: 11075 - RNA, 20 nt, Artificial Sequence
  TRAC targeting sequence
acucugcuaugauguccucc

SEQ ID NO: 11076 - RNA, 20 nt, Artificial Sequence
  TRAC targeting sequence
uagccccuugugccaaauaa

SEQ ID NO: 11077 - RNA, 20 nt, Artificial Sequence
  TRAC targeting sequence
aaucauagccccuugugcca

SEQ ID NO: 11078 - RNA, 20 nt, Artificial Sequence
  TRAC targeting sequence
uuaauucuaaucauagcccc

SEQ ID NO: 11079 - RNA, 20 nt, Artificial Sequence
  TRAC targeting sequence
cauuaauucuaaucauagcc

SEQ ID NO: 11080 - RNA, 20 nt, Artificial Sequence
  TRAC targeting sequence
ucucauuaauucuaaucaua

SEQ ID NO: 11081 - RNA, 20 nt, Artificial Sequence
  TRAC targeting sequence
uucaucucauuaauucuaau

SEQ ID NO: 11082 - RNA, 20 nt, Artificial Sequence
  TRAC targeting sequence
ggcuagaagacuagaaaaau

SEQ ID NO: 11083 - RNA, 20 nt, Artificial Sequence
  TRAC targeting sequence
agccagaauuuucuuucauc

SEQ ID NO: 11084 - RNA, 20 nt, Artificial Sequence
  TRAC targeting sequence
ucuagccagaauuuucuuuc

SEQ ID NO: 11085 - RNA, 20 nt, Artificial Sequence
  TRAC targeting sequence
agucuucuagccagaauuuu

SEQ ID NO: 11086 - RNA, 20 nt, Artificial Sequence
  TRAC targeting sequence
ggaaagaaaagauacaguaa

SEQ ID NO: 11087 - RNA, 20 nt, Artificial Sequence
  TRAC targeting sequence
ggauuuuucuagucuucuag

SEQ ID NO: 11088 - RNA, 20 nt, Artificial Sequence
  TRAC targeting sequence
uuccggauuuuucuagucuu

SEQ ID NO: 11089 - RNA, 20 nt, Artificial Sequence
  TRAC targeting sequence
uuucuuuccggauuuuucua

SEQ ID NO: 11090 - RNA, 20 nt, Artificial Sequence
  TRAC targeting sequence
cccaagguuuacuguaucuu

SEQ ID NO: 11091 - RNA, 20 nt, Artificial Sequence
  TRAC targeting sequence
uaguccaagcagcaaagagc

SEQ ID NO: 11092 - RNA, 20 nt, Artificial Sequence
  TRAC targeting sequence
aagcagcaaagagcagacag

SEQ ID NO: 11093 - RNA, 20 nt, Artificial Sequence
  TRAC targeting sequence
uugcugcuuggacuaggaua

SEQ ID NO: 11094 - RNA, 20 nt, Artificial Sequence
  TRAC targeting sequence
gcucuuugcugcuuggacua

SEQ ID NO: 11095 - RNA, 20 nt, Artificial Sequence
  TRAC targeting sequence
gucugcucuuugcugcuugg

SEQ ID NO: 11096 - RNA, 20 nt, Artificial Sequence
  TRAC targeting sequence
aauaaacaauuggccuuuuu

SEQ ID NO: 11097 - RNA, 20 nt, Artificial Sequence
  TRAC targeting sequence
gcaauuaucacaaugucuuc

SEQ ID NO: 11098 - RNA, 20 nt, Artificial Sequence
  TRAC targeting sequence
caaugucuucagcuucuugg

SEQ ID NO: 11099 - RNA, 20 nt, Artificial Sequence
  TRAC targeting sequence
ucagcuucuugggcaaauau

SEQ ID NO: 11100 - RNA, 20 nt, Artificial Sequence
  TRAC targeting sequence
gcuucuugggcaaauaucaa

SEQ ID NO: 11101 - RNA, 20 nt, Artificial Sequence
  TRAC targeting sequence
ugggcaaauaucaacagguc

SEQ ID NO: 11102 - RNA, 20 nt, Artificial Sequence
  TRAC targeting sequence
acagguccuaaaugcaaagu

SEQ ID NO: 11103 - RNA, 20 nt, Artificial Sequence
  TRAC targeting sequence
uaaaugcaaaguggaacagu

SEQ ID NO: 11104 - RNA, 20 nt, Artificial Sequence
  TRAC targeting sequence
acuuugcauuuaggaccugu

SEQ ID NO: 11105 - RNA, 20 nt, Artificial Sequence
  TRAC targeting sequence
ucuguuuccagaaccgagua

SEQ ID NO: 11106 - RNA, 20 nt, Artificial Sequence
  TRAC targeting sequence
guuuccagaaccgaguagcu

SEQ ID NO: 11107 - RNA, 20 nt, Artificial Sequence
  TRAC targeting sequence
agaaccgaguagcuuagccc

SEQ ID NO: 11108 - RNA, 20 nt, Artificial Sequence
  TRAC targeting sequence
ggaaacagaggacuguucca

SEQ ID NO: 11109 - RNA, 20 nt, Artificial Sequence
  TRAC targeting sequence
guucuggaaacagaggacug

SEQ ID NO: 11110 - RNA, 20 nt, Artificial Sequence
  TRAC targeting sequence
accacuguuuuuguagagga

SEQ ID NO: 11111 - RNA, 20 nt, Artificial Sequence
  TRAC targeting sequence
acaaaaacagugguugagca

SEQ ID NO: 11112 - RNA, 20 nt, Artificial Sequence
  TRAC targeting sequence
ucuacaaaaacagugguuga

SEQ ID NO: 11113 - RNA, 20 nt, Artificial Sequence
  TRAC targeting sequence
aacuccucuacaaaaacagu

SEQ ID NO: 11114 - RNA, 20 nt, Artificial Sequence
  TRAC targeting sequence
acacagcgucaaacuccucu

SEQ ID NO: 11115 - RNA, 20 nt, Artificial Sequence
  TRAC targeting sequence
auauuccacacagcgucaaa

SEQ ID NO: 11116 - RNA, 20 nt, Artificial Sequence
  TRAC targeting sequence
uuggcgcaggaaccauucug

SEQ ID NO: 11117 - RNA, 20 nt, Artificial Sequence
  TRAC targeting sequence
ugcgccaaagaccaguuugu

SEQ ID NO: 11118 - RNA, 20 nt, Artificial Sequence
  TRAC targeting sequence
gagagucaaguccugugagu

SEQ ID NO: 11119 - RNA, 20 nt, Artificial Sequence
  TRAC targeting sequence
gaaugguuccugcgccaaag

SEQ ID NO: 11120 - RNA, 20 nt, Artificial Sequence
  TRAC targeting sequence
cagaaugguuccugcgccaa

SEQ ID NO: 11121 - RNA, 20 nt, Artificial Sequence
  TRAC targeting sequence
aguccugugaguauaaaaca

SEQ ID NO: 11122 - RNA, 20 nt, Artificial Sequence
  TRAC targeting sequence
ugugaguauaaaacacacuc

SEQ ID NO: 11123 - RNA, 20 nt, Artificial Sequence
  TRAC targeting sequence
caggacuugacucucagaau

SEQ ID NO: 11124 - RNA, 20 nt, Artificial Sequence
  TRAC targeting sequence
agucccaaccuggguuucau

SEQ ID NO: 11125 - RNA, 20 nt, Artificial Sequence
  TRAC targeting sequence
caaccuggguuucauugcau

SEQ ID NO: 11126 - RNA, 20 nt, Artificial Sequence
  TRAC targeting sequence
uugcauauuaaauaaacuuu

SEQ ID NO: 11127 - RNA, 20 nt, Artificial Sequence
  TRAC targeting sequence
ggcugggaaguauuugauuc

SEQ ID NO: 11128 - RNA, 20 nt, Artificial Sequence
  TRAC targeting sequence
cagccagaaaaaguuuauuu

SEQ ID NO: 11129 - RNA, 20 nt, Artificial Sequence
  TRAC targeting sequence
aauacuucccagccagaaaa

SEQ ID NO: 11130 - RNA, 20 nt, Artificial Sequence
  TRAC targeting sequence
aaagaaaggaaaagugaaau

SEQ ID NO: 11131 - RNA, 20 nt, Artificial Sequence
  TRAC targeting sequence
uuagaaucaaauacuuccca

SEQ ID NO: 11132 - RNA, 20 nt, Artificial Sequence
  TRAC targeting sequence
uuucuuuagaaucaaauacu

SEQ ID NO: 11133 - RNA, 20 nt, Artificial Sequence
  TRAC targeting sequence
cuuuuccuuucuuuagaauc

SEQ ID NO: 11134 - RNA, 20 nt, Artificial Sequence
  TRAC targeting sequence
aagcgcaacgcaagcauuuc

SEQ ID NO: 11135 - RNA, 20 nt, Artificial Sequence
  TRAC targeting sequence
uuagugugauucauuaagaa

SEQ ID NO: 11136 - RNA, 20 nt, Artificial Sequence
  TRAC targeting sequence
cacuaaugaaaugcuugcgu

SEQ ID NO: 11137 - RNA, 20 nt, Artificial Sequence
  TRAC targeting sequence
uuaagaauuuccauggguug

SEQ ID NO: 11138 - RNA, 20 nt, Artificial Sequence
  TRAC targeting sequence
uaaugaaucacacuaaugaa

SEQ ID NO: 11139 - RNA, 20 nt, Artificial Sequence
  TRAC targeting sequence
auggguugccuucgagagcg

SEQ ID NO: 11140 - RNA, 20 nt, Artificial Sequence
  TRAC targeting sequence
agagcguuaaucacauccau

SEQ ID NO: 11141 - RNA, 20 nt, Artificial Sequence
  TRAC targeting sequence
aaggcaacccauggaaauuc

SEQ ID NO: 11142 - RNA, 20 nt, Artificial Sequence
  TRAC targeting sequence
cgaaggcaacccauggaaau

SEQ ID NO: 11143 - RNA, 20 nt, Artificial Sequence
  TRAC targeting sequence
cauccauucacuggugagac

SEQ ID NO: 11144 - RNA, 20 nt, Artificial Sequence
  TRAC targeting sequence
auucacuggugagacccaca

SEQ ID NO: 11145 - RNA, 20 nt, Artificial Sequence
  TRAC targeting sequence
cuggugagacccacaguuug

SEQ ID NO: 11146 - RNA, 20 nt, Artificial Sequence
  TRAC targeting sequence
ccagugaauggaugugauua

SEQ ID NO: 11147 - RNA, 20 nt, Artificial Sequence
  TRAC targeting sequence
caccagugaauggaugugau

SEQ ID NO: 11148 - RNA, 20 nt, Artificial Sequence
  TRAC targeting sequence
aacugugggucucaccagug

SEQ ID NO: 11149 - RNA, 20 nt, Artificial Sequence
  TRAC targeting sequence
auuuucaaacugugggucuc

SEQ ID NO: 11150 - RNA, 20 nt, Artificial Sequence
  TRAC targeting sequence
aauuuaacucaauuuucaaa

SEQ ID NO: 11151 - RNA, 20 nt, Artificial Sequence
  TRAC targeting sequence
ccaucucuguagaccacagu

SEQ ID NO: 11152 - RNA, 20 nt, Artificial Sequence
  TRAC targeting sequence
cuguagaccacagugcuugc

SEQ ID NO: 11153 - RNA, 20 nt, Artificial Sequence
  TRAC targeting sequence
guagaccacagugcuugcug

SEQ ID NO: 11154 - RNA, 20 nt, Artificial Sequence
  TRAC targeting sequence
acagagauggugacaauuuu

SEQ ID NO: 11155 - RNA, 20 nt, Artificial Sequence
  TRAC targeting sequence
agacuuccaaaauggaaccu

SEQ ID NO: 11156 - RNA, 20 nt, Artificial Sequence
  TRAC targeting sequence
agacacccaaacagcaagca

SEQ ID NO: 11157 - RNA, 20 nt, Artificial Sequence
  TRAC targeting sequence
aaaauggaaccucaaucugu

SEQ ID NO: 11158 - RNA, 20 nt, Artificial Sequence
  TRAC targeting sequence
auuuuggaagucuagacacc

SEQ ID NO: 11159 - RNA, 20 nt, Artificial Sequence
  TRAC targeting sequence
aucuguaguuucgagcuugg

SEQ ID NO: 11160 - RNA, 20 nt, Artificial Sequence
  TRAC targeting sequence
guaguuucgagcuuggagau

SEQ ID NO: 11161 - RNA, 20 nt, Artificial Sequence
  TRAC targeting sequence
agcuuggagauuuaucccga

SEQ ID NO: 11162 - RNA, 20 nt, Artificial Sequence
  TRAC targeting sequence
aaacuacagauugagguucc

SEQ ID NO: 11163 - RNA, 20 nt, Artificial Sequence
  TRAC targeting sequence
aagcucgaaacuacagauug

SEQ ID NO: 11164 - RNA, 20 nt, Artificial Sequence
  TRAC targeting sequence
ccaagcucgaaacuacagau

SEQ ID NO: 11165 - RNA, 20 nt, Artificial Sequence
  TRAC targeting sequence
cgagcccgugacuuagagau

SEQ ID NO: 11166 - RNA, 20 nt, Artificial Sequence
  TRAC targeting sequence
ggauaaaucuccaagcucga

SEQ ID NO: 11167 - RNA, 20 nt, Artificial Sequence
  TRAC targeting sequence
cgggcucgggauaaaucucc

SEQ ID NO: 11168 - RNA, 20 nt, Artificial Sequence
  TRAC targeting sequence
aagucacgggcucgggauaa

SEQ ID NO: 11169 - RNA, 20 nt, Artificial Sequence
  TRAC targeting sequence
cuaagucacgggcucgggau

SEQ ID NO: 11170 - RNA, 20 nt, Artificial Sequence
  TRAC targeting sequence
uacacaucucuaagucacgg

SEQ ID NO: 11171 - RNA, 20 nt, Artificial Sequence
  TRAC targeting sequence
cacaaaugcccuacaaggcc

SEQ ID NO: 11172 - RNA, 20 nt, Artificial Sequence
  TRAC targeting sequence
gugucaugaaauagccuggg

SEQ ID NO: 11173 - RNA, 20 nt, Artificial Sequence
  TRAC targeting sequence
ugaaauagccuggguagaca

SEQ ID NO: 11174 - RNA, 20 nt, Artificial Sequence
  TRAC targeting sequence
ugacacugaucccacaaaug

SEQ ID NO: 11175 - RNA, 20 nt, Artificial Sequence
  TRAC targeting sequence
acccaggcuauuucaugaca

SEQ ID NO: 11176 - RNA, 20 nt, Artificial Sequence
  TRAC targeting sequence
ccaaccugucuacccaggcu

SEQ ID NO: 11177 - RNA, 20 nt, Artificial Sequence
  TRAC targeting sequence
ucaccaaccugucuacccag

SEQ ID NO: 11178 - RNA, 20 nt, Artificial Sequence
  TRAC targeting sequence
ccucaccaaccugucuaccc

SEQ ID NO: 11179 - RNA, 20 nt, Artificial Sequence
  TRAC targeting sequence
ccagugucuccucaccaacc

SEQ ID NO: 11180 - RNA, 20 nt, Artificial Sequence
  TRAC targeting sequence
gcccuguuucuguaaagcug

SEQ ID NO: 11181 - RNA, 20 nt, Artificial Sequence
  TRAC targeting sequence
guaaagcugcugacagccgu

SEQ ID NO: 11182 - RNA, 20 nt, Artificial Sequence
  TRAC targeting sequence
gcagcuuuacagaaacaggg

SEQ ID NO: 11183 - RNA, 20 nt, Artificial Sequence
  TRAC targeting sequence
cggcugucagcagcuuuaca

SEQ ID NO: 11184 - RNA, 20 nt, Artificial Sequence
  TRAC targeting sequence
cacggcugucagcagcuuua

SEQ ID NO: 11185 - RNA, 20 nt, Artificial Sequence
  TRAC targeting sequence
ucucacggcugucagcagcu

SEQ ID NO: 11186 - RNA, 20 nt, Artificial Sequence
  TRAC targeting sequence
gcugcuuuucuucucacggc

SEQ ID NO: 11187 - RNA, 20 nt, Artificial Sequence
  TRAC targeting sequence
ccgcugcuuuucuucucacg

SEQ ID NO: 11188 - RNA, 20 nt, Artificial Sequence
  TRAC targeting sequence
gcuugucuccgcugcuuuuc

SEQ ID NO: 11189 - RNA, 20 nt, Artificial Sequence
  TRAC targeting sequence
caaaagucagcuugucuccg

SEQ ID NO: 11190 - RNA, 20 nt, Artificial Sequence
  TRAC targeting sequence
cggucccaaaagucagcuug

SEQ ID NO: 11191 - RNA, 20 nt, Artificial Sequence
  TRAC targeting sequence
uuuagcaguuaggcccagua

SEQ ID NO: 11192 - RNA, 20 nt, Artificial Sequence
  TRAC targeting sequence
gagcagaaaguaagauauuu

SEQ ID NO: 11193 - RNA, 20 nt, Artificial Sequence
  TRAC targeting sequence
gacuuacugggccuaacugc

SEQ ID NO: 11194 - RNA, 20 nt, Artificial Sequence
  TRAC targeting sequence
gcucagacuuacugggccua

SEQ ID NO: 11195 - RNA, 20 nt, Artificial Sequence
  TRAC targeting sequence
uacuuucugcucagacuuac

SEQ ID NO: 11196 - RNA, 20 nt, Artificial Sequence
  TRAC targeting sequence
uauuauuuguucuagccuga

SEQ ID NO: 11197 - RNA, 20 nt, Artificial Sequence
  TRAC targeting sequence
agccugacauuugaguuguc

SEQ ID NO: 11198 - RNA, 20 nt, Artificial Sequence
  TRAC targeting sequence
ggcuagaacaaauaauagga

SEQ ID NO: 11199 - RNA, 20 nt, Artificial Sequence
  TRAC targeting sequence
aaugucaggcuagaacaaau

SEQ ID NO: 11200 - RNA, 20 nt, Artificial Sequence
  TRAC targeting sequence
uccuuuggauuccagaucaa

SEQ ID NO: 11201 - RNA, 20 nt, Artificial Sequence
  TRAC targeting sequence
uuuggauuccagaucaacaa

SEQ ID NO: 11202 - RNA, 20 nt, Artificial Sequence
  TRAC targeting sequence
aaaggaggacaacucaaaug

SEQ ID NO: 11203 - RNA, 20 nt, Artificial Sequence
  TRAC targeting sequence
agaucaacaaaccauagugu

SEQ ID NO: 11204 - RNA, 20 nt, Artificial Sequence
  TRAC targeting sequence
ggaauccaaaggaggacaac

SEQ ID NO: 11205 - RNA, 20 nt, Artificial Sequence
  TRAC targeting sequence
acaaaccauagugucuuuuc

SEQ ID NO: 11206 - RNA, 20 nt, Artificial Sequence
  TRAC targeting sequence
uuucauacuccuuuuaauau

SEQ ID NO: 11207 - RNA, 20 nt, Artificial Sequence
  TRAC targeting sequence
uacuccuuuuaauauuugug

SEQ ID NO: 11208 - RNA, 20 nt, Artificial Sequence
  TRAC targeting sequence
uuuuaauauuuguggcuaag

SEQ ID NO: 11209 - RNA, 20 nt, Artificial Sequence
  TRAC targeting sequence
guucuucccaucuguccuac

SEQ ID NO: 11210 - RNA, 20 nt, Artificial Sequence
  TRAC targeting sequence
ucccaucuguccuacaugag

SEQ ID NO: 11211 - RNA, 20 nt, Artificial Sequence
  TRAC targeting sequence
caucuguccuacaugagggu

SEQ ID NO: 11212 - RNA, 20 nt, Artificial Sequence
  TRAC targeting sequence
guccuacaugaggguccugu

SEQ ID NO: 11213 - RNA, 20 nt, Artificial Sequence
  TRAC targeting sequence
uacaugaggguccuguggcc

SEQ ID NO: 11214 - RNA, 20 nt, Artificial Sequence
  TRAC targeting sequence
uguaggacagaugggaagaa

SEQ ID NO: 11215 - RNA, 20 nt, Artificial Sequence
  TRAC targeting sequence
uguggccagguccacauuca

SEQ ID NO: 11216 - RNA, 20 nt, Artificial Sequence
  TRAC targeting sequence
acauucauaaagaagccaac

SEQ ID NO: 11217 - RNA, 20 nt, Artificial Sequence
  TRAC targeting sequence
uaaagaagccaacagugaug

SEQ ID NO: 11218 - RNA, 20 nt, Artificial Sequence
  TRAC targeting sequence
uuaugaauguggaccuggcc

SEQ ID NO: 11219 - RNA, 20 nt, Artificial Sequence
  TRAC targeting sequence
cuguuggcuucuuuaugaau

SEQ ID NO: 11220 - RNA, 20 nt, Artificial Sequence
  TRAC targeting sequence
agaaacugcagucaucaucu

SEQ ID NO: 11221 - RNA, 20 nt, Artificial Sequence
  TRAC targeting sequence
ugacacacugccaaccaacu

SEQ ID NO: 11222 - RNA, 20 nt, Artificial Sequence
  TRAC targeting sequence
ucaucuccagggcccuuacu

SEQ ID NO: 11223 - RNA, 20 nt, Artificial Sequence
  TRAC targeting sequence
ucuccagggcccuuacucug

SEQ ID NO: 11224 - RNA, 20 nt, Artificial Sequence
  TRAC targeting sequence
ccagggcccuuacucugguu

SEQ ID NO: 11225 - RNA, 20 nt, Artificial Sequence
  TRAC targeting sequence
agggcccuuacucugguuau

SEQ ID NO: 11226 - RNA, 20 nt, Artificial Sequence
  TRAC targeting sequence
gguuauguguguuucaagcu

SEQ ID NO: 11227 - RNA, 20 nt, Artificial Sequence
  TRAC targeting sequence
agcuuuuaugccagcaacag

SEQ ID NO: 11228 - RNA, 20 nt, Artificial Sequence
  TRAC targeting sequence
guugcuggcauaaaagcuug

SEQ ID NO: 11229 - RNA, 20 nt, Artificial Sequence
  TRAC targeting sequence
ucuguugcuggcauaaaagc

SEQ ID NO: 11230 - RNA, 20 nt, Artificial Sequence
  TRAC targeting sequence
ccucuguugcuggcauaaaa

SEQ ID NO: 11231 - RNA, 20 nt, Artificial Sequence
  TRAC targeting sequence
cucuccucuguugcuggcau

SEQ ID NO: 11232 - RNA, 20 nt, Artificial Sequence
  TRAC targeting sequence
cccucuccucuguugcuggc

SEQ ID NO: 11233 - RNA, 20 nt, Artificial Sequence
  TRAC targeting sequence
cuucucccucuccucuguug

SEQ ID NO: 11234 - RNA, 20 nt, Artificial Sequence
  TRAC targeting sequence
uugcuacuggucacuucucc

SEQ ID NO: 11235 - RNA, 20 nt, Artificial Sequence
  TRAC targeting sequence
guggguuucagagcagcugu

SEQ ID NO: 11236 - RNA, 20 nt, Artificial Sequence
  TRAC targeting sequence
gagcagcuguggagguuacg

SEQ ID NO: 11237 - RNA, 20 nt, Artificial Sequence
  TRAC targeting sequence
gaaacccacagacaccaggu

SEQ ID NO: 11238 - RNA, 20 nt, Artificial Sequence
  TRAC targeting sequence
acagcugcucugaaacccac

SEQ ID NO: 11239 - RNA, 20 nt, Artificial Sequence
  TRAC targeting sequence
cguaaccuccacagcugcuc

SEQ ID NO: 11240 - RNA, 20 nt, Artificial Sequence
  TRAC targeting sequence
gggcaugaguuuuucuggca

SEQ ID NO: 11241 - RNA, 20 nt, Artificial Sequence
  TRAC targeting sequence
ugcccugaaccucccguaac

SEQ ID NO: 11242 - RNA, 20 nt, Artificial Sequence
  TRAC targeting sequence
ggcagaggaguuuauguaaa

SEQ ID NO: 11243 - RNA, 20 nt, Artificial Sequence
  TRAC targeting sequence
gccagaaaaacucaugcccu

SEQ ID NO: 11244 - RNA, 20 nt, Artificial Sequence
  TRAC targeting sequence
ucugccagaaaaacucaugc

SEQ ID NO: 11245 - RNA, 20 nt, Artificial Sequence
  TRAC targeting sequence
gggccaacccuuuacauaaa

SEQ ID NO: 11246 - RNA, 20 nt, Artificial Sequence
  TRAC targeting sequence
ggaggaggugcugacggacu

SEQ ID NO: 11247 - RNA, 20 nt, Artificial Sequence
  TRAC targeting sequence
ugaauacacacucugggcca

SEQ ID NO: 11248 - RNA, 20 nt, Artificial Sequence
  TRAC targeting sequence
uccugaauacacacucuggg

SEQ ID NO: 11249 - RNA, 20 nt, Artificial Sequence
  TRAC targeting sequence
gcaccuccuccugaauacac

SEQ ID NO: 11250 - RNA, 20 nt, Artificial Sequence
  TRAC targeting sequence
gucagcaccuccuccugaau

SEQ ID NO: 11251 - RNA, 20 nt, Artificial Sequence
  TRAC targeting sequence
ccuuuggcaaagggacucau

SEQ ID NO: 11252 - RNA, 20 nt, Artificial Sequence
  TRAC targeting sequence
cuuugccaaaggugaguccg

SEQ ID NO: 11253 - RNA, 20 nt, Artificial Sequence
  TRAC targeting sequence
ucuaaucauccagcccugua

SEQ ID NO: 11254 - RNA, 20 nt, Artificial Sequence
  TRAC targeting sequence
aaucauccagcccuguaagu

SEQ ID NO: 11255 - RNA, 20 nt, Artificial Sequence
  TRAC targeting sequence
uccagcccuguaagugcuuu

SEQ ID NO: 11256 - RNA, 20 nt, Artificial Sequence
  TRAC targeting sequence
agcccuguaagugcuuuugc

SEQ ID NO: 11257 - RNA, 20 nt, Artificial Sequence
  TRAC targeting sequence
caggcaaaagcacuuacagg

SEQ ID NO: 11258 - RNA, 20 nt, Artificial Sequence
  TRAC targeting sequence
aaaugcaguccucaugggga

SEQ ID NO: 11259 - RNA, 20 nt, Artificial Sequence
  TRAC targeting sequence
ucauggggacauuucuaaac

SEQ ID NO: 11260 - RNA, 20 nt, Artificial Sequence
  TRAC targeting sequence
uggggacauuucuaaaccuu

SEQ ID NO: 11261 - RNA, 20 nt, Artificial Sequence
  TRAC targeting sequence
ccaugaggacugcauuuuga

SEQ ID NO: 11262 - RNA, 20 nt, Artificial Sequence
  TRAC targeting sequence
aaaccuuggcucaugugcuu

SEQ ID NO: 11263 - RNA, 20 nt, Artificial Sequence
  TRAC targeting sequence
ugugcuucuggugccacuac

SEQ ID NO: 11264 - RNA, 20 nt, Artificial Sequence
  TRAC targeting sequence
ggugccacuaccauuuuugg

SEQ ID NO: 11265 - RNA, 20 nt, Artificial Sequence
  TRAC targeting sequence
uacuuacaugggagguuuug

SEQ ID NO: 11266 - RNA, 20 nt, Artificial Sequence
  TRAC targeting sequence
cauguaaguaggauagugcc

SEQ ID NO: 11267 - RNA, 20 nt, Artificial Sequence
  TRAC targeting sequence
aaaccucccauguaaguagg

SEQ ID NO: 11268 - RNA, 20 nt, Artificial Sequence
  TRAC targeting sequence
acauggcucaaaaccuccca

SEQ ID NO: 11269 - RNA, 20 nt, Artificial Sequence
  TRAC targeting sequence
uugucuacauggcucaaaac

SEQ ID NO: 11270 - RNA, 20 nt, Artificial Sequence
  TRAC targeting sequence
ccuccuugucuacauggcuc

SEQ ID NO: 11271 - RNA, 20 nt, Artificial Sequence
  TRAC targeting sequence
aaagcacaaacugcaucacc

SEQ ID NO: 11272 - RNA, 20 nt, Artificial Sequence
  TRAC targeting sequence
uccaaagcacaaacugcauc

SEQ ID NO: 11273 - RNA, 20 nt, Artificial Sequence
  TRAC targeting sequence
ugagaucugcccuuuggcaa

SEQ ID NO: 11274 - RNA, 20 nt, Artificial Sequence
  TRAC targeting sequence
ggaguccuccaaagcacaaa

SEQ ID NO: 11275 - RNA, 20 nt, Artificial Sequence
  TRAC targeting sequence
caggaguccuccaaagcaca

SEQ ID NO: 11276 - RNA, 20 nt, Artificial Sequence
  TRAC targeting sequence
gcccuuuggcaacuguguuu

SEQ ID NO: 11277 - RNA, 20 nt, Artificial Sequence
  TRAC targeting sequence
aacacaguugccaaagggca

SEQ ID NO: 11278 - RNA, 20 nt, Artificial Sequence
  TRAC targeting sequence
uacucaaacacaguugccaa

SEQ ID NO: 11279 - RNA, 20 nt, Artificial Sequence
  TRAC targeting sequence
cucauuggaaaaucuggaug

SEQ ID NO: 11280 - RNA, 20 nt, Artificial Sequence
  TRAC targeting sequence
uuggaaaaucuggaugccag

SEQ ID NO: 11281 - RNA, 20 nt, Artificial Sequence
  TRAC targeting sequence
aaugagggacuccuacucaa

SEQ ID NO: 11282 - RNA, 20 nt, Artificial Sequence
  TRAC targeting sequence
ggaugccagcagacaaaaga

SEQ ID NO: 11283 - RNA, 20 nt, Artificial Sequence
  TRAC targeting sequence
agauuuuccaaugagggacu

SEQ ID NO: 11284 - RNA, 20 nt, Artificial Sequence
  TRAC targeting sequence
gcuggcauccagauuuucca

SEQ ID NO: 11285 - RNA, 20 nt, Artificial Sequence
  TRAC targeting sequence
uuugucugcuggcauccaga

SEQ ID NO: 11286 - RNA, 20 nt, Artificial Sequence
  TRAC targeting sequence
uaucuuuugucugcuggcau

SEQ ID NO: 11287 - RNA, 20 nt, Artificial Sequence
  TRAC targeting sequence
uaagcucauaucuuuugucu

SEQ ID NO: 11288 - RNA, 20 nt, Artificial Sequence
  TRAC targeting sequence
caaacaaauggaggccacuu

SEQ ID NO: 11289 - RNA, 20 nt, Artificial Sequence
  TRAC targeting sequence
auuuguuugugacccauccu

SEQ ID NO: 11290 - RNA, 20 nt, Artificial Sequence
  TRAC targeting sequence
uugcaaaggugcugcuggca

SEQ ID NO: 11291 - RNA, 20 nt, Artificial Sequence
  TRAC targeting sequence
uaggaaauguggaaauggcu

SEQ ID NO: 11292 - RNA, 20 nt, Artificial Sequence
  TRAC targeting sequence
uaugaaagcaauuuucguug

SEQ ID NO: 11293 - RNA, 20 nt, Artificial Sequence
  TRAC targeting sequence
acauuuccuaugaaagcaau

SEQ ID NO: 11294 - RNA, 20 nt, Artificial Sequence
  TRAC targeting sequence
acacagccauuuccacauuu

SEQ ID NO: 11295 - RNA, 20 nt, Artificial Sequence
  TRAC targeting sequence
aucuacacagccauuuccac

SEQ ID NO: 11296 - RNA, 20 nt, Artificial Sequence
  TRAC targeting sequence
cuaucuacacagccauuucc

SEQ ID NO: 11297 - RNA, 20 nt, Artificial Sequence
  TRAC targeting sequence
ccuuuucugucuuuauaccc

SEQ ID NO: 11298 - RNA, 20 nt, Artificial Sequence
  TRAC targeting sequence
uuuucugucuuuauacccuc

SEQ ID NO: 11299 - RNA, 20 nt, Artificial Sequence
  TRAC targeting sequence
gucuuuauacccucuucucu

SEQ ID NO: 11300 - RNA, 20 nt, Artificial Sequence
  TRAC targeting sequence
uuauacccucuucucugccu

SEQ ID NO: 11301 - RNA, 20 nt, Artificial Sequence
  TRAC targeting sequence
ucucugccugacuuagggac

SEQ ID NO: 11302 - RNA, 20 nt, Artificial Sequence
  TRAC targeting sequence
cugccugacuuagggaccuu

SEQ ID NO: 11303 - RNA, 20 nt, Artificial Sequence
  TRAC targeting sequence
gccugacuuagggaccuuaa

SEQ ID NO: 11304 - RNA, 20 nt, Artificial Sequence
  TRAC targeting sequence
ggcagagaagaggguauaaa

SEQ ID NO: 11305 - RNA, 20 nt, Artificial Sequence
  TRAC targeting sequence
cuaagucaggcagagaagag

SEQ ID NO: 11306 - RNA, 20 nt, Artificial Sequence
  TRAC targeting sequence
aauuuaaggucccuaaguca

SEQ ID NO: 11307 - RNA, 20 nt, Artificial Sequence
  TRAC targeting sequence
uuugauuucucggccccauc

SEQ ID NO: 11308 - RNA, 20 nt, Artificial Sequence
  TRAC targeting sequence
aaugauuaauaacugcucua

SEQ ID NO: 11309 - RNA, 20 nt, Artificial Sequence
  TRAC targeting sequence
cggccccaucacucaucaag

SEQ ID NO: 11310 - RNA, 20 nt, Artificial Sequence
  TRAC targeting sequence
gccccaucacucaucaagua

SEQ ID NO: 11311 - RNA, 20 nt, Artificial Sequence
  TRAC targeting sequence
cucaucaaguaugacaagag

SEQ ID NO: 11312 - RNA, 20 nt, Artificial Sequence
  TRAC targeting sequence
ucaaguaugacaagagggau

SEQ ID NO: 11313 - RNA, 20 nt, Artificial Sequence
  TRAC targeting sequence
aguaugacaagagggauuca

SEQ ID NO: 11314 - RNA, 20 nt, Artificial Sequence
  TRAC targeting sequence
uacuugaugagugauggggc

SEQ ID NO: 11315 - RNA, 20 nt, Artificial Sequence
  TRAC targeting sequence
ugucauacuugaugagugau

SEQ ID NO: 11316 - RNA, 20 nt, Artificial Sequence
  TRAC targeting sequence
cucuugucauacuugaugag

SEQ ID NO: 11317 - RNA, 20 nt, Artificial Sequence
  TRAC targeting sequence
uuaagauaaaacccagaaac

SEQ ID NO: 11318 - RNA, 20 nt, Artificial Sequence
  TRAC targeting sequence
uaaugaaucccucuugucau

SEQ ID NO: 11319 - RNA, 20 nt, Artificial Sequence
  TRAC targeting sequence
ggguuuuaucuuaaugaauc

SEQ ID NO: 11320 - RNA, 20 nt, Artificial Sequence
  TRAC targeting sequence
guuucuggguuuuaucuuaa

SEQ ID NO: 11321 - RNA, 20 nt, Artificial Sequence
  TRAC targeting sequence
uuucuguuucuggguuuuau

SEQ ID NO: 11322 - RNA, 20 nt, Artificial Sequence
  TRAC targeting sequence
uuguccuuucuguuucuggg

SEQ ID NO: 11323 - RNA, 20 nt, Artificial Sequence
  TRAC targeting sequence
auucucaaugucuucagagu

SEQ ID NO: 11324 - RNA, 20 nt, Artificial Sequence
  TRAC targeting sequence
caaugucuucagaguugaac

SEQ ID NO: 11325 - RNA, 20 nt, Artificial Sequence
  TRAC targeting sequence
augucuucagaguugaacuu

SEQ ID NO: 11326 - RNA, 20 nt, Artificial Sequence
  TRAC targeting sequence
ucagaguugaacuugacaac

SEQ ID NO: 11327 - RNA, 20 nt, Artificial Sequence
  TRAC targeting sequence
gaguugaacuugacaacucc

SEQ ID NO: 11328 - RNA, 20 nt, Artificial Sequence
  TRAC targeting sequence
gaagacauugagaauugaau

SEQ ID NO: 11329 - RNA, 20 nt, Artificial Sequence
  TRAC targeting sequence
acucugaagacauugagaau

SEQ ID NO: 11330 - RNA, 20 nt, Artificial Sequence
  TRAC targeting sequence
aguucaacucugaagacauu

SEQ ID NO: 11331 - RNA, 20 nt, Artificial Sequence
  TRAC targeting sequence
ucagccuuaaccaucuaguc

SEQ ID NO: 11332 - RNA, 20 nt, Artificial Sequence
  TRAC targeting sequence
gccuuaaccaucuagucagc

SEQ ID NO: 11333 - RNA, 20 nt, Artificial Sequence
  TRAC targeting sequence
agucagcaccccaugaccaa

SEQ ID NO: 11334 - RNA, 20 nt, Artificial Sequence
  TRAC targeting sequence
gcaccccaugaccaacugag

SEQ ID NO: 11335 - RNA, 20 nt, Artificial Sequence
  TRAC targeting sequence
uggggugcugacuagauggu

SEQ ID NO: 11336 - RNA, 20 nt, Artificial Sequence
  TRAC targeting sequence
guuggucauggggugcugac

SEQ ID NO: 11337 - RNA, 20 nt, Artificial Sequence
  TRAC targeting sequence
aagagggcaaccagcaggua

SEQ ID NO: 11338 - RNA, 20 nt, Artificial Sequence
  TRAC targeting sequence
uugaccucaguuggucaugg

SEQ ID NO: 11339 - RNA, 20 nt, Artificial Sequence
  TRAC targeting sequence
agugaguaucuggccagagc

SEQ ID NO: 11340 - RNA, 20 nt, Artificial Sequence
  TRAC targeting sequence
cuugacuaacauuaccugcu

SEQ ID NO: 11341 - RNA, 20 nt, Artificial Sequence
  TRAC targeting sequence
ggccagagcccagcugcccu

SEQ ID NO: 11342 - RNA, 20 nt, Artificial Sequence
  TRAC targeting sequence
ggccagauacucacuugacu

SEQ ID NO: 11343 - RNA, 20 nt, Artificial Sequence
  TRAC targeting sequence
uaggaauuaauacuguggag

SEQ ID NO: 11344 - RNA, 20 nt, Artificial Sequence
  TRAC targeting sequence
uaugagggcagcugggcucu

SEQ ID NO: 11345 - RNA, 20 nt, Artificial Sequence
  TRAC targeting sequence
acaguauuaauuccuaugag

SEQ ID NO: 11346 - RNA, 20 nt, Artificial Sequence
  TRAC targeting sequence
caaacuccacaguauuaauu

SEQ ID NO: 11347 - RNA, 20 nt, Artificial Sequence
  TRAC targeting sequence
cuuucccaaacuccacagua

SEQ ID NO: 11348 - RNA, 20 nt, Artificial Sequence
  TRAC targeting sequence
gugagggcucacccaggcug

SEQ ID NO: 11349 - RNA, 20 nt, Artificial Sequence
  TRAC targeting sequence
cagaugcauuucccuuuccc

SEQ ID NO: 11350 - RNA, 20 nt, Artificial Sequence
  TRAC targeting sequence
cccaggcugcccaucuggga

SEQ ID NO: 11351 - RNA, 20 nt, Artificial Sequence
  TRAC targeting sequence
gggagagaucauggggagag

SEQ ID NO: 11352 - RNA, 20 nt, Artificial Sequence
  TRAC targeting sequence
cagaugggcagccuggguga

SEQ ID NO: 11353 - RNA, 20 nt, Artificial Sequence
  TRAC targeting sequence
cccagaugggcagccugggu

SEQ ID NO: 11354 - RNA, 20 nt, Artificial Sequence
  TRAC targeting sequence
cucccagaugggcagccugg

SEQ ID NO: 11355 - RNA, 20 nt, Artificial Sequence
  TRAC targeting sequence
uggggagaguucugagugag

SEQ ID NO: 11356 - RNA, 20 nt, Artificial Sequence
  TRAC targeting sequence
ccaugaucucucccagaugg

SEQ ID NO: 11357 - RNA, 20 nt, Artificial Sequence
  TRAC targeting sequence
ccccaugaucucucccagau

SEQ ID NO: 11358 - RNA, 20 nt, Artificial Sequence
  TRAC targeting sequence
gagugagggagugaacacca

SEQ ID NO: 11359 - RNA, 20 nt, Artificial Sequence
  TRAC targeting sequence
gaacucuccccaugaucucu

SEQ ID NO: 11360 - RNA, 20 nt, Artificial Sequence
  TRAC targeting sequence
cucagaacucuccccaugau

SEQ ID NO: 11361 - RNA, 20 nt, Artificial Sequence
  TRAC targeting sequence
cucacucagaacucucccca

SEQ ID NO: 11362 - RNA, 20 nt, Artificial Sequence
  TRAC targeting sequence
cucccucacucagaacucuc

SEQ ID NO: 11363 - RNA, 20 nt, Artificial Sequence
  TRAC targeting sequence
gguguucacucccucacuca

SEQ ID NO: 11364 - RNA, 20 nt, Artificial Sequence
  TRAC targeting sequence
aucugguguucacucccuca

SEQ ID NO: 11365 - RNA, 20 nt, Artificial Sequence
  TRAC targeting sequence
agcaacagguuucuguuaug

SEQ ID NO: 11366 - RNA, 20 nt, Artificial Sequence
  TRAC targeting sequence
guuaugaagcaucucacagu

SEQ ID NO: 11367 - RNA, 20 nt, Artificial Sequence
  TRAC targeting sequence
uaacagaaaccuguugcuug

SEQ ID NO: 11368 - RNA, 20 nt, Artificial Sequence
  TRAC targeting sequence
cacaguguaaauaccggcac

SEQ ID NO: 11369 - RNA, 20 nt, Artificial Sequence
  TRAC targeting sequence
caguguaaauaccggcacug

SEQ ID NO: 11370 - RNA, 20 nt, Artificial Sequence
  TRAC targeting sequence
ccuuugggacuggaacaaga

SEQ ID NO: 11371 - RNA, 20 nt, Artificial Sequence
  TRAC targeting sequence
caaaggugaguuuacuggca

SEQ ID NO: 11372 - RNA, 20 nt, Artificial Sequence
  TRAC targeting sequence
agucccaaaggugaguuuac

SEQ ID NO: 11373 - RNA, 20 nt, Artificial Sequence
  TRAC targeting sequence
uguuccagucccaaagguga

SEQ ID NO: 11374 - RNA, 20 nt, Artificial Sequence
  TRAC targeting sequence
ggucacgcucgguagguaac

SEQ ID NO: 11375 - RNA, 20 nt, Artificial Sequence
  TRAC targeting sequence
cgcucgguagguaacagaaa

SEQ ID NO: 11376 - RNA, 20 nt, Artificial Sequence
  TRAC targeting sequence
guagguaacagaaaccguga

SEQ ID NO: 11377 - RNA, 20 nt, Artificial Sequence
  TRAC targeting sequence
guuaccuaccgagcgugacc

SEQ ID NO: 11378 - RNA, 20 nt, Artificial Sequence
  TRAC targeting sequence
cgguuucuguuaccuaccga

SEQ ID NO: 11379 - RNA, 20 nt, Artificial Sequence
  TRAC targeting sequence
uuuaaaacaggggauacugc

SEQ ID NO: 11380 - RNA, 20 nt, Artificial Sequence
  TRAC targeting sequence
ccuguuuuaaaggaacacac

SEQ ID NO: 11381 - RNA, 20 nt, Artificial Sequence
  TRAC targeting sequence
gcaguauccccuguuuuaaa

SEQ ID NO: 11382 - RNA, 20 nt, Artificial Sequence
  TRAC targeting sequence
ccucugcaguauccccuguu

SEQ ID NO: 11383 - RNA, 20 nt, Artificial Sequence
  TRAC targeting sequence
uggcuggauguaguccuucc

SEQ ID NO: 11384 - RNA, 20 nt, Artificial Sequence
  TRAC targeting sequence
agccaggauauccccucugc

SEQ ID NO: 11385 - RNA, 20 nt, Artificial Sequence
  TRAC targeting sequence
uuccuuccuuccagugggag

SEQ ID NO: 11386 - RNA, 20 nt, Artificial Sequence
  TRAC targeting sequence
uuccuuccagugggagguga

SEQ ID NO: 11387 - RNA, 20 nt, Artificial Sequence
  TRAC targeting sequence
uuccagugggaggugaucuc

SEQ ID NO: 11388 - RNA, 20 nt, Artificial Sequence
  TRAC targeting sequence
agugggaggugaucucacug

SEQ ID NO: 11389 - RNA, 20 nt, Artificial Sequence
  TRAC targeting sequence
cacuggaaggaaggaaggac

SEQ ID NO: 11390 - RNA, 20 nt, Artificial Sequence
  TRAC targeting sequence
ccucccacuggaaggaagga

SEQ ID NO: 11391 - RNA, 20 nt, Artificial Sequence
  TRAC targeting sequence
cacugaggacacauaccugc

SEQ ID NO: 11392 - RNA, 20 nt, Artificial Sequence
  TRAC targeting sequence
cugaggacacauaccugcau

SEQ ID NO: 11393 - RNA, 20 nt, Artificial Sequence
  TRAC targeting sequence
gugagaucaccucccacugg

SEQ ID NO: 11394 - RNA, 20 nt, Artificial Sequence
  TRAC targeting sequence
ucagugagaucaccucccac

SEQ ID NO: 11395 - RNA, 20 nt, Artificial Sequence
  TRAC targeting sequence
gucaguucuugugcuauuuu

SEQ ID NO: 11396 - RNA, 20 nt, Artificial Sequence
  TRAC targeting sequence
guucuugugcuauuuuuaua

SEQ ID NO: 11397 - RNA, 20 nt, Artificial Sequence
  TRAC targeting sequence
ugugcuauuuuuauaccugu

SEQ ID NO: 11398 - RNA, 20 nt, Artificial Sequence
  TRAC targeting sequence
guaacagguauaaaaauagc

SEQ ID NO: 11399 - RNA, 20 nt, Artificial Sequence
  TRAC targeting sequence
uuuccaccugugaaaacaga

SEQ ID NO: 11400 - RNA, 20 nt, Artificial Sequence
  TRAC targeting sequence
accugugaaaacagaaccuc

SEQ ID NO: 11401 - RNA, 20 nt, Artificial Sequence
  TRAC targeting sequence
cagguggaaaggaaagccuc

SEQ ID NO: 11402 - RNA, 20 nt, Artificial Sequence
  TRAC targeting sequence
guuuucacagguggaaagga

SEQ ID NO: 11403 - RNA, 20 nt, Artificial Sequence
  TRAC targeting sequence
cugcuccaagcuucuucagu

SEQ ID NO: 11404 - RNA, 20 nt, Artificial Sequence
  TRAC targeting sequence
gcuccaagcuucuucagucu

SEQ ID NO: 11405 - RNA, 20 nt, Artificial Sequence
  TRAC targeting sequence
aagcuucuucagucuuuauu

SEQ ID NO: 11406 - RNA, 20 nt, Artificial Sequence
  TRAC targeting sequence
ucagucuuuauuacccuaug

SEQ ID NO: 11407 - RNA, 20 nt, Artificial Sequence
  TRAC targeting sequence
gucuuuauuacccuauguau

SEQ ID NO: 11408 - RNA, 20 nt, Artificial Sequence
  TRAC targeting sequence
uuauuacccuauguauuucc

SEQ ID NO: 11409 - RNA, 20 nt, Artificial Sequence
  TRAC targeting sequence
uuuagaacagugguuuggga

SEQ ID NO: 11410 - RNA, 20 nt, Artificial Sequence
  TRAC targeting sequence
aaaggaaauacauaggguaa

SEQ ID NO: 11411 - RNA, 20 nt, Artificial Sequence
  TRAC targeting sequence
caaaccacuguucuaaagga

SEQ ID NO: 11412 - RNA, 20 nt, Artificial Sequence
  TRAC targeting sequence
ucaggacuuugucucugaug

SEQ ID NO: 11413 - RNA, 20 nt, Artificial Sequence
  TRAC targeting sequence
ggacuuugucucugaugaua

SEQ ID NO: 11414 - RNA, 20 nt, Artificial Sequence
  TRAC targeting sequence
ugaugauaaauuaauuccca

SEQ ID NO: 11415 - RNA, 20 nt, Artificial Sequence
  TRAC targeting sequence
cugaugauaucacucugggc

SEQ ID NO: 11416 - RNA, 20 nt, Artificial Sequence
  TRAC targeting sequence
gaugauaucacucugggcaa

SEQ ID NO: 11417 - RNA, 20 nt, Artificial Sequence
  TRAC targeting sequence
gagacaaaguccugaugaua

SEQ ID NO: 11418 - RNA, 20 nt, Artificial Sequence
  TRAC targeting sequence
ucagagacaaaguccugaug

SEQ ID NO: 11419 - RNA, 20 nt, Artificial Sequence
  TRAC targeting sequence
cucugggcaacaaaaugaaa

SEQ ID NO: 11420 - RNA, 20 nt, Artificial Sequence
  TRAC targeting sequence
gggcaacaaaaugaaagggc

SEQ ID NO: 11421 - RNA, 20 nt, Artificial Sequence
  TRAC targeting sequence
uuuuguugcccagagugaua

SEQ ID NO: 11422 - RNA, 20 nt, Artificial Sequence
  TRAC targeting sequence
caaauagagaacagagaguc

SEQ ID NO: 11423 - RNA, 20 nt, Artificial Sequence
  TRAC targeting sequence
aauagagaacagagaguccu

SEQ ID NO: 11424 - RNA, 20 nt, Artificial Sequence
  TRAC targeting sequence
auuugagagcccuuucauuu

SEQ ID NO: 11425 - RNA, 20 nt, Artificial Sequence
  TRAC targeting sequence
cuauuugagagcccuuucau

SEQ ID NO: 11426 - RNA, 20 nt, Artificial Sequence
  TRAC targeting sequence
guucucuauuugagagcccu

SEQ ID NO: 11427 - RNA, 20 nt, Artificial Sequence
  TRAC targeting sequence
cuguucucuauuugagagcc

SEQ ID NO: 11428 - RNA, 20 nt, Artificial Sequence
  TRAC targeting sequence
ugaauacucggauaacuuuu

SEQ ID NO: 11429 - RNA, 20 nt, Artificial Sequence
  TRAC targeting sequence
ggacucucuguucucuauuu

SEQ ID NO: 11430 - RNA, 20 nt, Artificial Sequence
  TRAC targeting sequence
gauaacuuuuccagagugau

SEQ ID NO: 11431 - RNA, 20 nt, Artificial Sequence
  TRAC targeting sequence
gaguauucaggacucucugu

SEQ ID NO: 11432 - RNA, 20 nt, Artificial Sequence
  TRAC targeting sequence
agagugauauguguuaugcg

SEQ ID NO: 11433 - RNA, 20 nt, Artificial Sequence
  TRAC targeting sequence
ggaaaaguuauccgaguauu

SEQ ID NO: 11434 - RNA, 20 nt, Artificial Sequence
  TRAC targeting sequence
cucuggaaaaguuauccgag

SEQ ID NO: 11435 - RNA, 20 nt, Artificial Sequence
  TRAC targeting sequence
cauuacgcauaacacauauc

SEQ ID NO: 11436 - RNA, 20 nt, Artificial Sequence
  TRAC targeting sequence
ucccauuacgcauaacacau

SEQ ID NO: 11437 - RNA, 20 nt, Artificial Sequence
  TRAC targeting sequence
agcccacuucaucccauuac

SEQ ID NO: 11438 - RNA, 20 nt, Artificial Sequence
  TRAC targeting sequence
uucuagcccacuucauccca

SEQ ID NO: 11439 - RNA, 20 nt, Artificial Sequence
  TRAC targeting sequence
aaugacuauuuuggagacac

SEQ ID NO: 11440 - RNA, 20 nt, Artificial Sequence
  TRAC targeting sequence
uuggaaggucauucuagccc

SEQ ID NO: 11441 - RNA, 20 nt, Artificial Sequence
  TRAC targeting sequence
aaaauagucauuggaagguc

SEQ ID NO: 11442 - RNA, 20 nt, Artificial Sequence
  TRAC targeting sequence
ccaaaauagucauuggaagg

SEQ ID NO: 11443 - RNA, 20 nt, Artificial Sequence
  TRAC targeting sequence
uuagugugucuccaaaauag

SEQ ID NO: 11444 - RNA, 20 nt, Artificial Sequence
  TRAC targeting sequence
uauauccuuaacuuguuaga

SEQ ID NO: 11445 - RNA, 20 nt, Artificial Sequence
  TRAC targeting sequence
uuaacuuguuagaacauugg

SEQ ID NO: 11446 - RNA, 20 nt, Artificial Sequence
  TRAC targeting sequence
aacaaguuaaggauauagga

SEQ ID NO: 11447 - RNA, 20 nt, Artificial Sequence
  TRAC targeting sequence
ccaauguucuaacaaguuaa

SEQ ID NO: 11448 - RNA, 20 nt, Artificial Sequence
  TRAC targeting sequence
ugacccucuaagaacauaaa

SEQ ID NO: 11449 - RNA, 20 nt, Artificial Sequence
  TRAC targeting sequence
agauuuugcuuuacuucacc

SEQ ID NO: 11450 - RNA, 20 nt, Artificial Sequence
  TRAC targeting sequence
aagaacauaaacaaaugcca

SEQ ID NO: 11451 - RNA, 20 nt, Artificial Sequence
  TRAC targeting sequence
uagagggucaagauuuugcu

SEQ ID NO: 11452 - RNA, 20 nt, Artificial Sequence
  TRAC targeting sequence
ucucccccaaagcacugcca

SEQ ID NO: 11453 - RNA, 20 nt, Artificial Sequence
  TRAC targeting sequence
cccccaaagcacugccaugu

SEQ ID NO: 11454 - RNA, 20 nt, Artificial Sequence
  TRAC targeting sequence
cccaaagcacugccauguuu

SEQ ID NO: 11455 - RNA, 20 nt, Artificial Sequence
  TRAC targeting sequence
uuaugugcaauuaugaaaca

SEQ ID NO: 11456 - RNA, 20 nt, Artificial Sequence
  TRAC targeting sequence
uaauugcacauaaugaaaca

SEQ ID NO: 11457 - RNA, 20 nt, Artificial Sequence
  TRAC targeting sequence
uguauuuguuucauaauugc

SEQ ID NO: 11458 - RNA, 20 nt, Artificial Sequence
  TRAC targeting sequence
uauaaauuaucauguauuug

SEQ ID NO: 11459 - RNA, 20 nt, Artificial Sequence
  TRAC targeting sequence
auguaauuucauauaaauua

SEQ ID NO: 11460 - RNA, 20 nt, Artificial Sequence
  TRAC targeting sequence
ucuauguaauuucauauaaa

SEQ ID NO: 11461 - RNA, 20 nt, Artificial Sequence
  TRAC targeting sequence
aacuacucaucuauguaauu

SEQ ID NO: 11462 - RNA, 20 nt, Artificial Sequence
  TRAC targeting sequence
aaauacucaaacuacucauc

SEQ ID NO: 11463 - RNA, 20 nt, Artificial Sequence
  TRAC targeting sequence
ugggucaaaauacucaaacu

SEQ ID NO: 11464 - RNA, 20 nt, Artificial Sequence
  TRAC targeting sequence
uacucaugggucaaaauacu

SEQ ID NO: 11465 - RNA, 20 nt, Artificial Sequence
  TRAC targeting sequence
acaauuugcaucuuacucau

SEQ ID NO: 11466 - RNA, 20 nt, Artificial Sequence
  TRAC targeting sequence
cagguaguucuucauaaaaa

SEQ ID NO: 11467 - RNA, 20 nt, Artificial Sequence
  TRAC targeting sequence
gguaguucuucauaaaaagu

SEQ ID NO: 11468 - RNA, 20 nt, Artificial Sequence
  TRAC targeting sequence
ucauaaaaaguugucccuga

SEQ ID NO: 11469 - RNA, 20 nt, Artificial Sequence
  TRAC targeting sequence
uaaaaaguugucccugaaga

SEQ ID NO: 11470 - RNA, 20 nt, Artificial Sequence
  TRAC targeting sequence
cugaagacaaauaguguacc

SEQ ID NO: 11471 - RNA, 20 nt, Artificial Sequence
  TRAC targeting sequence
gggacaacuuuuuaugaaga

SEQ ID NO: 11472 - RNA, 20 nt, Artificial Sequence
  TRAC targeting sequence
ucagggacaacuuuuuauga

SEQ ID NO: 11473 - RNA, 20 nt, Artificial Sequence
  TRAC targeting sequence
ccaaauggugcauaaaccaa

SEQ ID NO: 11474 - RNA, 20 nt, Artificial Sequence
  TRAC targeting sequence
aacagguccccaaauggugc

SEQ ID NO: 11475 - RNA, 20 nt, Artificial Sequence
  TRAC targeting sequence
gcuuucaaacagguccccaa

SEQ ID NO: 11476 - RNA, 20 nt, Artificial Sequence
  TRAC targeting sequence
cagugugccaauuugggguc

SEQ ID NO: 11477 - RNA, 20 nt, Artificial Sequence
  TRAC targeting sequence
caauuaacugugcucagugc

SEQ ID NO: 11478 - RNA, 20 nt, Artificial Sequence
  TRAC targeting sequence
auuaacugugcucagugcac

SEQ ID NO: 11479 - RNA, 20 nt, Artificial Sequence
  TRAC targeting sequence
gugcacugauaagugcccau

SEQ ID NO: 11480 - RNA, 20 nt, Artificial Sequence
  TRAC targeting sequence
gugcacugagcacaguuaau

SEQ ID NO: 11481 - RNA, 20 nt, Artificial Sequence
  TRAC targeting sequence
agaagcaugacaaaaugacc

SEQ ID NO: 11482 - RNA, 20 nt, Artificial Sequence
  TRAC targeting sequence
agacuguaaauaugggcacu

SEQ ID NO: 11483 - RNA, 20 nt, Artificial Sequence
  TRAC targeting sequence
ugcuucuagacuguaaauau

SEQ ID NO: 11484 - RNA, 20 nt, Artificial Sequence
  TRAC targeting sequence
uuuugucaugcuucuagacu

SEQ ID NO: 11485 - RNA, 20 nt, Artificial Sequence
  TRAC targeting sequence
guaggaaaaggagaauggaa

SEQ ID NO: 11486 - RNA, 20 nt, Artificial Sequence
  TRAC targeting sequence
uacagaaauggggucauuuu

SEQ ID NO: 11487 - RNA, 20 nt, Artificial Sequence
  TRAC targeting sequence
uuuuccuacagaaauggggu

SEQ ID NO: 11488 - RNA, 20 nt, Artificial Sequence
  TRAC targeting sequence
ccuuuuccuacagaaauggg

SEQ ID NO: 11489 - RNA, 20 nt, Artificial Sequence
  TRAC targeting sequence
auucuccuuuuccuacagaa

SEQ ID NO: 11490 - RNA, 20 nt, Artificial Sequence
  TRAC targeting sequence
gugcugcucccccuuguccc

SEQ ID NO: 11491 - RNA, 20 nt, Artificial Sequence
  TRAC targeting sequence
cccuugucccugccaugcug

SEQ ID NO: 11492 - RNA, 20 nt, Artificial Sequence
  TRAC targeting sequence
cugccaugcugggagguggc

SEQ ID NO: 11493 - RNA, 20 nt, Artificial Sequence
  TRAC targeting sequence
cagcauggcagggacaaggg

SEQ ID NO: 11494 - RNA, 20 nt, Artificial Sequence
  TRAC targeting sequence
ccaggagguuuuuguuagag

SEQ ID NO: 11495 - RNA, 20 nt, Artificial Sequence
  TRAC targeting sequence
uggggaaaacuugcagccac

SEQ ID NO: 11496 - RNA, 20 nt, Artificial Sequence
  TRAC targeting sequence
aacaaaaaccuccuggggaa

SEQ ID NO: 11497 - RNA, 20 nt, Artificial Sequence
  TRAC targeting sequence
caguaauacaugcucuaaca

SEQ ID NO: 11498 - RNA, 20 nt, Artificial Sequence
  TRAC targeting sequence
uuguuauugucacaguaaua

SEQ ID NO: 11499 - RNA, 20 nt, Artificial Sequence
  TRAC targeting sequence
aaagcgcaugucauuguuau

SEQ ID NO: 11500 - RNA, 20 nt, Artificial Sequence
  TRAC targeting sequence
cugcuccaaagcgcauguca

SEQ ID NO: 11501 - RNA, 20 nt, Artificial Sequence
  TRAC targeting sequence
ggucccugcuccaaagcgca

SEQ ID NO: 11502 - RNA, 20 nt, Artificial Sequence
  TRAC targeting sequence
gucuggucccugcuccaaag

SEQ ID NO: 11503 - RNA, 20 nt, Artificial Sequence
  TRAC targeting sequence
cccaacuuacuugguuuuac

SEQ ID NO: 11504 - RNA, 20 nt, Artificial Sequence
  TRAC targeting sequence
aucuuaaaagcugaccugag

SEQ ID NO: 11505 - RNA, 20 nt, Artificial Sequence
  TRAC targeting sequence
uaaaagcugaccugagugag

SEQ ID NO: 11506 - RNA, 20 nt, Artificial Sequence
  TRAC targeting sequence
gcuuuuaagauugacccauu

SEQ ID NO: 11507 - RNA, 20 nt, Artificial Sequence
  TRAC targeting sequence
ggucagcuuuuaagauugac

SEQ ID NO: 11508 - RNA, 20 nt, Artificial Sequence
  TRAC targeting sequence
cucaggucagcuuuuaagau

SEQ ID NO: 11509 - RNA, 20 nt, Artificial Sequence
  TRAC targeting sequence
gggcaguuucugugggguua

SEQ ID NO: 11510 - RNA, 20 nt, Artificial Sequence
  TRAC targeting sequence
gugggguuaagacacugcca

SEQ ID NO: 11511 - RNA, 20 nt, Artificial Sequence
  TRAC targeting sequence
uaaccccacagaaacugccc

SEQ ID NO: 11512 - RNA, 20 nt, Artificial Sequence
  TRAC targeting sequence
caagaggaucuaaguaccug

SEQ ID NO: 11513 - RNA, 20 nt, Artificial Sequence
  TRAC targeting sequence
ugggaguggcagugucuuaa

SEQ ID NO: 11514 - RNA, 20 nt, Artificial Sequence
  TRAC targeting sequence
ucuugggaguggcagugucu

SEQ ID NO: 11515 - RNA, 20 nt, Artificial Sequence
  TRAC targeting sequence
aaguaccugguuucuuugug

SEQ ID NO: 11516 - RNA, 20 nt, Artificial Sequence
  TRAC targeting sequence
uugugccugagacccugagc

SEQ ID NO: 11517 - RNA, 20 nt, Artificial Sequence
  TRAC targeting sequence
ggcacaaagaaaccagguac

SEQ ID NO: 11518 - RNA, 20 nt, Artificial Sequence
  TRAC targeting sequence
caggcacaaagaaaccaggu

SEQ ID NO: 11519 - RNA, 20 nt, Artificial Sequence
  TRAC targeting sequence
gggucucaggcacaaagaaa

SEQ ID NO: 11520 - RNA, 20 nt, Artificial Sequence
  TRAC targeting sequence
aaccagcucagggucucagg

SEQ ID NO: 11521 - RNA, 20 nt, Artificial Sequence
  TRAC targeting sequence
guuaguugaugaauucuggc

SEQ ID NO: 11522 - RNA, 20 nt, Artificial Sequence
  TRAC targeting sequence
acuaacagacuuccaaccag

SEQ ID NO: 11523 - RNA, 20 nt, Artificial Sequence
  TRAC targeting sequence
ucaacuaacagacuuccaac

SEQ ID NO: 11524 - RNA, 20 nt, Artificial Sequence
  TRAC targeting sequence
ggcaaucuuaaggauuaggu

SEQ ID NO: 11525 - RNA, 20 nt, Artificial Sequence
  TRAC targeting sequence
uaaggauuaggucaagaaga

SEQ ID NO: 11526 - RNA, 20 nt, Artificial Sequence
  TRAC targeting sequence
uuaagauugccagaauucau

SEQ ID NO: 11527 - RNA, 20 nt, Artificial Sequence
  TRAC targeting sequence
agaagaaguagaaaauuuca

SEQ ID NO: 11528 - RNA, 20 nt, Artificial Sequence
  TRAC targeting sequence
ugaccuaauccuuaagauug

SEQ ID NO: 11529 - RNA, 20 nt, Artificial Sequence
  TRAC targeting sequence
ucuugaccuaauccuuaaga

SEQ ID NO: 11530 - RNA, 20 nt, Artificial Sequence
  TRAC targeting sequence
acuucuucuugaccuaaucc

SEQ ID NO: 11531 - RNA, 20 nt, Artificial Sequence
  TRAC targeting sequence
cugguuucuucauuggcuug

SEQ ID NO: 11532 - RNA, 20 nt, Artificial Sequence
  TRAC targeting sequence
ucauuggcuuggcucuggau

SEQ ID NO: 11533 - RNA, 20 nt, Artificial Sequence
  TRAC targeting sequence
uuggcuuggcucuggauaua

SEQ ID NO: 11534 - RNA, 20 nt, Artificial Sequence
  TRAC targeting sequence
ggauauauaaaaaugcuaaa

SEQ ID NO: 11535 - RNA, 20 nt, Artificial Sequence
  TRAC targeting sequence
agagccaagccaaugaagaa

SEQ ID NO: 11536 - RNA, 20 nt, Artificial Sequence
  TRAC targeting sequence
cuccuguaaucccagcacuu

SEQ ID NO: 11537 - RNA, 20 nt, Artificial Sequence
  TRAC targeting sequence
uguaaucccagcacuuuggg

SEQ ID NO: 11538 - RNA, 20 nt, Artificial Sequence
  TRAC targeting sequence
cagcacuuugggaggccgag

SEQ ID NO: 11539 - RNA, 20 nt, Artificial Sequence
  TRAC targeting sequence
caaagugcugggauuacagg

SEQ ID NO: 11540 - RNA, 20 nt, Artificial Sequence
  TRAC targeting sequence
gccucccaaagugcugggau

SEQ ID NO: 11541 - RNA, 20 nt, Artificial Sequence
  TRAC targeting sequence
cgccucggccucccaaagug

SEQ ID NO: 11542 - RNA, 20 nt, Artificial Sequence
  TRAC targeting sequence
ucccgccucggccucccaaa

SEQ ID NO: 11543 - RNA, 20 nt, Artificial Sequence
  TRAC targeting sequence
ugaggucaagagaugcagac

SEQ ID NO: 11544 - RNA, 20 nt, Artificial Sequence
  TRAC targeting sequence
ugaucuucccgccucggccu

SEQ ID NO: 11545 - RNA, 20 nt, Artificial Sequence
  TRAC targeting sequence
agagaugcagaccauccugg

SEQ ID NO: 11546 - RNA, 20 nt, Artificial Sequence
  TRAC targeting sequence
ugaccucaugaucuucccgc

SEQ ID NO: 11547 - RNA, 20 nt, Artificial Sequence
  TRAC targeting sequence
cuugaccucaugaucuuccc

SEQ ID NO: 11548 - RNA, 20 nt, Artificial Sequence
  TRAC targeting sequence
gcaucucuugaccucaugau

SEQ ID NO: 11549 - RNA, 20 nt, Artificial Sequence
  TRAC targeting sequence
uggccaacauggugaaaccc

SEQ ID NO: 11550 - RNA, 20 nt, Artificial Sequence
  TRAC targeting sequence
ccauguuggccaggaugguc

SEQ ID NO: 11551 - RNA, 20 nt, Artificial Sequence
  TRAC targeting sequence
cuacuaaaaauacaaaaaau

SEQ ID NO: 11552 - RNA, 20 nt, Artificial Sequence
  TRAC targeting sequence
acuaaaaauacaaaaaauua

SEQ ID NO: 11553 - RNA, 20 nt, Artificial Sequence
  TRAC targeting sequence
cagcuacucaggaggcugag

SEQ ID NO: 11554 - RNA, 20 nt, Artificial Sequence
  TRAC targeting sequence
ggaggcugaggcaggagaau

SEQ ID NO: 11555 - RNA, 20 nt, Artificial Sequence
  TRAC targeting sequence
ugaguagcugggacuaccgg

SEQ ID NO: 11556 - RNA, 20 nt, Artificial Sequence
  TRAC targeting sequence
gccuccugaguagcugggac

SEQ ID NO: 11557 - RNA, 20 nt, Artificial Sequence
  TRAC targeting sequence
ugccucagccuccugaguag

SEQ ID NO: 11558 - RNA, 20 nt, Artificial Sequence
  TRAC targeting sequence
ccugccucagccuccugagu

SEQ ID NO: 11559 - RNA, 20 nt, Artificial Sequence
  TRAC targeting sequence
cuugaacccggaaggcggag

SEQ ID NO: 11560 - RNA, 20 nt, Artificial Sequence
  TRAC targeting sequence
agcgauucuccugccucagc

SEQ ID NO: 11561 - RNA, 20 nt, Artificial Sequence
  TRAC targeting sequence
ggguucaagcgauucuccug

SEQ ID NO: 11562 - RNA, 20 nt, Artificial Sequence
  TRAC targeting sequence
gccuuccggguucaagcgau

SEQ ID NO: 11563 - RNA, 20 nt, Artificial Sequence
  TRAC targeting sequence
gcccacggcaaccuccgccu

SEQ ID NO: 11564 - RNA, 20 nt, Artificial Sequence
  TRAC targeting sequence
cggcccacggcaaccuccgc

SEQ ID NO: 11565 - RNA, 20 nt, Artificial Sequence
  TRAC targeting sequence
ugccacugcacuccagccug

SEQ ID NO: 11566 - RNA, 20 nt, Artificial Sequence
  TRAC targeting sequence
agccuggcgacagagcgaga

SEQ ID NO: 11567 - RNA, 20 nt, Artificial Sequence
  TRAC targeting sequence
ccaggcuggagugcaguggc

SEQ ID NO: 11568 - RNA, 20 nt, Artificial Sequence
  TRAC targeting sequence
gucgccaggcuggagugcag

SEQ ID NO: 11569 - RNA, 20 nt, Artificial Sequence
  TRAC targeting sequence
cucugucgccaggcuggagu

SEQ ID NO: 11570 - RNA, 20 nt, Artificial Sequence
  TRAC targeting sequence
cgcucugucgccaggcugga

SEQ ID NO: 11571 - RNA, 20 nt, Artificial Sequence
  TRAC targeting sequence
caaaaaaagaaagaaaaaga

SEQ ID NO: 11572 - RNA, 20 nt, Artificial Sequence
  TRAC targeting sequence
aaaaaagaaagaaaaagaaa

SEQ ID NO: 11573 - RNA, 20 nt, Artificial Sequence
  TRAC targeting sequence
uuuuuugagauguagucucg

SEQ ID NO: 11574 - RNA, 20 nt, Artificial Sequence
  TRAC targeting sequence
uucuuuuuuugagauguagu

SEQ ID NO: 11575 - RNA, 20 nt, Artificial Sequence
  TRAC targeting sequence
uuuucuuucuuuuuuugaga

SEQ ID NO: 11576 - RNA, 20 nt, Artificial Sequence
  TRAC targeting sequence
gccauauuucuuuuucuuuc

SEQ ID NO: 11577 - RNA, 20 nt, Artificial Sequence
  TRAC targeting sequence
cagccauauuucuuuuucuu

SEQ ID NO: 11578 - RNA, 20 nt, Artificial Sequence
  TRAC targeting sequence
uggucccuaaaguagccccu

SEQ ID NO: 11579 - RNA, 20 nt, Artificial Sequence
  TRAC targeting sequence
cuaaaguagccccugggacc

SEQ ID NO: 11580 - RNA, 20 nt, Artificial Sequence
  TRAC targeting sequence
caggggcuacuuuagggacc

SEQ ID NO: 11581 - RNA, 20 nt, Artificial Sequence
  TRAC targeting sequence
auguugaccuccugugcugg

SEQ ID NO: 11582 - RNA, 20 nt, Artificial Sequence
  TRAC targeting sequence
acauugaggucccaggggcu

SEQ ID NO: 11583 - RNA, 20 nt, Artificial Sequence
  TRAC targeting sequence
ugugcugggugggauguuuc

SEQ ID NO: 11584 - RNA, 20 nt, Artificial Sequence
  TRAC targeting sequence
cacccagcacaggaggucaa

SEQ ID NO: 11585 - RNA, 20 nt, Artificial Sequence
  TRAC targeting sequence
gcccaaccuugcuauugugc

SEQ ID NO: 11586 - RNA, 20 nt, Artificial Sequence
  TRAC targeting sequence
ggcacaagcauucugucaga

SEQ ID NO: 11587 - RNA, 20 nt, Artificial Sequence
  TRAC targeting sequence
gucagaacccaguguccuag

SEQ ID NO: 11588 - RNA, 20 nt, Artificial Sequence
  TRAC targeting sequence
gaacccaguguccuaggaac

SEQ ID NO: 11589 - RNA, 20 nt, Artificial Sequence
  TRAC targeting sequence
gacagaaugcuugugccaga

SEQ ID NO: 11590 - RNA, 20 nt, Artificial Sequence
  TRAC targeting sequence
uaggaacaaaacaggggauu

SEQ ID NO: 11591 - RNA, 20 nt, Artificial Sequence
  TRAC targeting sequence
uaggacacuggguucugaca

SEQ ID NO: 11592 - RNA, 20 nt, Artificial Sequence
  TRAC targeting sequence
ccuguuuuguuccuaggaca

SEQ ID NO: 11593 - RNA, 20 nt, Artificial Sequence
  TRAC targeting sequence
uaaauccccuguuuuguucc

SEQ ID NO: 11594 - RNA, 20 nt, Artificial Sequence
  TRAC targeting sequence
aguucagaucuaucugcaca

SEQ ID NO: 11595 - RNA, 20 nt, Artificial Sequence
  TRAC targeting sequence
gaucuaucugcacagccagc

SEQ ID NO: 11596 - RNA, 20 nt, Artificial Sequence
  TRAC targeting sequence
gaacuugaucguaaaucccc

SEQ ID NO: 11597 - RNA, 20 nt, Artificial Sequence
  TRAC targeting sequence
aucugcacagccagcuguua

SEQ ID NO: 11598 - RNA, 20 nt, Artificial Sequence
  TRAC targeting sequence
gcacagccagcuguuaauuu

SEQ ID NO: 11599 - RNA, 20 nt, Artificial Sequence
  TRAC targeting sequence
aaaauuaacagcuggcugug

SEQ ID NO: 11600 - RNA, 20 nt, Artificial Sequence
  TRAC targeting sequence
cuaaaauuaacagcuggcug

SEQ ID NO: 11601 - RNA, 20 nt, Artificial Sequence
  TRAC targeting sequence
ugaccuugcaaaggaacugg

SEQ ID NO: 11602 - RNA, 20 nt, Artificial Sequence
  TRAC targeting sequence
ggacaguucucuaaaauuaa

SEQ ID NO: 11603 - RNA, 20 nt, Artificial Sequence
  TRAC targeting sequence
uuugcaaggucaggacaguu

SEQ ID NO: 11604 - RNA, 20 nt, Artificial Sequence
  TRAC targeting sequence
aguuccuuugcaaggucagg

SEQ ID NO: 11605 - RNA, 20 nt, Artificial Sequence
  TRAC targeting sequence
guuuccaguuccuuugcaag

SEQ ID NO: 11606 - RNA, 20 nt, Artificial Sequence
  TRAC targeting sequence
ccaccuugcagccucuguuu

SEQ ID NO: 11607 - RNA, 20 nt, Artificial Sequence
  TRAC targeting sequence
ccccaccuugcagccucugu

SEQ ID NO: 11608 - RNA, 20 nt, Artificial Sequence
  TRAC targeting sequence
acuagaggggaaggugaucu

SEQ ID NO: 11609 - RNA, 20 nt, Artificial Sequence
  TRAC targeting sequence
aguggaagucuccccaccuu

SEQ ID NO: 11610 - RNA, 20 nt, Artificial Sequence
  TRAC targeting sequence
ccucuaguggaagucucccc

SEQ ID NO: 11611 - RNA, 20 nt, Artificial Sequence
  TRAC targeting sequence
ccuuccccucuaguggaagu

SEQ ID NO: 11612 - RNA, 20 nt, Artificial Sequence
  TRAC targeting sequence
cacuugcucagccuuccccu

SEQ ID NO: 11613 - RNA, 20 nt, Artificial Sequence
  TRAC targeting sequence
cuugcucagccuuccccucc

SEQ ID NO: 11614 - RNA, 20 nt, Artificial Sequence
  TRAC targeting sequence
gccuuccccuccauccuucc

SEQ ID NO: 11615 - RNA, 20 nt, Artificial Sequence
  TRAC targeting sequence
ccuccauccuucccaccugu

SEQ ID NO: 11616 - RNA, 20 nt, Artificial Sequence
  TRAC targeting sequence
auccuucccaccuguugauu

SEQ ID NO: 11617 - RNA, 20 nt, Artificial Sequence
  TRAC targeting sequence
uucccaccuguugauuauug

SEQ ID NO: 11618 - RNA, 20 nt, Artificial Sequence
  TRAC targeting sequence
caccuguugauuauuguaaa

SEQ ID NO: 11619 - RNA, 20 nt, Artificial Sequence
  TRAC targeting sequence
acaggugggaaggauggagg

SEQ ID NO: 11620 - RNA, 20 nt, Artificial Sequence
  TRAC targeting sequence
uauggggcuuuacaauaauc

SEQ ID NO: 11621 - RNA, 20 nt, Artificial Sequence
  TRAC targeting sequence
cacaguccuauggggcuuua

SEQ ID NO: 11622 - RNA, 20 nt, Artificial Sequence
  TRAC targeting sequence
auaauucacacaguccuaug

SEQ ID NO: 11623 - RNA, 20 nt, Artificial Sequence
  TRAC targeting sequence
uccauaauucacacaguccu

SEQ ID NO: 11624 - RNA, 20 nt, Artificial Sequence
  TRAC targeting sequence
uuggcuuccuccauaauuca

SEQ ID NO: 11625 - RNA, 20 nt, Artificial Sequence
  TRAC targeting sequence
caucuuuggaaaaggcacua

SEQ ID NO: 11626 - RNA, 20 nt, Artificial Sequence
  TRAC targeting sequence
ucuuuggaaaaggcacuaaa

SEQ ID NO: 11627 - RNA, 20 nt, Artificial Sequence
  TRAC targeting sequence
uuggaaaaggcacuaaacuc

SEQ ID NO: 11628 - RNA, 20 nt, Artificial Sequence
  TRAC targeting sequence
aaagaugagauuuccuuggc

SEQ ID NO: 11629 - RNA, 20 nt, Artificial Sequence
  TRAC targeting sequence
cuguuaaaccaaguaagugu

SEQ ID NO: 11630 - RNA, 20 nt, Artificial Sequence
  TRAC targeting sequence
guuaaaccaaguaaguguug

SEQ ID NO: 11631 - RNA, 20 nt, Artificial Sequence
  TRAC targeting sequence
ccaacacuuacuugguuuaa

SEQ ID NO: 11632 - RNA, 20 nt, Artificial Sequence
  TRAC targeting sequence
aaguccugauuuaucaucag

SEQ ID NO: 11633 - RNA, 20 nt, Artificial Sequence
  TRAC targeting sequence
ugauuuaucaucaguacuuu

SEQ ID NO: 11634 - RNA, 20 nt, Artificial Sequence
  TRAC targeting sequence
ggacuuugaauccccaacac

SEQ ID NO: 11635 - RNA, 20 nt, Artificial Sequence
  TRAC targeting sequence
ucaguacuuugucacucugg

SEQ ID NO: 11636 - RNA, 20 nt, Artificial Sequence
  TRAC targeting sequence
guacuuugucacucugggca

SEQ ID NO: 11637 - RNA, 20 nt, Artificial Sequence
  TRAC targeting sequence
cucugggcaacagaaugaaa

SEQ ID NO: 11638 - RNA, 20 nt, Artificial Sequence
  TRAC targeting sequence
gggcaacagaaugaaagggc

SEQ ID NO: 11639 - RNA, 20 nt, Artificial Sequence
  TRAC targeting sequence
guugcccagagugacaaagu

SEQ ID NO: 11640 - RNA, 20 nt, Artificial Sequence
  TRAC targeting sequence
uucuguugcccagagugaca

SEQ ID NO: 11641 - RNA, 20 nt, Artificial Sequence
  TRAC targeting sequence
caaauagagaacagagaguc

SEQ ID NO: 11642 - RNA, 20 nt, Artificial Sequence
  TRAC targeting sequence
aauagagaacagagaguccu

SEQ ID NO: 11643 - RNA, 20 nt, Artificial Sequence
  TRAC targeting sequence
auuugagagcccuuucauuc

SEQ ID NO: 11644 - RNA, 20 nt, Artificial Sequence
  TRAC targeting sequence
cuauuugagagcccuuucau

SEQ ID NO: 11645 - RNA, 20 nt, Artificial Sequence
  TRAC targeting sequence
guucucuauuugagagcccu

SEQ ID NO: 11646 - RNA, 20 nt, Artificial Sequence
  TRAC targeting sequence
cuguucucuauuugagagcc

SEQ ID NO: 11647 - RNA, 20 nt, Artificial Sequence
  TRAC targeting sequence
ugaauacucagauaacuuuu

SEQ ID NO: 11648 - RNA, 20 nt, Artificial Sequence
  TRAC targeting sequence
ggacucucuguucucuauuu

SEQ ID NO: 11649 - RNA, 20 nt, Artificial Sequence
  TRAC targeting sequence
gauaacuuuuccagagugau

SEQ ID NO: 11650 - RNA, 20 nt, Artificial Sequence
  TRAC targeting sequence
gaguauucaggacucucugu

SEQ ID NO: 11651 - RNA, 20 nt, Artificial Sequence
  TRAC targeting sequence
agagugauauguguuaugug

SEQ ID NO: 11652 - RNA, 20 nt, Artificial Sequence
  TRAC targeting sequence
ggaaaaguuaucugaguauu

SEQ ID NO: 11653 - RNA, 20 nt, Artificial Sequence
  TRAC targeting sequence
cucuggaaaaguuaucugag

SEQ ID NO: 11654 - RNA, 20 nt, Artificial Sequence
  TRAC targeting sequence
cauuacacauaacacauauc

SEQ ID NO: 11655 - RNA, 20 nt, Artificial Sequence
  TRAC targeting sequence
ucccauuacacauaacacau

SEQ ID NO: 11656 - RNA, 20 nt, Artificial Sequence
  TRAC targeting sequence
agcccacuucaucccauuac

SEQ ID NO: 11657 - RNA, 20 nt, Artificial Sequence
  TRAC targeting sequence
uucuagcccacuucauccca

SEQ ID NO: 11658 - RNA, 20 nt, Artificial Sequence
  TRAC targeting sequence
aaugacuguuuuggagacac

SEQ ID NO: 11659 - RNA, 20 nt, Artificial Sequence
  TRAC targeting sequence
uuggaaggucauucuagccc

SEQ ID NO: 11660 - RNA, 20 nt, Artificial Sequence
  TRAC targeting sequence
aaaacagucauuggaagguc

SEQ ID NO: 11661 - RNA, 20 nt, Artificial Sequence
  TRAC targeting sequence
ccaaaacagucauuggaagg

SEQ ID NO: 11662 - RNA, 20 nt, Artificial Sequence
  TRAC targeting sequence
uuagugugucuccaaaacag

SEQ ID NO: 11663 - RNA, 20 nt, Artificial Sequence
  TRAC targeting sequence
uauacccuuaacuuguuaga

SEQ ID NO: 11664 - RNA, 20 nt, Artificial Sequence
  TRAC targeting sequence
aacaaguuaaggguauagga

SEQ ID NO: 11665 - RNA, 20 nt, Artificial Sequence
  TRAC targeting sequence
ccaauguucuaacaaguuaa

SEQ ID NO: 11666 - RNA, 20 nt, Artificial Sequence
  TRAC targeting sequence
cuucaccaauguucuaacaa

SEQ ID NO: 11667 - RNA, 20 nt, Artificial Sequence
  TRAC targeting sequence
gcauugcacuuuaguugcac

SEQ ID NO: 11668 - RNA, 20 nt, Artificial Sequence
  TRAC targeting sequence
cucugcauugcacuuuaguu

SEQ ID NO: 11669 - RNA, 20 nt, Artificial Sequence
  TRAC targeting sequence
cucacucugcauugcacuuu

SEQ ID NO: 11670 - RNA, 20 nt, Artificial Sequence
  TRAC targeting sequence
cacucacucugcauugcacu

SEQ ID NO: 11671 - RNA, 20 nt, Artificial Sequence
  TRAC targeting sequence
ucucacucacucugcauugc

SEQ ID NO: 11672 - RNA, 20 nt, Artificial Sequence
  TRAC targeting sequence
cuucucacucacucugcauu

SEQ ID NO: 11673 - RNA, 20 nt, Artificial Sequence
  TRAC targeting sequence
uuucucugugauaucuuccc

SEQ ID NO: 11674 - RNA, 20 nt, Artificial Sequence
  TRAC targeting sequence
cugugauaucuuccccccac

SEQ ID NO: 11675 - RNA, 20 nt, Artificial Sequence
  TRAC targeting sequence
gugauaucuuccccccaccu

SEQ ID NO: 11676 - RNA, 20 nt, Artificial Sequence
  TRAC targeting sequence
cagagaaaggaguugguaag

SEQ ID NO: 11677 - RNA, 20 nt, Artificial Sequence
  TRAC targeting sequence
uccccccaccuucacccuug

SEQ ID NO: 11678 - RNA, 20 nt, Artificial Sequence
  TRAC targeting sequence
ccccaccuucacccuugaac

SEQ ID NO: 11679 - RNA, 20 nt, Artificial Sequence
  TRAC targeting sequence
cccuugaaccccacagaauu

SEQ ID NO: 11680 - RNA, 20 nt, Artificial Sequence
  TRAC targeting sequence
agggugaagguggggggaag

SEQ ID NO: 11681 - RNA, 20 nt, Artificial Sequence
  TRAC targeting sequence
gugggguucaagggugaagg

SEQ ID NO: 11682 - RNA, 20 nt, Artificial Sequence
  TRAC targeting sequence
guccaugccccuggcuguuc

SEQ ID NO: 11683 - RNA, 20 nt, Artificial Sequence
  TRAC targeting sequence
augccccuggcuguucccag

SEQ ID NO: 11684 - RNA, 20 nt, Artificial Sequence
  TRAC targeting sequence
caguccagaccagcacgucg

SEQ ID NO: 11685 - RNA, 20 nt, Artificial Sequence
  TRAC targeting sequence
agaccagcacgucguucugc

SEQ ID NO: 11686 - RNA, 20 nt, Artificial Sequence
  TRAC targeting sequence
ggacugggaacagccagggg

SEQ ID NO: 11687 - RNA, 20 nt, Artificial Sequence
  TRAC targeting sequence
uucugcuggacauaggaaaa

SEQ ID NO: 11688 - RNA, 20 nt, Artificial Sequence
  TRAC targeting sequence
gcuggacauaggaaaacucc

SEQ ID NO: 11689 - RNA, 20 nt, Artificial Sequence
  TRAC targeting sequence
agcagaacgacgugcugguc

SEQ ID NO: 11690 - RNA, 20 nt, Artificial Sequence
  TRAC targeting sequence
uauguccagcagaacgacgu

SEQ ID NO: 11691 - RNA, 20 nt, Artificial Sequence
  TRAC targeting sequence
agacuucauaacaugucaca

SEQ ID NO: 11692 - RNA, 20 nt, Artificial Sequence
  TRAC targeting sequence
ggaguuuuccuauguccagc

SEQ ID NO: 11693 - RNA, 20 nt, Artificial Sequence
  TRAC targeting sequence
uaacaugucacagggccccc

SEQ ID NO: 11694 - RNA, 20 nt, Artificial Sequence
  TRAC targeting sequence
cagggcccccucccucagau

SEQ ID NO: 11695 - RNA, 20 nt, Artificial Sequence
  TRAC targeting sequence
cucagauggcagaucucaau

SEQ ID NO: 11696 - RNA, 20 nt, Artificial Sequence
  TRAC targeting sequence
gauggcagaucucaauauug

SEQ ID NO: 11697 - RNA, 20 nt, Artificial Sequence
  TRAC targeting sequence
gagggagggggcccugugac

SEQ ID NO: 11698 - RNA, 20 nt, Artificial Sequence
  TRAC targeting sequence
gccaucugagggagggggcc

SEQ ID NO: 11699 - RNA, 20 nt, Artificial Sequence
  TRAC targeting sequence
caauauugaucacccacauc

SEQ ID NO: 11700 - RNA, 20 nt, Artificial Sequence
  TRAC targeting sequence
auauugaucacccacaucac

SEQ ID NO: 11701 - RNA, 20 nt, Artificial Sequence
  TRAC targeting sequence
auauugagaucugccaucug

SEQ ID NO: 11702 - RNA, 20 nt, Artificial Sequence
  TRAC targeting sequence
cccacaucacuguggggagu

SEQ ID NO: 11703 - RNA, 20 nt, Artificial Sequence
  TRAC targeting sequence
cuguggggaguggugaccuu

SEQ ID NO: 11704 - RNA, 20 nt, Artificial Sequence
  TRAC targeting sequence
ccacagugaugugggugauc

SEQ ID NO: 11705 - RNA, 20 nt, Artificial Sequence
  TRAC targeting sequence
ccacuccccacagugaugug

SEQ ID NO: 11706 - RNA, 20 nt, Artificial Sequence
  TRAC targeting sequence
gcaauggucucauggaagag

SEQ ID NO: 11707 - RNA, 20 nt, Artificial Sequence
  TRAC targeting sequence
cauggaagagggaagcuuua

SEQ ID NO: 11708 - RNA, 20 nt, Artificial Sequence
  TRAC targeting sequence
uggaagagggaagcuuuauu

SEQ ID NO: 11709 - RNA, 20 nt, Artificial Sequence
  TRAC targeting sequence
augagaccauugcugacaag

SEQ ID NO: 11710 - RNA, 20 nt, Artificial Sequence
  TRAC targeting sequence
uccaugagaccauugcugac

SEQ ID NO: 11711 - RNA, 20 nt, Artificial Sequence
  TRAC targeting sequence
cucuuccaugagaccauugc

SEQ ID NO: 11712 - RNA, 20 nt, Artificial Sequence
  TRAC targeting sequence
agggcccauggaugacccac

SEQ ID NO: 11713 - RNA, 20 nt, Artificial Sequence
  TRAC targeting sequence
augggcccuugaugguguaa

SEQ ID NO: 11714 - RNA, 20 nt, Artificial Sequence
  TRAC targeting sequence
uccaugggcccuugauggug

SEQ ID NO: 11715 - RNA, 20 nt, Artificial Sequence
  TRAC targeting sequence
gugugacugcugugugauug

SEQ ID NO: 11716 - RNA, 20 nt, Artificial Sequence
  TRAC targeting sequence
cacagacugugggucaucca

SEQ ID NO: 11717 - RNA, 20 nt, Artificial Sequence
  TRAC targeting sequence
cacagcagucacacagacug

SEQ ID NO: 11718 - RNA, 20 nt, Artificial Sequence
  TRAC targeting sequence
gacauuagcuuuaauaggaa

SEQ ID NO: 11719 - RNA, 20 nt, Artificial Sequence
  TRAC targeting sequence
gaaaaccaaucacacagcag

SEQ ID NO: 11720 - RNA, 20 nt, Artificial Sequence
  TRAC targeting sequence
uauuaaagcuaaugucugaa

SEQ ID NO: 11721 - RNA, 20 nt, Artificial Sequence
  TRAC targeting sequence
uaggagaagggacauggugg

SEQ ID NO: 11722 - RNA, 20 nt, Artificial Sequence
  TRAC targeting sequence
uaugauuccuauuaaagcua

SEQ ID NO: 11723 - RNA, 20 nt, Artificial Sequence
  TRAC targeting sequence
ccuaugauuccuauuaaagc

SEQ ID NO: 11724 - RNA, 20 nt, Artificial Sequence
  TRAC targeting sequence
cuucuccuaugauuccuauu

SEQ ID NO: 11725 - RNA, 20 nt, Artificial Sequence
  TRAC targeting sequence
cuaaacaaaaaaccccuugc

SEQ ID NO: 11726 - RNA, 20 nt, Artificial Sequence
  TRAC targeting sequence
cccuaaacaaaaaaccccuu

SEQ ID NO: 11727 - RNA, 20 nt, Artificial Sequence
  TRAC targeting sequence
acagugcguucucccuaaac

SEQ ID NO: 11728 - RNA, 20 nt, Artificial Sequence
  TRAC targeting sequence
aauuccggguaugcacucaa

SEQ ID NO: 11729 - RNA, 20 nt, Artificial Sequence
  TRAC targeting sequence
ggguaugcacucaacuucgg

SEQ ID NO: 11730 - RNA, 20 nt, Artificial Sequence
  TRAC targeting sequence
acuucggcaaaggcaccucg

SEQ ID NO: 11731 - RNA, 20 nt, Artificial Sequence
  TRAC targeting sequence
gcaaaggcaccucgcuguug

SEQ ID NO: 11732 - RNA, 20 nt, Artificial Sequence
  TRAC targeting sequence
cuguuggucacaccccguga

SEQ ID NO: 11733 - RNA, 20 nt, Artificial Sequence
  TRAC targeting sequence
caccccgugaguuuuugugg

SEQ ID NO: 11734 - RNA, 20 nt, Artificial Sequence
  TRAC targeting sequence
cggggugugaccaacagcga

SEQ ID NO: 11735 - RNA, 20 nt, Artificial Sequence
  TRAC targeting sequence
ucucuggaaagaaauccaau

SEQ ID NO: 11736 - RNA, 20 nt, Artificial Sequence
  TRAC targeting sequence
cuggaaagaaauccaauggg

SEQ ID NO: 11737 - RNA, 20 nt, Artificial Sequence
  TRAC targeting sequence
ggaaagaaauccaaugggac

SEQ ID NO: 11738 - RNA, 20 nt, Artificial Sequence
  TRAC targeting sequence
agagaggacaauuaguaaac

SEQ ID NO: 11739 - RNA, 20 nt, Artificial Sequence
  TRAC targeting sequence
uuccagagaggacaauuagu

SEQ ID NO: 11740 - RNA, 20 nt, Artificial Sequence
  TRAC targeting sequence
aaugggaccuguugaaacac

SEQ ID NO: 11741 - RNA, 20 nt, Artificial Sequence
  TRAC targeting sequence
cauuggauuucuuuccagag

SEQ ID NO: 11742 - RNA, 20 nt, Artificial Sequence
  TRAC targeting sequence
acaggucccauuggauuucu

SEQ ID NO: 11743 - RNA, 20 nt, Artificial Sequence
  TRAC targeting sequence
gcuguguuucaacagguccc

SEQ ID NO: 11744 - RNA, 20 nt, Artificial Sequence
  TRAC targeting sequence
gaugugugagcaagauauga

SEQ ID NO: 11745 - RNA, 20 nt, Artificial Sequence
  TRAC targeting sequence
gacauaguuaacaacugcau

SEQ ID NO: 11746 - RNA, 20 nt, Artificial Sequence
  TRAC targeting sequence
cacaucagacauaguuaaca

SEQ ID NO: 11747 - RNA, 20 nt, Artificial Sequence
  TRAC targeting sequence
ugcucacacaucagacauag

SEQ ID NO: 11748 - RNA, 20 nt, Artificial Sequence
  TRAC targeting sequence
uaucuugcucacacaucaga

SEQ ID NO: 11749 - RNA, 20 nt, Artificial Sequence
  TRAC targeting sequence
cuggaggcuggauuugguua

SEQ ID NO: 11750 - RNA, 20 nt, Artificial Sequence
  TRAC targeting sequence
agggaaacauguauucauau

SEQ ID NO: 11751 - RNA, 20 nt, Artificial Sequence
  TRAC targeting sequence
agccuccagggaaacaugua

SEQ ID NO: 11752 - RNA, 20 nt, Artificial Sequence
  TRAC targeting sequence
ggucucggggcaguuugaua

SEQ ID NO: 11753 - RNA, 20 nt, Artificial Sequence
  TRAC targeting sequence
cggggcaguuugauaaauug

SEQ ID NO: 11754 - RNA, 20 nt, Artificial Sequence
  TRAC targeting sequence
gggcaguuugauaaauugua

SEQ ID NO: 11755 - RNA, 20 nt, Artificial Sequence
  TRAC targeting sequence
aacugccccgagaccugaua

SEQ ID NO: 11756 - RNA, 20 nt, Artificial Sequence
  TRAC targeting sequence
cuguuuuucaaagguccaca

SEQ ID NO: 11757 - RNA, 20 nt, Artificial Sequence
  TRAC targeting sequence
aagguccacaaagcacguug

SEQ ID NO: 11758 - RNA, 20 nt, Artificial Sequence
  TRAC targeting sequence
acaaagcacguuguggcuuu

SEQ ID NO: 11759 - RNA, 20 nt, Artificial Sequence
  TRAC targeting sequence
caaagccacaacgugcuuug

SEQ ID NO: 11760 - RNA, 20 nt, Artificial Sequence
  TRAC targeting sequence
gccuuucccaaagccacaac

SEQ ID NO: 11761 - RNA, 20 nt, Artificial Sequence
  TRAC targeting sequence
cugccuuucccaaagccaca

SEQ ID NO: 11762 - RNA, 20 nt, Artificial Sequence
  TRAC targeting sequence
uaucucugccuuucccaaag

SEQ ID NO: 11763 - RNA, 20 nt, Artificial Sequence
  TRAC targeting sequence
caaagcuuugcuucuuaucu

SEQ ID NO: 11764 - RNA, 20 nt, Artificial Sequence
  TRAC targeting sequence
aucacaaagcuuugcuucuu

SEQ ID NO: 11765 - RNA, 20 nt, Artificial Sequence
  TRAC targeting sequence
cuaucacaaagcuuugcuuc

SEQ ID NO: 11766 - RNA, 20 nt, Artificial Sequence
  TRAC targeting sequence
gucucuaucacaaagcuuug

SEQ ID NO: 11767 - RNA, 20 nt, Artificial Sequence
  TRAC targeting sequence
uggccuuguuucugucucua

SEQ ID NO: 11768 - RNA, 20 nt, Artificial Sequence
  TRAC targeting sequence
cuuuucauggccuuguuucu

SEQ ID NO: 11769 - RNA, 20 nt, Artificial Sequence
  TRAC targeting sequence
uuggcuaugccauugcuuug

SEQ ID NO: 11770 - RNA, 20 nt, Artificial Sequence
  TRAC targeting sequence
ucaacagauaaguggcaagg

SEQ ID NO: 11771 - RNA, 20 nt, Artificial Sequence
  TRAC targeting sequence
acagauaaguggcaaggacc

SEQ ID NO: 11772 - RNA, 20 nt, Artificial Sequence
  TRAC targeting sequence
guugaggacacacuuccuug

SEQ ID NO: 11773 - RNA, 20 nt, Artificial Sequence
  TRAC targeting sequence
uugccacuuaucuguugagg

SEQ ID NO: 11774 - RNA, 20 nt, Artificial Sequence
  TRAC targeting sequence
acaggguccuugccacuuau

SEQ ID NO: 11775 - RNA, 20 nt, Artificial Sequence
  TRAC targeting sequence
acucaacaggguccuugcca

SEQ ID NO: 11776 - RNA, 20 nt, Artificial Sequence
  TRAC targeting sequence
gguagaauuaaaaaauaaga

SEQ ID NO: 11777 - RNA, 20 nt, Artificial Sequence
  TRAC targeting sequence
accagacaacacaagcauca

SEQ ID NO: 11778 - RNA, 20 nt, Artificial Sequence
  TRAC targeting sequence
uauuuuuuaauucuaccaga

SEQ ID NO: 11779 - RNA, 20 nt, Artificial Sequence
  TRAC targeting sequence
ucuuauuuuuuaauucuacc

SEQ ID NO: 11780 - RNA, 20 nt, Artificial Sequence
  TRAC targeting sequence
ugccuguaauucuaucacuu

SEQ ID NO: 11781 - RNA, 20 nt, Artificial Sequence
  TRAC targeting sequence
aucacuuugggaggcugagg

SEQ ID NO: 11782 - RNA, 20 nt, Artificial Sequence
  TRAC targeting sequence
cuuugggaggcugaggcagg

SEQ ID NO: 11783 - RNA, 20 nt, Artificial Sequence
  TRAC targeting sequence
caaagugauagaauuacagg

SEQ ID NO: 11784 - RNA, 20 nt, Artificial Sequence
  TRAC targeting sequence
gccucccaaagugauagaau

SEQ ID NO: 11785 - RNA, 20 nt, Artificial Sequence
  TRAC targeting sequence
accugccucagccucccaaa

SEQ ID NO: 11786 - RNA, 20 nt, Artificial Sequence
  TRAC targeting sequence
agcuauccaccugccucagc

SEQ ID NO: 11787 - RNA, 20 nt, Artificial Sequence
  TRAC targeting sequence
agaguucaagaccagccuga

SEQ ID NO: 11788 - RNA, 20 nt, Artificial Sequence
  TRAC targeting sequence
ugaccucaagcuauccaccu

SEQ ID NO: 11789 - RNA, 20 nt, Artificial Sequence
  TRAC targeting sequence
agaccagccugaucaacaua

SEQ ID NO: 11790 - RNA, 20 nt, Artificial Sequence
  TRAC targeting sequence
ugaacucuugaccucaagcu

SEQ ID NO: 11791 - RNA, 20 nt, Artificial Sequence
  TRAC targeting sequence
ggcuggucuugaacucuuga

SEQ ID NO: 11792 - RNA, 20 nt, Artificial Sequence
  TRAC targeting sequence
acauaaugaaaccccaucuc

SEQ ID NO: 11793 - RNA, 20 nt, Artificial Sequence
  TRAC targeting sequence
uuauguugaucaggcugguc

SEQ ID NO: 11794 - RNA, 20 nt, Artificial Sequence
  TRAC targeting sequence
cuacuaaaaauacaaaaauu

SEQ ID NO: 11795 - RNA, 20 nt, Artificial Sequence
  TRAC targeting sequence
acuaaaaauacaaaaauuag

SEQ ID NO: 11796 - RNA, 20 nt, Artificial Sequence
  TRAC targeting sequence
agcuacuugggaagcuaagg

SEQ ID NO: 11797 - RNA, 20 nt, Artificial Sequence
  TRAC targeting sequence
caaguagcuggaauuacagg

SEQ ID NO: 11798 - RNA, 20 nt, Artificial Sequence
  TRAC targeting sequence
ugccuuagcuucccaaguag

SEQ ID NO: 11799 - RNA, 20 nt, Artificial Sequence
  TRAC targeting sequence
cuugccuuagcuucccaagu

SEQ ID NO: 11800 - RNA, 20 nt, Artificial Sequence
  TRAC targeting sequence
cuugaacccgggaggcagag

SEQ ID NO: 11801 - RNA, 20 nt, Artificial Sequence
  TRAC targeting sequence
ugaacccgggaggcagagau

SEQ ID NO: 11802 - RNA, 20 nt, Artificial Sequence
  TRAC targeting sequence
agagauucucuugccuuagc

SEQ ID NO: 11803 - RNA, 20 nt, Artificial Sequence
  TRAC targeting sequence
cggguucaagagauucucuu

SEQ ID NO: 11804 - RNA, 20 nt, Artificial Sequence
  TRAC targeting sequence
gccucccggguucaagagau

SEQ ID NO: 11805 - RNA, 20 nt, Artificial Sequence
  TRAC targeting sequence
cugccucccggguucaagag

SEQ ID NO: 11806 - RNA, 20 nt, Artificial Sequence
  TRAC targeting sequence
cugcaaucucugccucccgg

SEQ ID NO: 11807 - RNA, 20 nt, Artificial Sequence
  TRAC targeting sequence
aggcucacugcaaucucugc

SEQ ID NO: 11808 - RNA, 20 nt, Artificial Sequence
  TRAC targeting sequence
uggcacugcauuccagccug

SEQ ID NO: 11809 - RNA, 20 nt, Artificial Sequence
  TRAC targeting sequence
agccugggugauagagcgag

SEQ ID NO: 11810 - RNA, 20 nt, Artificial Sequence
  TRAC targeting sequence
cccaggcuggaaugcagugc

SEQ ID NO: 11811 - RNA, 20 nt, Artificial Sequence
  TRAC targeting sequence
aucacccaggcuggaaugca

SEQ ID NO: 11812 - RNA, 20 nt, Artificial Sequence
  TRAC targeting sequence
cucuaucacccaggcuggaa

SEQ ID NO: 11813 - RNA, 20 nt, Artificial Sequence
  TRAC targeting sequence
cgcucuaucacccaggcugg

SEQ ID NO: 11814 - RNA, 20 nt, Artificial Sequence
  TRAC targeting sequence
gucucaaaaacaaaaagaaa

SEQ ID NO: 11815 - RNA, 20 nt, Artificial Sequence
  TRAC targeting sequence
caaaaacaaaaagaaagaaa

SEQ ID NO: 11816 - RNA, 20 nt, Artificial Sequence
  TRAC targeting sequence
aaaacaaaaagaaagaaaaa

SEQ ID NO: 11817 - RNA, 20 nt, Artificial Sequence
  TRAC targeting sequence
uuuuguuuuugagacggagu

SEQ ID NO: 11818 - RNA, 20 nt, Artificial Sequence
  TRAC targeting sequence
uucuuuuuguuuuugagacg

SEQ ID NO: 11819 - RNA, 20 nt, Artificial Sequence
  TRAC targeting sequence
guuuuucuuucuuuuuguuu

SEQ ID NO: 11820 - RNA, 20 nt, Artificial Sequence
  TRAC targeting sequence
ccuuauuuuucuguuuuucu

SEQ ID NO: 11821 - RNA, 20 nt, Artificial Sequence
  TRAC targeting sequence
acucgccuuauuuuucuguu

SEQ ID NO: 11822 - RNA, 20 nt, Artificial Sequence
  TRAC targeting sequence
guccacucgccuuauuuuuc

SEQ ID NO: 11823 - RNA, 20 nt, Artificial Sequence
  TRAC targeting sequence
ucaguccacucgccuuauuu

SEQ ID NO: 11824 - RNA, 20 nt, Artificial Sequence
  TRAC targeting sequence
agugaagggagggcagcagg

SEQ ID NO: 11825 - RNA, 20 nt, Artificial Sequence
  TRAC targeting sequence
cuggaguccucaguccacuc

SEQ ID NO: 11826 - RNA, 20 nt, Artificial Sequence
  TRAC targeting sequence
cuucacuggaguccucaguc

SEQ ID NO: 11827 - RNA, 20 nt, Artificial Sequence
  TRAC targeting sequence
ugcugcccucccuucacugg

SEQ ID NO: 11828 - RNA, 20 nt, Artificial Sequence
  TRAC targeting sequence
aagcuuggcauggcuuucuu

SEQ ID NO: 11829 - RNA, 20 nt, Artificial Sequence
  TRAC targeting sequence
uccucuacgagaauagcaga

SEQ ID NO: 11830 - RNA, 20 nt, Artificial Sequence
  TRAC targeting sequence
ucuacgagaauagcagaaca

SEQ ID NO: 11831 - RNA, 20 nt, Artificial Sequence
  TRAC targeting sequence
acgagaauagcagaacaaug

SEQ ID NO: 11832 - RNA, 20 nt, Artificial Sequence
  TRAC targeting sequence
uagaggaagaaagccaugcc

SEQ ID NO: 11833 - RNA, 20 nt, Artificial Sequence
  TRAC targeting sequence
cguagaggaagaaagccaug

SEQ ID NO: 11834 - RNA, 20 nt, Artificial Sequence
  TRAC targeting sequence
gcuauucucguagaggaaga

SEQ ID NO: 11835 - RNA, 20 nt, Artificial Sequence
  TRAC targeting sequence
cuagagagagaacagagccc

SEQ ID NO: 11836 - RNA, 20 nt, Artificial Sequence
  TRAC targeting sequence
agagagagaacagagcccuu

SEQ ID NO: 11837 - RNA, 20 nt, Artificial Sequence
  TRAC targeting sequence
agagaaaguuacauuguucu

SEQ ID NO: 11838 - RNA, 20 nt, Artificial Sequence
  TRAC targeting sequence
cuagagaaaguuacauuguu

SEQ ID NO: 11839 - RNA, 20 nt, Artificial Sequence
  TRAC targeting sequence
cucuagagaaaguuacauug

SEQ ID NO: 11840 - RNA, 20 nt, Artificial Sequence
  TRAC targeting sequence
cucucuagagaaaguuacau

SEQ ID NO: 11841 - RNA, 20 nt, Artificial Sequence
  TRAC targeting sequence
guucucucucuagagaaagu

SEQ ID NO: 11842 - RNA, 20 nt, Artificial Sequence
  TRAC targeting sequence
agggcucuguucucucucua

SEQ ID NO: 11843 - RNA, 20 nt, Artificial Sequence
  TRAC targeting sequence
caucaaugcuucuguuuagg

SEQ ID NO: 11844 - RNA, 20 nt, Artificial Sequence
  TRAC targeting sequence
augcuucuguuuagguagcc

SEQ ID NO: 11845 - RNA, 20 nt, Artificial Sequence
  TRAC targeting sequence
guuuagguagcccccuuccu

SEQ ID NO: 11846 - RNA, 20 nt, Artificial Sequence
  TRAC targeting sequence
ucaccguagggacaaagcag

SEQ ID NO: 11847 - RNA, 20 nt, Artificial Sequence
  TRAC targeting sequence
ccguagggacaaagcaggcc

SEQ ID NO: 11848 - RNA, 20 nt, Artificial Sequence
  TRAC targeting sequence
cuacggugaggaagggggcu

SEQ ID NO: 11849 - RNA, 20 nt, Artificial Sequence
  TRAC targeting sequence
augugggggccugcuuuguc

SEQ ID NO: 11850 - RNA, 20 nt, Artificial Sequence
  TRAC targeting sequence
cccccuuaacuaggcuggcc

SEQ ID NO: 11851 - RNA, 20 nt, Artificial Sequence
  TRAC targeting sequence
cauaggguuggcuuggccag

SEQ ID NO: 11852 - RNA, 20 nt, Artificial Sequence
  TRAC targeting sequence
cccauaggguuggcuuggcc

SEQ ID NO: 11853 - RNA, 20 nt, Artificial Sequence
  TRAC targeting sequence
gccucucccauaggguuggc

SEQ ID NO: 11854 - RNA, 20 nt, Artificial Sequence
  TRAC targeting sequence
cugccucucccauaggguug

SEQ ID NO: 11855 - RNA, 20 nt, Artificial Sequence
  TRAC targeting sequence
caggacugcagagggccucc

SEQ ID NO: 11856 - RNA, 20 nt, Artificial Sequence
  TRAC targeting sequence
ugggauucucugccucuccc

SEQ ID NO: 11857 - RNA, 20 nt, Artificial Sequence
  TRAC targeting sequence
gcaguccugggauucucugc

SEQ ID NO: 11858 - RNA, 20 nt, Artificial Sequence
  TRAC targeting sequence
ccauguccacuagauuaucu

SEQ ID NO: 11859 - RNA, 20 nt, Artificial Sequence
  TRAC targeting sequence
acuagauuaucuguaauaaa

SEQ ID NO: 11860 - RNA, 20 nt, Artificial Sequence
  TRAC targeting sequence
aguggacauggggaggcccu

SEQ ID NO: 11861 - RNA, 20 nt, Artificial Sequence
  TRAC targeting sequence
guaauaaaacagaauauuua

SEQ ID NO: 11862 - RNA, 20 nt, Artificial Sequence
  TRAC targeting sequence
guuuuauuacagauaaucua

SEQ ID NO: 11863 - RNA, 20 nt, Artificial Sequence
  TRAC targeting sequence
aaguugugaagcugugaggg

SEQ ID NO: 11864 - RNA, 20 nt, Artificial Sequence
  TRAC targeting sequence
caacuuggauaaauauucug

SEQ ID NO: 11865 - RNA, 20 nt, Artificial Sequence
  TRAC targeting sequence
cagcuucacaacuuggauaa

SEQ ID NO: 11866 - RNA, 20 nt, Artificial Sequence
  TRAC targeting sequence
cucacagcuucacaacuugg

SEQ ID NO: 11867 - RNA, 20 nt, Artificial Sequence
  TRAC targeting sequence
cccucacagcuucacaacuu

SEQ ID NO: 11868 - RNA, 20 nt, Artificial Sequence
  TRAC targeting sequence
ugauagauuauaaaaagcaa

SEQ ID NO: 11869 - RNA, 20 nt, Artificial Sequence
  TRAC targeting sequence
cgauuacccucucccucaca

SEQ ID NO: 11870 - RNA, 20 nt, Artificial Sequence
  TRAC targeting sequence
aucacgauuacccucucccu

SEQ ID NO: 11871 - RNA, 20 nt, Artificial Sequence
  TRAC targeting sequence
auauugcuuuuuauaaucua

SEQ ID NO: 11872 - RNA, 20 nt, Artificial Sequence
  TRAC targeting sequence
ccacacuugcagaauucagu

SEQ ID NO: 11873 - RNA, 20 nt, Artificial Sequence
  TRAC targeting sequence
acacuugcagaauucagugu

SEQ ID NO: 11874 - RNA, 20 nt, Artificial Sequence
  TRAC targeting sequence
gcaaguguggagacagcuug

SEQ ID NO: 11875 - RNA, 20 nt, Artificial Sequence
  TRAC targeting sequence
guguguuuuuuguuguuauu

SEQ ID NO: 11876 - RNA, 20 nt, Artificial Sequence
  TRAC targeting sequence
guuagaauuacagaaacagg

SEQ ID NO: 11877 - RNA, 20 nt, Artificial Sequence
  TRAC targeting sequence
aacagaaaaaaacccaauaa

SEQ ID NO: 11878 - RNA, 20 nt, Artificial Sequence
  TRAC targeting sequence
guaauucuaacagaaaaaaa

SEQ ID NO: 11879 - RNA, 20 nt, Artificial Sequence
  TRAC targeting sequence
ugcaggcacccuguuugcaa

SEQ ID NO: 11880 - RNA, 20 nt, Artificial Sequence
  TRAC targeting sequence
gccaucucacauuucaguag

SEQ ID NO: 11881 - RNA, 20 nt, Artificial Sequence
  TRAC targeting sequence
cacauuucaguaguauuuca

SEQ ID NO: 11882 - RNA, 20 nt, Artificial Sequence
  TRAC targeting sequence
cauuucaguaguauuucauc

SEQ ID NO: 11883 - RNA, 20 nt, Artificial Sequence
  TRAC targeting sequence
guaguauuucaucaacaauc

SEQ ID NO: 11884 - RNA, 20 nt, Artificial Sequence
  TRAC targeting sequence
ucaacaaucuucugcacacg

SEQ ID NO: 11885 - RNA, 20 nt, Artificial Sequence
  TRAC targeting sequence
acaaucuucugcacacgaac

SEQ ID NO: 11886 - RNA, 20 nt, Artificial Sequence
  TRAC targeting sequence
ucugcacacgaaccagcugu

SEQ ID NO: 11887 - RNA, 20 nt, Artificial Sequence
  TRAC targeting sequence
gcacacgaaccagcugugac

SEQ ID NO: 11888 - RNA, 20 nt, Artificial Sequence
  TRAC targeting sequence
ugugcagaagauuguugaug

SEQ ID NO: 11889 - RNA, 20 nt, Artificial Sequence
  TRAC targeting sequence
cagcugguucgugugcagaa

SEQ ID NO: 11890 - RNA, 20 nt, Artificial Sequence
  TRAC targeting sequence
gccccauuaccuuauuguca

SEQ ID NO: 11891 - RNA, 20 nt, Artificial Sequence
  TRAC targeting sequence
aguuuauacauuucaaugag

SEQ ID NO: 11892 - RNA, 20 nt, Artificial Sequence
  TRAC targeting sequence
auuuguuaacaaaucagccc

SEQ ID NO: 11893 - RNA, 20 nt, Artificial Sequence
  TRAC targeting sequence
augaguggccuagucaaaac

SEQ ID NO: 11894 - RNA, 20 nt, Artificial Sequence
  TRAC targeting sequence
uugaaauguauaaacucgau

SEQ ID NO: 11895 - RNA, 20 nt, Artificial Sequence
  TRAC targeting sequence
aaacacucagcuugaagcau

SEQ ID NO: 11896 - RNA, 20 nt, Artificial Sequence
  TRAC targeting sequence
gcuugaagcauccaacacug

SEQ ID NO: 11897 - RNA, 20 nt, Artificial Sequence
  TRAC targeting sequence
agcugaguguuuugacuagg

SEQ ID NO: 11898 - RNA, 20 nt, Artificial Sequence
  TRAC targeting sequence
aacacuguccauugcuuucc

SEQ ID NO: 11899 - RNA, 20 nt, Artificial Sequence
  TRAC targeting sequence
auugcuuucccccucccuga

SEQ ID NO: 11900 - RNA, 20 nt, Artificial Sequence
  TRAC targeting sequence
cccucccugaaaccacccuc

SEQ ID NO: 11901 - RNA, 20 nt, Artificial Sequence
  TRAC targeting sequence
cugaaaccacccucaaaggc

SEQ ID NO: 11902 - RNA, 20 nt, Artificial Sequence
  TRAC targeting sequence
gggagggggaaagcaaugga

SEQ ID NO: 11903 - RNA, 20 nt, Artificial Sequence
  TRAC targeting sequence
aaggccaaaacacuuucuuu

SEQ ID NO: 11904 - RNA, 20 nt, Artificial Sequence
  TRAC targeting sequence
uuuuguagcauccaugaugg

SEQ ID NO: 11905 - RNA, 20 nt, Artificial Sequence
  TRAC targeting sequence
augauggcuuuaucuuuuaa

SEQ ID NO: 11906 - RNA, 20 nt, Artificial Sequence
  TRAC targeting sequence
uggaugcuacaaaaagaaag

SEQ ID NO: 11907 - RNA, 20 nt, Artificial Sequence
  TRAC targeting sequence
uuuaaagguggauuuuacuc

SEQ ID NO: 11908 - RNA, 20 nt, Artificial Sequence
  TRAC targeting sequence
accuuuaaaagauaaagcca

SEQ ID NO: 11909 - RNA, 20 nt, Artificial Sequence
  TRAC targeting sequence
ugauaaucaaaauccuuuca

SEQ ID NO: 11910 - RNA, 20 nt, Artificial Sequence
  TRAC targeting sequence
agaguaaaauccaccuuuaa

SEQ ID NO: 11911 - RNA, 20 nt, Artificial Sequence
  TRAC targeting sequence
aaauccuuucagaaccaagg

SEQ ID NO: 11912 - RNA, 20 nt, Artificial Sequence
  TRAC targeting sequence
uuucagaaccaaggcuauua

SEQ ID NO: 11913 - RNA, 20 nt, Artificial Sequence
  TRAC targeting sequence
gaaccaaggcuauuaaauag

SEQ ID NO: 11914 - RNA, 20 nt, Artificial Sequence
  TRAC targeting sequence
gaaaggauuuugauuaucaa

SEQ ID NO: 11915 - RNA, 20 nt, Artificial Sequence
  TRAC targeting sequence
auuuaauagccuugguucug

SEQ ID NO: 11916 - RNA, 20 nt, Artificial Sequence
  TRAC targeting sequence
ucuauuuaauagccuugguu

SEQ ID NO: 11917 - RNA, 20 nt, Artificial Sequence
  TRAC targeting sequence
ccucuauuuaauagccuugg

SEQ ID NO: 11918 - RNA, 20 nt, Artificial Sequence
  TRAC targeting sequence
cuccucuauuuaauagccuu

SEQ ID NO: 11919 - RNA, 20 nt, Artificial Sequence
  TRAC targeting sequence
acuaguuacugauacuguuu

SEQ ID NO: 11920 - RNA, 20 nt, Artificial Sequence
  TRAC targeting sequence
auucucuccucuauuuaaua

SEQ ID NO: 11921 - RNA, 20 nt, Artificial Sequence
  TRAC targeting sequence
guaacuagucgauucucucc

SEQ ID NO: 11922 - RNA, 20 nt, Artificial Sequence
  TRAC targeting sequence
aaaacaguaucaguaacuag

SEQ ID NO: 11923 - RNA, 20 nt, Artificial Sequence
  TRAC targeting sequence
aaaaauagauguaacuauaa

SEQ ID NO: 11924 - RNA, 20 nt, Artificial Sequence
  TRAC targeting sequence
auuuuuggauccaaaacagu

SEQ ID NO: 11925 - RNA, 20 nt, Artificial Sequence
  TRAC targeting sequence
uggguuuguuuauguggcuc

SEQ ID NO: 11926 - RNA, 20 nt, Artificial Sequence
  TRAC targeting sequence
uaaacuggcucucgggggga

SEQ ID NO: 11927 - RNA, 20 nt, Artificial Sequence
  TRAC targeting sequence
cggggggaauccuagaugga

SEQ ID NO: 11928 - RNA, 20 nt, Artificial Sequence
  TRAC targeting sequence
gggggaauccuagauggaau

SEQ ID NO: 11929 - RNA, 20 nt, Artificial Sequence
  TRAC targeting sequence
ccccgagagccaguuuauga

SEQ ID NO: 11930 - RNA, 20 nt, Artificial Sequence
  TRAC targeting sequence
uagauggaauauuucagagg

SEQ ID NO: 11931 - RNA, 20 nt, Artificial Sequence
  TRAC targeting sequence
aggauuccccccgagagcca

SEQ ID NO: 11932 - RNA, 20 nt, Artificial Sequence
  TRAC targeting sequence
aucuaggauuccccccgaga

SEQ ID NO: 11933 - RNA, 20 nt, Artificial Sequence
  TRAC targeting sequence
gaggguucaacagucauuua

SEQ ID NO: 11934 - RNA, 20 nt, Artificial Sequence
  TRAC targeting sequence
gaaauauuccaucuaggauu

SEQ ID NO: 11935 - RNA, 20 nt, Artificial Sequence
  TRAC targeting sequence
acagucauuuagaugcuuaa

SEQ ID NO: 11936 - RNA, 20 nt, Artificial Sequence
  TRAC targeting sequence
uuuagaugcuuaaguccuca

SEQ ID NO: 11937 - RNA, 20 nt, Artificial Sequence
  TRAC targeting sequence
aaaugacuguugaacccucu

SEQ ID NO: 11938 - RNA, 20 nt, Artificial Sequence
  TRAC targeting sequence
ucauauguucacuaaaucag

SEQ ID NO: 11939 - RNA, 20 nt, Artificial Sequence
  TRAC targeting sequence
uauguucacuaaaucagacu

SEQ ID NO: 11940 - RNA, 20 nt, Artificial Sequence
  TRAC targeting sequence
cuaaaucagacucuuuaauu

SEQ ID NO: 11941 - RNA, 20 nt, Artificial Sequence
  TRAC targeting sequence
gacucuuuaauuaauaaaca

SEQ ID NO: 11942 - RNA, 20 nt, Artificial Sequence
  TRAC targeting sequence
gauuuagugaacauaugagg

SEQ ID NO: 11943 - RNA, 20 nt, Artificial Sequence
  TRAC targeting sequence
uuaauuaauaaacaugcaua

SEQ ID NO: 11944 - RNA, 20 nt, Artificial Sequence
  TRAC targeting sequence
uuaugcauguuuauuaauua

SEQ ID NO: 11945 - RNA, 20 nt, Artificial Sequence
  TRAC targeting sequence
ugcuaucuuuaugcauguuu

SEQ ID NO: 11946 - RNA, 20 nt, Artificial Sequence
  TRAC targeting sequence
caugcuaucuuuaugcaugu

SEQ ID NO: 11947 - RNA, 20 nt, Artificial Sequence
  TRAC targeting sequence
aucucaugcuaucuuuaugc

SEQ ID NO: 11948 - RNA, 20 nt, Artificial Sequence
  TRAC targeting sequence
ucaaucucaugcuaucuuua

SEQ ID NO: 11949 - RNA, 20 nt, Artificial Sequence
  TRAC targeting sequence
gacccaauagaagcagugaa

SEQ ID NO: 11950 - RNA, 20 nt, Artificial Sequence
  TRAC targeting sequence
gaguuugcaaaaguucuuca

SEQ ID NO: 11951 - RNA, 20 nt, Artificial Sequence
  TRAC targeting sequence
auuggguccgaguuugcaaa

SEQ ID NO: 11952 - RNA, 20 nt, Artificial Sequence
  TRAC targeting sequence
cugcuucuauuggguccgag

SEQ ID NO: 11953 - RNA, 20 nt, Artificial Sequence
  TRAC targeting sequence
ucacugcuucuauugggucc

SEQ ID NO: 11954 - RNA, 20 nt, Artificial Sequence
  TRAC targeting sequence
guaugaauuaagauauaauc

SEQ ID NO: 11955 - RNA, 20 nt, Artificial Sequence
  TRAC targeting sequence
uacagaaagucuucacugcu

SEQ ID NO: 11956 - RNA, 20 nt, Artificial Sequence
  TRAC targeting sequence
uaauucauacagaaagucuu

SEQ ID NO: 11957 - RNA, 20 nt, Artificial Sequence
  TRAC targeting sequence
gaaauaaauuacuuguagaa

SEQ ID NO: 11958 - RNA, 20 nt, Artificial Sequence
  TRAC targeting sequence
gauuauaucuuaauucauac

SEQ ID NO: 11959 - RNA, 20 nt, Artificial Sequence
  TRAC targeting sequence
acaaguaauuuauuucggau

SEQ ID NO: 11960 - RNA, 20 nt, Artificial Sequence
  TRAC targeting sequence
uauuuuucuacaaguaauuu

SEQ ID NO: 11961 - RNA, 20 nt, Artificial Sequence
  TRAC targeting sequence
aggccuuucaauggggaaag

SEQ ID NO: 11962 - RNA, 20 nt, Artificial Sequence
  TRAC targeting sequence
auggggaaagugcauguaau

SEQ ID NO: 11963 - RNA, 20 nt, Artificial Sequence
  TRAC targeting sequence
ccauugaaaggccuugaccu

SEQ ID NO: 11964 - RNA, 20 nt, Artificial Sequence
  TRAC targeting sequence
uggagaguaaagcugcuucc

SEQ ID NO: 11965 - RNA, 20 nt, Artificial Sequence
  TRAC targeting sequence
augaauaaaaggggcauuac

SEQ ID NO: 11966 - RNA, 20 nt, Artificial Sequence
  TRAC targeting sequence
ccaugaauaaaaggggcauu

SEQ ID NO: 11967 - RNA, 20 nt, Artificial Sequence
  TRAC targeting sequence
auaaaugguaacauuauguu

SEQ ID NO: 11968 - RNA, 20 nt, Artificial Sequence
  TRAC targeting sequence
acauaaaccaacauaauguu

SEQ ID NO: 11969 - RNA, 20 nt, Artificial Sequence
  TRAC targeting sequence
cuacauaaaccaacauaaug

SEQ ID NO: 11970 - RNA, 20 nt, Artificial Sequence
  TRAC targeting sequence
caguguuaugugucucuaca

SEQ ID NO: 11971 - RNA, 20 nt, Artificial Sequence
  TRAC targeting sequence
ggaaccuacaaauacaucuu

SEQ ID NO: 11972 - RNA, 20 nt, Artificial Sequence
  TRAC targeting sequence
ugagguagucacaguguuau

SEQ ID NO: 11973 - RNA, 20 nt, Artificial Sequence
  TRAC targeting sequence
uuggaacaggcaccaggcug

SEQ ID NO: 11974 - RNA, 20 nt, Artificial Sequence
  TRAC targeting sequence
aaagauguauuuguagguuc

SEQ ID NO: 11975 - RNA, 20 nt, Artificial Sequence
  TRAC targeting sequence
gccuggugccuguuccaaag

SEQ ID NO: 11976 - RNA, 20 nt, Artificial Sequence
  TRAC targeting sequence
cuugcuaaaaccuucagccu

SEQ ID NO: 11977 - RNA, 20 nt, Artificial Sequence
  TRAC targeting sequence
guaauacucacuugcuaaaa

SEQ ID NO: 11978 - RNA, 20 nt, Artificial Sequence
  TRAC targeting sequence
ugucuguaauacucacuugc

SEQ ID NO: 11979 - RNA, 20 nt, Artificial Sequence
  TRAC targeting sequence
uguuugagggacaagggaag

SEQ ID NO: 11980 - RNA, 20 nt, Artificial Sequence
  TRAC targeting sequence
aacaugaacaccaacaaccu

SEQ ID NO: 11981 - RNA, 20 nt, Artificial Sequence
  TRAC targeting sequence
cucaaacaugaacaccaaca

SEQ ID NO: 11982 - RNA, 20 nt, Artificial Sequence
  TRAC targeting sequence
cuugucccucaaacaugaac

SEQ ID NO: 11983 - RNA, 20 nt, Artificial Sequence
  TRAC targeting sequence
uaccuucccuugucccucaa

SEQ ID NO: 11984 - RNA, 20 nt, Artificial Sequence
  TRAC targeting sequence
cuuguccuaccuucccuugu

SEQ ID NO: 11985 - RNA, 20 nt, Artificial Sequence
  TRAC targeting sequence
cugcuaucugaagcggcaau

SEQ ID NO: 11986 - RNA, 20 nt, Artificial Sequence
  TRAC targeting sequence
gaagcggcaauucugggucc

SEQ ID NO: 11987 - RNA, 20 nt, Artificial Sequence
  TRAC targeting sequence
gauagcagugauuuuagcuu

SEQ ID NO: 11988 - RNA, 20 nt, Artificial Sequence
  TRAC targeting sequence
gggucccucuacucuggaca

SEQ ID NO: 11989 - RNA, 20 nt, Artificial Sequence
  TRAC targeting sequence
cucuacucuggacaggaggg

SEQ ID NO: 11990 - RNA, 20 nt, Artificial Sequence
  TRAC targeting sequence
acucuggacaggaggggcga

SEQ ID NO: 11991 - RNA, 20 nt, Artificial Sequence
  TRAC targeting sequence
ggacaggaggggcgaaggag

SEQ ID NO: 11992 - RNA, 20 nt, Artificial Sequence
  TRAC targeting sequence
agaguagagggacccagaau

SEQ ID NO: 11993 - RNA, 20 nt, Artificial Sequence
  TRAC targeting sequence
uguccagaguagagggaccc

SEQ ID NO: 11994 - RNA, 20 nt, Artificial Sequence
  TRAC targeting sequence
ccccuccuguccagaguaga

SEQ ID NO: 11995 - RNA, 20 nt, Artificial Sequence
  TRAC targeting sequence
uucgccccuccuguccagag

SEQ ID NO: 11996 - RNA, 20 nt, Artificial Sequence
  TRAC targeting sequence
ccuucgccccuccuguccag

SEQ ID NO: 11997 - RNA, 20 nt, Artificial Sequence
  TRAC targeting sequence
gaggcuuaccaugauggacu

SEQ ID NO: 11998 - RNA, 20 nt, Artificial Sequence
  TRAC targeting sequence
gagcucuccuucgccccucc

SEQ ID NO: 11999 - RNA, 20 nt, Artificial Sequence
  TRAC targeting sequence
ugguaagccucagagcucuc

SEQ ID NO: 12000 - RNA, 20 nt, Artificial Sequence
  TRAC targeting sequence
aucaugguaagccucagagc

SEQ ID NO: 12001 - RNA, 20 nt, Artificial Sequence
  TRAC targeting sequence
gcaguaaguccaucauggua

SEQ ID NO: 12002 - RNA, 20 nt, Artificial Sequence
  TRAC targeting sequence
uaagaauuguauccaucauu

SEQ ID NO: 12003 - RNA, 20 nt, Artificial Sequence
  TRAC targeting sequence
uaugaaaucggcaguaaguc

SEQ ID NO: 12004 - RNA, 20 nt, Artificial Sequence
  TRAC targeting sequence
aucauuagcaaaauguuuau

SEQ ID NO: 12005 - RNA, 20 nt, Artificial Sequence
  TRAC targeting sequence
uuagcaaaauguuuaugacu

SEQ ID NO: 12006 - RNA, 20 nt, Artificial Sequence
  TRAC targeting sequence
uaaacauuuugcuaaugaug

SEQ ID NO: 12007 - RNA, 20 nt, Artificial Sequence
  TRAC targeting sequence
agucauaaacauuuugcuaa

SEQ ID NO: 12008 - RNA, 20 nt, Artificial Sequence
  TRAC targeting sequence
agaaacuccuguuaacacaa

SEQ ID NO: 12009 - RNA, 20 nt, Artificial Sequence
  TRAC targeting sequence
ugaggccuucaagucauaaa

SEQ ID NO: 12010 - RNA, 20 nt, Artificial Sequence
  TRAC targeting sequence
uguuaacacaacaggaguuc

SEQ ID NO: 12011 - RNA, 20 nt, Artificial Sequence
  TRAC targeting sequence
uguuguguuaacaggaguuu

SEQ ID NO: 12012 - RNA, 20 nt, Artificial Sequence
  TRAC targeting sequence
guguucuuuauucuuuuaaa

SEQ ID NO: 12013 - RNA, 20 nt, Artificial Sequence
  TRAC targeting sequence
uuauucuuuuaaaacuauau

SEQ ID NO: 12014 - RNA, 20 nt, Artificial Sequence
  TRAC targeting sequence
uuuaaaacuauauucucacu

SEQ ID NO: 12015 - RNA, 20 nt, Artificial Sequence
  TRAC targeting sequence
cacuuuacauuuuucacuca

SEQ ID NO: 12016 - RNA, 20 nt, Artificial Sequence
  TRAC targeting sequence
cuuuacauuuuucacucauu

SEQ ID NO: 12017 - RNA, 20 nt, Artificial Sequence
  TRAC targeting sequence
cucauuuuucugccuuuuuu

SEQ ID NO: 12018 - RNA, 20 nt, Artificial Sequence
  TRAC targeting sequence
uuuuucugccuuuuuuuaug

SEQ ID NO: 12019 - RNA, 20 nt, Artificial Sequence
  TRAC targeting sequence
gccuuuuuuuaugcgucucu

SEQ ID NO: 12020 - RNA, 20 nt, Artificial Sequence
  TRAC targeting sequence
cuccucugugcaacucaaug

SEQ ID NO: 12021 - RNA, 20 nt, Artificial Sequence
  TRAC targeting sequence
ccucugugcaacucaaugcu

SEQ ID NO: 12022 - RNA, 20 nt, Artificial Sequence
  TRAC targeting sequence
ucugugcaacucaaugcuuc

SEQ ID NO: 12023 - RNA, 20 nt, Artificial Sequence
  TRAC targeting sequence
gugcaacucaaugcuucauc

SEQ ID NO: 12024 - RNA, 20 nt, Artificial Sequence
  TRAC targeting sequence
augcuucaucugggcauuca

SEQ ID NO: 12025 - RNA, 20 nt, Artificial Sequence
  TRAC targeting sequence
ucugggcauucauauuuuga

SEQ ID NO: 12026 - RNA, 20 nt, Artificial Sequence
  TRAC targeting sequence
gggcauucauauuuugagaa

SEQ ID NO: 12027 - RNA, 20 nt, Artificial Sequence
  TRAC targeting sequence
uauuuugagaaaucaucuca

SEQ ID NO: 12028 - RNA, 20 nt, Artificial Sequence
  TRAC targeting sequence
aaauaugaaugcccagauga

SEQ ID NO: 12029 - RNA, 20 nt, Artificial Sequence
  TRAC targeting sequence
caaaauaugaaugcccagau

SEQ ID NO: 12030 - RNA, 20 nt, Artificial Sequence
  TRAC targeting sequence
ucucaagaggaaaucauguc

SEQ ID NO: 12031 - RNA, 20 nt, Artificial Sequence
  TRAC targeting sequence
caagaggaaaucauguccag

SEQ ID NO: 12032 - RNA, 20 nt, Artificial Sequence
  TRAC targeting sequence
agaggaaaucauguccagau

SEQ ID NO: 12033 - RNA, 20 nt, Artificial Sequence
  TRAC targeting sequence
ugagaugauuucucaaaaua

SEQ ID NO: 12034 - RNA, 20 nt, Artificial Sequence
  TRAC targeting sequence
ucuugagaugauuucucaaa

SEQ ID NO: 12035 - RNA, 20 nt, Artificial Sequence
  TRAC targeting sequence
uguccagauccuagcauguc

SEQ ID NO: 12036 - RNA, 20 nt, Artificial Sequence
  TRAC targeting sequence
agauccuagcaugucacuca

SEQ ID NO: 12037 - RNA, 20 nt, Artificial Sequence
  TRAC targeting sequence
ggacaugauuuccucuugag

SEQ ID NO: 12038 - RNA, 20 nt, Artificial Sequence
  TRAC targeting sequence
uagcaugucacucaaagcuc

SEQ ID NO: 12039 - RNA, 20 nt, Artificial Sequence
  TRAC targeting sequence
cucaaagcucucugaaaucu

SEQ ID NO: 12040 - RNA, 20 nt, Artificial Sequence
  TRAC targeting sequence
aagcucucugaaaucugggc

SEQ ID NO: 12041 - RNA, 20 nt, Artificial Sequence
  TRAC targeting sequence
cugaaaucugggcccuuucu

SEQ ID NO: 12042 - RNA, 20 nt, Artificial Sequence
  TRAC targeting sequence
gaaaucugggcccuuucuau

SEQ ID NO: 12043 - RNA, 20 nt, Artificial Sequence
  TRAC targeting sequence
gagagcuuugagugacaugc

SEQ ID NO: 12044 - RNA, 20 nt, Artificial Sequence
  TRAC targeting sequence
gggcccuuucuauucuccaa

SEQ ID NO: 12045 - RNA, 20 nt, Artificial Sequence
  TRAC targeting sequence
auucuccaaauuuauuccca

SEQ ID NO: 12046 - RNA, 20 nt, Artificial Sequence
  TRAC targeting sequence
ccaaauuuauucccacugau

SEQ ID NO: 12047 - RNA, 20 nt, Artificial Sequence
  TRAC targeting sequence
aaauuuauucccacugauuc

SEQ ID NO: 12048 - RNA, 20 nt, Artificial Sequence
  TRAC targeting sequence
cacugauucccuuucaugaa

SEQ ID NO: 12049 - RNA, 20 nt, Artificial Sequence
  TRAC targeting sequence
gugggaauaaauuuggagaa

SEQ ID NO: 12050 - RNA, 20 nt, Artificial Sequence
  TRAC targeting sequence
cuuucaugaaugcucugcuc

SEQ ID NO: 12051 - RNA, 20 nt, Artificial Sequence
  TRAC targeting sequence
ugaaugcucugcuccaggaa

SEQ ID NO: 12052 - RNA, 20 nt, Artificial Sequence
  TRAC targeting sequence
ugaaagggaaucagugggaa

SEQ ID NO: 12053 - RNA, 20 nt, Artificial Sequence
  TRAC targeting sequence
gcuccaggaaaacuagguau

SEQ ID NO: 12054 - RNA, 20 nt, Artificial Sequence
  TRAC targeting sequence
aggaaaacuagguaucuccc

SEQ ID NO: 12055 - RNA, 20 nt, Artificial Sequence
  TRAC targeting sequence
uggagcagagcauucaugaa

SEQ ID NO: 12056 - RNA, 20 nt, Artificial Sequence
  TRAC targeting sequence
cccucccuugaauauuuaca

SEQ ID NO: 12057 - RNA, 20 nt, Artificial Sequence
  TRAC targeting sequence
cucccuugaauauuuacaca

SEQ ID NO: 12058 - RNA, 20 nt, Artificial Sequence
  TRAC targeting sequence
cuugaauauuuacacaugcc

SEQ ID NO: 12059 - RNA, 20 nt, Artificial Sequence
  TRAC targeting sequence
agggagggagauaccuaguu

SEQ ID NO: 12060 - RNA, 20 nt, Artificial Sequence
  TRAC targeting sequence
auacaucagacauccuggac

SEQ ID NO: 12061 - RNA, 20 nt, Artificial Sequence
  TRAC targeting sequence
gacauccuggacccaccacc

SEQ ID NO: 12062 - RNA, 20 nt, Artificial Sequence
  TRAC targeting sequence
gauguauggacacaggguac

SEQ ID NO: 12063 - RNA, 20 nt, Artificial Sequence
  TRAC targeting sequence
uggacccaccaccuaaaaca

SEQ ID NO: 12064 - RNA, 20 nt, Artificial Sequence
  TRAC targeting sequence
aggaugucugauguauggac

SEQ ID NO: 12065 - RNA, 20 nt, Artificial Sequence
  TRAC targeting sequence
ccugugcaagccuguuuuag

SEQ ID NO: 12066 - RNA, 20 nt, Artificial Sequence
  TRAC targeting sequence
ucaucucucagccuugagac

SEQ ID NO: 12067 - RNA, 20 nt, Artificial Sequence
  TRAC targeting sequence
ucucucagccuugagaccca

SEQ ID NO: 12068 - RNA, 20 nt, Artificial Sequence
  TRAC targeting sequence
cucagccuugagacccagca

SEQ ID NO: 12069 - RNA, 20 nt, Artificial Sequence
  TRAC targeting sequence
cagccuugagacccagcaca

SEQ ID NO: 12070 - RNA, 20 nt, Artificial Sequence
  TRAC targeting sequence
gccuugagacccagcacagg

SEQ ID NO: 12071 - RNA, 20 nt, Artificial Sequence
  TRAC targeting sequence
aggcugagagaugaugaggc

SEQ ID NO: 12072 - RNA, 20 nt, Artificial Sequence
  TRAC targeting sequence
caaggcugagagaugaugag

SEQ ID NO: 12073 - RNA, 20 nt, Artificial Sequence
  TRAC targeting sequence
ccagauuuaguuucauagga

SEQ ID NO: 12074 - RNA, 20 nt, Artificial Sequence
  TRAC targeting sequence
ggugaugccugugcuggguc

SEQ ID NO: 12075 - RNA, 20 nt, Artificial Sequence
  TRAC targeting sequence
uaggaagagcaugaaaaauc

SEQ ID NO: 12076 - RNA, 20 nt, Artificial Sequence
  TRAC targeting sequence
uaugaaacuaaaucugguga

SEQ ID NO: 12077 - RNA, 20 nt, Artificial Sequence
  TRAC targeting sequence
uccuaugaaacuaaaucugg

SEQ ID NO: 12078 - RNA, 20 nt, Artificial Sequence
  TRAC targeting sequence
ugcucuuccuaugaaacuaa

SEQ ID NO: 12079 - RNA, 20 nt, Artificial Sequence
  TRAC targeting sequence
uaucauuuuuuaauuaagca

SEQ ID NO: 12080 - RNA, 20 nt, Artificial Sequence
  TRAC targeting sequence
uuuuuuaauuaagcaggcca

SEQ ID NO: 12081 - RNA, 20 nt, Artificial Sequence
  TRAC targeting sequence
uaccuuggccugcuuaauua

SEQ ID NO: 12082 - RNA, 20 nt, Artificial Sequence
  TRAC targeting sequence
cuuaccuuggccugcuuaau

SEQ ID NO: 12083 - RNA, 20 nt, Artificial Sequence
  TRAC targeting sequence
aucagacaaagaagcaaagu

SEQ ID NO: 12084 - RNA, 20 nt, Artificial Sequence
  TRAC targeting sequence
gacaaagaagcaaaguagga

SEQ ID NO: 12085 - RNA, 20 nt, Artificial Sequence
  TRAC targeting sequence
gauggaucucuuaccuuggc

SEQ ID NO: 12086 - RNA, 20 nt, Artificial Sequence
  TRAC targeting sequence
uugucugauggaucucuuac

SEQ ID NO: 12087 - RNA, 20 nt, Artificial Sequence
  TRAC targeting sequence
uacuuugcuucuuugucuga

SEQ ID NO: 12088 - RNA, 20 nt, Artificial Sequence
  TRAC targeting sequence
uuccuacuuugcuucuuugu

SEQ ID NO: 12089 - RNA, 20 nt, Artificial Sequence
  TRAC targeting sequence
ccuuccuacuuugcuucuuu

SEQ ID NO: 12090 - RNA, 20 nt, Artificial Sequence
  TRAC targeting sequence
cuccuuccuacuuugcuucu

SEQ ID NO: 12091 - RNA, 20 nt, Artificial Sequence
  TRAC targeting sequence
cucuccuuccuacuuugcuu

SEQ ID NO: 12092 - RNA, 20 nt, Artificial Sequence
  TRAC targeting sequence
guaauggguuugcaaaggag

SEQ ID NO: 12093 - RNA, 20 nt, Artificial Sequence
  TRAC targeting sequence
uuugcaaacccauuacagaa

SEQ ID NO: 12094 - RNA, 20 nt, Artificial Sequence
  TRAC targeting sequence
ccuuugcaaacccauuacag

SEQ ID NO: 12095 - RNA, 20 nt, Artificial Sequence
  TRAC targeting sequence
gucccugaaauagcacuaau

SEQ ID NO: 12096 - RNA, 20 nt, Artificial Sequence
  TRAC targeting sequence
cugaaauagcacuaauauaa

SEQ ID NO: 12097 - RNA, 20 nt, Artificial Sequence
  TRAC targeting sequence
gggacagagcucuccuuugc

SEQ ID NO: 12098 - RNA, 20 nt, Artificial Sequence
  TRAC targeting sequence
aaguaggagauuuacaggcu

SEQ ID NO: 12099 - RNA, 20 nt, Artificial Sequence
  TRAC targeting sequence
uacuuggauuauauuagugc

SEQ ID NO: 12100 - RNA, 20 nt, Artificial Sequence
  TRAC targeting sequence
ccuacuuggauuauauuagu

SEQ ID NO: 12101 - RNA, 20 nt, Artificial Sequence
  TRAC targeting sequence
ugguuucccuuuggagugcu

SEQ ID NO: 12102 - RNA, 20 nt, Artificial Sequence
  TRAC targeting sequence
cuuuggagugcuccauuccu

SEQ ID NO: 12103 - RNA, 20 nt, Artificial Sequence
  TRAC targeting sequence
aaagggaaaccaagaaacau

SEQ ID NO: 12104 - RNA, 20 nt, Artificial Sequence
  TRAC targeting sequence
auuccuaacaccaguuguua

SEQ ID NO: 12105 - RNA, 20 nt, Artificial Sequence
  TRAC targeting sequence
uaacaccaguuguuaagccc

SEQ ID NO: 12106 - RNA, 20 nt, Artificial Sequence
  TRAC targeting sequence
ugaauguggccgggggugag

SEQ ID NO: 12107 - RNA, 20 nt, Artificial Sequence
  TRAC targeting sequence
ggaccaggggcuuaacaacu

SEQ ID NO: 12108 - RNA, 20 nt, Artificial Sequence
  TRAC targeting sequence
cccccggccacauucaggac

SEQ ID NO: 12109 - RNA, 20 nt, Artificial Sequence
  TRAC targeting sequence
ucacccccggccacauucag

SEQ ID NO: 12110 - RNA, 20 nt, Artificial Sequence
  TRAC targeting sequence
cacuuccucacccccggcca

SEQ ID NO: 12111 - RNA, 20 nt, Artificial Sequence
  TRAC targeting sequence
ucccacuuccucacccccgg

SEQ ID NO: 12112 - RNA, 20 nt, Artificial Sequence
  TRAC targeting sequence
ccucccacuuccucaccccc

SEQ ID NO: 12113 - RNA, 20 nt, Artificial Sequence
  TRAC targeting sequence
gugguggugcccauggaguu

SEQ ID NO: 12114 - RNA, 20 nt, Artificial Sequence
  TRAC targeting sequence
augggcaccaccacugagug

SEQ ID NO: 12115 - RNA, 20 nt, Artificial Sequence
  TRAC targeting sequence
ggcucagacuuucugugaga

SEQ ID NO: 12116 - RNA, 20 nt, Artificial Sequence
  TRAC targeting sequence
gacuuucugugagauaccuc

SEQ ID NO: 12117 - RNA, 20 nt, Artificial Sequence
  TRAC targeting sequence
gagcccgaaacuccaugggc

SEQ ID NO: 12118 - RNA, 20 nt, Artificial Sequence
  TRAC targeting sequence
gugagauaccucaaaauuga

SEQ ID NO: 12119 - RNA, 20 nt, Artificial Sequence
  TRAC targeting sequence
cagaaagucugagcccgaaa

SEQ ID NO: 12120 - RNA, 20 nt, Artificial Sequence
  TRAC targeting sequence
cacagaaagucugagcccga

SEQ ID NO: 12121 - RNA, 20 nt, Artificial Sequence
  TRAC targeting sequence
aaauugagagaagcucaaaa

SEQ ID NO: 12122 - RNA, 20 nt, Artificial Sequence
  TRAC targeting sequence
auuuugagguaucucacaga

SEQ ID NO: 12123 - RNA, 20 nt, Artificial Sequence
  TRAC targeting sequence
caauuuugagguaucucaca

SEQ ID NO: 12124 - RNA, 20 nt, Artificial Sequence
  TRAC targeting sequence
cucaauuuugagguaucuca

SEQ ID NO: 12125 - RNA, 20 nt, Artificial Sequence
  TRAC targeting sequence
aaaggaucaugcagcaaaaa

SEQ ID NO: 12126 - RNA, 20 nt, Artificial Sequence
  TRAC targeting sequence
uuuugagcuucucucaauuu

SEQ ID NO: 12127 - RNA, 20 nt, Artificial Sequence
  TRAC targeting sequence
ugcagcaaaaaugggagaag

SEQ ID NO: 12128 - RNA, 20 nt, Artificial Sequence
  TRAC targeting sequence
cauuuuugcugcaugauccu

SEQ ID NO: 12129 - RNA, 20 nt, Artificial Sequence
  TRAC targeting sequence
cccauuuuugcugcaugauc

SEQ ID NO: 12130 - RNA, 20 nt, Artificial Sequence
  TRAC targeting sequence
ccuucuuagucauaagagga

SEQ ID NO: 12131 - RNA, 20 nt, Artificial Sequence
  TRAC targeting sequence
uagucauaagaggauuauuu

SEQ ID NO: 12132 - RNA, 20 nt, Artificial Sequence
  TRAC targeting sequence
uaagaggauuauuucugauu

SEQ ID NO: 12133 - RNA, 20 nt, Artificial Sequence
  TRAC targeting sequence
uaugacuaagaaggugacuu

SEQ ID NO: 12134 - RNA, 20 nt, Artificial Sequence
  TRAC targeting sequence
ucuuaugacuaagaagguga

SEQ ID NO: 12135 - RNA, 20 nt, Artificial Sequence
  TRAC targeting sequence
gauuaguccuugagcugugu

SEQ ID NO: 12136 - RNA, 20 nt, Artificial Sequence
  TRAC targeting sequence
gaaauaauccucuuaugacu

SEQ ID NO: 12137 - RNA, 20 nt, Artificial Sequence
  TRAC targeting sequence
uugagcuguguuauguccug

SEQ ID NO: 12138 - RNA, 20 nt, Artificial Sequence
  TRAC targeting sequence
aggacuaaucagaaauaauc

SEQ ID NO: 12139 - RNA, 20 nt, Artificial Sequence
  TRAC targeting sequence
uggggaagggacaguaagag

SEQ ID NO: 12140 - RNA, 20 nt, Artificial Sequence
  TRAC targeting sequence
ccaggacauaacacagcuca

SEQ ID NO: 12141 - RNA, 20 nt, Artificial Sequence
  TRAC targeting sequence
cuuccccaggacauaacaca

SEQ ID NO: 12142 - RNA, 20 nt, Artificial Sequence
  TRAC targeting sequence
uacugucccuuccccaggac

SEQ ID NO: 12143 - RNA, 20 nt, Artificial Sequence
  TRAC targeting sequence
acucuuacugucccuucccc

SEQ ID NO: 12144 - RNA, 20 nt, Artificial Sequence
  TRAC targeting sequence
cuccuaggacaaggauagga

SEQ ID NO: 12145 - RNA, 20 nt, Artificial Sequence
  TRAC targeting sequence
ccuaggacaaggauaggaag

SEQ ID NO: 12146 - RNA, 20 nt, Artificial Sequence
  TRAC targeting sequence
uaggacaaggauaggaagug

SEQ ID NO: 12147 - RNA, 20 nt, Artificial Sequence
  TRAC targeting sequence
uaggagagacuuuucuacuc

SEQ ID NO: 12148 - RNA, 20 nt, Artificial Sequence
  TRAC targeting sequence
uuguccuaggagagacuuuu

SEQ ID NO: 12149 - RNA, 20 nt, Artificial Sequence
  TRAC targeting sequence
uauccuuguccuaggagaga

SEQ ID NO: 12150 - RNA, 20 nt, Artificial Sequence
  TRAC targeting sequence
ccacuuccuauccuuguccu

SEQ ID NO: 12151 - RNA, 20 nt, Artificial Sequence
  TRAC targeting sequence
uuuuccuggugacuagcaaa

SEQ ID NO: 12152 - RNA, 20 nt, Artificial Sequence
  TRAC targeting sequence
uggugacuagcaaagcaggg

SEQ ID NO: 12153 - RNA, 20 nt, Artificial Sequence
  TRAC targeting sequence
ccaggaaaaggacuuuucac

SEQ ID NO: 12154 - RNA, 20 nt, Artificial Sequence
  TRAC targeting sequence
ccugcuuugcuagucaccag

SEQ ID NO: 12155 - RNA, 20 nt, Artificial Sequence
  TRAC targeting sequence
uccccugcuuugcuagucac

SEQ ID NO: 12156 - RNA, 20 nt, Artificial Sequence
  TRAC targeting sequence
uuucauccccugcuuugcua

SEQ ID NO: 12157 - RNA, 20 nt, Artificial Sequence
  TRAC targeting sequence
ggaguuggaguccagggugg

SEQ ID NO: 12158 - RNA, 20 nt, Artificial Sequence
  TRAC targeting sequence
agaucuuuucauccccugcu

SEQ ID NO: 12159 - RNA, 20 nt, Artificial Sequence
  TRAC targeting sequence
aacuccagaucuuuucaucc

SEQ ID NO: 12160 - RNA, 20 nt, Artificial Sequence
  TRAC targeting sequence
aggguggauuccagggcaga

SEQ ID NO: 12161 - RNA, 20 nt, Artificial Sequence
  TRAC targeting sequence
acccuggacuccaacuccag

SEQ ID NO: 12162 - RNA, 20 nt, Artificial Sequence
  TRAC targeting sequence
agggcagacaacugcauagg

SEQ ID NO: 12163 - RNA, 20 nt, Artificial Sequence
  TRAC targeting sequence
gcccuggaauccacccugga

SEQ ID NO: 12164 - RNA, 20 nt, Artificial Sequence
  TRAC targeting sequence
uaugcaguugucugcccugg

SEQ ID NO: 12165 - RNA, 20 nt, Artificial Sequence
  TRAC targeting sequence
cgaguucuguggauugaaaa

SEQ ID NO: 12166 - RNA, 20 nt, Artificial Sequence
  TRAC targeting sequence
aguucuguggauugaaaagg

SEQ ID NO: 12167 - RNA, 20 nt, Artificial Sequence
  TRAC targeting sequence
agacaguccuaugcaguugu

SEQ ID NO: 12168 - RNA, 20 nt, Artificial Sequence
  TRAC targeting sequence
guggauugaaaagguugggc

SEQ ID NO: 12169 - RNA, 20 nt, Artificial Sequence
  TRAC targeting sequence
acagaacucgagacaguccu

SEQ ID NO: 12170 - RNA, 20 nt, Artificial Sequence
  TRAC targeting sequence
auccacagaacucgagacag

SEQ ID NO: 12171 - RNA, 20 nt, Artificial Sequence
  TRAC targeting sequence
cuucagauguuccugagcug

SEQ ID NO: 12172 - RNA, 20 nt, Artificial Sequence
  TRAC targeting sequence
gauguuccugagcugaccuc

SEQ ID NO: 12173 - RNA, 20 nt, Artificial Sequence
  TRAC targeting sequence
gaagggaugcccaaccuuuu

SEQ ID NO: 12174 - RNA, 20 nt, Artificial Sequence
  TRAC targeting sequence
ugagcugaccucagucagag

SEQ ID NO: 12175 - RNA, 20 nt, Artificial Sequence
  TRAC targeting sequence
ggaacaucugaagggaugcc

SEQ ID NO: 12176 - RNA, 20 nt, Artificial Sequence
  TRAC targeting sequence
gcucaggaacaucugaaggg

SEQ ID NO: 12177 - RNA, 20 nt, Artificial Sequence
  TRAC targeting sequence
gucagaggugcguggcucca

SEQ ID NO: 12178 - RNA, 20 nt, Artificial Sequence
  TRAC targeting sequence
gaggugcguggcuccagcac

SEQ ID NO: 12179 - RNA, 20 nt, Artificial Sequence
  TRAC targeting sequence
gacugaggucagcucaggaa

SEQ ID NO: 12180 - RNA, 20 nt, Artificial Sequence
  TRAC targeting sequence
agcacccagaaggugugacc

SEQ ID NO: 12181 - RNA, 20 nt, Artificial Sequence
  TRAC targeting sequence
gggugcuggagccacgcacc

SEQ ID NO: 12182 - RNA, 20 nt, Artificial Sequence
  TRAC targeting sequence
caccuucugggugcuggagc

SEQ ID NO: 12183 - RNA, 20 nt, Artificial Sequence
  TRAC targeting sequence
ucccaggugggccgugacag

SEQ ID NO: 12184 - RNA, 20 nt, Artificial Sequence
  TRAC targeting sequence
caggugggccgugacagcuu

SEQ ID NO: 12185 - RNA, 20 nt, Artificial Sequence
  TRAC targeting sequence
cggcccaccugggaggaggg

SEQ ID NO: 12186 - RNA, 20 nt, Artificial Sequence
  TRAC targeting sequence
cucaaucccucccacucuga

SEQ ID NO: 12187 - RNA, 20 nt, Artificial Sequence
  TRAC targeting sequence
aucccucccacucugacaac

SEQ ID NO: 12188 - RNA, 20 nt, Artificial Sequence
  TRAC targeting sequence
cucccacucugacaacaguc

SEQ ID NO: 12189 - RNA, 20 nt, Artificial Sequence
  TRAC targeting sequence
cacucugacaacagucucuc

SEQ ID NO: 12190 - RNA, 20 nt, Artificial Sequence
  TRAC targeting sequence
gacaacagucucucugauug

SEQ ID NO: 12191 - RNA, 20 nt, Artificial Sequence
  TRAC targeting sequence
gagugggagggauugaggga

SEQ ID NO: 12192 - RNA, 20 nt, Artificial Sequence
  TRAC targeting sequence
cucugauugcuuuugcuuug

SEQ ID NO: 12193 - RNA, 20 nt, Artificial Sequence
  TRAC targeting sequence
cugauugcuuuugcuuuggu

SEQ ID NO: 12194 - RNA, 20 nt, Artificial Sequence
  TRAC targeting sequence
gauugcuuuugcuuuggugc

SEQ ID NO: 12195 - RNA, 20 nt, Artificial Sequence
  TRAC targeting sequence
gagagacuguugucagagug

SEQ ID NO: 12196 - RNA, 20 nt, Artificial Sequence
  TRAC targeting sequence
ggacauaaacuguuccuacu

SEQ ID NO: 12197 - RNA, 20 nt, Artificial Sequence
  TRAC targeting sequence
agagcaccaaagcaaaagca

SEQ ID NO: 12198 - RNA, 20 nt, Artificial Sequence
  TRAC targeting sequence
uacuuuguccaagugaggua

SEQ ID NO: 12199 - RNA, 20 nt, Artificial Sequence
  TRAC targeting sequence
aagugagguauauaauuuuc

SEQ ID NO: 12200 - RNA, 20 nt, Artificial Sequence
  TRAC targeting sequence
cuuggacaaaguaggaacag

SEQ ID NO: 12201 - RNA, 20 nt, Artificial Sequence
  TRAC targeting sequence
gaacgcuggagaauuauuau

SEQ ID NO: 12202 - RNA, 20 nt, Artificial Sequence
  TRAC targeting sequence
gaaaauuauauaccucacuu

SEQ ID NO: 12203 - RNA, 20 nt, Artificial Sequence
  TRAC targeting sequence
agcguucugaaaauuauaua

SEQ ID NO: 12204 - RNA, 20 nt, Artificial Sequence
  TRAC targeting sequence
ccagcguucugaaaauuaua

SEQ ID NO: 12205 - RNA, 20 nt, Artificial Sequence
  TRAC targeting sequence
aaaacaccaguggauacgcu

SEQ ID NO: 12206 - RNA, 20 nt, Artificial Sequence
  TRAC targeting sequence
acugguguuuuagauaauaa

SEQ ID NO: 12207 - RNA, 20 nt, Artificial Sequence
  TRAC targeting sequence
guauucugggcuugugcagg

SEQ ID NO: 12208 - RNA, 20 nt, Artificial Sequence
  TRAC targeting sequence
gggcuugugcaggaaaacuc

SEQ ID NO: 12209 - RNA, 20 nt, Artificial Sequence
  TRAC targeting sequence
ugcacaagcccagaauacug

SEQ ID NO: 12210 - RNA, 20 nt, Artificial Sequence
  TRAC targeting sequence
uucuuuagaacauguagaaa

SEQ ID NO: 12211 - RNA, 20 nt, Artificial Sequence
  TRAC targeting sequence
uuagaacauguagaaagacu

SEQ ID NO: 12212 - RNA, 20 nt, Artificial Sequence
  TRAC targeting sequence
aaagaaagaguuuuccugca

SEQ ID NO: 12213 - RNA, 20 nt, Artificial Sequence
  TRAC targeting sequence
acauguucuaaagaaagagu

SEQ ID NO: 12214 - RNA, 20 nt, Artificial Sequence
  TRAC targeting sequence
uucuacauguucuaaagaaa

SEQ ID NO: 12215 - RNA, 20 nt, Artificial Sequence
  TRAC targeting sequence
uuuaguuauccaguguggaa

SEQ ID NO: 12216 - RNA, 20 nt, Artificial Sequence
  TRAC targeting sequence
aguguggaaacaguccugaa

SEQ ID NO: 12217 - RNA, 20 nt, Artificial Sequence
  TRAC targeting sequence
acacuggauaacuaaaggau

SEQ ID NO: 12218 - RNA, 20 nt, Artificial Sequence
  TRAC targeting sequence
ugaaauccaaacugauacug

SEQ ID NO: 12219 - RNA, 20 nt, Artificial Sequence
  TRAC targeting sequence
ggacuguuuccacacuggau

SEQ ID NO: 12220 - RNA, 20 nt, Artificial Sequence
  TRAC targeting sequence
aaacugauacugcgauccug

SEQ ID NO: 12221 - RNA, 20 nt, Artificial Sequence
  TRAC targeting sequence
guuuggauuucaggacuguu

SEQ ID NO: 12222 - RNA, 20 nt, Artificial Sequence
  TRAC targeting sequence
caguaucaguuuggauuuca

SEQ ID NO: 12223 - RNA, 20 nt, Artificial Sequence
  TRAC targeting sequence
ugugccagguuauuacugug

SEQ ID NO: 12224 - RNA, 20 nt, Artificial Sequence
  TRAC targeting sequence
caguaauaaccuggcacagg

SEQ ID NO: 12225 - RNA, 20 nt, Artificial Sequence
  TRAC targeting sequence
cugugcucacgauaucacuc

SEQ ID NO: 12226 - RNA, 20 nt, Artificial Sequence
  TRAC targeting sequence
gugcucacgauaucacuccu

SEQ ID NO: 12227 - RNA, 20 nt, Artificial Sequence
  TRAC targeting sequence
cgauaucacuccuuccagaa

SEQ ID NO: 12228 - RNA, 20 nt, Artificial Sequence
  TRAC targeting sequence
ugagcacagagaauauuaag

SEQ ID NO: 12229 - RNA, 20 nt, Artificial Sequence
  TRAC targeting sequence
cuccuuccagaagaucuuua

SEQ ID NO: 12230 - RNA, 20 nt, Artificial Sequence
  TRAC targeting sequence
uuccagaagaucuuuaggga

SEQ ID NO: 12231 - RNA, 20 nt, Artificial Sequence
  TRAC targeting sequence
agaagaucuuuagggaaaac

SEQ ID NO: 12232 - RNA, 20 nt, Artificial Sequence
  TRAC targeting sequence
ggaaggagugauaucgugag

SEQ ID NO: 12233 - RNA, 20 nt, Artificial Sequence
  TRAC targeting sequence
ucuggaaggagugauaucgu

SEQ ID NO: 12234 - RNA, 20 nt, Artificial Sequence
  TRAC targeting sequence
uuagggaaaacuuaguucag

SEQ ID NO: 12235 - RNA, 20 nt, Artificial Sequence
  TRAC targeting sequence
cuaaagaucuucuggaagga

SEQ ID NO: 12236 - RNA, 20 nt, Artificial Sequence
  TRAC targeting sequence
guuucuaggagguuuuugcu

SEQ ID NO: 12237 - RNA, 20 nt, Artificial Sequence
  TRAC targeting sequence
aggagguuuuugcucagccg

SEQ ID NO: 12238 - RNA, 20 nt, Artificial Sequence
  TRAC targeting sequence
uagaaacugaacuaaguuuu

SEQ ID NO: 12239 - RNA, 20 nt, Artificial Sequence
  TRAC targeting sequence
gccgaagaucacugugugaa

SEQ ID NO: 12240 - RNA, 20 nt, Artificial Sequence
  TRAC targeting sequence
gcugagcaaaaaccuccuag

SEQ ID NO: 12241 - RNA, 20 nt, Artificial Sequence
  TRAC targeting sequence
ucggcugagcaaaaaccucc

SEQ ID NO: 12242 - RNA, 20 nt, Artificial Sequence
  TRAC targeting sequence
cugugugaauaauaaugcag

SEQ ID NO: 12243 - RNA, 20 nt, Artificial Sequence
  TRAC targeting sequence
cacagugaucuucggcugag

SEQ ID NO: 12244 - RNA, 20 nt, Artificial Sequence
  TRAC targeting sequence
ccuuuggagggggaacaagg

SEQ ID NO: 12245 - RNA, 20 nt, Artificial Sequence
  TRAC targeting sequence
aaaggugagcauguugccug

SEQ ID NO: 12246 - RNA, 20 nt, Artificial Sequence
  TRAC targeting sequence
cccuccaaaggugagcaugu

SEQ ID NO: 12247 - RNA, 20 nt, Artificial Sequence
  TRAC targeting sequence
aaccccgugaguaucucugc

SEQ ID NO: 12248 - RNA, 20 nt, Artificial Sequence
  TRAC targeting sequence
cgggguuugaccauuaaccu

SEQ ID NO: 12249 - RNA, 20 nt, Artificial Sequence
  TRAC targeting sequence
cugcugaauccauaaugaau

SEQ ID NO: 12250 - RNA, 20 nt, Artificial Sequence
  TRAC targeting sequence
gcugaauccauaaugaaugc

SEQ ID NO: 12251 - RNA, 20 nt, Artificial Sequence
  TRAC targeting sequence
gcagagauacucacgggguu

SEQ ID NO: 12252 - RNA, 20 nt, Artificial Sequence
  TRAC targeting sequence
auaaugaaugcucuaauuuc

SEQ ID NO: 12253 - RNA, 20 nt, Artificial Sequence
  TRAC targeting sequence
uuauggauucagcagagaua

SEQ ID NO: 12254 - RNA, 20 nt, Artificial Sequence
  TRAC targeting sequence
aauuucaaaaggaagccgua

SEQ ID NO: 12255 - RNA, 20 nt, Artificial Sequence
  TRAC targeting sequence
aaaggaagccguagcacuga

SEQ ID NO: 12256 - RNA, 20 nt, Artificial Sequence
  TRAC targeting sequence
uuuugaaauuagagcauuca

SEQ ID NO: 12257 - RNA, 20 nt, Artificial Sequence
  TRAC targeting sequence
gugcuacggcuuccuuuuga

SEQ ID NO: 12258 - RNA, 20 nt, Artificial Sequence
  TRAC targeting sequence
guuuucuguuuucucuacuu

SEQ ID NO: 12259 - RNA, 20 nt, Artificial Sequence
  TRAC targeting sequence
guuuucucuacuuaauuuua

SEQ ID NO: 12260 - RNA, 20 nt, Artificial Sequence
  TRAC targeting sequence
cuacuuaauuuuaucuuuua

SEQ ID NO: 12261 - RNA, 20 nt, Artificial Sequence
  TRAC targeting sequence
acuuaauuuuaucuuuuaua

SEQ ID NO: 12262 - RNA, 20 nt, Artificial Sequence
  TRAC targeting sequence
uuuauauuaauucuaauggu

SEQ ID NO: 12263 - RNA, 20 nt, Artificial Sequence
  TRAC targeting sequence
aaugguuacauguuaucgau

SEQ ID NO: 12264 - RNA, 20 nt, Artificial Sequence
  TRAC targeting sequence
auacauggcauauguauaua

SEQ ID NO: 12265 - RNA, 20 nt, Artificial Sequence
  TRAC targeting sequence
auaacauguaaccauuagaa

SEQ ID NO: 12266 - RNA, 20 nt, Artificial Sequence
  TRAC targeting sequence
uauauacauaugccauguau

SEQ ID NO: 12267 - RNA, 20 nt, Artificial Sequence
  TRAC targeting sequence
auuuucauauauacauaugc

SEQ ID NO: 12268 - RNA, 20 nt, Artificial Sequence
  TRAC targeting sequence
ggcgugggaacaaaugugcu

SEQ ID NO: 12269 - RNA, 20 nt, Artificial Sequence
  TRAC targeting sequence
cacgccagacaguuacaugu

SEQ ID NO: 12270 - RNA, 20 nt, Artificial Sequence
  TRAC targeting sequence
agcacauuuguucccacgcc

SEQ ID NO: 12271 - RNA, 20 nt, Artificial Sequence
  TRAC targeting sequence
ccagcacauuuguucccacg

SEQ ID NO: 12272 - RNA, 20 nt, Artificial Sequence
  TRAC targeting sequence
guuuuucuccagcacauuug

SEQ ID NO: 12273 - RNA, 20 nt, Artificial Sequence
  TRAC targeting sequence
uguccuuuuugucuuaacca

SEQ ID NO: 12274 - RNA, 20 nt, Artificial Sequence
  TRAC targeting sequence
uuuuugucuuaaccauuugg

SEQ ID NO: 12275 - RNA, 20 nt, Artificial Sequence
  TRAC targeting sequence
uaaccauuugggucagaagg

SEQ ID NO: 12276 - RNA, 20 nt, Artificial Sequence
  TRAC targeting sequence
gaaggucugacugaguagaa

SEQ ID NO: 12277 - RNA, 20 nt, Artificial Sequence
  TRAC targeting sequence
gacccaaaugguuaagacaa

SEQ ID NO: 12278 - RNA, 20 nt, Artificial Sequence
  TRAC targeting sequence
gacugaguagaacaugggcu

SEQ ID NO: 12279 - RNA, 20 nt, Artificial Sequence
  TRAC targeting sequence
gaccuucugacccaaauggu

SEQ ID NO: 12280 - RNA, 20 nt, Artificial Sequence
  TRAC targeting sequence
gucagaccuucugacccaaa

SEQ ID NO: 12281 - RNA, 20 nt, Artificial Sequence
  TRAC targeting sequence
acucagucagaccuucugac

SEQ ID NO: 12282 - RNA, 20 nt, Artificial Sequence
  TRAC targeting sequence
cccagcccauguucuacuca

SEQ ID NO: 12283 - RNA, 20 nt, Artificial Sequence
  TRAC targeting sequence
cccacugcagugcucaccca

SEQ ID NO: 12284 - RNA, 20 nt, Artificial Sequence
  TRAC targeting sequence
uucuccagcagcuuugucag

SEQ ID NO: 12285 - RNA, 20 nt, Artificial Sequence
  TRAC targeting sequence
ccagcagcuuugucagaauu

SEQ ID NO: 12286 - RNA, 20 nt, Artificial Sequence
  TRAC targeting sequence
agcagcuuugucagaauuau

SEQ ID NO: 12287 - RNA, 20 nt, Artificial Sequence
  TRAC targeting sequence
gaauuaugcucuuugcuggc

SEQ ID NO: 12288 - RNA, 20 nt, Artificial Sequence
  TRAC targeting sequence
gacaaagcugcuggagaagg

SEQ ID NO: 12289 - RNA, 20 nt, Artificial Sequence
  TRAC targeting sequence
uugcuggccuggucagaagg

SEQ ID NO: 12290 - RNA, 20 nt, Artificial Sequence
  TRAC targeting sequence
gaaggcagcuuugucaggag

SEQ ID NO: 12291 - RNA, 20 nt, Artificial Sequence
  TRAC targeting sequence
gaccaggccagcaaagagca

SEQ ID NO: 12292 - RNA, 20 nt, Artificial Sequence
  TRAC targeting sequence
ggagguggaaggaugaacua

SEQ ID NO: 12293 - RNA, 20 nt, Artificial Sequence
  TRAC targeting sequence
ugacaaagcugccuucugac

SEQ ID NO: 12294 - RNA, 20 nt, Artificial Sequence
  TRAC targeting sequence
accuccugacaaagcugccu

SEQ ID NO: 12295 - RNA, 20 nt, Artificial Sequence
  TRAC targeting sequence
uuccaccuccugacaaagcu

SEQ ID NO: 12296 - RNA, 20 nt, Artificial Sequence
  TRAC targeting sequence
uccuuccaccuccugacaaa

SEQ ID NO: 12297 - RNA, 20 nt, Artificial Sequence
  TRAC targeting sequence
gaagagccuuuccacuccga

SEQ ID NO: 12298 - RNA, 20 nt, Artificial Sequence
  TRAC targeting sequence
gagguuaacuaguucauccu

SEQ ID NO: 12299 - RNA, 20 nt, Artificial Sequence
  TRAC targeting sequence
ucugagguuaacuaguucau

SEQ ID NO: 12300 - RNA, 20 nt, Artificial Sequence
  TRAC targeting sequence
acuccgaccaugcugggaau

SEQ ID NO: 12301 - RNA, 20 nt, Artificial Sequence
  TRAC targeting sequence
gaccaugcugggaauagacc

SEQ ID NO: 12302 - RNA, 20 nt, Artificial Sequence
  TRAC targeting sequence
gaguggaaaggcucuucuga

SEQ ID NO: 12303 - RNA, 20 nt, Artificial Sequence
  TRAC targeting sequence
cagcauggucggaguggaaa

SEQ ID NO: 12304 - RNA, 20 nt, Artificial Sequence
  TRAC targeting sequence
auucccagcauggucggagu

SEQ ID NO: 12305 - RNA, 20 nt, Artificial Sequence
  TRAC targeting sequence
uuuccgcugccucuuuagcc

SEQ ID NO: 12306 - RNA, 20 nt, Artificial Sequence
  TRAC targeting sequence
gcugccucuuuagccaacgu

SEQ ID NO: 12307 - RNA, 20 nt, Artificial Sequence
  TRAC targeting sequence
uuagccaacgucccagcugg

SEQ ID NO: 12308 - RNA, 20 nt, Artificial Sequence
  TRAC targeting sequence
cagcuggaggagcacgccgg

SEQ ID NO: 12309 - RNA, 20 nt, Artificial Sequence
  TRAC targeting sequence
agcugggacguuggcuaaag

SEQ ID NO: 12310 - RNA, 20 nt, Artificial Sequence
  TRAC targeting sequence
uccagcugggacguuggcua

SEQ ID NO: 12311 - RNA, 20 nt, Artificial Sequence
  TRAC targeting sequence
ggccggcgugcuccuccagc

SEQ ID NO: 12312 - RNA, 20 nt, Artificial Sequence
  TRAC targeting sequence
ccaaaucuggccggcgugcu

SEQ ID NO: 12313 - RNA, 20 nt, Artificial Sequence
  TRAC targeting sequence
auccccaaaucuggccggcg

SEQ ID NO: 12314 - RNA, 20 nt, Artificial Sequence
  TRAC targeting sequence
cuuucaauccccaaaucugg

SEQ ID NO: 12315 - RNA, 20 nt, Artificial Sequence
  TRAC targeting sequence
ugauacacauuggccugguc

SEQ ID NO: 12316 - RNA, 20 nt, Artificial Sequence
  TRAC targeting sequence
ggaaaucccuuucaaucccc

SEQ ID NO: 12317 - RNA, 20 nt, Artificial Sequence
  TRAC targeting sequence
guuuugguaaagcuuucuau

SEQ ID NO: 12318 - RNA, 20 nt, Artificial Sequence
  TRAC targeting sequence
augacuguguaaugcuggca

SEQ ID NO: 12319 - RNA, 20 nt, Artificial Sequence
  TRAC targeting sequence
uagaaagcuuuaccaaaacc

SEQ ID NO: 12320 - RNA, 20 nt, Artificial Sequence
  TRAC targeting sequence
gcuuacgguuguugccagca

SEQ ID NO: 12321 - RNA, 20 nt, Artificial Sequence
  TRAC targeting sequence
ccaaaucagcuuacgguugu

SEQ ID NO: 12322 - RNA, 20 nt, Artificial Sequence
  TRAC targeting sequence
caauccccaaaucagcuuac

SEQ ID NO: 12323 - RNA, 20 nt, Artificial Sequence
  TRAC targeting sequence
gagugagucuucguguuaac

SEQ ID NO: 12324 - RNA, 20 nt, Artificial Sequence
  TRAC targeting sequence
gauuuacugccaggcuuguu

SEQ ID NO: 12325 - RNA, 20 nt, Artificial Sequence
  TRAC targeting sequence
cucggauuuacugccaggcu

SEQ ID NO: 12326 - RNA, 20 nt, Artificial Sequence
  TRAC targeting sequence
ucguguuaacucugucaaac

SEQ ID NO: 12327 - RNA, 20 nt, Artificial Sequence
  TRAC targeting sequence
uguuaacucugucaaaccug

SEQ ID NO: 12328 - RNA, 20 nt, Artificial Sequence
  TRAC targeting sequence
gucaaaccugucugugcagu

SEQ ID NO: 12329 - RNA, 20 nt, Artificial Sequence
  TRAC targeting sequence
aaccugucugugcaguuuga

SEQ ID NO: 12330 - RNA, 20 nt, Artificial Sequence
  TRAC targeting sequence
gugcaguuugaaauaucuca

SEQ ID NO: 12331 - RNA, 20 nt, Artificial Sequence
  TRAC targeting sequence
aacugcacagacagguuuga

SEQ ID NO: 12332 - RNA, 20 nt, Artificial Sequence
  TRAC targeting sequence
cagaaacugccuccuucuuu

SEQ ID NO: 12333 - RNA, 20 nt, Artificial Sequence
  TRAC targeting sequence
gaaacugccuccuucuuuuu

SEQ ID NO: 12334 - RNA, 20 nt, Artificial Sequence
  TRAC targeting sequence
gagauauuucaaacugcaca

SEQ ID NO: 12335 - RNA, 20 nt, Artificial Sequence
  TRAC targeting sequence
uucuuuuuuagcccugaggu

SEQ ID NO: 12336 - RNA, 20 nt, Artificial Sequence
  TRAC targeting sequence
uuuuuagcccugagguuuaa

SEQ ID NO: 12337 - RNA, 20 nt, Artificial Sequence
  TRAC targeting sequence
gggcuaaaaaagaaggaggc

SEQ ID NO: 12338 - RNA, 20 nt, Artificial Sequence
  TRAC targeting sequence
uaaaccucagggcuaaaaaa

SEQ ID NO: 12339 - RNA, 20 nt, Artificial Sequence
  TRAC targeting sequence
aguuauggcuaguguuuucu

SEQ ID NO: 12340 - RNA, 20 nt, Artificial Sequence
  TRAC targeting sequence
uccuguccaccaaagcugaa

SEQ ID NO: 12341 - RNA, 20 nt, Artificial Sequence
  TRAC targeting sequence
uguccaccaaagcugaaccc

SEQ ID NO: 12342 - RNA, 20 nt, Artificial Sequence
  TRAC targeting sequence
accaaagcugaacccuugcc

SEQ ID NO: 12343 - RNA, 20 nt, Artificial Sequence
  TRAC targeting sequence
gcuuugguggacaggaagaa

SEQ ID NO: 12344 - RNA, 20 nt, Artificial Sequence
  TRAC targeting sequence
aucaaaauaacuagauagag

SEQ ID NO: 12345 - RNA, 20 nt, Artificial Sequence
  TRAC targeting sequence
aaauaacuagauagagggau

SEQ ID NO: 12346 - RNA, 20 nt, Artificial Sequence
  TRAC targeting sequence
aguuauuuugauugaggggu

SEQ ID NO: 12347 - RNA, 20 nt, Artificial Sequence
  TRAC targeting sequence
aucuaguuauuuugauugag

SEQ ID NO: 12348 - RNA, 20 nt, Artificial Sequence
  TRAC targeting sequence
cucuaucuaguuauuuugau

SEQ ID NO: 12349 - RNA, 20 nt, Artificial Sequence
  TRAC targeting sequence
auaugagcaggguaggaagg

SEQ ID NO: 12350 - RNA, 20 nt, Artificial Sequence
  TRAC targeting sequence
uauggaucccucuaucuagu

SEQ ID NO: 12351 - RNA, 20 nt, Artificial Sequence
  TRAC targeting sequence
uacccugcucauauggaucc

SEQ ID NO: 12352 - RNA, 20 nt, Artificial Sequence
  TRAC targeting sequence
aauggccuuccuacccugcu

SEQ ID NO: 12353 - RNA, 20 nt, Artificial Sequence
  TRAC targeting sequence
gcuguuuucuuagagagcaa

SEQ ID NO: 12354 - RNA, 20 nt, Artificial Sequence
  TRAC targeting sequence
uagagagcaaauacauucgu

SEQ ID NO: 12355 - RNA, 20 nt, Artificial Sequence
  TRAC targeting sequence
aagaaaacagcugaacacuc

SEQ ID NO: 12356 - RNA, 20 nt, Artificial Sequence
  TRAC targeting sequence
cuaagaaaacagcugaacac

SEQ ID NO: 12357 - RNA, 20 nt, Artificial Sequence
  TRAC targeting sequence
ugcauuccaaaaaggccugu

SEQ ID NO: 12358 - RNA, 20 nt, Artificial Sequence
  TRAC targeting sequence
aaaaaggccugugugggagc

SEQ ID NO: 12359 - RNA, 20 nt, Artificial Sequence
  TRAC targeting sequence
cacacaggccuuuuuggaau

SEQ ID NO: 12360 - RNA, 20 nt, Artificial Sequence
  TRAC targeting sequence
gugcucccacacaggccuuu

SEQ ID NO: 12361 - RNA, 20 nt, Artificial Sequence
  TRAC targeting sequence
guaauauucagugcucccac

SEQ ID NO: 12362 - RNA, 20 nt, Artificial Sequence
  TRAC targeting sequence
ccuucuguaauauucagugc

SEQ ID NO: 12363 - RNA, 20 nt, Artificial Sequence
  TRAC targeting sequence
uggccgcuuuagucugcacu

SEQ ID NO: 12364 - RNA, 20 nt, Artificial Sequence
  TRAC targeting sequence
gcacuaugccaaccucaccg

SEQ ID NO: 12365 - RNA, 20 nt, Artificial Sequence
  TRAC targeting sequence
ccgugggccauugguaaaua

SEQ ID NO: 12366 - RNA, 20 nt, Artificial Sequence
  TRAC targeting sequence
ggccaaagacaggucaagug

SEQ ID NO: 12367 - RNA, 20 nt, Artificial Sequence
  TRAC targeting sequence
uuggccagaaagcaacagua

SEQ ID NO: 12368 - RNA, 20 nt, Artificial Sequence
  TRAC targeting sequence
agugcugggaacucucggga

SEQ ID NO: 12369 - RNA, 20 nt, Artificial Sequence
  TRAC targeting sequence
cagcacuugaccugucuuug

SEQ ID NO: 12370 - RNA, 20 nt, Artificial Sequence
  TRAC targeting sequence
cgggacucacagucacgcua

SEQ ID NO: 12371 - RNA, 20 nt, Artificial Sequence
  TRAC targeting sequence
ggacucacagucacgcuagu

SEQ ID NO: 12372 - RNA, 20 nt, Artificial Sequence
  TRAC targeting sequence
cgagaguucccagcacuuga

SEQ ID NO: 12373 - RNA, 20 nt, Artificial Sequence
  TRAC targeting sequence
cagucacgcuagugaccgug

SEQ ID NO: 12374 - RNA, 20 nt, Artificial Sequence
  TRAC targeting sequence
cgcuagugaccgugcuagag

SEQ ID NO: 12375 - RNA, 20 nt, Artificial Sequence
  TRAC targeting sequence
cuagcgugacugugaguccc

SEQ ID NO: 12376 - RNA, 20 nt, Artificial Sequence
  TRAC targeting sequence
agcacggucacuagcgugac

SEQ ID NO: 12377 - RNA, 20 nt, Artificial Sequence
  TRAC targeting sequence
ccccacuguggauuauccag

SEQ ID NO: 12378 - RNA, 20 nt, Artificial Sequence
  TRAC targeting sequence
ccacuguggauuauccagaa

SEQ ID NO: 12379 - RNA, 20 nt, Artificial Sequence
  TRAC targeting sequence
acaguggggagaugugcucu

SEQ ID NO: 12380 - RNA, 20 nt, Artificial Sequence
  TRAC targeting sequence
agaaugacucaaacuugcga

SEQ ID NO: 12381 - RNA, 20 nt, Artificial Sequence
  TRAC targeting sequence
ggauaauccacaguggggag

SEQ ID NO: 12382 - RNA, 20 nt, Artificial Sequence
  TRAC targeting sequence
uucuggauaauccacagugg

SEQ ID NO: 12383 - RNA, 20 nt, Artificial Sequence
  TRAC targeting sequence
aacuugcgauauaacuccug

SEQ ID NO: 12384 - RNA, 20 nt, Artificial Sequence
  TRAC targeting sequence
caaguuugagucauucugga

SEQ ID NO: 12385 - RNA, 20 nt, Artificial Sequence
  TRAC targeting sequence
ugcaucucucaguucucuuu

SEQ ID NO: 12386 - RNA, 20 nt, Artificial Sequence
  TRAC targeting sequence
cucaguucucuuuggcuuag

SEQ ID NO: 12387 - RNA, 20 nt, Artificial Sequence
  TRAC targeting sequence
caguucucuuuggcuuagag

SEQ ID NO: 12388 - RNA, 20 nt, Artificial Sequence
  TRAC targeting sequence
guucucuuuggcuuagagcc

SEQ ID NO: 12389 - RNA, 20 nt, Artificial Sequence
  TRAC targeting sequence
cuuuggcuuagagccuuauu

SEQ ID NO: 12390 - RNA, 20 nt, Artificial Sequence
  TRAC targeting sequence
uuggcuuagagccuuauugu

SEQ ID NO: 12391 - RNA, 20 nt, Artificial Sequence
  TRAC targeting sequence
aagccaaagagaacugagag

SEQ ID NO: 12392 - RNA, 20 nt, Artificial Sequence
  TRAC targeting sequence
acaauaaggcucuaagccaa

SEQ ID NO: 12393 - RNA, 20 nt, Artificial Sequence
  TRAC targeting sequence
agcaaauccacaauaaggcu

SEQ ID NO: 12394 - RNA, 20 nt, Artificial Sequence
  TRAC targeting sequence
uguuaccucuagcaaaucca

SEQ ID NO: 12395 - RNA, 20 nt, Artificial Sequence
  TRAC targeting sequence
uuuccuguuaccucuagcaa

SEQ ID NO: 12396 - RNA, 20 nt, Artificial Sequence
  TRAC targeting sequence
guuccuuuccuguuaccucu

SEQ ID NO: 12397 - RNA, 20 nt, Artificial Sequence
  TRAC targeting sequence
uccuaauucuagccucuucu

SEQ ID NO: 12398 - RNA, 20 nt, Artificial Sequence
  TRAC targeting sequence
uaauucuagccucuucugag

SEQ ID NO: 12399 - RNA, 20 nt, Artificial Sequence
  TRAC targeting sequence
agccucuucugagaaguuau

SEQ ID NO: 12400 - RNA, 20 nt, Artificial Sequence
  TRAC targeting sequence
ucugagaaguuauucucugc

SEQ ID NO: 12401 - RNA, 20 nt, Artificial Sequence
  TRAC targeting sequence
gagaaguuauucucugcaag

SEQ ID NO: 12402 - RNA, 20 nt, Artificial Sequence
  TRAC targeting sequence
gaagaggcuagaauuaggau

SEQ ID NO: 12403 - RNA, 20 nt, Artificial Sequence
  TRAC targeting sequence
cagaagaggcuagaauuagg

SEQ ID NO: 12404 - RNA, 20 nt, Artificial Sequence
  TRAC targeting sequence
cugcaagagucuucaggagc

SEQ ID NO: 12405 - RNA, 20 nt, Artificial Sequence
  TRAC targeting sequence
gcaagagucuucaggagcau

SEQ ID NO: 12406 - RNA, 20 nt, Artificial Sequence
  TRAC targeting sequence
ugcagagaauaacuucucag

SEQ ID NO: 12407 - RNA, 20 nt, Artificial Sequence
  TRAC targeting sequence
ucaggagcaucuuacagacc

SEQ ID NO: 12408 - RNA, 20 nt, Artificial Sequence
  TRAC targeting sequence
ggagcaucuuacagaccacc

SEQ ID NO: 12409 - RNA, 20 nt, Artificial Sequence
  TRAC targeting sequence
ugaagacucuugcagagaau

SEQ ID NO: 12410 - RNA, 20 nt, Artificial Sequence
  TRAC targeting sequence
uacagaccaccuacacuauu

SEQ ID NO: 12411 - RNA, 20 nt, Artificial Sequence
  TRAC targeting sequence
guaagaugcuccugaagacu

SEQ ID NO: 12412 - RNA, 20 nt, Artificial Sequence
  TRAC targeting sequence
gaauuuuguuccgcacacca

SEQ ID NO: 12413 - RNA, 20 nt, Artificial Sequence
  TRAC targeting sequence
gaauaguguagguggucugu

SEQ ID NO: 12414 - RNA, 20 nt, Artificial Sequence
  TRAC targeting sequence
gcacaccacauuguguuccc

SEQ ID NO: 12415 - RNA, 20 nt, Artificial Sequence
  TRAC targeting sequence
cagcaguguuugcuguggcu

SEQ ID NO: 12416 - RNA, 20 nt, Artificial Sequence
  TRAC targeting sequence
ugagucaguucuggagcucc

SEQ ID NO: 12417 - RNA, 20 nt, Artificial Sequence
  TRAC targeting sequence
ggaccuggccccagccaaag

SEQ ID NO: 12418 - RNA, 20 nt, Artificial Sequence
  TRAC targeting sequence
guucuggagcuccaggcuug

SEQ ID NO: 12419 - RNA, 20 nt, Artificial Sequence
  TRAC targeting sequence
ggagcuccaggcuuggcaaa

SEQ ID NO: 12420 - RNA, 20 nt, Artificial Sequence
  TRAC targeting sequence
agaacugacucaggaccugg

SEQ ID NO: 12421 - RNA, 20 nt, Artificial Sequence
  TRAC targeting sequence
aggcuuggcaaagcuggaua

SEQ ID NO: 12422 - RNA, 20 nt, Artificial Sequence
  TRAC targeting sequence
agcuuugccaagccuggagc

SEQ ID NO: 12423 - RNA, 20 nt, Artificial Sequence
  TRAC targeting sequence
ccuugcccuuauccagcuuu

SEQ ID NO: 12424 - RNA, 20 nt, Artificial Sequence
  TRAC targeting sequence
gcuguacaacuccccuugcc

SEQ ID NO: 12425 - RNA, 20 nt, Artificial Sequence
  TRAC targeting sequence
ggaaagacaucuuugauaua

SEQ ID NO: 12426 - RNA, 20 nt, Artificial Sequence
  TRAC targeting sequence
ugaagcccuuugguucugcu

SEQ ID NO: 12427 - RNA, 20 nt, Artificial Sequence
  TRAC targeting sequence
uuccugaagcccuuugguuc

SEQ ID NO: 12428 - RNA, 20 nt, Artificial Sequence
  TRAC targeting sequence
uugauauagacauuaaugaa

SEQ ID NO: 12429 - RNA, 20 nt, Artificial Sequence
  TRAC targeting sequence
aagaugucuuuccugaagcc

SEQ ID NO: 12430 - RNA, 20 nt, Artificial Sequence
  TRAC targeting sequence
auaucaaagaugucuuuccu

SEQ ID NO: 12431 - RNA, 20 nt, Artificial Sequence
  TRAC targeting sequence
uuaaugucuauaucaaagau

SEQ ID NO: 12432 - RNA, 20 nt, Artificial Sequence
  TRAC targeting sequence
aaaugggcuucuauaugcua

SEQ ID NO: 12433 - RNA, 20 nt, Artificial Sequence
  TRAC targeting sequence
auaugcuaaccugauaagac

SEQ ID NO: 12434 - RNA, 20 nt, Artificial Sequence
  TRAC targeting sequence
gguuagcauauagaagccca

SEQ ID NO: 12435 - RNA, 20 nt, Artificial Sequence
  TRAC targeting sequence
uaucagguuagcauauagaa

SEQ ID NO: 12436 - RNA, 20 nt, Artificial Sequence
  TRAC targeting sequence
cuggggagaaggucaugcuu

SEQ ID NO: 12437 - RNA, 20 nt, Artificial Sequence
  TRAC targeting sequence
ggggagaaggucaugcuuuc

SEQ ID NO: 12438 - RNA, 20 nt, Artificial Sequence
  TRAC targeting sequence
ccagagagucuuaucagguu

SEQ ID NO: 12439 - RNA, 20 nt, Artificial Sequence
  TRAC targeting sequence
ccccagagagucuuaucagg

SEQ ID NO: 12440 - RNA, 20 nt, Artificial Sequence
  TRAC targeting sequence
ugcuuuccuuugcagcucua

SEQ ID NO: 12441 - RNA, 20 nt, Artificial Sequence
  TRAC targeting sequence
uuugcagcucuaaauauaag

SEQ ID NO: 12442 - RNA, 20 nt, Artificial Sequence
  TRAC targeting sequence
aaauauaagacacaugcaga

SEQ ID NO: 12443 - RNA, 20 nt, Artificial Sequence
  TRAC targeting sequence
uauauuuagagcugcaaagg

SEQ ID NO: 12444 - RNA, 20 nt, Artificial Sequence
  TRAC targeting sequence
gcaugugucuuauauuuaga

SEQ ID NO: 12445 - RNA, 20 nt, Artificial Sequence
  TRAC targeting sequence
uuuuuuuuuucugcaugugu

SEQ ID NO: 12446 - RNA, 20 nt, Artificial Sequence
  TRAC targeting sequence
cauucuuuuuuuuuuucugc

SEQ ID NO: 12447 - RNA, 20 nt, Artificial Sequence
  TRAC targeting sequence
guuacagugccaaaaugaag

SEQ ID NO: 12448 - RNA, 20 nt, Artificial Sequence
  TRAC targeting sequence
uuuuggcacuguaacagaca

SEQ ID NO: 12449 - RNA, 20 nt, Artificial Sequence
  TRAC targeting sequence
ucauuuuggcacuguaacag

SEQ ID NO: 12450 - RNA, 20 nt, Artificial Sequence
  TRAC targeting sequence
guauaaauauuagauuuguc

SEQ ID NO: 12451 - RNA, 20 nt, Artificial Sequence
  TRAC targeting sequence
aauauuuauacugauuaucu

SEQ ID NO: 12452 - RNA, 20 nt, Artificial Sequence
  TRAC targeting sequence
uaauauuaaguuuaugaaau

SEQ ID NO: 12453 - RNA, 20 nt, Artificial Sequence
  TRAC targeting sequence
uaaacuuaauauuaagacaa

SEQ ID NO: 12454 - RNA, 20 nt, Artificial Sequence
  TRAC targeting sequence
uucagaagaacuaucucagg

SEQ ID NO: 12455 - RNA, 20 nt, Artificial Sequence
  TRAC targeting sequence
gaagaacuaucucaggauau

SEQ ID NO: 12456 - RNA, 20 nt, Artificial Sequence
  TRAC targeting sequence
gaaagacuuacauuucauaa

SEQ ID NO: 12457 - RNA, 20 nt, Artificial Sequence
  TRAC targeting sequence
ucugaaagacuuacauuuca

SEQ ID NO: 12458 - RNA, 20 nt, Artificial Sequence
  TRAC targeting sequence
caggauauauuuauuagguc

SEQ ID NO: 12459 - RNA, 20 nt, Artificial Sequence
  TRAC targeting sequence
ggauauauuuauuaggucaa

SEQ ID NO: 12460 - RNA, 20 nt, Artificial Sequence
  TRAC targeting sequence
ugagauaguucuucugaaag

SEQ ID NO: 12461 - RNA, 20 nt, Artificial Sequence
  TRAC targeting sequence
augaaauauuuuauccaugu

SEQ ID NO: 12462 - RNA, 20 nt, Artificial Sequence
  TRAC targeting sequence
uugaccuaauaaauauaucc

SEQ ID NO: 12463 - RNA, 20 nt, Artificial Sequence
  TRAC targeting sequence
augugacugguauacacacu

SEQ ID NO: 12464 - RNA, 20 nt, Artificial Sequence
  TRAC targeting sequence
cauggauaaaauauuucauu

SEQ ID NO: 12465 - RNA, 20 nt, Artificial Sequence
  TRAC targeting sequence
aaggagaacccaaaauggca

SEQ ID NO: 12466 - RNA, 20 nt, Artificial Sequence
  TRAC targeting sequence
uuugaaguguguauaccagu

SEQ ID NO: 12467 - RNA, 20 nt, Artificial Sequence
  TRAC targeting sequence
ccuuugaaguguguauacca

SEQ ID NO: 12468 - RNA, 20 nt, Artificial Sequence
  TRAC targeting sequence
ccugccugccauuuuggguu

SEQ ID NO: 12469 - RNA, 20 nt, Artificial Sequence
  TRAC targeting sequence
uuagccacccuccccugccu

SEQ ID NO: 12470 - RNA, 20 nt, Artificial Sequence
  TRAC targeting sequence
uaacuacuaugccauaccuu

SEQ ID NO: 12471 - RNA, 20 nt, Artificial Sequence
  TRAC targeting sequence
uauucuuaacuacuaugcca

SEQ ID NO: 12472 - RNA, 20 nt, Artificial Sequence
  TRAC targeting sequence
aaaauucauauucuuaacua

SEQ ID NO: 12473 - RNA, 20 nt, Artificial Sequence
  TRAC targeting sequence
uaauucagaagguuacuuaa

SEQ ID NO: 12474 - RNA, 20 nt, Artificial Sequence
  TRAC targeting sequence
gaagguuacuuaaucucuuu

SEQ ID NO: 12475 - RNA, 20 nt, Artificial Sequence
  TRAC targeting sequence
gaauuaggauuuacccaaac

SEQ ID NO: 12476 - RNA, 20 nt, Artificial Sequence
  TRAC targeting sequence
cuuuaugccucuuuuuucuc

SEQ ID NO: 12477 - RNA, 20 nt, Artificial Sequence
  TRAC targeting sequence
uuaugccucuuuuuucucau

SEQ ID NO: 12478 - RNA, 20 nt, Artificial Sequence
  TRAC targeting sequence
uuuuucucaucuguaaaaug

SEQ ID NO: 12479 - RNA, 20 nt, Artificial Sequence
  TRAC targeting sequence
caucuguaaaauggggaugg

SEQ ID NO: 12480 - RNA, 20 nt, Artificial Sequence
  TRAC targeting sequence
ucuguaaaauggggauggua

SEQ ID NO: 12481 - RNA, 20 nt, Artificial Sequence
  TRAC targeting sequence
guaaaauggggaugguaaua

SEQ ID NO: 12482 - RNA, 20 nt, Artificial Sequence
  TRAC targeting sequence
ccauuuuacagaugagaaaa

SEQ ID NO: 12483 - RNA, 20 nt, Artificial Sequence
  TRAC targeting sequence
cugagauguuacgagauuua

SEQ ID NO: 12484 - RNA, 20 nt, Artificial Sequence
  TRAC targeting sequence
gugagcuagguacuauuacc

SEQ ID NO: 12485 - RNA, 20 nt, Artificial Sequence
  TRAC targeting sequence
cagugagcuagguacuauua

SEQ ID NO: 12486 - RNA, 20 nt, Artificial Sequence
  TRAC targeting sequence
uaacaucucagugagcuagg

SEQ ID NO: 12487 - RNA, 20 nt, Artificial Sequence
  TRAC targeting sequence
cguaacaucucagugagcua

SEQ ID NO: 12488 - RNA, 20 nt, Artificial Sequence
  TRAC targeting sequence
uuaaaucucguaacaucuca

SEQ ID NO: 12489 - RNA, 20 nt, Artificial Sequence
  TRAC targeting sequence
auuauagguauuagcucuuu

SEQ ID NO: 12490 - RNA, 20 nt, Artificial Sequence
  TRAC targeting sequence
ggcugccauuaugcaaaguc

SEQ ID NO: 12491 - RNA, 20 nt, Artificial Sequence
  TRAC targeting sequence
aucgggcugccauuaugcaa

SEQ ID NO: 12492 - RNA, 20 nt, Artificial Sequence
  TRAC targeting sequence
guuaauauguuuuuauugcu

SEQ ID NO: 12493 - RNA, 20 nt, Artificial Sequence
  TRAC targeting sequence
gguugcuggagggaaggaag

SEQ ID NO: 12494 - RNA, 20 nt, Artificial Sequence
  TRAC targeting sequence
agcaaccugacauaguagca

SEQ ID NO: 12495 - RNA, 20 nt, Artificial Sequence
  TRAC targeting sequence
cuccagcaaccugacauagu

SEQ ID NO: 12496 - RNA, 20 nt, Artificial Sequence
  TRAC targeting sequence
uucccuccagcaaccugaca

SEQ ID NO: 12497 - RNA, 20 nt, Artificial Sequence
  TRAC targeting sequence
uccuucccuccagcaaccug

SEQ ID NO: 12498 - RNA, 20 nt, Artificial Sequence
  TRAC targeting sequence
auuuuucuuccuucccucca

SEQ ID NO: 12499 - RNA, 20 nt, Artificial Sequence
  TRAC targeting sequence
uuuccauuuuucuuccuucc

SEQ ID NO: 12500 - RNA, 20 nt, Artificial Sequence
  TRAC targeting sequence
ccauuuauaguuuuuguaaa

SEQ ID NO: 12501 - RNA, 20 nt, Artificial Sequence
  TRAC targeting sequence
aaugcuguacuuuacaaaaa

SEQ ID NO: 12502 - RNA, 20 nt, Artificial Sequence
  TRAC targeting sequence
agcaacacaggcaaacuaau

SEQ ID NO: 12503 - RNA, 20 nt, Artificial Sequence
  TRAC targeting sequence
uugggcaagggacaacuuua

SEQ ID NO: 12504 - RNA, 20 nt, Artificial Sequence
  TRAC targeting sequence
cuugcccaaagauuaguuug

SEQ ID NO: 12505 - RNA, 20 nt, Artificial Sequence
  TRAC targeting sequence
ggauguuucuaagugaagug

SEQ ID NO: 12506 - RNA, 20 nt, Artificial Sequence
  TRAC targeting sequence
agaccuaccugguuuuacuu

SEQ ID NO: 12507 - RNA, 20 nt, Artificial Sequence
  TRAC targeting sequence
aagugaagugcaguuaucca

SEQ ID NO: 12508 - RNA, 20 nt, Artificial Sequence
  TRAC targeting sequence
cuuagaaacauccagaccua

SEQ ID NO: 12509 - RNA, 20 nt, Artificial Sequence
  TRAC targeting sequence
acucuguucguuuuuuguuu

SEQ ID NO: 12510 - RNA, 20 nt, Artificial Sequence
  TRAC targeting sequence
guucguuuuuuguuuaaucu

SEQ ID NO: 12511 - RNA, 20 nt, Artificial Sequence
  TRAC targeting sequence
uuuuuuguuuaaucuucucu

SEQ ID NO: 12512 - RNA, 20 nt, Artificial Sequence
  TRAC targeting sequence
ucucugucucaacuucuaac

SEQ ID NO: 12513 - RNA, 20 nt, Artificial Sequence
  TRAC targeting sequence
cugucucaacuucuaaccaa

SEQ ID NO: 12514 - RNA, 20 nt, Artificial Sequence
  TRAC targeting sequence
gucucaacuucuaaccaaaa

SEQ ID NO: 12515 - RNA, 20 nt, Artificial Sequence
  TRAC targeting sequence
caacuucuaaccaaaaacuc

SEQ ID NO: 12516 - RNA, 20 nt, Artificial Sequence
  TRAC targeting sequence
acuucuaaccaaaaacucuu

SEQ ID NO: 12517 - RNA, 20 nt, Artificial Sequence
  TRAC targeting sequence
aaccaaaaacucuuacucuu

SEQ ID NO: 12518 - RNA, 20 nt, Artificial Sequence
  TRAC targeting sequence
uacucuuagguuauauuuuc

SEQ ID NO: 12519 - RNA, 20 nt, Artificial Sequence
  TRAC targeting sequence
uagguuauauuuuccuuuua

SEQ ID NO: 12520 - RNA, 20 nt, Artificial Sequence
  TRAC targeting sequence
uuuuauaaaaguaaguagaa

SEQ ID NO: 12521 - RNA, 20 nt, Artificial Sequence
  TRAC targeting sequence
acuuacuuuuauaaaaggaa

SEQ ID NO: 12522 - RNA, 20 nt, Artificial Sequence
  TRAC targeting sequence
gguugauaugauccuuucua

SEQ ID NO: 12523 - RNA, 20 nt, Artificial Sequence
  TRAC targeting sequence
accagacuuuacacacauuc

SEQ ID NO: 12524 - RNA, 20 nt, Artificial Sequence
  TRAC targeting sequence
uaucaaccagacuuuacaca

SEQ ID NO: 12525 - RNA, 20 nt, Artificial Sequence
  TRAC targeting sequence
uuucuaacucacuugguuuc

SEQ ID NO: 12526 - RNA, 20 nt, Artificial Sequence
  TRAC targeting sequence
aacucacuugguuucagcua

SEQ ID NO: 12527 - RNA, 20 nt, Artificial Sequence
  TRAC targeting sequence
cuugguuucagcuaguggca

SEQ ID NO: 12528 - RNA, 20 nt, Artificial Sequence
  TRAC targeting sequence
gcuaguggcaaaaagaaggg

SEQ ID NO: 12529 - RNA, 20 nt, Artificial Sequence
  TRAC targeting sequence
uuuugccacuagcugaaacc

SEQ ID NO: 12530 - RNA, 20 nt, Artificial Sequence
  TRAC targeting sequence
aauacacccuucuuuuugcc

SEQ ID NO: 12531 - RNA, 20 nt, Artificial Sequence
  TRAC targeting sequence
ggaauucuuagguuaaggcu

SEQ ID NO: 12532 - RNA, 20 nt, Artificial Sequence
  TRAC targeting sequence
agauccaauacacccuucuu

SEQ ID NO: 12533 - RNA, 20 nt, Artificial Sequence
  TRAC targeting sequence
uagguuaaggcugagagaau

SEQ ID NO: 12534 - RNA, 20 nt, Artificial Sequence
  TRAC targeting sequence
gccuuaaccuaagaauucca

SEQ ID NO: 12535 - RNA, 20 nt, Artificial Sequence
  TRAC targeting sequence
cagccuuaaccuaagaauuc

SEQ ID NO: 12536 - RNA, 20 nt, Artificial Sequence
  TRAC targeting sequence
cucagccuuaaccuaagaau

SEQ ID NO: 12537 - RNA, 20 nt, Artificial Sequence
  TRAC targeting sequence
cauucucucagccuuaaccu

SEQ ID NO: 12538 - RNA, 20 nt, Artificial Sequence
  TRAC targeting sequence
gccaaacucacauucucuca

SEQ ID NO: 12539 - RNA, 20 nt, Artificial Sequence
  TRAC targeting sequence
aagucagccaaacucacauu

SEQ ID NO: 12540 - RNA, 20 nt, Artificial Sequence
  TRAC targeting sequence
uccaagucagccaaacucac

SEQ ID NO: 12541 - RNA, 20 nt, Artificial Sequence
  TRAC targeting sequence
aaugugggugguucacacaa

SEQ ID NO: 12542 - RNA, 20 nt, Artificial Sequence
  TRAC targeting sequence
cacaaaagaaggugauuuuu

SEQ ID NO: 12543 - RNA, 20 nt, Artificial Sequence
  TRAC targeting sequence
uuugugugaaccacccacau

SEQ ID NO: 12544 - RNA, 20 nt, Artificial Sequence
  TRAC targeting sequence
ccuucuuuugugugaaccac

SEQ ID NO: 12545 - RNA, 20 nt, Artificial Sequence
  TRAC targeting sequence
uaauaauauacuaaaguaga

SEQ ID NO: 12546 - RNA, 20 nt, Artificial Sequence
  TRAC targeting sequence
acuuuaguauauuauuauga

SEQ ID NO: 12547 - RNA, 20 nt, Artificial Sequence
  TRAC targeting sequence
acccuugugaccaccagaau

SEQ ID NO: 12548 - RNA, 20 nt, Artificial Sequence
  TRAC targeting sequence
caaggguggauucuacuuua

SEQ ID NO: 12549 - RNA, 20 nt, Artificial Sequence
  TRAC targeting sequence
gguggucacaaggguggauu

SEQ ID NO: 12550 - RNA, 20 nt, Artificial Sequence
  TRAC targeting sequence
aguacagucuuccaaggaca

SEQ ID NO: 12551 - RNA, 20 nt, Artificial Sequence
  TRAC targeting sequence
uccaaggacaaaauggguag

SEQ ID NO: 12552 - RNA, 20 nt, Artificial Sequence
  TRAC targeting sequence
aaggacaaaauggguagcau

SEQ ID NO: 12553 - RNA, 20 nt, Artificial Sequence
  TRAC targeting sequence
uuggaagacuguacuugaau

SEQ ID NO: 12554 - RNA, 20 nt, Artificial Sequence
  TRAC targeting sequence
augcuacccauuuuguccuu

SEQ ID NO: 12555 - RNA, 20 nt, Artificial Sequence
  TRAC targeting sequence
uuuccaugcuacccauuuug

SEQ ID NO: 12556 - RNA, 20 nt, Artificial Sequence
  TRAC targeting sequence
ccccaaaaaaacauaucauu

SEQ ID NO: 12557 - RNA, 20 nt, Artificial Sequence
  TRAC targeting sequence
ccauguuuuuuccccccaaa

SEQ ID NO: 12558 - RNA, 20 nt, Artificial Sequence
  TRAC targeting sequence
ccccauguuuuuucccccca

SEQ ID NO: 12559 - RNA, 20 nt, Artificial Sequence
  TRAC targeting sequence
cuccccauguuuuuuccccc

SEQ ID NO: 12560 - RNA, 20 nt, Artificial Sequence
  TRAC targeting sequence
cucuccccauguuuuuuccc

SEQ ID NO: 12561 - RNA, 20 nt, Artificial Sequence
  TRAC targeting sequence
cucucuccccauguuuuuuc

SEQ ID NO: 12562 - RNA, 20 nt, Artificial Sequence
  TRAC targeting sequence
cucucucuccccauguuuuu

SEQ ID NO: 12563 - RNA, 20 nt, Artificial Sequence
  TRAC targeting sequence
ccuuucucucucucucccca

SEQ ID NO: 12564 - RNA, 20 nt, Artificial Sequence
  TRAC targeting sequence
ggauuguuaggaaacaugga

SEQ ID NO: 12565 - RNA, 20 nt, Artificial Sequence
  TRAC targeting sequence
agacaacuaauaguccccuu

SEQ ID NO: 12566 - RNA, 20 nt, Artificial Sequence
  TRAC targeting sequence
uaacaauccagacaacuaau

SEQ ID NO: 12567 - RNA, 20 nt, Artificial Sequence
  TRAC targeting sequence
auguuuccuaacaauccaga

SEQ ID NO: 12568 - RNA, 20 nt, Artificial Sequence
  TRAC targeting sequence
uccauguuuccuaacaaucc

SEQ ID NO: 12569 - RNA, 20 nt, Artificial Sequence
  TRAC targeting sequence
uguuguaagguuuggcaaag

SEQ ID NO: 12570 - RNA, 20 nt, Artificial Sequence
  TRAC targeting sequence
ccaaguagaaguccaaaugu

SEQ ID NO: 12571 - RNA, 20 nt, Artificial Sequence
  TRAC targeting sequence
acuuggugauaaccuuugcc

SEQ ID NO: 12572 - RNA, 20 nt, Artificial Sequence
  TRAC targeting sequence
aaauguguguaacauacccc

SEQ ID NO: 12573 - RNA, 20 nt, Artificial Sequence
  TRAC targeting sequence
auaacguuugccagggguau

SEQ ID NO: 12574 - RNA, 20 nt, Artificial Sequence
  TRAC targeting sequence
ucuauaacguuugccagggg

SEQ ID NO: 12575 - RNA, 20 nt, Artificial Sequence
  TRAC targeting sequence
uucuucuauaacguuugcca

SEQ ID NO: 12576 - RNA, 20 nt, Artificial Sequence
  TRAC targeting sequence
cgccuguaaucccagcacuu

SEQ ID NO: 12577 - RNA, 20 nt, Artificial Sequence
  TRAC targeting sequence
cagcacuuugggaggccgag

SEQ ID NO: 12578 - RNA, 20 nt, Artificial Sequence
  TRAC targeting sequence
caaagugcugggauuacagg

SEQ ID NO: 12579 - RNA, 20 nt, Artificial Sequence
  TRAC targeting sequence
gccucccaaagugcugggau

SEQ ID NO: 12580 - RNA, 20 nt, Artificial Sequence
  TRAC targeting sequence
acccgccucggccucccaaa

SEQ ID NO: 12581 - RNA, 20 nt, Artificial Sequence
  TRAC targeting sequence
cgaggucaggaguucgagac

SEQ ID NO: 12582 - RNA, 20 nt, Artificial Sequence
  TRAC targeting sequence
ugauccacccgccucggccu

SEQ ID NO: 12583 - RNA, 20 nt, Artificial Sequence
  TRAC targeting sequence
ggaguucgagaccauccugg

SEQ ID NO: 12584 - RNA, 20 nt, Artificial Sequence
  TRAC targeting sequence
ugaccucgugauccacccgc

SEQ ID NO: 12585 - RNA, 20 nt, Artificial Sequence
  TRAC targeting sequence
agaccauccuggcuaacaca

SEQ ID NO: 12586 - RNA, 20 nt, Artificial Sequence
  TRAC targeting sequence
aacuccugaccucgugaucc

SEQ ID NO: 12587 - RNA, 20 nt, Artificial Sequence
  TRAC targeting sequence
cgaacuccugaccucgugau

SEQ ID NO: 12588 - RNA, 20 nt, Artificial Sequence
  TRAC targeting sequence
uggcuaacacagugaaaccc

SEQ ID NO: 12589 - RNA, 20 nt, Artificial Sequence
  TRAC targeting sequence
cuguguuagccaggaugguc

SEQ ID NO: 12590 - RNA, 20 nt, Artificial Sequence
  TRAC targeting sequence
cuacuaaaaaaaaauacaaa

SEQ ID NO: 12591 - RNA, 20 nt, Artificial Sequence
  TRAC targeting sequence
acuaaaaaaaaauacaaaaa

SEQ ID NO: 12592 - RNA, 20 nt, Artificial Sequence
  TRAC targeting sequence
caacuacuacagaggcugag

SEQ ID NO: 12593 - RNA, 20 nt, Artificial Sequence
  TRAC targeting sequence
guaguaguugggacuacagg

SEQ ID NO: 12594 - RNA, 20 nt, Artificial Sequence
  TRAC targeting sequence
gccucuguaguaguugggac

SEQ ID NO: 12595 - RNA, 20 nt, Artificial Sequence
  TRAC targeting sequence
ugccucagccucuguaguag

SEQ ID NO: 12596 - RNA, 20 nt, Artificial Sequence
  TRAC targeting sequence
ccugccucagccucuguagu

SEQ ID NO: 12597 - RNA, 20 nt, Artificial Sequence
  TRAC targeting sequence
cgccauucuccugccucagc

SEQ ID NO: 12598 - RNA, 20 nt, Artificial Sequence
  TRAC targeting sequence
cagguucacgccauucuccu

SEQ ID NO: 12599 - RNA, 20 nt, Artificial Sequence
  TRAC targeting sequence
accucccagguucacgccau

SEQ ID NO: 12600 - RNA, 20 nt, Artificial Sequence
  TRAC targeting sequence
gcaguggcacaaacuccacc

SEQ ID NO: 12601 - RNA, 20 nt, Artificial Sequence
  TRAC targeting sequence
cagcaguggcacaaacucca

SEQ ID NO: 12602 - RNA, 20 nt, Artificial Sequence
  TRAC targeting sequence
cgccacugcacuccagcgug

SEQ ID NO: 12603 - RNA, 20 nt, Artificial Sequence
  TRAC targeting sequence
agcgugcgcgacagagugag

SEQ ID NO: 12604 - RNA, 20 nt, Artificial Sequence
  TRAC targeting sequence
cgcacgcuggagugcagugg

SEQ ID NO: 12605 - RNA, 20 nt, Artificial Sequence
  TRAC targeting sequence
gucgcgcacgcuggagugca

SEQ ID NO: 12606 - RNA, 20 nt, Artificial Sequence
  TRAC targeting sequence
cucugucgcgcacgcuggag

SEQ ID NO: 12607 - RNA, 20 nt, Artificial Sequence
  TRAC targeting sequence
cacucugucgcgcacgcugg

SEQ ID NO: 12608 - RNA, 20 nt, Artificial Sequence
  TRAC targeting sequence
aucucaaaaaaagaagaagg

SEQ ID NO: 12609 - RNA, 20 nt, Artificial Sequence
  TRAC targeting sequence
caaaaaaagaagaaggaagc

SEQ ID NO: 12610 - RNA, 20 nt, Artificial Sequence
  TRAC targeting sequence
aaaaaagaagaaggaagcug

SEQ ID NO: 12611 - RNA, 20 nt, Artificial Sequence
  TRAC targeting sequence
uuuuuugagauggagucuca

SEQ ID NO: 12612 - RNA, 20 nt, Artificial Sequence
  TRAC targeting sequence
ucuuuuuuugagauggaguc

SEQ ID NO: 12613 - RNA, 20 nt, Artificial Sequence
  TRAC targeting sequence
uucuucuuuuuuugagaugg

SEQ ID NO: 12614 - RNA, 20 nt, Artificial Sequence
  TRAC targeting sequence
cagcuuccuucuucuuuuuu

SEQ ID NO: 12615 - RNA, 20 nt, Artificial Sequence
  TRAC targeting sequence
cucaccuguaaucucagcau

SEQ ID NO: 12616 - RNA, 20 nt, Artificial Sequence
  TRAC targeting sequence
caccuguaaucucagcauuu

SEQ ID NO: 12617 - RNA, 20 nt, Artificial Sequence
  TRAC targeting sequence
ccuguaaucucagcauuuug

SEQ ID NO: 12618 - RNA, 20 nt, Artificial Sequence
  TRAC targeting sequence
cagcauuuuggaaggcugag

SEQ ID NO: 12619 - RNA, 20 nt, Artificial Sequence
  TRAC targeting sequence
gcauuuuggaaggcugaggc

SEQ ID NO: 12620 - RNA, 20 nt, Artificial Sequence
  TRAC targeting sequence
aaaaugcugagauuacaggu

SEQ ID NO: 12621 - RNA, 20 nt, Artificial Sequence
  TRAC targeting sequence
gccuuccaaaaugcugagau

SEQ ID NO: 12622 - RNA, 20 nt, Artificial Sequence
  TRAC targeting sequence
ugccucagccuuccaaaaug

SEQ ID NO: 12623 - RNA, 20 nt, Artificial Sequence
  TRAC targeting sequence
uccugccucagccuuccaaa

SEQ ID NO: 12624 - RNA, 20 nt, Artificial Sequence
  TRAC targeting sequence
cuugaggccaggaguucaag

SEQ ID NO: 12625 - RNA, 20 nt, Artificial Sequence
  TRAC targeting sequence
agugauccuccugccucagc

SEQ ID NO: 12626 - RNA, 20 nt, Artificial Sequence
  TRAC targeting sequence
uggccucaagugauccuccu

SEQ ID NO: 12627 - RNA, 20 nt, Artificial Sequence
  TRAC targeting sequence
agaccacccugggcaacaca

SEQ ID NO: 12628 - RNA, 20 nt, Artificial Sequence
  TRAC targeting sequence
ugaacuccuggccucaagug

SEQ ID NO: 12629 - RNA, 20 nt, Artificial Sequence
  TRAC targeting sequence
cuguguugcccagggugguc

SEQ ID NO: 12630 - RNA, 20 nt, Artificial Sequence
  TRAC targeting sequence
cacuguguugcccagggugg

SEQ ID NO: 12631 - RNA, 20 nt, Artificial Sequence
  TRAC targeting sequence
cuacaaaaaauaaauaaaua

SEQ ID NO: 12632 - RNA, 20 nt, Artificial Sequence
  TRAC targeting sequence
acaaaaaauaaauaaauaaa

SEQ ID NO: 12633 - RNA, 20 nt, Artificial Sequence
  TRAC targeting sequence
uccuagcuacugaagagguu

SEQ ID NO: 12634 - RNA, 20 nt, Artificial Sequence
  TRAC targeting sequence
uagcuacugaagagguugag

SEQ ID NO: 12635 - RNA, 20 nt, Artificial Sequence
  TRAC targeting sequence
guagcuaggaugacaggugc

SEQ ID NO: 12636 - RNA, 20 nt, Artificial Sequence
  TRAC targeting sequence
ucaguagcuaggaugacagg

SEQ ID NO: 12637 - RNA, 20 nt, Artificial Sequence
  TRAC targeting sequence
accucuucaguagcuaggau

SEQ ID NO: 12638 - RNA, 20 nt, Artificial Sequence
  TRAC targeting sequence
ugccucaaccucuucaguag

SEQ ID NO: 12639 - RNA, 20 nt, Artificial Sequence
  TRAC targeting sequence
uccugccucaaccucuucag

SEQ ID NO: 12640 - RNA, 20 nt, Artificial Sequence
  TRAC targeting sequence
cuugugcccaggaggucaag

SEQ ID NO: 12641 - RNA, 20 nt, Artificial Sequence
  TRAC targeting sequence
ugggcacaagugauccuccu

SEQ ID NO: 12642 - RNA, 20 nt, Artificial Sequence
  TRAC targeting sequence
agguuacagugagccaagaa

SEQ ID NO: 12643 - RNA, 20 nt, Artificial Sequence
  TRAC targeting sequence
cuguaaccuugaccuccugg

SEQ ID NO: 12644 - RNA, 20 nt, Artificial Sequence
  TRAC targeting sequence
uggcucacuguaaccuugac

SEQ ID NO: 12645 - RNA, 20 nt, Artificial Sequence
  TRAC targeting sequence
agccuggacaacaaaguaag

SEQ ID NO: 12646 - RNA, 20 nt, Artificial Sequence
  TRAC targeting sequence
aggcuggagugcaguggugu

SEQ ID NO: 12647 - RNA, 20 nt, Artificial Sequence
  TRAC targeting sequence
uacuuuguuguccaggcugg

SEQ ID NO: 12648 - RNA, 20 nt, Artificial Sequence
  TRAC targeting sequence
ugucucuaaaaauauauauu

SEQ ID NO: 12649 - RNA, 20 nt, Artificial Sequence
  TRAC targeting sequence
cuaaaaauauauauuuaaaa

SEQ ID NO: 12650 - RNA, 20 nt, Artificial Sequence
  TRAC targeting sequence
aaaaauauauauuuaaaaau

SEQ ID NO: 12651 - RNA, 20 nt, Artificial Sequence
  TRAC targeting sequence
uuaacuuauuuauuuuauau

SEQ ID NO: 12652 - RNA, 20 nt, Artificial Sequence
  TRAC targeting sequence
uucuuuaacuuauuuauuuu

SEQ ID NO: 12653 - RNA, 20 nt, Artificial Sequence
  TRAC targeting sequence
uccuucuuuaacuuauuuau

SEQ ID NO: 12654 - RNA, 20 nt, Artificial Sequence
  TRAC targeting sequence
uuccuccuucuuuaacuuau

SEQ ID NO: 12655 - RNA, 20 nt, Artificial Sequence
  TRAC targeting sequence
ccuuccuccuucuuuaacuu

SEQ ID NO: 12656 - RNA, 20 nt, Artificial Sequence
  TRAC targeting sequence
ucuccuuccuccuucuuuaa

SEQ ID NO: 12657 - RNA, 20 nt, Artificial Sequence
  TRAC targeting sequence
ucaucuccuuccuccuucuu

SEQ ID NO: 12658 - RNA, 20 nt, Artificial Sequence
  TRAC targeting sequence
uacuaagccaaauuuucuuc

SEQ ID NO: 12659 - RNA, 20 nt, Artificial Sequence
  TRAC targeting sequence
gcccaguacaaaaacgcuuu

SEQ ID NO: 12660 - RNA, 20 nt, Artificial Sequence
  TRAC targeting sequence
aacuggggcaaacaaccucu

SEQ ID NO: 12661 - RNA, 20 nt, Artificial Sequence
  TRAC targeting sequence
ucuuugggacuggaacgaga

SEQ ID NO: 12662 - RNA, 20 nt, Artificial Sequence
  TRAC targeting sequence
uugggacuggaacgagacuc

SEQ ID NO: 12663 - RNA, 20 nt, Artificial Sequence
  TRAC targeting sequence
caaagaagagguuguuugcc

SEQ ID NO: 12664 - RNA, 20 nt, Artificial Sequence
  TRAC targeting sequence
agucccaaagaagagguugu

SEQ ID NO: 12665 - RNA, 20 nt, Artificial Sequence
  TRAC targeting sequence
uuccagucccaaagaagagg

SEQ ID NO: 12666 - RNA, 20 nt, Artificial Sequence
  TRAC targeting sequence
cguuccagucccaaagaaga

SEQ ID NO: 12667 - RNA, 20 nt, Artificial Sequence
  TRAC targeting sequence
ccguuauucccuguaagucc

SEQ ID NO: 12668 - RNA, 20 nt, Artificial Sequence
  TRAC targeting sequence
cuguaaguccuuaccucuug

SEQ ID NO: 12669 - RNA, 20 nt, Artificial Sequence
  TRAC targeting sequence
uuaccucuugacaaaaaagc

SEQ ID NO: 12670 - RNA, 20 nt, Artificial Sequence
  TRAC targeting sequence
ugacaaaaaagcucuuaguc

SEQ ID NO: 12671 - RNA, 20 nt, Artificial Sequence
  TRAC targeting sequence
agagguaaggacuuacaggg

SEQ ID NO: 12672 - RNA, 20 nt, Artificial Sequence
  TRAC targeting sequence
uagucuguaaugacaaguuc

SEQ ID NO: 12673 - RNA, 20 nt, Artificial Sequence
  TRAC targeting sequence
guaaugacaaguucucacau

SEQ ID NO: 12674 - RNA, 20 nt, Artificial Sequence
  TRAC targeting sequence
uuacagacuaagagcuuuuu

SEQ ID NO: 12675 - RNA, 20 nt, Artificial Sequence
  TRAC targeting sequence
cacaucccagacaccuaaug

SEQ ID NO: 12676 - RNA, 20 nt, Artificial Sequence
  TRAC targeting sequence
caucccagacaccuaaugaa

SEQ ID NO: 12677 - RNA, 20 nt, Artificial Sequence
  TRAC targeting sequence
cagacaccuaaugaauuucu

SEQ ID NO: 12678 - RNA, 20 nt, Artificial Sequence
  TRAC targeting sequence
gggaugugagaacuugucau

SEQ ID NO: 12679 - RNA, 20 nt, Artificial Sequence
  TRAC targeting sequence
uuaggugucugggaugugag

SEQ ID NO: 12680 - RNA, 20 nt, Artificial Sequence
  TRAC targeting sequence
aaaugagcuuccauguguua

SEQ ID NO: 12681 - RNA, 20 nt, Artificial Sequence
  TRAC targeting sequence
uuuagaaauucauuaggugu

SEQ ID NO: 12682 - RNA, 20 nt, Artificial Sequence
  TRAC targeting sequence
auguguuaaacugauaaaac

SEQ ID NO: 12683 - RNA, 20 nt, Artificial Sequence
  TRAC targeting sequence
guuuaacacauggaagcuca

SEQ ID NO: 12684 - RNA, 20 nt, Artificial Sequence
  TRAC targeting sequence
cuagggagaaggucacccuu

SEQ ID NO: 12685 - RNA, 20 nt, Artificial Sequence
  TRAC targeting sequence
agggagaaggucacccuuac

SEQ ID NO: 12686 - RNA, 20 nt, Artificial Sequence
  TRAC targeting sequence
cuagagaguuuuaucaguuu

SEQ ID NO: 12687 - RNA, 20 nt, Artificial Sequence
  TRAC targeting sequence
cccuagagaguuuuaucagu

SEQ ID NO: 12688 - RNA, 20 nt, Artificial Sequence
  TRAC targeting sequence
cccuuaccuuugcggcucua

SEQ ID NO: 12689 - RNA, 20 nt, Artificial Sequence
  TRAC targeting sequence
aaauguaagacauguuguaa

SEQ ID NO: 12690 - RNA, 20 nt, Artificial Sequence
  TRAC targeting sequence
uacauuuagagccgcaaagg

SEQ ID NO: 12691 - RNA, 20 nt, Artificial Sequence
  TRAC targeting sequence
uacaacaugucuuacauuua

SEQ ID NO: 12692 - RNA, 20 nt, Artificial Sequence
  TRAC targeting sequence
caauuuuucuuacaacaugu

SEQ ID NO: 12693 - RNA, 20 nt, Artificial Sequence
  TRAC targeting sequence
uuuuggcacugcaauuaaca

SEQ ID NO: 12694 - RNA, 20 nt, Artificial Sequence
  TRAC targeting sequence
ucauuuuggcacugcaauua

SEQ ID NO: 12695 - RNA, 20 nt, Artificial Sequence
  TRAC targeting sequence
cugucuucauuuuggcacug

SEQ ID NO: 12696 - RNA, 20 nt, Artificial Sequence
  TRAC targeting sequence
aacauuaaaacuagcccaau

SEQ ID NO: 12697 - RNA, 20 nt, Artificial Sequence
  TRAC targeting sequence
aaagaaccaucucagggugc

SEQ ID NO: 12698 - RNA, 20 nt, Artificial Sequence
  TRAC targeting sequence
uuggaaaggcuuauauuuua

SEQ ID NO: 12699 - RNA, 20 nt, Artificial Sequence
  TRAC targeting sequence
cagggugcauuuauuaguuu

SEQ ID NO: 12700 - RNA, 20 nt, Artificial Sequence
  TRAC targeting sequence
gggugcauuuauuaguuugu

SEQ ID NO: 12701 - RNA, 20 nt, Artificial Sequence
  TRAC targeting sequence
auacagcccaauuguccagu

SEQ ID NO: 12702 - RNA, 20 nt, Artificial Sequence
  TRAC targeting sequence
aguuacuuugauuaauguug

SEQ ID NO: 12703 - RNA, 20 nt, Artificial Sequence
  TRAC targeting sequence
aaguaacuggacaauugggc

SEQ ID NO: 12704 - RNA, 20 nt, Artificial Sequence
  TRAC targeting sequence
gcuaccaacauuaaucaaag

SEQ ID NO: 12705 - RNA, 20 nt, Artificial Sequence
  TRAC targeting sequence
gcaucagcuaccaacauuaa

SEQ ID NO: 12706 - RNA, 20 nt, Artificial Sequence
  TRAC targeting sequence
cuaaauaucugcaucagcua

SEQ ID NO: 12707 - RNA, 20 nt, Artificial Sequence
  TRAC targeting sequence
uugagaaaacuucuuugugc

SEQ ID NO: 12708 - RNA, 20 nt, Artificial Sequence
  TRAC targeting sequence
aggaagucccuaaauaucug

SEQ ID NO: 12709 - RNA, 20 nt, Artificial Sequence
  TRAC targeting sequence
caaggaagucccuaaauauc

SEQ ID NO: 12710 - RNA, 20 nt, Artificial Sequence
  TRAC targeting sequence
uugugcucaaaauugcauga

SEQ ID NO: 12711 - RNA, 20 nt, Artificial Sequence
  TRAC targeting sequence
aaauugcaugaauugaaugg

SEQ ID NO: 12712 - RNA, 20 nt, Artificial Sequence
  TRAC targeting sequence
ugcaauuuugagcacaaaga

SEQ ID NO: 12713 - RNA, 20 nt, Artificial Sequence
  TRAC targeting sequence
auucaugcaauuuugagcac

SEQ ID NO: 12714 - RNA, 20 nt, Artificial Sequence
  TRAC targeting sequence
guuucacuuugugcuguaua

SEQ ID NO: 12715 - RNA, 20 nt, Artificial Sequence
  TRAC targeting sequence
cuuugugcuguauagacuca

SEQ ID NO: 12716 - RNA, 20 nt, Artificial Sequence
  TRAC targeting sequence
auacagcacaaagugaaaca

SEQ ID NO: 12717 - RNA, 20 nt, Artificial Sequence
  TRAC targeting sequence
gccuaauaaaaacaaaugcu

SEQ ID NO: 12718 - RNA, 20 nt, Artificial Sequence
  TRAC targeting sequence
cagucugucuccucuccaca

SEQ ID NO: 12719 - RNA, 20 nt, Artificial Sequence
  TRAC targeting sequence
gucuccucuccacacagaaa

SEQ ID NO: 12720 - RNA, 20 nt, Artificial Sequence
  TRAC targeting sequence
ccucuccacacagaaaguuu

SEQ ID NO: 12721 - RNA, 20 nt, Artificial Sequence
  TRAC targeting sequence
ucuccacacagaaaguuucc

SEQ ID NO: 12722 - RNA, 20 nt, Artificial Sequence
  TRAC targeting sequence
ccacacagaaaguuucccuu

SEQ ID NO: 12723 - RNA, 20 nt, Artificial Sequence
  TRAC targeting sequence
acacagaaaguuucccuuuc

SEQ ID NO: 12724 - RNA, 20 nt, Artificial Sequence
  TRAC targeting sequence
guguggagaggagacagacu

SEQ ID NO: 12725 - RNA, 20 nt, Artificial Sequence
  TRAC targeting sequence
cuuucuacuaaacagcaucu

SEQ ID NO: 12726 - RNA, 20 nt, Artificial Sequence
  TRAC targeting sequence
acuaaacagcaucucuucac

SEQ ID NO: 12727 - RNA, 20 nt, Artificial Sequence
  TRAC targeting sequence
cuucacacgaagaaaagaug

SEQ ID NO: 12728 - RNA, 20 nt, Artificial Sequence
  TRAC targeting sequence
ucacacgaagaaaagaugcc

SEQ ID NO: 12729 - RNA, 20 nt, Artificial Sequence
  TRAC targeting sequence
cacgaagaaaagaugcccag

SEQ ID NO: 12730 - RNA, 20 nt, Artificial Sequence
  TRAC targeting sequence
ugugaagagaugcuguuuag

SEQ ID NO: 12731 - RNA, 20 nt, Artificial Sequence
  TRAC targeting sequence
ucgugugaagagaugcuguu

SEQ ID NO: 12732 - RNA, 20 nt, Artificial Sequence
  TRAC targeting sequence
uuucuucgugugaagagaug

SEQ ID NO: 12733 - RNA, 20 nt, Artificial Sequence
  TRAC targeting sequence
aauggcuugcugggcaucuu

SEQ ID NO: 12734 - RNA, 20 nt, Artificial Sequence
  TRAC targeting sequence
uauaaaugcaaacuagcagc

SEQ ID NO: 12735 - RNA, 20 nt, Artificial Sequence
  TRAC targeting sequence
uuuccuuagaagggaugaag

SEQ ID NO: 12736 - RNA, 20 nt, Artificial Sequence
  TRAC targeting sequence
uuagaagggaugaagacacu

SEQ ID NO: 12737 - RNA, 20 nt, Artificial Sequence
  TRAC targeting sequence
aaggaaaggagucauauaaa

SEQ ID NO: 12738 - RNA, 20 nt, Artificial Sequence
  TRAC targeting sequence
cuucuaaggaaaggagucau

SEQ ID NO: 12739 - RNA, 20 nt, Artificial Sequence
  TRAC targeting sequence
ucccuucuaaggaaaggagu

SEQ ID NO: 12740 - RNA, 20 nt, Artificial Sequence
  TRAC targeting sequence
ucaucccuucuaaggaaagg

SEQ ID NO: 12741 - RNA, 20 nt, Artificial Sequence
  TRAC targeting sequence
uauaaagugucuucaucccu

SEQ ID NO: 12742 - RNA, 20 nt, Artificial Sequence
  TRAC targeting sequence
guuuagcuaauaagucguau

SEQ ID NO: 12743 - RNA, 20 nt, Artificial Sequence
  TRAC targeting sequence
aucuguuuagcuaauaaguc

SEQ ID NO: 12744 - RNA, 20 nt, Artificial Sequence
  TRAC targeting sequence
uaauuaggcugucaaucugu

SEQ ID NO: 12745 - RNA, 20 nt, Artificial Sequence
  TRAC targeting sequence
uccuaauuaggcugucaauc

SEQ ID NO: 12746 - RNA, 20 nt, Artificial Sequence
  TRAC targeting sequence
cuuccuaauuaggcugucaa

SEQ ID NO: 12747 - RNA, 20 nt, Artificial Sequence
  TRAC targeting sequence
cucuuccuaauuaggcuguc

SEQ ID NO: 12748 - RNA, 20 nt, Artificial Sequence
  TRAC targeting sequence
guuucucucuuccuaauuag

SEQ ID NO: 12749 - RNA, 20 nt, Artificial Sequence
  TRAC targeting sequence
gaguaucuuuuuguggcugc

SEQ ID NO: 12750 - RNA, 20 nt, Artificial Sequence
  TRAC targeting sequence
gaaucuguuucucucuuccu

SEQ ID NO: 12751 - RNA, 20 nt, Artificial Sequence
  TRAC targeting sequence
uuuuguggcugcuguuccua

SEQ ID NO: 12752 - RNA, 20 nt, Artificial Sequence
  TRAC targeting sequence
uacccccucguguagaacau

SEQ ID NO: 12753 - RNA, 20 nt, Artificial Sequence
  TRAC targeting sequence
uguagaacauuuggucagau

SEQ ID NO: 12754 - RNA, 20 nt, Artificial Sequence
  TRAC targeting sequence
acacgaggggguaggaacag

SEQ ID NO: 12755 - RNA, 20 nt, Artificial Sequence
  TRAC targeting sequence
gauggcucuuugagacagaa

SEQ ID NO: 12756 - RNA, 20 nt, Artificial Sequence
  TRAC targeting sequence
gaccaaauguucuacacgag

SEQ ID NO: 12757 - RNA, 20 nt, Artificial Sequence
  TRAC targeting sequence
uugagacagaaauaagacag

SEQ ID NO: 12758 - RNA, 20 nt, Artificial Sequence
  TRAC targeting sequence
aagagccaucugaccaaaug

SEQ ID NO: 12759 - RNA, 20 nt, Artificial Sequence
  TRAC targeting sequence
caaagagccaucugaccaaa

SEQ ID NO: 12760 - RNA, 20 nt, Artificial Sequence
  TRAC targeting sequence
gucucaaagagccaucugac

SEQ ID NO: 12761 - RNA, 20 nt, Artificial Sequence
  TRAC targeting sequence
uauuucugucucaaagagcc

SEQ ID NO: 12762 - RNA, 20 nt, Artificial Sequence
  TRAC targeting sequence
cugucuuauuucugucucaa

SEQ ID NO: 12763 - RNA, 20 nt, Artificial Sequence
  TRAC targeting sequence
cugcuuguagugugggacgu

SEQ ID NO: 12764 - RNA, 20 nt, Artificial Sequence
  TRAC targeting sequence
gcuuguagugugggacgucu

SEQ ID NO: 12765 - RNA, 20 nt, Artificial Sequence
  TRAC targeting sequence
cacacuacaagcagagacca

SEQ ID NO: 12766 - RNA, 20 nt, Artificial Sequence
  TRAC targeting sequence
cagcugcaccuaagagguug

SEQ ID NO: 12767 - RNA, 20 nt, Artificial Sequence
  TRAC targeting sequence
gcugcaccuaagagguuguc

SEQ ID NO: 12768 - RNA, 20 nt, Artificial Sequence
  TRAC targeting sequence
uaggugcagcugagacgucc

SEQ ID NO: 12769 - RNA, 20 nt, Artificial Sequence
  TRAC targeting sequence
caggaguacuaaauagguca

SEQ ID NO: 12770 - RNA, 20 nt, Artificial Sequence
  TRAC targeting sequence
ugugacaaccucuuaggugc

SEQ ID NO: 12771 - RNA, 20 nt, Artificial Sequence
  TRAC targeting sequence
gggcaacugacacagccagg

SEQ ID NO: 12772 - RNA, 20 nt, Artificial Sequence
  TRAC targeting sequence
guugcccugaccuauuuagu

SEQ ID NO: 12773 - RNA, 20 nt, Artificial Sequence
  TRAC targeting sequence
uggcugugucaguugcccug

SEQ ID NO: 12774 - RNA, 20 nt, Artificial Sequence
  TRAC targeting sequence
uuccccuagaacuugugugu

SEQ ID NO: 12775 - RNA, 20 nt, Artificial Sequence
  TRAC targeting sequence
ccuagaacuugugugugcuc

SEQ ID NO: 12776 - RNA, 20 nt, Artificial Sequence
  TRAC targeting sequence
aggggaaagaaauuuuccug

SEQ ID NO: 12777 - RNA, 20 nt, Artificial Sequence
  TRAC targeting sequence
ccaagcaaagcgugacuaau

SEQ ID NO: 12778 - RNA, 20 nt, Artificial Sequence
  TRAC targeting sequence
cgcuuugcuuggugagcaca

SEQ ID NO: 12779 - RNA, 20 nt, Artificial Sequence
  TRAC targeting sequence
aaauuagucacgcuuugcuu

SEQ ID NO: 12780 - RNA, 20 nt, Artificial Sequence
  TRAC targeting sequence
auuguuagugugugucuacc

SEQ ID NO: 12781 - RNA, 20 nt, Artificial Sequence
  TRAC targeting sequence
acccuucuugccuuuguuuu

SEQ ID NO: 12782 - RNA, 20 nt, Artificial Sequence
  TRAC targeting sequence
ugccuuuguuuucagacccu

SEQ ID NO: 12783 - RNA, 20 nt, Artificial Sequence
  TRAC targeting sequence
gacccuuccucucuagaucc

SEQ ID NO: 12784 - RNA, 20 nt, Artificial Sequence
  TRAC targeting sequence
gaaaacaaaggcaagaaggg

SEQ ID NO: 12785 - RNA, 20 nt, Artificial Sequence
  TRAC targeting sequence
ucucuagauccuuuuccuuc

SEQ ID NO: 12786 - RNA, 20 nt, Artificial Sequence
  TRAC targeting sequence
cuagauccuuuuccuuccau

SEQ ID NO: 12787 - RNA, 20 nt, Artificial Sequence
  TRAC targeting sequence
agauccuuuuccuuccaucu

SEQ ID NO: 12788 - RNA, 20 nt, Artificial Sequence
  TRAC targeting sequence
agagaggaagggucugaaaa

SEQ ID NO: 12789 - RNA, 20 nt, Artificial Sequence
  TRAC targeting sequence
uuuuccuuccaucuccaacu

SEQ ID NO: 12790 - RNA, 20 nt, Artificial Sequence
  TRAC targeting sequence
uuccaucuccaacuccugua

SEQ ID NO: 12791 - RNA, 20 nt, Artificial Sequence
  TRAC targeting sequence
aucuccaacuccuguaugua

SEQ ID NO: 12792 - RNA, 20 nt, Artificial Sequence
  TRAC targeting sequence
ccaacuccuguauguaaauc

SEQ ID NO: 12793 - RNA, 20 nt, Artificial Sequence
  TRAC targeting sequence
aacuccuguauguaaauccc

SEQ ID NO: 12794 - RNA, 20 nt, Artificial Sequence
  TRAC targeting sequence
uguauguaaaucccugcucu

SEQ ID NO: 12795 - RNA, 20 nt, Artificial Sequence
  TRAC targeting sequence
cugcucucuccuuugaauuc

SEQ ID NO: 12796 - RNA, 20 nt, Artificial Sequence
  TRAC targeting sequence
cuccuuugaauuccugacug

SEQ ID NO: 12797 - RNA, 20 nt, Artificial Sequence
  TRAC targeting sequence
ccuuugaauuccugacugcu

SEQ ID NO: 12798 - RNA, 20 nt, Artificial Sequence
  TRAC targeting sequence
uuugaauuccugacugcuau

SEQ ID NO: 12799 - RNA, 20 nt, Artificial Sequence
  TRAC targeting sequence
aaggagagagcagggauuua

SEQ ID NO: 12800 - RNA, 20 nt, Artificial Sequence
  TRAC targeting sequence
ugacugcuaugcccaugccc

SEQ ID NO: 12801 - RNA, 20 nt, Artificial Sequence
  TRAC targeting sequence
ggaauucaaaggagagagca

SEQ ID NO: 12802 - RNA, 20 nt, Artificial Sequence
  TRAC targeting sequence
guaaccaucagcuguauuuc

SEQ ID NO: 12803 - RNA, 20 nt, Artificial Sequence
  TRAC targeting sequence
gcuguauuucugaggacuuu

SEQ ID NO: 12804 - RNA, 20 nt, Artificial Sequence
  TRAC targeting sequence
gaggacuuuccuagcuccuu

SEQ ID NO: 12805 - RNA, 20 nt, Artificial Sequence
  TRAC targeting sequence
gaaauacagcugaugguuac

SEQ ID NO: 12806 - RNA, 20 nt, Artificial Sequence
  TRAC targeting sequence
ucagaaauacagcugauggu

SEQ ID NO: 12807 - RNA, 20 nt, Artificial Sequence
  TRAC targeting sequence
uagcuccuugagugauccuc

SEQ ID NO: 12808 - RNA, 20 nt, Artificial Sequence
  TRAC targeting sequence
uugagugauccucaaauggc

SEQ ID NO: 12809 - RNA, 20 nt, Artificial Sequence
  TRAC targeting sequence
aggagcuaggaaaguccuca

SEQ ID NO: 12810 - RNA, 20 nt, Artificial Sequence
  TRAC targeting sequence
cucaaggagcuaggaaaguc

SEQ ID NO: 12811 - RNA, 20 nt, Artificial Sequence
  TRAC targeting sequence
ucaaauggcucagggcccug

SEQ ID NO: 12812 - RNA, 20 nt, Artificial Sequence
  TRAC targeting sequence
aauggcucagggcccugagg

SEQ ID NO: 12813 - RNA, 20 nt, Artificial Sequence
  TRAC targeting sequence
gggcccugagggaaucuuug

SEQ ID NO: 12814 - RNA, 20 nt, Artificial Sequence
  TRAC targeting sequence
gggcccugagccauuugagg

SEQ ID NO: 12815 - RNA, 20 nt, Artificial Sequence
  TRAC targeting sequence
cucagggcccugagccauuu

SEQ ID NO: 12816 - RNA, 20 nt, Artificial Sequence
  TRAC targeting sequence
uugcugaggguuggccccag

SEQ ID NO: 12817 - RNA, 20 nt, Artificial Sequence
  TRAC targeting sequence
gcaaagauucccucagggcc

SEQ ID NO: 12818 - RNA, 20 nt, Artificial Sequence
  TRAC targeting sequence
gcuggggccaacccucagca

SEQ ID NO: 12819 - RNA, 20 nt, Artificial Sequence
  TRAC targeting sequence
gcagcggcucugcuggggcc

SEQ ID NO: 12820 - RNA, 20 nt, Artificial Sequence
  TRAC targeting sequence
accucugcagcggcucugcu

SEQ ID NO: 12821 - RNA, 20 nt, Artificial Sequence
  TRAC targeting sequence
cuugguggccaccucuaccu

SEQ ID NO: 12822 - RNA, 20 nt, Artificial Sequence
  TRAC targeting sequence
gugucccuugguggccaccu

SEQ ID NO: 12823 - RNA, 20 nt, Artificial Sequence
  TRAC targeting sequence
ugcaggcagucugugucccu

SEQ ID NO: 12824 - RNA, 20 nt, Artificial Sequence
  TRAC targeting sequence
agccuucaugcaggcagucu

SEQ ID NO: 12825 - RNA, 20 nt, Artificial Sequence
  TRAC targeting sequence
ugggcccagcuccagccuuc

SEQ ID NO: 12826 - RNA, 20 nt, Artificial Sequence
  TRAC targeting sequence
uccugggcccagcuccagcc

SEQ ID NO: 12827 - RNA, 20 nt, Artificial Sequence
  TRAC targeting sequence
ucauccugggcccagcucca

SEQ ID NO: 12828 - RNA, 20 nt, Artificial Sequence
  TRAC targeting sequence
ggaaggaggggcugacacga

SEQ ID NO: 12829 - RNA, 20 nt, Artificial Sequence
  TRAC targeting sequence
ugaggcuuuuccucauccug

SEQ ID NO: 12830 - RNA, 20 nt, Artificial Sequence
  TRAC targeting sequence
uuccugaggcuuuuccucau

SEQ ID NO: 12831 - RNA, 20 nt, Artificial Sequence
  TRAC targeting sequence
gccccuccuuccugaggcuu

SEQ ID NO: 12832 - RNA, 20 nt, Artificial Sequence
  TRAC targeting sequence
ugucagccccuccuuccuga

SEQ ID NO: 12833 - RNA, 20 nt, Artificial Sequence
  TRAC targeting sequence
uuauuucgugucagccccuc

SEQ ID NO: 12834 - RNA, 20 nt, Artificial Sequence
  TRAC targeting sequence
ugagaugugcgucugaaucc

SEQ ID NO: 12835 - RNA, 20 nt, Artificial Sequence
  TRAC targeting sequence
ugaaugccaugguauuccuu

SEQ ID NO: 12836 - RNA, 20 nt, Artificial Sequence
  TRAC targeting sequence
caugaaugccaugguauucc

SEQ ID NO: 12837 - RNA, 20 nt, Artificial Sequence
  TRAC targeting sequence
gaauccucucucuugccuga

SEQ ID NO: 12838 - RNA, 20 nt, Artificial Sequence
  TRAC targeting sequence
gacgcacaucucaugaaugc

SEQ ID NO: 12839 - RNA, 20 nt, Artificial Sequence
  TRAC targeting sequence
ucucucuugccugagaagcu

SEQ ID NO: 12840 - RNA, 20 nt, Artificial Sequence
  TRAC targeting sequence
cucuugccugagaagcuuua

SEQ ID NO: 12841 - RNA, 20 nt, Artificial Sequence
  TRAC targeting sequence
cuugccugagaagcuuuagc

SEQ ID NO: 12842 - RNA, 20 nt, Artificial Sequence
  TRAC targeting sequence
ugccugagaagcuuuagcuu

SEQ ID NO: 12843 - RNA, 20 nt, Artificial Sequence
  TRAC targeting sequence
ggcaagagagaggauucaga

SEQ ID NO: 12844 - RNA, 20 nt, Artificial Sequence
  TRAC targeting sequence
caggcaagagagaggauuca

SEQ ID NO: 12845 - RNA, 20 nt, Artificial Sequence
  TRAC targeting sequence
accuugagacacaaaacaug

SEQ ID NO: 12846 - RNA, 20 nt, Artificial Sequence
  TRAC targeting sequence
agguggaagcuaaagcuucu

SEQ ID NO: 12847 - RNA, 20 nt, Artificial Sequence
  TRAC targeting sequence
caagguggaagcuaaagcuu

SEQ ID NO: 12848 - RNA, 20 nt, Artificial Sequence
  TRAC targeting sequence
aaacaaagcaauaugauagg

SEQ ID NO: 12849 - RNA, 20 nt, Artificial Sequence
  TRAC targeting sequence
agugcugucaaaacaaagca

SEQ ID NO: 12850 - RNA, 20 nt, Artificial Sequence
  TRAC targeting sequence
guucuagugcugucaaaaca

SEQ ID NO: 12851 - RNA, 20 nt, Artificial Sequence
  TRAC targeting sequence
cuguucuagugcugucaaaa

SEQ ID NO: 12852 - RNA, 20 nt, Artificial Sequence
  TRAC targeting sequence
aaggcaaacaagaccagugu

SEQ ID NO: 12853 - RNA, 20 nt, Artificial Sequence
  TRAC targeting sequence
uguuugccuuugaucucugu

SEQ ID NO: 12854 - RNA, 20 nt, Artificial Sequence
  TRAC targeting sequence
ugugagcccugaggagaggu

SEQ ID NO: 12855 - RNA, 20 nt, Artificial Sequence
  TRAC targeting sequence
caagacacuggucuuguuug

SEQ ID NO: 12856 - RNA, 20 nt, Artificial Sequence
  TRAC targeting sequence
gggcucacaagacacugguc

SEQ ID NO: 12857 - RNA, 20 nt, Artificial Sequence
  TRAC targeting sequence
ucagggcucacaagacacug

SEQ ID NO: 12858 - RNA, 20 nt, Artificial Sequence
  TRAC targeting sequence
uccggaaagggaaggccuuu

SEQ ID NO: 12859 - RNA, 20 nt, Artificial Sequence
  TRAC targeting sequence
ggaaagggaaggccuuuuau

SEQ ID NO: 12860 - RNA, 20 nt, Artificial Sequence
  TRAC targeting sequence
ggaagaugcaacgccacauc

SEQ ID NO: 12861 - RNA, 20 nt, Artificial Sequence
  TRAC targeting sequence
cuuuccggaagaugcaacgc

SEQ ID NO: 12862 - RNA, 20 nt, Artificial Sequence
  TRAC targeting sequence
guucgccaagcuugaaccca

SEQ ID NO: 12863 - RNA, 20 nt, Artificial Sequence
  TRAC targeting sequence
ccaagcuugaacccaagggg

SEQ ID NO: 12864 - RNA, 20 nt, Artificial Sequence
  TRAC targeting sequence
agcuuggcgaacagauugca

SEQ ID NO: 12865 - RNA, 20 nt, Artificial Sequence
  TRAC targeting sequence
cacaaagcaccauaugggcu

SEQ ID NO: 12866 - RNA, 20 nt, Artificial Sequence
  TRAC targeting sequence
ggccaguagcccauauggug

SEQ ID NO: 12867 - RNA, 20 nt, Artificial Sequence
  TRAC targeting sequence
caguugcuaaauucaggcca

SEQ ID NO: 12868 - RNA, 20 nt, Artificial Sequence
  TRAC targeting sequence
ucccaguugcuaaauucagg

SEQ ID NO: 12869 - RNA, 20 nt, Artificial Sequence
  TRAC targeting sequence
auggaggggacacaauuuua

SEQ ID NO: 12870 - RNA, 20 nt, Artificial Sequence
  TRAC targeting sequence
auugaccuccucccaguugc

SEQ ID NO: 12871 - RNA, 20 nt, Artificial Sequence
  TRAC targeting sequence
ccuccauugaccuccuccca

SEQ ID NO: 12872 - RNA, 20 nt, Artificial Sequence
  TRAC targeting sequence
uguaaauuuaaaauuguguc

SEQ ID NO: 12873 - RNA, 20 nt, Artificial Sequence
  TRAC targeting sequence
uccugcuuuacacuugaaua

SEQ ID NO: 12874 - RNA, 20 nt, Artificial Sequence
  TRAC targeting sequence
ccucuuccugcuuuacacuu

SEQ ID NO: 12875 - RNA, 20 nt, Artificial Sequence
  TRAC targeting sequence
gaagcuuagcaggugacagg

SEQ ID NO: 12876 - RNA, 20 nt, Artificial Sequence
  TRAC targeting sequence
gaaucaccucuuccugcuuu

SEQ ID NO: 12877 - RNA, 20 nt, Artificial Sequence
  TRAC targeting sequence
ccugcuaagcuucugaauca

SEQ ID NO: 12878 - RNA, 20 nt, Artificial Sequence
  TRAC targeting sequence
ugucaccugcuaagcuucug

SEQ ID NO: 12879 - RNA, 20 nt, Artificial Sequence
  TRAC targeting sequence
ccugucaccugcuaagcuuc

SEQ ID NO: 12880 - RNA, 20 nt, Artificial Sequence
  TRAC targeting sequence
guguaauuucuccugucacc

SEQ ID NO: 12881 - RNA, 20 nt, Artificial Sequence
  TRAC targeting sequence
gccuaacccacagcauguag

SEQ ID NO: 12882 - RNA, 20 nt, Artificial Sequence
  TRAC targeting sequence
gugggaaaccauuugagggc

SEQ ID NO: 12883 - RNA, 20 nt, Artificial Sequence
  TRAC targeting sequence
cacugaggaguuugucgggu

SEQ ID NO: 12884 - RNA, 20 nt, Artificial Sequence
  TRAC targeting sequence
aaugguuucccacugaggag

SEQ ID NO: 12885 - RNA, 20 nt, Artificial Sequence
  TRAC targeting sequence
gcccucaaaugguuucccac

SEQ ID NO: 12886 - RNA, 20 nt, Artificial Sequence
  TRAC targeting sequence
ggccagucugcccucaaaug

SEQ ID NO: 12887 - RNA, 20 nt, Artificial Sequence
  TRAC targeting sequence
gugcuuucuggccagucugc

SEQ ID NO: 12888 - RNA, 20 nt, Artificial Sequence
  TRAC targeting sequence
caucugugcuuucuggccag

SEQ ID NO: 12889 - RNA, 20 nt, Artificial Sequence
  TRAC targeting sequence
auucccaucugugcuuucug

SEQ ID NO: 12890 - RNA, 20 nt, Artificial Sequence
  TRAC targeting sequence
cauccauucccaucugugcu

SEQ ID NO: 12891 - RNA, 20 nt, Artificial Sequence
  TRAC targeting sequence
aaaaguccauucuagucaca

SEQ ID NO: 12892 - RNA, 20 nt, Artificial Sequence
  TRAC targeting sequence
auucuagucacaaaccccaa

SEQ ID NO: 12893 - RNA, 20 nt, Artificial Sequence
  TRAC targeting sequence
agucacaaaccccaaggcag

SEQ ID NO: 12894 - RNA, 20 nt, Artificial Sequence
  TRAC targeting sequence
ggggcucuucugccccacug

SEQ ID NO: 12895 - RNA, 20 nt, Artificial Sequence
  TRAC targeting sequence
gucuggggcucuucugcccc

SEQ ID NO: 12896 - RNA, 20 nt, Artificial Sequence
  TRAC targeting sequence
ggugcuucugucuggggcuc

SEQ ID NO: 12897 - RNA, 20 nt, Artificial Sequence
  TRAC targeting sequence
ggccaagcuggcucaggugc

SEQ ID NO: 12898 - RNA, 20 nt, Artificial Sequence
  TRAC targeting sequence
ggacccuuugaucuugcugg

SEQ ID NO: 12899 - RNA, 20 nt, Artificial Sequence
  TRAC targeting sequence
ugacaguuaggucaggccaa

SEQ ID NO: 12900 - RNA, 20 nt, Artificial Sequence
  TRAC targeting sequence
aaggguccugacaguuaggu

SEQ ID NO: 12901 - RNA, 20 nt, Artificial Sequence
  TRAC targeting sequence
ugcuggagcuugacuuggag

SEQ ID NO: 12902 - RNA, 20 nt, Artificial Sequence
  TRAC targeting sequence
agcaagaucaaaggguccug

SEQ ID NO: 12903 - RNA, 20 nt, Artificial Sequence
  TRAC targeting sequence
agcuccagcaagaucaaagg

SEQ ID NO: 12904 - RNA, 20 nt, Artificial Sequence
  TRAC targeting sequence
aagucaagcuccagcaagau

SEQ ID NO: 12905 - RNA, 20 nt, Artificial Sequence
  TRAC targeting sequence
ccaagucaagcuccagcaag

SEQ ID NO: 12906 - RNA, 20 nt, Artificial Sequence
  TRAC targeting sequence
gguucuggggauucucaggg

SEQ ID NO: 12907 - RNA, 20 nt, Artificial Sequence
  TRAC targeting sequence
ggggauucucaggggccaua

SEQ ID NO: 12908 - RNA, 20 nt, Artificial Sequence
  TRAC targeting sequence
ccagaaccagauguuuucuc

SEQ ID NO: 12909 - RNA, 20 nt, Artificial Sequence
  TRAC targeting sequence
caggggccauauagugugaa

SEQ ID NO: 12910 - RNA, 20 nt, Artificial Sequence
  TRAC targeting sequence
ggggccauauagugugaaac

SEQ ID NO: 12911 - RNA, 20 nt, Artificial Sequence
  TRAC targeting sequence
cacuauauggccccugagaa

SEQ ID NO: 12912 - RNA, 20 nt, Artificial Sequence
  TRAC targeting sequence
guuucacacuauauggcccc

SEQ ID NO: 12913 - RNA, 20 nt, Artificial Sequence
  TRAC targeting sequence
ccucgguuucacacuauaug

SEQ ID NO: 12914 - RNA, 20 nt, Artificial Sequence
  TRAC targeting sequence
guagcacugugacuggggga

SEQ ID NO: 12915 - RNA, 20 nt, Artificial Sequence
  TRAC targeting sequence
cagugcuacagagcuuuaca

SEQ ID NO: 12916 - RNA, 20 nt, Artificial Sequence
  TRAC targeting sequence
cccagucacagugcuacaga

SEQ ID NO: 12917 - RNA, 20 nt, Artificial Sequence
  TRAC targeting sequence
guagguuuuguagcacugug

SEQ ID NO: 12918 - RNA, 20 nt, Artificial Sequence
  TRAC targeting sequence
cuguagguuuuguagcacug

SEQ ID NO: 12919 - RNA, 20 nt, Artificial Sequence
  TRAC targeting sequence
cugggauauccucacccugg

SEQ ID NO: 12920 - RNA, 20 nt, Artificial Sequence
  TRAC targeting sequence
cagggaaauggcacuuuugc

SEQ ID NO: 12921 - RNA, 20 nt, Artificial Sequence
  TRAC targeting sequence
ucacccugggucccaugccu

SEQ ID NO: 12922 - RNA, 20 nt, Artificial Sequence
  TRAC targeting sequence
cccugggucccaugccucag

SEQ ID NO: 12923 - RNA, 20 nt, Artificial Sequence
  TRAC targeting sequence
uuugcaauagaaucaacaug

SEQ ID NO: 12924 - RNA, 20 nt, Artificial Sequence
  TRAC targeting sequence
cuuuugcaauagaaucaaca

SEQ ID NO: 12925 - RNA, 20 nt, Artificial Sequence
  TRAC targeting sequence
uauaacucucuuuugcaaua

SEQ ID NO: 12926 - RNA, 20 nt, Artificial Sequence
  TRAC targeting sequence
uacggaauuucuaaauucaa

SEQ ID NO: 12927 - RNA, 20 nt, Artificial Sequence
  TRAC targeting sequence
guaugagguggcucauauaa

SEQ ID NO: 12928 - RNA, 20 nt, Artificial Sequence
  TRAC targeting sequence
aaauucaaaccucuagagag

SEQ ID NO: 12929 - RNA, 20 nt, Artificial Sequence
  TRAC targeting sequence
aaccucuagagagauuuacc

SEQ ID NO: 12930 - RNA, 20 nt, Artificial Sequence
  TRAC targeting sequence
agagagauuuacccaagugc

SEQ ID NO: 12931 - RNA, 20 nt, Artificial Sequence
  TRAC targeting sequence
agagguuugaauuuagaaau

SEQ ID NO: 12932 - RNA, 20 nt, Artificial Sequence
  TRAC targeting sequence
cuagagguuugaauuuagaa

SEQ ID NO: 12933 - RNA, 20 nt, Artificial Sequence
  TRAC targeting sequence
cucuagagguuugaauuuag

SEQ ID NO: 12934 - RNA, 20 nt, Artificial Sequence
  TRAC targeting sequence
caaacugcaaagcaaagcac

SEQ ID NO: 12935 - RNA, 20 nt, Artificial Sequence
  TRAC targeting sequence
gagcacugcaucaaguguac

SEQ ID NO: 12936 - RNA, 20 nt, Artificial Sequence
  TRAC targeting sequence
gaacuguugcuuucuauugu

SEQ ID NO: 12937 - RNA, 20 nt, Artificial Sequence
  TRAC targeting sequence
aguguacugugcuggaaagg

SEQ ID NO: 12938 - RNA, 20 nt, Artificial Sequence
  TRAC targeting sequence
agcacaguacacuugaugca

SEQ ID NO: 12939 - RNA, 20 nt, Artificial Sequence
  TRAC targeting sequence
gccauaggaaauaugguccu

SEQ ID NO: 12940 - RNA, 20 nt, Artificial Sequence
  TRAC targeting sequence
uauggcggaccuuuccagca

SEQ ID NO: 12941 - RNA, 20 nt, Artificial Sequence
  TRAC targeting sequence
uccauacuccucagacaaca

SEQ ID NO: 12942 - RNA, 20 nt, Artificial Sequence
  TRAC targeting sequence
auacuccucagacaacagcc

SEQ ID NO: 12943 - RNA, 20 nt, Artificial Sequence
  TRAC targeting sequence
ucagacaacagccuuccgaa

SEQ ID NO: 12944 - RNA, 20 nt, Artificial Sequence
  TRAC targeting sequence
gcuuuaggacuggaggaucu

SEQ ID NO: 12945 - RNA, 20 nt, Artificial Sequence
  TRAC targeting sequence
cgucagcuuuaggacuggag

SEQ ID NO: 12946 - RNA, 20 nt, Artificial Sequence
  TRAC targeting sequence
ucccgucagcuuuaggacug

SEQ ID NO: 12947 - RNA, 20 nt, Artificial Sequence
  TRAC targeting sequence
caccuaccuucuucccguca

SEQ ID NO: 12948 - RNA, 20 nt, Artificial Sequence
  TRAC targeting sequence
gcgcugcucccaccuaccuu

SEQ ID NO: 12949 - RNA, 20 nt, Artificial Sequence
  TRAC targeting sequence
aaaaaccucagcgcugcucc

SEQ ID NO: 12950 - RNA, 20 nt, Artificial Sequence
  TRAC targeting sequence
ucaagugcugugacaccgau

SEQ ID NO: 12951 - RNA, 20 nt, Artificial Sequence
  TRAC targeting sequence
agugcugugacaccgauaaa

SEQ ID NO: 12952 - RNA, 20 nt, Artificial Sequence
  TRAC targeting sequence
cagcacuugaggacguucca

SEQ ID NO: 12953 - RNA, 20 nt, Artificial Sequence
  TRAC targeting sequence
gugucacagcacuugaggac

SEQ ID NO: 12954 - RNA, 20 nt, Artificial Sequence
  TRAC targeting sequence
ucuuuggaaaaggaacccgu

SEQ ID NO: 12955 - RNA, 20 nt, Artificial Sequence
  TRAC targeting sequence
uuggaaaaggaacccgugug

SEQ ID NO: 12956 - RNA, 20 nt, Artificial Sequence
  TRAC targeting sequence
aaagaugaguuuaucggugu

SEQ ID NO: 12957 - RNA, 20 nt, Artificial Sequence
  TRAC targeting sequence
uuuuccaaagaugaguuuau

SEQ ID NO: 12958 - RNA, 20 nt, Artificial Sequence
  TRAC targeting sequence
cacggguuccuuuuccaaag

SEQ ID NO: 12959 - RNA, 20 nt, Artificial Sequence
  TRAC targeting sequence
acagucacacggguuccuuu

SEQ ID NO: 12960 - RNA, 20 nt, Artificial Sequence
  TRAC targeting sequence
uuuauuuaucugaaguuuaa

SEQ ID NO: 12961 - RNA, 20 nt, Artificial Sequence
  TRAC targeting sequence
gaaguuuaagguuaaggcau

SEQ ID NO: 12962 - RNA, 20 nt, Artificial Sequence
  TRAC targeting sequence
gauaaauaaaugaguuacuu

SEQ ID NO: 12963 - RNA, 20 nt, Artificial Sequence
  TRAC targeting sequence
cccauuucccauuucaggau

SEQ ID NO: 12964 - RNA, 20 nt, Artificial Sequence
  TRAC targeting sequence
uaaaugcuagcuauuucacc

SEQ ID NO: 12965 - RNA, 20 nt, Artificial Sequence
  TRAC targeting sequence
uccuaaaugcuagcuauuuc

SEQ ID NO: 12966 - RNA, 20 nt, Artificial Sequence
  TRAC targeting sequence
ugggaagaggugaaauaugg

SEQ ID NO: 12967 - RNA, 20 nt, Artificial Sequence
  TRAC targeting sequence
caggaguccuccuaaaugcu

SEQ ID NO: 12968 - RNA, 20 nt, Artificial Sequence
  TRAC targeting sequence
ucccaggaguccuccuaaau

SEQ ID NO: 12969 - RNA, 20 nt, Artificial Sequence
  TRAC targeting sequence
ccucuucccaggaguccucc

SEQ ID NO: 12970 - RNA, 20 nt, Artificial Sequence
  TRAC targeting sequence
uuuccauaggagaggagcag

SEQ ID NO: 12971 - RNA, 20 nt, Artificial Sequence
  TRAC targeting sequence
auaggagaggagcagaaggu

SEQ ID NO: 12972 - RNA, 20 nt, Artificial Sequence
  TRAC targeting sequence
uauggaaaggauuaaccaua

SEQ ID NO: 12973 - RNA, 20 nt, Artificial Sequence
  TRAC targeting sequence
ccuauggaaaggauuaacca

SEQ ID NO: 12974 - RNA, 20 nt, Artificial Sequence
  TRAC targeting sequence
ucuccuauggaaaggauuaa

SEQ ID NO: 12975 - RNA, 20 nt, Artificial Sequence
  TRAC targeting sequence
gcuccucuccuauggaaagg

SEQ ID NO: 12976 - RNA, 20 nt, Artificial Sequence
  TRAC targeting sequence
guaaaaaaagaguuuggggc

SEQ ID NO: 12977 - RNA, 20 nt, Artificial Sequence
  TRAC targeting sequence
uuuuuuacagacaccuucug

SEQ ID NO: 12978 - RNA, 20 nt, Artificial Sequence
  TRAC targeting sequence
uaugccccaaacucuuuuuu

SEQ ID NO: 12979 - RNA, 20 nt, Artificial Sequence
  TRAC targeting sequence
cuucauaugccccaaacucu

SEQ ID NO: 12980 - RNA, 20 nt, Artificial Sequence
  TRAC targeting sequence
ggcucagaggaaacagagaa

SEQ ID NO: 12981 - RNA, 20 nt, Artificial Sequence
  TRAC targeting sequence
ccccacccuccaugcccagg

SEQ ID NO: 12982 - RNA, 20 nt, Artificial Sequence
  TRAC targeting sequence
cugguguugcgauauuucuc

SEQ ID NO: 12983 - RNA, 20 nt, Artificial Sequence
  TRAC targeting sequence
caacaccagggacuacuugc

SEQ ID NO: 12984 - RNA, 20 nt, Artificial Sequence
  TRAC targeting sequence
cuuuagaagaaaauaaccug

SEQ ID NO: 12985 - RNA, 20 nt, Artificial Sequence
  TRAC targeting sequence
uuagaagaaaauaaccuguu

SEQ ID NO: 12986 - RNA, 20 nt, Artificial Sequence
  TRAC targeting sequence
aaagagaaauaucgcaacac

SEQ ID NO: 12987 - RNA, 20 nt, Artificial Sequence
  TRAC targeting sequence
ucuaaagagaaauaucgcaa

SEQ ID NO: 12988 - RNA, 20 nt, Artificial Sequence
  TRAC targeting sequence
gacauuuguuucuaauuguu

SEQ ID NO: 12989 - RNA, 20 nt, Artificial Sequence
  TRAC targeting sequence
gaaacagguuauuuucuucu

SEQ ID NO: 12990 - RNA, 20 nt, Artificial Sequence
  TRAC targeting sequence
aauuguuugagcugcaaaug

SEQ ID NO: 12991 - RNA, 20 nt, Artificial Sequence
  TRAC targeting sequence
aacaauuagaaacaaauguc

SEQ ID NO: 12992 - RNA, 20 nt, Artificial Sequence
  TRAC targeting sequence
uuugcagcucaaacaauuag

SEQ ID NO: 12993 - RNA, 20 nt, Artificial Sequence
  TRAC targeting sequence
cuaguaaccuaguuuucauu

SEQ ID NO: 12994 - RNA, 20 nt, Artificial Sequence
  TRAC targeting sequence
cacuaguaaccuaguuuuca

SEQ ID NO: 12995 - RNA, 20 nt, Artificial Sequence
  TRAC targeting sequence
cauauuucucacuaguaacc

SEQ ID NO: 12996 - RNA, 20 nt, Artificial Sequence
  TRAC targeting sequence
gguucccacugagaccagau

SEQ ID NO: 12997 - RNA, 20 nt, Artificial Sequence
  TRAC targeting sequence
cacugagaccagauuccaag

SEQ ID NO: 12998 - RNA, 20 nt, Artificial Sequence
  TRAC targeting sequence
gugggaaccagaauguccca

SEQ ID NO: 12999 - RNA, 20 nt, Artificial Sequence
  TRAC targeting sequence
cagugggaaccagaaugucc

SEQ ID NO: 13000 - RNA, 20 nt, Artificial Sequence
  TRAC targeting sequence
ggucucagugggaaccagaa

SEQ ID NO: 13001 - RNA, 20 nt, Artificial Sequence
  TRAC targeting sequence
aagcaggacaaagugaaugu

SEQ ID NO: 13002 - RNA, 20 nt, Artificial Sequence
  TRAC targeting sequence
ugcuuggaaucuggucucag

SEQ ID NO: 13003 - RNA, 20 nt, Artificial Sequence
  TRAC targeting sequence
cuuuguccugcuuggaaucu

SEQ ID NO: 13004 - RNA, 20 nt, Artificial Sequence
  TRAC targeting sequence
aacuaagaaaugcuuugaag

SEQ ID NO: 13005 - RNA, 20 nt, Artificial Sequence
  TRAC targeting sequence
uaguuggaagcacuacacau

SEQ ID NO: 13006 - RNA, 20 nt, Artificial Sequence
  TRAC targeting sequence
aagcauuucuuaguuggaag

SEQ ID NO: 13007 - RNA, 20 nt, Artificial Sequence
  TRAC targeting sequence
ccaggacacagccaggagag

SEQ ID NO: 13008 - RNA, 20 nt, Artificial Sequence
  TRAC targeting sequence
aggacacagccaggagaguu

SEQ ID NO: 13009 - RNA, 20 nt, Artificial Sequence
  TRAC targeting sequence
uggagacuucaaagcauuuc

SEQ ID NO: 13010 - RNA, 20 nt, Artificial Sequence
  TRAC targeting sequence
uggcuguguccuggagacuu

SEQ ID NO: 13011 - RNA, 20 nt, Artificial Sequence
  TRAC targeting sequence
ccuggcuguguccuggagac

SEQ ID NO: 13012 - RNA, 20 nt, Artificial Sequence
  TRAC targeting sequence
guguugagcacaauccuuca

SEQ ID NO: 13013 - RNA, 20 nt, Artificial Sequence
  TRAC targeting sequence
uugguguccuuucaaugaca

SEQ ID NO: 13014 - RNA, 20 nt, Artificial Sequence
  TRAC targeting sequence
uuucaaugacauuugaauuc

SEQ ID NO: 13015 - RNA, 20 nt, Artificial Sequence
  TRAC targeting sequence
augacauuugaauucgaccg

SEQ ID NO: 13016 - RNA, 20 nt, Artificial Sequence
  TRAC targeting sequence
uugaaaggacaccaaagaug

SEQ ID NO: 13017 - RNA, 20 nt, Artificial Sequence
  TRAC targeting sequence
aaugucauugaaaggacacc

SEQ ID NO: 13018 - RNA, 20 nt, Artificial Sequence
  TRAC targeting sequence
accgugucuugcuaaaaaau

SEQ ID NO: 13019 - RNA, 20 nt, Artificial Sequence
  TRAC targeting sequence
aauucaaaugucauugaaag

SEQ ID NO: 13020 - RNA, 20 nt, Artificial Sequence
  TRAC targeting sequence
ugcuaaaaaauaaaauaaaa

SEQ ID NO: 13021 - RNA, 20 nt, Artificial Sequence
  TRAC targeting sequence
augcaaauaaaaagaacguc

SEQ ID NO: 13022 - RNA, 20 nt, Artificial Sequence
  TRAC targeting sequence
aucuuuuaauggcuaucaga

SEQ ID NO: 13023 - RNA, 20 nt, Artificial Sequence
  TRAC targeting sequence
uuuaauggcuaucagaauag

SEQ ID NO: 13024 - RNA, 20 nt, Artificial Sequence
  TRAC targeting sequence
gaauaguacaacuaggcuau

SEQ ID NO: 13025 - RNA, 20 nt, Artificial Sequence
  TRAC targeting sequence
gauagccauuaaaagauaga

SEQ ID NO: 13026 - RNA, 20 nt, Artificial Sequence
  TRAC targeting sequence
aacccaugugauuucaaguu

SEQ ID NO: 13027 - RNA, 20 nt, Artificial Sequence
  TRAC targeting sequence
cauggguuugauagccuagu

SEQ ID NO: 13028 - RNA, 20 nt, Artificial Sequence
  TRAC targeting sequence
aguuuccuuuuaauuauauu

SEQ ID NO: 13029 - RNA, 20 nt, Artificial Sequence
  TRAC targeting sequence
uuuuaauuauauuuuaaguu

SEQ ID NO: 13030 - RNA, 20 nt, Artificial Sequence
  TRAC targeting sequence
cuuuuuaacuuaaaauauaa

SEQ ID NO: 13031 - RNA, 20 nt, Artificial Sequence
  TRAC targeting sequence
uaauuugcuuaauaauuuaa

SEQ ID NO: 13032 - RNA, 20 nt, Artificial Sequence
  TRAC targeting sequence
gucauaauuugcuuaauaau

SEQ ID NO: 13033 - RNA, 20 nt, Artificial Sequence
  TRAC targeting sequence
ucugucauaauuugcuuaau

SEQ ID NO: 13034 - RNA, 20 nt, Artificial Sequence
  TRAC targeting sequence
uagucaucugucauaauuug

SEQ ID NO: 13035 - RNA, 20 nt, Artificial Sequence
  TRAC targeting sequence
cccgcuuuuuuggucauagu

SEQ ID NO: 13036 - RNA, 20 nt, Artificial Sequence
  TRAC targeting sequence
cccccgcuuuuuuggucaua

SEQ ID NO: 13037 - RNA, 20 nt, Artificial Sequence
  TRAC targeting sequence
auuaagcacaucucccccgc

SEQ ID NO: 13038 - RNA, 20 nt, Artificial Sequence
  TRAC targeting sequence
caaacuucaauuaagcacau

SEQ ID NO: 13039 - RNA, 20 nt, Artificial Sequence
  TRAC targeting sequence
gcacuucccaaacuucaauu

SEQ ID NO: 13040 - RNA, 20 nt, Artificial Sequence
  TRAC targeting sequence
uauuggugcauuucaucagc

SEQ ID NO: 13041 - RNA, 20 nt, Artificial Sequence
  TRAC targeting sequence
ucagccuuugaagugaaaaa

SEQ ID NO: 13042 - RNA, 20 nt, Artificial Sequence
  TRAC targeting sequence
gccuuugaagugaaaaagua

SEQ ID NO: 13043 - RNA, 20 nt, Artificial Sequence
  TRAC targeting sequence
aaggcugaugaaaugcacca

SEQ ID NO: 13044 - RNA, 20 nt, Artificial Sequence
  TRAC targeting sequence
cuucaaaggcugaugaaaug

SEQ ID NO: 13045 - RNA, 20 nt, Artificial Sequence
  TRAC targeting sequence
agagggggcacaaccuagaa

SEQ ID NO: 13046 - RNA, 20 nt, Artificial Sequence
  TRAC targeting sequence
ggauaccccuuacuuuuuca

SEQ ID NO: 13047 - RNA, 20 nt, Artificial Sequence
  TRAC targeting sequence
agguugugcccccucuggau

SEQ ID NO: 13048 - RNA, 20 nt, Artificial Sequence
  TRAC targeting sequence
uugaauggcagcuucuauuu

SEQ ID NO: 13049 - RNA, 20 nt, Artificial Sequence
  TRAC targeting sequence
aagauauucuagguugugcc

SEQ ID NO: 13050 - RNA, 20 nt, Artificial Sequence
  TRAC targeting sequence
auuuuuaagcuaccaacauu

SEQ ID NO: 13051 - RNA, 20 nt, Artificial Sequence
  TRAC targeting sequence
aauguugguagcuuaaaaau

SEQ ID NO: 13052 - RNA, 20 nt, Artificial Sequence
  TRAC targeting sequence
uuaauccaauguugguagcu

SEQ ID NO: 13053 - RNA, 20 nt, Artificial Sequence
  TRAC targeting sequence
cuuuaauccaauguugguag

SEQ ID NO: 13054 - RNA, 20 nt, Artificial Sequence
  TRAC targeting sequence
ucucagaagccuuuugaugc

SEQ ID NO: 13055 - RNA, 20 nt, Artificial Sequence
  TRAC targeting sequence
cagaagccuuuugaugcuuu

SEQ ID NO: 13056 - RNA, 20 nt, Artificial Sequence
  TRAC targeting sequence
gaagccuuuugaugcuuuuu

SEQ ID NO: 13057 - RNA, 20 nt, Artificial Sequence
  TRAC targeting sequence
gagaagauaaaggcccuggg

SEQ ID NO: 13058 - RNA, 20 nt, Artificial Sequence
  TRAC targeting sequence
aaaggcuucugagaagauaa

SEQ ID NO: 13059 - RNA, 20 nt, Artificial Sequence
  TRAC targeting sequence
uugggagcuucuuucaaguu

SEQ ID NO: 13060 - RNA, 20 nt, Artificial Sequence
  TRAC targeting sequence
caaggaaaaaaaaagcauca

SEQ ID NO: 13061 - RNA, 20 nt, Artificial Sequence
  TRAC targeting sequence
uucaaguucuuacuuacgga

SEQ ID NO: 13062 - RNA, 20 nt, Artificial Sequence
  TRAC targeting sequence
aguucuuacuuacggagcuc

SEQ ID NO: 13063 - RNA, 20 nt, Artificial Sequence
  TRAC targeting sequence
uacuuacggagcuccugggu

SEQ ID NO: 13064 - RNA, 20 nt, Artificial Sequence
  TRAC targeting sequence
guaaguaagaacuugaaaga

SEQ ID NO: 13065 - RNA, 20 nt, Artificial Sequence
  TRAC targeting sequence
uggguagcacaaaacuaaca

SEQ ID NO: 13066 - RNA, 20 nt, Artificial Sequence
  TRAC targeting sequence
ucuggauacaguaaaccugg

SEQ ID NO: 13067 - RNA, 20 nt, Artificial Sequence
  TRAC targeting sequence
ggauacaguaaaccuggaga

SEQ ID NO: 13068 - RNA, 20 nt, Artificial Sequence
  TRAC targeting sequence
agaggacuaaagugugggau

SEQ ID NO: 13069 - RNA, 20 nt, Artificial Sequence
  TRAC targeting sequence
agguuuacuguauccagagg

SEQ ID NO: 13070 - RNA, 20 nt, Artificial Sequence
  TRAC targeting sequence
ccagguuuacuguauccaga

SEQ ID NO: 13071 - RNA, 20 nt, Artificial Sequence
  TRAC targeting sequence
cuccagguuuacuguaucca

SEQ ID NO: 13072 - RNA, 20 nt, Artificial Sequence
  TRAC targeting sequence
uaaaacagaacagagaaaca

SEQ ID NO: 13073 - RNA, 20 nt, Artificial Sequence
  TRAC targeting sequence
guuuuacgaagcuaaguggu

SEQ ID NO: 13074 - RNA, 20 nt, Artificial Sequence
  TRAC targeting sequence
guucuguuuuacgaagcuaa

SEQ ID NO: 13075 - RNA, 20 nt, Artificial Sequence
  TRAC targeting sequence
cuguucuguuuuacgaagcu

SEQ ID NO: 13076 - RNA, 20 nt, Artificial Sequence
  TRAC targeting sequence
uguuucucuguucuguuuua

SEQ ID NO: 13077 - RNA, 20 nt, Artificial Sequence
  TRAC targeting sequence
augcuguuuuguccuguuuc

SEQ ID NO: 13078 - RNA, 20 nt, Artificial Sequence
  TRAC targeting sequence
auuccacaugaucguaguga

SEQ ID NO: 13079 - RNA, 20 nt, Artificial Sequence
  TRAC targeting sequence
ugguaccucaauuccacaug

SEQ ID NO: 13080 - RNA, 20 nt, Artificial Sequence
  TRAC targeting sequence
auaaaacgcaagucauggua

SEQ ID NO: 13081 - RNA, 20 nt, Artificial Sequence
  TRAC targeting sequence
ggaaacugaaucuuaaaggg

SEQ ID NO: 13082 - RNA, 20 nt, Artificial Sequence
  TRAC targeting sequence
ugauccauaaaacgcaaguc

SEQ ID NO: 13083 - RNA, 20 nt, Artificial Sequence
  TRAC targeting sequence
guuuccugauccauaaaacg

SEQ ID NO: 13084 - RNA, 20 nt, Artificial Sequence
  TRAC targeting sequence
uaaagggguuccucaagauc

SEQ ID NO: 13085 - RNA, 20 nt, Artificial Sequence
  TRAC targeting sequence
ucaagaucacacagcuuagu

SEQ ID NO: 13086 - RNA, 20 nt, Artificial Sequence
  TRAC targeting sequence
agaucacacagcuuaguaaa

SEQ ID NO: 13087 - RNA, 20 nt, Artificial Sequence
  TRAC targeting sequence
ugaggaaccccuuuaagauu

SEQ ID NO: 13088 - RNA, 20 nt, Artificial Sequence
  TRAC targeting sequence
cacagcuuaguaaagucauc

SEQ ID NO: 13089 - RNA, 20 nt, Artificial Sequence
  TRAC targeting sequence
agguggaaggacuugcaggu

SEQ ID NO: 13090 - RNA, 20 nt, Artificial Sequence
  TRAC targeting sequence
cccagggacucacacaguuu

SEQ ID NO: 13091 - RNA, 20 nt, Artificial Sequence
  TRAC targeting sequence
cagggacucacacaguuuuc

SEQ ID NO: 13092 - RNA, 20 nt, Artificial Sequence
  TRAC targeting sequence
cugggagaaaauggcuccag

SEQ ID NO: 13093 - RNA, 20 nt, Artificial Sequence
  TRAC targeting sequence
cacaguuuucucccuccccu

SEQ ID NO: 13094 - RNA, 20 nt, Artificial Sequence
  TRAC targeting sequence
cccuccccuccuccaggucu

SEQ ID NO: 13095 - RNA, 20 nt, Artificial Sequence
  TRAC targeting sequence
cuccccuccuccaggucucc

SEQ ID NO: 13096 - RNA, 20 nt, Artificial Sequence
  TRAC targeting sequence
ccuccuccaggucuccacuc

SEQ ID NO: 13097 - RNA, 20 nt, Artificial Sequence
  TRAC targeting sequence
uccaggucuccacucaaaug

SEQ ID NO: 13098 - RNA, 20 nt, Artificial Sequence
  TRAC targeting sequence
aggucuccacucaaauguca

SEQ ID NO: 13099 - RNA, 20 nt, Artificial Sequence
  TRAC targeting sequence
ccacucaaaugucauuucca

SEQ ID NO: 13100 - RNA, 20 nt, Artificial Sequence
  TRAC targeting sequence
acucaaaugucauuuccagu

SEQ ID NO: 13101 - RNA, 20 nt, Artificial Sequence
  TRAC targeting sequence
aaugucauuuccagugaauc

SEQ ID NO: 13102 - RNA, 20 nt, Artificial Sequence
  TRAC targeting sequence
uuuccagugaauccuuuccc

SEQ ID NO: 13103 - RNA, 20 nt, Artificial Sequence
  TRAC targeting sequence
agugaauccuuucccuacca

SEQ ID NO: 13104 - RNA, 20 nt, Artificial Sequence
  TRAC targeting sequence
cuggaaaugacauuugagug

SEQ ID NO: 13105 - RNA, 20 nt, Artificial Sequence
  TRAC targeting sequence
uuucccuaccaccucauguc

SEQ ID NO: 13106 - RNA, 20 nt, Artificial Sequence
  TRAC targeting sequence
cuaccaccucaugucacucu

SEQ ID NO: 13107 - RNA, 20 nt, Artificial Sequence
  TRAC targeting sequence
gagaaaaagucagcuauggu

SEQ ID NO: 13108 - RNA, 20 nt, Artificial Sequence
  TRAC targeting sequence
gauucauucauuccuuuauu

SEQ ID NO: 13109 - RNA, 20 nt, Artificial Sequence
  TRAC targeting sequence
cugauucauucauuccuuua

SEQ ID NO: 13110 - RNA, 20 nt, Artificial Sequence
  TRAC targeting sequence
gcuaugguauaaagcaaaag

SEQ ID NO: 13111 - RNA, 20 nt, Artificial Sequence
  TRAC targeting sequence
uuugcuuuauaccauagcug

SEQ ID NO: 13112 - RNA, 20 nt, Artificial Sequence
  TRAC targeting sequence
uuucuuuugcuuuauaccau

SEQ ID NO: 13113 - RNA, 20 nt, Artificial Sequence
  TRAC targeting sequence
uuuuucuuuucuuuugcuuu

SEQ ID NO: 13114 - RNA, 20 nt, Artificial Sequence
  TRAC targeting sequence
cuucauuuuucuuuucuuuu

SEQ ID NO: 13115 - RNA, 20 nt, Artificial Sequence
  TRAC targeting sequence
guagguuaccagcuucccuu

SEQ ID NO: 13116 - RNA, 20 nt, Artificial Sequence
  TRAC targeting sequence
gggugccagggaaucgacau

SEQ ID NO: 13117 - RNA, 20 nt, Artificial Sequence
  TRAC targeting sequence
cuggcacccagaacagugcc

SEQ ID NO: 13118 - RNA, 20 nt, Artificial Sequence
  TRAC targeting sequence
acaugaacaaagcaggcaug

SEQ ID NO: 13119 - RNA, 20 nt, Artificial Sequence
  TRAC targeting sequence
auucccuggcacccagaaca

SEQ ID NO: 13120 - RNA, 20 nt, Artificial Sequence
  TRAC targeting sequence
ugucgauucccuggcaccca

SEQ ID NO: 13121 - RNA, 20 nt, Artificial Sequence
  TRAC targeting sequence
ugccugcuuuguucaugucg

SEQ ID NO: 13122 - RNA, 20 nt, Artificial Sequence
  TRAC targeting sequence
gccauauuggagcuuauuuu

SEQ ID NO: 13123 - RNA, 20 nt, Artificial Sequence
  TRAC targeting sequence
aauauggcagaaguucaugc

SEQ ID NO: 13124 - RNA, 20 nt, Artificial Sequence
  TRAC targeting sequence
aauggcaaaagacagauggu

SEQ ID NO: 13125 - RNA, 20 nt, Artificial Sequence
  TRAC targeting sequence
uuugccauuagaaaauaagc

SEQ ID NO: 13126 - RNA, 20 nt, Artificial Sequence
  TRAC targeting sequence
gucuuuugccauuagaaaau

SEQ ID NO: 13127 - RNA, 20 nt, Artificial Sequence
  TRAC targeting sequence
uuauucuccuucccggcuuu

SEQ ID NO: 13128 - RNA, 20 nt, Artificial Sequence
  TRAC targeting sequence
ucuuuauucuccuucccggc

SEQ ID NO: 13129 - RNA, 20 nt, Artificial Sequence
  TRAC targeting sequence
cacuaguccucuuuauucuc

SEQ ID NO: 13130 - RNA, 20 nt, Artificial Sequence
  TRAC targeting sequence
cucccacuaguccucuuuau

SEQ ID NO: 13131 - RNA, 20 nt, Artificial Sequence
  TRAC targeting sequence
guuuaaaacugcaugcuggu

SEQ ID NO: 13132 - RNA, 20 nt, Artificial Sequence
  TRAC targeting sequence
ucuguuuaaaacugcaugcu

SEQ ID NO: 13133 - RNA, 20 nt, Artificial Sequence
  TRAC targeting sequence
cagaaggucucacuggaaag

SEQ ID NO: 13134 - RNA, 20 nt, Artificial Sequence
  TRAC targeting sequence
gugacucuucuguuuaaaac

SEQ ID NO: 13135 - RNA, 20 nt, Artificial Sequence
  TRAC targeting sequence
cacuggaaaggugacagugg

SEQ ID NO: 13136 - RNA, 20 nt, Artificial Sequence
  TRAC targeting sequence
cuggaaaggugacaguggag

SEQ ID NO: 13137 - RNA, 20 nt, Artificial Sequence
  TRAC targeting sequence
agugagaccuucugugacuc

SEQ ID NO: 13138 - RNA, 20 nt, Artificial Sequence
  TRAC targeting sequence
ccuuuccagugagaccuucu

SEQ ID NO: 13139 - RNA, 20 nt, Artificial Sequence
  TRAC targeting sequence
acugucaccuuuccagugag

SEQ ID NO: 13140 - RNA, 20 nt, Artificial Sequence
  TRAC targeting sequence
gcuccacugucaccuuucca

SEQ ID NO: 13141 - RNA, 20 nt, Artificial Sequence
  TRAC targeting sequence
cugcuccacugucaccuuuc

SEQ ID NO: 13142 - RNA, 20 nt, Artificial Sequence
  TRAC targeting sequence
ggucucugcuccacugucac

SEQ ID NO: 13143 - RNA, 20 nt, Artificial Sequence
  TRAC targeting sequence
ucgggucucugcuccacugu

SEQ ID NO: 13144 - RNA, 20 nt, Artificial Sequence
  TRAC targeting sequence
cuuuaccaccuccucggguc

SEQ ID NO: 13145 - RNA, 20 nt, Artificial Sequence
  TRAC targeting sequence
aauaauuacaucgagucucu

SEQ ID NO: 13146 - RNA, 20 nt, Artificial Sequence
  TRAC targeting sequence
agucucucuaguucacagau

SEQ ID NO: 13147 - RNA, 20 nt, Artificial Sequence
  TRAC targeting sequence
auguaauuauuagaauguuu

SEQ ID NO: 13148 - RNA, 20 nt, Artificial Sequence
  TRAC targeting sequence
cucuaguucacagaugcugu

SEQ ID NO: 13149 - RNA, 20 nt, Artificial Sequence
  TRAC targeting sequence
cuaguucacagaugcuguau

SEQ ID NO: 13150 - RNA, 20 nt, Artificial Sequence
  TRAC targeting sequence
aguucacagaugcuguaucu

SEQ ID NO: 13151 - RNA, 20 nt, Artificial Sequence
  TRAC targeting sequence
cagaugcuguaucuaaucuu

SEQ ID NO: 13152 - RNA, 20 nt, Artificial Sequence
  TRAC targeting sequence
gugaacuagagagacucgau

SEQ ID NO: 13153 - RNA, 20 nt, Artificial Sequence
  TRAC targeting sequence
aaucuuauaaccuauaauac

SEQ ID NO: 13154 - RNA, 20 nt, Artificial Sequence
  TRAC targeting sequence
uauaaccuauaauacggaag

SEQ ID NO: 13155 - RNA, 20 nt, Artificial Sequence
  TRAC targeting sequence
guauuauagguuauaagauu

SEQ ID NO: 13156 - RNA, 20 nt, Artificial Sequence
  TRAC targeting sequence
uccguauuauagguuauaag

SEQ ID NO: 13157 - RNA, 20 nt, Artificial Sequence
  TRAC targeting sequence
ucacuucguagagaaaccag

SEQ ID NO: 13158 - RNA, 20 nt, Artificial Sequence
  TRAC targeting sequence
cuucguagagaaaccagaua

SEQ ID NO: 13159 - RNA, 20 nt, Artificial Sequence
  TRAC targeting sequence
uagagaaaccagauaaagcu

SEQ ID NO: 13160 - RNA, 20 nt, Artificial Sequence
  TRAC targeting sequence
acgaagugaggauaacaucu

SEQ ID NO: 13161 - RNA, 20 nt, Artificial Sequence
  TRAC targeting sequence
cuacgaagugaggauaacau

SEQ ID NO: 13162 - RNA, 20 nt, Artificial Sequence
  TRAC targeting sequence
gguuucucuacgaagugagg

SEQ ID NO: 13163 - RNA, 20 nt, Artificial Sequence
  TRAC targeting sequence
gugaguuuaaggaacuuggc

SEQ ID NO: 13164 - RNA, 20 nt, Artificial Sequence
  TRAC targeting sequence
cugagcuuuaucugguuucu

SEQ ID NO: 13165 - RNA, 20 nt, Artificial Sequence
  TRAC targeting sequence
uuaaacucacugagcuuuau

SEQ ID NO: 13166 - RNA, 20 nt, Artificial Sequence
  TRAC targeting sequence
acuuuacaacgacuaggaac

SEQ ID NO: 13167 - RNA, 20 nt, Artificial Sequence
  TRAC targeting sequence
uuguaaaguagaaggauguc

SEQ ID NO: 13168 - RNA, 20 nt, Artificial Sequence
  TRAC targeting sequence
uagucguuguaaaguagaag

SEQ ID NO: 13169 - RNA, 20 nt, Artificial Sequence
  TRAC targeting sequence
uguuagugauucuccaacua

SEQ ID NO: 13170 - RNA, 20 nt, Artificial Sequence
  TRAC targeting sequence
cuaacaugaagggugguucc

SEQ ID NO: 13171 - RNA, 20 nt, Artificial Sequence
  TRAC targeting sequence
ccaacuaucaucuacagucu

SEQ ID NO: 13172 - RNA, 20 nt, Artificial Sequence
  TRAC targeting sequence
aacuaucaucuacagucuuu

SEQ ID NO: 13173 - RNA, 20 nt, Artificial Sequence
  TRAC targeting sequence
ucuacagucuuuuaaggauu

SEQ ID NO: 13174 - RNA, 20 nt, Artificial Sequence
  TRAC targeting sequence
acagucuuuuaaggauugua

SEQ ID NO: 13175 - RNA, 20 nt, Artificial Sequence
  TRAC targeting sequence
uuuaaggauuguaaacugau

SEQ ID NO: 13176 - RNA, 20 nt, Artificial Sequence
  TRAC targeting sequence
uuaaaagacuguagaugaua

SEQ ID NO: 13177 - RNA, 20 nt, Artificial Sequence
  TRAC targeting sequence
guuuacaauccuuaaaagac

SEQ ID NO: 13178 - RNA, 20 nt, Artificial Sequence
  TRAC targeting sequence
gaaaaauccauauucccucc

SEQ ID NO: 13179 - RNA, 20 nt, Artificial Sequence
  TRAC targeting sequence
gaucaguuuacaauccuuaa

SEQ ID NO: 13180 - RNA, 20 nt, Artificial Sequence
  TRAC targeting sequence
auauucccuccuugguuuuu

SEQ ID NO: 13181 - RNA, 20 nt, Artificial Sequence
  TRAC targeting sequence
cuccuugguuuuuaugagug

SEQ ID NO: 13182 - RNA, 20 nt, Artificial Sequence
  TRAC targeting sequence
uugguuuuuaugagugacau

SEQ ID NO: 13183 - RNA, 20 nt, Artificial Sequence
  TRAC targeting sequence
uaaaaaccaaggagggaaua

SEQ ID NO: 13184 - RNA, 20 nt, Artificial Sequence
  TRAC targeting sequence
cucauaaaaaccaaggaggg

SEQ ID NO: 13185 - RNA, 20 nt, Artificial Sequence
  TRAC targeting sequence
cauagauucugauguucacg

SEQ ID NO: 13186 - RNA, 20 nt, Artificial Sequence
  TRAC targeting sequence
uagauucugauguucacgua

SEQ ID NO: 13187 - RNA, 20 nt, Artificial Sequence
  TRAC targeting sequence
augagauugccuguauguca

SEQ ID NO: 13188 - RNA, 20 nt, Artificial Sequence
  TRAC targeting sequence
gauguucacguauaacagaa

SEQ ID NO: 13189 - RNA, 20 nt, Artificial Sequence
  TRAC targeting sequence
gaaucuaugagauugccugu

SEQ ID NO: 13190 - RNA, 20 nt, Artificial Sequence
  TRAC targeting sequence
cguauaacagaaauuaauuu

SEQ ID NO: 13191 - RNA, 20 nt, Artificial Sequence
  TRAC targeting sequence
guuauacgugaacaucagaa

SEQ ID NO: 13192 - RNA, 20 nt, Artificial Sequence
  TRAC targeting sequence
cuucuaagugugagaguguc

SEQ ID NO: 13193 - RNA, 20 nt, Artificial Sequence
  TRAC targeting sequence
aagugugagagugucauuga

SEQ ID NO: 13194 - RNA, 20 nt, Artificial Sequence
  TRAC targeting sequence
cacuuagaagugacaguuaa

SEQ ID NO: 13195 - RNA, 20 nt, Artificial Sequence
  TRAC targeting sequence
cacacuuagaagugacaguu

SEQ ID NO: 13196 - RNA, 20 nt, Artificial Sequence
  TRAC targeting sequence
uugaagcuugcuaaaauuug

SEQ ID NO: 13197 - RNA, 20 nt, Artificial Sequence
  TRAC targeting sequence
augacacucucacacuuaga

SEQ ID NO: 13198 - RNA, 20 nt, Artificial Sequence
  TRAC targeting sequence
aauuuuagcaagcuucaaug

SEQ ID NO: 13199 - RNA, 20 nt, Artificial Sequence
  TRAC targeting sequence
ugcauaucaaauuuuagcaa

SEQ ID NO: 13200 - RNA, 20 nt, Artificial Sequence
  TRAC targeting sequence
auuuuaauaacacauucaug

SEQ ID NO: 13201 - RNA, 20 nt, Artificial Sequence
  TRAC targeting sequence
auccauuuuaauaacacauu

SEQ ID NO: 13202 - RNA, 20 nt, Artificial Sequence
  TRAC targeting sequence
auuuuguacuaagcaguuug

SEQ ID NO: 13203 - RNA, 20 nt, Artificial Sequence
  TRAC targeting sequence
cugccucaccuaaguguagc

SEQ ID NO: 13204 - RNA, 20 nt, Artificial Sequence
  TRAC targeting sequence
ccuaaguguagcccgaaggu

SEQ ID NO: 13205 - RNA, 20 nt, Artificial Sequence
  TRAC targeting sequence
ggcuacacuuaggugaggca

SEQ ID NO: 13206 - RNA, 20 nt, Artificial Sequence
  TRAC targeting sequence
accuucgggcuacacuuagg

SEQ ID NO: 13207 - RNA, 20 nt, Artificial Sequence
  TRAC targeting sequence
ccaccuucgggcuacacuua

SEQ ID NO: 13208 - RNA, 20 nt, Artificial Sequence
  TRAC targeting sequence
augaccaacguuccacccuu

SEQ ID NO: 13209 - RNA, 20 nt, Artificial Sequence
  TRAC targeting sequence
uagagcagugguucuccacc

SEQ ID NO: 13210 - RNA, 20 nt, Artificial Sequence
  TRAC targeting sequence
acccuucuuuccucuugauc

SEQ ID NO: 13211 - RNA, 20 nt, Artificial Sequence
  TRAC targeting sequence
uuccucuugaucaaaccaaa

SEQ ID NO: 13212 - RNA, 20 nt, Artificial Sequence
  TRAC targeting sequence
gucagauuguaauaugggca

SEQ ID NO: 13213 - RNA, 20 nt, Artificial Sequence
  TRAC targeting sequence
gauuguaauaugggcaaaag

SEQ ID NO: 13214 - RNA, 20 nt, Artificial Sequence
  TRAC targeting sequence
gacagaauuugugcucaaau

SEQ ID NO: 13215 - RNA, 20 nt, Artificial Sequence
  TRAC targeting sequence
aagcuuuugcccauauuaca

SEQ ID NO: 13216 - RNA, 20 nt, Artificial Sequence
  TRAC targeting sequence
auuugaugcuagagucaccu

SEQ ID NO: 13217 - RNA, 20 nt, Artificial Sequence
  TRAC targeting sequence
aauagaaauccaagcuuuug

SEQ ID NO: 13218 - RNA, 20 nt, Artificial Sequence
  TRAC targeting sequence
agcaucaaauagaaauccaa

SEQ ID NO: 13219 - RNA, 20 nt, Artificial Sequence
  TRAC targeting sequence
ccucuuguuccauccugaag

SEQ ID NO: 13220 - RNA, 20 nt, Artificial Sequence
  TRAC targeting sequence
uguuccauccugaaggacaa

SEQ ID NO: 13221 - RNA, 20 nt, Artificial Sequence
  TRAC targeting sequence
auccugaaggacaaccucua

SEQ ID NO: 13222 - RNA, 20 nt, Artificial Sequence
  TRAC targeting sequence
ugaaggacaaccucuaagac

SEQ ID NO: 13223 - RNA, 20 nt, Artificial Sequence
  TRAC targeting sequence
cuuuacggcaacccuagccc

SEQ ID NO: 13224 - RNA, 20 nt, Artificial Sequence
  TRAC targeting sequence
aaaaacuaccuugcuuuucc

SEQ ID NO: 13225 - RNA, 20 nt, Artificial Sequence
  TRAC targeting sequence
gcugugccagaccccugauc

SEQ ID NO: 13226 - RNA, 20 nt, Artificial Sequence
  TRAC targeting sequence
ggcacagcugacauaccuaa

SEQ ID NO: 13227 - RNA, 20 nt, Artificial Sequence
  TRAC targeting sequence
ggggucuggcacagcugaca

SEQ ID NO: 13228 - RNA, 20 nt, Artificial Sequence
  TRAC targeting sequence
uuggcaaaggaaccuaucug

SEQ ID NO: 13229 - RNA, 20 nt, Artificial Sequence
  TRAC targeting sequence
uuugccaaagaucagggguc

SEQ ID NO: 13230 - RNA, 20 nt, Artificial Sequence
  TRAC targeting sequence
ggagguacaacaacguaagu

SEQ ID NO: 13231 - RNA, 20 nt, Artificial Sequence
  TRAC targeting sequence
agauagguuccuuugccaaa

SEQ ID NO: 13232 - RNA, 20 nt, Artificial Sequence
  TRAC targeting sequence
uucuuaugaccacuauguuu

SEQ ID NO: 13233 - RNA, 20 nt, Artificial Sequence
  TRAC targeting sequence
uaugaccacuauguuuggca

SEQ ID NO: 13234 - RNA, 20 nt, Artificial Sequence
  TRAC targeting sequence
uaagaaggaaaaguagguua

SEQ ID NO: 13235 - RNA, 20 nt, Artificial Sequence
  TRAC targeting sequence
aagucaccagguuaggaagc

SEQ ID NO: 13236 - RNA, 20 nt, Artificial Sequence
  TRAC targeting sequence
ccagguuaggaagcagugcu

SEQ ID NO: 13237 - RNA, 20 nt, Artificial Sequence
  TRAC targeting sequence
uaaccuggugacuuagaaaa

SEQ ID NO: 13238 - RNA, 20 nt, Artificial Sequence
  TRAC targeting sequence
gaggccaaguuccaaucugu

SEQ ID NO: 13239 - RNA, 20 nt, Artificial Sequence
  TRAC targeting sequence
gauuuacugguucagcgugc

SEQ ID NO: 13240 - RNA, 20 nt, Artificial Sequence
  TRAC targeting sequence
aaucuguccaaugcauuaac

SEQ ID NO: 13241 - RNA, 20 nt, Artificial Sequence
  TRAC targeting sequence
guccaaugcauuaacugaca

SEQ ID NO: 13242 - RNA, 20 nt, Artificial Sequence
  TRAC targeting sequence
aaugcauuaacugacaaugc

SEQ ID NO: 13243 - RNA, 20 nt, Artificial Sequence
  TRAC targeting sequence
guuaaugcauuggacagauu

SEQ ID NO: 13244 - RNA, 20 nt, Artificial Sequence
  TRAC targeting sequence
gcuaaugcauugucaguuaa

SEQ ID NO: 13245 - RNA, 20 nt, Artificial Sequence
  TRAC targeting sequence
gugacuuaacugcacugaac

SEQ ID NO: 13246 - RNA, 20 nt, Artificial Sequence
  TRAC targeting sequence
cagaguuugucagcuaaugc

SEQ ID NO: 13247 - RNA, 20 nt, Artificial Sequence
  TRAC targeting sequence
gugcaguuaagucacagagu

SEQ ID NO: 13248 - RNA, 20 nt, Artificial Sequence
  TRAC targeting sequence
ccagaccaauucuuaugaac

SEQ ID NO: 13249 - RNA, 20 nt, Artificial Sequence
  TRAC targeting sequence
ggggauaaucaggaucauag

SEQ ID NO: 13250 - RNA, 20 nt, Artificial Sequence
  TRAC targeting sequence
uaugaacaauugggaggaaa

SEQ ID NO: 13251 - RNA, 20 nt, Artificial Sequence
  TRAC targeting sequence
uaagaauuggucuggggaua

SEQ ID NO: 13252 - RNA, 20 nt, Artificial Sequence
  TRAC targeting sequence
caauuguucauaagaauugg

SEQ ID NO: 13253 - RNA, 20 nt, Artificial Sequence
  TRAC targeting sequence
ucccaauuguucauaagaau

SEQ ID NO: 13254 - RNA, 20 nt, Artificial Sequence
  TRAC targeting sequence
uugcuuuuccucccaauugu

SEQ ID NO: 13255 - RNA, 20 nt, Artificial Sequence
  TRAC targeting sequence
caccauugggcuuccuugcu

SEQ ID NO: 13256 - RNA, 20 nt, Artificial Sequence
  TRAC targeting sequence
uauuacccaguaggaauucu

SEQ ID NO: 13257 - RNA, 20 nt, Artificial Sequence
  TRAC targeting sequence
gugagauggaucuaaaaaua

SEQ ID NO: 13258 - RNA, 20 nt, Artificial Sequence
  TRAC targeting sequence
cagacaaaggcacuguaaag

SEQ ID NO: 13259 - RNA, 20 nt, Artificial Sequence
  TRAC targeting sequence
cacagacaaaggcacuguaa

SEQ ID NO: 13260 - RNA, 20 nt, Artificial Sequence
  TRAC targeting sequence
aucucacagacaaaggcacu

SEQ ID NO: 13261 - RNA, 20 nt, Artificial Sequence
  TRAC targeting sequence
aaaaauaucaccucauagag

SEQ ID NO: 13262 - RNA, 20 nt, Artificial Sequence
  TRAC targeting sequence
ccucauagaguuuauuucaa

SEQ ID NO: 13263 - RNA, 20 nt, Artificial Sequence
  TRAC targeting sequence
uagaguuuauuucaauaacu

SEQ ID NO: 13264 - RNA, 20 nt, Artificial Sequence
  TRAC targeting sequence
augaggugauauuuuuagau

SEQ ID NO: 13265 - RNA, 20 nt, Artificial Sequence
  TRAC targeting sequence
auaacuuuguugaaguagua

SEQ ID NO: 13266 - RNA, 20 nt, Artificial Sequence
  TRAC targeting sequence
acuaaaucaaucacaacagg

SEQ ID NO: 13267 - RNA, 20 nt, Artificial Sequence
  TRAC targeting sequence
caagguggaagcuaaagcuu

SEQ ID NO: 13268 - RNA, 20 nt, Artificial Sequence
  TRAC targeting sequence
uaaccacauguuuugugucu

SEQ ID NO: 13269 - RNA, 20 nt, Artificial Sequence
  TRAC targeting sequence
ucauaaccacauguuuugug

SEQ ID NO: 13270 - RNA, 20 nt, Artificial Sequence
  TRAC targeting sequence
cuucauaaccacauguuuug

SEQ ID NO: 13271 - RNA, 20 nt, Artificial Sequence
  TRAC targeting sequence
ucucuucauaaccacauguu

SEQ ID NO: 13272 - RNA, 20 nt, Artificial Sequence
  TRAC targeting sequence
uuuacaaaaaccuugucauc

SEQ ID NO: 13273 - RNA, 20 nt, Artificial Sequence
  TRAC targeting sequence
uucuuuuacaaaaaccuugu

SEQ ID NO: 13274 - RNA, 20 nt, Artificial Sequence
  TRAC targeting sequence
acaauggcucauucuuuuac

SEQ ID NO: 13275 - RNA, 20 nt, Artificial Sequence
  TRAC targeting sequence
caaagccuauccacaauggc

SEQ ID NO: 13276 - RNA, 20 nt, Artificial Sequence
  TRAC targeting sequence
ggcacucaagugauuguuuu

SEQ ID NO: 13277 - RNA, 20 nt, Artificial Sequence
  TRAC targeting sequence
agugauuguuuuaccacgua

SEQ ID NO: 13278 - RNA, 20 nt, Artificial Sequence
  TRAC targeting sequence
cuugagugccggacccgcaa

SEQ ID NO: 13279 - RNA, 20 nt, Artificial Sequence
  TRAC targeting sequence
uuucucauuucugugggcug

SEQ ID NO: 13280 - RNA, 20 nt, Artificial Sequence
  TRAC targeting sequence
cauuucugugggcuguuaug

SEQ ID NO: 13281 - RNA, 20 nt, Artificial Sequence
  TRAC targeting sequence
uuucugugggcuguuauguc

SEQ ID NO: 13282 - RNA, 20 nt, Artificial Sequence
  TRAC targeting sequence
gugggcuguuauguccguaa

SEQ ID NO: 13283 - RNA, 20 nt, Artificial Sequence
  TRAC targeting sequence
guaaaucauauagaacaguu

SEQ ID NO: 13284 - RNA, 20 nt, Artificial Sequence
  TRAC targeting sequence
uauagaacaguucuucuuau

SEQ ID NO: 13285 - RNA, 20 nt, Artificial Sequence
  TRAC targeting sequence
auaugauuuacggacauaac

SEQ ID NO: 13286 - RNA, 20 nt, Artificial Sequence
  TRAC targeting sequence
ucuuaugcacacacacacac

SEQ ID NO: 13287 - RNA, 20 nt, Artificial Sequence
  TRAC targeting sequence
uaugcacacacacacacaca

SEQ ID NO: 13288 - RNA, 20 nt, Artificial Sequence
  TRAC targeting sequence
agucacugaggagaaacagu

SEQ ID NO: 13289 - RNA, 20 nt, Artificial Sequence
  TRAC targeting sequence
cugaggagaaacagucucug

SEQ ID NO: 13290 - RNA, 20 nt, Artificial Sequence
  TRAC targeting sequence
gugacuggaaaaugggugug

SEQ ID NO: 13291 - RNA, 20 nt, Artificial Sequence
  TRAC targeting sequence
ucagugacuggaaaaugggu

SEQ ID NO: 13292 - RNA, 20 nt, Artificial Sequence
  TRAC targeting sequence
ccucagugacuggaaaaugg

SEQ ID NO: 13293 - RNA, 20 nt, Artificial Sequence
  TRAC targeting sequence
cugggucuaccuacacagcc

SEQ ID NO: 13294 - RNA, 20 nt, Artificial Sequence
  TRAC targeting sequence
gggucuaccuacacagccag

SEQ ID NO: 13295 - RNA, 20 nt, Artificial Sequence
  TRAC targeting sequence
accuacacagccaguuugac

SEQ ID NO: 13296 - RNA, 20 nt, Artificial Sequence
  TRAC targeting sequence
aacuggcuguguagguagac

SEQ ID NO: 13297 - RNA, 20 nt, Artificial Sequence
  TRAC targeting sequence
uaauggucaaacuggcugug

SEQ ID NO: 13298 - RNA, 20 nt, Artificial Sequence
  TRAC targeting sequence
aauucauuuuucaagauaau

SEQ ID NO: 13299 - RNA, 20 nt, Artificial Sequence
  TRAC targeting sequence
uuuuucaagauaauuuuaac

SEQ ID NO: 13300 - RNA, 20 nt, Artificial Sequence
  TRAC targeting sequence
agauaauuuuaacugguucc

SEQ ID NO: 13301 - RNA, 20 nt, Artificial Sequence
  TRAC targeting sequence
ugaaaaaugaauuugaccau

SEQ ID NO: 13302 - RNA, 20 nt, Artificial Sequence
  TRAC targeting sequence
auuuaaugcugccaacagcc

SEQ ID NO: 13303 - RNA, 20 nt, Artificial Sequence
  TRAC targeting sequence
ugggaaccuaaucuauguuc

SEQ ID NO: 13304 - RNA, 20 nt, Artificial Sequence
  TRAC targeting sequence
cacgacaugcuaaugcccuu

SEQ ID NO: 13305 - RNA, 20 nt, Artificial Sequence
  TRAC targeting sequence
auguucacucacugcugugg

SEQ ID NO: 13306 - RNA, 20 nt, Artificial Sequence
  TRAC targeting sequence
cucacugcugugggaggaca

SEQ ID NO: 13307 - RNA, 20 nt, Artificial Sequence
  TRAC targeting sequence
cugcugugggaggacaguca

SEQ ID NO: 13308 - RNA, 20 nt, Artificial Sequence
  TRAC targeting sequence
cacagcagugagugaacaua

SEQ ID NO: 13309 - RNA, 20 nt, Artificial Sequence
  TRAC targeting sequence
ucccacagcagugagugaac

SEQ ID NO: 13310 - RNA, 20 nt, Artificial Sequence
  TRAC targeting sequence
uuucuucuucuccccuggca

SEQ ID NO: 13311 - RNA, 20 nt, Artificial Sequence
  TRAC targeting sequence
ucuucuccccuggcagucag

SEQ ID NO: 13312 - RNA, 20 nt, Artificial Sequence
  TRAC targeting sequence
ucuccccuggcagucagacu

SEQ ID NO: 13313 - RNA, 20 nt, Artificial Sequence
  TRAC targeting sequence
ccccuggcagucagacuuca

SEQ ID NO: 13314 - RNA, 20 nt, Artificial Sequence
  TRAC targeting sequence
ccuggcagucagacuucaga

SEQ ID NO: 13315 - RNA, 20 nt, Artificial Sequence
  TRAC targeting sequence
gacuucagaauccagcugac

SEQ ID NO: 13316 - RNA, 20 nt, Artificial Sequence
  TRAC targeting sequence
gacugccaggggagaagaag

SEQ ID NO: 13317 - RNA, 20 nt, Artificial Sequence
  TRAC targeting sequence
gaauccagcugaccuuuucc

SEQ ID NO: 13318 - RNA, 20 nt, Artificial Sequence
  TRAC targeting sequence
gaagucugacugccagggga

SEQ ID NO: 13319 - RNA, 20 nt, Artificial Sequence
  TRAC targeting sequence
agcugaccuuuuccaugccu

SEQ ID NO: 13320 - RNA, 20 nt, Artificial Sequence
  TRAC targeting sequence
gcuggauucugaagucugac

SEQ ID NO: 13321 - RNA, 20 nt, Artificial Sequence
  TRAC targeting sequence
augccugucucuucuggcag

SEQ ID NO: 13322 - RNA, 20 nt, Artificial Sequence
  TRAC targeting sequence
cuucuggcagauuaaguggu

SEQ ID NO: 13323 - RNA, 20 nt, Artificial Sequence
  TRAC targeting sequence
ucuggcagauuaagugguua

SEQ ID NO: 13324 - RNA, 20 nt, Artificial Sequence
  TRAC targeting sequence
ggcagauuaagugguuauuu

SEQ ID NO: 13325 - RNA, 20 nt, Artificial Sequence
  TRAC targeting sequence
gccagaagagacaggcaugg

SEQ ID NO: 13326 - RNA, 20 nt, Artificial Sequence
  TRAC targeting sequence
acuaacuuucuuguggaaaa

SEQ ID NO: 13327 - RNA, 20 nt, Artificial Sequence
  TRAC targeting sequence
uguggaaaaacacacaagac

SEQ ID NO: 13328 - RNA, 20 nt, Artificial Sequence
  TRAC targeting sequence
acaagaaaguuaguggaaau

SEQ ID NO: 13329 - RNA, 20 nt, Artificial Sequence
  TRAC targeting sequence
uguguguuuuuccacaagaa

SEQ ID NO: 13330 - RNA, 20 nt, Artificial Sequence
  TRAC targeting sequence
gucuuguguguuuuuccaca

SEQ ID NO: 13331 - RNA, 20 nt, Artificial Sequence
  TRAC targeting sequence
ccuucaguuuuuacuaagaa

SEQ ID NO: 13332 - RNA, 20 nt, Artificial Sequence
  TRAC targeting sequence
uucaguuuuuacuaagaaag

SEQ ID NO: 13333 - RNA, 20 nt, Artificial Sequence
  TRAC targeting sequence
guuuuuacuaagaaaguuuu

SEQ ID NO: 13334 - RNA, 20 nt, Artificial Sequence
  TRAC targeting sequence
uaguaaaaacugaaggagaa

SEQ ID NO: 13335 - RNA, 20 nt, Artificial Sequence
  TRAC targeting sequence
uuuugacaauaaacuucagc

SEQ ID NO: 13336 - RNA, 20 nt, Artificial Sequence
  TRAC targeting sequence
aaaugauaaccacaaaacuu

SEQ ID NO: 13337 - RNA, 20 nt, Artificial Sequence
  TRAC targeting sequence
gcuagcauagucccuacuau

SEQ ID NO: 13338 - RNA, 20 nt, Artificial Sequence
  TRAC targeting sequence
cuacuauucauguuaauaau

SEQ ID NO: 13339 - RNA, 20 nt, Artificial Sequence
  TRAC targeting sequence
uguuaauaauaucuugacuu

SEQ ID NO: 13340 - RNA, 20 nt, Artificial Sequence
  TRAC targeting sequence
ugacuugaaccaucauauuu

SEQ ID NO: 13341 - RNA, 20 nt, Artificial Sequence
  TRAC targeting sequence
agauauuauuaacaugaaua

SEQ ID NO: 13342 - RNA, 20 nt, Artificial Sequence
  TRAC targeting sequence
agucaagauauuauuaacau

SEQ ID NO: 13343 - RNA, 20 nt, Artificial Sequence
  TRAC targeting sequence
uauuuuccccacaucauuca

SEQ ID NO: 13344 - RNA, 20 nt, Artificial Sequence
  TRAC targeting sequence
ccacaucauucacaaugcau

SEQ ID NO: 13345 - RNA, 20 nt, Artificial Sequence
  TRAC targeting sequence
uucacaaugcauuucaaugc

SEQ ID NO: 13346 - RNA, 20 nt, Artificial Sequence
  TRAC targeting sequence
caaugcauuucaaugcugua

SEQ ID NO: 13347 - RNA, 20 nt, Artificial Sequence
  TRAC targeting sequence
augcuguaacccacugcacc

SEQ ID NO: 13348 - RNA, 20 nt, Artificial Sequence
  TRAC targeting sequence
ccagcccuuuuaucuucaca

SEQ ID NO: 13349 - RNA, 20 nt, Artificial Sequence
  TRAC targeting sequence
ucacaacguucucuaauaag

SEQ ID NO: 13350 - RNA, 20 nt, Artificial Sequence
  TRAC targeting sequence
caacguucucuaauaaggua

SEQ ID NO: 13351 - RNA, 20 nt, Artificial Sequence
  TRAC targeting sequence
cuaauaagguaaacaggauc

SEQ ID NO: 13352 - RNA, 20 nt, Artificial Sequence
  TRAC targeting sequence
aauaagguaaacaggaucau

SEQ ID NO: 13353 - RNA, 20 nt, Artificial Sequence
  TRAC targeting sequence
uguuuaccuuauuagagaac

SEQ ID NO: 13354 - RNA, 20 nt, Artificial Sequence
  TRAC targeting sequence
uacaucaucaaacauauguc

SEQ ID NO: 13355 - RNA, 20 nt, Artificial Sequence
  TRAC targeting sequence
ucaaacauaugucacagaca

SEQ ID NO: 13356 - RNA, 20 nt, Artificial Sequence
  TRAC targeting sequence
aacauaugucacagacagaa

SEQ ID NO: 13357 - RNA, 20 nt, Artificial Sequence
  TRAC targeting sequence
cagacagaaaagcugacaca

SEQ ID NO: 13358 - RNA, 20 nt, Artificial Sequence
  TRAC targeting sequence
gugacauauguuugaugaug

SEQ ID NO: 13359 - RNA, 20 nt, Artificial Sequence
  TRAC targeting sequence
gucugugacauauguuugau

SEQ ID NO: 13360 - RNA, 20 nt, Artificial Sequence
  TRAC targeting sequence
gcuuuucugucugugacaua

SEQ ID NO: 13361 - RNA, 20 nt, Artificial Sequence
  TRAC targeting sequence
gugugucagcuuuucugucu

SEQ ID NO: 13362 - RNA, 20 nt, Artificial Sequence
  TRAC targeting sequence
aaccaaaaaaaaaucauaac

SEQ ID NO: 13363 - RNA, 20 nt, Artificial Sequence
  TRAC targeting sequence
uaacugggauuagagcuuga

SEQ ID NO: 13364 - RNA, 20 nt, Artificial Sequence
  TRAC targeting sequence
caguuaugauuuuuuuuugg

SEQ ID NO: 13365 - RNA, 20 nt, Artificial Sequence
  TRAC targeting sequence
aaucccaguuaugauuuuuu

SEQ ID NO: 13366 - RNA, 20 nt, Artificial Sequence
  TRAC targeting sequence
agcucuaaucccaguuauga

SEQ ID NO: 13367 - RNA, 20 nt, Artificial Sequence
  TRAC targeting sequence
caagcucuaaucccaguuau

SEQ ID NO: 13368 - RNA, 20 nt, Artificial Sequence
  TRAC targeting sequence
cuauuuucuuacagugaacu

SEQ ID NO: 13369 - RNA, 20 nt, Artificial Sequence
  TRAC targeting sequence
uacagugaacugucuugagc

SEQ ID NO: 13370 - RNA, 20 nt, Artificial Sequence
  TRAC targeting sequence
cuguaagaaaauagggaauc

SEQ ID NO: 13371 - RNA, 20 nt, Artificial Sequence
  TRAC targeting sequence
ugagcugucacuuaaugcau

SEQ ID NO: 13372 - RNA, 20 nt, Artificial Sequence
  TRAC targeting sequence
agacaguucacuguaagaaa

SEQ ID NO: 13373 - RNA, 20 nt, Artificial Sequence
  TRAC targeting sequence
cuuaaugcauugaaaacaua

SEQ ID NO: 13374 - RNA, 20 nt, Artificial Sequence
  TRAC targeting sequence
augcauuaagugacagcuca

SEQ ID NO: 13375 - RNA, 20 nt, Artificial Sequence
  TRAC targeting sequence
gaacaugaaacuugacugaa

SEQ ID NO: 13376 - RNA, 20 nt, Artificial Sequence
  TRAC targeting sequence
gaaaaugccuauggccugug

SEQ ID NO: 13377 - RNA, 20 nt, Artificial Sequence
  TRAC targeting sequence
uguucugaaaaugccuaugg

SEQ ID NO: 13378 - RNA, 20 nt, Artificial Sequence
  TRAC targeting sequence
aguuucauguucugaaaaug

SEQ ID NO: 13379 - RNA, 20 nt, Artificial Sequence
  TRAC targeting sequence
gucaaguuucauguucugaa

SEQ ID NO: 13380 - RNA, 20 nt, Artificial Sequence
  TRAC targeting sequence
guuuuuguuucagucaaguu

SEQ ID NO: 13381 - RNA, 20 nt, Artificial Sequence
  TRAC targeting sequence
aacagucaguuuuuguuuca

SEQ ID NO: 13382 - RNA, 20 nt, Artificial Sequence
  TRAC targeting sequence
ccaaaucuccuuugcuauug

SEQ ID NO: 13383 - RNA, 20 nt, Artificial Sequence
  TRAC targeting sequence
ccuuugcuauugauagucau

SEQ ID NO: 13384 - RNA, 20 nt, Artificial Sequence
  TRAC targeting sequence
uuugcuauugauagucauuu

SEQ ID NO: 13385 - RNA, 20 nt, Artificial Sequence
  TRAC targeting sequence
auagcaaaggagauuugggg

SEQ ID NO: 13386 - RNA, 20 nt, Artificial Sequence
  TRAC targeting sequence
uuuggugccagugacaggga

SEQ ID NO: 13387 - RNA, 20 nt, Artificial Sequence
  TRAC targeting sequence
cuggcaccaaaugacuauca

SEQ ID NO: 13388 - RNA, 20 nt, Artificial Sequence
  TRAC targeting sequence
cugucacuggcaccaaauga

SEQ ID NO: 13389 - RNA, 20 nt, Artificial Sequence
  TRAC targeting sequence
ucccugucacuggcaccaaa

SEQ ID NO: 13390 - RNA, 20 nt, Artificial Sequence
  TRAC targeting sequence
gcucuucccugucacuggca

SEQ ID NO: 13391 - RNA, 20 nt, Artificial Sequence
  TRAC targeting sequence
uaagccccucugcucuuccc

SEQ ID NO: 13392 - RNA, 20 nt, Artificial Sequence
  TRAC targeting sequence
acaaaaaccuccuaagcccc

SEQ ID NO: 13393 - RNA, 20 nt, Artificial Sequence
  TRAC targeting sequence
caguaucacugugucuuaua

SEQ ID NO: 13394 - RNA, 20 nt, Artificial Sequence
  TRAC targeting sequence
guaucacugugucuuauaac

SEQ ID NO: 13395 - RNA, 20 nt, Artificial Sequence
  TRAC targeting sequence
cugugucuuauaacaccgac

SEQ ID NO: 13396 - RNA, 20 nt, Artificial Sequence
  TRAC targeting sequence
uauaacaccgacaagcucau

SEQ ID NO: 13397 - RNA, 20 nt, Artificial Sequence
  TRAC targeting sequence
guguuauaagacacagugau

SEQ ID NO: 13398 - RNA, 20 nt, Artificial Sequence
  TRAC targeting sequence
ucuuugggacugggaccaga

SEQ ID NO: 13399 - RNA, 20 nt, Artificial Sequence
  TRAC targeting sequence
uugggacugggaccagauua

SEQ ID NO: 13400 - RNA, 20 nt, Artificial Sequence
  TRAC targeting sequence
caaagaugagcuugucggug

SEQ ID NO: 13401 - RNA, 20 nt, Artificial Sequence
  TRAC targeting sequence
cagucccaaagaugagcuug

SEQ ID NO: 13402 - RNA, 20 nt, Artificial Sequence
  TRAC targeting sequence
ggucccagucccaaagauga

SEQ ID NO: 13403 - RNA, 20 nt, Artificial Sequence
  TRAC targeting sequence
uuccaaguaaguacuagaaa

SEQ ID NO: 13404 - RNA, 20 nt, Artificial Sequence
  TRAC targeting sequence
aaguaaguacuagaaaccaa

SEQ ID NO: 13405 - RNA, 20 nt, Artificial Sequence
  TRAC targeting sequence
aguacuuacuuggaaagacu

SEQ ID NO: 13406 - RNA, 20 nt, Artificial Sequence
  TRAC targeting sequence
uugguuucuaguacuuacuu

SEQ ID NO: 13407 - RNA, 20 nt, Artificial Sequence
  TRAC targeting sequence
aaauggcuccuugguuucua

SEQ ID NO: 13408 - RNA, 20 nt, Artificial Sequence
  TRAC targeting sequence
uuuucuuuuucuuuuuuuuu

SEQ ID NO: 13409 - RNA, 20 nt, Artificial Sequence
  TRAC targeting sequence
uuuucuuuuuuuuuuaaaug

SEQ ID NO: 13410 - RNA, 20 nt, Artificial Sequence
  TRAC targeting sequence
uuuuuuuuuaaaugaaguuu

SEQ ID NO: 13411 - RNA, 20 nt, Artificial Sequence
  TRAC targeting sequence
uuuaaaaaaaaaagaaaaag

SEQ ID NO: 13412 - RNA, 20 nt, Artificial Sequence
  TRAC targeting sequence
uuguugcgcaggcuggagug

SEQ ID NO: 13413 - RNA, 20 nt, Artificial Sequence
  TRAC targeting sequence
agccugcgcaacaaagagca

SEQ ID NO: 13414 - RNA, 20 nt, Artificial Sequence
  TRAC targeting sequence
ugccacugcacuccagccug

SEQ ID NO: 13415 - RNA, 20 nt, Artificial Sequence
  TRAC targeting sequence
cggcucacuacaaccuccac

SEQ ID NO: 13416 - RNA, 20 nt, Artificial Sequence
  TRAC targeting sequence
gcucacuacaaccuccaccu

SEQ ID NO: 13417 - RNA, 20 nt, Artificial Sequence
  TRAC targeting sequence
cuacaaccuccaccucccgg

SEQ ID NO: 13418 - RNA, 20 nt, Artificial Sequence
  TRAC targeting sequence
accucccggguucaagcgau

SEQ ID NO: 13419 - RNA, 20 nt, Artificial Sequence
  TRAC targeting sequence
cggguucaagcgauucuccu

SEQ ID NO: 13420 - RNA, 20 nt, Artificial Sequence
  TRAC targeting sequence
agcgauucuccugucucagc

SEQ ID NO: 13421 - RNA, 20 nt, Artificial Sequence
  TRAC targeting sequence
cuugaacccgggagguggag

SEQ ID NO: 13422 - RNA, 20 nt, Artificial Sequence
  TRAC targeting sequence
ccugucucagccucccgagu

SEQ ID NO: 13423 - RNA, 20 nt, Artificial Sequence
  TRAC targeting sequence
ugucucagccucccgaguag

SEQ ID NO: 13424 - RNA, 20 nt, Artificial Sequence
  TRAC targeting sequence
cagccucccgaguagcuggg

SEQ ID NO: 13425 - RNA, 20 nt, Artificial Sequence
  TRAC targeting sequence
gccucccgaguagcugggau

SEQ ID NO: 13426 - RNA, 20 nt, Artificial Sequence
  TRAC targeting sequence
cgaguagcugggauuacagg

SEQ ID NO: 13427 - RNA, 20 nt, Artificial Sequence
  TRAC targeting sequence
ggaggcugagacaggagaau

SEQ ID NO: 13428 - RNA, 20 nt, Artificial Sequence
  TRAC targeting sequence
cagcuacucgggaggcugag

SEQ ID NO: 13429 - RNA, 20 nt, Artificial Sequence
  TRAC targeting sequence
acuaaaaauacaaaaauuag

SEQ ID NO: 13430 - RNA, 20 nt, Artificial Sequence
  TRAC targeting sequence
ccauguuggccaggcugguc

SEQ ID NO: 13431 - RNA, 20 nt, Artificial Sequence
  TRAC targeting sequence
ugaacuccugaccucaagug

SEQ ID NO: 13432 - RNA, 20 nt, Artificial Sequence
  TRAC targeting sequence
agaccagccuggccaacaug

SEQ ID NO: 13433 - RNA, 20 nt, Artificial Sequence
  TRAC targeting sequence
ugaccucaagugaucugccu

SEQ ID NO: 13434 - RNA, 20 nt, Artificial Sequence
  TRAC targeting sequence
ggaguucaagaccagccugg

SEQ ID NO: 13435 - RNA, 20 nt, Artificial Sequence
  TRAC targeting sequence
agugaucugccugccucggc

SEQ ID NO: 13436 - RNA, 20 nt, Artificial Sequence
  TRAC targeting sequence
cuugaggucaggaguucaag

SEQ ID NO: 13437 - RNA, 20 nt, Artificial Sequence
  TRAC targeting sequence
gccugccucggccugccaaa

SEQ ID NO: 13438 - RNA, 20 nt, Artificial Sequence
  TRAC targeting sequence
gccugccaaagauuacaggc

SEQ ID NO: 13439 - RNA, 20 nt, Artificial Sequence
  TRAC targeting sequence
uuggcaggccgaggcaggca

SEQ ID NO: 13440 - RNA, 20 nt, Artificial Sequence
  TRAC targeting sequence
auaaacaggaacguucucac

SEQ ID NO: 13441 - RNA, 20 nt, Artificial Sequence
  TRAC targeting sequence
uguuuauagaaaacaccuuu

SEQ ID NO: 13442 - RNA, 20 nt, Artificial Sequence
  TRAC targeting sequence
cacagcacugcaggccaccc

SEQ ID NO: 13443 - RNA, 20 nt, Artificial Sequence
  TRAC targeting sequence
cagcacugcaggccacccuu

SEQ ID NO: 13444 - RNA, 20 nt, Artificial Sequence
  TRAC targeting sequence
gagcucuguaggggccuuua

SEQ ID NO: 13445 - RNA, 20 nt, Artificial Sequence
  TRAC targeting sequence
gaguugguaaggguggccug

SEQ ID NO: 13446 - RNA, 20 nt, Artificial Sequence
  TRAC targeting sequence
guaggggccuuuagcaccua

SEQ ID NO: 13447 - RNA, 20 nt, Artificial Sequence
  TRAC targeting sequence
gcagcuauaggugcuaaagg

SEQ ID NO: 13448 - RNA, 20 nt, Artificial Sequence
  TRAC targeting sequence
auaaaccaauuaaucuauau

SEQ ID NO: 13449 - RNA, 20 nt, Artificial Sequence
  TRAC targeting sequence
auaugugaacaauuuaaccu

SEQ ID NO: 13450 - RNA, 20 nt, Artificial Sequence
  TRAC targeting sequence
cauauagauuaauugguuua

SEQ ID NO: 13451 - RNA, 20 nt, Artificial Sequence
  TRAC targeting sequence
cauauagguuaaauuguuca

SEQ ID NO: 13452 - RNA, 20 nt, Artificial Sequence
  TRAC targeting sequence
guaccaugguguucacauau

SEQ ID NO: 13453 - RNA, 20 nt, Artificial Sequence
  TRAC targeting sequence
uaccagcagugaaaagaagg

SEQ ID NO: 13454 - RNA, 20 nt, Artificial Sequence
  TRAC targeting sequence
cugcugguaagauuuuacuc

SEQ ID NO: 13455 - RNA, 20 nt, Artificial Sequence
  TRAC targeting sequence
uuucacugcugguaagauuu

SEQ ID NO: 13456 - RNA, 20 nt, Artificial Sequence
  TRAC targeting sequence
agugccuucuuuucacugcu

SEQ ID NO: 13457 - RNA, 20 nt, Artificial Sequence
  TRAC targeting sequence
gaugcauuaugacucuaaac

SEQ ID NO: 13458 - RNA, 20 nt, Artificial Sequence
  TRAC targeting sequence
gacgcucuagugccuucuuu

SEQ ID NO: 13459 - RNA, 20 nt, Artificial Sequence
  TRAC targeting sequence
uaaugcaucugacgcucuag

SEQ ID NO: 13460 - RNA, 20 nt, Artificial Sequence
  TRAC targeting sequence
aaacaaaugaucuguuuccc

SEQ ID NO: 13461 - RNA, 20 nt, Artificial Sequence
  TRAC targeting sequence
uuuguuuagagucauaaugc

SEQ ID NO: 13462 - RNA, 20 nt, Artificial Sequence
  TRAC targeting sequence
guuucccucuuuugcauuuu

SEQ ID NO: 13463 - RNA, 20 nt, Artificial Sequence
  TRAC targeting sequence
cucuuuugcauuuuuauuua

SEQ ID NO: 13464 - RNA, 20 nt, Artificial Sequence
  TRAC targeting sequence
uuugcauuuuuauuuaaaau

SEQ ID NO: 13465 - RNA, 20 nt, Artificial Sequence
  TRAC targeting sequence
gggaaggugaagcaaguuca

SEQ ID NO: 13466 - RNA, 20 nt, Artificial Sequence
  TRAC targeting sequence
cugauauuuuaaauaaaaau

SEQ ID NO: 13467 - RNA, 20 nt, Artificial Sequence
  TRAC targeting sequence
ccuucccugauauuuuaaau

SEQ ID NO: 13468 - RNA, 20 nt, Artificial Sequence
  TRAC targeting sequence
acuucuccaauuugaaaacu

SEQ ID NO: 13469 - RNA, 20 nt, Artificial Sequence
  TRAC targeting sequence
ccaauuugaaaacuguuucu

SEQ ID NO: 13470 - RNA, 20 nt, Artificial Sequence
  TRAC targeting sequence
aauuugaaaacuguuucuga

SEQ ID NO: 13471 - RNA, 20 nt, Artificial Sequence
  TRAC targeting sequence
aauuggagaaguugaacuug

SEQ ID NO: 13472 - RNA, 20 nt, Artificial Sequence
  TRAC targeting sequence
gaauuaugcuucccuuguau

SEQ ID NO: 13473 - RNA, 20 nt, Artificial Sequence
  TRAC targeting sequence
gaaacaguuuucaaauugga

SEQ ID NO: 13474 - RNA, 20 nt, Artificial Sequence
  TRAC targeting sequence
cuuguaugcagagagaccua

SEQ ID NO: 13475 - RNA, 20 nt, Artificial Sequence
  TRAC targeting sequence
gcauacaagggaagcauaau

SEQ ID NO: 13476 - RNA, 20 nt, Artificial Sequence
  TRAC targeting sequence
cugcauacaagggaagcaua

SEQ ID NO: 13477 - RNA, 20 nt, Artificial Sequence
  TRAC targeting sequence
cucugcauacaagggaagca

SEQ ID NO: 13478 - RNA, 20 nt, Artificial Sequence
  TRAC targeting sequence
aggucucucugcauacaagg

SEQ ID NO: 13479 - RNA, 20 nt, Artificial Sequence
  TRAC targeting sequence
aucuaggucucucugcauac

SEQ ID NO: 13480 - RNA, 20 nt, Artificial Sequence
  TRAC targeting sequence
aaagucaaucuaggucucuc

SEQ ID NO: 13481 - RNA, 20 nt, Artificial Sequence
  TRAC targeting sequence
uucgauuuaaucaaauguaa

SEQ ID NO: 13482 - RNA, 20 nt, Artificial Sequence
  TRAC targeting sequence
auuuaaucaaauguaauuaa

SEQ ID NO: 13483 - RNA, 20 nt, Artificial Sequence
  TRAC targeting sequence
aaugacuaaacauccaaagu

SEQ ID NO: 13484 - RNA, 20 nt, Artificial Sequence
  TRAC targeting sequence
aauguaauuaaaugagcaaa

SEQ ID NO: 13485 - RNA, 20 nt, Artificial Sequence
  TRAC targeting sequence
uuuaauuacauuugauuaaa

SEQ ID NO: 13486 - RNA, 20 nt, Artificial Sequence
  TRAC targeting sequence
ccaauagccaauauuccuau

SEQ ID NO: 13487 - RNA, 20 nt, Artificial Sequence
  TRAC targeting sequence
aauagccaauauuccuaugu

SEQ ID NO: 13488 - RNA, 20 nt, Artificial Sequence
  TRAC targeting sequence
uauguuguuucauuguuuua

SEQ ID NO: 13489 - RNA, 20 nt, Artificial Sequence
  TRAC targeting sequence
uuguuuuaugugcuuugcuc

SEQ ID NO: 13490 - RNA, 20 nt, Artificial Sequence
  TRAC targeting sequence
agacuuuuugucugggcuuu

SEQ ID NO: 13491 - RNA, 20 nt, Artificial Sequence
  TRAC targeting sequence
agagcaaagcacauaaaaca

SEQ ID NO: 13492 - RNA, 20 nt, Artificial Sequence
  TRAC targeting sequence
gggcuuugucucuaauagga

SEQ ID NO: 13493 - RNA, 20 nt, Artificial Sequence
  TRAC targeting sequence
cuaauaggauccccggaagg

SEQ ID NO: 13494 - RNA, 20 nt, Artificial Sequence
  TRAC targeting sequence
aauaggauccccggaaggac

SEQ ID NO: 13495 - RNA, 20 nt, Artificial Sequence
  TRAC targeting sequence
uauuagagacaaagcccaga

SEQ ID NO: 13496 - RNA, 20 nt, Artificial Sequence
  TRAC targeting sequence
ccggaaggacagugaagguu

SEQ ID NO: 13497 - RNA, 20 nt, Artificial Sequence
  TRAC targeting sequence
ggggauccuauuagagacaa

SEQ ID NO: 13498 - RNA, 20 nt, Artificial Sequence
  TRAC targeting sequence
uuccggggauccuauuagag

SEQ ID NO: 13499 - RNA, 20 nt, Artificial Sequence
  TRAC targeting sequence
cuguccuuccggggauccua

SEQ ID NO: 13500 - RNA, 20 nt, Artificial Sequence
  TRAC targeting sequence
guguggauagcaacuaucag

SEQ ID NO: 13501 - RNA, 20 nt, Artificial Sequence
  TRAC targeting sequence
acacagacacaaaaaccuua

SEQ ID NO: 13502 - RNA, 20 nt, Artificial Sequence
  TRAC targeting sequence
guuaaucuggggcgcuggga

SEQ ID NO: 13503 - RNA, 20 nt, Artificial Sequence
  TRAC targeting sequence
ggggcgcugggaccaagcua

SEQ ID NO: 13504 - RNA, 20 nt, Artificial Sequence
  TRAC targeting sequence
cagcgccccagauuaacuga

SEQ ID NO: 13505 - RNA, 20 nt, Artificial Sequence
  TRAC targeting sequence
cagagaugugacugcacggg

SEQ ID NO: 13506 - RNA, 20 nt, Artificial Sequence
  TRAC targeting sequence
gagaugugacugcacgggag

SEQ ID NO: 13507 - RNA, 20 nt, Artificial Sequence
  TRAC targeting sequence
gagacuuaccuggcuuuaua

SEQ ID NO: 13508 - RNA, 20 nt, Artificial Sequence
  TRAC targeting sequence
cugagacuuaccuggcuuua

SEQ ID NO: 13509 - RNA, 20 nt, Artificial Sequence
  TRAC targeting sequence
caucucugagacuuaccugg

SEQ ID NO: 13510 - RNA, 20 nt, Artificial Sequence
  TRAC targeting sequence
cgugcagucacaucucugag

SEQ ID NO: 13511 - RNA, 20 nt, Artificial Sequence
  TRAC targeting sequence
cccgugcagucacaucucug

SEQ ID NO: 13512 - RNA, 20 nt, Artificial Sequence
  TRAC targeting sequence
ucucccgugcagucacaucu

SEQ ID NO: 13513 - RNA, 20 nt, Artificial Sequence
  TRAC targeting sequence
ccucucccgugcagucacau

SEQ ID NO: 13514 - RNA, 20 nt, Artificial Sequence
  TRAC targeting sequence
acuagugucuccucucccgu

SEQ ID NO: 13515 - RNA, 20 nt, Artificial Sequence
  TRAC targeting sequence
gcaugcuacacuuugugcau

SEQ ID NO: 13516 - RNA, 20 nt, Artificial Sequence
  TRAC targeting sequence
uaaaaauauaaucugcaugc

SEQ ID NO: 13517 - RNA, 20 nt, Artificial Sequence
  TRAC targeting sequence
gccugcuggagacaaugcac

SEQ ID NO: 13518 - RNA, 20 nt, Artificial Sequence
  TRAC targeting sequence
agcaggcugacuuguucuua

SEQ ID NO: 13519 - RNA, 20 nt, Artificial Sequence
  TRAC targeting sequence
ccagcaggcugacuuguucu

SEQ ID NO: 13520 - RNA, 20 nt, Artificial Sequence
  TRAC targeting sequence
acccaaauggggucuccacu

SEQ ID NO: 13521 - RNA, 20 nt, Artificial Sequence
  TRAC targeting sequence
ccacucccagugagaagcau

SEQ ID NO: 13522 - RNA, 20 nt, Artificial Sequence
  TRAC targeting sequence
acucccagugagaagcaugu

SEQ ID NO: 13523 - RNA, 20 nt, Artificial Sequence
  TRAC targeting sequence
cagugagaagcaugucagcc

SEQ ID NO: 13524 - RNA, 20 nt, Artificial Sequence
  TRAC targeting sequence
cugggaguggagaccccauu

SEQ ID NO: 13525 - RNA, 20 nt, Artificial Sequence
  TRAC targeting sequence
cacugggaguggagacccca

SEQ ID NO: 13526 - RNA, 20 nt, Artificial Sequence
  TRAC targeting sequence
gccgcuaacucuuuuguuug

SEQ ID NO: 13527 - RNA, 20 nt, Artificial Sequence
  TRAC targeting sequence
uuuguuuggucuaguagcuu

SEQ ID NO: 13528 - RNA, 20 nt, Artificial Sequence
  TRAC targeting sequence
aguagcuuccggaaugaaua

SEQ ID NO: 13529 - RNA, 20 nt, Artificial Sequence
  TRAC targeting sequence
ggaaugaauaaugcuuaagu

SEQ ID NO: 13530 - RNA, 20 nt, Artificial Sequence
  TRAC targeting sequence
ggaagcuacuagaccaaaca

SEQ ID NO: 13531 - RNA, 20 nt, Artificial Sequence
  TRAC targeting sequence
uuccggaagcuacuagacca

SEQ ID NO: 13532 - RNA, 20 nt, Artificial Sequence
  TRAC targeting sequence
aagagagcagagccagguug

SEQ ID NO: 13533 - RNA, 20 nt, Artificial Sequence
  TRAC targeting sequence
uagagggcuacuuaagcauu

SEQ ID NO: 13534 - RNA, 20 nt, Artificial Sequence
  TRAC targeting sequence
cuuagagggcuacuuaagca

SEQ ID NO: 13535 - RNA, 20 nt, Artificial Sequence
  TRAC targeting sequence
gcucucuuagagggcuacuu

SEQ ID NO: 13536 - RNA, 20 nt, Artificial Sequence
  TRAC targeting sequence
cuaacaaccuggcucugcuc

SEQ ID NO: 13537 - RNA, 20 nt, Artificial Sequence
  TRAC targeting sequence
aauucccucugauaugguua

SEQ ID NO: 13538 - RNA, 20 nt, Artificial Sequence
  TRAC targeting sequence
cucugauaugguuaaaacuc

SEQ ID NO: 13539 - RNA, 20 nt, Artificial Sequence
  TRAC targeting sequence
gauaugguuaaaacucuuug

SEQ ID NO: 13540 - RNA, 20 nt, Artificial Sequence
  TRAC targeting sequence
gagggaauuagauauucccu

SEQ ID NO: 13541 - RNA, 20 nt, Artificial Sequence
  TRAC targeting sequence
uugccaagggcagaaccagc

SEQ ID NO: 13542 - RNA, 20 nt, Artificial Sequence
  TRAC targeting sequence
gcccuuggcaaagaguuuua

SEQ ID NO: 13543 - RNA, 20 nt, Artificial Sequence
  TRAC targeting sequence
uuccauuggaagagcaaauu

SEQ ID NO: 13544 - RNA, 20 nt, Artificial Sequence
  TRAC targeting sequence
auuggaagagcaaauucaga

SEQ ID NO: 13545 - RNA, 20 nt, Artificial Sequence
  TRAC targeting sequence
aauggaaugaggcugguucu

SEQ ID NO: 13546 - RNA, 20 nt, Artificial Sequence
  TRAC targeting sequence
uccaauggaaugaggcuggu

SEQ ID NO: 13547 - RNA, 20 nt, Artificial Sequence
  TRAC targeting sequence
gagaaaaaggaaagggucac

SEQ ID NO: 13548 - RNA, 20 nt, Artificial Sequence
  TRAC targeting sequence
gaauuugcucuuccaaugga

SEQ ID NO: 13549 - RNA, 20 nt, Artificial Sequence
  TRAC targeting sequence
cugaauuugcucuuccaaug

SEQ ID NO: 13550 - RNA, 20 nt, Artificial Sequence
  TRAC targeting sequence
uuuuucucugaauuugcucu

SEQ ID NO: 13551 - RNA, 20 nt, Artificial Sequence
  TRAC targeting sequence
cacagccaaagacgguaaaa

SEQ ID NO: 13552 - RNA, 20 nt, Artificial Sequence
  TRAC targeting sequence
uuggcugugugacccuuucc

SEQ ID NO: 13553 - RNA, 20 nt, Artificial Sequence
  TRAC targeting sequence
aaggugaaaaauagccaagu

SEQ ID NO: 13554 - RNA, 20 nt, Artificial Sequence
  TRAC targeting sequence
ccuuugaacauuuuaccguc

SEQ ID NO: 13555 - RNA, 20 nt, Artificial Sequence
  TRAC targeting sequence
gcagcucuccugacauccuu

SEQ ID NO: 13556 - RNA, 20 nt, Artificial Sequence
  TRAC targeting sequence
ccugacauccuugccucagg

SEQ ID NO: 13557 - RNA, 20 nt, Artificial Sequence
  TRAC targeting sequence
ugacauccuugccucaggcu

SEQ ID NO: 13558 - RNA, 20 nt, Artificial Sequence
  TRAC targeting sequence
ggagagcugcagacuuggcu

SEQ ID NO: 13559 - RNA, 20 nt, Artificial Sequence
  TRAC targeting sequence
uugccucaggcugcuguccc

SEQ ID NO: 13560 - RNA, 20 nt, Artificial Sequence
  TRAC targeting sequence
ggcugcugucccacguggag

SEQ ID NO: 13561 - RNA, 20 nt, Artificial Sequence
  TRAC targeting sequence
cacguggagagcagaugccu

SEQ ID NO: 13562 - RNA, 20 nt, Artificial Sequence
  TRAC targeting sequence
acgugggacagcagccugag

SEQ ID NO: 13563 - RNA, 20 nt, Artificial Sequence
  TRAC targeting sequence
ccacgugggacagcagccug

SEQ ID NO: 13564 - RNA, 20 nt, Artificial Sequence
  TRAC targeting sequence
gcucuccacgugggacagca

SEQ ID NO: 13565 - RNA, 20 nt, Artificial Sequence
  TRAC targeting sequence
cggucacuugcuggagucac

SEQ ID NO: 13566 - RNA, 20 nt, Artificial Sequence
  TRAC targeting sequence
gucacuugcuggagucacuc

SEQ ID NO: 13567 - RNA, 20 nt, Artificial Sequence
  TRAC targeting sequence
cuugcuggagucacucaggg

SEQ ID NO: 13568 - RNA, 20 nt, Artificial Sequence
  TRAC targeting sequence
agcaagugaccgagagcuuu

SEQ ID NO: 13569 - RNA, 20 nt, Artificial Sequence
  TRAC targeting sequence
cucaggguucugggccuugg

SEQ ID NO: 13570 - RNA, 20 nt, Artificial Sequence
  TRAC targeting sequence
ggguucugggccuugggaug

SEQ ID NO: 13571 - RNA, 20 nt, Artificial Sequence
  TRAC targeting sequence
gggccuugggauguaacuua

SEQ ID NO: 13572 - RNA, 20 nt, Artificial Sequence
  TRAC targeting sequence
caaggcccagaacccugagu

SEQ ID NO: 13573 - RNA, 20 nt, Artificial Sequence
  TRAC targeting sequence
uuuaaguuacaucccaaggc

SEQ ID NO: 13574 - RNA, 20 nt, Artificial Sequence
  TRAC targeting sequence
gggcacugucagaggaauau

SEQ ID NO: 13575 - RNA, 20 nt, Artificial Sequence
  TRAC targeting sequence
gaggaauaugaaggcugcag

SEQ ID NO: 13576 - RNA, 20 nt, Artificial Sequence
  TRAC targeting sequence
gacagugcccugacacuguc

SEQ ID NO: 13577 - RNA, 20 nt, Artificial Sequence
  TRAC targeting sequence
ucugacagugcccugacacu

SEQ ID NO: 13578 - RNA, 20 nt, Artificial Sequence
  TRAC targeting sequence
uauuccucugacagugcccu

SEQ ID NO: 13579 - RNA, 20 nt, Artificial Sequence
  TRAC targeting sequence
cugcagccuucauauuccuc

SEQ ID NO: 13580 - RNA, 20 nt, Artificial Sequence
  TRAC targeting sequence
gcuuuugcuacacugggacu

SEQ ID NO: 13581 - RNA, 20 nt, Artificial Sequence
  TRAC targeting sequence
caguguagcaaaagcugacu

SEQ ID NO: 13582 - RNA, 20 nt, Artificial Sequence
  TRAC targeting sequence
gucccaguguagcaaaagcu

SEQ ID NO: 13583 - RNA, 20 nt, Artificial Sequence
  TRAC targeting sequence
aagccuggaaagacacaaag

SEQ ID NO: 13584 - RNA, 20 nt, Artificial Sequence
  TRAC targeting sequence
aggcuuagaacaccucaguc

SEQ ID NO: 13585 - RNA, 20 nt, Artificial Sequence
  TRAC targeting sequence
uuccaggcuuagaacaccuc

SEQ ID NO: 13586 - RNA, 20 nt, Artificial Sequence
  TRAC targeting sequence
ucaucccaaccugccgugcc

SEQ ID NO: 13587 - RNA, 20 nt, Artificial Sequence
  TRAC targeting sequence
ucccaaccugccgugccccu

SEQ ID NO: 13588 - RNA, 20 nt, Artificial Sequence
  TRAC targeting sequence
caaccugccgugccccuccu

SEQ ID NO: 13589 - RNA, 20 nt, Artificial Sequence
  TRAC targeting sequence
uugaggguuaguguaaggcu

SEQ ID NO: 13590 - RNA, 20 nt, Artificial Sequence
  TRAC targeting sequence
aggaggggcacggcagguug

SEQ ID NO: 13591 - RNA, 20 nt, Artificial Sequence
  TRAC targeting sequence
gaaggacugugugaauuaug

SEQ ID NO: 13592 - RNA, 20 nt, Artificial Sequence
  TRAC targeting sequence
gagccuuacacuaacccuca

SEQ ID NO: 13593 - RNA, 20 nt, Artificial Sequence
  TRAC targeting sequence
uucagagccuuacacuaacc

SEQ ID NO: 13594 - RNA, 20 nt, Artificial Sequence
  TRAC targeting sequence
cacaguccuucagagccuua

SEQ ID NO: 13595 - RNA, 20 nt, Artificial Sequence
  TRAC targeting sequence
ucuuuggaacuggcacucug

SEQ ID NO: 13596 - RNA, 20 nt, Artificial Sequence
  TRAC targeting sequence
uuggaacuggcacucugcuu

SEQ ID NO: 13597 - RNA, 20 nt, Artificial Sequence
  TRAC targeting sequence
aaagaugagcuuguuuguag

SEQ ID NO: 13598 - RNA, 20 nt, Artificial Sequence
  TRAC targeting sequence
gcuugcuguccagccaagua

SEQ ID NO: 13599 - RNA, 20 nt, Artificial Sequence
  TRAC targeting sequence
agccaaguacguaaguagug

SEQ ID NO: 13600 - RNA, 20 nt, Artificial Sequence
  TRAC targeting sequence
gguggauucuguguccaugg

SEQ ID NO: 13601 - RNA, 20 nt, Artificial Sequence
  TRAC targeting sequence
accugacacaugccacuacu

SEQ ID NO: 13602 - RNA, 20 nt, Artificial Sequence
  TRAC targeting sequence
guguccauggcaaguaggaa

SEQ ID NO: 13603 - RNA, 20 nt, Artificial Sequence
  TRAC targeting sequence
auggcaaguaggaagcgaca

SEQ ID NO: 13604 - RNA, 20 nt, Artificial Sequence
  TRAC targeting sequence
uacuugccauggacacagaa

SEQ ID NO: 13605 - RNA, 20 nt, Artificial Sequence
  TRAC targeting sequence
cuuccuacuugccauggaca

SEQ ID NO: 13606 - RNA, 20 nt, Artificial Sequence
  TRAC targeting sequence
accuaaggguggcugucgcu

SEQ ID NO: 13607 - RNA, 20 nt, Artificial Sequence
  TRAC targeting sequence
uuuccaccuaaggguggcug

SEQ ID NO: 13608 - RNA, 20 nt, Artificial Sequence
  TRAC targeting sequence
gccauccuuuccaccuaagg

SEQ ID NO: 13609 - RNA, 20 nt, Artificial Sequence
  TRAC targeting sequence
accuucagccauccuuucca

SEQ ID NO: 13610 - RNA, 20 nt, Artificial Sequence
  TRAC targeting sequence
cugcugucaucucuuaucug

SEQ ID NO: 13611 - RNA, 20 nt, Artificial Sequence
  TRAC targeting sequence
ucucuuaucugccgugauau

SEQ ID NO: 13612 - RNA, 20 nt, Artificial Sequence
  TRAC targeting sequence
cuuaucugccgugauauagc

SEQ ID NO: 13613 - RNA, 20 nt, Artificial Sequence
  TRAC targeting sequence
uaucugccgugauauagcag

SEQ ID NO: 13614 - RNA, 20 nt, Artificial Sequence
  TRAC targeting sequence
gccgugauauagcaggcugu

SEQ ID NO: 13615 - RNA, 20 nt, Artificial Sequence
  TRAC targeting sequence
cggcagauaagagaugacag

SEQ ID NO: 13616 - RNA, 20 nt, Artificial Sequence
  TRAC targeting sequence
aaauucccauucuccuggau

SEQ ID NO: 13617 - RNA, 20 nt, Artificial Sequence
  TRAC targeting sequence
cauucuccuggauggcacac

SEQ ID NO: 13618 - RNA, 20 nt, Artificial Sequence
  TRAC targeting sequence
ccuggauggcacaccacagu

SEQ ID NO: 13619 - RNA, 20 nt, Artificial Sequence
  TRAC targeting sequence
uggauggcacaccacaguca

SEQ ID NO: 13620 - RNA, 20 nt, Artificial Sequence
  TRAC targeting sequence
aggagaaugggaauuuugac

SEQ ID NO: 13621 - RNA, 20 nt, Artificial Sequence
  TRAC targeting sequence
ggggaggggaaacaugcuaa

SEQ ID NO: 13622 - RNA, 20 nt, Artificial Sequence
  TRAC targeting sequence
ccugacuguggugugccauc

SEQ ID NO: 13623 - RNA, 20 nt, Artificial Sequence
  TRAC targeting sequence
ccuccccugacuguggugug

SEQ ID NO: 13624 - RNA, 20 nt, Artificial Sequence
  TRAC targeting sequence
uaaaauuagcauguuucccc

SEQ ID NO: 13625 - RNA, 20 nt, Artificial Sequence
  TRAC targeting sequence
ccugggguuuaucauaaaau

SEQ ID NO: 13626 - RNA, 20 nt, Artificial Sequence
  TRAC targeting sequence
ccccugggguuuaucauaaa

SEQ ID NO: 13627 - RNA, 20 nt, Artificial Sequence
  TRAC targeting sequence
uuuucuccccugggguuuau

SEQ ID NO: 13628 - RNA, 20 nt, Artificial Sequence
  TRAC targeting sequence
cacaguagucuuuuucuccc

SEQ ID NO: 13629 - RNA, 20 nt, Artificial Sequence
  TRAC targeting sequence
acuaaauuuucccacaguag

SEQ ID NO: 13630 - RNA, 20 nt, Artificial Sequence
  TRAC targeting sequence
caacuaaauuuucccacagu

SEQ ID NO: 13631 - RNA, 20 nt, Artificial Sequence
  TRAC targeting sequence
aauuguucucaacuaaaugc

SEQ ID NO: 13632 - RNA, 20 nt, Artificial Sequence
  TRAC targeting sequence
caacuaaaugcugcaggcuu

SEQ ID NO: 13633 - RNA, 20 nt, Artificial Sequence
  TRAC targeting sequence
acuaaaugcugcaggcuuua

SEQ ID NO: 13634 - RNA, 20 nt, Artificial Sequence
  TRAC targeting sequence
gugaacccaguuucccaguu

SEQ ID NO: 13635 - RNA, 20 nt, Artificial Sequence
  TRAC targeting sequence
cagaagcauaaagccugcag

SEQ ID NO: 13636 - RNA, 20 nt, Artificial Sequence
  TRAC targeting sequence
caguuauucauugacccuga

SEQ ID NO: 13637 - RNA, 20 nt, Artificial Sequence
  TRAC targeting sequence
uugacccugaacauacguuu

SEQ ID NO: 13638 - RNA, 20 nt, Artificial Sequence
  TRAC targeting sequence
augaauaacugggaaacugg

SEQ ID NO: 13639 - RNA, 20 nt, Artificial Sequence
  TRAC targeting sequence
gggucaaugaauaacuggga

SEQ ID NO: 13640 - RNA, 20 nt, Artificial Sequence
  TRAC targeting sequence
cuccuaaccuauuuauacaa

SEQ ID NO: 13641 - RNA, 20 nt, Artificial Sequence
  TRAC targeting sequence
ccuaaccuauuuauacaauu

SEQ ID NO: 13642 - RNA, 20 nt, Artificial Sequence
  TRAC targeting sequence
uaaccuauuuauacaauuau

SEQ ID NO: 13643 - RNA, 20 nt, Artificial Sequence
  TRAC targeting sequence
gccgguccaaaugccuucuu

SEQ ID NO: 13644 - RNA, 20 nt, Artificial Sequence
  TRAC targeting sequence
aaaugccuucuucuauaggc

SEQ ID NO: 13645 - RNA, 20 nt, Artificial Sequence
  TRAC targeting sequence
ucuauaggccauguuuuuau

SEQ ID NO: 13646 - RNA, 20 nt, Artificial Sequence
  TRAC targeting sequence
auaggccauguuuuuauuuc

SEQ ID NO: 13647 - RNA, 20 nt, Artificial Sequence
  TRAC targeting sequence
cuuccaaaagagacuccaga

SEQ ID NO: 13648 - RNA, 20 nt, Artificial Sequence
  TRAC targeting sequence
uccaaaagagacuccagagc

SEQ ID NO: 13649 - RNA, 20 nt, Artificial Sequence
  TRAC targeting sequence
aaaagagacuccagagccau

SEQ ID NO: 13650 - RNA, 20 nt, Artificial Sequence
  TRAC targeting sequence
uuuggaagagaaauaaaaac

SEQ ID NO: 13651 - RNA, 20 nt, Artificial Sequence
  TRAC targeting sequence
cuuuuggaagagaaauaaaa

SEQ ID NO: 13652 - RNA, 20 nt, Artificial Sequence
  TRAC targeting sequence
agagccauccuugggaagag

SEQ ID NO: 13653 - RNA, 20 nt, Artificial Sequence
  TRAC targeting sequence
ggagucucuuuuggaagaga

SEQ ID NO: 13654 - RNA, 20 nt, Artificial Sequence
  TRAC targeting sequence
uugggaagagugcugagaag

SEQ ID NO: 13655 - RNA, 20 nt, Artificial Sequence
  TRAC targeting sequence
caaggauggcucuggagucu

SEQ ID NO: 13656 - RNA, 20 nt, Artificial Sequence
  TRAC targeting sequence
ucccaaggauggcucuggag

SEQ ID NO: 13657 - RNA, 20 nt, Artificial Sequence
  TRAC targeting sequence
gcacucuucccaaggauggc

SEQ ID NO: 13658 - RNA, 20 nt, Artificial Sequence
  TRAC targeting sequence
cagcacucuucccaaggaug

SEQ ID NO: 13659 - RNA, 20 nt, Artificial Sequence
  TRAC targeting sequence
ggcaggccuaacucccaggg

SEQ ID NO: 13660 - RNA, 20 nt, Artificial Sequence
  TRAC targeting sequence
caggggucagggaggggaaa

SEQ ID NO: 13661 - RNA, 20 nt, Artificial Sequence
  TRAC targeting sequence
gggaggggaaagagaaggcu

SEQ ID NO: 13662 - RNA, 20 nt, Artificial Sequence
  TRAC targeting sequence
cugaccccugggaguuaggc

SEQ ID NO: 13663 - RNA, 20 nt, Artificial Sequence
  TRAC targeting sequence
ccucccugaccccugggagu

SEQ ID NO: 13664 - RNA, 20 nt, Artificial Sequence
  TRAC targeting sequence
uuccccucccugaccccugg

SEQ ID NO: 13665 - RNA, 20 nt, Artificial Sequence
  TRAC targeting sequence
cuuuccccucccugaccccu

SEQ ID NO: 13666 - RNA, 20 nt, Artificial Sequence
  TRAC targeting sequence
guacuagaacugugauccac

SEQ ID NO: 13667 - RNA, 20 nt, Artificial Sequence
  TRAC targeting sequence
aguacugagcuaaguuaccc

SEQ ID NO: 13668 - RNA, 20 nt, Artificial Sequence
  TRAC targeting sequence
caguucuaguacugagcuaa

SEQ ID NO: 13669 - RNA, 20 nt, Artificial Sequence
  TRAC targeting sequence
acguaucugucacucuauuu

SEQ ID NO: 13670 - RNA, 20 nt, Artificial Sequence
  TRAC targeting sequence
gucacucuauuuccuacguu

SEQ ID NO: 13671 - RNA, 20 nt, Artificial Sequence
  TRAC targeting sequence
cucuauuuccuacguuugcu

SEQ ID NO: 13672 - RNA, 20 nt, Artificial Sequence
  TRAC targeting sequence
auuuccuacguuugcuuccc

SEQ ID NO: 13673 - RNA, 20 nt, Artificial Sequence
  TRAC targeting sequence
uacguuugcuucccuuuugu

SEQ ID NO: 13674 - RNA, 20 nt, Artificial Sequence
  TRAC targeting sequence
cuuuuguuuucucuagaaua

SEQ ID NO: 13675 - RNA, 20 nt, Artificial Sequence
  TRAC targeting sequence
cuagaauaaguucuuuuugu

SEQ ID NO: 13676 - RNA, 20 nt, Artificial Sequence
  TRAC targeting sequence
agaauaaguucuuuuuguuu

SEQ ID NO: 13677 - RNA, 20 nt, Artificial Sequence
  TRAC targeting sequence
agagaaaacaaaagggaagc

SEQ ID NO: 13678 - RNA, 20 nt, Artificial Sequence
  TRAC targeting sequence
uuuuguuugcucuggacacc

SEQ ID NO: 13679 - RNA, 20 nt, Artificial Sequence
  TRAC targeting sequence
ggacacccacugcucccagg

SEQ ID NO: 13680 - RNA, 20 nt, Artificial Sequence
  TRAC targeting sequence
agagcaaacaaaaagaacuu

SEQ ID NO: 13681 - RNA, 20 nt, Artificial Sequence
  TRAC targeting sequence
caggaugaaaggagagaaau

SEQ ID NO: 13682 - RNA, 20 nt, Artificial Sequence
  TRAC targeting sequence
ugggagcaguggguguccag

SEQ ID NO: 13683 - RNA, 20 nt, Artificial Sequence
  TRAC targeting sequence
uccugggagcaguggguguc

SEQ ID NO: 13684 - RNA, 20 nt, Artificial Sequence
  TRAC targeting sequence
uuucauccugggagcagugg

SEQ ID NO: 13685 - RNA, 20 nt, Artificial Sequence
  TRAC targeting sequence
ccuuucauccugggagcagu

SEQ ID NO: 13686 - RNA, 20 nt, Artificial Sequence
  TRAC targeting sequence
cuccuuucauccugggagca

SEQ ID NO: 13687 - RNA, 20 nt, Artificial Sequence
  TRAC targeting sequence
uuucucuccuuucauccugg

SEQ ID NO: 13688 - RNA, 20 nt, Artificial Sequence
  TRAC targeting sequence
cauuucucuccuuucauccu

SEQ ID NO: 13689 - RNA, 20 nt, Artificial Sequence
  TRAC targeting sequence
guuuugaacacuuccucuug

SEQ ID NO: 13690 - RNA, 20 nt, Artificial Sequence
  TRAC targeting sequence
aaacugaucucauuucucuc

SEQ ID NO: 13691 - RNA, 20 nt, Artificial Sequence
  TRAC targeting sequence
ucuugaaauauaaagaauca

SEQ ID NO: 13692 - RNA, 20 nt, Artificial Sequence
  TRAC targeting sequence
ugaaauauaaagaaucaaca

SEQ ID NO: 13693 - RNA, 20 nt, Artificial Sequence
  TRAC targeting sequence
agaggaaguguucaaaacug

SEQ ID NO: 13694 - RNA, 20 nt, Artificial Sequence
  TRAC targeting sequence
uuauauuucaagaggaagug

SEQ ID NO: 13695 - RNA, 20 nt, Artificial Sequence
  TRAC targeting sequence
acaaguuacagucauguugg

SEQ ID NO: 13696 - RNA, 20 nt, Artificial Sequence
  TRAC targeting sequence
uguuggggacuucuucucuc

SEQ ID NO: 13697 - RNA, 20 nt, Artificial Sequence
  TRAC targeting sequence
ccaacaugacuguaacuugu

SEQ ID NO: 13698 - RNA, 20 nt, Artificial Sequence
  TRAC targeting sequence
ucucucuccaagcuuaaauu

SEQ ID NO: 13699 - RNA, 20 nt, Artificial Sequence
  TRAC targeting sequence
cucuccaagcuuaaauuucu

SEQ ID NO: 13700 - RNA, 20 nt, Artificial Sequence
  TRAC targeting sequence
cuccaagcuuaaauuucuau

SEQ ID NO: 13701 - RNA, 20 nt, Artificial Sequence
  TRAC targeting sequence
ccaagcuuaaauuucuauua

SEQ ID NO: 13702 - RNA, 20 nt, Artificial Sequence
  TRAC targeting sequence
aagcuuaaauuucuauuacg

SEQ ID NO: 13703 - RNA, 20 nt, Artificial Sequence
  TRAC targeting sequence
auuacguaagccuuacuuuu

SEQ ID NO: 13704 - RNA, 20 nt, Artificial Sequence
  TRAC targeting sequence
ugguuaaaaguaaggcuuac

SEQ ID NO: 13705 - RNA, 20 nt, Artificial Sequence
  TRAC targeting sequence
cuaacuuucuugguuaaaag

SEQ ID NO: 13706 - RNA, 20 nt, Artificial Sequence
  TRAC targeting sequence
cugucugggaugcucacccc

SEQ ID NO: 13707 - RNA, 20 nt, Artificial Sequence
  TRAC targeting sequence
gggaugcucaccccucucuc

SEQ ID NO: 13708 - RNA, 20 nt, Artificial Sequence
  TRAC targeting sequence
cagacagugauaccauguca

SEQ ID NO: 13709 - RNA, 20 nt, Artificial Sequence
  TRAC targeting sequence
ccccucucucuuuucuccag

SEQ ID NO: 13710 - RNA, 20 nt, Artificial Sequence
  TRAC targeting sequence
cucuuuucuccagauacucc

SEQ ID NO: 13711 - RNA, 20 nt, Artificial Sequence
  TRAC targeting sequence
cuuuucuccagauacuccgu

SEQ ID NO: 13712 - RNA, 20 nt, Artificial Sequence
  TRAC targeting sequence
uuucuccagauacuccgugu

SEQ ID NO: 13713 - RNA, 20 nt, Artificial Sequence
  TRAC targeting sequence
ccagauacuccguguauacu

SEQ ID NO: 13714 - RNA, 20 nt, Artificial Sequence
  TRAC targeting sequence
agauacuccguguauacuaa

SEQ ID NO: 13715 - RNA, 20 nt, Artificial Sequence
  TRAC targeting sequence
ggagaaaagagagaggggug

SEQ ID NO: 13716 - RNA, 20 nt, Artificial Sequence
  TRAC targeting sequence
guguauacuaaagcucagcc

SEQ ID NO: 13717 - RNA, 20 nt, Artificial Sequence
  TRAC targeting sequence
gccaaugcucagcuuuguga

SEQ ID NO: 13718 - RNA, 20 nt, Artificial Sequence
  TRAC targeting sequence
gcuuugugauaaaggagcug

SEQ ID NO: 13719 - RNA, 20 nt, Artificial Sequence
  TRAC targeting sequence
caaagcugagcauuggcuga

SEQ ID NO: 13720 - RNA, 20 nt, Artificial Sequence
  TRAC targeting sequence
uuuaucacaaagcugagcau

SEQ ID NO: 13721 - RNA, 20 nt, Artificial Sequence
  TRAC targeting sequence
uuaucucugccuuuaggaua

SEQ ID NO: 13722 - RNA, 20 nt, Artificial Sequence
  TRAC targeting sequence
cugccuuuaggauacagucu

SEQ ID NO: 13723 - RNA, 20 nt, Artificial Sequence
  TRAC targeting sequence
gccuuuaggauacagucuuu

SEQ ID NO: 13724 - RNA, 20 nt, Artificial Sequence
  TRAC targeting sequence
uaaaggcagagauaaagaca

SEQ ID NO: 13725 - RNA, 20 nt, Artificial Sequence
  TRAC targeting sequence
uuuuuauaacagaaaguguu

SEQ ID NO: 13726 - RNA, 20 nt, Artificial Sequence
  TRAC targeting sequence
guuauaaaaaagacuguauc

SEQ ID NO: 13727 - RNA, 20 nt, Artificial Sequence
  TRAC targeting sequence
cuucucccauuuauuucaug

SEQ ID NO: 13728 - RNA, 20 nt, Artificial Sequence
  TRAC targeting sequence
cccauuuauuucauggcugg

SEQ ID NO: 13729 - RNA, 20 nt, Artificial Sequence
  TRAC targeting sequence
cauuuauuucauggcuggac

SEQ ID NO: 13730 - RNA, 20 nt, Artificial Sequence
  TRAC targeting sequence
uggcuggacucucuaccccu

SEQ ID NO: 13731 - RNA, 20 nt, Artificial Sequence
  TRAC targeting sequence
agccaugaaauaaaugggag

SEQ ID NO: 13732 - RNA, 20 nt, Artificial Sequence
  TRAC targeting sequence
cuaccccuuccuggcugaaa

SEQ ID NO: 13733 - RNA, 20 nt, Artificial Sequence
  TRAC targeting sequence
accccuuccuggcugaaaca

SEQ ID NO: 13734 - RNA, 20 nt, Artificial Sequence
  TRAC targeting sequence
uggcugaaacagcauauggg

SEQ ID NO: 13735 - RNA, 20 nt, Artificial Sequence
  TRAC targeting sequence
gccaggaagggguagagagu

SEQ ID NO: 13736 - RNA, 20 nt, Artificial Sequence
  TRAC targeting sequence
augguggaacuucuuuggga

SEQ ID NO: 13737 - RNA, 20 nt, Artificial Sequence
  TRAC targeting sequence
accauggacccauaugcugu

SEQ ID NO: 13738 - RNA, 20 nt, Artificial Sequence
  TRAC targeting sequence
uugggaaaaaaaaaaaauag

SEQ ID NO: 13739 - RNA, 20 nt, Artificial Sequence
  TRAC targeting sequence
caaagaaguuccaccaugga

SEQ ID NO: 13740 - RNA, 20 nt, Artificial Sequence
  TRAC targeting sequence
auuuuuuuuuuuucccaaag

SEQ ID NO: 13741 - RNA, 20 nt, Artificial Sequence
  TRAC targeting sequence
aacaguucuauuuuuuuuuu

SEQ ID NO: 13742 - RNA, 20 nt, Artificial Sequence
  TRAC targeting sequence
ucccucaugaaauguuuuuu

SEQ ID NO: 13743 - RNA, 20 nt, Artificial Sequence
  TRAC targeting sequence
cucaugaaauguuuuuuagg

SEQ ID NO: 13744 - RNA, 20 nt, Artificial Sequence
  TRAC targeting sequence
ugaaauguuuuuuaggcuau

SEQ ID NO: 13745 - RNA, 20 nt, Artificial Sequence
  TRAC targeting sequence
ugagggaagaguggcaaaag

SEQ ID NO: 13746 - RNA, 20 nt, Artificial Sequence
  TRAC targeting sequence
aauaagcauuauuacacauu

SEQ ID NO: 13747 - RNA, 20 nt, Artificial Sequence
  TRAC targeting sequence
auguguaauaaugcuuauuu

SEQ ID NO: 13748 - RNA, 20 nt, Artificial Sequence
  TRAC targeting sequence
caauguguaauaaugcuuau

SEQ ID NO: 13749 - RNA, 20 nt, Artificial Sequence
  TRAC targeting sequence
aagccuucucaauguguaau

SEQ ID NO: 13750 - RNA, 20 nt, Artificial Sequence
  TRAC targeting sequence
aguuuuuucaaagccuucuc

SEQ ID NO: 13751 - RNA, 20 nt, Artificial Sequence
  TRAC targeting sequence
cugagucuggaggugagcug

SEQ ID NO: 13752 - RNA, 20 nt, Artificial Sequence
  TRAC targeting sequence
gugaucaaguuuuuucaaag

SEQ ID NO: 13753 - RNA, 20 nt, Artificial Sequence
  TRAC targeting sequence
ggaggugagcugggauggcu

SEQ ID NO: 13754 - RNA, 20 nt, Artificial Sequence
  TRAC targeting sequence
agacucagugaucaaguuuu

SEQ ID NO: 13755 - RNA, 20 nt, Artificial Sequence
  TRAC targeting sequence
ccuccagacucagugaucaa

SEQ ID NO: 13756 - RNA, 20 nt, Artificial Sequence
  TRAC targeting sequence
cagcucaccuccagacucag

SEQ ID NO: 13757 - RNA, 20 nt, Artificial Sequence
  TRAC targeting sequence
guagcuggaaaauaucccug

SEQ ID NO: 13758 - RNA, 20 nt, Artificial Sequence
  TRAC targeting sequence
agcuacagagccaucccagc

SEQ ID NO: 13759 - RNA, 20 nt, Artificial Sequence
  TRAC targeting sequence
cuguggguguaggaauguac

SEQ ID NO: 13760 - RNA, 20 nt, Artificial Sequence
  TRAC targeting sequence
uacacccacagggauauuuu

SEQ ID NO: 13761 - RNA, 20 nt, Artificial Sequence
  TRAC targeting sequence
cuucaaacuuguguguuuag

SEQ ID NO: 13762 - RNA, 20 nt, Artificial Sequence
  TRAC targeting sequence
aacuuguguguuuagggcug

SEQ ID NO: 13763 - RNA, 20 nt, Artificial Sequence
  TRAC targeting sequence
gcccuaaacacacaaguuug

SEQ ID NO: 13764 - RNA, 20 nt, Artificial Sequence
  TRAC targeting sequence
cacauacgacagcaagaguu

SEQ ID NO: 13765 - RNA, 20 nt, Artificial Sequence
  TRAC targeting sequence
uaugugugagcucagcccua

SEQ ID NO: 13766 - RNA, 20 nt, Artificial Sequence
  TRAC targeting sequence
ugcugucguaugugugagcu

SEQ ID NO: 13767 - RNA, 20 nt, Artificial Sequence
  TRAC targeting sequence
aauuuguuaacaacucuugc

SEQ ID NO: 13768 - RNA, 20 nt, Artificial Sequence
  TRAC targeting sequence
gcuuuggcaguuuuaugccu

SEQ ID NO: 13769 - RNA, 20 nt, Artificial Sequence
  TRAC targeting sequence
aggcauaaaacugccaaagc

SEQ ID NO: 13770 - RNA, 20 nt, Artificial Sequence
  TRAC targeting sequence
uuugcauuucuaggcauaaa

SEQ ID NO: 13771 - RNA, 20 nt, Artificial Sequence
  TRAC targeting sequence
uaaguuuggcauuuuuaaag

SEQ ID NO: 13772 - RNA, 20 nt, Artificial Sequence
  TRAC targeting sequence
uuuaaaaaugccaaacuuau

SEQ ID NO: 13773 - RNA, 20 nt, Artificial Sequence
  TRAC targeting sequence
ccuuuaaaaaugccaaacuu

SEQ ID NO: 13774 - RNA, 20 nt, Artificial Sequence
  TRAC targeting sequence
gcaacauaaagcaaacaaug

SEQ ID NO: 13775 - RNA, 20 nt, Artificial Sequence
  TRAC targeting sequence
uccuaucauaaaaggccaga

SEQ ID NO: 13776 - RNA, 20 nt, Artificial Sequence
  TRAC targeting sequence
uaucauaaaaggccagaaac

SEQ ID NO: 13777 - RNA, 20 nt, Artificial Sequence
  TRAC targeting sequence
uaaaaggccagaaacacaga

SEQ ID NO: 13778 - RNA, 20 nt, Artificial Sequence
  TRAC targeting sequence
ggccuuuuaugauaggaaga

SEQ ID NO: 13779 - RNA, 20 nt, Artificial Sequence
  TRAC targeting sequence
guguuucuggccuuuuauga

SEQ ID NO: 13780 - RNA, 20 nt, Artificial Sequence
  TRAC targeting sequence
cuguguuucuggccuuuuau

SEQ ID NO: 13781 - RNA, 20 nt, Artificial Sequence
  TRAC targeting sequence
uuuuuuuuuuuugcuuucuc

SEQ ID NO: 13782 - RNA, 20 nt, Artificial Sequence
  TRAC targeting sequence
uuguguuuuuuuuuuuuuuc

SEQ ID NO: 13783 - RNA, 20 nt, Artificial Sequence
  TRAC targeting sequence
ccuuguguuuuuuuuuuuuu

SEQ ID NO: 13784 - RNA, 20 nt, Artificial Sequence
  TRAC targeting sequence
aacugcccccucaccacagu

SEQ ID NO: 13785 - RNA, 20 nt, Artificial Sequence
  TRAC targeting sequence
ccacagugcuauguguuugg

SEQ ID NO: 13786 - RNA, 20 nt, Artificial Sequence
  TRAC targeting sequence
guaaaggcaggaagugcugu

SEQ ID NO: 13787 - RNA, 20 nt, Artificial Sequence
  TRAC targeting sequence
ugccuuuacugaaacccaua

SEQ ID NO: 13788 - RNA, 20 nt, Artificial Sequence
  TRAC targeting sequence
cacagcacuuccugccuuua

SEQ ID NO: 13789 - RNA, 20 nt, Artificial Sequence
  TRAC targeting sequence
ggcauuguuauucccacagc

SEQ ID NO: 13790 - RNA, 20 nt, Artificial Sequence
  TRAC targeting sequence
uguuuggagauggaacucag

SEQ ID NO: 13791 - RNA, 20 nt, Artificial Sequence
  TRAC targeting sequence
aaacaugagucuggcauugu

SEQ ID NO: 13792 - RNA, 20 nt, Artificial Sequence
  TRAC targeting sequence
ccaaacaugagucuggcauu

SEQ ID NO: 13793 - RNA, 20 nt, Artificial Sequence
  TRAC targeting sequence
aucuccaaacaugagucugg

SEQ ID NO: 13794 - RNA, 20 nt, Artificial Sequence
  TRAC targeting sequence
gcugguggugaagcccagua

SEQ ID NO: 13795 - RNA, 20 nt, Artificial Sequence
  TRAC targeting sequence
ccaccagcugaguuccaucu

SEQ ID NO: 13796 - RNA, 20 nt, Artificial Sequence
  TRAC targeting sequence
auaaaacauggccacuuacu

SEQ ID NO: 13797 - RNA, 20 nt, Artificial Sequence
  TRAC targeting sequence
aauaucaauaaaacauggcc

SEQ ID NO: 13798 - RNA, 20 nt, Artificial Sequence
  TRAC targeting sequence
cgugaaguuaguggagauuu

SEQ ID NO: 13799 - RNA, 20 nt, Artificial Sequence
  TRAC targeting sequence
cgggauuuauuuguuugguc

SEQ ID NO: 13800 - RNA, 20 nt, Artificial Sequence
  TRAC targeting sequence
acuaacuucacgggauuuau

SEQ ID NO: 13801 - RNA, 20 nt, Artificial Sequence
  TRAC targeting sequence
ccacuaacuucacgggauuu

SEQ ID NO: 13802 - RNA, 20 nt, Artificial Sequence
  TRAC targeting sequence
acuucuugaaaaaugacuuu

SEQ ID NO: 13803 - RNA, 20 nt, Artificial Sequence
  TRAC targeting sequence
ugaaaaaugacuuuugugaa

SEQ ID NO: 13804 - RNA, 20 nt, Artificial Sequence
  TRAC targeting sequence
agaaguagauuuguuuacau

SEQ ID NO: 13805 - RNA, 20 nt, Artificial Sequence
  TRAC targeting sequence
uuuuucaagaaguagauuug

SEQ ID NO: 13806 - RNA, 20 nt, Artificial Sequence
  TRAC targeting sequence
caaaagucauuuuucaagaa

SEQ ID NO: 13807 - RNA, 20 nt, Artificial Sequence
  TRAC targeting sequence
uguauucacaaaagucauuu

SEQ ID NO: 13808 - RNA, 20 nt, Artificial Sequence
  TRAC targeting sequence
ugauuauugagacuagagca

SEQ ID NO: 13809 - RNA, 20 nt, Artificial Sequence
  TRAC targeting sequence
cgaguguuucauguauucac

SEQ ID NO: 13810 - RNA, 20 nt, Artificial Sequence
  TRAC targeting sequence
auaaucacgaguguuucaug

SEQ ID NO: 13811 - RNA, 20 nt, Artificial Sequence
  TRAC targeting sequence
caauaaucacgaguguuuca

SEQ ID NO: 13812 - RNA, 20 nt, Artificial Sequence
  TRAC targeting sequence
agucucaauaaucacgagug

SEQ ID NO: 13813 - RNA, 20 nt, Artificial Sequence
  TRAC targeting sequence
uuauugcucuagucucaaua

SEQ ID NO: 13814 - RNA, 20 nt, Artificial Sequence
  TRAC targeting sequence
uuuugccuuuauuuaucauu

SEQ ID NO: 13815 - RNA, 20 nt, Artificial Sequence
  TRAC targeting sequence
cauuuugccuuuauuuauca

SEQ ID NO: 13816 - RNA, 20 nt, Artificial Sequence
  TRAC targeting sequence
ccuuuaacauuguggcuuag

SEQ ID NO: 13817 - RNA, 20 nt, Artificial Sequence
  TRAC targeting sequence
uucuucuagagagauauggg

SEQ ID NO: 13818 - RNA, 20 nt, Artificial Sequence
  TRAC targeting sequence
ucuagagagauauggggcca

SEQ ID NO: 13819 - RNA, 20 nt, Artificial Sequence
  TRAC targeting sequence
agagagauauggggccauga

SEQ ID NO: 13820 - RNA, 20 nt, Artificial Sequence
  TRAC targeting sequence
agaagaaagagggcuaagcc

SEQ ID NO: 13821 - RNA, 20 nt, Artificial Sequence
  TRAC targeting sequence
cuagaagaaagagggcuaag

SEQ ID NO: 13822 - RNA, 20 nt, Artificial Sequence
  TRAC targeting sequence
cucuagaagaaagagggcua

SEQ ID NO: 13823 - RNA, 20 nt, Artificial Sequence
  TRAC targeting sequence
uggccccauaucucucuaga

SEQ ID NO: 13824 - RNA, 20 nt, Artificial Sequence
  TRAC targeting sequence
cuuaaacuauguucugcaau

SEQ ID NO: 13825 - RNA, 20 nt, Artificial Sequence
  TRAC targeting sequence
uaaacuauguucugcaauga

SEQ ID NO: 13826 - RNA, 20 nt, Artificial Sequence
  TRAC targeting sequence
gcaaugacuuguguguuuac

SEQ ID NO: 13827 - RNA, 20 nt, Artificial Sequence
  TRAC targeting sequence
uugcagaacauaguuuaaga

SEQ ID NO: 13828 - RNA, 20 nt, Artificial Sequence
  TRAC targeting sequence
gauuuuagccacagaauuug

SEQ ID NO: 13829 - RNA, 20 nt, Artificial Sequence
  TRAC targeting sequence
gaguaaacacacaagucauu

SEQ ID NO: 13830 - RNA, 20 nt, Artificial Sequence
  TRAC targeting sequence
guggcuaaaaucagaguaaa

SEQ ID NO: 13831 - RNA, 20 nt, Artificial Sequence
  TRAC targeting sequence
auucuauuaaaaaugagaau

SEQ ID NO: 13832 - RNA, 20 nt, Artificial Sequence
  TRAC targeting sequence
auuaaaaaugagaaucuauc

SEQ ID NO: 13833 - RNA, 20 nt, Artificial Sequence
  TRAC targeting sequence
uuuuuaauagaauggaaaac

SEQ ID NO: 13834 - RNA, 20 nt, Artificial Sequence
  TRAC targeting sequence
cauuuuuaauagaauggaaa

SEQ ID NO: 13835 - RNA, 20 nt, Artificial Sequence
  TRAC targeting sequence
aucucauuuuaaaugcuacu

SEQ ID NO: 13836 - RNA, 20 nt, Artificial Sequence
  TRAC targeting sequence
cauuuuaaaugcuacuaaua

SEQ ID NO: 13837 - RNA, 20 nt, Artificial Sequence
  TRAC targeting sequence
uuuuaaaugcuacuaauauu

SEQ ID NO: 13838 - RNA, 20 nt, Artificial Sequence
  TRAC targeting sequence
uugucucuuguaccugcaua

SEQ ID NO: 13839 - RNA, 20 nt, Artificial Sequence
  TRAC targeting sequence
cuuguaccugcauauauauu

SEQ ID NO: 13840 - RNA, 20 nt, Artificial Sequence
  TRAC targeting sequence
uguaccugcauauauauuca

SEQ ID NO: 13841 - RNA, 20 nt, Artificial Sequence
  TRAC targeting sequence
uuucaaaaagaucucauaag

SEQ ID NO: 13842 - RNA, 20 nt, Artificial Sequence
  TRAC targeting sequence
aaaagaucucauaagaaacc

SEQ ID NO: 13843 - RNA, 20 nt, Artificial Sequence
  TRAC targeting sequence
uuuugaaaugaauauauaug

SEQ ID NO: 13844 - RNA, 20 nt, Artificial Sequence
  TRAC targeting sequence
cauaagaaacccaaacauug

SEQ ID NO: 13845 - RNA, 20 nt, Artificial Sequence
  TRAC targeting sequence
uaagaaacccaaacauuguc

SEQ ID NO: 13846 - RNA, 20 nt, Artificial Sequence
  TRAC targeting sequence
uaugagaucuuuuugaaaug

SEQ ID NO: 13847 - RNA, 20 nt, Artificial Sequence
  TRAC targeting sequence
cauuuugacaaauguccaca

SEQ ID NO: 13848 - RNA, 20 nt, Artificial Sequence
  TRAC targeting sequence
aaaugcgacaauguuugggu

SEQ ID NO: 13849 - RNA, 20 nt, Artificial Sequence
  TRAC targeting sequence
acaucuagucccguaauguc

SEQ ID NO: 13850 - RNA, 20 nt, Artificial Sequence
  TRAC targeting sequence
agucccguaaugucaaauuu

SEQ ID NO: 13851 - RNA, 20 nt, Artificial Sequence
  TRAC targeting sequence
cguaaugucaaauuucacua

SEQ ID NO: 13852 - RNA, 20 nt, Artificial Sequence
  TRAC targeting sequence
aauuucacuaaaaacacagc

SEQ ID NO: 13853 - RNA, 20 nt, Artificial Sequence
  TRAC targeting sequence
cuaaaaacacagccugacua

SEQ ID NO: 13854 - RNA, 20 nt, Artificial Sequence
  TRAC targeting sequence
ggcuguguuuuuagugaaau

SEQ ID NO: 13855 - RNA, 20 nt, Artificial Sequence
  TRAC targeting sequence
acugcauuugcauagucagg

SEQ ID NO: 13856 - RNA, 20 nt, Artificial Sequence
  TRAC targeting sequence
uccacugcauuugcauaguc

SEQ ID NO: 13857 - RNA, 20 nt, Artificial Sequence
  TRAC targeting sequence
gaaauggauugacacuccca

SEQ ID NO: 13858 - RNA, 20 nt, Artificial Sequence
  TRAC targeting sequence
gaauuguuuuuuucuuccac

SEQ ID NO: 13859 - RNA, 20 nt, Artificial Sequence
  TRAC targeting sequence
auuucugaauuguuuuuuuc

SEQ ID NO: 13860 - RNA, 20 nt, Artificial Sequence
  TRAC targeting sequence
auccauuucugaauuguuuu

SEQ ID NO: 13861 - RNA, 20 nt, Artificial Sequence
  TRAC targeting sequence
cagguggcuuuauaaacacc

SEQ ID NO: 13862 - RNA, 20 nt, Artificial Sequence
  TRAC targeting sequence
uuuuagguguuuauaaagcc

SEQ ID NO: 13863 - RNA, 20 nt, Artificial Sequence
  TRAC targeting sequence
agagugaaauaaaauggcag

SEQ ID NO: 13864 - RNA, 20 nt, Artificial Sequence
  TRAC targeting sequence
ggauuuccuuuuagguguuu

SEQ ID NO: 13865 - RNA, 20 nt, Artificial Sequence
  TRAC targeting sequence
cucuggauuuccuuuuaggu

SEQ ID NO: 13866 - RNA, 20 nt, Artificial Sequence
  TRAC targeting sequence
uaccugccauuuuauuucac

SEQ ID NO: 13867 - RNA, 20 nt, Artificial Sequence
  TRAC targeting sequence
uguuaucauaccugccauuu

SEQ ID NO: 13868 - RNA, 20 nt, Artificial Sequence
  TRAC targeting sequence
uuaaaaaaaaaucguguuau

SEQ ID NO: 13869 - RNA, 20 nt, Artificial Sequence
  TRAC targeting sequence
auuccuccauggggaauaaa

SEQ ID NO: 13870 - RNA, 20 nt, Artificial Sequence
  TRAC targeting sequence
uccauggggaauaaaaguuu

SEQ ID NO: 13871 - RNA, 20 nt, Artificial Sequence
  TRAC targeting sequence
auggggaauaaaaguuuuua

SEQ ID NO: 13872 - RNA, 20 nt, Artificial Sequence
  TRAC targeting sequence
ccauggaggaauugaucauu

SEQ ID NO: 13873 - RNA, 20 nt, Artificial Sequence
  TRAC targeting sequence
uugaaaaggagggaaauagg

SEQ ID NO: 13874 - RNA, 20 nt, Artificial Sequence
  TRAC targeting sequence
aggagguaaguuuaaaaacu

SEQ ID NO: 13875 - RNA, 20 nt, Artificial Sequence
  TRAC targeting sequence
uuuucaaggagguaaguuua

SEQ ID NO: 13876 - RNA, 20 nt, Artificial Sequence
  TRAC targeting sequence
cuccuuuucaaggagguaag

SEQ ID NO: 13877 - RNA, 20 nt, Artificial Sequence
  TRAC targeting sequence
uauuucccuccuuuucaagg

SEQ ID NO: 13878 - RNA, 20 nt, Artificial Sequence
  TRAC targeting sequence
ggagccuggcauucccaggu

SEQ ID NO: 13879 - RNA, 20 nt, Artificial Sequence
  TRAC targeting sequence
ugaacuccuauuucccuccu

SEQ ID NO: 13880 - RNA, 20 nt, Artificial Sequence
  TRAC targeting sequence
caggugugcuccuggggugu

SEQ ID NO: 13881 - RNA, 20 nt, Artificial Sequence
  TRAC targeting sequence
uggggugucuguuucuccac

SEQ ID NO: 13882 - RNA, 20 nt, Artificial Sequence
  TRAC targeting sequence
guuucuccacauugccauuu

SEQ ID NO: 13883 - RNA, 20 nt, Artificial Sequence
  TRAC targeting sequence
ccacauugccauuuuggaga

SEQ ID NO: 13884 - RNA, 20 nt, Artificial Sequence
  TRAC targeting sequence
acauugccauuuuggagaca

SEQ ID NO: 13885 - RNA, 20 nt, Artificial Sequence
  TRAC targeting sequence
aaaauggcaauguggagaaa

SEQ ID NO: 13886 - RNA, 20 nt, Artificial Sequence
  TRAC targeting sequence
ccaaaauggcaauguggaga

SEQ ID NO: 13887 - RNA, 20 nt, Artificial Sequence
  TRAC targeting sequence
uauugucuccaaaauggcaa

SEQ ID NO: 13888 - RNA, 20 nt, Artificial Sequence
  TRAC targeting sequence
aaauguccaaccaaaaaacu

SEQ ID NO: 13889 - RNA, 20 nt, Artificial Sequence
  TRAC targeting sequence
aaccaaaaaacuaauauuaa

SEQ ID NO: 13890 - RNA, 20 nt, Artificial Sequence
  TRAC targeting sequence
uaauauuaguuuuuugguug

SEQ ID NO: 13891 - RNA, 20 nt, Artificial Sequence
  TRAC targeting sequence
agccucuuaauauuaguuuu

SEQ ID NO: 13892 - RNA, 20 nt, Artificial Sequence
  TRAC targeting sequence
ccacauugacugucuguuau

SEQ ID NO: 13893 - RNA, 20 nt, Artificial Sequence
  TRAC targeting sequence
auguggugacuccagccucu

SEQ ID NO: 13894 - RNA, 20 nt, Artificial Sequence
  TRAC targeting sequence
guuauuaaacccuauaacag

SEQ ID NO: 13895 - RNA, 20 nt, Artificial Sequence
  TRAC targeting sequence
uaauuauaaccuguuauagg

SEQ ID NO: 13896 - RNA, 20 nt, Artificial Sequence
  TRAC targeting sequence
auaaucuuaauuauaaccug

SEQ ID NO: 13897 - RNA, 20 nt, Artificial Sequence
  TRAC targeting sequence
uuccauaaucuuaauuauaa

SEQ ID NO: 13898 - RNA, 20 nt, Artificial Sequence
  TRAC targeting sequence
uuggguuagucauuccauaa

SEQ ID NO: 13899 - RNA, 20 nt, Artificial Sequence
  TRAC targeting sequence
uauuuuaaagcuccuugggu

SEQ ID NO: 13900 - RNA, 20 nt, Artificial Sequence
  TRAC targeting sequence
gccuugggaaaugcuggaag

SEQ ID NO: 13901 - RNA, 20 nt, Artificial Sequence
  TRAC targeting sequence
caaggcugaaccguuuaaaa

SEQ ID NO: 13902 - RNA, 20 nt, Artificial Sequence
  TRAC targeting sequence
agcauuucccaaggcugaac

SEQ ID NO: 13903 - RNA, 20 nt, Artificial Sequence
  TRAC targeting sequence
uccagcauuucccaaggcug

SEQ ID NO: 13904 - RNA, 20 nt, Artificial Sequence
  TRAC targeting sequence
uugucuuccagcauuuccca

SEQ ID NO: 13905 - RNA, 20 nt, Artificial Sequence
  TRAC targeting sequence
uuuccuugucuuccagcauu

SEQ ID NO: 13906 - RNA, 20 nt, Artificial Sequence
  TRAC targeting sequence
cauuuccuugucuuccagca

SEQ ID NO: 13907 - RNA, 20 nt, Artificial Sequence
  TRAC targeting sequence
aucucauuuccuugucuucc

SEQ ID NO: 13908 - RNA, 20 nt, Artificial Sequence
  TRAC targeting sequence
ucuaucucauuuccuugucu

SEQ ID NO: 13909 - RNA, 20 nt, Artificial Sequence
  TRAC targeting sequence
auagguuuguuuuacgucug

SEQ ID NO: 13910 - RNA, 20 nt, Artificial Sequence
  TRAC targeting sequence
ggugaacauauccaucccau

SEQ ID NO: 13911 - RNA, 20 nt, Artificial Sequence
  TRAC targeting sequence
ccagacguaaaacaaaccua

SEQ ID NO: 13912 - RNA, 20 nt, Artificial Sequence
  TRAC targeting sequence
aucccauguuaauuuuuuuu

SEQ ID NO: 13913 - RNA, 20 nt, Artificial Sequence
  TRAC targeting sequence
cauguuaauuuuuuuuaacg

SEQ ID NO: 13914 - RNA, 20 nt, Artificial Sequence
  TRAC targeting sequence
uuaaaaaaaauuaacauggg

SEQ ID NO: 13915 - RNA, 20 nt, Artificial Sequence
  TRAC targeting sequence
uagucguuaaaaaaaauuaa

SEQ ID NO: 13916 - RNA, 20 nt, Artificial Sequence
  TRAC targeting sequence
uuaucauagucguuaaaaaa

SEQ ID NO: 13917 - RNA, 20 nt, Artificial Sequence
  TRAC targeting sequence
uuggggucagguagaaccca

SEQ ID NO: 13918 - RNA, 20 nt, Artificial Sequence
  TRAC targeting sequence
gguagaacccaaaggaggaa

SEQ ID NO: 13919 - RNA, 20 nt, Artificial Sequence
  TRAC targeting sequence
accugaccccaaagaagcuc

SEQ ID NO: 13920 - RNA, 20 nt, Artificial Sequence
  TRAC targeting sequence
uuuggguucuaccugacccc

SEQ ID NO: 13921 - RNA, 20 nt, Artificial Sequence
  TRAC targeting sequence
uccuuuggguucuaccugac

SEQ ID NO: 13922 - RNA, 20 nt, Artificial Sequence
  TRAC targeting sequence
uccuccuuuggguucuaccu

SEQ ID NO: 13923 - RNA, 20 nt, Artificial Sequence
  TRAC targeting sequence
cuuccuccuuuggguucuac

SEQ ID NO: 13924 - RNA, 20 nt, Artificial Sequence
  TRAC targeting sequence
cauuuucucuuccuccuuug

SEQ ID NO: 13925 - RNA, 20 nt, Artificial Sequence
  TRAC targeting sequence
uuaagugucaaacaaggauc

SEQ ID NO: 13926 - RNA, 20 nt, Artificial Sequence
  TRAC targeting sequence
aacaaggauccagccagggu

SEQ ID NO: 13927 - RNA, 20 nt, Artificial Sequence
  TRAC targeting sequence
uuguuugacacuuaaagaac

SEQ ID NO: 13928 - RNA, 20 nt, Artificial Sequence
  TRAC targeting sequence
agccaggguugagggcaaug

SEQ ID NO: 13929 - RNA, 20 nt, Artificial Sequence
  TRAC targeting sequence
acccuggcuggauccuuguu

SEQ ID NO: 13930 - RNA, 20 nt, Artificial Sequence
  TRAC targeting sequence
cucucuugguggugagagac

SEQ ID NO: 13931 - RNA, 20 nt, Artificial Sequence
  TRAC targeting sequence
cuugguggugagagaccaca

SEQ ID NO: 13932 - RNA, 20 nt, Artificial Sequence
  TRAC targeting sequence
ugguggugagagaccacauc

SEQ ID NO: 13933 - RNA, 20 nt, Artificial Sequence
  TRAC targeting sequence
ccaccaagagagggaagccu

SEQ ID NO: 13934 - RNA, 20 nt, Artificial Sequence
  TRAC targeting sequence
caccaccaagagagggaagc

SEQ ID NO: 13935 - RNA, 20 nt, Artificial Sequence
  TRAC targeting sequence
cucaccaccaagagagggaa

SEQ ID NO: 13936 - RNA, 20 nt, Artificial Sequence
  TRAC targeting sequence
auggacuguggaaggagaac

SEQ ID NO: 13937 - RNA, 20 nt, Artificial Sequence
  TRAC targeting sequence
auggauguggucucucacca

SEQ ID NO: 13938 - RNA, 20 nt, Artificial Sequence
  TRAC targeting sequence
acaguccauggauguggucu

SEQ ID NO: 13939 - RNA, 20 nt, Artificial Sequence
  TRAC targeting sequence
uuccacaguccauggaugug

SEQ ID NO: 13940 - RNA, 20 nt, Artificial Sequence
  TRAC targeting sequence
ccuuccacaguccauggaug

SEQ ID NO: 13941 - RNA, 20 nt, Artificial Sequence
  TRAC targeting sequence
aaaagacggggaucccuugg

SEQ ID NO: 13942 - RNA, 20 nt, Artificial Sequence
  TRAC targeting sequence
uuuagaaaauguucuccuuc

SEQ ID NO: 13943 - RNA, 20 nt, Artificial Sequence
  TRAC targeting sequence
ccgucuuuuagaaaauguuc

SEQ ID NO: 13944 - RNA, 20 nt, Artificial Sequence
  TRAC targeting sequence
cuugggcuaaaaugaaugau

SEQ ID NO: 13945 - RNA, 20 nt, Artificial Sequence
  TRAC targeting sequence
uuuuagcccaagggaucccc

SEQ ID NO: 13946 - RNA, 20 nt, Artificial Sequence
  TRAC targeting sequence
uucauuuuagcccaagggau

SEQ ID NO: 13947 - RNA, 20 nt, Artificial Sequence
  TRAC targeting sequence
ugacccccagcuagggcagg

SEQ ID NO: 13948 - RNA, 20 nt, Artificial Sequence
  TRAC targeting sequence
ugagcaucauucauuuuagc

SEQ ID NO: 13949 - RNA, 20 nt, Artificial Sequence
  TRAC targeting sequence
uuauagcccugcccuagcug

SEQ ID NO: 13950 - RNA, 20 nt, Artificial Sequence
  TRAC targeting sequence
ucagaauuuggugacagggc

SEQ ID NO: 13951 - RNA, 20 nt, Artificial Sequence
  TRAC targeting sequence
gaauuuggugacagggcaaa

SEQ ID NO: 13952 - RNA, 20 nt, Artificial Sequence
  TRAC targeting sequence
gaggauaccuugccuuaugu

SEQ ID NO: 13953 - RNA, 20 nt, Artificial Sequence
  TRAC targeting sequence
ccaaauucugaggauaccuu

SEQ ID NO: 13954 - RNA, 20 nt, Artificial Sequence
  TRAC targeting sequence
agaacuuaaggcuuagagcc

SEQ ID NO: 13955 - RNA, 20 nt, Artificial Sequence
  TRAC targeting sequence
agaauuugcccugucaccaa

SEQ ID NO: 13956 - RNA, 20 nt, Artificial Sequence
  TRAC targeting sequence
aagccuuaaguucuagaauu

SEQ ID NO: 13957 - RNA, 20 nt, Artificial Sequence
  TRAC targeting sequence
cccuggcucuaagccuuaag

SEQ ID NO: 13958 - RNA, 20 nt, Artificial Sequence
  TRAC targeting sequence
cuucacccuggcucuaagcc

SEQ ID NO: 13959 - RNA, 20 nt, Artificial Sequence
  TRAC targeting sequence
ucccuucacccuggcucuaa

SEQ ID NO: 13960 - RNA, 20 nt, Artificial Sequence
  TRAC targeting sequence
guaaugcaguuccuucucag

SEQ ID NO: 13961 - RNA, 20 nt, Artificial Sequence
  TRAC targeting sequence
uucucagguggaaauccaga

SEQ ID NO: 13962 - RNA, 20 nt, Artificial Sequence
  TRAC targeting sequence
cagguggaaauccagauaug

SEQ ID NO: 13963 - RNA, 20 nt, Artificial Sequence
  TRAC targeting sequence
gguggaaauccagauaugug

SEQ ID NO: 13964 - RNA, 20 nt, Artificial Sequence
  TRAC targeting sequence
accugagaaggaacugcauu

SEQ ID NO: 13965 - RNA, 20 nt, Artificial Sequence
  TRAC targeting sequence
agauaugugcccuaagugac

SEQ ID NO: 13966 - RNA, 20 nt, Artificial Sequence
  TRAC targeting sequence
ggauuuccaccugagaagga

SEQ ID NO: 13967 - RNA, 20 nt, Artificial Sequence
  TRAC targeting sequence
cuuagggcacauaucuggau

SEQ ID NO: 13968 - RNA, 20 nt, Artificial Sequence
  TRAC targeting sequence
ugccccauuuuuguuugggc

SEQ ID NO: 13969 - RNA, 20 nt, Artificial Sequence
  TRAC targeting sequence
gaaaaguggauuccuagcuc

SEQ ID NO: 13970 - RNA, 20 nt, Artificial Sequence
  TRAC targeting sequence
gagcccaaacaaaaaugggg

SEQ ID NO: 13971 - RNA, 20 nt, Artificial Sequence
  TRAC targeting sequence
acuuuucagagcccaaacaa

SEQ ID NO: 13972 - RNA, 20 nt, Artificial Sequence
  TRAC targeting sequence
uagcucaguggcugucugcc

SEQ ID NO: 13973 - RNA, 20 nt, Artificial Sequence
  TRAC targeting sequence
guggcugucugccagguauc

SEQ ID NO: 13974 - RNA, 20 nt, Artificial Sequence
  TRAC targeting sequence
gccagguaucuuuugccuuc

SEQ ID NO: 13975 - RNA, 20 nt, Artificial Sequence
  TRAC targeting sequence
uuugccuucaguaacagaau

SEQ ID NO: 13976 - RNA, 20 nt, Artificial Sequence
  TRAC targeting sequence
guaacagaauuauguuugau

SEQ ID NO: 13977 - RNA, 20 nt, Artificial Sequence
  TRAC targeting sequence
guuacugaaggcaaaagaua

SEQ ID NO: 13978 - RNA, 20 nt, Artificial Sequence
  TRAC targeting sequence
aacauaauucuguuacugaa

SEQ ID NO: 13979 - RNA, 20 nt, Artificial Sequence
  TRAC targeting sequence
aauaucaaacauaauucugu

SEQ ID NO: 13980 - RNA, 20 nt, Artificial Sequence
  TRAC targeting sequence
uuuccaauaucaaacauaau

SEQ ID NO: 13981 - RNA, 20 nt, Artificial Sequence
  TRAC targeting sequence
cucucagugucaaaugaggu

SEQ ID NO: 13982 - RNA, 20 nt, Artificial Sequence
  TRAC targeting sequence
cagugucaaaugaggucauu

SEQ ID NO: 13983 - RNA, 20 nt, Artificial Sequence
  TRAC targeting sequence
gugucaaaugaggucauuca

SEQ ID NO: 13984 - RNA, 20 nt, Artificial Sequence
  TRAC targeting sequence
aaugaggucauucaacuucc

SEQ ID NO: 13985 - RNA, 20 nt, Artificial Sequence
  TRAC targeting sequence
uuugacacugagagugaauu

SEQ ID NO: 13986 - RNA, 20 nt, Artificial Sequence
  TRAC targeting sequence
uucaacuuccucucgcacau

SEQ ID NO: 13987 - RNA, 20 nt, Artificial Sequence
  TRAC targeting sequence
acuuccucucgcacauuugc

SEQ ID NO: 13988 - RNA, 20 nt, Artificial Sequence
  TRAC targeting sequence
ucucgcacauuugcaauaag

SEQ ID NO: 13989 - RNA, 20 nt, Artificial Sequence
  TRAC targeting sequence
cgcacauuugcaauaagcag

SEQ ID NO: 13990 - RNA, 20 nt, Artificial Sequence
  TRAC targeting sequence
cacauuugcaauaagcagca

SEQ ID NO: 13991 - RNA, 20 nt, Artificial Sequence
  TRAC targeting sequence
ugcugcuuauugcaaaugug

SEQ ID NO: 13992 - RNA, 20 nt, Artificial Sequence
  TRAC targeting sequence
agcagaacaacuagaagaca

SEQ ID NO: 13993 - RNA, 20 nt, Artificial Sequence
  TRAC targeting sequence
gcuugaauuucaugcugcuu

SEQ ID NO: 13994 - RNA, 20 nt, Artificial Sequence
  TRAC targeting sequence
aguuguucugcuugaauuuc

SEQ ID NO: 13995 - RNA, 20 nt, Artificial Sequence
  TRAC targeting sequence
ucuaguuguucugcuugaau

SEQ ID NO: 13996 - RNA, 20 nt, Artificial Sequence
  TRAC targeting sequence
gugucuucuaguuguucugc

SEQ ID NO: 13997 - RNA, 20 nt, Artificial Sequence
  TRAC targeting sequence
cugugucuucuaguuguucu

SEQ ID NO: 13998 - RNA, 20 nt, Artificial Sequence
  TRAC targeting sequence
uucucugugucuucuaguug

SEQ ID NO: 13999 - RNA, 20 nt, Artificial Sequence
  TRAC targeting sequence
gccaucuuucucugugucuu

SEQ ID NO: 14000 - RNA, 20 nt, Artificial Sequence
  TRAC targeting sequence
gcucagccaucuuucucugu

SEQ ID NO: 14001 - RNA, 20 nt, Artificial Sequence
  TRAC targeting sequence
uuaucagcucagccaucuuu

SEQ ID NO: 14002 - RNA, 20 nt, Artificial Sequence
  TRAC targeting sequence
uguaauaaacaggccucauu

SEQ ID NO: 14003 - RNA, 20 nt, Artificial Sequence
  TRAC targeting sequence
ccuguaauaaacaggccuca

SEQ ID NO: 14004 - RNA, 20 nt, Artificial Sequence
  TRAC targeting sequence
ucuccuguaauaaacaggcc

SEQ ID NO: 14005 - RNA, 20 nt, Artificial Sequence
  TRAC targeting sequence
cuucuccuguaauaaacagg

SEQ ID NO: 14006 - RNA, 20 nt, Artificial Sequence
  TRAC targeting sequence
uauauugucucuucuccugu

SEQ ID NO: 14007 - RNA, 20 nt, Artificial Sequence
  TRAC targeting sequence
guuaagucccaugagguuga

SEQ ID NO: 14008 - RNA, 20 nt, Artificial Sequence
  TRAC targeting sequence
caugagguugaaauauccac

SEQ ID NO: 14009 - RNA, 20 nt, Artificial Sequence
  TRAC targeting sequence
ugggacuuaacagauuccua

SEQ ID NO: 14010 - RNA, 20 nt, Artificial Sequence
  TRAC targeting sequence
accucaugggacuuaacaga

SEQ ID NO: 14011 - RNA, 20 nt, Artificial Sequence
  TRAC targeting sequence
accaaaaaauaugcagcugu

SEQ ID NO: 14012 - RNA, 20 nt, Artificial Sequence
  TRAC targeting sequence
cccaaaaaaaagucacuagg

SEQ ID NO: 14013 - RNA, 20 nt, Artificial Sequence
  TRAC targeting sequence
cuaggaguuuuuguuauggu

SEQ ID NO: 14014 - RNA, 20 nt, Artificial Sequence
  TRAC targeting sequence
uagugacuuuuuuuuggggg

SEQ ID NO: 14015 - RNA, 20 nt, Artificial Sequence
  TRAC targeting sequence
caaucacagugugaacagag

SEQ ID NO: 14016 - RNA, 20 nt, Artificial Sequence
  TRAC targeting sequence
cagugugaacagagaugaca

SEQ ID NO: 14017 - RNA, 20 nt, Artificial Sequence
  TRAC targeting sequence
cacugugauugggaccauaa

SEQ ID NO: 14018 - RNA, 20 nt, Artificial Sequence
  TRAC targeting sequence
guucacacugugauugggac

SEQ ID NO: 14019 - RNA, 20 nt, Artificial Sequence
  TRAC targeting sequence
cuguucacacugugauuggg

SEQ ID NO: 14020 - RNA, 20 nt, Artificial Sequence
  TRAC targeting sequence
ucucuguucacacugugauu

SEQ ID NO: 14021 - RNA, 20 nt, Artificial Sequence
  TRAC targeting sequence
ugucaucucuguucacacug

SEQ ID NO: 14022 - RNA, 20 nt, Artificial Sequence
  TRAC targeting sequence
ucuuuggaaaagggacacga

SEQ ID NO: 14023 - RNA, 20 nt, Artificial Sequence
  TRAC targeting sequence
uuggaaaagggacacgacuu

SEQ ID NO: 14024 - RNA, 20 nt, Artificial Sequence
  TRAC targeting sequence
aaagaugaucuugucaucuc

SEQ ID NO: 14025 - RNA, 20 nt, Artificial Sequence
  TRAC targeting sequence
cuuuuccaaagaugaucuug

SEQ ID NO: 14026 - RNA, 20 nt, Artificial Sequence
  TRAC targeting sequence
ugucccuuuuccaaagauga

SEQ ID NO: 14027 - RNA, 20 nt, Artificial Sequence
  TRAC targeting sequence
uauucuccccaguaagugcu

SEQ ID NO: 14028 - RNA, 20 nt, Artificial Sequence
  TRAC targeting sequence
ccccaguaagugcuguuuau

SEQ ID NO: 14029 - RNA, 20 nt, Artificial Sequence
  TRAC targeting sequence
ccaguaagugcuguuuaugu

SEQ ID NO: 14030 - RNA, 20 nt, Artificial Sequence
  TRAC targeting sequence
cauaaacagcacuuacuggg

SEQ ID NO: 14031 - RNA, 20 nt, Artificial Sequence
  TRAC targeting sequence
gacauuaacucccacugagu

SEQ ID NO: 14032 - RNA, 20 nt, Artificial Sequence
  TRAC targeting sequence
gaaaaucacauaaacagcac

SEQ ID NO: 14033 - RNA, 20 nt, Artificial Sequence
  TRAC targeting sequence
cacugaguucaaacugcuga

SEQ ID NO: 14034 - RNA, 20 nt, Artificial Sequence
  TRAC targeting sequence
gugggaguuaaugucagaaa

SEQ ID NO: 14035 - RNA, 20 nt, Artificial Sequence
  TRAC targeting sequence
aacugcugagaguguucagu

SEQ ID NO: 14036 - RNA, 20 nt, Artificial Sequence
  TRAC targeting sequence
gcaguuugaacucaguggga

SEQ ID NO: 14037 - RNA, 20 nt, Artificial Sequence
  TRAC targeting sequence
cagcaguuugaacucagugg

SEQ ID NO: 14038 - RNA, 20 nt, Artificial Sequence
  TRAC targeting sequence
guaggaaaguuucuaagaca

SEQ ID NO: 14039 - RNA, 20 nt, Artificial Sequence
  TRAC targeting sequence
uacugaacacucucagcagu

SEQ ID NO: 14040 - RNA, 20 nt, Artificial Sequence
  TRAC targeting sequence
aagacauguggguggccugu

SEQ ID NO: 14041 - RNA, 20 nt, Artificial Sequence
  TRAC targeting sequence
uagaaacuuuccuacugaac

SEQ ID NO: 14042 - RNA, 20 nt, Artificial Sequence
  TRAC targeting sequence
ugggcucuucucuugcagag

SEQ ID NO: 14043 - RNA, 20 nt, Artificial Sequence
  TRAC targeting sequence
ucucuugcagagguccaguc

SEQ ID NO: 14044 - RNA, 20 nt, Artificial Sequence
  TRAC targeting sequence
cuugcagagguccaguccuc

SEQ ID NO: 14045 - RNA, 20 nt, Artificial Sequence
  TRAC targeting sequence
ugcagagguccaguccucag

SEQ ID NO: 14046 - RNA, 20 nt, Artificial Sequence
  TRAC targeting sequence
gcaagagaagagcccaggac

SEQ ID NO: 14047 - RNA, 20 nt, Artificial Sequence
  TRAC targeting sequence
aguccucagccuuuccacag

SEQ ID NO: 14048 - RNA, 20 nt, Artificial Sequence
  TRAC targeting sequence
ucagccuuuccacagcugag

SEQ ID NO: 14049 - RNA, 20 nt, Artificial Sequence
  TRAC targeting sequence
gccuuuccacagcugagcca

SEQ ID NO: 14050 - RNA, 20 nt, Artificial Sequence
  TRAC targeting sequence
acagcugagccaaauaccaa

SEQ ID NO: 14051 - RNA, 20 nt, Artificial Sequence
  TRAC targeting sequence
gcuguggaaaggcugaggac

SEQ ID NO: 14052 - RNA, 20 nt, Artificial Sequence
  TRAC targeting sequence
ccccuccagggcuggaaaag

SEQ ID NO: 14053 - RNA, 20 nt, Artificial Sequence
  TRAC targeting sequence
ccuccagggcuggaaaaguu

SEQ ID NO: 14054 - RNA, 20 nt, Artificial Sequence
  TRAC targeting sequence
agggcuggaaaaguugcuac

SEQ ID NO: 14055 - RNA, 20 nt, Artificial Sequence
  TRAC targeting sequence
agcccuggaggggagaauuu

SEQ ID NO: 14056 - RNA, 20 nt, Artificial Sequence
  TRAC targeting sequence
ucugcuacccaaauauaaau

SEQ ID NO: 14057 - RNA, 20 nt, Artificial Sequence
  TRAC targeting sequence
gcuacccaaauauaaauuau

SEQ ID NO: 14058 - RNA, 20 nt, Artificial Sequence
  TRAC targeting sequence
uaauaaacaauaaaaaaaua

SEQ ID NO: 14059 - RNA, 20 nt, Artificial Sequence
  TRAC targeting sequence
ucuuaauaaacaauaaaaaa

SEQ ID NO: 14060 - RNA, 20 nt, Artificial Sequence
  TRAC targeting sequence
uuuacucuucuuaauaaaca

SEQ ID NO: 14061 - RNA, 20 nt, Artificial Sequence
  TRAC targeting sequence
ugacacuuuguccagaaccu

SEQ ID NO: 14062 - RNA, 20 nt, Artificial Sequence
  TRAC targeting sequence
cgauucuuuuacucuucuua

SEQ ID NO: 14063 - RNA, 20 nt, Artificial Sequence
  TRAC targeting sequence
agaaccuauuuuccagucuu

SEQ ID NO: 14064 - RNA, 20 nt, Artificial Sequence
  TRAC targeting sequence
ggacaaagugucacgauucu

SEQ ID NO: 14065 - RNA, 20 nt, Artificial Sequence
  TRAC targeting sequence
agucuuuucccccaggcuug

SEQ ID NO: 14066 - RNA, 20 nt, Artificial Sequence
  TRAC targeting sequence
uuucccccaggcuugucccu

SEQ ID NO: 14067 - RNA, 20 nt, Artificial Sequence
  TRAC targeting sequence
cccaggcuugucccugguaa

SEQ ID NO: 14068 - RNA, 20 nt, Artificial Sequence
  TRAC targeting sequence
cugguaaccucuguuuggac

SEQ ID NO: 14069 - RNA, 20 nt, Artificial Sequence
  TRAC targeting sequence
guuuggacucauuguuaagc

SEQ ID NO: 14070 - RNA, 20 nt, Artificial Sequence
  TRAC targeting sequence
aaacagagguuaccagggac

SEQ ID NO: 14071 - RNA, 20 nt, Artificial Sequence
  TRAC targeting sequence
uuguuaagcccagcgugauu

SEQ ID NO: 14072 - RNA, 20 nt, Artificial Sequence
  TRAC targeting sequence
cgcugggcuuaacaaugagu

SEQ ID NO: 14073 - RNA, 20 nt, Artificial Sequence
  TRAC targeting sequence
aacuaaauugauuuuggaaa

SEQ ID NO: 14074 - RNA, 20 nt, Artificial Sequence
  TRAC targeting sequence
auuuaguuggagccaaaaau

SEQ ID NO: 14075 - RNA, 20 nt, Artificial Sequence
  TRAC targeting sequence
aaaaucaauuuaguuggagc

SEQ ID NO: 14076 - RNA, 20 nt, Artificial Sequence
  TRAC targeting sequence
uuuccaaaaucaauuuaguu

SEQ ID NO: 14077 - RNA, 20 nt, Artificial Sequence
  TRAC targeting sequence
agcauaccuaugaccccucu

SEQ ID NO: 14078 - RNA, 20 nt, Artificial Sequence
  TRAC targeting sequence
uagguaugcuggagucauuu

SEQ ID NO: 14079 - RNA, 20 nt, Artificial Sequence
  TRAC targeting sequence
ccuuccacccuccauaaaag

SEQ ID NO: 14080 - RNA, 20 nt, Artificial Sequence
  TRAC targeting sequence
uuccacccuccauaaaagau

SEQ ID NO: 14081 - RNA, 20 nt, Artificial Sequence
  TRAC targeting sequence
acccuccauaaaagauuuau

SEQ ID NO: 14082 - RNA, 20 nt, Artificial Sequence
  TRAC targeting sequence
auaaaagauuuauuuuucuu

SEQ ID NO: 14083 - RNA, 20 nt, Artificial Sequence
  TRAC targeting sequence
uuuauggaggguggaaggag

SEQ ID NO: 14084 - RNA, 20 nt, Artificial Sequence
  TRAC targeting sequence
uuauuuggccucugcugaga

SEQ ID NO: 14085 - RNA, 20 nt, Artificial Sequence
  TRAC targeting sequence
gcugagauuccuggcuuuga

SEQ ID NO: 14086 - RNA, 20 nt, Artificial Sequence
  TRAC targeting sequence
gcagaggccaaauaaagaaa

SEQ ID NO: 14087 - RNA, 20 nt, Artificial Sequence
  TRAC targeting sequence
cagcagaggccaaauaaaga

SEQ ID NO: 14088 - RNA, 20 nt, Artificial Sequence
  TRAC targeting sequence
uggcuuugaugccccaggau

SEQ ID NO: 14089 - RNA, 20 nt, Artificial Sequence
  TRAC targeting sequence
aagccaggaaucucagcaga

SEQ ID NO: 14090 - RNA, 20 nt, Artificial Sequence
  TRAC targeting sequence
uggggcaucaaagccaggaa

SEQ ID NO: 14091 - RNA, 20 nt, Artificial Sequence
  TRAC targeting sequence
cucauuucccuuguuccagg

SEQ ID NO: 14092 - RNA, 20 nt, Artificial Sequence
  TRAC targeting sequence
cauuucccuuguuccaggga

SEQ ID NO: 14093 - RNA, 20 nt, Artificial Sequence
  TRAC targeting sequence
uuucccuuguuccagggaua

SEQ ID NO: 14094 - RNA, 20 nt, Artificial Sequence
  TRAC targeting sequence
cuuguuccagggauaaguga

SEQ ID NO: 14095 - RNA, 20 nt, Artificial Sequence
  TRAC targeting sequence
agggauaagugagagaugac

SEQ ID NO: 14096 - RNA, 20 nt, Artificial Sequence
  TRAC targeting sequence
cuggaacaagggaaaugaga

SEQ ID NO: 14097 - RNA, 20 nt, Artificial Sequence
  TRAC targeting sequence
cuuaucccuggaacaaggga

SEQ ID NO: 14098 - RNA, 20 nt, Artificial Sequence
  TRAC targeting sequence
cacuuaucccuggaacaagg

SEQ ID NO: 14099 - RNA, 20 nt, Artificial Sequence
  TRAC targeting sequence
cucacuuaucccuggaacaa

SEQ ID NO: 14100 - RNA, 20 nt, Artificial Sequence
  TRAC targeting sequence
ucucucacuuaucccuggaa

SEQ ID NO: 14101 - RNA, 20 nt, Artificial Sequence
  TRAC targeting sequence
uuaaaaagucaucucucacu

SEQ ID NO: 14102 - RNA, 20 nt, Artificial Sequence
  TRAC targeting sequence
ucuuagagacaacaaagaga

SEQ ID NO: 14103 - RNA, 20 nt, Artificial Sequence
  TRAC targeting sequence
uagagacaacaaagagagua

SEQ ID NO: 14104 - RNA, 20 nt, Artificial Sequence
  TRAC targeting sequence
aagaugaaaguagcucuuua

SEQ ID NO: 14105 - RNA, 20 nt, Artificial Sequence
  TRAC targeting sequence
cuaagaugaaaguagcucuu

SEQ ID NO: 14106 - RNA, 20 nt, Artificial Sequence
  TRAC targeting sequence
uuguugucucuaagaugaaa

SEQ ID NO: 14107 - RNA, 20 nt, Artificial Sequence
  TRAC targeting sequence
cuuuguugucucuaagauga

SEQ ID NO: 14108 - RNA, 20 nt, Artificial Sequence
  TRAC targeting sequence
ugcuggcauacucucuuugu

SEQ ID NO: 14109 - RNA, 20 nt, Artificial Sequence
  TRAC targeting sequence
ugcauugagccuucucacuc

SEQ ID NO: 14110 - RNA, 20 nt, Artificial Sequence
  TRAC targeting sequence
augcaagauguugcucuugc

SEQ ID NO: 14111 - RNA, 20 nt, Artificial Sequence
  TRAC targeting sequence
cacucuaugccauuuuccaa

SEQ ID NO: 14112 - RNA, 20 nt, Artificial Sequence
  TRAC targeting sequence
cucuaugccauuuuccaaau

SEQ ID NO: 14113 - RNA, 20 nt, Artificial Sequence
  TRAC targeting sequence
augccauuuuccaaaucuuu

SEQ ID NO: 14114 - RNA, 20 nt, Artificial Sequence
  TRAC targeting sequence
aaaucuuuuucuuuauuuag

SEQ ID NO: 14115 - RNA, 20 nt, Artificial Sequence
  TRAC targeting sequence
uuuucuuuauuuaggauaag

SEQ ID NO: 14116 - RNA, 20 nt, Artificial Sequence
  TRAC targeting sequence
uuauuuaggauaagugacca

SEQ ID NO: 14117 - RNA, 20 nt, Artificial Sequence
  TRAC targeting sequence
uaaauaaagaaaaagauuug

SEQ ID NO: 14118 - RNA, 20 nt, Artificial Sequence
  TRAC targeting sequence
cuuauccuaaauaaagaaaa

SEQ ID NO: 14119 - RNA, 20 nt, Artificial Sequence
  TRAC targeting sequence
uuuuuauuucuaguacagca

SEQ ID NO: 14120 - RNA, 20 nt, Artificial Sequence
  TRAC targeting sequence
aguacagcaaagaguacauc

SEQ ID NO: 14121 - RNA, 20 nt, Artificial Sequence
  TRAC targeting sequence
uugcuguacuagaaauaaaa

SEQ ID NO: 14122 - RNA, 20 nt, Artificial Sequence
  TRAC targeting sequence
ugaugucagaaacagggauu

SEQ ID NO: 14123 - RNA, 20 nt, Artificial Sequence
  TRAC targeting sequence
ugauguacucuuugcuguac

SEQ ID NO: 14124 - RNA, 20 nt, Artificial Sequence
  TRAC targeting sequence
gaaacagggauuuccuuugg

SEQ ID NO: 14125 - RNA, 20 nt, Artificial Sequence
  TRAC targeting sequence
gacaucaugauguacucuuu

SEQ ID NO: 14126 - RNA, 20 nt, Artificial Sequence
  TRAC targeting sequence
cuguuucugacaucaugaug

SEQ ID NO: 14127 - RNA, 20 nt, Artificial Sequence
  TRAC targeting sequence
uuuggaauguuuuucacagg

SEQ ID NO: 14128 - RNA, 20 nt, Artificial Sequence
  TRAC targeting sequence
aaaggaaaucccuguuucug

SEQ ID NO: 14129 - RNA, 20 nt, Artificial Sequence
  TRAC targeting sequence
caggcuaacaauaagcuaga

SEQ ID NO: 14130 - RNA, 20 nt, Artificial Sequence
  TRAC targeting sequence
agcuuauuguuagccuguga

SEQ ID NO: 14131 - RNA, 20 nt, Artificial Sequence
  TRAC targeting sequence
gcaagcaauucagaaaugca

SEQ ID NO: 14132 - RNA, 20 nt, Artificial Sequence
  TRAC targeting sequence
gaaaugcaucccugagcuac

SEQ ID NO: 14133 - RNA, 20 nt, Artificial Sequence
  TRAC targeting sequence
gaauugcuugcagacuucua

SEQ ID NO: 14134 - RNA, 20 nt, Artificial Sequence
  TRAC targeting sequence
cugagcuacaacuccaugua

SEQ ID NO: 14135 - RNA, 20 nt, Artificial Sequence
  TRAC targeting sequence
gggaugcauuucugaauugc

SEQ ID NO: 14136 - RNA, 20 nt, Artificial Sequence
  TRAC targeting sequence
auguauggaagcucaucagc

SEQ ID NO: 14137 - RNA, 20 nt, Artificial Sequence
  TRAC targeting sequence
auacauggaguuguagcuca

SEQ ID NO: 14138 - RNA, 20 nt, Artificial Sequence
  TRAC targeting sequence
ucagcaggguagacaggcaa

SEQ ID NO: 14139 - RNA, 20 nt, Artificial Sequence
  TRAC targeting sequence
gcaggguagacaggcaaagc

SEQ ID NO: 14140 - RNA, 20 nt, Artificial Sequence
  TRAC targeting sequence
acccugcugaugagcuucca

SEQ ID NO: 14141 - RNA, 20 nt, Artificial Sequence
  TRAC targeting sequence
gcuuugccugucuacccugc

SEQ ID NO: 14142 - RNA, 20 nt, Artificial Sequence
  TRAC targeting sequence
acaaaguaugguauaauuaa

SEQ ID NO: 14143 - RNA, 20 nt, Artificial Sequence
  TRAC targeting sequence
cuacaaaguaugguauaauu

SEQ ID NO: 14144 - RNA, 20 nt, Artificial Sequence
  TRAC targeting sequence
cccaaucucuacaaaguaug

SEQ ID NO: 14145 - RNA, 20 nt, Artificial Sequence
  TRAC targeting sequence
cccccaaucucuacaaagua

SEQ ID NO: 14146 - RNA, 20 nt, Artificial Sequence
  TRAC targeting sequence
uuagcacgcauuugcccacu

SEQ ID NO: 14147 - RNA, 20 nt, Artificial Sequence
  TRAC targeting sequence
ccacuuaaccauaguuuuug

SEQ ID NO: 14148 - RNA, 20 nt, Artificial Sequence
  TRAC targeting sequence
ccccacuuaaccauaguuuu

SEQ ID NO: 14149 - RNA, 20 nt, Artificial Sequence
  TRAC targeting sequence
agaugguucuaacagggaag

SEQ ID NO: 14150 - RNA, 20 nt, Artificial Sequence
  TRAC targeting sequence
agaaaucuccccacuuaacc

SEQ ID NO: 14151 - RNA, 20 nt, Artificial Sequence
  TRAC targeting sequence
aacagggaagaagaccaaca

SEQ ID NO: 14152 - RNA, 20 nt, Artificial Sequence
  TRAC targeting sequence
cuguuagaaccaucuagaaa

SEQ ID NO: 14153 - RNA, 20 nt, Artificial Sequence
  TRAC targeting sequence
ucccuguuagaaccaucuag

SEQ ID NO: 14154 - RNA, 20 nt, Artificial Sequence
  TRAC targeting sequence
ucuucccuguuagaaccauc

SEQ ID NO: 14155 - RNA, 20 nt, Artificial Sequence
  TRAC targeting sequence
uguuggucuucuucccuguu

SEQ ID NO: 14156 - RNA, 20 nt, Artificial Sequence
  TRAC targeting sequence
ucuuguuggucuucuucccu

SEQ ID NO: 14157 - RNA, 20 nt, Artificial Sequence
  TRAC targeting sequence
aggaaaaccaccaaggccag

SEQ ID NO: 14158 - RNA, 20 nt, Artificial Sequence
  TRAC targeting sequence
uggaaguuuccucuuguugg

SEQ ID NO: 14159 - RNA, 20 nt, Artificial Sequence
  TRAC targeting sequence
ggguuuuuguuauggaggaa

SEQ ID NO: 14160 - RNA, 20 nt, Artificial Sequence
  TRAC targeting sequence
auaacaaaaacccugaaugc

SEQ ID NO: 14161 - RNA, 20 nt, Artificial Sequence
  TRAC targeting sequence
uccauaacaaaaacccugaa

SEQ ID NO: 14162 - RNA, 20 nt, Artificial Sequence
  TRAC targeting sequence
cugugggaauucaggaaaca

SEQ ID NO: 14163 - RNA, 20 nt, Artificial Sequence
  TRAC targeting sequence
cacagugauuuccuccauaa

SEQ ID NO: 14164 - RNA, 20 nt, Artificial Sequence
  TRAC targeting sequence
ggaaacacaccucuugucuu

SEQ ID NO: 14165 - RNA, 20 nt, Artificial Sequence
  TRAC targeting sequence
ugaauucccacagugauuuc

SEQ ID NO: 14166 - RNA, 20 nt, Artificial Sequence
  TRAC targeting sequence
ugucuuuggaaagggcacaa

SEQ ID NO: 14167 - RNA, 20 nt, Artificial Sequence
  TRAC targeting sequence
uuggaaagggcacaagacuu

SEQ ID NO: 14168 - RNA, 20 nt, Artificial Sequence
  TRAC targeting sequence
aaagacaagagguguguuuc

SEQ ID NO: 14169 - RNA, 20 nt, Artificial Sequence
  TRAC targeting sequence
ugugcccuuuccaaagacaa

SEQ ID NO: 14170 - RNA, 20 nt, Artificial Sequence
  TRAC targeting sequence
gugauugcaaguaaguguuu

SEQ ID NO: 14171 - RNA, 20 nt, Artificial Sequence
  TRAC targeting sequence
cagaaagucuugugcccuuu

SEQ ID NO: 14172 - RNA, 20 nt, Artificial Sequence
  TRAC targeting sequence
agccauccuugauuuugauc

SEQ ID NO: 14173 - RNA, 20 nt, Artificial Sequence
  TRAC targeting sequence
uugauuuugaucagcaaugg

SEQ ID NO: 14174 - RNA, 20 nt, Artificial Sequence
  TRAC targeting sequence
aggauggcuagaaacacuua

SEQ ID NO: 14175 - RNA, 20 nt, Artificial Sequence
  TRAC targeting sequence
aaaucaaggauggcuagaaa

SEQ ID NO: 14176 - RNA, 20 nt, Artificial Sequence
  TRAC targeting sequence
gcaauggcuucuucccuuga

SEQ ID NO: 14177 - RNA, 20 nt, Artificial Sequence
  TRAC targeting sequence
ucccuugaauuauuuuucag

SEQ ID NO: 14178 - RNA, 20 nt, Artificial Sequence
  TRAC targeting sequence
cuugaauuauuuuucagugu

SEQ ID NO: 14179 - RNA, 20 nt, Artificial Sequence
  TRAC targeting sequence
agggaagaagccauugcuga

SEQ ID NO: 14180 - RNA, 20 nt, Artificial Sequence
  TRAC targeting sequence
guguaccuagaaugcuuuug

SEQ ID NO: 14181 - RNA, 20 nt, Artificial Sequence
  TRAC targeting sequence
agguacacugaaaaauaauu

SEQ ID NO: 14182 - RNA, 20 nt, Artificial Sequence
  TRAC targeting sequence
ugggggcaaaagcauucuag

SEQ ID NO: 14183 - RNA, 20 nt, Artificial Sequence
  TRAC targeting sequence
aaaccuuucuugggggcaaa

SEQ ID NO: 14184 - RNA, 20 nt, Artificial Sequence
  TRAC targeting sequence
uuccaaaccuuucuuggggg

SEQ ID NO: 14185 - RNA, 20 nt, Artificial Sequence
  TRAC targeting sequence
uuagcauugcgcaggaaaau

SEQ ID NO: 14186 - RNA, 20 nt, Artificial Sequence
  TRAC targeting sequence
ugcgcaaugcuaaugaccca

SEQ ID NO: 14187 - RNA, 20 nt, Artificial Sequence
  TRAC targeting sequence
guuauaauucgaaagccaac

SEQ ID NO: 14188 - RNA, 20 nt, Artificial Sequence
  TRAC targeting sequence
aaagccaacuggacagucau

SEQ ID NO: 14189 - RNA, 20 nt, Artificial Sequence
  TRAC targeting sequence
aauuauaacagaauaaccug

SEQ ID NO: 14190 - RNA, 20 nt, Artificial Sequence
  TRAC targeting sequence
aguuggcuuucgaauuauaa

SEQ ID NO: 14191 - RNA, 20 nt, Artificial Sequence
  TRAC targeting sequence
ugaaugcacacagaucuggg

SEQ ID NO: 14192 - RNA, 20 nt, Artificial Sequence
  TRAC targeting sequence
ugacuguccaguuggcuuuc

SEQ ID NO: 14193 - RNA, 20 nt, Artificial Sequence
  TRAC targeting sequence
gugugcauucaugacugucc

SEQ ID NO: 14194 - RNA, 20 nt, Artificial Sequence
  TRAC targeting sequence
gggcccugcauugcacccug

SEQ ID NO: 14195 - RNA, 20 nt, Artificial Sequence
  TRAC targeting sequence
agcuuguucugaccguaauc

SEQ ID NO: 14196 - RNA, 20 nt, Artificial Sequence
  TRAC targeting sequence
gaccguaauccuggcccagu

SEQ ID NO: 14197 - RNA, 20 nt, Artificial Sequence
  TRAC targeting sequence
gaacaagcuggaggcaacua

SEQ ID NO: 14198 - RNA, 20 nt, Artificial Sequence
  TRAC targeting sequence
uggcccaguuuccuccucug

SEQ ID NO: 14199 - RNA, 20 nt, Artificial Sequence
  TRAC targeting sequence
uccucugaucccaggagaca

SEQ ID NO: 14200 - RNA, 20 nt, Artificial Sequence
  TRAC targeting sequence
ucugaucccaggagacaaaa

SEQ ID NO: 14201 - RNA, 20 nt, Artificial Sequence
  TRAC targeting sequence
gaucccaggagacaaaagcc

SEQ ID NO: 14202 - RNA, 20 nt, Artificial Sequence
  TRAC targeting sequence
gaggaggaaacugggccagg

SEQ ID NO: 14203 - RNA, 20 nt, Artificial Sequence
  TRAC targeting sequence
caggagacaaaagcccuggg

SEQ ID NO: 14204 - RNA, 20 nt, Artificial Sequence
  TRAC targeting sequence
ugggaucagaggaggaaacu

SEQ ID NO: 14205 - RNA, 20 nt, Artificial Sequence
  TRAC targeting sequence
ccugggaucagaggaggaaa

SEQ ID NO: 14206 - RNA, 20 nt, Artificial Sequence
  TRAC targeting sequence
gcccagggcuuuugucuccu

SEQ ID NO: 14207 - RNA, 20 nt, Artificial Sequence
  TRAC targeting sequence
cugcccagggcuuuugucuc

SEQ ID NO: 14208 - RNA, 20 nt, Artificial Sequence
  TRAC targeting sequence
gguucucugcccagggcuuu

SEQ ID NO: 14209 - RNA, 20 nt, Artificial Sequence
  TRAC targeting sequence
cccaggcuaaguagucuggu

SEQ ID NO: 14210 - RNA, 20 nt, Artificial Sequence
  TRAC targeting sequence
gagauccauaagccuuuuuu

SEQ ID NO: 14211 - RNA, 20 nt, Artificial Sequence
  TRAC targeting sequence
gacaagccuuuuugugcuuc

SEQ ID NO: 14212 - RNA, 20 nt, Artificial Sequence
  TRAC targeting sequence
cagacaagccuuuuugugcu

SEQ ID NO: 14213 - RNA, 20 nt, Artificial Sequence
  TRAC targeting sequence
auaagccuuuuuuuuuuuuc

SEQ ID NO: 14214 - RNA, 20 nt, Artificial Sequence
  TRAC targeting sequence
uuuucuuuuuuuuuuuuuuu

SEQ ID NO: 14215 - RNA, 20 nt, Artificial Sequence
  TRAC targeting sequence
uuuuuuuuuuuuuuuuuuuu

SEQ ID NO: 14216 - RNA, 20 nt, Artificial Sequence
  TRAC targeting sequence
aaaaaaaaaaaaaaaaaaaa

SEQ ID NO: 14217 - RNA, 20 nt, Artificial Sequence
  TRAC targeting sequence
caaaaaaaaaaaaaaaaaaa

SEQ ID NO: 14218 - RNA, 20 nt, Artificial Sequence
  TRAC targeting sequence
gucucaaaaaaaaaaaaaaa

SEQ ID NO: 14219 - RNA, 20 nt, Artificial Sequence
  TRAC targeting sequence
cgcucugucgcccaggcugg

SEQ ID NO: 14220 - RNA, 20 nt, Artificial Sequence
  TRAC targeting sequence
cucugucgcccaggcuggag

SEQ ID NO: 14221 - RNA, 20 nt, Artificial Sequence
  TRAC targeting sequence
gucgcccaggcuggagugca

SEQ ID NO: 14222 - RNA, 20 nt, Artificial Sequence
  TRAC targeting sequence
cccaggcuggagugcagugg

SEQ ID NO: 14223 - RNA, 20 nt, Artificial Sequence
  TRAC targeting sequence
agccugggcgacagagcgag

SEQ ID NO: 14224 - RNA, 20 nt, Artificial Sequence
  TRAC targeting sequence
caccacugcacuccagccug

SEQ ID NO: 14225 - RNA, 20 nt, Artificial Sequence
  TRAC targeting sequence
cggcucacugcaagcuccgc

SEQ ID NO: 14226 - RNA, 20 nt, Artificial Sequence
  TRAC targeting sequence
gcucacugcaagcuccgccu

SEQ ID NO: 14227 - RNA, 20 nt, Artificial Sequence
  TRAC targeting sequence
cugcaagcuccgccucccgg

SEQ ID NO: 14228 - RNA, 20 nt, Artificial Sequence
  TRAC targeting sequence
gccucccggguucacaccau

SEQ ID NO: 14229 - RNA, 20 nt, Artificial Sequence
  TRAC targeting sequence
cggguucacaccauucuccu

SEQ ID NO: 14230 - RNA, 20 nt, Artificial Sequence
  TRAC targeting sequence
caccauucuccugccucagc

SEQ ID NO: 14231 - RNA, 20 nt, Artificial Sequence
  TRAC targeting sequence
ccugccucagccucccuagu

SEQ ID NO: 14232 - RNA, 20 nt, Artificial Sequence
  TRAC targeting sequence
ugccucagccucccuaguag

SEQ ID NO: 14233 - RNA, 20 nt, Artificial Sequence
  TRAC targeting sequence
gccucccuaguagcugggac

SEQ ID NO: 14234 - RNA, 20 nt, Artificial Sequence
  TRAC targeting sequence
cuaguagcugggacuacagg

SEQ ID NO: 14235 - RNA, 20 nt, Artificial Sequence
  TRAC targeting sequence
cagcuacuagggaggcugag

SEQ ID NO: 14236 - RNA, 20 nt, Artificial Sequence
  TRAC targeting sequence
ccaccacguccggcuaauuu

SEQ ID NO: 14237 - RNA, 20 nt, Artificial Sequence
  TRAC targeting sequence
ggcuaauuuuuuguauuuuu

SEQ ID NO: 14238 - RNA, 20 nt, Artificial Sequence
  TRAC targeting sequence
acuaaaaaaaaauacaaaaa

SEQ ID NO: 14239 - RNA, 20 nt, Artificial Sequence
  TRAC targeting sequence
cuacuaaaaaaaaauacaaa

SEQ ID NO: 14240 - RNA, 20 nt, Artificial Sequence
  TRAC targeting sequence
ccgcguuggccaggaugauc

SEQ ID NO: 14241 - RNA, 20 nt, Artificial Sequence
  TRAC targeting sequence
uggccaacgcggugaaaccc

SEQ ID NO: 14242 - RNA, 20 nt, Artificial Sequence
  TRAC targeting sequence
uccuggccaacgcggugaaa

SEQ ID NO: 14243 - RNA, 20 nt, Artificial Sequence
  TRAC targeting sequence
cgaucucccgaccucgugau

SEQ ID NO: 14244 - RNA, 20 nt, Artificial Sequence
  TRAC targeting sequence
aucucccgaccucgugaucc

SEQ ID NO: 14245 - RNA, 20 nt, Artificial Sequence
  TRAC targeting sequence
agaucauccuggccaacgcg

SEQ ID NO: 14246 - RNA, 20 nt, Artificial Sequence
  TRAC targeting sequence
cccgaccucgugauccaccc

SEQ ID NO: 14247 - RNA, 20 nt, Artificial Sequence
  TRAC targeting sequence
cgaccucgugauccacccgc

SEQ ID NO: 14248 - RNA, 20 nt, Artificial Sequence
  TRAC targeting sequence
ggagaucgagaucauccugg

SEQ ID NO: 14249 - RNA, 20 nt, Artificial Sequence
  TRAC targeting sequence
ugauccacccgccucagccu

SEQ ID NO: 14250 - RNA, 20 nt, Artificial Sequence
  TRAC targeting sequence
cgaggucgggagaucgagau

SEQ ID NO: 14251 - RNA, 20 nt, Artificial Sequence
  TRAC targeting sequence
acccgccucagccucccaaa

SEQ ID NO: 14252 - RNA, 20 nt, Artificial Sequence
  TRAC targeting sequence
gccucccaaagugcugggau

SEQ ID NO: 14253 - RNA, 20 nt, Artificial Sequence
  TRAC targeting sequence
caaagugcugggauuacagg

SEQ ID NO: 14254 - RNA, 20 nt, Artificial Sequence
  TRAC targeting sequence
cagcacuuugggaggcugag

SEQ ID NO: 14255 - RNA, 20 nt, Artificial Sequence
  TRAC targeting sequence
cgccuguaaucccagcacuu

SEQ ID NO: 14256 - RNA, 20 nt, Artificial Sequence
  TRAC targeting sequence
auuuaauguuguuauucauu

SEQ ID NO: 14257 - RNA, 20 nt, Artificial Sequence
  TRAC targeting sequence
uuuugauuugcccaaguaau

SEQ ID NO: 14258 - RNA, 20 nt, Artificial Sequence
  TRAC targeting sequence
aaaugaauaacaacauuaaa

SEQ ID NO: 14259 - RNA, 20 nt, Artificial Sequence
  TRAC targeting sequence
cauuguaaaccauucaaauu

SEQ ID NO: 14260 - RNA, 20 nt, Artificial Sequence
  TRAC targeting sequence
uuguaaaccauucaaauuac

SEQ ID NO: 14261 - RNA, 20 nt, Artificial Sequence
  TRAC targeting sequence
aauuacagauaaaguccagg

SEQ ID NO: 14262 - RNA, 20 nt, Artificial Sequence
  TRAC targeting sequence
guaauuugaaugguuuacaa

SEQ ID NO: 14263 - RNA, 20 nt, Artificial Sequence
  TRAC targeting sequence
aggcacgguggcucacaccu

SEQ ID NO: 14264 - RNA, 20 nt, Artificial Sequence
  TRAC targeting sequence
caccuguaaucccagcacuu

SEQ ID NO: 14265 - RNA, 20 nt, Artificial Sequence
  TRAC targeting sequence
cagcacuuuagaaggcugag

SEQ ID NO: 14266 - RNA, 20 nt, Artificial Sequence
  TRAC targeting sequence
aaagugcugggauuacaggu

SEQ ID NO: 14267 - RNA, 20 nt, Artificial Sequence
  TRAC targeting sequence
gccuucuaaagugcugggau

SEQ ID NO: 14268 - RNA, 20 nt, Artificial Sequence
  TRAC targeting sequence
ccugaggucaggaguuugag

SEQ ID NO: 14269 - RNA, 20 nt, Artificial Sequence
  TRAC targeting sequence
ggugauuugcccaccucagc

SEQ ID NO: 14270 - RNA, 20 nt, Artificial Sequence
  TRAC targeting sequence
ggaguuugagaccagucugg

SEQ ID NO: 14271 - RNA, 20 nt, Artificial Sequence
  TRAC targeting sequence
ugaccucaggugauuugccc

SEQ ID NO: 14272 - RNA, 20 nt, Artificial Sequence
  TRAC targeting sequence
aacuccugaccucaggugau

SEQ ID NO: 14273 - RNA, 20 nt, Artificial Sequence
  TRAC targeting sequence
caaacuccugaccucaggug

SEQ ID NO: 14274 - RNA, 20 nt, Artificial Sequence
  TRAC targeting sequence
ggccaacaugaugaaauccc

SEQ ID NO: 14275 - RNA, 20 nt, Artificial Sequence
  TRAC targeting sequence
uguuggccagacuggucuca

SEQ ID NO: 14276 - RNA, 20 nt, Artificial Sequence
  TRAC targeting sequence
ucauguuggccagacugguc

SEQ ID NO: 14277 - RNA, 20 nt, Artificial Sequence
  TRAC targeting sequence
caucucuacuaaaaauacga

SEQ ID NO: 14278 - RNA, 20 nt, Artificial Sequence
  TRAC targeting sequence
cuacuaaaaauacgaaaagu

SEQ ID NO: 14279 - RNA, 20 nt, Artificial Sequence
  TRAC targeting sequence
acuaaaaauacgaaaaguag

SEQ ID NO: 14280 - RNA, 20 nt, Artificial Sequence
  TRAC targeting sequence
uauuuuuaguagagauggga

SEQ ID NO: 14281 - RNA, 20 nt, Artificial Sequence
  TRAC targeting sequence
aucgugguggcaggcaccua

SEQ ID NO: 14282 - RNA, 20 nt, Artificial Sequence
  TRAC targeting sequence
ugguggcaggcaccuauaau

SEQ ID NO: 14283 - RNA, 20 nt, Artificial Sequence
  TRAC targeting sequence
cagcuacucaggaggcugag

SEQ ID NO: 14284 - RNA, 20 nt, Artificial Sequence
  TRAC targeting sequence
ggaggcugaggcaggauaau

SEQ ID NO: 14285 - RNA, 20 nt, Artificial Sequence
  TRAC targeting sequence
ugaguagcugggauuauagg

SEQ ID NO: 14286 - RNA, 20 nt, Artificial Sequence
  TRAC targeting sequence
gccuccugaguagcugggau

SEQ ID NO: 14287 - RNA, 20 nt, Artificial Sequence
  TRAC targeting sequence
ugccucagccuccugaguag

SEQ ID NO: 14288 - RNA, 20 nt, Artificial Sequence
  TRAC targeting sequence
cuugaacccgggagguugag

SEQ ID NO: 14289 - RNA, 20 nt, Artificial Sequence
  TRAC targeting sequence
agugauuauccugccucagc

SEQ ID NO: 14290 - RNA, 20 nt, Artificial Sequence
  TRAC targeting sequence
cggguucaagugauuauccu

SEQ ID NO: 14291 - RNA, 20 nt, Artificial Sequence
  TRAC targeting sequence
accucccggguucaagugau

SEQ ID NO: 14292 - RNA, 20 nt, Artificial Sequence
  TRAC targeting sequence
uggcaaccucaaccucccgg

SEQ ID NO: 14293 - RNA, 20 nt, Artificial Sequence
  TRAC targeting sequence
gcucauggcaaccucaaccu

SEQ ID NO: 14294 - RNA, 20 nt, Artificial Sequence
  TRAC targeting sequence
cggcucauggcaaccucaac

SEQ ID NO: 14295 - RNA, 20 nt, Artificial Sequence
  TRAC targeting sequence
ugccacugcacuccagccug

SEQ ID NO: 14296 - RNA, 20 nt, Artificial Sequence
  TRAC targeting sequence
agccugggugacagagugag

SEQ ID NO: 14297 - RNA, 20 nt, Artificial Sequence
  TRAC targeting sequence
cccaggcuggagugcagugg

SEQ ID NO: 14298 - RNA, 20 nt, Artificial Sequence
  TRAC targeting sequence
gucacccaggcuggagugca

SEQ ID NO: 14299 - RNA, 20 nt, Artificial Sequence
  TRAC targeting sequence
cucugucacccaggcuggag

SEQ ID NO: 14300 - RNA, 20 nt, Artificial Sequence
  TRAC targeting sequence
cacucugucacccaggcugg

SEQ ID NO: 14301 - RNA, 20 nt, Artificial Sequence
  TRAC targeting sequence
aucucaaaaaaaaaaaaaaa

SEQ ID NO: 14302 - RNA, 20 nt, Artificial Sequence
  TRAC targeting sequence
caaaaaaaaaaaaaaaauua

SEQ ID NO: 14303 - RNA, 20 nt, Artificial Sequence
  TRAC targeting sequence
aaaaaaaaaaaaaaauuaca

SEQ ID NO: 14304 - RNA, 20 nt, Artificial Sequence
  TRAC targeting sequence
guaauuuuuuuuuuuuuuuu

SEQ ID NO: 14305 - RNA, 20 nt, Artificial Sequence
  TRAC targeting sequence
ccuuggccacuuccuucagu

SEQ ID NO: 14306 - RNA, 20 nt, Artificial Sequence
  TRAC targeting sequence
uucaguaucaguuuccuccu

SEQ ID NO: 14307 - RNA, 20 nt, Artificial Sequence
  TRAC targeting sequence
guaucaguuuccuccucccc

SEQ ID NO: 14308 - RNA, 20 nt, Artificial Sequence
  TRAC targeting sequence
guuuccuccuccccaaaagu

SEQ ID NO: 14309 - RNA, 20 nt, Artificial Sequence
  TRAC targeting sequence
uccuccccaaaagugaccac

SEQ ID NO: 14310 - RNA, 20 nt, Artificial Sequence
  TRAC targeting sequence
uccccaaaagugaccacuga

SEQ ID NO: 14311 - RNA, 20 nt, Artificial Sequence
  TRAC targeting sequence
ccaaaagugaccacugaaac

SEQ ID NO: 14312 - RNA, 20 nt, Artificial Sequence
  TRAC targeting sequence
cuuuuggggaggaggaaacu

SEQ ID NO: 14313 - RNA, 20 nt, Artificial Sequence
  TRAC targeting sequence
guggucacuuuuggggagga

SEQ ID NO: 14314 - RNA, 20 nt, Artificial Sequence
  TRAC targeting sequence
caacacaccaagcugguuuc

SEQ ID NO: 14315 - RNA, 20 nt, Artificial Sequence
  TRAC targeting sequence
ucacaacacaccaagcuggu

SEQ ID NO: 14316 - RNA, 20 nt, Artificial Sequence
  TRAC targeting sequence
cuguggaauauguuuaugug

SEQ ID NO: 14317 - RNA, 20 nt, Artificial Sequence
  TRAC targeting sequence
guggaauauguuuaugugaa

SEQ ID NO: 14318 - RNA, 20 nt, Artificial Sequence
  TRAC targeting sequence
acagagaaacucaucacaac

SEQ ID NO: 14319 - RNA, 20 nt, Artificial Sequence
  TRAC targeting sequence
cauaaacauauuccacagag

SEQ ID NO: 14320 - RNA, 20 nt, Artificial Sequence
  TRAC targeting sequence
caucuucaaccaggaaagcu

SEQ ID NO: 14321 - RNA, 20 nt, Artificial Sequence
  TRAC targeting sequence
ucaaccaggaaagcuugaga

SEQ ID NO: 14322 - RNA, 20 nt, Artificial Sequence
  TRAC targeting sequence
accaggaaagcuugagaggg

SEQ ID NO: 14323 - RNA, 20 nt, Artificial Sequence
  TRAC targeting sequence
ugguugaagaugggauuuca

SEQ ID NO: 14324 - RNA, 20 nt, Artificial Sequence
  TRAC targeting sequence
agcuuuccugguugaagaug

SEQ ID NO: 14325 - RNA, 20 nt, Artificial Sequence
  TRAC targeting sequence
caagcuuuccugguugaaga

SEQ ID NO: 14326 - RNA, 20 nt, Artificial Sequence
  TRAC targeting sequence
cucucaagcuuuccugguug

SEQ ID NO: 14327 - RNA, 20 nt, Artificial Sequence
  TRAC targeting sequence
gacugcaguuugcaggauuu

SEQ ID NO: 14328 - RNA, 20 nt, Artificial Sequence
  TRAC targeting sequence
gagcccuuucccucucaagc

SEQ ID NO: 14329 - RNA, 20 nt, Artificial Sequence
  TRAC targeting sequence
ugcaaacugcagucugagcc

SEQ ID NO: 14330 - RNA, 20 nt, Artificial Sequence
  TRAC targeting sequence
auuagauauaaggaacaguu

SEQ ID NO: 14331 - RNA, 20 nt, Artificial Sequence
  TRAC targeting sequence
aauugaaauccugcaaacug

SEQ ID NO: 14332 - RNA, 20 nt, Artificial Sequence
  TRAC targeting sequence
uuauaucuaauugaaauccu

SEQ ID NO: 14333 - RNA, 20 nt, Artificial Sequence
  TRAC targeting sequence
acuguuccuuauaucuaauu

SEQ ID NO: 14334 - RNA, 20 nt, Artificial Sequence
  TRAC targeting sequence
aaucaacuguuccuuauauc

SEQ ID NO: 14335 - RNA, 20 nt, Artificial Sequence
  TRAC targeting sequence
uacaucuaaucaacuguucc

SEQ ID NO: 14336 - RNA, 20 nt, Artificial Sequence
  TRAC targeting sequence
uuugcuaacagcucuuacau

SEQ ID NO: 14337 - RNA, 20 nt, Artificial Sequence
  TRAC targeting sequence
uaguuuuuauaagguuuucc

SEQ ID NO: 14338 - RNA, 20 nt, Artificial Sequence
  TRAC targeting sequence
uaauaacuagacaggucuuu

SEQ ID NO: 14339 - RNA, 20 nt, Artificial Sequence
  TRAC targeting sequence
aguuauuaagagcuccuagu

SEQ ID NO: 14340 - RNA, 20 nt, Artificial Sequence
  TRAC targeting sequence
uuggucagacaacacacuga

SEQ ID NO: 14341 - RNA, 20 nt, Artificial Sequence
  TRAC targeting sequence
gacaacacacugacugagga

SEQ ID NO: 14342 - RNA, 20 nt, Artificial Sequence
  TRAC targeting sequence
gaccaaagaccugucuaguu

SEQ ID NO: 14343 - RNA, 20 nt, Artificial Sequence
  TRAC targeting sequence
guguguugucugaccaaaga

SEQ ID NO: 14344 - RNA, 20 nt, Artificial Sequence
  TRAC targeting sequence
gucaguguguugucugacca

SEQ ID NO: 14345 - RNA, 20 nt, Artificial Sequence
  TRAC targeting sequence
ucagucaguguguugucuga

SEQ ID NO: 14346 - RNA, 20 nt, Artificial Sequence
  TRAC targeting sequence
uguccucagucaguguguug

SEQ ID NO: 14347 - RNA, 20 nt, Artificial Sequence
  TRAC targeting sequence
uccuguccucagucagugug

SEQ ID NO: 14348 - RNA, 20 nt, Artificial Sequence
  TRAC targeting sequence
auccuccuguccucagucag

SEQ ID NO: 14349 - RNA, 20 nt, Artificial Sequence
  TRAC targeting sequence
augaccucugaaaguccagc

SEQ ID NO: 14350 - RNA, 20 nt, Artificial Sequence
  TRAC targeting sequence
aauccauccuccuguccuca

SEQ ID NO: 14351 - RNA, 20 nt, Artificial Sequence
  TRAC targeting sequence
ucgaauccauccuccugucc

SEQ ID NO: 14352 - RNA, 20 nt, Artificial Sequence
  TRAC targeting sequence
gaaaguccagccaggacucu

SEQ ID NO: 14353 - RNA, 20 nt, Artificial Sequence
  TRAC targeting sequence
gaggucaucgaauccauccu

SEQ ID NO: 14354 - RNA, 20 nt, Artificial Sequence
  TRAC targeting sequence
agccaggacucuggaggacu

SEQ ID NO: 14355 - RNA, 20 nt, Artificial Sequence
  TRAC targeting sequence
uggcuggacuuucagagguc

SEQ ID NO: 14356 - RNA, 20 nt, Artificial Sequence
  TRAC targeting sequence
ggaggacucugaggaauggu

SEQ ID NO: 14357 - RNA, 20 nt, Artificial Sequence
  TRAC targeting sequence
agaguccuggcuggacuuuc

SEQ ID NO: 14358 - RNA, 20 nt, Artificial Sequence
  TRAC targeting sequence
uccagaguccuggcuggacu

SEQ ID NO: 14359 - RNA, 20 nt, Artificial Sequence
  TRAC targeting sequence
gaggaauggucuguuccaua

SEQ ID NO: 14360 - RNA, 20 nt, Artificial Sequence
  TRAC targeting sequence
gaguccuccagaguccuggc

SEQ ID NO: 14361 - RNA, 20 nt, Artificial Sequence
  TRAC targeting sequence
ucagaguccuccagaguccu

SEQ ID NO: 14362 - RNA, 20 nt, Artificial Sequence
  TRAC targeting sequence
guuccauagccugccucugu

SEQ ID NO: 14363 - RNA, 20 nt, Artificial Sequence
  TRAC targeting sequence
auagccugccucuguaaugc

SEQ ID NO: 14364 - RNA, 20 nt, Artificial Sequence
  TRAC targeting sequence
guaaugcccuucucucuugc

SEQ ID NO: 14365 - RNA, 20 nt, Artificial Sequence
  TRAC targeting sequence
cucuugccuauugucugguu

SEQ ID NO: 14366 - RNA, 20 nt, Artificial Sequence
  TRAC targeting sequence
cuugccuauugucugguugu

SEQ ID NO: 14367 - RNA, 20 nt, Artificial Sequence
  TRAC targeting sequence
ugccuauugucugguuguug

SEQ ID NO: 14368 - RNA, 20 nt, Artificial Sequence
  TRAC targeting sequence
gguuguuguuacagucugag

SEQ ID NO: 14369 - RNA, 20 nt, Artificial Sequence
  TRAC targeting sequence
gagcuuuugucagagcugcu

SEQ ID NO: 14370 - RNA, 20 nt, Artificial Sequence
  TRAC targeting sequence
gacuguaacaacaaccagac

SEQ ID NO: 14371 - RNA, 20 nt, Artificial Sequence
  TRAC targeting sequence
gagcugcuccuaugcuguga

SEQ ID NO: 14372 - RNA, 20 nt, Artificial Sequence
  TRAC targeting sequence
gacaaaagcucagacuguaa

SEQ ID NO: 14373 - RNA, 20 nt, Artificial Sequence
  TRAC targeting sequence
uaugcugugaguggucugau

SEQ ID NO: 14374 - RNA, 20 nt, Artificial Sequence
  TRAC targeting sequence
cagcauaggagcagcucuga

SEQ ID NO: 14375 - RNA, 20 nt, Artificial Sequence
  TRAC targeting sequence
gauuuucucagcaucucugg

SEQ ID NO: 14376 - RNA, 20 nt, Artificial Sequence
  TRAC targeting sequence
gaccacucacagcauaggag

SEQ ID NO: 14377 - RNA, 20 nt, Artificial Sequence
  TRAC targeting sequence
cagcaucucugggguuuuug

SEQ ID NO: 14378 - RNA, 20 nt, Artificial Sequence
  TRAC targeting sequence
gcaucucugggguuuuugca

SEQ ID NO: 14379 - RNA, 20 nt, Artificial Sequence
  TRAC targeting sequence
cugggguuuuugcaaagcaa

SEQ ID NO: 14380 - RNA, 20 nt, Artificial Sequence
  TRAC targeting sequence
gggguuuuugcaaagcaagg

SEQ ID NO: 14381 - RNA, 20 nt, Artificial Sequence
  TRAC targeting sequence
uugcuuugcaaaaaccccag

SEQ ID NO: 14382 - RNA, 20 nt, Artificial Sequence
  TRAC targeting sequence
gugcauacucuggggcuggg

SEQ ID NO: 14383 - RNA, 20 nt, Artificial Sequence
  TRAC targeting sequence
ggggcugggaguuaccaacu

SEQ ID NO: 14384 - RNA, 20 nt, Artificial Sequence
  TRAC targeting sequence
cagccccagaguaugcacag

SEQ ID NO: 14385 - RNA, 20 nt, Artificial Sequence
  TRAC targeting sequence
cuuucgggaaggggaccaaa

SEQ ID NO: 14386 - RNA, 20 nt, Artificial Sequence
  TRAC targeting sequence
ggaaggggaccaaacucucg

SEQ ID NO: 14387 - RNA, 20 nt, Artificial Sequence
  TRAC targeting sequence
cgaaagugaguugguaacuc

SEQ ID NO: 14388 - RNA, 20 nt, Artificial Sequence
  TRAC targeting sequence
ccuucccgaaagugaguugg

SEQ ID NO: 14389 - RNA, 20 nt, Artificial Sequence
  TRAC targeting sequence
cggucauaccaaguaaguuc

SEQ ID NO: 14390 - RNA, 20 nt, Artificial Sequence
  TRAC targeting sequence
gucauaccaaguaaguucuu

SEQ ID NO: 14391 - RNA, 20 nt, Artificial Sequence
  TRAC targeting sequence
uaccaaguaaguucuucuuu

SEQ ID NO: 14392 - RNA, 20 nt, Artificial Sequence
  TRAC targeting sequence
ucuuucuggcuaauuauucu

SEQ ID NO: 14393 - RNA, 20 nt, Artificial Sequence
  TRAC targeting sequence
uucuggcuaauuauucuucc

SEQ ID NO: 14394 - RNA, 20 nt, Artificial Sequence
  TRAC targeting sequence
ggcuaauuauucuucccgag

SEQ ID NO: 14395 - RNA, 20 nt, Artificial Sequence
  TRAC targeting sequence
ucccgagaagccugucuucc

SEQ ID NO: 14396 - RNA, 20 nt, Artificial Sequence
  TRAC targeting sequence
cgagaagccugucuuccauc

SEQ ID NO: 14397 - RNA, 20 nt, Artificial Sequence
  TRAC targeting sequence
ggaagaauaauuagccagaa

SEQ ID NO: 14398 - RNA, 20 nt, Artificial Sequence
  TRAC targeting sequence
cgggaagaauaauuagccag

SEQ ID NO: 14399 - RNA, 20 nt, Artificial Sequence
  TRAC targeting sequence
uccaucaugcagaagcuguc

SEQ ID NO: 14400 - RNA, 20 nt, Artificial Sequence
  TRAC targeting sequence
aucaugcagaagcugucaaa

SEQ ID NO: 14401 - RNA, 20 nt, Artificial Sequence
  TRAC targeting sequence
ugcagaagcugucaaaacac

SEQ ID NO: 14402 - RNA, 20 nt, Artificial Sequence
  TRAC targeting sequence
gcaugauggaagacaggcuu

SEQ ID NO: 14403 - RNA, 20 nt, Artificial Sequence
  TRAC targeting sequence
aaacacaggugguguuuucu

SEQ ID NO: 14404 - RNA, 20 nt, Artificial Sequence
  TRAC targeting sequence
uugcuugguuuguguugggu

SEQ ID NO: 14405 - RNA, 20 nt, Artificial Sequence
  TRAC targeting sequence
guuggaaaacaagguuauua

SEQ ID NO: 14406 - RNA, 20 nt, Artificial Sequence
  TRAC targeting sequence
aacugauauuacuaaccacc

SEQ ID NO: 14407 - RNA, 20 nt, Artificial Sequence
  TRAC targeting sequence
cuggggcauuguauucggac

SEQ ID NO: 14408 - RNA, 20 nt, Artificial Sequence
  TRAC targeting sequence
gacauuuaauauccauguag

SEQ ID NO: 14409 - RNA, 20 nt, Artificial Sequence
  TRAC targeting sequence
gaauacaaugccccagggaa

SEQ ID NO: 14410 - RNA, 20 nt, Artificial Sequence
  TRAC targeting sequence
auguagucucucccugugaa

SEQ ID NO: 14411 - RNA, 20 nt, Artificial Sequence
  TRAC targeting sequence
cucccugugaaaauauguga

SEQ ID NO: 14412 - RNA, 20 nt, Artificial Sequence
  TRAC targeting sequence
cccugugaaaauaugugaac

SEQ ID NO: 14413 - RNA, 20 nt, Artificial Sequence
  TRAC targeting sequence
cugugaaaauaugugaaccu

SEQ ID NO: 14414 - RNA, 20 nt, Artificial Sequence
  TRAC targeting sequence
cagggagagacuacauggau

SEQ ID NO: 14415 - RNA, 20 nt, Artificial Sequence
  TRAC targeting sequence
cauauuuucacagggagaga

SEQ ID NO: 14416 - RNA, 20 nt, Artificial Sequence
  TRAC targeting sequence
acgaaaagaaagguccaagg

SEQ ID NO: 14417 - RNA, 20 nt, Artificial Sequence
  TRAC targeting sequence
uggagguucacauauuuuca

SEQ ID NO: 14418 - RNA, 20 nt, Artificial Sequence
  TRAC targeting sequence
uuucguggagguucacauau

SEQ ID NO: 14419 - RNA, 20 nt, Artificial Sequence
  TRAC targeting sequence
aaggaaaguagcagggaaaa

SEQ ID NO: 14420 - RNA, 20 nt, Artificial Sequence
  TRAC targeting sequence
uuggaccuuucuuuucgugg

SEQ ID NO: 14421 - RNA, 20 nt, Artificial Sequence
  TRAC targeting sequence
cugcuacuuuccuuggaccu

SEQ ID NO: 14422 - RNA, 20 nt, Artificial Sequence
  TRAC targeting sequence
ugccuuuucccugcuacuuu

SEQ ID NO: 14423 - RNA, 20 nt, Artificial Sequence
  TRAC targeting sequence
aauuccugccuuuucccugc

SEQ ID NO: 14424 - RNA, 20 nt, Artificial Sequence
  TRAC targeting sequence
uccaauuccugccuuuuccc

SEQ ID NO: 14425 - RNA, 20 nt, Artificial Sequence
  TRAC targeting sequence
uuggcuauuuucauccaauu

SEQ ID NO: 14426 - RNA, 20 nt, Artificial Sequence
  TRAC targeting sequence
ugcaggcucuuuggcuauuu

SEQ ID NO: 14427 - RNA, 20 nt, Artificial Sequence
  TRAC targeting sequence
ugccuuguuuauauuccugc

SEQ ID NO: 14428 - RNA, 20 nt, Artificial Sequence
  TRAC targeting sequence
caggagacagagcaguagcc

SEQ ID NO: 14429 - RNA, 20 nt, Artificial Sequence
  TRAC targeting sequence
ugggauccugccuuguuuau

SEQ ID NO: 14430 - RNA, 20 nt, Artificial Sequence
  TRAC targeting sequence
ccugggauccugccuuguuu

SEQ ID NO: 14431 - RNA, 20 nt, Artificial Sequence
  TRAC targeting sequence
gucuccugggauccugccuu

SEQ ID NO: 14432 - RNA, 20 nt, Artificial Sequence
  TRAC targeting sequence
aaguggcuacugcucugucu

SEQ ID NO: 14433 - RNA, 20 nt, Artificial Sequence
  TRAC targeting sequence
cucaaaguggcuacugcucu

SEQ ID NO: 14434 - RNA, 20 nt, Artificial Sequence
  TRAC targeting sequence
caggaggugcuccugccaag

SEQ ID NO: 14435 - RNA, 20 nt, Artificial Sequence
  TRAC targeting sequence
ugggaaauucacucaaagug

SEQ ID NO: 14436 - RNA, 20 nt, Artificial Sequence
  TRAC targeting sequence
ugccaaggcccauaccuuca

SEQ ID NO: 14437 - RNA, 20 nt, Artificial Sequence
  TRAC targeting sequence
aggaaaauuaaggcaaauag

SEQ ID NO: 14438 - RNA, 20 nt, Artificial Sequence
  TRAC targeting sequence
uugaagguaugggccuuggc

SEQ ID NO: 14439 - RNA, 20 nt, Artificial Sequence
  TRAC targeting sequence
auuugccuuaauuuuccuug

SEQ ID NO: 14440 - RNA, 20 nt, Artificial Sequence
  TRAC targeting sequence
ccagcccaauucuauuugcc

SEQ ID NO: 14441 - RNA, 20 nt, Artificial Sequence
  TRAC targeting sequence
ucccacguucuaaccuaauu

SEQ ID NO: 14442 - RNA, 20 nt, Artificial Sequence
  TRAC targeting sequence
cacguucuaaccuaauuaua

SEQ ID NO: 14443 - RNA, 20 nt, Artificial Sequence
  TRAC targeting sequence
aaccuaauuauaaggagguu

SEQ ID NO: 14444 - RNA, 20 nt, Artificial Sequence
  TRAC targeting sequence
uuauaauuagguuagaacgu

SEQ ID NO: 14445 - RNA, 20 nt, Artificial Sequence
  TRAC targeting sequence
ucucagguuuuguuuuccug

SEQ ID NO: 14446 - RNA, 20 nt, Artificial Sequence
  TRAC targeting sequence
cagguuuuguuuuccugcuu

SEQ ID NO: 14447 - RNA, 20 nt, Artificial Sequence
  TRAC targeting sequence
gguuuuguuuuccugcuuuc

SEQ ID NO: 14448 - RNA, 20 nt, Artificial Sequence
  TRAC targeting sequence
ugcuuuccucccuaaccucc

SEQ ID NO: 14449 - RNA, 20 nt, Artificial Sequence
  TRAC targeting sequence
ucccuaaccuccaccugucu

SEQ ID NO: 14450 - RNA, 20 nt, Artificial Sequence
  TRAC targeting sequence
cuaaccuccaccugucuucc

SEQ ID NO: 14451 - RNA, 20 nt, Artificial Sequence
  TRAC targeting sequence
accugucuuccuagaggccu

SEQ ID NO: 14452 - RNA, 20 nt, Artificial Sequence
  TRAC targeting sequence
uccuagaggccugagucaag

SEQ ID NO: 14453 - RNA, 20 nt, Artificial Sequence
  TRAC targeting sequence
uagaggccugagucaagguu

SEQ ID NO: 14454 - RNA, 20 nt, Artificial Sequence
  TRAC targeting sequence
aggaagacagguggagguua

SEQ ID NO: 14455 - RNA, 20 nt, Artificial Sequence
  TRAC targeting sequence
ggccucuaggaagacaggug

SEQ ID NO: 14456 - RNA, 20 nt, Artificial Sequence
  TRAC targeting sequence
agguuauugcaauagcacua

SEQ ID NO: 14457 - RNA, 20 nt, Artificial Sequence
  TRAC targeting sequence
uuagugcuauugcaauaacc

SEQ ID NO: 14458 - RNA, 20 nt, Artificial Sequence
  TRAC targeting sequence
accuuuggggaugggacuac

SEQ ID NO: 14459 - RNA, 20 nt, Artificial Sequence
  TRAC targeting sequence
ccaaagguugauuugccugc

SEQ ID NO: 14460 - RNA, 20 nt, Artificial Sequence
  TRAC targeting sequence
cauccccaaagguugauuug

SEQ ID NO: 14461 - RNA, 20 nt, Artificial Sequence
  TRAC targeting sequence
cugugaagccaaguaaguug

SEQ ID NO: 14462 - RNA, 20 nt, Artificial Sequence
  TRAC targeting sequence
cagugagcguagucccaucc

SEQ ID NO: 14463 - RNA, 20 nt, Artificial Sequence
  TRAC targeting sequence
ucuuugccuaggccuucagg

SEQ ID NO: 14464 - RNA, 20 nt, Artificial Sequence
  TRAC targeting sequence
uugccuaggccuucaggggc

SEQ ID NO: 14465 - RNA, 20 nt, Artificial Sequence
  TRAC targeting sequence
ggggcaaucaaucaaaccau

SEQ ID NO: 14466 - RNA, 20 nt, Artificial Sequence
  TRAC targeting sequence
aucaaaccauuaguuugaaa

SEQ ID NO: 14467 - RNA, 20 nt, Artificial Sequence
  TRAC targeting sequence
aaccauuaguuugaaaaaga

SEQ ID NO: 14468 - RNA, 20 nt, Artificial Sequence
  TRAC targeting sequence
aacuaaugguuugauugauu

SEQ ID NO: 14469 - RNA, 20 nt, Artificial Sequence
  TRAC targeting sequence
uuuucaaacuaaugguuuga

SEQ ID NO: 14470 - RNA, 20 nt, Artificial Sequence
  TRAC targeting sequence
uaugcaucugguugggcucu

SEQ ID NO: 14471 - RNA, 20 nt, Artificial Sequence
  TRAC targeting sequence
gguugggcucuuuauuaaug

SEQ ID NO: 14472 - RNA, 20 nt, Artificial Sequence
  TRAC targeting sequence
uuauuaauguucuuucccca

SEQ ID NO: 14473 - RNA, 20 nt, Artificial Sequence
  TRAC targeting sequence
uuccccaggccaaagagagu

SEQ ID NO: 14474 - RNA, 20 nt, Artificial Sequence
  TRAC targeting sequence
ccaggccaaagagaguuggu

SEQ ID NO: 14475 - RNA, 20 nt, Artificial Sequence
  TRAC targeting sequence
uuggccuggggaaagaacau

SEQ ID NO: 14476 - RNA, 20 nt, Artificial Sequence
  TRAC targeting sequence
cuuuggccuggggaaagaac

SEQ ID NO: 14477 - RNA, 20 nt, Artificial Sequence
  TRAC targeting sequence
cuucccugcuuuaaaaugag

SEQ ID NO: 14478 - RNA, 20 nt, Artificial Sequence
  TRAC targeting sequence
ucccugcuuuaaaaugagau

SEQ ID NO: 14479 - RNA, 20 nt, Artificial Sequence
  TRAC targeting sequence
cugcuuuaaaaugagauaug

SEQ ID NO: 14480 - RNA, 20 nt, Artificial Sequence
  TRAC targeting sequence
uuuuaaagcagggaagagaa

SEQ ID NO: 14481 - RNA, 20 nt, Artificial Sequence
  TRAC targeting sequence
cauuuuaaagcagggaagag

SEQ ID NO: 14482 - RNA, 20 nt, Artificial Sequence
  TRAC targeting sequence
uaucucauuuuaaagcaggg

SEQ ID NO: 14483 - RNA, 20 nt, Artificial Sequence
  TRAC targeting sequence
gcaugugggcaugcgugugu

SEQ ID NO: 14484 - RNA, 20 nt, Artificial Sequence
  TRAC targeting sequence
ugcucuagcucaugguaagg

SEQ ID NO: 14485 - RNA, 20 nt, Artificial Sequence
  TRAC targeting sequence
agcucaugguaagggcuucu

SEQ ID NO: 14486 - RNA, 20 nt, Artificial Sequence
  TRAC targeting sequence
ugguaagggcuucucaggag

SEQ ID NO: 14487 - RNA, 20 nt, Artificial Sequence
  TRAC targeting sequence
caggagcauauacaacauuu

SEQ ID NO: 14488 - RNA, 20 nt, Artificial Sequence
  TRAC targeting sequence
ggagcauauacaacauuuug

SEQ ID NO: 14489 - RNA, 20 nt, Artificial Sequence
  TRAC targeting sequence
ugagaagcccuuaccaugag

SEQ ID NO: 14490 - RNA, 20 nt, Artificial Sequence
  TRAC targeting sequence
aaauguuguauaugcuccug

SEQ ID NO: 14491 - RNA, 20 nt, Artificial Sequence
  TRAC targeting sequence
uucaaaauguuguauaugcu

SEQ ID NO: 14492 - RNA, 20 nt, Artificial Sequence
  TRAC targeting sequence
auuucuuucaaaauguugua

SEQ ID NO: 14493 - RNA, 20 nt, Artificial Sequence
  TRAC targeting sequence
cuauuucuuucaaaauguug

SEQ ID NO: 14494 - RNA, 20 nt, Artificial Sequence
  TRAC targeting sequence
uuauuguuuguuucucuauu

SEQ ID NO: 14495 - RNA, 20 nt, Artificial Sequence
  TRAC targeting sequence
auuggcucauuauuguuugu

SEQ ID NO: 14496 - RNA, 20 nt, Artificial Sequence
  TRAC targeting sequence
ggaagguucuccaccacccc

SEQ ID NO: 14497 - RNA, 20 nt, Artificial Sequence
  TRAC targeting sequence
ugacagcuccauuggcucau

SEQ ID NO: 14498 - RNA, 20 nt, Artificial Sequence
  TRAC targeting sequence
ccaccaccccugaccaggcu

SEQ ID NO: 14499 - RNA, 20 nt, Artificial Sequence
  TRAC targeting sequence
accaccccugaccaggcuuc

SEQ ID NO: 14500 - RNA, 20 nt, Artificial Sequence
  TRAC targeting sequence
ggggugguggagaaccuucc

SEQ ID NO: 14501 - RNA, 20 nt, Artificial Sequence
  TRAC targeting sequence
cagcaggaucucuggccaua

SEQ ID NO: 14502 - RNA, 20 nt, Artificial Sequence
  TRAC targeting sequence
ugcugggaagccuggucagg

SEQ ID NO: 14503 - RNA, 20 nt, Artificial Sequence
  TRAC targeting sequence
cuggccauauaggaugugcu

SEQ ID NO: 14504 - RNA, 20 nt, Artificial Sequence
  TRAC targeting sequence
ggccauauaggaugugcuug

SEQ ID NO: 14505 - RNA, 20 nt, Artificial Sequence
  TRAC targeting sequence
uauauggccagagauccugc

SEQ ID NO: 14506 - RNA, 20 nt, Artificial Sequence
  TRAC targeting sequence
gauggucuaggaugggaaau

SEQ ID NO: 14507 - RNA, 20 nt, Artificial Sequence
  TRAC targeting sequence
gauauagugcaagcacaucc

SEQ ID NO: 14508 - RNA, 20 nt, Artificial Sequence
  TRAC targeting sequence
aggaugggaaauaucucucu

SEQ ID NO: 14509 - RNA, 20 nt, Artificial Sequence
  TRAC targeting sequence
uagaccauccgauauagugc

SEQ ID NO: 14510 - RNA, 20 nt, Artificial Sequence
  TRAC targeting sequence
cauccuagaccauccgauau

SEQ ID NO: 14511 - RNA, 20 nt, Artificial Sequence
  TRAC targeting sequence
cucuguaauuaauuccaaaa

SEQ ID NO: 14512 - RNA, 20 nt, Artificial Sequence
  TRAC targeting sequence
cuguaauuaauuccaaaauu

SEQ ID NO: 14513 - RNA, 20 nt, Artificial Sequence
  TRAC targeting sequence
guaauuaauuccaaaauuug

SEQ ID NO: 14514 - RNA, 20 nt, Artificial Sequence
  TRAC targeting sequence
aaaauuuggcaacccuuauu

SEQ ID NO: 14515 - RNA, 20 nt, Artificial Sequence
  TRAC targeting sequence
ggcaauaaggguugccaaau

SEQ ID NO: 14516 - RNA, 20 nt, Artificial Sequence
  TRAC targeting sequence
cauaucuaaguuugaucucc

SEQ ID NO: 14517 - RNA, 20 nt, Artificial Sequence
  TRAC targeting sequence
uaucuaaguuugaucucccu

SEQ ID NO: 14518 - RNA, 20 nt, Artificial Sequence
  TRAC targeting sequence
aaguuugaucucccugcugc

SEQ ID NO: 14519 - RNA, 20 nt, Artificial Sequence
  TRAC targeting sequence
aacuuagauaugagaaguac

SEQ ID NO: 14520 - RNA, 20 nt, Artificial Sequence
  TRAC targeting sequence
cccugcugcgauuuaaauau

SEQ ID NO: 14521 - RNA, 20 nt, Artificial Sequence
  TRAC targeting sequence
cugcugcgauuuaaauaucu

SEQ ID NO: 14522 - RNA, 20 nt, Artificial Sequence
  TRAC targeting sequence
cagcagggagaucaaacuua

SEQ ID NO: 14523 - RNA, 20 nt, Artificial Sequence
  TRAC targeting sequence
acuugaaaagaaccacuaga

SEQ ID NO: 14524 - RNA, 20 nt, Artificial Sequence
  TRAC targeting sequence
aguagauauuuaaaucgcag

SEQ ID NO: 14525 - RNA, 20 nt, Artificial Sequence
  TRAC targeting sequence
uuucaaguagauauuuaaau

SEQ ID NO: 14526 - RNA, 20 nt, Artificial Sequence
  TRAC targeting sequence
agugguucuuuucaaguaga

SEQ ID NO: 14527 - RNA, 20 nt, Artificial Sequence
  TRAC targeting sequence
guacaucuggauugagaauc

SEQ ID NO: 14528 - RNA, 20 nt, Artificial Sequence
  TRAC targeting sequence
ggauugagaaucaaguaacu

SEQ ID NO: 14529 - RNA, 20 nt, Artificial Sequence
  TRAC targeting sequence
agauguacagaguucuagug

SEQ ID NO: 14530 - RNA, 20 nt, Artificial Sequence
  TRAC targeting sequence
auccagauguacagaguucu

SEQ ID NO: 14531 - RNA, 20 nt, Artificial Sequence
  TRAC targeting sequence
caauccagauguacagaguu

SEQ ID NO: 14532 - RNA, 20 nt, Artificial Sequence
  TRAC targeting sequence
aguaacugccauagaauaug

SEQ ID NO: 14533 - RNA, 20 nt, Artificial Sequence
  TRAC targeting sequence
auggcaguuacuugauucuc

SEQ ID NO: 14534 - RNA, 20 nt, Artificial Sequence
  TRAC targeting sequence
uauucuauggcaguuacuug

SEQ ID NO: 14535 - RNA, 20 nt, Artificial Sequence
  TRAC targeting sequence
gccucauauucuauggcagu

SEQ ID NO: 14536 - RNA, 20 nt, Artificial Sequence
  TRAC targeting sequence
gcagcaccucugacguguca

SEQ ID NO: 14537 - RNA, 20 nt, Artificial Sequence
  TRAC targeting sequence
gacgugucauggguccccuc

SEQ ID NO: 14538 - RNA, 20 nt, Artificial Sequence
  TRAC targeting sequence
gaggugcugcagaggugggc

SEQ ID NO: 14539 - RNA, 20 nt, Artificial Sequence
  TRAC targeting sequence
uggguccccucuggacauuu

SEQ ID NO: 14540 - RNA, 20 nt, Artificial Sequence
  TRAC targeting sequence
ccucuggacauuuugagcuc

SEQ ID NO: 14541 - RNA, 20 nt, Artificial Sequence
  TRAC targeting sequence
ggacauuuugagcucaagua

SEQ ID NO: 14542 - RNA, 20 nt, Artificial Sequence
  TRAC targeting sequence
agaggggacccaugacacgu

SEQ ID NO: 14543 - RNA, 20 nt, Artificial Sequence
  TRAC targeting sequence
aaauguccagaggggaccca

SEQ ID NO: 14544 - RNA, 20 nt, Artificial Sequence
  TRAC targeting sequence
aguaauaauggauuaagcag

SEQ ID NO: 14545 - RNA, 20 nt, Artificial Sequence
  TRAC targeting sequence
auuauuacuugagcucaaaa

SEQ ID NO: 14546 - RNA, 20 nt, Artificial Sequence
  TRAC targeting sequence
ugcuuaauccauuauuacuu

SEQ ID NO: 14547 - RNA, 20 nt, Artificial Sequence
  TRAC targeting sequence
aaagcuugugcuauccugcu

SEQ ID NO: 14548 - RNA, 20 nt, Artificial Sequence
  TRAC targeting sequence
guuuccaaagcuugugcuau

SEQ ID NO: 14549 - RNA, 20 nt, Artificial Sequence
  TRAC targeting sequence
gguuuuucuguuuccaaagc

SEQ ID NO: 14550 - RNA, 20 nt, Artificial Sequence
  TRAC targeting sequence
aguccuugcuccacuacuua

SEQ ID NO: 14551 - RNA, 20 nt, Artificial Sequence
  TRAC targeting sequence
uugcuccacuacuuaccuag

SEQ ID NO: 14552 - RNA, 20 nt, Artificial Sequence
  TRAC targeting sequence
acuacuuaccuagcugugug

SEQ ID NO: 14553 - RNA, 20 nt, Artificial Sequence
  TRAC targeting sequence
cacagcuagguaaguagugg

SEQ ID NO: 14554 - RNA, 20 nt, Artificial Sequence
  TRAC targeting sequence
aggucacacagcuagguaag

SEQ ID NO: 14555 - RNA, 20 nt, Artificial Sequence
  TRAC targeting sequence
cucugagccucaguuucccc

SEQ ID NO: 14556 - RNA, 20 nt, Artificial Sequence
  TRAC targeting sequence
cugagccucaguuuccccau

SEQ ID NO: 14557 - RNA, 20 nt, Artificial Sequence
  TRAC targeting sequence
gagccucaguuuccccaucc

SEQ ID NO: 14558 - RNA, 20 nt, Artificial Sequence
  TRAC targeting sequence
gagagauuaaguaacuuguu

SEQ ID NO: 14559 - RNA, 20 nt, Artificial Sequence
  TRAC targeting sequence
guuuccccauccacaaaaug

SEQ ID NO: 14560 - RNA, 20 nt, Artificial Sequence
  TRAC targeting sequence
ccauccacaaaaugaagaua

SEQ ID NO: 14561 - RNA, 20 nt, Artificial Sequence
  TRAC targeting sequence
acaaaaugaagauaaaaaua

SEQ ID NO: 14562 - RNA, 20 nt, Artificial Sequence
  TRAC targeting sequence
uuuuguggauggggaaacug

SEQ ID NO: 14563 - RNA, 20 nt, Artificial Sequence
  TRAC targeting sequence
ucauuuuguggauggggaaa

SEQ ID NO: 14564 - RNA, 20 nt, Artificial Sequence
  TRAC targeting sequence
uaccucguugagucaucgua

SEQ ID NO: 14565 - RNA, 20 nt, Artificial Sequence
  TRAC targeting sequence
uugagucaucguaaagauga

SEQ ID NO: 14566 - RNA, 20 nt, Artificial Sequence
  TRAC targeting sequence
acgagguaggaauauuuuua

SEQ ID NO: 14567 - RNA, 20 nt, Artificial Sequence
  TRAC targeting sequence
ucguaaagaugaaauaauac

SEQ ID NO: 14568 - RNA, 20 nt, Artificial Sequence
  TRAC targeting sequence
uaaagaugaaauaauacagc

SEQ ID NO: 14569 - RNA, 20 nt, Artificial Sequence
  TRAC targeting sequence
uuacgaugacucaacgaggu

SEQ ID NO: 14570 - RNA, 20 nt, Artificial Sequence
  TRAC targeting sequence
ucuuuacgaugacucaacga

SEQ ID NO: 14571 - RNA, 20 nt, Artificial Sequence
  TRAC targeting sequence
gaacauagaaaaagcucauu

SEQ ID NO: 14572 - RNA, 20 nt, Artificial Sequence
  TRAC targeting sequence
gagcacuaugcuaacuacuu

SEQ ID NO: 14573 - RNA, 20 nt, Artificial Sequence
  TRAC targeting sequence
auguucugagcacuaugcua

SEQ ID NO: 14574 - RNA, 20 nt, Artificial Sequence
  TRAC targeting sequence
uuaaacccucgcuauuaaua

SEQ ID NO: 14575 - RNA, 20 nt, Artificial Sequence
  TRAC targeting sequence
cuauuaauaauaaugauaaa

SEQ ID NO: 14576 - RNA, 20 nt, Artificial Sequence
  TRAC targeting sequence
uuauuauuaauagcgagggu

SEQ ID NO: 14577 - RNA, 20 nt, Artificial Sequence
  TRAC targeting sequence
ucucuaacccacagcagagc

SEQ ID NO: 14578 - RNA, 20 nt, Artificial Sequence
  TRAC targeting sequence
cuaacccacagcagagccuu

SEQ ID NO: 14579 - RNA, 20 nt, Artificial Sequence
  TRAC targeting sequence
aacccacagcagagccuuug

SEQ ID NO: 14580 - RNA, 20 nt, Artificial Sequence
  TRAC targeting sequence
gcuguggguuagagaugaug

SEQ ID NO: 14581 - RNA, 20 nt, Artificial Sequence
  TRAC targeting sequence
ucugucaagguucuguugug

SEQ ID NO: 14582 - RNA, 20 nt, Artificial Sequence
  TRAC targeting sequence
gucaagguucuguugugcau

SEQ ID NO: 14583 - RNA, 20 nt, Artificial Sequence
  TRAC targeting sequence
agguucuguugugcaucagc

SEQ ID NO: 14584 - RNA, 20 nt, Artificial Sequence
  TRAC targeting sequence
guugugcaucagcagcagag

SEQ ID NO: 14585 - RNA, 20 nt, Artificial Sequence
  TRAC targeting sequence
gcagcagagcuggaauuggg

SEQ ID NO: 14586 - RNA, 20 nt, Artificial Sequence
  TRAC targeting sequence
gcugcugaugcacaacagaa

SEQ ID NO: 14587 - RNA, 20 nt, Artificial Sequence
  TRAC targeting sequence
agcucugcugcugaugcaca

SEQ ID NO: 14588 - RNA, 20 nt, Artificial Sequence
  TRAC targeting sequence
ccccaauuccagcucugcug

SEQ ID NO: 14589 - RNA, 20 nt, Artificial Sequence
  TRAC targeting sequence
acccuccccccaauuccagc

SEQ ID NO: 14590 - RNA, 20 nt, Artificial Sequence
  TRAC targeting sequence
ccacccuccccccaauucca

SEQ ID NO: 14591 - RNA, 20 nt, Artificial Sequence
  TRAC targeting sequence
gccuguucuaugaaauucuu

SEQ ID NO: 14592 - RNA, 20 nt, Artificial Sequence
  TRAC targeting sequence
augaaauucuucaccuggga

SEQ ID NO: 14593 - RNA, 20 nt, Artificial Sequence
  TRAC targeting sequence
uagaacaggcugacauucuc

SEQ ID NO: 14594 - RNA, 20 nt, Artificial Sequence
  TRAC targeting sequence
ucaccugggauuugaaagug

SEQ ID NO: 14595 - RNA, 20 nt, Artificial Sequence
  TRAC targeting sequence
ccugggauuugaaaguggaa

SEQ ID NO: 14596 - RNA, 20 nt, Artificial Sequence
  TRAC targeting sequence
caggugaagaauuucauaga

SEQ ID NO: 14597 - RNA, 20 nt, Artificial Sequence
  TRAC targeting sequence
aaucccaggugaagaauuuc

SEQ ID NO: 14598 - RNA, 20 nt, Artificial Sequence
  TRAC targeting sequence
acuuucaaaucccaggugaa

SEQ ID NO: 14599 - RNA, 20 nt, Artificial Sequence
  TRAC targeting sequence
uuguauuuccacuuucaaau

SEQ ID NO: 14600 - RNA, 20 nt, Artificial Sequence
  TRAC targeting sequence
ugacuaauuuaaauacaaaa

SEQ ID NO: 14601 - RNA, 20 nt, Artificial Sequence
  TRAC targeting sequence
ggauucuuuguauuuccacu

SEQ ID NO: 14602 - RNA, 20 nt, Artificial Sequence
  TRAC targeting sequence
uccaagugucagaggcaggg

SEQ ID NO: 14603 - RNA, 20 nt, Artificial Sequence
  TRAC targeting sequence
aagugucagaggcaggggag

SEQ ID NO: 14604 - RNA, 20 nt, Artificial Sequence
  TRAC targeting sequence
gaggcaggggagagguuucu

SEQ ID NO: 14605 - RNA, 20 nt, Artificial Sequence
  TRAC targeting sequence
gacacuuggaugauuuugua

SEQ ID NO: 14606 - RNA, 20 nt, Artificial Sequence
  TRAC targeting sequence
ccugccucugacacuuggau

SEQ ID NO: 14607 - RNA, 20 nt, Artificial Sequence
  TRAC targeting sequence
ccccugccucugacacuugg

SEQ ID NO: 14608 - RNA, 20 nt, Artificial Sequence
  TRAC targeting sequence
gcagagagcugcauagcugg

SEQ ID NO: 14609 - RNA, 20 nt, Artificial Sequence
  TRAC targeting sequence
gcagaaaccucuccccugcc

SEQ ID NO: 14610 - RNA, 20 nt, Artificial Sequence
  TRAC targeting sequence
cugcagaaaccucuccccug

SEQ ID NO: 14611 - RNA, 20 nt, Artificial Sequence
  TRAC targeting sequence
cagcuaugcagcucucugca

SEQ ID NO: 14612 - RNA, 20 nt, Artificial Sequence
  TRAC targeting sequence
ucaaggcuacacacacacgc

SEQ ID NO: 14613 - RNA, 20 nt, Artificial Sequence
  TRAC targeting sequence
aggcuacacacacacgcuug

SEQ ID NO: 14614 - RNA, 20 nt, Artificial Sequence
  TRAC targeting sequence
aagcguguguguguagccuu

SEQ ID NO: 14615 - RNA, 20 nt, Artificial Sequence
  TRAC targeting sequence
cugcuccaagcgugugugug

SEQ ID NO: 14616 - RNA, 20 nt, Artificial Sequence
  TRAC targeting sequence
caggauggcagggcaaaggu

SEQ ID NO: 14617 - RNA, 20 nt, Artificial Sequence
  TRAC targeting sequence
ugugaaccgcaucccugcuc

SEQ ID NO: 14618 - RNA, 20 nt, Artificial Sequence
  TRAC targeting sequence
gcaaccuuugcccugccauc

SEQ ID NO: 14619 - RNA, 20 nt, Artificial Sequence
  TRAC targeting sequence
guucugcaaccuuugcccug

SEQ ID NO: 14620 - RNA, 20 nt, Artificial Sequence
  TRAC targeting sequence
ccaucaccaaaaugacccca

SEQ ID NO: 14621 - RNA, 20 nt, Artificial Sequence
  TRAC targeting sequence
ccaaaaugaccccagcauga

SEQ ID NO: 14622 - RNA, 20 nt, Artificial Sequence
  TRAC targeting sequence
uuuuggugauggggaaguac

SEQ ID NO: 14623 - RNA, 20 nt, Artificial Sequence
  TRAC targeting sequence
ugcuggggucauuuugguga

SEQ ID NO: 14624 - RNA, 20 nt, Artificial Sequence
  TRAC targeting sequence
uuuaaggugucccgagcccc

SEQ ID NO: 14625 - RNA, 20 nt, Artificial Sequence
  TRAC targeting sequence
cgagccccuucccaaaagac

SEQ ID NO: 14626 - RNA, 20 nt, Artificial Sequence
  TRAC targeting sequence
ggacaccuuaaaggaaauca

SEQ ID NO: 14627 - RNA, 20 nt, Artificial Sequence
  TRAC targeting sequence
caaaagacaggcuccccaug

SEQ ID NO: 14628 - RNA, 20 nt, Artificial Sequence
  TRAC targeting sequence
uuugggaaggggcucgggac

SEQ ID NO: 14629 - RNA, 20 nt, Artificial Sequence
  TRAC targeting sequence
ccauguggaggggcaaugac

SEQ ID NO: 14630 - RNA, 20 nt, Artificial Sequence
  TRAC targeting sequence
acauggggagccugucuuuu

SEQ ID NO: 14631 - RNA, 20 nt, Artificial Sequence
  TRAC targeting sequence
uugccccuccacauggggag

SEQ ID NO: 14632 - RNA, 20 nt, Artificial Sequence
  TRAC targeting sequence
gucauugccccuccacaugg

SEQ ID NO: 14633 - RNA, 20 nt, Artificial Sequence
  TRAC targeting sequence
cucugucauugccccuccac

SEQ ID NO: 14634 - RNA, 20 nt, Artificial Sequence
  TRAC targeting sequence
ucccucugucauugccccuc

SEQ ID NO: 14635 - RNA, 20 nt, Artificial Sequence
  TRAC targeting sequence
aucuucccucugucauugcc

SEQ ID NO: 14636 - RNA, 20 nt, Artificial Sequence
  TRAC targeting sequence
cauaaaguuuccaucuuccc

SEQ ID NO: 14637 - RNA, 20 nt, Artificial Sequence
  TRAC targeting sequence
cccuucccauaaaguuucca

SEQ ID NO: 14638 - RNA, 20 nt, Artificial Sequence
  TRAC targeting sequence
aucccaagguuguccuucuc

SEQ ID NO: 14639 - RNA, 20 nt, Artificial Sequence
  TRAC targeting sequence
caagguuguccuucuccucu

SEQ ID NO: 14640 - RNA, 20 nt, Artificial Sequence
  TRAC targeting sequence
uucuccucuucaggguagug

SEQ ID NO: 14641 - RNA, 20 nt, Artificial Sequence
  TRAC targeting sequence
ccucuucaggguagugaagc

SEQ ID NO: 14642 - RNA, 20 nt, Artificial Sequence
  TRAC targeting sequence
ucuucaggguagugaagcuc

SEQ ID NO: 14643 - RNA, 20 nt, Artificial Sequence
  TRAC targeting sequence
ucaggguagugaagcucaug

SEQ ID NO: 14644 - RNA, 20 nt, Artificial Sequence
  TRAC targeting sequence
ggguagugaagcucaugaga

SEQ ID NO: 14645 - RNA, 20 nt, Artificial Sequence
  TRAC targeting sequence
cuacccugaagaggagaagg

SEQ ID NO: 14646 - RNA, 20 nt, Artificial Sequence
  TRAC targeting sequence
ugagaaauauggcuccugaa

SEQ ID NO: 14647 - RNA, 20 nt, Artificial Sequence
  TRAC targeting sequence
ugagcuucacuacccugaag

SEQ ID NO: 14648 - RNA, 20 nt, Artificial Sequence
  TRAC targeting sequence
caugagcuucacuacccuga

SEQ ID NO: 14649 - RNA, 20 nt, Artificial Sequence
  TRAC targeting sequence
ugaaaauagccacuaaauga

SEQ ID NO: 14650 - RNA, 20 nt, Artificial Sequence
  TRAC targeting sequence
ggagccauauuucucaugag

SEQ ID NO: 14651 - RNA, 20 nt, Artificial Sequence
  TRAC targeting sequence
uuuaguggcuauuuucagga

SEQ ID NO: 14652 - RNA, 20 nt, Artificial Sequence
  TRAC targeting sequence
ccaaccuggagguagaggau

SEQ ID NO: 14653 - RNA, 20 nt, Artificial Sequence
  TRAC targeting sequence
aaccuggagguagaggauca

SEQ ID NO: 14654 - RNA, 20 nt, Artificial Sequence
  TRAC targeting sequence
agguuggagaguuucauuua

SEQ ID NO: 14655 - RNA, 20 nt, Artificial Sequence
  TRAC targeting sequence
accuccagguuggagaguuu

SEQ ID NO: 14656 - RNA, 20 nt, Artificial Sequence
  TRAC targeting sequence
ucuaccuccagguuggagag

SEQ ID NO: 14657 - RNA, 20 nt, Artificial Sequence
  TRAC targeting sequence
guaaagucugcagaggcaaa

SEQ ID NO: 14658 - RNA, 20 nt, Artificial Sequence
  TRAC targeting sequence
gcagaggcaaaaugaggcag

SEQ ID NO: 14659 - RNA, 20 nt, Artificial Sequence
  TRAC targeting sequence
gcagacuuuacugauccucu

SEQ ID NO: 14660 - RNA, 20 nt, Artificial Sequence
  TRAC targeting sequence
uuuugccucugcagacuuua

SEQ ID NO: 14661 - RNA, 20 nt, Artificial Sequence
  TRAC targeting sequence
aagaaaagagguugagggca

SEQ ID NO: 14662 - RNA, 20 nt, Artificial Sequence
  TRAC targeting sequence
uugaaauaaacugccucauu

SEQ ID NO: 14663 - RNA, 20 nt, Artificial Sequence
  TRAC targeting sequence
uuucuuugaaauaaacugcc

SEQ ID NO: 14664 - RNA, 20 nt, Artificial Sequence
  TRAC targeting sequence
accucuuuucuuugaaauaa

SEQ ID NO: 14665 - RNA, 20 nt, Artificial Sequence
  TRAC targeting sequence
caccuugcccucaaccucuu

SEQ ID NO: 14666 - RNA, 20 nt, Artificial Sequence
  TRAC targeting sequence
cacaucuaaaucugggaaag

SEQ ID NO: 14667 - RNA, 20 nt, Artificial Sequence
  TRAC targeting sequence
aaaucugggaaaggaagcau

SEQ ID NO: 14668 - RNA, 20 nt, Artificial Sequence
  TRAC targeting sequence
gggaaaggaagcauuaaaca

SEQ ID NO: 14669 - RNA, 20 nt, Artificial Sequence
  TRAC targeting sequence
cagauuuagaugugugacuu

SEQ ID NO: 14670 - RNA, 20 nt, Artificial Sequence
  TRAC targeting sequence
uuucccagauuuagaugugu

SEQ ID NO: 14671 - RNA, 20 nt, Artificial Sequence
  TRAC targeting sequence
guuuaaugcuuccuuuccca

SEQ ID NO: 14672 - RNA, 20 nt, Artificial Sequence
  TRAC targeting sequence
ucuguuuaaugcuuccuuuc

SEQ ID NO: 14673 - RNA, 20 nt, Artificial Sequence
  TRAC targeting sequence
gucuucuguuuaaugcuucc

SEQ ID NO: 14674 - RNA, 20 nt, Artificial Sequence
  TRAC targeting sequence
gcucuccaccuccaccagga

SEQ ID NO: 14675 - RNA, 20 nt, Artificial Sequence
  TRAC targeting sequence
ccaccuccaccaggauucag

SEQ ID NO: 14676 - RNA, 20 nt, Artificial Sequence
  TRAC targeting sequence
accuccaccaggauucagac

SEQ ID NO: 14677 - RNA, 20 nt, Artificial Sequence
  TRAC targeting sequence
accaggauucagaccacagg

SEQ ID NO: 14678 - RNA, 20 nt, Artificial Sequence
  TRAC targeting sequence
ugguggagguggagagccga

SEQ ID NO: 14679 - RNA, 20 nt, Artificial Sequence
  TRAC targeting sequence
gaccacaggacauggcuaau

SEQ ID NO: 14680 - RNA, 20 nt, Artificial Sequence
  TRAC targeting sequence
gaauccugguggagguggag

SEQ ID NO: 14681 - RNA, 20 nt, Artificial Sequence
  TRAC targeting sequence
uguggucugaauccuggugg

SEQ ID NO: 14682 - RNA, 20 nt, Artificial Sequence
  TRAC targeting sequence
ugcaguauuagccauguccu

SEQ ID NO: 14683 - RNA, 20 nt, Artificial Sequence
  TRAC targeting sequence
cuucuugcaguauuagccau

SEQ ID NO: 14684 - RNA, 20 nt, Artificial Sequence
  TRAC targeting sequence
aauagguuuuugaacaguga

SEQ ID NO: 14685 - RNA, 20 nt, Artificial Sequence
  TRAC targeting sequence
aaaaccuauuagaaagguuu

SEQ ID NO: 14686 - RNA, 20 nt, Artificial Sequence
  TRAC targeting sequence
cuguucaaaaaccuauuaga

SEQ ID NO: 14687 - RNA, 20 nt, Artificial Sequence
  TRAC targeting sequence
uuuucacuguucaaaaaccu

SEQ ID NO: 14688 - RNA, 20 nt, Artificial Sequence
  TRAC targeting sequence
ggaguaguugccagggcacu

SEQ ID NO: 14689 - RNA, 20 nt, Artificial Sequence
  TRAC targeting sequence
ugacagcucauuuucacugu

SEQ ID NO: 14690 - RNA, 20 nt, Artificial Sequence
  TRAC targeting sequence
cuagagaguuuuugaaagga

SEQ ID NO: 14691 - RNA, 20 nt, Artificial Sequence
  TRAC targeting sequence
agagaguuuuugaaaggaga

SEQ ID NO: 14692 - RNA, 20 nt, Artificial Sequence
  TRAC targeting sequence
agagaaagugcccuggcaac

SEQ ID NO: 14693 - RNA, 20 nt, Artificial Sequence
  TRAC targeting sequence
cuagagaaagugcccuggca

SEQ ID NO: 14694 - RNA, 20 nt, Artificial Sequence
  TRAC targeting sequence
aaaacucucuagagaaagug

SEQ ID NO: 14695 - RNA, 20 nt, Artificial Sequence
  TRAC targeting sequence
uuucaaaaacucucuagaga

SEQ ID NO: 14696 - RNA, 20 nt, Artificial Sequence
  TRAC targeting sequence
ccuuucaaaaacucucuaga

SEQ ID NO: 14697 - RNA, 20 nt, Artificial Sequence
  TRAC targeting sequence
aucuccuuucaaaaacucuc

SEQ ID NO: 14698 - RNA, 20 nt, Artificial Sequence
  TRAC targeting sequence
gaggugauuggagugcagcc

SEQ ID NO: 14699 - RNA, 20 nt, Artificial Sequence
  TRAC targeting sequence
gauagcagggugucuaucuc

SEQ ID NO: 14700 - RNA, 20 nt, Artificial Sequence
  TRAC targeting sequence
ccucugauagcagggugucu

SEQ ID NO: 14701 - RNA, 20 nt, Artificial Sequence
  TRAC targeting sequence
aaucaccucugauagcaggg

SEQ ID NO: 14702 - RNA, 20 nt, Artificial Sequence
  TRAC targeting sequence
aggcaggaggagaaaugaga

SEQ ID NO: 14703 - RNA, 20 nt, Artificial Sequence
  TRAC targeting sequence
aggcagggcugcacuccaau

SEQ ID NO: 14704 - RNA, 20 nt, Artificial Sequence
  TRAC targeting sequence
ugccucgaggcagggcugca

SEQ ID NO: 14705 - RNA, 20 nt, Artificial Sequence
  TRAC targeting sequence
uccugccucgaggcagggcu

SEQ ID NO: 14706 - RNA, 20 nt, Artificial Sequence
  TRAC targeting sequence
ccuccugccucgaggcaggg

SEQ ID NO: 14707 - RNA, 20 nt, Artificial Sequence
  TRAC targeting sequence
uuucuccuccugccucgagg

SEQ ID NO: 14708 - RNA, 20 nt, Artificial Sequence
  TRAC targeting sequence
cauuucuccuccugccucga

SEQ ID NO: 14709 - RNA, 20 nt, Artificial Sequence
  TRAC targeting sequence
cucauuucuccuccugccuc

SEQ ID NO: 14710 - RNA, 20 nt, Artificial Sequence
  TRAC targeting sequence
uaaagccucuuuccagcccc

SEQ ID NO: 14711 - RNA, 20 nt, Artificial Sequence
  TRAC targeting sequence
uuccagcccccagagccugu

SEQ ID NO: 14712 - RNA, 20 nt, Artificial Sequence
  TRAC targeting sequence
agcccccagagccugucucc

SEQ ID NO: 14713 - RNA, 20 nt, Artificial Sequence
  TRAC targeting sequence
gggggcuggaaagaggcuuu

SEQ ID NO: 14714 - RNA, 20 nt, Artificial Sequence
  TRAC targeting sequence
ccaugaaaaaggcccaggcu

SEQ ID NO: 14715 - RNA, 20 nt, Artificial Sequence
  TRAC targeting sequence
augaaaaaggcccaggcuca

SEQ ID NO: 14716 - RNA, 20 nt, Artificial Sequence
  TRAC targeting sequence
uggagacaggcucugggggc

SEQ ID NO: 14717 - RNA, 20 nt, Artificial Sequence
  TRAC targeting sequence
uuaaugcagagcugcauccu

SEQ ID NO: 14718 - RNA, 20 nt, Artificial Sequence
  TRAC targeting sequence
gcauuaaugagccugggccu

SEQ ID NO: 14719 - RNA, 20 nt, Artificial Sequence
  TRAC targeting sequence
uccaggacacaggggguugc

SEQ ID NO: 14720 - RNA, 20 nt, Artificial Sequence
  TRAC targeting sequence
aggacacaggggguugcugg

SEQ ID NO: 14721 - RNA, 20 nt, Artificial Sequence
  TRAC targeting sequence
uggaggaugcagcucugcau

SEQ ID NO: 14722 - RNA, 20 nt, Artificial Sequence
  TRAC targeting sequence
aaacuuaacaacccagcaac

SEQ ID NO: 14723 - RNA, 20 nt, Artificial Sequence
  TRAC targeting sequence
cuuuguucucaagacuugac

SEQ ID NO: 14724 - RNA, 20 nt, Artificial Sequence
  TRAC targeting sequence
caagacuugacuugauaaau

SEQ ID NO: 14725 - RNA, 20 nt, Artificial Sequence
  TRAC targeting sequence
agacuugacuugauaaaugg

SEQ ID NO: 14726 - RNA, 20 nt, Artificial Sequence
  TRAC targeting sequence
ugagaacaaagggaguuugg

SEQ ID NO: 14727 - RNA, 20 nt, Artificial Sequence
  TRAC targeting sequence
agucuugagaacaaagggag

SEQ ID NO: 14728 - RNA, 20 nt, Artificial Sequence
  TRAC targeting sequence
agucaagucuugagaacaaa

SEQ ID NO: 14729 - RNA, 20 nt, Artificial Sequence
  TRAC targeting sequence
cuuuaaagccaaaaacacag

SEQ ID NO: 14730 - RNA, 20 nt, Artificial Sequence
  TRAC targeting sequence
gagugcuguguuguuugugg

SEQ ID NO: 14731 - RNA, 20 nt, Artificial Sequence
  TRAC targeting sequence
gaaccuguguuuuuggcuuu

SEQ ID NO: 14732 - RNA, 20 nt, Artificial Sequence
  TRAC targeting sequence
acaccacaaacaacacagca

SEQ ID NO: 14733 - RNA, 20 nt, Artificial Sequence
  TRAC targeting sequence
caacaccacaaacaacacag

SEQ ID NO: 14734 - RNA, 20 nt, Artificial Sequence
  TRAC targeting sequence
agccugggcaucucaacacc

SEQ ID NO: 14735 - RNA, 20 nt, Artificial Sequence
  TRAC targeting sequence
cuccagccugggcaucucaa

SEQ ID NO: 14736 - RNA, 20 nt, Artificial Sequence
  TRAC targeting sequence
ucccuccagccugggcaucu

SEQ ID NO: 14737 - RNA, 20 nt, Artificial Sequence
  TRAC targeting sequence
aggggguuuuugcugagccc

SEQ ID NO: 14738 - RNA, 20 nt, Artificial Sequence
  TRAC targeting sequence
gcaaaaacccccuagagcuu

SEQ ID NO: 14739 - RNA, 20 nt, Artificial Sequence
  TRAC targeting sequence
gggcucagcaaaaacccccu

SEQ ID NO: 14740 - RNA, 20 nt, Artificial Sequence
  TRAC targeting sequence
ccacaguguuucugggcuca

SEQ ID NO: 14741 - RNA, 20 nt, Artificial Sequence
  TRAC targeting sequence
gaauuuugucuuuggucccg

SEQ ID NO: 14742 - RNA, 20 nt, Artificial Sequence
  TRAC targeting sequence
gaccauaguuauccccacag

SEQ ID NO: 14743 - RNA, 20 nt, Artificial Sequence
  TRAC targeting sequence
uuggucccggaaccagauug

SEQ ID NO: 14744 - RNA, 20 nt, Artificial Sequence
  TRAC targeting sequence
cggaaccagauuguccgugc

SEQ ID NO: 14745 - RNA, 20 nt, Artificial Sequence
  TRAC targeting sequence
gggaccaaagacaaaauucu

SEQ ID NO: 14746 - RNA, 20 nt, Artificial Sequence
  TRAC targeting sequence
gguuccgggaccaaagacaa

SEQ ID NO: 14747 - RNA, 20 nt, Artificial Sequence
  TRAC targeting sequence
gugcugcccuguaaguacag

SEQ ID NO: 14748 - RNA, 20 nt, Artificial Sequence
  TRAC targeting sequence
acuuaacuguacuuacaggg

SEQ ID NO: 14749 - RNA, 20 nt, Artificial Sequence
  TRAC targeting sequence
ccacuuaacuguacuuacag

SEQ ID NO: 14750 - RNA, 20 nt, Artificial Sequence
  TRAC targeting sequence
aucuccacuuaacuguacuu

SEQ ID NO: 14751 - RNA, 20 nt, Artificial Sequence
  TRAC targeting sequence
uuuucuaucuccacuuaacu

SEQ ID NO: 14752 - RNA, 20 nt, Artificial Sequence
  TRAC targeting sequence
agugcuugauguggggagaa

SEQ ID NO: 14753 - RNA, 20 nt, Artificial Sequence
  TRAC targeting sequence
agcacuggacucauuuucua

SEQ ID NO: 14754 - RNA, 20 nt, Artificial Sequence
  TRAC targeting sequence
ccacaucaagcacuggacuc

SEQ ID NO: 14755 - RNA, 20 nt, Artificial Sequence
  TRAC targeting sequence
ccccacaucaagcacuggac

SEQ ID NO: 14756 - RNA, 20 nt, Artificial Sequence
  TRAC targeting sequence
ugaggccaggaguccaccgu

SEQ ID NO: 14757 - RNA, 20 nt, Artificial Sequence
  TRAC targeting sequence
agacccugcagcuucucccc

SEQ ID NO: 14758 - RNA, 20 nt, Artificial Sequence
  TRAC targeting sequence
uggccucaagacccugcagc

SEQ ID NO: 14759 - RNA, 20 nt, Artificial Sequence
  TRAC targeting sequence
accgugaccucaggaguggu

SEQ ID NO: 14760 - RNA, 20 nt, Artificial Sequence
  TRAC targeting sequence
cgguggacuccuggccucaa

SEQ ID NO: 14761 - RNA, 20 nt, Artificial Sequence
  TRAC targeting sequence
ggaguggugauggagaagaa

SEQ ID NO: 14762 - RNA, 20 nt, Artificial Sequence
  TRAC targeting sequence
ugaggucacgguggacuccu

SEQ ID NO: 14763 - RNA, 20 nt, Artificial Sequence
  TRAC targeting sequence
ccacuccugaggucacggug

SEQ ID NO: 14764 - RNA, 20 nt, Artificial Sequence
  TRAC targeting sequence
aucaccacuccugaggucac

SEQ ID NO: 14765 - RNA, 20 nt, Artificial Sequence
  TRAC targeting sequence
ccaucaccacuccugagguc

SEQ ID NO: 14766 - RNA, 20 nt, Artificial Sequence
  TRAC targeting sequence
ucuccaucaccacuccugag

SEQ ID NO: 14767 - RNA, 20 nt, Artificial Sequence
  TRAC targeting sequence
uuuuuuaaccuucuucucca

SEQ ID NO: 14768 - RNA, 20 nt, Artificial Sequence
  TRAC targeting sequence
uuccuuuuuuaaccuucuuc

SEQ ID NO: 14769 - RNA, 20 nt, Artificial Sequence
  TRAC targeting sequence
cauuccuuuuuuaaccuucu

SEQ ID NO: 14770 - RNA, 20 nt, Artificial Sequence
  TRAC targeting sequence
guuucucauuccuuuuuuaa

SEQ ID NO: 14771 - RNA, 20 nt, Artificial Sequence
  TRAC targeting sequence
uuaugguucuguuucucauu

SEQ ID NO: 14772 - RNA, 20 nt, Artificial Sequence
  TRAC targeting sequence
guauuguccuuaugguucug

SEQ ID NO: 14773 - RNA, 20 nt, Artificial Sequence
  TRAC targeting sequence
ucuguauuguccuuaugguu

SEQ ID NO: 14774 - RNA, 20 nt, Artificial Sequence
  TRAC targeting sequence
uuuucgggaaggaaaaucac

SEQ ID NO: 14775 - RNA, 20 nt, Artificial Sequence
  TRAC targeting sequence
ggaaggaaaaucacaaggcc

SEQ ID NO: 14776 - RNA, 20 nt, Artificial Sequence
  TRAC targeting sequence
cgaaaaugaacccuuccucu

SEQ ID NO: 14777 - RNA, 20 nt, Artificial Sequence
  TRAC targeting sequence
uucccgaaaaugaacccuuc

SEQ ID NO: 14778 - RNA, 20 nt, Artificial Sequence
  TRAC targeting sequence
caaggccgugugauuaacgc

SEQ ID NO: 14779 - RNA, 20 nt, Artificial Sequence
  TRAC targeting sequence
cacggccuugugauuuuccu

SEQ ID NO: 14780 - RNA, 20 nt, Artificial Sequence
  TRAC targeting sequence
agcguuaaucacacggccuu

SEQ ID NO: 14781 - RNA, 20 nt, Artificial Sequence
  TRAC targeting sequence
uccagcguuaaucacacggc

SEQ ID NO: 14782 - RNA, 20 nt, Artificial Sequence
  TRAC targeting sequence
uuuggagggucccuucucag

SEQ ID NO: 14783 - RNA, 20 nt, Artificial Sequence
  TRAC targeting sequence
aaaggagugcauuuccucca

SEQ ID NO: 14784 - RNA, 20 nt, Artificial Sequence
  TRAC targeting sequence
cuucucaggagggcuuugug

SEQ ID NO: 14785 - RNA, 20 nt, Artificial Sequence
  TRAC targeting sequence
caggagggcuuugugucggg

SEQ ID NO: 14786 - RNA, 20 nt, Artificial Sequence
  TRAC targeting sequence
ggagggcuuugugucgggga

SEQ ID NO: 14787 - RNA, 20 nt, Artificial Sequence
  TRAC targeting sequence
ugagaagggacccuccaaag

SEQ ID NO: 14788 - RNA, 20 nt, Artificial Sequence
  TRAC targeting sequence
gggaaagcugagcuguuagg

SEQ ID NO: 14789 - RNA, 20 nt, Artificial Sequence
  TRAC targeting sequence
ccgacacaaagcccuccuga

SEQ ID NO: 14790 - RNA, 20 nt, Artificial Sequence
  TRAC targeting sequence
gcuuuccccgacacaaagcc

SEQ ID NO: 14791 - RNA, 20 nt, Artificial Sequence
  TRAC targeting sequence
aaaaccuaacagcucagcuu

SEQ ID NO: 14792 - RNA, 20 nt, Artificial Sequence
  TRAC targeting sequence
gcaucaaaaaccuaacagcu

SEQ ID NO: 14793 - RNA, 20 nt, Artificial Sequence
  TRAC targeting sequence
cagcaucaaaaaccuaacag

SEQ ID NO: 14794 - RNA, 20 nt, Artificial Sequence
  TRAC targeting sequence
cuaugcagaaggacaaggcu

SEQ ID NO: 14795 - RNA, 20 nt, Artificial Sequence
  TRAC targeting sequence
gcauagugauuaucucagca

SEQ ID NO: 14796 - RNA, 20 nt, Artificial Sequence
  TRAC targeting sequence
uucugcauagugauuaucuc

SEQ ID NO: 14797 - RNA, 20 nt, Artificial Sequence
  TRAC targeting sequence
ccuuuaucuuugggaagggg

SEQ ID NO: 14798 - RNA, 20 nt, Artificial Sequence
  TRAC targeting sequence
uuuaucuuugggaaggggac

SEQ ID NO: 14799 - RNA, 20 nt, Artificial Sequence
  TRAC targeting sequence
uugggaaggggacaaggcug

SEQ ID NO: 14800 - RNA, 20 nt, Artificial Sequence
  TRAC targeting sequence
caaagauaaaggagaagccu

SEQ ID NO: 14801 - RNA, 20 nt, Artificial Sequence
  TRAC targeting sequence
ccuucccaaagauaaaggag

SEQ ID NO: 14802 - RNA, 20 nt, Artificial Sequence
  TRAC targeting sequence
agccaaguaagugacauaua

SEQ ID NO: 14803 - RNA, 20 nt, Artificial Sequence
  TRAC targeting sequence
cuuacuuggcuugacaagca

SEQ ID NO: 14804 - RNA, 20 nt, Artificial Sequence
  TRAC targeting sequence
gcacauauaaauuauauguc

SEQ ID NO: 14805 - RNA, 20 nt, Artificial Sequence
  TRAC targeting sequence
uauucagcacauauaaauua

SEQ ID NO: 14806 - RNA, 20 nt, Artificial Sequence
  TRAC targeting sequence
ccaagaggaaaacuugcccu

SEQ ID NO: 14807 - RNA, 20 nt, Artificial Sequence
  TRAC targeting sequence
aagaggaaaacuugcccucu

SEQ ID NO: 14808 - RNA, 20 nt, Artificial Sequence
  TRAC targeting sequence
uggagauaaucauauucagc

SEQ ID NO: 14809 - RNA, 20 nt, Artificial Sequence
  TRAC targeting sequence
ucuuggagauaaucauauuc

SEQ ID NO: 14810 - RNA, 20 nt, Artificial Sequence
  TRAC targeting sequence
uuuccacgggugccuccuug

SEQ ID NO: 14811 - RNA, 20 nt, Artificial Sequence
  TRAC targeting sequence
acgggugccuccuuggguca

SEQ ID NO: 14812 - RNA, 20 nt, Artificial Sequence
  TRAC targeting sequence
uugggucaggaggacauuaa

SEQ ID NO: 14813 - RNA, 20 nt, Artificial Sequence
  TRAC targeting sequence
ggaggacauuaaagguguug

SEQ ID NO: 14814 - RNA, 20 nt, Artificial Sequence
  TRAC targeting sequence
ugacccaaggaggcacccgu

SEQ ID NO: 14815 - RNA, 20 nt, Artificial Sequence
  TRAC targeting sequence
uccugacccaaggaggcacc

SEQ ID NO: 14816 - RNA, 20 nt, Artificial Sequence
  TRAC targeting sequence
acaccuuuaauguccuccug

SEQ ID NO: 14817 - RNA, 20 nt, Artificial Sequence
  TRAC targeting sequence
gcucaacaccuuuaaugucc

SEQ ID NO: 14818 - RNA, 20 nt, Artificial Sequence
  TRAC targeting sequence
ucaccuucuucauccuugaa

SEQ ID NO: 14819 - RNA, 20 nt, Artificial Sequence
  TRAC targeting sequence
ccuucuucauccuugaagga

SEQ ID NO: 14820 - RNA, 20 nt, Artificial Sequence
  TRAC targeting sequence
ucauccuugaaggagcuuua

SEQ ID NO: 14821 - RNA, 20 nt, Artificial Sequence
  TRAC targeting sequence
uccuugaaggagcuuuaaga

SEQ ID NO: 14822 - RNA, 20 nt, Artificial Sequence
  TRAC targeting sequence
uugaaggagcuuuaagaggu

SEQ ID NO: 14823 - RNA, 20 nt, Artificial Sequence
  TRAC targeting sequence
aggaugaagaaggugacgag

SEQ ID NO: 14824 - RNA, 20 nt, Artificial Sequence
  TRAC targeting sequence
uucaaggaugaagaagguga

SEQ ID NO: 14825 - RNA, 20 nt, Artificial Sequence
  TRAC targeting sequence
uaaagcuccuucaaggauga

SEQ ID NO: 14826 - RNA, 20 nt, Artificial Sequence
  TRAC targeting sequence
acaccucuuaaagcuccuuc

SEQ ID NO: 14827 - RNA, 20 nt, Artificial Sequence
  TRAC targeting sequence
ccuccacaccucuuaaagcu

SEQ ID NO: 14828 - RNA, 20 nt, Artificial Sequence
  TRAC targeting sequence
uccccuccacaccucuuaaa

SEQ ID NO: 14829 - RNA, 20 nt, Artificial Sequence
  TRAC targeting sequence
ugguggguuucuuccccucc

SEQ ID NO: 14830 - RNA, 20 nt, Artificial Sequence
  TRAC targeting sequence
aggcugggcuuauugguggg

SEQ ID NO: 14831 - RNA, 20 nt, Artificial Sequence
  TRAC targeting sequence
caaggcugggcuuauuggug

SEQ ID NO: 14832 - RNA, 20 nt, Artificial Sequence
  TRAC targeting sequence
acucugucagacuugaauaa

SEQ ID NO: 14833 - RNA, 20 nt, Artificial Sequence
  TRAC targeting sequence
gucagacuugaauaagaacc

SEQ ID NO: 14834 - RNA, 20 nt, Artificial Sequence
  TRAC targeting sequence
gacuugaauaagaaccaucu

SEQ ID NO: 14835 - RNA, 20 nt, Artificial Sequence
  TRAC targeting sequence
gacagaguggaggggucuca

SEQ ID NO: 14836 - RNA, 20 nt, Artificial Sequence
  TRAC targeting sequence
agucugacagaguggagggg

SEQ ID NO: 14837 - RNA, 20 nt, Artificial Sequence
  TRAC targeting sequence
uauucaagucugacagagug

SEQ ID NO: 14838 - RNA, 20 nt, Artificial Sequence
  TRAC targeting sequence
gagaacaaggucuuccucag

SEQ ID NO: 14839 - RNA, 20 nt, Artificial Sequence
  TRAC targeting sequence
gaugguucuuauucaagucu

SEQ ID NO: 14840 - RNA, 20 nt, Artificial Sequence
  TRAC targeting sequence
cagaugguucuuauucaagu

SEQ ID NO: 14841 - RNA, 20 nt, Artificial Sequence
  TRAC targeting sequence
uccucagaaggggacuccag

SEQ ID NO: 14842 - RNA, 20 nt, Artificial Sequence
  TRAC targeting sequence
ucagaaggggacuccagcau

SEQ ID NO: 14843 - RNA, 20 nt, Artificial Sequence
  TRAC targeting sequence
gaaggggacuccagcauagu

SEQ ID NO: 14844 - RNA, 20 nt, Artificial Sequence
  TRAC targeting sequence
gaggaagaccuuguucucag

SEQ ID NO: 14845 - RNA, 20 nt, Artificial Sequence
  TRAC targeting sequence
ccuucugaggaagaccuugu

SEQ ID NO: 14846 - RNA, 20 nt, Artificial Sequence
  TRAC targeting sequence
agcauagucauccccauuug

SEQ ID NO: 14847 - RNA, 20 nt, Artificial Sequence
  TRAC targeting sequence
uccccauuugauagauuuug

SEQ ID NO: 14848 - RNA, 20 nt, Artificial Sequence
  TRAC targeting sequence
ccauuugauagauuuugaaa

SEQ ID NO: 14849 - RNA, 20 nt, Artificial Sequence
  TRAC targeting sequence
aauggggaugacuaugcugg

SEQ ID NO: 14850 - RNA, 20 nt, Artificial Sequence
  TRAC targeting sequence
aucaaauggggaugacuaug

SEQ ID NO: 14851 - RNA, 20 nt, Artificial Sequence
  TRAC targeting sequence
aaaucuaucaaauggggaug

SEQ ID NO: 14852 - RNA, 20 nt, Artificial Sequence
  TRAC targeting sequence
gggcggggcagaguggcuca

SEQ ID NO: 14853 - RNA, 20 nt, Artificial Sequence
  TRAC targeting sequence
gccccgcccugaguuucaaa

SEQ ID NO: 14854 - RNA, 20 nt, Artificial Sequence
  TRAC targeting sequence
ugccuguaaucccagcacuu

SEQ ID NO: 14855 - RNA, 20 nt, Artificial Sequence
  TRAC targeting sequence
cagcacuuugggaagcugag

SEQ ID NO: 14856 - RNA, 20 nt, Artificial Sequence
  TRAC targeting sequence
caaagugcugggauuacagg

SEQ ID NO: 14857 - RNA, 20 nt, Artificial Sequence
  TRAC targeting sequence
gcuucccaaagugcugggau

SEQ ID NO: 14858 - RNA, 20 nt, Artificial Sequence
  TRAC targeting sequence
accugccucagcuucccaaa

SEQ ID NO: 14859 - RNA, 20 nt, Artificial Sequence
  TRAC targeting sequence
cuugaaggucaggaguucga

SEQ ID NO: 14860 - RNA, 20 nt, Artificial Sequence
  TRAC targeting sequence
agugauccaccugccucagc

SEQ ID NO: 14861 - RNA, 20 nt, Artificial Sequence
  TRAC targeting sequence
ggaguucgagaccugccugg

SEQ ID NO: 14862 - RNA, 20 nt, Artificial Sequence
  TRAC targeting sequence
ugaccuucaagugauccacc

SEQ ID NO: 14863 - RNA, 20 nt, Artificial Sequence
  TRAC targeting sequence
agaccugccuggccaacaug

SEQ ID NO: 14864 - RNA, 20 nt, Artificial Sequence
  TRAC targeting sequence
aacuccugaccuucaaguga

SEQ ID NO: 14865 - RNA, 20 nt, Artificial Sequence
  TRAC targeting sequence
cgaacuccugaccuucaagu

SEQ ID NO: 14866 - RNA, 20 nt, Artificial Sequence
  TRAC targeting sequence
ccauguuggccaggcagguc

SEQ ID NO: 14867 - RNA, 20 nt, Artificial Sequence
  TRAC targeting sequence
cuacuaaaaauaaaaaaaau

SEQ ID NO: 14868 - RNA, 20 nt, Artificial Sequence
  TRAC targeting sequence
acuaaaaauaaaaaaaauua

SEQ ID NO: 14869 - RNA, 20 nt, Artificial Sequence
  TRAC targeting sequence
cagcuacucagaaggcugag

SEQ ID NO: 14870 - RNA, 20 nt, Artificial Sequence
  TRAC targeting sequence
gaaggcugaggcaggagaau

SEQ ID NO: 14871 - RNA, 20 nt, Artificial Sequence
  TRAC targeting sequence
gaguagcugggauuacaggu

SEQ ID NO: 14872 - RNA, 20 nt, Artificial Sequence
  TRAC targeting sequence
gccuucugaguagcugggau

SEQ ID NO: 14873 - RNA, 20 nt, Artificial Sequence
  TRAC targeting sequence
ugccucagccuucugaguag

SEQ ID NO: 14874 - RNA, 20 nt, Artificial Sequence
  TRAC targeting sequence
ccugccucagccuucugagu

SEQ ID NO: 14875 - RNA, 20 nt, Artificial Sequence
  TRAC targeting sequence
cuugaacccgggaggcggag

SEQ ID NO: 14876 - RNA, 20 nt, Artificial Sequence
  TRAC targeting sequence
agcgauucuccugccucagc

SEQ ID NO: 14877 - RNA, 20 nt, Artificial Sequence
  TRAC targeting sequence
cggguucaagcgauucuccu

SEQ ID NO: 14878 - RNA, 20 nt, Artificial Sequence
  TRAC targeting sequence
gccucccggguucaagcgau

SEQ ID NO: 14879 - RNA, 20 nt, Artificial Sequence
  TRAC targeting sequence
cugcaaccuccgccucccgg

SEQ ID NO: 14880 - RNA, 20 nt, Artificial Sequence
  TRAC targeting sequence
uggcucacugcaaccuccgc

SEQ ID NO: 14881 - RNA, 20 nt, Artificial Sequence
  TRAC targeting sequence
ugccauugcacuccagccug

SEQ ID NO: 14882 - RNA, 20 nt, Artificial Sequence
  TRAC targeting sequence
agccugggcaacaaaagcga

SEQ ID NO: 14883 - RNA, 20 nt, Artificial Sequence
  TRAC targeting sequence
cuuuuguugcccaggcugga

SEQ ID NO: 14884 - RNA, 20 nt, Artificial Sequence
  TRAC targeting sequence
ucucaaacaaacaaacaagc

SEQ ID NO: 14885 - RNA, 20 nt, Artificial Sequence
  TRAC targeting sequence
caaacaaacaaacaagcuca

SEQ ID NO: 14886 - RNA, 20 nt, Artificial Sequence
  TRAC targeting sequence
aacaaacaaacaagcucagg

SEQ ID NO: 14887 - RNA, 20 nt, Artificial Sequence
  TRAC targeting sequence
ggcaaguagaggccagugau

SEQ ID NO: 14888 - RNA, 20 nt, Artificial Sequence
  TRAC targeting sequence
acuugccugagcuuguuugu

SEQ ID NO: 14889 - RNA, 20 nt, Artificial Sequence
  TRAC targeting sequence
cuggccucuacuugccugag

SEQ ID NO: 14890 - RNA, 20 nt, Artificial Sequence
  TRAC targeting sequence
uccaauaggaacagauccca

SEQ ID NO: 14891 - RNA, 20 nt, Artificial Sequence
  TRAC targeting sequence
aauaggaacagaucccaagc

SEQ ID NO: 14892 - RNA, 20 nt, Artificial Sequence
  TRAC targeting sequence
uauuggaagaguguuaauca

SEQ ID NO: 14893 - RNA, 20 nt, Artificial Sequence
  TRAC targeting sequence
guuccuauuggaagaguguu

SEQ ID NO: 14894 - RNA, 20 nt, Artificial Sequence
  TRAC targeting sequence
caagcaaccugcaguaguuu

SEQ ID NO: 14895 - RNA, 20 nt, Artificial Sequence
  TRAC targeting sequence
aguaggcucgugaacucaaa

SEQ ID NO: 14896 - RNA, 20 nt, Artificial Sequence
  TRAC targeting sequence
ugaacucaaaacaccaaguu

SEQ ID NO: 14897 - RNA, 20 nt, Artificial Sequence
  TRAC targeting sequence
cgagccuacuggaaaaacua

SEQ ID NO: 14898 - RNA, 20 nt, Artificial Sequence
  TRAC targeting sequence
aaacaccaaguuauuuaaau

SEQ ID NO: 14899 - RNA, 20 nt, Artificial Sequence
  TRAC targeting sequence
uuuaaauaacuugguguuuu

SEQ ID NO: 14900 - RNA, 20 nt, Artificial Sequence
  TRAC targeting sequence
caacgguugcccugucauuu

SEQ ID NO: 14901 - RNA, 20 nt, Artificial Sequence
  TRAC targeting sequence
gcugucauuugaguagugcu

SEQ ID NO: 14902 - RNA, 20 nt, Artificial Sequence
  TRAC targeting sequence
uuugaguagugcugaggacu

SEQ ID NO: 14903 - RNA, 20 nt, Artificial Sequence
  TRAC targeting sequence
aaugacagcugaucacaacg

SEQ ID NO: 14904 - RNA, 20 nt, Artificial Sequence
  TRAC targeting sequence
gcacuacucaaaugacagcu

SEQ ID NO: 14905 - RNA, 20 nt, Artificial Sequence
  TRAC targeting sequence
ucagcacuacucaaaugaca

SEQ ID NO: 14906 - RNA, 20 nt, Artificial Sequence
  TRAC targeting sequence
gaccuugaguaaacgccuag

SEQ ID NO: 14907 - RNA, 20 nt, Artificial Sequence
  TRAC targeting sequence
gacccaguccucagcacuac

SEQ ID NO: 14908 - RNA, 20 nt, Artificial Sequence
  TRAC targeting sequence
aggucagacccaguccucag

SEQ ID NO: 14909 - RNA, 20 nt, Artificial Sequence
  TRAC targeting sequence
aucccugcagcaucuaaagc

SEQ ID NO: 14910 - RNA, 20 nt, Artificial Sequence
  TRAC targeting sequence
cugcagcaucuaaagcggac

SEQ ID NO: 14911 - RNA, 20 nt, Artificial Sequence
  TRAC targeting sequence
aaagcggacgcccaggcuuc

SEQ ID NO: 14912 - RNA, 20 nt, Artificial Sequence
  TRAC targeting sequence
gcuuuagaugcugcagggau

SEQ ID NO: 14913 - RNA, 20 nt, Artificial Sequence
  TRAC targeting sequence
cugaccccagcagucuggcu

SEQ ID NO: 14914 - RNA, 20 nt, Artificial Sequence
  TRAC targeting sequence
gugaagccugggcguccgcu

SEQ ID NO: 14915 - RNA, 20 nt, Artificial Sequence
  TRAC targeting sequence
ggcuuucugcccuugccgcc

SEQ ID NO: 14916 - RNA, 20 nt, Artificial Sequence
  TRAC targeting sequence
gcccuugccgcccaggaggu

SEQ ID NO: 14917 - RNA, 20 nt, Artificial Sequence
  TRAC targeting sequence
ugggcggcaagggcagaaag

SEQ ID NO: 14918 - RNA, 20 nt, Artificial Sequence
  TRAC targeting sequence
uggcacacaccauccuuagu

SEQ ID NO: 14919 - RNA, 20 nt, Artificial Sequence
  TRAC targeting sequence
uuagugucuugaaagaagag

SEQ ID NO: 14920 - RNA, 20 nt, Artificial Sequence
  TRAC targeting sequence
ugaaagaagagaaauuaaaa

SEQ ID NO: 14921 - RNA, 20 nt, Artificial Sequence
  TRAC targeting sequence
agacacuaaggauggugugu

SEQ ID NO: 14922 - RNA, 20 nt, Artificial Sequence
  TRAC targeting sequence
uucaagacacuaaggauggu

SEQ ID NO: 14923 - RNA, 20 nt, Artificial Sequence
  TRAC targeting sequence
ucuuucaagacacuaaggau

SEQ ID NO: 14924 - RNA, 20 nt, Artificial Sequence
  TRAC targeting sequence
cuucuuucaagacacuaagg

SEQ ID NO: 14925 - RNA, 20 nt, Artificial Sequence
  TRAC targeting sequence
uuuaauuucucuucuuucaa

SEQ ID NO: 14926 - RNA, 20 nt, Artificial Sequence
  TRAC targeting sequence
cuuuuaauuucucuucuuuc

SEQ ID NO: 14927 - RNA, 20 nt, Artificial Sequence
  TRAC targeting sequence
cccuuucucuuuuaauuucu

SEQ ID NO: 14928 - RNA, 20 nt, Artificial Sequence
  TRAC targeting sequence
cauaucaugcaguugccuca

SEQ ID NO: 14929 - RNA, 20 nt, Artificial Sequence
  TRAC targeting sequence
uaucaugcaguugccucauu

SEQ ID NO: 14930 - RNA, 20 nt, Artificial Sequence
  TRAC targeting sequence
ugcaguugccucauuuugua

SEQ ID NO: 14931 - RNA, 20 nt, Artificial Sequence
  TRAC targeting sequence
uuuuguagcaagauuguuuc

SEQ ID NO: 14932 - RNA, 20 nt, Artificial Sequence
  TRAC targeting sequence
ugcuacaaaaugaggcaacu

SEQ ID NO: 14933 - RNA, 20 nt, Artificial Sequence
  TRAC targeting sequence
ccaugagcaguuugucuuca

SEQ ID NO: 14934 - RNA, 20 nt, Artificial Sequence
  TRAC targeting sequence
uggggaaacaaucuugcuac

SEQ ID NO: 14935 - RNA, 20 nt, Artificial Sequence
  TRAC targeting sequence
ucauucagcagcugucuucu

SEQ ID NO: 14936 - RNA, 20 nt, Artificial Sequence
  TRAC targeting sequence
uucagcagcugucuucucug

SEQ ID NO: 14937 - RNA, 20 nt, Artificial Sequence
  TRAC targeting sequence
gcagcugucuucucugggga

SEQ ID NO: 14938 - RNA, 20 nt, Artificial Sequence
  TRAC targeting sequence
ucucuggggaagccauuuug

SEQ ID NO: 14939 - RNA, 20 nt, Artificial Sequence
  TRAC targeting sequence
cuggggaagccauuuuguag

SEQ ID NO: 14940 - RNA, 20 nt, Artificial Sequence
  TRAC targeting sequence
ggggaagccauuuuguagag

SEQ ID NO: 14941 - RNA, 20 nt, Artificial Sequence
  TRAC targeting sequence
ccagagaagacagcugcuga

SEQ ID NO: 14942 - RNA, 20 nt, Artificial Sequence
  TRAC targeting sequence
acaaaauggcuuccccagag

SEQ ID NO: 14943 - RNA, 20 nt, Artificial Sequence
  TRAC targeting sequence
cagugugacaacugacagcu

SEQ ID NO: 14944 - RNA, 20 nt, Artificial Sequence
  TRAC targeting sequence
cacugugacaaacaccucua

SEQ ID NO: 14945 - RNA, 20 nt, Artificial Sequence
  TRAC targeting sequence
guugucacacugugacaaac

SEQ ID NO: 14946 - RNA, 20 nt, Artificial Sequence
  TRAC targeting sequence
cccagcugucaguugucaca

SEQ ID NO: 14947 - RNA, 20 nt, Artificial Sequence
  TRAC targeting sequence
aguuuggagcagggacccag

SEQ ID NO: 14948 - RNA, 20 nt, Artificial Sequence
  TRAC targeting sequence
aaacuggaauuucccccagc

SEQ ID NO: 14949 - RNA, 20 nt, Artificial Sequence
  TRAC targeting sequence
cugcuccaaacuggaauuuc

SEQ ID NO: 14950 - RNA, 20 nt, Artificial Sequence
  TRAC targeting sequence
ccccagguaagccccauucc

SEQ ID NO: 14951 - RNA, 20 nt, Artificial Sequence
  TRAC targeting sequence
cuggagccucaccugcccuu

SEQ ID NO: 14952 - RNA, 20 nt, Artificial Sequence
  TRAC targeting sequence
agggaauggggcuuaccugg

SEQ ID NO: 14953 - RNA, 20 nt, Artificial Sequence
  TRAC targeting sequence
ccugcccuuaguauuuggca

SEQ ID NO: 14954 - RNA, 20 nt, Artificial Sequence
  TRAC targeting sequence
agccgagacuaugagaaaca

SEQ ID NO: 14955 - RNA, 20 nt, Artificial Sequence
  TRAC targeting sequence
gcuagaaauauuuggcaugc

SEQ ID NO: 14956 - RNA, 20 nt, Artificial Sequence
  TRAC targeting sequence
cggcuagaaauauuuggcau

SEQ ID NO: 14957 - RNA, 20 nt, Artificial Sequence
  TRAC targeting sequence
uagucucggcuagaaauauu

SEQ ID NO: 14958 - RNA, 20 nt, Artificial Sequence
  TRAC targeting sequence
cauagucucggcuagaaaua

SEQ ID NO: 14959 - RNA, 20 nt, Artificial Sequence
  TRAC targeting sequence
gaaaggaagccauuucccug

SEQ ID NO: 14960 - RNA, 20 nt, Artificial Sequence
  TRAC targeting sequence
gauguguuucucauagucuc

SEQ ID NO: 14961 - RNA, 20 nt, Artificial Sequence
  TRAC targeting sequence
uuucagauguguuucucaua

SEQ ID NO: 14962 - RNA, 20 nt, Artificial Sequence
  TRAC targeting sequence
cugaacagcaguacccaaag

SEQ ID NO: 14963 - RNA, 20 nt, Artificial Sequence
  TRAC targeting sequence
gggaaauggcuuccuuucag

SEQ ID NO: 14964 - RNA, 20 nt, Artificial Sequence
  TRAC targeting sequence
uuuuugcuuaauggcuuugg

SEQ ID NO: 14965 - RNA, 20 nt, Artificial Sequence
  TRAC targeting sequence
cauuuuugcuuaauggcuuu

SEQ ID NO: 14966 - RNA, 20 nt, Artificial Sequence
  TRAC targeting sequence
cucauuuuugcuuaauggcu

SEQ ID NO: 14967 - RNA, 20 nt, Artificial Sequence
  TRAC targeting sequence
gacugguguuaaauagaaac

SEQ ID NO: 14968 - RNA, 20 nt, Artificial Sequence
  TRAC targeting sequence
gaucucucauuuuugcuuaa

SEQ ID NO: 14969 - RNA, 20 nt, Artificial Sequence
  TRAC targeting sequence
auuuaacaccagucugaucu

SEQ ID NO: 14970 - RNA, 20 nt, Artificial Sequence
  TRAC targeting sequence
aaaaacguuucuauuuaaca

SEQ ID NO: 14971 - RNA, 20 nt, Artificial Sequence
  TRAC targeting sequence
cauuauucucuaucagucuc

SEQ ID NO: 14972 - RNA, 20 nt, Artificial Sequence
  TRAC targeting sequence
uuauucucuaucagucuccu

SEQ ID NO: 14973 - RNA, 20 nt, Artificial Sequence
  TRAC targeting sequence
cuaucagucuccugugugaa

SEQ ID NO: 14974 - RNA, 20 nt, Artificial Sequence
  TRAC targeting sequence
aucagucuccugugugaaua

SEQ ID NO: 14975 - RNA, 20 nt, Artificial Sequence
  TRAC targeting sequence
gucuccugugugaauacccu

SEQ ID NO: 14976 - RNA, 20 nt, Artificial Sequence
  TRAC targeting sequence
ccugugugaauacccuuauu

SEQ ID NO: 14977 - RNA, 20 nt, Artificial Sequence
  TRAC targeting sequence
ugugugaauacccuuauuuc

SEQ ID NO: 14978 - RNA, 20 nt, Artificial Sequence
  TRAC targeting sequence
cacaggagacugauagagaa

SEQ ID NO: 14979 - RNA, 20 nt, Artificial Sequence
  TRAC targeting sequence
cuuauaaggaaaaaaguuac

SEQ ID NO: 14980 - RNA, 20 nt, Artificial Sequence
  TRAC targeting sequence
uuauaagggaaauaagggua

SEQ ID NO: 14981 - RNA, 20 nt, Artificial Sequence
  TRAC targeting sequence
ugcuuauuguaacuuuuuuc

SEQ ID NO: 14982 - RNA, 20 nt, Artificial Sequence
  TRAC targeting sequence
uggcuauccugcuuauugua

SEQ ID NO: 14983 - RNA, 20 nt, Artificial Sequence
  TRAC targeting sequence
ugcuguggugugggagcaau

SEQ ID NO: 14984 - RNA, 20 nt, Artificial Sequence
  TRAC targeting sequence
cacaccacagcaugaaucau

SEQ ID NO: 14985 - RNA, 20 nt, Artificial Sequence
  TRAC targeting sequence
gcuguggauuugggggugga

SEQ ID NO: 14986 - RNA, 20 nt, Artificial Sequence
  TRAC targeting sequence
acagcagauugcucccacac

SEQ ID NO: 14987 - RNA, 20 nt, Artificial Sequence
  TRAC targeting sequence
acccccaaauccacagcaga

SEQ ID NO: 14988 - RNA, 20 nt, Artificial Sequence
  TRAC targeting sequence
uccacccccaaauccacagc

SEQ ID NO: 14989 - RNA, 20 nt, Artificial Sequence
  TRAC targeting sequence
aauccuccacccccaaaucc

SEQ ID NO: 14990 - RNA, 20 nt, Artificial Sequence
  TRAC targeting sequence
ggcagacuggauguguuuuu

SEQ ID NO: 14991 - RNA, 20 nt, Artificial Sequence
  TRAC targeting sequence
gccugaacacauuucuaauc

SEQ ID NO: 14992 - RNA, 20 nt, Artificial Sequence
  TRAC targeting sequence
agucugccugaacacauuuc

SEQ ID NO: 14993 - RNA, 20 nt, Artificial Sequence
  TRAC targeting sequence
aaaacacauccagucugccu

SEQ ID NO: 14994 - RNA, 20 nt, Artificial Sequence
  TRAC targeting sequence
ugucaaaaacacauccaguc

SEQ ID NO: 14995 - RNA, 20 nt, Artificial Sequence
  TRAC targeting sequence
cacuguguuacauauccugu

SEQ ID NO: 14996 - RNA, 20 nt, Artificial Sequence
  TRAC targeting sequence
cugguuauaaaucacacugu

SEQ ID NO: 14997 - RNA, 20 nt, Artificial Sequence
  TRAC targeting sequence
ucccugguuauaaaucacac

SEQ ID NO: 14998 - RNA, 20 nt, Artificial Sequence
  TRAC targeting sequence
ucggacagggaacggaguua

SEQ ID NO: 14999 - RNA, 20 nt, Artificial Sequence
  TRAC targeting sequence
gacagggaacggaguuaucu

SEQ ID NO: 15000 - RNA, 20 nt, Artificial Sequence
  TRAC targeting sequence
gaagauaagcuuuccucccu

SEQ ID NO: 15001 - RNA, 20 nt, Artificial Sequence
  TRAC targeting sequence
cuguccgaagauaagcuuuc

SEQ ID NO: 15002 - RNA, 20 nt, Artificial Sequence
  TRAC targeting sequence
guucccuguccgaagauaag

SEQ ID NO: 15003 - RNA, 20 nt, Artificial Sequence
  TRAC targeting sequence
gugaaacccaguaaguauaa

SEQ ID NO: 15004 - RNA, 20 nt, Artificial Sequence
  TRAC targeting sequence
cagauaacuccguucccugu

SEQ ID NO: 15005 - RNA, 20 nt, Artificial Sequence
  TRAC targeting sequence
cuggauuaagcaaugucugu

SEQ ID NO: 15006 - RNA, 20 nt, Artificial Sequence
  TRAC targeting sequence
agggauacaauuuuauacuu

SEQ ID NO: 15007 - RNA, 20 nt, Artificial Sequence
  TRAC targeting sequence
guggauuaagggcugauuua

SEQ ID NO: 15008 - RNA, 20 nt, Artificial Sequence
  TRAC targeting sequence
acagacauugcuuaauccag

SEQ ID NO: 15009 - RNA, 20 nt, Artificial Sequence
  TRAC targeting sequence
gcccuuaauccacagacauu

SEQ ID NO: 15010 - RNA, 20 nt, Artificial Sequence
  TRAC targeting sequence
aaaucagcccuuaauccaca

SEQ ID NO: 15011 - RNA, 20 nt, Artificial Sequence
  TRAC targeting sequence
uaugguguauaauugggucu

SEQ ID NO: 15012 - RNA, 20 nt, Artificial Sequence
  TRAC targeting sequence
ucauaugguguauaauuggg

SEQ ID NO: 15013 - RNA, 20 nt, Artificial Sequence
  TRAC targeting sequence
aaacauucuucauauggugu

SEQ ID NO: 15014 - RNA, 20 nt, Artificial Sequence
  TRAC targeting sequence
cuaaacauucuucauauggu

SEQ ID NO: 15015 - RNA, 20 nt, Artificial Sequence
  TRAC targeting sequence
cccucucuaaacauucuuca

SEQ ID NO: 15016 - RNA, 20 nt, Artificial Sequence
  TRAC targeting sequence
ucccccucucuaaacauucu

SEQ ID NO: 15017 - RNA, 20 nt, Artificial Sequence
  TRAC targeting sequence
aauaggaagccaaucgucgu

SEQ ID NO: 15018 - RNA, 20 nt, Artificial Sequence
  TRAC targeting sequence
uauuugaugcucaucccccu

SEQ ID NO: 15019 - RNA, 20 nt, Artificial Sequence
  TRAC targeting sequence
ucguccuggcuaggaucuag

SEQ ID NO: 15020 - RNA, 20 nt, Artificial Sequence
  TRAC targeting sequence
uccuggcuaggaucuagcau

SEQ ID NO: 15021 - RNA, 20 nt, Artificial Sequence
  TRAC targeting sequence
uggcuaggaucuagcaucuc

SEQ ID NO: 15022 - RNA, 20 nt, Artificial Sequence
  TRAC targeting sequence
uagccaggacgacgauuggc

SEQ ID NO: 15023 - RNA, 20 nt, Artificial Sequence
  TRAC targeting sequence
agcaucucagugcaaaaugg

SEQ ID NO: 15024 - RNA, 20 nt, Artificial Sequence
  TRAC targeting sequence
cagugcaaaaugggcuaugu

SEQ ID NO: 15025 - RNA, 20 nt, Artificial Sequence
  TRAC targeting sequence
gugcaaaaugggcuauguaa

SEQ ID NO: 15026 - RNA, 20 nt, Artificial Sequence
  TRAC targeting sequence
gggaauugcuccugaauaua

SEQ ID NO: 15027 - RNA, 20 nt, Artificial Sequence
  TRAC targeting sequence
cagaggcacacuuacauagc

SEQ ID NO: 15028 - RNA, 20 nt, Artificial Sequence
  TRAC targeting sequence
ugaauauauguguugggacu

SEQ ID NO: 15029 - RNA, 20 nt, Artificial Sequence
  TRAC targeting sequence
ggagcaauucccagaggcac

SEQ ID NO: 15030 - RNA, 20 nt, Artificial Sequence
  TRAC targeting sequence
caacacauauauucaggagc

SEQ ID NO: 15031 - RNA, 20 nt, Artificial Sequence
  TRAC targeting sequence
uacauuuuagucccaacaca

SEQ ID NO: 15032 - RNA, 20 nt, Artificial Sequence
  TRAC targeting sequence
cagccaauacaacaaguagc

SEQ ID NO: 15033 - RNA, 20 nt, Artificial Sequence
  TRAC targeting sequence
uaucccuggauuugugcagu

SEQ ID NO: 15034 - RNA, 20 nt, Artificial Sequence
  TRAC targeting sequence
cuggauuugugcaguaauug

SEQ ID NO: 15035 - RNA, 20 nt, Artificial Sequence
  TRAC targeting sequence
agggauaugaucccagccaa

SEQ ID NO: 15036 - RNA, 20 nt, Artificial Sequence
  TRAC targeting sequence
ccaauuacugcacaaaucca

SEQ ID NO: 15037 - RNA, 20 nt, Artificial Sequence
  TRAC targeting sequence
ugucaccaauuacugcacaa

SEQ ID NO: 15038 - RNA, 20 nt, Artificial Sequence
  TRAC targeting sequence
aauuccuuaacaaaccuucu

SEQ ID NO: 15039 - RNA, 20 nt, Artificial Sequence
  TRAC targeting sequence
uuaacaaaccuucuaaggca

SEQ ID NO: 15040 - RNA, 20 nt, Artificial Sequence
  TRAC targeting sequence
aaggcacuauucuauuuggc

SEQ ID NO: 15041 - RNA, 20 nt, Artificial Sequence
  TRAC targeting sequence
auuuggcuaagauuauguca

SEQ ID NO: 15042 - RNA, 20 nt, Artificial Sequence
  TRAC targeting sequence
uagccaaauagaauagugcc

SEQ ID NO: 15043 - RNA, 20 nt, Artificial Sequence
  TRAC targeting sequence
auuuauagaaggaaagaacc

SEQ ID NO: 15044 - RNA, 20 nt, Artificial Sequence
  TRAC targeting sequence
auaaauugacauaaucuuag

SEQ ID NO: 15045 - RNA, 20 nt, Artificial Sequence
  TRAC targeting sequence
uucuauaaauugacauaauc

SEQ ID NO: 15046 - RNA, 20 nt, Artificial Sequence
  TRAC targeting sequence
uuccuucuauaaauugacau

SEQ ID NO: 15047 - RNA, 20 nt, Artificial Sequence
  TRAC targeting sequence
uuauuuacaagguucuuucc

SEQ ID NO: 15048 - RNA, 20 nt, Artificial Sequence
  TRAC targeting sequence
uuaaccaaaaguaaugugau

SEQ ID NO: 15049 - RNA, 20 nt, Artificial Sequence
  TRAC targeting sequence
cauuacuuuugguuaaugau

SEQ ID NO: 15050 - RNA, 20 nt, Artificial Sequence
  TRAC targeting sequence
cucucaaagucugaaaaacc

SEQ ID NO: 15051 - RNA, 20 nt, Artificial Sequence
  TRAC targeting sequence
cucaaagucugaaaaaccac

SEQ ID NO: 15052 - RNA, 20 nt, Artificial Sequence
  TRAC targeting sequence
caaagucugaaaaaccacuu

SEQ ID NO: 15053 - RNA, 20 nt, Artificial Sequence
  TRAC targeting sequence
aagucugaaaaaccacuuuu

SEQ ID NO: 15054 - RNA, 20 nt, Artificial Sequence
  TRAC targeting sequence
gaaaaaccacuuuuuuuuaa

SEQ ID NO: 15055 - RNA, 20 nt, Artificial Sequence
  TRAC targeting sequence
gacuuugagagagacuaauc

SEQ ID NO: 15056 - RNA, 20 nt, Artificial Sequence
  TRAC targeting sequence
ugacuacugagggacacuuc

SEQ ID NO: 15057 - RNA, 20 nt, Artificial Sequence
  TRAC targeting sequence
ugaguaaacuuuuuaaaaaa

SEQ ID NO: 15058 - RNA, 20 nt, Artificial Sequence
  TRAC targeting sequence
guagucaugaguaaacuuuu

SEQ ID NO: 15059 - RNA, 20 nt, Artificial Sequence
  TRAC targeting sequence
cucaguagucaugaguaaac

SEQ ID NO: 15060 - RNA, 20 nt, Artificial Sequence
  TRAC targeting sequence
uguuucugagacuuucagcc

SEQ ID NO: 15061 - RNA, 20 nt, Artificial Sequence
  TRAC targeting sequence
gagacuuucagccaaaaauu

SEQ ID NO: 15062 - RNA, 20 nt, Artificial Sequence
  TRAC targeting sequence
gaaacaggaagugucccuca

SEQ ID NO: 15063 - RNA, 20 nt, Artificial Sequence
  TRAC targeting sequence
cagaaacaggaagugucccu

SEQ ID NO: 15064 - RNA, 20 nt, Artificial Sequence
  TRAC targeting sequence
gccaaaaauucguacagcgu

SEQ ID NO: 15065 - RNA, 20 nt, Artificial Sequence
  TRAC targeting sequence
uacagcguagccucacggag

SEQ ID NO: 15066 - RNA, 20 nt, Artificial Sequence
  TRAC targeting sequence
cggagcagagagaaccuuga

SEQ ID NO: 15067 - RNA, 20 nt, Artificial Sequence
  TRAC targeting sequence
gugaggcuacgcuguacgaa

SEQ ID NO: 15068 - RNA, 20 nt, Artificial Sequence
  TRAC targeting sequence
gcuccgugaggcuacgcugu

SEQ ID NO: 15069 - RNA, 20 nt, Artificial Sequence
  TRAC targeting sequence
cugcuccgugaggcuacgcu

SEQ ID NO: 15070 - RNA, 20 nt, Artificial Sequence
  TRAC targeting sequence
cucugcuccgugaggcuacg

SEQ ID NO: 15071 - RNA, 20 nt, Artificial Sequence
  TRAC targeting sequence
agguucucucugcuccguga

SEQ ID NO: 15072 - RNA, 20 nt, Artificial Sequence
  TRAC targeting sequence
uuuuugacuuucuccaugga

SEQ ID NO: 15073 - RNA, 20 nt, Artificial Sequence
  TRAC targeting sequence
aaaaggaauguugucaaggu

SEQ ID NO: 15074 - RNA, 20 nt, Artificial Sequence
  TRAC targeting sequence
ccauggaugagaaaacugag

SEQ ID NO: 15075 - RNA, 20 nt, Artificial Sequence
  TRAC targeting sequence
auggaugagaaaacugaggc

SEQ ID NO: 15076 - RNA, 20 nt, Artificial Sequence
  TRAC targeting sequence
auggagaaagucaaaaagga

SEQ ID NO: 15077 - RNA, 20 nt, Artificial Sequence
  TRAC targeting sequence
uccauggagaaagucaaaaa

SEQ ID NO: 15078 - RNA, 20 nt, Artificial Sequence
  TRAC targeting sequence
cauccauggagaaagucaaa

SEQ ID NO: 15079 - RNA, 20 nt, Artificial Sequence
  TRAC targeting sequence
guuuucucauccauggagaa

SEQ ID NO: 15080 - RNA, 20 nt, Artificial Sequence
  TRAC targeting sequence
gggaagagacagaucccggc

SEQ ID NO: 15081 - RNA, 20 nt, Artificial Sequence
  TRAC targeting sequence
cugagccucaguuuucucau

SEQ ID NO: 15082 - RNA, 20 nt, Artificial Sequence
  TRAC targeting sequence
ucccugagccucaguuuucu

SEQ ID NO: 15083 - RNA, 20 nt, Artificial Sequence
  TRAC targeting sequence
cuucccugagccucaguuuu

SEQ ID NO: 15084 - RNA, 20 nt, Artificial Sequence
  TRAC targeting sequence
gucucuucccugagccucag

SEQ ID NO: 15085 - RNA, 20 nt, Artificial Sequence
  TRAC targeting sequence
cggccccacagccagucuau

SEQ ID NO: 15086 - RNA, 20 nt, Artificial Sequence
  TRAC targeting sequence
auggcugagcuagaacuaga

SEQ ID NO: 15087 - RNA, 20 nt, Artificial Sequence
  TRAC targeting sequence
gccauagacuggcugugggg

SEQ ID NO: 15088 - RNA, 20 nt, Artificial Sequence
  TRAC targeting sequence
agcucagccauagacuggcu

SEQ ID NO: 15089 - RNA, 20 nt, Artificial Sequence
  TRAC targeting sequence
aguucuagcucagccauaga

SEQ ID NO: 15090 - RNA, 20 nt, Artificial Sequence
  TRAC targeting sequence
cuaauuugccaaaccuguca

SEQ ID NO: 15091 - RNA, 20 nt, Artificial Sequence
  TRAC targeting sequence
aauuugccaaaccugucagu

SEQ ID NO: 15092 - RNA, 20 nt, Artificial Sequence
  TRAC targeting sequence
guuggcucaaacuugaaguu

SEQ ID NO: 15093 - RNA, 20 nt, Artificial Sequence
  TRAC targeting sequence
aacuugaaguuugaagaguc

SEQ ID NO: 15094 - RNA, 20 nt, Artificial Sequence
  TRAC targeting sequence
aguuugagccaacugacagg

SEQ ID NO: 15095 - RNA, 20 nt, Artificial Sequence
  TRAC targeting sequence
aacuucaaguuugagccaac

SEQ ID NO: 15096 - RNA, 20 nt, Artificial Sequence
  TRAC targeting sequence
ucaaacuucaaguuugagcc

SEQ ID NO: 15097 - RNA, 20 nt, Artificial Sequence
  TRAC targeting sequence
gcaagauucaucugacaaau

SEQ ID NO: 15098 - RNA, 20 nt, Artificial Sequence
  TRAC targeting sequence
ugcggacucuucaaacuuca

SEQ ID NO: 15099 - RNA, 20 nt, Artificial Sequence
  TRAC targeting sequence
ucugacaaauauuuucaugu

SEQ ID NO: 15100 - RNA, 20 nt, Artificial Sequence
  TRAC targeting sequence
gacaaauauuuucauguacu

SEQ ID NO: 15101 - RNA, 20 nt, Artificial Sequence
  TRAC targeting sequence
gaugaaucuugcggacucuu

SEQ ID NO: 15102 - RNA, 20 nt, Artificial Sequence
  TRAC targeting sequence
uguacuugcccucugccagg

SEQ ID NO: 15103 - RNA, 20 nt, Artificial Sequence
  TRAC targeting sequence
gccaggcucguugcugaaac

SEQ ID NO: 15104 - RNA, 20 nt, Artificial Sequence
  TRAC targeting sequence
uugcugaaaccagggaucca

SEQ ID NO: 15105 - RNA, 20 nt, Artificial Sequence
  TRAC targeting sequence
gcaacgagccuggcagaggg

SEQ ID NO: 15106 - RNA, 20 nt, Artificial Sequence
  TRAC targeting sequence
cugguuucagcaacgagccu

SEQ ID NO: 15107 - RNA, 20 nt, Artificial Sequence
  TRAC targeting sequence
aacaggaagcaaacucagug

SEQ ID NO: 15108 - RNA, 20 nt, Artificial Sequence
  TRAC targeting sequence
uguuggaucccugguuucag

SEQ ID NO: 15109 - RNA, 20 nt, Artificial Sequence
  TRAC targeting sequence
gugugauauugccuucauga

SEQ ID NO: 15110 - RNA, 20 nt, Artificial Sequence
  TRAC targeting sequence
cacugaguuugcuuccuguu

SEQ ID NO: 15111 - RNA, 20 nt, Artificial Sequence
  TRAC targeting sequence
ugaaacuuacauucuggagg

SEQ ID NO: 15112 - RNA, 20 nt, Artificial Sequence
  TRAC targeting sequence
ugaaggcaauaucacacuga

SEQ ID NO: 15113 - RNA, 20 nt, Artificial Sequence
  TRAC targeting sequence
ggagguggauuccauguuuc

SEQ ID NO: 15114 - RNA, 20 nt, Artificial Sequence
  TRAC targeting sequence
agaauguaaguuucaugaag

SEQ ID NO: 15115 - RNA, 20 nt, Artificial Sequence
  TRAC targeting sequence
accuccagaauguaaguuuc

SEQ ID NO: 15116 - RNA, 20 nt, Artificial Sequence
  TRAC targeting sequence
auguuucuucccagauauga

SEQ ID NO: 15117 - RNA, 20 nt, Artificial Sequence
  TRAC targeting sequence
ucccagauaugacaaugcuu

SEQ ID NO: 15118 - RNA, 20 nt, Artificial Sequence
  TRAC targeting sequence
cagauaugacaaugcuuacc

SEQ ID NO: 15119 - RNA, 20 nt, Artificial Sequence
  TRAC targeting sequence
gggaagaaacauggaaucca

SEQ ID NO: 15120 - RNA, 20 nt, Artificial Sequence
  TRAC targeting sequence
uaucugggaagaaacaugga

SEQ ID NO: 15121 - RNA, 20 nt, Artificial Sequence
  TRAC targeting sequence
ggguaagcauugucauaucu

SEQ ID NO: 15122 - RNA, 20 nt, Artificial Sequence
  TRAC targeting sequence
cuugggcauggcucucuuau

SEQ ID NO: 15123 - RNA, 20 nt, Artificial Sequence
  TRAC targeting sequence
ugggcauggcucucuuauac

SEQ ID NO: 15124 - RNA, 20 nt, Artificial Sequence
  TRAC targeting sequence
cuuauacuaucaucacuucc

SEQ ID NO: 15125 - RNA, 20 nt, Artificial Sequence
  TRAC targeting sequence
uauacuaucaucacuuccuu

SEQ ID NO: 15126 - RNA, 20 nt, Artificial Sequence
  TRAC targeting sequence
ucacuuccuuaggaaauacu

SEQ ID NO: 15127 - RNA, 20 nt, Artificial Sequence
  TRAC targeting sequence
cuuccuuaggaaauacuaaa

SEQ ID NO: 15128 - RNA, 20 nt, Artificial Sequence
  TRAC targeting sequence
uuaggaaauacuaaaacuaa

SEQ ID NO: 15129 - RNA, 20 nt, Artificial Sequence
  TRAC targeting sequence
uaaggaagugaugauaguau

SEQ ID NO: 15130 - RNA, 20 nt, Artificial Sequence
  TRAC targeting sequence
uugagcagauaacuaacaca

SEQ ID NO: 15131 - RNA, 20 nt, Artificial Sequence
  TRAC targeting sequence
aggacuuuaaacugcagcaa

SEQ ID NO: 15132 - RNA, 20 nt, Artificial Sequence
  TRAC targeting sequence
gcucaaggacuuuaaacugc

SEQ ID NO: 15133 - RNA, 20 nt, Artificial Sequence
  TRAC targeting sequence
ggagaagggaaaugcccaaa

SEQ ID NO: 15134 - RNA, 20 nt, Artificial Sequence
  TRAC targeting sequence
ugacuaaagugguaugugug

SEQ ID NO: 15135 - RNA, 20 nt, Artificial Sequence
  TRAC targeting sequence
ccugacuaaagugguaugug

SEQ ID NO: 15136 - RNA, 20 nt, Artificial Sequence
  TRAC targeting sequence
cuucuccugacuaaaguggu

SEQ ID NO: 15137 - RNA, 20 nt, Artificial Sequence
  TRAC targeting sequence
cuuuugggcauuucccuucu

SEQ ID NO: 15138 - RNA, 20 nt, Artificial Sequence
  TRAC targeting sequence
acuucacuuuugggcauuuc

SEQ ID NO: 15139 - RNA, 20 nt, Artificial Sequence
  TRAC targeting sequence
uaguuuucuacuucacuuuu

SEQ ID NO: 15140 - RNA, 20 nt, Artificial Sequence
  TRAC targeting sequence
gauaauugauuauuauaaag

SEQ ID NO: 15141 - RNA, 20 nt, Artificial Sequence
  TRAC targeting sequence
gacaaauuccuaguuuucua

SEQ ID NO: 15142 - RNA, 20 nt, Artificial Sequence
  TRAC targeting sequence
auuaucagacaaauuccuag

SEQ ID NO: 15143 - RNA, 20 nt, Artificial Sequence
  TRAC targeting sequence
gugugaaaugaguggccaaa

SEQ ID NO: 15144 - RNA, 20 nt, Artificial Sequence
  TRAC targeting sequence
cacugauaaaauaacuuuau

SEQ ID NO: 15145 - RNA, 20 nt, Artificial Sequence
  TRAC targeting sequence
uuucacacugauaaaauaac

SEQ ID NO: 15146 - RNA, 20 nt, Artificial Sequence
  TRAC targeting sequence
aguuaauuuggccacucauu

SEQ ID NO: 15147 - RNA, 20 nt, Artificial Sequence
  TRAC targeting sequence
guaccuaccucacuuugauu

SEQ ID NO: 15148 - RNA, 20 nt, Artificial Sequence
  TRAC targeting sequence
cuuugauucuauagacucag

SEQ ID NO: 15149 - RNA, 20 nt, Artificial Sequence
  TRAC targeting sequence
aagugagguagguacagagc

SEQ ID NO: 15150 - RNA, 20 nt, Artificial Sequence
  TRAC targeting sequence
auagacucagucucaggagg

SEQ ID NO: 15151 - RNA, 20 nt, Artificial Sequence
  TRAC targeting sequence
auagaaucaaagugagguag

SEQ ID NO: 15152 - RNA, 20 nt, Artificial Sequence
  TRAC targeting sequence
gucucaggaggauucaagaa

SEQ ID NO: 15153 - RNA, 20 nt, Artificial Sequence
  TRAC targeting sequence
caggaggauucaagaauuca

SEQ ID NO: 15154 - RNA, 20 nt, Artificial Sequence
  TRAC targeting sequence
ggaggauucaagaauucaga

SEQ ID NO: 15155 - RNA, 20 nt, Artificial Sequence
  TRAC targeting sequence
ugagacugagucuauagaau

SEQ ID NO: 15156 - RNA, 20 nt, Artificial Sequence
  TRAC targeting sequence
uccugagacugagucuauag

SEQ ID NO: 15157 - RNA, 20 nt, Artificial Sequence
  TRAC targeting sequence
agaauucagacaguucucug

SEQ ID NO: 15158 - RNA, 20 nt, Artificial Sequence
  TRAC targeting sequence
ugaauccuccugagacugag

SEQ ID NO: 15159 - RNA, 20 nt, Artificial Sequence
  TRAC targeting sequence
gacaguucucugaugacaua

SEQ ID NO: 15160 - RNA, 20 nt, Artificial Sequence
  TRAC targeting sequence
gaauucuugaauccuccuga

SEQ ID NO: 15161 - RNA, 20 nt, Artificial Sequence
  TRAC targeting sequence
cugaugacauaauccaguga

SEQ ID NO: 15162 - RNA, 20 nt, Artificial Sequence
  TRAC targeting sequence
gaugacauaauccagugaug

SEQ ID NO: 15163 - RNA, 20 nt, Artificial Sequence
  TRAC targeting sequence
gagaacugucugaauucuug

SEQ ID NO: 15164 - RNA, 20 nt, Artificial Sequence
  TRAC targeting sequence
ucagagaacugucugaauuc

SEQ ID NO: 15165 - RNA, 20 nt, Artificial Sequence
  TRAC targeting sequence
agugaugcccacaacagagg

SEQ ID NO: 15166 - RNA, 20 nt, Artificial Sequence
  TRAC targeting sequence
cuggauuaugucaucagaga

SEQ ID NO: 15167 - RNA, 20 nt, Artificial Sequence
  TRAC targeting sequence
guugugggcaucacuggauu

SEQ ID NO: 15168 - RNA, 20 nt, Artificial Sequence
  TRAC targeting sequence
ucuguugugggcaucacugg

SEQ ID NO: 15169 - RNA, 20 nt, Artificial Sequence
  TRAC targeting sequence
cuauucuggacuuugugagu

SEQ ID NO: 15170 - RNA, 20 nt, Artificial Sequence
  TRAC targeting sequence
auucuggacuuugugagucu

SEQ ID NO: 15171 - RNA, 20 nt, Artificial Sequence
  TRAC targeting sequence
ggacuuugugagucuccuug

SEQ ID NO: 15172 - RNA, 20 nt, Artificial Sequence
  TRAC targeting sequence
agaauagagaauacgccucc

SEQ ID NO: 15173 - RNA, 20 nt, Artificial Sequence
  TRAC targeting sequence
caaaguccagaauagagaau

SEQ ID NO: 15174 - RNA, 20 nt, Artificial Sequence
  TRAC targeting sequence
ccuuggaugaaaagauucaa

SEQ ID NO: 15175 - RNA, 20 nt, Artificial Sequence
  TRAC targeting sequence
uuggaugaaaagauucaagu

SEQ ID NO: 15176 - RNA, 20 nt, Artificial Sequence
  TRAC targeting sequence
aaggagacucacaaagucca

SEQ ID NO: 15177 - RNA, 20 nt, Artificial Sequence
  TRAC targeting sequence
uccaaggagacucacaaagu

SEQ ID NO: 15178 - RNA, 20 nt, Artificial Sequence
  TRAC targeting sequence
uuucauccaaggagacucac

SEQ ID NO: 15179 - RNA, 20 nt, Artificial Sequence
  TRAC targeting sequence
agugcuguuuugacaccuaa

SEQ ID NO: 15180 - RNA, 20 nt, Artificial Sequence
  TRAC targeting sequence
aaacagcacuugaaucuuuu

SEQ ID NO: 15181 - RNA, 20 nt, Artificial Sequence
  TRAC targeting sequence
gagaguauuugcucuauaca

SEQ ID NO: 15182 - RNA, 20 nt, Artificial Sequence
  TRAC targeting sequence
gauuuuaggugucaaaacag

SEQ ID NO: 15183 - RNA, 20 nt, Artificial Sequence
  TRAC targeting sequence
cugauuuuaggugucaaaac

SEQ ID NO: 15184 - RNA, 20 nt, Artificial Sequence
  TRAC targeting sequence
auacauauaucgaaaauaca

SEQ ID NO: 15185 - RNA, 20 nt, Artificial Sequence
  TRAC targeting sequence
aaaauacacaguuaauguuu

SEQ ID NO: 15186 - RNA, 20 nt, Artificial Sequence
  TRAC targeting sequence
auauauguauagagcaaaua

SEQ ID NO: 15187 - RNA, 20 nt, Artificial Sequence
  TRAC targeting sequence
aaacauuaacuguguauuuu

SEQ ID NO: 15188 - RNA, 20 nt, Artificial Sequence
  TRAC targeting sequence
acuacaaaguucuaaacauu

SEQ ID NO: 15189 - RNA, 20 nt, Artificial Sequence
  TRAC targeting sequence
acuuuccacuacaaaguucu

SEQ ID NO: 15190 - RNA, 20 nt, Artificial Sequence
  TRAC targeting sequence
ccuaaaagaaaaugggauug

SEQ ID NO: 15191 - RNA, 20 nt, Artificial Sequence
  TRAC targeting sequence
uuuaggggaccuuugcuuuc

SEQ ID NO: 15192 - RNA, 20 nt, Artificial Sequence
  TRAC targeting sequence
cauuuucuuuuaggggaccu

SEQ ID NO: 15193 - RNA, 20 nt, Artificial Sequence
  TRAC targeting sequence
uuacaaucccauuuucuuuu

SEQ ID NO: 15194 - RNA, 20 nt, Artificial Sequence
  TRAC targeting sequence
ucuuuacaaucccauuuucu

SEQ ID NO: 15195 - RNA, 20 nt, Artificial Sequence
  TRAC targeting sequence
uucgucuuuacaaucccauu

SEQ ID NO: 15196 - RNA, 20 nt, Artificial Sequence
  TRAC targeting sequence
uaaacuaacccuccuucguc

SEQ ID NO: 15197 - RNA, 20 nt, Artificial Sequence
  TRAC targeting sequence
acaaauccuaaacuaacccu

SEQ ID NO: 15198 - RNA, 20 nt, Artificial Sequence
  TRAC targeting sequence
guuuggcuacuccagaccaa

SEQ ID NO: 15199 - RNA, 20 nt, Artificial Sequence
  TRAC targeting sequence
agaccaaaccuagauuaaca

SEQ ID NO: 15200 - RNA, 20 nt, Artificial Sequence
  TRAC targeting sequence
ggaguagccaaacugacuuu

SEQ ID NO: 15201 - RNA, 20 nt, Artificial Sequence
  TRAC targeting sequence
agguuuggucuggaguagcc

SEQ ID NO: 15202 - RNA, 20 nt, Artificial Sequence
  TRAC targeting sequence
cuguuaaucuagguuugguc

SEQ ID NO: 15203 - RNA, 20 nt, Artificial Sequence
  TRAC targeting sequence
uaaaggaagcacugccagcu

SEQ ID NO: 15204 - RNA, 20 nt, Artificial Sequence
  TRAC targeting sequence
uuuaugaauuaggccugcau

SEQ ID NO: 15205 - RNA, 20 nt, Artificial Sequence
  TRAC targeting sequence
uuauucagugcuuugccaac

SEQ ID NO: 15206 - RNA, 20 nt, Artificial Sequence
  TRAC targeting sequence
gugcuuugccaaccuggccu

SEQ ID NO: 15207 - RNA, 20 nt, Artificial Sequence
  TRAC targeting sequence
aacaggccagguuggcaaag

SEQ ID NO: 15208 - RNA, 20 nt, Artificial Sequence
  TRAC targeting sequence
gguuuuuguuguugagcaaa

SEQ ID NO: 15209 - RNA, 20 nt, Artificial Sequence
  TRAC targeting sequence
acaacaaaaaccagaucaaa

SEQ ID NO: 15210 - RNA, 20 nt, Artificial Sequence
  TRAC targeting sequence
uaguguuucuucugguucug

SEQ ID NO: 15211 - RNA, 20 nt, Artificial Sequence
  TRAC targeting sequence
ucugguucugcaaggcaacu

SEQ ID NO: 15212 - RNA, 20 nt, Artificial Sequence
  TRAC targeting sequence
gguucugcaaggcaacugac

SEQ ID NO: 15213 - RNA, 20 nt, Artificial Sequence
  TRAC targeting sequence
gcaaggcaacugaccuuugg

SEQ ID NO: 15214 - RNA, 20 nt, Artificial Sequence
  TRAC targeting sequence
guugccuugcagaaccagaa

SEQ ID NO: 15215 - RNA, 20 nt, Artificial Sequence
  TRAC targeting sequence
aaaggucaguugccuugcag

SEQ ID NO: 15216 - RNA, 20 nt, Artificial Sequence
  TRAC targeting sequence
gggacacaauugacuguuuu

SEQ ID NO: 15217 - RNA, 20 nt, Artificial Sequence
  TRAC targeting sequence
cagauccaaaggucaguugc

SEQ ID NO: 15218 - RNA, 20 nt, Artificial Sequence
  TRAC targeting sequence
auugugucccagauccaaag

SEQ ID NO: 15219 - RNA, 20 nt, Artificial Sequence
  TRAC targeting sequence
auuaaauacuauuugcacug

SEQ ID NO: 15220 - RNA, 20 nt, Artificial Sequence
  TRAC targeting sequence
gugcaaauaguauuuaauug

SEQ ID NO: 15221 - RNA, 20 nt, Artificial Sequence
  TRAC targeting sequence
acaaauguauucuguacaug

SEQ ID NO: 15222 - RNA, 20 nt, Artificial Sequence
  TRAC targeting sequence
guacauguaacuuaaugggc

SEQ ID NO: 15223 - RNA, 20 nt, Artificial Sequence
  TRAC targeting sequence
ggcccauuaaguuacaugua

SEQ ID NO: 15224 - RNA, 20 nt, Artificial Sequence
  TRAC targeting sequence
accucaggcccauuaaguua

SEQ ID NO: 15225 - RNA, 20 nt, Artificial Sequence
  TRAC targeting sequence
ucaaccucaggcccauuaag

SEQ ID NO: 15226 - RNA, 20 nt, Artificial Sequence
  TRAC targeting sequence
ccaucuucaaccucaggccc

SEQ ID NO: 15227 - RNA, 20 nt, Artificial Sequence
  TRAC targeting sequence
ccccaucuucaaccucaggc

SEQ ID NO: 15228 - RNA, 20 nt, Artificial Sequence
  TRAC targeting sequence
cuccccaucuucaaccucag

SEQ ID NO: 15229 - RNA, 20 nt, Artificial Sequence
  TRAC targeting sequence
aguaugcauuguugcugucu

SEQ ID NO: 15230 - RNA, 20 nt, Artificial Sequence
  TRAC targeting sequence
cauuacccuuucuaguaugc

SEQ ID NO: 15231 - RNA, 20 nt, Artificial Sequence
  TRAC targeting sequence
gcucgcauuacccuuucuag

SEQ ID NO: 15232 - RNA, 20 nt, Artificial Sequence
  TRAC targeting sequence
cugcucgcauuacccuuucu

SEQ ID NO: 15233 - RNA, 20 nt, Artificial Sequence
  TRAC targeting sequence
gagaccaagaagagaaagag

SEQ ID NO: 15234 - RNA, 20 nt, Artificial Sequence
  TRAC targeting sequence
gauaaauaauucucugcucg

SEQ ID NO: 15235 - RNA, 20 nt, Artificial Sequence
  TRAC targeting sequence
cugauaaauaauucucugcu

SEQ ID NO: 15236 - RNA, 20 nt, Artificial Sequence
  TRAC targeting sequence
uggucucugauaaauaauuc

SEQ ID NO: 15237 - RNA, 20 nt, Artificial Sequence
  TRAC targeting sequence
ucuuggucucugauaaauaa

SEQ ID NO: 15238 - RNA, 20 nt, Artificial Sequence
  TRAC targeting sequence
cuucuuggucucugauaaau

SEQ ID NO: 15239 - RNA, 20 nt, Artificial Sequence
  TRAC targeting sequence
uucucuucuuggucucugau

SEQ ID NO: 15240 - RNA, 20 nt, Artificial Sequence
  TRAC targeting sequence
cuuucucuucuuggucucug

SEQ ID NO: 15241 - RNA, 20 nt, Artificial Sequence
  TRAC targeting sequence
uauuacuaaaagccuuagca

SEQ ID NO: 15242 - RNA, 20 nt, Artificial Sequence
  TRAC targeting sequence
uuaacuccuauuacuaaaag

SEQ ID NO: 15243 - RNA, 20 nt, Artificial Sequence
  TRAC targeting sequence
uuuucauuaacuccuauuac

SEQ ID NO: 15244 - RNA, 20 nt, Artificial Sequence
  TRAC targeting sequence
auucauuuucauuaacuccu

SEQ ID NO: 15245 - RNA, 20 nt, Artificial Sequence
  TRAC targeting sequence
uuuuaacuuagaagaauugc

SEQ ID NO: 15246 - RNA, 20 nt, Artificial Sequence
  TRAC targeting sequence
aaguuaaaaugaaauuuuuu

SEQ ID NO: 15247 - RNA, 20 nt, Artificial Sequence
  TRAC targeting sequence
ucuaaguuaaaaugaaauuu

SEQ ID NO: 15248 - RNA, 20 nt, Artificial Sequence
  TRAC targeting sequence
gcaauucuucuaaguuaaaa

SEQ ID NO: 15249 - RNA, 20 nt, Artificial Sequence
  TRAC targeting sequence
cauuauucagcaauucuucu

SEQ ID NO: 15250 - RNA, 20 nt, Artificial Sequence
  TRAC targeting sequence
guucccauuauucagcaauu

SEQ ID NO: 15251 - RNA, 20 nt, Artificial Sequence
  TRAC targeting sequence
auaaggggaaccucugcuuc

SEQ ID NO: 15252 - RNA, 20 nt, Artificial Sequence
  TRAC targeting sequence
ccuuauggaaucuguuccca

SEQ ID NO: 15253 - RNA, 20 nt, Artificial Sequence
  TRAC targeting sequence
gcuucugaaaauauuugcac

SEQ ID NO: 15254 - RNA, 20 nt, Artificial Sequence
  TRAC targeting sequence
gaaaauauuugcacuaggac

SEQ ID NO: 15255 - RNA, 20 nt, Artificial Sequence
  TRAC targeting sequence
gaagcagagguuccccuuau

SEQ ID NO: 15256 - RNA, 20 nt, Artificial Sequence
  TRAC targeting sequence
uagugcaaauauuuucagaa

SEQ ID NO: 15257 - RNA, 20 nt, Artificial Sequence
  TRAC targeting sequence
cacaccaagucuaguugguc

SEQ ID NO: 15258 - RNA, 20 nt, Artificial Sequence
  TRAC targeting sequence
caccaagucuaguuggucac

SEQ ID NO: 15259 - RNA, 20 nt, Artificial Sequence
  TRAC targeting sequence
aguuggucacuuacauuuuu

SEQ ID NO: 15260 - RNA, 20 nt, Artificial Sequence
  TRAC targeting sequence
cuuacauuuuuagccuauuc

SEQ ID NO: 15261 - RNA, 20 nt, Artificial Sequence
  TRAC targeting sequence
aguagcuauuucuaaauaag

SEQ ID NO: 15262 - RNA, 20 nt, Artificial Sequence
  TRAC targeting sequence
aaauaagucuuuaaacauag

SEQ ID NO: 15263 - RNA, 20 nt, Artificial Sequence
  TRAC targeting sequence
uuaaacauagaggugccuau

SEQ ID NO: 15264 - RNA, 20 nt, Artificial Sequence
  TRAC targeting sequence
auguuuaaagacuuauuuag

SEQ ID NO: 15265 - RNA, 20 nt, Artificial Sequence
  TRAC targeting sequence
uaaauauaggcaccucuaug

SEQ ID NO: 15266 - RNA, 20 nt, Artificial Sequence
  TRAC targeting sequence
uuuaaauaucuuaaauauag

SEQ ID NO: 15267 - RNA, 20 nt, Artificial Sequence
  TRAC targeting sequence
auuucuauagcucucuggug

SEQ ID NO: 15268 - RNA, 20 nt, Artificial Sequence
  TRAC targeting sequence
auagcucucuggugcccuuc

SEQ ID NO: 15269 - RNA, 20 nt, Artificial Sequence
  TRAC targeting sequence
cuggugcccuuccagcaaag

SEQ ID NO: 15270 - RNA, 20 nt, Artificial Sequence
  TRAC targeting sequence
ggugcccuuccagcaaagca

SEQ ID NO: 15271 - RNA, 20 nt, Artificial Sequence
  TRAC targeting sequence
agcaaagcauugcuguaaca

SEQ ID NO: 15272 - RNA, 20 nt, Artificial Sequence
  TRAC targeting sequence
uuucuacaagugagaacaag

SEQ ID NO: 15273 - RNA, 20 nt, Artificial Sequence
  TRAC targeting sequence
acaagugagaacaaguaagc

SEQ ID NO: 15274 - RNA, 20 nt, Artificial Sequence
  TRAC targeting sequence
cuuguagaaaugauaagcaa

SEQ ID NO: 15275 - RNA, 20 nt, Artificial Sequence
  TRAC targeting sequence
cacuuguagaaaugauaagc

SEQ ID NO: 15276 - RNA, 20 nt, Artificial Sequence
  TRAC targeting sequence
aaaauugcaugaguauuaua

SEQ ID NO: 15277 - RNA, 20 nt, Artificial Sequence
  TRAC targeting sequence
ugcaauuuuggagggccagg

SEQ ID NO: 15278 - RNA, 20 nt, Artificial Sequence
  TRAC targeting sequence
aagccaaguaauuauaauac

SEQ ID NO: 15279 - RNA, 20 nt, Artificial Sequence
  TRAC targeting sequence
aucuaagccaaguaauuaua

SEQ ID NO: 15280 - RNA, 20 nt, Artificial Sequence
  TRAC targeting sequence
cuucuguguuacuucucaua

SEQ ID NO: 15281 - RNA, 20 nt, Artificial Sequence
  TRAC targeting sequence
guguuacuucucauaacugu

SEQ ID NO: 15282 - RNA, 20 nt, Artificial Sequence
  TRAC targeting sequence
cauaacuguguucauuuguu

SEQ ID NO: 15283 - RNA, 20 nt, Artificial Sequence
  TRAC targeting sequence
uaacuguguucauuuguuga

SEQ ID NO: 15284 - RNA, 20 nt, Artificial Sequence
  TRAC targeting sequence
uuuguugagaucuguuuaac

SEQ ID NO: 15285 - RNA, 20 nt, Artificial Sequence
  TRAC targeting sequence
acaaaugaacacaguuauga

SEQ ID NO: 15286 - RNA, 20 nt, Artificial Sequence
  TRAC targeting sequence
caacaaaugaacacaguuau

SEQ ID NO: 15287 - RNA, 20 nt, Artificial Sequence
  TRAC targeting sequence
guuuaacuccaaacugugug

SEQ ID NO: 15288 - RNA, 20 nt, Artificial Sequence
  TRAC targeting sequence
aaacugugugggcgucuaac

SEQ ID NO: 15289 - RNA, 20 nt, Artificial Sequence
  TRAC targeting sequence
aacuguuggcacuaagguuu

SEQ ID NO: 15290 - RNA, 20 nt, Artificial Sequence
  TRAC targeting sequence
uuucucuugaaauugccagc

SEQ ID NO: 15291 - RNA, 20 nt, Artificial Sequence
  TRAC targeting sequence
cuugaaauugccagcaaaau

SEQ ID NO: 15292 - RNA, 20 nt, Artificial Sequence
  TRAC targeting sequence
ugaaauugccagcaaaauau

SEQ ID NO: 15293 - RNA, 20 nt, Artificial Sequence
  TRAC targeting sequence
agagaaaagaaaccuuagug

SEQ ID NO: 15294 - RNA, 20 nt, Artificial Sequence
  TRAC targeting sequence
ucuagacuugcaaaugacaa

SEQ ID NO: 15295 - RNA, 20 nt, Artificial Sequence
  TRAC targeting sequence
agacuugcaaaugacaacua

SEQ ID NO: 15296 - RNA, 20 nt, Artificial Sequence
  TRAC targeting sequence
agaugaaacauuauuuaugg

SEQ ID NO: 15297 - RNA, 20 nt, Artificial Sequence
  TRAC targeting sequence
uuugcaagucuagaugaaac

SEQ ID NO: 15298 - RNA, 20 nt, Artificial Sequence
  TRAC targeting sequence
uuuuuuuucuuuugcuuugu

SEQ ID NO: 15299 - RNA, 20 nt, Artificial Sequence
  TRAC targeting sequence
uuugcuuuguuucuuuuuuu

SEQ ID NO: 15300 - RNA, 20 nt, Artificial Sequence
  TRAC targeting sequence
uuuuuucugaagggaauaug

SEQ ID NO: 15301 - RNA, 20 nt, Artificial Sequence
  TRAC targeting sequence
gaagggaauaugcaagcagg

SEQ ID NO: 15302 - RNA, 20 nt, Artificial Sequence
  TRAC targeting sequence
gaaaaaaagaaacaaagcaa

SEQ ID NO: 15303 - RNA, 20 nt, Artificial Sequence
  TRAC targeting sequence
cuucagaaaaaaagaaacaa

SEQ ID NO: 15304 - RNA, 20 nt, Artificial Sequence
  TRAC targeting sequence
ugcuugcauauucccuucag

SEQ ID NO: 15305 - RNA, 20 nt, Artificial Sequence
  TRAC targeting sequence
aacuguacauuuuggcuuuu

SEQ ID NO: 15306 - RNA, 20 nt, Artificial Sequence
  TRAC targeting sequence
gggaggagagugucaaugug

SEQ ID NO: 15307 - RNA, 20 nt, Artificial Sequence
  TRAC targeting sequence
cagaccccacagucaaacug

SEQ ID NO: 15308 - RNA, 20 nt, Artificial Sequence
  TRAC targeting sequence
ucccagaccccacagucaaa

SEQ ID NO: 15309 - RNA, 20 nt, Artificial Sequence
  TRAC targeting sequence
ccucccagaccccacaguca

SEQ ID NO: 15310 - RNA, 20 nt, Artificial Sequence
  TRAC targeting sequence
auguggaugcuaaaauauac

SEQ ID NO: 15311 - RNA, 20 nt, Artificial Sequence
  TRAC targeting sequence
acauugacacucuccuccca

SEQ ID NO: 15312 - RNA, 20 nt, Artificial Sequence
  TRAC targeting sequence
cagagaggcuauagugaucu

SEQ ID NO: 15313 - RNA, 20 nt, Artificial Sequence
  TRAC targeting sequence
gugacaguaccuacauuaua

SEQ ID NO: 15314 - RNA, 20 nt, Artificial Sequence
  TRAC targeting sequence
cugugacaguaccuacauua

SEQ ID NO: 15315 - RNA, 20 nt, Artificial Sequence
  TRAC targeting sequence
cuauagccucucugugacag

SEQ ID NO: 15316 - RNA, 20 nt, Artificial Sequence
  TRAC targeting sequence
uauuagaucauacauacaga

SEQ ID NO: 15317 - RNA, 20 nt, Artificial Sequence
  TRAC targeting sequence
aauaagaucacuauagccuc

SEQ ID NO: 15318 - RNA, 20 nt, Artificial Sequence
  TRAC targeting sequence
uacauacagagcaccacugg

SEQ ID NO: 15319 - RNA, 20 nt, Artificial Sequence
  TRAC targeting sequence
guauguaugaucuaauaaga

SEQ ID NO: 15320 - RNA, 20 nt, Artificial Sequence
  TRAC targeting sequence
gcuggcguugcucggggugu

SEQ ID NO: 15321 - RNA, 20 nt, Artificial Sequence
  TRAC targeting sequence
ggguguccuuaagaaaagcu

SEQ ID NO: 15322 - RNA, 20 nt, Artificial Sequence
  TRAC targeting sequence
uuaagaaaagcucaggucua

SEQ ID NO: 15323 - RNA, 20 nt, Artificial Sequence
  TRAC targeting sequence
uaaggacaccccgagcaacg

SEQ ID NO: 15324 - RNA, 20 nt, Artificial Sequence
  TRAC targeting sequence
ggucuaguugucaagugcaa

SEQ ID NO: 15325 - RNA, 20 nt, Artificial Sequence
  TRAC targeting sequence
aguugucaagugcaacccag

SEQ ID NO: 15326 - RNA, 20 nt, Artificial Sequence
  TRAC targeting sequence
agugcaacccagauucagau

SEQ ID NO: 15327 - RNA, 20 nt, Artificial Sequence
  TRAC targeting sequence
ggguugcacuugacaacuag

SEQ ID NO: 15328 - RNA, 20 nt, Artificial Sequence
  TRAC targeting sequence
gauacagagucucagagaga

SEQ ID NO: 15329 - RNA, 20 nt, Artificial Sequence
  TRAC targeting sequence
gaaucuggguugcacuugac

SEQ ID NO: 15330 - RNA, 20 nt, Artificial Sequence
  TRAC targeting sequence
guaucugaaucuggguugca

SEQ ID NO: 15331 - RNA, 20 nt, Artificial Sequence
  TRAC targeting sequence
cagagagaagcuuccagauc

SEQ ID NO: 15332 - RNA, 20 nt, Artificial Sequence
  TRAC targeting sequence
gagagaagcuuccagaucac

SEQ ID NO: 15333 - RNA, 20 nt, Artificial Sequence
  TRAC targeting sequence
gagacucuguaucugaaucu

SEQ ID NO: 15334 - RNA, 20 nt, Artificial Sequence
  TRAC targeting sequence
cugagacucuguaucugaau

SEQ ID NO: 15335 - RNA, 20 nt, Artificial Sequence
  TRAC targeting sequence
cucugagacucuguaucuga

SEQ ID NO: 15336 - RNA, 20 nt, Artificial Sequence
  TRAC targeting sequence
agaucacccuggagcuaaau

SEQ ID NO: 15337 - RNA, 20 nt, Artificial Sequence
  TRAC targeting sequence
ggaagcuucucucugagacu

SEQ ID NO: 15338 - RNA, 20 nt, Artificial Sequence
  TRAC targeting sequence
cccuggagcuaaaugcagaa

SEQ ID NO: 15339 - RNA, 20 nt, Artificial Sequence
  TRAC targeting sequence
agggugaucuggaagcuucu

SEQ ID NO: 15340 - RNA, 20 nt, Artificial Sequence
  TRAC targeting sequence
gcauuuagcuccagggugau

SEQ ID NO: 15341 - RNA, 20 nt, Artificial Sequence
  TRAC targeting sequence
uauucugcauuuagcuccag

SEQ ID NO: 15342 - RNA, 20 nt, Artificial Sequence
  TRAC targeting sequence
ccuuaguuaagucuaccuga

SEQ ID NO: 15343 - RNA, 20 nt, Artificial Sequence
  TRAC targeting sequence
accugaggggaauuuucauu

SEQ ID NO: 15344 - RNA, 20 nt, Artificial Sequence
  TRAC targeting sequence
gguagacuuaacuaagggga

SEQ ID NO: 15345 - RNA, 20 nt, Artificial Sequence
  TRAC targeting sequence
ccucagguagacuuaacuaa

SEQ ID NO: 15346 - RNA, 20 nt, Artificial Sequence
  TRAC targeting sequence
uuuauaauuaggaaaagaga

SEQ ID NO: 15347 - RNA, 20 nt, Artificial Sequence
  TRAC targeting sequence
uaauuauaaaugaaaauucc

SEQ ID NO: 15348 - RNA, 20 nt, Artificial Sequence
  TRAC targeting sequence
uuuccuaauuauaaaugaaa

SEQ ID NO: 15349 - RNA, 20 nt, Artificial Sequence
  TRAC targeting sequence
cuuuuccuaauuauaaauga

SEQ ID NO: 15350 - RNA, 20 nt, Artificial Sequence
  TRAC targeting sequence
uuaccuuucucuuuuccuaa

SEQ ID NO: 15351 - RNA, 20 nt, Artificial Sequence
  TRAC targeting sequence
uguuucaaauauugugugca

SEQ ID NO: 15352 - RNA, 20 nt, Artificial Sequence
  TRAC targeting sequence
aauauugugugcauugagca

SEQ ID NO: 15353 - RNA, 20 nt, Artificial Sequence
  TRAC targeting sequence
augcacacaauauuugaaac

SEQ ID NO: 15354 - RNA, 20 nt, Artificial Sequence
  TRAC targeting sequence
gugcucaaugcacacaauau

SEQ ID NO: 15355 - RNA, 20 nt, Artificial Sequence
  TRAC targeting sequence
ucugugcucaaugcacacaa

SEQ ID NO: 15356 - RNA, 20 nt, Artificial Sequence
  TRAC targeting sequence
uguguccucugugcucaaug

SEQ ID NO: 15357 - RNA, 20 nt, Artificial Sequence
  TRAC targeting sequence
uucuuguguccucugugcuc

SEQ ID NO: 15358 - RNA, 20 nt, Artificial Sequence
  TRAC targeting sequence
gcuuggguucauucuugugu

SEQ ID NO: 15359 - RNA, 20 nt, Artificial Sequence
  TRAC targeting sequence
uuaguuuucugcuuggguuc

SEQ ID NO: 15360 - RNA, 20 nt, Artificial Sequence
  TRAC targeting sequence
uuucuuuaguuuucugcuug

SEQ ID NO: 15361 - RNA, 20 nt, Artificial Sequence
  TRAC targeting sequence
auaaaaccacugaagaaaac

SEQ ID NO: 15362 - RNA, 20 nt, Artificial Sequence
  TRAC targeting sequence
gugguuuuauugauuucuuu

SEQ ID NO: 15363 - RNA, 20 nt, Artificial Sequence
  TRAC targeting sequence
ucagugguuuuauugauuuc

SEQ ID NO: 15364 - RNA, 20 nt, Artificial Sequence
  TRAC targeting sequence
ugccugucucugauaaugaa

SEQ ID NO: 15365 - RNA, 20 nt, Artificial Sequence
  TRAC targeting sequence
cugauaaugaaugugccuuc

SEQ ID NO: 15366 - RNA, 20 nt, Artificial Sequence
  TRAC targeting sequence
gauaaugaaugugccuuccc

SEQ ID NO: 15367 - RNA, 20 nt, Artificial Sequence
  TRAC targeting sequence
gagacaggcaagauaagggc

SEQ ID NO: 15368 - RNA, 20 nt, Artificial Sequence
  TRAC targeting sequence
uuaucagagacaggcaagau

SEQ ID NO: 15369 - RNA, 20 nt, Artificial Sequence
  TRAC targeting sequence
cugcucauuccucacuuugg

SEQ ID NO: 15370 - RNA, 20 nt, Artificial Sequence
  TRAC targeting sequence
uuccucacuuugguucucaa

SEQ ID NO: 15371 - RNA, 20 nt, Artificial Sequence
  TRAC targeting sequence
ucacuuugguucucaaauuu

SEQ ID NO: 15372 - RNA, 20 nt, Artificial Sequence
  TRAC targeting sequence
cuuugguucucaaauuuucc

SEQ ID NO: 15373 - RNA, 20 nt, Artificial Sequence
  TRAC targeting sequence
caaauuuuccagggaauuag

SEQ ID NO: 15374 - RNA, 20 nt, Artificial Sequence
  TRAC targeting sequence
aauuuuccagggaauuagca

SEQ ID NO: 15375 - RNA, 20 nt, Artificial Sequence
  TRAC targeting sequence
agggaauuagcaaagaacug

SEQ ID NO: 15376 - RNA, 20 nt, Artificial Sequence
  TRAC targeting sequence
cuggaaaauuugagaaccaa

SEQ ID NO: 15377 - RNA, 20 nt, Artificial Sequence
  TRAC targeting sequence
uugcuaauucccuggaaaau

SEQ ID NO: 15378 - RNA, 20 nt, Artificial Sequence
  TRAC targeting sequence
uggucuaauuugguuaguca

SEQ ID NO: 15379 - RNA, 20 nt, Artificial Sequence
  TRAC targeting sequence
aauuugguuagucaucucug

SEQ ID NO: 15380 - RNA, 20 nt, Artificial Sequence
  TRAC targeting sequence
ucucuggauaacaagucucc

SEQ ID NO: 15381 - RNA, 20 nt, Artificial Sequence
  TRAC targeting sequence
cuggauaacaagucuccuuu

SEQ ID NO: 15382 - RNA, 20 nt, Artificial Sequence
  TRAC targeting sequence
ggauaacaagucuccuuuuu

SEQ ID NO: 15383 - RNA, 20 nt, Artificial Sequence
  TRAC targeting sequence
agagaugacuaaccaaauua

SEQ ID NO: 15384 - RNA, 20 nt, Artificial Sequence
  TRAC targeting sequence
ccuuuuuaggaagugccagg

SEQ ID NO: 15385 - RNA, 20 nt, Artificial Sequence
  TRAC targeting sequence
uuuuuaggaagugccagggg

SEQ ID NO: 15386 - RNA, 20 nt, Artificial Sequence
  TRAC targeting sequence
uaaaaaggagacuuguuauc

SEQ ID NO: 15387 - RNA, 20 nt, Artificial Sequence
  TRAC targeting sequence
ccuggcacuuccuaaaaagg

SEQ ID NO: 15388 - RNA, 20 nt, Artificial Sequence
  TRAC targeting sequence
acaaauuuuacuuuggaucu

SEQ ID NO: 15389 - RNA, 20 nt, Artificial Sequence
  TRAC targeting sequence
aaaguaaaauuuguugaagu

SEQ ID NO: 15390 - RNA, 20 nt, Artificial Sequence
  TRAC targeting sequence
gggaccaaacucaauguaaa

SEQ ID NO: 15391 - RNA, 20 nt, Artificial Sequence
  TRAC targeting sequence
cagauccaaaguaaaauuug

SEQ ID NO: 15392 - RNA, 20 nt, Artificial Sequence
  TRAC targeting sequence
auguaaaaccaaguaaguua

SEQ ID NO: 15393 - RNA, 20 nt, Artificial Sequence
  TRAC targeting sequence
aggcaacuauaacuuacuug

SEQ ID NO: 15394 - RNA, 20 nt, Artificial Sequence
  TRAC targeting sequence
ucuaggcaacuauaacuuac

SEQ ID NO: 15395 - RNA, 20 nt, Artificial Sequence
  TRAC targeting sequence
ucuuuucagucuguauuuca

SEQ ID NO: 15396 - RNA, 20 nt, Artificial Sequence
  TRAC targeting sequence
uuucagucuguauuucaguu

SEQ ID NO: 15397 - RNA, 20 nt, Artificial Sequence
  TRAC targeting sequence
gucuguauuucaguucuuuu

SEQ ID NO: 15398 - RNA, 20 nt, Artificial Sequence
  TRAC targeting sequence
guauuucaguucuuuuauuu

SEQ ID NO: 15399 - RNA, 20 nt, Artificial Sequence
  TRAC targeting sequence
guucuuuuauuuugcauuuu

SEQ ID NO: 15400 - RNA, 20 nt, Artificial Sequence
  TRAC targeting sequence
uuuauuuugcauuuuggguc

SEQ ID NO: 15401 - RNA, 20 nt, Artificial Sequence
  TRAC targeting sequence
ccacccaugauauuuuauua

SEQ ID NO: 15402 - RNA, 20 nt, Artificial Sequence
  TRAC targeting sequence
uggguggggacccaaaaugc

SEQ ID NO: 15403 - RNA, 20 nt, Artificial Sequence
  TRAC targeting sequence
uuauucauaugucacuugaa

SEQ ID NO: 15404 - RNA, 20 nt, Artificial Sequence
  TRAC targeting sequence
uaugucacuugaacagauau

SEQ ID NO: 15405 - RNA, 20 nt, Artificial Sequence
  TRAC targeting sequence
cuugaacagauauguaguaa

SEQ ID NO: 15406 - RNA, 20 nt, Artificial Sequence
  TRAC targeting sequence
agugacauaugaauaaggac

SEQ ID NO: 15407 - RNA, 20 nt, Artificial Sequence
  TRAC targeting sequence
guucaagugacauaugaaua

SEQ ID NO: 15408 - RNA, 20 nt, Artificial Sequence
  TRAC targeting sequence
caugaucgaguagacaugcu

SEQ ID NO: 15409 - RNA, 20 nt, Artificial Sequence
  TRAC targeting sequence
ugaucgaguagacaugcuga

SEQ ID NO: 15410 - RNA, 20 nt, Artificial Sequence
  TRAC targeting sequence
ugagauuuguuuacuacaua

SEQ ID NO: 15411 - RNA, 20 nt, Artificial Sequence
  TRAC targeting sequence
aguagacaugcugaaacugc

SEQ ID NO: 15412 - RNA, 20 nt, Artificial Sequence
  TRAC targeting sequence
aucaugagauuuguuuacua

SEQ ID NO: 15413 - RNA, 20 nt, Artificial Sequence
  TRAC targeting sequence
acucgaucaugagauuuguu

SEQ ID NO: 15414 - RNA, 20 nt, Artificial Sequence
  TRAC targeting sequence
gcaugucuacucgaucauga

SEQ ID NO: 15415 - RNA, 20 nt, Artificial Sequence
  TRAC targeting sequence
caaggugcuauucuuuauaa

SEQ ID NO: 15416 - RNA, 20 nt, Artificial Sequence
  TRAC targeting sequence
aggugcuauucuuuauaagg

SEQ ID NO: 15417 - RNA, 20 nt, Artificial Sequence
  TRAC targeting sequence
uuauaaggaaaaugcccaaa

SEQ ID NO: 15418 - RNA, 20 nt, Artificial Sequence
  TRAC targeting sequence
uuauaaagaauagcaccuug

SEQ ID NO: 15419 - RNA, 20 nt, Artificial Sequence
  TRAC targeting sequence
guagcaacaguuaaaauuug

SEQ ID NO: 15420 - RNA, 20 nt, Artificial Sequence
  TRAC targeting sequence
uuuguucaguagcaacaguu

SEQ ID NO: 15421 - RNA, 20 nt, Artificial Sequence
  TRAC targeting sequence
aaaugcucuuuuguucagua

SEQ ID NO: 15422 - RNA, 20 nt, Artificial Sequence
  TRAC targeting sequence
ggggugcuuuaaauuauauc

SEQ ID NO: 15423 - RNA, 20 nt, Artificial Sequence
  TRAC targeting sequence
aggauuucagagaggagaca

SEQ ID NO: 15424 - RNA, 20 nt, Artificial Sequence
  TRAC targeting sequence
uggacauucaggggugcuuu

SEQ ID NO: 15425 - RNA, 20 nt, Artificial Sequence
  TRAC targeting sequence
gagaggagacaugacaaauu

SEQ ID NO: 15426 - RNA, 20 nt, Artificial Sequence
  TRAC targeting sequence
gaaauccuggacauucaggg

SEQ ID NO: 15427 - RNA, 20 nt, Artificial Sequence
  TRAC targeting sequence
cugaaauccuggacauucag

SEQ ID NO: 15428 - RNA, 20 nt, Artificial Sequence
  TRAC targeting sequence
ucucugaaauccuggacauu

SEQ ID NO: 15429 - RNA, 20 nt, Artificial Sequence
  TRAC targeting sequence
ccucucugaaauccuggaca

SEQ ID NO: 15430 - RNA, 20 nt, Artificial Sequence
  TRAC targeting sequence
ugucuccucucugaaauccu

SEQ ID NO: 15431 - RNA, 20 nt, Artificial Sequence
  TRAC targeting sequence
uuaaauaauacauauaauuu

SEQ ID NO: 15432 - RNA, 20 nt, Artificial Sequence
  TRAC targeting sequence
ucuuuaaauaauacauauaa

SEQ ID NO: 15433 - RNA, 20 nt, Artificial Sequence
  TRAC targeting sequence
uuucaucuuuaaauaauaca

SEQ ID NO: 15434 - RNA, 20 nt, Artificial Sequence
  TRAC targeting sequence
aauucuuuucaucuuuaaau

SEQ ID NO: 15435 - RNA, 20 nt, Artificial Sequence
  TRAC targeting sequence
ucuugaaaauacucuaauaa

SEQ ID NO: 15436 - RNA, 20 nt, Artificial Sequence
  TRAC targeting sequence
ugaaaauacucuaauaacua

SEQ ID NO: 15437 - RNA, 20 nt, Artificial Sequence
  TRAC targeting sequence
agaggaucuaauucuuuuca

SEQ ID NO: 15438 - RNA, 20 nt, Artificial Sequence
  TRAC targeting sequence
aauaacuaacauuucuucaa

SEQ ID NO: 15439 - RNA, 20 nt, Artificial Sequence
  TRAC targeting sequence
ucaacauucgcaauaugcaa

SEQ ID NO: 15440 - RNA, 20 nt, Artificial Sequence
  TRAC targeting sequence
acauucgcaauaugcaaagc

SEQ ID NO: 15441 - RNA, 20 nt, Artificial Sequence
  TRAC targeting sequence
caauaugcaaagcaccuuuc

SEQ ID NO: 15442 - RNA, 20 nt, Artificial Sequence
  TRAC targeting sequence
uaccuugacucaucugaccc

SEQ ID NO: 15443 - RNA, 20 nt, Artificial Sequence
  TRAC targeting sequence
agguaugaaaggugcuuugc

SEQ ID NO: 15444 - RNA, 20 nt, Artificial Sequence
  TRAC targeting sequence
ucugacccuccuaacaaccc

SEQ ID NO: 15445 - RNA, 20 nt, Artificial Sequence
  TRAC targeting sequence
gacccuccuaacaacccucu

SEQ ID NO: 15446 - RNA, 20 nt, Artificial Sequence
  TRAC targeting sequence
gaugagucaagguaugaaag

SEQ ID NO: 15447 - RNA, 20 nt, Artificial Sequence
  TRAC targeting sequence
uaacaacccucugggauaga

SEQ ID NO: 15448 - RNA, 20 nt, Artificial Sequence
  TRAC targeting sequence
gggauagauauuaccuaucu

SEQ ID NO: 15449 - RNA, 20 nt, Artificial Sequence
  TRAC targeting sequence
cagaggguuguuaggagggu

SEQ ID NO: 15450 - RNA, 20 nt, Artificial Sequence
  TRAC targeting sequence
aucccagaggguuguuagga

SEQ ID NO: 15451 - RNA, 20 nt, Artificial Sequence
  TRAC targeting sequence
ccgcuuccacagaugaggaa

SEQ ID NO: 15452 - RNA, 20 nt, Artificial Sequence
  TRAC targeting sequence
gcuuccacagaugaggaaac

SEQ ID NO: 15453 - RNA, 20 nt, Artificial Sequence
  TRAC targeting sequence
acagaugaggaaacagugug

SEQ ID NO: 15454 - RNA, 20 nt, Artificial Sequence
  TRAC targeting sequence
guggaagcggagauagguaa

SEQ ID NO: 15455 - RNA, 20 nt, Artificial Sequence
  TRAC targeting sequence
ucuguggaagcggagauagg

SEQ ID NO: 15456 - RNA, 20 nt, Artificial Sequence
  TRAC targeting sequence
ucaucuguggaagcggagau

SEQ ID NO: 15457 - RNA, 20 nt, Artificial Sequence
  TRAC targeting sequence
cacuguuuccucaucugugg

SEQ ID NO: 15458 - RNA, 20 nt, Artificial Sequence
  TRAC targeting sequence
uugcuuuaguuuuaccuuuc

SEQ ID NO: 15459 - RNA, 20 nt, Artificial Sequence
  TRAC targeting sequence
accucuuugcuuuaguuuua

SEQ ID NO: 15460 - RNA, 20 nt, Artificial Sequence
  TRAC targeting sequence
ccgcagaugaggggcagagc

SEQ ID NO: 15461 - RNA, 20 nt, Artificial Sequence
  TRAC targeting sequence
gcggugagcccuuggguaac

SEQ ID NO: 15462 - RNA, 20 nt, Artificial Sequence
  TRAC targeting sequence
ucugcggugagcccuugggu

SEQ ID NO: 15463 - RNA, 20 nt, Artificial Sequence
  TRAC targeting sequence
gccccucaucugcggugagc

SEQ ID NO: 15464 - RNA, 20 nt, Artificial Sequence
  TRAC targeting sequence
agcucugccccucaucugcg

SEQ ID NO: 15465 - RNA, 20 nt, Artificial Sequence
  TRAC targeting sequence
uaaucuagcucugccccuca

SEQ ID NO: 15466 - RNA, 20 nt, Artificial Sequence
  TRAC targeting sequence
ccuagcccacucucuuaacc

SEQ ID NO: 15467 - RNA, 20 nt, Artificial Sequence
  TRAC targeting sequence
cuuaaccauggucuugguga

SEQ ID NO: 15468 - RNA, 20 nt, Artificial Sequence
  TRAC targeting sequence
uaaccauggucuuggugagg

SEQ ID NO: 15469 - RNA, 20 nt, Artificial Sequence
  TRAC targeting sequence
uggugagguuuguguagggc

SEQ ID NO: 15470 - RNA, 20 nt, Artificial Sequence
  TRAC targeting sequence
ccaagaccaugguuaagaga

SEQ ID NO: 15471 - RNA, 20 nt, Artificial Sequence
  TRAC targeting sequence
cccuacacaaaccucaccaa

SEQ ID NO: 15472 - RNA, 20 nt, Artificial Sequence
  TRAC targeting sequence
cacugugguucuaacgacua

SEQ ID NO: 15473 - RNA, 20 nt, Artificial Sequence
  TRAC targeting sequence
aacgacuacaagcucagcuu

SEQ ID NO: 15474 - RNA, 20 nt, Artificial Sequence
  TRAC targeting sequence
uuagaaccacagugcgaggu

SEQ ID NO: 15475 - RNA, 20 nt, Artificial Sequence
  TRAC targeting sequence
gcuuuggagccggaaccaca

SEQ ID NO: 15476 - RNA, 20 nt, Artificial Sequence
  TRAC targeting sequence
aaagcugagcuuguagucgu

SEQ ID NO: 15477 - RNA, 20 nt, Artificial Sequence
  TRAC targeting sequence
ggcuccaaagcugagcuugu

SEQ ID NO: 15478 - RNA, 20 nt, Artificial Sequence
  TRAC targeting sequence
uacaguuacugugguuccgg

SEQ ID NO: 15479 - RNA, 20 nt, Artificial Sequence
  TRAC targeting sequence
uacuuacuugcucuuacagu

SEQ ID NO: 15480 - RNA, 20 nt, Artificial Sequence
  TRAC targeting sequence
uucuuacuuacuugcucuua

SEQ ID NO: 15481 - RNA, 20 nt, Artificial Sequence
  TRAC targeting sequence
agaauaauuuuaagcaaaau

SEQ ID NO: 15482 - RNA, 20 nt, Artificial Sequence
  TRAC targeting sequence
ggacuuuucuuucuuacuua

SEQ ID NO: 15483 - RNA, 20 nt, Artificial Sequence
  TRAC targeting sequence
gcaauuucaccuaggaagug

SEQ ID NO: 15484 - RNA, 20 nt, Artificial Sequence
  TRAC targeting sequence
ccuaggaagugcaaugucaa

SEQ ID NO: 15485 - RNA, 20 nt, Artificial Sequence
  TRAC targeting sequence
uaggugaaauugcugaaaaa

SEQ ID NO: 15486 - RNA, 20 nt, Artificial Sequence
  TRAC targeting sequence
agaacuaaauucuaagagcu

SEQ ID NO: 15487 - RNA, 20 nt, Artificial Sequence
  TRAC targeting sequence
ugacauugcacuuccuaggu

SEQ ID NO: 15488 - RNA, 20 nt, Artificial Sequence
  TRAC targeting sequence
aagagcuuucccaguuugug

SEQ ID NO: 15489 - RNA, 20 nt, Artificial Sequence
  TRAC targeting sequence
uagaauuuaguucuugacau

SEQ ID NO: 15490 - RNA, 20 nt, Artificial Sequence
  TRAC targeting sequence
caguuuguguuagaaccaua

SEQ ID NO: 15491 - RNA, 20 nt, Artificial Sequence
  TRAC targeting sequence
aacacaaacugggaaagcuc

SEQ ID NO: 15492 - RNA, 20 nt, Artificial Sequence
  TRAC targeting sequence
accucacacgucucccucgc

SEQ ID NO: 15493 - RNA, 20 nt, Artificial Sequence
  TRAC targeting sequence
cacgucucccucgccuucuc

SEQ ID NO: 15494 - RNA, 20 nt, Artificial Sequence
  TRAC targeting sequence
cccucgccuucucugucacc

SEQ ID NO: 15495 - RNA, 20 nt, Artificial Sequence
  TRAC targeting sequence
cucgccuucucugucaccuc

SEQ ID NO: 15496 - RNA, 20 nt, Artificial Sequence
  TRAC targeting sequence
ccuucucugucaccucagaa

SEQ ID NO: 15497 - RNA, 20 nt, Artificial Sequence
  TRAC targeting sequence
cugucaccucagaacagcuc

SEQ ID NO: 15498 - RNA, 20 nt, Artificial Sequence
  TRAC targeting sequence
gucaccucagaacagcuccu

SEQ ID NO: 15499 - RNA, 20 nt, Artificial Sequence
  TRAC targeting sequence
ccucagaacagcuccuccua

SEQ ID NO: 15500 - RNA, 20 nt, Artificial Sequence
  TRAC targeting sequence
gaacagcuccuccuaaggca

SEQ ID NO: 15501 - RNA, 20 nt, Artificial Sequence
  TRAC targeting sequence
gaggugacagagaaggcgag

SEQ ID NO: 15502 - RNA, 20 nt, Artificial Sequence
  TRAC targeting sequence
uccuaaggcaugacuucaca

SEQ ID NO: 15503 - RNA, 20 nt, Artificial Sequence
  TRAC targeting sequence
uaaggcaugacuucacaaug

SEQ ID NO: 15504 - RNA, 20 nt, Artificial Sequence
  TRAC targeting sequence
ugccuuaggaggagcuguuc

SEQ ID NO: 15505 - RNA, 20 nt, Artificial Sequence
  TRAC targeting sequence
caaugguacauuuguuggug

SEQ ID NO: 15506 - RNA, 20 nt, Artificial Sequence
  TRAC targeting sequence
uuguggucagauaaaaacug

SEQ ID NO: 15507 - RNA, 20 nt, Artificial Sequence
  TRAC targeting sequence
gauaaaaacugagcuaauua

SEQ ID NO: 15508 - RNA, 20 nt, Artificial Sequence
  TRAC targeting sequence
gaccacaaagacugcgccac

SEQ ID NO: 15509 - RNA, 20 nt, Artificial Sequence
  TRAC targeting sequence
guuuuuaucugaccacaaag

SEQ ID NO: 15510 - RNA, 20 nt, Artificial Sequence
  TRAC targeting sequence
gaaauuaucucaggucucua

SEQ ID NO: 15511 - RNA, 20 nt, Artificial Sequence
  TRAC targeting sequence
gauaauuagcucaguuuuua

SEQ ID NO: 15512 - RNA, 20 nt, Artificial Sequence
  TRAC targeting sequence
caggucucuaagugagagag

SEQ ID NO: 15513 - RNA, 20 nt, Artificial Sequence
  TRAC targeting sequence
ggucucuaagugagagaguu

SEQ ID NO: 15514 - RNA, 20 nt, Artificial Sequence
  TRAC targeting sequence
cuaagugagagaguuaacuc

SEQ ID NO: 15515 - RNA, 20 nt, Artificial Sequence
  TRAC targeting sequence
aagugagagaguuaacuccu

SEQ ID NO: 15516 - RNA, 20 nt, Artificial Sequence
  TRAC targeting sequence
cuuagagaccugagauaauu

SEQ ID NO: 15517 - RNA, 20 nt, Artificial Sequence
  TRAC targeting sequence
cacuuagagaccugagauaa

SEQ ID NO: 15518 - RNA, 20 nt, Artificial Sequence
  TRAC targeting sequence
cucacuuagagaccugagau

SEQ ID NO: 15519 - RNA, 20 nt, Artificial Sequence
  TRAC targeting sequence
uuucaaauauuugaagaacu

SEQ ID NO: 15520 - RNA, 20 nt, Artificial Sequence
  TRAC targeting sequence
aauauuugaagaacuacgau

SEQ ID NO: 15521 - RNA, 20 nt, Artificial Sequence
  TRAC targeting sequence
aauauuugaaaggaguuaac

SEQ ID NO: 15522 - RNA, 20 nt, Artificial Sequence
  TRAC targeting sequence
ucaaauauuugaaaggaguu

SEQ ID NO: 15523 - RNA, 20 nt, Artificial Sequence
  TRAC targeting sequence
uaguucuucaaauauuugaa

SEQ ID NO: 15524 - RNA, 20 nt, Artificial Sequence
  TRAC targeting sequence
acaucguaguucuucaaaua

SEQ ID NO: 15525 - RNA, 20 nt, Artificial Sequence
  TRAC targeting sequence
ccccuuaccuggucuacauc

SEQ ID NO: 15526 - RNA, 20 nt, Artificial Sequence
  TRAC targeting sequence
acacucaccccuuaccuggu

SEQ ID NO: 15527 - RNA, 20 nt, Artificial Sequence
  TRAC targeting sequence
aaacgagcaggugcaagaug

SEQ ID NO: 15528 - RNA, 20 nt, Artificial Sequence
  TRAC targeting sequence
uuuugauuuggccuccacac

SEQ ID NO: 15529 - RNA, 20 nt, Artificial Sequence
  TRAC targeting sequence
ugcaccugcucguuuugauu

SEQ ID NO: 15530 - RNA, 20 nt, Artificial Sequence
  TRAC targeting sequence
ccucaaacauuguugaacaa

SEQ ID NO: 15531 - RNA, 20 nt, Artificial Sequence
  TRAC targeting sequence
aacauuguugaacaagugga

SEQ ID NO: 15532 - RNA, 20 nt, Artificial Sequence
  TRAC targeting sequence
acaauguuugaggggagguu

SEQ ID NO: 15533 - RNA, 20 nt, Artificial Sequence
  TRAC targeting sequence
acuuguucaacaauguuuga

SEQ ID NO: 15534 - RNA, 20 nt, Artificial Sequence
  TRAC targeting sequence
acugcagggcaguuccacuu

SEQ ID NO: 15535 - RNA, 20 nt, Artificial Sequence
  TRAC targeting sequence
caaagcagccuuuccacugc

SEQ ID NO: 15536 - RNA, 20 nt, Artificial Sequence
  TRAC targeting sequence
auacuucacaaagcagccuu

SEQ ID NO: 15537 - RNA, 20 nt, Artificial Sequence
  TRAC targeting sequence
uccuuagauaucuucaugcc

SEQ ID NO: 15538 - RNA, 20 nt, Artificial Sequence
  TRAC targeting sequence
uuagauaucuucaugccaga

SEQ ID NO: 15539 - RNA, 20 nt, Artificial Sequence
  TRAC targeting sequence
aaggaagaaaaguuccauac

SEQ ID NO: 15540 - RNA, 20 nt, Artificial Sequence
  TRAC targeting sequence
ucaugccagaccccuaaggu

SEQ ID NO: 15541 - RNA, 20 nt, Artificial Sequence
  TRAC targeting sequence
ugccagaccccuaagguuaa

SEQ ID NO: 15542 - RNA, 20 nt, Artificial Sequence
  TRAC targeting sequence
ggcaugaagauaucuaagga

SEQ ID NO: 15543 - RNA, 20 nt, Artificial Sequence
  TRAC targeting sequence
ugguuaaccuuaggggucug

SEQ ID NO: 15544 - RNA, 20 nt, Artificial Sequence
  TRAC targeting sequence
caugguuaaccuuagggguc

SEQ ID NO: 15545 - RNA, 20 nt, Artificial Sequence
  TRAC targeting sequence
gcaacaucucaugguuaacc

SEQ ID NO: 15546 - RNA, 20 nt, Artificial Sequence
  TRAC targeting sequence
augccauuuuagcuauuaga

SEQ ID NO: 15547 - RNA, 20 nt, Artificial Sequence
  TRAC targeting sequence
aauagcuaaaauggcauaga

SEQ ID NO: 15548 - RNA, 20 nt, Artificial Sequence
  TRAC targeting sequence
aucuaauagcuaaaauggca

SEQ ID NO: 15549 - RNA, 20 nt, Artificial Sequence
  TRAC targeting sequence
ccucugggcucccuuucaaa

SEQ ID NO: 15550 - RNA, 20 nt, Artificial Sequence
  TRAC targeting sequence
gggcucccuuucaaaucuaa

SEQ ID NO: 15551 - RNA, 20 nt, Artificial Sequence
  TRAC targeting sequence
cuuucaaaucuaaaugcuaa

SEQ ID NO: 15552 - RNA, 20 nt, Artificial Sequence
  TRAC targeting sequence
aaucuaaaugcuaagauccc

SEQ ID NO: 15553 - RNA, 20 nt, Artificial Sequence
  TRAC targeting sequence
aaaugcuaagaucccaugac

SEQ ID NO: 15554 - RNA, 20 nt, Artificial Sequence
  TRAC targeting sequence
uagcauuuagauuugaaagg

SEQ ID NO: 15555 - RNA, 20 nt, Artificial Sequence
  TRAC targeting sequence
caugacucaagccuggagga

SEQ ID NO: 15556 - RNA, 20 nt, Artificial Sequence
  TRAC targeting sequence
ugggaucuuagcauuuagau

SEQ ID NO: 15557 - RNA, 20 nt, Artificial Sequence
  TRAC targeting sequence
agccuggaggauuaauaggu

SEQ ID NO: 15558 - RNA, 20 nt, Artificial Sequence
  TRAC targeting sequence
aggcuugagucaugggaucu

SEQ ID NO: 15559 - RNA, 20 nt, Artificial Sequence
  TRAC targeting sequence
uccaggcuugagucauggga

SEQ ID NO: 15560 - RNA, 20 nt, Artificial Sequence
  TRAC targeting sequence
ccuauuaauccuccaggcuu

SEQ ID NO: 15561 - RNA, 20 nt, Artificial Sequence
  TRAC targeting sequence
gacuuguuucuucuauuuuu

SEQ ID NO: 15562 - RNA, 20 nt, Artificial Sequence
  TRAC targeting sequence
gagcucaccuauuaauccuc

SEQ ID NO: 15563 - RNA, 20 nt, Artificial Sequence
  TRAC targeting sequence
ucuauuuuuacuauuuugau

SEQ ID NO: 15564 - RNA, 20 nt, Artificial Sequence
  TRAC targeting sequence
auuuuuacuauuuugauagc

SEQ ID NO: 15565 - RNA, 20 nt, Artificial Sequence
  TRAC targeting sequence
aaauaguaaaaauagaagaa

SEQ ID NO: 15566 - RNA, 20 nt, Artificial Sequence
  TRAC targeting sequence
uuggcuaucaaaauaguaaa

SEQ ID NO: 15567 - RNA, 20 nt, Artificial Sequence
  TRAC targeting sequence
ucaaauuauucauaagcuaa

SEQ ID NO: 15568 - RNA, 20 nt, Artificial Sequence
  TRAC targeting sequence
aauuauucauaagcuaaagc

SEQ ID NO: 15569 - RNA, 20 nt, Artificial Sequence
  TRAC targeting sequence
uaagcuaaagccuacuuggg

SEQ ID NO: 15570 - RNA, 20 nt, Artificial Sequence
  TRAC targeting sequence
caaguaggcuuuagcuuaug

SEQ ID NO: 15571 - RNA, 20 nt, Artificial Sequence
  TRAC targeting sequence
agguguaaaaaucccaagua

SEQ ID NO: 15572 - RNA, 20 nt, Artificial Sequence
  TRAC targeting sequence
ucuagguguaaaaaucccaa

SEQ ID NO: 15573 - RNA, 20 nt, Artificial Sequence
  TRAC targeting sequence
uaccccaccaucuucuaggu

SEQ ID NO: 15574 - RNA, 20 nt, Artificial Sequence
  TRAC targeting sequence
cagugcaguaaaugagaaaa

SEQ ID NO: 15575 - RNA, 20 nt, Artificial Sequence
  TRAC targeting sequence
uuuacugcacugggaaauca

SEQ ID NO: 15576 - RNA, 20 nt, Artificial Sequence
  TRAC targeting sequence
cauuuacugcacugggaaau

SEQ ID NO: 15577 - RNA, 20 nt, Artificial Sequence
  TRAC targeting sequence
uauuguuuucucauuuacug

SEQ ID NO: 15578 - RNA, 20 nt, Artificial Sequence
  TRAC targeting sequence
ccuauuguuuucucauuuac

SEQ ID NO: 15579 - RNA, 20 nt, Artificial Sequence
  TRAC targeting sequence
aggaggaaaaaaagaaggaa

SEQ ID NO: 15580 - RNA, 20 nt, Artificial Sequence
  TRAC targeting sequence
uugaugucuccuauuguuuu

SEQ ID NO: 15581 - RNA, 20 nt, Artificial Sequence
  TRAC targeting sequence
uccuugaugucuccuauugu

SEQ ID NO: 15582 - RNA, 20 nt, Artificial Sequence
  TRAC targeting sequence
uuuuuuccuccuugaugucu

SEQ ID NO: 15583 - RNA, 20 nt, Artificial Sequence
  TRAC targeting sequence
uucuuuuuuuccuccuugau

SEQ ID NO: 15584 - RNA, 20 nt, Artificial Sequence
  TRAC targeting sequence
uccuucuuuuuuuccuccuu

SEQ ID NO: 15585 - RNA, 20 nt, Artificial Sequence
  TRAC targeting sequence
cuuccuucuuuuuuuccucc

SEQ ID NO: 15586 - RNA, 20 nt, Artificial Sequence
  TRAC targeting sequence
cuuuaucucuuccuucuuuu

SEQ ID NO: 15587 - RNA, 20 nt, Artificial Sequence
  TRAC targeting sequence
uaagggaggcucagagguug

SEQ ID NO: 15588 - RNA, 20 nt, Artificial Sequence
  TRAC targeting sequence
cuuaagacauucccuuuauc

SEQ ID NO: 15589 - RNA, 20 nt, Artificial Sequence
  TRAC targeting sequence
gagguugaaugaaggaaaug

SEQ ID NO: 15590 - RNA, 20 nt, Artificial Sequence
  TRAC targeting sequence
gagccucccuuaagacauuc

SEQ ID NO: 15591 - RNA, 20 nt, Artificial Sequence
  TRAC targeting sequence
accucugagccucccuuaag

SEQ ID NO: 15592 - RNA, 20 nt, Artificial Sequence
  TRAC targeting sequence
uucaaccucugagccucccu

SEQ ID NO: 15593 - RNA, 20 nt, Artificial Sequence
  TRAC targeting sequence
uucauucaaccucugagccu

SEQ ID NO: 15594 - RNA, 20 nt, Artificial Sequence
  TRAC targeting sequence
uuuccuucauucaaccucug

SEQ ID NO: 15595 - RNA, 20 nt, Artificial Sequence
  TRAC targeting sequence
ccucauuuccuucauucaac

SEQ ID NO: 15596 - RNA, 20 nt, Artificial Sequence
  TRAC targeting sequence
gcaaaaucaccucauuuccu

SEQ ID NO: 15597 - RNA, 20 nt, Artificial Sequence
  TRAC targeting sequence
ucugcaaaaucaccucauuu

SEQ ID NO: 15598 - RNA, 20 nt, Artificial Sequence
  TRAC targeting sequence
guccucugcaaaaucaccuc

SEQ ID NO: 15599 - RNA, 20 nt, Artificial Sequence
  TRAC targeting sequence
aagauuuuacaauuucaccu

SEQ ID NO: 15600 - RNA, 20 nt, Artificial Sequence
  TRAC targeting sequence
uugauagccacaucuguccu

SEQ ID NO: 15601 - RNA, 20 nt, Artificial Sequence
  TRAC targeting sequence
ccuuuggaaagggauccaaa

SEQ ID NO: 15602 - RNA, 20 nt, Artificial Sequence
  TRAC targeting sequence
aaaggugaaauuguaaaauc

SEQ ID NO: 15603 - RNA, 20 nt, Artificial Sequence
  TRAC targeting sequence
cuuuccaaaggugaaauugu

SEQ ID NO: 15604 - RNA, 20 nt, Artificial Sequence
  TRAC targeting sequence
aaacauaaugucacuccaag

SEQ ID NO: 15605 - RNA, 20 nt, Artificial Sequence
  TRAC targeting sequence
cuccaaguaagugagcagcc

SEQ ID NO: 15606 - RNA, 20 nt, Artificial Sequence
  TRAC targeting sequence
aaguaagugagcagccuuuu

SEQ ID NO: 15607 - RNA, 20 nt, Artificial Sequence
  TRAC targeting sequence
cuuacuuggagugacauuau

SEQ ID NO: 15608 - RNA, 20 nt, Artificial Sequence
  TRAC targeting sequence
aaaauagggccaggggagca

SEQ ID NO: 15609 - RNA, 20 nt, Artificial Sequence
  TRAC targeting sequence
aguacaaaaggcugcucacu

SEQ ID NO: 15610 - RNA, 20 nt, Artificial Sequence
  TRAC targeting sequence
ccuggcccuauuuucgagua

SEQ ID NO: 15611 - RNA, 20 nt, Artificial Sequence
  TRAC targeting sequence
uccaauuuaaacacacucaa

SEQ ID NO: 15612 - RNA, 20 nt, Artificial Sequence
  TRAC targeting sequence
aauuuaaacacacucaaaag

SEQ ID NO: 15613 - RNA, 20 nt, Artificial Sequence
  TRAC targeting sequence
aaaggauguguaauugcuuu

SEQ ID NO: 15614 - RNA, 20 nt, Artificial Sequence
  TRAC targeting sequence
uuuugaguguguuuaaauug

SEQ ID NO: 15615 - RNA, 20 nt, Artificial Sequence
  TRAC targeting sequence
gaugggagggaacucugaag

SEQ ID NO: 15616 - RNA, 20 nt, Artificial Sequence
  TRAC targeting sequence
gaaagcaauuacacauccuu

SEQ ID NO: 15617 - RNA, 20 nt, Artificial Sequence
  TRAC targeting sequence
caucagaaagcaauuacaca

SEQ ID NO: 15618 - RNA, 20 nt, Artificial Sequence
  TRAC targeting sequence
cucccaucagaaagcaauua

SEQ ID NO: 15619 - RNA, 20 nt, Artificial Sequence
  TRAC targeting sequence
gaagguagaaagacuauugu

SEQ ID NO: 15620 - RNA, 20 nt, Artificial Sequence
  TRAC targeting sequence
gaguucccucccaucagaaa

SEQ ID NO: 15621 - RNA, 20 nt, Artificial Sequence
  TRAC targeting sequence
accuucagaguucccuccca

SEQ ID NO: 15622 - RNA, 20 nt, Artificial Sequence
  TRAC targeting sequence
uucuaccuucagaguucccu

SEQ ID NO: 15623 - RNA, 20 nt, Artificial Sequence
  TRAC targeting sequence
gugguaacaauagucuuucu

SEQ ID NO: 15624 - RNA, 20 nt, Artificial Sequence
  TRAC targeting sequence
cuugucccuggagauauagc

SEQ ID NO: 15625 - RNA, 20 nt, Artificial Sequence
  TRAC targeting sequence
cuggagauauagcaucugag

SEQ ID NO: 15626 - RNA, 20 nt, Artificial Sequence
  TRAC targeting sequence
agggacaagugaucuguggu

SEQ ID NO: 15627 - RNA, 20 nt, Artificial Sequence
  TRAC targeting sequence
ccagggacaagugaucugug

SEQ ID NO: 15628 - RNA, 20 nt, Artificial Sequence
  TRAC targeting sequence
gaggacugacugucuagcuu

SEQ ID NO: 15629 - RNA, 20 nt, Artificial Sequence
  TRAC targeting sequence
gaugcuauaucuccagggac

SEQ ID NO: 15630 - RNA, 20 nt, Artificial Sequence
  TRAC targeting sequence
ucagaugcuauaucuccagg

SEQ ID NO: 15631 - RNA, 20 nt, Artificial Sequence
  TRAC targeting sequence
guccucagaugcuauaucuc

SEQ ID NO: 15632 - RNA, 20 nt, Artificial Sequence
  TRAC targeting sequence
agcuuagacugcugucugca

SEQ ID NO: 15633 - RNA, 20 nt, Artificial Sequence
  TRAC targeting sequence
aagcuagacagucaguccuc

SEQ ID NO: 15634 - RNA, 20 nt, Artificial Sequence
  TRAC targeting sequence
gcacaagaagaagacuuaca

SEQ ID NO: 15635 - RNA, 20 nt, Artificial Sequence
  TRAC targeting sequence
ugugcagacagcagucuaag

SEQ ID NO: 15636 - RNA, 20 nt, Artificial Sequence
  TRAC targeting sequence
ucuugugcagacagcagucu

SEQ ID NO: 15637 - RNA, 20 nt, Artificial Sequence
  TRAC targeting sequence
ucuucuugugcagacagcag

SEQ ID NO: 15638 - RNA, 20 nt, Artificial Sequence
  TRAC targeting sequence
guaagucuucuucuugugca

SEQ ID NO: 15639 - RNA, 20 nt, Artificial Sequence
  TRAC targeting sequence
uuaagcaucuguaagucuuc

SEQ ID NO: 15640 - RNA, 20 nt, Artificial Sequence
  TRAC targeting sequence
uccuuaagcaucuguaaguc

SEQ ID NO: 15641 - RNA, 20 nt, Artificial Sequence
  TRAC targeting sequence
auccuccuuaagcaucugua

SEQ ID NO: 15642 - RNA, 20 nt, Artificial Sequence
  TRAC targeting sequence
acccuguacuccaaagcuga

SEQ ID NO: 15643 - RNA, 20 nt, Artificial Sequence
  TRAC targeting sequence
aaagcugaggggagagggga

SEQ ID NO: 15644 - RNA, 20 nt, Artificial Sequence
  TRAC targeting sequence
gcuuuggaguacaggguuga

SEQ ID NO: 15645 - RNA, 20 nt, Artificial Sequence
  TRAC targeting sequence
ccucagcuuuggaguacagg

SEQ ID NO: 15646 - RNA, 20 nt, Artificial Sequence
  TRAC targeting sequence
ccccucagcuuuggaguaca

SEQ ID NO: 15647 - RNA, 20 nt, Artificial Sequence
  TRAC targeting sequence
ccucuccccucagcuuugga

SEQ ID NO: 15648 - RNA, 20 nt, Artificial Sequence
  TRAC targeting sequence
cauccccucuccccucagcu

SEQ ID NO: 15649 - RNA, 20 nt, Artificial Sequence
  TRAC targeting sequence
uguaaaggggaccagcauug

SEQ ID NO: 15650 - RNA, 20 nt, Artificial Sequence
  TRAC targeting sequence
ccuuuacaugaacccagccc

SEQ ID NO: 15651 - RNA, 20 nt, Artificial Sequence
  TRAC targeting sequence
gcacaaugcugguccccuuu

SEQ ID NO: 15652 - RNA, 20 nt, Artificial Sequence
  TRAC targeting sequence
gucggcacaaugcugguccc

SEQ ID NO: 15653 - RNA, 20 nt, Artificial Sequence
  TRAC targeting sequence
acccuggggaggcuauacuu

SEQ ID NO: 15654 - RNA, 20 nt, Artificial Sequence
  TRAC targeting sequence
ccaggguugagccucugucg

SEQ ID NO: 15655 - RNA, 20 nt, Artificial Sequence
  TRAC targeting sequence
aaaguauagccuccccaggg

SEQ ID NO: 15656 - RNA, 20 nt, Artificial Sequence
  TRAC targeting sequence
uccaaaguauagccucccca

SEQ ID NO: 15657 - RNA, 20 nt, Artificial Sequence
  TRAC targeting sequence
ucuuccaaaguauagccucc

SEQ ID NO: 15658 - RNA, 20 nt, Artificial Sequence
  TRAC targeting sequence
guugacugucuggccuggug

SEQ ID NO: 15659 - RNA, 20 nt, Artificial Sequence
  TRAC targeting sequence
acugaguuccucuuccaaag

SEQ ID NO: 15660 - RNA, 20 nt, Artificial Sequence
  TRAC targeting sequence
ggccuggugagugagucgcu

SEQ ID NO: 15661 - RNA, 20 nt, Artificial Sequence
  TRAC targeting sequence
ccaggccagacagucaacug

SEQ ID NO: 15662 - RNA, 20 nt, Artificial Sequence
  TRAC targeting sequence
cucaccaggccagacaguca

SEQ ID NO: 15663 - RNA, 20 nt, Artificial Sequence
  TRAC targeting sequence
cuuucuauuccaggaaaaua

SEQ ID NO: 15664 - RNA, 20 nt, Artificial Sequence
  TRAC targeting sequence
auuccaggaaaauauuacug

SEQ ID NO: 15665 - RNA, 20 nt, Artificial Sequence
  TRAC targeting sequence
aggaaaauauuacuguggag

SEQ ID NO: 15666 - RNA, 20 nt, Artificial Sequence
  TRAC targeting sequence
uggaauagaaagcgacucac

SEQ ID NO: 15667 - RNA, 20 nt, Artificial Sequence
  TRAC targeting sequence
acaguaauauuuuccuggaa

SEQ ID NO: 15668 - RNA, 20 nt, Artificial Sequence
  TRAC targeting sequence
ccacaguaauauuuuccugg

SEQ ID NO: 15669 - RNA, 20 nt, Artificial Sequence
  TRAC targeting sequence
ccuuuuaauuucuccacagu

SEQ ID NO: 15670 - RNA, 20 nt, Artificial Sequence
  TRAC targeting sequence
ccccuuuuaauuucuccaca

SEQ ID NO: 15671 - RNA, 20 nt, Artificial Sequence
  TRAC targeting sequence
ucuccccuuuuaauuucucc

SEQ ID NO: 15672 - RNA, 20 nt, Artificial Sequence
  TRAC targeting sequence
uuuagucuugaaacuaaaga

SEQ ID NO: 15673 - RNA, 20 nt, Artificial Sequence
  TRAC targeting sequence
ugaaacuaaagagauaugug

SEQ ID NO: 15674 - RNA, 20 nt, Artificial Sequence
  TRAC targeting sequence
agacuaaaggaguuaauuca

SEQ ID NO: 15675 - RNA, 20 nt, Artificial Sequence
  TRAC targeting sequence
uuaguuucaagacuaaagga

SEQ ID NO: 15676 - RNA, 20 nt, Artificial Sequence
  TRAC targeting sequence
cuuuaguuucaagacuaaag

SEQ ID NO: 15677 - RNA, 20 nt, Artificial Sequence
  TRAC targeting sequence
ccuccuggaggaccccaguc

SEQ ID NO: 15678 - RNA, 20 nt, Artificial Sequence
  TRAC targeting sequence
uggaggaccccagucccuag

SEQ ID NO: 15679 - RNA, 20 nt, Artificial Sequence
  TRAC targeting sequence
aggaggggaaguacacauau

SEQ ID NO: 15680 - RNA, 20 nt, Artificial Sequence
  TRAC targeting sequence
uccaggaggggaaguacaca

SEQ ID NO: 15681 - RNA, 20 nt, Artificial Sequence
  TRAC targeting sequence
cuagguagauuaggacgagg

SEQ ID NO: 15682 - RNA, 20 nt, Artificial Sequence
  TRAC targeting sequence
accuagggacugggguccuc

SEQ ID NO: 15683 - RNA, 20 nt, Artificial Sequence
  TRAC targeting sequence
uaaucuaccuagggacuggg

SEQ ID NO: 15684 - RNA, 20 nt, Artificial Sequence
  TRAC targeting sequence
uccuaaucuaccuagggacu

SEQ ID NO: 15685 - RNA, 20 nt, Artificial Sequence
  TRAC targeting sequence
ucguccuaaucuaccuaggg

SEQ ID NO: 15686 - RNA, 20 nt, Artificial Sequence
  TRAC targeting sequence
gcuuccucguccuaaucuac

SEQ ID NO: 15687 - RNA, 20 nt, Artificial Sequence
  TRAC targeting sequence
cucugcuuccucguccuaau

SEQ ID NO: 15688 - RNA, 20 nt, Artificial Sequence
  TRAC targeting sequence
cccucugcuuccucguccua

SEQ ID NO: 15689 - RNA, 20 nt, Artificial Sequence
  TRAC targeting sequence
ccuuugucucccucugcuuc

SEQ ID NO: 15690 - RNA, 20 nt, Artificial Sequence
  TRAC targeting sequence
aucgccuuugucucccucug

SEQ ID NO: 15691 - RNA, 20 nt, Artificial Sequence
  TRAC targeting sequence
cuuuuaggaacccaggaauc

SEQ ID NO: 15692 - RNA, 20 nt, Artificial Sequence
  TRAC targeting sequence
uaaaagggacuuuccaucgc

SEQ ID NO: 15693 - RNA, 20 nt, Artificial Sequence
  TRAC targeting sequence
uggguuccuaaaagggacuu

SEQ ID NO: 15694 - RNA, 20 nt, Artificial Sequence
  TRAC targeting sequence
gagagaacuugauggucccc

SEQ ID NO: 15695 - RNA, 20 nt, Artificial Sequence
  TRAC targeting sequence
gauuccuggguuccuaaaag

SEQ ID NO: 15696 - RNA, 20 nt, Artificial Sequence
  TRAC targeting sequence
cugauuccuggguuccuaaa

SEQ ID NO: 15697 - RNA, 20 nt, Artificial Sequence
  TRAC targeting sequence
cucugauuccuggguuccua

SEQ ID NO: 15698 - RNA, 20 nt, Artificial Sequence
  TRAC targeting sequence
aguucucucugauuccuggg

SEQ ID NO: 15699 - RNA, 20 nt, Artificial Sequence
  TRAC targeting sequence
ccaccaaaggcaaagaaggg

SEQ ID NO: 15700 - RNA, 20 nt, Artificial Sequence
  TRAC targeting sequence
uugccuuugguggggaccau

SEQ ID NO: 15701 - RNA, 20 nt, Artificial Sequence
  TRAC targeting sequence
cuucuuugccuuuggugggg

SEQ ID NO: 15702 - RNA, 20 nt, Artificial Sequence
  TRAC targeting sequence
cacuaaaacaugugagcauc

SEQ ID NO: 15703 - RNA, 20 nt, Artificial Sequence
  TRAC targeting sequence
cauguuuuagugggaccucc

SEQ ID NO: 15704 - RNA, 20 nt, Artificial Sequence
  TRAC targeting sequence
uaaaacaccugcucuggucc

SEQ ID NO: 15705 - RNA, 20 nt, Artificial Sequence
  TRAC targeting sequence
gguccacccacaauauuugg

SEQ ID NO: 15706 - RNA, 20 nt, Artificial Sequence
  TRAC targeting sequence
acccacaauauuuggugaag

SEQ ID NO: 15707 - RNA, 20 nt, Artificial Sequence
  TRAC targeting sequence
ccaaauauuguggguggacc

SEQ ID NO: 15708 - RNA, 20 nt, Artificial Sequence
  TRAC targeting sequence
uucaccaaauauugugggug

SEQ ID NO: 15709 - RNA, 20 nt, Artificial Sequence
  TRAC targeting sequence
acccagaaugggcaagcaaa

SEQ ID NO: 15710 - RNA, 20 nt, Artificial Sequence
  TRAC targeting sequence
ggguggagggccauguccuu

SEQ ID NO: 15711 - RNA, 20 nt, Artificial Sequence
  TRAC targeting sequence
aguuugcuugcccauucugg

SEQ ID NO: 15712 - RNA, 20 nt, Artificial Sequence
  TRAC targeting sequence
aagguguguuuuucuugggu

SEQ ID NO: 15713 - RNA, 20 nt, Artificial Sequence
  TRAC targeting sequence
uggguccugugacucuuggc

SEQ ID NO: 15714 - RNA, 20 nt, Artificial Sequence
  TRAC targeting sequence
ugugacucuuggccgucucc

SEQ ID NO: 15715 - RNA, 20 nt, Artificial Sequence
  TRAC targeting sequence
caggacccaagaaaaacaca

SEQ ID NO: 15716 - RNA, 20 nt, Artificial Sequence
  TRAC targeting sequence
uggccgucucccugucagag

SEQ ID NO: 15717 - RNA, 20 nt, Artificial Sequence
  TRAC targeting sequence
cccugucagaggcuccaucu

SEQ ID NO: 15718 - RNA, 20 nt, Artificial Sequence
  TRAC targeting sequence
cugucagaggcuccaucugu

SEQ ID NO: 15719 - RNA, 20 nt, Artificial Sequence
  TRAC targeting sequence
gaggcuccaucugucgcugc

SEQ ID NO: 15720 - RNA, 20 nt, Artificial Sequence
  TRAC targeting sequence
gacagggagacggccaagag

SEQ ID NO: 15721 - RNA, 20 nt, Artificial Sequence
  TRAC targeting sequence
aucugucgcugcacucuuuc

SEQ ID NO: 15722 - RNA, 20 nt, Artificial Sequence
  TRAC targeting sequence
gucgcugcacucuuucuuau

SEQ ID NO: 15723 - RNA, 20 nt, Artificial Sequence
  TRAC targeting sequence
cugcacucuuucuuauugag

SEQ ID NO: 15724 - RNA, 20 nt, Artificial Sequence
  TRAC targeting sequence
uucuuauugagaauggccuc

SEQ ID NO: 15725 - RNA, 20 nt, Artificial Sequence
  TRAC targeting sequence
uauugagaauggccucuccg

SEQ ID NO: 15726 - RNA, 20 nt, Artificial Sequence
  TRAC targeting sequence
auaagaaagagugcagcgac

SEQ ID NO: 15727 - RNA, 20 nt, Artificial Sequence
  TRAC targeting sequence
caauaagaaagagugcagcg

SEQ ID NO: 15728 - RNA, 20 nt, Artificial Sequence
  TRAC targeting sequence
ccgugguucucuguaaacuu

SEQ ID NO: 15729 - RNA, 20 nt, Artificial Sequence
  TRAC targeting sequence
gugguucucuguaaacuuuc

SEQ ID NO: 15730 - RNA, 20 nt, Artificial Sequence
  TRAC targeting sequence
cuguaaacuuuccccaagaa

SEQ ID NO: 15731 - RNA, 20 nt, Artificial Sequence
  TRAC targeting sequence
guaaacuuuccccaagaagc

SEQ ID NO: 15732 - RNA, 20 nt, Artificial Sequence
  TRAC targeting sequence
ccaagaagccuguuuccaug

SEQ ID NO: 15733 - RNA, 20 nt, Artificial Sequence
  TRAC targeting sequence
uggggaaaguuuacagagaa

SEQ ID NO: 15734 - RNA, 20 nt, Artificial Sequence
  TRAC targeting sequence
augcuuccucagcacuuagc

SEQ ID NO: 15735 - RNA, 20 nt, Artificial Sequence
  TRAC targeting sequence
ucagcacuuagccucaccga

SEQ ID NO: 15736 - RNA, 20 nt, Artificial Sequence
  TRAC targeting sequence
gcacuuagccucaccgaugg

SEQ ID NO: 15737 - RNA, 20 nt, Artificial Sequence
  TRAC targeting sequence
ccgauggaugggcucuagag

SEQ ID NO: 15738 - RNA, 20 nt, Artificial Sequence
  TRAC targeting sequence
gugaggcuaagugcugagga

SEQ ID NO: 15739 - RNA, 20 nt, Artificial Sequence
  TRAC targeting sequence
aucggugaggcuaagugcug

SEQ ID NO: 15740 - RNA, 20 nt, Artificial Sequence
  TRAC targeting sequence
agaguagcuggagggagucu

SEQ ID NO: 15741 - RNA, 20 nt, Artificial Sequence
  TRAC targeting sequence
agagcccauccaucggugag

SEQ ID NO: 15742 - RNA, 20 nt, Artificial Sequence
  TRAC targeting sequence
agcuacucuagagcccaucc

SEQ ID NO: 15743 - RNA, 20 nt, Artificial Sequence
  TRAC targeting sequence
cuccagcuacucuagagccc

SEQ ID NO: 15744 - RNA, 20 nt, Artificial Sequence
  TRAC targeting sequence
gggucugaaacuuucacuga

SEQ ID NO: 15745 - RNA, 20 nt, Artificial Sequence
  TRAC targeting sequence
gaaacuuucacugagaaagu

SEQ ID NO: 15746 - RNA, 20 nt, Artificial Sequence
  TRAC targeting sequence
gacccagacucccuccagcu

SEQ ID NO: 15747 - RNA, 20 nt, Artificial Sequence
  TRAC targeting sequence
cugagaaaguaaaguugauc

SEQ ID NO: 15748 - RNA, 20 nt, Artificial Sequence
  TRAC targeting sequence
gugaaaguuucagacccaga

SEQ ID NO: 15749 - RNA, 20 nt, Artificial Sequence
  TRAC targeting sequence
cagugaaaguuucagaccca

SEQ ID NO: 15750 - RNA, 20 nt, Artificial Sequence
  TRAC targeting sequence
acuuuacuuucucagugaaa

SEQ ID NO: 15751 - RNA, 20 nt, Artificial Sequence
  TRAC targeting sequence
gcaguauccaguggauaugg

SEQ ID NO: 15752 - RNA, 20 nt, Artificial Sequence
  TRAC targeting sequence
aguggauauggcagcuggga

SEQ ID NO: 15753 - RNA, 20 nt, Artificial Sequence
  TRAC targeting sequence
acuggauacugcggaucaac

SEQ ID NO: 15754 - RNA, 20 nt, Artificial Sequence
  TRAC targeting sequence
cagcugccauauccacugga

SEQ ID NO: 15755 - RNA, 20 nt, Artificial Sequence
  TRAC targeting sequence
ucccagcugccauauccacu

SEQ ID NO: 15756 - RNA, 20 nt, Artificial Sequence
  TRAC targeting sequence
uagguccucccagcugccau

SEQ ID NO: 15757 - RNA, 20 nt, Artificial Sequence
  TRAC targeting sequence
guccuagguccucccagcug

SEQ ID NO: 15758 - RNA, 20 nt, Artificial Sequence
  TRAC targeting sequence
uccucucuuuggggccuuuc

SEQ ID NO: 15759 - RNA, 20 nt, Artificial Sequence
  TRAC targeting sequence
ucucuuuggggccuuuccug

SEQ ID NO: 15760 - RNA, 20 nt, Artificial Sequence
  TRAC targeting sequence
cuuuggggccuuuccugggc

SEQ ID NO: 15761 - RNA, 20 nt, Artificial Sequence
  TRAC targeting sequence
uuggggccuuuccugggcac

SEQ ID NO: 15762 - RNA, 20 nt, Artificial Sequence
  TRAC targeting sequence
ugggcacucgauugaauaca

SEQ ID NO: 15763 - RNA, 20 nt, Artificial Sequence
  TRAC targeting sequence
auugaauacagaaacccugu

SEQ ID NO: 15764 - RNA, 20 nt, Artificial Sequence
  TRAC targeting sequence
agugcccaggaaaggcccca

SEQ ID NO: 15765 - RNA, 20 nt, Artificial Sequence
  TRAC targeting sequence
aucgagugcccaggaaaggc

SEQ ID NO: 15766 - RNA, 20 nt, Artificial Sequence
  TRAC targeting sequence
guauucaaucgagugcccag

SEQ ID NO: 15767 - RNA, 20 nt, Artificial Sequence
  TRAC targeting sequence
uauacaugcaugcacuugcu

SEQ ID NO: 15768 - RNA, 20 nt, Artificial Sequence
  TRAC targeting sequence
uucagcauuuccauucugaa

SEQ ID NO: 15769 - RNA, 20 nt, Artificial Sequence
  TRAC targeting sequence
gcauuuccauucugaaugua

SEQ ID NO: 15770 - RNA, 20 nt, Artificial Sequence
  TRAC targeting sequence
auucugaauguaugaauagc

SEQ ID NO: 15771 - RNA, 20 nt, Artificial Sequence
  TRAC targeting sequence
gaauguaugaauagccuuac

SEQ ID NO: 15772 - RNA, 20 nt, Artificial Sequence
  TRAC targeting sequence
gaauggaaaugcugaaugaa

SEQ ID NO: 15773 - RNA, 20 nt, Artificial Sequence
  TRAC targeting sequence
uacauucagaauggaaaugc

SEQ ID NO: 15774 - RNA, 20 nt, Artificial Sequence
  TRAC targeting sequence
gaagacucccuggagcuuac

SEQ ID NO: 15775 - RNA, 20 nt, Artificial Sequence
  TRAC targeting sequence
gaguaaggcuauucauacau

SEQ ID NO: 15776 - RNA, 20 nt, Artificial Sequence
  TRAC targeting sequence
ucagaguaaggcuauucaua

SEQ ID NO: 15777 - RNA, 20 nt, Artificial Sequence
  TRAC targeting sequence
cuggagcuuacagggcuuuc

SEQ ID NO: 15778 - RNA, 20 nt, Artificial Sequence
  TRAC targeting sequence
agggagucuucagaguaagg

SEQ ID NO: 15779 - RNA, 20 nt, Artificial Sequence
  TRAC targeting sequence
guuuucagagaaaauugccu

SEQ ID NO: 15780 - RNA, 20 nt, Artificial Sequence
  TRAC targeting sequence
gagaaaauugccuuugugag

SEQ ID NO: 15781 - RNA, 20 nt, Artificial Sequence
  TRAC targeting sequence
gaaaacagaaagcccuguaa

SEQ ID NO: 15782 - RNA, 20 nt, Artificial Sequence
  TRAC targeting sequence
cugaaaacagaaagcccugu

SEQ ID NO: 15783 - RNA, 20 nt, Artificial Sequence
  TRAC targeting sequence
caaaggcaauuuucucugaa

SEQ ID NO: 15784 - RNA, 20 nt, Artificial Sequence
  TRAC targeting sequence
cacaaaggcaauuuucucug

SEQ ID NO: 15785 - RNA, 20 nt, Artificial Sequence
  TRAC targeting sequence
ggggcccacuuggccauuuu

SEQ ID NO: 15786 - RNA, 20 nt, Artificial Sequence
  TRAC targeting sequence
uucaggggcccacuuggcca

SEQ ID NO: 15787 - RNA, 20 nt, Artificial Sequence
  TRAC targeting sequence
accauaaccucauucagggg

SEQ ID NO: 15788 - RNA, 20 nt, Artificial Sequence
  TRAC targeting sequence
caaccauaaccucauucagg

SEQ ID NO: 15789 - RNA, 20 nt, Artificial Sequence
  TRAC targeting sequence
uuauucacagagcaagaucc

SEQ ID NO: 15790 - RNA, 20 nt, Artificial Sequence
  TRAC targeting sequence
cagagcaagauccgaauucc

SEQ ID NO: 15791 - RNA, 20 nt, Artificial Sequence
  TRAC targeting sequence
gugaauaaggauaauauuaa

SEQ ID NO: 15792 - RNA, 20 nt, Artificial Sequence
  TRAC targeting sequence
ugcucugugaauaaggauaa

SEQ ID NO: 15793 - RNA, 20 nt, Artificial Sequence
  TRAC targeting sequence
gaauucccaaagcagaguag

SEQ ID NO: 15794 - RNA, 20 nt, Artificial Sequence
  TRAC targeting sequence
gaucuugcucugugaauaag

SEQ ID NO: 15795 - RNA, 20 nt, Artificial Sequence
  TRAC targeting sequence
caaagcagaguagacaauaa

SEQ ID NO: 15796 - RNA, 20 nt, Artificial Sequence
  TRAC targeting sequence
gcuuugggaauucggaucuu

SEQ ID NO: 15797 - RNA, 20 nt, Artificial Sequence
  TRAC targeting sequence
acucugcuuugggaauucgg

SEQ ID NO: 15798 - RNA, 20 nt, Artificial Sequence
  TRAC targeting sequence
cauaguuauugucuacucug

SEQ ID NO: 15799 - RNA, 20 nt, Artificial Sequence
  TRAC targeting sequence
aagcccuucacauaguuauu

SEQ ID NO: 15800 - RNA, 20 nt, Artificial Sequence
  TRAC targeting sequence
agcucuaugaagaggauaca

SEQ ID NO: 15801 - RNA, 20 nt, Artificial Sequence
  TRAC targeting sequence
augaagaggauacagugcua

SEQ ID NO: 15802 - RNA, 20 nt, Artificial Sequence
  TRAC targeting sequence
uagagcuggaaugcuugcaa

SEQ ID NO: 15803 - RNA, 20 nt, Artificial Sequence
  TRAC targeting sequence
ucauagagcuggaaugcuug

SEQ ID NO: 15804 - RNA, 20 nt, Artificial Sequence
  TRAC targeting sequence
ucuucauagagcuggaaugc

SEQ ID NO: 15805 - RNA, 20 nt, Artificial Sequence
  TRAC targeting sequence
uagcacuguauccucuucau

SEQ ID NO: 15806 - RNA, 20 nt, Artificial Sequence
  TRAC targeting sequence
ccuagcacuguauccucuuc

SEQ ID NO: 15807 - RNA, 20 nt, Artificial Sequence
  TRAC targeting sequence
uaucuccuagcacuguaucc

SEQ ID NO: 15808 - RNA, 20 nt, Artificial Sequence
  TRAC targeting sequence
acuuuuccaagaccauagaa

SEQ ID NO: 15809 - RNA, 20 nt, Artificial Sequence
  TRAC targeting sequence
aagaccauagaaaauguccu

SEQ ID NO: 15810 - RNA, 20 nt, Artificial Sequence
  TRAC targeting sequence
uggaaaaguggaggguuugc

SEQ ID NO: 15811 - RNA, 20 nt, Artificial Sequence
  TRAC targeting sequence
auggucuuggaaaaguggag

SEQ ID NO: 15812 - RNA, 20 nt, Artificial Sequence
  TRAC targeting sequence
uuuguugagcaccaacugag

SEQ ID NO: 15813 - RNA, 20 nt, Artificial Sequence
  TRAC targeting sequence
acaaaggacauuuucuaugg

SEQ ID NO: 15814 - RNA, 20 nt, Artificial Sequence
  TRAC targeting sequence
guuggugcucaacaaaggac

SEQ ID NO: 15815 - RNA, 20 nt, Artificial Sequence
  TRAC targeting sequence
uggucccugugguuuuugcu

SEQ ID NO: 15816 - RNA, 20 nt, Artificial Sequence
  TRAC targeting sequence
cugugguuuuugcugggccu

SEQ ID NO: 15817 - RNA, 20 nt, Artificial Sequence
  TRAC targeting sequence
uugugugaucaaagcugcag

SEQ ID NO: 15818 - RNA, 20 nt, Artificial Sequence
  TRAC targeting sequence
cacaaugauuuaaggcccag

SEQ ID NO: 15819 - RNA, 20 nt, Artificial Sequence
  TRAC targeting sequence
aagcugcaggcaacaagcua

SEQ ID NO: 15820 - RNA, 20 nt, Artificial Sequence
  TRAC targeting sequence
aaaaguuagcuuguugccug

SEQ ID NO: 15821 - RNA, 20 nt, Artificial Sequence
  TRAC targeting sequence
uccaaaaguuagcuuguugc

SEQ ID NO: 15822 - RNA, 20 nt, Artificial Sequence
  TRAC targeting sequence
uccuccaaaaguuagcuugu

SEQ ID NO: 15823 - RNA, 20 nt, Artificial Sequence
  TRAC targeting sequence
cuugguuuaacuagcacccu

SEQ ID NO: 15824 - RNA, 20 nt, Artificial Sequence
  TRAC targeting sequence
agccccaguacucacuuggu

SEQ ID NO: 15825 - RNA, 20 nt, Artificial Sequence
  TRAC targeting sequence
auugugggucaagccccagu

SEQ ID NO: 15826 - RNA, 20 nt, Artificial Sequence
  TRAC targeting sequence
ucaauuugcaauucaaugug

SEQ ID NO: 15827 - RNA, 20 nt, Artificial Sequence
  TRAC targeting sequence
auuugcaauucaaugugccg

SEQ ID NO: 15828 - RNA, 20 nt, Artificial Sequence
  TRAC targeting sequence
augugccguauuggcccaaa

SEQ ID NO: 15829 - RNA, 20 nt, Artificial Sequence
  TRAC targeting sequence
caaacuugucuuuaaaaugu

SEQ ID NO: 15830 - RNA, 20 nt, Artificial Sequence
  TRAC targeting sequence
aacuugucuuuaaaauguuu

SEQ ID NO: 15831 - RNA, 20 nt, Artificial Sequence
  TRAC targeting sequence
uuaaaauguuucauguugcu

SEQ ID NO: 15832 - RNA, 20 nt, Artificial Sequence
  TRAC targeting sequence
uguugcucuuaugcauaaac

SEQ ID NO: 15833 - RNA, 20 nt, Artificial Sequence
  TRAC targeting sequence
uaugcauaaacaugcacuua

SEQ ID NO: 15834 - RNA, 20 nt, Artificial Sequence
  TRAC targeting sequence
gcauggauaaaggauauugu

SEQ ID NO: 15835 - RNA, 20 nt, Artificial Sequence
  TRAC targeting sequence
augcugaauuuguacauaag

SEQ ID NO: 15836 - RNA, 20 nt, Artificial Sequence
  TRAC targeting sequence
uuuauccaugcugaauuugu

SEQ ID NO: 15837 - RNA, 20 nt, Artificial Sequence
  TRAC targeting sequence
ucuugacauuuucuagaauc

SEQ ID NO: 15838 - RNA, 20 nt, Artificial Sequence
  TRAC targeting sequence
ugacauuuucuagaaucuau

SEQ ID NO: 15839 - RNA, 20 nt, Artificial Sequence
  TRAC targeting sequence
agaugacaauauccuuuauc

SEQ ID NO: 15840 - RNA, 20 nt, Artificial Sequence
  TRAC targeting sequence
agaaucuauuuucuuaagag

SEQ ID NO: 15841 - RNA, 20 nt, Artificial Sequence
  TRAC targeting sequence
agaaaaugucaagaugacaa

SEQ ID NO: 15842 - RNA, 20 nt, Artificial Sequence
  TRAC targeting sequence
auuuucuuaagagaaggcac

SEQ ID NO: 15843 - RNA, 20 nt, Artificial Sequence
  TRAC targeting sequence
uaagagaaggcacauaguaa

SEQ ID NO: 15844 - RNA, 20 nt, Artificial Sequence
  TRAC targeting sequence
uaagaaaauagauucuagaa

SEQ ID NO: 15845 - RNA, 20 nt, Artificial Sequence
  TRAC targeting sequence
cuuaagaaaauagauucuag

SEQ ID NO: 15846 - RNA, 20 nt, Artificial Sequence
  TRAC targeting sequence
uauuucuucacauuucuuaa

SEQ ID NO: 15847 - RNA, 20 nt, Artificial Sequence
  TRAC targeting sequence
ucacauuucuuaacugauuu

SEQ ID NO: 15848 - RNA, 20 nt, Artificial Sequence
  TRAC targeting sequence
cauuucuuaacugauuuucc

SEQ ID NO: 15849 - RNA, 20 nt, Artificial Sequence
  TRAC targeting sequence
uaacugauuuucccaagagg

SEQ ID NO: 15850 - RNA, 20 nt, Artificial Sequence
  TRAC targeting sequence
guuaagaaaugugaagaaau

SEQ ID NO: 15851 - RNA, 20 nt, Artificial Sequence
  TRAC targeting sequence
caagaggcagaggaacuugg

SEQ ID NO: 15852 - RNA, 20 nt, Artificial Sequence
  TRAC targeting sequence
ugggaaaaucaguuaagaaa

SEQ ID NO: 15853 - RNA, 20 nt, Artificial Sequence
  TRAC targeting sequence
gccucuugggaaaaucaguu

SEQ ID NO: 15854 - RNA, 20 nt, Artificial Sequence
  TRAC targeting sequence
ucugccucuugggaaaauca

SEQ ID NO: 15855 - RNA, 20 nt, Artificial Sequence
  TRAC targeting sequence
aaguuccucugccucuuggg

SEQ ID NO: 15856 - RNA, 20 nt, Artificial Sequence
  TRAC targeting sequence
gucuauucagaguaguugau

SEQ ID NO: 15857 - RNA, 20 nt, Artificial Sequence
  TRAC targeting sequence
auucagaguaguugauuuga

SEQ ID NO: 15858 - RNA, 20 nt, Artificial Sequence
  TRAC targeting sequence
gaguaguugauuugaauaug

SEQ ID NO: 15859 - RNA, 20 nt, Artificial Sequence
  TRAC targeting sequence
gaauagacagaaacgccacg

SEQ ID NO: 15860 - RNA, 20 nt, Artificial Sequence
  TRAC targeting sequence
acuacucugaauagacagaa

SEQ ID NO: 15861 - RNA, 20 nt, Artificial Sequence
  TRAC targeting sequence
aaucaacuacucugaauaga

SEQ ID NO: 15862 - RNA, 20 nt, Artificial Sequence
  TRAC targeting sequence
gcuauuguaaccauauucaa

SEQ ID NO: 15863 - RNA, 20 nt, Artificial Sequence
  TRAC targeting sequence
uugcucugcuauuguaacca

SEQ ID NO: 15864 - RNA, 20 nt, Artificial Sequence
  TRAC targeting sequence
aagguucaaaauauugcugu

SEQ ID NO: 15865 - RNA, 20 nt, Artificial Sequence
  TRAC targeting sequence
aaauauugcugucuguacca

SEQ ID NO: 15866 - RNA, 20 nt, Artificial Sequence
  TRAC targeting sequence
guaccagccugcagccucua

SEQ ID NO: 15867 - RNA, 20 nt, Artificial Sequence
  TRAC targeting sequence
auaaccauuauucugauuua

SEQ ID NO: 15868 - RNA, 20 nt, Artificial Sequence
  TRAC targeting sequence
gauuuauuuccucuggcccu

SEQ ID NO: 15869 - RNA, 20 nt, Artificial Sequence
  TRAC targeting sequence
gaauaaugguuauagaggcu

SEQ ID NO: 15870 - RNA, 20 nt, Artificial Sequence
  TRAC targeting sequence
ucuggcccucauuuuuccca

SEQ ID NO: 15871 - RNA, 20 nt, Artificial Sequence
  TRAC targeting sequence
ggcccucauuuuucccaauu

SEQ ID NO: 15872 - RNA, 20 nt, Artificial Sequence
  TRAC targeting sequence
uuuuucccaauuaauguaac

SEQ ID NO: 15873 - RNA, 20 nt, Artificial Sequence
  TRAC targeting sequence
caauuaauguaacugaaaua

SEQ ID NO: 15874 - RNA, 20 nt, Artificial Sequence
  TRAC targeting sequence
guuacauuaauugggaaaaa

SEQ ID NO: 15875 - RNA, 20 nt, Artificial Sequence
  TRAC targeting sequence
uccgguucacagaaagugug

SEQ ID NO: 15876 - RNA, 20 nt, Artificial Sequence
  TRAC targeting sequence
gguucacagaaaguguguga

SEQ ID NO: 15877 - RNA, 20 nt, Artificial Sequence
  TRAC targeting sequence
cagaaagugugugaggauua

SEQ ID NO: 15878 - RNA, 20 nt, Artificial Sequence
  TRAC targeting sequence
gugaaccggaagauaauggu

SEQ ID NO: 15879 - RNA, 20 nt, Artificial Sequence
  TRAC targeting sequence
cacacuuucugugaaccgga

SEQ ID NO: 15880 - RNA, 20 nt, Artificial Sequence
  TRAC targeting sequence
ucacacacuuucugugaacc

SEQ ID NO: 15881 - RNA, 20 nt, Artificial Sequence
  TRAC targeting sequence
cugcucugaaaaggaauuga

SEQ ID NO: 15882 - RNA, 20 nt, Artificial Sequence
  TRAC targeting sequence
gaaaaggaauugagcuggag

SEQ ID NO: 15883 - RNA, 20 nt, Artificial Sequence
  TRAC targeting sequence
gagcagcgacuuuuuaaucc

SEQ ID NO: 15884 - RNA, 20 nt, Artificial Sequence
  TRAC targeting sequence
uuuucagagcagcgacuuuu

SEQ ID NO: 15885 - RNA, 20 nt, Artificial Sequence
  TRAC targeting sequence
auuccuuuucagagcagcga

SEQ ID NO: 15886 - RNA, 20 nt, Artificial Sequence
  TRAC targeting sequence
agcucaauuccuuuucagag

SEQ ID NO: 15887 - RNA, 20 nt, Artificial Sequence
  TRAC targeting sequence
uuugggggauuauuguuuug

SEQ ID NO: 15888 - RNA, 20 nt, Artificial Sequence
  TRAC targeting sequence
cccaaaagaaaacccuccag

SEQ ID NO: 15889 - RNA, 20 nt, Artificial Sequence
  TRAC targeting sequence
acaaaacaauaaucccccaa

SEQ ID NO: 15890 - RNA, 20 nt, Artificial Sequence
  TRAC targeting sequence
cuuucauugagggagagaau

SEQ ID NO: 15891 - RNA, 20 nt, Artificial Sequence
  TRAC targeting sequence
uucauugagggagagaauaa

SEQ ID NO: 15892 - RNA, 20 nt, Artificial Sequence
  TRAC targeting sequence
uugagggagagaauaagaaa

SEQ ID NO: 15893 - RNA, 20 nt, Artificial Sequence
  TRAC targeting sequence
augaaagagacaauaccauc

SEQ ID NO: 15894 - RNA, 20 nt, Artificial Sequence
  TRAC targeting sequence
cucaaugaaagagacaauac

SEQ ID NO: 15895 - RNA, 20 nt, Artificial Sequence
  TRAC targeting sequence
cccucaaugaaagagacaau

SEQ ID NO: 15896 - RNA, 20 nt, Artificial Sequence
  TRAC targeting sequence
cucccucaaugaaagagaca

SEQ ID NO: 15897 - RNA, 20 nt, Artificial Sequence
  TRAC targeting sequence
uauucucucccucaaugaaa

SEQ ID NO: 15898 - RNA, 20 nt, Artificial Sequence
  TRAC targeting sequence
uuucuuauucucucccucaa

SEQ ID NO: 15899 - RNA, 20 nt, Artificial Sequence
  TRAC targeting sequence
aguaugccuccuuucuuauu

SEQ ID NO: 15900 - RNA, 20 nt, Artificial Sequence
  TRAC targeting sequence
uauuaccuugccuuucaagu

SEQ ID NO: 15901 - RNA, 20 nt, Artificial Sequence
  TRAC targeting sequence
auacaugaacgugugcaaaa

SEQ ID NO: 15902 - RNA, 20 nt, Artificial Sequence
  TRAC targeting sequence
uguauugaucauauuaccuu

SEQ ID NO: 15903 - RNA, 20 nt, Artificial Sequence
  TRAC targeting sequence
uuaaggcauucaacuagaag

SEQ ID NO: 15904 - RNA, 20 nt, Artificial Sequence
  TRAC targeting sequence
acuagaagccaaaaaacagu

SEQ ID NO: 15905 - RNA, 20 nt, Artificial Sequence
  TRAC targeting sequence
aguugaaugccuuaaugauu

SEQ ID NO: 15906 - RNA, 20 nt, Artificial Sequence
  TRAC targeting sequence
auacuguuuuuuggcuucua

SEQ ID NO: 15907 - RNA, 20 nt, Artificial Sequence
  TRAC targeting sequence
gccacucacucacuaggcag

SEQ ID NO: 15908 - RNA, 20 nt, Artificial Sequence
  TRAC targeting sequence
cucacuaggcagccaugaga

SEQ ID NO: 15909 - RNA, 20 nt, Artificial Sequence
  TRAC targeting sequence
cuaggcagccaugagaagau

SEQ ID NO: 15910 - RNA, 20 nt, Artificial Sequence
  TRAC targeting sequence
uggcugccuagugagugagu

SEQ ID NO: 15911 - RNA, 20 nt, Artificial Sequence
  TRAC targeting sequence
cauggcugccuagugaguga

SEQ ID NO: 15912 - RNA, 20 nt, Artificial Sequence
  TRAC targeting sequence
ucucauggcugccuagugag

SEQ ID NO: 15913 - RNA, 20 nt, Artificial Sequence
  TRAC targeting sequence
ccaagcucucccagccucag

SEQ ID NO: 15914 - RNA, 20 nt, Artificial Sequence
  TRAC targeting sequence
cccagccucaguuaaccuaa

SEQ ID NO: 15915 - RNA, 20 nt, Artificial Sequence
  TRAC targeting sequence
cagccucaguuaaccuaaaa

SEQ ID NO: 15916 - RNA, 20 nt, Artificial Sequence
  TRAC targeting sequence
guuaaccuaaaauguggaga

SEQ ID NO: 15917 - RNA, 20 nt, Artificial Sequence
  TRAC targeting sequence
acauuuuagguuaacugagg

SEQ ID NO: 15918 - RNA, 20 nt, Artificial Sequence
  TRAC targeting sequence
ccacauuuuagguuaacuga

SEQ ID NO: 15919 - RNA, 20 nt, Artificial Sequence
  TRAC targeting sequence
agccuugacuacuucaaagg

SEQ ID NO: 15920 - RNA, 20 nt, Artificial Sequence
  TRAC targeting sequence
aggcuggaauaauaaucucc

SEQ ID NO: 15921 - RNA, 20 nt, Artificial Sequence
  TRAC targeting sequence
aaggaugcuaugaaauucag

SEQ ID NO: 15922 - RNA, 20 nt, Artificial Sequence
  TRAC targeting sequence
uuugaaguagucaaggcugg

SEQ ID NO: 15923 - RNA, 20 nt, Artificial Sequence
  TRAC targeting sequence
uagcauccuuugaaguaguc

SEQ ID NO: 15924 - RNA, 20 nt, Artificial Sequence
  TRAC targeting sequence
gaugagauaauauaugugaa

SEQ ID NO: 15925 - RNA, 20 nt, Artificial Sequence
  TRAC targeting sequence
gaauuucauagcauccuuug

SEQ ID NO: 15926 - RNA, 20 nt, Artificial Sequence
  TRAC targeting sequence
ucugaauuucauagcauccu

SEQ ID NO: 15927 - RNA, 20 nt, Artificial Sequence
  TRAC targeting sequence
caucugaauuucauagcauc

SEQ ID NO: 15928 - RNA, 20 nt, Artificial Sequence
  TRAC targeting sequence
cauauauuaucucaucugaa

SEQ ID NO: 15929 - RNA, 20 nt, Artificial Sequence
  TRAC targeting sequence
ccuugaaaaagauggguggu

SEQ ID NO: 15930 - RNA, 20 nt, Artificial Sequence
  TRAC targeting sequence
uugaaaaagaugggugguca

SEQ ID NO: 15931 - RNA, 20 nt, Artificial Sequence
  TRAC targeting sequence
aggagauuucacauauauua

SEQ ID NO: 15932 - RNA, 20 nt, Artificial Sequence
  TRAC targeting sequence
uuuucaaggagauuucacau

SEQ ID NO: 15933 - RNA, 20 nt, Artificial Sequence
  TRAC targeting sequence
aaugauucaugauuuuuuuu

SEQ ID NO: 15934 - RNA, 20 nt, Artificial Sequence
  TRAC targeting sequence
uuugaccacccaucuuuuuc

SEQ ID NO: 15935 - RNA, 20 nt, Artificial Sequence
  TRAC targeting sequence
ugauuuuuuuuuuuuuuuuu

SEQ ID NO: 15936 - RNA, 20 nt, Artificial Sequence
  TRAC targeting sequence
ugaaucauuugaccacccau

SEQ ID NO: 15937 - RNA, 20 nt, Artificial Sequence
  TRAC targeting sequence
aaaaaaaaaaaaaaaaaaaa

SEQ ID NO: 15938 - RNA, 20 nt, Artificial Sequence
  TRAC targeting sequence
caaaaaaaaaaaaaaaaaaa

SEQ ID NO: 15939 - RNA, 20 nt, Artificial Sequence
  TRAC targeting sequence
gucucaaaaaaaaaaaaaaa

SEQ ID NO: 15940 - RNA, 20 nt, Artificial Sequence
  TRAC targeting sequence
cgcucugucgcccaggcugg

SEQ ID NO: 15941 - RNA, 20 nt, Artificial Sequence
  TRAC targeting sequence
cucugucgcccaggcuggag

SEQ ID NO: 15942 - RNA, 20 nt, Artificial Sequence
  TRAC targeting sequence
gucgcccaggcuggagugca

SEQ ID NO: 15943 - RNA, 20 nt, Artificial Sequence
  TRAC targeting sequence
cccaggcuggagugcagugg

SEQ ID NO: 15944 - RNA, 20 nt, Artificial Sequence
  TRAC targeting sequence
agccugggcgacagagcgag

SEQ ID NO: 15945 - RNA, 20 nt, Artificial Sequence
  TRAC targeting sequence
cgccacugcacuccagccug

SEQ ID NO: 15946 - RNA, 20 nt, Artificial Sequence
  TRAC targeting sequence
cggcucacugcaagcuccgc

SEQ ID NO: 15947 - RNA, 20 nt, Artificial Sequence
  TRAC targeting sequence
gcucacugcaagcuccgccu

SEQ ID NO: 15948 - RNA, 20 nt, Artificial Sequence
  TRAC targeting sequence
cugcaagcuccgccucccgg

SEQ ID NO: 15949 - RNA, 20 nt, Artificial Sequence
  TRAC targeting sequence
gccucccggguucacgccau

SEQ ID NO: 15950 - RNA, 20 nt, Artificial Sequence
  TRAC targeting sequence
cggguucacgccauucuccu

SEQ ID NO: 15951 - RNA, 20 nt, Artificial Sequence
  TRAC targeting sequence
cgccauucuccugccucagc

SEQ ID NO: 15952 - RNA, 20 nt, Artificial Sequence
  TRAC targeting sequence
ccugccucagccucccaagu

SEQ ID NO: 15953 - RNA, 20 nt, Artificial Sequence
  TRAC targeting sequence
ugccucagccucccaaguag

SEQ ID NO: 15954 - RNA, 20 nt, Artificial Sequence
  TRAC targeting sequence
gccucccaaguagcugggac

SEQ ID NO: 15955 - RNA, 20 nt, Artificial Sequence
  TRAC targeting sequence
caaguagcugggaccacagg

SEQ ID NO: 15956 - RNA, 20 nt, Artificial Sequence
  TRAC targeting sequence
cagcuacuugggaggcugag

SEQ ID NO: 15957 - RNA, 20 nt, Artificial Sequence
  TRAC targeting sequence
acuaaaaauacaaaaaauua

SEQ ID NO: 15958 - RNA, 20 nt, Artificial Sequence
  TRAC targeting sequence
cuacuaaaaauacaaaaaau

SEQ ID NO: 15959 - RNA, 20 nt, Artificial Sequence
  TRAC targeting sequence
ucucuacuaaaaauacaaaa

SEQ ID NO: 15960 - RNA, 20 nt, Artificial Sequence
  TRAC targeting sequence
ccguuuuagccgggaugguc

SEQ ID NO: 15961 - RNA, 20 nt, Artificial Sequence
  TRAC targeting sequence
cggcuaaaacggugaaaccu

SEQ ID NO: 15962 - RNA, 20 nt, Artificial Sequence
  TRAC targeting sequence
cgaucuccugaccucgugau

SEQ ID NO: 15963 - RNA, 20 nt, Artificial Sequence
  TRAC targeting sequence
aucuccugaccucgugaucc

SEQ ID NO: 15964 - RNA, 20 nt, Artificial Sequence
  TRAC targeting sequence
agaccaucccggcuaaaacg

SEQ ID NO: 15965 - RNA, 20 nt, Artificial Sequence
  TRAC targeting sequence
ccugaccucgugauccgccc

SEQ ID NO: 15966 - RNA, 20 nt, Artificial Sequence
  TRAC targeting sequence
ugaccucgugauccgcccgc

SEQ ID NO: 15967 - RNA, 20 nt, Artificial Sequence
  TRAC targeting sequence
ggagaucgagaccaucccgg

SEQ ID NO: 15968 - RNA, 20 nt, Artificial Sequence
  TRAC targeting sequence
ugauccgcccgccucggccu

SEQ ID NO: 15969 - RNA, 20 nt, Artificial Sequence
  TRAC targeting sequence
cgaggucaggagaucgagac

SEQ ID NO: 15970 - RNA, 20 nt, Artificial Sequence
  TRAC targeting sequence
gcccgccucggccucccaaa

SEQ ID NO: 15971 - RNA, 20 nt, Artificial Sequence
  TRAC targeting sequence
gccucccaaagugcugggau

SEQ ID NO: 15972 - RNA, 20 nt, Artificial Sequence
  TRAC targeting sequence
caaagugcugggauuacagg

SEQ ID NO: 15973 - RNA, 20 nt, Artificial Sequence
  TRAC targeting sequence
cagcacuuugggaggccgag

SEQ ID NO: 15974 - RNA, 20 nt, Artificial Sequence
  TRAC targeting sequence
cgccuguaaucccagcacuu

SEQ ID NO: 15975 - RNA, 20 nt, Artificial Sequence
  TRAC targeting sequence
ugauuuuuaauaguuagauu

SEQ ID NO: 15976 - RNA, 20 nt, Artificial Sequence
  TRAC targeting sequence
ugaggccgggcgcgguggcu

SEQ ID NO: 15977 - RNA, 20 nt, Artificial Sequence
  TRAC targeting sequence
aacuauuaaaaaucaugagg

SEQ ID NO: 15978 - RNA, 20 nt, Artificial Sequence
  TRAC targeting sequence
uuugaggguaaacuuaaagg

SEQ ID NO: 15979 - RNA, 20 nt, Artificial Sequence
  TRAC targeting sequence
aaugaaauuuugcauaaaau

SEQ ID NO: 15980 - RNA, 20 nt, Artificial Sequence
  TRAC targeting sequence
ccuuuaaguuuacccucaaa

SEQ ID NO: 15981 - RNA, 20 nt, Artificial Sequence
  TRAC targeting sequence
auuaaacuuguucaccuuua

SEQ ID NO: 15982 - RNA, 20 nt, Artificial Sequence
  TRAC targeting sequence
gccauggccaaaguccauua

SEQ ID NO: 15983 - RNA, 20 nt, Artificial Sequence
  TRAC targeting sequence
cugccauggccaaaguccau

SEQ ID NO: 15984 - RNA, 20 nt, Artificial Sequence
  TRAC targeting sequence
aaaccuaaccauuucucugc

SEQ ID NO: 15985 - RNA, 20 nt, Artificial Sequence
  TRAC targeting sequence
accuuauauccaaaccuaac

SEQ ID NO: 15986 - RNA, 20 nt, Artificial Sequence
  TRAC targeting sequence
cuaauuauaagaaaaaaaag

SEQ ID NO: 15987 - RNA, 20 nt, Artificial Sequence
  TRAC targeting sequence
aauuauaagaaaaaaaagga

SEQ ID NO: 15988 - RNA, 20 nt, Artificial Sequence
  TRAC targeting sequence
uauaauuagagagguccacc

SEQ ID NO: 15989 - RNA, 20 nt, Artificial Sequence
  TRAC targeting sequence
uuuuuuuucuuauaauuaga

SEQ ID NO: 15990 - RNA, 20 nt, Artificial Sequence
  TRAC targeting sequence
uguuccuuuuuuuucuuaua

SEQ ID NO: 15991 - RNA, 20 nt, Artificial Sequence
  TRAC targeting sequence
cauguuccuuuuuuuucuua

SEQ ID NO: 15992 - RNA, 20 nt, Artificial Sequence
  TRAC targeting sequence
ccaauucucauguuccuuuu

SEQ ID NO: 15993 - RNA, 20 nt, Artificial Sequence
  TRAC targeting sequence
uguucaccaauucucauguu

SEQ ID NO: 15994 - RNA, 20 nt, Artificial Sequence
  TRAC targeting sequence
cuggagaucuucagaaaccu

SEQ ID NO: 15995 - RNA, 20 nt, Artificial Sequence
  TRAC targeting sequence
agggaaggucuuguucacca

SEQ ID NO: 15996 - RNA, 20 nt, Artificial Sequence
  TRAC targeting sequence
ccagggaaggucuuguucac

SEQ ID NO: 15997 - RNA, 20 nt, Artificial Sequence
  TRAC targeting sequence
ucagaaaccugaggucacuc

SEQ ID NO: 15998 - RNA, 20 nt, Artificial Sequence
  TRAC targeting sequence
gaaaccugaggucacucagg

SEQ ID NO: 15999 - RNA, 20 nt, Artificial Sequence
  TRAC targeting sequence
gaagaucuccagggaagguc

SEQ ID NO: 16000 - RNA, 20 nt, Artificial Sequence
  TRAC targeting sequence
gguuucugaagaucuccagg

SEQ ID NO: 16001 - RNA, 20 nt, Artificial Sequence
  TRAC targeting sequence
cucaggagagaaauguguga

SEQ ID NO: 16002 - RNA, 20 nt, Artificial Sequence
  TRAC targeting sequence
ggagagaaaugugugaaguu

SEQ ID NO: 16003 - RNA, 20 nt, Artificial Sequence
  TRAC targeting sequence
ugagugaccucagguuucug

SEQ ID NO: 16004 - RNA, 20 nt, Artificial Sequence
  TRAC targeting sequence
ccugagugaccucagguuuc

SEQ ID NO: 16005 - RNA, 20 nt, Artificial Sequence
  TRAC targeting sequence
cuccugagugaccucagguu

SEQ ID NO: 16006 - RNA, 20 nt, Artificial Sequence
  TRAC targeting sequence
cacauuucucuccugaguga

SEQ ID NO: 16007 - RNA, 20 nt, Artificial Sequence
  TRAC targeting sequence
acuucacacauuucucuccu

SEQ ID NO: 16008 - RNA, 20 nt, Artificial Sequence
  TRAC targeting sequence
caacuucacacauuucucuc

SEQ ID NO: 16009 - RNA, 20 nt, Artificial Sequence
  TRAC targeting sequence
cugaaguuucccaccauucc

SEQ ID NO: 16010 - RNA, 20 nt, Artificial Sequence
  TRAC targeting sequence
gaaguuucccaccauuccaa

SEQ ID NO: 16011 - RNA, 20 nt, Artificial Sequence
  TRAC targeting sequence
gagaccauuuacuguaagcu

SEQ ID NO: 16012 - RNA, 20 nt, Artificial Sequence
  TRAC targeting sequence
caccauuccaaagagugcgu

SEQ ID NO: 16013 - RNA, 20 nt, Artificial Sequence
  TRAC targeting sequence
aaagagugcgugagcuuaaa

SEQ ID NO: 16014 - RNA, 20 nt, Artificial Sequence
  TRAC targeting sequence
uuggaauggugggaaacuuc

SEQ ID NO: 16015 - RNA, 20 nt, Artificial Sequence
  TRAC targeting sequence
cgcacucuuuggaauggugg

SEQ ID NO: 16016 - RNA, 20 nt, Artificial Sequence
  TRAC targeting sequence
ugaguuuagcuaaauaugug

SEQ ID NO: 16017 - RNA, 20 nt, Artificial Sequence
  TRAC targeting sequence
cgaaaaauuuuaagcucacg

SEQ ID NO: 16018 - RNA, 20 nt, Artificial Sequence
  TRAC targeting sequence
aacacuaagcacauauuuag

SEQ ID NO: 16019 - RNA, 20 nt, Artificial Sequence
  TRAC targeting sequence
accaagcaaaagaacccugg

SEQ ID NO: 16020 - RNA, 20 nt, Artificial Sequence
  TRAC targeting sequence
uuugcuugguugaaaccuaa

SEQ ID NO: 16021 - RNA, 20 nt, Artificial Sequence
  TRAC targeting sequence
caggguucuuuugcuugguu

SEQ ID NO: 16022 - RNA, 20 nt, Artificial Sequence
  TRAC targeting sequence
cccaggguucuuuugcuugg

SEQ ID NO: 16023 - RNA, 20 nt, Artificial Sequence
  TRAC targeting sequence
gcuuggaaaugaagcauccu

SEQ ID NO: 16024 - RNA, 20 nt, Artificial Sequence
  TRAC targeting sequence
aagcagaguacuucucccag

SEQ ID NO: 16025 - RNA, 20 nt, Artificial Sequence
  TRAC targeting sequence
uuuccaagcagaguacuucu

SEQ ID NO: 16026 - RNA, 20 nt, Artificial Sequence
  TRAC targeting sequence
uuugguuuuugugguacaau

SEQ ID NO: 16027 - RNA, 20 nt, Artificial Sequence
  TRAC targeting sequence
auuguaccacaaaaaccaaa

SEQ ID NO: 16028 - RNA, 20 nt, Artificial Sequence
  TRAC targeting sequence
cuguggguuuucagauggcc

SEQ ID NO: 16029 - RNA, 20 nt, Artificial Sequence
  TRAC targeting sequence
gauggccagaagcugcucuu

SEQ ID NO: 16030 - RNA, 20 nt, Artificial Sequence
  TRAC targeting sequence
gaaaacccacagugaucuau

SEQ ID NO: 16031 - RNA, 20 nt, Artificial Sequence
  TRAC targeting sequence
ggccaucugaaaacccacag

SEQ ID NO: 16032 - RNA, 20 nt, Artificial Sequence
  TRAC targeting sequence
uugcaagggggaccauguua

SEQ ID NO: 16033 - RNA, 20 nt, Artificial Sequence
  TRAC targeting sequence
cccuugcaaagagcagcuuc

SEQ ID NO: 16034 - RNA, 20 nt, Artificial Sequence
  TRAC targeting sequence
accuuuaacauggucccccu

SEQ ID NO: 16035 - RNA, 20 nt, Artificial Sequence
  TRAC targeting sequence
uaguaaguauuauuacuaau

SEQ ID NO: 16036 - RNA, 20 nt, Artificial Sequence
  TRAC targeting sequence
uuaguaauaauacuuacuaa

SEQ ID NO: 16037 - RNA, 20 nt, Artificial Sequence
  TRAC targeting sequence
uaauugauuaguuuuugaga

SEQ ID NO: 16038 - RNA, 20 nt, Artificial Sequence
  TRAC targeting sequence
auuaagaauucauuaguaau

SEQ ID NO: 16039 - RNA, 20 nt, Artificial Sequence
  TRAC targeting sequence
aaaacuaaucaauuaagaau

SEQ ID NO: 16040 - RNA, 20 nt, Artificial Sequence
  TRAC targeting sequence
caaaaacuaaucaauuaaga

SEQ ID NO: 16041 - RNA, 20 nt, Artificial Sequence
  TRAC targeting sequence
aaaaaagcuuauuacuuguc

SEQ ID NO: 16042 - RNA, 20 nt, Artificial Sequence
  TRAC targeting sequence
aaguggacugccaaauguuc

SEQ ID NO: 16043 - RNA, 20 nt, Artificial Sequence
  TRAC targeting sequence
acuuagauuuccaaaaaagc

SEQ ID NO: 16044 - RNA, 20 nt, Artificial Sequence
  TRAC targeting sequence
cgauuuauccauauugcaug

SEQ ID NO: 16045 - RNA, 20 nt, Artificial Sequence
  TRAC targeting sequence
auuuauccauauugcauggg

SEQ ID NO: 16046 - RNA, 20 nt, Artificial Sequence
  TRAC targeting sequence
agaacauuuggcaguccacu

SEQ ID NO: 16047 - RNA, 20 nt, Artificial Sequence
  TRAC targeting sequence
auauugcauggggagcagag

SEQ ID NO: 16048 - RNA, 20 nt, Artificial Sequence
  TRAC targeting sequence
ccaugcaauauggauaaauc

SEQ ID NO: 16049 - RNA, 20 nt, Artificial Sequence
  TRAC targeting sequence
gcuccccaugcaauauggau

SEQ ID NO: 16050 - RNA, 20 nt, Artificial Sequence
  TRAC targeting sequence
ucaugccuucuccauccuca

SEQ ID NO: 16051 - RNA, 20 nt, Artificial Sequence
  TRAC targeting sequence
ugccuucuccauccucacuu

SEQ ID NO: 16052 - RNA, 20 nt, Artificial Sequence
  TRAC targeting sequence
ccauccucacuucugccagg

SEQ ID NO: 16053 - RNA, 20 nt, Artificial Sequence
  TRAC targeting sequence
auccucacuucugccaggua

SEQ ID NO: 16054 - RNA, 20 nt, Artificial Sequence
  TRAC targeting sequence
ucacuucugccagguagcag

SEQ ID NO: 16055 - RNA, 20 nt, Artificial Sequence
  TRAC targeting sequence
cuucugccagguagcaguuu

SEQ ID NO: 16056 - RNA, 20 nt, Artificial Sequence
  TRAC targeting sequence
gccagguagcaguuugcauu

SEQ ID NO: 16057 - RNA, 20 nt, Artificial Sequence
  TRAC targeting sequence
cuguuaacaaugcaaacugc

SEQ ID NO: 16058 - RNA, 20 nt, Artificial Sequence
  TRAC targeting sequence
gcuucccuguuaacaaugca

SEQ ID NO: 16059 - RNA, 20 nt, Artificial Sequence
  TRAC targeting sequence
auucugcuucccuguuaaca

SEQ ID NO: 16060 - RNA, 20 nt, Artificial Sequence
  TRAC targeting sequence
guuaagcuuccauucugcuu

SEQ ID NO: 16061 - RNA, 20 nt, Artificial Sequence
  TRAC targeting sequence
cuguuaagcuuccauucugc

SEQ ID NO: 16062 - RNA, 20 nt, Artificial Sequence
  TRAC targeting sequence
auacugcuucucuguuaagc

SEQ ID NO: 16063 - RNA, 20 nt, Artificial Sequence
  TRAC targeting sequence
uccauacugcuucucuguua

SEQ ID NO: 16064 - RNA, 20 nt, Artificial Sequence
  TRAC targeting sequence
ccuuagcccaguggucaguu

SEQ ID NO: 16065 - RNA, 20 nt, Artificial Sequence
  TRAC targeting sequence
uuagcccaguggucaguugc

SEQ ID NO: 16066 - RNA, 20 nt, Artificial Sequence
  TRAC targeting sequence
guugcaucagagaagucugc

SEQ ID NO: 16067 - RNA, 20 nt, Artificial Sequence
  TRAC targeting sequence
gagaagucugcucugaaaug

SEQ ID NO: 16068 - RNA, 20 nt, Artificial Sequence
  TRAC targeting sequence
gaugcaacugaccacugggc

SEQ ID NO: 16069 - RNA, 20 nt, Artificial Sequence
  TRAC targeting sequence
cugaugcaacugaccacugg

SEQ ID NO: 16070 - RNA, 20 nt, Artificial Sequence
  TRAC targeting sequence
gcucugaaaugcgaacacuu

SEQ ID NO: 16071 - RNA, 20 nt, Artificial Sequence
  TRAC targeting sequence
gaaaugcgaacacuuucucu

SEQ ID NO: 16072 - RNA, 20 nt, Artificial Sequence
  TRAC targeting sequence
gagcagacuucucugaugca

SEQ ID NO: 16073 - RNA, 20 nt, Artificial Sequence
  TRAC targeting sequence
cauuucagagcagacuucuc

SEQ ID NO: 16074 - RNA, 20 nt, Artificial Sequence
  TRAC targeting sequence
cuugcagcuggcagcccccu

SEQ ID NO: 16075 - RNA, 20 nt, Artificial Sequence
  TRAC targeting sequence
ugcagcuggcagcccccugc

SEQ ID NO: 16076 - RNA, 20 nt, Artificial Sequence
  TRAC targeting sequence
gugcccuccauggccagggc

SEQ ID NO: 16077 - RNA, 20 nt, Artificial Sequence
  TRAC targeting sequence
auggccagggccaaagcuuc

SEQ ID NO: 16078 - RNA, 20 nt, Artificial Sequence
  TRAC targeting sequence
aggugcccagauaacauccc

SEQ ID NO: 16079 - RNA, 20 nt, Artificial Sequence
  TRAC targeting sequence
gggcaccuggaagcuuuggc

SEQ ID NO: 16080 - RNA, 20 nt, Artificial Sequence
  TRAC targeting sequence
caaagucacucugagagaag

SEQ ID NO: 16081 - RNA, 20 nt, Artificial Sequence
  TRAC targeting sequence
cucugagagaagagagaaaa

SEQ ID NO: 16082 - RNA, 20 nt, Artificial Sequence
  TRAC targeting sequence
gagagaagagagaaaaucgg

SEQ ID NO: 16083 - RNA, 20 nt, Artificial Sequence
  TRAC targeting sequence
gagugacuuugggauguuau

SEQ ID NO: 16084 - RNA, 20 nt, Artificial Sequence
  TRAC targeting sequence
cagagugacuuugggauguu

SEQ ID NO: 16085 - RNA, 20 nt, Artificial Sequence
  TRAC targeting sequence
cucagagugacuuugggaug

SEQ ID NO: 16086 - RNA, 20 nt, Artificial Sequence
  TRAC targeting sequence
ucucucagagugacuuuggg

SEQ ID NO: 16087 - RNA, 20 nt, Artificial Sequence
  TRAC targeting sequence
cuucucucagagugacuuug

SEQ ID NO: 16088 - RNA, 20 nt, Artificial Sequence
  TRAC targeting sequence
cucuucucucagagugacuu

SEQ ID NO: 16089 - RNA, 20 nt, Artificial Sequence
  TRAC targeting sequence
gucuuacuuuaccuuuucua

SEQ ID NO: 16090 - RNA, 20 nt, Artificial Sequence
  TRAC targeting sequence
uacuuuaccuuuucuaacca

SEQ ID NO: 16091 - RNA, 20 nt, Artificial Sequence
  TRAC targeting sequence
aaccaggaauuuacaugguu

SEQ ID NO: 16092 - RNA, 20 nt, Artificial Sequence
  TRAC targeting sequence
ugguuagaaaagguaaagua

SEQ ID NO: 16093 - RNA, 20 nt, Artificial Sequence
  TRAC targeting sequence
aacacuucagcagggagaag

SEQ ID NO: 16094 - RNA, 20 nt, Artificial Sequence
  TRAC targeting sequence
gcagggagaagacaugaucu

SEQ ID NO: 16095 - RNA, 20 nt, Artificial Sequence
  TRAC targeting sequence
cugcugaaguguuagaugua

SEQ ID NO: 16096 - RNA, 20 nt, Artificial Sequence
  TRAC targeting sequence
cccugcugaaguguuagaug

SEQ ID NO: 16097 - RNA, 20 nt, Artificial Sequence
  TRAC targeting sequence
ucucccugcugaaguguuag

SEQ ID NO: 16098 - RNA, 20 nt, Artificial Sequence
  TRAC targeting sequence
ugucuucucccugcugaagu

SEQ ID NO: 16099 - RNA, 20 nt, Artificial Sequence
  TRAC targeting sequence
aaguguccauguggacacuc

SEQ ID NO: 16100 - RNA, 20 nt, Artificial Sequence
  TRAC targeting sequence
auguggacacucugugugac

SEQ ID NO: 16101 - RNA, 20 nt, Artificial Sequence
  TRAC targeting sequence
acauggacacuuagaucaug

SEQ ID NO: 16102 - RNA, 20 nt, Artificial Sequence
  TRAC targeting sequence
gugugacucggauccaggau

SEQ ID NO: 16103 - RNA, 20 nt, Artificial Sequence
  TRAC targeting sequence
cacagaguguccacauggac

SEQ ID NO: 16104 - RNA, 20 nt, Artificial Sequence
  TRAC targeting sequence
gauccaggaucugcucuuuc

SEQ ID NO: 16105 - RNA, 20 nt, Artificial Sequence
  TRAC targeting sequence
gagucacacagaguguccac

SEQ ID NO: 16106 - RNA, 20 nt, Artificial Sequence
  TRAC targeting sequence
aggaucugcucuuucagccc

SEQ ID NO: 16107 - RNA, 20 nt, Artificial Sequence
  TRAC targeting sequence
uggauccgagucacacagag

SEQ ID NO: 16108 - RNA, 20 nt, Artificial Sequence
  TRAC targeting sequence
gcucuuucagccccuccauu

SEQ ID NO: 16109 - RNA, 20 nt, Artificial Sequence
  TRAC targeting sequence
uucagccccuccauuuaucg

SEQ ID NO: 16110 - RNA, 20 nt, Artificial Sequence
  TRAC targeting sequence
gccccuccauuuaucgcaaa

SEQ ID NO: 16111 - RNA, 20 nt, Artificial Sequence
  TRAC targeting sequence
auuuaucgcaaaagggauga

SEQ ID NO: 16112 - RNA, 20 nt, Artificial Sequence
  TRAC targeting sequence
caaaagggaugaugauuaau

SEQ ID NO: 16113 - RNA, 20 nt, Artificial Sequence
  TRAC targeting sequence
cuuuugcgauaaauggaggg

SEQ ID NO: 16114 - RNA, 20 nt, Artificial Sequence
  TRAC targeting sequence
ucccuuuugcgauaaaugga

SEQ ID NO: 16115 - RNA, 20 nt, Artificial Sequence
  TRAC targeting sequence
ucaucccuuuugcgauaaau

SEQ ID NO: 16116 - RNA, 20 nt, Artificial Sequence
  TRAC targeting sequence
uccaugccuagacuucacuu

SEQ ID NO: 16117 - RNA, 20 nt, Artificial Sequence
  TRAC targeting sequence
augccuagacuucacuuuag

SEQ ID NO: 16118 - RNA, 20 nt, Artificial Sequence
  TRAC targeting sequence
aggcauggaggaauuaauca

SEQ ID NO: 16119 - RNA, 20 nt, Artificial Sequence
  TRAC targeting sequence
cuuuagacaucaccucagag

SEQ ID NO: 16120 - RNA, 20 nt, Artificial Sequence
  TRAC targeting sequence
aaagugaagucuaggcaugg

SEQ ID NO: 16121 - RNA, 20 nt, Artificial Sequence
  TRAC targeting sequence
ccucagagaggccugucuua

SEQ ID NO: 16122 - RNA, 20 nt, Artificial Sequence
  TRAC targeting sequence
gagaggccugucuuacccag

SEQ ID NO: 16123 - RNA, 20 nt, Artificial Sequence
  TRAC targeting sequence
gaggugaugucuaaagugaa

SEQ ID NO: 16124 - RNA, 20 nt, Artificial Sequence
  TRAC targeting sequence
cugaggugaugucuaaagug

SEQ ID NO: 16125 - RNA, 20 nt, Artificial Sequence
  TRAC targeting sequence
uacccagccaaucuaacaag

SEQ ID NO: 16126 - RNA, 20 nt, Artificial Sequence
  TRAC targeting sequence
aacaagccaucaaacacagc

SEQ ID NO: 16127 - RNA, 20 nt, Artificial Sequence
  TRAC targeting sequence
aacacagccacugccuggcu

SEQ ID NO: 16128 - RNA, 20 nt, Artificial Sequence
  TRAC targeting sequence
cuacccuguuauuuagccug

SEQ ID NO: 16129 - RNA, 20 nt, Artificial Sequence
  TRAC targeting sequence
acccuguuauuuagccugau

SEQ ID NO: 16130 - RNA, 20 nt, Artificial Sequence
  TRAC targeting sequence
ggcuaaauaacaggguagag

SEQ ID NO: 16131 - RNA, 20 nt, Artificial Sequence
  TRAC targeting sequence
cacacuuucaucacuuaaca

SEQ ID NO: 16132 - RNA, 20 nt, Artificial Sequence
  TRAC targeting sequence
ucacuuaacauuauacuauc

SEQ ID NO: 16133 - RNA, 20 nt, Artificial Sequence
  TRAC targeting sequence
cuuaacauuauacuaucugu

SEQ ID NO: 16134 - RNA, 20 nt, Artificial Sequence
  TRAC targeting sequence
guguauuuauuguuugccuu

SEQ ID NO: 16135 - RNA, 20 nt, Artificial Sequence
  TRAC targeting sequence
ucuagaccguagacaccagg

SEQ ID NO: 16136 - RNA, 20 nt, Artificial Sequence
  TRAC targeting sequence
agaccguagacaccaggagg

SEQ ID NO: 16137 - RNA, 20 nt, Artificial Sequence
  TRAC targeting sequence
agaagaaggcaaacaauaaa

SEQ ID NO: 16138 - RNA, 20 nt, Artificial Sequence
  TRAC targeting sequence
acggucuagaagaaggcaaa

SEQ ID NO: 16139 - RNA, 20 nt, Artificial Sequence
  TRAC targeting sequence
uggugucuacggucuagaag

SEQ ID NO: 16140 - RNA, 20 nt, Artificial Sequence
  TRAC targeting sequence
uccuggugucuacggucuag

SEQ ID NO: 16141 - RNA, 20 nt, Artificial Sequence
  TRAC targeting sequence
ccguccuccuggugucuacg

SEQ ID NO: 16142 - RNA, 20 nt, Artificial Sequence
  TRAC targeting sequence
aaguggcucucaccguaucc

SEQ ID NO: 16143 - RNA, 20 nt, Artificial Sequence
  TRAC targeting sequence
caccguaucccuagugccgg

SEQ ID NO: 16144 - RNA, 20 nt, Artificial Sequence
  TRAC targeting sequence
ccguaucccuagugccggca

SEQ ID NO: 16145 - RNA, 20 nt, Artificial Sequence
  TRAC targeting sequence
cuagugccggcacaaugucu

SEQ ID NO: 16146 - RNA, 20 nt, Artificial Sequence
  TRAC targeting sequence
uuacacaucggagguguuca

SEQ ID NO: 16147 - RNA, 20 nt, Artificial Sequence
  TRAC targeting sequence
gagguguucagugaacaguu

SEQ ID NO: 16148 - RNA, 20 nt, Artificial Sequence
  TRAC targeting sequence
gauguguaaagacauugugc

SEQ ID NO: 16149 - RNA, 20 nt, Artificial Sequence
  TRAC targeting sequence
gugaacaguuacugagugaa

SEQ ID NO: 16150 - RNA, 20 nt, Artificial Sequence
  TRAC targeting sequence
cugaacaccuccgaugugua

SEQ ID NO: 16151 - RNA, 20 nt, Artificial Sequence
  TRAC targeting sequence
guaacuguucacugaacacc

SEQ ID NO: 16152 - RNA, 20 nt, Artificial Sequence
  TRAC targeting sequence
cucaguaacuguucacugaa

SEQ ID NO: 16153 - RNA, 20 nt, Artificial Sequence
  TRAC targeting sequence
uuuauucacucaguaacugu

SEQ ID NO: 16154 - RNA, 20 nt, Artificial Sequence
  TRAC targeting sequence
uuuucaugaaauuacagagc

SEQ ID NO: 16155 - RNA, 20 nt, Artificial Sequence
  TRAC targeting sequence
ugaaauuacagagcuuugcu

SEQ ID NO: 16156 - RNA, 20 nt, Artificial Sequence
  TRAC targeting sequence
ugaaaaagagcggcaguugg

SEQ ID NO: 16157 - RNA, 20 nt, Artificial Sequence
  TRAC targeting sequence
guaauuucaugaaaaagagc

SEQ ID NO: 16158 - RNA, 20 nt, Artificial Sequence
  TRAC targeting sequence
uacccaaauacuaaaaccua

SEQ ID NO: 16159 - RNA, 20 nt, Artificial Sequence
  TRAC targeting sequence
guagguuuuaguauuugggu

SEQ ID NO: 16160 - RNA, 20 nt, Artificial Sequence
  TRAC targeting sequence
caguagguuuuaguauuugg

SEQ ID NO: 16161 - RNA, 20 nt, Artificial Sequence
  TRAC targeting sequence
aucauuuauaguuauaucca

SEQ ID NO: 16162 - RNA, 20 nt, Artificial Sequence
  TRAC targeting sequence
uuuauaguuauauccaaggu

SEQ ID NO: 16163 - RNA, 20 nt, Artificial Sequence
  TRAC targeting sequence
aagguggauuugagugagca

SEQ ID NO: 16164 - RNA, 20 nt, Artificial Sequence
  TRAC targeting sequence
accuuggauauaacuauaaa

SEQ ID NO: 16165 - RNA, 20 nt, Artificial Sequence
  TRAC targeting sequence
aauccaccuuggauauaacu

SEQ ID NO: 16166 - RNA, 20 nt, Artificial Sequence
  TRAC targeting sequence
cucaaauccaccuuggauau

SEQ ID NO: 16167 - RNA, 20 nt, Artificial Sequence
  TRAC targeting sequence
uguaccugcucacucaaauc

SEQ ID NO: 16168 - RNA, 20 nt, Artificial Sequence
  TRAC targeting sequence
uuucacugugccaaccaggc

SEQ ID NO: 16169 - RNA, 20 nt, Artificial Sequence
  TRAC targeting sequence
cugugccaaccaggcaggaa

SEQ ID NO: 16170 - RNA, 20 nt, Artificial Sequence
  TRAC targeting sequence
ugccugguuggcacagugaa

SEQ ID NO: 16171 - RNA, 20 nt, Artificial Sequence
  TRAC targeting sequence
gaucuuugggaagggaacca

SEQ ID NO: 16172 - RNA, 20 nt, Artificial Sequence
  TRAC targeting sequence
gagcaguuccugccugguug

SEQ ID NO: 16173 - RNA, 20 nt, Artificial Sequence
  TRAC targeting sequence
uugggaagggaaccaccuua

SEQ ID NO: 16174 - RNA, 20 nt, Artificial Sequence
  TRAC targeting sequence
caaagaucagagcaguuccu

SEQ ID NO: 16175 - RNA, 20 nt, Artificial Sequence
  TRAC targeting sequence
cuucccaaagaucagagcag

SEQ ID NO: 16176 - RNA, 20 nt, Artificial Sequence
  TRAC targeting sequence
gugaguuccaguaaguaccu

SEQ ID NO: 16177 - RNA, 20 nt, Artificial Sequence
  TRAC targeting sequence
cugauaaggugguucccuuc

SEQ ID NO: 16178 - RNA, 20 nt, Artificial Sequence
  TRAC targeting sequence
aguaaguaccugauaauuau

SEQ ID NO: 16179 - RNA, 20 nt, Artificial Sequence
  TRAC targeting sequence
gguacuuacuggaacucacu

SEQ ID NO: 16180 - RNA, 20 nt, Artificial Sequence
  TRAC targeting sequence
auaauuaucagguacuuacu

SEQ ID NO: 16181 - RNA, 20 nt, Artificial Sequence
  TRAC targeting sequence
uagugcuuguacuuauccug

SEQ ID NO: 16182 - RNA, 20 nt, Artificial Sequence
  TRAC targeting sequence
uguagucauauauugcacag

SEQ ID NO: 16183 - RNA, 20 nt, Artificial Sequence
  TRAC targeting sequence
uauauugcacaggugaccaa

SEQ ID NO: 16184 - RNA, 20 nt, Artificial Sequence
  TRAC targeting sequence
ccugugcaauauaugacuac

SEQ ID NO: 16185 - RNA, 20 nt, Artificial Sequence
  TRAC targeting sequence
uauuucuuugaguuaaggaa

SEQ ID NO: 16186 - RNA, 20 nt, Artificial Sequence
  TRAC targeting sequence
uugaguuaaggaauauugac

SEQ ID NO: 16187 - RNA, 20 nt, Artificial Sequence
  TRAC targeting sequence
aagaaauaggaggcauuugg

SEQ ID NO: 16188 - RNA, 20 nt, Artificial Sequence
  TRAC targeting sequence
uuaacucaaagaaauaggag

SEQ ID NO: 16189 - RNA, 20 nt, Artificial Sequence
  TRAC targeting sequence
auauuccuuaacucaaagaa

SEQ ID NO: 16190 - RNA, 20 nt, Artificial Sequence
  TRAC targeting sequence
aaugucaauauuccuuaacu

SEQ ID NO: 16191 - RNA, 20 nt, Artificial Sequence
  TRAC targeting sequence
ucaaaugucaauauuccuua

SEQ ID NO: 16192 - RNA, 20 nt, Artificial Sequence
  TRAC targeting sequence
ucaucaaaugucaauauucc

SEQ ID NO: 16193 - RNA, 20 nt, Artificial Sequence
  TRAC targeting sequence
cauguguuuaaauggcuuuc

SEQ ID NO: 16194 - RNA, 20 nt, Artificial Sequence
  TRAC targeting sequence
aauuuucccauguguuuaaa

SEQ ID NO: 16195 - RNA, 20 nt, Artificial Sequence
  TRAC targeting sequence
cucaccccuaauacuccaac

SEQ ID NO: 16196 - RNA, 20 nt, Artificial Sequence
  TRAC targeting sequence
caccccuaauacuccaacca

SEQ ID NO: 16197 - RNA, 20 nt, Artificial Sequence
  TRAC targeting sequence
ccccuaauacuccaaccaua

SEQ ID NO: 16198 - RNA, 20 nt, Artificial Sequence
  TRAC targeting sequence
aaccauagccccuguccuau

SEQ ID NO: 16199 - RNA, 20 nt, Artificial Sequence
  TRAC targeting sequence
uauuccaugcucuuaaaaaa

SEQ ID NO: 16200 - RNA, 20 nt, Artificial Sequence
  TRAC targeting sequence
augcucuuaaaaaaauuuua

SEQ ID NO: 16201 - RNA, 20 nt, Artificial Sequence
  TRAC targeting sequence
uaaaaaaauuuuaauugaua

SEQ ID NO: 16202 - RNA, 20 nt, Artificial Sequence
  TRAC targeting sequence
auuaaaauuuuuuuaagagc

SEQ ID NO: 16203 - RNA, 20 nt, Artificial Sequence
  TRAC targeting sequence
aucaauuaaaauuuuuuuaa

SEQ ID NO: 16204 - RNA, 20 nt, Artificial Sequence
  TRAC targeting sequence
ucuaucaauuaaaauuuuuu

SEQ ID NO: 16205 - RNA, 20 nt, Artificial Sequence
  TRAC targeting sequence
uucuucuaucaauuaaaauu

SEQ ID NO: 16206 - RNA, 20 nt, Artificial Sequence
  TRAC targeting sequence
uucuuucuucuaucaauuaa

SEQ ID NO: 16207 - RNA, 20 nt, Artificial Sequence
  TRAC targeting sequence
acaaggauaugagcaauuug

SEQ ID NO: 16208 - RNA, 20 nt, Artificial Sequence
  TRAC targeting sequence
uuguagauaaucuuucuuuc

SEQ ID NO: 16209 - RNA, 20 nt, Artificial Sequence
  TRAC targeting sequence
uauccuuguagauaaucuuu

SEQ ID NO: 16210 - RNA, 20 nt, Artificial Sequence
  TRAC targeting sequence
uuuuaccacuguuuagcaaa

SEQ ID NO: 16211 - RNA, 20 nt, Artificial Sequence
  TRAC targeting sequence
cguuuuaccacuguuuagca

SEQ ID NO: 16212 - RNA, 20 nt, Artificial Sequence
  TRAC targeting sequence
acaccuguacauaaucucgu

SEQ ID NO: 16213 - RNA, 20 nt, Artificial Sequence
  TRAC targeting sequence
uagguaaaaaugggggucag

SEQ ID NO: 16214 - RNA, 20 nt, Artificial Sequence
  TRAC targeting sequence
gagcugcuauccuuuggcua

SEQ ID NO: 16215 - RNA, 20 nt, Artificial Sequence
  TRAC targeting sequence
gacccccauuuuuaccuagg

SEQ ID NO: 16216 - RNA, 20 nt, Artificial Sequence
  TRAC targeting sequence
uuuggcuaguaaaacaagau

SEQ ID NO: 16217 - RNA, 20 nt, Artificial Sequence
  TRAC targeting sequence
uguuuuacuagccaaaggau

SEQ ID NO: 16218 - RNA, 20 nt, Artificial Sequence
  TRAC targeting sequence
ccaaguaaucuuguuuuacu

SEQ ID NO: 16219 - RNA, 20 nt, Artificial Sequence
  TRAC targeting sequence
ccucgaaagaaauaaguuuc

SEQ ID NO: 16220 - RNA, 20 nt, Artificial Sequence
  TRAC targeting sequence
ucgaaagaaauaaguuucag

SEQ ID NO: 16221 - RNA, 20 nt, Artificial Sequence
  TRAC targeting sequence
aaagaaauaaguuucagagu

SEQ ID NO: 16222 - RNA, 20 nt, Artificial Sequence
  TRAC targeting sequence
aggagauuuacauaauuuca

SEQ ID NO: 16223 - RNA, 20 nt, Artificial Sequence
  TRAC targeting sequence
uucgaggagauuuacauaau

SEQ ID NO: 16224 - RNA, 20 nt, Artificial Sequence
  TRAC targeting sequence
gaguugucuagagaauauca

SEQ ID NO: 16225 - RNA, 20 nt, Artificial Sequence
  TRAC targeting sequence
gaaacuuauuucuuucgagg

SEQ ID NO: 16226 - RNA, 20 nt, Artificial Sequence
  TRAC targeting sequence
agagaauaucacuuggacug

SEQ ID NO: 16227 - RNA, 20 nt, Artificial Sequence
  TRAC targeting sequence
agacaacucugaaacuuauu

SEQ ID NO: 16228 - RNA, 20 nt, Artificial Sequence
  TRAC targeting sequence
cuagacaacucugaaacuua

SEQ ID NO: 16229 - RNA, 20 nt, Artificial Sequence
  TRAC targeting sequence
cuuggacuguucucaggcuu

SEQ ID NO: 16230 - RNA, 20 nt, Artificial Sequence
  TRAC targeting sequence
aagugauauucucuagacaa

SEQ ID NO: 16231 - RNA, 20 nt, Artificial Sequence
  TRAC targeting sequence
caggcuuuccacuacaucua

SEQ ID NO: 16232 - RNA, 20 nt, Artificial Sequence
  TRAC targeting sequence
ggcuuuccacuacaucuauu

SEQ ID NO: 16233 - RNA, 20 nt, Artificial Sequence
  TRAC targeting sequence
acuacaucuauuguaccacu

SEQ ID NO: 16234 - RNA, 20 nt, Artificial Sequence
  TRAC targeting sequence
auuguaccacuauggugccc

SEQ ID NO: 16235 - RNA, 20 nt, Artificial Sequence
  TRAC targeting sequence
gggcaccauagugguacaau

SEQ ID NO: 16236 - RNA, 20 nt, Artificial Sequence
  TRAC targeting sequence
uuucagggcaccauaguggu

SEQ ID NO: 16237 - RNA, 20 nt, Artificial Sequence
  TRAC targeting sequence
caggcuuaauuccauggcuu

SEQ ID NO: 16238 - RNA, 20 nt, Artificial Sequence
  TRAC targeting sequence
ggcuuaauuccauggcuuag

SEQ ID NO: 16239 - RNA, 20 nt, Artificial Sequence
  TRAC targeting sequence
auggcuuagucuuuauucca

SEQ ID NO: 16240 - RNA, 20 nt, Artificial Sequence
  TRAC targeting sequence
uuauuccaguaucaaaaagg

SEQ ID NO: 16241 - RNA, 20 nt, Artificial Sequence
  TRAC targeting sequence
aguaucaaaaagggggaauc

SEQ ID NO: 16242 - RNA, 20 nt, Artificial Sequence
  TRAC targeting sequence
aaaagggggaaucccagcca

SEQ ID NO: 16243 - RNA, 20 nt, Artificial Sequence
  TRAC targeting sequence
cccuuuuugauacuggaaua

SEQ ID NO: 16244 - RNA, 20 nt, Artificial Sequence
  TRAC targeting sequence
cagccagagcucccaugagg

SEQ ID NO: 16245 - RNA, 20 nt, Artificial Sequence
  TRAC targeting sequence
ggcugggauucccccuuuuu

SEQ ID NO: 16246 - RNA, 20 nt, Artificial Sequence
  TRAC targeting sequence
caugagggaggauagcugca

SEQ ID NO: 16247 - RNA, 20 nt, Artificial Sequence
  TRAC targeting sequence
ugggagcucuggcugggauu

SEQ ID NO: 16248 - RNA, 20 nt, Artificial Sequence
  TRAC targeting sequence
cucaugggagcucuggcugg

SEQ ID NO: 16249 - RNA, 20 nt, Artificial Sequence
  TRAC targeting sequence
ucccucaugggagcucuggc

SEQ ID NO: 16250 - RNA, 20 nt, Artificial Sequence
  TRAC targeting sequence
auuaucaagguaacucgguc

SEQ ID NO: 16251 - RNA, 20 nt, Artificial Sequence
  TRAC targeting sequence
agguaacucggucauuuuug

SEQ ID NO: 16252 - RNA, 20 nt, Artificial Sequence
  TRAC targeting sequence
gucauuuuugucaggcagca

SEQ ID NO: 16253 - RNA, 20 nt, Artificial Sequence
  TRAC targeting sequence
uuuuugucaggcagcacagu

SEQ ID NO: 16254 - RNA, 20 nt, Artificial Sequence
  TRAC targeting sequence
ggcagcacagugcugugauu

SEQ ID NO: 16255 - RNA, 20 nt, Artificial Sequence
  TRAC targeting sequence
cagcacugugcugccugaca

SEQ ID NO: 16256 - RNA, 20 nt, Artificial Sequence
  TRAC targeting sequence
ucuuugggagugggacaaga

SEQ ID NO: 16257 - RNA, 20 nt, Artificial Sequence
  TRAC targeting sequence
uugggagugggacaagauua

SEQ ID NO: 16258 - RNA, 20 nt, Artificial Sequence
  TRAC targeting sequence
caaagaugaaugugcuauaa

SEQ ID NO: 16259 - RNA, 20 nt, Artificial Sequence
  TRAC targeting sequence
cacucccaaagaugaaugug

SEQ ID NO: 16260 - RNA, 20 nt, Artificial Sequence
  TRAC targeting sequence
ugucccacucccaaagauga

SEQ ID NO: 16261 - RNA, 20 nt, Artificial Sequence
  TRAC targeting sequence
guaaaaccugguaaguaggc

SEQ ID NO: 16262 - RNA, 20 nt, Artificial Sequence
  TRAC targeting sequence
cuaaaguaggaggcuuaaug

SEQ ID NO: 16263 - RNA, 20 nt, Artificial Sequence
  TRAC targeting sequence
uacuuuagugacauauugcc

SEQ ID NO: 16264 - RNA, 20 nt, Artificial Sequence
  TRAC targeting sequence
guagccacauuaagccuccu

SEQ ID NO: 16265 - RNA, 20 nt, Artificial Sequence
  TRAC targeting sequence
caguagccacauuaagccuc

SEQ ID NO: 16266 - RNA, 20 nt, Artificial Sequence
  TRAC targeting sequence
aaauacugcaguaaguuuag

SEQ ID NO: 16267 - RNA, 20 nt, Artificial Sequence
  TRAC targeting sequence
agaaauuaaugguuuaugca

SEQ ID NO: 16268 - RNA, 20 nt, Artificial Sequence
  TRAC targeting sequence
ugacacuugggccuuccaaa

SEQ ID NO: 16269 - RNA, 20 nt, Artificial Sequence
  TRAC targeting sequence
gcauaaaccauuaauuucuu

SEQ ID NO: 16270 - RNA, 20 nt, Artificial Sequence
  TRAC targeting sequence
acuuaagucugcauaaacca

SEQ ID NO: 16271 - RNA, 20 nt, Artificial Sequence
  TRAC targeting sequence
aaugaaggaagaaauguuaa

SEQ ID NO: 16272 - RNA, 20 nt, Artificial Sequence
  TRAC targeting sequence
uuggaauccacuuaagucug

SEQ ID NO: 16273 - RNA, 20 nt, Artificial Sequence
  TRAC targeting sequence
uucauuggaauccacuuaag

SEQ ID NO: 16274 - RNA, 20 nt, Artificial Sequence
  TRAC targeting sequence
uccuucauuggaauccacuu

SEQ ID NO: 16275 - RNA, 20 nt, Artificial Sequence
  TRAC targeting sequence
gugccauuacuuuaacauuu

SEQ ID NO: 16276 - RNA, 20 nt, Artificial Sequence
  TRAC targeting sequence
ucugugccauuacuuuaaca

SEQ ID NO: 16277 - RNA, 20 nt, Artificial Sequence
  TRAC targeting sequence
auccucugugccauuacuuu

SEQ ID NO: 16278 - RNA, 20 nt, Artificial Sequence
  TRAC targeting sequence
ucuauccucugugccauuac

SEQ ID NO: 16279 - RNA, 20 nt, Artificial Sequence
  TRAC targeting sequence
cagcuagcucuucuauccuc

SEQ ID NO: 16280 - RNA, 20 nt, Artificial Sequence
  TRAC targeting sequence
acauggcuauuuuuuuucac

SEQ ID NO: 16281 - RNA, 20 nt, Artificial Sequence
  TRAC targeting sequence
uccacauggcuauuuuuuuu

SEQ ID NO: 16282 - RNA, 20 nt, Artificial Sequence
  TRAC targeting sequence
guugcguuugguucauccac

SEQ ID NO: 16283 - RNA, 20 nt, Artificial Sequence
  TRAC targeting sequence
gucuguugcguuugguucau

SEQ ID NO: 16284 - RNA, 20 nt, Artificial Sequence
  TRAC targeting sequence
uucagucuguugcguuuggu

SEQ ID NO: 16285 - RNA, 20 nt, Artificial Sequence
  TRAC targeting sequence
aggcucuuucagucuguugc

SEQ ID NO: 16286 - RNA, 20 nt, Artificial Sequence
  TRAC targeting sequence
cuaggcucuuucagucuguu

SEQ ID NO: 16287 - RNA, 20 nt, Artificial Sequence
  TRAC targeting sequence
acucucuaggcucuuucagu

SEQ ID NO: 16288 - RNA, 20 nt, Artificial Sequence
  TRAC targeting sequence
uaaagaaaaaggcagaaagu

SEQ ID NO: 16289 - RNA, 20 nt, Artificial Sequence
  TRAC targeting sequence
uuaggaucaacucucuaggc

SEQ ID NO: 16290 - RNA, 20 nt, Artificial Sequence
  TRAC targeting sequence
gccuuuuucuuuaggaucaa

SEQ ID NO: 16291 - RNA, 20 nt, Artificial Sequence
  TRAC targeting sequence
ggcugagcacuuccaguucu

SEQ ID NO: 16292 - RNA, 20 nt, Artificial Sequence
  TRAC targeting sequence
gccagacuuucugccuuuuu

SEQ ID NO: 16293 - RNA, 20 nt, Artificial Sequence
  TRAC targeting sequence
aguucugcugaccuggcuug

SEQ ID NO: 16294 - RNA, 20 nt, Artificial Sequence
  TRAC targeting sequence
gcugaccuggcuugauuagu

SEQ ID NO: 16295 - RNA, 20 nt, Artificial Sequence
  TRAC targeting sequence
gcagaacuggaagugcucag

SEQ ID NO: 16296 - RNA, 20 nt, Artificial Sequence
  TRAC targeting sequence
agccaggucagcagaacugg

SEQ ID NO: 16297 - RNA, 20 nt, Artificial Sequence
  TRAC targeting sequence
cuaaucaagccaggucagca

SEQ ID NO: 16298 - RNA, 20 nt, Artificial Sequence
  TRAC targeting sequence
gggccacaguaucuuuaucu

SEQ ID NO: 16299 - RNA, 20 nt, Artificial Sequence
  TRAC targeting sequence
uuaucuauaaaaugaaaaca

SEQ ID NO: 16300 - RNA, 20 nt, Artificial Sequence
  TRAC targeting sequence
auaaaaugaaaacauuuaau

SEQ ID NO: 16301 - RNA, 20 nt, Artificial Sequence
  TRAC targeting sequence
uuuuauagauaaagauacug

SEQ ID NO: 16302 - RNA, 20 nt, Artificial Sequence
  TRAC targeting sequence
ccucagauuuuuuguuuuaa

SEQ ID NO: 16303 - RNA, 20 nt, Artificial Sequence
  TRAC targeting sequence
gauuuuuuguuuuaauuuug

SEQ ID NO: 16304 - RNA, 20 nt, Artificial Sequence
  TRAC targeting sequence
gaggugauauuaaauguuuu

SEQ ID NO: 16305 - RNA, 20 nt, Artificial Sequence
  TRAC targeting sequence
uuaaaauaaauauauacacc

SEQ ID NO: 16306 - RNA, 20 nt, Artificial Sequence
  TRAC targeting sequence
cauauauuagcuuaucuuua

SEQ ID NO: 16307 - RNA, 20 nt, Artificial Sequence
  TRAC targeting sequence
uaaaugcuauccacauguaa

SEQ ID NO: 16308 - RNA, 20 nt, Artificial Sequence
  TRAC targeting sequence
acauguaaaauauuauuugu

SEQ ID NO: 16309 - RNA, 20 nt, Artificial Sequence
  TRAC targeting sequence
auaaacaaauaauauuuuac

SEQ ID NO: 16310 - RNA, 20 nt, Artificial Sequence
  TRAC targeting sequence
gauuuagaauucuuuuaaca

SEQ ID NO: 16311 - RNA, 20 nt, Artificial Sequence
  TRAC targeting sequence
gacauaguuuuuuuuuguuc

SEQ ID NO: 16312 - RNA, 20 nt, Artificial Sequence
  TRAC targeting sequence
aaaucugacauaguuuuuuu

SEQ ID NO: 16313 - RNA, 20 nt, Artificial Sequence
  TRAC targeting sequence
uuuaacaugagaauuuguag

SEQ ID NO: 16314 - RNA, 20 nt, Artificial Sequence
  TRAC targeting sequence
uguuaaaagaauucuaaauc

SEQ ID NO: 16315 - RNA, 20 nt, Artificial Sequence
  TRAC targeting sequence
cauguuaaaagaauucuaaa

SEQ ID NO: 16316 - RNA, 20 nt, Artificial Sequence
  TRAC targeting sequence
uagugaaauagccauuuaca

SEQ ID NO: 16317 - RNA, 20 nt, Artificial Sequence
  TRAC targeting sequence
cuaagaaccuacaaauucuc

SEQ ID NO: 16318 - RNA, 20 nt, Artificial Sequence
  TRAC targeting sequence
cauguaaauggcuauuucac

SEQ ID NO: 16319 - RNA, 20 nt, Artificial Sequence
  TRAC targeting sequence
guagcccuaggcauugguaa

SEQ ID NO: 16320 - RNA, 20 nt, Artificial Sequence
  TRAC targeting sequence
cuucuacugaaauauagugg

SEQ ID NO: 16321 - RNA, 20 nt, Artificial Sequence
  TRAC targeting sequence
ucuacugaaauauaguggcu

SEQ ID NO: 16322 - RNA, 20 nt, Artificial Sequence
  TRAC targeting sequence
acugaaauauaguggcucaa

SEQ ID NO: 16323 - RNA, 20 nt, Artificial Sequence
  TRAC targeting sequence
guagaagagaaagugcuuuu

SEQ ID NO: 16324 - RNA, 20 nt, Artificial Sequence
  TRAC targeting sequence
aaugcuacccaaaugaaaag

SEQ ID NO: 16325 - RNA, 20 nt, Artificial Sequence
  TRAC targeting sequence
uuuggguagcauuugagcca

SEQ ID NO: 16326 - RNA, 20 nt, Artificial Sequence
  TRAC targeting sequence
ccugcccuuuucauuugggu

SEQ ID NO: 16327 - RNA, 20 nt, Artificial Sequence
  TRAC targeting sequence
cuuccccugcccuuuucauu

SEQ ID NO: 16328 - RNA, 20 nt, Artificial Sequence
  TRAC targeting sequence
uuuuguaaaggcaggcauua

SEQ ID NO: 16329 - RNA, 20 nt, Artificial Sequence
  TRAC targeting sequence
cacuguaaugccugccuuua

SEQ ID NO: 16330 - RNA, 20 nt, Artificial Sequence
  TRAC targeting sequence
ggggguuaccagaaaguuac

SEQ ID NO: 16331 - RNA, 20 nt, Artificial Sequence
  TRAC targeting sequence
gguaacccccagaauucaca

SEQ ID NO: 16332 - RNA, 20 nt, Artificial Sequence
  TRAC targeting sequence
aaagguaacuuucugguaac

SEQ ID NO: 16333 - RNA, 20 nt, Artificial Sequence
  TRAC targeting sequence
aguuccaaagguaacuuucu

SEQ ID NO: 16334 - RNA, 20 nt, Artificial Sequence
  TRAC targeting sequence
aagucaucccaagugagucc

SEQ ID NO: 16335 - RNA, 20 nt, Artificial Sequence
  TRAC targeting sequence
ucccaagugaguccaauuuc

SEQ ID NO: 16336 - RNA, 20 nt, Artificial Sequence
  TRAC targeting sequence
caagugaguccaauuuccua

SEQ ID NO: 16337 - RNA, 20 nt, Artificial Sequence
  TRAC targeting sequence
cuugggaugacuuggagcuu

SEQ ID NO: 16338 - RNA, 20 nt, Artificial Sequence
  TRAC targeting sequence
aauuuccuaugcuuuccucu

SEQ ID NO: 16339 - RNA, 20 nt, Artificial Sequence
  TRAC targeting sequence
uaugcuuuccucuuccuugu

SEQ ID NO: 16340 - RNA, 20 nt, Artificial Sequence
  TRAC targeting sequence
ucuuccuuguguugucuucu

SEQ ID NO: 16341 - RNA, 20 nt, Artificial Sequence
  TRAC targeting sequence
uccuuguguugucuucucuc

SEQ ID NO: 16342 - RNA, 20 nt, Artificial Sequence
  TRAC targeting sequence
uuguguugucuucucucaga

SEQ ID NO: 16343 - RNA, 20 nt, Artificial Sequence
  TRAC targeting sequence
ucucucagaccguaacauuu

SEQ ID NO: 16344 - RNA, 20 nt, Artificial Sequence
  TRAC targeting sequence
cucagaccguaacauuugga

SEQ ID NO: 16345 - RNA, 20 nt, Artificial Sequence
  TRAC targeting sequence
cagaccguaacauuuggagc

SEQ ID NO: 16346 - RNA, 20 nt, Artificial Sequence
  TRAC targeting sequence
gaccguaacauuuggagcac

SEQ ID NO: 16347 - RNA, 20 nt, Artificial Sequence
  TRAC targeting sequence
gagagaagacaacacaagga

SEQ ID NO: 16348 - RNA, 20 nt, Artificial Sequence
  TRAC targeting sequence
aaauguuacggucugagaga

SEQ ID NO: 16349 - RNA, 20 nt, Artificial Sequence
  TRAC targeting sequence
uuaugugcuccaaauguuac

SEQ ID NO: 16350 - RNA, 20 nt, Artificial Sequence
  TRAC targeting sequence
cuuuaugugcuccaaauguu

SEQ ID NO: 16351 - RNA, 20 nt, Artificial Sequence
  TRAC targeting sequence
uuucuggcuguuucaggaga

SEQ ID NO: 16352 - RNA, 20 nt, Artificial Sequence
  TRAC targeting sequence
ggcuguuucaggagacugaa

SEQ ID NO: 16353 - RNA, 20 nt, Artificial Sequence
  TRAC targeting sequence
ggagacugaaaaggauugua

SEQ ID NO: 16354 - RNA, 20 nt, Artificial Sequence
  TRAC targeting sequence
ugaaacagccagaaaagagc

SEQ ID NO: 16355 - RNA, 20 nt, Artificial Sequence
  TRAC targeting sequence
ccugaaacagccagaaaaga

SEQ ID NO: 16356 - RNA, 20 nt, Artificial Sequence
  TRAC targeting sequence
gucuccugaaacagccagaa

SEQ ID NO: 16357 - RNA, 20 nt, Artificial Sequence
  TRAC targeting sequence
uuuucagucuccugaaacag

SEQ ID NO: 16358 - RNA, 20 nt, Artificial Sequence
  TRAC targeting sequence
uauacaauccuuuucagucu

SEQ ID NO: 16359 - RNA, 20 nt, Artificial Sequence
  TRAC targeting sequence
uuuagcauguucuuaguauu

SEQ ID NO: 16360 - RNA, 20 nt, Artificial Sequence
  TRAC targeting sequence
uaguauuguuuuguccagug

SEQ ID NO: 16361 - RNA, 20 nt, Artificial Sequence
  TRAC targeting sequence
aguguguguuucuucuuaau

SEQ ID NO: 16362 - RNA, 20 nt, Artificial Sequence
  TRAC targeting sequence
ucuuaauaucaaaaaaaacu

SEQ ID NO: 16363 - RNA, 20 nt, Artificial Sequence
  TRAC targeting sequence
uaauaucaaaaaaaacuaag

SEQ ID NO: 16364 - RNA, 20 nt, Artificial Sequence
  TRAC targeting sequence
aaaaaaacuaagacauugcc

SEQ ID NO: 16365 - RNA, 20 nt, Artificial Sequence
  TRAC targeting sequence
uaguuuuuuuugauauuaag

SEQ ID NO: 16366 - RNA, 20 nt, Artificial Sequence
  TRAC targeting sequence
caggcaaugucuuaguuuuu

SEQ ID NO: 16367 - RNA, 20 nt, Artificial Sequence
  TRAC targeting sequence
auuggcuucacaggcaaugu

SEQ ID NO: 16368 - RNA, 20 nt, Artificial Sequence
  TRAC targeting sequence
acuguuuuccauuggcuuca

SEQ ID NO: 16369 - RNA, 20 nt, Artificial Sequence
  TRAC targeting sequence
uugcaaaucuacuguuuucc

SEQ ID NO: 16370 - RNA, 20 nt, Artificial Sequence
  TRAC targeting sequence
uuucuuugcaaaucuacugu

SEQ ID NO: 16371 - RNA, 20 nt, Artificial Sequence
  TRAC targeting sequence
uuaguucuuuucuuugcaaa

SEQ ID NO: 16372 - RNA, 20 nt, Artificial Sequence
  TRAC targeting sequence
cuuuaguucuuuucuuugca

SEQ ID NO: 16373 - RNA, 20 nt, Artificial Sequence
  TRAC targeting sequence
ucucuuuaguucuuuucuuu

SEQ ID NO: 16374 - RNA, 20 nt, Artificial Sequence
  TRAC targeting sequence
gcuuuaagcuugguaaaaag

SEQ ID NO: 16375 - RNA, 20 nt, Artificial Sequence
  TRAC targeting sequence
uuuaaucagagggaugcuug

SEQ ID NO: 16376 - RNA, 20 nt, Artificial Sequence
  TRAC targeting sequence
gagggaugcuugguucuggg

SEQ ID NO: 16377 - RNA, 20 nt, Artificial Sequence
  TRAC targeting sequence
gauuaaaggacacccacucu

SEQ ID NO: 16378 - RNA, 20 nt, Artificial Sequence
  TRAC targeting sequence
cucugauuaaaggacaccca

SEQ ID NO: 16379 - RNA, 20 nt, Artificial Sequence
  TRAC targeting sequence
gggggcuggauaggacucag

SEQ ID NO: 16380 - RNA, 20 nt, Artificial Sequence
  TRAC targeting sequence
agcccccagaaccaagcauc

SEQ ID NO: 16381 - RNA, 20 nt, Artificial Sequence
  TRAC targeting sequence
uauccagcccccagaaccaa

SEQ ID NO: 16382 - RNA, 20 nt, Artificial Sequence
  TRAC targeting sequence
gguaaguaacaaggcuacca

SEQ ID NO: 16383 - RNA, 20 nt, Artificial Sequence
  TRAC targeting sequence
gugguagccuuguuacuuac

SEQ ID NO: 16384 - RNA, 20 nt, Artificial Sequence
  TRAC targeting sequence
cugagcuucuaaaaugaguu

SEQ ID NO: 16385 - RNA, 20 nt, Artificial Sequence
  TRAC targeting sequence
gugacucagugguagccuug

SEQ ID NO: 16386 - RNA, 20 nt, Artificial Sequence
  TRAC targeting sequence
aaaaugaguugacucggggg

SEQ ID NO: 16387 - RNA, 20 nt, Artificial Sequence
  TRAC targeting sequence
uuuuagaagcucagugacuc

SEQ ID NO: 16388 - RNA, 20 nt, Artificial Sequence
  TRAC targeting sequence
acucauuuuagaagcucagu

SEQ ID NO: 16389 - RNA, 20 nt, Artificial Sequence
  TRAC targeting sequence
ggggagcaggaagcugccac

SEQ ID NO: 16390 - RNA, 20 nt, Artificial Sequence
  TRAC targeting sequence
cccgagucaacucauuuuag

SEQ ID NO: 16391 - RNA, 20 nt, Artificial Sequence
  TRAC targeting sequence
ugcucccccgagucaacuca

SEQ ID NO: 16392 - RNA, 20 nt, Artificial Sequence
  TRAC targeting sequence
ugaugaucugaaugcuauuc

SEQ ID NO: 16393 - RNA, 20 nt, Artificial Sequence
  TRAC targeting sequence
ugaguggcagcuuccugcuc

SEQ ID NO: 16394 - RNA, 20 nt, Artificial Sequence
  TRAC targeting sequence
ucaugaguggcagcuuccug

SEQ ID NO: 16395 - RNA, 20 nt, Artificial Sequence
  TRAC targeting sequence
gaaugcuauuccgugaaguu

SEQ ID NO: 16396 - RNA, 20 nt, Artificial Sequence
  TRAC targeting sequence
gaucaucaugaguggcagcu

SEQ ID NO: 16397 - RNA, 20 nt, Artificial Sequence
  TRAC targeting sequence
gugaaguuucagauugauug

SEQ ID NO: 16398 - RNA, 20 nt, Artificial Sequence
  TRAC targeting sequence
cggaauagcauucagaucau

SEQ ID NO: 16399 - RNA, 20 nt, Artificial Sequence
  TRAC targeting sequence
gauugauugaaguuaaaauu

SEQ ID NO: 16400 - RNA, 20 nt, Artificial Sequence
  TRAC targeting sequence
gaaacuucacggaauagcau

SEQ ID NO: 16401 - RNA, 20 nt, Artificial Sequence
  TRAC targeting sequence
aucugaaacuucacggaaua

SEQ ID NO: 16402 - RNA, 20 nt, Artificial Sequence
  TRAC targeting sequence
aucaaucugaaacuucacgg

SEQ ID NO: 16403 - RNA, 20 nt, Artificial Sequence
  TRAC targeting sequence
ccccuaauuuuaacuucaau

SEQ ID NO: 16404 - RNA, 20 nt, Artificial Sequence
  TRAC targeting sequence
ggaaucuaaaaauugauaac

SEQ ID NO: 16405 - RNA, 20 nt, Artificial Sequence
  TRAC targeting sequence
ugacauagugucaccccuaa

SEQ ID NO: 16406 - RNA, 20 nt, Artificial Sequence
  TRAC targeting sequence
aaaaauugauaacuguaaug

SEQ ID NO: 16407 - RNA, 20 nt, Artificial Sequence
  TRAC targeting sequence
auuuuuagauuccugacaua

SEQ ID NO: 16408 - RNA, 20 nt, Artificial Sequence
  TRAC targeting sequence
auuacaguuaucaauuuuua

SEQ ID NO: 16409 - RNA, 20 nt, Artificial Sequence
  TRAC targeting sequence
uuuccauuacaguuaucaau

SEQ ID NO: 16410 - RNA, 20 nt, Artificial Sequence
  TRAC targeting sequence
uucauuuccauuacaguuau

SEQ ID NO: 16411 - RNA, 20 nt, Artificial Sequence
  TRAC targeting sequence
guuggauaaauggaguugaa

SEQ ID NO: 16412 - RNA, 20 nt, Artificial Sequence
  TRAC targeting sequence
aacagauguagcuagcccuu

SEQ ID NO: 16413 - RNA, 20 nt, Artificial Sequence
  TRAC targeting sequence
auuuauccaacagauguagc

SEQ ID NO: 16414 - RNA, 20 nt, Artificial Sequence
  TRAC targeting sequence
acuccauuuauccaacagau

SEQ ID NO: 16415 - RNA, 20 nt, Artificial Sequence
  TRAC targeting sequence
ugaauuugauggcgacagac

SEQ ID NO: 16416 - RNA, 20 nt, Artificial Sequence
  TRAC targeting sequence
ugauuuucaacuccauuuau

SEQ ID NO: 16417 - RNA, 20 nt, Artificial Sequence
  TRAC targeting sequence
aauucaugauuuucaacucc

SEQ ID NO: 16418 - RNA, 20 nt, Artificial Sequence
  TRAC targeting sequence
ccaucaaauucaugauuuuc

SEQ ID NO: 16419 - RNA, 20 nt, Artificial Sequence
  TRAC targeting sequence
gucgccaucaaauucaugau

SEQ ID NO: 16420 - RNA, 20 nt, Artificial Sequence
  TRAC targeting sequence
gggucugucgccaucaaauu

SEQ ID NO: 16421 - RNA, 20 nt, Artificial Sequence
  TRAC targeting sequence
cugggucugucgccaucaaa

SEQ ID NO: 16422 - RNA, 20 nt, Artificial Sequence
  TRAC targeting sequence
accugcccaacucucugggu

SEQ ID NO: 16423 - RNA, 20 nt, Artificial Sequence
  TRAC targeting sequence
uuucaagugauaugcaguaa

SEQ ID NO: 16424 - RNA, 20 nt, Artificial Sequence
  TRAC targeting sequence
agugauaugcaguaaauacc

SEQ ID NO: 16425 - RNA, 20 nt, Artificial Sequence
  TRAC targeting sequence
cuugaaaugaaguuucuacc

SEQ ID NO: 16426 - RNA, 20 nt, Artificial Sequence
  TRAC targeting sequence
aauuugggguauuuacugca

SEQ ID NO: 16427 - RNA, 20 nt, Artificial Sequence
  TRAC targeting sequence
aauggccuguguaaaaagga

SEQ ID NO: 16428 - RNA, 20 nt, Artificial Sequence
  TRAC targeting sequence
uuuuuacacaggccauuuga

SEQ ID NO: 16429 - RNA, 20 nt, Artificial Sequence
  TRAC targeting sequence
cuuccuuuuuacacaggcca

SEQ ID NO: 16430 - RNA, 20 nt, Artificial Sequence
  TRAC targeting sequence
ccuuguaggugaaaaggcca

SEQ ID NO: 16431 - RNA, 20 nt, Artificial Sequence
  TRAC targeting sequence
uuguaggugaaaaggccaua

SEQ ID NO: 16432 - RNA, 20 nt, Artificial Sequence
  TRAC targeting sequence
ccuacaaggagauacggguu

SEQ ID NO: 16433 - RNA, 20 nt, Artificial Sequence
  TRAC targeting sequence
cuaggucuuagguaugaaaa

SEQ ID NO: 16434 - RNA, 20 nt, Artificial Sequence
  TRAC targeting sequence
aggucuuagguaugaaaagg

SEQ ID NO: 16435 - RNA, 20 nt, Artificial Sequence
  TRAC targeting sequence
uagguaugaaaaggaugugu

SEQ ID NO: 16436 - RNA, 20 nt, Artificial Sequence
  TRAC targeting sequence
uaccuaagaccuagagauau

SEQ ID NO: 16437 - RNA, 20 nt, Artificial Sequence
  TRAC targeting sequence
uuuucauaccuaagaccuag

SEQ ID NO: 16438 - RNA, 20 nt, Artificial Sequence
  TRAC targeting sequence
ggguguuuuugacugacuaa

SEQ ID NO: 16439 - RNA, 20 nt, Artificial Sequence
  TRAC targeting sequence
aaaacacccagaagcccaca

SEQ ID NO: 16440 - RNA, 20 nt, Artificial Sequence
  TRAC targeting sequence
gucaaaaacacccagaagcc

SEQ ID NO: 16441 - RNA, 20 nt, Artificial Sequence
  TRAC targeting sequence
uagucagucaaaaacaccca

SEQ ID NO: 16442 - RNA, 20 nt, Artificial Sequence
  TRAC targeting sequence
cacaguguuucuuagucagu

SEQ ID NO: 16443 - RNA, 20 nt, Artificial Sequence
  TRAC targeting sequence
aucccacaguguuucuuagu

SEQ ID NO: 16444 - RNA, 20 nt, Artificial Sequence
  TRAC targeting sequence
auuuauagcugcuauccauc

SEQ ID NO: 16445 - RNA, 20 nt, Artificial Sequence
  TRAC targeting sequence
ucgggagugggaccagacug

SEQ ID NO: 16446 - RNA, 20 nt, Artificial Sequence
  TRAC targeting sequence
ggagugggaccagacugcug

SEQ ID NO: 16447 - RNA, 20 nt, Artificial Sequence
  TRAC targeting sequence
cgaagaucaauuuauagcug

SEQ ID NO: 16448 - RNA, 20 nt, Artificial Sequence
  TRAC targeting sequence
cacucccgaagaucaauuua

SEQ ID NO: 16449 - RNA, 20 nt, Artificial Sequence
  TRAC targeting sequence
ggucccacucccgaagauca

SEQ ID NO: 16450 - RNA, 20 nt, Artificial Sequence
  TRAC targeting sequence
ggccugguaaguaagguguc

SEQ ID NO: 16451 - RNA, 20 nt, Artificial Sequence
  TRAC targeting sequence
gagaggcaacagaaagauug

SEQ ID NO: 16452 - RNA, 20 nt, Artificial Sequence
  TRAC targeting sequence
gacaccuuacuuaccaggcc

SEQ ID NO: 16453 - RNA, 20 nt, Artificial Sequence
  TRAC targeting sequence
cugacaccuuacuuaccagg

SEQ ID NO: 16454 - RNA, 20 nt, Artificial Sequence
  TRAC targeting sequence
guugccucucugacaccuua

SEQ ID NO: 16455 - RNA, 20 nt, Artificial Sequence
  TRAC targeting sequence
uucuguugccucucugacac

SEQ ID NO: 16456 - RNA, 20 nt, Artificial Sequence
  TRAC targeting sequence
aucuuucuguugccucucug

SEQ ID NO: 16457 - RNA, 20 nt, Artificial Sequence
  TRAC targeting sequence
ucaugucucaggaaaugauu

SEQ ID NO: 16458 - RNA, 20 nt, Artificial Sequence
  TRAC targeting sequence
ugucucaggaaaugauugua

SEQ ID NO: 16459 - RNA, 20 nt, Artificial Sequence
  TRAC targeting sequence
caggaaaugauuguauaaug

SEQ ID NO: 16460 - RNA, 20 nt, Artificial Sequence
  TRAC targeting sequence
ggaaaugauuguauaaugca

SEQ ID NO: 16461 - RNA, 20 nt, Artificial Sequence
  TRAC targeting sequence
ugagacaugaagacauuuua

SEQ ID NO: 16462 - RNA, 20 nt, Artificial Sequence
  TRAC targeting sequence
uuuccugagacaugaagaca

SEQ ID NO: 16463 - RNA, 20 nt, Artificial Sequence
  TRAC targeting sequence
uuuugcauuauacaaucauu

SEQ ID NO: 16464 - RNA, 20 nt, Artificial Sequence
  TRAC targeting sequence
agcucauuuugcauuauaca

SEQ ID NO: 16465 - RNA, 20 nt, Artificial Sequence
  TRAC targeting sequence
uaaaaaacuccagcucauuu

SEQ ID NO: 16466 - RNA, 20 nt, Artificial Sequence
  TRAC targeting sequence
aguaacagugcuccuaaaaa

SEQ ID NO: 16467 - RNA, 20 nt, Artificial Sequence
  TRAC targeting sequence
gaugucugguucuagcaaaa

SEQ ID NO: 16468 - RNA, 20 nt, Artificial Sequence
  TRAC targeting sequence
gaacucuaguaacagugcuc

SEQ ID NO: 16469 - RNA, 20 nt, Artificial Sequence
  TRAC targeting sequence
gguucuagcaaaagaacccu

SEQ ID NO: 16470 - RNA, 20 nt, Artificial Sequence
  TRAC targeting sequence
agcaaaagaacccuaauaua

SEQ ID NO: 16471 - RNA, 20 nt, Artificial Sequence
  TRAC targeting sequence
uuugcuagaaccagacauca

SEQ ID NO: 16472 - RNA, 20 nt, Artificial Sequence
  TRAC targeting sequence
cucucuagaaggaacaagga

SEQ ID NO: 16473 - RNA, 20 nt, Artificial Sequence
  TRAC targeting sequence
cuagaaggaacaaggaagag

SEQ ID NO: 16474 - RNA, 20 nt, Artificial Sequence
  TRAC targeting sequence
agaaggaacaaggaagagga

SEQ ID NO: 16475 - RNA, 20 nt, Artificial Sequence
  TRAC targeting sequence
agagagggauuacagcuaua

SEQ ID NO: 16476 - RNA, 20 nt, Artificial Sequence
  TRAC targeting sequence
uucuagagagggauuacagc

SEQ ID NO: 16477 - RNA, 20 nt, Artificial Sequence
  TRAC targeting sequence
uuguuccuucuagagaggga

SEQ ID NO: 16478 - RNA, 20 nt, Artificial Sequence
  TRAC targeting sequence
uccuuguuccuucuagagag

SEQ ID NO: 16479 - RNA, 20 nt, Artificial Sequence
  TRAC targeting sequence
ucuuccuuguuccuucuaga

SEQ ID NO: 16480 - RNA, 20 nt, Artificial Sequence
  TRAC targeting sequence
ucucugaaagcuccuccuaa

SEQ ID NO: 16481 - RNA, 20 nt, Artificial Sequence
  TRAC targeting sequence
cugaaagcuccuccuaagau

SEQ ID NO: 16482 - RNA, 20 nt, Artificial Sequence
  TRAC targeting sequence
gaaagcuccuccuaagauuu

SEQ ID NO: 16483 - RNA, 20 nt, Artificial Sequence
  TRAC targeting sequence
gagaagaauccucuuccuug

SEQ ID NO: 16484 - RNA, 20 nt, Artificial Sequence
  TRAC targeting sequence
uccuaagauuuauccauccu

SEQ ID NO: 16485 - RNA, 20 nt, Artificial Sequence
  TRAC targeting sequence
uaagauuuauccauccucug

SEQ ID NO: 16486 - RNA, 20 nt, Artificial Sequence
  TRAC targeting sequence
uaggaggagcuuucagagaa

SEQ ID NO: 16487 - RNA, 20 nt, Artificial Sequence
  TRAC targeting sequence
auccucugccaaagugucuu

SEQ ID NO: 16488 - RNA, 20 nt, Artificial Sequence
  TRAC targeting sequence
ucugccaaagugucuugugg

SEQ ID NO: 16489 - RNA, 20 nt, Artificial Sequence
  TRAC targeting sequence
gccaaagugucuuguggauc

SEQ ID NO: 16490 - RNA, 20 nt, Artificial Sequence
  TRAC targeting sequence
uguggauccaggauacuuac

SEQ ID NO: 16491 - RNA, 20 nt, Artificial Sequence
  TRAC targeting sequence
acaagacacuuuggcagagg

SEQ ID NO: 16492 - RNA, 20 nt, Artificial Sequence
  TRAC targeting sequence
aggauacuuacaucuuuguu

SEQ ID NO: 16493 - RNA, 20 nt, Artificial Sequence
  TRAC targeting sequence
uggauccacaagacacuuug

SEQ ID NO: 16494 - RNA, 20 nt, Artificial Sequence
  TRAC targeting sequence
uuguuagcagugcuggccca

SEQ ID NO: 16495 - RNA, 20 nt, Artificial Sequence
  TRAC targeting sequence
gccucagaucaccuaucccu

SEQ ID NO: 16496 - RNA, 20 nt, Artificial Sequence
  TRAC targeting sequence
gaucaccuaucccucauuug

SEQ ID NO: 16497 - RNA, 20 nt, Artificial Sequence
  TRAC targeting sequence
gaggcugagcagguugggcc

SEQ ID NO: 16498 - RNA, 20 nt, Artificial Sequence
  TRAC targeting sequence
ccuaucccucauuuguaaaa

SEQ ID NO: 16499 - RNA, 20 nt, Artificial Sequence
  TRAC targeting sequence
cucauuuguaaaaugaggau

SEQ ID NO: 16500 - RNA, 20 nt, Artificial Sequence
  TRAC targeting sequence
uuuguaaaaugaggauaaua

SEQ ID NO: 16501 - RNA, 20 nt, Artificial Sequence
  TRAC targeting sequence
uuuuacaaaugagggauagg

SEQ ID NO: 16502 - RNA, 20 nt, Artificial Sequence
  TRAC targeting sequence
ucauuuuacaaaugagggau

SEQ ID NO: 16503 - RNA, 20 nt, Artificial Sequence
  TRAC targeting sequence
uggcacaguugaagcccaaa

SEQ ID NO: 16504 - RNA, 20 nt, Artificial Sequence
  TRAC targeting sequence
acugugccaugagcuuaaau

SEQ ID NO: 16505 - RNA, 20 nt, Artificial Sequence
  TRAC targeting sequence
uuugggcuucaacugugcca

SEQ ID NO: 16506 - RNA, 20 nt, Artificial Sequence
  TRAC targeting sequence
acuaccucauuugggcuuca

SEQ ID NO: 16507 - RNA, 20 nt, Artificial Sequence
  TRAC targeting sequence
gcauauauuccacuaccuca

SEQ ID NO: 16508 - RNA, 20 nt, Artificial Sequence
  TRAC targeting sequence
auuuggcucauaaaugaagg

SEQ ID NO: 16509 - RNA, 20 nt, Artificial Sequence
  TRAC targeting sequence
uaaaugaagguuuucuuucc

SEQ ID NO: 16510 - RNA, 20 nt, Artificial Sequence
  TRAC targeting sequence
uuuaugagccaaauggauua

SEQ ID NO: 16511 - RNA, 20 nt, Artificial Sequence
  TRAC targeting sequence
uuccuuuucccuaaguagau

SEQ ID NO: 16512 - RNA, 20 nt, Artificial Sequence
  TRAC targeting sequence
uuuucccuaaguagaucaug

SEQ ID NO: 16513 - RNA, 20 nt, Artificial Sequence
  TRAC targeting sequence
cuaaguagaucauggguuga

SEQ ID NO: 16514 - RNA, 20 nt, Artificial Sequence
  TRAC targeting sequence
acuuagggaaaaggaaagaa

SEQ ID NO: 16515 - RNA, 20 nt, Artificial Sequence
  TRAC targeting sequence
uggguugaaauaccuaacac

SEQ ID NO: 16516 - RNA, 20 nt, Artificial Sequence
  TRAC targeting sequence
acccaugaucuacuuaggga

SEQ ID NO: 16517 - RNA, 20 nt, Artificial Sequence
  TRAC targeting sequence
uuuuuguauggggauuugcu

SEQ ID NO: 16518 - RNA, 20 nt, Artificial Sequence
  TRAC targeting sequence
ccauacaaaaaugauuugca

SEQ ID NO: 16519 - RNA, 20 nt, Artificial Sequence
  TRAC targeting sequence
cacuauagcaaauccccaua

SEQ ID NO: 16520 - RNA, 20 nt, Artificial Sequence
  TRAC targeting sequence
ggauacagcacccucaccuu

SEQ ID NO: 16521 - RNA, 20 nt, Artificial Sequence
  TRAC targeting sequence
ugaauucacacuauagcaaa

SEQ ID NO: 16522 - RNA, 20 nt, Artificial Sequence
  TRAC targeting sequence
ccuuugggaaggggacuaug

SEQ ID NO: 16523 - RNA, 20 nt, Artificial Sequence
  TRAC targeting sequence
caaaggugagggugcuguau

SEQ ID NO: 16524 - RNA, 20 nt, Artificial Sequence
  TRAC targeting sequence
ccuucccaaaggugagggug

SEQ ID NO: 16525 - RNA, 20 nt, Artificial Sequence
  TRAC targeting sequence
agucucuccagguacauguu

SEQ ID NO: 16526 - RNA, 20 nt, Artificial Sequence
  TRAC targeting sequence
cuccagguacauguugaccc

SEQ ID NO: 16527 - RNA, 20 nt, Artificial Sequence
  TRAC targeting sequence
ccagguacauguugacccca

SEQ ID NO: 16528 - RNA, 20 nt, Artificial Sequence
  TRAC targeting sequence
agguacauguugaccccauc

SEQ ID NO: 16529 - RNA, 20 nt, Artificial Sequence
  TRAC targeting sequence
acauguaccuggagagacua

SEQ ID NO: 16530 - RNA, 20 nt, Artificial Sequence
  TRAC targeting sequence
cacccauguuuucccccuau

SEQ ID NO: 16531 - RNA, 20 nt, Artificial Sequence
  TRAC targeting sequence
cccuaucugguuuaaggcuu

SEQ ID NO: 16532 - RNA, 20 nt, Artificial Sequence
  TRAC targeting sequence
gguuuaaggcuuccauaugu

SEQ ID NO: 16533 - RNA, 20 nt, Artificial Sequence
  TRAC targeting sequence
auauguauugcguguuaucc

SEQ ID NO: 16534 - RNA, 20 nt, Artificial Sequence
  TRAC targeting sequence
ucauggauuucaucauccuu

SEQ ID NO: 16535 - RNA, 20 nt, Artificial Sequence
  TRAC targeting sequence
uggauuucaucauccuuguu

SEQ ID NO: 16536 - RNA, 20 nt, Artificial Sequence
  TRAC targeting sequence
augaggauaacacgcaauac

SEQ ID NO: 16537 - RNA, 20 nt, Artificial Sequence
  TRAC targeting sequence
ucauccuuguuuuauuauca

SEQ ID NO: 16538 - RNA, 20 nt, Artificial Sequence
  TRAC targeting sequence
uccuuguuuuauuaucaaug

SEQ ID NO: 16539 - RNA, 20 nt, Artificial Sequence
  TRAC targeting sequence
uuguuuuauuaucaauguuc

SEQ ID NO: 16540 - RNA, 20 nt, Artificial Sequence
  TRAC targeting sequence
auguucugugaauuuaagau

SEQ ID NO: 16541 - RNA, 20 nt, Artificial Sequence
  TRAC targeting sequence
gugaauuuaagauugagccu

SEQ ID NO: 16542 - RNA, 20 nt, Artificial Sequence
  TRAC targeting sequence
cagaacauugauaauaaaac

SEQ ID NO: 16543 - RNA, 20 nt, Artificial Sequence
  TRAC targeting sequence
uaaauucacagaacauugau

SEQ ID NO: 16544 - RNA, 20 nt, Artificial Sequence
  TRAC targeting sequence
aucuuaaauucacagaacau

SEQ ID NO: 16545 - RNA, 20 nt, Artificial Sequence
  TRAC targeting sequence
auggacucuucauuuaaaaa

SEQ ID NO: 16546 - RNA, 20 nt, Artificial Sequence
  TRAC targeting sequence
auggaggcucaaucuuaaau

SEQ ID NO: 16547 - RNA, 20 nt, Artificial Sequence
  TRAC targeting sequence
ucauuuaaaaaugaaaauag

SEQ ID NO: 16548 - RNA, 20 nt, Artificial Sequence
  TRAC targeting sequence
uuuaaaaaugaaaauagcua

SEQ ID NO: 16549 - RNA, 20 nt, Artificial Sequence
  TRAC targeting sequence
uuuuuaaaugaagaguccau

SEQ ID NO: 16550 - RNA, 20 nt, Artificial Sequence
  TRAC targeting sequence
auuagcuauuuucauuuuua

SEQ ID NO: 16551 - RNA, 20 nt, Artificial Sequence
  TRAC targeting sequence
ucuauuagcuauuuucauuu

SEQ ID NO: 16552 - RNA, 20 nt, Artificial Sequence
  TRAC targeting sequence
aacucuucuauuagcuauuu

SEQ ID NO: 16553 - RNA, 20 nt, Artificial Sequence
  TRAC targeting sequence
acuguuauuuccaacucuuc

SEQ ID NO: 16554 - RNA, 20 nt, Artificial Sequence
  TRAC targeting sequence
cuaggucaggauggagaagg

SEQ ID NO: 16555 - RNA, 20 nt, Artificial Sequence
  TRAC targeting sequence
ggauggagaagggaguaaua

SEQ ID NO: 16556 - RNA, 20 nt, Artificial Sequence
  TRAC targeting sequence
ugaccuagugaauuaguucu

SEQ ID NO: 16557 - RNA, 20 nt, Artificial Sequence
  TRAC targeting sequence
auccugaccuagugaauuag

SEQ ID NO: 16558 - RNA, 20 nt, Artificial Sequence
  TRAC targeting sequence
ccauccugaccuagugaauu

SEQ ID NO: 16559 - RNA, 20 nt, Artificial Sequence
  TRAC targeting sequence
cuucuccauccugaccuagu

SEQ ID NO: 16560 - RNA, 20 nt, Artificial Sequence
  TRAC targeting sequence
aggguauuacucccuucucc

SEQ ID NO: 16561 - RNA, 20 nt, Artificial Sequence
  TRAC targeting sequence
uaauugucuaggguauuacu

SEQ ID NO: 16562 - RNA, 20 nt, Artificial Sequence
  TRAC targeting sequence
agaaauagacucacuuccug

SEQ ID NO: 16563 - RNA, 20 nt, Artificial Sequence
  TRAC targeting sequence
ggaaaaaccacguuuguccu

SEQ ID NO: 16564 - RNA, 20 nt, Artificial Sequence
  TRAC targeting sequence
auuucuggaaaaaccacguu

SEQ ID NO: 16565 - RNA, 20 nt, Artificial Sequence
  TRAC targeting sequence
cuuccuguuuaaagccuaga

SEQ ID NO: 16566 - RNA, 20 nt, Artificial Sequence
  TRAC targeting sequence
uguuuaaagccuagacugug

SEQ ID NO: 16567 - RNA, 20 nt, Artificial Sequence
  TRAC targeting sequence
aggcuuuaaacaggaaguga

SEQ ID NO: 16568 - RNA, 20 nt, Artificial Sequence
  TRAC targeting sequence
cuccccgggcacccuucaca

SEQ ID NO: 16569 - RNA, 20 nt, Artificial Sequence
  TRAC targeting sequence
ccccgggcacccuucacauu

SEQ ID NO: 16570 - RNA, 20 nt, Artificial Sequence
  TRAC targeting sequence
ccgggcacccuucacauucc

SEQ ID NO: 16571 - RNA, 20 nt, Artificial Sequence
  TRAC targeting sequence
cauuccucuaacccuccaua

SEQ ID NO: 16572 - RNA, 20 nt, Artificial Sequence
  TRAC targeting sequence
ucuaacccuccauaucccaa

SEQ ID NO: 16573 - RNA, 20 nt, Artificial Sequence
  TRAC targeting sequence
aacccuccauaucccaaauu

SEQ ID NO: 16574 - RNA, 20 nt, Artificial Sequence
  TRAC targeting sequence
auaucccaaauuuagcugug

SEQ ID NO: 16575 - RNA, 20 nt, Artificial Sequence
  TRAC targeting sequence
caaauuuagcuguggaaucu

SEQ ID NO: 16576 - RNA, 20 nt, Artificial Sequence
  TRAC targeting sequence
acagcuaaauuugggauaug

SEQ ID NO: 16577 - RNA, 20 nt, Artificial Sequence
  TRAC targeting sequence
uagacaaucugugaccuaug

SEQ ID NO: 16578 - RNA, 20 nt, Artificial Sequence
  TRAC targeting sequence
aagauuccacagcuaaauuu

SEQ ID NO: 16579 - RNA, 20 nt, Artificial Sequence
  TRAC targeting sequence
gugaccuaugcagcuacaga

SEQ ID NO: 16580 - RNA, 20 nt, Artificial Sequence
  TRAC targeting sequence
cagauugucuaagauuccac

SEQ ID NO: 16581 - RNA, 20 nt, Artificial Sequence
  TRAC targeting sequence
guagcugcauaggucacaga

SEQ ID NO: 16582 - RNA, 20 nt, Artificial Sequence
  TRAC targeting sequence
uuucuuacugagaauaucug

SEQ ID NO: 16583 - RNA, 20 nt, Artificial Sequence
  TRAC targeting sequence
uacugagaauaucugccuau

SEQ ID NO: 16584 - RNA, 20 nt, Artificial Sequence
  TRAC targeting sequence
guaagaaaagauuucuguag

SEQ ID NO: 16585 - RNA, 20 nt, Artificial Sequence
  TRAC targeting sequence
caguaagaaaagauuucugu

SEQ ID NO: 16586 - RNA, 20 nt, Artificial Sequence
  TRAC targeting sequence
gccuauuugaaccaaaagau

SEQ ID NO: 16587 - RNA, 20 nt, Artificial Sequence
  TRAC targeting sequence
aauaggcagauauucucagu

SEQ ID NO: 16588 - RNA, 20 nt, Artificial Sequence
  TRAC targeting sequence
uuugguucaaauaggcagau

SEQ ID NO: 16589 - RNA, 20 nt, Artificial Sequence
  TRAC targeting sequence
uugagaauagacagucucua

SEQ ID NO: 16590 - RNA, 20 nt, Artificial Sequence
  TRAC targeting sequence
aggaucuuuugguucaaaua

SEQ ID NO: 16591 - RNA, 20 nt, Artificial Sequence
  TRAC targeting sequence
caaggaucuuuugguucaaa

SEQ ID NO: 16592 - RNA, 20 nt, Artificial Sequence
  TRAC targeting sequence
auucucaaggaucuuuuggu

SEQ ID NO: 16593 - RNA, 20 nt, Artificial Sequence
  TRAC targeting sequence
cuaauauuccaugaaguguc

SEQ ID NO: 16594 - RNA, 20 nt, Artificial Sequence
  TRAC targeting sequence
aauauuccaugaagugucug

SEQ ID NO: 16595 - RNA, 20 nt, Artificial Sequence
  TRAC targeting sequence
augaagugucugauaugguc

SEQ ID NO: 16596 - RNA, 20 nt, Artificial Sequence
  TRAC targeting sequence
uggaauauuagagacugucu

SEQ ID NO: 16597 - RNA, 20 nt, Artificial Sequence
  TRAC targeting sequence
gauaugguccuuuuacaaaa

SEQ ID NO: 16598 - RNA, 20 nt, Artificial Sequence
  TRAC targeting sequence
gacacuucauggaauauuag

SEQ ID NO: 16599 - RNA, 20 nt, Artificial Sequence
  TRAC targeting sequence
uuuuacaaaaguaaauacuu

SEQ ID NO: 16600 - RNA, 20 nt, Artificial Sequence
  TRAC targeting sequence
aguauuuacuuuuguaaaag

SEQ ID NO: 16601 - RNA, 20 nt, Artificial Sequence
  TRAC targeting sequence
ugcuuaauugaaguuaaaca

SEQ ID NO: 16602 - RNA, 20 nt, Artificial Sequence
  TRAC targeting sequence
auuaagcaagaauuuaucaa

SEQ ID NO: 16603 - RNA, 20 nt, Artificial Sequence
  TRAC targeting sequence
uuggguguuuaacuucaauu

SEQ ID NO: 16604 - RNA, 20 nt, Artificial Sequence
  TRAC targeting sequence
gguuuccaggccaaagggaa

SEQ ID NO: 16605 - RNA, 20 nt, Artificial Sequence
  TRAC targeting sequence
aggccaaagggaagaagaaa

SEQ ID NO: 16606 - RNA, 20 nt, Artificial Sequence
  TRAC targeting sequence
cuuuggccuggaaaccugau

SEQ ID NO: 16607 - RNA, 20 nt, Artificial Sequence
  TRAC targeting sequence
ucccuuuggccuggaaaccu

SEQ ID NO: 16608 - RNA, 20 nt, Artificial Sequence
  TRAC targeting sequence
ucuucccuuuggccuggaaa

SEQ ID NO: 16609 - RNA, 20 nt, Artificial Sequence
  TRAC targeting sequence
uuugcuuaauuuucuucuuc

SEQ ID NO: 16610 - RNA, 20 nt, Artificial Sequence
  TRAC targeting sequence
aauguacugugucauuugcu

SEQ ID NO: 16611 - RNA, 20 nt, Artificial Sequence
  TRAC targeting sequence
ccacuacacgcucaaaugua

SEQ ID NO: 16612 - RNA, 20 nt, Artificial Sequence
  TRAC targeting sequence
uccccacuacacgcucaaau

SEQ ID NO: 16613 - RNA, 20 nt, Artificial Sequence
  TRAC targeting sequence
uccuccccacuacacgcuca

SEQ ID NO: 16614 - RNA, 20 nt, Artificial Sequence
  TRAC targeting sequence
agcauuucuuccuccccacu

SEQ ID NO: 16615 - RNA, 20 nt, Artificial Sequence
  TRAC targeting sequence
caaucuagcauuucuuccuc

SEQ ID NO: 16616 - RNA, 20 nt, Artificial Sequence
  TRAC targeting sequence
aauagagccauguuuugguc

SEQ ID NO: 16617 - RNA, 20 nt, Artificial Sequence
  TRAC targeting sequence
auuugaaucccaaucuagca

SEQ ID NO: 16618 - RNA, 20 nt, Artificial Sequence
  TRAC targeting sequence
cugcugccaacuagcaaugu

SEQ ID NO: 16619 - RNA, 20 nt, Artificial Sequence
  TRAC targeting sequence
gcugccaacuagcaauguaa

SEQ ID NO: 16620 - RNA, 20 nt, Artificial Sequence
  TRAC targeting sequence
aaguuacauugcuaguuggc

SEQ ID NO: 16621 - RNA, 20 nt, Artificial Sequence
  TRAC targeting sequence
ggucuaaguuacauugcuag

SEQ ID NO: 16622 - RNA, 20 nt, Artificial Sequence
  TRAC targeting sequence
cuugccucuaagccucaguu

SEQ ID NO: 16623 - RNA, 20 nt, Artificial Sequence
  TRAC targeting sequence
ugccucuaagccucaguuuc

SEQ ID NO: 16624 - RNA, 20 nt, Artificial Sequence
  TRAC targeting sequence
aagccucaguuucuuuaucu

SEQ ID NO: 16625 - RNA, 20 nt, Artificial Sequence
  TRAC targeting sequence
guuucuuuaucuguaaaugg

SEQ ID NO: 16626 - RNA, 20 nt, Artificial Sequence
  TRAC targeting sequence
uuaucuguaaauggggaagu

SEQ ID NO: 16627 - RNA, 20 nt, Artificial Sequence
  TRAC targeting sequence
guaaauggggaagugggucc

SEQ ID NO: 16628 - RNA, 20 nt, Artificial Sequence
  TRAC targeting sequence
ccauuuacagauaaagaaac

SEQ ID NO: 16629 - RNA, 20 nt, Artificial Sequence
  TRAC targeting sequence
aauggccucucuggccucuu

SEQ ID NO: 16630 - RNA, 20 nt, Artificial Sequence
  TRAC targeting sequence
cuggccucuuaguacaaaaa

SEQ ID NO: 16631 - RNA, 20 nt, Artificial Sequence
  TRAC targeting sequence
ggccucuuaguacaaaaagu

SEQ ID NO: 16632 - RNA, 20 nt, Artificial Sequence
  TRAC targeting sequence
uaguacaaaaagucuaugaa

SEQ ID NO: 16633 - RNA, 20 nt, Artificial Sequence
  TRAC targeting sequence
augaauguaucccauuuggg

SEQ ID NO: 16634 - RNA, 20 nt, Artificial Sequence
  TRAC targeting sequence
uagacuuuuuguacuaagag

SEQ ID NO: 16635 - RNA, 20 nt, Artificial Sequence
  TRAC targeting sequence
cauuuggggcacuuuuuucu

SEQ ID NO: 16636 - RNA, 20 nt, Artificial Sequence
  TRAC targeting sequence
ccuaggaguaacucaauagc

SEQ ID NO: 16637 - RNA, 20 nt, Artificial Sequence
  TRAC targeting sequence
uaggaguaacucaauagcua

SEQ ID NO: 16638 - RNA, 20 nt, Artificial Sequence
  TRAC targeting sequence
uaggagaaaaaagugcccca

SEQ ID NO: 16639 - RNA, 20 nt, Artificial Sequence
  TRAC targeting sequence
auagcuauuuuaaagcuuga

SEQ ID NO: 16640 - RNA, 20 nt, Artificial Sequence
  TRAC targeting sequence
agcuuuaaaauagcuauuga

SEQ ID NO: 16641 - RNA, 20 nt, Artificial Sequence
  TRAC targeting sequence
aacucauuagagcacaucaa

SEQ ID NO: 16642 - RNA, 20 nt, Artificial Sequence
  TRAC targeting sequence
uuagagcacaucaagaagag

SEQ ID NO: 16643 - RNA, 20 nt, Artificial Sequence
  TRAC targeting sequence
aaugaguuagaaaacacuca

SEQ ID NO: 16644 - RNA, 20 nt, Artificial Sequence
  TRAC targeting sequence
agaagaggggugaagugaca

SEQ ID NO: 16645 - RNA, 20 nt, Artificial Sequence
  TRAC targeting sequence
ugaugugcucuaaugaguua

SEQ ID NO: 16646 - RNA, 20 nt, Artificial Sequence
  TRAC targeting sequence
ucuugaugugcucuaaugag

SEQ ID NO: 16647 - RNA, 20 nt, Artificial Sequence
  TRAC targeting sequence
ccccucuucuugaugugcuc

SEQ ID NO: 16648 - RNA, 20 nt, Artificial Sequence
  TRAC targeting sequence
cuucaccccucuucuugaug

SEQ ID NO: 16649 - RNA, 20 nt, Artificial Sequence
  TRAC targeting sequence
cuuuugucacuucaccccuc

SEQ ID NO: 16650 - RNA, 20 nt, Artificial Sequence
  TRAC targeting sequence
caauaaacucccuuuuguca

SEQ ID NO: 16651 - RNA, 20 nt, Artificial Sequence
  TRAC targeting sequence
aacacugugauacucacggg

SEQ ID NO: 16652 - RNA, 20 nt, Artificial Sequence
  TRAC targeting sequence
caguguuugaugccucacaa

SEQ ID NO: 16653 - RNA, 20 nt, Artificial Sequence
  TRAC targeting sequence
cgggaggaggaaacaaacuc

SEQ ID NO: 16654 - RNA, 20 nt, Artificial Sequence
  TRAC targeting sequence
cgugaguaucacaguguuug

SEQ ID NO: 16655 - RNA, 20 nt, Artificial Sequence
  TRAC targeting sequence
ucccgugaguaucacagugu

SEQ ID NO: 16656 - RNA, 20 nt, Artificial Sequence
  TRAC targeting sequence
uccucccgugaguaucacag

SEQ ID NO: 16657 - RNA, 20 nt, Artificial Sequence
  TRAC targeting sequence
ccuuugggacaggcacucag

SEQ ID NO: 16658 - RNA, 20 nt, Artificial Sequence
  TRAC targeting sequence
caaaggugaguuuguuuccu

SEQ ID NO: 16659 - RNA, 20 nt, Artificial Sequence
  TRAC targeting sequence
gcuaaaaguggaacucagua

SEQ ID NO: 16660 - RNA, 20 nt, Artificial Sequence
  TRAC targeting sequence
acuuuuagcugagugccugu

SEQ ID NO: 16661 - RNA, 20 nt, Artificial Sequence
  TRAC targeting sequence
guaaguaugagauucuaugg

SEQ ID NO: 16662 - RNA, 20 nt, Artificial Sequence
  TRAC targeting sequence
uacuuacugaguuccacuuu

SEQ ID NO: 16663 - RNA, 20 nt, Artificial Sequence
  TRAC targeting sequence
cauacuuacugaguuccacu

SEQ ID NO: 16664 - RNA, 20 nt, Artificial Sequence
  TRAC targeting sequence
augguaauuacaaaauguau

SEQ ID NO: 16665 - RNA, 20 nt, Artificial Sequence
  TRAC targeting sequence
ggugacaauaaguggaagaa

SEQ ID NO: 16666 - RNA, 20 nt, Artificial Sequence
  TRAC targeting sequence
ccagaauacauuuuguaauu

SEQ ID NO: 16667 - RNA, 20 nt, Artificial Sequence
  TRAC targeting sequence
acuuauugucaccagaauac

SEQ ID NO: 16668 - RNA, 20 nt, Artificial Sequence
  TRAC targeting sequence
uccacuuauugucaccagaa

SEQ ID NO: 16669 - RNA, 20 nt, Artificial Sequence
  TRAC targeting sequence
ccuuuucuuccacuuauugu

SEQ ID NO: 16670 - RNA, 20 nt, Artificial Sequence
  TRAC targeting sequence
uuguaucuuauuuuuaaucu

SEQ ID NO: 16671 - RNA, 20 nt, Artificial Sequence
  TRAC targeting sequence
uauuuuuaaucuauuacuga

SEQ ID NO: 16672 - RNA, 20 nt, Artificial Sequence
  TRAC targeting sequence
auuacugaagcauuaagaau

SEQ ID NO: 16673 - RNA, 20 nt, Artificial Sequence
  TRAC targeting sequence
guaauagauuaaaaauaaga

SEQ ID NO: 16674 - RNA, 20 nt, Artificial Sequence
  TRAC targeting sequence
uaaugcuucaguaauagauu

SEQ ID NO: 16675 - RNA, 20 nt, Artificial Sequence
  TRAC targeting sequence
caauucuuaaugcuucagua

SEQ ID NO: 16676 - RNA, 20 nt, Artificial Sequence
  TRAC targeting sequence
agauaaauuagugaaaguau

SEQ ID NO: 16677 - RNA, 20 nt, Artificial Sequence
  TRAC targeting sequence
ggaugucacaauucuuaaug

SEQ ID NO: 16678 - RNA, 20 nt, Artificial Sequence
  TRAC targeting sequence
cuaauuuaucuggaugucac

SEQ ID NO: 16679 - RNA, 20 nt, Artificial Sequence
  TRAC targeting sequence
aaggcuauauaagcaugcuu

SEQ ID NO: 16680 - RNA, 20 nt, Artificial Sequence
  TRAC targeting sequence
uuaggguggaauuuagcuaa

SEQ ID NO: 16681 - RNA, 20 nt, Artificial Sequence
  TRAC targeting sequence
acccuaacgaaagcaugcuu

SEQ ID NO: 16682 - RNA, 20 nt, Artificial Sequence
  TRAC targeting sequence
uagugguuagcuaaauucca

SEQ ID NO: 16683 - RNA, 20 nt, Artificial Sequence
  TRAC targeting sequence
aagauaugagauuuucagcu

SEQ ID NO: 16684 - RNA, 20 nt, Artificial Sequence
  TRAC targeting sequence
uggaaaaagucuuagugguu

SEQ ID NO: 16685 - RNA, 20 nt, Artificial Sequence
  TRAC targeting sequence
uaucuuggaaaaagucuuag

SEQ ID NO: 16686 - RNA, 20 nt, Artificial Sequence
  TRAC targeting sequence
cauaucuuggaaaaagucuu

SEQ ID NO: 16687 - RNA, 20 nt, Artificial Sequence
  TRAC targeting sequence
gcucucuucaacgugagagu

SEQ ID NO: 16688 - RNA, 20 nt, Artificial Sequence
  TRAC targeting sequence
cuucaacgugagaguuuuua

SEQ ID NO: 16689 - RNA, 20 nt, Artificial Sequence
  TRAC targeting sequence
ucaacgugagaguuuuuaau

SEQ ID NO: 16690 - RNA, 20 nt, Artificial Sequence
  TRAC targeting sequence
acgugagaguuuuuaauacu

SEQ ID NO: 16691 - RNA, 20 nt, Artificial Sequence
  TRAC targeting sequence
cguugaagagagcugaaaau

SEQ ID NO: 16692 - RNA, 20 nt, Artificial Sequence
  TRAC targeting sequence
cacguugaagagagcugaaa

SEQ ID NO: 16693 - RNA, 20 nt, Artificial Sequence
  TRAC targeting sequence
uuuagcuuaauacuaguauu

SEQ ID NO: 16694 - RNA, 20 nt, Artificial Sequence
  TRAC targeting sequence
auggaagaaaagagcuagaa

SEQ ID NO: 16695 - RNA, 20 nt, Artificial Sequence
  TRAC targeting sequence
auugagcaucguuuagcuua

SEQ ID NO: 16696 - RNA, 20 nt, Artificial Sequence
  TRAC targeting sequence
uccauugagcaucguuuagc

SEQ ID NO: 16697 - RNA, 20 nt, Artificial Sequence
  TRAC targeting sequence
uuucuuccauugagcaucgu

SEQ ID NO: 16698 - RNA, 20 nt, Artificial Sequence
  TRAC targeting sequence
agcucuuuucuuccauugag

SEQ ID NO: 16699 - RNA, 20 nt, Artificial Sequence
  TRAC targeting sequence
ucuagcucuuuucuuccauu

SEQ ID NO: 16700 - RNA, 20 nt, Artificial Sequence
  TRAC targeting sequence
gcucuucuagcucuuuucuu

SEQ ID NO: 16701 - RNA, 20 nt, Artificial Sequence
  TRAC targeting sequence
ugaucaaauagauccuuucu

SEQ ID NO: 16702 - RNA, 20 nt, Artificial Sequence
  TRAC targeting sequence
ugacggugcaauuuucugcu

SEQ ID NO: 16703 - RNA, 20 nt, Artificial Sequence
  TRAC targeting sequence
aauagauccuuucuacuucc

SEQ ID NO: 16704 - RNA, 20 nt, Artificial Sequence
  TRAC targeting sequence
auuugaucaugacggugcaa

SEQ ID NO: 16705 - RNA, 20 nt, Artificial Sequence
  TRAC targeting sequence
uuucuacuuccacugccaug

SEQ ID NO: 16706 - RNA, 20 nt, Artificial Sequence
  TRAC targeting sequence
acuuccacugccauggacuc

SEQ ID NO: 16707 - RNA, 20 nt, Artificial Sequence
  TRAC targeting sequence
acugccauggacucaguggu

SEQ ID NO: 16708 - RNA, 20 nt, Artificial Sequence
  TRAC targeting sequence
auggcaguggaaguagaaag

SEQ ID NO: 16709 - RNA, 20 nt, Artificial Sequence
  TRAC targeting sequence
guggugcauuuagaagaggg

SEQ ID NO: 16710 - RNA, 20 nt, Artificial Sequence
  TRAC targeting sequence
aaaugcaccacugaguccau

SEQ ID NO: 16711 - RNA, 20 nt, Artificial Sequence
  TRAC targeting sequence
ucuaaaugcaccacugaguc

SEQ ID NO: 16712 - RNA, 20 nt, Artificial Sequence
  TRAC targeting sequence
aggucauuuuagccaugccc

SEQ ID NO: 16713 - RNA, 20 nt, Artificial Sequence
  TRAC targeting sequence
uuuuagccaugccccaaaaa

SEQ ID NO: 16714 - RNA, 20 nt, Artificial Sequence
  TRAC targeting sequence
caauucauuccagagauugu

SEQ ID NO: 16715 - RNA, 20 nt, Artificial Sequence
  TRAC targeting sequence
uuccagagauugugcccccu

SEQ ID NO: 16716 - RNA, 20 nt, Artificial Sequence
  TRAC targeting sequence
agagauugugcccccuuaug

SEQ ID NO: 16717 - RNA, 20 nt, Artificial Sequence
  TRAC targeting sequence
ggaaugaauugggagugguu

SEQ ID NO: 16718 - RNA, 20 nt, Artificial Sequence
  TRAC targeting sequence
cuggaaugaauugggagugg

SEQ ID NO: 16719 - RNA, 20 nt, Artificial Sequence
  TRAC targeting sequence
uccaagaagagucagugaag

SEQ ID NO: 16720 - RNA, 20 nt, Artificial Sequence
  TRAC targeting sequence
aagaagagucagugaaguac

SEQ ID NO: 16721 - RNA, 20 nt, Artificial Sequence
  TRAC targeting sequence
uggaugauguuuagcauaag

SEQ ID NO: 16722 - RNA, 20 nt, Artificial Sequence
  TRAC targeting sequence
ucuuggaugauguuuagcau

SEQ ID NO: 16723 - RNA, 20 nt, Artificial Sequence
  TRAC targeting sequence
gugaaguacagagaaaggaa

SEQ ID NO: 16724 - RNA, 20 nt, Artificial Sequence
  TRAC targeting sequence
cugacucuucuuggaugaug

SEQ ID NO: 16725 - RNA, 20 nt, Artificial Sequence
  TRAC targeting sequence
guacuucacugacucuucuu

SEQ ID NO: 16726 - RNA, 20 nt, Artificial Sequence
  TRAC targeting sequence
cuguacuucacugacucuuc

SEQ ID NO: 16727 - RNA, 20 nt, Artificial Sequence
  TRAC targeting sequence
uuucucuguacuucacugac

SEQ ID NO: 16728 - RNA, 20 nt, Artificial Sequence
  TRAC targeting sequence
uguuucgguccagaguucua

SEQ ID NO: 16729 - RNA, 20 nt, Artificial Sequence
  TRAC targeting sequence
guccagaguucuagguuuga

SEQ ID NO: 16730 - RNA, 20 nt, Artificial Sequence
  TRAC targeting sequence
agaguucuagguuugauuug

SEQ ID NO: 16731 - RNA, 20 nt, Artificial Sequence
  TRAC targeting sequence
ggaccgaaacaagaagcccu

SEQ ID NO: 16732 - RNA, 20 nt, Artificial Sequence
  TRAC targeting sequence
agguuugauuuggucccaac

SEQ ID NO: 16733 - RNA, 20 nt, Artificial Sequence
  TRAC targeting sequence
aaccuagaacucuggaccga

SEQ ID NO: 16734 - RNA, 20 nt, Artificial Sequence
  TRAC targeting sequence
caacuggaugugugauauug

SEQ ID NO: 16735 - RNA, 20 nt, Artificial Sequence
  TRAC targeting sequence
aguugggaccaaaucaaacc

SEQ ID NO: 16736 - RNA, 20 nt, Artificial Sequence
  TRAC targeting sequence
cacauccaguugggaccaaa

SEQ ID NO: 16737 - RNA, 20 nt, Artificial Sequence
  TRAC targeting sequence
aauaucacacauccaguugg

SEQ ID NO: 16738 - RNA, 20 nt, Artificial Sequence
  TRAC targeting sequence
uuccaauaucacacauccag

SEQ ID NO: 16739 - RNA, 20 nt, Artificial Sequence
  TRAC targeting sequence
uugccccucucugcaccuca

SEQ ID NO: 16740 - RNA, 20 nt, Artificial Sequence
  TRAC targeting sequence
cugcaccucagacuccucca

SEQ ID NO: 16741 - RNA, 20 nt, Artificial Sequence
  TRAC targeting sequence
gcaccucagacuccuccagu

SEQ ID NO: 16742 - RNA, 20 nt, Artificial Sequence
  TRAC targeting sequence
gacuccuccaguggaugagg

SEQ ID NO: 16743 - RNA, 20 nt, Artificial Sequence
  TRAC targeting sequence
gaggugcagagaggggcaau

SEQ ID NO: 16744 - RNA, 20 nt, Artificial Sequence
  TRAC targeting sequence
uccaguggaugaggggguca

SEQ ID NO: 16745 - RNA, 20 nt, Artificial Sequence
  TRAC targeting sequence
aguggaugagggggucaaag

SEQ ID NO: 16746 - RNA, 20 nt, Artificial Sequence
  TRAC targeting sequence
acuggaggagucugaggugc

SEQ ID NO: 16747 - RNA, 20 nt, Artificial Sequence
  TRAC targeting sequence
uccacuggaggagucugagg

SEQ ID NO: 16748 - RNA, 20 nt, Artificial Sequence
  TRAC targeting sequence
aagcccucaaaaucuguugu

SEQ ID NO: 16749 - RNA, 20 nt, Artificial Sequence
  TRAC targeting sequence
aaaucuguuguucugggauu

SEQ ID NO: 16750 - RNA, 20 nt, Artificial Sequence
  TRAC targeting sequence
guuguucugggauuucgcua

SEQ ID NO: 16751 - RNA, 20 nt, Artificial Sequence
  TRAC targeting sequence
gggauuucgcuauuauacca

SEQ ID NO: 16752 - RNA, 20 nt, Artificial Sequence
  TRAC targeting sequence
cagaacaacagauuuugagg

SEQ ID NO: 16753 - RNA, 20 nt, Artificial Sequence
  TRAC targeting sequence
cuauuauaccacccgagagu

SEQ ID NO: 16754 - RNA, 20 nt, Artificial Sequence
  TRAC targeting sequence
ggugguauaauagcgaaauc

SEQ ID NO: 16755 - RNA, 20 nt, Artificial Sequence
  TRAC targeting sequence
cgggugguauaauagcgaaa

SEQ ID NO: 16756 - RNA, 20 nt, Artificial Sequence
  TRAC targeting sequence
uauaaacucucgggugguau

SEQ ID NO: 16757 - RNA, 20 nt, Artificial Sequence
  TRAC targeting sequence
agaguauggaaucuugugag

SEQ ID NO: 16758 - RNA, 20 nt, Artificial Sequence
  TRAC targeting sequence
aguccuauaaacucucgggu

SEQ ID NO: 16759 - RNA, 20 nt, Artificial Sequence
  TRAC targeting sequence
cgaguccuauaaacucucgg

SEQ ID NO: 16760 - RNA, 20 nt, Artificial Sequence
  TRAC targeting sequence
auacucucgaguccuauaaa

SEQ ID NO: 16761 - RNA, 20 nt, Artificial Sequence
  TRAC targeting sequence
ugugaguauuucauaaacaa

SEQ ID NO: 16762 - RNA, 20 nt, Artificial Sequence
  TRAC targeting sequence
caagauuccauacucucgag

SEQ ID NO: 16763 - RNA, 20 nt, Artificial Sequence
  TRAC targeting sequence
uaaacaaauucuaugacccu

SEQ ID NO: 16764 - RNA, 20 nt, Artificial Sequence
  TRAC targeting sequence
augacccucaggaaauagcc

SEQ ID NO: 16765 - RNA, 20 nt, Artificial Sequence
  TRAC targeting sequence
uagaauuuguuuaugaaaua

SEQ ID NO: 16766 - RNA, 20 nt, Artificial Sequence
  TRAC targeting sequence
ggaaauagcccuguuaauca

SEQ ID NO: 16767 - RNA, 20 nt, Artificial Sequence
  TRAC targeting sequence
ugagggucauagaauuuguu

SEQ ID NO: 16768 - RNA, 20 nt, Artificial Sequence
  TRAC targeting sequence
acaaccuaacuuaacauaga

SEQ ID NO: 16769 - RNA, 20 nt, Artificial Sequence
  TRAC targeting sequence
auguuaaguuagguuguuga

SEQ ID NO: 16770 - RNA, 20 nt, Artificial Sequence
  TRAC targeting sequence
cagucccuaccauguuuaga

SEQ ID NO: 16771 - RNA, 20 nt, Artificial Sequence
  TRAC targeting sequence
gucccuaccauguuuagaua

SEQ ID NO: 16772 - RNA, 20 nt, Artificial Sequence
  TRAC targeting sequence
cuaccauguuuagauacgau

SEQ ID NO: 16773 - RNA, 20 nt, Artificial Sequence
  TRAC targeting sequence
aaacaugguagggacugaga

SEQ ID NO: 16774 - RNA, 20 nt, Artificial Sequence
  TRAC targeting sequence
uaucuaaacaugguagggac

SEQ ID NO: 16775 - RNA, 20 nt, Artificial Sequence
  TRAC targeting sequence
agcaucguaucuaaacaugg

SEQ ID NO: 16776 - RNA, 20 nt, Artificial Sequence
  TRAC targeting sequence
ugcaucuagcaucguaucua

SEQ ID NO: 16777 - RNA, 20 nt, Artificial Sequence
  TRAC targeting sequence
acaugucaugcaucuagcau

SEQ ID NO: 16778 - RNA, 20 nt, Artificial Sequence
  TRAC targeting sequence
ucugaaauaacucugugagg

SEQ ID NO: 16779 - RNA, 20 nt, Artificial Sequence
  TRAC targeting sequence
gaaauaacucugugagguaa

SEQ ID NO: 16780 - RNA, 20 nt, Artificial Sequence
  TRAC targeting sequence
gaugaacaauucuacauguc

SEQ ID NO: 16781 - RNA, 20 nt, Artificial Sequence
  TRAC targeting sequence
gugagguaaggggaaguauc

SEQ ID NO: 16782 - RNA, 20 nt, Artificial Sequence
  TRAC targeting sequence
cagaguuauuucagaugaac

SEQ ID NO: 16783 - RNA, 20 nt, Artificial Sequence
  TRAC targeting sequence
ccuuaccucacagaguuauu

SEQ ID NO: 16784 - RNA, 20 nt, Artificial Sequence
  TRAC targeting sequence
uauuuuacaaaagaagaaac

SEQ ID NO: 16785 - RNA, 20 nt, Artificial Sequence
  TRAC targeting sequence
uuuguaaaauaagauacuuc

SEQ ID NO: 16786 - RNA, 20 nt, Artificial Sequence
  TRAC targeting sequence
ucuuuuguaaaauaagauac

SEQ ID NO: 16787 - RNA, 20 nt, Artificial Sequence
  TRAC targeting sequence
guuucuucuuuuguaaaaua

SEQ ID NO: 16788 - RNA, 20 nt, Artificial Sequence
  TRAC targeting sequence
gagaaggaagugcccaagau

SEQ ID NO: 16789 - RNA, 20 nt, Artificial Sequence
  TRAC targeting sequence
gagccucaguuucuucuuuu

SEQ ID NO: 16790 - RNA, 20 nt, Artificial Sequence
  TRAC targeting sequence
cugagccucaguuucuucuu

SEQ ID NO: 16791 - RNA, 20 nt, Artificial Sequence
  TRAC targeting sequence
uucucugagccucaguuucu

SEQ ID NO: 16792 - RNA, 20 nt, Artificial Sequence
  TRAC targeting sequence
ugggcacuuccuucucugag

SEQ ID NO: 16793 - RNA, 20 nt, Artificial Sequence
  TRAC targeting sequence
caaagcuaguaaguaaaggg

SEQ ID NO: 16794 - RNA, 20 nt, Artificial Sequence
  TRAC targeting sequence
gccugccugacuaaaaagcc

SEQ ID NO: 16795 - RNA, 20 nt, Artificial Sequence
  TRAC targeting sequence
ggcaggcagacccaaguuua

SEQ ID NO: 16796 - RNA, 20 nt, Artificial Sequence
  TRAC targeting sequence
uucuuuuauuuuauuuuauu

SEQ ID NO: 16797 - RNA, 20 nt, Artificial Sequence
  TRAC targeting sequence
uuuauuuuauuuuauuuuau

SEQ ID NO: 16798 - RNA, 20 nt, Artificial Sequence
  TRAC targeting sequence
gagacagagucuugcucugu

SEQ ID NO: 16799 - RNA, 20 nt, Artificial Sequence
  TRAC targeting sequence
gaaauaaauaaauaaauaaa

SEQ ID NO: 16800 - RNA, 20 nt, Artificial Sequence
  TRAC targeting sequence
cagaaauaaauaaauaaaua

SEQ ID NO: 16801 - RNA, 20 nt, Artificial Sequence
  TRAC targeting sequence
gucucagaaauaaauaaaua

SEQ ID NO: 16802 - RNA, 20 nt, Artificial Sequence
  TRAC targeting sequence
ugcucugucacccaggcugg

SEQ ID NO: 16803 - RNA, 20 nt, Artificial Sequence
  TRAC targeting sequence
gucacccaggcuggagugca

SEQ ID NO: 16804 - RNA, 20 nt, Artificial Sequence
  TRAC targeting sequence
cccaggcuggagugcagugc

SEQ ID NO: 16805 - RNA, 20 nt, Artificial Sequence
  TRAC targeting sequence
agccugggugacagagcaag

SEQ ID NO: 16806 - RNA, 20 nt, Artificial Sequence
  TRAC targeting sequence
cagcucacugcagccucugc

SEQ ID NO: 16807 - RNA, 20 nt, Artificial Sequence
  TRAC targeting sequence
gcucacugcagccucugccu

SEQ ID NO: 16808 - RNA, 20 nt, Artificial Sequence
  TRAC targeting sequence
cugcagccucugccucccag

SEQ ID NO: 16809 - RNA, 20 nt, Artificial Sequence
  TRAC targeting sequence
gccucccagguucaagcgau

SEQ ID NO: 16810 - RNA, 20 nt, Artificial Sequence
  TRAC targeting sequence
cagguucaagcgauucgauu

SEQ ID NO: 16811 - RNA, 20 nt, Artificial Sequence
  TRAC targeting sequence
agcgauucgauucuccugcc

SEQ ID NO: 16812 - RNA, 20 nt, Artificial Sequence
  TRAC targeting sequence
cuugaaccugggaggcagag

SEQ ID NO: 16813 - RNA, 20 nt, Artificial Sequence
  TRAC targeting sequence
auucuccugccucagccucc

SEQ ID NO: 16814 - RNA, 20 nt, Artificial Sequence
  TRAC targeting sequence
aaucgcuugaaccugggagg

SEQ ID NO: 16815 - RNA, 20 nt, Artificial Sequence
  TRAC targeting sequence
ccugccucagccucccaagu

SEQ ID NO: 16816 - RNA, 20 nt, Artificial Sequence
  TRAC targeting sequence
ugccucagccucccaaguag

SEQ ID NO: 16817 - RNA, 20 nt, Artificial Sequence
  TRAC targeting sequence
gccucccaaguagcuggggu

SEQ ID NO: 16818 - RNA, 20 nt, Artificial Sequence
  TRAC targeting sequence
caaguagcugggguuacagg

SEQ ID NO: 16819 - RNA, 20 nt, Artificial Sequence
  TRAC targeting sequence
ggugugguggcgcaugccug

SEQ ID NO: 16820 - RNA, 20 nt, Artificial Sequence
  TRAC targeting sequence
uucuacugcaugaugucgua

SEQ ID NO: 16821 - RNA, 20 nt, Artificial Sequence
  TRAC targeting sequence
acugcaugaugucguagagc

SEQ ID NO: 16822 - RNA, 20 nt, Artificial Sequence
  TRAC targeting sequence
ugcaguagaaagagcagggc

SEQ ID NO: 16823 - RNA, 20 nt, Artificial Sequence
  TRAC targeting sequence
uagagcuugugcucuaguuu

SEQ ID NO: 16824 - RNA, 20 nt, Artificial Sequence
  TRAC targeting sequence
acgacaucaugcaguagaaa

SEQ ID NO: 16825 - RNA, 20 nt, Artificial Sequence
  TRAC targeting sequence
aguuuacuuagaaaugagag

SEQ ID NO: 16826 - RNA, 20 nt, Artificial Sequence
  TRAC targeting sequence
aaguaaacuagagcacaagc

SEQ ID NO: 16827 - RNA, 20 nt, Artificial Sequence
  TRAC targeting sequence
uuucuaaguaaacuagagca

SEQ ID NO: 16828 - RNA, 20 nt, Artificial Sequence
  TRAC targeting sequence
cauuucuaaguaaacuagag

SEQ ID NO: 16829 - RNA, 20 nt, Artificial Sequence
  TRAC targeting sequence
ccucucauuucuaaguaaac

SEQ ID NO: 16830 - RNA, 20 nt, Artificial Sequence
  TRAC targeting sequence
cagugacuggugaaaugcuu

SEQ ID NO: 16831 - RNA, 20 nt, Artificial Sequence
  TRAC targeting sequence
cugugauuggcaucaccucu

SEQ ID NO: 16832 - RNA, 20 nt, Artificial Sequence
  TRAC targeting sequence
ccagucacugugauuggcau

SEQ ID NO: 16833 - RNA, 20 nt, Artificial Sequence
  TRAC targeting sequence
aagcauuucaccagucacug

SEQ ID NO: 16834 - RNA, 20 nt, Artificial Sequence
  TRAC targeting sequence
uuucuacuuuagauauugcu

SEQ ID NO: 16835 - RNA, 20 nt, Artificial Sequence
  TRAC targeting sequence
acuuuagauauugcugugag

SEQ ID NO: 16836 - RNA, 20 nt, Artificial Sequence
  TRAC targeting sequence
aaaguagaaaagauaaauuc

SEQ ID NO: 16837 - RNA, 20 nt, Artificial Sequence
  TRAC targeting sequence
cagcaauaucuaaaguagaa

SEQ ID NO: 16838 - RNA, 20 nt, Artificial Sequence
  TRAC targeting sequence
aacucacagcaauaucuaaa

SEQ ID NO: 16839 - RNA, 20 nt, Artificial Sequence
  TRAC targeting sequence
cuaacucacagcaauaucua

SEQ ID NO: 16840 - RNA, 20 nt, Artificial Sequence
  TRAC targeting sequence
ggaaaucuugacauggaugc

SEQ ID NO: 16841 - RNA, 20 nt, Artificial Sequence
  TRAC targeting sequence
cgaagcacccucucuaacuc

SEQ ID NO: 16842 - RNA, 20 nt, Artificial Sequence
  TRAC targeting sequence
ugacauggaugccccaagug

SEQ ID NO: 16843 - RNA, 20 nt, Artificial Sequence
  TRAC targeting sequence
agauuucccgaagcacccuc

SEQ ID NO: 16844 - RNA, 20 nt, Artificial Sequence
  TRAC targeting sequence
augucaagauuucccgaagc

SEQ ID NO: 16845 - RNA, 20 nt, Artificial Sequence
  TRAC targeting sequence
aaagaguucuccuccccuuu

SEQ ID NO: 16846 - RNA, 20 nt, Artificial Sequence
  TRAC targeting sequence
uuagacacuuggggcaucca

SEQ ID NO: 16847 - RNA, 20 nt, Artificial Sequence
  TRAC targeting sequence
ccuccccuuucaaugacaaa

SEQ ID NO: 16848 - RNA, 20 nt, Artificial Sequence
  TRAC targeting sequence
uccccuuucaaugacaaaac

SEQ ID NO: 16849 - RNA, 20 nt, Artificial Sequence
  TRAC targeting sequence
ccuuucaaugacaaaacaaa

SEQ ID NO: 16850 - RNA, 20 nt, Artificial Sequence
  TRAC targeting sequence
augacaaaacaaaguacaga

SEQ ID NO: 16851 - RNA, 20 nt, Artificial Sequence
  TRAC targeting sequence
uugaaaggggaggagaacuc

SEQ ID NO: 16852 - RNA, 20 nt, Artificial Sequence
  TRAC targeting sequence
guacuuuguuuugucauuga

SEQ ID NO: 16853 - RNA, 20 nt, Artificial Sequence
  TRAC targeting sequence
cagcaacucuguacuuuguu

SEQ ID NO: 16854 - RNA, 20 nt, Artificial Sequence
  TRAC targeting sequence
cuauugggguaaaugcuccc

SEQ ID NO: 16855 - RNA, 20 nt, Artificial Sequence
  TRAC targeting sequence
cccuauugggguaaaugcuc

SEQ ID NO: 16856 - RNA, 20 nt, Artificial Sequence
  TRAC targeting sequence
uuucucccuauugggguaaa

SEQ ID NO: 16857 - RNA, 20 nt, Artificial Sequence
  TRAC targeting sequence
cuuuucucccuauuggggua

SEQ ID NO: 16858 - RNA, 20 nt, Artificial Sequence
  TRAC targeting sequence
ccucucuuuucucccuauug

SEQ ID NO: 16859 - RNA, 20 nt, Artificial Sequence
  TRAC targeting sequence
cuuguucugacugucccuuu

SEQ ID NO: 16860 - RNA, 20 nt, Artificial Sequence
  TRAC targeting sequence
gacugucccuuuccuucgcu

SEQ ID NO: 16861 - RNA, 20 nt, Artificial Sequence
  TRAC targeting sequence
gaacaagggaguggcugcag

SEQ ID NO: 16862 - RNA, 20 nt, Artificial Sequence
  TRAC targeting sequence
cuuuccuucgcuguuucuug

SEQ ID NO: 16863 - RNA, 20 nt, Artificial Sequence
  TRAC targeting sequence
uucgcuguuucuuguauuuu

SEQ ID NO: 16864 - RNA, 20 nt, Artificial Sequence
  TRAC targeting sequence
cuguuucuuguauuuucccc

SEQ ID NO: 16865 - RNA, 20 nt, Artificial Sequence
  TRAC targeting sequence
uguauuuuccccaggcagac

SEQ ID NO: 16866 - RNA, 20 nt, Artificial Sequence
  TRAC targeting sequence
ccaggcagaccagccaccaa

SEQ ID NO: 16867 - RNA, 20 nt, Artificial Sequence
  TRAC targeting sequence
gccuggggaaaauacaagaa

SEQ ID NO: 16868 - RNA, 20 nt, Artificial Sequence
  TRAC targeting sequence
guuauauugguggcuggucu

SEQ ID NO: 16869 - RNA, 20 nt, Artificial Sequence
  TRAC targeting sequence
acaagagccugacuccuuug

SEQ ID NO: 16870 - RNA, 20 nt, Artificial Sequence
  TRAC targeting sequence
uguagaucaguuauauuggu

SEQ ID NO: 16871 - RNA, 20 nt, Artificial Sequence
  TRAC targeting sequence
ggcucuuguagaucaguuau

SEQ ID NO: 16872 - RNA, 20 nt, Artificial Sequence
  TRAC targeting sequence
uuugugaguuauagagaaau

SEQ ID NO: 16873 - RNA, 20 nt, Artificial Sequence
  TRAC targeting sequence
caaaggagucaggcucuugu

SEQ ID NO: 16874 - RNA, 20 nt, Artificial Sequence
  TRAC targeting sequence
auaacucacaaaggagucag

SEQ ID NO: 16875 - RNA, 20 nt, Artificial Sequence
  TRAC targeting sequence
cuauaacucacaaaggaguc

SEQ ID NO: 16876 - RNA, 20 nt, Artificial Sequence
  TRAC targeting sequence
cccugcauuucucuauaacu

SEQ ID NO: 16877 - RNA, 20 nt, Artificial Sequence
  TRAC targeting sequence
augugcaaagugccuucacc

SEQ ID NO: 16878 - RNA, 20 nt, Artificial Sequence
  TRAC targeting sequence
gagagacagccucaaaauau

SEQ ID NO: 16879 - RNA, 20 nt, Artificial Sequence
  TRAC targeting sequence
gagcuaaaguucuaugugca

SEQ ID NO: 16880 - RNA, 20 nt, Artificial Sequence
  TRAC targeting sequence
cagagcuaaaguucuaugug

SEQ ID NO: 16881 - RNA, 20 nt, Artificial Sequence
  TRAC targeting sequence
cucagagcuaaaguucuaug

SEQ ID NO: 16882 - RNA, 20 nt, Artificial Sequence
  TRAC targeting sequence
aaauaucuaguucaccccuc

SEQ ID NO: 16883 - RNA, 20 nt, Artificial Sequence
  TRAC targeting sequence
aguucaccccucuuuauuuu

SEQ ID NO: 16884 - RNA, 20 nt, Artificial Sequence
  TRAC targeting sequence
ccccucuuuauuuucccaau

SEQ ID NO: 16885 - RNA, 20 nt, Artificial Sequence
  TRAC targeting sequence
uuauuuucccaauaaggaaa

SEQ ID NO: 16886 - RNA, 20 nt, Artificial Sequence
  TRAC targeting sequence
caauaaggaaauuaagaccc

SEQ ID NO: 16887 - RNA, 20 nt, Artificial Sequence
  TRAC targeting sequence
uuauugggaaaauaaagagg

SEQ ID NO: 16888 - RNA, 20 nt, Artificial Sequence
  TRAC targeting sequence
uaauuuccuuauugggaaaa

SEQ ID NO: 16889 - RNA, 20 nt, Artificial Sequence
  TRAC targeting sequence
gggucuuaauuuccuuauug

SEQ ID NO: 16890 - RNA, 20 nt, Artificial Sequence
  TRAC targeting sequence
cugggucuuaauuuccuuau

SEQ ID NO: 16891 - RNA, 20 nt, Artificial Sequence
  TRAC targeting sequence
gccaaccucucugggucuua

SEQ ID NO: 16892 - RNA, 20 nt, Artificial Sequence
  TRAC targeting sequence
aaggucagugcgaacuaggg

SEQ ID NO: 16893 - RNA, 20 nt, Artificial Sequence
  TRAC targeting sequence
gugcgaacuagggcugggac

SEQ ID NO: 16894 - RNA, 20 nt, Artificial Sequence
  TRAC targeting sequence
cacugaccuuagacaauuca

SEQ ID NO: 16895 - RNA, 20 nt, Artificial Sequence
  TRAC targeting sequence
cagcccuaguucgcacugac

SEQ ID NO: 16896 - RNA, 20 nt, Artificial Sequence
  TRAC targeting sequence
agucccagcccuaguucgca

SEQ ID NO: 16897 - RNA, 20 nt, Artificial Sequence
  TRAC targeting sequence
agguucuagucccagcccua

SEQ ID NO: 16898 - RNA, 20 nt, Artificial Sequence
  TRAC targeting sequence
ccagguucuagucccagccc

SEQ ID NO: 16899 - RNA, 20 nt, Artificial Sequence
  TRAC targeting sequence
ugguccuggggccauauucu

SEQ ID NO: 16900 - RNA, 20 nt, Artificial Sequence
  TRAC targeting sequence
uggggccauauucugugacu

SEQ ID NO: 16901 - RNA, 20 nt, Artificial Sequence
  TRAC targeting sequence
gugacugcuguuuggugaac

SEQ ID NO: 16902 - RNA, 20 nt, Artificial Sequence
  TRAC targeting sequence
cagaauauggccccaggacc

SEQ ID NO: 16903 - RNA, 20 nt, Artificial Sequence
  TRAC targeting sequence
ccaaacagcagucacagaau

SEQ ID NO: 16904 - RNA, 20 nt, Artificial Sequence
  TRAC targeting sequence
gauagguaggaagugugagu

SEQ ID NO: 16905 - RNA, 20 nt, Artificial Sequence
  TRAC targeting sequence
gaaguuuaguucaccaaaca

SEQ ID NO: 16906 - RNA, 20 nt, Artificial Sequence
  TRAC targeting sequence
uaccuaucagaaguuuaguu

SEQ ID NO: 16907 - RNA, 20 nt, Artificial Sequence
  TRAC targeting sequence
cacuuccuaccuaucagaag

SEQ ID NO: 16908 - RNA, 20 nt, Artificial Sequence
  TRAC targeting sequence
uaaacaggaaaaacaaauag

SEQ ID NO: 16909 - RNA, 20 nt, Artificial Sequence
  TRAC targeting sequence
uguuuaugagcauaacucac

SEQ ID NO: 16910 - RNA, 20 nt, Artificial Sequence
  TRAC targeting sequence
ccuuguaaaaccuauuuguu

SEQ ID NO: 16911 - RNA, 20 nt, Artificial Sequence
  TRAC targeting sequence
uccuuauuacuagcaccuua

SEQ ID NO: 16912 - RNA, 20 nt, Artificial Sequence
  TRAC targeting sequence
uuauuacuagcaccuuagua

SEQ ID NO: 16913 - RNA, 20 nt, Artificial Sequence
  TRAC targeting sequence
cuagaccugcuccccagcug

SEQ ID NO: 16914 - RNA, 20 nt, Artificial Sequence
  TRAC targeting sequence
agggagccuauacuaaggug

SEQ ID NO: 16915 - RNA, 20 nt, Artificial Sequence
  TRAC targeting sequence
ccagcugugguguaaaaaug

SEQ ID NO: 16916 - RNA, 20 nt, Artificial Sequence
  TRAC targeting sequence
auuuuuacaccacagcuggg

SEQ ID NO: 16917 - RNA, 20 nt, Artificial Sequence
  TRAC targeting sequence
uuccauuuuuacaccacagc

SEQ ID NO: 16918 - RNA, 20 nt, Artificial Sequence
  TRAC targeting sequence
ccuuccauuuuuacaccaca

SEQ ID NO: 16919 - RNA, 20 nt, Artificial Sequence
  TRAC targeting sequence
uucuccuuccauuuuuacac

SEQ ID NO: 16920 - RNA, 20 nt, Artificial Sequence
  TRAC targeting sequence
cagugcaaaucacuguggga

SEQ ID NO: 16921 - RNA, 20 nt, Artificial Sequence
  TRAC targeting sequence
cugugggaaauacuggaggc

SEQ ID NO: 16922 - RNA, 20 nt, Artificial Sequence
  TRAC targeting sequence
cacagugauuugcacugcga

SEQ ID NO: 16923 - RNA, 20 nt, Artificial Sequence
  TRAC targeting sequence
aguauuucccacagugauuu

SEQ ID NO: 16924 - RNA, 20 nt, Artificial Sequence
  TRAC targeting sequence
aaacuaucuuuggagcagga

SEQ ID NO: 16925 - RNA, 20 nt, Artificial Sequence
  TRAC targeting sequence
uuggagcaggaacaagacua

SEQ ID NO: 16926 - RNA, 20 nt, Artificial Sequence
  TRAC targeting sequence
aaagauaguuuugaagccuc

SEQ ID NO: 16927 - RNA, 20 nt, Artificial Sequence
  TRAC targeting sequence
ugcuccaaagauaguuuuga

SEQ ID NO: 16928 - RNA, 20 nt, Artificial Sequence
  TRAC targeting sequence
uguuccugcuccaaagauag

SEQ ID NO: 16929 - RNA, 20 nt, Artificial Sequence
  TRAC targeting sequence
augaaauaaccugauuuaua

SEQ ID NO: 16930 - RNA, 20 nt, Artificial Sequence
  TRAC targeting sequence
uggaacuuacuugcuuuaac

SEQ ID NO: 16931 - RNA, 20 nt, Artificial Sequence
  TRAC targeting sequence
gguuauuucauggaacuuac

SEQ ID NO: 16932 - RNA, 20 nt, Artificial Sequence
  TRAC targeting sequence
acuguaauauaaaucagguu

SEQ ID NO: 16933 - RNA, 20 nt, Artificial Sequence
  TRAC targeting sequence
ucaacuguaauauaaaucag

SEQ ID NO: 16934 - RNA, 20 nt, Artificial Sequence
  TRAC targeting sequence
guuuucauugauuuuuuucu

SEQ ID NO: 16935 - RNA, 20 nt, Artificial Sequence
  TRAC targeting sequence
uugauuuuuuucuuuuuagg

SEQ ID NO: 16936 - RNA, 20 nt, Artificial Sequence
  TRAC targeting sequence
augaaaacagauguucuuca

SEQ ID NO: 16937 - RNA, 20 nt, Artificial Sequence
  TRAC targeting sequence
uuuuagggggaaggggacau

SEQ ID NO: 16938 - RNA, 20 nt, Artificial Sequence
  TRAC targeting sequence
cccuaaaaagaaaaaaauca

SEQ ID NO: 16939 - RNA, 20 nt, Artificial Sequence
  TRAC targeting sequence
ccuucccccuaaaaagaaaa

SEQ ID NO: 16940 - RNA, 20 nt, Artificial Sequence
  TRAC targeting sequence
gccaguuaaauuagaagaua

SEQ ID NO: 16941 - RNA, 20 nt, Artificial Sequence
  TRAC targeting sequence
aauuuaacuggcagacaaaa

SEQ ID NO: 16942 - RNA, 20 nt, Artificial Sequence
  TRAC targeting sequence
ucuaauuuaacuggcagaca

SEQ ID NO: 16943 - RNA, 20 nt, Artificial Sequence
  TRAC targeting sequence
augggcaucacucuugcaag

SEQ ID NO: 16944 - RNA, 20 nt, Artificial Sequence
  TRAC targeting sequence
cucuugcaagaaacauguau

SEQ ID NO: 16945 - RNA, 20 nt, Artificial Sequence
  TRAC targeting sequence
ugcaagaaacauguauaaua

SEQ ID NO: 16946 - RNA, 20 nt, Artificial Sequence
  TRAC targeting sequence
ugcaagagugaugcccaugg

SEQ ID NO: 16947 - RNA, 20 nt, Artificial Sequence
  TRAC targeting sequence
acacuuaacuguuuguuauu

SEQ ID NO: 16948 - RNA, 20 nt, Artificial Sequence
  TRAC targeting sequence
auccacacuuaacuguuugu

SEQ ID NO: 16949 - RNA, 20 nt, Artificial Sequence
  TRAC targeting sequence
cuagguccuaucuagaacug

SEQ ID NO: 16950 - RNA, 20 nt, Artificial Sequence
  TRAC targeting sequence
uaucuagaacugaaacucug

SEQ ID NO: 16951 - RNA, 20 nt, Artificial Sequence
  TRAC targeting sequence
agaacugaaacucuguaauu

SEQ ID NO: 16952 - RNA, 20 nt, Artificial Sequence
  TRAC targeting sequence
agauaggaccuagggaaguu

SEQ ID NO: 16953 - RNA, 20 nt, Artificial Sequence
  TRAC targeting sequence
guucuagauaggaccuaggg

SEQ ID NO: 16954 - RNA, 20 nt, Artificial Sequence
  TRAC targeting sequence
guaauuauauuaauaacuuu

SEQ ID NO: 16955 - RNA, 20 nt, Artificial Sequence
  TRAC targeting sequence
aguuaaaaaaguuauuaaua

SEQ ID NO: 16956 - RNA, 20 nt, Artificial Sequence
  TRAC targeting sequence
cuaauauucaaguuaaaaaa

SEQ ID NO: 16957 - RNA, 20 nt, Artificial Sequence
  TRAC targeting sequence
gcuuuguauaccuuggguua

SEQ ID NO: 16958 - RNA, 20 nt, Artificial Sequence
  TRAC targeting sequence
ucaguuggguucuaucugau

SEQ ID NO: 16959 - RNA, 20 nt, Artificial Sequence
  TRAC targeting sequence
guuggguucuaucugauuug

SEQ ID NO: 16960 - RNA, 20 nt, Artificial Sequence
  TRAC targeting sequence
aucugauuuguugucaucuu

SEQ ID NO: 16961 - RNA, 20 nt, Artificial Sequence
  TRAC targeting sequence
gauuuguugucaucuuccaa

SEQ ID NO: 16962 - RNA, 20 nt, Artificial Sequence
  TRAC targeting sequence
gauagaacccaacugaagau

SEQ ID NO: 16963 - RNA, 20 nt, Artificial Sequence
  TRAC targeting sequence
ucuuccaauggucuuaggaa

SEQ ID NO: 16964 - RNA, 20 nt, Artificial Sequence
  TRAC targeting sequence
uccaauggucuuaggaaaau

SEQ ID NO: 16965 - RNA, 20 nt, Artificial Sequence
  TRAC targeting sequence
aauggucuuaggaaaauuaa

SEQ ID NO: 16966 - RNA, 20 nt, Artificial Sequence
  TRAC targeting sequence
uaggaaaauuaagguuaaau

SEQ ID NO: 16967 - RNA, 20 nt, Artificial Sequence
  TRAC targeting sequence
uaagaccauuggaagaugac

SEQ ID NO: 16968 - RNA, 20 nt, Artificial Sequence
  TRAC targeting sequence
uacuauuuaaccuuaauuuu

SEQ ID NO: 16969 - RNA, 20 nt, Artificial Sequence
  TRAC targeting sequence
aaucuuacuauuuaaccuua

SEQ ID NO: 16970 - RNA, 20 nt, Artificial Sequence
  TRAC targeting sequence
uaccacuuugguacaugcau

SEQ ID NO: 16971 - RNA, 20 nt, Artificial Sequence
  TRAC targeting sequence
gcaugcauguaccaaagugg

SEQ ID NO: 16972 - RNA, 20 nt, Artificial Sequence
  TRAC targeting sequence
augucugcaugcauguacca

SEQ ID NO: 16973 - RNA, 20 nt, Artificial Sequence
  TRAC targeting sequence
caugcaaguuaguuacuaag

SEQ ID NO: 16974 - RNA, 20 nt, Artificial Sequence
  TRAC targeting sequence
uaggcuauggcccagugaca

SEQ ID NO: 16975 - RNA, 20 nt, Artificial Sequence
  TRAC targeting sequence
cugggccauagccuaggauu

SEQ ID NO: 16976 - RNA, 20 nt, Artificial Sequence
  TRAC targeting sequence
cauuuuguacagaguuaugu

SEQ ID NO: 16977 - RNA, 20 nt, Artificial Sequence
  TRAC targeting sequence
guacaaaaugggacccuguc

SEQ ID NO: 16978 - RNA, 20 nt, Artificial Sequence
  TRAC targeting sequence
gagugugaacacaggcuuuc

SEQ ID NO: 16979 - RNA, 20 nt, Artificial Sequence
  TRAC targeting sequence
gacauaacucuguacaaaau

SEQ ID NO: 16980 - RNA, 20 nt, Artificial Sequence
  TRAC targeting sequence
cacucugacauaacucugua

SEQ ID NO: 16981 - RNA, 20 nt, Artificial Sequence
  TRAC targeting sequence
gaaacuuguauuuggaacug

SEQ ID NO: 16982 - RNA, 20 nt, Artificial Sequence
  TRAC targeting sequence
gaaagccuguguucacacuc

SEQ ID NO: 16983 - RNA, 20 nt, Artificial Sequence
  TRAC targeting sequence
aaauacaaguuucugaaagc

SEQ ID NO: 16984 - RNA, 20 nt, Artificial Sequence
  TRAC targeting sequence
ggugccaguuccaaauacaa

SEQ ID NO: 16985 - RNA, 20 nt, Artificial Sequence
  TRAC targeting sequence
ggucaguccaaguaagucaa

SEQ ID NO: 16986 - RNA, 20 nt, Artificial Sequence
  TRAC targeting sequence
guccaaguaagucaaaucug

SEQ ID NO: 16987 - RNA, 20 nt, Artificial Sequence
  TRAC targeting sequence
aaguaagucaaaucugcaga

SEQ ID NO: 16988 - RNA, 20 nt, Artificial Sequence
  TRAC targeting sequence
aaucugcagaaauguguagc

SEQ ID NO: 16989 - RNA, 20 nt, Artificial Sequence
  TRAC targeting sequence
gcagaaauguguagcccuau

SEQ ID NO: 16990 - RNA, 20 nt, Artificial Sequence
  TRAC targeting sequence
gcagauuugacuuacuugga

SEQ ID NO: 16991 - RNA, 20 nt, Artificial Sequence
  TRAC targeting sequence
ucaauauugggcauauaugg

SEQ ID NO: 16992 - RNA, 20 nt, Artificial Sequence
  TRAC targeting sequence
auauugggcauauauggaua

SEQ ID NO: 16993 - RNA, 20 nt, Artificial Sequence
  TRAC targeting sequence
auauaugcccaauauugagg

SEQ ID NO: 16994 - RNA, 20 nt, Artificial Sequence
  TRAC targeting sequence
ggucuauaauagauuauuau

SEQ ID NO: 16995 - RNA, 20 nt, Artificial Sequence
  TRAC targeting sequence
auaauagauuauuauuacua

SEQ ID NO: 16996 - RNA, 20 nt, Artificial Sequence
  TRAC targeting sequence
auuauagaccagaauaauua

SEQ ID NO: 16997 - RNA, 20 nt, Artificial Sequence
  TRAC targeting sequence
uauuaaucauaacaaugcug

SEQ ID NO: 16998 - RNA, 20 nt, Artificial Sequence
  TRAC targeting sequence
uaacaaugcugcuaauuuca

SEQ ID NO: 16999 - RNA, 20 nt, Artificial Sequence
  TRAC targeting sequence
aauauacauuuucugccaua

SEQ ID NO: 17000 - RNA, 20 nt, Artificial Sequence
  TRAC targeting sequence
gccauauuauuauuuuuacc

SEQ ID NO: 17001 - RNA, 20 nt, Artificial Sequence
  TRAC targeting sequence
uuaaagguaaaaauaauaau

SEQ ID NO: 17002 - RNA, 20 nt, Artificial Sequence
  TRAC targeting sequence
ccuuaaagguaaaaauaaua

SEQ ID NO: 17003 - RNA, 20 nt, Artificial Sequence
  TRAC targeting sequence
agauaucaggagggaaauau

SEQ ID NO: 17004 - RNA, 20 nt, Artificial Sequence
  TRAC targeting sequence
ugacaauaauucuccuuaaa

SEQ ID NO: 17005 - RNA, 20 nt, Artificial Sequence
  TRAC targeting sequence
ggagggaaauauuugaauuu

SEQ ID NO: 17006 - RNA, 20 nt, Artificial Sequence
  TRAC targeting sequence
ugauaucuugacaauaauuc

SEQ ID NO: 17007 - RNA, 20 nt, Artificial Sequence
  TRAC targeting sequence
cuccugauaucuugacaaua

SEQ ID NO: 17008 - RNA, 20 nt, Artificial Sequence
  TRAC targeting sequence
aauauuucccuccugauauc

SEQ ID NO: 17009 - RNA, 20 nt, Artificial Sequence
  TRAC targeting sequence
uuugagucaaguuucuuauu

SEQ ID NO: 17010 - RNA, 20 nt, Artificial Sequence
  TRAC targeting sequence
aaggaaauucaaauauuucc

SEQ ID NO: 17011 - RNA, 20 nt, Artificial Sequence
  TRAC targeting sequence
aguuucuuauuuguucguca

SEQ ID NO: 17012 - RNA, 20 nt, Artificial Sequence
  TRAC targeting sequence
uauuuguucgucaguuccca

SEQ ID NO: 17013 - RNA, 20 nt, Artificial Sequence
  TRAC targeting sequence
ucaguucccaccucucugcu

SEQ ID NO: 17014 - RNA, 20 nt, Artificial Sequence
  TRAC targeting sequence
guucccaccucucugcugag

SEQ ID NO: 17015 - RNA, 20 nt, Artificial Sequence
  TRAC targeting sequence
caccucucugcugaggguca

SEQ ID NO: 17016 - RNA, 20 nt, Artificial Sequence
  TRAC targeting sequence
cugcugagggucauaugaac

SEQ ID NO: 17017 - RNA, 20 nt, Artificial Sequence
  TRAC targeting sequence
gcugagggucauaugaaccu

SEQ ID NO: 17018 - RNA, 20 nt, Artificial Sequence
  TRAC targeting sequence
gcagagaggugggaacugac

SEQ ID NO: 17019 - RNA, 20 nt, Artificial Sequence
  TRAC targeting sequence
uaugaaccucacgauguuuu

SEQ ID NO: 17020 - RNA, 20 nt, Artificial Sequence
  TRAC targeting sequence
uaugacccucagcagagagg

SEQ ID NO: 17021 - RNA, 20 nt, Artificial Sequence
  TRAC targeting sequence
cgauguuuugguuuuuauac

SEQ ID NO: 17022 - RNA, 20 nt, Artificial Sequence
  TRAC targeting sequence
ugagguucauaugacccuca

SEQ ID NO: 17023 - RNA, 20 nt, Artificial Sequence
  TRAC targeting sequence
uauuaucucucuuagaaaug

SEQ ID NO: 17024 - RNA, 20 nt, Artificial Sequence
  TRAC targeting sequence
cucuuagaaaugcuuccuug

SEQ ID NO: 17025 - RNA, 20 nt, Artificial Sequence
  TRAC targeting sequence
cuuagaaaugcuuccuuggu

SEQ ID NO: 17026 - RNA, 20 nt, Artificial Sequence
  TRAC targeting sequence
uagaaaugcuuccuugguuu

SEQ ID NO: 17027 - RNA, 20 nt, Artificial Sequence
  TRAC targeting sequence
aagagagauaauaagaaggc

SEQ ID NO: 17028 - RNA, 20 nt, Artificial Sequence
  TRAC targeting sequence
uugguuuuuccuugccuaag

SEQ ID NO: 17029 - RNA, 20 nt, Artificial Sequence
  TRAC targeting sequence
uugccuaagcacuuagauuu

SEQ ID NO: 17030 - RNA, 20 nt, Artificial Sequence
  TRAC targeting sequence
aagugcuuaggcaaggaaaa

SEQ ID NO: 17031 - RNA, 20 nt, Artificial Sequence
  TRAC targeting sequence
cauuuacccagaguauacuu

SEQ ID NO: 17032 - RNA, 20 nt, Artificial Sequence
  TRAC targeting sequence
ggguaaaugugagcugcaaa

SEQ ID NO: 17033 - RNA, 20 nt, Artificial Sequence
  TRAC targeting sequence
cccaaaacuggccucccugu

SEQ ID NO: 17034 - RNA, 20 nt, Artificial Sequence
  TRAC targeting sequence
caaaacuggccucccugucc

SEQ ID NO: 17035 - RNA, 20 nt, Artificial Sequence
  TRAC targeting sequence
cugucccaauaauuaugcac

SEQ ID NO: 17036 - RNA, 20 nt, Artificial Sequence
  TRAC targeting sequence
caauaauuaugcacaguaaa

SEQ ID NO: 17037 - RNA, 20 nt, Artificial Sequence
  TRAC targeting sequence
guucaauucaguaaaugauu

SEQ ID NO: 17038 - RNA, 20 nt, Artificial Sequence
  TRAC targeting sequence
auucaguaaaugauuauuga

SEQ ID NO: 17039 - RNA, 20 nt, Artificial Sequence
  TRAC targeting sequence
guaaaugauuauugaguauc

SEQ ID NO: 17040 - RNA, 20 nt, Artificial Sequence
  TRAC targeting sequence
uuuacugaauugaacugacu

SEQ ID NO: 17041 - RNA, 20 nt, Artificial Sequence
  TRAC targeting sequence
auaaucauuuacugaauuga

SEQ ID NO: 17042 - RNA, 20 nt, Artificial Sequence
  TRAC targeting sequence
ucaacaaaccagggaaucau

SEQ ID NO: 17043 - RNA, 20 nt, Artificial Sequence
  TRAC targeting sequence
acaaaccagggaaucaucau

SEQ ID NO: 17044 - RNA, 20 nt, Artificial Sequence
  TRAC targeting sequence
cugguuuguugaugauacuc

SEQ ID NO: 17045 - RNA, 20 nt, Artificial Sequence
  TRAC targeting sequence
ucauugguuuuaaaagaaag

SEQ ID NO: 17046 - RNA, 20 nt, Artificial Sequence
  TRAC targeting sequence
uugguuuuaaaagaaagaaa

SEQ ID NO: 17047 - RNA, 20 nt, Artificial Sequence
  TRAC targeting sequence
uuuaaaaccaaugaugauuc

SEQ ID NO: 17048 - RNA, 20 nt, Artificial Sequence
  TRAC targeting sequence
uucuuuuaaaaccaaugaug

SEQ ID NO: 17049 - RNA, 20 nt, Artificial Sequence
  TRAC targeting sequence
uuguuucuuucuuuuaaaac

SEQ ID NO: 17050 - RNA, 20 nt, Artificial Sequence
  TRAC targeting sequence
uuucuuuguuucuuucuuuu

SEQ ID NO: 17051 - RNA, 20 nt, Artificial Sequence
  TRAC targeting sequence
uaggcuucugaucucaagaa

SEQ ID NO: 17052 - RNA, 20 nt, Artificial Sequence
  TRAC targeting sequence
gaucucaagaacuuccaguc

SEQ ID NO: 17053 - RNA, 20 nt, Artificial Sequence
  TRAC targeting sequence
gaagccuaagauagcuuagg

SEQ ID NO: 17054 - RNA, 20 nt, Artificial Sequence
  TRAC targeting sequence
caagaacuuccagucuuauc

SEQ ID NO: 17055 - RNA, 20 nt, Artificial Sequence
  TRAC targeting sequence
agaacuuccagucuuaucag

SEQ ID NO: 17056 - RNA, 20 nt, Artificial Sequence
  TRAC targeting sequence
ugagaucagaagccuaagau

SEQ ID NO: 17057 - RNA, 20 nt, Artificial Sequence
  TRAC targeting sequence
agucuuaucagagaaacuaa

SEQ ID NO: 17058 - RNA, 20 nt, Artificial Sequence
  TRAC targeting sequence
uaucagagaaacuaagcacu

SEQ ID NO: 17059 - RNA, 20 nt, Artificial Sequence
  TRAC targeting sequence
gagaaacuaagcacucauaa

SEQ ID NO: 17060 - RNA, 20 nt, Artificial Sequence
  TRAC targeting sequence
gauaagacuggaaguucuug

SEQ ID NO: 17061 - RNA, 20 nt, Artificial Sequence
  TRAC targeting sequence
cugauaagacuggaaguucu

SEQ ID NO: 17062 - RNA, 20 nt, Artificial Sequence
  TRAC targeting sequence
uaauaaaaagucuaacaaca

SEQ ID NO: 17063 - RNA, 20 nt, Artificial Sequence
  TRAC targeting sequence
aacaacaauuuauaugugua

SEQ ID NO: 17064 - RNA, 20 nt, Artificial Sequence
  TRAC targeting sequence
uggcacauacacauauaaau

SEQ ID NO: 17065 - RNA, 20 nt, Artificial Sequence
  TRAC targeting sequence
ugagggcuggagacaggaca

SEQ ID NO: 17066 - RNA, 20 nt, Artificial Sequence
  TRAC targeting sequence
ggaaacccaccccccuaucu

SEQ ID NO: 17067 - RNA, 20 nt, Artificial Sequence
  TRAC targeting sequence
agcccucaggaaacccaccc

SEQ ID NO: 17068 - RNA, 20 nt, Artificial Sequence
  TRAC targeting sequence
ccagcccucaggaaacccac

SEQ ID NO: 17069 - RNA, 20 nt, Artificial Sequence
  TRAC targeting sequence
ugucuccagcccucaggaaa

SEQ ID NO: 17070 - RNA, 20 nt, Artificial Sequence
  TRAC targeting sequence
uaccuguccugucuccagcc

SEQ ID NO: 17071 - RNA, 20 nt, Artificial Sequence
  TRAC targeting sequence
uuggcagagaacacacauga

SEQ ID NO: 17072 - RNA, 20 nt, Artificial Sequence
  TRAC targeting sequence
gccaaagaaugcggcugugc

SEQ ID NO: 17073 - RNA, 20 nt, Artificial Sequence
  TRAC targeting sequence
cugccaaagaaugcggcugu

SEQ ID NO: 17074 - RNA, 20 nt, Artificial Sequence
  TRAC targeting sequence
uguguguucucugccaaaga

SEQ ID NO: 17075 - RNA, 20 nt, Artificial Sequence
  TRAC targeting sequence
cccaaauauguuucuggaaa

SEQ ID NO: 17076 - RNA, 20 nt, Artificial Sequence
  TRAC targeting sequence
ggaaacggaauugagucugu

SEQ ID NO: 17077 - RNA, 20 nt, Artificial Sequence
  TRAC targeting sequence
agaaacauauuugggggaau

SEQ ID NO: 17078 - RNA, 20 nt, Artificial Sequence
  TRAC targeting sequence
guuuccagaaacauauuugg

SEQ ID NO: 17079 - RNA, 20 nt, Artificial Sequence
  TRAC targeting sequence
auuccguuuccagaaacaua

SEQ ID NO: 17080 - RNA, 20 nt, Artificial Sequence
  TRAC targeting sequence
guucugugcugagaucuuug

SEQ ID NO: 17081 - RNA, 20 nt, Artificial Sequence
  TRAC targeting sequence
gugcugagaucuuugacuuu

SEQ ID NO: 17082 - RNA, 20 nt, Artificial Sequence
  TRAC targeting sequence
gcacagaacagacucaauuc

SEQ ID NO: 17083 - RNA, 20 nt, Artificial Sequence
  TRAC targeting sequence
cagcacagaacagacucaau

SEQ ID NO: 17084 - RNA, 20 nt, Artificial Sequence
  TRAC targeting sequence
uugacuuucuugaggacaaa

SEQ ID NO: 17085 - RNA, 20 nt, Artificial Sequence
  TRAC targeting sequence
aagaucucagcacagaacag

SEQ ID NO: 17086 - RNA, 20 nt, Artificial Sequence
  TRAC targeting sequence
ugaggacaaaagcccccuug

SEQ ID NO: 17087 - RNA, 20 nt, Artificial Sequence
  TRAC targeting sequence
agaaagucaaagaucucagc

SEQ ID NO: 17088 - RNA, 20 nt, Artificial Sequence
  TRAC targeting sequence
ucaagaaagucaaagaucuc

SEQ ID NO: 17089 - RNA, 20 nt, Artificial Sequence
  TRAC targeting sequence
uugagcgggggugaggacag

SEQ ID NO: 17090 - RNA, 20 nt, Artificial Sequence
  TRAC targeting sequence
aggaugcuaacugccaaggg

SEQ ID NO: 17091 - RNA, 20 nt, Artificial Sequence
  TRAC targeting sequence
cccccgcucaaggaugcuaa

SEQ ID NO: 17092 - RNA, 20 nt, Artificial Sequence
  TRAC targeting sequence
ucacccccgcucaaggaugc

SEQ ID NO: 17093 - RNA, 20 nt, Artificial Sequence
  TRAC targeting sequence
guccucacccccgcucaagg

SEQ ID NO: 17094 - RNA, 20 nt, Artificial Sequence
  TRAC targeting sequence
uguuucuguccucacccccg

SEQ ID NO: 17095 - RNA, 20 nt, Artificial Sequence
  TRAC targeting sequence
uuccuguuucuguccucacc

SEQ ID NO: 17096 - RNA, 20 nt, Artificial Sequence
  TRAC targeting sequence
ggcgugagucacccaagacu

SEQ ID NO: 17097 - RNA, 20 nt, Artificial Sequence
  TRAC targeting sequence
cgccugacucauuccuguuu

SEQ ID NO: 17098 - RNA, 20 nt, Artificial Sequence
  TRAC targeting sequence
cccaagacucucacucagcc

SEQ ID NO: 17099 - RNA, 20 nt, Artificial Sequence
  TRAC targeting sequence
ugggugacucacgccugacu

SEQ ID NO: 17100 - RNA, 20 nt, Artificial Sequence
  TRAC targeting sequence
cacucagccccaagaggaug

SEQ ID NO: 17101 - RNA, 20 nt, Artificial Sequence
  TRAC targeting sequence
cucagccccaagaggaugga

SEQ ID NO: 17102 - RNA, 20 nt, Artificial Sequence
  TRAC targeting sequence
gccccaagaggauggaguga

SEQ ID NO: 17103 - RNA, 20 nt, Artificial Sequence
  TRAC targeting sequence
uggggcugagugagagucuu

SEQ ID NO: 17104 - RNA, 20 nt, Artificial Sequence
  TRAC targeting sequence
ucuuggggcugagugagagu

SEQ ID NO: 17105 - RNA, 20 nt, Artificial Sequence
  TRAC targeting sequence
auccucuuggggcugaguga

SEQ ID NO: 17106 - RNA, 20 nt, Artificial Sequence
  TRAC targeting sequence
cuccauccucuuggggcuga

SEQ ID NO: 17107 - RNA, 20 nt, Artificial Sequence
  TRAC targeting sequence
gagucaugccgaggcauguc

SEQ ID NO: 17108 - RNA, 20 nt, Artificial Sequence
  TRAC targeting sequence
gagucacuccauccucuugg

SEQ ID NO: 17109 - RNA, 20 nt, Artificial Sequence
  TRAC targeting sequence
ugccgaggcaugucuuuagc

SEQ ID NO: 17110 - RNA, 20 nt, Artificial Sequence
  TRAC targeting sequence
gcaugacucagagucacucc

SEQ ID NO: 17111 - RNA, 20 nt, Artificial Sequence
  TRAC targeting sequence
uuagcaugugcuccagcaca

SEQ ID NO: 17112 - RNA, 20 nt, Artificial Sequence
  TRAC targeting sequence
agcacagugugcauuuaugg

SEQ ID NO: 17113 - RNA, 20 nt, Artificial Sequence
  TRAC targeting sequence
ccuugccauaaaugcacacu

SEQ ID NO: 17114 - RNA, 20 nt, Artificial Sequence
  TRAC targeting sequence
cuaggaaaaugguaccuucu

SEQ ID NO: 17115 - RNA, 20 nt, Artificial Sequence
  TRAC targeting sequence
uagugacaugugcaaaaaug

SEQ ID NO: 17116 - RNA, 20 nt, Artificial Sequence
  TRAC targeting sequence
ucucaggcauggcagaugaa

SEQ ID NO: 17117 - RNA, 20 nt, Artificial Sequence
  TRAC targeting sequence
caggcauggcagaugaagua

SEQ ID NO: 17118 - RNA, 20 nt, Artificial Sequence
  TRAC targeting sequence
ggcauggcagaugaaguagg

SEQ ID NO: 17119 - RNA, 20 nt, Artificial Sequence
  TRAC targeting sequence
gccaugccugagaagaaggu

SEQ ID NO: 17120 - RNA, 20 nt, Artificial Sequence
  TRAC targeting sequence
ucugccaugccugagaagaa

SEQ ID NO: 17121 - RNA, 20 nt, Artificial Sequence
  TRAC targeting sequence
uacuucaucugccaugccug

SEQ ID NO: 17122 - RNA, 20 nt, Artificial Sequence
  TRAC targeting sequence
cugguaucuuuagaaauacu

SEQ ID NO: 17123 - RNA, 20 nt, Artificial Sequence
  TRAC targeting sequence
gguaucuuuagaaauacuca

SEQ ID NO: 17124 - RNA, 20 nt, Artificial Sequence
  TRAC targeting sequence
uuagaaauacucacacccau

SEQ ID NO: 17125 - RNA, 20 nt, Artificial Sequence
  TRAC targeting sequence
aaagauaccagagagcaggc

SEQ ID NO: 17126 - RNA, 20 nt, Artificial Sequence
  TRAC targeting sequence
cacccauccagccuauguag

SEQ ID NO: 17127 - RNA, 20 nt, Artificial Sequence
  TRAC targeting sequence
agccuauguaggauacaaug

SEQ ID NO: 17128 - RNA, 20 nt, Artificial Sequence
  TRAC targeting sequence
uacauaggcuggaugggugu

SEQ ID NO: 17129 - RNA, 20 nt, Artificial Sequence
  TRAC targeting sequence
ugaaguuuuaugaagauucu

SEQ ID NO: 17130 - RNA, 20 nt, Artificial Sequence
  TRAC targeting sequence
ugaaaaacauuguauccuac

SEQ ID NO: 17131 - RNA, 20 nt, Artificial Sequence
  TRAC targeting sequence
uaaaacuucaugaaaaacau

SEQ ID NO: 17132 - RNA, 20 nt, Artificial Sequence
  TRAC targeting sequence
ucauaaaacuucaugaaaaa

SEQ ID NO: 17133 - RNA, 20 nt, Artificial Sequence
  TRAC targeting sequence
guuuuucccaaaggagaaau

SEQ ID NO: 17134 - RNA, 20 nt, Artificial Sequence
  TRAC targeting sequence
caaaggagaaauagccaaag

SEQ ID NO: 17135 - RNA, 20 nt, Artificial Sequence
  TRAC targeting sequence
uuugggaaaaacagaaucuu

SEQ ID NO: 17136 - RNA, 20 nt, Artificial Sequence
  TRAC targeting sequence
ccuuugggaaaaacagaauc

SEQ ID NO: 17137 - RNA, 20 nt, Artificial Sequence
  TRAC targeting sequence
auaaacacagcuuuggcuau

SEQ ID NO: 17138 - RNA, 20 nt, Artificial Sequence
  TRAC targeting sequence
cagcuaucaauaaacacagc

SEQ ID NO: 17139 - RNA, 20 nt, Artificial Sequence
  TRAC targeting sequence
ucacagcuaucaauaaacac

SEQ ID NO: 17140 - RNA, 20 nt, Artificial Sequence
  TRAC targeting sequence
ucaucacagcuaucaauaaa

SEQ ID NO: 17141 - RNA, 20 nt, Artificial Sequence
  TRAC targeting sequence
uuuuccucaucacagcuauc

SEQ ID NO: 17142 - RNA, 20 nt, Artificial Sequence
  TRAC targeting sequence
ggugcuguuuauacccuuua

SEQ ID NO: 17143 - RNA, 20 nt, Artificial Sequence
  TRAC targeting sequence
cuaaaggguauaaacagcac

SEQ ID NO: 17144 - RNA, 20 nt, Artificial Sequence
  TRAC targeting sequence
uucaagucuucauaccaccc

SEQ ID NO: 17145 - RNA, 20 nt, Artificial Sequence
  TRAC targeting sequence
agucuucauaccacccauua

SEQ ID NO: 17146 - RNA, 20 nt, Artificial Sequence
  TRAC targeting sequence
ucauaccacccauuacaagg

SEQ ID NO: 17147 - RNA, 20 nt, Artificial Sequence
  TRAC targeting sequence
uaccacccauuacaaggaaa

SEQ ID NO: 17148 - RNA, 20 nt, Artificial Sequence
  TRAC targeting sequence
uuguaaugggugguaugaag

SEQ ID NO: 17149 - RNA, 20 nt, Artificial Sequence
  TRAC targeting sequence
gccuuucaggguuuccagau

SEQ ID NO: 17150 - RNA, 20 nt, Artificial Sequence
  TRAC targeting sequence
ggguuuccagaucuuagagc

SEQ ID NO: 17151 - RNA, 20 nt, Artificial Sequence
  TRAC targeting sequence
agaucuuagagcuacuguga

SEQ ID NO: 17152 - RNA, 20 nt, Artificial Sequence
  TRAC targeting sequence
ggaaacccugaaaggcggau

SEQ ID NO: 17153 - RNA, 20 nt, Artificial Sequence
  TRAC targeting sequence
uagagcuacugugaagggga

SEQ ID NO: 17154 - RNA, 20 nt, Artificial Sequence
  TRAC targeting sequence
aagaucuggaaacccugaaa

SEQ ID NO: 17155 - RNA, 20 nt, Artificial Sequence
  TRAC targeting sequence
caguagcucuaagaucugga

SEQ ID NO: 17156 - RNA, 20 nt, Artificial Sequence
  TRAC targeting sequence
ccuucacaguagcucuaaga

SEQ ID NO: 17157 - RNA, 20 nt, Artificial Sequence
  TRAC targeting sequence
ucagagaaggggugggcaaa

SEQ ID NO: 17158 - RNA, 20 nt, Artificial Sequence
  TRAC targeting sequence
gagaaggggugggcaaaacc

SEQ ID NO: 17159 - RNA, 20 nt, Artificial Sequence
  TRAC targeting sequence
gaagacacauccccuucaca

SEQ ID NO: 17160 - RNA, 20 nt, Artificial Sequence
  TRAC targeting sequence
cugaagacacauccccuuca

SEQ ID NO: 17161 - RNA, 20 nt, Artificial Sequence
  TRAC targeting sequence
ugguuuugcccaccccuucu

SEQ ID NO: 17162 - RNA, 20 nt, Artificial Sequence
  TRAC targeting sequence
cacuguguaaguguauuaca

SEQ ID NO: 17163 - RNA, 20 nt, Artificial Sequence
  TRAC targeting sequence
cauagucacacuguguaagu

SEQ ID NO: 17164 - RNA, 20 nt, Artificial Sequence
  TRAC targeting sequence
guuguucccauagucacacu

SEQ ID NO: 17165 - RNA, 20 nt, Artificial Sequence
  TRAC targeting sequence
cuuuugggaaggggaaccaa

SEQ ID NO: 17166 - RNA, 20 nt, Artificial Sequence
  TRAC targeting sequence
caaaagcgagucuguuguuc

SEQ ID NO: 17167 - RNA, 20 nt, Artificial Sequence
  TRAC targeting sequence
ccuucccaaaagcgagucug

SEQ ID NO: 17168 - RNA, 20 nt, Artificial Sequence
  TRAC targeting sequence
uaccaaguaagugagcuggg

SEQ ID NO: 17169 - RNA, 20 nt, Artificial Sequence
  TRAC targeting sequence
cuuacuugguaugaccacca

SEQ ID NO: 17170 - RNA, 20 nt, Artificial Sequence
  TRAC targeting sequence
cagcucacuuacuugguaug

SEQ ID NO: 17171 - RNA, 20 nt, Artificial Sequence
  TRAC targeting sequence
uccugcacaaauggccacag

SEQ ID NO: 17172 - RNA, 20 nt, Artificial Sequence
  TRAC targeting sequence
ugcacaaauggccacagcca

SEQ ID NO: 17173 - RNA, 20 nt, Artificial Sequence
  TRAC targeting sequence
cuacccugugcuggagagcc

SEQ ID NO: 17174 - RNA, 20 nt, Artificial Sequence
  TRAC targeting sequence
agcacaggguagggaugggg

SEQ ID NO: 17175 - RNA, 20 nt, Artificial Sequence
  TRAC targeting sequence
ccagcacaggguagggaugg

SEQ ID NO: 17176 - RNA, 20 nt, Artificial Sequence
  TRAC targeting sequence
uaucauauuuccaugggagc

SEQ ID NO: 17177 - RNA, 20 nt, Artificial Sequence
  TRAC targeting sequence
uauuuccaugggagcggggg

SEQ ID NO: 17178 - RNA, 20 nt, Artificial Sequence
  TRAC targeting sequence
augggagcgggggaaggaca

SEQ ID NO: 17179 - RNA, 20 nt, Artificial Sequence
  TRAC targeting sequence
cauggaaauaugauaagagg

SEQ ID NO: 17180 - RNA, 20 nt, Artificial Sequence
  TRAC targeting sequence
cccgcucccauggaaauaug

SEQ ID NO: 17181 - RNA, 20 nt, Artificial Sequence
  TRAC targeting sequence
uucccccgcucccauggaaa

SEQ ID NO: 17182 - RNA, 20 nt, Artificial Sequence
  TRAC targeting sequence
ucagugcuauaucgaagaac

SEQ ID NO: 17183 - RNA, 20 nt, Artificial Sequence
  TRAC targeting sequence
gugcuauaucgaagaaccuu

SEQ ID NO: 17184 - RNA, 20 nt, Artificial Sequence
  TRAC targeting sequence
aagaaccuuaggcggccacu

SEQ ID NO: 17185 - RNA, 20 nt, Artificial Sequence
  TRAC targeting sequence
auauagcacugaugaauggc

SEQ ID NO: 17186 - RNA, 20 nt, Artificial Sequence
  TRAC targeting sequence
ucgauauagcacugaugaau

SEQ ID NO: 17187 - RNA, 20 nt, Artificial Sequence
  TRAC targeting sequence
caaaucuuugccugucccug

SEQ ID NO: 17188 - RNA, 20 nt, Artificial Sequence
  TRAC targeting sequence
uugccugucccugguuucuu

SEQ ID NO: 17189 - RNA, 20 nt, Artificial Sequence
  TRAC targeting sequence
cugguuucuuucacucuccc

SEQ ID NO: 17190 - RNA, 20 nt, Artificial Sequence
  TRAC targeting sequence
uucacucuccccuucucugc

SEQ ID NO: 17191 - RNA, 20 nt, Artificial Sequence
  TRAC targeting sequence
cucuccccuucucugcaucu

SEQ ID NO: 17192 - RNA, 20 nt, Artificial Sequence
  TRAC targeting sequence
ccccuucucugcaucuccac

SEQ ID NO: 17193 - RNA, 20 nt, Artificial Sequence
  TRAC targeting sequence
ccuucucugcaucuccacug

SEQ ID NO: 17194 - RNA, 20 nt, Artificial Sequence
  TRAC targeting sequence
cugcaucuccacugaccaca

SEQ ID NO: 17195 - RNA, 20 nt, Artificial Sequence
  TRAC targeting sequence
gcaucuccacugaccacacu

SEQ ID NO: 17196 - RNA, 20 nt, Artificial Sequence
  TRAC targeting sequence
ccacugaccacacucccauu

SEQ ID NO: 17197 - RNA, 20 nt, Artificial Sequence
  TRAC targeting sequence
acugaccacacucccauucu

SEQ ID NO: 17198 - RNA, 20 nt, Artificial Sequence
  TRAC targeting sequence
guggagaugcagagaagggg

SEQ ID NO: 17199 - RNA, 20 nt, Artificial Sequence
  TRAC targeting sequence
cauucucauguaagcugccc

SEQ ID NO: 17200 - RNA, 20 nt, Artificial Sequence
  TRAC targeting sequence
cauguaagcugccccugauc

SEQ ID NO: 17201 - RNA, 20 nt, Artificial Sequence
  TRAC targeting sequence
uguaagcugccccugaucuu

SEQ ID NO: 17202 - RNA, 20 nt, Artificial Sequence
  TRAC targeting sequence
ggggcagcuuacaugagaau

SEQ ID NO: 17203 - RNA, 20 nt, Artificial Sequence
  TRAC targeting sequence
ucccugaggcuggauuucag

SEQ ID NO: 17204 - RNA, 20 nt, Artificial Sequence
  TRAC targeting sequence
cugaggcuggauuucagauu

SEQ ID NO: 17205 - RNA, 20 nt, Artificial Sequence
  TRAC targeting sequence
gggaagaucaggggcagcuu

SEQ ID NO: 17206 - RNA, 20 nt, Artificial Sequence
  TRAC targeting sequence
agccucagggaagaucaggg

SEQ ID NO: 17207 - RNA, 20 nt, Artificial Sequence
  TRAC targeting sequence
gauugaacaaaggaccacaa

SEQ ID NO: 17208 - RNA, 20 nt, Artificial Sequence
  TRAC targeting sequence
gaaauccagccucagggaag

SEQ ID NO: 17209 - RNA, 20 nt, Artificial Sequence
  TRAC targeting sequence
aucugaaauccagccucagg

SEQ ID NO: 17210 - RNA, 20 nt, Artificial Sequence
  TRAC targeting sequence
uuuguucaaucugaaaucca

SEQ ID NO: 17211 - RNA, 20 nt, Artificial Sequence
  TRAC targeting sequence
cuuuugugguccuuuguuca

SEQ ID NO: 17212 - RNA, 20 nt, Artificial Sequence
  TRAC targeting sequence
cacuuuugugguccuuuguu

SEQ ID NO: 17213 - RNA, 20 nt, Artificial Sequence
  TRAC targeting sequence
agcucucacuuuuguggucc

SEQ ID NO: 17214 - RNA, 20 nt, Artificial Sequence
  TRAC targeting sequence
ccuccagcucucacuuuugu

SEQ ID NO: 17215 - RNA, 20 nt, Artificial Sequence
  TRAC targeting sequence
ccacgguccccuccagcucu

SEQ ID NO: 17216 - RNA, 20 nt, Artificial Sequence
  TRAC targeting sequence
ugcucauguugcagagggac

SEQ ID NO: 17217 - RNA, 20 nt, Artificial Sequence
  TRAC targeting sequence
uguugcagagggaccugaug

SEQ ID NO: 17218 - RNA, 20 nt, Artificial Sequence
  TRAC targeting sequence
gcaacaugagcaagaugucc

SEQ ID NO: 17219 - RNA, 20 nt, Artificial Sequence
  TRAC targeting sequence
cucugcaacaugagcaagau

SEQ ID NO: 17220 - RNA, 20 nt, Artificial Sequence
  TRAC targeting sequence
ggucccucugcaacaugagc

SEQ ID NO: 17221 - RNA, 20 nt, Artificial Sequence
  TRAC targeting sequence
agcaucuguccaagaccgug

SEQ ID NO: 17222 - RNA, 20 nt, Artificial Sequence
  TRAC targeting sequence
guccaagaccgugcugaugg

SEQ ID NO: 17223 - RNA, 20 nt, Artificial Sequence
  TRAC targeting sequence
aagaccgugcugauggucag

SEQ ID NO: 17224 - RNA, 20 nt, Artificial Sequence
  TRAC targeting sequence
uggacagaugcuagacccug

SEQ ID NO: 17225 - RNA, 20 nt, Artificial Sequence
  TRAC targeting sequence
gcacggucuuggacagaugc

SEQ ID NO: 17226 - RNA, 20 nt, Artificial Sequence
  TRAC targeting sequence
gugcacagcaguggaggggc

SEQ ID NO: 17227 - RNA, 20 nt, Artificial Sequence
  TRAC targeting sequence
acugcugugcacugaccauc

SEQ ID NO: 17228 - RNA, 20 nt, Artificial Sequence
  TRAC targeting sequence
cacccugaguuugguggagc

SEQ ID NO: 17229 - RNA, 20 nt, Artificial Sequence
  TRAC targeting sequence
gggugggaguaaagggcugg

SEQ ID NO: 17230 - RNA, 20 nt, Artificial Sequence
  TRAC targeting sequence
accaaacucagggugggagu

SEQ ID NO: 17231 - RNA, 20 nt, Artificial Sequence
  TRAC targeting sequence
uugcuaagugacccucaaac

SEQ ID NO: 17232 - RNA, 20 nt, Artificial Sequence
  TRAC targeting sequence
cuuagcaaagagcugugugg

SEQ ID NO: 17233 - RNA, 20 nt, Artificial Sequence
  TRAC targeting sequence
aacccagugugagauaagcu

SEQ ID NO: 17234 - RNA, 20 nt, Artificial Sequence
  TRAC targeting sequence
cacuggguuugagggucacu

SEQ ID NO: 17235 - RNA, 20 nt, Artificial Sequence
  TRAC targeting sequence
cacacuggguuugaggguca

SEQ ID NO: 17236 - RNA, 20 nt, Artificial Sequence
  TRAC targeting sequence
gcuuaucucacacuggguuu

SEQ ID NO: 17237 - RNA, 20 nt, Artificial Sequence
  TRAC targeting sequence
acacucagcuuaucucacac

SEQ ID NO: 17238 - RNA, 20 nt, Artificial Sequence
  TRAC targeting sequence
cuagcaggugggcacuguca

SEQ ID NO: 17239 - RNA, 20 nt, Artificial Sequence
  TRAC targeting sequence
guacuugguucccuagcagg

SEQ ID NO: 17240 - RNA, 20 nt, Artificial Sequence
  TRAC targeting sequence
ugccccagcucaggacugug

SEQ ID NO: 17241 - RNA, 20 nt, Artificial Sequence
  TRAC targeting sequence
ggacuguggcgcaggccaug

SEQ ID NO: 17242 - RNA, 20 nt, Artificial Sequence
  TRAC targeting sequence
ugagcuggggcaggaacuca

SEQ ID NO: 17243 - RNA, 20 nt, Artificial Sequence
  TRAC targeting sequence
uggccugcgccacaguccug

SEQ ID NO: 17244 - RNA, 20 nt, Artificial Sequence
  TRAC targeting sequence
cugagccucaguuuucauau

SEQ ID NO: 17245 - RNA, 20 nt, Artificial Sequence
  TRAC targeting sequence
gggaggucauggccugcgcc

SEQ ID NO: 17246 - RNA, 20 nt, Artificial Sequence
  TRAC targeting sequence
guuuucauaucucugaagua

SEQ ID NO: 17247 - RNA, 20 nt, Artificial Sequence
  TRAC targeting sequence
uaucucugaaguagacagca

SEQ ID NO: 17248 - RNA, 20 nt, Artificial Sequence
  TRAC targeting sequence
cugaaguagacagcaugguc

SEQ ID NO: 17249 - RNA, 20 nt, Artificial Sequence
  TRAC targeting sequence
gaaguagacagcauggucuc

SEQ ID NO: 17250 - RNA, 20 nt, Artificial Sequence
  TRAC targeting sequence
gagauaugaaaacugaggcu

SEQ ID NO: 17251 - RNA, 20 nt, Artificial Sequence
  TRAC targeting sequence
acuucagagauaugaaaacu

SEQ ID NO: 17252 - RNA, 20 nt, Artificial Sequence
  TRAC targeting sequence
cuguuuccucccaucuuuca

SEQ ID NO: 17253 - RNA, 20 nt, Artificial Sequence
  TRAC targeting sequence
guuuccucccaucuuucaaa

SEQ ID NO: 17254 - RNA, 20 nt, Artificial Sequence
  TRAC targeting sequence
ucccaucuuucaaaaauucu

SEQ ID NO: 17255 - RNA, 20 nt, Artificial Sequence
  TRAC targeting sequence
caucuuucaaaaauucuaug

SEQ ID NO: 17256 - RNA, 20 nt, Artificial Sequence
  TRAC targeting sequence
uucaaaaauucuauggaaau

SEQ ID NO: 17257 - RNA, 20 nt, Artificial Sequence
  TRAC targeting sequence
aaaauucuauggaaauuauu

SEQ ID NO: 17258 - RNA, 20 nt, Artificial Sequence
  TRAC targeting sequence
auggaaauuauugugacuuu

SEQ ID NO: 17259 - RNA, 20 nt, Artificial Sequence
  TRAC targeting sequence
auagaauuuuugaaagaugg

SEQ ID NO: 17260 - RNA, 20 nt, Artificial Sequence
  TRAC targeting sequence
caauaauuuccauagaauuu

SEQ ID NO: 17261 - RNA, 20 nt, Artificial Sequence
  TRAC targeting sequence
cuguaauuguaggguuucac

SEQ ID NO: 17262 - RNA, 20 nt, Artificial Sequence
  TRAC targeting sequence
guaauuguaggguuucacag

SEQ ID NO: 17263 - RNA, 20 nt, Artificial Sequence
  TRAC targeting sequence
cagaggcagggccuugucug

SEQ ID NO: 17264 - RNA, 20 nt, Artificial Sequence
  TRAC targeting sequence
gugaaacccuacaauuacag

SEQ ID NO: 17265 - RNA, 20 nt, Artificial Sequence
  TRAC targeting sequence
gagucaaggucauuagaaau

SEQ ID NO: 17266 - RNA, 20 nt, Artificial Sequence
  TRAC targeting sequence
gacaaggcccugccucugug

SEQ ID NO: 17267 - RNA, 20 nt, Artificial Sequence
  TRAC targeting sequence
aggucauuagaaauaaagga

SEQ ID NO: 17268 - RNA, 20 nt, Artificial Sequence
  TRAC targeting sequence
uuagaaauaaaggaauccaa

SEQ ID NO: 17269 - RNA, 20 nt, Artificial Sequence
  TRAC targeting sequence
aaugaccuugacucagacaa

SEQ ID NO: 17270 - RNA, 20 nt, Artificial Sequence
  TRAC targeting sequence
uuuauuucuaaugaccuuga

SEQ ID NO: 17271 - RNA, 20 nt, Artificial Sequence
  TRAC targeting sequence
aagggcuuuggaugccuugg

SEQ ID NO: 17272 - RNA, 20 nt, Artificial Sequence
  TRAC targeting sequence
aaagcccuuggauuccuuua

SEQ ID NO: 17273 - RNA, 20 nt, Artificial Sequence
  TRAC targeting sequence
aggugguaaagagggaagga

SEQ ID NO: 17274 - RNA, 20 nt, Artificial Sequence
  TRAC targeting sequence
uuaccaccuagaauuaggcc

SEQ ID NO: 17275 - RNA, 20 nt, Artificial Sequence
  TRAC targeting sequence
cucuuuaccaccuagaauua

SEQ ID NO: 17276 - RNA, 20 nt, Artificial Sequence
  TRAC targeting sequence
uucccucuuuaccaccuaga

SEQ ID NO: 17277 - RNA, 20 nt, Artificial Sequence
  TRAC targeting sequence
uccuucccucuuuaccaccu

SEQ ID NO: 17278 - RNA, 20 nt, Artificial Sequence
  TRAC targeting sequence
caggaagugccuaaauccug

SEQ ID NO: 17279 - RNA, 20 nt, Artificial Sequence
  TRAC targeting sequence
ugugauuugugcuuucaucc

SEQ ID NO: 17280 - RNA, 20 nt, Artificial Sequence
  TRAC targeting sequence
ugcuuggauuuaguguugcc

SEQ ID NO: 17281 - RNA, 20 nt, Artificial Sequence
  TRAC targeting sequence
aagcaggauuuaggcacuuc

SEQ ID NO: 17282 - RNA, 20 nt, Artificial Sequence
  TRAC targeting sequence
aacagggauaugcagaaauc

SEQ ID NO: 17283 - RNA, 20 nt, Artificial Sequence
  TRAC targeting sequence
cuguuugaggcaacacuaaa

SEQ ID NO: 17284 - RNA, 20 nt, Artificial Sequence
  TRAC targeting sequence
gcauaucccuguuugaggca

SEQ ID NO: 17285 - RNA, 20 nt, Artificial Sequence
  TRAC targeting sequence
aaccccagggucucccauag

SEQ ID NO: 17286 - RNA, 20 nt, Artificial Sequence
  TRAC targeting sequence
cccauaggaagaagacuagg

SEQ ID NO: 17287 - RNA, 20 nt, Artificial Sequence
  TRAC targeting sequence
cauaggaagaagacuaggag

SEQ ID NO: 17288 - RNA, 20 nt, Artificial Sequence
  TRAC targeting sequence
uaugggagacccugggguug

SEQ ID NO: 17289 - RNA, 20 nt, Artificial Sequence
  TRAC targeting sequence
uccuaugggagacccugggg

SEQ ID NO: 17290 - RNA, 20 nt, Artificial Sequence
  TRAC targeting sequence
ucuuccuaugggagacccug

SEQ ID NO: 17291 - RNA, 20 nt, Artificial Sequence
  TRAC targeting sequence
uagucuucuuccuaugggag

SEQ ID NO: 17292 - RNA, 20 nt, Artificial Sequence
  TRAC targeting sequence
cacuccuagucuucuuccua

SEQ ID NO: 17293 - RNA, 20 nt, Artificial Sequence
  TRAC targeting sequence
uuggcacuucccacuccuag

SEQ ID NO: 17294 - RNA, 20 nt, Artificial Sequence
  TRAC targeting sequence
ggaaaggaaaagagaacaag

SEQ ID NO: 17295 - RNA, 20 nt, Artificial Sequence
  TRAC targeting sequence
agagcucuuuggcacuuccc

SEQ ID NO: 17296 - RNA, 20 nt, Artificial Sequence
  TRAC targeting sequence
uuuccagagcucuuuggcac

SEQ ID NO: 17297 - RNA, 20 nt, Artificial Sequence
  TRAC targeting sequence
uuuccuuuccagagcucuuu

SEQ ID NO: 17298 - RNA, 20 nt, Artificial Sequence
  TRAC targeting sequence
cuuuuccuuuccagagcucu

SEQ ID NO: 17299 - RNA, 20 nt, Artificial Sequence
  TRAC targeting sequence
uuguucucuuuuccuuucca

SEQ ID NO: 17300 - RNA, 20 nt, Artificial Sequence
  TRAC targeting sequence
gagaaaaggaggucagaaca

SEQ ID NO: 17301 - RNA, 20 nt, Artificial Sequence
  TRAC targeting sequence
gagugcuccuuguucucuuu

SEQ ID NO: 17302 - RNA, 20 nt, Artificial Sequence
  TRAC targeting sequence
cagagugcuccuuguucucu

SEQ ID NO: 17303 - RNA, 20 nt, Artificial Sequence
  TRAC targeting sequence
uuuucucagagugcuccuug

SEQ ID NO: 17304 - RNA, 20 nt, Artificial Sequence
  TRAC targeting sequence
gaacagcuucaggaaaaacg

SEQ ID NO: 17305 - RNA, 20 nt, Artificial Sequence
  TRAC targeting sequence
gaccuccuuuucucagagug

SEQ ID NO: 17306 - RNA, 20 nt, Artificial Sequence
  TRAC targeting sequence
ggaaaaacgucacauaaaau

SEQ ID NO: 17307 - RNA, 20 nt, Artificial Sequence
  TRAC targeting sequence
ggaaaaacgucacauaaaau

SEQ ID NO: 17308 - RNA, 20 nt, Artificial Sequence
  TRAC targeting sequence
ugaagcuguucugaccuccu

SEQ ID NO: 17309 - RNA, 20 nt, Artificial Sequence
  TRAC targeting sequence
cauaaaauuuccuuugcucu

SEQ ID NO: 17310 - RNA, 20 nt, Artificial Sequence
  TRAC targeting sequence
uuugcucucuguccucgcag

SEQ ID NO: 17311 - RNA, 20 nt, Artificial Sequence
  TRAC targeting sequence
cuguccucgcagcacuuuca

SEQ ID NO: 17312 - RNA, 20 nt, Artificial Sequence
  TRAC targeting sequence
guccucgcagcacuuucaga

SEQ ID NO: 17313 - RNA, 20 nt, Artificial Sequence
  TRAC targeting sequence
ucgcagcacuuucagaagcu

SEQ ID NO: 17314 - RNA, 20 nt, Artificial Sequence
  TRAC targeting sequence
cagcacuuucagaagcuccu

SEQ ID NO: 17315 - RNA, 20 nt, Artificial Sequence
  TRAC targeting sequence
gaagcuccuugcaucugacu

SEQ ID NO: 17316 - RNA, 20 nt, Artificial Sequence
  TRAC targeting sequence
gaaagugcugcgaggacaga

SEQ ID NO: 17317 - RNA, 20 nt, Artificial Sequence
  TRAC targeting sequence
uugcaucugacuaaagagua

SEQ ID NO: 17318 - RNA, 20 nt, Artificial Sequence
  TRAC targeting sequence
gacuaaagaguagcagagcc

SEQ ID NO: 17319 - RNA, 20 nt, Artificial Sequence
  TRAC targeting sequence
gaugcaaggagcuucugaaa

SEQ ID NO: 17320 - RNA, 20 nt, Artificial Sequence
  TRAC targeting sequence
uuagucagaugcaaggagcu

SEQ ID NO: 17321 - RNA, 20 nt, Artificial Sequence
  TRAC targeting sequence
gcuacucuuuagucagaugc

SEQ ID NO: 17322 - RNA, 20 nt, Artificial Sequence
  TRAC targeting sequence
ggcucugcuacucuuuaguc

SEQ ID NO: 17323 - RNA, 20 nt, Artificial Sequence
  TRAC targeting sequence
gaaugucugccccaagcaag

SEQ ID NO: 17324 - RNA, 20 nt, Artificial Sequence
  TRAC targeting sequence
gagggucuggcucugcuacu

SEQ ID NO: 17325 - RNA, 20 nt, Artificial Sequence
  TRAC targeting sequence
gccccaagcaagcagagugu

SEQ ID NO: 17326 - RNA, 20 nt, Artificial Sequence
  TRAC targeting sequence
gcuugcuuggggcagacauu

SEQ ID NO: 17327 - RNA, 20 nt, Artificial Sequence
  TRAC targeting sequence
cagcaccccaauacaaacac

SEQ ID NO: 17328 - RNA, 20 nt, Artificial Sequence
  TRAC targeting sequence
gcucccagcaccccaauaca

SEQ ID NO: 17329 - RNA, 20 nt, Artificial Sequence
  TRAC targeting sequence
ccaugucugcucccagcacc

SEQ ID NO: 17330 - RNA, 20 nt, Artificial Sequence
  TRAC targeting sequence
cugcugaugggaagguggua

SEQ ID NO: 17331 - RNA, 20 nt, Artificial Sequence
  TRAC targeting sequence
gcugaugggaaggugguauu

SEQ ID NO: 17332 - RNA, 20 nt, Artificial Sequence
  TRAC targeting sequence
gcagagaagcagggcagcaa

SEQ ID NO: 17333 - RNA, 20 nt, Artificial Sequence
  TRAC targeting sequence
caucagcagagaagcagggc

SEQ ID NO: 17334 - RNA, 20 nt, Artificial Sequence
  TRAC targeting sequence
ccuggguacacgggggccaa

SEQ ID NO: 17335 - RNA, 20 nt, Artificial Sequence
  TRAC targeting sequence
uuggcccccguguacccagg

SEQ ID NO: 17336 - RNA, 20 nt, Artificial Sequence
  TRAC targeting sequence
ccaguccccagccccuggcu

SEQ ID NO: 17337 - RNA, 20 nt, Artificial Sequence
  TRAC targeting sequence
aguccccagccccuggcucc

SEQ ID NO: 17338 - RNA, 20 nt, Artificial Sequence
  TRAC targeting sequence
ccagccccuggcucccgccc

SEQ ID NO: 17339 - RNA, 20 nt, Artificial Sequence
  TRAC targeting sequence
cgccccugggcuccagcacu

SEQ ID NO: 17340 - RNA, 20 nt, Artificial Sequence
  TRAC targeting sequence
agcacucgggggcucuaagg

SEQ ID NO: 17341 - RNA, 20 nt, Artificial Sequence
  TRAC targeting sequence
ggggcucuaaggacagcagu

SEQ ID NO: 17342 - RNA, 20 nt, Artificial Sequence
  TRAC targeting sequence
aaggacagcaguaggagacu

SEQ ID NO: 17343 - RNA, 20 nt, Artificial Sequence
  TRAC targeting sequence
uuagagcccccgagugcugg

SEQ ID NO: 17344 - RNA, 20 nt, Artificial Sequence
  TRAC targeting sequence
uacugcuguccuuagagccc

SEQ ID NO: 17345 - RNA, 20 nt, Artificial Sequence
  TRAC targeting sequence
ccuacugcuguccuuagagc

SEQ ID NO: 17346 - RNA, 20 nt, Artificial Sequence
  TRAC targeting sequence
acaacucagagaguauucag

SEQ ID NO: 17347 - RNA, 20 nt, Artificial Sequence
  TRAC targeting sequence
gagaguauucaggaggguuu

SEQ ID NO: 17348 - RNA, 20 nt, Artificial Sequence
  TRAC targeting sequence
gaguuguagaaagucuccua

SEQ ID NO: 17349 - RNA, 20 nt, Artificial Sequence
  TRAC targeting sequence
cugaguuguagaaagucucc

SEQ ID NO: 17350 - RNA, 20 nt, Artificial Sequence
  TRAC targeting sequence
ggaggguuucccaggauguu

SEQ ID NO: 17351 - RNA, 20 nt, Artificial Sequence
  TRAC targeting sequence
ugaauacucucugaguugua

SEQ ID NO: 17352 - RNA, 20 nt, Artificial Sequence
  TRAC targeting sequence
caggauguugcccaauacca

SEQ ID NO: 17353 - RNA, 20 nt, Artificial Sequence
  TRAC targeting sequence
ugggaaacccuccugaauac

SEQ ID NO: 17354 - RNA, 20 nt, Artificial Sequence
  TRAC targeting sequence
accaauugccccaugguauu

SEQ ID NO: 17355 - RNA, 20 nt, Artificial Sequence
  TRAC targeting sequence
cucuaccaauugccccaugg

SEQ ID NO: 17356 - RNA, 20 nt, Artificial Sequence
  TRAC targeting sequence
caugaaacagguuuuaucaa

SEQ ID NO: 17357 - RNA, 20 nt, Artificial Sequence
  TRAC targeting sequence
ugugaccucccucuaccaau

SEQ ID NO: 17358 - RNA, 20 nt, Artificial Sequence
  TRAC targeting sequence
aaggcuguccucacugugug

SEQ ID NO: 17359 - RNA, 20 nt, Artificial Sequence
  TRAC targeting sequence
ucacugugugcaucaggagg

SEQ ID NO: 17360 - RNA, 20 nt, Artificial Sequence
  TRAC targeting sequence
cugugugcaucaggaggaag

SEQ ID NO: 17361 - RNA, 20 nt, Artificial Sequence
  TRAC targeting sequence
ggaggaagcuacauaccuac

SEQ ID NO: 17362 - RNA, 20 nt, Artificial Sequence
  TRAC targeting sequence
ugaugcacacagugaggaca

SEQ ID NO: 17363 - RNA, 20 nt, Artificial Sequence
  TRAC targeting sequence
uccugaugcacacagugagg

SEQ ID NO: 17364 - RNA, 20 nt, Artificial Sequence
  TRAC targeting sequence
aaauguagguauguagcuuc

SEQ ID NO: 17365 - RNA, 20 nt, Artificial Sequence
  TRAC targeting sequence
uccaaauguagguauguagc

SEQ ID NO: 17366 - RNA, 20 nt, Artificial Sequence
  TRAC targeting sequence
ucuuccaaauguagguaugu

SEQ ID NO: 17367 - RNA, 20 nt, Artificial Sequence
  TRAC targeting sequence
uccguguaaguauuauagaa

SEQ ID NO: 17368 - RNA, 20 nt, Artificial Sequence
  TRAC targeting sequence
guguaaguauuauagaaaug

SEQ ID NO: 17369 - RNA, 20 nt, Artificial Sequence
  TRAC targeting sequence
auaauacuuacacggaugaa

SEQ ID NO: 17370 - RNA, 20 nt, Artificial Sequence
  TRAC targeting sequence
uuucuauaauacuuacacgg

SEQ ID NO: 17371 - RNA, 20 nt, Artificial Sequence
  TRAC targeting sequence
agggaaauuuugcagacaga

SEQ ID NO: 17372 - RNA, 20 nt, Artificial Sequence
  TRAC targeting sequence
cuugaucauuucuauaauac

SEQ ID NO: 17373 - RNA, 20 nt, Artificial Sequence
  TRAC targeting sequence
gcaaaauuucccuugaucau

SEQ ID NO: 17374 - RNA, 20 nt, Artificial Sequence
  TRAC targeting sequence
gucugcaaaauuucccuuga

SEQ ID NO: 17375 - RNA, 20 nt, Artificial Sequence
  TRAC targeting sequence
auaauauaaucugucugcaa

SEQ ID NO: 17376 - RNA, 20 nt, Artificial Sequence
  TRAC targeting sequence
uuccauaauauaaucugucu

SEQ ID NO: 17377 - RNA, 20 nt, Artificial Sequence
  TRAC targeting sequence
cuacuacaguauccuuccau

SEQ ID NO: 17378 - RNA, 20 nt, Artificial Sequence
  TRAC targeting sequence
cacuacuacaguauccuucc

SEQ ID NO: 17379 - RNA, 20 nt, Artificial Sequence
  TRAC targeting sequence
caacacaaacucucacuacu

SEQ ID NO: 17380 - RNA, 20 nt, Artificial Sequence
  TRAC targeting sequence
auuccaucauuaaaggaguc

SEQ ID NO: 17381 - RNA, 20 nt, Artificial Sequence
  TRAC targeting sequence
aucauuaaaggaguccuuug

SEQ ID NO: 17382 - RNA, 20 nt, Artificial Sequence
  TRAC targeting sequence
uuaaaggaguccuuuguugc

SEQ ID NO: 17383 - RNA, 20 nt, Artificial Sequence
  TRAC targeting sequence
uuuaaugauggaauagauca

SEQ ID NO: 17384 - RNA, 20 nt, Artificial Sequence
  TRAC targeting sequence
uuuguugccugggaguaacu

SEQ ID NO: 17385 - RNA, 20 nt, Artificial Sequence
  TRAC targeting sequence
caggcaacaaaggacuccuu

SEQ ID NO: 17386 - RNA, 20 nt, Artificial Sequence
  TRAC targeting sequence
gugucaggucugaugagaug

SEQ ID NO: 17387 - RNA, 20 nt, Artificial Sequence
  TRAC targeting sequence
ggucugaugagaugauugag

SEQ ID NO: 17388 - RNA, 20 nt, Artificial Sequence
  TRAC targeting sequence
gaugagaugauugaggcugu

SEQ ID NO: 17389 - RNA, 20 nt, Artificial Sequence
  TRAC targeting sequence
gaccugacacugauaguuac

SEQ ID NO: 17390 - RNA, 20 nt, Artificial Sequence
  TRAC targeting sequence
ucagaccugacacugauagu

SEQ ID NO: 17391 - RNA, 20 nt, Artificial Sequence
  TRAC targeting sequence
caucagaccugacacugaua

SEQ ID NO: 17392 - RNA, 20 nt, Artificial Sequence
  TRAC targeting sequence
ucucaucagaccugacacug

SEQ ID NO: 17393 - RNA, 20 nt, Artificial Sequence
  TRAC targeting sequence
aucaucucaucagaccugac

SEQ ID NO: 17394 - RNA, 20 nt, Artificial Sequence
  TRAC targeting sequence
ggcacagccucaaucaucuc

SEQ ID NO: 17395 - RNA, 20 nt, Artificial Sequence
  TRAC targeting sequence
uugugcaaaacccuuguccg

SEQ ID NO: 17396 - RNA, 20 nt, Artificial Sequence
  TRAC targeting sequence
gaggacaaauccccaaguug

SEQ ID NO: 17397 - RNA, 20 nt, Artificial Sequence
  TRAC targeting sequence
gaaaucauugugcaaaaccc

SEQ ID NO: 17398 - RNA, 20 nt, Artificial Sequence
  TRAC targeting sequence
ucugaaaucauugugcaaaa

SEQ ID NO: 17399 - RNA, 20 nt, Artificial Sequence
  TRAC targeting sequence
ccaaguugugaaaaaagacu

SEQ ID NO: 17400 - RNA, 20 nt, Artificial Sequence
  TRAC targeting sequence
caacuuggggauuuguccuc

SEQ ID NO: 17401 - RNA, 20 nt, Artificial Sequence
  TRAC targeting sequence
uuuuucacaacuuggggauu

SEQ ID NO: 17402 - RNA, 20 nt, Artificial Sequence
  TRAC targeting sequence
cucuugguuagguuucuaaa

SEQ ID NO: 17403 - RNA, 20 nt, Artificial Sequence
  TRAC targeting sequence
ugguuagguuucuaaaacag

SEQ ID NO: 17404 - RNA, 20 nt, Artificial Sequence
  TRAC targeting sequence
aaaacagaacuuucuucuug

SEQ ID NO: 17405 - RNA, 20 nt, Artificial Sequence
  TRAC targeting sequence
guuuuagaaaccuaaccaag

SEQ ID NO: 17406 - RNA, 20 nt, Artificial Sequence
  TRAC targeting sequence
ucuuggcaaccaaggggucu

SEQ ID NO: 17407 - RNA, 20 nt, Artificial Sequence
  TRAC targeting sequence
uggcaaccaaggggucuacu

SEQ ID NO: 17408 - RNA, 20 nt, Artificial Sequence
  TRAC targeting sequence
acucugcccccucacuccua

SEQ ID NO: 17409 - RNA, 20 nt, Artificial Sequence
  TRAC targeting sequence
gcccccucacuccuaugucu

SEQ ID NO: 17410 - RNA, 20 nt, Artificial Sequence
  TRAC targeting sequence
cuccuaugucucuuccaccu

SEQ ID NO: 17411 - RNA, 20 nt, Artificial Sequence
  TRAC targeting sequence
uaugucucuuccaccugaga

SEQ ID NO: 17412 - RNA, 20 nt, Artificial Sequence
  TRAC targeting sequence
cuuccaccugagacucuguc

SEQ ID NO: 17413 - RNA, 20 nt, Artificial Sequence
  TRAC targeting sequence
uccaccugagacucugucac

SEQ ID NO: 17414 - RNA, 20 nt, Artificial Sequence
  TRAC targeting sequence
accugagacucugucaccac

SEQ ID NO: 17415 - RNA, 20 nt, Artificial Sequence
  TRAC targeting sequence
gguggaagagacauaggagu

SEQ ID NO: 17416 - RNA, 20 nt, Artificial Sequence
  TRAC targeting sequence
cagguggaagagacauagga

SEQ ID NO: 17417 - RNA, 20 nt, Artificial Sequence
  TRAC targeting sequence
gucaccaccuccccuagaau

SEQ ID NO: 17418 - RNA, 20 nt, Artificial Sequence
  TRAC targeting sequence
ccaccuccccuagaauccgu

SEQ ID NO: 17419 - RNA, 20 nt, Artificial Sequence
  TRAC targeting sequence
ccuagaauccgugagauacc

SEQ ID NO: 17420 - RNA, 20 nt, Artificial Sequence
  TRAC targeting sequence
aggggagguggugacagagu

SEQ ID NO: 17421 - RNA, 20 nt, Artificial Sequence
  TRAC targeting sequence
gugagauaccuuccccugaa

SEQ ID NO: 17422 - RNA, 20 nt, Artificial Sequence
  TRAC targeting sequence
cggauucuaggggagguggu

SEQ ID NO: 17423 - RNA, 20 nt, Artificial Sequence
  TRAC targeting sequence
cacggauucuaggggaggug

SEQ ID NO: 17424 - RNA, 20 nt, Artificial Sequence
  TRAC targeting sequence
ccugaauuagagcauaccag

SEQ ID NO: 17425 - RNA, 20 nt, Artificial Sequence
  TRAC targeting sequence
ggggaagguaucucacggau

SEQ ID NO: 17426 - RNA, 20 nt, Artificial Sequence
  TRAC targeting sequence
aauucaggggaagguaucuc

SEQ ID NO: 17427 - RNA, 20 nt, Artificial Sequence
  TRAC targeting sequence
gcacccuggcugguaugcuc

SEQ ID NO: 17428 - RNA, 20 nt, Artificial Sequence
  TRAC targeting sequence
gugguacuggaauggauggu

SEQ ID NO: 17429 - RNA, 20 nt, Artificial Sequence
  TRAC targeting sequence
aguaccacagagugccucag

SEQ ID NO: 17430 - RNA, 20 nt, Artificial Sequence
  TRAC targeting sequence
auuccaguaccacagagugc

SEQ ID NO: 17431 - RNA, 20 nt, Artificial Sequence
  TRAC targeting sequence
cuguaccauccauuccagua

SEQ ID NO: 17432 - RNA, 20 nt, Artificial Sequence
  TRAC targeting sequence
gggcuucuggcugcaagaag

SEQ ID NO: 17433 - RNA, 20 nt, Artificial Sequence
  TRAC targeting sequence
ggcugcaagaagccucaucc

SEQ ID NO: 17434 - RNA, 20 nt, Artificial Sequence
  TRAC targeting sequence
ugcagccagaagcccagaaa

SEQ ID NO: 17435 - RNA, 20 nt, Artificial Sequence
  TRAC targeting sequence
uccuuucccccaguguaaag

SEQ ID NO: 17436 - RNA, 20 nt, Artificial Sequence
  TRAC targeting sequence
uuucccccaguguaaagcau

SEQ ID NO: 17437 - RNA, 20 nt, Artificial Sequence
  TRAC targeting sequence
cccaguguaaagcauugcug

SEQ ID NO: 17438 - RNA, 20 nt, Artificial Sequence
  TRAC targeting sequence
cagcaaugcuuuacacuggg

SEQ ID NO: 17439 - RNA, 20 nt, Artificial Sequence
  TRAC targeting sequence
ucccauuaugagcuacuauu

SEQ ID NO: 17440 - RNA, 20 nt, Artificial Sequence
  TRAC targeting sequence
cauuaugagcuacuauuuac

SEQ ID NO: 17441 - RNA, 20 nt, Artificial Sequence
  TRAC targeting sequence
uaaugggaugauucccagca

SEQ ID NO: 17442 - RNA, 20 nt, Artificial Sequence
  TRAC targeting sequence
guaaauaguagcucauaaug

SEQ ID NO: 17443 - RNA, 20 nt, Artificial Sequence
  TRAC targeting sequence
ggcauucaguaaauaguagc

SEQ ID NO: 17444 - RNA, 20 nt, Artificial Sequence
  TRAC targeting sequence
cuugucuuuuauguaauccu

SEQ ID NO: 17445 - RNA, 20 nt, Artificial Sequence
  TRAC targeting sequence
ugucuuuuauguaauccuca

SEQ ID NO: 17446 - RNA, 20 nt, Artificial Sequence
  TRAC targeting sequence
uuuauguaauccucauucag

SEQ ID NO: 17447 - RNA, 20 nt, Artificial Sequence
  TRAC targeting sequence
ucauucagugauuacacaca

SEQ ID NO: 17448 - RNA, 20 nt, Artificial Sequence
  TRAC targeting sequence
uucagugauuacacacaucc

SEQ ID NO: 17449 - RNA, 20 nt, Artificial Sequence
  TRAC targeting sequence
gugauuacacacauccuaau

SEQ ID NO: 17450 - RNA, 20 nt, Artificial Sequence
  TRAC targeting sequence
cugaaugaggauuacauaaa

SEQ ID NO: 17451 - RNA, 20 nt, Artificial Sequence
  TRAC targeting sequence
uaauaauagguagccgauau

SEQ ID NO: 17452 - RNA, 20 nt, Artificial Sequence
  TRAC targeting sequence
gcuaccuauuauuaggaugu

SEQ ID NO: 17453 - RNA, 20 nt, Artificial Sequence
  TRAC targeting sequence
ccuguaaaaugggcaaaaua

SEQ ID NO: 17454 - RNA, 20 nt, Artificial Sequence
  TRAC targeting sequence
ucaccuguaaaaugggcaaa

SEQ ID NO: 17455 - RNA, 20 nt, Artificial Sequence
  TRAC targeting sequence
guuuccucaccuguaaaaug

SEQ ID NO: 17456 - RNA, 20 nt, Artificial Sequence
  TRAC targeting sequence
caagccucuguuuccucacc

SEQ ID NO: 17457 - RNA, 20 nt, Artificial Sequence
  TRAC targeting sequence
aagauuauauagccacgaau

SEQ ID NO: 17458 - RNA, 20 nt, Artificial Sequence
  TRAC targeting sequence
uggauaaguuacuuauccca

SEQ ID NO: 17459 - RNA, 20 nt, Artificial Sequence
  TRAC targeting sequence
uggcuauauaaucuuggaua

SEQ ID NO: 17460 - RNA, 20 nt, Artificial Sequence
  TRAC targeting sequence
uucguggcuauauaaucuug

SEQ ID NO: 17461 - RNA, 20 nt, Artificial Sequence
  TRAC targeting sequence
gucauucguggcuauauaau

SEQ ID NO: 17462 - RNA, 20 nt, Artificial Sequence
  TRAC targeting sequence
agcucugucauucguggcua

SEQ ID NO: 17463 - RNA, 20 nt, Artificial Sequence
  TRAC targeting sequence
aaucuguuugacucuagggc

SEQ ID NO: 17464 - RNA, 20 nt, Artificial Sequence
  TRAC targeting sequence
guuugacucuagggccuugu

SEQ ID NO: 17465 - RNA, 20 nt, Artificial Sequence
  TRAC targeting sequence
aacagauuugaguuaaacuc

SEQ ID NO: 17466 - RNA, 20 nt, Artificial Sequence
  TRAC targeting sequence
agggccuuguuauuaaccgu

SEQ ID NO: 17467 - RNA, 20 nt, Artificial Sequence
  TRAC targeting sequence
ugcauucugugaaggaagac

SEQ ID NO: 17468 - RNA, 20 nt, Artificial Sequence
  TRAC targeting sequence
gugaaggaagacuucacacc

SEQ ID NO: 17469 - RNA, 20 nt, Artificial Sequence
  TRAC targeting sequence
cagaaugcaggaggcauggu

SEQ ID NO: 17470 - RNA, 20 nt, Artificial Sequence
  TRAC targeting sequence
uucacagaaugcaggaggca

SEQ ID NO: 17471 - RNA, 20 nt, Artificial Sequence
  TRAC targeting sequence
uccuucacagaaugcaggag

SEQ ID NO: 17472 - RNA, 20 nt, Artificial Sequence
  TRAC targeting sequence
caccucaaaggccaucuguu

SEQ ID NO: 17473 - RNA, 20 nt, Artificial Sequence
  TRAC targeting sequence
aaggccaucuguuuggccuu

SEQ ID NO: 17474 - RNA, 20 nt, Artificial Sequence
  TRAC targeting sequence
guuuggccuuugguuugccc

SEQ ID NO: 17475 - RNA, 20 nt, Artificial Sequence
  TRAC targeting sequence
ugagccuucuuaccauagcg

SEQ ID NO: 17476 - RNA, 20 nt, Artificial Sequence
  TRAC targeting sequence
ggaugggcaaaccaaaggcc

SEQ ID NO: 17477 - RNA, 20 nt, Artificial Sequence
  TRAC targeting sequence
uaccauagcgaccauggcau

SEQ ID NO: 17478 - RNA, 20 nt, Artificial Sequence
  TRAC targeting sequence
cuaugguaagaaggcucagg

SEQ ID NO: 17479 - RNA, 20 nt, Artificial Sequence
  TRAC targeting sequence
ccaugccauggucgcuaugg

SEQ ID NO: 17480 - RNA, 20 nt, Artificial Sequence
  TRAC targeting sequence
gcacuucugaagagaucagc

SEQ ID NO: 17481 - RNA, 20 nt, Artificial Sequence
  TRAC targeting sequence
gaagagaucagcagagucau

SEQ ID NO: 17482 - RNA, 20 nt, Artificial Sequence
  TRAC targeting sequence
gaagugcugagucaccaugc

SEQ ID NO: 17483 - RNA, 20 nt, Artificial Sequence
  TRAC targeting sequence
ucagaagugcugagucacca

SEQ ID NO: 17484 - RNA, 20 nt, Artificial Sequence
  TRAC targeting sequence
cuucagaagugcugagucac

SEQ ID NO: 17485 - RNA, 20 nt, Artificial Sequence
  TRAC targeting sequence
gcagagucauuggguugggu

SEQ ID NO: 17486 - RNA, 20 nt, Artificial Sequence
  TRAC targeting sequence
gcugaucucuucagaagugc

SEQ ID NO: 17487 - RNA, 20 nt, Artificial Sequence
  TRAC targeting sequence
uuggguuggguggcagaaua

SEQ ID NO: 17488 - RNA, 20 nt, Artificial Sequence
  TRAC targeting sequence
gccacccaacccaaugacuc

SEQ ID NO: 17489 - RNA, 20 nt, Artificial Sequence
  TRAC targeting sequence
cugccauaccuguauucugc

SEQ ID NO: 17490 - RNA, 20 nt, Artificial Sequence
  TRAC targeting sequence
cucccugccauaccuguauu

SEQ ID NO: 17491 - RNA, 20 nt, Artificial Sequence
  TRAC targeting sequence
uucccucccugccauaccug

SEQ ID NO: 17492 - RNA, 20 nt, Artificial Sequence
  TRAC targeting sequence
ccuucccucccugccauacc

SEQ ID NO: 17493 - RNA, 20 nt, Artificial Sequence
  TRAC targeting sequence
cccuaaguuucuccuucccu

SEQ ID NO: 17494 - RNA, 20 nt, Artificial Sequence
  TRAC targeting sequence
aacuguaugcgcaauaaaca

SEQ ID NO: 17495 - RNA, 20 nt, Artificial Sequence
  TRAC targeting sequence
cuaacuguaugcgcaauaaa

SEQ ID NO: 17496 - RNA, 20 nt, Artificial Sequence
  TRAC targeting sequence
cucuaacuguaugcgcaaua

SEQ ID NO: 17497 - RNA, 20 nt, Artificial Sequence
  TRAC targeting sequence
uucucucuaacuguaugcgc

SEQ ID NO: 17498 - RNA, 20 nt, Artificial Sequence
  TRAC targeting sequence
acaaaccauagaauaggcug

SEQ ID NO: 17499 - RNA, 20 nt, Artificial Sequence
  TRAC targeting sequence
augguuuguugauacauuuu

SEQ ID NO: 17500 - RNA, 20 nt, Artificial Sequence
  TRAC targeting sequence
cccaagaaacugugagugua

SEQ ID NO: 17501 - RNA, 20 nt, Artificial Sequence
  TRAC targeting sequence
caagaaacugugaguguaug

SEQ ID NO: 17502 - RNA, 20 nt, Artificial Sequence
  TRAC targeting sequence
ugggagaaaaacuuuuaagc

SEQ ID NO: 17503 - RNA, 20 nt, Artificial Sequence
  TRAC targeting sequence
caguuucuugggagaaaaac

SEQ ID NO: 17504 - RNA, 20 nt, Artificial Sequence
  TRAC targeting sequence
uacacucacaguuucuuggg

SEQ ID NO: 17505 - RNA, 20 nt, Artificial Sequence
  TRAC targeting sequence
ugggcagcugcccccagcug

SEQ ID NO: 17506 - RNA, 20 nt, Artificial Sequence
  TRAC targeting sequence
gccagcugggggcagcugcc

SEQ ID NO: 17507 - RNA, 20 nt, Artificial Sequence
  TRAC targeting sequence
ugcccucugccagcuggggg

SEQ ID NO: 17508 - RNA, 20 nt, Artificial Sequence
  TRAC targeting sequence
caguacaaaauccugcccuc

SEQ ID NO: 17509 - RNA, 20 nt, Artificial Sequence
  TRAC targeting sequence
acacccugguacaucacagu

SEQ ID NO: 17510 - RNA, 20 nt, Artificial Sequence
  TRAC targeting sequence
ugcccguguccacacccugg

SEQ ID NO: 17511 - RNA, 20 nt, Artificial Sequence
  TRAC targeting sequence
ccugcccguguccacacccu

SEQ ID NO: 17512 - RNA, 20 nt, Artificial Sequence
  TRAC targeting sequence
caaaaguaagugcucuccug

SEQ ID NO: 17513 - RNA, 20 nt, Artificial Sequence
  TRAC targeting sequence
acucccaaaaguaagugcuc

SEQ ID NO: 17514 - RNA, 20 nt, Artificial Sequence
  TRAC targeting sequence
uguuccacucccaaaaguaa

SEQ ID NO: 17515 - RNA, 20 nt, Artificial Sequence
  TRAC targeting sequence
aagugcaaccaaguaaguac

SEQ ID NO: 17516 - RNA, 20 nt, Artificial Sequence
  TRAC targeting sequence
ggccaaagacacagaaagcc

SEQ ID NO: 17517 - RNA, 20 nt, Artificial Sequence
  TRAC targeting sequence
uuggccagagccuaaguuug

SEQ ID NO: 17518 - RNA, 20 nt, Artificial Sequence
  TRAC targeting sequence
gugucuuuggccagagccua

SEQ ID NO: 17519 - RNA, 20 nt, Artificial Sequence
  TRAC targeting sequence
gcuuucuuagaugaugaauc

SEQ ID NO: 17520 - RNA, 20 nt, Artificial Sequence
  TRAC targeting sequence
uagaugaugaaucuguacuu

SEQ ID NO: 17521 - RNA, 20 nt, Artificial Sequence
  TRAC targeting sequence
aagaaagcagaguaggggcu

SEQ ID NO: 17522 - RNA, 20 nt, Artificial Sequence
  TRAC targeting sequence
ucuaagaaagcagaguaggg

SEQ ID NO: 17523 - RNA, 20 nt, Artificial Sequence
  TRAC targeting sequence
ucaucuaagaaagcagagua

SEQ ID NO: 17524 - RNA, 20 nt, Artificial Sequence
  TRAC targeting sequence
guacuuccugaacuaauuuu

SEQ ID NO: 17525 - RNA, 20 nt, Artificial Sequence
  TRAC targeting sequence
ugaacuaauuuuucauguuu

SEQ ID NO: 17526 - RNA, 20 nt, Artificial Sequence
  TRAC targeting sequence
ggaaguacagauucaucauc

SEQ ID NO: 17527 - RNA, 20 nt, Artificial Sequence
  TRAC targeting sequence
uguuucuuuaugaggcuuga

SEQ ID NO: 17528 - RNA, 20 nt, Artificial Sequence
  TRAC targeting sequence
uuaugaggcuugaauaucuu

SEQ ID NO: 17529 - RNA, 20 nt, Artificial Sequence
  TRAC targeting sequence
uaaagaaacaugaaaaauua

SEQ ID NO: 17530 - RNA, 20 nt, Artificial Sequence
  TRAC targeting sequence
agccucauaaagaaacauga

SEQ ID NO: 17531 - RNA, 20 nt, Artificial Sequence
  TRAC targeting sequence
ugaaauuuuaauuccuagcc

SEQ ID NO: 17532 - RNA, 20 nt, Artificial Sequence
  TRAC targeting sequence
agauauucaagccucauaaa

SEQ ID NO: 17533 - RNA, 20 nt, Artificial Sequence
  TRAC targeting sequence
uagccacuagcuuaauaguc

SEQ ID NO: 17534 - RNA, 20 nt, Artificial Sequence
  TRAC targeting sequence
guuuucuaacgguaguauuu

SEQ ID NO: 17535 - RNA, 20 nt, Artificial Sequence
  TRAC targeting sequence
aacgguaguauuugccaaug

SEQ ID NO: 17536 - RNA, 20 nt, Artificial Sequence
  TRAC targeting sequence
cauuggcaaauacuaccguu

SEQ ID NO: 17537 - RNA, 20 nt, Artificial Sequence
  TRAC targeting sequence
ucauugcagagacagauucc

SEQ ID NO: 17538 - RNA, 20 nt, Artificial Sequence
  TRAC targeting sequence
uugcagagacagauuccuuu

SEQ ID NO: 17539 - RNA, 20 nt, Artificial Sequence
  TRAC targeting sequence
gcaaugaugaaauggccaau

SEQ ID NO: 17540 - RNA, 20 nt, Artificial Sequence
  TRAC targeting sequence
cugcaaugaugaaauggcca

SEQ ID NO: 17541 - RNA, 20 nt, Artificial Sequence
  TRAC targeting sequence
gucucugcaaugaugaaaug

SEQ ID NO: 17542 - RNA, 20 nt, Artificial Sequence
  TRAC targeting sequence
uuugagacaaaagaucuuua

SEQ ID NO: 17543 - RNA, 20 nt, Artificial Sequence
  TRAC targeting sequence
aaggaaucugucucugcaau

SEQ ID NO: 17544 - RNA, 20 nt, Artificial Sequence
  TRAC targeting sequence
caaaggaaucugucucugca

SEQ ID NO: 17545 - RNA, 20 nt, Artificial Sequence
  TRAC targeting sequence
uuugucucaaaggaaucugu

SEQ ID NO: 17546 - RNA, 20 nt, Artificial Sequence
  TRAC targeting sequence
uuaucagaaaagaaacugug

SEQ ID NO: 17547 - RNA, 20 nt, Artificial Sequence
  TRAC targeting sequence
gaaaagaaacugugacugau

SEQ ID NO: 17548 - RNA, 20 nt, Artificial Sequence
  TRAC targeting sequence
gauaaagaucuuuugucuca

SEQ ID NO: 17549 - RNA, 20 nt, Artificial Sequence
  TRAC targeting sequence
uuucugauaaagaucuuuug

SEQ ID NO: 17550 - RNA, 20 nt, Artificial Sequence
  TRAC targeting sequence
caguuucuuuucugauaaag

SEQ ID NO: 17551 - RNA, 20 nt, Artificial Sequence
  TRAC targeting sequence
gucacaguuucuuuucugau

SEQ ID NO: 17552 - RNA, 20 nt, Artificial Sequence
  TRAC targeting sequence
uuuggcauaaucagucacag

SEQ ID NO: 17553 - RNA, 20 nt, Artificial Sequence
  TRAC targeting sequence
auuuaguuuucaugaaaggu

SEQ ID NO: 17554 - RNA, 20 nt, Artificial Sequence
  TRAC targeting sequence
ugaaaggugaugaauuaugc

SEQ ID NO: 17555 - RNA, 20 nt, Artificial Sequence
  TRAC targeting sequence
ugaaaacuaaauggaacaaa

SEQ ID NO: 17556 - RNA, 20 nt, Artificial Sequence
  TRAC targeting sequence
ccuuucaugaaaacuaaaug

SEQ ID NO: 17557 - RNA, 20 nt, Artificial Sequence
  TRAC targeting sequence
ucaccuuucaugaaaacuaa

SEQ ID NO: 17558 - RNA, 20 nt, Artificial Sequence
  TRAC targeting sequence
caaagacucugggcauugga

SEQ ID NO: 17559 - RNA, 20 nt, Artificial Sequence
  TRAC targeting sequence
uugggaagcauaauucauca

SEQ ID NO: 17560 - RNA, 20 nt, Artificial Sequence
  TRAC targeting sequence
gggcauuggacacacuuucu

SEQ ID NO: 17561 - RNA, 20 nt, Artificial Sequence
  TRAC targeting sequence
aaugcccagagucuuuggga

SEQ ID NO: 17562 - RNA, 20 nt, Artificial Sequence
  TRAC targeting sequence
caaaacugcacauccaauug

SEQ ID NO: 17563 - RNA, 20 nt, Artificial Sequence
  TRAC targeting sequence
aaacugcacauccaauugag

SEQ ID NO: 17564 - RNA, 20 nt, Artificial Sequence
  TRAC targeting sequence
aauugagagauauaggaaga

SEQ ID NO: 17565 - RNA, 20 nt, Artificial Sequence
  TRAC targeting sequence
auuggaugugcaguuuugag

SEQ ID NO: 17566 - RNA, 20 nt, Artificial Sequence
  TRAC targeting sequence
caauuggaugugcaguuuug

SEQ ID NO: 17567 - RNA, 20 nt, Artificial Sequence
  TRAC targeting sequence
cucaauuggaugugcaguuu

SEQ ID NO: 17568 - RNA, 20 nt, Artificial Sequence
  TRAC targeting sequence
uauaucucucaauuggaugu

SEQ ID NO: 17569 - RNA, 20 nt, Artificial Sequence
  TRAC targeting sequence
uccuauaucucucaauugga

SEQ ID NO: 17570 - RNA, 20 nt, Artificial Sequence
  TRAC targeting sequence
aaguucuuccuauaucucuc

SEQ ID NO: 17571 - RNA, 20 nt, Artificial Sequence
  TRAC targeting sequence
uuuuuacaaacuuuuuauua

SEQ ID NO: 17572 - RNA, 20 nt, Artificial Sequence
  TRAC targeting sequence
auaugguuccuuuuuacaaa

SEQ ID NO: 17573 - RNA, 20 nt, Artificial Sequence
  TRAC targeting sequence
uuaauuucuauaugguuccu

SEQ ID NO: 17574 - RNA, 20 nt, Artificial Sequence
  TRAC targeting sequence
ucuuuaauuucuauaugguu

SEQ ID NO: 17575 - RNA, 20 nt, Artificial Sequence
  TRAC targeting sequence
uuucuucuuuaauuucuaua

SEQ ID NO: 17576 - RNA, 20 nt, Artificial Sequence
  TRAC targeting sequence
uaaugaaagaagauaacaga

SEQ ID NO: 17577 - RNA, 20 nt, Artificial Sequence
  TRAC targeting sequence
uuaagacuauuucauuucuu

SEQ ID NO: 17578 - RNA, 20 nt, Artificial Sequence
  TRAC targeting sequence
uucauuaagacuauuucauu

SEQ ID NO: 17579 - RNA, 20 nt, Artificial Sequence
  TRAC targeting sequence
ucuuucauuaagacuauuuc

SEQ ID NO: 17580 - RNA, 20 nt, Artificial Sequence
  TRAC targeting sequence
guuaucuucuuucauuaaga

SEQ ID NO: 17581 - RNA, 20 nt, Artificial Sequence
  TRAC targeting sequence
aaugcaguucuguuaucuuc

SEQ ID NO: 17582 - RNA, 20 nt, Artificial Sequence
  TRAC targeting sequence
uuucuaaugcaguucuguua

SEQ ID NO: 17583 - RNA, 20 nt, Artificial Sequence
  TRAC targeting sequence
auucguuucuaaugcaguuc

SEQ ID NO: 17584 - RNA, 20 nt, Artificial Sequence
  TRAC targeting sequence
aaauauuuccauucguuucu

SEQ ID NO: 17585 - RNA, 20 nt, Artificial Sequence
  TRAC targeting sequence
acaaauauuuauuggacaau

SEQ ID NO: 17586 - RNA, 20 nt, Artificial Sequence
  TRAC targeting sequence
aauaaauauuuguugaauac

SEQ ID NO: 17587 - RNA, 20 nt, Artificial Sequence
  TRAC targeting sequence
aagcacuauguuaaguguga

SEQ ID NO: 17588 - RNA, 20 nt, Artificial Sequence
  TRAC targeting sequence
cacuuaacauagugcuugga

SEQ ID NO: 17589 - RNA, 20 nt, Artificial Sequence
  TRAC targeting sequence
ucacacuuaacauagugcuu

SEQ ID NO: 17590 - RNA, 20 nt, Artificial Sequence
  TRAC targeting sequence
cuuccucacacuuaacauag

SEQ ID NO: 17591 - RNA, 20 nt, Artificial Sequence
  TRAC targeting sequence
cauucccuuccucacacuua

SEQ ID NO: 17592 - RNA, 20 nt, Artificial Sequence
  TRAC targeting sequence
cucccauucccuuccucaca

SEQ ID NO: 17593 - RNA, 20 nt, Artificial Sequence
  TRAC targeting sequence
cuucccucccauucccuucc

SEQ ID NO: 17594 - RNA, 20 nt, Artificial Sequence
  TRAC targeting sequence
cuucccuucccucccauucc

SEQ ID NO: 17595 - RNA, 20 nt, Artificial Sequence
  TRAC targeting sequence
uucccuucccuucccuccca

SEQ ID NO: 17596 - RNA, 20 nt, Artificial Sequence
  TRAC targeting sequence
uuuccuucccuucccuuccc

SEQ ID NO: 17597 - RNA, 20 nt, Artificial Sequence
  TRAC targeting sequence
uuccuuuccuucccuucccu

SEQ ID NO: 17598 - RNA, 20 nt, Artificial Sequence
  TRAC targeting sequence
uuucuuuccuuuccuucccu

SEQ ID NO: 17599 - RNA, 20 nt, Artificial Sequence
  TRAC targeting sequence
ccuuucuuuccuuuccuucc

SEQ ID NO: 17600 - RNA, 20 nt, Artificial Sequence
  TRAC targeting sequence
ucuccuuucuuuccuuuccu

SEQ ID NO: 17601 - RNA, 20 nt, Artificial Sequence
  TRAC targeting sequence
acuuccucuccuuucuuucc

SEQ ID NO: 17602 - RNA, 20 nt, Artificial Sequence
  TRAC targeting sequence
ucuacuuccucuccuuucuu

SEQ ID NO: 17603 - RNA, 20 nt, Artificial Sequence
  TRAC targeting sequence
uuccucuacuuccucuccuu

SEQ ID NO: 17604 - RNA, 20 nt, Artificial Sequence
  TRAC targeting sequence
cgguccuuccucuacuuccu

SEQ ID NO: 17605 - RNA, 20 nt, Artificial Sequence
  TRAC targeting sequence
cucccgguccuuccucuacu

SEQ ID NO: 17606 - RNA, 20 nt, Artificial Sequence
  TRAC targeting sequence
cucccucccgguccuuccuc

SEQ ID NO: 17607 - RNA, 20 nt, Artificial Sequence
  TRAC targeting sequence
ucccucccucccgguccuuc

SEQ ID NO: 17608 - RNA, 20 nt, Artificial Sequence
  TRAC targeting sequence
uucuucccucccucccgguc

SEQ ID NO: 17609 - RNA, 20 nt, Artificial Sequence
  TRAC targeting sequence
uccuucuucccucccucccg

SEQ ID NO: 17610 - RNA, 20 nt, Artificial Sequence
  TRAC targeting sequence
uuuucuuccuucuucccucc

SEQ ID NO: 17611 - RNA, 20 nt, Artificial Sequence
  TRAC targeting sequence
uccuuuucuuccuucuuccc

SEQ ID NO: 17612 - RNA, 20 nt, Artificial Sequence
  TRAC targeting sequence
uuuccuccuuuucuuccuuc

SEQ ID NO: 17613 - RNA, 20 nt, Artificial Sequence
  TRAC targeting sequence
cuccuuuccuccuuuucuuc

SEQ ID NO: 17614 - RNA, 20 nt, Artificial Sequence
  TRAC targeting sequence
uucccuccuuuccuccuuuu

SEQ ID NO: 17615 - RNA, 20 nt, Artificial Sequence
  TRAC targeting sequence
cuccuucccuccuuuccucc

SEQ ID NO: 17616 - RNA, 20 nt, Artificial Sequence
  TRAC targeting sequence
cuuucauccagggaaggagg

SEQ ID NO: 17617 - RNA, 20 nt, Artificial Sequence
  TRAC targeting sequence
uucauccagggaaggaggga

SEQ ID NO: 17618 - RNA, 20 nt, Artificial Sequence
  TRAC targeting sequence
uccagggaaggagggagagu

SEQ ID NO: 17619 - RNA, 20 nt, Artificial Sequence
  TRAC targeting sequence
agggaaggagggagagucuc

SEQ ID NO: 17620 - RNA, 20 nt, Artificial Sequence
  TRAC targeting sequence
cuggaugaaagagaaccucc

SEQ ID NO: 17621 - RNA, 20 nt, Artificial Sequence
  TRAC targeting sequence
uucccuggaugaaagagaac

SEQ ID NO: 17622 - RNA, 20 nt, Artificial Sequence
  TRAC targeting sequence
cuccuucccuggaugaaaga

SEQ ID NO: 17623 - RNA, 20 nt, Artificial Sequence
  TRAC targeting sequence
cccuccuucccuggaugaaa

SEQ ID NO: 17624 - RNA, 20 nt, Artificial Sequence
  TRAC targeting sequence
cugccauccgggagcucaga

SEQ ID NO: 17625 - RNA, 20 nt, Artificial Sequence
  TRAC targeting sequence
gccauccgggagcucagagu

SEQ ID NO: 17626 - RNA, 20 nt, Artificial Sequence
  TRAC targeting sequence
gggagcucagagugcaaaca

SEQ ID NO: 17627 - RNA, 20 nt, Artificial Sequence
  TRAC targeting sequence
cggauggcagagacucuccc

SEQ ID NO: 17628 - RNA, 20 nt, Artificial Sequence
  TRAC targeting sequence
gagugcaaacagacaacuau

SEQ ID NO: 17629 - RNA, 20 nt, Artificial Sequence
  TRAC targeting sequence
gagcucccggauggcagaga

SEQ ID NO: 17630 - RNA, 20 nt, Artificial Sequence
  TRAC targeting sequence
guuugcacucugagcucccg

SEQ ID NO: 17631 - RNA, 20 nt, Artificial Sequence
  TRAC targeting sequence
ccacgucauaguggagguac

SEQ ID NO: 17632 - RNA, 20 nt, Artificial Sequence
  TRAC targeting sequence
uaguggagguacaugcaagu

SEQ ID NO: 17633 - RNA, 20 nt, Artificial Sequence
  TRAC targeting sequence
acuaugacguggugacaaua

SEQ ID NO: 17634 - RNA, 20 nt, Artificial Sequence
  TRAC targeting sequence
auugcaacuugcauguaccu

SEQ ID NO: 17635 - RNA, 20 nt, Artificial Sequence
  TRAC targeting sequence
guugugcuuccauugcaacu

SEQ ID NO: 17636 - RNA, 20 nt, Artificial Sequence
  TRAC targeting sequence
ucuguugugcuuccauugca

SEQ ID NO: 17637 - RNA, 20 nt, Artificial Sequence
  TRAC targeting sequence
ugucuucuguugugcuucca

SEQ ID NO: 17638 - RNA, 20 nt, Artificial Sequence
  TRAC targeting sequence
aauucucauugccugguaca

SEQ ID NO: 17639 - RNA, 20 nt, Artificial Sequence
  TRAC targeting sequence
cauugccugguacauacaca

SEQ ID NO: 17640 - RNA, 20 nt, Artificial Sequence
  TRAC targeting sequence
uugccugguacauacacaca

SEQ ID NO: 17641 - RNA, 20 nt, Artificial Sequence
  TRAC targeting sequence
uccacuauaccuuaagcucc

SEQ ID NO: 17642 - RNA, 20 nt, Artificial Sequence
  TRAC targeting sequence
acuauaccuuaagcuccaug

SEQ ID NO: 17643 - RNA, 20 nt, Artificial Sequence
  TRAC targeting sequence
augagggcaggacccuuuuu

SEQ ID NO: 17644 - RNA, 20 nt, Artificial Sequence
  TRAC targeting sequence
uggagcuuaagguauagugg

SEQ ID NO: 17645 - RNA, 20 nt, Artificial Sequence
  TRAC targeting sequence
ugcccucauggagcuuaagg

SEQ ID NO: 17646 - RNA, 20 nt, Artificial Sequence
  TRAC targeting sequence
uccucacagcucuacagcuc

SEQ ID NO: 17647 - RNA, 20 nt, Artificial Sequence
  TRAC targeting sequence
ucacagcucuacagcucagc

SEQ ID NO: 17648 - RNA, 20 nt, Artificial Sequence
  TRAC targeting sequence
cagcucuacagcucagcaca

SEQ ID NO: 17649 - RNA, 20 nt, Artificial Sequence
  TRAC targeting sequence
acagcucagcacaaugccug

SEQ ID NO: 17650 - RNA, 20 nt, Artificial Sequence
  TRAC targeting sequence
gcacaaugccuggcacauag

SEQ ID NO: 17651 - RNA, 20 nt, Artificial Sequence
  TRAC targeting sequence
ccaaacaaaugauugugggg

SEQ ID NO: 17652 - RNA, 20 nt, Artificial Sequence
  TRAC targeting sequence
uuuguuuggugacaccuaug

SEQ ID NO: 17653 - RNA, 20 nt, Artificial Sequence
  TRAC targeting sequence
ccacaaucauuuguuuggug

SEQ ID NO: 17654 - RNA, 20 nt, Artificial Sequence
  TRAC targeting sequence
ggcuagaugaguuaugauuu

SEQ ID NO: 17655 - RNA, 20 nt, Artificial Sequence
  TRAC targeting sequence
agccagaaggcauuuuuuuc

SEQ ID NO: 17656 - RNA, 20 nt, Artificial Sequence
  TRAC targeting sequence
ucuagccagaaggcauuuuu

SEQ ID NO: 17657 - RNA, 20 nt, Artificial Sequence
  TRAC targeting sequence
uaacucaucuagccagaagg

SEQ ID NO: 17658 - RNA, 20 nt, Artificial Sequence
  TRAC targeting sequence
cuaacagagagaguuguuag

SEQ ID NO: 17659 - RNA, 20 nt, Artificial Sequence
  TRAC targeting sequence
aacagagagaguuguuagac

SEQ ID NO: 17660 - RNA, 20 nt, Artificial Sequence
  TRAC targeting sequence
guuagagaauauuuguuaau

SEQ ID NO: 17661 - RNA, 20 nt, Artificial Sequence
  TRAC targeting sequence
cuguuagagaauauuuguua

SEQ ID NO: 17662 - RNA, 20 nt, Artificial Sequence
  TRAC targeting sequence
cucuguuagagaauauuugu

SEQ ID NO: 17663 - RNA, 20 nt, Artificial Sequence
  TRAC targeting sequence
aacaacucucucuguuagag

SEQ ID NO: 17664 - RNA, 20 nt, Artificial Sequence
  TRAC targeting sequence
aaaccaggagauugcagaau

SEQ ID NO: 17665 - RNA, 20 nt, Artificial Sequence
  TRAC targeting sequence
ugguuuugaggucuaacaac

SEQ ID NO: 17666 - RNA, 20 nt, Artificial Sequence
  TRAC targeting sequence
ccugguuuugaggucuaaca

SEQ ID NO: 17667 - RNA, 20 nt, Artificial Sequence
  TRAC targeting sequence
gcaaucuccugguuuugagg

SEQ ID NO: 17668 - RNA, 20 nt, Artificial Sequence
  TRAC targeting sequence
auccagaugucugugguggg

SEQ ID NO: 17669 - RNA, 20 nt, Artificial Sequence
  TRAC targeting sequence
agaugucuguggugggagaa

SEQ ID NO: 17670 - RNA, 20 nt, Artificial Sequence
  TRAC targeting sequence
ggauggauucugcaaucucc

SEQ ID NO: 17671 - RNA, 20 nt, Artificial Sequence
  TRAC targeting sequence
guggugggagaaggcccauc

SEQ ID NO: 17672 - RNA, 20 nt, Artificial Sequence
  TRAC targeting sequence
caccacagacaucuggaugg

SEQ ID NO: 17673 - RNA, 20 nt, Artificial Sequence
  TRAC targeting sequence
cccaccacagacaucuggau

SEQ ID NO: 17674 - RNA, 20 nt, Artificial Sequence
  TRAC targeting sequence
cucagggaagagcaccucug

SEQ ID NO: 17675 - RNA, 20 nt, Artificial Sequence
  TRAC targeting sequence
cagggaagagcaccucugua

SEQ ID NO: 17676 - RNA, 20 nt, Artificial Sequence
  TRAC targeting sequence
gggaagagcaccucuguauu

SEQ ID NO: 17677 - RNA, 20 nt, Artificial Sequence
  TRAC targeting sequence
cugagagaugggccuucucc

SEQ ID NO: 17678 - RNA, 20 nt, Artificial Sequence
  TRAC targeting sequence
ucccugagagaugggccuuc

SEQ ID NO: 17679 - RNA, 20 nt, Artificial Sequence
  TRAC targeting sequence
guauuuaucuguucauaugu

SEQ ID NO: 17680 - RNA, 20 nt, Artificial Sequence
  TRAC targeting sequence
guucauaugugugcuucauc

SEQ ID NO: 17681 - RNA, 20 nt, Artificial Sequence
  TRAC targeting sequence
uaugugugcuucaucaaagc

SEQ ID NO: 17682 - RNA, 20 nt, Artificial Sequence
  TRAC targeting sequence
ucaaagccucuucucagcca

SEQ ID NO: 17683 - RNA, 20 nt, Artificial Sequence
  TRAC targeting sequence
aagccucuucucagccaugg

SEQ ID NO: 17684 - RNA, 20 nt, Artificial Sequence
  TRAC targeting sequence
ucucagccaugguucaggcu

SEQ ID NO: 17685 - RNA, 20 nt, Artificial Sequence
  TRAC targeting sequence
cagccaugguucaggcugaa

SEQ ID NO: 17686 - RNA, 20 nt, Artificial Sequence
  TRAC targeting sequence
gccaugguucaggcugaauu

SEQ ID NO: 17687 - RNA, 20 nt, Artificial Sequence
  TRAC targeting sequence
ggcugaauuuauaaagcuug

SEQ ID NO: 17688 - RNA, 20 nt, Artificial Sequence
  TRAC targeting sequence
gccugaaccauggcugagaa

SEQ ID NO: 17689 - RNA, 20 nt, Artificial Sequence
  TRAC targeting sequence
agcuuuauaaauucagccug

SEQ ID NO: 17690 - RNA, 20 nt, Artificial Sequence
  TRAC targeting sequence
uauuucucaagaaucagaga

SEQ ID NO: 17691 - RNA, 20 nt, Artificial Sequence
  TRAC targeting sequence
caagaaucagagaucagagg

SEQ ID NO: 17692 - RNA, 20 nt, Artificial Sequence
  TRAC targeting sequence
agaaucagagaucagaggug

SEQ ID NO: 17693 - RNA, 20 nt, Artificial Sequence
  TRAC targeting sequence
ugagaaauacgauagguuuc

SEQ ID NO: 17694 - RNA, 20 nt, Artificial Sequence
  TRAC targeting sequence
gagaucagagguggaagguu

SEQ ID NO: 17695 - RNA, 20 nt, Artificial Sequence
  TRAC targeting sequence
gauucuugagaaauacgaua

SEQ ID NO: 17696 - RNA, 20 nt, Artificial Sequence
  TRAC targeting sequence
cugauucuugagaaauacga

SEQ ID NO: 17697 - RNA, 20 nt, Artificial Sequence
  TRAC targeting sequence
gagguggaagguuuacaaua

SEQ ID NO: 17698 - RNA, 20 nt, Artificial Sequence
  TRAC targeting sequence
gaucucugauucuugagaaa

SEQ ID NO: 17699 - RNA, 20 nt, Artificial Sequence
  TRAC targeting sequence
accucugaucucugauucuu

SEQ ID NO: 17700 - RNA, 20 nt, Artificial Sequence
  TRAC targeting sequence
cgauaaguaagcaguacaaa

SEQ ID NO: 17701 - RNA, 20 nt, Artificial Sequence
  TRAC targeting sequence
auaaguaagcaguacaaaug

SEQ ID NO: 17702 - RNA, 20 nt, Artificial Sequence
  TRAC targeting sequence
agauauuguaaaccuuccac

SEQ ID NO: 17703 - RNA, 20 nt, Artificial Sequence
  TRAC targeting sequence
uuuguacugcuuacuuaucg

SEQ ID NO: 17704 - RNA, 20 nt, Artificial Sequence
  TRAC targeting sequence
agcaguaaaaaagaaagagg

SEQ ID NO: 17705 - RNA, 20 nt, Artificial Sequence
  TRAC targeting sequence
uuuuuacugcuagaacucau

SEQ ID NO: 17706 - RNA, 20 nt, Artificial Sequence
  TRAC targeting sequence
uucuuuuuuacugcuagaac

SEQ ID NO: 17707 - RNA, 20 nt, Artificial Sequence
  TRAC targeting sequence
aaugauaaauauaugaagcc

SEQ ID NO: 17708 - RNA, 20 nt, Artificial Sequence
  TRAC targeting sequence
uuagaccucuuucuuuuuua

SEQ ID NO: 17709 - RNA, 20 nt, Artificial Sequence
  TRAC targeting sequence
uauauuuaucauuagaccuc

SEQ ID NO: 17710 - RNA, 20 nt, Artificial Sequence
  TRAC targeting sequence
ccacuugagagaccuccuag

SEQ ID NO: 17711 - RNA, 20 nt, Artificial Sequence
  TRAC targeting sequence
acuugagagaccuccuagaa

SEQ ID NO: 17712 - RNA, 20 nt, Artificial Sequence
  TRAC targeting sequence
aguggagacaggcuucauau

SEQ ID NO: 17713 - RNA, 20 nt, Artificial Sequence
  TRAC targeting sequence
caaguggagacaggcuucau

SEQ ID NO: 17714 - RNA, 20 nt, Artificial Sequence
  TRAC targeting sequence
cucaaguggagacaggcuuc

SEQ ID NO: 17715 - RNA, 20 nt, Artificial Sequence
  TRAC targeting sequence
uagaaaagauuuguucuaag

SEQ ID NO: 17716 - RNA, 20 nt, Artificial Sequence
  TRAC targeting sequence
aggaggucucucaaguggag

SEQ ID NO: 17717 - RNA, 20 nt, Artificial Sequence
  TRAC targeting sequence
uuucuaggaggucucucaag

SEQ ID NO: 17718 - RNA, 20 nt, Artificial Sequence
  TRAC targeting sequence
aaggaaacuuuucuccauua

SEQ ID NO: 17719 - RNA, 20 nt, Artificial Sequence
  TRAC targeting sequence
uuagaacaaaucuuuucuag

SEQ ID NO: 17720 - RNA, 20 nt, Artificial Sequence
  TRAC targeting sequence
ccauuaggagcagaaucauc

SEQ ID NO: 17721 - RNA, 20 nt, Artificial Sequence
  TRAC targeting sequence
auuaggagcagaaucaucuu

SEQ ID NO: 17722 - RNA, 20 nt, Artificial Sequence
  TRAC targeting sequence
uaauggagaaaaguuuccuu

SEQ ID NO: 17723 - RNA, 20 nt, Artificial Sequence
  TRAC targeting sequence
gcuccuaauggagaaaaguu

SEQ ID NO: 17724 - RNA, 20 nt, Artificial Sequence
  TRAC targeting sequence
ucuuggaaauauacagcucc

SEQ ID NO: 17725 - RNA, 20 nt, Artificial Sequence
  TRAC targeting sequence
uggaaauauacagcuccaag

SEQ ID NO: 17726 - RNA, 20 nt, Artificial Sequence
  TRAC targeting sequence
aagaugauucugcuccuaau

SEQ ID NO: 17727 - RNA, 20 nt, Artificial Sequence
  TRAC targeting sequence
aaguuguguuagaaaggugu

SEQ ID NO: 17728 - RNA, 20 nt, Artificial Sequence
  TRAC targeting sequence
aacacaacuuggagcuguau

SEQ ID NO: 17729 - RNA, 20 nt, Artificial Sequence
  TRAC targeting sequence
uuguacacaccuuucuaaca

SEQ ID NO: 17730 - RNA, 20 nt, Artificial Sequence
  TRAC targeting sequence
ucuuuguacacaccuuucua

SEQ ID NO: 17731 - RNA, 20 nt, Artificial Sequence
  TRAC targeting sequence
cauuuggaauaaggcauuaa

SEQ ID NO: 17732 - RNA, 20 nt, Artificial Sequence
  TRAC targeting sequence
aaaugugaauuuuuggucuu

SEQ ID NO: 17733 - RNA, 20 nt, Artificial Sequence
  TRAC targeting sequence
aguagggaaacccugcaaag

SEQ ID NO: 17734 - RNA, 20 nt, Artificial Sequence
  TRAC targeting sequence
cuacuagaaacaauggcaac

SEQ ID NO: 17735 - RNA, 20 nt, Artificial Sequence
  TRAC targeting sequence
uagauccugcauguugacgc

SEQ ID NO: 17736 - RNA, 20 nt, Artificial Sequence
  TRAC targeting sequence
acgaugccccaacacuuugc

SEQ ID NO: 17737 - RNA, 20 nt, Artificial Sequence
  TRAC targeting sequence
ugcauguugacgccugcaac

SEQ ID NO: 17738 - RNA, 20 nt, Artificial Sequence
  TRAC targeting sequence
acaugcaggaucuacgaugc

SEQ ID NO: 17739 - RNA, 20 nt, Artificial Sequence
  TRAC targeting sequence
gccccggagcuguuccgaca

SEQ ID NO: 17740 - RNA, 20 nt, Artificial Sequence
  TRAC targeting sequence
ggggcagauuaguugcaggc

SEQ ID NO: 17741 - RNA, 20 nt, Artificial Sequence
  TRAC targeting sequence
gacaguggcuggagcauuug

SEQ ID NO: 17742 - RNA, 20 nt, Artificial Sequence
  TRAC targeting sequence
gaacagcuccggggcagauu

SEQ ID NO: 17743 - RNA, 20 nt, Artificial Sequence
  TRAC targeting sequence
agccacugucggaacagcuc

SEQ ID NO: 17744 - RNA, 20 nt, Artificial Sequence
  TRAC targeting sequence
acaauugccaaaauaaaaug

SEQ ID NO: 17745 - RNA, 20 nt, Artificial Sequence
  TRAC targeting sequence
uuuuauuuuggcaauuguug

SEQ ID NO: 17746 - RNA, 20 nt, Artificial Sequence
  TRAC targeting sequence
ugaugauuagaaagaaauaa

SEQ ID NO: 17747 - RNA, 20 nt, Artificial Sequence
  TRAC targeting sequence
cgaaauagcuucauuuuauu

SEQ ID NO: 17748 - RNA, 20 nt, Artificial Sequence
  TRAC targeting sequence
ucacgaaauagcuucauuuu

SEQ ID NO: 17749 - RNA, 20 nt, Artificial Sequence
  TRAC targeting sequence
aaucaucacgaaauagcuuc

SEQ ID NO: 17750 - RNA, 20 nt, Artificial Sequence
  TRAC targeting sequence
uucuaaucaucacgaaauag

SEQ ID NO: 17751 - RNA, 20 nt, Artificial Sequence
  TRAC targeting sequence
gcaucaaugaggccucugau

SEQ ID NO: 17752 - RNA, 20 nt, Artificial Sequence
  TRAC targeting sequence
augaggccucugaugcaucu

SEQ ID NO: 17753 - RNA, 20 nt, Artificial Sequence
  TRAC targeting sequence
uugaugcugauuauuucuuu

SEQ ID NO: 17754 - RNA, 20 nt, Artificial Sequence
  TRAC targeting sequence
gaugcaucuucaggagugag

SEQ ID NO: 17755 - RNA, 20 nt, Artificial Sequence
  TRAC targeting sequence
gaggccucauugaugcugau

SEQ ID NO: 17756 - RNA, 20 nt, Artificial Sequence
  TRAC targeting sequence
ucaggagugaguagguggaa

SEQ ID NO: 17757 - RNA, 20 nt, Artificial Sequence
  TRAC targeting sequence
ggagugaguagguggaauga

SEQ ID NO: 17758 - RNA, 20 nt, Artificial Sequence
  TRAC targeting sequence
ugaagaugcaucagaggccu

SEQ ID NO: 17759 - RNA, 20 nt, Artificial Sequence
  TRAC targeting sequence
cuccugaagaugcaucagag

SEQ ID NO: 17760 - RNA, 20 nt, Artificial Sequence
  TRAC targeting sequence
accuacucacuccugaagau

SEQ ID NO: 17761 - RNA, 20 nt, Artificial Sequence
  TRAC targeting sequence
uuccaccuacucacuccuga

SEQ ID NO: 17762 - RNA, 20 nt, Artificial Sequence
  TRAC targeting sequence
ucauuccaccuacucacucc

SEQ ID NO: 17763 - RNA, 20 nt, Artificial Sequence
  TRAC targeting sequence
ccuaccaggucuucauucca

SEQ ID NO: 17764 - RNA, 20 nt, Artificial Sequence
  TRAC targeting sequence
caccuaccaggucuucauuc

SEQ ID NO: 17765 - RNA, 20 nt, Artificial Sequence
  TRAC targeting sequence
cucuugucagagaaaguuug

SEQ ID NO: 17766 - RNA, 20 nt, Artificial Sequence
  TRAC targeting sequence
cuugucagagaaaguuugac

SEQ ID NO: 17767 - RNA, 20 nt, Artificial Sequence
  TRAC targeting sequence
ugucagagaaaguuugacuu

SEQ ID NO: 17768 - RNA, 20 nt, Artificial Sequence
  TRAC targeting sequence
gagaaaguuugacuuggggg

SEQ ID NO: 17769 - RNA, 20 nt, Artificial Sequence
  TRAC targeting sequence
gacaagagagaaaagucuca

SEQ ID NO: 17770 - RNA, 20 nt, Artificial Sequence
  TRAC targeting sequence
cugacaagagagaaaagucu

SEQ ID NO: 17771 - RNA, 20 nt, Artificial Sequence
  TRAC targeting sequence
aacuuucucugacaagagag

SEQ ID NO: 17772 - RNA, 20 nt, Artificial Sequence
  TRAC targeting sequence
cccaagucaaacuuucucug

SEQ ID NO: 17773 - RNA, 20 nt, Artificial Sequence
  TRAC targeting sequence
aggcucccccaagucaaacu

SEQ ID NO: 17774 - RNA, 20 nt, Artificial Sequence
  TRAC targeting sequence
cuguuuuccaggcuccccca

SEQ ID NO: 17775 - RNA, 20 nt, Artificial Sequence
  TRAC targeting sequence
ugucccuguuuuccaggcuc

SEQ ID NO: 17776 - RNA, 20 nt, Artificial Sequence
  TRAC targeting sequence
ccugucccuguuuuccaggc

SEQ ID NO: 17777 - RNA, 20 nt, Artificial Sequence
  TRAC targeting sequence
aucuccugucccuguuuucc

SEQ ID NO: 17778 - RNA, 20 nt, Artificial Sequence
  TRAC targeting sequence
gaguucuuguaaagcaccau

SEQ ID NO: 17779 - RNA, 20 nt, Artificial Sequence
  TRAC targeting sequence
gaccugggcagggcaugccu

SEQ ID NO: 17780 - RNA, 20 nt, Artificial Sequence
  TRAC targeting sequence
uguaaagcaccaucugauug

SEQ ID NO: 17781 - RNA, 20 nt, Artificial Sequence
  TRAC targeting sequence
gauuguguguuuucuggugg

SEQ ID NO: 17782 - RNA, 20 nt, Artificial Sequence
  TRAC targeting sequence
gauggugcuuuacaagaacu

SEQ ID NO: 17783 - RNA, 20 nt, Artificial Sequence
  TRAC targeting sequence
gguggcuacaauaagcugau

SEQ ID NO: 17784 - RNA, 20 nt, Artificial Sequence
  TRAC targeting sequence
gcuuauuguagccaccagaa

SEQ ID NO: 17785 - RNA, 20 nt, Artificial Sequence
  TRAC targeting sequence
aaaaaucagcuuauuguagc

SEQ ID NO: 17786 - RNA, 20 nt, Artificial Sequence
  TRAC targeting sequence
cugcuccaaaaaucagcuua

SEQ ID NO: 17787 - RNA, 20 nt, Artificial Sequence
  TRAC targeting sequence
cauggguguacagccagccu

SEQ ID NO: 17788 - RNA, 20 nt, Artificial Sequence
  TRAC targeting sequence
uacucacauggguguacagc

SEQ ID NO: 17789 - RNA, 20 nt, Artificial Sequence
  TRAC targeting sequence
cuugcagggucauacucaca

SEQ ID NO: 17790 - RNA, 20 nt, Artificial Sequence
  TRAC targeting sequence
uuuugcacuggucacuugca

SEQ ID NO: 17791 - RNA, 20 nt, Artificial Sequence
  TRAC targeting sequence
guucuuuuugcacuggucac

SEQ ID NO: 17792 - RNA, 20 nt, Artificial Sequence
  TRAC targeting sequence
augagaaaacaggugaugau

SEQ ID NO: 17793 - RNA, 20 nt, Artificial Sequence
  TRAC targeting sequence
uagacaaguggucaguucuu

SEQ ID NO: 17794 - RNA, 20 nt, Artificial Sequence
  TRAC targeting sequence
cauagacaaguggucaguuc

SEQ ID NO: 17795 - RNA, 20 nt, Artificial Sequence
  TRAC targeting sequence
ccuguuuucucauagacaag

SEQ ID NO: 17796 - RNA, 20 nt, Artificial Sequence
  TRAC targeting sequence
ucaccuguuuucucauagac

SEQ ID NO: 17797 - RNA, 20 nt, Artificial Sequence
  TRAC targeting sequence
auagcaaacuuggggauaua

SEQ ID NO: 17798 - RNA, 20 nt, Artificial Sequence
  TRAC targeting sequence
ccaaguuugcuauagaucau

SEQ ID NO: 17799 - RNA, 20 nt, Artificial Sequence
  TRAC targeting sequence
auauauccccaaguuugcua

SEQ ID NO: 17800 - RNA, 20 nt, Artificial Sequence
  TRAC targeting sequence
caauauauccccaaguuugc

SEQ ID NO: 17801 - RNA, 20 nt, Artificial Sequence
  TRAC targeting sequence
uuuuccauuccuacaagcuc

SEQ ID NO: 17802 - RNA, 20 nt, Artificial Sequence
  TRAC targeting sequence
auuccuacaagcucucuugg

SEQ ID NO: 17803 - RNA, 20 nt, Artificial Sequence
  TRAC targeting sequence
uacaagcucucuuggugacu

SEQ ID NO: 17804 - RNA, 20 nt, Artificial Sequence
  TRAC targeting sequence
cuuggugacuuaaaauguuc

SEQ ID NO: 17805 - RNA, 20 nt, Artificial Sequence
  TRAC targeting sequence
uggugacuuaaaauguuccc

SEQ ID NO: 17806 - RNA, 20 nt, Artificial Sequence
  TRAC targeting sequence
ccaagagagcuuguaggaau

SEQ ID NO: 17807 - RNA, 20 nt, Artificial Sequence
  TRAC targeting sequence
cauuucucauaugaaacaca

SEQ ID NO: 17808 - RNA, 20 nt, Artificial Sequence
  TRAC targeting sequence
cauaugaaacacagaagugc

SEQ ID NO: 17809 - RNA, 20 nt, Artificial Sequence
  TRAC targeting sequence
uaugaaacacagaagugcca

SEQ ID NO: 17810 - RNA, 20 nt, Artificial Sequence
  TRAC targeting sequence
uaugagaaaugggaacauuu

SEQ ID NO: 17811 - RNA, 20 nt, Artificial Sequence
  TRAC targeting sequence
guguuucauaugagaaaugg

SEQ ID NO: 17812 - RNA, 20 nt, Artificial Sequence
  TRAC targeting sequence
uggcacuucuguguuucaua

SEQ ID NO: 17813 - RNA, 20 nt, Artificial Sequence
  TRAC targeting sequence
uuuacgcaauuggcucuugg

SEQ ID NO: 17814 - RNA, 20 nt, Artificial Sequence
  TRAC targeting sequence
gagcagaauaauuuauagaa

SEQ ID NO: 17815 - RNA, 20 nt, Artificial Sequence
  TRAC targeting sequence
gauuuucauuuacgcaauug

SEQ ID NO: 17816 - RNA, 20 nt, Artificial Sequence
  TRAC targeting sequence
gcucagauuuucauuuacgc

SEQ ID NO: 17817 - RNA, 20 nt, Artificial Sequence
  TRAC targeting sequence
auaaauuauucugcucagau

SEQ ID NO: 17818 - RNA, 20 nt, Artificial Sequence
  TRAC targeting sequence
uuuuauguuucuauaaauua

SEQ ID NO: 17819 - RNA, 20 nt, Artificial Sequence
  TRAC targeting sequence
aaauaaugagugcuuucaag

SEQ ID NO: 17820 - RNA, 20 nt, Artificial Sequence
  TRAC targeting sequence
uuauuuggaacucuuuuuau

SEQ ID NO: 17821 - RNA, 20 nt, Artificial Sequence
  TRAC targeting sequence
agugaagcugauaauaucgg

SEQ ID NO: 17822 - RNA, 20 nt, Artificial Sequence
  TRAC targeting sequence
cuugaaagcacucauuauuu

SEQ ID NO: 17823 - RNA, 20 nt, Artificial Sequence
  TRAC targeting sequence
gcuucacuugaaagcacuca

SEQ ID NO: 17824 - RNA, 20 nt, Artificial Sequence
  TRAC targeting sequence
gcaccagauaaucugaacau

SEQ ID NO: 17825 - RNA, 20 nt, Artificial Sequence
  TRAC targeting sequence
ggugccgauauuaucagcuu

SEQ ID NO: 17826 - RNA, 20 nt, Artificial Sequence
  TRAC targeting sequence
gaacauucaggaaauuagcu

SEQ ID NO: 17827 - RNA, 20 nt, Artificial Sequence
  TRAC targeting sequence
gauuaucuggugccgauauu

SEQ ID NO: 17828 - RNA, 20 nt, Artificial Sequence
  TRAC targeting sequence
ggaaauuagcuaagugcccu

SEQ ID NO: 17829 - RNA, 20 nt, Artificial Sequence
  TRAC targeting sequence
ugaauguucagauuaucugg

SEQ ID NO: 17830 - RNA, 20 nt, Artificial Sequence
  TRAC targeting sequence
cccaagggcacuuagcuaau

SEQ ID NO: 17831 - RNA, 20 nt, Artificial Sequence
  TRAC targeting sequence
uucccccaagggcacuuagc

SEQ ID NO: 17832 - RNA, 20 nt, Artificial Sequence
  TRAC targeting sequence
cuuucccccaagggcacuua

SEQ ID NO: 17833 - RNA, 20 nt, Artificial Sequence
  TRAC targeting sequence
ucucuuucccccaagggcac

SEQ ID NO: 17834 - RNA, 20 nt, Artificial Sequence
  TRAC targeting sequence
cuuuuauugcagcauguagc

SEQ ID NO: 17835 - RNA, 20 nt, Artificial Sequence
  TRAC targeting sequence
uuuauugcagcauguagcua

SEQ ID NO: 17836 - RNA, 20 nt, Artificial Sequence
  TRAC targeting sequence
cuggauuggcuaauaaacau

SEQ ID NO: 17837 - RNA, 20 nt, Artificial Sequence
  TRAC targeting sequence
agggaauuuagcuacaugcu

SEQ ID NO: 17838 - RNA, 20 nt, Artificial Sequence
  TRAC targeting sequence
ccauaccauguuuauuagcc

SEQ ID NO: 17839 - RNA, 20 nt, Artificial Sequence
  TRAC targeting sequence
cuacucauagaaucuuccuc

SEQ ID NO: 17840 - RNA, 20 nt, Artificial Sequence
  TRAC targeting sequence
uagaaucuuccucucuggag

SEQ ID NO: 17841 - RNA, 20 nt, Artificial Sequence
  TRAC targeting sequence
augaguagggauccccauac

SEQ ID NO: 17842 - RNA, 20 nt, Artificial Sequence
  TRAC targeting sequence
uccucucuggaguuaggaga

SEQ ID NO: 17843 - RNA, 20 nt, Artificial Sequence
  TRAC targeting sequence
ucucuggaguuaggagaguu

SEQ ID NO: 17844 - RNA, 20 nt, Artificial Sequence
  TRAC targeting sequence
cuggaguuaggagaguuuuc

SEQ ID NO: 17845 - RNA, 20 nt, Artificial Sequence
  TRAC targeting sequence
ggaguuaggagaguuuucag

SEQ ID NO: 17846 - RNA, 20 nt, Artificial Sequence
  TRAC targeting sequence
agagaggaagauucuaugag

SEQ ID NO: 17847 - RNA, 20 nt, Artificial Sequence
  TRAC targeting sequence
uaacuccagagaggaagauu

SEQ ID NO: 17848 - RNA, 20 nt, Artificial Sequence
  TRAC targeting sequence
ccuaacuccagagaggaaga

SEQ ID NO: 17849 - RNA, 20 nt, Artificial Sequence
  TRAC targeting sequence
gcuuccuccuaaggguaaaa

SEQ ID NO: 17850 - RNA, 20 nt, Artificial Sequence
  TRAC targeting sequence
uccuaaggguaaaaguggcc

SEQ ID NO: 17851 - RNA, 20 nt, Artificial Sequence
  TRAC targeting sequence
uaaggguaaaaguggcccag

SEQ ID NO: 17852 - RNA, 20 nt, Artificial Sequence
  TRAC targeting sequence
gggccacuuuuacccuuagg

SEQ ID NO: 17853 - RNA, 20 nt, Artificial Sequence
  TRAC targeting sequence
guuaggggucugggccacuu

SEQ ID NO: 17854 - RNA, 20 nt, Artificial Sequence
  TRAC targeting sequence
auaccuuguaauugcaugug

SEQ ID NO: 17855 - RNA, 20 nt, Artificial Sequence
  TRAC targeting sequence
acauugcugccucuauaccu

SEQ ID NO: 17856 - RNA, 20 nt, Artificial Sequence
  TRAC targeting sequence
cucuacauugcugccucuau

SEQ ID NO: 17857 - RNA, 20 nt, Artificial Sequence
  TRAC targeting sequence
gugggccucccucuacauug

SEQ ID NO: 17858 - RNA, 20 nt, Artificial Sequence
  TRAC targeting sequence
ccaggucugugggccucccu

SEQ ID NO: 17859 - RNA, 20 nt, Artificial Sequence
  TRAC targeting sequence
gggcucuacucucacuggcu

SEQ ID NO: 17860 - RNA, 20 nt, Artificial Sequence
  TRAC targeting sequence
acucucacuggcuguuuuca

SEQ ID NO: 17861 - RNA, 20 nt, Artificial Sequence
  TRAC targeting sequence
cacuggcuguuuucaauaaa

SEQ ID NO: 17862 - RNA, 20 nt, Artificial Sequence
  TRAC targeting sequence
cuggcuguuuucaauaaagc

SEQ ID NO: 17863 - RNA, 20 nt, Artificial Sequence
  TRAC targeting sequence
auaaagccuccacuuucuca

SEQ ID NO: 17864 - RNA, 20 nt, Artificial Sequence
  TRAC targeting sequence
acuuucucagcagcaaaaug

SEQ ID NO: 17865 - RNA, 20 nt, Artificial Sequence
  TRAC targeting sequence
cagcagcaaaaugacuauaa

SEQ ID NO: 17866 - RNA, 20 nt, Artificial Sequence
  TRAC targeting sequence
gcagcaaaaugacuauaacu

SEQ ID NO: 17867 - RNA, 20 nt, Artificial Sequence
  TRAC targeting sequence
uuuugcugcugagaaagugg

SEQ ID NO: 17868 - RNA, 20 nt, Artificial Sequence
  TRAC targeting sequence
uaauaauaugagauaauggc

SEQ ID NO: 17869 - RNA, 20 nt, Artificial Sequence
  TRAC targeting sequence
uauuauuaugauguaguuau

SEQ ID NO: 17870 - RNA, 20 nt, Artificial Sequence
  TRAC targeting sequence
cauauuauuaugauguaguu

SEQ ID NO: 17871 - RNA, 20 nt, Artificial Sequence
  TRAC targeting sequence
ggccauuaucucauauuauu

SEQ ID NO: 17872 - RNA, 20 nt, Artificial Sequence
  TRAC targeting sequence
cuuuuuacauucuggccauu

SEQ ID NO: 17873 - RNA, 20 nt, Artificial Sequence
  TRAC targeting sequence
auaaguaguagcuuuucuaa

SEQ ID NO: 17874 - RNA, 20 nt, Artificial Sequence
  TRAC targeting sequence
aaaauauuauuauaauuauu

SEQ ID NO: 17875 - RNA, 20 nt, Artificial Sequence
  TRAC targeting sequence
auaauaauaauuauaauaau

SEQ ID NO: 17876 - RNA, 20 nt, Artificial Sequence
  TRAC targeting sequence
uaaagggaaaggagaaucgc

SEQ ID NO: 17877 - RNA, 20 nt, Artificial Sequence
  TRAC targeting sequence
cuuuaugauaguguaaaccu

SEQ ID NO: 17878 - RNA, 20 nt, Artificial Sequence
  TRAC targeting sequence
uuucccuuuaugauagugua

SEQ ID NO: 17879 - RNA, 20 nt, Artificial Sequence
  TRAC targeting sequence
ccuuucccuuuaugauagug

SEQ ID NO: 17880 - RNA, 20 nt, Artificial Sequence
  TRAC targeting sequence
cuuccuugggaaauaaaaga

SEQ ID NO: 17881 - RNA, 20 nt, Artificial Sequence
  TRAC targeting sequence
uugggaaauaaaagauguaa

SEQ ID NO: 17882 - RNA, 20 nt, Artificial Sequence
  TRAC targeting sequence
caaggaagcgauucuccuuu

SEQ ID NO: 17883 - RNA, 20 nt, Artificial Sequence
  TRAC targeting sequence
uuuauuucccaaggaagcga

SEQ ID NO: 17884 - RNA, 20 nt, Artificial Sequence
  TRAC targeting sequence
uuguugcuuacaucuuuuau

SEQ ID NO: 17885 - RNA, 20 nt, Artificial Sequence
  TRAC targeting sequence
uugggucuuuguugcuuaca

SEQ ID NO: 17886 - RNA, 20 nt, Artificial Sequence
  TRAC targeting sequence
aaaaggcuccuugggucuuu

SEQ ID NO: 17887 - RNA, 20 nt, Artificial Sequence
  TRAC targeting sequence
gggaccccaguggcuuccag

SEQ ID NO: 17888 - RNA, 20 nt, Artificial Sequence
  TRAC targeting sequence
cagagcaacauucuaaaagg

SEQ ID NO: 17889 - RNA, 20 nt, Artificial Sequence
  TRAC targeting sequence
agcagauuagcaucaagaag

SEQ ID NO: 17890 - RNA, 20 nt, Artificial Sequence
  TRAC targeting sequence
gcuggaagccacuggggucc

SEQ ID NO: 17891 - RNA, 20 nt, Artificial Sequence
  TRAC targeting sequence
agaagguuaucucaaagacc

SEQ ID NO: 17892 - RNA, 20 nt, Artificial Sequence
  TRAC targeting sequence
ugaugcuaaucugcuggaag

SEQ ID NO: 17893 - RNA, 20 nt, Artificial Sequence
  TRAC targeting sequence
caaagaccuuacccacagug

SEQ ID NO: 17894 - RNA, 20 nt, Artificial Sequence
  TRAC targeting sequence
aagaccuuacccacaguggg

SEQ ID NO: 17895 - RNA, 20 nt, Artificial Sequence
  TRAC targeting sequence
uugagauaaccuucuugaug

SEQ ID NO: 17896 - RNA, 20 nt, Artificial Sequence
  TRAC targeting sequence
aagauaaucuuuggaucagg

SEQ ID NO: 17897 - RNA, 20 nt, Artificial Sequence
  TRAC targeting sequence
uggaagcacugcuguacccc

SEQ ID NO: 17898 - RNA, 20 nt, Artificial Sequence
  TRAC targeting sequence
uuggaucagggaccagacuc

SEQ ID NO: 17899 - RNA, 20 nt, Artificial Sequence
  TRAC targeting sequence
aaagauuaucuuggaagcac

SEQ ID NO: 17900 - RNA, 20 nt, Artificial Sequence
  TRAC targeting sequence
gggaccagacucagcauccg

SEQ ID NO: 17901 - RNA, 20 nt, Artificial Sequence
  TRAC targeting sequence
cugauccaaagauuaucuug

SEQ ID NO: 17902 - RNA, 20 nt, Artificial Sequence
  TRAC targeting sequence
ggucccugauccaaagauua

SEQ ID NO: 17903 - RNA, 20 nt, Artificial Sequence
  TRAC targeting sequence
gcauccggccaaguaaguag

SEQ ID NO: 17904 - RNA, 20 nt, Artificial Sequence
  TRAC targeting sequence
ggccaaguaaguagaaugaa

SEQ ID NO: 17905 - RNA, 20 nt, Artificial Sequence
  TRAC targeting sequence
acuuacuuggccggaugcug

SEQ ID NO: 17906 - RNA, 20 nt, Artificial Sequence
  TRAC targeting sequence
uucuacuuacuuggccggau

SEQ ID NO: 17907 - RNA, 20 nt, Artificial Sequence
  TRAC targeting sequence
ugcuucauucuacuuacuug

SEQ ID NO: 17908 - RNA, 20 nt, Artificial Sequence
  TRAC targeting sequence
ccugcuucauucuacuuacu

SEQ ID NO: 17909 - RNA, 20 nt, Artificial Sequence
  TRAC targeting sequence
cuugcucuccugcuucauuc

SEQ ID NO: 17910 - RNA, 20 nt, Artificial Sequence
  TRAC targeting sequence
ucccuugcucuccugcuuca

SEQ ID NO: 17911 - RNA, 20 nt, Artificial Sequence
  TRAC targeting sequence
guccucccuugcucuccugc

SEQ ID NO: 17912 - RNA, 20 nt, Artificial Sequence
  TRAC targeting sequence
ucuuuguccaaaaugccaac

SEQ ID NO: 17913 - RNA, 20 nt, Artificial Sequence
  TRAC targeting sequence
uuguccaaaaugccaacuug

SEQ ID NO: 17914 - RNA, 20 nt, Artificial Sequence
  TRAC targeting sequence
aaaaugccaacuugaaccca

SEQ ID NO: 17915 - RNA, 20 nt, Artificial Sequence
  TRAC targeting sequence
aguuggcauuuuggacaaag

SEQ ID NO: 17916 - RNA, 20 nt, Artificial Sequence
  TRAC targeting sequence
ucugugggcuccaaaauggu

SEQ ID NO: 17917 - RNA, 20 nt, Artificial Sequence
  TRAC targeting sequence
gugggcuccaaaaugguuuc

SEQ ID NO: 17918 - RNA, 20 nt, Artificial Sequence
  TRAC targeting sequence
aaaaugguuucuuccaccca

SEQ ID NO: 17919 - RNA, 20 nt, Artificial Sequence
  TRAC targeting sequence
uccacccauccccagaaaau

SEQ ID NO: 17920 - RNA, 20 nt, Artificial Sequence
  TRAC targeting sequence
acccauccccagaaaauccu

SEQ ID NO: 17921 - RNA, 20 nt, Artificial Sequence
  TRAC targeting sequence
ccagaaaauccucccaucca

SEQ ID NO: 17922 - RNA, 20 nt, Artificial Sequence
  TRAC targeting sequence
ggggauggguggaagaaacc

SEQ ID NO: 17923 - RNA, 20 nt, Artificial Sequence
  TRAC targeting sequence
ucccauccagcucucggugc

SEQ ID NO: 17924 - RNA, 20 nt, Artificial Sequence
  TRAC targeting sequence
cauccagcucucggugcucu

SEQ ID NO: 17925 - RNA, 20 nt, Artificial Sequence
  TRAC targeting sequence
agcucucggugcucugcaga

SEQ ID NO: 17926 - RNA, 20 nt, Artificial Sequence
  TRAC targeting sequence
cggugcucugcagacaucau

SEQ ID NO: 17927 - RNA, 20 nt, Artificial Sequence
  TRAC targeting sequence
gugcucugcagacaucaucc

SEQ ID NO: 17928 - RNA, 20 nt, Artificial Sequence
  TRAC targeting sequence
gcagacaucauccuuaggcu

SEQ ID NO: 17929 - RNA, 20 nt, Artificial Sequence
  TRAC targeting sequence
gcagagcaccgagagcugga

SEQ ID NO: 17930 - RNA, 20 nt, Artificial Sequence
  TRAC targeting sequence
uccuuaggcugggaccuuag

SEQ ID NO: 17931 - RNA, 20 nt, Artificial Sequence
  TRAC targeting sequence
uuaggcugggaccuuaggaa

SEQ ID NO: 17932 - RNA, 20 nt, Artificial Sequence
  TRAC targeting sequence
cagccuaaggaugaugucug

SEQ ID NO: 17933 - RNA, 20 nt, Artificial Sequence
  TRAC targeting sequence
uaaggucccagccuaaggau

SEQ ID NO: 17934 - RNA, 20 nt, Artificial Sequence
  TRAC targeting sequence
ugguuccuaaggucccagcc

SEQ ID NO: 17935 - RNA, 20 nt, Artificial Sequence
  TRAC targeting sequence
uugccugccucaugguuccu

SEQ ID NO: 17936 - RNA, 20 nt, Artificial Sequence
  TRAC targeting sequence
cucauugccugccucauggu

SEQ ID NO: 17937 - RNA, 20 nt, Artificial Sequence
  TRAC targeting sequence
ugaaccuuccacaaacauau

SEQ ID NO: 17938 - RNA, 20 nt, Artificial Sequence
  TRAC targeting sequence
ggaguacucgcucauugccu

SEQ ID NO: 17939 - RNA, 20 nt, Artificial Sequence
  TRAC targeting sequence
acaaacauauccaagauacu

SEQ ID NO: 17940 - RNA, 20 nt, Artificial Sequence
  TRAC targeting sequence
aagauacugcugccuggaau

SEQ ID NO: 17941 - RNA, 20 nt, Artificial Sequence
  TRAC targeting sequence
uggauauguuuguggaaggu

SEQ ID NO: 17942 - RNA, 20 nt, Artificial Sequence
  TRAC targeting sequence
aggcagcaguaucuuggaua

SEQ ID NO: 17943 - RNA, 20 nt, Artificial Sequence
  TRAC targeting sequence
auuccaggcagcaguaucuu

SEQ ID NO: 17944 - RNA, 20 nt, Artificial Sequence
  TRAC targeting sequence
agggaauuauugguuuauug

SEQ ID NO: 17945 - RNA, 20 nt, Artificial Sequence
  TRAC targeting sequence
cuagaacaaaaaccucaauu

SEQ ID NO: 17946 - RNA, 20 nt, Artificial Sequence
  TRAC targeting sequence
auaaaccaauaauucccuag

SEQ ID NO: 17947 - RNA, 20 nt, Artificial Sequence
  TRAC targeting sequence
uaugaagucacaaccucagc

SEQ ID NO: 17948 - RNA, 20 nt, Artificial Sequence
  TRAC targeting sequence
uaugauuucaauaaaccaau

SEQ ID NO: 17949 - RNA, 20 nt, Artificial Sequence
  TRAC targeting sequence
caaccucagcccagggaauc

SEQ ID NO: 17950 - RNA, 20 nt, Artificial Sequence
  TRAC targeting sequence
gcccagggaaucacagcaga

SEQ ID NO: 17951 - RNA, 20 nt, Artificial Sequence
  TRAC targeting sequence
cugggcugagguugugacuu

SEQ ID NO: 17952 - RNA, 20 nt, Artificial Sequence
  TRAC targeting sequence
cagcagaauggaacaggagg

SEQ ID NO: 17953 - RNA, 20 nt, Artificial Sequence
  TRAC targeting sequence
gcugugauucccugggcuga

SEQ ID NO: 17954 - RNA, 20 nt, Artificial Sequence
  TRAC targeting sequence
auucugcugugauucccugg

SEQ ID NO: 17955 - RNA, 20 nt, Artificial Sequence
  TRAC targeting sequence
uguuccauucugcugugauu

SEQ ID NO: 17956 - RNA, 20 nt, Artificial Sequence
  TRAC targeting sequence
uccuguuccauucugcugug

SEQ ID NO: 17957 - RNA, 20 nt, Artificial Sequence
  TRAC targeting sequence
ccuccuguuccauucugcug

SEQ ID NO: 17958 - RNA, 20 nt, Artificial Sequence
  TRAC targeting sequence
gaagcgaaauuucagugcaa

SEQ ID NO: 17959 - RNA, 20 nt, Artificial Sequence
  TRAC targeting sequence
gauacaaaaguucuccuccu

SEQ ID NO: 17960 - RNA, 20 nt, Artificial Sequence
  TRAC targeting sequence
cuucugauacaaaaguucuc

SEQ ID NO: 17961 - RNA, 20 nt, Artificial Sequence
  TRAC targeting sequence
gugcaaaagagcagaagguu

SEQ ID NO: 17962 - RNA, 20 nt, Artificial Sequence
  TRAC targeting sequence
uuugcacugaaauuucgcuu

SEQ ID NO: 17963 - RNA, 20 nt, Artificial Sequence
  TRAC targeting sequence
gcucuuuugcacugaaauuu

SEQ ID NO: 17964 - RNA, 20 nt, Artificial Sequence
  TRAC targeting sequence
cgccuguaauccuagcacuu

SEQ ID NO: 17965 - RNA, 20 nt, Artificial Sequence
  TRAC targeting sequence
uagcacuuugggaggccgag

SEQ ID NO: 17966 - RNA, 20 nt, Artificial Sequence
  TRAC targeting sequence
caaagugcuaggauuacagg

SEQ ID NO: 17967 - RNA, 20 nt, Artificial Sequence
  TRAC targeting sequence
gccucccaaagugcuaggau

SEQ ID NO: 17968 - RNA, 20 nt, Artificial Sequence
  TRAC targeting sequence
cugccucggccucccaaagu

SEQ ID NO: 17969 - RNA, 20 nt, Artificial Sequence
  TRAC targeting sequence
cccugccucggccucccaaa

SEQ ID NO: 17970 - RNA, 20 nt, Artificial Sequence
  TRAC targeting sequence
caaggucaggagaucaagac

SEQ ID NO: 17971 - RNA, 20 nt, Artificial Sequence
  TRAC targeting sequence
ggagaucaagaccauccugg

SEQ ID NO: 17972 - RNA, 20 nt, Artificial Sequence
  TRAC targeting sequence
ugaccuugugaucucccugc

SEQ ID NO: 17973 - RNA, 20 nt, Artificial Sequence
  TRAC targeting sequence
ccugaccuugugaucucccu

SEQ ID NO: 17974 - RNA, 20 nt, Artificial Sequence
  TRAC targeting sequence
agaccauccuggcuaacaca

SEQ ID NO: 17975 - RNA, 20 nt, Artificial Sequence
  TRAC targeting sequence
ugaucuccugaccuugugau

SEQ ID NO: 17976 - RNA, 20 nt, Artificial Sequence
  TRAC targeting sequence
uggcuaacacagugaaaccc

SEQ ID NO: 17977 - RNA, 20 nt, Artificial Sequence
  TRAC targeting sequence
cuguguuagccaggaugguc

SEQ ID NO: 17978 - RNA, 20 nt, Artificial Sequence
  TRAC targeting sequence
cuacuaaaaauacaaaaauu

SEQ ID NO: 17979 - RNA, 20 nt, Artificial Sequence
  TRAC targeting sequence
acuaaaaauacaaaaauuag

SEQ ID NO: 17980 - RNA, 20 nt, Artificial Sequence
  TRAC targeting sequence
cgcccggcuaauuuuuguau

SEQ ID NO: 17981 - RNA, 20 nt, Artificial Sequence
  TRAC targeting sequence
cagcuacucgggagacugag

SEQ ID NO: 17982 - RNA, 20 nt, Artificial Sequence
  TRAC targeting sequence
gcuacucgggagacugaggc

SEQ ID NO: 17983 - RNA, 20 nt, Artificial Sequence
  TRAC targeting sequence
ggagacugaggcaggagaau

SEQ ID NO: 17984 - RNA, 20 nt, Artificial Sequence
  TRAC targeting sequence
cgaguagcugagacuacagg

SEQ ID NO: 17985 - RNA, 20 nt, Artificial Sequence
  TRAC targeting sequence
cccgaguagcugagacuaca

SEQ ID NO: 17986 - RNA, 20 nt, Artificial Sequence
  TRAC targeting sequence
gucucccgaguagcugagac

SEQ ID NO: 17987 - RNA, 20 nt, Artificial Sequence
  TRAC targeting sequence
ugccucagucucccgaguag

SEQ ID NO: 17988 - RNA, 20 nt, Artificial Sequence
  TRAC targeting sequence
ccugccucagucucccgagu

SEQ ID NO: 17989 - RNA, 20 nt, Artificial Sequence
  TRAC targeting sequence
acaauucuccugccucaguc

SEQ ID NO: 17990 - RNA, 20 nt, Artificial Sequence
  TRAC targeting sequence
cggguucaacaauucuccug

SEQ ID NO: 17991 - RNA, 20 nt, Artificial Sequence
  TRAC targeting sequence
gccucccggguucaacaauu

SEQ ID NO: 17992 - RNA, 20 nt, Artificial Sequence
  TRAC targeting sequence
cugccucccggguucaacaa

SEQ ID NO: 17993 - RNA, 20 nt, Artificial Sequence
  TRAC targeting sequence
cugcaaucucugccucccgg

SEQ ID NO: 17994 - RNA, 20 nt, Artificial Sequence
  TRAC targeting sequence
gcucacugcaaucucugccu

SEQ ID NO: 17995 - RNA, 20 nt, Artificial Sequence
  TRAC targeting sequence
cagcucacugcaaucucugc

SEQ ID NO: 17996 - RNA, 20 nt, Artificial Sequence
  TRAC targeting sequence
caucauugcacuccagccug

SEQ ID NO: 17997 - RNA, 20 nt, Artificial Sequence
  TRAC targeting sequence
uugcacuccagccugggcaa

SEQ ID NO: 17998 - RNA, 20 nt, Artificial Sequence
  TRAC targeting sequence
agccugggcaacagagcaag

SEQ ID NO: 17999 - RNA, 20 nt, Artificial Sequence
  TRAC targeting sequence
guugcccaggcuggagugca

SEQ ID NO: 18000 - RNA, 20 nt, Artificial Sequence
  TRAC targeting sequence
ugcucuguugcccaggcugg

SEQ ID NO: 18001 - RNA, 20 nt, Artificial Sequence
  TRAC targeting sequence
uucucaaaaaaacaaaaaaa

SEQ ID NO: 18002 - RNA, 20 nt, Artificial Sequence
  TRAC targeting sequence
caaaaaaacaaaaaaaaaaa

SEQ ID NO: 18003 - RNA, 20 nt, Artificial Sequence
  TRAC targeting sequence
aaaaaacaaaaaaaaaaaaa

SEQ ID NO: 18004 - RNA, 20 nt, Artificial Sequence
  TRAC targeting sequence
uuuuuuuuuuuuuuuuuguu

SEQ ID NO: 18005 - RNA, 20 nt, Artificial Sequence
  TRAC targeting sequence
aacccuuaggagugugauua

SEQ ID NO: 18006 - RNA, 20 nt, Artificial Sequence
  TRAC targeting sequence
uaaggguuagaccuucuuuu

SEQ ID NO: 18007 - RNA, 20 nt, Artificial Sequence
  TRAC targeting sequence
cacuccuaaggguuagaccu

SEQ ID NO: 18008 - RNA, 20 nt, Artificial Sequence
  TRAC targeting sequence
uguucuccugccuugugggg

SEQ ID NO: 18009 - RNA, 20 nt, Artificial Sequence
  TRAC targeting sequence
ccugccuugugggggagauc

SEQ ID NO: 18010 - RNA, 20 nt, Artificial Sequence
  TRAC targeting sequence
ugccuugugggggagaucag

SEQ ID NO: 18011 - RNA, 20 nt, Artificial Sequence
  TRAC targeting sequence
cccacaaggcaggagaacag

SEQ ID NO: 18012 - RNA, 20 nt, Artificial Sequence
  TRAC targeting sequence
cccccacaaggcaggagaac

SEQ ID NO: 18013 - RNA, 20 nt, Artificial Sequence
  TRAC targeting sequence
guguuucucuuauuuaagua

SEQ ID NO: 18014 - RNA, 20 nt, Artificial Sequence
  TRAC targeting sequence
cuuauuuaaguaauagguag

SEQ ID NO: 18015 - RNA, 20 nt, Artificial Sequence
  TRAC targeting sequence
uauuuaaguaauagguaggu

SEQ ID NO: 18016 - RNA, 20 nt, Artificial Sequence
  TRAC targeting sequence
ugugaguuugugcaauggug

SEQ ID NO: 18017 - RNA, 20 nt, Artificial Sequence
  TRAC targeting sequence
caggaccuaccuauuacuua

SEQ ID NO: 18018 - RNA, 20 nt, Artificial Sequence
  TRAC targeting sequence
ccuacgguaugaauacugga

SEQ ID NO: 18019 - RNA, 20 nt, Artificial Sequence
  TRAC targeting sequence
uaccguaggugacaccauug

SEQ ID NO: 18020 - RNA, 20 nt, Artificial Sequence
  TRAC targeting sequence
aguauucauaccguagguga

SEQ ID NO: 18021 - RNA, 20 nt, Artificial Sequence
  TRAC targeting sequence
uccaguauucauaccguagg

SEQ ID NO: 18022 - RNA, 20 nt, Artificial Sequence
  TRAC targeting sequence
auuguuccuccaguauucau

SEQ ID NO: 18023 - RNA, 20 nt, Artificial Sequence
  TRAC targeting sequence
cauuugggaaagggacccau

SEQ ID NO: 18024 - RNA, 20 nt, Artificial Sequence
  TRAC targeting sequence
caaaugugaguuuaucaauu

SEQ ID NO: 18025 - RNA, 20 nt, Artificial Sequence
  TRAC targeting sequence
cuuucccaaaugugaguuua

SEQ ID NO: 18026 - RNA, 20 nt, Artificial Sequence
  TRAC targeting sequence
uuauaucuggugagucaucc

SEQ ID NO: 18027 - RNA, 20 nt, Artificial Sequence
  TRAC targeting sequence
ggugagucaucccagguggc

SEQ ID NO: 18028 - RNA, 20 nt, Artificial Sequence
  TRAC targeting sequence
ccagauauaaugaauacaug

SEQ ID NO: 18029 - RNA, 20 nt, Artificial Sequence
  TRAC targeting sequence
ucccagguggcaccacgugc

SEQ ID NO: 18030 - RNA, 20 nt, Artificial Sequence
  TRAC targeting sequence
cagguggcaccacgugcaac

SEQ ID NO: 18031 - RNA, 20 nt, Artificial Sequence
  TRAC targeting sequence
cuaauccuuucucuggagau

SEQ ID NO: 18032 - RNA, 20 nt, Artificial Sequence
  TRAC targeting sequence
uuucucuggagauaucacuu

SEQ ID NO: 18033 - RNA, 20 nt, Artificial Sequence
  TRAC targeting sequence
cuggagauaucacuuauuac

SEQ ID NO: 18034 - RNA, 20 nt, Artificial Sequence
  TRAC targeting sequence
ggagauaucacuuauuacua

SEQ ID NO: 18035 - RNA, 20 nt, Artificial Sequence
  TRAC targeting sequence
agagaaaggauuagugacac

SEQ ID NO: 18036 - RNA, 20 nt, Artificial Sequence
  TRAC targeting sequence
ccagagaaaggauuagugac

SEQ ID NO: 18037 - RNA, 20 nt, Artificial Sequence
  TRAC targeting sequence
cuuauuacuauggugaggcu

SEQ ID NO: 18038 - RNA, 20 nt, Artificial Sequence
  TRAC targeting sequence
ccauaguaauaagugauauc

SEQ ID NO: 18039 - RNA, 20 nt, Artificial Sequence
  TRAC targeting sequence
acagcaagccucaccauagu

SEQ ID NO: 18040 - RNA, 20 nt, Artificial Sequence
  TRAC targeting sequence
uacagaggucugggaaggga

SEQ ID NO: 18041 - RNA, 20 nt, Artificial Sequence
  TRAC targeting sequence
guaagaaaauuaguuacaac

SEQ ID NO: 18042 - RNA, 20 nt, Artificial Sequence
  TRAC targeting sequence
gggaagggaaaagcauuacu

SEQ ID NO: 18043 - RNA, 20 nt, Artificial Sequence
  TRAC targeting sequence
cagaccucuguaagaaaauu

SEQ ID NO: 18044 - RNA, 20 nt, Artificial Sequence
  TRAC targeting sequence
cuucccagaccucuguaaga

SEQ ID NO: 18045 - RNA, 20 nt, Artificial Sequence
  TRAC targeting sequence
aucuugaauauucauguuuc

SEQ ID NO: 18046 - RNA, 20 nt, Artificial Sequence
  TRAC targeting sequence
ugaauauucauguuucucua

SEQ ID NO: 18047 - RNA, 20 nt, Artificial Sequence
  TRAC targeting sequence
agauagauaguaaugcuuuu

SEQ ID NO: 18048 - RNA, 20 nt, Artificial Sequence
  TRAC targeting sequence
uguuucucuaggucaaacac

SEQ ID NO: 18049 - RNA, 20 nt, Artificial Sequence
  TRAC targeting sequence
cuaggucaaacacauuaaaa

SEQ ID NO: 18050 - RNA, 20 nt, Artificial Sequence
  TRAC targeting sequence
aggucaaacacauuaaaauu

SEQ ID NO: 18051 - RNA, 20 nt, Artificial Sequence
  TRAC targeting sequence
aacacauuaaaauuugacuu

SEQ ID NO: 18052 - RNA, 20 nt, Artificial Sequence
  TRAC targeting sequence
aauuuuaauguguuugaccu

SEQ ID NO: 18053 - RNA, 20 nt, Artificial Sequence
  TRAC targeting sequence
uucaauggguauuguaaaau

SEQ ID NO: 18054 - RNA, 20 nt, Artificial Sequence
  TRAC targeting sequence
auggguauuguaaaaugccu

SEQ ID NO: 18055 - RNA, 20 nt, Artificial Sequence
  TRAC targeting sequence
augugacuaucacucuauaa

SEQ ID NO: 18056 - RNA, 20 nt, Artificial Sequence
  TRAC targeting sequence
cauagaaggcauuuuacaau

SEQ ID NO: 18057 - RNA, 20 nt, Artificial Sequence
  TRAC targeting sequence
cucuauaaaauguuagacug

SEQ ID NO: 18058 - RNA, 20 nt, Artificial Sequence
  TRAC targeting sequence
auaaaauguuagacugagua

SEQ ID NO: 18059 - RNA, 20 nt, Artificial Sequence
  TRAC targeting sequence
aacauuuuauagagugauag

SEQ ID NO: 18060 - RNA, 20 nt, Artificial Sequence
  TRAC targeting sequence
gucuaacauuuuauagagug

SEQ ID NO: 18061 - RNA, 20 nt, Artificial Sequence
  TRAC targeting sequence
uacucagucuaacauuuuau

SEQ ID NO: 18062 - RNA, 20 nt, Artificial Sequence
  TRAC targeting sequence
cacuucauacucagucuaac

SEQ ID NO: 18063 - RNA, 20 nt, Artificial Sequence
  TRAC targeting sequence
cacacuucauacucagucua

SEQ ID NO: 18064 - RNA, 20 nt, Artificial Sequence
  TRAC targeting sequence
aucucacacuucauacucag

SEQ ID NO: 18065 - RNA, 20 nt, Artificial Sequence
  TRAC targeting sequence
uguccuguccucaaguggua

SEQ ID NO: 18066 - RNA, 20 nt, Artificial Sequence
  TRAC targeting sequence
uguccucaagugguauaaaa

SEQ ID NO: 18067 - RNA, 20 nt, Artificial Sequence
  TRAC targeting sequence
ucaagugguauaaaaacuag

SEQ ID NO: 18068 - RNA, 20 nt, Artificial Sequence
  TRAC targeting sequence
agugguauaaaaacuagaca

SEQ ID NO: 18069 - RNA, 20 nt, Artificial Sequence
  TRAC targeting sequence
aguuuuuauaccacuugagg

SEQ ID NO: 18070 - RNA, 20 nt, Artificial Sequence
  TRAC targeting sequence
guaccuuugucuaguuuuua

SEQ ID NO: 18071 - RNA, 20 nt, Artificial Sequence
  TRAC targeting sequence
ggcugcuuaauuuacaauag

SEQ ID NO: 18072 - RNA, 20 nt, Artificial Sequence
  TRAC targeting sequence
auacuaaaauaguuuucugg

SEQ ID NO: 18073 - RNA, 20 nt, Artificial Sequence
  TRAC targeting sequence
acuggucaauacuaaaauag

SEQ ID NO: 18074 - RNA, 20 nt, Artificial Sequence
  TRAC targeting sequence
ucaacuggucaauacuaaaa

SEQ ID NO: 18075 - RNA, 20 nt, Artificial Sequence
  TRAC targeting sequence
auggacacaauagagauuca

SEQ ID NO: 18076 - RNA, 20 nt, Artificial Sequence
  TRAC targeting sequence
auugacaucaucaacugguc

SEQ ID NO: 18077 - RNA, 20 nt, Artificial Sequence
  TRAC targeting sequence
auuguguccauugacaucau

SEQ ID NO: 18078 - RNA, 20 nt, Artificial Sequence
  TRAC targeting sequence
cuauuguguccauugacauc

SEQ ID NO: 18079 - RNA, 20 nt, Artificial Sequence
  TRAC targeting sequence
gaggggauagggugcuggcu

SEQ ID NO: 18080 - RNA, 20 nt, Artificial Sequence
  TRAC targeting sequence
gaaucucuauuguguccauu

SEQ ID NO: 18081 - RNA, 20 nt, Artificial Sequence
  TRAC targeting sequence
ccucugaaucucuauugugu

SEQ ID NO: 18082 - RNA, 20 nt, Artificial Sequence
  TRAC targeting sequence
gccagcacccuauccccucu

SEQ ID NO: 18083 - RNA, 20 nt, Artificial Sequence
  TRAC targeting sequence
cagccagcacccuauccccu

SEQ ID NO: 18084 - RNA, 20 nt, Artificial Sequence
  TRAC targeting sequence
aggccaacuucucagccagc

SEQ ID NO: 18085 - RNA, 20 nt, Artificial Sequence
  TRAC targeting sequence
gucuaggccaacuucucagc

SEQ ID NO: 18086 - RNA, 20 nt, Artificial Sequence
  TRAC targeting sequence
cagucuaggccaacuucuca

SEQ ID NO: 18087 - RNA, 20 nt, Artificial Sequence
  TRAC targeting sequence
ugugguacaaaggauucauu

SEQ ID NO: 18088 - RNA, 20 nt, Artificial Sequence
  TRAC targeting sequence
uuuguaccacaggaaacuuc

SEQ ID NO: 18089 - RNA, 20 nt, Artificial Sequence
  TRAC targeting sequence
uugagcccugaaggauggau

SEQ ID NO: 18090 - RNA, 20 nt, Artificial Sequence
  TRAC targeting sequence
augaauccuuuguaccacag

SEQ ID NO: 18091 - RNA, 20 nt, Artificial Sequence
  TRAC targeting sequence
gggcucaaugaauccuuugu

SEQ ID NO: 18092 - RNA, 20 nt, Artificial Sequence
  TRAC targeting sequence
uucagggcucaaugaauccu

SEQ ID NO: 18093 - RNA, 20 nt, Artificial Sequence
  TRAC targeting sequence
auccuucagggcucaaugaa

SEQ ID NO: 18094 - RNA, 20 nt, Artificial Sequence
  TRAC targeting sequence
uauccauccuucagggcuca

SEQ ID NO: 18095 - RNA, 20 nt, Artificial Sequence
  TRAC targeting sequence
guaugggcagagaaaggaga

SEQ ID NO: 18096 - RNA, 20 nt, Artificial Sequence
  TRAC targeting sequence
gcccauacagaucuuaucca

SEQ ID NO: 18097 - RNA, 20 nt, Artificial Sequence
  TRAC targeting sequence
cugcccauacagaucuuauc

SEQ ID NO: 18098 - RNA, 20 nt, Artificial Sequence
  TRAC targeting sequence
uuucucugcccauacagauc

SEQ ID NO: 18099 - RNA, 20 nt, Artificial Sequence
  TRAC targeting sequence
ccuuucucugcccauacaga

SEQ ID NO: 18100 - RNA, 20 nt, Artificial Sequence
  TRAC targeting sequence
cuccuuucucugcccauaca

SEQ ID NO: 18101 - RNA, 20 nt, Artificial Sequence
  TRAC targeting sequence
cuucucuccuuucucugccc

SEQ ID NO: 18102 - RNA, 20 nt, Artificial Sequence
  TRAC targeting sequence
gggcguagggaacgacaaga

SEQ ID NO: 18103 - RNA, 20 nt, Artificial Sequence
  TRAC targeting sequence
cuacgcccagaacuucccuu

SEQ ID NO: 18104 - RNA, 20 nt, Artificial Sequence
  TRAC targeting sequence
uucccuacgcccagaacuuc

SEQ ID NO: 18105 - RNA, 20 nt, Artificial Sequence
  TRAC targeting sequence
ugucguucccuacgcccaga

SEQ ID NO: 18106 - RNA, 20 nt, Artificial Sequence
  TRAC targeting sequence
uucuugucguucccuacgcc

SEQ ID NO: 18107 - RNA, 20 nt, Artificial Sequence
  TRAC targeting sequence
ugccuucuuucuugucguuc

SEQ ID NO: 18108 - RNA, 20 nt, Artificial Sequence
  TRAC targeting sequence
ugggaauaaucaaggcacau

SEQ ID NO: 18109 - RNA, 20 nt, Artificial Sequence
  TRAC targeting sequence
caagaucaugccuucuuucu

SEQ ID NO: 18110 - RNA, 20 nt, Artificial Sequence
  TRAC targeting sequence
aggcacaugcaaaguagccu

SEQ ID NO: 18111 - RNA, 20 nt, Artificial Sequence
  TRAC targeting sequence
gauaauaaaauugguugaaa

SEQ ID NO: 18112 - RNA, 20 nt, Artificial Sequence
  TRAC targeting sequence
gauguauacuuaggcuacuu

SEQ ID NO: 18113 - RNA, 20 nt, Artificial Sequence
  TRAC targeting sequence
accaauuuuauuaucagaug

SEQ ID NO: 18114 - RNA, 20 nt, Artificial Sequence
  TRAC targeting sequence
gagaagaugucuuuuuaggc

SEQ ID NO: 18115 - RNA, 20 nt, Artificial Sequence
  TRAC targeting sequence
gacuacuuuucaaccaauuu

SEQ ID NO: 18116 - RNA, 20 nt, Artificial Sequence
  TRAC targeting sequence
cugacuacuuuucaaccaau

SEQ ID NO: 18117 - RNA, 20 nt, Artificial Sequence
  TRAC targeting sequence
ucucugacuacuuuucaacc

SEQ ID NO: 18118 - RNA, 20 nt, Artificial Sequence
  TRAC targeting sequence
uuuuaggcauggaaaaagga

SEQ ID NO: 18119 - RNA, 20 nt, Artificial Sequence
  TRAC targeting sequence
augccuaaaaagacaucuuc

SEQ ID NO: 18120 - RNA, 20 nt, Artificial Sequence
  TRAC targeting sequence
uuuuuccaugccuaaaaaga

SEQ ID NO: 18121 - RNA, 20 nt, Artificial Sequence
  TRAC targeting sequence
aguauuuccuuuuuccaugc

SEQ ID NO: 18122 - RNA, 20 nt, Artificial Sequence
  TRAC targeting sequence
acagaauacagaaauuaggg

SEQ ID NO: 18123 - RNA, 20 nt, Artificial Sequence
  TRAC targeting sequence
guugaaugcucuaguauuuc

SEQ ID NO: 18124 - RNA, 20 nt, Artificial Sequence
  TRAC targeting sequence
guauucuguugaaugcucua

SEQ ID NO: 18125 - RNA, 20 nt, Artificial Sequence
  TRAC targeting sequence
caauggcuggcccuggcccu

SEQ ID NO: 18126 - RNA, 20 nt, Artificial Sequence
  TRAC targeting sequence
guuucccaauggcuggcccu

SEQ ID NO: 18127 - RNA, 20 nt, Artificial Sequence
  TRAC targeting sequence
caguuucccaauggcuggcc

SEQ ID NO: 18128 - RNA, 20 nt, Artificial Sequence
  TRAC targeting sequence
gauuuagagaugcagacuag

SEQ ID NO: 18129 - RNA, 20 nt, Artificial Sequence
  TRAC targeting sequence
gauucucaguuucccaaugg

SEQ ID NO: 18130 - RNA, 20 nt, Artificial Sequence
  TRAC targeting sequence
aaaucggauucucaguuucc

SEQ ID NO: 18131 - RNA, 20 nt, Artificial Sequence
  TRAC targeting sequence
cuaaaucggauucucaguuu

SEQ ID NO: 18132 - RNA, 20 nt, Artificial Sequence
  TRAC targeting sequence
gcaucucuaaaucggauucu

SEQ ID NO: 18133 - RNA, 20 nt, Artificial Sequence
  TRAC targeting sequence
agucugcaucucuaaaucgg

SEQ ID NO: 18134 - RNA, 20 nt, Artificial Sequence
  TRAC targeting sequence
cuucuagucugcaucucuaa

SEQ ID NO: 18135 - RNA, 20 nt, Artificial Sequence
  TRAC targeting sequence
ccuucacuucuagucugcau

SEQ ID NO: 18136 - RNA, 20 nt, Artificial Sequence
  TRAC targeting sequence
caccuucacuucuagucugc

SEQ ID NO: 18137 - RNA, 20 nt, Artificial Sequence
  TRAC targeting sequence
gcggcaccauagcuggcugc

SEQ ID NO: 18138 - RNA, 20 nt, Artificial Sequence
  TRAC targeting sequence
ccucuccuuccucagugggc

SEQ ID NO: 18139 - RNA, 20 nt, Artificial Sequence
  TRAC targeting sequence
ccuuccucagugggcucuga

SEQ ID NO: 18140 - RNA, 20 nt, Artificial Sequence
  TRAC targeting sequence
uuccucagugggcucugaga

SEQ ID NO: 18141 - RNA, 20 nt, Artificial Sequence
  TRAC targeting sequence
ucagugggcucugagagggg

SEQ ID NO: 18142 - RNA, 20 nt, Artificial Sequence
  TRAC targeting sequence
gugggcucugagagggguca

SEQ ID NO: 18143 - RNA, 20 nt, Artificial Sequence
  TRAC targeting sequence
gagaggggucaucccacacc

SEQ ID NO: 18144 - RNA, 20 nt, Artificial Sequence
  TRAC targeting sequence
gagcccacugaggaaggaga

SEQ ID NO: 18145 - RNA, 20 nt, Artificial Sequence
  TRAC targeting sequence
cagagcccacugaggaagga

SEQ ID NO: 18146 - RNA, 20 nt, Artificial Sequence
  TRAC targeting sequence
ucccacaccuuagaggagga

SEQ ID NO: 18147 - RNA, 20 nt, Artificial Sequence
  TRAC targeting sequence
cacaccuuagaggaggagaa

SEQ ID NO: 18148 - RNA, 20 nt, Artificial Sequence
  TRAC targeting sequence
aaggugugggaugaccccuc

SEQ ID NO: 18149 - RNA, 20 nt, Artificial Sequence
  TRAC targeting sequence
ucuaaggugugggaugaccc

SEQ ID NO: 18150 - RNA, 20 nt, Artificial Sequence
  TRAC targeting sequence
uccucuaaggugugggauga

SEQ ID NO: 18151 - RNA, 20 nt, Artificial Sequence
  TRAC targeting sequence
ccuccucuaaggugugggau

SEQ ID NO: 18152 - RNA, 20 nt, Artificial Sequence
  TRAC targeting sequence
cuuagguuucuccuccucua

SEQ ID NO: 18153 - RNA, 20 nt, Artificial Sequence
  TRAC targeting sequence
guaauagagacacggggcau

SEQ ID NO: 18154 - RNA, 20 nt, Artificial Sequence
  TRAC targeting sequence
auuacagaaucccuuagguu

SEQ ID NO: 18155 - RNA, 20 nt, Artificial Sequence
  TRAC targeting sequence
cuauuacagaaucccuuagg

SEQ ID NO: 18156 - RNA, 20 nt, Artificial Sequence
  TRAC targeting sequence
uaccaugccccgugucucua

SEQ ID NO: 18157 - RNA, 20 nt, Artificial Sequence
  TRAC targeting sequence
caguugcaauuuggcaaagg

SEQ ID NO: 18158 - RNA, 20 nt, Artificial Sequence
  TRAC targeting sequence
uuugccaaauugcaacuggg

SEQ ID NO: 18159 - RNA, 20 nt, Artificial Sequence
  TRAC targeting sequence
gguuccuuugccaaauugca

SEQ ID NO: 18160 - RNA, 20 nt, Artificial Sequence
  TRAC targeting sequence
acuucuccccguacgucugc

SEQ ID NO: 18161 - RNA, 20 nt, Artificial Sequence
  TRAC targeting sequence
ccccguacgucugcccaugc

SEQ ID NO: 18162 - RNA, 20 nt, Artificial Sequence
  TRAC targeting sequence
ccguacgucugcccaugccc

SEQ ID NO: 18163 - RNA, 20 nt, Artificial Sequence
  TRAC targeting sequence
gcccaugcccacaguuuccu

SEQ ID NO: 18164 - RNA, 20 nt, Artificial Sequence
  TRAC targeting sequence
ugaugcucacuaaagccucg

SEQ ID NO: 18165 - RNA, 20 nt, Artificial Sequence
  TRAC targeting sequence
ggaaacugugggcaugggca

SEQ ID NO: 18166 - RNA, 20 nt, Artificial Sequence
  TRAC targeting sequence
cuaaagccucggugggaccc

SEQ ID NO: 18167 - RNA, 20 nt, Artificial Sequence
  TRAC targeting sequence
gugggacccagagugacugu

SEQ ID NO: 18168 - RNA, 20 nt, Artificial Sequence
  TRAC targeting sequence
caccgaggcuuuagugagca

SEQ ID NO: 18169 - RNA, 20 nt, Artificial Sequence
  TRAC targeting sequence
gggucccaccgaggcuuuag

SEQ ID NO: 18170 - RNA, 20 nt, Artificial Sequence
  TRAC targeting sequence
cucugggucccaccgaggcu

SEQ ID NO: 18171 - RNA, 20 nt, Artificial Sequence
  TRAC targeting sequence
cuaauucugauuucuggguc

SEQ ID NO: 18172 - RNA, 20 nt, Artificial Sequence
  TRAC targeting sequence
gauuucugggucccuagugc

SEQ ID NO: 18173 - RNA, 20 nt, Artificial Sequence
  TRAC targeting sequence
gaauuagugacagucacucu

SEQ ID NO: 18174 - RNA, 20 nt, Artificial Sequence
  TRAC targeting sequence
gggucccuagugcccaaaca

SEQ ID NO: 18175 - RNA, 20 nt, Artificial Sequence
  TRAC targeting sequence
cuagugcccaaacacggggg

SEQ ID NO: 18176 - RNA, 20 nt, Artificial Sequence
  TRAC targeting sequence
cccguguuugggcacuaggg

SEQ ID NO: 18177 - RNA, 20 nt, Artificial Sequence
  TRAC targeting sequence
gucccccguguuugggcacu

SEQ ID NO: 18178 - RNA, 20 nt, Artificial Sequence
  TRAC targeting sequence
uuaccauuaaaucugucccc

SEQ ID NO: 18179 - RNA, 20 nt, Artificial Sequence
  TRAC targeting sequence
aucacugcugugucccuagg

SEQ ID NO: 18180 - RNA, 20 nt, Artificial Sequence
  TRAC targeting sequence
cugcugugucccuagggauc

SEQ ID NO: 18181 - RNA, 20 nt, Artificial Sequence
  TRAC targeting sequence
cuagggaucuaaagcacuag

SEQ ID NO: 18182 - RNA, 20 nt, Artificial Sequence
  TRAC targeting sequence
cuagggacacagcagugauu

SEQ ID NO: 18183 - RNA, 20 nt, Artificial Sequence
  TRAC targeting sequence
aaagcacuagagcacaugug

SEQ ID NO: 18184 - RNA, 20 nt, Artificial Sequence
  TRAC targeting sequence
agugcuuuagaucccuaggg

SEQ ID NO: 18185 - RNA, 20 nt, Artificial Sequence
  TRAC targeting sequence
gcaguucauuuugaauuuaa

SEQ ID NO: 18186 - RNA, 20 nt, Artificial Sequence
  TRAC targeting sequence
uuuugaauuuaaaggacagc

SEQ ID NO: 18187 - RNA, 20 nt, Artificial Sequence
  TRAC targeting sequence
aaaugaacugcagaagcaca

SEQ ID NO: 18188 - RNA, 20 nt, Artificial Sequence
  TRAC targeting sequence
uuuaaauucaaaaugaacug

SEQ ID NO: 18189 - RNA, 20 nt, Artificial Sequence
  TRAC targeting sequence
uaagcuguccuuuaaauuca

SEQ ID NO: 18190 - RNA, 20 nt, Artificial Sequence
  TRAC targeting sequence
agaauagcugaauuuccacc

SEQ ID NO: 18191 - RNA, 20 nt, Artificial Sequence
  TRAC targeting sequence
agauccuaagcuguccuuua

SEQ ID NO: 18192 - RNA, 20 nt, Artificial Sequence
  TRAC targeting sequence
gcuauucuagauccuaagcu

SEQ ID NO: 18193 - RNA, 20 nt, Artificial Sequence
  TRAC targeting sequence
accucaaaacauugguuccg

SEQ ID NO: 18194 - RNA, 20 nt, Artificial Sequence
  TRAC targeting sequence
aaacauugguuccgucuugc

SEQ ID NO: 18195 - RNA, 20 nt, Artificial Sequence
  TRAC targeting sequence
gucuugccaagccuaccuuc

SEQ ID NO: 18196 - RNA, 20 nt, Artificial Sequence
  TRAC targeting sequence
ugccaagccuaccuucugau

SEQ ID NO: 18197 - RNA, 20 nt, Artificial Sequence
  TRAC targeting sequence
gauaucaucagugaugggau

SEQ ID NO: 18198 - RNA, 20 nt, Artificial Sequence
  TRAC targeting sequence
gaagguaggcuuggcaagac

SEQ ID NO: 18199 - RNA, 20 nt, Artificial Sequence
  TRAC targeting sequence
ucagugaugggauguguuuu

SEQ ID NO: 18200 - RNA, 20 nt, Artificial Sequence
  TRAC targeting sequence
gugaugggauguguuuuucu

SEQ ID NO: 18201 - RNA, 20 nt, Artificial Sequence
  TRAC targeting sequence
cugaugauaucagaagguag

SEQ ID NO: 18202 - RNA, 20 nt, Artificial Sequence
  TRAC targeting sequence
caucacugaugauaucagaa

SEQ ID NO: 18203 - RNA, 20 nt, Artificial Sequence
  TRAC targeting sequence
uacuaggguagaauaggaug

SEQ ID NO: 18204 - RNA, 20 nt, Artificial Sequence
  TRAC targeting sequence
acccuaguaagaaaaacaca

SEQ ID NO: 18205 - RNA, 20 nt, Artificial Sequence
  TRAC targeting sequence
uauucuacccuaguaagaaa

SEQ ID NO: 18206 - RNA, 20 nt, Artificial Sequence
  TRAC targeting sequence
cuccccaaaggacucuggca

SEQ ID NO: 18207 - RNA, 20 nt, Artificial Sequence
  TRAC targeting sequence
ccccaaaggacucuggcaga

SEQ ID NO: 18208 - RNA, 20 nt, Artificial Sequence
  TRAC targeting sequence
ccaaaggacucuggcagaca

SEQ ID NO: 18209 - RNA, 20 nt, Artificial Sequence
  TRAC targeting sequence
uuuggggagagacauccuau

SEQ ID NO: 18210 - RNA, 20 nt, Artificial Sequence
  TRAC targeting sequence
ggcagacagaccccuaaaca

SEQ ID NO: 18211 - RNA, 20 nt, Artificial Sequence
  TRAC targeting sequence
gccagaguccuuuggggaga

SEQ ID NO: 18212 - RNA, 20 nt, Artificial Sequence
  TRAC targeting sequence
gucugccagaguccuuuggg

SEQ ID NO: 18213 - RNA, 20 nt, Artificial Sequence
  TRAC targeting sequence
aaauuaaaagcggcaaagag

SEQ ID NO: 18214 - RNA, 20 nt, Artificial Sequence
  TRAC targeting sequence
uugccgcuuuuaauuuggag

SEQ ID NO: 18215 - RNA, 20 nt, Artificial Sequence
  TRAC targeting sequence
cuuugccgcuuuuaauuugg

SEQ ID NO: 18216 - RNA, 20 nt, Artificial Sequence
  TRAC targeting sequence
accuuaucucuuugccgcuu

SEQ ID NO: 18217 - RNA, 20 nt, Artificial Sequence
  TRAC targeting sequence
aguucaaccuuaucucuuug

SEQ ID NO: 18218 - RNA, 20 nt, Artificial Sequence
  TRAC targeting sequence
ccauguacgucuaguucaac

SEQ ID NO: 18219 - RNA, 20 nt, Artificial Sequence
  TRAC targeting sequence
cauguaccuuuuauacuuuu

SEQ ID NO: 18220 - RNA, 20 nt, Artificial Sequence
  TRAC targeting sequence
uucccauguaccuuuuauac

SEQ ID NO: 18221 - RNA, 20 nt, Artificial Sequence
  TRAC targeting sequence
uuucauucccauguaccuuu

SEQ ID NO: 18222 - RNA, 20 nt, Artificial Sequence
  TRAC targeting sequence
aacucagccccuguugccau

SEQ ID NO: 18223 - RNA, 20 nt, Artificial Sequence
  TRAC targeting sequence
gccccuguugccauuucuca

SEQ ID NO: 18224 - RNA, 20 nt, Artificial Sequence
  TRAC targeting sequence
cagagucuuguguucugugg

SEQ ID NO: 18225 - RNA, 20 nt, Artificial Sequence
  TRAC targeting sequence
gagucuuguguucuguggca

SEQ ID NO: 18226 - RNA, 20 nt, Artificial Sequence
  TRAC targeting sequence
gagaaauggcaacaggggcu

SEQ ID NO: 18227 - RNA, 20 nt, Artificial Sequence
  TRAC targeting sequence
uguguucuguggcauugcgc

SEQ ID NO: 18228 - RNA, 20 nt, Artificial Sequence
  TRAC targeting sequence
guggcauugcgcuuucuaga

SEQ ID NO: 18229 - RNA, 20 nt, Artificial Sequence
  TRAC targeting sequence
agaccaacaguguccaauag

SEQ ID NO: 18230 - RNA, 20 nt, Artificial Sequence
  TRAC targeting sequence
agaaagcgcaaugccacaga

SEQ ID NO: 18231 - RNA, 20 nt, Artificial Sequence
  TRAC targeting sequence
aauagaacuuucuguggcaa

SEQ ID NO: 18232 - RNA, 20 nt, Artificial Sequence
  TRAC targeting sequence
auuggacacuguuggucuag

SEQ ID NO: 18233 - RNA, 20 nt, Artificial Sequence
  TRAC targeting sequence
guggcaauggaaauguccug

SEQ ID NO: 18234 - RNA, 20 nt, Artificial Sequence
  TRAC targeting sequence
auugccacagaaaguucuau

SEQ ID NO: 18235 - RNA, 20 nt, Artificial Sequence
  TRAC targeting sequence
ugucaaucugcacuguccca

SEQ ID NO: 18236 - RNA, 20 nt, Artificial Sequence
  TRAC targeting sequence
aucugcacugucccauacaa

SEQ ID NO: 18237 - RNA, 20 nt, Artificial Sequence
  TRAC targeting sequence
gcacugucccauacaauagc

SEQ ID NO: 18238 - RNA, 20 nt, Artificial Sequence
  TRAC targeting sequence
cauacaauagccaccagcua

SEQ ID NO: 18239 - RNA, 20 nt, Artificial Sequence
  TRAC targeting sequence
auagccacauguagcuggug

SEQ ID NO: 18240 - RNA, 20 nt, Artificial Sequence
  TRAC targeting sequence
ugaaaugaaguuuccauuuu

SEQ ID NO: 18241 - RNA, 20 nt, Artificial Sequence
  TRAC targeting sequence
agagcucaauagccacaugu

SEQ ID NO: 18242 - RNA, 20 nt, Artificial Sequence
  TRAC targeting sequence
uuucaagagcucaauagcca

SEQ ID NO: 18243 - RNA, 20 nt, Artificial Sequence
  TRAC targeting sequence
auuuuuaauugaaaacauuu

SEQ ID NO: 18244 - RNA, 20 nt, Artificial Sequence
  TRAC targeting sequence
auuaaaaauggaaacuucau

SEQ ID NO: 18245 - RNA, 20 nt, Artificial Sequence
  TRAC targeting sequence
cauugacuaauuuuuauuuc

SEQ ID NO: 18246 - RNA, 20 nt, Artificial Sequence
  TRAC targeting sequence
augugaaauaaaauguuuuc

SEQ ID NO: 18247 - RNA, 20 nt, Artificial Sequence
  TRAC targeting sequence
acagccacauguagcuagag

SEQ ID NO: 18248 - RNA, 20 nt, Artificial Sequence
  TRAC targeting sequence
agcuacauguggcuguugaa

SEQ ID NO: 18249 - RNA, 20 nt, Artificial Sequence
  TRAC targeting sequence
cuagcuacauguggcuguug

SEQ ID NO: 18250 - RNA, 20 nt, Artificial Sequence
  TRAC targeting sequence
gguauaauagucucuagcua

SEQ ID NO: 18251 - RNA, 20 nt, Artificial Sequence
  TRAC targeting sequence
gucugguauaauagucucua

SEQ ID NO: 18252 - RNA, 20 nt, Artificial Sequence
  TRAC targeting sequence
aggcugcucugucugguaua

SEQ ID NO: 18253 - RNA, 20 nt, Artificial Sequence
  TRAC targeting sequence
ucuccagucugacacccacc

SEQ ID NO: 18254 - RNA, 20 nt, Artificial Sequence
  TRAC targeting sequence
ccagucugacacccaccagc

SEQ ID NO: 18255 - RNA, 20 nt, Artificial Sequence
  TRAC targeting sequence
agucugacacccaccagccc

SEQ ID NO: 18256 - RNA, 20 nt, Artificial Sequence
  TRAC targeting sequence
gacacccaccagccccagga

SEQ ID NO: 18257 - RNA, 20 nt, Artificial Sequence
  TRAC targeting sequence
gacuggagaagaucuaggcu

SEQ ID NO: 18258 - RNA, 20 nt, Artificial Sequence
  TRAC targeting sequence
uggggcuggugggugucaga

SEQ ID NO: 18259 - RNA, 20 nt, Artificial Sequence
  TRAC targeting sequence
aguccuggggcuggugggug

SEQ ID NO: 18260 - RNA, 20 nt, Artificial Sequence
  TRAC targeting sequence
cucaaguccuggggcuggug

SEQ ID NO: 18261 - RNA, 20 nt, Artificial Sequence
  TRAC targeting sequence
ugguuaaacacucacucaag

SEQ ID NO: 18262 - RNA, 20 nt, Artificial Sequence
  TRAC targeting sequence
aaguuggguuucugccccac

SEQ ID NO: 18263 - RNA, 20 nt, Artificial Sequence
  TRAC targeting sequence
gccccacaaggccacccccu

SEQ ID NO: 18264 - RNA, 20 nt, Artificial Sequence
  TRAC targeting sequence
ucuuuaaagccaaccugcau

SEQ ID NO: 18265 - RNA, 20 nt, Artificial Sequence
  TRAC targeting sequence
uuaaagccaaccugcaucug

SEQ ID NO: 18266 - RNA, 20 nt, Artificial Sequence
  TRAC targeting sequence
gguggccccugauccccugc

SEQ ID NO: 18267 - RNA, 20 nt, Artificial Sequence
  TRAC targeting sequence
ggggccaccagaugcagguu

SEQ ID NO: 18268 - RNA, 20 nt, Artificial Sequence
  TRAC targeting sequence
ccugccuugaggaucggcac

SEQ ID NO: 18269 - RNA, 20 nt, Artificial Sequence
  TRAC targeting sequence
aggcaggggaucaggggcca

SEQ ID NO: 18270 - RNA, 20 nt, Artificial Sequence
  TRAC targeting sequence
ucaaggcaggggaucagggg

SEQ ID NO: 18271 - RNA, 20 nt, Artificial Sequence
  TRAC targeting sequence
gcacuuccagacuccucucc

SEQ ID NO: 18272 - RNA, 20 nt, Artificial Sequence
  TRAC targeting sequence
agacuccucucccccucugc

SEQ ID NO: 18273 - RNA, 20 nt, Artificial Sequence
  TRAC targeting sequence
ggaagugccgauccucaagg

SEQ ID NO: 18274 - RNA, 20 nt, Artificial Sequence
  TRAC targeting sequence
ucucccccucugcagugcug

SEQ ID NO: 18275 - RNA, 20 nt, Artificial Sequence
  TRAC targeting sequence
cccccucugcagugcugucc

SEQ ID NO: 18276 - RNA, 20 nt, Artificial Sequence
  TRAC targeting sequence
cccucugcagugcuguccag

SEQ ID NO: 18277 - RNA, 20 nt, Artificial Sequence
  TRAC targeting sequence
gcagugcuguccaguacccc

SEQ ID NO: 18278 - RNA, 20 nt, Artificial Sequence
  TRAC targeting sequence
aguacccccacugaugacua

SEQ ID NO: 18279 - RNA, 20 nt, Artificial Sequence
  TRAC targeting sequence
guggggguacuggacagcac

SEQ ID NO: 18280 - RNA, 20 nt, Artificial Sequence
  TRAC targeting sequence
ucaguggggguacuggacag

SEQ ID NO: 18281 - RNA, 20 nt, Artificial Sequence
  TRAC targeting sequence
gggggauguguugguagagc

SEQ ID NO: 18282 - RNA, 20 nt, Artificial Sequence
  TRAC targeting sequence
cccugauuguuagucaucag

SEQ ID NO: 18283 - RNA, 20 nt, Artificial Sequence
  TRAC targeting sequence
accaacacaucccccugauu

SEQ ID NO: 18284 - RNA, 20 nt, Artificial Sequence
  TRAC targeting sequence
gucugucccuucccagcaaa

SEQ ID NO: 18285 - RNA, 20 nt, Artificial Sequence
  TRAC targeting sequence
gucccuucccagcaaaggaa

SEQ ID NO: 18286 - RNA, 20 nt, Artificial Sequence
  TRAC targeting sequence
cuucccagcaaaggaacuau

SEQ ID NO: 18287 - RNA, 20 nt, Artificial Sequence
  TRAC targeting sequence
cagcaaaggaacuaugccuu

SEQ ID NO: 18288 - RNA, 20 nt, Artificial Sequence
  TRAC targeting sequence
uuugcugggaagggacagac

SEQ ID NO: 18289 - RNA, 20 nt, Artificial Sequence
  TRAC targeting sequence
cccagagugaugucaggcug

SEQ ID NO: 18290 - RNA, 20 nt, Artificial Sequence
  TRAC targeting sequence
gggugaaggcccuaaggcau

SEQ ID NO: 18291 - RNA, 20 nt, Artificial Sequence
  TRAC targeting sequence
cucugggugaaggcccuaag

SEQ ID NO: 18292 - RNA, 20 nt, Artificial Sequence
  TRAC targeting sequence
ggcugcccaagcaugaggag

SEQ ID NO: 18293 - RNA, 20 nt, Artificial Sequence
  TRAC targeting sequence
ugcuugggcagccugacauc

SEQ ID NO: 18294 - RNA, 20 nt, Artificial Sequence
  TRAC targeting sequence
ucaugcuugggcagccugac

SEQ ID NO: 18295 - RNA, 20 nt, Artificial Sequence
  TRAC targeting sequence
cuccucaugcuugggcagcc

SEQ ID NO: 18296 - RNA, 20 nt, Artificial Sequence
  TRAC targeting sequence
gccuacuucccuccucaugc

SEQ ID NO: 18297 - RNA, 20 nt, Artificial Sequence
  TRAC targeting sequence
ucuggagccaaagcucugga

SEQ ID NO: 18298 - RNA, 20 nt, Artificial Sequence
  TRAC targeting sequence
ggagccaaagcucuggaugu

SEQ ID NO: 18299 - RNA, 20 nt, Artificial Sequence
  TRAC targeting sequence
agaggauucugccuacuucc

SEQ ID NO: 18300 - RNA, 20 nt, Artificial Sequence
  TRAC targeting sequence
ggaugucucuccccucugac

SEQ ID NO: 18301 - RNA, 20 nt, Artificial Sequence
  TRAC targeting sequence
agagcuuuggcuccagagga

SEQ ID NO: 18302 - RNA, 20 nt, Artificial Sequence
  TRAC targeting sequence
cuccccucugaccauggagc

SEQ ID NO: 18303 - RNA, 20 nt, Artificial Sequence
  TRAC targeting sequence
ccccucugaccauggagccc

SEQ ID NO: 18304 - RNA, 20 nt, Artificial Sequence
  TRAC targeting sequence
ccucugaccauggagcccac

SEQ ID NO: 18305 - RNA, 20 nt, Artificial Sequence
  TRAC targeting sequence
gaccauggagcccaccccug

SEQ ID NO: 18306 - RNA, 20 nt, Artificial Sequence
  TRAC targeting sequence
gaggggagagacauccagag

SEQ ID NO: 18307 - RNA, 20 nt, Artificial Sequence
  TRAC targeting sequence
auggucagaggggagagaca

SEQ ID NO: 18308 - RNA, 20 nt, Artificial Sequence
  TRAC targeting sequence
acugcuccagggacagcccu

SEQ ID NO: 18309 - RNA, 20 nt, Artificial Sequence
  TRAC targeting sequence
agggacagcccuaugcugca

SEQ ID NO: 18310 - RNA, 20 nt, Artificial Sequence
  TRAC targeting sequence
cuggagcaguggagcagggg

SEQ ID NO: 18311 - RNA, 20 nt, Artificial Sequence
  TRAC targeting sequence
gcccccacucagcaucccag

SEQ ID NO: 18312 - RNA, 20 nt, Artificial Sequence
  TRAC targeting sequence
gcaucccaggggcugauuuc

SEQ ID NO: 18313 - RNA, 20 nt, Artificial Sequence
  TRAC targeting sequence
caggggcugauuucuuuggu

SEQ ID NO: 18314 - RNA, 20 nt, Artificial Sequence
  TRAC targeting sequence
gccccugggaugcugagugg

SEQ ID NO: 18315 - RNA, 20 nt, Artificial Sequence
  TRAC targeting sequence
uugguuuuggauccagcugg

SEQ ID NO: 18316 - RNA, 20 nt, Artificial Sequence
  TRAC targeting sequence
aaaaccaaagaaaucagccc

SEQ ID NO: 18317 - RNA, 20 nt, Artificial Sequence
  TRAC targeting sequence
agcuggaugucugcauugcc

SEQ ID NO: 18318 - RNA, 20 nt, Artificial Sequence
  TRAC targeting sequence
agcuggauccaaaaccaaag

SEQ ID NO: 18319 - RNA, 20 nt, Artificial Sequence
  TRAC targeting sequence
gcauugccgaggccaccagg

SEQ ID NO: 18320 - RNA, 20 nt, Artificial Sequence
  TRAC targeting sequence
gcaaugcagacauccagcug

SEQ ID NO: 18321 - RNA, 20 nt, Artificial Sequence
  TRAC targeting sequence
gcaacugucggggaaucacc

SEQ ID NO: 18322 - RNA, 20 nt, Artificial Sequence
  TRAC targeting sequence
gggaaucaccagggucugag

SEQ ID NO: 18323 - RNA, 20 nt, Artificial Sequence
  TRAC targeting sequence
ccgacaguugcugagccagc

SEQ ID NO: 18324 - RNA, 20 nt, Artificial Sequence
  TRAC targeting sequence
ccagggucugagaaaucuug

SEQ ID NO: 18325 - RNA, 20 nt, Artificial Sequence
  TRAC targeting sequence
gagaaaucuugugcgcaugu

SEQ ID NO: 18326 - RNA, 20 nt, Artificial Sequence
  TRAC targeting sequence
gacccuggugauuccccgac

SEQ ID NO: 18327 - RNA, 20 nt, Artificial Sequence
  TRAC targeting sequence
cagacccuggugauuccccg

SEQ ID NO: 18328 - RNA, 20 nt, Artificial Sequence
  TRAC targeting sequence
ugugcgcaugugaggggcug

SEQ ID NO: 18329 - RNA, 20 nt, Artificial Sequence
  TRAC targeting sequence
caugcgcacaagauuucuca

SEQ ID NO: 18330 - RNA, 20 nt, Artificial Sequence
  TRAC targeting sequence
cacagccccucacaugcgca

SEQ ID NO: 18331 - RNA, 20 nt, Artificial Sequence
  TRAC targeting sequence
gcucccacagccccucacau

SEQ ID NO: 18332 - RNA, 20 nt, Artificial Sequence
  TRAC targeting sequence
cugcucccacagccccucac

SEQ ID NO: 18333 - RNA, 20 nt, Artificial Sequence
  TRAC targeting sequence
cacccagugguucucugcuc

SEQ ID NO: 18334 - RNA, 20 nt, Artificial Sequence
  TRAC targeting sequence
aauccccacccugcuggaaa

SEQ ID NO: 18335 - RNA, 20 nt, Artificial Sequence
  TRAC targeting sequence
ccacccugcuggaaacucuc

SEQ ID NO: 18336 - RNA, 20 nt, Artificial Sequence
  TRAC targeting sequence
agcaggguggggauuagaau

SEQ ID NO: 18337 - RNA, 20 nt, Artificial Sequence
  TRAC targeting sequence
cuggguggccccaacaugcu

SEQ ID NO: 18338 - RNA, 20 nt, Artificial Sequence
  TRAC targeting sequence
ggguggccccaacaugcuaa

SEQ ID NO: 18339 - RNA, 20 nt, Artificial Sequence
  TRAC targeting sequence
uccggcaaaccucuguuucc

SEQ ID NO: 18340 - RNA, 20 nt, Artificial Sequence
  TRAC targeting sequence
ggcaaaccucuguuuccucc

SEQ ID NO: 18341 - RNA, 20 nt, Artificial Sequence
  TRAC targeting sequence
guuuccuccucaaaaggcag

SEQ ID NO: 18342 - RNA, 20 nt, Artificial Sequence
  TRAC targeting sequence
uccucaaaaggcaggagguc

SEQ ID NO: 18343 - RNA, 20 nt, Artificial Sequence
  TRAC targeting sequence
ucaaaaggcaggaggucgga

SEQ ID NO: 18344 - RNA, 20 nt, Artificial Sequence
  TRAC targeting sequence
aaaggcaggaggucggaaag

SEQ ID NO: 18345 - RNA, 20 nt, Artificial Sequence
  TRAC targeting sequence
ugccuuuugaggaggaaaca

SEQ ID NO: 18346 - RNA, 20 nt, Artificial Sequence
  TRAC targeting sequence
gaaagaauaaacaaugagag

SEQ ID NO: 18347 - RNA, 20 nt, Artificial Sequence
  TRAC targeting sequence
gaccuccugccuuuugagga

SEQ ID NO: 18348 - RNA, 20 nt, Artificial Sequence
  TRAC targeting sequence
uuccgaccuccugccuuuug

SEQ ID NO: 18349 - RNA, 20 nt, Artificial Sequence
  TRAC targeting sequence
uuguuuauucuuuccgaccu

SEQ ID NO: 18350 - RNA, 20 nt, Artificial Sequence
  TRAC targeting sequence
cauuguuuauucuuuccgac

SEQ ID NO: 18351 - RNA, 20 nt, Artificial Sequence
  TRAC targeting sequence
cauuaaaaacacaaaauccu

SEQ ID NO: 18352 - RNA, 20 nt, Artificial Sequence
  TRAC targeting sequence
uacggaaauacugaagaaug

SEQ ID NO: 18353 - RNA, 20 nt, Artificial Sequence
  TRAC targeting sequence
guaggauuuuguguuuuuaa

SEQ ID NO: 18354 - RNA, 20 nt, Artificial Sequence
  TRAC targeting sequence
guauuuccguaggauuuugu

SEQ ID NO: 18355 - RNA, 20 nt, Artificial Sequence
  TRAC targeting sequence
ucaguauuuccguaggauuu

SEQ ID NO: 18356 - RNA, 20 nt, Artificial Sequence
  TRAC targeting sequence
uucuucaguauuuccguagg

SEQ ID NO: 18357 - RNA, 20 nt, Artificial Sequence
  TRAC targeting sequence
cagcacuaaggaaaagccuc

SEQ ID NO: 18358 - RNA, 20 nt, Artificial Sequence
  TRAC targeting sequence
gcacuaaggaaaagccucca

SEQ ID NO: 18359 - RNA, 20 nt, Artificial Sequence
  TRAC targeting sequence
uuagugcugagacucauucu

SEQ ID NO: 18360 - RNA, 20 nt, Artificial Sequence
  TRAC targeting sequence
agcagcuccugcuuucugag

SEQ ID NO: 18361 - RNA, 20 nt, Artificial Sequence
  TRAC targeting sequence
ugcuuucugagggugaagga

SEQ ID NO: 18362 - RNA, 20 nt, Artificial Sequence
  TRAC targeting sequence
gagggugaaggauagacgcu

SEQ ID NO: 18363 - RNA, 20 nt, Artificial Sequence
  TRAC targeting sequence
gaaagcaggagcugcuggag

SEQ ID NO: 18364 - RNA, 20 nt, Artificial Sequence
  TRAC targeting sequence
cccucagaaagcaggagcug

SEQ ID NO: 18365 - RNA, 20 nt, Artificial Sequence
  TRAC targeting sequence
uucacccucagaaagcagga

SEQ ID NO: 18366 - RNA, 20 nt, Artificial Sequence
  TRAC targeting sequence
auccuucacccucagaaagc

SEQ ID NO: 18367 - RNA, 20 nt, Artificial Sequence
  TRAC targeting sequence
gcaugacucacuagcacucu

SEQ ID NO: 18368 - RNA, 20 nt, Artificial Sequence
  TRAC targeting sequence
ugcagagccacagcgucuau

SEQ ID NO: 18369 - RNA, 20 nt, Artificial Sequence
  TRAC targeting sequence
cuagcacucuaucacggcca

SEQ ID NO: 18370 - RNA, 20 nt, Artificial Sequence
  TRAC targeting sequence
aucacggccauauucuggca

SEQ ID NO: 18371 - RNA, 20 nt, Artificial Sequence
  TRAC targeting sequence
cggccauauucuggcagggu

SEQ ID NO: 18372 - RNA, 20 nt, Artificial Sequence
  TRAC targeting sequence
ggcagggucaguggcuccaa

SEQ ID NO: 18373 - RNA, 20 nt, Artificial Sequence
  TRAC targeting sequence
guggcuccaacuaacauuug

SEQ ID NO: 18374 - RNA, 20 nt, Artificial Sequence
  TRAC targeting sequence
aacuaacauuuguuugguac

SEQ ID NO: 18375 - RNA, 20 nt, Artificial Sequence
  TRAC targeting sequence
auuuaauaaacuguaaagua

SEQ ID NO: 18376 - RNA, 20 nt, Artificial Sequence
  TRAC targeting sequence
auauaaacaucuauuuaaua

SEQ ID NO: 18377 - RNA, 20 nt, Artificial Sequence
  TRAC targeting sequence
ccauauaaacaucuauuuaa

SEQ ID NO: 18378 - RNA, 20 nt, Artificial Sequence
  TRAC targeting sequence
cauuucuuucucagaagagc

SEQ ID NO: 18379 - RNA, 20 nt, Artificial Sequence
  TRAC targeting sequence
uuucuuucucagaagagccu

SEQ ID NO: 18380 - RNA, 20 nt, Artificial Sequence
  TRAC targeting sequence
uucucagaagagccuggcua

SEQ ID NO: 18381 - RNA, 20 nt, Artificial Sequence
  TRAC targeting sequence
cagaagagccuggcuaggaa

SEQ ID NO: 18382 - RNA, 20 nt, Artificial Sequence
  TRAC targeting sequence
gaagagccuggcuaggaagg

SEQ ID NO: 18383 - RNA, 20 nt, Artificial Sequence
  TRAC targeting sequence
gagaaagaaaugagagcuuc

SEQ ID NO: 18384 - RNA, 20 nt, Artificial Sequence
  TRAC targeting sequence
ucugagaaagaaaugagagc

SEQ ID NO: 18385 - RNA, 20 nt, Artificial Sequence
  TRAC targeting sequence
uagccaggcucuucugagaa

SEQ ID NO: 18386 - RNA, 20 nt, Artificial Sequence
  TRAC targeting sequence
accuuccuagccaggcucuu

SEQ ID NO: 18387 - RNA, 20 nt, Artificial Sequence
  TRAC targeting sequence
uccaccuuccuagccaggcu

SEQ ID NO: 18388 - RNA, 20 nt, Artificial Sequence
  TRAC targeting sequence
uuuugcaggugaaauuccug

SEQ ID NO: 18389 - RNA, 20 nt, Artificial Sequence
  TRAC targeting sequence
ccugcaaaaugaauauggug

SEQ ID NO: 18390 - RNA, 20 nt, Artificial Sequence
  TRAC targeting sequence
ugagauguaaggagcugcug

SEQ ID NO: 18391 - RNA, 20 nt, Artificial Sequence
  TRAC targeting sequence
ggaauuucaccugcaaaaug

SEQ ID NO: 18392 - RNA, 20 nt, Artificial Sequence
  TRAC targeting sequence
caggaauuucaccugcaaaa

SEQ ID NO: 18393 - RNA, 20 nt, Artificial Sequence
  TRAC targeting sequence
uuacaucucaggaauuucac

SEQ ID NO: 18394 - RNA, 20 nt, Artificial Sequence
  TRAC targeting sequence
cagcagcuccuuacaucuca

SEQ ID NO: 18395 - RNA, 20 nt, Artificial Sequence
  TRAC targeting sequence
aggccuuauaucgaguaaac

SEQ ID NO: 18396 - RNA, 20 nt, Artificial Sequence
  TRAC targeting sequence
aguaaacgguagugcugggg

SEQ ID NO: 18397 - RNA, 20 nt, Artificial Sequence
  TRAC targeting sequence
auauaaggccuugagcaagu

SEQ ID NO: 18398 - RNA, 20 nt, Artificial Sequence
  TRAC targeting sequence
aagccccagcacuaccguuu

SEQ ID NO: 18399 - RNA, 20 nt, Artificial Sequence
  TRAC targeting sequence
gauuuauaguucaaaaccuc

SEQ ID NO: 18400 - RNA, 20 nt, Artificial Sequence
  TRAC targeting sequence
gaacaccugcgucuaagccc

SEQ ID NO: 18401 - RNA, 20 nt, Artificial Sequence
  TRAC targeting sequence
aaaccucuaucaaugagaga

SEQ ID NO: 18402 - RNA, 20 nt, Artificial Sequence
  TRAC targeting sequence
aucaaugagagagcaaucuc

SEQ ID NO: 18403 - RNA, 20 nt, Artificial Sequence
  TRAC targeting sequence
augagagagcaaucuccugg

SEQ ID NO: 18404 - RNA, 20 nt, Artificial Sequence
  TRAC targeting sequence
uugauagagguuuugaacua

SEQ ID NO: 18405 - RNA, 20 nt, Artificial Sequence
  TRAC targeting sequence
cauugauagagguuuugaac

SEQ ID NO: 18406 - RNA, 20 nt, Artificial Sequence
  TRAC targeting sequence
cucauugauagagguuuuga

SEQ ID NO: 18407 - RNA, 20 nt, Artificial Sequence
  TRAC targeting sequence
ccugguaaugugauagauuu

SEQ ID NO: 18408 - RNA, 20 nt, Artificial Sequence
  TRAC targeting sequence
ugguaaugugauagauuucc

SEQ ID NO: 18409 - RNA, 20 nt, Artificial Sequence
  TRAC targeting sequence
cauuaccaggagauugcucu

SEQ ID NO: 18410 - RNA, 20 nt, Artificial Sequence
  TRAC targeting sequence
aucacauuaccaggagauug

SEQ ID NO: 18411 - RNA, 20 nt, Artificial Sequence
  TRAC targeting sequence
caacuuaaugccaacauacc

SEQ ID NO: 18412 - RNA, 20 nt, Artificial Sequence
  TRAC targeting sequence
cauucugcuaaugcccagcc

SEQ ID NO: 18413 - RNA, 20 nt, Artificial Sequence
  TRAC targeting sequence
gcuaaugcccagccuaaguu

SEQ ID NO: 18414 - RNA, 20 nt, Artificial Sequence
  TRAC targeting sequence
ccaacuuaggcugggcauua

SEQ ID NO: 18415 - RNA, 20 nt, Artificial Sequence
  TRAC targeting sequence
ccccaacuuaggcugggcau

SEQ ID NO: 18416 - RNA, 20 nt, Artificial Sequence
  TRAC targeting sequence
agauuccaagauguacaguu

SEQ ID NO: 18417 - RNA, 20 nt, Artificial Sequence
  TRAC targeting sequence
ggaguggucuccccaacuua

SEQ ID NO: 18418 - RNA, 20 nt, Artificial Sequence
  TRAC targeting sequence
aagauguacaguuugcuuug

SEQ ID NO: 18419 - RNA, 20 nt, Artificial Sequence
  TRAC targeting sequence
uggaaucuggaguggucucc

SEQ ID NO: 18420 - RNA, 20 nt, Artificial Sequence
  TRAC targeting sequence
caugccugccuuuacucugc

SEQ ID NO: 18421 - RNA, 20 nt, Artificial Sequence
  TRAC targeting sequence
gccagaguuauauugcuggg

SEQ ID NO: 18422 - RNA, 20 nt, Artificial Sequence
  TRAC targeting sequence
ggcagaguaaaggcaggcau

SEQ ID NO: 18423 - RNA, 20 nt, Artificial Sequence
  TRAC targeting sequence
aaaccccagcaauauaacuc

SEQ ID NO: 18424 - RNA, 20 nt, Artificial Sequence
  TRAC targeting sequence
ucaaaaccccagcaauauaa

SEQ ID NO: 18425 - RNA, 20 nt, Artificial Sequence
  TRAC targeting sequence
ucuucaaaaccccagcaaua

SEQ ID NO: 18426 - RNA, 20 nt, Artificial Sequence
  TRAC targeting sequence
uauuaaauaaaagaauaagc

SEQ ID NO: 18427 - RNA, 20 nt, Artificial Sequence
  TRAC targeting sequence
uuuauuuaauaggaucuucu

SEQ ID NO: 18428 - RNA, 20 nt, Artificial Sequence
  TRAC targeting sequence
gguuuccuugaguggcaggc

SEQ ID NO: 18429 - RNA, 20 nt, Artificial Sequence
  TRAC targeting sequence
uugaguggcaggccaggccu

SEQ ID NO: 18430 - RNA, 20 nt, Artificial Sequence
  TRAC targeting sequence
aggaaaccugaaaugcaggg

SEQ ID NO: 18431 - RNA, 20 nt, Artificial Sequence
  TRAC targeting sequence
cggccaggccuggccugcca

SEQ ID NO: 18432 - RNA, 20 nt, Artificial Sequence
  TRAC targeting sequence
cugaaaucauggccucuugg

SEQ ID NO: 18433 - RNA, 20 nt, Artificial Sequence
  TRAC targeting sequence
gugaacguucacggccaggc

SEQ ID NO: 18434 - RNA, 20 nt, Artificial Sequence
  TRAC targeting sequence
uggccucuuggccaagauug

SEQ ID NO: 18435 - RNA, 20 nt, Artificial Sequence
  TRAC targeting sequence
uggccaagauugauagcuug

SEQ ID NO: 18436 - RNA, 20 nt, Artificial Sequence
  TRAC targeting sequence
uggccaagaggccaugauuu

SEQ ID NO: 18437 - RNA, 20 nt, Artificial Sequence
  TRAC targeting sequence
aucuuggccaagaggccaug

SEQ ID NO: 18438 - RNA, 20 nt, Artificial Sequence
  TRAC targeting sequence
cugagucccaguccaucacg

SEQ ID NO: 18439 - RNA, 20 nt, Artificial Sequence
  TRAC targeting sequence
gggacaggcacaagcuauca

SEQ ID NO: 18440 - RNA, 20 nt, Artificial Sequence
  TRAC targeting sequence
caguccaucacgagcagcug

SEQ ID NO: 18441 - RNA, 20 nt, Artificial Sequence
  TRAC targeting sequence
aucacgagcagcugguuucu

SEQ ID NO: 18442 - RNA, 20 nt, Artificial Sequence
  TRAC targeting sequence
cgagcagcugguuucuaaga

SEQ ID NO: 18443 - RNA, 20 nt, Artificial Sequence
  TRAC targeting sequence
ugauggacugggacucaggg

SEQ ID NO: 18444 - RNA, 20 nt, Artificial Sequence
  TRAC targeting sequence
aagaugcuauuucccguaua

SEQ ID NO: 18445 - RNA, 20 nt, Artificial Sequence
  TRAC targeting sequence
uagaaaccagcugcucguga

SEQ ID NO: 18446 - RNA, 20 nt, Artificial Sequence
  TRAC targeting sequence
cguauaaagcaugagaccgu

SEQ ID NO: 18447 - RNA, 20 nt, Artificial Sequence
  TRAC targeting sequence
ugcuuuauacgggaaauagc

SEQ ID NO: 18448 - RNA, 20 nt, Artificial Sequence
  TRAC targeting sequence
caugcuuuauacgggaaaua

SEQ ID NO: 18449 - RNA, 20 nt, Artificial Sequence
  TRAC targeting sequence
cggucucaugcuuuauacgg

SEQ ID NO: 18450 - RNA, 20 nt, Artificial Sequence
  TRAC targeting sequence
guggggcuggcaagucacgg

SEQ ID NO: 18451 - RNA, 20 nt, Artificial Sequence
  TRAC targeting sequence
aucacuggcaucuggacucc

SEQ ID NO: 18452 - RNA, 20 nt, Artificial Sequence
  TRAC targeting sequence
cuggcaucuggacuccagcc

SEQ ID NO: 18453 - RNA, 20 nt, Artificial Sequence
  TRAC targeting sequence
ggacuccagccuggguuggg

SEQ ID NO: 18454 - RNA, 20 nt, Artificial Sequence
  TRAC targeting sequence
agaugccagugauggacaag

SEQ ID NO: 18455 - RNA, 20 nt, Artificial Sequence
  TRAC targeting sequence
agccuggguuggggcaaaga

SEQ ID NO: 18456 - RNA, 20 nt, Artificial Sequence
  TRAC targeting sequence
uugccccaacccaggcugga

SEQ ID NO: 18457 - RNA, 20 nt, Artificial Sequence
  TRAC targeting sequence
cucuuugccccaacccaggc

SEQ ID NO: 18458 - RNA, 20 nt, Artificial Sequence
  TRAC targeting sequence
uuucccucuuugccccaacc

SEQ ID NO: 18459 - RNA, 20 nt, Artificial Sequence
  TRAC targeting sequence
cauuucccucuuugccccaa

SEQ ID NO: 18460 - RNA, 20 nt, Artificial Sequence
  TRAC targeting sequence
uguccuaacccugauccucu

SEQ ID NO: 18461 - RNA, 20 nt, Artificial Sequence
  TRAC targeting sequence
uaacccugauccucuugucc

SEQ ID NO: 18462 - RNA, 20 nt, Artificial Sequence
  TRAC targeting sequence
ggguuaggacaugaucucau

SEQ ID NO: 18463 - RNA, 20 nt, Artificial Sequence
  TRAC targeting sequence
ucuugucccacagauaucca

SEQ ID NO: 18464 - RNA, 20 nt, Artificial Sequence
  TRAC targeting sequence
ugucccacagauauccagaa

SEQ ID NO: 18465 - RNA, 20 nt, Artificial Sequence
  TRAC targeting sequence
cacagauauccagaacccug

SEQ ID NO: 18466 - RNA, 20 nt, Artificial Sequence
  TRAC targeting sequence
gugggacaagaggaucaggg

SEQ ID NO: 18467 - RNA, 20 nt, Artificial Sequence
  TRAC targeting sequence
agaacccugacccugccgug

SEQ ID NO: 18468 - RNA, 20 nt, Artificial Sequence
  TRAC targeting sequence
ggauaucugugggacaagag

SEQ ID NO: 18469 - RNA, 20 nt, Artificial Sequence
  TRAC targeting sequence
ggguucuggauaucuguggg

SEQ ID NO: 18470 - RNA, 20 nt, Artificial Sequence
  TRAC targeting sequence
gcugguacacggcaggguca

SEQ ID NO: 18471 - RNA, 20 nt, Artificial Sequence
  TRAC targeting sequence
cagcugguacacggcagggu

SEQ ID NO: 18472 - RNA, 20 nt, Artificial Sequence
  TRAC targeting sequence
cucagcugguacacggcagg

SEQ ID NO: 18473 - RNA, 20 nt, Artificial Sequence
  TRAC targeting sequence
aaauccagugacaagucugu

SEQ ID NO: 18474 - RNA, 20 nt, Artificial Sequence
  TRAC targeting sequence
agugacaagucugucugccu

SEQ ID NO: 18475 - RNA, 20 nt, Artificial Sequence
  TRAC targeting sequence
cuggauuuagagucucucag

SEQ ID NO: 18476 - RNA, 20 nt, Artificial Sequence
  TRAC targeting sequence
gucugccuauucaccgauuu

SEQ ID NO: 18477 - RNA, 20 nt, Artificial Sequence
  TRAC targeting sequence
gccuauucaccgauuuugau

SEQ ID NO: 18478 - RNA, 20 nt, Artificial Sequence
  TRAC targeting sequence
ccgauuuugauucucaaaca

SEQ ID NO: 18479 - RNA, 20 nt, Artificial Sequence
  TRAC targeting sequence
gugaauaggcagacagacuu

SEQ ID NO: 18480 - RNA, 20 nt, Artificial Sequence
  TRAC targeting sequence
aaaucggugaauaggcagac

SEQ ID NO: 18481 - RNA, 20 nt, Artificial Sequence
  TRAC targeting sequence
caaacaaaugugucacaaag

SEQ ID NO: 18482 - RNA, 20 nt, Artificial Sequence
  TRAC targeting sequence
aacaaaugugucacaaagua

SEQ ID NO: 18483 - RNA, 20 nt, Artificial Sequence
  TRAC targeting sequence
caaaguaaggauucugaugu

SEQ ID NO: 18484 - RNA, 20 nt, Artificial Sequence
  TRAC targeting sequence
uuacuuugugacacauuugu

SEQ ID NO: 18485 - RNA, 20 nt, Artificial Sequence
  TRAC targeting sequence
gauguguauaucacagacaa

SEQ ID NO: 18486 - RNA, 20 nt, Artificial Sequence
  TRAC targeting sequence
gaauccuuacuuugugacac

SEQ ID NO: 18487 - RNA, 20 nt, Artificial Sequence
  TRAC targeting sequence
cagacaaaacugugcuagac

SEQ ID NO: 18488 - RNA, 20 nt, Artificial Sequence
  TRAC targeting sequence
gugauauacacaucagaauc

SEQ ID NO: 18489 - RNA, 20 nt, Artificial Sequence
  TRAC targeting sequence
agcacaguuuugucugugau

SEQ ID NO: 18490 - RNA, 20 nt, Artificial Sequence
  TRAC targeting sequence
ugucuagcacaguuuugucu

SEQ ID NO: 18491 - RNA, 20 nt, Artificial Sequence
  TRAC targeting sequence
auggacuucaagagcaacag

SEQ ID NO: 18492 - RNA, 20 nt, Artificial Sequence
  TRAC targeting sequence
auagaccucaugucuagcac

SEQ ID NO: 18493 - RNA, 20 nt, Artificial Sequence
  TRAC targeting sequence
agagcaacagugcuguggcc

SEQ ID NO: 18494 - RNA, 20 nt, Artificial Sequence
  TRAC targeting sequence
ugaaguccauagaccucaug

SEQ ID NO: 18495 - RNA, 20 nt, Artificial Sequence
  TRAC targeting sequence
aggccacagcacuguugcuc

SEQ ID NO: 18496 - RNA, 20 nt, Artificial Sequence
  TRAC targeting sequence
gacuuugcaugugcaaacgc

SEQ ID NO: 18497 - RNA, 20 nt, Artificial Sequence
  TRAC targeting sequence
gauuuguugcuccaggccac

SEQ ID NO: 18498 - RNA, 20 nt, Artificial Sequence
  TRAC targeting sequence
acaacagcauuauuccagaa

SEQ ID NO: 18499 - RNA, 20 nt, Artificial Sequence
  TRAC targeting sequence
agaagacaccuucuucccca

SEQ ID NO: 18500 - RNA, 20 nt, Artificial Sequence
  TRAC targeting sequence
ggaauaaugcuguuguugaa

SEQ ID NO: 18501 - RNA, 20 nt, Artificial Sequence
  TRAC targeting sequence
ucuggaauaaugcuguuguu

SEQ ID NO: 18502 - RNA, 20 nt, Artificial Sequence
  TRAC targeting sequence
uccccagcccagguaagggc

SEQ ID NO: 18503 - RNA, 20 nt, Artificial Sequence
  TRAC targeting sequence
ccagcccagguaagggcagc

SEQ ID NO: 18504 - RNA, 20 nt, Artificial Sequence
  TRAC targeting sequence
caggcuguuuccuugcuuca

SEQ ID NO: 18505 - RNA, 20 nt, Artificial Sequence
  TRAC targeting sequence
uugcuucaggaauggccagg

SEQ ID NO: 18506 - RNA, 20 nt, Artificial Sequence
  TRAC targeting sequence
ggaauggccagguucugccc

SEQ ID NO: 18507 - RNA, 20 nt, Artificial Sequence
  TRAC targeting sequence
ugaagcaaggaaacagccug

SEQ ID NO: 18508 - RNA, 20 nt, Artificial Sequence
  TRAC targeting sequence
gcccagagcucuggucaaug

SEQ ID NO: 18509 - RNA, 20 nt, Artificial Sequence
  TRAC targeting sequence
gggcagaaccuggccauucc

SEQ ID NO: 18510 - RNA, 20 nt, Artificial Sequence
  TRAC targeting sequence
ggucaaugaugucuaaaacu

SEQ ID NO: 18511 - RNA, 20 nt, Artificial Sequence
  TRAC targeting sequence
augaugucuaaaacuccucu

SEQ ID NO: 18512 - RNA, 20 nt, Artificial Sequence
  TRAC targeting sequence
uugaccagagcucugggcag

SEQ ID NO: 18513 - RNA, 20 nt, Artificial Sequence
  TRAC targeting sequence
aaaacuccucugauuggugg

SEQ ID NO: 18514 - RNA, 20 nt, Artificial Sequence
  TRAC targeting sequence
ucugauugguggucucggcc

SEQ ID NO: 18515 - RNA, 20 nt, Artificial Sequence
  TRAC targeting sequence
gauugguggucucggccuua

SEQ ID NO: 18516 - RNA, 20 nt, Artificial Sequence
  TRAC targeting sequence
gaggaguuuuagacaucauu

SEQ ID NO: 18517 - RNA, 20 nt, Artificial Sequence
  TRAC targeting sequence
cggccuuauccauugccacc

SEQ ID NO: 18518 - RNA, 20 nt, Artificial Sequence
  TRAC targeting sequence
gccuuauccauugccaccaa

SEQ ID NO: 18519 - RNA, 20 nt, Artificial Sequence
  TRAC targeting sequence
auugccaccaaaacccucuu

SEQ ID NO: 18520 - RNA, 20 nt, Artificial Sequence
  TRAC targeting sequence
uuuuacuaagaaacagugag

SEQ ID NO: 18521 - RNA, 20 nt, Artificial Sequence
  TRAC targeting sequence
uaguaaaaagaggguuuugg

SEQ ID NO: 18522 - RNA, 20 nt, Artificial Sequence
  TRAC targeting sequence
cuguuucuuaguaaaaagag

SEQ ID NO: 18523 - RNA, 20 nt, Artificial Sequence
  TRAC targeting sequence
ggcaguccagagaaugacac

SEQ ID NO: 18524 - RNA, 20 nt, Artificial Sequence
  TRAC targeting sequence
agagaaugacacgggaaaaa

SEQ ID NO: 18525 - RNA, 20 nt, Artificial Sequence
  TRAC targeting sequence
ggacugccagaacaaggcuc

SEQ ID NO: 18526 - RNA, 20 nt, Artificial Sequence
  TRAC targeting sequence
cuggacugccagaacaaggc

SEQ ID NO: 18527 - RNA, 20 nt, Artificial Sequence
  TRAC targeting sequence
uucucuggacugccagaaca

SEQ ID NO: 18528 - RNA, 20 nt, Artificial Sequence
  TRAC targeting sequence
cgugucauucucuggacugc

SEQ ID NO: 18529 - RNA, 20 nt, Artificial Sequence
  TRAC targeting sequence
gcuuuuuucccgugucauuc

SEQ ID NO: 18530 - RNA, 20 nt, Artificial Sequence
  TRAC targeting sequence
ucugcuuuuuucccguguca

SEQ ID NO: 18531 - RNA, 20 nt, Artificial Sequence
  TRAC targeting sequence
ucaucugcuuuuuucccgug

SEQ ID NO: 18532 - RNA, 20 nt, Artificial Sequence
  TRAC targeting sequence
cuucaucugcuuuuuucccg

SEQ ID NO: 18533 - RNA, 20 nt, Artificial Sequence
  TRAC targeting sequence
ugccaccuucucuucaucug

SEQ ID NO: 18534 - RNA, 20 nt, Artificial Sequence
  TRAC targeting sequence
ccugccaccuucucuucauc

SEQ ID NO: 18535 - RNA, 20 nt, Artificial Sequence
  TRAC targeting sequence
gucucuccaacugaguuccu

SEQ ID NO: 18536 - RNA, 20 nt, Artificial Sequence
  TRAC targeting sequence
cuccaacugaguuccugccu

SEQ ID NO: 18537 - RNA, 20 nt, Artificial Sequence
  TRAC targeting sequence
ccaacugaguuccugccugc

SEQ ID NO: 18538 - RNA, 20 nt, Artificial Sequence
  TRAC targeting sequence
aacugaguuccugccugccu

SEQ ID NO: 18539 - RNA, 20 nt, Artificial Sequence
  TRAC targeting sequence
guuggagagacugaggcugg

SEQ ID NO: 18540 - RNA, 20 nt, Artificial Sequence
  TRAC targeting sequence
ugccugccugccuuugcuca

SEQ ID NO: 18541 - RNA, 20 nt, Artificial Sequence
  TRAC targeting sequence
gacuguuugccccuuacugc

SEQ ID NO: 18542 - RNA, 20 nt, Artificial Sequence
  TRAC targeting sequence
gagcaaaggcaggcaggcag

SEQ ID NO: 18543 - RNA, 20 nt, Artificial Sequence
  TRAC targeting sequence
ucuaggccucauucuaagcc

SEQ ID NO: 18544 - RNA, 20 nt, Artificial Sequence
  TRAC targeting sequence
aggccucauucuaagccccu

SEQ ID NO: 18545 - RNA, 20 nt, Artificial Sequence
  TRAC targeting sequence
uucuaagccccuucuccaag

SEQ ID NO: 18546 - RNA, 20 nt, Artificial Sequence
  TRAC targeting sequence
aagccccuucuccaaguugc

SEQ ID NO: 18547 - RNA, 20 nt, Artificial Sequence
  TRAC targeting sequence
ccaaguugccucuccuuauu

SEQ ID NO: 18548 - RNA, 20 nt, Artificial Sequence
  TRAC targeting sequence
aaguugccucuccuuauuuc

SEQ ID NO: 18549 - RNA, 20 nt, Artificial Sequence
  TRAC targeting sequence
ccuuauuucucccugucugc

SEQ ID NO: 18550 - RNA, 20 nt, Artificial Sequence
  TRAC targeting sequence
uuauuucucccugucugcca

SEQ ID NO: 18551 - RNA, 20 nt, Artificial Sequence
  TRAC targeting sequence
cccugucugccaaaaaaucu

SEQ ID NO: 18552 - RNA, 20 nt, Artificial Sequence
  TRAC targeting sequence
cugucugccaaaaaaucuuu

SEQ ID NO: 18553 - RNA, 20 nt, Artificial Sequence
  TRAC targeting sequence
gccaaaaaaucuuucccagc

SEQ ID NO: 18554 - RNA, 20 nt, Artificial Sequence
  TRAC targeting sequence
uucccagcucacuaagucag

SEQ ID NO: 18555 - RNA, 20 nt, Artificial Sequence
  TRAC targeting sequence
cagcucacuaagucagucuc

SEQ ID NO: 18556 - RNA, 20 nt, Artificial Sequence
  TRAC targeting sequence
cuaagucagucucacgcagu

SEQ ID NO: 18557 - RNA, 20 nt, Artificial Sequence
  TRAC targeting sequence
gucucacgcagucacucauu

SEQ ID NO: 18558 - RNA, 20 nt, Artificial Sequence
  TRAC targeting sequence
cacgcagucacucauuaacc

SEQ ID NO: 18559 - RNA, 20 nt, Artificial Sequence
  TRAC targeting sequence
cgcagucacucauuaaccca

SEQ ID NO: 18560 - RNA, 20 nt, Artificial Sequence
  TRAC targeting sequence
cucauuaacccaccaaucac

SEQ ID NO: 18561 - RNA, 20 nt, Artificial Sequence
  TRAC targeting sequence
uuaacccaccaaucacugau

SEQ ID NO: 18562 - RNA, 20 nt, Artificial Sequence
  TRAC targeting sequence
cugauugugccggcacauga

SEQ ID NO: 18563 - RNA, 20 nt, Artificial Sequence
  TRAC targeting sequence
gugauugguggguuaaugag

SEQ ID NO: 18564 - RNA, 20 nt, Artificial Sequence
  TRAC targeting sequence
ugugccggcacaaucaguga

SEQ ID NO: 18565 - RNA, 20 nt, Artificial Sequence
  TRAC targeting sequence
acaccuggugcauucaugug

SEQ ID NO: 18566 - RNA, 20 nt, Artificial Sequence
  TRAC targeting sequence
acuucaacaccuggugcauu

SEQ ID NO: 18567 - RNA, 20 nt, Artificial Sequence
  TRAC targeting sequence
uccacuucaacaccuggugc

SEQ ID NO: 18568 - RNA, 20 nt, Artificial Sequence
  TRAC targeting sequence
gaugaggggugugcccagag

SEQ ID NO: 18569 - RNA, 20 nt, Artificial Sequence
  TRAC targeting sequence
gacuuuuuaauuccuccacu

SEQ ID NO: 18570 - RNA, 20 nt, Artificial Sequence
  TRAC targeting sequence
ucugacuuuuuaauuccucc

SEQ ID NO: 18571 - RNA, 20 nt, Artificial Sequence
  TRAC targeting sequence
gggcacaccccucaucugac

SEQ ID NO: 18572 - RNA, 20 nt, Artificial Sequence
  TRAC targeting sequence
ucugggcacaccccucaucu

SEQ ID NO: 18573 - RNA, 20 nt, Artificial Sequence
  TRAC targeting sequence
aguugggggagcccaucugu

SEQ ID NO: 18574 - RNA, 20 nt, Artificial Sequence
  TRAC targeting sequence
cccaacuagaauggugcuuc

SEQ ID NO: 18575 - RNA, 20 nt, Artificial Sequence
  TRAC targeting sequence
gucagcugggaaaaguccaa

SEQ ID NO: 18576 - RNA, 20 nt, Artificial Sequence
  TRAC targeting sequence
gcugggaaaaguccaaauaa

SEQ ID NO: 18577 - RNA, 20 nt, Artificial Sequence
  TRAC targeting sequence
cagcugacagaugggcuccc

SEQ ID NO: 18578 - RNA, 20 nt, Artificial Sequence
  TRAC targeting sequence
aaauaacuucagauuggaau

SEQ ID NO: 18579 - RNA, 20 nt, Artificial Sequence
  TRAC targeting sequence
gauuggaauguguuuuaacu

SEQ ID NO: 18580 - RNA, 20 nt, Artificial Sequence
  TRAC targeting sequence
gaaguuauuuggacuuuucc

SEQ ID NO: 18581 - RNA, 20 nt, Artificial Sequence
  TRAC targeting sequence
aaucugaaguuauuuggacu

SEQ ID NO: 18582 - RNA, 20 nt, Artificial Sequence
  TRAC targeting sequence
ggguugagaaaacagcuacc

SEQ ID NO: 18583 - RNA, 20 nt, Artificial Sequence
  TRAC targeting sequence
acccugaguuaaaacacauu

SEQ ID NO: 18584 - RNA, 20 nt, Artificial Sequence
  TRAC targeting sequence
caacccugaguuaaaacaca

SEQ ID NO: 18585 - RNA, 20 nt, Artificial Sequence
  TRAC targeting sequence
ggacaaaagucagggaaggg

SEQ ID NO: 18586 - RNA, 20 nt, Artificial Sequence
  TRAC targeting sequence
ugaagguagcuguuuucuca

SEQ ID NO: 18587 - RNA, 20 nt, Artificial Sequence
  TRAC targeting sequence
gggaagggcucucugaagaa

SEQ ID NO: 18588 - RNA, 20 nt, Artificial Sequence
  TRAC targeting sequence
cugacuuuuguccugaaggu

SEQ ID NO: 18589 - RNA, 20 nt, Artificial Sequence
  TRAC targeting sequence
cugaagaaaugcuacuugaa

SEQ ID NO: 18590 - RNA, 20 nt, Artificial Sequence
  TRAC targeting sequence
gaagaaaugcuacuugaaga

SEQ ID NO: 18591 - RNA, 20 nt, Artificial Sequence
  TRAC targeting sequence
gagagcccuucccugacuuu

SEQ ID NO: 18592 - RNA, 20 nt, Artificial Sequence
  TRAC targeting sequence
ucagagagcccuucccugac

SEQ ID NO: 18593 - RNA, 20 nt, Artificial Sequence
  TRAC targeting sequence
aguagcauuucuucagagag

SEQ ID NO: 18594 - RNA, 20 nt, Artificial Sequence
  TRAC targeting sequence
ucaaguagcauuucuucaga

SEQ ID NO: 18595 - RNA, 20 nt, Artificial Sequence
  TRAC targeting sequence
cugcccuugguagggcuggu

SEQ ID NO: 18596 - RNA, 20 nt, Artificial Sequence
  TRAC targeting sequence
cccugcccuugguagggcug

SEQ ID NO: 18597 - RNA, 20 nt, Artificial Sequence
  TRAC targeting sequence
ucucccugcccuugguaggg

SEQ ID NO: 18598 - RNA, 20 nt, Artificial Sequence
  TRAC targeting sequence
auaggguccucucccugccc

SEQ ID NO: 18599 - RNA, 20 nt, Artificial Sequence
  TRAC targeting sequence
caggccucuauaggguccuc

SEQ ID NO: 18600 - RNA, 20 nt, Artificial Sequence
  TRAC targeting sequence
ugucccaggccucuauaggg

SEQ ID NO: 18601 - RNA, 20 nt, Artificial Sequence
  TRAC targeting sequence
augagaaaggagaagagcag

SEQ ID NO: 18602 - RNA, 20 nt, Artificial Sequence
  TRAC targeting sequence
uugagcuccugucccaggcc

SEQ ID NO: 18603 - RNA, 20 nt, Artificial Sequence
  TRAC targeting sequence
cauugagcuccugucccagg

SEQ ID NO: 18604 - RNA, 20 nt, Artificial Sequence
  TRAC targeting sequence
uuucucauugagcuccuguc

SEQ ID NO: 18605 - RNA, 20 nt, Artificial Sequence
  TRAC targeting sequence
ccuuucucauugagcuccug

SEQ ID NO: 18606 - RNA, 20 nt, Artificial Sequence
  TRAC targeting sequence
ucuccuuucucauugagcuc

SEQ ID NO: 18607 - RNA, 20 nt, Artificial Sequence
  TRAC targeting sequence
ugccugcugcucuucuccuu

SEQ ID NO: 18608 - RNA, 20 nt, Artificial Sequence
  TRAC targeting sequence
acucaugccugcugcucuuc

SEQ ID NO: 18609 - RNA, 20 nt, Artificial Sequence
  TRAC targeting sequence
uucaacucaugccugcugcu

SEQ ID NO: 18610 - RNA, 20 nt, Artificial Sequence
  TRAC targeting sequence
uucauucaacucaugccugc

SEQ ID NO: 18611 - RNA, 20 nt, Artificial Sequence
  TRAC targeting sequence
cagggccuucuaggccauga

SEQ ID NO: 18612 - RNA, 20 nt, Artificial Sequence
  TRAC targeting sequence
aggccaugagaggguagaca

SEQ ID NO: 18613 - RNA, 20 nt, Artificial Sequence
  TRAC targeting sequence
uggccuagaaggcccuguga

SEQ ID NO: 18614 - RNA, 20 nt, Artificial Sequence
  TRAC targeting sequence
cauggccuagaaggcccugu

SEQ ID NO: 18615 - RNA, 20 nt, Artificial Sequence
  TRAC targeting sequence
acccucucauggccuagaag

SEQ ID NO: 18616 - RNA, 20 nt, Artificial Sequence
  TRAC targeting sequence
aaggacgccagaaagcuguu

SEQ ID NO: 18617 - RNA, 20 nt, Artificial Sequence
  TRAC targeting sequence
uuagaauacugucuacccuc

SEQ ID NO: 18618 - RNA, 20 nt, Artificial Sequence
  TRAC targeting sequence
ggcguccuuagaauacuguc

SEQ ID NO: 18619 - RNA, 20 nt, Artificial Sequence
  TRAC targeting sequence
acagcuuucuggcguccuua

SEQ ID NO: 18620 - RNA, 20 nt, Artificial Sequence
  TRAC targeting sequence
gcuucaagcaggggagggac

SEQ ID NO: 18621 - RNA, 20 nt, Artificial Sequence
  TRAC targeting sequence
agcaggggagggacaccuaa

SEQ ID NO: 18622 - RNA, 20 nt, Artificial Sequence
  TRAC targeting sequence
ccugcuugaagccgaucaac

SEQ ID NO: 18623 - RNA, 20 nt, Artificial Sequence
  TRAC targeting sequence
cuccccugcuugaagccgau

SEQ ID NO: 18624 - RNA, 20 nt, Artificial Sequence
  TRAC targeting sequence
uuuuuuuuuuuuuuuuuuuu

SEQ ID NO: 18625 - RNA, 20 nt, Artificial Sequence
  TRAC targeting sequence
aaaaaaaaaaaaaaaaaaaa

SEQ ID NO: 18626 - RNA, 20 nt, Artificial Sequence
  TRAC targeting sequence
caaaaaaaaaaaaaaaaaaa

SEQ ID NO: 18627 - RNA, 20 nt, Artificial Sequence
  TRAC targeting sequence
aucucaaaaaaaaaaaaaaa

SEQ ID NO: 18628 - RNA, 20 nt, Artificial Sequence
  TRAC targeting sequence
uguugcccaggcuggagugc

SEQ ID NO: 18629 - RNA, 20 nt, Artificial Sequence
  TRAC targeting sequence
augguuuguugauacauuuu

SEQ ID NO: 18630 - RNA, 20 nt, Artificial Sequence
  TRAC targeting sequence
cccaagaaacugugagugua

SEQ ID NO: 18631 - RNA, 20 nt, Artificial Sequence
  TRAC targeting sequence
caagaaacugugaguguaug

SEQ ID NO: 18632 - RNA, 20 nt, Artificial Sequence
  TRAC targeting sequence
ugggagaaaaacuuuuaagc

SEQ ID NO: 18633 - RNA, 20 nt, Artificial Sequence
  TRAC targeting sequence
caguuucuugggagaaaaac

SEQ ID NO: 18634 - RNA, 20 nt, Artificial Sequence
  TRAC targeting sequence
uacacucacaguuucuuggg

SEQ ID NO: 18635 - RNA, 20 nt, Artificial Sequence
  TRAC targeting sequence
ugggcagcugcccccagcug

SEQ ID NO: 18636 - RNA, 20 nt, Artificial Sequence
  TRAC targeting sequence
gccagcugggggcagcugcc

SEQ ID NO: 18637 - RNA, 20 nt, Artificial Sequence
  TRAC targeting sequence
ugcccucugccagcuggggg

SEQ ID NO: 18638 - RNA, 20 nt, Artificial Sequence
  TRAC targeting sequence
caguacaaaauccugcccuc

SEQ ID NO: 18639 - RNA, 20 nt, Artificial Sequence
  TRAC targeting sequence
acacccugguacaucacagu

SEQ ID NO: 18640 - RNA, 20 nt, Artificial Sequence
  TRAC targeting sequence
ugcccguguccacacccugg

SEQ ID NO: 18641 - RNA, 20 nt, Artificial Sequence
  TRAC targeting sequence
ccugcccguguccacacccu

SEQ ID NO: 18642 - RNA, 20 nt, Artificial Sequence
  TRAC targeting sequence
caaaaguaagugcucuccug

SEQ ID NO: 18643 - RNA, 20 nt, Artificial Sequence
  TRAC targeting sequence
acucccaaaaguaagugcuc

SEQ ID NO: 18644 - RNA, 20 nt, Artificial Sequence
  TRAC targeting sequence
uguuccacucccaaaaguaa

SEQ ID NO: 18645 - RNA, 20 nt, Artificial Sequence
  TRAC targeting sequence
aagugcaaccaaguaaguac

SEQ ID NO: 18646 - RNA, 20 nt, Artificial Sequence
  TRAC targeting sequence
ggccaaagacacagaaagcc

SEQ ID NO: 18647 - RNA, 20 nt, Artificial Sequence
  TRAC targeting sequence
uuggccagagccuaaguuug

SEQ ID NO: 18648 - RNA, 20 nt, Artificial Sequence
  TRAC targeting sequence
gugucuuuggccagagccua

SEQ ID NO: 18649 - RNA, 20 nt, Artificial Sequence
  TRAC targeting sequence
gcuuucuuagaugaugaauc

SEQ ID NO: 18650 - RNA, 20 nt, Artificial Sequence
  TRAC targeting sequence
uagaugaugaaucuguacuu

SEQ ID NO: 18651 - RNA, 20 nt, Artificial Sequence
  TRAC targeting sequence
aagaaagcagaguaggggcu

SEQ ID NO: 18652 - RNA, 20 nt, Artificial Sequence
  TRAC targeting sequence
ucuaagaaagcagaguaggg

SEQ ID NO: 18653 - RNA, 20 nt, Artificial Sequence
  TRAC targeting sequence
ucaucuaagaaagcagagua

SEQ ID NO: 18654 - RNA, 20 nt, Artificial Sequence
  TRAC targeting sequence
guacuuccugaacuaauuuu

SEQ ID NO: 18655 - RNA, 20 nt, Artificial Sequence
  TRAC targeting sequence
ugaacuaauuuuucauguuu

SEQ ID NO: 18656 - RNA, 20 nt, Artificial Sequence
  TRAC targeting sequence
ggaaguacagauucaucauc

SEQ ID NO: 18657 - RNA, 20 nt, Artificial Sequence
  TRAC targeting sequence
uguuucuuuaugaggcuuga

SEQ ID NO: 18658 - RNA, 20 nt, Artificial Sequence
  TRAC targeting sequence
uuaugaggcuugaauaucuu

SEQ ID NO: 18659 - RNA, 20 nt, Artificial Sequence
  TRAC targeting sequence
uaaagaaacaugaaaaauua

SEQ ID NO: 18660 - RNA, 20 nt, Artificial Sequence
  TRAC targeting sequence
agccucauaaagaaacauga

SEQ ID NO: 18661 - RNA, 20 nt, Artificial Sequence
  TRAC targeting sequence
ugaaauuuuaauuccuagcc

SEQ ID NO: 18662 - RNA, 20 nt, Artificial Sequence
  TRAC targeting sequence
agauauucaagccucauaaa

SEQ ID NO: 18663 - RNA, 20 nt, Artificial Sequence
  TRAC targeting sequence
uagccacuagcuuaauaguc

SEQ ID NO: 18664 - RNA, 20 nt, Artificial Sequence
  TRAC targeting sequence
guuuucuaacgguaguauuu

SEQ ID NO: 18665 - RNA, 20 nt, Artificial Sequence
  TRAC targeting sequence
aacgguaguauuugccaaug

SEQ ID NO: 18666 - RNA, 20 nt, Artificial Sequence
  TRAC targeting sequence
cauuggcaaauacuaccguu

SEQ ID NO: 18667 - RNA, 20 nt, Artificial Sequence
  TRAC targeting sequence
ucauugcagagacagauucc

SEQ ID NO: 18668 - RNA, 20 nt, Artificial Sequence
  TRAC targeting sequence
uugcagagacagauuccuuu

SEQ ID NO: 18669 - RNA, 20 nt, Artificial Sequence
  TRAC targeting sequence
gcaaugaugaaauggccaau

SEQ ID NO: 18670 - RNA, 20 nt, Artificial Sequence
  TRAC targeting sequence
cugcaaugaugaaauggcca

SEQ ID NO: 18671 - RNA, 20 nt, Artificial Sequence
  TRAC targeting sequence
gucucugcaaugaugaaaug

SEQ ID NO: 18672 - RNA, 20 nt, Artificial Sequence
  TRAC targeting sequence
uuugagacaaaagaucuuua

SEQ ID NO: 18673 - RNA, 20 nt, Artificial Sequence
  TRAC targeting sequence
aaggaaucugucucugcaau

SEQ ID NO: 18674 - RNA, 20 nt, Artificial Sequence
  TRAC targeting sequence
caaaggaaucugucucugca

SEQ ID NO: 18675 - RNA, 20 nt, Artificial Sequence
  TRAC targeting sequence
uuugucucaaaggaaucugu

SEQ ID NO: 18676 - RNA, 20 nt, Artificial Sequence
  TRAC targeting sequence
uuaucagaaaagaaacugug

SEQ ID NO: 18677 - RNA, 20 nt, Artificial Sequence
  TRAC targeting sequence
gaaaagaaacugugacugau

SEQ ID NO: 18678 - RNA, 20 nt, Artificial Sequence
  TRAC targeting sequence
gauaaagaucuuuugucuca

SEQ ID NO: 18679 - RNA, 20 nt, Artificial Sequence
  TRAC targeting sequence
uuucugauaaagaucuuuug

SEQ ID NO: 18680 - RNA, 20 nt, Artificial Sequence
  TRAC targeting sequence
caguuucuuuucugauaaag

SEQ ID NO: 18681 - RNA, 20 nt, Artificial Sequence
  TRAC targeting sequence
gucacaguuucuuuucugau

SEQ ID NO: 18682 - RNA, 20 nt, Artificial Sequence
  TRAC targeting sequence
uuuggcauaaucagucacag

SEQ ID NO: 18683 - RNA, 20 nt, Artificial Sequence
  TRAC targeting sequence
auuuaguuuucaugaaaggu

SEQ ID NO: 18684 - RNA, 20 nt, Artificial Sequence
  TRAC targeting sequence
ugaaaggugaugaauuaugc

SEQ ID NO: 18685 - RNA, 20 nt, Artificial Sequence
  TRAC targeting sequence
ugaaaacuaaauggaacaaa

SEQ ID NO: 18686 - RNA, 20 nt, Artificial Sequence
  TRAC targeting sequence
ccuuucaugaaaacuaaaug

SEQ ID NO: 18687 - RNA, 20 nt, Artificial Sequence
  TRAC targeting sequence
ucaccuuucaugaaaacuaa

SEQ ID NO: 18688 - RNA, 20 nt, Artificial Sequence
  TRAC targeting sequence
caaagacucugggcauugga

SEQ ID NO: 18689 - RNA, 20 nt, Artificial Sequence
  TRAC targeting sequence
uugggaagcauaauucauca

SEQ ID NO: 18690 - RNA, 20 nt, Artificial Sequence
  TRAC targeting sequence
gggcauuggacacacuuucu

SEQ ID NO: 18691 - RNA, 20 nt, Artificial Sequence
  TRAC targeting sequence
aaugcccagagucuuuggga

SEQ ID NO: 18692 - RNA, 20 nt, Artificial Sequence
  TRAC targeting sequence
caaaacugcacauccaauug

SEQ ID NO: 18693 - RNA, 20 nt, Artificial Sequence
  TRAC targeting sequence
aaacugcacauccaauugag

SEQ ID NO: 18694 - RNA, 20 nt, Artificial Sequence
  TRAC targeting sequence
aauugagagauauaggaaga

SEQ ID NO: 18695 - RNA, 20 nt, Artificial Sequence
  TRAC targeting sequence
auuggaugugcaguuuugag

SEQ ID NO: 18696 - RNA, 20 nt, Artificial Sequence
  TRAC targeting sequence
caauuggaugugcaguuuug

SEQ ID NO: 18697 - RNA, 20 nt, Artificial Sequence
  TRAC targeting sequence
cucaauuggaugugcaguuu

SEQ ID NO: 18698 - RNA, 20 nt, Artificial Sequence
  TRAC targeting sequence
uauaucucucaauuggaugu

SEQ ID NO: 18699 - RNA, 20 nt, Artificial Sequence
  TRAC targeting sequence
uccuauaucucucaauugga

SEQ ID NO: 18700 - RNA, 20 nt, Artificial Sequence
  TRAC targeting sequence
aaguucuuccuauaucucuc

SEQ ID NO: 18701 - RNA, 20 nt, Artificial Sequence
  TRAC targeting sequence
uuuuuacaaacuuuuuauua

SEQ ID NO: 18702 - RNA, 20 nt, Artificial Sequence
  TRAC targeting sequence
auaugguuccuuuuuacaaa

SEQ ID NO: 18703 - RNA, 20 nt, Artificial Sequence
  TRAC targeting sequence
uuaauuucuauaugguuccu

SEQ ID NO: 18704 - RNA, 20 nt, Artificial Sequence
  TRAC targeting sequence
ucuuuaauuucuauaugguu

SEQ ID NO: 18705 - RNA, 20 nt, Artificial Sequence
  TRAC targeting sequence
uuucuucuuuaauuucuaua

SEQ ID NO: 18706 - RNA, 20 nt, Artificial Sequence
  TRAC targeting sequence
uaaugaaagaagauaacaga

SEQ ID NO: 18707 - RNA, 20 nt, Artificial Sequence
  TRAC targeting sequence
uuaagacuauuucauuucuu

SEQ ID NO: 18708 - RNA, 20 nt, Artificial Sequence
  TRAC targeting sequence
uucauuaagacuauuucauu

SEQ ID NO: 18709 - RNA, 20 nt, Artificial Sequence
  TRAC targeting sequence
ucuuucauuaagacuauuuc

SEQ ID NO: 18710 - RNA, 20 nt, Artificial Sequence
  TRAC targeting sequence
guuaucuucuuucauuaaga

SEQ ID NO: 18711 - RNA, 20 nt, Artificial Sequence
  TRAC targeting sequence
aaugcaguucuguuaucuuc

SEQ ID NO: 18712 - RNA, 20 nt, Artificial Sequence
  TRAC targeting sequence
uuucuaaugcaguucuguua

SEQ ID NO: 18713 - RNA, 20 nt, Artificial Sequence
  TRAC targeting sequence
auucguuucuaaugcaguuc

SEQ ID NO: 18714 - RNA, 20 nt, Artificial Sequence
  TRAC targeting sequence
aaauauuuccauucguuucu

SEQ ID NO: 18715 - RNA, 20 nt, Artificial Sequence
  TRAC targeting sequence
acaaauauuuauuggacaau

SEQ ID NO: 18716 - RNA, 20 nt, Artificial Sequence
  TRAC targeting sequence
aauaaauauuuguugaauac

SEQ ID NO: 18717 - RNA, 20 nt, Artificial Sequence
  TRAC targeting sequence
aagcacuauguuaaguguga

SEQ ID NO: 18718 - RNA, 20 nt, Artificial Sequence
  TRAC targeting sequence
cacuuaacauagugcuugga

SEQ ID NO: 18719 - RNA, 20 nt, Artificial Sequence
  TRAC targeting sequence
ucacacuuaacauagugcuu

SEQ ID NO: 18720 - RNA, 20 nt, Artificial Sequence
  TRAC targeting sequence
cuuccucacacuuaacauag

SEQ ID NO: 18721 - RNA, 20 nt, Artificial Sequence
  TRAC targeting sequence
cauucccuuccucacacuua

SEQ ID NO: 18722 - RNA, 20 nt, Artificial Sequence
  TRAC targeting sequence
cucccauucccuuccucaca

SEQ ID NO: 18723 - RNA, 20 nt, Artificial Sequence
  TRAC targeting sequence
cuucccucccauucccuucc

SEQ ID NO: 18724 - RNA, 20 nt, Artificial Sequence
  TRAC targeting sequence
cuucccuucccucccauucc

SEQ ID NO: 18725 - RNA, 20 nt, Artificial Sequence
  TRAC targeting sequence
uucccuucccuucccuccca

SEQ ID NO: 18726 - RNA, 20 nt, Artificial Sequence
  TRAC targeting sequence
uuuccuucccuucccuuccc

SEQ ID NO: 18727 - RNA, 20 nt, Artificial Sequence
  TRAC targeting sequence
uuccuuuccuucccuucccu

SEQ ID NO: 18728 - RNA, 20 nt, Artificial Sequence
  TRAC targeting sequence
uuucuuuccuuuccuucccu

SEQ ID NO: 18729 - RNA, 20 nt, Artificial Sequence
  TRAC targeting sequence
ccuuucuuuccuuuccuucc

SEQ ID NO: 18730 - RNA, 20 nt, Artificial Sequence
  TRAC targeting sequence
ucuccuuucuuuccuuuccu

SEQ ID NO: 18731 - RNA, 20 nt, Artificial Sequence
  TRAC targeting sequence
acuuccucuccuuucuuucc

SEQ ID NO: 18732 - RNA, 20 nt, Artificial Sequence
  TRAC targeting sequence
ucuacuuccucuccuuucuu

SEQ ID NO: 18733 - RNA, 20 nt, Artificial Sequence
  TRAC targeting sequence
uuccucuacuuccucuccuu

SEQ ID NO: 18734 - RNA, 20 nt, Artificial Sequence
  TRAC targeting sequence
cgguccuuccucuacuuccu

SEQ ID NO: 18735 - RNA, 20 nt, Artificial Sequence
  TRAC targeting sequence
cucccgguccuuccucuacu

SEQ ID NO: 18736 - RNA, 20 nt, Artificial Sequence
  TRAC targeting sequence
cucccucccgguccuuccuc

SEQ ID NO: 18737 - RNA, 20 nt, Artificial Sequence
  TRAC targeting sequence
ucccucccucccgguccuuc

SEQ ID NO: 18738 - RNA, 20 nt, Artificial Sequence
  TRAC targeting sequence
uucuucccucccucccgguc

SEQ ID NO: 18739 - RNA, 20 nt, Artificial Sequence
  TRAC targeting sequence
uccuucuucccucccucccg

SEQ ID NO: 18740 - RNA, 20 nt, Artificial Sequence
  TRAC targeting sequence
uuuucuuccuucuucccucc

SEQ ID NO: 18741 - RNA, 20 nt, Artificial Sequence
  TRAC targeting sequence
uccuuuucuuccuucuuccc

SEQ ID NO: 18742 - RNA, 20 nt, Artificial Sequence
  TRAC targeting sequence
uuuccuccuuuucuuccuuc

SEQ ID NO: 18743 - RNA, 20 nt, Artificial Sequence
  TRAC targeting sequence
cuccuuuccuccuuuucuuc

SEQ ID NO: 18744 - RNA, 20 nt, Artificial Sequence
  TRAC targeting sequence
uucccuccuuuccuccuuuu

SEQ ID NO: 18745 - RNA, 20 nt, Artificial Sequence
  TRAC targeting sequence
cuccuucccuccuuuccucc

SEQ ID NO: 18746 - RNA, 20 nt, Artificial Sequence
  TRAC targeting sequence
cuuucauccagggaaggagg

SEQ ID NO: 18747 - RNA, 20 nt, Artificial Sequence
  TRAC targeting sequence
uucauccagggaaggaggga

SEQ ID NO: 18748 - RNA, 20 nt, Artificial Sequence
  TRAC targeting sequence
uccagggaaggagggagagu

SEQ ID NO: 18749 - RNA, 20 nt, Artificial Sequence
  TRAC targeting sequence
agggaaggagggagagucuc

SEQ ID NO: 18750 - RNA, 20 nt, Artificial Sequence
  TRAC targeting sequence
cuggaugaaagagaaccucc

SEQ ID NO: 18751 - RNA, 20 nt, Artificial Sequence
  TRAC targeting sequence
uucccuggaugaaagagaac

SEQ ID NO: 18752 - RNA, 20 nt, Artificial Sequence
  TRAC targeting sequence
cuccuucccuggaugaaaga

SEQ ID NO: 18753 - RNA, 20 nt, Artificial Sequence
  TRAC targeting sequence
cccuccuucccuggaugaaa

SEQ ID NO: 18754 - RNA, 20 nt, Artificial Sequence
  TRAC targeting sequence
cugccauccgggagcucaga

SEQ ID NO: 18755 - RNA, 20 nt, Artificial Sequence
  TRAC targeting sequence
gccauccgggagcucagagu

SEQ ID NO: 18756 - RNA, 20 nt, Artificial Sequence
  TRAC targeting sequence
gggagcucagagugcaaaca

SEQ ID NO: 18757 - RNA, 20 nt, Artificial Sequence
  TRAC targeting sequence
cggauggcagagacucuccc

SEQ ID NO: 18758 - RNA, 20 nt, Artificial Sequence
  TRAC targeting sequence
gagugcaaacagacaacuau

SEQ ID NO: 18759 - RNA, 20 nt, Artificial Sequence
  TRAC targeting sequence
gagcucccggauggcagaga

SEQ ID NO: 18760 - RNA, 20 nt, Artificial Sequence
  TRAC targeting sequence
guuugcacucugagcucccg

SEQ ID NO: 18761 - RNA, 20 nt, Artificial Sequence
  TRAC targeting sequence
ccacgucauaguggagguac

SEQ ID NO: 18762 - RNA, 20 nt, Artificial Sequence
  TRAC targeting sequence
uaguggagguacaugcaagu

SEQ ID NO: 18763 - RNA, 20 nt, Artificial Sequence
  TRAC targeting sequence
acuaugacguggugacaaua

SEQ ID NO: 18764 - RNA, 20 nt, Artificial Sequence
  TRAC targeting sequence
auugcaacuugcauguaccu

SEQ ID NO: 18765 - RNA, 20 nt, Artificial Sequence
  TRAC targeting sequence
guugugcuuccauugcaacu

SEQ ID NO: 18766 - RNA, 20 nt, Artificial Sequence
  TRAC targeting sequence
ucuguugugcuuccauugca

SEQ ID NO: 18767 - RNA, 20 nt, Artificial Sequence
  TRAC targeting sequence
ugucuucuguugugcuucca

SEQ ID NO: 18768 - RNA, 20 nt, Artificial Sequence
  TRAC targeting sequence
aauucucauugccugguaca

SEQ ID NO: 18769 - RNA, 20 nt, Artificial Sequence
  TRAC targeting sequence
cauugccugguacauacaca

SEQ ID NO: 18770 - RNA, 20 nt, Artificial Sequence
  TRAC targeting sequence
uugccugguacauacacaca

SEQ ID NO: 18771 - RNA, 20 nt, Artificial Sequence
  TRAC targeting sequence
uccacuauaccuuaagcucc

SEQ ID NO: 18772 - RNA, 20 nt, Artificial Sequence
  TRAC targeting sequence
acuauaccuuaagcuccaug

SEQ ID NO: 18773 - RNA, 20 nt, Artificial Sequence
  TRAC targeting sequence
augagggcaggacccuuuuu

SEQ ID NO: 18774 - RNA, 20 nt, Artificial Sequence
  TRAC targeting sequence
uggagcuuaagguauagugg

SEQ ID NO: 18775 - RNA, 20 nt, Artificial Sequence
  TRAC targeting sequence
ugcccucauggagcuuaagg

SEQ ID NO: 18776 - RNA, 20 nt, Artificial Sequence
  TRAC targeting sequence
uccucacagcucuacagcuc

SEQ ID NO: 18777 - RNA, 20 nt, Artificial Sequence
  TRAC targeting sequence
ucacagcucuacagcucagc

SEQ ID NO: 18778 - RNA, 20 nt, Artificial Sequence
  TRAC targeting sequence
cagcucuacagcucagcaca

SEQ ID NO: 18779 - RNA, 20 nt, Artificial Sequence
  TRAC targeting sequence
acagcucagcacaaugccug

SEQ ID NO: 18780 - RNA, 20 nt, Artificial Sequence
  TRAC targeting sequence
gcacaaugccuggcacauag

SEQ ID NO: 18781 - RNA, 20 nt, Artificial Sequence
  TRAC targeting sequence
ccaaacaaaugauugugggg

SEQ ID NO: 18782 - RNA, 20 nt, Artificial Sequence
  TRAC targeting sequence
uuuguuuggugacaccuaug

SEQ ID NO: 18783 - RNA, 20 nt, Artificial Sequence
  TRAC targeting sequence
ccacaaucauuuguuuggug

SEQ ID NO: 18784 - RNA, 20 nt, Artificial Sequence
  TRAC targeting sequence
ggcuagaugaguuaugauuu

SEQ ID NO: 18785 - RNA, 20 nt, Artificial Sequence
  TRAC targeting sequence
agccagaaggcauuuuuuuc

SEQ ID NO: 18786 - RNA, 20 nt, Artificial Sequence
  TRAC targeting sequence
ucuagccagaaggcauuuuu

SEQ ID NO: 18787 - RNA, 20 nt, Artificial Sequence
  TRAC targeting sequence
uaacucaucuagccagaagg

SEQ ID NO: 18788 - RNA, 20 nt, Artificial Sequence
  TRAC targeting sequence
cuaacagagagaguuguuag

SEQ ID NO: 18789 - RNA, 20 nt, Artificial Sequence
  TRAC targeting sequence
aacagagagaguuguuagac

SEQ ID NO: 18790 - RNA, 20 nt, Artificial Sequence
  TRAC targeting sequence
guuagagaauauuuguuaau

SEQ ID NO: 18791 - RNA, 20 nt, Artificial Sequence
  TRAC targeting sequence
cuguuagagaauauuuguua

SEQ ID NO: 18792 - RNA, 20 nt, Artificial Sequence
  TRAC targeting sequence
cucuguuagagaauauuugu

SEQ ID NO: 18793 - RNA, 20 nt, Artificial Sequence
  TRAC targeting sequence
aacaacucucucuguuagag

SEQ ID NO: 18794 - RNA, 20 nt, Artificial Sequence
  TRAC targeting sequence
aaaccaggagauugcagaau

SEQ ID NO: 18795 - RNA, 20 nt, Artificial Sequence
  TRAC targeting sequence
ugguuuugaggucuaacaac

SEQ ID NO: 18796 - RNA, 20 nt, Artificial Sequence
  TRAC targeting sequence
ccugguuuugaggucuaaca

SEQ ID NO: 18797 - RNA, 20 nt, Artificial Sequence
  TRAC targeting sequence
gcaaucuccugguuuugagg

SEQ ID NO: 18798 - RNA, 20 nt, Artificial Sequence
  TRAC targeting sequence
auccagaugucugugguggg

SEQ ID NO: 18799 - RNA, 20 nt, Artificial Sequence
  TRAC targeting sequence
agaugucuguggugggagaa

SEQ ID NO: 18800 - RNA, 20 nt, Artificial Sequence
  TRAC targeting sequence
ggauggauucugcaaucucc

SEQ ID NO: 18801 - RNA, 20 nt, Artificial Sequence
  TRAC targeting sequence
guggugggagaaggcccauc

SEQ ID NO: 18802 - RNA, 20 nt, Artificial Sequence
  TRAC targeting sequence
caccacagacaucuggaugg

SEQ ID NO: 18803 - RNA, 20 nt, Artificial Sequence
  TRAC targeting sequence
cccaccacagacaucuggau

SEQ ID NO: 18804 - RNA, 20 nt, Artificial Sequence
  TRAC targeting sequence
cucagggaagagcaccucug

SEQ ID NO: 18805 - RNA, 20 nt, Artificial Sequence
  TRAC targeting sequence
cagggaagagcaccucugua

SEQ ID NO: 18806 - RNA, 20 nt, Artificial Sequence
  TRAC targeting sequence
gggaagagcaccucuguauu

SEQ ID NO: 18807 - RNA, 20 nt, Artificial Sequence
  TRAC targeting sequence
cugagagaugggccuucucc

SEQ ID NO: 18808 - RNA, 20 nt, Artificial Sequence
  TRAC targeting sequence
ucccugagagaugggccuuc

SEQ ID NO: 18809 - RNA, 20 nt, Artificial Sequence
  TRAC targeting sequence
guauuuaucuguucauaugu

SEQ ID NO: 18810 - RNA, 20 nt, Artificial Sequence
  TRAC targeting sequence
guucauaugugugcuucauc

SEQ ID NO: 18811 - RNA, 20 nt, Artificial Sequence
  TRAC targeting sequence
uaugugugcuucaucaaagc

SEQ ID NO: 18812 - RNA, 20 nt, Artificial Sequence
  TRAC targeting sequence
ucaaagccucuucucagcca

SEQ ID NO: 18813 - RNA, 20 nt, Artificial Sequence
  TRAC targeting sequence
aagccucuucucagccaugg

SEQ ID NO: 18814 - RNA, 20 nt, Artificial Sequence
  TRAC targeting sequence
ucucagccaugguucaggcu

SEQ ID NO: 18815 - RNA, 20 nt, Artificial Sequence
  TRAC targeting sequence
cagccaugguucaggcugaa

SEQ ID NO: 18816 - RNA, 20 nt, Artificial Sequence
  TRAC targeting sequence
gccaugguucaggcugaauu

SEQ ID NO: 18817 - RNA, 20 nt, Artificial Sequence
  TRAC targeting sequence
ggcugaauuuauaaagcuug

SEQ ID NO: 18818 - RNA, 20 nt, Artificial Sequence
  TRAC targeting sequence
gccugaaccauggcugagaa

SEQ ID NO: 18819 - RNA, 20 nt, Artificial Sequence
  TRAC targeting sequence
agcuuuauaaauucagccug

SEQ ID NO: 18820 - RNA, 20 nt, Artificial Sequence
  TRAC targeting sequence
uauuucucaagaaucagaga

SEQ ID NO: 18821 - RNA, 20 nt, Artificial Sequence
  TRAC targeting sequence
caagaaucagagaucagagg

SEQ ID NO: 18822 - RNA, 20 nt, Artificial Sequence
  TRAC targeting sequence
agaaucagagaucagaggug

SEQ ID NO: 18823 - RNA, 20 nt, Artificial Sequence
  TRAC targeting sequence
ugagaaauacgauagguuuc

SEQ ID NO: 18824 - RNA, 20 nt, Artificial Sequence
  TRAC targeting sequence
gagaucagagguggaagguu

SEQ ID NO: 18825 - RNA, 20 nt, Artificial Sequence
  TRAC targeting sequence
gauucuugagaaauacgaua

SEQ ID NO: 18826 - RNA, 20 nt, Artificial Sequence
  TRAC targeting sequence
cugauucuugagaaauacga

SEQ ID NO: 18827 - RNA, 20 nt, Artificial Sequence
  TRAC targeting sequence
gagguggaagguuuacaaua

SEQ ID NO: 18828 - RNA, 20 nt, Artificial Sequence
  TRAC targeting sequence
gaucucugauucuugagaaa

SEQ ID NO: 18829 - RNA, 20 nt, Artificial Sequence
  TRAC targeting sequence
accucugaucucugauucuu

SEQ ID NO: 18830 - RNA, 20 nt, Artificial Sequence
  TRAC targeting sequence
cgauaaguaagcaguacaaa

SEQ ID NO: 18831 - RNA, 20 nt, Artificial Sequence
  TRAC targeting sequence
auaaguaagcaguacaaaug

SEQ ID NO: 18832 - RNA, 20 nt, Artificial Sequence
  TRAC targeting sequence
agauauuguaaaccuuccac

SEQ ID NO: 18833 - RNA, 20 nt, Artificial Sequence
  TRAC targeting sequence
uuuguacugcuuacuuaucg

SEQ ID NO: 18834 - RNA, 20 nt, Artificial Sequence
  TRAC targeting sequence
agcaguaaaaaagaaagagg

SEQ ID NO: 18835 - RNA, 20 nt, Artificial Sequence
  TRAC targeting sequence
uuuuuacugcuagaacucau

SEQ ID NO: 18836 - RNA, 20 nt, Artificial Sequence
  TRAC targeting sequence
uucuuuuuuacugcuagaac

SEQ ID NO: 18837 - RNA, 20 nt, Artificial Sequence
  TRAC targeting sequence
aaugauaaauauaugaagcc

SEQ ID NO: 18838 - RNA, 20 nt, Artificial Sequence
  TRAC targeting sequence
uuagaccucuuucuuuuuua

SEQ ID NO: 18839 - RNA, 20 nt, Artificial Sequence
  TRAC targeting sequence
uauauuuaucauuagaccuc

SEQ ID NO: 18840 - RNA, 20 nt, Artificial Sequence
  TRAC targeting sequence
ccacuugagagaccuccuag

SEQ ID NO: 18841 - RNA, 20 nt, Artificial Sequence
  TRAC targeting sequence
acuugagagaccuccuagaa

SEQ ID NO: 18842 - RNA, 20 nt, Artificial Sequence
  TRAC targeting sequence
aguggagacaggcuucauau

SEQ ID NO: 18843 - RNA, 20 nt, Artificial Sequence
  TRAC targeting sequence
caaguggagacaggcuucau

SEQ ID NO: 18844 - RNA, 20 nt, Artificial Sequence
  TRAC targeting sequence
cucaaguggagacaggcuuc

SEQ ID NO: 18845 - RNA, 20 nt, Artificial Sequence
  TRAC targeting sequence
uagaaaagauuuguucuaag

SEQ ID NO: 18846 - RNA, 20 nt, Artificial Sequence
  TRAC targeting sequence
aggaggucucucaaguggag

SEQ ID NO: 18847 - RNA, 20 nt, Artificial Sequence
  TRAC targeting sequence
uuucuaggaggucucucaag

SEQ ID NO: 18848 - RNA, 20 nt, Artificial Sequence
  TRAC targeting sequence
aaggaaacuuuucuccauua

SEQ ID NO: 18849 - RNA, 20 nt, Artificial Sequence
  TRAC targeting sequence
uuagaacaaaucuuuucuag

SEQ ID NO: 18850 - RNA, 20 nt, Artificial Sequence
  TRAC targeting sequence
ccauuaggagcagaaucauc

SEQ ID NO: 18851 - RNA, 20 nt, Artificial Sequence
  TRAC targeting sequence
auuaggagcagaaucaucuu

SEQ ID NO: 18852 - RNA, 20 nt, Artificial Sequence
  TRAC targeting sequence
uaauggagaaaaguuuccuu

SEQ ID NO: 18853 - RNA, 20 nt, Artificial Sequence
  TRAC targeting sequence
gcuccuaauggagaaaaguu

SEQ ID NO: 18854 - RNA, 20 nt, Artificial Sequence
  TRAC targeting sequence
ucuuggaaauauacagcucc

SEQ ID NO: 18855 - RNA, 20 nt, Artificial Sequence
  TRAC targeting sequence
uggaaauauacagcuccaag

SEQ ID NO: 18856 - RNA, 20 nt, Artificial Sequence
  TRAC targeting sequence
aagaugauucugcuccuaau

SEQ ID NO: 18857 - RNA, 20 nt, Artificial Sequence
  TRAC targeting sequence
aaguuguguuagaaaggugu

SEQ ID NO: 18858 - RNA, 20 nt, Artificial Sequence
  TRAC targeting sequence
aacacaacuuggagcuguau

SEQ ID NO: 18859 - RNA, 20 nt, Artificial Sequence
  TRAC targeting sequence
uuguacacaccuuucuaaca

SEQ ID NO: 18860 - RNA, 20 nt, Artificial Sequence
  TRAC targeting sequence
ucuuuguacacaccuuucua

SEQ ID NO: 18861 - RNA, 20 nt, Artificial Sequence
  TRAC targeting sequence
cauuuggaauaaggcauuaa

SEQ ID NO: 18862 - RNA, 20 nt, Artificial Sequence
  TRAC targeting sequence
aaaugugaauuuuuggucuu

SEQ ID NO: 18863 - RNA, 20 nt, Artificial Sequence
  TRAC targeting sequence
aguagggaaacccugcaaag

SEQ ID NO: 18864 - RNA, 20 nt, Artificial Sequence
  TRAC targeting sequence
cuacuagaaacaauggcaac

SEQ ID NO: 18865 - RNA, 20 nt, Artificial Sequence
  TRAC targeting sequence
uagauccugcauguugacgc

SEQ ID NO: 18866 - RNA, 20 nt, Artificial Sequence
  TRAC targeting sequence
acgaugccccaacacuuugc

SEQ ID NO: 18867 - RNA, 20 nt, Artificial Sequence
  TRAC targeting sequence
ugcauguugacgccugcaac

SEQ ID NO: 18868 - RNA, 20 nt, Artificial Sequence
  TRAC targeting sequence
acaugcaggaucuacgaugc

SEQ ID NO: 18869 - RNA, 20 nt, Artificial Sequence
  TRAC targeting sequence
gccccggagcuguuccgaca

SEQ ID NO: 18870 - RNA, 20 nt, Artificial Sequence
  TRAC targeting sequence
ggggcagauuaguugcaggc

SEQ ID NO: 18871 - RNA, 20 nt, Artificial Sequence
  TRAC targeting sequence
gacaguggcuggagcauuug

SEQ ID NO: 18872 - RNA, 20 nt, Artificial Sequence
  TRAC targeting sequence
gaacagcuccggggcagauu

SEQ ID NO: 18873 - RNA, 20 nt, Artificial Sequence
  TRAC targeting sequence
agccacugucggaacagcuc

SEQ ID NO: 18874 - RNA, 20 nt, Artificial Sequence
  TRAC targeting sequence
acaauugccaaaauaaaaug

SEQ ID NO: 18875 - RNA, 20 nt, Artificial Sequence
  TRAC targeting sequence
uuuuauuuuggcaauuguug

SEQ ID NO: 18876 - RNA, 20 nt, Artificial Sequence
  TRAC targeting sequence
ugaugauuagaaagaaauaa

SEQ ID NO: 18877 - RNA, 20 nt, Artificial Sequence
  TRAC targeting sequence
cgaaauagcuucauuuuauu

SEQ ID NO: 18878 - RNA, 20 nt, Artificial Sequence
  TRAC targeting sequence
ucacgaaauagcuucauuuu

SEQ ID NO: 18879 - RNA, 20 nt, Artificial Sequence
  TRAC targeting sequence
aaucaucacgaaauagcuuc

SEQ ID NO: 18880 - RNA, 20 nt, Artificial Sequence
  TRAC targeting sequence
uucuaaucaucacgaaauag

SEQ ID NO: 18881 - RNA, 20 nt, Artificial Sequence
  TRAC targeting sequence
gcaucaaugaggccucugau

SEQ ID NO: 18882 - RNA, 20 nt, Artificial Sequence
  TRAC targeting sequence
augaggccucugaugcaucu

SEQ ID NO: 18883 - RNA, 20 nt, Artificial Sequence
  TRAC targeting sequence
uugaugcugauuauuucuuu

SEQ ID NO: 18884 - RNA, 20 nt, Artificial Sequence
  TRAC targeting sequence
gaugcaucuucaggagugag

SEQ ID NO: 18885 - RNA, 20 nt, Artificial Sequence
  TRAC targeting sequence
gaggccucauugaugcugau

SEQ ID NO: 18886 - RNA, 20 nt, Artificial Sequence
  TRAC targeting sequence
ucaggagugaguagguggaa

SEQ ID NO: 18887 - RNA, 20 nt, Artificial Sequence
  TRAC targeting sequence
ggagugaguagguggaauga

SEQ ID NO: 18888 - RNA, 20 nt, Artificial Sequence
  TRAC targeting sequence
ugaagaugcaucagaggccu

SEQ ID NO: 18889 - RNA, 20 nt, Artificial Sequence
  TRAC targeting sequence
cuccugaagaugcaucagag

SEQ ID NO: 18890 - RNA, 20 nt, Artificial Sequence
  TRAC targeting sequence
accuacucacuccugaagau

SEQ ID NO: 18891 - RNA, 20 nt, Artificial Sequence
  TRAC targeting sequence
uuccaccuacucacuccuga

SEQ ID NO: 18892 - RNA, 20 nt, Artificial Sequence
  TRAC targeting sequence
ucauuccaccuacucacucc

SEQ ID NO: 18893 - RNA, 20 nt, Artificial Sequence
  TRAC targeting sequence
ccuaccaggucuucauucca

SEQ ID NO: 18894 - RNA, 20 nt, Artificial Sequence
  TRAC targeting sequence
caccuaccaggucuucauuc

SEQ ID NO: 18895 - RNA, 20 nt, Artificial Sequence
  TRAC targeting sequence
cucuugucagagaaaguuug

SEQ ID NO: 18896 - RNA, 20 nt, Artificial Sequence
  TRAC targeting sequence
cuugucagagaaaguuugac

SEQ ID NO: 18897 - RNA, 20 nt, Artificial Sequence
  TRAC targeting sequence
ugucagagaaaguuugacuu

SEQ ID NO: 18898 - RNA, 20 nt, Artificial Sequence
  TRAC targeting sequence
gagaaaguuugacuuggggg

SEQ ID NO: 18899 - RNA, 20 nt, Artificial Sequence
  TRAC targeting sequence
gacaagagagaaaagucuca

SEQ ID NO: 18900 - RNA, 20 nt, Artificial Sequence
  TRAC targeting sequence
cugacaagagagaaaagucu

SEQ ID NO: 18901 - RNA, 20 nt, Artificial Sequence
  TRAC targeting sequence
aacuuucucugacaagagag

SEQ ID NO: 18902 - RNA, 20 nt, Artificial Sequence
  TRAC targeting sequence
cccaagucaaacuuucucug

SEQ ID NO: 18903 - RNA, 20 nt, Artificial Sequence
  TRAC targeting sequence
aggcucccccaagucaaacu

SEQ ID NO: 18904 - RNA, 20 nt, Artificial Sequence
  TRAC targeting sequence
cuguuuuccaggcuccccca

SEQ ID NO: 18905 - RNA, 20 nt, Artificial Sequence
  TRAC targeting sequence
ugucccuguuuuccaggcuc

SEQ ID NO: 18906 - RNA, 20 nt, Artificial Sequence
  TRAC targeting sequence
ccugucccuguuuuccaggc

SEQ ID NO: 18907 - RNA, 20 nt, Artificial Sequence
  TRAC targeting sequence
aucuccugucccuguuuucc

SEQ ID NO: 18908 - RNA, 20 nt, Artificial Sequence
  TRAC targeting sequence
gaguucuuguaaagcaccau

SEQ ID NO: 18909 - RNA, 20 nt, Artificial Sequence
  TRAC targeting sequence
gaccugggcagggcaugccu

SEQ ID NO: 18910 - RNA, 20 nt, Artificial Sequence
  TRAC targeting sequence
uguaaagcaccaucugauug

SEQ ID NO: 18911 - RNA, 20 nt, Artificial Sequence
  TRAC targeting sequence
gauuguguguuuucuggugg

SEQ ID NO: 18912 - RNA, 20 nt, Artificial Sequence
  TRAC targeting sequence
gauggugcuuuacaagaacu

SEQ ID NO: 18913 - RNA, 20 nt, Artificial Sequence
  TRAC targeting sequence
gguggcuacaauaagcugau

SEQ ID NO: 18914 - RNA, 20 nt, Artificial Sequence
  TRAC targeting sequence
gcuuauuguagccaccagaa

SEQ ID NO: 18915 - RNA, 20 nt, Artificial Sequence
  TRAC targeting sequence
aaaaaucagcuuauuguagc

SEQ ID NO: 18916 - RNA, 20 nt, Artificial Sequence
  TRAC targeting sequence
cugcuccaaaaaucagcuua

SEQ ID NO: 18917 - RNA, 20 nt, Artificial Sequence
  TRAC targeting sequence
cauggguguacagccagccu

SEQ ID NO: 18918 - RNA, 20 nt, Artificial Sequence
  TRAC targeting sequence
uacucacauggguguacagc

SEQ ID NO: 18919 - RNA, 20 nt, Artificial Sequence
  TRAC targeting sequence
cuugcagggucauacucaca

SEQ ID NO: 18920 - RNA, 20 nt, Artificial Sequence
  TRAC targeting sequence
uuuugcacuggucacuugca

SEQ ID NO: 18921 - RNA, 20 nt, Artificial Sequence
  TRAC targeting sequence
guucuuuuugcacuggucac

SEQ ID NO: 18922 - RNA, 20 nt, Artificial Sequence
  TRAC targeting sequence
augagaaaacaggugaugau

SEQ ID NO: 18923 - RNA, 20 nt, Artificial Sequence
  TRAC targeting sequence
uagacaaguggucaguucuu

SEQ ID NO: 18924 - RNA, 20 nt, Artificial Sequence
  TRAC targeting sequence
cauagacaaguggucaguuc

SEQ ID NO: 18925 - RNA, 20 nt, Artificial Sequence
  TRAC targeting sequence
ccuguuuucucauagacaag

SEQ ID NO: 18926 - RNA, 20 nt, Artificial Sequence
  TRAC targeting sequence
ucaccuguuuucucauagac

SEQ ID NO: 18927 - RNA, 20 nt, Artificial Sequence
  TRAC targeting sequence
auagcaaacuuggggauaua

SEQ ID NO: 18928 - RNA, 20 nt, Artificial Sequence
  TRAC targeting sequence
ccaaguuugcuauagaucau

SEQ ID NO: 18929 - RNA, 20 nt, Artificial Sequence
  TRAC targeting sequence
auauauccccaaguuugcua

SEQ ID NO: 18930 - RNA, 20 nt, Artificial Sequence
  TRAC targeting sequence
caauauauccccaaguuugc

SEQ ID NO: 18931 - RNA, 20 nt, Artificial Sequence
  TRAC targeting sequence
uuuuccauuccuacaagcuc

SEQ ID NO: 18932 - RNA, 20 nt, Artificial Sequence
  TRAC targeting sequence
auuccuacaagcucucuugg

SEQ ID NO: 18933 - RNA, 20 nt, Artificial Sequence
  TRAC targeting sequence
uacaagcucucuuggugacu

SEQ ID NO: 18934 - RNA, 20 nt, Artificial Sequence
  TRAC targeting sequence
cuuggugacuuaaaauguuc

SEQ ID NO: 18935 - RNA, 20 nt, Artificial Sequence
  TRAC targeting sequence
uggugacuuaaaauguuccc

SEQ ID NO: 18936 - RNA, 20 nt, Artificial Sequence
  TRAC targeting sequence
ccaagagagcuuguaggaau

SEQ ID NO: 18937 - RNA, 20 nt, Artificial Sequence
  TRAC targeting sequence
cauuucucauaugaaacaca

SEQ ID NO: 18938 - RNA, 20 nt, Artificial Sequence
  TRAC targeting sequence
cauaugaaacacagaagugc

SEQ ID NO: 18939 - RNA, 20 nt, Artificial Sequence
  TRAC targeting sequence
uaugaaacacagaagugcca

SEQ ID NO: 18940 - RNA, 20 nt, Artificial Sequence
  TRAC targeting sequence
uaugagaaaugggaacauuu

SEQ ID NO: 18941 - RNA, 20 nt, Artificial Sequence
  TRAC targeting sequence
guguuucauaugagaaaugg

SEQ ID NO: 18942 - RNA, 20 nt, Artificial Sequence
  TRAC targeting sequence
uggcacuucuguguuucaua

SEQ ID NO: 18943 - RNA, 20 nt, Artificial Sequence
  TRAC targeting sequence
uuuacgcaauuggcucuugg

SEQ ID NO: 18944 - RNA, 20 nt, Artificial Sequence
  TRAC targeting sequence
gagcagaauaauuuauagaa

SEQ ID NO: 18945 - RNA, 20 nt, Artificial Sequence
  TRAC targeting sequence
gauuuucauuuacgcaauug

SEQ ID NO: 18946 - RNA, 20 nt, Artificial Sequence
  TRAC targeting sequence
gcucagauuuucauuuacgc

SEQ ID NO: 18947 - RNA, 20 nt, Artificial Sequence
  TRAC targeting sequence
auaaauuauucugcucagau

SEQ ID NO: 18948 - RNA, 20 nt, Artificial Sequence
  TRAC targeting sequence
uuuuauguuucuauaaauua

SEQ ID NO: 18949 - RNA, 20 nt, Artificial Sequence
  TRAC targeting sequence
aaauaaugagugcuuucaag

SEQ ID NO: 18950 - RNA, 20 nt, Artificial Sequence
  TRAC targeting sequence
uuauuuggaacucuuuuuau

SEQ ID NO: 18951 - RNA, 20 nt, Artificial Sequence
  TRAC targeting sequence
agugaagcugauaauaucgg

SEQ ID NO: 18952 - RNA, 20 nt, Artificial Sequence
  TRAC targeting sequence
cuugaaagcacucauuauuu

SEQ ID NO: 18953 - RNA, 20 nt, Artificial Sequence
  TRAC targeting sequence
gcuucacuugaaagcacuca

SEQ ID NO: 18954 - RNA, 20 nt, Artificial Sequence
  TRAC targeting sequence
gcaccagauaaucugaacau

SEQ ID NO: 18955 - RNA, 20 nt, Artificial Sequence
  TRAC targeting sequence
ggugccgauauuaucagcuu

SEQ ID NO: 18956 - RNA, 20 nt, Artificial Sequence
  TRAC targeting sequence
gaacauucaggaaauuagcu

SEQ ID NO: 18957 - RNA, 20 nt, Artificial Sequence
  TRAC targeting sequence
gauuaucuggugccgauauu

SEQ ID NO: 18958 - RNA, 20 nt, Artificial Sequence
  TRAC targeting sequence
ggaaauuagcuaagugcccu

SEQ ID NO: 18959 - RNA, 20 nt, Artificial Sequence
  TRAC targeting sequence
ugaauguucagauuaucugg

SEQ ID NO: 18960 - RNA, 20 nt, Artificial Sequence
  TRAC targeting sequence
cccaagggcacuuagcuaau

SEQ ID NO: 18961 - RNA, 20 nt, Artificial Sequence
  TRAC targeting sequence
uucccccaagggcacuuagc

SEQ ID NO: 18962 - RNA, 20 nt, Artificial Sequence
  TRAC targeting sequence
cuuucccccaagggcacuua

SEQ ID NO: 18963 - RNA, 20 nt, Artificial Sequence
  TRAC targeting sequence
ucucuuucccccaagggcac

SEQ ID NO: 18964 - RNA, 20 nt, Artificial Sequence
  TRAC targeting sequence
cuuuuauugcagcauguagc

SEQ ID NO: 18965 - RNA, 20 nt, Artificial Sequence
  TRAC targeting sequence
uuuauugcagcauguagcua

SEQ ID NO: 18966 - RNA, 20 nt, Artificial Sequence
  TRAC targeting sequence
cuggauuggcuaauaaacau

SEQ ID NO: 18967 - RNA, 20 nt, Artificial Sequence
  TRAC targeting sequence
agggaauuuagcuacaugcu

SEQ ID NO: 18968 - RNA, 20 nt, Artificial Sequence
  TRAC targeting sequence
ccauaccauguuuauuagcc

SEQ ID NO: 18969 - RNA, 20 nt, Artificial Sequence
  TRAC targeting sequence
cuacucauagaaucuuccuc

SEQ ID NO: 18970 - RNA, 20 nt, Artificial Sequence
  TRAC targeting sequence
uagaaucuuccucucuggag

SEQ ID NO: 18971 - RNA, 20 nt, Artificial Sequence
  TRAC targeting sequence
augaguagggauccccauac

SEQ ID NO: 18972 - RNA, 20 nt, Artificial Sequence
  TRAC targeting sequence
uccucucuggaguuaggaga

SEQ ID NO: 18973 - RNA, 20 nt, Artificial Sequence
  TRAC targeting sequence
ucucuggaguuaggagaguu

SEQ ID NO: 18974 - RNA, 20 nt, Artificial Sequence
  TRAC targeting sequence
cuggaguuaggagaguuuuc

SEQ ID NO: 18975 - RNA, 20 nt, Artificial Sequence
  TRAC targeting sequence
ggaguuaggagaguuuucag

SEQ ID NO: 18976 - RNA, 20 nt, Artificial Sequence
  TRAC targeting sequence
agagaggaagauucuaugag

SEQ ID NO: 18977 - RNA, 20 nt, Artificial Sequence
  TRAC targeting sequence
uaacuccagagaggaagauu

SEQ ID NO: 18978 - RNA, 20 nt, Artificial Sequence
  TRAC targeting sequence
ccuaacuccagagaggaaga

SEQ ID NO: 18979 - RNA, 20 nt, Artificial Sequence
  TRAC targeting sequence
gcuuccuccuaaggguaaaa

SEQ ID NO: 18980 - RNA, 20 nt, Artificial Sequence
  TRAC targeting sequence
uccuaaggguaaaaguggcc

SEQ ID NO: 18981 - RNA, 20 nt, Artificial Sequence
  TRAC targeting sequence
uaaggguaaaaguggcccag

SEQ ID NO: 18982 - RNA, 20 nt, Artificial Sequence
  TRAC targeting sequence
gggccacuuuuacccuuagg

SEQ ID NO: 18983 - RNA, 20 nt, Artificial Sequence
  TRAC targeting sequence
guuaggggucugggccacuu

SEQ ID NO: 18984 - RNA, 20 nt, Artificial Sequence
  TRAC targeting sequence
auaccuuguaauugcaugug

SEQ ID NO: 18985 - RNA, 20 nt, Artificial Sequence
  TRAC targeting sequence
acauugcugccucuauaccu

SEQ ID NO: 18986 - RNA, 20 nt, Artificial Sequence
  TRAC targeting sequence
cucuacauugcugccucuau

SEQ ID NO: 18987 - RNA, 20 nt, Artificial Sequence
  TRAC targeting sequence
gugggccucccucuacauug

SEQ ID NO: 18988 - RNA, 20 nt, Artificial Sequence
  TRAC targeting sequence
ccaggucugugggccucccu

SEQ ID NO: 18989 - RNA, 20 nt, Artificial Sequence
  TRAC targeting sequence
gggcucuacucucacuggcu

SEQ ID NO: 18990 - RNA, 20 nt, Artificial Sequence
  TRAC targeting sequence
acucucacuggcuguuuuca

SEQ ID NO: 18991 - RNA, 20 nt, Artificial Sequence
  TRAC targeting sequence
cacuggcuguuuucaauaaa

SEQ ID NO: 18992 - RNA, 20 nt, Artificial Sequence
  TRAC targeting sequence
cuggcuguuuucaauaaagc

SEQ ID NO: 18993 - RNA, 20 nt, Artificial Sequence
  TRAC targeting sequence
auaaagccuccacuuucuca

SEQ ID NO: 18994 - RNA, 20 nt, Artificial Sequence
  TRAC targeting sequence
acuuucucagcagcaaaaug

SEQ ID NO: 18995 - RNA, 20 nt, Artificial Sequence
  TRAC targeting sequence
cagcagcaaaaugacuauaa

SEQ ID NO: 18996 - RNA, 20 nt, Artificial Sequence
  TRAC targeting sequence
gcagcaaaaugacuauaacu

SEQ ID NO: 18997 - RNA, 20 nt, Artificial Sequence
  TRAC targeting sequence
uuuugcugcugagaaagugg

SEQ ID NO: 18998 - RNA, 20 nt, Artificial Sequence
  TRAC targeting sequence
uaauaauaugagauaauggc

SEQ ID NO: 18999 - RNA, 20 nt, Artificial Sequence
  TRAC targeting sequence
uauuauuaugauguaguuau

SEQ ID NO: 19000 - RNA, 20 nt, Artificial Sequence
  TRAC targeting sequence
cauauuauuaugauguaguu

SEQ ID NO: 19001 - RNA, 20 nt, Artificial Sequence
  TRAC targeting sequence
ggccauuaucucauauuauu

SEQ ID NO: 19002 - RNA, 20 nt, Artificial Sequence
  TRAC targeting sequence
cuuuuuacauucuggccauu

SEQ ID NO: 19003 - RNA, 20 nt, Artificial Sequence
  TRAC targeting sequence
auaaguaguagcuuuucuaa

SEQ ID NO: 19004 - RNA, 20 nt, Artificial Sequence
  TRAC targeting sequence
aaaauauuauuauaauuauu

SEQ ID NO: 19005 - RNA, 20 nt, Artificial Sequence
  TRAC targeting sequence
auaauaauaauuauaauaau

SEQ ID NO: 19006 - RNA, 20 nt, Artificial Sequence
  TRAC targeting sequence
uaaagggaaaggagaaucgc

SEQ ID NO: 19007 - RNA, 20 nt, Artificial Sequence
  TRAC targeting sequence
cuuuaugauaguguaaaccu

SEQ ID NO: 19008 - RNA, 20 nt, Artificial Sequence
  TRAC targeting sequence
uuucccuuuaugauagugua

SEQ ID NO: 19009 - RNA, 20 nt, Artificial Sequence
  TRAC targeting sequence
ccuuucccuuuaugauagug

SEQ ID NO: 19010 - RNA, 20 nt, Artificial Sequence
  TRAC targeting sequence
cuuccuugggaaauaaaaga

SEQ ID NO: 19011 - RNA, 20 nt, Artificial Sequence
  TRAC targeting sequence
uugggaaauaaaagauguaa

SEQ ID NO: 19012 - RNA, 20 nt, Artificial Sequence
  TRAC targeting sequence
caaggaagcgauucuccuuu

SEQ ID NO: 19013 - RNA, 20 nt, Artificial Sequence
  TRAC targeting sequence
uuuauuucccaaggaagcga

SEQ ID NO: 19014 - RNA, 20 nt, Artificial Sequence
  TRAC targeting sequence
uuguugcuuacaucuuuuau

SEQ ID NO: 19015 - RNA, 20 nt, Artificial Sequence
  TRAC targeting sequence
uugggucuuuguugcuuaca

SEQ ID NO: 19016 - RNA, 20 nt, Artificial Sequence
  TRAC targeting sequence
aaaaggcuccuugggucuuu

SEQ ID NO: 19017 - RNA, 20 nt, Artificial Sequence
  TRAC targeting sequence
gggaccccaguggcuuccag

SEQ ID NO: 19018 - RNA, 20 nt, Artificial Sequence
  TRAC targeting sequence
cagagcaacauucuaaaagg

SEQ ID NO: 19019 - RNA, 20 nt, Artificial Sequence
  TRAC targeting sequence
agcagauuagcaucaagaag

SEQ ID NO: 19020 - RNA, 20 nt, Artificial Sequence
  TRAC targeting sequence
gcuggaagccacuggggucc

SEQ ID NO: 19021 - RNA, 20 nt, Artificial Sequence
  TRAC targeting sequence
agaagguuaucucaaagacc

SEQ ID NO: 19022 - RNA, 20 nt, Artificial Sequence
  TRAC targeting sequence
ugaugcuaaucugcuggaag

SEQ ID NO: 19023 - RNA, 20 nt, Artificial Sequence
  TRAC targeting sequence
caaagaccuuacccacagug

SEQ ID NO: 19024 - RNA, 20 nt, Artificial Sequence
  TRAC targeting sequence
aagaccuuacccacaguggg

SEQ ID NO: 19025 - RNA, 20 nt, Artificial Sequence
  TRAC targeting sequence
uugagauaaccuucuugaug

SEQ ID NO: 19026 - RNA, 20 nt, Artificial Sequence
  TRAC targeting sequence
aagauaaucuuuggaucagg

SEQ ID NO: 19027 - RNA, 20 nt, Artificial Sequence
  TRAC targeting sequence
uggaagcacugcuguacccc

SEQ ID NO: 19028 - RNA, 20 nt, Artificial Sequence
  TRAC targeting sequence
uuggaucagggaccagacuc

SEQ ID NO: 19029 - RNA, 20 nt, Artificial Sequence
  TRAC targeting sequence
aaagauuaucuuggaagcac

SEQ ID NO: 19030 - RNA, 20 nt, Artificial Sequence
  TRAC targeting sequence
gggaccagacucagcauccg

SEQ ID NO: 19031 - RNA, 20 nt, Artificial Sequence
  TRAC targeting sequence
cugauccaaagauuaucuug

SEQ ID NO: 19032 - RNA, 20 nt, Artificial Sequence
  TRAC targeting sequence
ggucccugauccaaagauua

SEQ ID NO: 19033 - RNA, 20 nt, Artificial Sequence
  TRAC targeting sequence
gcauccggccaaguaaguag

SEQ ID NO: 19034 - RNA, 20 nt, Artificial Sequence
  TRAC targeting sequence
ggccaaguaaguagaaugaa

SEQ ID NO: 19035 - RNA, 20 nt, Artificial Sequence
  TRAC targeting sequence
acuuacuuggccggaugcug

SEQ ID NO: 19036 - RNA, 20 nt, Artificial Sequence
  TRAC targeting sequence
uucuacuuacuuggccggau

SEQ ID NO: 19037 - RNA, 20 nt, Artificial Sequence
  TRAC targeting sequence
ugcuucauucuacuuacuug

SEQ ID NO: 19038 - RNA, 20 nt, Artificial Sequence
  TRAC targeting sequence
ccugcuucauucuacuuacu

SEQ ID NO: 19039 - RNA, 20 nt, Artificial Sequence
  TRAC targeting sequence
cuugcucuccugcuucauuc

SEQ ID NO: 19040 - RNA, 20 nt, Artificial Sequence
  TRAC targeting sequence
ucccuugcucuccugcuuca

SEQ ID NO: 19041 - RNA, 20 nt, Artificial Sequence
  TRAC targeting sequence
guccucccuugcucuccugc

SEQ ID NO: 19042 - RNA, 20 nt, Artificial Sequence
  TRAC targeting sequence
ucuuuguccaaaaugccaac

SEQ ID NO: 19043 - RNA, 20 nt, Artificial Sequence
  TRAC targeting sequence
uuguccaaaaugccaacuug

SEQ ID NO: 19044 - RNA, 20 nt, Artificial Sequence
  TRAC targeting sequence
aaaaugccaacuugaaccca

SEQ ID NO: 19045 - RNA, 20 nt, Artificial Sequence
  TRAC targeting sequence
aguuggcauuuuggacaaag

SEQ ID NO: 19046 - RNA, 20 nt, Artificial Sequence
  TRAC targeting sequence
ucugugggcuccaaaauggu

SEQ ID NO: 19047 - RNA, 20 nt, Artificial Sequence
  TRAC targeting sequence
gugggcuccaaaaugguuuc

SEQ ID NO: 19048 - RNA, 20 nt, Artificial Sequence
  TRAC targeting sequence
aaaaugguuucuuccaccca

SEQ ID NO: 19049 - RNA, 20 nt, Artificial Sequence
  TRAC targeting sequence
uccacccauccccagaaaau

SEQ ID NO: 19050 - RNA, 20 nt, Artificial Sequence
  TRAC targeting sequence
acccauccccagaaaauccu

SEQ ID NO: 19051 - RNA, 20 nt, Artificial Sequence
  TRAC targeting sequence
ccagaaaauccucccaucca

SEQ ID NO: 19052 - RNA, 20 nt, Artificial Sequence
  TRAC targeting sequence
ggggauggguggaagaaacc

SEQ ID NO: 19053 - RNA, 20 nt, Artificial Sequence
  TRAC targeting sequence
ucccauccagcucucggugc

SEQ ID NO: 19054 - RNA, 20 nt, Artificial Sequence
  TRAC targeting sequence
cauccagcucucggugcucu

SEQ ID NO: 19055 - RNA, 20 nt, Artificial Sequence
  TRAC targeting sequence
agcucucggugcucugcaga

SEQ ID NO: 19056 - RNA, 20 nt, Artificial Sequence
  TRAC targeting sequence
cggugcucugcagacaucau

SEQ ID NO: 19057 - RNA, 20 nt, Artificial Sequence
  TRAC targeting sequence
gugcucugcagacaucaucc

SEQ ID NO: 19058 - RNA, 20 nt, Artificial Sequence
  TRAC targeting sequence
gcagacaucauccuuaggcu

SEQ ID NO: 19059 - RNA, 20 nt, Artificial Sequence
  TRAC targeting sequence
gcagagcaccgagagcugga

SEQ ID NO: 19060 - RNA, 20 nt, Artificial Sequence
  TRAC targeting sequence
uccuuaggcugggaccuuag

SEQ ID NO: 19061 - RNA, 20 nt, Artificial Sequence
  TRAC targeting sequence
uuaggcugggaccuuaggaa

SEQ ID NO: 19062 - RNA, 20 nt, Artificial Sequence
  TRAC targeting sequence
cagccuaaggaugaugucug

SEQ ID NO: 19063 - RNA, 20 nt, Artificial Sequence
  TRAC targeting sequence
uaaggucccagccuaaggau

SEQ ID NO: 19064 - RNA, 20 nt, Artificial Sequence
  TRAC targeting sequence
ugguuccuaaggucccagcc

SEQ ID NO: 19065 - RNA, 20 nt, Artificial Sequence
  TRAC targeting sequence
uugccugccucaugguuccu

SEQ ID NO: 19066 - RNA, 20 nt, Artificial Sequence
  TRAC targeting sequence
cucauugccugccucauggu

SEQ ID NO: 19067 - RNA, 20 nt, Artificial Sequence
  TRAC targeting sequence
ugaaccuuccacaaacauau

SEQ ID NO: 19068 - RNA, 20 nt, Artificial Sequence
  TRAC targeting sequence
ggaguacucgcucauugccu

SEQ ID NO: 19069 - RNA, 20 nt, Artificial Sequence
  TRAC targeting sequence
acaaacauauccaagauacu

SEQ ID NO: 19070 - RNA, 20 nt, Artificial Sequence
  TRAC targeting sequence
aagauacugcugccuggaau

SEQ ID NO: 19071 - RNA, 20 nt, Artificial Sequence
  TRAC targeting sequence
uggauauguuuguggaaggu

SEQ ID NO: 19072 - RNA, 20 nt, Artificial Sequence
  TRAC targeting sequence
aggcagcaguaucuuggaua

SEQ ID NO: 19073 - RNA, 20 nt, Artificial Sequence
  TRAC targeting sequence
auuccaggcagcaguaucuu

SEQ ID NO: 19074 - RNA, 20 nt, Artificial Sequence
  TRAC targeting sequence
agggaauuauugguuuauug

SEQ ID NO: 19075 - RNA, 20 nt, Artificial Sequence
  TRAC targeting sequence
cuagaacaaaaaccucaauu

SEQ ID NO: 19076 - RNA, 20 nt, Artificial Sequence
  TRAC targeting sequence
auaaaccaauaauucccuag

SEQ ID NO: 19077 - RNA, 20 nt, Artificial Sequence
  TRAC targeting sequence
uaugaagucacaaccucagc

SEQ ID NO: 19078 - RNA, 20 nt, Artificial Sequence
  TRAC targeting sequence
uaugauuucaauaaaccaau

SEQ ID NO: 19079 - RNA, 20 nt, Artificial Sequence
  TRAC targeting sequence
caaccucagcccagggaauc

SEQ ID NO: 19080 - RNA, 20 nt, Artificial Sequence
  TRAC targeting sequence
gcccagggaaucacagcaga

SEQ ID NO: 19081 - RNA, 20 nt, Artificial Sequence
  TRAC targeting sequence
cugggcugagguugugacuu

SEQ ID NO: 19082 - RNA, 20 nt, Artificial Sequence
  TRAC targeting sequence
cagcagaauggaacaggagg

SEQ ID NO: 19083 - RNA, 20 nt, Artificial Sequence
  TRAC targeting sequence
gcugugauucccugggcuga

SEQ ID NO: 19084 - RNA, 20 nt, Artificial Sequence
  TRAC targeting sequence
auucugcugugauucccugg

SEQ ID NO: 19085 - RNA, 20 nt, Artificial Sequence
  TRAC targeting sequence
uguuccauucugcugugauu

SEQ ID NO: 19086 - RNA, 20 nt, Artificial Sequence
  TRAC targeting sequence
uccuguuccauucugcugug

SEQ ID NO: 19087 - RNA, 20 nt, Artificial Sequence
  TRAC targeting sequence
ccuccuguuccauucugcug

SEQ ID NO: 19088 - RNA, 20 nt, Artificial Sequence
  TRAC targeting sequence
gaagcgaaauuucagugcaa

SEQ ID NO: 19089 - RNA, 20 nt, Artificial Sequence
  TRAC targeting sequence
gauacaaaaguucuccuccu

SEQ ID NO: 19090 - RNA, 20 nt, Artificial Sequence
  TRAC targeting sequence
cuucugauacaaaaguucuc

SEQ ID NO: 19091 - RNA, 20 nt, Artificial Sequence
  TRAC targeting sequence
gugcaaaagagcagaagguu

SEQ ID NO: 19092 - RNA, 20 nt, Artificial Sequence
  TRAC targeting sequence
uuugcacugaaauuucgcuu

SEQ ID NO: 19093 - RNA, 20 nt, Artificial Sequence
  TRAC targeting sequence
gcucuuuugcacugaaauuu

SEQ ID NO: 19094 - RNA, 20 nt, Artificial Sequence
  TRAC targeting sequence
cgccuguaauccuagcacuu

SEQ ID NO: 19095 - RNA, 20 nt, Artificial Sequence
  TRAC targeting sequence
uagcacuuugggaggccgag

SEQ ID NO: 19096 - RNA, 20 nt, Artificial Sequence
  TRAC targeting sequence
caaagugcuaggauuacagg

SEQ ID NO: 19097 - RNA, 20 nt, Artificial Sequence
  TRAC targeting sequence
gccucccaaagugcuaggau

SEQ ID NO: 19098 - RNA, 20 nt, Artificial Sequence
  TRAC targeting sequence
cugccucggccucccaaagu

SEQ ID NO: 19099 - RNA, 20 nt, Artificial Sequence
  TRAC targeting sequence
cccugccucggccucccaaa

SEQ ID NO: 19100 - RNA, 20 nt, Artificial Sequence
  TRAC targeting sequence
caaggucaggagaucaagac

SEQ ID NO: 19101 - RNA, 20 nt, Artificial Sequence
  TRAC targeting sequence
ggagaucaagaccauccugg

SEQ ID NO: 19102 - RNA, 20 nt, Artificial Sequence
  TRAC targeting sequence
ugaccuugugaucucccugc

SEQ ID NO: 19103 - RNA, 20 nt, Artificial Sequence
  TRAC targeting sequence
ccugaccuugugaucucccu

SEQ ID NO: 19104 - RNA, 20 nt, Artificial Sequence
  TRAC targeting sequence
agaccauccuggcuaacaca

SEQ ID NO: 19105 - RNA, 20 nt, Artificial Sequence
  TRAC targeting sequence
ugaucuccugaccuugugau

SEQ ID NO: 19106 - RNA, 20 nt, Artificial Sequence
  TRAC targeting sequence
uggcuaacacagugaaaccc

SEQ ID NO: 19107 - RNA, 20 nt, Artificial Sequence
  TRAC targeting sequence
cuguguuagccaggaugguc

SEQ ID NO: 19108 - RNA, 20 nt, Artificial Sequence
  TRAC targeting sequence
cuacuaaaaauacaaaaauu

SEQ ID NO: 19109 - RNA, 20 nt, Artificial Sequence
  TRAC targeting sequence
acuaaaaauacaaaaauuag

SEQ ID NO: 19110 - RNA, 20 nt, Artificial Sequence
  TRAC targeting sequence
cgcccggcuaauuuuuguau

SEQ ID NO: 19111 - RNA, 20 nt, Artificial Sequence
  TRAC targeting sequence
cagcuacucgggagacugag

SEQ ID NO: 19112 - RNA, 20 nt, Artificial Sequence
  TRAC targeting sequence
gcuacucgggagacugaggc

SEQ ID NO: 19113 - RNA, 20 nt, Artificial Sequence
  TRAC targeting sequence
ggagacugaggcaggagaau

SEQ ID NO: 19114 - RNA, 20 nt, Artificial Sequence
  TRAC targeting sequence
cgaguagcugagacuacagg

SEQ ID NO: 19115 - RNA, 20 nt, Artificial Sequence
  TRAC targeting sequence
cccgaguagcugagacuaca

SEQ ID NO: 19116 - RNA, 20 nt, Artificial Sequence
  TRAC targeting sequence
gucucccgaguagcugagac

SEQ ID NO: 19117 - RNA, 20 nt, Artificial Sequence
  TRAC targeting sequence
ugccucagucucccgaguag

SEQ ID NO: 19118 - RNA, 20 nt, Artificial Sequence
  TRAC targeting sequence
ccugccucagucucccgagu

SEQ ID NO: 19119 - RNA, 20 nt, Artificial Sequence
  TRAC targeting sequence
acaauucuccugccucaguc

SEQ ID NO: 19120 - RNA, 20 nt, Artificial Sequence
  TRAC targeting sequence
cggguucaacaauucuccug

SEQ ID NO: 19121 - RNA, 20 nt, Artificial Sequence
  TRAC targeting sequence
gccucccggguucaacaauu

SEQ ID NO: 19122 - RNA, 20 nt, Artificial Sequence
  TRAC targeting sequence
cugccucccggguucaacaa

SEQ ID NO: 19123 - RNA, 20 nt, Artificial Sequence
  TRAC targeting sequence
cugcaaucucugccucccgg

SEQ ID NO: 19124 - RNA, 20 nt, Artificial Sequence
  TRAC targeting sequence
gcucacugcaaucucugccu

SEQ ID NO: 19125 - RNA, 20 nt, Artificial Sequence
  TRAC targeting sequence
cagcucacugcaaucucugc

SEQ ID NO: 19126 - RNA, 20 nt, Artificial Sequence
  TRAC targeting sequence
caucauugcacuccagccug

SEQ ID NO: 19127 - RNA, 20 nt, Artificial Sequence
  TRAC targeting sequence
uugcacuccagccugggcaa

SEQ ID NO: 19128 - RNA, 20 nt, Artificial Sequence
  TRAC targeting sequence
agccugggcaacagagcaag

SEQ ID NO: 19129 - RNA, 20 nt, Artificial Sequence
  TRAC targeting sequence
guugcccaggcuggagugca

SEQ ID NO: 19130 - RNA, 20 nt, Artificial Sequence
  TRAC targeting sequence
ugcucuguugcccaggcugg

SEQ ID NO: 19131 - RNA, 20 nt, Artificial Sequence
  TRAC targeting sequence
uucucaaaaaaacaaaaaaa

SEQ ID NO: 19132 - RNA, 20 nt, Artificial Sequence
  TRAC targeting sequence
caaaaaaacaaaaaaaaaaa

SEQ ID NO: 19133 - RNA, 20 nt, Artificial Sequence
  TRAC targeting sequence
aaaaaacaaaaaaaaaaaaa

SEQ ID NO: 19134 - RNA, 20 nt, Artificial Sequence
  TRAC targeting sequence
uuuuuuuuuuuuuuuuuguu

SEQ ID NO: 19135 - RNA, 20 nt, Artificial Sequence
  TRAC targeting sequence
aacccuuaggagugugauua

SEQ ID NO: 19136 - RNA, 20 nt, Artificial Sequence
  TRAC targeting sequence
uaaggguuagaccuucuuuu

SEQ ID NO: 19137 - RNA, 20 nt, Artificial Sequence
  TRAC targeting sequence
cacuccuaaggguuagaccu

SEQ ID NO: 19138 - RNA, 20 nt, Artificial Sequence
  TRAC targeting sequence
uguucuccugccuugugggg

SEQ ID NO: 19139 - RNA, 20 nt, Artificial Sequence
  TRAC targeting sequence
ccugccuugugggggagauc

SEQ ID NO: 19140 - RNA, 20 nt, Artificial Sequence
  TRAC targeting sequence
ugccuugugggggagaucag

SEQ ID NO: 19141 - RNA, 20 nt, Artificial Sequence
  TRAC targeting sequence
cccacaaggcaggagaacag

SEQ ID NO: 19142 - RNA, 20 nt, Artificial Sequence
  TRAC targeting sequence
cccccacaaggcaggagaac

SEQ ID NO: 19143 - RNA, 20 nt, Artificial Sequence
  TRAC targeting sequence
guguuucucuuauuuaagua

SEQ ID NO: 19144 - RNA, 20 nt, Artificial Sequence
  TRAC targeting sequence
cuuauuuaaguaauagguag

SEQ ID NO: 19145 - RNA, 20 nt, Artificial Sequence
  TRAC targeting sequence
uauuuaaguaauagguaggu

SEQ ID NO: 19146 - RNA, 20 nt, Artificial Sequence
  TRAC targeting sequence
ugugaguuugugcaauggug

SEQ ID NO: 19147 - RNA, 20 nt, Artificial Sequence
  TRAC targeting sequence
caggaccuaccuauuacuua

SEQ ID NO: 19148 - RNA, 20 nt, Artificial Sequence
  TRAC targeting sequence
ccuacgguaugaauacugga

SEQ ID NO: 19149 - RNA, 20 nt, Artificial Sequence
  TRAC targeting sequence
uaccguaggugacaccauug

SEQ ID NO: 19150 - RNA, 20 nt, Artificial Sequence
  TRAC targeting sequence
aguauucauaccguagguga

SEQ ID NO: 19151 - RNA, 20 nt, Artificial Sequence
  TRAC targeting sequence
uccaguauucauaccguagg

SEQ ID NO: 19152 - RNA, 20 nt, Artificial Sequence
  TRAC targeting sequence
auuguuccuccaguauucau

SEQ ID NO: 19153 - RNA, 20 nt, Artificial Sequence
  TRAC targeting sequence
cauuugggaaagggacccau

SEQ ID NO: 19154 - RNA, 20 nt, Artificial Sequence
  TRAC targeting sequence
caaaugugaguuuaucaauu

SEQ ID NO: 19155 - RNA, 20 nt, Artificial Sequence
  TRAC targeting sequence
cuuucccaaaugugaguuua

SEQ ID NO: 19156 - RNA, 20 nt, Artificial Sequence
  TRAC targeting sequence
uuauaucuggugagucaucc

SEQ ID NO: 19157 - RNA, 20 nt, Artificial Sequence
  TRAC targeting sequence
ggugagucaucccagguggc

SEQ ID NO: 19158 - RNA, 20 nt, Artificial Sequence
  TRAC targeting sequence
ccagauauaaugaauacaug

SEQ ID NO: 19159 - RNA, 20 nt, Artificial Sequence
  TRAC targeting sequence
ucccagguggcaccacgugc

SEQ ID NO: 19160 - RNA, 20 nt, Artificial Sequence
  TRAC targeting sequence
cagguggcaccacgugcaac

SEQ ID NO: 19161 - RNA, 20 nt, Artificial Sequence
  TRAC targeting sequence
cuaauccuuucucuggagau

SEQ ID NO: 19162 - RNA, 20 nt, Artificial Sequence
  TRAC targeting sequence
uuucucuggagauaucacuu

SEQ ID NO: 19163 - RNA, 20 nt, Artificial Sequence
  TRAC targeting sequence
cuggagauaucacuuauuac

SEQ ID NO: 19164 - RNA, 20 nt, Artificial Sequence
  TRAC targeting sequence
ggagauaucacuuauuacua

SEQ ID NO: 19165 - RNA, 20 nt, Artificial Sequence
  TRAC targeting sequence
agagaaaggauuagugacac

SEQ ID NO: 19166 - RNA, 20 nt, Artificial Sequence
  TRAC targeting sequence
ccagagaaaggauuagugac

SEQ ID NO: 19167 - RNA, 20 nt, Artificial Sequence
  TRAC targeting sequence
cuuauuacuauggugaggcu

SEQ ID NO: 19168 - RNA, 20 nt, Artificial Sequence
  TRAC targeting sequence
ccauaguaauaagugauauc

SEQ ID NO: 19169 - RNA, 20 nt, Artificial Sequence
  TRAC targeting sequence
acagcaagccucaccauagu

SEQ ID NO: 19170 - RNA, 20 nt, Artificial Sequence
  TRAC targeting sequence
uacagaggucugggaaggga

SEQ ID NO: 19171 - RNA, 20 nt, Artificial Sequence
  TRAC targeting sequence
guaagaaaauuaguuacaac

SEQ ID NO: 19172 - RNA, 20 nt, Artificial Sequence
  TRAC targeting sequence
gggaagggaaaagcauuacu

SEQ ID NO: 19173 - RNA, 20 nt, Artificial Sequence
  TRAC targeting sequence
cagaccucuguaagaaaauu

SEQ ID NO: 19174 - RNA, 20 nt, Artificial Sequence
  TRAC targeting sequence
cuucccagaccucuguaaga

SEQ ID NO: 19175 - RNA, 20 nt, Artificial Sequence
  TRAC targeting sequence
aucuugaauauucauguuuc

SEQ ID NO: 19176 - RNA, 20 nt, Artificial Sequence
  TRAC targeting sequence
ugaauauucauguuucucua

SEQ ID NO: 19177 - RNA, 20 nt, Artificial Sequence
  TRAC targeting sequence
agauagauaguaaugcuuuu

SEQ ID NO: 19178 - RNA, 20 nt, Artificial Sequence
  TRAC targeting sequence
uguuucucuaggucaaacac

SEQ ID NO: 19179 - RNA, 20 nt, Artificial Sequence
  TRAC targeting sequence
cuaggucaaacacauuaaaa

SEQ ID NO: 19180 - RNA, 20 nt, Artificial Sequence
  TRAC targeting sequence
aggucaaacacauuaaaauu

SEQ ID NO: 19181 - RNA, 20 nt, Artificial Sequence
  TRAC targeting sequence
aacacauuaaaauuugacuu

SEQ ID NO: 19182 - RNA, 20 nt, Artificial Sequence
  TRAC targeting sequence
aauuuuaauguguuugaccu

SEQ ID NO: 19183 - RNA, 20 nt, Artificial Sequence
  TRAC targeting sequence
uucaauggguauuguaaaau

SEQ ID NO: 19184 - RNA, 20 nt, Artificial Sequence
  TRAC targeting sequence
auggguauuguaaaaugccu

SEQ ID NO: 19185 - RNA, 20 nt, Artificial Sequence
  TRAC targeting sequence
augugacuaucacucuauaa

SEQ ID NO: 19186 - RNA, 20 nt, Artificial Sequence
  TRAC targeting sequence
cauagaaggcauuuuacaau

SEQ ID NO: 19187 - RNA, 20 nt, Artificial Sequence
  TRAC targeting sequence
cucuauaaaauguuagacug

SEQ ID NO: 19188 - RNA, 20 nt, Artificial Sequence
  TRAC targeting sequence
auaaaauguuagacugagua

SEQ ID NO: 19189 - RNA, 20 nt, Artificial Sequence
  TRAC targeting sequence
aacauuuuauagagugauag

SEQ ID NO: 19190 - RNA, 20 nt, Artificial Sequence
  TRAC targeting sequence
gucuaacauuuuauagagug

SEQ ID NO: 19191 - RNA, 20 nt, Artificial Sequence
  TRAC targeting sequence
uacucagucuaacauuuuau

SEQ ID NO: 19192 - RNA, 20 nt, Artificial Sequence
  TRAC targeting sequence
cacuucauacucagucuaac

SEQ ID NO: 19193 - RNA, 20 nt, Artificial Sequence
  TRAC targeting sequence
cacacuucauacucagucua

SEQ ID NO: 19194 - RNA, 20 nt, Artificial Sequence
  TRAC targeting sequence
aucucacacuucauacucag

SEQ ID NO: 19195 - RNA, 20 nt, Artificial Sequence
  TRAC targeting sequence
uguccuguccucaaguggua

SEQ ID NO: 19196 - RNA, 20 nt, Artificial Sequence
  TRAC targeting sequence
uguccucaagugguauaaaa

SEQ ID NO: 19197 - RNA, 20 nt, Artificial Sequence
  TRAC targeting sequence
ucaagugguauaaaaacuag

SEQ ID NO: 19198 - RNA, 20 nt, Artificial Sequence
  TRAC targeting sequence
agugguauaaaaacuagaca

SEQ ID NO: 19199 - RNA, 20 nt, Artificial Sequence
  TRAC targeting sequence
aguuuuuauaccacuugagg

SEQ ID NO: 19200 - RNA, 20 nt, Artificial Sequence
  TRAC targeting sequence
guaccuuugucuaguuuuua

SEQ ID NO: 19201 - RNA, 20 nt, Artificial Sequence
  TRAC targeting sequence
ggcugcuuaauuuacaauag

SEQ ID NO: 19202 - RNA, 20 nt, Artificial Sequence
  TRAC targeting sequence
auacuaaaauaguuuucugg

SEQ ID NO: 19203 - RNA, 20 nt, Artificial Sequence
  TRAC targeting sequence
acuggucaauacuaaaauag

SEQ ID NO: 19204 - RNA, 20 nt, Artificial Sequence
  TRAC targeting sequence
ucaacuggucaauacuaaaa

SEQ ID NO: 19205 - RNA, 20 nt, Artificial Sequence
  TRAC targeting sequence
auggacacaauagagauuca

SEQ ID NO: 19206 - RNA, 20 nt, Artificial Sequence
  TRAC targeting sequence
auugacaucaucaacugguc

SEQ ID NO: 19207 - RNA, 20 nt, Artificial Sequence
  TRAC targeting sequence
auuguguccauugacaucau

SEQ ID NO: 19208 - RNA, 20 nt, Artificial Sequence
  TRAC targeting sequence
cuauuguguccauugacauc

SEQ ID NO: 19209 - RNA, 20 nt, Artificial Sequence
  TRAC targeting sequence
gaggggauagggugcuggcu

SEQ ID NO: 19210 - RNA, 20 nt, Artificial Sequence
  TRAC targeting sequence
gaaucucuauuguguccauu

SEQ ID NO: 19211 - RNA, 20 nt, Artificial Sequence
  TRAC targeting sequence
ccucugaaucucuauugugu

SEQ ID NO: 19212 - RNA, 20 nt, Artificial Sequence
  TRAC targeting sequence
gccagcacccuauccccucu

SEQ ID NO: 19213 - RNA, 20 nt, Artificial Sequence
  TRAC targeting sequence
cagccagcacccuauccccu

SEQ ID NO: 19214 - RNA, 20 nt, Artificial Sequence
  TRAC targeting sequence
aggccaacuucucagccagc

SEQ ID NO: 19215 - RNA, 20 nt, Artificial Sequence
  TRAC targeting sequence
gucuaggccaacuucucagc

SEQ ID NO: 19216 - RNA, 20 nt, Artificial Sequence
  TRAC targeting sequence
cagucuaggccaacuucuca

SEQ ID NO: 19217 - RNA, 20 nt, Artificial Sequence
  TRAC targeting sequence
ugugguacaaaggauucauu

SEQ ID NO: 19218 - RNA, 20 nt, Artificial Sequence
  TRAC targeting sequence
uuuguaccacaggaaacuuc

SEQ ID NO: 19219 - RNA, 20 nt, Artificial Sequence
  TRAC targeting sequence
uugagcccugaaggauggau

SEQ ID NO: 19220 - RNA, 20 nt, Artificial Sequence
  TRAC targeting sequence
augaauccuuuguaccacag

SEQ ID NO: 19221 - RNA, 20 nt, Artificial Sequence
  TRAC targeting sequence
gggcucaaugaauccuuugu

SEQ ID NO: 19222 - RNA, 20 nt, Artificial Sequence
  TRAC targeting sequence
uucagggcucaaugaauccu

SEQ ID NO: 19223 - RNA, 20 nt, Artificial Sequence
  TRAC targeting sequence
auccuucagggcucaaugaa

SEQ ID NO: 19224 - RNA, 20 nt, Artificial Sequence
  TRAC targeting sequence
uauccauccuucagggcuca

SEQ ID NO: 19225 - RNA, 20 nt, Artificial Sequence
  TRAC targeting sequence
guaugggcagagaaaggaga

SEQ ID NO: 19226 - RNA, 20 nt, Artificial Sequence
  TRAC targeting sequence
gcccauacagaucuuaucca

SEQ ID NO: 19227 - RNA, 20 nt, Artificial Sequence
  TRAC targeting sequence
cugcccauacagaucuuauc

SEQ ID NO: 19228 - RNA, 20 nt, Artificial Sequence
  TRAC targeting sequence
uuucucugcccauacagauc

SEQ ID NO: 19229 - RNA, 20 nt, Artificial Sequence
  TRAC targeting sequence
ccuuucucugcccauacaga

SEQ ID NO: 19230 - RNA, 20 nt, Artificial Sequence
  TRAC targeting sequence
cuccuuucucugcccauaca

SEQ ID NO: 19231 - RNA, 20 nt, Artificial Sequence
  TRAC targeting sequence
cuucucuccuuucucugccc

SEQ ID NO: 19232 - RNA, 20 nt, Artificial Sequence
  TRAC targeting sequence
gggcguagggaacgacaaga

SEQ ID NO: 19233 - RNA, 20 nt, Artificial Sequence
  TRAC targeting sequence
cuacgcccagaacuucccuu

SEQ ID NO: 19234 - RNA, 20 nt, Artificial Sequence
  TRAC targeting sequence
uucccuacgcccagaacuuc

SEQ ID NO: 19235 - RNA, 20 nt, Artificial Sequence
  TRAC targeting sequence
ugucguucccuacgcccaga

SEQ ID NO: 19236 - RNA, 20 nt, Artificial Sequence
  TRAC targeting sequence
uucuugucguucccuacgcc

SEQ ID NO: 19237 - RNA, 20 nt, Artificial Sequence
  TRAC targeting sequence
ugccuucuuucuugucguuc

SEQ ID NO: 19238 - RNA, 20 nt, Artificial Sequence
  TRAC targeting sequence
ugggaauaaucaaggcacau

SEQ ID NO: 19239 - RNA, 20 nt, Artificial Sequence
  TRAC targeting sequence
caagaucaugccuucuuucu

SEQ ID NO: 19240 - RNA, 20 nt, Artificial Sequence
  TRAC targeting sequence
aggcacaugcaaaguagccu

SEQ ID NO: 19241 - RNA, 20 nt, Artificial Sequence
  TRAC targeting sequence
gauaauaaaauugguugaaa

SEQ ID NO: 19242 - RNA, 20 nt, Artificial Sequence
  TRAC targeting sequence
gauguauacuuaggcuacuu

SEQ ID NO: 19243 - RNA, 20 nt, Artificial Sequence
  TRAC targeting sequence
accaauuuuauuaucagaug

SEQ ID NO: 19244 - RNA, 20 nt, Artificial Sequence
  TRAC targeting sequence
gagaagaugucuuuuuaggc

SEQ ID NO: 19245 - RNA, 20 nt, Artificial Sequence
  TRAC targeting sequence
gacuacuuuucaaccaauuu

SEQ ID NO: 19246 - RNA, 20 nt, Artificial Sequence
  TRAC targeting sequence
cugacuacuuuucaaccaau

SEQ ID NO: 19247 - RNA, 20 nt, Artificial Sequence
  TRAC targeting sequence
ucucugacuacuuuucaacc

SEQ ID NO: 19248 - RNA, 20 nt, Artificial Sequence
  TRAC targeting sequence
uuuuaggcauggaaaaagga

SEQ ID NO: 19249 - RNA, 20 nt, Artificial Sequence
  TRAC targeting sequence
augccuaaaaagacaucuuc

SEQ ID NO: 19250 - RNA, 20 nt, Artificial Sequence
  TRAC targeting sequence
uuuuuccaugccuaaaaaga

SEQ ID NO: 19251 - RNA, 20 nt, Artificial Sequence
  TRAC targeting sequence
aguauuuccuuuuuccaugc

SEQ ID NO: 19252 - RNA, 20 nt, Artificial Sequence
  TRAC targeting sequence
acagaauacagaaauuaggg

SEQ ID NO: 19253 - RNA, 20 nt, Artificial Sequence
  TRAC targeting sequence
guugaaugcucuaguauuuc

SEQ ID NO: 19254 - RNA, 20 nt, Artificial Sequence
  TRAC targeting sequence
guauucuguugaaugcucua

SEQ ID NO: 19255 - RNA, 20 nt, Artificial Sequence
  TRAC targeting sequence
caauggcuggcccuggcccu

SEQ ID NO: 19256 - RNA, 20 nt, Artificial Sequence
  TRAC targeting sequence
guuucccaauggcuggcccu

SEQ ID NO: 19257 - RNA, 20 nt, Artificial Sequence
  TRAC targeting sequence
caguuucccaauggcuggcc

SEQ ID NO: 19258 - RNA, 20 nt, Artificial Sequence
  TRAC targeting sequence
gauuuagagaugcagacuag

SEQ ID NO: 19259 - RNA, 20 nt, Artificial Sequence
  TRAC targeting sequence
gauucucaguuucccaaugg

SEQ ID NO: 19260 - RNA, 20 nt, Artificial Sequence
  TRAC targeting sequence
aaaucggauucucaguuucc

SEQ ID NO: 19261 - RNA, 20 nt, Artificial Sequence
  TRAC targeting sequence
cuaaaucggauucucaguuu

SEQ ID NO: 19262 - RNA, 20 nt, Artificial Sequence
  TRAC targeting sequence
gcaucucuaaaucggauucu

SEQ ID NO: 19263 - RNA, 20 nt, Artificial Sequence
  TRAC targeting sequence
agucugcaucucuaaaucgg

SEQ ID NO: 19264 - RNA, 20 nt, Artificial Sequence
  TRAC targeting sequence
cuucuagucugcaucucuaa

SEQ ID NO: 19265 - RNA, 20 nt, Artificial Sequence
  TRAC targeting sequence
ccuucacuucuagucugcau

SEQ ID NO: 19266 - RNA, 20 nt, Artificial Sequence
  TRAC targeting sequence
caccuucacuucuagucugc

SEQ ID NO: 19267 - RNA, 20 nt, Artificial Sequence
  TRAC targeting sequence
gcggcaccauagcuggcugc

SEQ ID NO: 19268 - RNA, 20 nt, Artificial Sequence
  TRAC targeting sequence
ccucuccuuccucagugggc

SEQ ID NO: 19269 - RNA, 20 nt, Artificial Sequence
  TRAC targeting sequence
ccuuccucagugggcucuga

SEQ ID NO: 19270 - RNA, 20 nt, Artificial Sequence
  TRAC targeting sequence
uuccucagugggcucugaga

SEQ ID NO: 19271 - RNA, 20 nt, Artificial Sequence
  TRAC targeting sequence
ucagugggcucugagagggg

SEQ ID NO: 19272 - RNA, 20 nt, Artificial Sequence
  TRAC targeting sequence
gugggcucugagagggguca

SEQ ID NO: 19273 - RNA, 20 nt, Artificial Sequence
  TRAC targeting sequence
gagaggggucaucccacacc

SEQ ID NO: 19274 - RNA, 20 nt, Artificial Sequence
  TRAC targeting sequence
gagcccacugaggaaggaga

SEQ ID NO: 19275 - RNA, 20 nt, Artificial Sequence
  TRAC targeting sequence
cagagcccacugaggaagga

SEQ ID NO: 19276 - RNA, 20 nt, Artificial Sequence
  TRAC targeting sequence
ucccacaccuuagaggagga

SEQ ID NO: 19277 - RNA, 20 nt, Artificial Sequence
  TRAC targeting sequence
cacaccuuagaggaggagaa

SEQ ID NO: 19278 - RNA, 20 nt, Artificial Sequence
  TRAC targeting sequence
aaggugugggaugaccccuc

SEQ ID NO: 19279 - RNA, 20 nt, Artificial Sequence
  TRAC targeting sequence
ucuaaggugugggaugaccc

SEQ ID NO: 19280 - RNA, 20 nt, Artificial Sequence
  TRAC targeting sequence
uccucuaaggugugggauga

SEQ ID NO: 19281 - RNA, 20 nt, Artificial Sequence
  TRAC targeting sequence
ccuccucuaaggugugggau

SEQ ID NO: 19282 - RNA, 20 nt, Artificial Sequence
  TRAC targeting sequence
cuuagguuucuccuccucua

SEQ ID NO: 19283 - RNA, 20 nt, Artificial Sequence
  TRAC targeting sequence
guaauagagacacggggcau

SEQ ID NO: 19284 - RNA, 20 nt, Artificial Sequence
  TRAC targeting sequence
auuacagaaucccuuagguu

SEQ ID NO: 19285 - RNA, 20 nt, Artificial Sequence
  TRAC targeting sequence
cuauuacagaaucccuuagg

SEQ ID NO: 19286 - RNA, 20 nt, Artificial Sequence
  TRAC targeting sequence
uaccaugccccgugucucua

SEQ ID NO: 19287 - RNA, 20 nt, Artificial Sequence
  TRAC targeting sequence
caguugcaauuuggcaaagg

SEQ ID NO: 19288 - RNA, 20 nt, Artificial Sequence
  TRAC targeting sequence
uuugccaaauugcaacuggg

SEQ ID NO: 19289 - RNA, 20 nt, Artificial Sequence
  TRAC targeting sequence
gguuccuuugccaaauugca

SEQ ID NO: 19290 - RNA, 20 nt, Artificial Sequence
  TRAC targeting sequence
acuucuccccguacgucugc

SEQ ID NO: 19291 - RNA, 20 nt, Artificial Sequence
  TRAC targeting sequence
ccccguacgucugcccaugc

SEQ ID NO: 19292 - RNA, 20 nt, Artificial Sequence
  TRAC targeting sequence
ccguacgucugcccaugccc

SEQ ID NO: 19293 - RNA, 20 nt, Artificial Sequence
  TRAC targeting sequence
gcccaugcccacaguuuccu

SEQ ID NO: 19294 - RNA, 20 nt, Artificial Sequence
  TRAC targeting sequence
ugaugcucacuaaagccucg

SEQ ID NO: 19295 - RNA, 20 nt, Artificial Sequence
  TRAC targeting sequence
ggaaacugugggcaugggca

SEQ ID NO: 19296 - RNA, 20 nt, Artificial Sequence
  TRAC targeting sequence
cuaaagccucggugggaccc

SEQ ID NO: 19297 - RNA, 20 nt, Artificial Sequence
  TRAC targeting sequence
gugggacccagagugacugu

SEQ ID NO: 19298 - RNA, 20 nt, Artificial Sequence
  TRAC targeting sequence
caccgaggcuuuagugagca

SEQ ID NO: 19299 - RNA, 20 nt, Artificial Sequence
  TRAC targeting sequence
gggucccaccgaggcuuuag

SEQ ID NO: 19300 - RNA, 20 nt, Artificial Sequence
  TRAC targeting sequence
cucugggucccaccgaggcu

SEQ ID NO: 19301 - RNA, 20 nt, Artificial Sequence
  TRAC targeting sequence
cuaauucugauuucuggguc

SEQ ID NO: 19302 - RNA, 20 nt, Artificial Sequence
  TRAC targeting sequence
gauuucugggucccuagugc

SEQ ID NO: 19303 - RNA, 20 nt, Artificial Sequence
  TRAC targeting sequence
gaauuagugacagucacucu

SEQ ID NO: 19304 - RNA, 20 nt, Artificial Sequence
  TRAC targeting sequence
gggucccuagugcccaaaca

SEQ ID NO: 19305 - RNA, 20 nt, Artificial Sequence
  TRAC targeting sequence
cuagugcccaaacacggggg

SEQ ID NO: 19306 - RNA, 20 nt, Artificial Sequence
  TRAC targeting sequence
cccguguuugggcacuaggg

SEQ ID NO: 19307 - RNA, 20 nt, Artificial Sequence
  TRAC targeting sequence
gucccccguguuugggcacu

SEQ ID NO: 19308 - RNA, 20 nt, Artificial Sequence
  TRAC targeting sequence
uuaccauuaaaucugucccc

SEQ ID NO: 19309 - RNA, 20 nt, Artificial Sequence
  TRAC targeting sequence
aucacugcugugucccuagg

SEQ ID NO: 19310 - RNA, 20 nt, Artificial Sequence
  TRAC targeting sequence
cugcugugucccuagggauc

SEQ ID NO: 19311 - RNA, 20 nt, Artificial Sequence
  TRAC targeting sequence
cuagggaucuaaagcacuag

SEQ ID NO: 19312 - RNA, 20 nt, Artificial Sequence
  TRAC targeting sequence
cuagggacacagcagugauu

SEQ ID NO: 19313 - RNA, 20 nt, Artificial Sequence
  TRAC targeting sequence
aaagcacuagagcacaugug

SEQ ID NO: 19314 - RNA, 20 nt, Artificial Sequence
  TRAC targeting sequence
agugcuuuagaucccuaggg

SEQ ID NO: 19315 - RNA, 20 nt, Artificial Sequence
  TRAC targeting sequence
gcaguucauuuugaauuuaa

SEQ ID NO: 19316 - RNA, 20 nt, Artificial Sequence
  TRAC targeting sequence
uuuugaauuuaaaggacagc

SEQ ID NO: 19317 - RNA, 20 nt, Artificial Sequence
  TRAC targeting sequence
aaaugaacugcagaagcaca

SEQ ID NO: 19318 - RNA, 20 nt, Artificial Sequence
  TRAC targeting sequence
uuuaaauucaaaaugaacug

SEQ ID NO: 19319 - RNA, 20 nt, Artificial Sequence
  TRAC targeting sequence
uaagcuguccuuuaaauuca

SEQ ID NO: 19320 - RNA, 20 nt, Artificial Sequence
  TRAC targeting sequence
agaauagcugaauuuccacc

SEQ ID NO: 19321 - RNA, 20 nt, Artificial Sequence
  TRAC targeting sequence
agauccuaagcuguccuuua

SEQ ID NO: 19322 - RNA, 20 nt, Artificial Sequence
  TRAC targeting sequence
gcuauucuagauccuaagcu

SEQ ID NO: 19323 - RNA, 20 nt, Artificial Sequence
  TRAC targeting sequence
accucaaaacauugguuccg

SEQ ID NO: 19324 - RNA, 20 nt, Artificial Sequence
  TRAC targeting sequence
aaacauugguuccgucuugc

SEQ ID NO: 19325 - RNA, 20 nt, Artificial Sequence
  TRAC targeting sequence
gucuugccaagccuaccuuc

SEQ ID NO: 19326 - RNA, 20 nt, Artificial Sequence
  TRAC targeting sequence
ugccaagccuaccuucugau

SEQ ID NO: 19327 - RNA, 20 nt, Artificial Sequence
  TRAC targeting sequence
gauaucaucagugaugggau

SEQ ID NO: 19328 - RNA, 20 nt, Artificial Sequence
  TRAC targeting sequence
gaagguaggcuuggcaagac

SEQ ID NO: 19329 - RNA, 20 nt, Artificial Sequence
  TRAC targeting sequence
ucagugaugggauguguuuu

SEQ ID NO: 19330 - RNA, 20 nt, Artificial Sequence
  TRAC targeting sequence
gugaugggauguguuuuucu

SEQ ID NO: 19331 - RNA, 20 nt, Artificial Sequence
  TRAC targeting sequence
cugaugauaucagaagguag

SEQ ID NO: 19332 - RNA, 20 nt, Artificial Sequence
  TRAC targeting sequence
caucacugaugauaucagaa

SEQ ID NO: 19333 - RNA, 20 nt, Artificial Sequence
  TRAC targeting sequence
uacuaggguagaauaggaug

SEQ ID NO: 19334 - RNA, 20 nt, Artificial Sequence
  TRAC targeting sequence
acccuaguaagaaaaacaca

SEQ ID NO: 19335 - RNA, 20 nt, Artificial Sequence
  TRAC targeting sequence
uauucuacccuaguaagaaa

SEQ ID NO: 19336 - RNA, 20 nt, Artificial Sequence
  TRAC targeting sequence
cuccccaaaggacucuggca

SEQ ID NO: 19337 - RNA, 20 nt, Artificial Sequence
  TRAC targeting sequence
ccccaaaggacucuggcaga

SEQ ID NO: 19338 - RNA, 20 nt, Artificial Sequence
  TRAC targeting sequence
ccaaaggacucuggcagaca

SEQ ID NO: 19339 - RNA, 20 nt, Artificial Sequence
  TRAC targeting sequence
uuuggggagagacauccuau

SEQ ID NO: 19340 - RNA, 20 nt, Artificial Sequence
  TRAC targeting sequence
ggcagacagaccccuaaaca

SEQ ID NO: 19341 - RNA, 20 nt, Artificial Sequence
  TRAC targeting sequence
gccagaguccuuuggggaga

SEQ ID NO: 19342 - RNA, 20 nt, Artificial Sequence
  TRAC targeting sequence
gucugccagaguccuuuggg

SEQ ID NO: 19343 - RNA, 20 nt, Artificial Sequence
  TRAC targeting sequence
aaauuaaaagcggcaaagag

SEQ ID NO: 19344 - RNA, 20 nt, Artificial Sequence
  TRAC targeting sequence
uugccgcuuuuaauuuggag

SEQ ID NO: 19345 - RNA, 20 nt, Artificial Sequence
  TRAC targeting sequence
cuuugccgcuuuuaauuugg

SEQ ID NO: 19346 - RNA, 20 nt, Artificial Sequence
  TRAC targeting sequence
accuuaucucuuugccgcuu

SEQ ID NO: 19347 - RNA, 20 nt, Artificial Sequence
  TRAC targeting sequence
aguucaaccuuaucucuuug

SEQ ID NO: 19348 - RNA, 20 nt, Artificial Sequence
  TRAC targeting sequence
ccauguacgucuaguucaac

SEQ ID NO: 19349 - RNA, 20 nt, Artificial Sequence
  TRAC targeting sequence
cauguaccuuuuauacuuuu

SEQ ID NO: 19350 - RNA, 20 nt, Artificial Sequence
  TRAC targeting sequence
uucccauguaccuuuuauac

SEQ ID NO: 19351 - RNA, 20 nt, Artificial Sequence
  TRAC targeting sequence
uuucauucccauguaccuuu

SEQ ID NO: 19352 - RNA, 20 nt, Artificial Sequence
  TRAC targeting sequence
aacucagccccuguugccau

SEQ ID NO: 19353 - RNA, 20 nt, Artificial Sequence
  TRAC targeting sequence
gccccuguugccauuucuca

SEQ ID NO: 19354 - RNA, 20 nt, Artificial Sequence
  TRAC targeting sequence
cagagucuuguguucugugg

SEQ ID NO: 19355 - RNA, 20 nt, Artificial Sequence
  TRAC targeting sequence
gagucuuguguucuguggca

SEQ ID NO: 19356 - RNA, 20 nt, Artificial Sequence
  TRAC targeting sequence
gagaaauggcaacaggggcu

SEQ ID NO: 19357 - RNA, 20 nt, Artificial Sequence
  TRAC targeting sequence
uguguucuguggcauugcgc

SEQ ID NO: 19358 - RNA, 20 nt, Artificial Sequence
  TRAC targeting sequence
guggcauugcgcuuucuaga

SEQ ID NO: 19359 - RNA, 20 nt, Artificial Sequence
  TRAC targeting sequence
agaccaacaguguccaauag

SEQ ID NO: 19360 - RNA, 20 nt, Artificial Sequence
  TRAC targeting sequence
agaaagcgcaaugccacaga

SEQ ID NO: 19361 - RNA, 20 nt, Artificial Sequence
  TRAC targeting sequence
aauagaacuuucuguggcaa

SEQ ID NO: 19362 - RNA, 20 nt, Artificial Sequence
  TRAC targeting sequence
auuggacacuguuggucuag

SEQ ID NO: 19363 - RNA, 20 nt, Artificial Sequence
  TRAC targeting sequence
guggcaauggaaauguccug

SEQ ID NO: 19364 - RNA, 20 nt, Artificial Sequence
  TRAC targeting sequence
auugccacagaaaguucuau

SEQ ID NO: 19365 - RNA, 20 nt, Artificial Sequence
  TRAC targeting sequence
ugucaaucugcacuguccca

SEQ ID NO: 19366 - RNA, 20 nt, Artificial Sequence
  TRAC targeting sequence
aucugcacugucccauacaa

SEQ ID NO: 19367 - RNA, 20 nt, Artificial Sequence
  TRAC targeting sequence
gcacugucccauacaauagc

SEQ ID NO: 19368 - RNA, 20 nt, Artificial Sequence
  TRAC targeting sequence
cauacaauagccaccagcua

SEQ ID NO: 19369 - RNA, 20 nt, Artificial Sequence
  TRAC targeting sequence
auagccacauguagcuggug

SEQ ID NO: 19370 - RNA, 20 nt, Artificial Sequence
  TRAC targeting sequence
ugaaaugaaguuuccauuuu

SEQ ID NO: 19371 - RNA, 20 nt, Artificial Sequence
  TRAC targeting sequence
agagcucaauagccacaugu

SEQ ID NO: 19372 - RNA, 20 nt, Artificial Sequence
  TRAC targeting sequence
uuucaagagcucaauagcca

SEQ ID NO: 19373 - RNA, 20 nt, Artificial Sequence
  TRAC targeting sequence
auuuuuaauugaaaacauuu

SEQ ID NO: 19374 - RNA, 20 nt, Artificial Sequence
  TRAC targeting sequence
auuaaaaauggaaacuucau

SEQ ID NO: 19375 - RNA, 20 nt, Artificial Sequence
  TRAC targeting sequence
cauugacuaauuuuuauuuc

SEQ ID NO: 19376 - RNA, 20 nt, Artificial Sequence
  TRAC targeting sequence
augugaaauaaaauguuuuc

SEQ ID NO: 19377 - RNA, 20 nt, Artificial Sequence
  TRAC targeting sequence
acagccacauguagcuagag

SEQ ID NO: 19378 - RNA, 20 nt, Artificial Sequence
  TRAC targeting sequence
agcuacauguggcuguugaa

SEQ ID NO: 19379 - RNA, 20 nt, Artificial Sequence
  TRAC targeting sequence
cuagcuacauguggcuguug

SEQ ID NO: 19380 - RNA, 20 nt, Artificial Sequence
  TRAC targeting sequence
gguauaauagucucuagcua

SEQ ID NO: 19381 - RNA, 20 nt, Artificial Sequence
  TRAC targeting sequence
gucugguauaauagucucua

SEQ ID NO: 19382 - RNA, 20 nt, Artificial Sequence
  TRAC targeting sequence
aggcugcucugucugguaua

SEQ ID NO: 19383 - RNA, 20 nt, Artificial Sequence
  TRAC targeting sequence
ucuccagucugacacccacc

SEQ ID NO: 19384 - RNA, 20 nt, Artificial Sequence
  TRAC targeting sequence
ccagucugacacccaccagc

SEQ ID NO: 19385 - RNA, 20 nt, Artificial Sequence
  TRAC targeting sequence
agucugacacccaccagccc

SEQ ID NO: 19386 - RNA, 20 nt, Artificial Sequence
  TRAC targeting sequence
gacacccaccagccccagga

SEQ ID NO: 19387 - RNA, 20 nt, Artificial Sequence
  TRAC targeting sequence
gacuggagaagaucuaggcu

SEQ ID NO: 19388 - RNA, 20 nt, Artificial Sequence
  TRAC targeting sequence
uggggcuggugggugucaga

SEQ ID NO: 19389 - RNA, 20 nt, Artificial Sequence
  TRAC targeting sequence
aguccuggggcuggugggug

SEQ ID NO: 19390 - RNA, 20 nt, Artificial Sequence
  TRAC targeting sequence
cucaaguccuggggcuggug

SEQ ID NO: 19391 - RNA, 20 nt, Artificial Sequence
  TRAC targeting sequence
ugguuaaacacucacucaag

SEQ ID NO: 19392 - RNA, 20 nt, Artificial Sequence
  TRAC targeting sequence
aaguuggguuucugccccac

SEQ ID NO: 19393 - RNA, 20 nt, Artificial Sequence
  TRAC targeting sequence
gccccacaaggccacccccu

SEQ ID NO: 19394 - RNA, 20 nt, Artificial Sequence
  TRAC targeting sequence
ucuuuaaagccaaccugcau

SEQ ID NO: 19395 - RNA, 20 nt, Artificial Sequence
  TRAC targeting sequence
uuaaagccaaccugcaucug

SEQ ID NO: 19396 - RNA, 20 nt, Artificial Sequence
  TRAC targeting sequence
gguggccccugauccccugc

SEQ ID NO: 19397 - RNA, 20 nt, Artificial Sequence
  TRAC targeting sequence
ggggccaccagaugcagguu

SEQ ID NO: 19398 - RNA, 20 nt, Artificial Sequence
  TRAC targeting sequence
ccugccuugaggaucggcac

SEQ ID NO: 19399 - RNA, 20 nt, Artificial Sequence
  TRAC targeting sequence
aggcaggggaucaggggcca

SEQ ID NO: 19400 - RNA, 20 nt, Artificial Sequence
  TRAC targeting sequence
ucaaggcaggggaucagggg

SEQ ID NO: 19401 - RNA, 20 nt, Artificial Sequence
  TRAC targeting sequence
gcacuuccagacuccucucc

SEQ ID NO: 19402 - RNA, 20 nt, Artificial Sequence
  TRAC targeting sequence
agacuccucucccccucugc

SEQ ID NO: 19403 - RNA, 20 nt, Artificial Sequence
  TRAC targeting sequence
ggaagugccgauccucaagg

SEQ ID NO: 19404 - RNA, 20 nt, Artificial Sequence
  TRAC targeting sequence
ucucccccucugcagugcug

SEQ ID NO: 19405 - RNA, 20 nt, Artificial Sequence
  TRAC targeting sequence
cccccucugcagugcugucc

SEQ ID NO: 19406 - RNA, 20 nt, Artificial Sequence
  TRAC targeting sequence
cccucugcagugcuguccag

SEQ ID NO: 19407 - RNA, 20 nt, Artificial Sequence
  TRAC targeting sequence
gcagugcuguccaguacccc

SEQ ID NO: 19408 - RNA, 20 nt, Artificial Sequence
  TRAC targeting sequence
aguacccccacugaugacua

SEQ ID NO: 19409 - RNA, 20 nt, Artificial Sequence
  TRAC targeting sequence
guggggguacuggacagcac

SEQ ID NO: 19410 - RNA, 20 nt, Artificial Sequence
  TRAC targeting sequence
ucaguggggguacuggacag

SEQ ID NO: 19411 - RNA, 20 nt, Artificial Sequence
  TRAC targeting sequence
gggggauguguugguagagc

SEQ ID NO: 19412 - RNA, 20 nt, Artificial Sequence
  TRAC targeting sequence
cccugauuguuagucaucag

SEQ ID NO: 19413 - RNA, 20 nt, Artificial Sequence
  TRAC targeting sequence
accaacacaucccccugauu

SEQ ID NO: 19414 - RNA, 20 nt, Artificial Sequence
  TRAC targeting sequence
gucugucccuucccagcaaa

SEQ ID NO: 19415 - RNA, 20 nt, Artificial Sequence
  TRAC targeting sequence
gucccuucccagcaaaggaa

SEQ ID NO: 19416 - RNA, 20 nt, Artificial Sequence
  TRAC targeting sequence
cuucccagcaaaggaacuau

SEQ ID NO: 19417 - RNA, 20 nt, Artificial Sequence
  TRAC targeting sequence
cagcaaaggaacuaugccuu

SEQ ID NO: 19418 - RNA, 20 nt, Artificial Sequence
  TRAC targeting sequence
uuugcugggaagggacagac

SEQ ID NO: 19419 - RNA, 20 nt, Artificial Sequence
  TRAC targeting sequence
cccagagugaugucaggcug

SEQ ID NO: 19420 - RNA, 20 nt, Artificial Sequence
  TRAC targeting sequence
gggugaaggcccuaaggcau

SEQ ID NO: 19421 - RNA, 20 nt, Artificial Sequence
  TRAC targeting sequence
cucugggugaaggcccuaag

SEQ ID NO: 19422 - RNA, 20 nt, Artificial Sequence
  TRAC targeting sequence
ggcugcccaagcaugaggag

SEQ ID NO: 19423 - RNA, 20 nt, Artificial Sequence
  TRAC targeting sequence
ugcuugggcagccugacauc

SEQ ID NO: 19424 - RNA, 20 nt, Artificial Sequence
  TRAC targeting sequence
ucaugcuugggcagccugac

SEQ ID NO: 19425 - RNA, 20 nt, Artificial Sequence
  TRAC targeting sequence
cuccucaugcuugggcagcc

SEQ ID NO: 19426 - RNA, 20 nt, Artificial Sequence
  TRAC targeting sequence
gccuacuucccuccucaugc

SEQ ID NO: 19427 - RNA, 20 nt, Artificial Sequence
  TRAC targeting sequence
ucuggagccaaagcucugga

SEQ ID NO: 19428 - RNA, 20 nt, Artificial Sequence
  TRAC targeting sequence
ggagccaaagcucuggaugu

SEQ ID NO: 19429 - RNA, 20 nt, Artificial Sequence
  TRAC targeting sequence
agaggauucugccuacuucc

SEQ ID NO: 19430 - RNA, 20 nt, Artificial Sequence
  TRAC targeting sequence
ggaugucucuccccucugac

SEQ ID NO: 19431 - RNA, 20 nt, Artificial Sequence
  TRAC targeting sequence
agagcuuuggcuccagagga

SEQ ID NO: 19432 - RNA, 20 nt, Artificial Sequence
  TRAC targeting sequence
cuccccucugaccauggagc

SEQ ID NO: 19433 - RNA, 20 nt, Artificial Sequence
  TRAC targeting sequence
ccccucugaccauggagccc

SEQ ID NO: 19434 - RNA, 20 nt, Artificial Sequence
  TRAC targeting sequence
ccucugaccauggagcccac

SEQ ID NO: 19435 - RNA, 20 nt, Artificial Sequence
  TRAC targeting sequence
gaccauggagcccaccccug

SEQ ID NO: 19436 - RNA, 20 nt, Artificial Sequence
  TRAC targeting sequence
gaggggagagacauccagag

SEQ ID NO: 19437 - RNA, 20 nt, Artificial Sequence
  TRAC targeting sequence
auggucagaggggagagaca

SEQ ID NO: 19438 - RNA, 20 nt, Artificial Sequence
  TRAC targeting sequence
acugcuccagggacagcccu

SEQ ID NO: 19439 - RNA, 20 nt, Artificial Sequence
  TRAC targeting sequence
agggacagcccuaugcugca

SEQ ID NO: 19440 - RNA, 20 nt, Artificial Sequence
  TRAC targeting sequence
cuggagcaguggagcagggg

SEQ ID NO: 19441 - RNA, 20 nt, Artificial Sequence
  TRAC targeting sequence
gcccccacucagcaucccag

SEQ ID NO: 19442 - RNA, 20 nt, Artificial Sequence
  TRAC targeting sequence
gcaucccaggggcugauuuc

SEQ ID NO: 19443 - RNA, 20 nt, Artificial Sequence
  TRAC targeting sequence
caggggcugauuucuuuggu

SEQ ID NO: 19444 - RNA, 20 nt, Artificial Sequence
  TRAC targeting sequence
gccccugggaugcugagugg

SEQ ID NO: 19445 - RNA, 20 nt, Artificial Sequence
  TRAC targeting sequence
uugguuuuggauccagcugg

SEQ ID NO: 19446 - RNA, 20 nt, Artificial Sequence
  TRAC targeting sequence
aaaaccaaagaaaucagccc

SEQ ID NO: 19447 - RNA, 20 nt, Artificial Sequence
  TRAC targeting sequence
agcuggaugucugcauugcc

SEQ ID NO: 19448 - RNA, 20 nt, Artificial Sequence
  TRAC targeting sequence
agcuggauccaaaaccaaag

SEQ ID NO: 19449 - RNA, 20 nt, Artificial Sequence
  TRAC targeting sequence
gcauugccgaggccaccagg

SEQ ID NO: 19450 - RNA, 20 nt, Artificial Sequence
  TRAC targeting sequence
gcaaugcagacauccagcug

SEQ ID NO: 19451 - RNA, 20 nt, Artificial Sequence
  TRAC targeting sequence
gcaacugucggggaaucacc

SEQ ID NO: 19452 - RNA, 20 nt, Artificial Sequence
  TRAC targeting sequence
gggaaucaccagggucugag

SEQ ID NO: 19453 - RNA, 20 nt, Artificial Sequence
  TRAC targeting sequence
ccgacaguugcugagccagc

SEQ ID NO: 19454 - RNA, 20 nt, Artificial Sequence
  TRAC targeting sequence
ccagggucugagaaaucuug

SEQ ID NO: 19455 - RNA, 20 nt, Artificial Sequence
  TRAC targeting sequence
gagaaaucuugugcgcaugu

SEQ ID NO: 19456 - RNA, 20 nt, Artificial Sequence
  TRAC targeting sequence
gacccuggugauuccccgac

SEQ ID NO: 19457 - RNA, 20 nt, Artificial Sequence
  TRAC targeting sequence
cagacccuggugauuccccg

SEQ ID NO: 19458 - RNA, 20 nt, Artificial Sequence
  TRAC targeting sequence
ugugcgcaugugaggggcug

SEQ ID NO: 19459 - RNA, 20 nt, Artificial Sequence
  TRAC targeting sequence
caugcgcacaagauuucuca

SEQ ID NO: 19460 - RNA, 20 nt, Artificial Sequence
  TRAC targeting sequence
cacagccccucacaugcgca

SEQ ID NO: 19461 - RNA, 20 nt, Artificial Sequence
  TRAC targeting sequence
gcucccacagccccucacau

SEQ ID NO: 19462 - RNA, 20 nt, Artificial Sequence
  TRAC targeting sequence
cugcucccacagccccucac

SEQ ID NO: 19463 - RNA, 20 nt, Artificial Sequence
  TRAC targeting sequence
cacccagugguucucugcuc

SEQ ID NO: 19464 - RNA, 20 nt, Artificial Sequence
  TRAC targeting sequence
aauccccacccugcuggaaa

SEQ ID NO: 19465 - RNA, 20 nt, Artificial Sequence
  TRAC targeting sequence
ccacccugcuggaaacucuc

SEQ ID NO: 19466 - RNA, 20 nt, Artificial Sequence
  TRAC targeting sequence
agcaggguggggauuagaau

SEQ ID NO: 19467 - RNA, 20 nt, Artificial Sequence
  TRAC targeting sequence
cuggguggccccaacaugcu

SEQ ID NO: 19468 - RNA, 20 nt, Artificial Sequence
  TRAC targeting sequence
ggguggccccaacaugcuaa

SEQ ID NO: 19469 - RNA, 20 nt, Artificial Sequence
  TRAC targeting sequence
uccggcaaaccucuguuucc

SEQ ID NO: 19470 - RNA, 20 nt, Artificial Sequence
  TRAC targeting sequence
ggcaaaccucuguuuccucc

SEQ ID NO: 19471 - RNA, 20 nt, Artificial Sequence
  TRAC targeting sequence
guuuccuccucaaaaggcag

SEQ ID NO: 19472 - RNA, 20 nt, Artificial Sequence
  TRAC targeting sequence
uccucaaaaggcaggagguc

SEQ ID NO: 19473 - RNA, 20 nt, Artificial Sequence
  TRAC targeting sequence
ucaaaaggcaggaggucgga

SEQ ID NO: 19474 - RNA, 20 nt, Artificial Sequence
  TRAC targeting sequence
aaaggcaggaggucggaaag

SEQ ID NO: 19475 - RNA, 20 nt, Artificial Sequence
  TRAC targeting sequence
ugccuuuugaggaggaaaca

SEQ ID NO: 19476 - RNA, 20 nt, Artificial Sequence
  TRAC targeting sequence
gaaagaauaaacaaugagag

SEQ ID NO: 19477 - RNA, 20 nt, Artificial Sequence
  TRAC targeting sequence
gaccuccugccuuuugagga

SEQ ID NO: 19478 - RNA, 20 nt, Artificial Sequence
  TRAC targeting sequence
uuccgaccuccugccuuuug

SEQ ID NO: 19479 - RNA, 20 nt, Artificial Sequence
  TRAC targeting sequence
uuguuuauucuuuccgaccu

SEQ ID NO: 19480 - RNA, 20 nt, Artificial Sequence
  TRAC targeting sequence
cauuguuuauucuuuccgac

SEQ ID NO: 19481 - RNA, 20 nt, Artificial Sequence
  TRAC targeting sequence
cauuaaaaacacaaaauccu

SEQ ID NO: 19482 - RNA, 20 nt, Artificial Sequence
  TRAC targeting sequence
uacggaaauacugaagaaug

SEQ ID NO: 19483 - RNA, 20 nt, Artificial Sequence
  TRAC targeting sequence
guaggauuuuguguuuuuaa

SEQ ID NO: 19484 - RNA, 20 nt, Artificial Sequence
  TRAC targeting sequence
guauuuccguaggauuuugu

SEQ ID NO: 19485 - RNA, 20 nt, Artificial Sequence
  TRAC targeting sequence
ucaguauuuccguaggauuu

SEQ ID NO: 19486 - RNA, 20 nt, Artificial Sequence
  TRAC targeting sequence
uucuucaguauuuccguagg

SEQ ID NO: 19487 - RNA, 20 nt, Artificial Sequence
  TRAC targeting sequence
cagcacuaaggaaaagccuc

SEQ ID NO: 19488 - RNA, 20 nt, Artificial Sequence
  TRAC targeting sequence
gcacuaaggaaaagccucca

SEQ ID NO: 19489 - RNA, 20 nt, Artificial Sequence
  TRAC targeting sequence
uuagugcugagacucauucu

SEQ ID NO: 19490 - RNA, 20 nt, Artificial Sequence
  TRAC targeting sequence
agcagcuccugcuuucugag

SEQ ID NO: 19491 - RNA, 20 nt, Artificial Sequence
  TRAC targeting sequence
ugcuuucugagggugaagga

SEQ ID NO: 19492 - RNA, 20 nt, Artificial Sequence
  TRAC targeting sequence
gagggugaaggauagacgcu

SEQ ID NO: 19493 - RNA, 20 nt, Artificial Sequence
  TRAC targeting sequence
gaaagcaggagcugcuggag

SEQ ID NO: 19494 - RNA, 20 nt, Artificial Sequence
  TRAC targeting sequence
cccucagaaagcaggagcug

SEQ ID NO: 19495 - RNA, 20 nt, Artificial Sequence
  TRAC targeting sequence
uucacccucagaaagcagga

SEQ ID NO: 19496 - RNA, 20 nt, Artificial Sequence
  TRAC targeting sequence
auccuucacccucagaaagc

SEQ ID NO: 19497 - RNA, 20 nt, Artificial Sequence
  TRAC targeting sequence
gcaugacucacuagcacucu

SEQ ID NO: 19498 - RNA, 20 nt, Artificial Sequence
  TRAC targeting sequence
ugcagagccacagcgucuau

SEQ ID NO: 19499 - RNA, 20 nt, Artificial Sequence
  TRAC targeting sequence
cuagcacucuaucacggcca

SEQ ID NO: 19500 - RNA, 20 nt, Artificial Sequence
  TRAC targeting sequence
aucacggccauauucuggca

SEQ ID NO: 19501 - RNA, 20 nt, Artificial Sequence
  TRAC targeting sequence
cggccauauucuggcagggu

SEQ ID NO: 19502 - RNA, 20 nt, Artificial Sequence
  TRAC targeting sequence
ggcagggucaguggcuccaa

SEQ ID NO: 19503 - RNA, 20 nt, Artificial Sequence
  TRAC targeting sequence
guggcuccaacuaacauuug

SEQ ID NO: 19504 - RNA, 20 nt, Artificial Sequence
  TRAC targeting sequence
aacuaacauuuguuugguac

SEQ ID NO: 19505 - RNA, 20 nt, Artificial Sequence
  TRAC targeting sequence
auuuaauaaacuguaaagua

SEQ ID NO: 19506 - RNA, 20 nt, Artificial Sequence
  TRAC targeting sequence
auauaaacaucuauuuaaua

SEQ ID NO: 19507 - RNA, 20 nt, Artificial Sequence
  TRAC targeting sequence
ccauauaaacaucuauuuaa

SEQ ID NO: 19508 - RNA, 20 nt, Artificial Sequence
  TRAC targeting sequence
cauuucuuucucagaagagc

SEQ ID NO: 19509 - RNA, 20 nt, Artificial Sequence
  TRAC targeting sequence
uuucuuucucagaagagccu

SEQ ID NO: 19510 - RNA, 20 nt, Artificial Sequence
  TRAC targeting sequence
uucucagaagagccuggcua

SEQ ID NO: 19511 - RNA, 20 nt, Artificial Sequence
  TRAC targeting sequence
cagaagagccuggcuaggaa

SEQ ID NO: 19512 - RNA, 20 nt, Artificial Sequence
  TRAC targeting sequence
gaagagccuggcuaggaagg

SEQ ID NO: 19513 - RNA, 20 nt, Artificial Sequence
  TRAC targeting sequence
gagaaagaaaugagagcuuc

SEQ ID NO: 19514 - RNA, 20 nt, Artificial Sequence
  TRAC targeting sequence
ucugagaaagaaaugagagc

SEQ ID NO: 19515 - RNA, 20 nt, Artificial Sequence
  TRAC targeting sequence
uagccaggcucuucugagaa

SEQ ID NO: 19516 - RNA, 20 nt, Artificial Sequence
  TRAC targeting sequence
accuuccuagccaggcucuu

SEQ ID NO: 19517 - RNA, 20 nt, Artificial Sequence
  TRAC targeting sequence
uccaccuuccuagccaggcu

SEQ ID NO: 19518 - RNA, 20 nt, Artificial Sequence
  TRAC targeting sequence
uuuugcaggugaaauuccug

SEQ ID NO: 19519 - RNA, 20 nt, Artificial Sequence
  TRAC targeting sequence
ccugcaaaaugaauauggug

SEQ ID NO: 19520 - RNA, 20 nt, Artificial Sequence
  TRAC targeting sequence
ugagauguaaggagcugcug

SEQ ID NO: 19521 - RNA, 20 nt, Artificial Sequence
  TRAC targeting sequence
ggaauuucaccugcaaaaug

SEQ ID NO: 19522 - RNA, 20 nt, Artificial Sequence
  TRAC targeting sequence
caggaauuucaccugcaaaa

SEQ ID NO: 19523 - RNA, 20 nt, Artificial Sequence
  TRAC targeting sequence
uuacaucucaggaauuucac

SEQ ID NO: 19524 - RNA, 20 nt, Artificial Sequence
  TRAC targeting sequence
cagcagcuccuuacaucuca

SEQ ID NO: 19525 - RNA, 20 nt, Artificial Sequence
  TRAC targeting sequence
aggccuuauaucgaguaaac

SEQ ID NO: 19526 - RNA, 20 nt, Artificial Sequence
  TRAC targeting sequence
aguaaacgguagugcugggg

SEQ ID NO: 19527 - RNA, 20 nt, Artificial Sequence
  TRAC targeting sequence
auauaaggccuugagcaagu

SEQ ID NO: 19528 - RNA, 20 nt, Artificial Sequence
  TRAC targeting sequence
aagccccagcacuaccguuu

SEQ ID NO: 19529 - RNA, 20 nt, Artificial Sequence
  TRAC targeting sequence
gauuuauaguucaaaaccuc

SEQ ID NO: 19530 - RNA, 20 nt, Artificial Sequence
  TRAC targeting sequence
gaacaccugcgucuaagccc

SEQ ID NO: 19531 - RNA, 20 nt, Artificial Sequence
  TRAC targeting sequence
aaaccucuaucaaugagaga

SEQ ID NO: 19532 - RNA, 20 nt, Artificial Sequence
  TRAC targeting sequence
aucaaugagagagcaaucuc

SEQ ID NO: 19533 - RNA, 20 nt, Artificial Sequence
  TRAC targeting sequence
augagagagcaaucuccugg

SEQ ID NO: 19534 - RNA, 20 nt, Artificial Sequence
  TRAC targeting sequence
uugauagagguuuugaacua

SEQ ID NO: 19535 - RNA, 20 nt, Artificial Sequence
  TRAC targeting sequence
cauugauagagguuuugaac

SEQ ID NO: 19536 - RNA, 20 nt, Artificial Sequence
  TRAC targeting sequence
cucauugauagagguuuuga

SEQ ID NO: 19537 - RNA, 20 nt, Artificial Sequence
  TRAC targeting sequence
ccugguaaugugauagauuu

SEQ ID NO: 19538 - RNA, 20 nt, Artificial Sequence
  TRAC targeting sequence
ugguaaugugauagauuucc

SEQ ID NO: 19539 - RNA, 20 nt, Artificial Sequence
  TRAC targeting sequence
cauuaccaggagauugcucu

SEQ ID NO: 19540 - RNA, 20 nt, Artificial Sequence
  TRAC targeting sequence
aucacauuaccaggagauug

SEQ ID NO: 19541 - RNA, 20 nt, Artificial Sequence
  TRAC targeting sequence
caacuuaaugccaacauacc

SEQ ID NO: 19542 - RNA, 20 nt, Artificial Sequence
  TRAC targeting sequence
cauucugcuaaugcccagcc

SEQ ID NO: 19543 - RNA, 20 nt, Artificial Sequence
  TRAC targeting sequence
gcuaaugcccagccuaaguu

SEQ ID NO: 19544 - RNA, 20 nt, Artificial Sequence
  TRAC targeting sequence
ccaacuuaggcugggcauua

SEQ ID NO: 19545 - RNA, 20 nt, Artificial Sequence
  TRAC targeting sequence
ccccaacuuaggcugggcau

SEQ ID NO: 19546 - RNA, 20 nt, Artificial Sequence
  TRAC targeting sequence
agauuccaagauguacaguu

SEQ ID NO: 19547 - RNA, 20 nt, Artificial Sequence
  TRAC targeting sequence
ggaguggucuccccaacuua

SEQ ID NO: 19548 - RNA, 20 nt, Artificial Sequence
  TRAC targeting sequence
aagauguacaguuugcuuug

SEQ ID NO: 19549 - RNA, 20 nt, Artificial Sequence
  TRAC targeting sequence
uggaaucuggaguggucucc

SEQ ID NO: 19550 - RNA, 20 nt, Artificial Sequence
  TRAC targeting sequence
caugccugccuuuacucugc

SEQ ID NO: 19551 - RNA, 20 nt, Artificial Sequence
  TRAC targeting sequence
gccagaguuauauugcuggg

SEQ ID NO: 19552 - RNA, 20 nt, Artificial Sequence
  TRAC targeting sequence
ggcagaguaaaggcaggcau

SEQ ID NO: 19553 - RNA, 20 nt, Artificial Sequence
  TRAC targeting sequence
aaaccccagcaauauaacuc

SEQ ID NO: 19554 - RNA, 20 nt, Artificial Sequence
  TRAC targeting sequence
ucaaaaccccagcaauauaa

SEQ ID NO: 19555 - RNA, 20 nt, Artificial Sequence
  TRAC targeting sequence
ucuucaaaaccccagcaaua

SEQ ID NO: 19556 - RNA, 20 nt, Artificial Sequence
  TRAC targeting sequence
uauuaaauaaaagaauaagc

SEQ ID NO: 19557 - RNA, 20 nt, Artificial Sequence
  TRAC targeting sequence
uuuauuuaauaggaucuucu

SEQ ID NO: 19558 - RNA, 20 nt, Artificial Sequence
  TRAC targeting sequence
gguuuccuugaguggcaggc

SEQ ID NO: 19559 - RNA, 20 nt, Artificial Sequence
  TRAC targeting sequence
uugaguggcaggccaggccu

SEQ ID NO: 19560 - RNA, 20 nt, Artificial Sequence
  TRAC targeting sequence
aggaaaccugaaaugcaggg

SEQ ID NO: 19561 - RNA, 20 nt, Artificial Sequence
  TRAC targeting sequence
cggccaggccuggccugcca

SEQ ID NO: 19562 - RNA, 20 nt, Artificial Sequence
  TRAC targeting sequence
cugaaaucauggccucuugg

SEQ ID NO: 19563 - RNA, 20 nt, Artificial Sequence
  TRAC targeting sequence
gugaacguucacggccaggc

SEQ ID NO: 19564 - RNA, 20 nt, Artificial Sequence
  TRAC targeting sequence
uggccucuuggccaagauug

SEQ ID NO: 19565 - RNA, 20 nt, Artificial Sequence
  TRAC targeting sequence
uggccaagauugauagcuug

SEQ ID NO: 19566 - RNA, 20 nt, Artificial Sequence
  TRAC targeting sequence
uggccaagaggccaugauuu

SEQ ID NO: 19567 - RNA, 20 nt, Artificial Sequence
  TRAC targeting sequence
aucuuggccaagaggccaug

SEQ ID NO: 19568 - RNA, 20 nt, Artificial Sequence
  TRAC targeting sequence
cugagucccaguccaucacg

SEQ ID NO: 19569 - RNA, 20 nt, Artificial Sequence
  TRAC targeting sequence
gggacaggcacaagcuauca

SEQ ID NO: 19570 - RNA, 20 nt, Artificial Sequence
  TRAC targeting sequence
caguccaucacgagcagcug

SEQ ID NO: 19571 - RNA, 20 nt, Artificial Sequence
  TRAC targeting sequence
aucacgagcagcugguuucu

SEQ ID NO: 19572 - RNA, 20 nt, Artificial Sequence
  TRAC targeting sequence
cgagcagcugguuucuaaga

SEQ ID NO: 19573 - RNA, 20 nt, Artificial Sequence
  TRAC targeting sequence
ugauggacugggacucaggg

SEQ ID NO: 19574 - RNA, 20 nt, Artificial Sequence
  TRAC targeting sequence
aagaugcuauuucccguaua

SEQ ID NO: 19575 - RNA, 20 nt, Artificial Sequence
  TRAC targeting sequence
uagaaaccagcugcucguga

SEQ ID NO: 19576 - RNA, 20 nt, Artificial Sequence
  TRAC targeting sequence
cguauaaagcaugagaccgu

SEQ ID NO: 19577 - RNA, 20 nt, Artificial Sequence
  TRAC targeting sequence
ugcuuuauacgggaaauagc

SEQ ID NO: 19578 - RNA, 20 nt, Artificial Sequence
  TRAC targeting sequence
caugcuuuauacgggaaaua

SEQ ID NO: 19579 - RNA, 20 nt, Artificial Sequence
  TRAC targeting sequence
cggucucaugcuuuauacgg

SEQ ID NO: 19580 - RNA, 20 nt, Artificial Sequence
  TRAC targeting sequence
guggggcuggcaagucacgg

SEQ ID NO: 19581 - RNA, 20 nt, Artificial Sequence
  TRAC targeting sequence
aucacuggcaucuggacucc

SEQ ID NO: 19582 - RNA, 20 nt, Artificial Sequence
  TRAC targeting sequence
cuggcaucuggacuccagcc

SEQ ID NO: 19583 - RNA, 20 nt, Artificial Sequence
  TRAC targeting sequence
ggacuccagccuggguuggg

SEQ ID NO: 19584 - RNA, 20 nt, Artificial Sequence
  TRAC targeting sequence
agaugccagugauggacaag

SEQ ID NO: 19585 - RNA, 20 nt, Artificial Sequence
  TRAC targeting sequence
agccuggguuggggcaaaga

SEQ ID NO: 19586 - RNA, 20 nt, Artificial Sequence
  TRAC targeting sequence
uugccccaacccaggcugga

SEQ ID NO: 19587 - RNA, 20 nt, Artificial Sequence
  TRAC targeting sequence
cucuuugccccaacccaggc

SEQ ID NO: 19588 - RNA, 20 nt, Artificial Sequence
  TRAC targeting sequence
uuucccucuuugccccaacc

SEQ ID NO: 19589 - RNA, 20 nt, Artificial Sequence
  TRAC targeting sequence
cauuucccucuuugccccaa

SEQ ID NO: 19590 - RNA, 20 nt, Artificial Sequence
  TRAC targeting sequence
uguccuaacccugauccucu

SEQ ID NO: 19591 - RNA, 20 nt, Artificial Sequence
  TRAC targeting sequence
uaacccugauccucuugucc

SEQ ID NO: 19592 - RNA, 20 nt, Artificial Sequence
  TRAC targeting sequence
ggguuaggacaugaucucau

SEQ ID NO: 19593 - RNA, 20 nt, Artificial Sequence
  TRAC targeting sequence
ucuugucccacagauaucca

SEQ ID NO: 19594 - RNA, 20 nt, Artificial Sequence
  TRAC targeting sequence
ugucccacagauauccagaa

SEQ ID NO: 19595 - RNA, 20 nt, Artificial Sequence
  TRAC targeting sequence
cacagauauccagaacccug

SEQ ID NO: 19596 - RNA, 20 nt, Artificial Sequence
  TRAC targeting sequence
gugggacaagaggaucaggg

SEQ ID NO: 19597 - RNA, 20 nt, Artificial Sequence
  TRAC targeting sequence
agaacccugacccugccgug

SEQ ID NO: 19598 - RNA, 20 nt, Artificial Sequence
  TRAC targeting sequence
ggauaucugugggacaagag

SEQ ID NO: 19599 - RNA, 20 nt, Artificial Sequence
  TRAC targeting sequence
ggguucuggauaucuguggg

SEQ ID NO: 19600 - RNA, 20 nt, Artificial Sequence
  TRAC targeting sequence
gcugguacacggcaggguca

SEQ ID NO: 19601 - RNA, 20 nt, Artificial Sequence
  TRAC targeting sequence
cagcugguacacggcagggu

SEQ ID NO: 19602 - RNA, 20 nt, Artificial Sequence
  TRAC targeting sequence
cucagcugguacacggcagg

SEQ ID NO: 19603 - RNA, 20 nt, Artificial Sequence
  TRAC targeting sequence
aaauccagugacaagucugu

SEQ ID NO: 19604 - RNA, 20 nt, Artificial Sequence
  TRAC targeting sequence
agugacaagucugucugccu

SEQ ID NO: 19605 - RNA, 20 nt, Artificial Sequence
  TRAC targeting sequence
cuggauuuagagucucucag

SEQ ID NO: 19606 - RNA, 20 nt, Artificial Sequence
  TRAC targeting sequence
gucugccuauucaccgauuu

SEQ ID NO: 19607 - RNA, 20 nt, Artificial Sequence
  TRAC targeting sequence
gccuauucaccgauuuugau

SEQ ID NO: 19608 - RNA, 20 nt, Artificial Sequence
  TRAC targeting sequence
ccgauuuugauucucaaaca

SEQ ID NO: 19609 - RNA, 20 nt, Artificial Sequence
  TRAC targeting sequence
gugaauaggcagacagacuu

SEQ ID NO: 19610 - RNA, 20 nt, Artificial Sequence
  TRAC targeting sequence
aaaucggugaauaggcagac

SEQ ID NO: 19611 - RNA, 20 nt, Artificial Sequence
  TRAC targeting sequence
caaacaaaugugucacaaag

SEQ ID NO: 19612 - RNA, 20 nt, Artificial Sequence
  TRAC targeting sequence
aacaaaugugucacaaagua

SEQ ID NO: 19613 - RNA, 20 nt, Artificial Sequence
  TRAC targeting sequence
caaaguaaggauucugaugu

SEQ ID NO: 19614 - RNA, 20 nt, Artificial Sequence
  TRAC targeting sequence
uuacuuugugacacauuugu

SEQ ID NO: 19615 - RNA, 20 nt, Artificial Sequence
  TRAC targeting sequence
gauguguauaucacagacaa

SEQ ID NO: 19616 - RNA, 20 nt, Artificial Sequence
  TRAC targeting sequence
gaauccuuacuuugugacac

SEQ ID NO: 19617 - RNA, 20 nt, Artificial Sequence
  TRAC targeting sequence
cagacaaaacugugcuagac

SEQ ID NO: 19618 - RNA, 20 nt, Artificial Sequence
  TRAC targeting sequence
gugauauacacaucagaauc

SEQ ID NO: 19619 - RNA, 20 nt, Artificial Sequence
  TRAC targeting sequence
agcacaguuuugucugugau

SEQ ID NO: 19620 - RNA, 20 nt, Artificial Sequence
  TRAC targeting sequence
ugucuagcacaguuuugucu

SEQ ID NO: 19621 - RNA, 20 nt, Artificial Sequence
  TRAC targeting sequence
auggacuucaagagcaacag

SEQ ID NO: 19622 - RNA, 20 nt, Artificial Sequence
  TRAC targeting sequence
auagaccucaugucuagcac

SEQ ID NO: 19623 - RNA, 20 nt, Artificial Sequence
  TRAC targeting sequence
agagcaacagugcuguggcc

SEQ ID NO: 19624 - RNA, 20 nt, Artificial Sequence
  TRAC targeting sequence
ugaaguccauagaccucaug

SEQ ID NO: 19625 - RNA, 20 nt, Artificial Sequence
  TRAC targeting sequence
aggccacagcacuguugcuc

SEQ ID NO: 19626 - RNA, 20 nt, Artificial Sequence
  TRAC targeting sequence
gacuuugcaugugcaaacgc

SEQ ID NO: 19627 - RNA, 20 nt, Artificial Sequence
  TRAC targeting sequence
gauuuguugcuccaggccac

SEQ ID NO: 19628 - RNA, 20 nt, Artificial Sequence
  TRAC targeting sequence
acaacagcauuauuccagaa

SEQ ID NO: 19629 - RNA, 20 nt, Artificial Sequence
  TRAC targeting sequence
agaagacaccuucuucccca

SEQ ID NO: 19630 - RNA, 20 nt, Artificial Sequence
  TRAC targeting sequence
ggaauaaugcuguuguugaa

SEQ ID NO: 19631 - RNA, 20 nt, Artificial Sequence
  TRAC targeting sequence
ucuggaauaaugcuguuguu

SEQ ID NO: 19632 - RNA, 20 nt, Artificial Sequence
  TRAC targeting sequence
uccccagcccagguaagggc

SEQ ID NO: 19633 - RNA, 20 nt, Artificial Sequence
  TRAC targeting sequence
ccagcccagguaagggcagc

SEQ ID NO: 19634 - RNA, 20 nt, Artificial Sequence
  TRAC targeting sequence
caggcuguuuccuugcuuca

SEQ ID NO: 19635 - RNA, 20 nt, Artificial Sequence
  TRAC targeting sequence
uugcuucaggaauggccagg

SEQ ID NO: 19636 - RNA, 20 nt, Artificial Sequence
  TRAC targeting sequence
ggaauggccagguucugccc

SEQ ID NO: 19637 - RNA, 20 nt, Artificial Sequence
  TRAC targeting sequence
ugaagcaaggaaacagccug

SEQ ID NO: 19638 - RNA, 20 nt, Artificial Sequence
  TRAC targeting sequence
gcccagagcucuggucaaug

SEQ ID NO: 19639 - RNA, 20 nt, Artificial Sequence
  TRAC targeting sequence
gggcagaaccuggccauucc

SEQ ID NO: 19640 - RNA, 20 nt, Artificial Sequence
  TRAC targeting sequence
ggucaaugaugucuaaaacu

SEQ ID NO: 19641 - RNA, 20 nt, Artificial Sequence
  TRAC targeting sequence
augaugucuaaaacuccucu

SEQ ID NO: 19642 - RNA, 20 nt, Artificial Sequence
  TRAC targeting sequence
uugaccagagcucugggcag

SEQ ID NO: 19643 - RNA, 20 nt, Artificial Sequence
  TRAC targeting sequence
aaaacuccucugauuggugg

SEQ ID NO: 19644 - RNA, 20 nt, Artificial Sequence
  TRAC targeting sequence
ucugauugguggucucggcc

SEQ ID NO: 19645 - RNA, 20 nt, Artificial Sequence
  TRAC targeting sequence
gauugguggucucggccuua

SEQ ID NO: 19646 - RNA, 20 nt, Artificial Sequence
  TRAC targeting sequence
gaggaguuuuagacaucauu

SEQ ID NO: 19647 - RNA, 20 nt, Artificial Sequence
  TRAC targeting sequence
cggccuuauccauugccacc

SEQ ID NO: 19648 - RNA, 20 nt, Artificial Sequence
  TRAC targeting sequence
gccuuauccauugccaccaa

SEQ ID NO: 19649 - RNA, 20 nt, Artificial Sequence
  TRAC targeting sequence
auugccaccaaaacccucuu

SEQ ID NO: 19650 - RNA, 20 nt, Artificial Sequence
  TRAC targeting sequence
uuuuacuaagaaacagugag

SEQ ID NO: 19651 - RNA, 20 nt, Artificial Sequence
  TRAC targeting sequence
uaguaaaaagaggguuuugg

SEQ ID NO: 19652 - RNA, 20 nt, Artificial Sequence
  TRAC targeting sequence
cuguuucuuaguaaaaagag

SEQ ID NO: 19653 - RNA, 20 nt, Artificial Sequence
  TRAC targeting sequence
ggcaguccagagaaugacac

SEQ ID NO: 19654 - RNA, 20 nt, Artificial Sequence
  TRAC targeting sequence
agagaaugacacgggaaaaa

SEQ ID NO: 19655 - RNA, 20 nt, Artificial Sequence
  TRAC targeting sequence
ggacugccagaacaaggcuc

SEQ ID NO: 19656 - RNA, 20 nt, Artificial Sequence
  TRAC targeting sequence
cuggacugccagaacaaggc

SEQ ID NO: 19657 - RNA, 20 nt, Artificial Sequence
  TRAC targeting sequence
uucucuggacugccagaaca

SEQ ID NO: 19658 - RNA, 20 nt, Artificial Sequence
  TRAC targeting sequence
cgugucauucucuggacugc

SEQ ID NO: 19659 - RNA, 20 nt, Artificial Sequence
  TRAC targeting sequence
gcuuuuuucccgugucauuc

SEQ ID NO: 19660 - RNA, 20 nt, Artificial Sequence
  TRAC targeting sequence
ucugcuuuuuucccguguca

SEQ ID NO: 19661 - RNA, 20 nt, Artificial Sequence
  TRAC targeting sequence
ucaucugcuuuuuucccgug

SEQ ID NO: 19662 - RNA, 20 nt, Artificial Sequence
  TRAC targeting sequence
cuucaucugcuuuuuucccg

SEQ ID NO: 19663 - RNA, 20 nt, Artificial Sequence
  TRAC targeting sequence
ugccaccuucucuucaucug

SEQ ID NO: 19664 - RNA, 20 nt, Artificial Sequence
  TRAC targeting sequence
ccugccaccuucucuucauc

SEQ ID NO: 19665 - RNA, 20 nt, Artificial Sequence
  TRAC targeting sequence
gucucuccaacugaguuccu

SEQ ID NO: 19666 - RNA, 20 nt, Artificial Sequence
  TRAC targeting sequence
cuccaacugaguuccugccu

SEQ ID NO: 19667 - RNA, 20 nt, Artificial Sequence
  TRAC targeting sequence
ccaacugaguuccugccugc

SEQ ID NO: 19668 - RNA, 20 nt, Artificial Sequence
  TRAC targeting sequence
aacugaguuccugccugccu

SEQ ID NO: 19669 - RNA, 20 nt, Artificial Sequence
  TRAC targeting sequence
guuggagagacugaggcugg

SEQ ID NO: 19670 - RNA, 20 nt, Artificial Sequence
  TRAC targeting sequence
ugccugccugccuuugcuca

SEQ ID NO: 19671 - RNA, 20 nt, Artificial Sequence
  TRAC targeting sequence
gacuguuugccccuuacugc

SEQ ID NO: 19672 - RNA, 20 nt, Artificial Sequence
  TRAC targeting sequence
gagcaaaggcaggcaggcag

SEQ ID NO: 19673 - RNA, 20 nt, Artificial Sequence
  TRAC targeting sequence
ucuaggccucauucuaagcc

SEQ ID NO: 19674 - RNA, 20 nt, Artificial Sequence
  TRAC targeting sequence
aggccucauucuaagccccu

SEQ ID NO: 19675 - RNA, 20 nt, Artificial Sequence
  TRAC targeting sequence
uucuaagccccuucuccaag

SEQ ID NO: 19676 - RNA, 20 nt, Artificial Sequence
  TRAC targeting sequence
aagccccuucuccaaguugc

SEQ ID NO: 19677 - RNA, 20 nt, Artificial Sequence
  TRAC targeting sequence
ccaaguugccucuccuuauu

SEQ ID NO: 19678 - RNA, 20 nt, Artificial Sequence
  TRAC targeting sequence
aaguugccucuccuuauuuc

SEQ ID NO: 19679 - RNA, 20 nt, Artificial Sequence
  TRAC targeting sequence
ccuuauuucucccugucugc

SEQ ID NO: 19680 - RNA, 20 nt, Artificial Sequence
  TRAC targeting sequence
uuauuucucccugucugcca

SEQ ID NO: 19681 - RNA, 20 nt, Artificial Sequence
  TRAC targeting sequence
cccugucugccaaaaaaucu

SEQ ID NO: 19682 - RNA, 20 nt, Artificial Sequence
  TRAC targeting sequence
cugucugccaaaaaaucuuu

SEQ ID NO: 19683 - RNA, 20 nt, Artificial Sequence
  TRAC targeting sequence
gccaaaaaaucuuucccagc

SEQ ID NO: 19684 - RNA, 20 nt, Artificial Sequence
  TRAC targeting sequence
uucccagcucacuaagucag

SEQ ID NO: 19685 - RNA, 20 nt, Artificial Sequence
  TRAC targeting sequence
cagcucacuaagucagucuc

SEQ ID NO: 19686 - RNA, 20 nt, Artificial Sequence
  TRAC targeting sequence
cuaagucagucucacgcagu

SEQ ID NO: 19687 - RNA, 20 nt, Artificial Sequence
  TRAC targeting sequence
gucucacgcagucacucauu

SEQ ID NO: 19688 - RNA, 20 nt, Artificial Sequence
  TRAC targeting sequence
cacgcagucacucauuaacc

SEQ ID NO: 19689 - RNA, 20 nt, Artificial Sequence
  TRAC targeting sequence
cgcagucacucauuaaccca

SEQ ID NO: 19690 - RNA, 20 nt, Artificial Sequence
  TRAC targeting sequence
cucauuaacccaccaaucac

SEQ ID NO: 19691 - RNA, 20 nt, Artificial Sequence
  TRAC targeting sequence
uuaacccaccaaucacugau

SEQ ID NO: 19692 - RNA, 20 nt, Artificial Sequence
  TRAC targeting sequence
cugauugugccggcacauga

SEQ ID NO: 19693 - RNA, 20 nt, Artificial Sequence
  TRAC targeting sequence
gugauugguggguuaaugag

SEQ ID NO: 19694 - RNA, 20 nt, Artificial Sequence
  TRAC targeting sequence
ugugccggcacaaucaguga

SEQ ID NO: 19695 - RNA, 20 nt, Artificial Sequence
  TRAC targeting sequence
acaccuggugcauucaugug

SEQ ID NO: 19696 - RNA, 20 nt, Artificial Sequence
  TRAC targeting sequence
acuucaacaccuggugcauu

SEQ ID NO: 19697 - RNA, 20 nt, Artificial Sequence
  TRAC targeting sequence
uccacuucaacaccuggugc

SEQ ID NO: 19698 - RNA, 20 nt, Artificial Sequence
  TRAC targeting sequence
gaugaggggugugcccagag

SEQ ID NO: 19699 - RNA, 20 nt, Artificial Sequence
  TRAC targeting sequence
gacuuuuuaauuccuccacu

SEQ ID NO: 19700 - RNA, 20 nt, Artificial Sequence
  TRAC targeting sequence
ucugacuuuuuaauuccucc

SEQ ID NO: 19701 - RNA, 20 nt, Artificial Sequence
  TRAC targeting sequence
gggcacaccccucaucugac

SEQ ID NO: 19702 - RNA, 20 nt, Artificial Sequence
  TRAC targeting sequence
ucugggcacaccccucaucu

SEQ ID NO: 19703 - RNA, 20 nt, Artificial Sequence
  TRAC targeting sequence
aguugggggagcccaucugu

SEQ ID NO: 19704 - RNA, 20 nt, Artificial Sequence
  TRAC targeting sequence
cccaacuagaauggugcuuc

SEQ ID NO: 19705 - RNA, 20 nt, Artificial Sequence
  TRAC targeting sequence
gucagcugggaaaaguccaa

SEQ ID NO: 19706 - RNA, 20 nt, Artificial Sequence
  TRAC targeting sequence
gcugggaaaaguccaaauaa

SEQ ID NO: 19707 - RNA, 20 nt, Artificial Sequence
  TRAC targeting sequence
cagcugacagaugggcuccc

SEQ ID NO: 19708 - RNA, 20 nt, Artificial Sequence
  TRAC targeting sequence
aaauaacuucagauuggaau

SEQ ID NO: 19709 - RNA, 20 nt, Artificial Sequence
  TRAC targeting sequence
gauuggaauguguuuuaacu

SEQ ID NO: 19710 - RNA, 20 nt, Artificial Sequence
  TRAC targeting sequence
gaaguuauuuggacuuuucc

SEQ ID NO: 19711 - RNA, 20 nt, Artificial Sequence
  TRAC targeting sequence
aaucugaaguuauuuggacu

SEQ ID NO: 19712 - RNA, 20 nt, Artificial Sequence
  TRAC targeting sequence
ggguugagaaaacagcuacc

SEQ ID NO: 19713 - RNA, 20 nt, Artificial Sequence
  TRAC targeting sequence
acccugaguuaaaacacauu

SEQ ID NO: 19714 - RNA, 20 nt, Artificial Sequence
  TRAC targeting sequence
caacccugaguuaaaacaca

SEQ ID NO: 19715 - RNA, 20 nt, Artificial Sequence
  TRAC targeting sequence
ggacaaaagucagggaaggg

SEQ ID NO: 19716 - RNA, 20 nt, Artificial Sequence
  TRAC targeting sequence
ugaagguagcuguuuucuca

SEQ ID NO: 19717 - RNA, 20 nt, Artificial Sequence
  TRAC targeting sequence
gggaagggcucucugaagaa

SEQ ID NO: 19718 - RNA, 20 nt, Artificial Sequence
  TRAC targeting sequence
cugacuuuuguccugaaggu

SEQ ID NO: 19719 - RNA, 20 nt, Artificial Sequence
  TRAC targeting sequence
cugaagaaaugcuacuugaa

SEQ ID NO: 19720 - RNA, 20 nt, Artificial Sequence
  TRAC targeting sequence
gaagaaaugcuacuugaaga

SEQ ID NO: 19721 - RNA, 20 nt, Artificial Sequence
  TRAC targeting sequence
gagagcccuucccugacuuu

SEQ ID NO: 19722 - RNA, 20 nt, Artificial Sequence
  TRAC targeting sequence
ucagagagcccuucccugac

SEQ ID NO: 19723 - RNA, 20 nt, Artificial Sequence
  TRAC targeting sequence
aguagcauuucuucagagag

SEQ ID NO: 19724 - RNA, 20 nt, Artificial Sequence
  TRAC targeting sequence
ucaaguagcauuucuucaga

SEQ ID NO: 19725 - RNA, 20 nt, Artificial Sequence
  TRAC targeting sequence
cugcccuugguagggcuggu

SEQ ID NO: 19726 - RNA, 20 nt, Artificial Sequence
  TRAC targeting sequence
cccugcccuugguagggcug

SEQ ID NO: 19727 - RNA, 20 nt, Artificial Sequence
  TRAC targeting sequence
ucucccugcccuugguaggg

SEQ ID NO: 19728 - RNA, 20 nt, Artificial Sequence
  TRAC targeting sequence
auaggguccucucccugccc

SEQ ID NO: 19729 - RNA, 20 nt, Artificial Sequence
  TRAC targeting sequence
caggccucuauaggguccuc

SEQ ID NO: 19730 - RNA, 20 nt, Artificial Sequence
  TRAC targeting sequence
ugucccaggccucuauaggg

SEQ ID NO: 19731 - RNA, 20 nt, Artificial Sequence
  TRAC targeting sequence
augagaaaggagaagagcag

SEQ ID NO: 19732 - RNA, 20 nt, Artificial Sequence
  TRAC targeting sequence
uugagcuccugucccaggcc

SEQ ID NO: 19733 - RNA, 20 nt, Artificial Sequence
  TRAC targeting sequence
cauugagcuccugucccagg

SEQ ID NO: 19734 - RNA, 20 nt, Artificial Sequence
  TRAC targeting sequence
uuucucauugagcuccuguc

SEQ ID NO: 19735 - RNA, 20 nt, Artificial Sequence
  TRAC targeting sequence
ccuuucucauugagcuccug

SEQ ID NO: 19736 - RNA, 20 nt, Artificial Sequence
  TRAC targeting sequence
ucuccuuucucauugagcuc

SEQ ID NO: 19737 - RNA, 20 nt, Artificial Sequence
  TRAC targeting sequence
ugccugcugcucuucuccuu

SEQ ID NO: 19738 - RNA, 20 nt, Artificial Sequence
  TRAC targeting sequence
acucaugccugcugcucuuc

SEQ ID NO: 19739 - RNA, 20 nt, Artificial Sequence
  TRAC targeting sequence
uucaacucaugccugcugcu

SEQ ID NO: 19740 - RNA, 20 nt, Artificial Sequence
  TRAC targeting sequence
uucauucaacucaugccugc

SEQ ID NO: 19741 - RNA, 20 nt, Artificial Sequence
  TRAC targeting sequence
cagggccuucuaggccauga

SEQ ID NO: 19742 - RNA, 20 nt, Artificial Sequence
  TRAC targeting sequence
aggccaugagaggguagaca

SEQ ID NO: 19743 - RNA, 20 nt, Artificial Sequence
  TRAC targeting sequence
uggccuagaaggcccuguga

SEQ ID NO: 19744 - RNA, 20 nt, Artificial Sequence
  TRAC targeting sequence
cauggccuagaaggcccugu

SEQ ID NO: 19745 - RNA, 20 nt, Artificial Sequence
  TRAC targeting sequence
acccucucauggccuagaag

SEQ ID NO: 19746 - RNA, 20 nt, Artificial Sequence
  TRAC targeting sequence
aaggacgccagaaagcuguu

SEQ ID NO: 19747 - RNA, 20 nt, Artificial Sequence
  TRAC targeting sequence
uuagaauacugucuacccuc

SEQ ID NO: 19748 - RNA, 20 nt, Artificial Sequence
  TRAC targeting sequence
ggcguccuuagaauacuguc

SEQ ID NO: 19749 - RNA, 20 nt, Artificial Sequence
  TRAC targeting sequence
acagcuuucuggcguccuua

SEQ ID NO: 19750 - RNA, 20 nt, Artificial Sequence
  TRAC targeting sequence
gcuucaagcaggggagggac

SEQ ID NO: 19751 - RNA, 20 nt, Artificial Sequence
  TRAC targeting sequence
agcaggggagggacaccuaa

SEQ ID NO: 19752 - RNA, 20 nt, Artificial Sequence
  TRAC targeting sequence
ccugcuugaagccgaucaac

SEQ ID NO: 19753 - RNA, 20 nt, Artificial Sequence
  TRAC targeting sequence
cuccccugcuugaagccgau

SEQ ID NO: 19754 - RNA, 20 nt, Artificial Sequence
  TRAC targeting sequence
uuuuuuuuuuuuuuuuuuuu

SEQ ID NO: 19755 - RNA, 20 nt, Artificial Sequence
  TRAC targeting sequence
aaaaaaaaaaaaaaaaaaaa

SEQ ID NO: 19756 - RNA, 20 nt, Artificial Sequence
  TRAC targeting sequence
caaaaaaaaaaaaaaaaaaa

SEQ ID NO: 19757 - RNA, 20 nt, Artificial Sequence
  TRAC targeting sequence
aucucaaaaaaaaaaaaaaa

SEQ ID NO: 19758 - RNA, 20 nt, Artificial Sequence
  TRAC targeting sequence
uguugcccaggcuggagugc

SEQ ID NO: 19759 - RNA, 20 nt, Artificial Sequence
  TRAC targeting sequence
agccugggcaacaagagcaa

SEQ ID NO: 19760 - RNA, 20 nt, Artificial Sequence
  TRAC targeting sequence
uggcucacugcaaccuccgc

SEQ ID NO: 19761 - RNA, 20 nt, Artificial Sequence
  TRAC targeting sequence
cugcaaccuccgccucccag

SEQ ID NO: 19762 - RNA, 20 nt, Artificial Sequence
  TRAC targeting sequence
gccucccagguucaagugau

SEQ ID NO: 19763 - RNA, 20 nt, Artificial Sequence
  TRAC targeting sequence
cagguucaagugauucuccu

SEQ ID NO: 19764 - RNA, 20 nt, Artificial Sequence
  TRAC targeting sequence
agugauucuccugccucagc

SEQ ID NO: 19765 - RNA, 20 nt, Artificial Sequence
  TRAC targeting sequence
cuugaaccugggaggcggag

SEQ ID NO: 19766 - RNA, 20 nt, Artificial Sequence
  TRAC targeting sequence
ccugccucagccucccgagu

SEQ ID NO: 19767 - RNA, 20 nt, Artificial Sequence
  TRAC targeting sequence
ugccucagccucccgaguag

SEQ ID NO: 19768 - RNA, 20 nt, Artificial Sequence
  TRAC targeting sequence
gccucccgaguagcugagau

SEQ ID NO: 19769 - RNA, 20 nt, Artificial Sequence
  TRAC targeting sequence
cgaguagcugagauuacagg

SEQ ID NO: 19770 - RNA, 20 nt, Artificial Sequence
  TRAC targeting sequence
ggaggcugaggcaggagaau

SEQ ID NO: 19771 - RNA, 20 nt, Artificial Sequence
  TRAC targeting sequence
gcuacucgggaggcugaggc

SEQ ID NO: 19772 - RNA, 20 nt, Artificial Sequence
  TRAC targeting sequence
cagcuacucgggaggcugag

SEQ ID NO: 19773 - RNA, 20 nt, Artificial Sequence
  TRAC targeting sequence
acuaaaaauacaaaaaauua

SEQ ID NO: 19774 - RNA, 20 nt, Artificial Sequence
  TRAC targeting sequence
cuacuaaaaauacaaaaaau

SEQ ID NO: 19775 - RNA, 20 nt, Artificial Sequence
  TRAC targeting sequence
cuauguuggccaggcugguc

SEQ ID NO: 19776 - RNA, 20 nt, Artificial Sequence
  TRAC targeting sequence
cgaacuccugaccucaggug

SEQ ID NO: 19777 - RNA, 20 nt, Artificial Sequence
  TRAC targeting sequence
aacuccugaccucaggugau

SEQ ID NO: 19778 - RNA, 20 nt, Artificial Sequence
  TRAC targeting sequence
agaccagccuggccaacaua

SEQ ID NO: 19779 - RNA, 20 nt, Artificial Sequence
  TRAC targeting sequence
ugaccucaggugauccaccc

SEQ ID NO: 19780 - RNA, 20 nt, Artificial Sequence
  TRAC targeting sequence
ggaguucgagaccagccugg

SEQ ID NO: 19781 - RNA, 20 nt, Artificial Sequence
  TRAC targeting sequence
ggugauccacccgcuucagc

SEQ ID NO: 19782 - RNA, 20 nt, Artificial Sequence
  TRAC targeting sequence
ccugaggucaggaguucgag

SEQ ID NO: 19783 - RNA, 20 nt, Artificial Sequence
  TRAC targeting sequence
acccgcuucagccucccaaa

SEQ ID NO: 19784 - RNA, 20 nt, Artificial Sequence
  TRAC targeting sequence
gccucccaaagugcugggau

SEQ ID NO: 19785 - RNA, 20 nt, Artificial Sequence
  TRAC targeting sequence
caaagugcugggauuacagg

SEQ ID NO: 19786 - RNA, 20 nt, Artificial Sequence
  TRAC targeting sequence
cagcacuuugggaggcugaa

SEQ ID NO: 19787 - RNA, 20 nt, Artificial Sequence
  TRAC targeting sequence
cgccuguaaucccagcacuu

SEQ ID NO: 19788 - RNA, 20 nt, Artificial Sequence
  TRAC targeting sequence
uaaagaucaaucugagugcu

SEQ ID NO: 19789 - RNA, 20 nt, Artificial Sequence
  TRAC targeting sequence
uuaagaaaagcaggccgggu

SEQ ID NO: 19790 - RNA, 20 nt, Artificial Sequence
  TRAC targeting sequence
aucugagugcuguacggaga

SEQ ID NO: 19791 - RNA, 20 nt, Artificial Sequence
  TRAC targeting sequence
gagugcuguacggagagugg

SEQ ID NO: 19792 - RNA, 20 nt, Artificial Sequence
  TRAC targeting sequence
gauugaucuuuaagaaaagc

SEQ ID NO: 19793 - RNA, 20 nt, Artificial Sequence
  TRAC targeting sequence
guacagcacucagauugauc

SEQ ID NO: 19794 - RNA, 20 nt, Artificial Sequence
  TRAC targeting sequence
ccguacagcacucagauuga

SEQ ID NO: 19795 - RNA, 20 nt, Artificial Sequence
  TRAC targeting sequence
uggcuuacaacccacucucc

SEQ ID NO: 19796 - RNA, 20 nt, Artificial Sequence
  TRAC targeting sequence
acucuuggcuuacaacccac

SEQ ID NO: 19797 - RNA, 20 nt, Artificial Sequence
  TRAC targeting sequence
gcuucuacucuuggcuuaca

SEQ ID NO: 19798 - RNA, 20 nt, Artificial Sequence
  TRAC targeting sequence
cuuucugcuucuacucuugg

SEQ ID NO: 19799 - RNA, 20 nt, Artificial Sequence
  TRAC targeting sequence
gcugcaacugcucccuuucu

SEQ ID NO: 19800 - RNA, 20 nt, Artificial Sequence
  TRAC targeting sequence
cugcugcaacugcucccuuu

SEQ ID NO: 19801 - RNA, 20 nt, Artificial Sequence
  TRAC targeting sequence
cucugcugcaacugcucccu

SEQ ID NO: 19802 - RNA, 20 nt, Artificial Sequence
  TRAC targeting sequence
ucucucugcugcaacugcuc

SEQ ID NO: 19803 - RNA, 20 nt, Artificial Sequence
  TRAC targeting sequence
aucaucucucugcugcaacu

SEQ ID NO: 19804 - RNA, 20 nt, Artificial Sequence
  TRAC targeting sequence
cugccaccacccugcccagg

SEQ ID NO: 19805 - RNA, 20 nt, Artificial Sequence
  TRAC targeting sequence
gguuucaaagguagaaccau

SEQ ID NO: 19806 - RNA, 20 nt, Artificial Sequence
  TRAC targeting sequence
aagguagaaccaugcaggga

SEQ ID NO: 19807 - RNA, 20 nt, Artificial Sequence
  TRAC targeting sequence
accuuugaaaccugaauggu

SEQ ID NO: 19808 - RNA, 20 nt, Artificial Sequence
  TRAC targeting sequence
cugcaugguucuaccuuuga

SEQ ID NO: 19809 - RNA, 20 nt, Artificial Sequence
  TRAC targeting sequence
ucccugcaugguucuaccuu

SEQ ID NO: 19810 - RNA, 20 nt, Artificial Sequence
  TRAC targeting sequence
caucccugcaugguucuacc

SEQ ID NO: 19811 - RNA, 20 nt, Artificial Sequence
  TRAC targeting sequence
uugcuuucucaucccugcau

SEQ ID NO: 19812 - RNA, 20 nt, Artificial Sequence
  TRAC targeting sequence
ccucuuugcuuucucauccc

SEQ ID NO: 19813 - RNA, 20 nt, Artificial Sequence
  TRAC targeting sequence
aggaaggcagcuggauuuug

SEQ ID NO: 19814 - RNA, 20 nt, Artificial Sequence
  TRAC targeting sequence
uugauccccucuuugcuuuc

SEQ ID NO: 19815 - RNA, 20 nt, Artificial Sequence
  TRAC targeting sequence
agcugccuuccuugaucccc

SEQ ID NO: 19816 - RNA, 20 nt, Artificial Sequence
  TRAC targeting sequence
ggccaaaauccagcugccuu

SEQ ID NO: 19817 - RNA, 20 nt, Artificial Sequence
  TRAC targeting sequence
gcugcucaggccaaaaucca

SEQ ID NO: 19818 - RNA, 20 nt, Artificial Sequence
  TRAC targeting sequence
augauagugccguuuacuaa

SEQ ID NO: 19819 - RNA, 20 nt, Artificial Sequence
  TRAC targeting sequence
uugacucagcugcucaggcc

SEQ ID NO: 19820 - RNA, 20 nt, Artificial Sequence
  TRAC targeting sequence
uaguaaacggcacuaucauu

SEQ ID NO: 19821 - RNA, 20 nt, Artificial Sequence
  TRAC targeting sequence
ucuuaguaaacggcacuauc

SEQ ID NO: 19822 - RNA, 20 nt, Artificial Sequence
  TRAC targeting sequence
uugguuucuucuuaguaaac

SEQ ID NO: 19823 - RNA, 20 nt, Artificial Sequence
  TRAC targeting sequence
cugcaccccaaauuuuuucc

SEQ ID NO: 19824 - RNA, 20 nt, Artificial Sequence
  TRAC targeting sequence
aaacuuuuuggaacauauga

SEQ ID NO: 19825 - RNA, 20 nt, Artificial Sequence
  TRAC targeting sequence
aaaaaguuuugaucccugca

SEQ ID NO: 19826 - RNA, 20 nt, Artificial Sequence
  TRAC targeting sequence
uauguuccaaaaaguuuuga

SEQ ID NO: 19827 - RNA, 20 nt, Artificial Sequence
  TRAC targeting sequence
uuauggcccuugucacuaug

SEQ ID NO: 19828 - RNA, 20 nt, Artificial Sequence
  TRAC targeting sequence
cuauguaugccucgcugccu

SEQ ID NO: 19829 - RNA, 20 nt, Artificial Sequence
  TRAC targeting sequence
cugccuccauuggacucuag

SEQ ID NO: 19830 - RNA, 20 nt, Artificial Sequence
  TRAC targeting sequence
auuggacucuagaaugaagc

SEQ ID NO: 19831 - RNA, 20 nt, Artificial Sequence
  TRAC targeting sequence
aauggaggcagcgaggcaua

SEQ ID NO: 19832 - RNA, 20 nt, Artificial Sequence
  TRAC targeting sequence
agaaugaagccaggcaagag

SEQ ID NO: 19833 - RNA, 20 nt, Artificial Sequence
  TRAC targeting sequence
agaguccaauggaggcagcg

SEQ ID NO: 19834 - RNA, 20 nt, Artificial Sequence
  TRAC targeting sequence
uucuagaguccaauggaggc

SEQ ID NO: 19835 - RNA, 20 nt, Artificial Sequence
  TRAC targeting sequence
ugccuggcuucauucuagag

SEQ ID NO: 19836 - RNA, 20 nt, Artificial Sequence
  TRAC targeting sequence
augugugauggcacaugugg

SEQ ID NO: 19837 - RNA, 20 nt, Artificial Sequence
  TRAC targeting sequence
cacauagacccugcucuugc

SEQ ID NO: 19838 - RNA, 20 nt, Artificial Sequence
  TRAC targeting sequence
ugcaacauguacuuuguaca

SEQ ID NO: 19839 - RNA, 20 nt, Artificial Sequence
  TRAC targeting sequence
auauacacuguuuguacaaa

SEQ ID NO: 19840 - RNA, 20 nt, Artificial Sequence
  TRAC targeting sequence
auuuacucaauauacacugu

SEQ ID NO: 19841 - RNA, 20 nt, Artificial Sequence
  TRAC targeting sequence
aggagccgagguaucggucc

SEQ ID NO: 19842 - RNA, 20 nt, Artificial Sequence
  TRAC targeting sequence
uggacaccauuucuauuuac

SEQ ID NO: 19843 - RNA, 20 nt, Artificial Sequence
  TRAC targeting sequence
gcuccuggacaccauuucua

SEQ ID NO: 19844 - RNA, 20 nt, Artificial Sequence
  TRAC targeting sequence
guccugccagggccaggggc

SEQ ID NO: 19845 - RNA, 20 nt, Artificial Sequence
  TRAC targeting sequence
ugccagggccaggggcucuc

SEQ ID NO: 19846 - RNA, 20 nt, Artificial Sequence
  TRAC targeting sequence
cccuagcaggugcucauaug

SEQ ID NO: 19847 - RNA, 20 nt, Artificial Sequence
  TRAC targeting sequence
cuagcaggugcucauaugcu

SEQ ID NO: 19848 - RNA, 20 nt, Artificial Sequence
  TRAC targeting sequence
uaugcuguaaguucccucca

SEQ ID NO: 19849 - RNA, 20 nt, Artificial Sequence
  TRAC targeting sequence
cuccagaucucuccacaagg

SEQ ID NO: 19850 - RNA, 20 nt, Artificial Sequence
  TRAC targeting sequence
agaucucuccacaaggaggc

SEQ ID NO: 19851 - RNA, 20 nt, Artificial Sequence
  TRAC targeting sequence
ggagggaacuuacagcauau

SEQ ID NO: 19852 - RNA, 20 nt, Artificial Sequence
  TRAC targeting sequence
cuccacaaggaggcauggaa

SEQ ID NO: 19853 - RNA, 20 nt, Artificial Sequence
  TRAC targeting sequence
ccacaaggaggcauggaaag

SEQ ID NO: 19854 - RNA, 20 nt, Artificial Sequence
  TRAC targeting sequence
acaaggaggcauggaaaggc

SEQ ID NO: 19855 - RNA, 20 nt, Artificial Sequence
  TRAC targeting sequence
uuguggagagaucuggaggg

SEQ ID NO: 19856 - RNA, 20 nt, Artificial Sequence
  TRAC targeting sequence
augccuccuuguggagagau

SEQ ID NO: 19857 - RNA, 20 nt, Artificial Sequence
  TRAC targeting sequence
ccugcccaagaacuaggagg

SEQ ID NO: 19858 - RNA, 20 nt, Artificial Sequence
  TRAC targeting sequence
ugggcaggugaacaacuaca

SEQ ID NO: 19859 - RNA, 20 nt, Artificial Sequence
  TRAC targeting sequence
uaguucuugggcaggugaac

SEQ ID NO: 19860 - RNA, 20 nt, Artificial Sequence
  TRAC targeting sequence
ggggugggagagucagccug

SEQ ID NO: 19861 - RNA, 20 nt, Artificial Sequence
  TRAC targeting sequence
caccccagaccuccuaguuc

SEQ ID NO: 19862 - RNA, 20 nt, Artificial Sequence
  TRAC targeting sequence
cccaccccagaccuccuagu

SEQ ID NO: 19863 - RNA, 20 nt, Artificial Sequence
  TRAC targeting sequence
gccugcucuggaugcugaaa

SEQ ID NO: 19864 - RNA, 20 nt, Artificial Sequence
  TRAC targeting sequence
ggaugcugaaagaaugucug

SEQ ID NO: 19865 - RNA, 20 nt, Artificial Sequence
  TRAC targeting sequence
agagcaggcugacucuccca

SEQ ID NO: 19866 - RNA, 20 nt, Artificial Sequence
  TRAC targeting sequence
gcauccagagcaggcugacu

SEQ ID NO: 19867 - RNA, 20 nt, Artificial Sequence
  TRAC targeting sequence
uucagcauccagagcaggcu

SEQ ID NO: 19868 - RNA, 20 nt, Artificial Sequence
  TRAC targeting sequence
guuuuuccuuuuagaaaguu

SEQ ID NO: 19869 - RNA, 20 nt, Artificial Sequence
  TRAC targeting sequence
uuuuagaaaguuccugugau

SEQ ID NO: 19870 - RNA, 20 nt, Artificial Sequence
  TRAC targeting sequence
aaaaggaaaaacagacauuc

SEQ ID NO: 19871 - RNA, 20 nt, Artificial Sequence
  TRAC targeting sequence
ugugaugucaagcuggucga

SEQ ID NO: 19872 - RNA, 20 nt, Artificial Sequence
  TRAC targeting sequence
caggaacuuucuaaaaggaa

SEQ ID NO: 19873 - RNA, 20 nt, Artificial Sequence
  TRAC targeting sequence
agcuggucgagaaaagcuuu

SEQ ID NO: 19874 - RNA, 20 nt, Artificial Sequence
  TRAC targeting sequence
agaaaagcuuugaaacaggu

SEQ ID NO: 19875 - RNA, 20 nt, Artificial Sequence
  TRAC targeting sequence
accagcuugacaucacagga

SEQ ID NO: 19876 - RNA, 20 nt, Artificial Sequence
  TRAC targeting sequence
cgaccagcuugacaucacag

SEQ ID NO: 19877 - RNA, 20 nt, Artificial Sequence
  TRAC targeting sequence
aagcuuuucucgaccagcuu

SEQ ID NO: 19878 - RNA, 20 nt, Artificial Sequence
  TRAC targeting sequence
uaccuguuucaaagcuuuuc

SEQ ID NO: 19879 - RNA, 20 nt, Artificial Sequence
  TRAC targeting sequence
agccuggguuugcacaggau

SEQ ID NO: 19880 - RNA, 20 nt, Artificial Sequence
  TRAC targeting sequence
ugugcaaacccaggcuagac

SEQ ID NO: 19881 - RNA, 20 nt, Artificial Sequence
  TRAC targeting sequence
gcaauccugugcaaacccag

SEQ ID NO: 19882 - RNA, 20 nt, Artificial Sequence
  TRAC targeting sequence
cuuccgcaauccugugcaaa

SEQ ID NO: 19883 - RNA, 20 nt, Artificial Sequence
  TRAC targeting sequence
ucacuuccgcaauccugugc

SEQ ID NO: 19884 - RNA, 20 nt, Artificial Sequence
  TRAC targeting sequence
aggcaggguuauugcggguu

SEQ ID NO: 19885 - RNA, 20 nt, Artificial Sequence
  TRAC targeting sequence
uccaggcaggguuauugcgg

SEQ ID NO: 19886 - RNA, 20 nt, Artificial Sequence
  TRAC targeting sequence
cucauccaggcaggguuauu

SEQ ID NO: 19887 - RNA, 20 nt, Artificial Sequence
  TRAC targeting sequence
cacucccucauccaggcagg

SEQ ID NO: 19888 - RNA, 20 nt, Artificial Sequence
  TRAC targeting sequence
ucccacucccucauccaggc

SEQ ID NO: 19889 - RNA, 20 nt, Artificial Sequence
  TRAC targeting sequence
acuaauuucuucccacuccc

SEQ ID NO: 19890 - RNA, 20 nt, Artificial Sequence
  TRAC targeting sequence
cacaucuacuaauuucuucc

SEQ ID NO: 19891 - RNA, 20 nt, Artificial Sequence
  TRAC targeting sequence
uucccacaucuacuaauuuc

SEQ ID NO: 19892 - RNA, 20 nt, Artificial Sequence
  TRAC targeting sequence
uucauucccacaucuacuaa

SEQ ID NO: 19893 - RNA, 20 nt, Artificial Sequence
  TRAC targeting sequence
ucauucauucccacaucuac

SEQ ID NO: 19894 - RNA, 20 nt, Artificial Sequence
  TRAC targeting sequence
ucaucauucauucccacauc

SEQ ID NO: 19895 - RNA, 20 nt, Artificial Sequence
  TRAC targeting sequence
auuccucaucauucauuccc

SEQ ID NO: 19896 - RNA, 20 nt, Artificial Sequence
  TRAC targeting sequence
agaccugcccagagcugggu

SEQ ID NO: 19897 - RNA, 20 nt, Artificial Sequence
  TRAC targeting sequence
ugaaccgcuguuuccauucc

SEQ ID NO: 19898 - RNA, 20 nt, Artificial Sequence
  TRAC targeting sequence
gggcaggucuugaaccgcug

SEQ ID NO: 19899 - RNA, 20 nt, Artificial Sequence
  TRAC targeting sequence
cuccugaaucccucucacca

SEQ ID NO: 19900 - RNA, 20 nt, Artificial Sequence
  TRAC targeting sequence
ccugaaucccucucaccauc

SEQ ID NO: 19901 - RNA, 20 nt, Artificial Sequence
  TRAC targeting sequence
ugaaucccucucaccaucuc

SEQ ID NO: 19902 - RNA, 20 nt, Artificial Sequence
  TRAC targeting sequence
ggagagaccccacccagcuc

SEQ ID NO: 19903 - RNA, 20 nt, Artificial Sequence
  TRAC targeting sequence
cucucaccaucucugacuuu

SEQ ID NO: 19904 - RNA, 20 nt, Artificial Sequence
  TRAC targeting sequence
caccaucucugacuuuccau

SEQ ID NO: 19905 - RNA, 20 nt, Artificial Sequence
  TRAC targeting sequence
ccaucucugacuuuccauuc

SEQ ID NO: 19906 - RNA, 20 nt, Artificial Sequence
  TRAC targeting sequence
cugacuuuccauucuaagca

SEQ ID NO: 19907 - RNA, 20 nt, Artificial Sequence
  TRAC targeting sequence
gacuuuccauucuaagcacu

SEQ ID NO: 19908 - RNA, 20 nt, Artificial Sequence
  TRAC targeting sequence
gagauggugagagggauuca

SEQ ID NO: 19909 - RNA, 20 nt, Artificial Sequence
  TRAC targeting sequence
auucuaagcacuuugaggau

SEQ ID NO: 19910 - RNA, 20 nt, Artificial Sequence
  TRAC targeting sequence
aagcacuuugaggaugaguu

SEQ ID NO: 19911 - RNA, 20 nt, Artificial Sequence
  TRAC targeting sequence
aagugcuuagaauggaaagu

SEQ ID NO: 19912 - RNA, 20 nt, Artificial Sequence
  TRAC targeting sequence
ucaaagugcuuagaauggaa

SEQ ID NO: 19913 - RNA, 20 nt, Artificial Sequence
  TRAC targeting sequence
uccucaaagugcuuagaaug

SEQ ID NO: 19914 - RNA, 20 nt, Artificial Sequence
  TRAC targeting sequence
agcuucaauagaccaaggac

SEQ ID NO: 19915 - RNA, 20 nt, Artificial Sequence
  TRAC targeting sequence
auagaccaaggacucucucc

SEQ ID NO: 19916 - RNA, 20 nt, Artificial Sequence
  TRAC targeting sequence
auugaagcuagaaacucauc

SEQ ID NO: 19917 - RNA, 20 nt, Artificial Sequence
  TRAC targeting sequence
uuggucuauugaagcuagaa

SEQ ID NO: 19918 - RNA, 20 nt, Artificial Sequence
  TRAC targeting sequence
cuccuaggccucuguauucc

SEQ ID NO: 19919 - RNA, 20 nt, Artificial Sequence
  TRAC targeting sequence
ccuaggccucuguauuccuu

SEQ ID NO: 19920 - RNA, 20 nt, Artificial Sequence
  TRAC targeting sequence
uaggccucuguauuccuuuc

SEQ ID NO: 19921 - RNA, 20 nt, Artificial Sequence
  TRAC targeting sequence
guauuccuuucaacagcucc

SEQ ID NO: 19922 - RNA, 20 nt, Artificial Sequence
  TRAC targeting sequence
uuucaacagcuccacuguca

SEQ ID NO: 19923 - RNA, 20 nt, Artificial Sequence
  TRAC targeting sequence
acagcuccacugucaagaga

SEQ ID NO: 19924 - RNA, 20 nt, Artificial Sequence
  TRAC targeting sequence
acugucaagagagccagaga

SEQ ID NO: 19925 - RNA, 20 nt, Artificial Sequence
  TRAC targeting sequence
agagagccagagagagcuuc

SEQ ID NO: 19926 - RNA, 20 nt, Artificial Sequence
  TRAC targeting sequence
ugacaguggagcuguugaaa

SEQ ID NO: 19927 - RNA, 20 nt, Artificial Sequence
  TRAC targeting sequence
cuugacaguggagcuguuga

SEQ ID NO: 19928 - RNA, 20 nt, Artificial Sequence
  TRAC targeting sequence
ggcucucuugacaguggagc

SEQ ID NO: 19929 - RNA, 20 nt, Artificial Sequence
  TRAC targeting sequence
cuggcucucuugacagugga

SEQ ID NO: 19930 - RNA, 20 nt, Artificial Sequence
  TRAC targeting sequence
cucuggcucucuugacagug

SEQ ID NO: 19931 - RNA, 20 nt, Artificial Sequence
  TRAC targeting sequence
ggguggcccagcugugaaau

SEQ ID NO: 19932 - RNA, 20 nt, Artificial Sequence
  TRAC targeting sequence
cagcugggccacccagaagc

SEQ ID NO: 19933 - RNA, 20 nt, Artificial Sequence
  TRAC targeting sequence
gagucccuuagggauagccc

SEQ ID NO: 19934 - RNA, 20 nt, Artificial Sequence
  TRAC targeting sequence
gaaauuucacagcugggcca

SEQ ID NO: 19935 - RNA, 20 nt, Artificial Sequence
  TRAC targeting sequence
cuuagggauagcccuaaacg

SEQ ID NO: 19936 - RNA, 20 nt, Artificial Sequence
  TRAC targeting sequence
cuaagggacucagaaauuuc

SEQ ID NO: 19937 - RNA, 20 nt, Artificial Sequence
  TRAC targeting sequence
uuuagggcuaucccuaaggg

SEQ ID NO: 19938 - RNA, 20 nt, Artificial Sequence
  TRAC targeting sequence
gguucguuuagggcuauccc

SEQ ID NO: 19939 - RNA, 20 nt, Artificial Sequence
  TRAC targeting sequence
uccugaggacagccaagagg

SEQ ID NO: 19940 - RNA, 20 nt, Artificial Sequence
  TRAC targeting sequence
ugaggacagccaagagguuu

SEQ ID NO: 19941 - RNA, 20 nt, Artificial Sequence
  TRAC targeting sequence
ggaugaucugguucguuuag

SEQ ID NO: 19942 - RNA, 20 nt, Artificial Sequence
  TRAC targeting sequence
ucaggaugaucugguucguu

SEQ ID NO: 19943 - RNA, 20 nt, Artificial Sequence
  TRAC targeting sequence
uggcuguccucaggaugauc

SEQ ID NO: 19944 - RNA, 20 nt, Artificial Sequence
  TRAC targeting sequence
uucaagacaagcaacaguac

SEQ ID NO: 19945 - RNA, 20 nt, Artificial Sequence
  TRAC targeting sequence
agacaagcaacaguacucac

SEQ ID NO: 19946 - RNA, 20 nt, Artificial Sequence
  TRAC targeting sequence
ugaaagaaggcaaaaccucu

SEQ ID NO: 19947 - RNA, 20 nt, Artificial Sequence
  TRAC targeting sequence
cauaggcugugggcaauggu

SEQ ID NO: 19948 - RNA, 20 nt, Artificial Sequence
  TRAC targeting sequence
ugucucucaagaauccccug

SEQ ID NO: 19949 - RNA, 20 nt, Artificial Sequence
  TRAC targeting sequence
cucaagaauccccugccacu

SEQ ID NO: 19950 - RNA, 20 nt, Artificial Sequence
  TRAC targeting sequence
caagaauccccugccacucc

SEQ ID NO: 19951 - RNA, 20 nt, Artificial Sequence
  TRAC targeting sequence
agaauccccugccacuccuc

SEQ ID NO: 19952 - RNA, 20 nt, Artificial Sequence
  TRAC targeting sequence
ugagagacaggaccauugcc

SEQ ID NO: 19953 - RNA, 20 nt, Artificial Sequence
  TRAC targeting sequence
ccugccacuccucacaccca

SEQ ID NO: 19954 - RNA, 20 nt, Artificial Sequence
  TRAC targeting sequence
ucacacccacccugggccca

SEQ ID NO: 19955 - RNA, 20 nt, Artificial Sequence
  TRAC targeting sequence
cacccacccugggcccauau

SEQ ID NO: 19956 - RNA, 20 nt, Artificial Sequence
  TRAC targeting sequence
uuuccauuugaguuguucuu

SEQ ID NO: 19957 - RNA, 20 nt, Artificial Sequence
  TRAC targeting sequence
auuugaguuguucuuauuga

SEQ ID NO: 19958 - RNA, 20 nt, Artificial Sequence
  TRAC targeting sequence
aauggaaaugaauaugggcc

SEQ ID NO: 19959 - RNA, 20 nt, Artificial Sequence
  TRAC targeting sequence
uauugagucauccuuccugu

SEQ ID NO: 19960 - RNA, 20 nt, Artificial Sequence
  TRAC targeting sequence
auaagaacaacucaaaugga

SEQ ID NO: 19961 - RNA, 20 nt, Artificial Sequence
  TRAC targeting sequence
uccuuccugugguagcggaa

SEQ ID NO: 19962 - RNA, 20 nt, Artificial Sequence
  TRAC targeting sequence
uuccugugguagcggaacuc

SEQ ID NO: 19963 - RNA, 20 nt, Artificial Sequence
  TRAC targeting sequence
ugugguagcggaacucacua

SEQ ID NO: 19964 - RNA, 20 nt, Artificial Sequence
  TRAC targeting sequence
gcuaccacaggaaggaugac

SEQ ID NO: 19965 - RNA, 20 nt, Artificial Sequence
  TRAC targeting sequence
cuaaggggcccaucuggacc

SEQ ID NO: 19966 - RNA, 20 nt, Artificial Sequence
  TRAC targeting sequence
ggacccgagguauugugaug

SEQ ID NO: 19967 - RNA, 20 nt, Artificial Sequence
  TRAC targeting sequence
agaugggccccuuagugagu

SEQ ID NO: 19968 - RNA, 20 nt, Artificial Sequence
  TRAC targeting sequence
gguccagaugggccccuuag

SEQ ID NO: 19969 - RNA, 20 nt, Artificial Sequence
  TRAC targeting sequence
caauaccucggguccagaug

SEQ ID NO: 19970 - RNA, 20 nt, Artificial Sequence
  TRAC targeting sequence
ucacaauaccucggguccag

SEQ ID NO: 19971 - RNA, 20 nt, Artificial Sequence
  TRAC targeting sequence
gagcaccuaccccaucccca

SEQ ID NO: 19972 - RNA, 20 nt, Artificial Sequence
  TRAC targeting sequence
gaauuuaucaucacaauacc

SEQ ID NO: 19973 - RNA, 20 nt, Artificial Sequence
  TRAC targeting sequence
ccagaagggcucagaaauaa

SEQ ID NO: 19974 - RNA, 20 nt, Artificial Sequence
  TRAC targeting sequence
ggggaugggguaggugcuca

SEQ ID NO: 19975 - RNA, 20 nt, Artificial Sequence
  TRAC targeting sequence
gaaauaaaauaagagccaag

SEQ ID NO: 19976 - RNA, 20 nt, Artificial Sequence
  TRAC targeting sequence
gagcccuucuggggaugggg

SEQ ID NO: 19977 - RNA, 20 nt, Artificial Sequence
  TRAC targeting sequence
uauuuuauuucugagcccuu

SEQ ID NO: 19978 - RNA, 20 nt, Artificial Sequence
  TRAC targeting sequence
agucgguguuuccugucuug

SEQ ID NO: 19979 - RNA, 20 nt, Artificial Sequence
  TRAC targeting sequence
guguuuccugucuugaaaca

SEQ ID NO: 19980 - RNA, 20 nt, Artificial Sequence
  TRAC targeting sequence
ugucuugaaacacaauacug

SEQ ID NO: 19981 - RNA, 20 nt, Artificial Sequence
  TRAC targeting sequence
ugaaacacaauacuguuggc

SEQ ID NO: 19982 - RNA, 20 nt, Artificial Sequence
  TRAC targeting sequence
agacaggaaacaccgacuag

SEQ ID NO: 19983 - RNA, 20 nt, Artificial Sequence
  TRAC targeting sequence
agggccaacaguauuguguu

SEQ ID NO: 19984 - RNA, 20 nt, Artificial Sequence
  TRAC targeting sequence
uccagggccaacaguauugu

SEQ ID NO: 19985 - RNA, 20 nt, Artificial Sequence
  TRAC targeting sequence
gugcauucuuccagggccaa

SEQ ID NO: 19986 - RNA, 20 nt, Artificial Sequence
  TRAC targeting sequence
guuuguaaggggauaugcac

SEQ ID NO: 19987 - RNA, 20 nt, Artificial Sequence
  TRAC targeting sequence
ccuuacaaacagauucugug

SEQ ID NO: 19988 - RNA, 20 nt, Artificial Sequence
  TRAC targeting sequence
gugcauauccccuuacaaac

SEQ ID NO: 19989 - RNA, 20 nt, Artificial Sequence
  TRAC targeting sequence
cuugcagcuucugugcauau

SEQ ID NO: 19990 - RNA, 20 nt, Artificial Sequence
  TRAC targeting sequence
ugucccuugcagcuucugug

SEQ ID NO: 19991 - RNA, 20 nt, Artificial Sequence
  TRAC targeting sequence
ugcaccuccugucccuugca

SEQ ID NO: 19992 - RNA, 20 nt, Artificial Sequence
  TRAC targeting sequence
cccacccagccugcucugcc

SEQ ID NO: 19993 - RNA, 20 nt, Artificial Sequence
  TRAC targeting sequence
gccuuggggaaaaccguggg

SEQ ID NO: 19994 - RNA, 20 nt, Artificial Sequence
  TRAC targeting sequence
ccaaggcagagcaggcuggg

SEQ ID NO: 19995 - RNA, 20 nt, Artificial Sequence
  TRAC targeting sequence
ugcaggccaugcaggccugg

SEQ ID NO: 19996 - RNA, 20 nt, Artificial Sequence
  TRAC targeting sequence
caggccugcauggccugcag

SEQ ID NO: 19997 - RNA, 20 nt, Artificial Sequence
  TRAC targeting sequence
ugguuuuacagauacgaacc

SEQ ID NO: 19998 - RNA, 20 nt, Artificial Sequence
  TRAC targeting sequence
guaaaaccaagaggccacag

SEQ ID NO: 19999 - RNA, 20 nt, Artificial Sequence
  TRAC targeting sequence
uaucuguaaaaccaagaggc

SEQ ID NO: 20000 - RNA, 20 nt, Artificial Sequence
  TRAC targeting sequence
aaaccugucagugauugggu

SEQ ID NO: 20001 - RNA, 20 nt, Artificial Sequence
  TRAC targeting sequence
gugauuggguuccgaauccu

SEQ ID NO: 20002 - RNA, 20 nt, Artificial Sequence
  TRAC targeting sequence
cugacagguuuugaaaguuu

SEQ ID NO: 20003 - RNA, 20 nt, Artificial Sequence
  TRAC targeting sequence
gaauccuccuccugaaagug

SEQ ID NO: 20004 - RNA, 20 nt, Artificial Sequence
  TRAC targeting sequence
gaacccaaucacugacaggu

SEQ ID NO: 20005 - RNA, 20 nt, Artificial Sequence
  TRAC targeting sequence
uccuccugaaaguggccggg

SEQ ID NO: 20006 - RNA, 20 nt, Artificial Sequence
  TRAC targeting sequence
uccugaaaguggccggguuu

SEQ ID NO: 20007 - RNA, 20 nt, Artificial Sequence
  TRAC targeting sequence
ugaaaguggccggguuuaau

SEQ ID NO: 20008 - RNA, 20 nt, Artificial Sequence
  TRAC targeting sequence
ggaggaggauucggaaccca

SEQ ID NO: 20009 - RNA, 20 nt, Artificial Sequence
  TRAC targeting sequence
gcucaugacgcugcggcugu

SEQ ID NO: 20010 - RNA, 20 nt, Artificial Sequence
  TRAC targeting sequence
ugacgcugcggcuguggucc

SEQ ID NO: 20011 - RNA, 20 nt, Artificial Sequence
  TRAC targeting sequence
ugagcagauuaaacccggcc

SEQ ID NO: 20012 - RNA, 20 nt, Artificial Sequence
  TRAC targeting sequence
agcugaggugaggggccuug

SEQ ID NO: 20013 - RNA, 20 nt, Artificial Sequence
  TRAC targeting sequence
gcuggaccacagccgcagcg

SEQ ID NO: 20014 - RNA, 20 nt, Artificial Sequence
  TRAC targeting sequence
ccucagcuggaccacagccg

SEQ ID NO: 20015 - RNA, 20 nt, Artificial Sequence
  TRAC targeting sequence
aggccccucaccucagcugg

SEQ ID NO: 20016 - RNA, 20 nt, Artificial Sequence
  TRAC targeting sequence
cagcuucaaggccccucacc

SEQ ID NO: 20017 - RNA, 20 nt, Artificial Sequence
  TRAC targeting sequence
cuaaaccccacucccagcuu

SEQ ID NO: 20018 - RNA, 20 nt, Artificial Sequence
  TRAC targeting sequence
cugggugcauccuaagcucu

SEQ ID NO: 20019 - RNA, 20 nt, Artificial Sequence
  TRAC targeting sequence
gggugcauccuaagcucuga

SEQ ID NO: 20020 - RNA, 20 nt, Artificial Sequence
  TRAC targeting sequence
uaagcucugagagcaaaccu

SEQ ID NO: 20021 - RNA, 20 nt, Artificial Sequence
  TRAC targeting sequence
gagagcaaaccucccugcag

SEQ ID NO: 20022 - RNA, 20 nt, Artificial Sequence
  TRAC targeting sequence
gagcuuaggaugcacccaga

SEQ ID NO: 20023 - RNA, 20 nt, Artificial Sequence
  TRAC targeting sequence
cagagcuuaggaugcaccca

SEQ ID NO: 20024 - RNA, 20 nt, Artificial Sequence
  TRAC targeting sequence
cugcagggucuugcuuuuaa

SEQ ID NO: 20025 - RNA, 20 nt, Artificial Sequence
  TRAC targeting sequence
ugcuuuuaaguccaaagccu

SEQ ID NO: 20026 - RNA, 20 nt, Artificial Sequence
  TRAC targeting sequence
aaagccugagcccaccaaac

SEQ ID NO: 20027 - RNA, 20 nt, Artificial Sequence
  TRAC targeting sequence
ggcuuuggacuuaaaagcaa

SEQ ID NO: 20028 - RNA, 20 nt, Artificial Sequence
  TRAC targeting sequence
ccuacuucuuccuguuacaa

SEQ ID NO: 20029 - RNA, 20 nt, Artificial Sequence
  TRAC targeting sequence
uacuucuuccuguuacaaau

SEQ ID NO: 20030 - RNA, 20 nt, Artificial Sequence
  TRAC targeting sequence
uccuguuacaaauuccucuu

SEQ ID NO: 20031 - RNA, 20 nt, Artificial Sequence
  TRAC targeting sequence
uguuacaaauuccucuugug

SEQ ID NO: 20032 - RNA, 20 nt, Artificial Sequence
  TRAC targeting sequence
ucuugugcaauaauaauggc

SEQ ID NO: 20033 - RNA, 20 nt, Artificial Sequence
  TRAC targeting sequence
ugugcaauaauaauggccug

SEQ ID NO: 20034 - RNA, 20 nt, Artificial Sequence
  TRAC targeting sequence
ggccauuauuauugcacaag

SEQ ID NO: 20035 - RNA, 20 nt, Artificial Sequence
  TRAC targeting sequence
ucauuucagccgccucaguu

SEQ ID NO: 20036 - RNA, 20 nt, Artificial Sequence
  TRAC targeting sequence
uuucagccgccucaguugca

SEQ ID NO: 20037 - RNA, 20 nt, Artificial Sequence
  TRAC targeting sequence
gccgccucaguugcacuucu

SEQ ID NO: 20038 - RNA, 20 nt, Artificial Sequence
  TRAC targeting sequence
guugcacuucuccccuauga

SEQ ID NO: 20039 - RNA, 20 nt, Artificial Sequence
  TRAC targeting sequence
ccccuaugagguaggaagaa

SEQ ID NO: 20040 - RNA, 20 nt, Artificial Sequence
  TRAC targeting sequence
ccuaugagguaggaagaaca

SEQ ID NO: 20041 - RNA, 20 nt, Artificial Sequence
  TRAC targeting sequence
uaggggagaagugcaacuga

SEQ ID NO: 20042 - RNA, 20 nt, Artificial Sequence
  TRAC targeting sequence
uaccucauaggggagaagug

SEQ ID NO: 20043 - RNA, 20 nt, Artificial Sequence
  TRAC targeting sequence
uccuaccucauaggggagaa

SEQ ID NO: 20044 - RNA, 20 nt, Artificial Sequence
  TRAC targeting sequence
aaacaacuguucuuccuacc

SEQ ID NO: 20045 - RNA, 20 nt, Artificial Sequence
  TRAC targeting sequence
uuucuaaacaacuguucuuc

SEQ ID NO: 20046 - RNA, 20 nt, Artificial Sequence
  TRAC targeting sequence
ucguuucuaaacaacuguuc

SEQ ID NO: 20047 - RNA, 20 nt, Artificial Sequence
  TRAC targeting sequence
guuucuucguuucuaaacaa

SEQ ID NO: 20048 - RNA, 20 nt, Artificial Sequence
  TRAC targeting sequence
uuagcuguggggccucaguu

SEQ ID NO: 20049 - RNA, 20 nt, Artificial Sequence
  TRAC targeting sequence
acucauuagcuguggggccu

SEQ ID NO: 20050 - RNA, 20 nt, Artificial Sequence
  TRAC targeting sequence
uccacucauuagcugugggg

SEQ ID NO: 20051 - RNA, 20 nt, Artificial Sequence
  TRAC targeting sequence
uccuccacucauuagcugug

SEQ ID NO: 20052 - RNA, 20 nt, Artificial Sequence
  TRAC targeting sequence
cuuccuccacucauuagcug

SEQ ID NO: 20053 - RNA, 20 nt, Artificial Sequence
  TRAC targeting sequence
cucuuccuccacucauuagc

SEQ ID NO: 20054 - RNA, 20 nt, Artificial Sequence
  TRAC targeting sequence
cucaccguguaaccuccuca

SEQ ID NO: 20055 - RNA, 20 nt, Artificial Sequence
  TRAC targeting sequence
caccguguaaccuccucaug

SEQ ID NO: 20056 - RNA, 20 nt, Artificial Sequence
  TRAC targeting sequence
ccguguaaccuccucauguc

SEQ ID NO: 20057 - RNA, 20 nt, Artificial Sequence
  TRAC targeting sequence
ucauguccucucuccccagu

SEQ ID NO: 20058 - RNA, 20 nt, Artificial Sequence
  TRAC targeting sequence
uguccucucuccccaguacg

SEQ ID NO: 20059 - RNA, 20 nt, Artificial Sequence
  TRAC targeting sequence
ucucuccccaguacggcucu

SEQ ID NO: 20060 - RNA, 20 nt, Artificial Sequence
  TRAC targeting sequence
cuccccaguacggcucucuu

SEQ ID NO: 20061 - RNA, 20 nt, Artificial Sequence
  TRAC targeting sequence
ccccaguacggcucucuuag

SEQ ID NO: 20062 - RNA, 20 nt, Artificial Sequence
  TRAC targeting sequence
ccaguacggcucucuuagcu

SEQ ID NO: 20063 - RNA, 20 nt, Artificial Sequence
  TRAC targeting sequence
cuuagcucaguagaaagaag

SEQ ID NO: 20064 - RNA, 20 nt, Artificial Sequence
  TRAC targeting sequence
uagcucaguagaaagaagac

SEQ ID NO: 20065 - RNA, 20 nt, Artificial Sequence
  TRAC targeting sequence
guagaaagaagacauuacac

SEQ ID NO: 20066 - RNA, 20 nt, Artificial Sequence
  TRAC targeting sequence
acugagcuaagagagccgua

SEQ ID NO: 20067 - RNA, 20 nt, Artificial Sequence
  TRAC targeting sequence
uucuacugagcuaagagagc

SEQ ID NO: 20068 - RNA, 20 nt, Artificial Sequence
  TRAC targeting sequence
ucuuucuacugagcuaagag

SEQ ID NO: 20069 - RNA, 20 nt, Artificial Sequence
  TRAC targeting sequence
uauuacaccccaauccuggc

SEQ ID NO: 20070 - RNA, 20 nt, Artificial Sequence
  TRAC targeting sequence
uggcuagagucuccgcaccc

SEQ ID NO: 20071 - RNA, 20 nt, Artificial Sequence
  TRAC targeting sequence
agccaggauugggguguaau

SEQ ID NO: 20072 - RNA, 20 nt, Artificial Sequence
  TRAC targeting sequence
ccgcacccuccucccccagg

SEQ ID NO: 20073 - RNA, 20 nt, Artificial Sequence
  TRAC targeting sequence
gcacccuccucccccagggu

SEQ ID NO: 20074 - RNA, 20 nt, Artificial Sequence
  TRAC targeting sequence
ucccccaggguccccagucg

SEQ ID NO: 20075 - RNA, 20 nt, Artificial Sequence
  TRAC targeting sequence
cccaggguccccagucgucu

SEQ ID NO: 20076 - RNA, 20 nt, Artificial Sequence
  TRAC targeting sequence
ccagucgucuugcugacaac

SEQ ID NO: 20077 - RNA, 20 nt, Artificial Sequence
  TRAC targeting sequence
ucuugcugacaacugcaucc

SEQ ID NO: 20078 - RNA, 20 nt, Artificial Sequence
  TRAC targeting sequence
ugcugacaacugcauccugu

SEQ ID NO: 20079 - RNA, 20 nt, Artificial Sequence
  TRAC targeting sequence
gcaagacgacuggggacccu

SEQ ID NO: 20080 - RNA, 20 nt, Artificial Sequence
  TRAC targeting sequence
uguuccaucaccaucaaaaa

SEQ ID NO: 20081 - RNA, 20 nt, Artificial Sequence
  TRAC targeting sequence
aucaccaucaaaaaaaaacu

SEQ ID NO: 20082 - RNA, 20 nt, Artificial Sequence
  TRAC targeting sequence
ccaucaaaaaaaaacuccag

SEQ ID NO: 20083 - RNA, 20 nt, Artificial Sequence
  TRAC targeting sequence
aaaaaaaacuccaggcuggg

SEQ ID NO: 20084 - RNA, 20 nt, Artificial Sequence
  TRAC targeting sequence
aggcugggugcgggggcuca

SEQ ID NO: 20085 - RNA, 20 nt, Artificial Sequence
  TRAC targeting sequence
caccuguaaucccagcacuu

SEQ ID NO: 20086 - RNA, 20 nt, Artificial Sequence
  TRAC targeting sequence
cagcacuuugggaggcagag

SEQ ID NO: 20087 - RNA, 20 nt, Artificial Sequence
  TRAC targeting sequence
caaagugcugggauuacagg

SEQ ID NO: 20088 - RNA, 20 nt, Artificial Sequence
  TRAC targeting sequence
gccucccaaagugcugggau

SEQ ID NO: 20089 - RNA, 20 nt, Artificial Sequence
  TRAC targeting sequence
ugccucugccucccaaagug

SEQ ID NO: 20090 - RNA, 20 nt, Artificial Sequence
  TRAC targeting sequence
uccugccucugccucccaaa

SEQ ID NO: 20091 - RNA, 20 nt, Artificial Sequence
  TRAC targeting sequence
ugugcuccuccugccucugc

SEQ ID NO: 20092 - RNA, 20 nt, Artificial Sequence
  TRAC targeting sequence
agcuccugugcuccuccugc

SEQ ID NO: 20093 - RNA, 20 nt, Artificial Sequence
  TRAC targeting sequence
ccagcuccugugcuccuccu

SEQ ID NO: 20094 - RNA, 20 nt, Artificial Sequence
  TRAC targeting sequence
cuguguugcccaggcugguc

SEQ ID NO: 20095 - RNA, 20 nt, Artificial Sequence
  TRAC targeting sequence
cccuguguugcccaggcugg

SEQ ID NO: 20096 - RNA, 20 nt, Artificial Sequence
  TRAC targeting sequence
acaaaaagugaaaaaauuaa

SEQ ID NO: 20097 - RNA, 20 nt, Artificial Sequence
  TRAC targeting sequence
cuuuuuguagaggcgggguc

SEQ ID NO: 20098 - RNA, 20 nt, Artificial Sequence
  TRAC targeting sequence
cagcuacuuaagaggcugag

SEQ ID NO: 20099 - RNA, 20 nt, Artificial Sequence
  TRAC targeting sequence
uaaguagcugggacuacagg

SEQ ID NO: 20100 - RNA, 20 nt, Artificial Sequence
  TRAC targeting sequence
gccucuuaaguagcugggac

SEQ ID NO: 20101 - RNA, 20 nt, Artificial Sequence
  TRAC targeting sequence
cagccucuuaaguagcuggg

SEQ ID NO: 20102 - RNA, 20 nt, Artificial Sequence
  TRAC targeting sequence
caucucagccucuuaaguag

SEQ ID NO: 20103 - RNA, 20 nt, Artificial Sequence
  TRAC targeting sequence
ucccaucucagccucuuaag

SEQ ID NO: 20104 - RNA, 20 nt, Artificial Sequence
  TRAC targeting sequence
cuugagcccuggaauguuga

SEQ ID NO: 20105 - RNA, 20 nt, Artificial Sequence
  TRAC targeting sequence
agcgauccucccaucucagc

SEQ ID NO: 20106 - RNA, 20 nt, Artificial Sequence
  TRAC targeting sequence
agggcucaagcgauccuccc

SEQ ID NO: 20107 - RNA, 20 nt, Artificial Sequence
  TRAC targeting sequence
acauuccagggcucaagcga

SEQ ID NO: 20108 - RNA, 20 nt, Artificial Sequence
  TRAC targeting sequence
uuguagccucaacauuccag

SEQ ID NO: 20109 - RNA, 20 nt, Artificial Sequence
  TRAC targeting sequence
cagcucauuguagccucaac

SEQ ID NO: 20110 - RNA, 20 nt, Artificial Sequence
  TRAC targeting sequence
cugcacuccagccuggaaga

SEQ ID NO: 20111 - RNA, 20 nt, Artificial Sequence
  TRAC targeting sequence
agccuggaagacaaagcaag

SEQ ID NO: 20112 - RNA, 20 nt, Artificial Sequence
  TRAC targeting sequence
aggcuggagugcagugacgc

SEQ ID NO: 20113 - RNA, 20 nt, Artificial Sequence
  TRAC targeting sequence
uccaggcuggagugcaguga

SEQ ID NO: 20114 - RNA, 20 nt, Artificial Sequence
  TRAC targeting sequence
ugcuuugucuuccaggcugg

SEQ ID NO: 20115 - RNA, 20 nt, Artificial Sequence
  TRAC targeting sequence
ugucucaaauaauaaaaaaa

SEQ ID NO: 20116 - RNA, 20 nt, Artificial Sequence
  TRAC targeting sequence
caaauaauaaaaaaaauaag

SEQ ID NO: 20117 - RNA, 20 nt, Artificial Sequence
  TRAC targeting sequence
aauaauaaaaaaaauaagaa

SEQ ID NO: 20118 - RNA, 20 nt, Artificial Sequence
  TRAC targeting sequence
uauuuuuuuuauuauuugag

SEQ ID NO: 20119 - RNA, 20 nt, Artificial Sequence
  TRAC targeting sequence
aggguacauuugcuccuaga

SEQ ID NO: 20120 - RNA, 20 nt, Artificial Sequence
  TRAC targeting sequence
uagaacucuaccacauagcc

SEQ ID NO: 20121 - RNA, 20 nt, Artificial Sequence
  TRAC targeting sequence
aggagcaaauguacccugga

SEQ ID NO: 20122 - RNA, 20 nt, Artificial Sequence
  TRAC targeting sequence
accacauagccccaaacaga

SEQ ID NO: 20123 - RNA, 20 nt, Artificial Sequence
  TRAC targeting sequence
guuuggggcuaugugguaga

SEQ ID NO: 20124 - RNA, 20 nt, Artificial Sequence
  TRAC targeting sequence
ccaucacaucccuaacaguc

SEQ ID NO: 20125 - RNA, 20 nt, Artificial Sequence
  TRAC targeting sequence
caucccuaacaguccugggu

SEQ ID NO: 20126 - RNA, 20 nt, Artificial Sequence
  TRAC targeting sequence
cuaacaguccugggucuucc

SEQ ID NO: 20127 - RNA, 20 nt, Artificial Sequence
  TRAC targeting sequence
ugggucuuccucagugucca

SEQ ID NO: 20128 - RNA, 20 nt, Artificial Sequence
  TRAC targeting sequence
uccucaguguccagccugac

SEQ ID NO: 20129 - RNA, 20 nt, Artificial Sequence
  TRAC targeting sequence
ucaguguccagccugacuuc

SEQ ID NO: 20130 - RNA, 20 nt, Artificial Sequence
  TRAC targeting sequence
guguccagccugacuucugu

SEQ ID NO: 20131 - RNA, 20 nt, Artificial Sequence
  TRAC targeting sequence
agccugacuucuguucuucc

SEQ ID NO: 20132 - RNA, 20 nt, Artificial Sequence
  TRAC targeting sequence
ggcuggacacugaggaagac

SEQ ID NO: 20133 - RNA, 20 nt, Artificial Sequence
  TRAC targeting sequence
guucuuccucauuccagauc

SEQ ID NO: 20134 - RNA, 20 nt, Artificial Sequence
  TRAC targeting sequence
uccucauuccagaucugcaa

SEQ ID NO: 20135 - RNA, 20 nt, Artificial Sequence
  TRAC targeting sequence
ucauuccagaucugcaagau

SEQ ID NO: 20136 - RNA, 20 nt, Artificial Sequence
  TRAC targeting sequence
uuccagaucugcaagauugu

SEQ ID NO: 20137 - RNA, 20 nt, Artificial Sequence
  TRAC targeting sequence
agaucugcaagauuguaaga

SEQ ID NO: 20138 - RNA, 20 nt, Artificial Sequence
  TRAC targeting sequence
ggaaugaggaagaacagaag

SEQ ID NO: 20139 - RNA, 20 nt, Artificial Sequence
  TRAC targeting sequence
gcaagauuguaagacagccu

SEQ ID NO: 20140 - RNA, 20 nt, Artificial Sequence
  TRAC targeting sequence
ugcagaucuggaaugaggaa

SEQ ID NO: 20141 - RNA, 20 nt, Artificial Sequence
  TRAC targeting sequence
uacaaucuugcagaucugga

SEQ ID NO: 20142 - RNA, 20 nt, Artificial Sequence
  TRAC targeting sequence
cucgcuccuuccucugcauu

SEQ ID NO: 20143 - RNA, 20 nt, Artificial Sequence
  TRAC targeting sequence
cuccuuccucugcauugccc

SEQ ID NO: 20144 - RNA, 20 nt, Artificial Sequence
  TRAC targeting sequence
uuccucugcauugccccucu

SEQ ID NO: 20145 - RNA, 20 nt, Artificial Sequence
  TRAC targeting sequence
ucugcauugccccucuucuc

SEQ ID NO: 20146 - RNA, 20 nt, Artificial Sequence
  TRAC targeting sequence
gcauugccccucuucucccu

SEQ ID NO: 20147 - RNA, 20 nt, Artificial Sequence
  TRAC targeting sequence
ucucccucuccaaacagagg

SEQ ID NO: 20148 - RNA, 20 nt, Artificial Sequence
  TRAC targeting sequence
cccucuccaaacagagggaa

SEQ ID NO: 20149 - RNA, 20 nt, Artificial Sequence
  TRAC targeting sequence
cucuccaaacagagggaacu

SEQ ID NO: 20150 - RNA, 20 nt, Artificial Sequence
  TRAC targeting sequence
ccaaacagagggaacucucc

SEQ ID NO: 20151 - RNA, 20 nt, Artificial Sequence
  TRAC targeting sequence
aaacagagggaacucuccua

SEQ ID NO: 20152 - RNA, 20 nt, Artificial Sequence
  TRAC targeting sequence
guuuggagagggagaagagg

SEQ ID NO: 20153 - RNA, 20 nt, Artificial Sequence
  TRAC targeting sequence
cucuguuuggagagggagaa

SEQ ID NO: 20154 - RNA, 20 nt, Artificial Sequence
  TRAC targeting sequence
ccuacccccaaggaggugaa

SEQ ID NO: 20155 - RNA, 20 nt, Artificial Sequence
  TRAC targeting sequence
uacccccaaggaggugaaag

SEQ ID NO: 20156 - RNA, 20 nt, Artificial Sequence
  TRAC targeting sequence
uuggggguaggagaguuccc

SEQ ID NO: 20157 - RNA, 20 nt, Artificial Sequence
  TRAC targeting sequence
ccuccuuggggguaggagag

SEQ ID NO: 20158 - RNA, 20 nt, Artificial Sequence
  TRAC targeting sequence
gugcccccccggcaaugcca

SEQ ID NO: 20159 - RNA, 20 nt, Artificial Sequence
  TRAC targeting sequence
aguugguggcauugccgggg

SEQ ID NO: 20160 - RNA, 20 nt, Artificial Sequence
  TRAC targeting sequence
uacccgaauuuaugauuaag

SEQ ID NO: 20161 - RNA, 20 nt, Artificial Sequence
  TRAC targeting sequence
gguaggauccaguugguggc

SEQ ID NO: 20162 - RNA, 20 nt, Artificial Sequence
  TRAC targeting sequence
uaaauucggguaggauccag

SEQ ID NO: 20163 - RNA, 20 nt, Artificial Sequence
  TRAC targeting sequence
uaaucauaaauucggguagg

SEQ ID NO: 20164 - RNA, 20 nt, Artificial Sequence
  TRAC targeting sequence
gcaaucuuaaucauaaauuc

SEQ ID NO: 20165 - RNA, 20 nt, Artificial Sequence
  TRAC targeting sequence
ucagcaaucuuaaucauaaa

SEQ ID NO: 20166 - RNA, 20 nt, Artificial Sequence
  TRAC targeting sequence
guucccuuauugcugcuugu

SEQ ID NO: 20167 - RNA, 20 nt, Artificial Sequence
  TRAC targeting sequence
cuuauugcugcuugucacug

SEQ ID NO: 20168 - RNA, 20 nt, Artificial Sequence
  TRAC targeting sequence
cugccugacauucacggcag

SEQ ID NO: 20169 - RNA, 20 nt, Artificial Sequence
  TRAC targeting sequence
ggcagugacaagcagcaaua

SEQ ID NO: 20170 - RNA, 20 nt, Artificial Sequence
  TRAC targeting sequence
cggcagaggcaaggcugcug

SEQ ID NO: 20171 - RNA, 20 nt, Artificial Sequence
  TRAC targeting sequence
gccgugaaugucaggcagug

SEQ ID NO: 20172 - RNA, 20 nt, Artificial Sequence
  TRAC targeting sequence
ccuggcugugcacauucccu

SEQ ID NO: 20173 - RNA, 20 nt, Artificial Sequence
  TRAC targeting sequence
cuccugcuccccagagacug

SEQ ID NO: 20174 - RNA, 20 nt, Artificial Sequence
  TRAC targeting sequence
ugcuccccagagacugccuc

SEQ ID NO: 20175 - RNA, 20 nt, Artificial Sequence
  TRAC targeting sequence
ccagagacugccuccgccau

SEQ ID NO: 20176 - RNA, 20 nt, Artificial Sequence
  TRAC targeting sequence
ggggagcaggagggaaugug

SEQ ID NO: 20177 - RNA, 20 nt, Artificial Sequence
  TRAC targeting sequence
cuggggagcaggagggaaug

SEQ ID NO: 20178 - RNA, 20 nt, Artificial Sequence
  TRAC targeting sequence
gccaucccacagaugaugga

SEQ ID NO: 20179 - RNA, 20 nt, Artificial Sequence
  TRAC targeting sequence
cacagaugauggaucuucag

SEQ ID NO: 20180 - RNA, 20 nt, Artificial Sequence
  TRAC targeting sequence
gugggauggcggaggcaguc

SEQ ID NO: 20181 - RNA, 20 nt, Artificial Sequence
  TRAC targeting sequence
ucugugggauggcggaggca

SEQ ID NO: 20182 - RNA, 20 nt, Artificial Sequence
  TRAC targeting sequence
aucaucugugggauggcgga

SEQ ID NO: 20183 - RNA, 20 nt, Artificial Sequence
  TRAC targeting sequence
ucaguggguucucuugggcu

SEQ ID NO: 20184 - RNA, 20 nt, Artificial Sequence
  TRAC targeting sequence
guggguucucuugggcucua

SEQ ID NO: 20185 - RNA, 20 nt, Artificial Sequence
  TRAC targeting sequence
cuugggcucuagguccugca

SEQ ID NO: 20186 - RNA, 20 nt, Artificial Sequence
  TRAC targeting sequence
ugggcucuagguccugcaga

SEQ ID NO: 20187 - RNA, 20 nt, Artificial Sequence
  TRAC targeting sequence
agguccugcagaauguugug

SEQ ID NO: 20188 - RNA, 20 nt, Artificial Sequence
  TRAC targeting sequence
ugcagaauguugugaggggu

SEQ ID NO: 20189 - RNA, 20 nt, Artificial Sequence
  TRAC targeting sequence
gcaggaccuagagcccaaga

SEQ ID NO: 20190 - RNA, 20 nt, Artificial Sequence
  TRAC targeting sequence
caacauucugcaggaccuag

SEQ ID NO: 20191 - RNA, 20 nt, Artificial Sequence
  TRAC targeting sequence
uaaagaaauacauaguauuc

SEQ ID NO: 20192 - RNA, 20 nt, Artificial Sequence
  TRAC targeting sequence
uuaugaacacuauuaaaaaa

SEQ ID NO: 20193 - RNA, 20 nt, Artificial Sequence
  TRAC targeting sequence
ucuucucaagacgugggggg

SEQ ID NO: 20194 - RNA, 20 nt, Artificial Sequence
  TRAC targeting sequence
ucucaagacguggggggaaa

SEQ ID NO: 20195 - RNA, 20 nt, Artificial Sequence
  TRAC targeting sequence
caagacguggggggaaauua

SEQ ID NO: 20196 - RNA, 20 nt, Artificial Sequence
  TRAC targeting sequence
agacguggggggaaauuauc

SEQ ID NO: 20197 - RNA, 20 nt, Artificial Sequence
  TRAC targeting sequence
ugagaagaagaauacuaugu

SEQ ID NO: 20198 - RNA, 20 nt, Artificial Sequence
  TRAC targeting sequence
ccccacgucuugagaagaag

SEQ ID NO: 20199 - RNA, 20 nt, Artificial Sequence
  TRAC targeting sequence
cauuaucgaggcccugcuau

SEQ ID NO: 20200 - RNA, 20 nt, Artificial Sequence
  TRAC targeting sequence
uuaucgaggcccugcuaugc

SEQ ID NO: 20201 - RNA, 20 nt, Artificial Sequence
  TRAC targeting sequence
aggcccugcuaugcugugua

SEQ ID NO: 20202 - RNA, 20 nt, Artificial Sequence
  TRAC targeting sequence
auaaugagauaauuuccccc

SEQ ID NO: 20203 - RNA, 20 nt, Artificial Sequence
  TRAC targeting sequence
gggcguguuguauguccugc

SEQ ID NO: 20204 - RNA, 20 nt, Artificial Sequence
  TRAC targeting sequence
ugcugccgaugccuucauua

SEQ ID NO: 20205 - RNA, 20 nt, Artificial Sequence
  TRAC targeting sequence
gcagcaggacauacaacacg

SEQ ID NO: 20206 - RNA, 20 nt, Artificial Sequence
  TRAC targeting sequence
uuaaaaugauuuggaagagc

SEQ ID NO: 20207 - RNA, 20 nt, Artificial Sequence
  TRAC targeting sequence
uuuuaaugaaggcaucggca

SEQ ID NO: 20208 - RNA, 20 nt, Artificial Sequence
  TRAC targeting sequence
aaaucauuuuaaugaaggca

SEQ ID NO: 20209 - RNA, 20 nt, Artificial Sequence
  TRAC targeting sequence
uccaaaucauuuuaaugaag

SEQ ID NO: 20210 - RNA, 20 nt, Artificial Sequence
  TRAC targeting sequence
gcucuuccaaaucauuuuaa

SEQ ID NO: 20211 - RNA, 20 nt, Artificial Sequence
  TRAC targeting sequence
cugcucuuccaaaucauuuu

SEQ ID NO: 20212 - RNA, 20 nt, Artificial Sequence
  TRAC targeting sequence
guuugacuggguuugguagg

SEQ ID NO: 20213 - RNA, 20 nt, Artificial Sequence
  TRAC targeting sequence
aacagaggcacagucucugc

SEQ ID NO: 20214 - RNA, 20 nt, Artificial Sequence
  TRAC targeting sequence
uaccaaacccagucaaacag

SEQ ID NO: 20215 - RNA, 20 nt, Artificial Sequence
  TRAC targeting sequence
uuuucugcuugcuggugauc

SEQ ID NO: 20216 - RNA, 20 nt, Artificial Sequence
  TRAC targeting sequence
gcuugcuggugaucacuagc

SEQ ID NO: 20217 - RNA, 20 nt, Artificial Sequence
  TRAC targeting sequence
ccagcaagcagaaaaugacu

SEQ ID NO: 20218 - RNA, 20 nt, Artificial Sequence
  TRAC targeting sequence
cuagcugggcagagaaaaac

SEQ ID NO: 20219 - RNA, 20 nt, Artificial Sequence
  TRAC targeting sequence
gcccagcuagugaucaccag

SEQ ID NO: 20220 - RNA, 20 nt, Artificial Sequence
  TRAC targeting sequence
cugcccagcuagugaucacc

SEQ ID NO: 20221 - RNA, 20 nt, Artificial Sequence
  TRAC targeting sequence
augaugcuguccaggaagcc

SEQ ID NO: 20222 - RNA, 20 nt, Artificial Sequence
  TRAC targeting sequence
uagacaaaugccuugguuuu

SEQ ID NO: 20223 - RNA, 20 nt, Artificial Sequence
  TRAC targeting sequence
aggaagccucauucaacaag

SEQ ID NO: 20224 - RNA, 20 nt, Artificial Sequence
  TRAC targeting sequence
uggacagcaucauagacaaa

SEQ ID NO: 20225 - RNA, 20 nt, Artificial Sequence
  TRAC targeting sequence
uucaacaagcugccuaaguc

SEQ ID NO: 20226 - RNA, 20 nt, Artificial Sequence
  TRAC targeting sequence
acaagcugccuaagucaacc

SEQ ID NO: 20227 - RNA, 20 nt, Artificial Sequence
  TRAC targeting sequence
accucuucuuggaauaaccu

SEQ ID NO: 20228 - RNA, 20 nt, Artificial Sequence
  TRAC targeting sequence
ucuuggaauaaccucuaaaa

SEQ ID NO: 20229 - RNA, 20 nt, Artificial Sequence
  TRAC targeting sequence
uggaauaaccucuaaaagcu

SEQ ID NO: 20230 - RNA, 20 nt, Artificial Sequence
  TRAC targeting sequence
aagaagagguugacuuaggc

SEQ ID NO: 20231 - RNA, 20 nt, Artificial Sequence
  TRAC targeting sequence
aaaagcuuccgcuuagcagg

SEQ ID NO: 20232 - RNA, 20 nt, Artificial Sequence
  TRAC targeting sequence
gcuuagcaggcuaugcugag

SEQ ID NO: 20233 - RNA, 20 nt, Artificial Sequence
  TRAC targeting sequence
gcauagccugcuaagcggaa

SEQ ID NO: 20234 - RNA, 20 nt, Artificial Sequence
  TRAC targeting sequence
uggcccucagcauagccugc

SEQ ID NO: 20235 - RNA, 20 nt, Artificial Sequence
  TRAC targeting sequence
aagcugguagguggguuuuc

SEQ ID NO: 20236 - RNA, 20 nt, Artificial Sequence
  TRAC targeting sequence
ucucccacucucaugccacg

SEQ ID NO: 20237 - RNA, 20 nt, Artificial Sequence
  TRAC targeting sequence
cccacucucaugccacgcca

SEQ ID NO: 20238 - RNA, 20 nt, Artificial Sequence
  TRAC targeting sequence
cacucucaugccacgccacg

SEQ ID NO: 20239 - RNA, 20 nt, Artificial Sequence
  TRAC targeting sequence
caugccacgccacgggacca

SEQ ID NO: 20240 - RNA, 20 nt, Artificial Sequence
  TRAC targeting sequence
ugccacgccacgggaccacc

SEQ ID NO: 20241 - RNA, 20 nt, Artificial Sequence
  TRAC targeting sequence
cguggcguggcaugagagug

SEQ ID NO: 20242 - RNA, 20 nt, Artificial Sequence
  TRAC targeting sequence
uguuauggguggucccgugg

SEQ ID NO: 20243 - RNA, 20 nt, Artificial Sequence
  TRAC targeting sequence
cugccacccauguguguggg

SEQ ID NO: 20244 - RNA, 20 nt, Artificial Sequence
  TRAC targeting sequence
gccgcaggucacugccaccc

SEQ ID NO: 20245 - RNA, 20 nt, Artificial Sequence
  TRAC targeting sequence
cugucugccgcaggucacug

SEQ ID NO: 20246 - RNA, 20 nt, Artificial Sequence
  TRAC targeting sequence
ccaaaaugccacccacuguc

SEQ ID NO: 20247 - RNA, 20 nt, Artificial Sequence
  TRAC targeting sequence
ccugcccuccaggagcauuu

SEQ ID NO: 20248 - RNA, 20 nt, Artificial Sequence
  TRAC targeting sequence
ugcccuccaggagcauuucc

SEQ ID NO: 20249 - RNA, 20 nt, Artificial Sequence
  TRAC targeting sequence
aggagcauuuccuuugccuc

SEQ ID NO: 20250 - RNA, 20 nt, Artificial Sequence
  TRAC targeting sequence
uggagggcaggagacagugg

SEQ ID NO: 20251 - RNA, 20 nt, Artificial Sequence
  TRAC targeting sequence
uuugccucuccucucagacu

SEQ ID NO: 20252 - RNA, 20 nt, Artificial Sequence
  TRAC targeting sequence
ccucucagacuggguuucca

SEQ ID NO: 20253 - RNA, 20 nt, Artificial Sequence
  TRAC targeting sequence
ucucagacuggguuuccacu

SEQ ID NO: 20254 - RNA, 20 nt, Artificial Sequence
  TRAC targeting sequence
cagacuggguuuccacugaa

SEQ ID NO: 20255 - RNA, 20 nt, Artificial Sequence
  TRAC targeting sequence
gacuggguuuccacugaaac

SEQ ID NO: 20256 - RNA, 20 nt, Artificial Sequence
  TRAC targeting sequence
gagaggagaggcaaaggaaa

SEQ ID NO: 20257 - RNA, 20 nt, Artificial Sequence
  TRAC targeting sequence
acugaaacugugcauugucu

SEQ ID NO: 20258 - RNA, 20 nt, Artificial Sequence
  TRAC targeting sequence
guggaaacccagucugagag

SEQ ID NO: 20259 - RNA, 20 nt, Artificial Sequence
  TRAC targeting sequence
cacaaauucguggcugggga

SEQ ID NO: 20260 - RNA, 20 nt, Artificial Sequence
  TRAC targeting sequence
caaauucguggcuggggacc

SEQ ID NO: 20261 - RNA, 20 nt, Artificial Sequence
  TRAC targeting sequence
uggcuggggaccacccacca

SEQ ID NO: 20262 - RNA, 20 nt, Artificial Sequence
  TRAC targeting sequence
ccagccacgaauuugugaga

SEQ ID NO: 20263 - RNA, 20 nt, Artificial Sequence
  TRAC targeting sequence
gcugccugauccagccccac

SEQ ID NO: 20264 - RNA, 20 nt, Artificial Sequence
  TRAC targeting sequence
ggcagcagaguggugggugg

SEQ ID NO: 20265 - RNA, 20 nt, Artificial Sequence
  TRAC targeting sequence
agccccacgccagcccuuug

SEQ ID NO: 20266 - RNA, 20 nt, Artificial Sequence
  TRAC targeting sequence
aagggcuggcguggggcugg

SEQ ID NO: 20267 - RNA, 20 nt, Artificial Sequence
  TRAC targeting sequence
gcuugggcaccucaaagggc

SEQ ID NO: 20268 - RNA, 20 nt, Artificial Sequence
  TRAC targeting sequence
uggugucagcuugggcaccu

SEQ ID NO: 20269 - RNA, 20 nt, Artificial Sequence
  TRAC targeting sequence
accuugcuccuggugucagc

SEQ ID NO: 20270 - RNA, 20 nt, Artificial Sequence
  TRAC targeting sequence
caaccuugcuccugguguca

SEQ ID NO: 20271 - RNA, 20 nt, Artificial Sequence
  TRAC targeting sequence
ucucaaccuugcuccuggug

SEQ ID NO: 20272 - RNA, 20 nt, Artificial Sequence
  TRAC targeting sequence
cagcuuccucucaaccuugc

SEQ ID NO: 20273 - RNA, 20 nt, Artificial Sequence
  TRAC targeting sequence
ugcuggggucacagcuuccu

SEQ ID NO: 20274 - RNA, 20 nt, Artificial Sequence
  TRAC targeting sequence
caccaucccggaugugagaa

SEQ ID NO: 20275 - RNA, 20 nt, Artificial Sequence
  TRAC targeting sequence
cggaugugagaaugaggaaa

SEQ ID NO: 20276 - RNA, 20 nt, Artificial Sequence
  TRAC targeting sequence
gggauggugggaacauaaag

SEQ ID NO: 20277 - RNA, 20 nt, Artificial Sequence
  TRAC targeting sequence
cauccgggauggugggaaca

SEQ ID NO: 20278 - RNA, 20 nt, Artificial Sequence
  TRAC targeting sequence
cacauccgggauggugggaa

SEQ ID NO: 20279 - RNA, 20 nt, Artificial Sequence
  TRAC targeting sequence
uucucacauccgggauggug

SEQ ID NO: 20280 - RNA, 20 nt, Artificial Sequence
  TRAC targeting sequence
ucauucucacauccgggaug

SEQ ID NO: 20281 - RNA, 20 nt, Artificial Sequence
  TRAC targeting sequence
uuuuuuccucauucucacau

SEQ ID NO: 20282 - RNA, 20 nt, Artificial Sequence
  TRAC targeting sequence
ccuuuuuuccucauucucac

SEQ ID NO: 20283 - RNA, 20 nt, Artificial Sequence
  TRAC targeting sequence
ucuccuuuuuuccucauucu

SEQ ID NO: 20284 - RNA, 20 nt, Artificial Sequence
  TRAC targeting sequence
ccccacaagcccagagauuu

SEQ ID NO: 20285 - RNA, 20 nt, Artificial Sequence
  TRAC targeting sequence
ccacaagcccagagauuuga

SEQ ID NO: 20286 - RNA, 20 nt, Artificial Sequence
  TRAC targeting sequence
gggcuuguggggagacagcu

SEQ ID NO: 20287 - RNA, 20 nt, Artificial Sequence
  TRAC targeting sequence
cugggcuuguggggagacag

SEQ ID NO: 20288 - RNA, 20 nt, Artificial Sequence
  TRAC targeting sequence
aaucucugggcuugugggga

SEQ ID NO: 20289 - RNA, 20 nt, Artificial Sequence
  TRAC targeting sequence
gucaaaucucugggcuugug

SEQ ID NO: 20290 - RNA, 20 nt, Artificial Sequence
  TRAC targeting sequence
ucggucaaaucucugggcuu

SEQ ID NO: 20291 - RNA, 20 nt, Artificial Sequence
  TRAC targeting sequence
ccucggucaaaucucugggc

SEQ ID NO: 20292 - RNA, 20 nt, Artificial Sequence
  TRAC targeting sequence
acucuccucggucaaaucuc

SEQ ID NO: 20293 - RNA, 20 nt, Artificial Sequence
  TRAC targeting sequence
agcucucaccuaagagaaaa

SEQ ID NO: 20294 - RNA, 20 nt, Artificial Sequence
  TRAC targeting sequence
aggccucuacucuccucggu

SEQ ID NO: 20295 - RNA, 20 nt, Artificial Sequence
  TRAC targeting sequence
caccuaagagaaaagacaug

SEQ ID NO: 20296 - RNA, 20 nt, Artificial Sequence
  TRAC targeting sequence
ccuaagagaaaagacauggg

SEQ ID NO: 20297 - RNA, 20 nt, Artificial Sequence
  TRAC targeting sequence
uaggugagagcucgaggccu

SEQ ID NO: 20298 - RNA, 20 nt, Artificial Sequence
  TRAC targeting sequence
cuuaggugagagcucgaggc

SEQ ID NO: 20299 - RNA, 20 nt, Artificial Sequence
  TRAC targeting sequence
uuucucuuaggugagagcuc

SEQ ID NO: 20300 - RNA, 20 nt, Artificial Sequence
  TRAC targeting sequence
ugggguccacagcucacugc

SEQ ID NO: 20301 - RNA, 20 nt, Artificial Sequence
  TRAC targeting sequence
acagcucacugcgcucuccc

SEQ ID NO: 20302 - RNA, 20 nt, Artificial Sequence
  TRAC targeting sequence
cugcgcucucccuccugaga

SEQ ID NO: 20303 - RNA, 20 nt, Artificial Sequence
  TRAC targeting sequence
cccuccugagacuccugcug

SEQ ID NO: 20304 - RNA, 20 nt, Artificial Sequence
  TRAC targeting sequence
cuccugagacuccugcugcc

SEQ ID NO: 20305 - RNA, 20 nt, Artificial Sequence
  TRAC targeting sequence
ugagacuccugcugccagag

SEQ ID NO: 20306 - RNA, 20 nt, Artificial Sequence
  TRAC targeting sequence
ggagggagagcgcagugagc

SEQ ID NO: 20307 - RNA, 20 nt, Artificial Sequence
  TRAC targeting sequence
caggagggagagcgcaguga

SEQ ID NO: 20308 - RNA, 20 nt, Artificial Sequence
  TRAC targeting sequence
ugcugccagagcaccuuucc

SEQ ID NO: 20309 - RNA, 20 nt, Artificial Sequence
  TRAC targeting sequence
ggcagcaggagucucaggag

SEQ ID NO: 20310 - RNA, 20 nt, Artificial Sequence
  TRAC targeting sequence
ccagggucauggaugcugag

SEQ ID NO: 20311 - RNA, 20 nt, Artificial Sequence
  TRAC targeting sequence
uggaugcugagggaaacaca

SEQ ID NO: 20312 - RNA, 20 nt, Artificial Sequence
  TRAC targeting sequence
augacccuggggaaaggugc

SEQ ID NO: 20313 - RNA, 20 nt, Artificial Sequence
  TRAC targeting sequence
gcauccaugacccuggggaa

SEQ ID NO: 20314 - RNA, 20 nt, Artificial Sequence
  TRAC targeting sequence
cucagcauccaugacccugg

SEQ ID NO: 20315 - RNA, 20 nt, Artificial Sequence
  TRAC targeting sequence
aaguuguguuucccucagca

SEQ ID NO: 20316 - RNA, 20 nt, Artificial Sequence
  TRAC targeting sequence
cuaaguuguguuucccucag

SEQ ID NO: 20317 - RNA, 20 nt, Artificial Sequence
  TRAC targeting sequence
accauccacccagcaagcac

SEQ ID NO: 20318 - RNA, 20 nt, Artificial Sequence
  TRAC targeting sequence
acccagcaagcacagcuacc

SEQ ID NO: 20319 - RNA, 20 nt, Artificial Sequence
  TRAC targeting sequence
ugguagcugugcuugcuggg

SEQ ID NO: 20320 - RNA, 20 nt, Artificial Sequence
  TRAC targeting sequence
gcuuugggucuugguagcug

SEQ ID NO: 20321 - RNA, 20 nt, Artificial Sequence
  TRAC targeting sequence
cacccugggcauugguaagc

SEQ ID NO: 20322 - RNA, 20 nt, Artificial Sequence
  TRAC targeting sequence
aucccugaauaacuccaugg

SEQ ID NO: 20323 - RNA, 20 nt, Artificial Sequence
  TRAC targeting sequence
cugaauaacuccaugguucc

SEQ ID NO: 20324 - RNA, 20 nt, Artificial Sequence
  TRAC targeting sequence
gggauggaacccccucccac

SEQ ID NO: 20325 - RNA, 20 nt, Artificial Sequence
  TRAC targeting sequence
augguuccccuaugcgucug

SEQ ID NO: 20326 - RNA, 20 nt, Artificial Sequence
  TRAC targeting sequence
ccuaugcgucugaccauccc

SEQ ID NO: 20327 - RNA, 20 nt, Artificial Sequence
  TRAC targeting sequence
gaccaucccagccagaaaua

SEQ ID NO: 20328 - RNA, 20 nt, Artificial Sequence
  TRAC targeting sequence
gacgcauaggggaaccaugg

SEQ ID NO: 20329 - RNA, 20 nt, Artificial Sequence
  TRAC targeting sequence
cagccagaaauacauaaauc

SEQ ID NO: 20330 - RNA, 20 nt, Artificial Sequence
  TRAC targeting sequence
ggcugggauggucagacgca

SEQ ID NO: 20331 - RNA, 20 nt, Artificial Sequence
  TRAC targeting sequence
ucucagcuacaauucaggcc

SEQ ID NO: 20332 - RNA, 20 nt, Artificial Sequence
  TRAC targeting sequence
cagcuacaauucaggccugc

SEQ ID NO: 20333 - RNA, 20 nt, Artificial Sequence
  TRAC targeting sequence
gcuacaauucaggccugcuu

SEQ ID NO: 20334 - RNA, 20 nt, Artificial Sequence
  TRAC targeting sequence
ggccugcuucuuuucauagg

SEQ ID NO: 20335 - RNA, 20 nt, Artificial Sequence
  TRAC targeting sequence
uuucauagggaugaagcuac

SEQ ID NO: 20336 - RNA, 20 nt, Artificial Sequence
  TRAC targeting sequence
uagggaugaagcuacagguu

SEQ ID NO: 20337 - RNA, 20 nt, Artificial Sequence
  TRAC targeting sequence
cuaugaaaagaagcaggccu

SEQ ID NO: 20338 - RNA, 20 nt, Artificial Sequence
  TRAC targeting sequence
ucccuaugaaaagaagcagg

SEQ ID NO: 20339 - RNA, 20 nt, Artificial Sequence
  TRAC targeting sequence
accuguagcuucaucccuau

SEQ ID NO: 20340 - RNA, 20 nt, Artificial Sequence
  TRAC targeting sequence
cuuaucugaaaugcuuggua

SEQ ID NO: 20341 - RNA, 20 nt, Artificial Sequence
  TRAC targeting sequence
gaaaugcuugguacuagaag

SEQ ID NO: 20342 - RNA, 20 nt, Artificial Sequence
  TRAC targeting sequence
gauaagggauacucaaccug

SEQ ID NO: 20343 - RNA, 20 nt, Artificial Sequence
  TRAC targeting sequence
aguaccaagcauuucagaua

SEQ ID NO: 20344 - RNA, 20 nt, Artificial Sequence
  TRAC targeting sequence
gguuuuggauuuuuuuuuuu

SEQ ID NO: 20345 - RNA, 20 nt, Artificial Sequence
  TRAC targeting sequence
aaaaccugaacacuucuagu

SEQ ID NO: 20346 - RNA, 20 nt, Artificial Sequence
  TRAC targeting sequence
aaaaaaaaaaaaaaaaaucc

SEQ ID NO: 20347 - RNA, 20 nt, Artificial Sequence
  TRAC targeting sequence
acccccagccucaaaaaaaa

SEQ ID NO: 20348 - RNA, 20 nt, Artificial Sequence
  TRAC targeting sequence
gcaucccuaaucuaaaaauc

SEQ ID NO: 20349 - RNA, 20 nt, Artificial Sequence
  TRAC targeting sequence
cuaaucuaaaaaucugaaau

SEQ ID NO: 20350 - RNA, 20 nt, Artificial Sequence
  TRAC targeting sequence
aaaaaucugaaauccaagau

SEQ ID NO: 20351 - RNA, 20 nt, Artificial Sequence
  TRAC targeting sequence
gaaauccaagaugccccagu

SEQ ID NO: 20352 - RNA, 20 nt, Artificial Sequence
  TRAC targeting sequence
gauuuuuagauuagggaugc

SEQ ID NO: 20353 - RNA, 20 nt, Artificial Sequence
  TRAC targeting sequence
aagaugccccagugagugag

SEQ ID NO: 20354 - RNA, 20 nt, Artificial Sequence
  TRAC targeting sequence
uggauuucagauuuuuagau

SEQ ID NO: 20355 - RNA, 20 nt, Artificial Sequence
  TRAC targeting sequence
cuggggcaucuuggauuuca

SEQ ID NO: 20356 - RNA, 20 nt, Artificial Sequence
  TRAC targeting sequence
cucacuggggcaucuuggau

SEQ ID NO: 20357 - RNA, 20 nt, Artificial Sequence
  TRAC targeting sequence
uuugagcaucauguuggcau

SEQ ID NO: 20358 - RNA, 20 nt, Artificial Sequence
  TRAC targeting sequence
aaggaaaugcucacucacug

SEQ ID NO: 20359 - RNA, 20 nt, Artificial Sequence
  TRAC targeting sequence
uguuggcauuuaaaaaguuu

SEQ ID NO: 20360 - RNA, 20 nt, Artificial Sequence
  TRAC targeting sequence
gauuuuggagcauuuccaau

SEQ ID NO: 20361 - RNA, 20 nt, Artificial Sequence
  TRAC targeting sequence
gaaacuuuuuaaaugccaac

SEQ ID NO: 20362 - RNA, 20 nt, Artificial Sequence
  TRAC targeting sequence
aaaaucugaaacuuuuuaaa

SEQ ID NO: 20363 - RNA, 20 nt, Artificial Sequence
  TRAC targeting sequence
aauuucagauuuuugaauua

SEQ ID NO: 20364 - RNA, 20 nt, Artificial Sequence
  TRAC targeting sequence
gauuuuugaauuagggaugc

SEQ ID NO: 20365 - RNA, 20 nt, Artificial Sequence
  TRAC targeting sequence
gaaauuggaaaugcuccaaa

SEQ ID NO: 20366 - RNA, 20 nt, Artificial Sequence
  TRAC targeting sequence
aaaaucugaaauuggaaaug

SEQ ID NO: 20367 - RNA, 20 nt, Artificial Sequence
  TRAC targeting sequence
cuaauucaaaaaucugaaau

SEQ ID NO: 20368 - RNA, 20 nt, Artificial Sequence
  TRAC targeting sequence
ccuauuaaagcugguacagg

SEQ ID NO: 20369 - RNA, 20 nt, Artificial Sequence
  TRAC targeting sequence
aggucaccuauuaaagcugg

SEQ ID NO: 20370 - RNA, 20 nt, Artificial Sequence
  TRAC targeting sequence
cuccccucuacaggcuuaug

SEQ ID NO: 20371 - RNA, 20 nt, Artificial Sequence
  TRAC targeting sequence
ccucuacaggcuuauguguu

SEQ ID NO: 20372 - RNA, 20 nt, Artificial Sequence
  TRAC targeting sequence
acaggcuuauguguugccac

SEQ ID NO: 20373 - RNA, 20 nt, Artificial Sequence
  TRAC targeting sequence
uaaguggcaacacauaagcc

SEQ ID NO: 20374 - RNA, 20 nt, Artificial Sequence
  TRAC targeting sequence
gguaggacuggaggcuaccu

SEQ ID NO: 20375 - RNA, 20 nt, Artificial Sequence
  TRAC targeting sequence
uacccgacauuucguaagug

SEQ ID NO: 20376 - RNA, 20 nt, Artificial Sequence
  TRAC targeting sequence
aguccuacccgacauuucgu

SEQ ID NO: 20377 - RNA, 20 nt, Artificial Sequence
  TRAC targeting sequence
cacucccugcaccucugauu

SEQ ID NO: 20378 - RNA, 20 nt, Artificial Sequence
  TRAC targeting sequence
cugcaccucugauucuguga

SEQ ID NO: 20379 - RNA, 20 nt, Artificial Sequence
  TRAC targeting sequence
gauucugugaccccugcaga

SEQ ID NO: 20380 - RNA, 20 nt, Artificial Sequence
  TRAC targeting sequence
gaggugcagggagugggagg

SEQ ID NO: 20381 - RNA, 20 nt, Artificial Sequence
  TRAC targeting sequence
gugaccccugcagaauuaag

SEQ ID NO: 20382 - RNA, 20 nt, Artificial Sequence
  TRAC targeting sequence
cagaaucagaggugcaggga

SEQ ID NO: 20383 - RNA, 20 nt, Artificial Sequence
  TRAC targeting sequence
gcaggggucacagaaucaga

SEQ ID NO: 20384 - RNA, 20 nt, Artificial Sequence
  TRAC targeting sequence
uaauucugcaggggucacag

SEQ ID NO: 20385 - RNA, 20 nt, Artificial Sequence
  TRAC targeting sequence
cuucuccuggucagcccuac

SEQ ID NO: 20386 - RNA, 20 nt, Artificial Sequence
  TRAC targeting sequence
ccuggucagcccuacugacg

SEQ ID NO: 20387 - RNA, 20 nt, Artificial Sequence
  TRAC targeting sequence
uggucagcccuacugacggg

SEQ ID NO: 20388 - RNA, 20 nt, Artificial Sequence
  TRAC targeting sequence
gcccuacugacgggagucac

SEQ ID NO: 20389 - RNA, 20 nt, Artificial Sequence
  TRAC targeting sequence
guagggcugaccaggagaag

SEQ ID NO: 20390 - RNA, 20 nt, Artificial Sequence
  TRAC targeting sequence
cgucaguagggcugaccagg

SEQ ID NO: 20391 - RNA, 20 nt, Artificial Sequence
  TRAC targeting sequence
cagaauccccaguucuuucu

SEQ ID NO: 20392 - RNA, 20 nt, Artificial Sequence
  TRAC targeting sequence
gugacucccgucaguagggc

SEQ ID NO: 20393 - RNA, 20 nt, Artificial Sequence
  TRAC targeting sequence
ccaguucuuucuaagcugcc

SEQ ID NO: 20394 - RNA, 20 nt, Artificial Sequence
  TRAC targeting sequence
uucuaagcugccccaucucu

SEQ ID NO: 20395 - RNA, 20 nt, Artificial Sequence
  TRAC targeting sequence
aagcugccccaucucucacc

SEQ ID NO: 20396 - RNA, 20 nt, Artificial Sequence
  TRAC targeting sequence
cucaccuaaauacaaucccc

SEQ ID NO: 20397 - RNA, 20 nt, Artificial Sequence
  TRAC targeting sequence
caccuaaauacaauccccuu

SEQ ID NO: 20398 - RNA, 20 nt, Artificial Sequence
  TRAC targeting sequence
ccuaaauacaauccccuuaa

SEQ ID NO: 20399 - RNA, 20 nt, Artificial Sequence
  TRAC targeting sequence
ccuuaaauaacaccaaaggg

SEQ ID NO: 20400 - RNA, 20 nt, Artificial Sequence
  TRAC targeting sequence
cuuugguguuauuuaagggg

SEQ ID NO: 20401 - RNA, 20 nt, Artificial Sequence
  TRAC targeting sequence
gaccuccaucacagcagggu

SEQ ID NO: 20402 - RNA, 20 nt, Artificial Sequence
  TRAC targeting sequence
gagcccuuucccuuuggugu

SEQ ID NO: 20403 - RNA, 20 nt, Artificial Sequence
  TRAC targeting sequence
aucacagcagggucacucuc

SEQ ID NO: 20404 - RNA, 20 nt, Artificial Sequence
  TRAC targeting sequence
cagcagggucacucucgcac

SEQ ID NO: 20405 - RNA, 20 nt, Artificial Sequence
  TRAC targeting sequence
cucucgcacgugguaggacc

SEQ ID NO: 20406 - RNA, 20 nt, Artificial Sequence
  TRAC targeting sequence
cgcacgugguaggaccauac

SEQ ID NO: 20407 - RNA, 20 nt, Artificial Sequence
  TRAC targeting sequence
cacgugguaggaccauacca

SEQ ID NO: 20408 - RNA, 20 nt, Artificial Sequence
  TRAC targeting sequence
uaccacgugcgagagugacc

SEQ ID NO: 20409 - RNA, 20 nt, Artificial Sequence
  TRAC targeting sequence
caaaggcgggguuugccacc

SEQ ID NO: 20410 - RNA, 20 nt, Artificial Sequence
  TRAC targeting sequence
ccaaagguggcaaaccccgc

SEQ ID NO: 20411 - RNA, 20 nt, Artificial Sequence
  TRAC targeting sequence
ggggggccucuaccuccuca

SEQ ID NO: 20412 - RNA, 20 nt, Artificial Sequence
  TRAC targeting sequence
accuccucaccagucugaca

SEQ ID NO: 20413 - RNA, 20 nt, Artificial Sequence
  TRAC targeting sequence
ucaccagucugacacaaugc

SEQ ID NO: 20414 - RNA, 20 nt, Artificial Sequence
  TRAC targeting sequence
ccagucugacacaaugccag

SEQ ID NO: 20415 - RNA, 20 nt, Artificial Sequence
  TRAC targeting sequence
gacacaaugccagagauucc

SEQ ID NO: 20416 - RNA, 20 nt, Artificial Sequence
  TRAC targeting sequence
gacuggugaggagguagagg

SEQ ID NO: 20417 - RNA, 20 nt, Artificial Sequence
  TRAC targeting sequence
ggcauugugucagacuggug

SEQ ID NO: 20418 - RNA, 20 nt, Artificial Sequence
  TRAC targeting sequence
cuggcauugugucagacugg

SEQ ID NO: 20419 - RNA, 20 nt, Artificial Sequence
  TRAC targeting sequence
accacugggaauuucuuaua

SEQ ID NO: 20420 - RNA, 20 nt, Artificial Sequence
  TRAC targeting sequence
cagugguggaaucucuggca

SEQ ID NO: 20421 - RNA, 20 nt, Artificial Sequence
  TRAC targeting sequence
uauaauuaaagcauucucuu

SEQ ID NO: 20422 - RNA, 20 nt, Artificial Sequence
  TRAC targeting sequence
cuucccuguauuaaaugaaa

SEQ ID NO: 20423 - RNA, 20 nt, Artificial Sequence
  TRAC targeting sequence
ucccuguauuaaaugaaaau

SEQ ID NO: 20424 - RNA, 20 nt, Artificial Sequence
  TRAC targeting sequence
cuguauuaaaugaaaaugcc

SEQ ID NO: 20425 - RNA, 20 nt, Artificial Sequence
  TRAC targeting sequence
uuuaauacagggaagagaau

SEQ ID NO: 20426 - RNA, 20 nt, Artificial Sequence
  TRAC targeting sequence
caggggcauuuucauuuaau

SEQ ID NO: 20427 - RNA, 20 nt, Artificial Sequence
  TRAC targeting sequence
cccaggggcauuuucauuua

SEQ ID NO: 20428 - RNA, 20 nt, Artificial Sequence
  TRAC targeting sequence
auuaacucucccaggggcau

SEQ ID NO: 20429 - RNA, 20 nt, Artificial Sequence
  TRAC targeting sequence
accauuaaaaacugagggcc

SEQ ID NO: 20430 - RNA, 20 nt, Artificial Sequence
  TRAC targeting sequence
guuuuuaaugguugauaaag

SEQ ID NO: 20431 - RNA, 20 nt, Artificial Sequence
  TRAC targeting sequence
cuuucuuuucccccugaagu

SEQ ID NO: 20432 - RNA, 20 nt, Artificial Sequence
  TRAC targeting sequence
uucuuuucccccugaagugg

SEQ ID NO: 20433 - RNA, 20 nt, Artificial Sequence
  TRAC targeting sequence
uuucccccugaagugguacu

SEQ ID NO: 20434 - RNA, 20 nt, Artificial Sequence
  TRAC targeting sequence
cccugaagugguacuucauu

SEQ ID NO: 20435 - RNA, 20 nt, Artificial Sequence
  TRAC targeting sequence
gggggaaaagaaagagaaac

SEQ ID NO: 20436 - RNA, 20 nt, Artificial Sequence
  TRAC targeting sequence
uuuuguuuuauagaaaaaag

SEQ ID NO: 20437 - RNA, 20 nt, Artificial Sequence
  TRAC targeting sequence
auaaaacaaaaugaaguacc

SEQ ID NO: 20438 - RNA, 20 nt, Artificial Sequence
  TRAC targeting sequence
uuuuucuauaaaacaaaaug

SEQ ID NO: 20439 - RNA, 20 nt, Artificial Sequence
  TRAC targeting sequence
ggcaagggaagugugggugg

SEQ ID NO: 20440 - RNA, 20 nt, Artificial Sequence
  TRAC targeting sequence
cuugccugaaucuuuuuucu

SEQ ID NO: 20441 - RNA, 20 nt, Artificial Sequence
  TRAC targeting sequence
ccagccacccacacuucccu

SEQ ID NO: 20442 - RNA, 20 nt, Artificial Sequence
  TRAC targeting sequence
gcuccuuugaguuggcugca

SEQ ID NO: 20443 - RNA, 20 nt, Artificial Sequence
  TRAC targeting sequence
uuugaguuggcugcagugac

SEQ ID NO: 20444 - RNA, 20 nt, Artificial Sequence
  TRAC targeting sequence
aaggagcagaccugccuccc

SEQ ID NO: 20445 - RNA, 20 nt, Artificial Sequence
  TRAC targeting sequence
cugcagccaacucaaaggag

SEQ ID NO: 20446 - RNA, 20 nt, Artificial Sequence
  TRAC targeting sequence
augucacugcagccaacuca

SEQ ID NO: 20447 - RNA, 20 nt, Artificial Sequence
  TRAC targeting sequence
cagggcugagggaaggagac

SEQ ID NO: 20448 - RNA, 20 nt, Artificial Sequence
  TRAC targeting sequence
gcccugugacuuccauguca

SEQ ID NO: 20449 - RNA, 20 nt, Artificial Sequence
  TRAC targeting sequence
cucagcccugugacuuccau

SEQ ID NO: 20450 - RNA, 20 nt, Artificial Sequence
  TRAC targeting sequence
uucccucagcccugugacuu

SEQ ID NO: 20451 - RNA, 20 nt, Artificial Sequence
  TRAC targeting sequence
ccuucccucagcccugugac

SEQ ID NO: 20452 - RNA, 20 nt, Artificial Sequence
  TRAC targeting sequence
ugucuccuucccucagcccu

SEQ ID NO: 20453 - RNA, 20 nt, Artificial Sequence
  TRAC targeting sequence
aggcucuugucuccuucccu

SEQ ID NO: 20454 - RNA, 20 nt, Artificial Sequence
  TRAC targeting sequence
cugcuguccaggcucuuguc

SEQ ID NO: 20455 - RNA, 20 nt, Artificial Sequence
  TRAC targeting sequence
aagacagaccccuccaagaa

SEQ ID NO: 20456 - RNA, 20 nt, Artificial Sequence
  TRAC targeting sequence
uugaccccuucacugcuguc

SEQ ID NO: 20457 - RNA, 20 nt, Artificial Sequence
  TRAC targeting sequence
gucuuugaccccuucacugc

SEQ ID NO: 20458 - RNA, 20 nt, Artificial Sequence
  TRAC targeting sequence
aagaaccucagaggagaccc

SEQ ID NO: 20459 - RNA, 20 nt, Artificial Sequence
  TRAC targeting sequence
uggaggggucugucuuugac

SEQ ID NO: 20460 - RNA, 20 nt, Artificial Sequence
  TRAC targeting sequence
gaggagacccggacugcagg

SEQ ID NO: 20461 - RNA, 20 nt, Artificial Sequence
  TRAC targeting sequence
gagguucuuggaggggucug

SEQ ID NO: 20462 - RNA, 20 nt, Artificial Sequence
  TRAC targeting sequence
ucugagguucuuggaggggu

SEQ ID NO: 20463 - RNA, 20 nt, Artificial Sequence
  TRAC targeting sequence
ccucugagguucuuggaggg

SEQ ID NO: 20464 - RNA, 20 nt, Artificial Sequence
  TRAC targeting sequence
gggucuccucugagguucuu

SEQ ID NO: 20465 - RNA, 20 nt, Artificial Sequence
  TRAC targeting sequence
ugcaguccgggucuccucug

SEQ ID NO: 20466 - RNA, 20 nt, Artificial Sequence
  TRAC targeting sequence
ccugcaguccgggucuccuc

SEQ ID NO: 20467 - RNA, 20 nt, Artificial Sequence
  TRAC targeting sequence
ugcaggucuccugcaguccg

SEQ ID NO: 20468 - RNA, 20 nt, Artificial Sequence
  TRAC targeting sequence
cacgggccuccugcaggucu

SEQ ID NO: 20469 - RNA, 20 nt, Artificial Sequence
  TRAC targeting sequence
acaggcucccacgggccucc

SEQ ID NO: 20470 - RNA, 20 nt, Artificial Sequence
  TRAC targeting sequence
acaggccuccacaggcuccc

SEQ ID NO: 20471 - RNA, 20 nt, Artificial Sequence
  TRAC targeting sequence
cgcgggccuccacaggccuc

SEQ ID NO: 20472 - RNA, 20 nt, Artificial Sequence
  TRAC targeting sequence
acaggcucccgcgggccucc

SEQ ID NO: 20473 - RNA, 20 nt, Artificial Sequence
  TRAC targeting sequence
acaggccuccacaggcuccc

SEQ ID NO: 20474 - RNA, 20 nt, Artificial Sequence
  TRAC targeting sequence
cgcgggccuccacaggccuc

SEQ ID NO: 20475 - RNA, 20 nt, Artificial Sequence
  TRAC targeting sequence
acaggcucccgcgggccucc

SEQ ID NO: 20476 - RNA, 20 nt, Artificial Sequence
  TRAC targeting sequence
acaggccuccacaggcuccc

SEQ ID NO: 20477 - RNA, 20 nt, Artificial Sequence
  TRAC targeting sequence
acaggccuccacaggccucc

SEQ ID NO: 20478 - RNA, 20 nt, Artificial Sequence
  TRAC targeting sequence
gcgggagccuguggaggccu

SEQ ID NO: 20479 - RNA, 20 nt, Artificial Sequence
  TRAC targeting sequence
cgcagaccuccacaggccuc

SEQ ID NO: 20480 - RNA, 20 nt, Artificial Sequence
  TRAC targeting sequence
acaggcucccgcagaccucc

SEQ ID NO: 20481 - RNA, 20 nt, Artificial Sequence
  TRAC targeting sequence
acaggccuccacaggcuccc

SEQ ID NO: 20482 - RNA, 20 nt, Artificial Sequence
  TRAC targeting sequence
cgcaggccuccacaggccuc

SEQ ID NO: 20483 - RNA, 20 nt, Artificial Sequence
  TRAC targeting sequence
acaggcucccgcaggccucc

SEQ ID NO: 20484 - RNA, 20 nt, Artificial Sequence
  TRAC targeting sequence
acaggccuccacaggcuccc

SEQ ID NO: 20485 - RNA, 20 nt, Artificial Sequence
  TRAC targeting sequence
acaggccuccacaggccucc

SEQ ID NO: 20486 - RNA, 20 nt, Artificial Sequence
  TRAC targeting sequence
gcgggagccuguggaggucu

SEQ ID NO: 20487 - RNA, 20 nt, Artificial Sequence
  TRAC targeting sequence
cgcagaccuccacaggccuc

SEQ ID NO: 20488 - RNA, 20 nt, Artificial Sequence
  TRAC targeting sequence
acaggcucccgcagaccucc

SEQ ID NO: 20489 - RNA, 20 nt, Artificial Sequence
  TRAC targeting sequence
gcgggagccuguggaggccu

SEQ ID NO: 20490 - RNA, 20 nt, Artificial Sequence
  TRAC targeting sequence
cgcagaccuccacaggcucc

SEQ ID NO: 20491 - RNA, 20 nt, Artificial Sequence
  TRAC targeting sequence
acaggcucccgcagaccucc

SEQ ID NO: 20492 - RNA, 20 nt, Artificial Sequence
  TRAC targeting sequence
acaggccuccacaggcuccc

SEQ ID NO: 20493 - RNA, 20 nt, Artificial Sequence
  TRAC targeting sequence
acaggccuccacaggccucc

SEQ ID NO: 20494 - RNA, 20 nt, Artificial Sequence
  TRAC targeting sequence
cgcaggccuccacaggccuc

SEQ ID NO: 20495 - RNA, 20 nt, Artificial Sequence
  TRAC targeting sequence
acaggcucccgcaggccucc

SEQ ID NO: 20496 - RNA, 20 nt, Artificial Sequence
  TRAC targeting sequence
gcgggagccuguggaggccu

SEQ ID NO: 20497 - RNA, 20 nt, Artificial Sequence
  TRAC targeting sequence
cgcagaccuccacaggcucc

SEQ ID NO: 20498 - RNA, 20 nt, Artificial Sequence
  TRAC targeting sequence
acaggcucccgcagaccucc

SEQ ID NO: 20499 - RNA, 20 nt, Artificial Sequence
  TRAC targeting sequence
acaggccuccacaggcuccc

SEQ ID NO: 20500 - RNA, 20 nt, Artificial Sequence
  TRAC targeting sequence
acaggccuccacaggccucc

SEQ ID NO: 20501 - RNA, 20 nt, Artificial Sequence
  TRAC targeting sequence
gcgggagccuguggaggccu

SEQ ID NO: 20502 - RNA, 20 nt, Artificial Sequence
  TRAC targeting sequence
cgcagaccuccacaggccuc

SEQ ID NO: 20503 - RNA, 20 nt, Artificial Sequence
  TRAC targeting sequence
acaggcucccgcagaccucc

SEQ ID NO: 20504 - RNA, 20 nt, Artificial Sequence
  TRAC targeting sequence
acaggccuccacaggcuccc

SEQ ID NO: 20505 - RNA, 20 nt, Artificial Sequence
  TRAC targeting sequence
acaggccuccacaggccucc

SEQ ID NO: 20506 - RNA, 20 nt, Artificial Sequence
  TRAC targeting sequence
gcgggagccuguggaggccu

SEQ ID NO: 20507 - RNA, 20 nt, Artificial Sequence
  TRAC targeting sequence
cgcagaccuccacaggccuc

SEQ ID NO: 20508 - RNA, 20 nt, Artificial Sequence
  TRAC targeting sequence
acaggcucccgcagaccucc

SEQ ID NO: 20509 - RNA, 20 nt, Artificial Sequence
  TRAC targeting sequence
acaggccuccacaggcuccc

SEQ ID NO: 20510 - RNA, 20 nt, Artificial Sequence
  TRAC targeting sequence
ggcagcaaagcccagcaguc

SEQ ID NO: 20511 - RNA, 20 nt, Artificial Sequence
  TRAC targeting sequence
cuggucccccaaggccgccc

SEQ ID NO: 20512 - RNA, 20 nt, Artificial Sequence
  TRAC targeting sequence
cccaaggccgcccacagauc

SEQ ID NO: 20513 - RNA, 20 nt, Artificial Sequence
  TRAC targeting sequence
gugggcggccuugggggacc

SEQ ID NO: 20514 - RNA, 20 nt, Artificial Sequence
  TRAC targeting sequence
augcaaggugaugcagcagg

SEQ ID NO: 20515 - RNA, 20 nt, Artificial Sequence
  TRAC targeting sequence
ccuugcauagaucugugggc

SEQ ID NO: 20516 - RNA, 20 nt, Artificial Sequence
  TRAC targeting sequence
auagccccugcugcaucacc

SEQ ID NO: 20517 - RNA, 20 nt, Artificial Sequence
  TRAC targeting sequence
cugcuugggugugggugggu

SEQ ID NO: 20518 - RNA, 20 nt, Artificial Sequence
  TRAC targeting sequence
ugccucccugcuugggugug

SEQ ID NO: 20519 - RNA, 20 nt, Artificial Sequence
  TRAC targeting sequence
ucgugccucccugcuugggu

SEQ ID NO: 20520 - RNA, 20 nt, Artificial Sequence
  TRAC targeting sequence
cccuaccugcccgggccuug

SEQ ID NO: 20521 - RNA, 20 nt, Artificial Sequence
  TRAC targeting sequence
ggaaagcaggcucagcucca

SEQ ID NO: 20522 - RNA, 20 nt, Artificial Sequence
  TRAC targeting sequence
ggaugucccccuaccugccc

SEQ ID NO: 20523 - RNA, 20 nt, Artificial Sequence
  TRAC targeting sequence
gcuccaccccugagaaauuu

SEQ ID NO: 20524 - RNA, 20 nt, Artificial Sequence
  TRAC targeting sequence
accccugagaaauuuccguc

SEQ ID NO: 20525 - RNA, 20 nt, Artificial Sequence
  TRAC targeting sequence
gggguggagcugagccugcu

SEQ ID NO: 20526 - RNA, 20 nt, Artificial Sequence
  TRAC targeting sequence
cagggguggagcugagccug

SEQ ID NO: 20527 - RNA, 20 nt, Artificial Sequence
  TRAC targeting sequence
gucuaaauccaggagauccu

SEQ ID NO: 20528 - RNA, 20 nt, Artificial Sequence
  TRAC targeting sequence
aaauccaggagauccuugau

SEQ ID NO: 20529 - RNA, 20 nt, Artificial Sequence
  TRAC targeting sequence
aggagauccuugauucagca

SEQ ID NO: 20530 - RNA, 20 nt, Artificial Sequence
  TRAC targeting sequence
uggauuuagacggaaauuuc

SEQ ID NO: 20531 - RNA, 20 nt, Artificial Sequence
  TRAC targeting sequence
ccuggauuuagacggaaauu

SEQ ID NO: 20532 - RNA, 20 nt, Artificial Sequence
  TRAC targeting sequence
uugauucagcaagaaccuuc

SEQ ID NO: 20533 - RNA, 20 nt, Artificial Sequence
  TRAC targeting sequence
aggaucuccuggauuuagac

SEQ ID NO: 20534 - RNA, 20 nt, Artificial Sequence
  TRAC targeting sequence
gcaagaaccuucccucaugu

SEQ ID NO: 20535 - RNA, 20 nt, Artificial Sequence
  TRAC targeting sequence
ugcugaaucaaggaucuccu

SEQ ID NO: 20536 - RNA, 20 nt, Artificial Sequence
  TRAC targeting sequence
cucauguccgaggcuguuaa

SEQ ID NO: 20537 - RNA, 20 nt, Artificial Sequence
  TRAC targeting sequence
uguccgaggcuguuaaaccu

SEQ ID NO: 20538 - RNA, 20 nt, Artificial Sequence
  TRAC targeting sequence
gaggcuguuaaaccuaaagc

SEQ ID NO: 20539 - RNA, 20 nt, Artificial Sequence
  TRAC targeting sequence
gacaugagggaagguucuug

SEQ ID NO: 20540 - RNA, 20 nt, Artificial Sequence
  TRAC targeting sequence
gcccuaacuggcuuuagguu

SEQ ID NO: 20541 - RNA, 20 nt, Artificial Sequence
  TRAC targeting sequence
gagggguggaccaggagcaa

SEQ ID NO: 20542 - RNA, 20 nt, Artificial Sequence
  TRAC targeting sequence
gaccucugcccuaacuggcu

SEQ ID NO: 20543 - RNA, 20 nt, Artificial Sequence
  TRAC targeting sequence
accccucugaccucugcccu

SEQ ID NO: 20544 - RNA, 20 nt, Artificial Sequence
  TRAC targeting sequence
ugguccaccccucugaccuc

SEQ ID NO: 20545 - RNA, 20 nt, Artificial Sequence
  TRAC targeting sequence
agggugagcaaguguuggga

SEQ ID NO: 20546 - RNA, 20 nt, Artificial Sequence
  TRAC targeting sequence
acccacuugcuccuggucca

SEQ ID NO: 20547 - RNA, 20 nt, Artificial Sequence
  TRAC targeting sequence
cccucgacccacuugcuccu

SEQ ID NO: 20548 - RNA, 20 nt, Artificial Sequence
  TRAC targeting sequence
caacacuugcucacccucga

SEQ ID NO: 20549 - RNA, 20 nt, Artificial Sequence
  TRAC targeting sequence
ccacucccaacacuugcuca

SEQ ID NO: 20550 - RNA, 20 nt, Artificial Sequence
  TRAC targeting sequence
auccccacucccaacacuug

SEQ ID NO: 20551 - RNA, 20 nt, Artificial Sequence
  TRAC targeting sequence
auccaucuccgacugcucug

SEQ ID NO: 20552 - RNA, 20 nt, Artificial Sequence
  TRAC targeting sequence
aucuccgacugcucugcucg

SEQ ID NO: 20553 - RNA, 20 nt, Artificial Sequence
  TRAC targeting sequence
ccgacugcucugcucgcaua

SEQ ID NO: 20554 - RNA, 20 nt, Artificial Sequence
  TRAC targeting sequence
gacugcucugcucgcauauc

SEQ ID NO: 20555 - RNA, 20 nt, Artificial Sequence
  TRAC targeting sequence
gagauggauggaguuucuau

SEQ ID NO: 20556 - RNA, 20 nt, Artificial Sequence
  TRAC targeting sequence
gcucgcauaucuggcuccag

SEQ ID NO: 20557 - RNA, 20 nt, Artificial Sequence
  TRAC targeting sequence
cauaucuggcuccagggccc

SEQ ID NO: 20558 - RNA, 20 nt, Artificial Sequence
  TRAC targeting sequence
ggcuccagggcccaccuggu

SEQ ID NO: 20559 - RNA, 20 nt, Artificial Sequence
  TRAC targeting sequence
agggcccaccugguauguca

SEQ ID NO: 20560 - RNA, 20 nt, Artificial Sequence
  TRAC targeting sequence
gagggaauuagaacggccuu

SEQ ID NO: 20561 - RNA, 20 nt, Artificial Sequence
  TRAC targeting sequence
gacauaccaggugggcccug

SEQ ID NO: 20562 - RNA, 20 nt, Artificial Sequence
  TRAC targeting sequence
cucugacauaccaggugggc

SEQ ID NO: 20563 - RNA, 20 nt, Artificial Sequence
  TRAC targeting sequence
aauucccucugacauaccag

SEQ ID NO: 20564 - RNA, 20 nt, Artificial Sequence
  TRAC targeting sequence
caaggccguucuaauucccu

SEQ ID NO: 20565 - RNA, 20 nt, Artificial Sequence
  TRAC targeting sequence
ucacaaggccguucuaauuc

SEQ ID NO: 20566 - RNA, 20 nt, Artificial Sequence
  TRAC targeting sequence
ggagaagggcuccugugccc

SEQ ID NO: 20567 - RNA, 20 nt, Artificial Sequence
  TRAC targeting sequence
ugagccuccucacaaggccg

SEQ ID NO: 20568 - RNA, 20 nt, Artificial Sequence
  TRAC targeting sequence
ccugagccuccucacaaggc

SEQ ID NO: 20569 - RNA, 20 nt, Artificial Sequence
  TRAC targeting sequence
ugugcccaccggccaaguca

SEQ ID NO: 20570 - RNA, 20 nt, Artificial Sequence
  TRAC targeting sequence
gcacugggccuaacgccacc

SEQ ID NO: 20571 - RNA, 20 nt, Artificial Sequence
  TRAC targeting sequence
gugcagagggcccagcuaua

SEQ ID NO: 20572 - RNA, 20 nt, Artificial Sequence
  TRAC targeting sequence
gcacugaggggcuuugcugu

SEQ ID NO: 20573 - RNA, 20 nt, Artificial Sequence
  TRAC targeting sequence
guauagcugggcccucugca

SEQ ID NO: 20574 - RNA, 20 nt, Artificial Sequence
  TRAC targeting sequence
aggcuaagcaaugcccaguu

SEQ ID NO: 20575 - RNA, 20 nt, Artificial Sequence
  TRAC targeting sequence
cuccaggcuaagcaaugccc

SEQ ID NO: 20576 - RNA, 20 nt, Artificial Sequence
  TRAC targeting sequence
gcugccuauucccuccaggc

SEQ ID NO: 20577 - RNA, 20 nt, Artificial Sequence
  TRAC targeting sequence
ucagcugccuauucccucca

SEQ ID NO: 20578 - RNA, 20 nt, Artificial Sequence
  TRAC targeting sequence
ccucagcugccuauucccuc

SEQ ID NO: 20579 - RNA, 20 nt, Artificial Sequence
  TRAC targeting sequence
aggucuccucagcugccuau

SEQ ID NO: 20580 - RNA, 20 nt, Artificial Sequence
  TRAC targeting sequence
ugaagagacuggccaugaag

SEQ ID NO: 20581 - RNA, 20 nt, Artificial Sequence
  TRAC targeting sequence
ugacuguguuuuccaggucu

SEQ ID NO: 20582 - RNA, 20 nt, Artificial Sequence
  TRAC targeting sequence
ucaugacuguguuuuccagg

SEQ ID NO: 20583 - RNA, 20 nt, Artificial Sequence
  TRAC targeting sequence
cuucaugacuguguuuucca

SEQ ID NO: 20584 - RNA, 20 nt, Artificial Sequence
  TRAC targeting sequence
uggccagucucuucaugacu

SEQ ID NO: 20585 - RNA, 20 nt, Artificial Sequence
  TRAC targeting sequence
ucauggccagucucuucaug

SEQ ID NO: 20586 - RNA, 20 nt, Artificial Sequence
  TRAC targeting sequence
gugggucuucauggccaguc

SEQ ID NO: 20587 - RNA, 20 nt, Artificial Sequence
  TRAC targeting sequence
cagggucugugggucuucau

SEQ ID NO: 20588 - RNA, 20 nt, Artificial Sequence
  TRAC targeting sequence
accagccuggacccaaccuc

SEQ ID NO: 20589 - RNA, 20 nt, Artificial Sequence
  TRAC targeting sequence
aggcugguagagcugcagcu

SEQ ID NO: 20590 - RNA, 20 nt, Artificial Sequence
  TRAC targeting sequence
ggccgacaucccagcaggga

SEQ ID NO: 20591 - RNA, 20 nt, Artificial Sequence
  TRAC targeting sequence
gccugagguuggguccaggc

SEQ ID NO: 20592 - RNA, 20 nt, Artificial Sequence
  TRAC targeting sequence
cagcagggaacauguuacua

SEQ ID NO: 20593 - RNA, 20 nt, Artificial Sequence
  TRAC targeting sequence
cugcugggaugucggccuga

SEQ ID NO: 20594 - RNA, 20 nt, Artificial Sequence
  TRAC targeting sequence
acaacuggccuuaguaacau

SEQ ID NO: 20595 - RNA, 20 nt, Artificial Sequence
  TRAC targeting sequence
cuucuacaacuggccuuagu

SEQ ID NO: 20596 - RNA, 20 nt, Artificial Sequence
  TRAC targeting sequence
cuggacacaugcccuacucu

SEQ ID NO: 20597 - RNA, 20 nt, Artificial Sequence
  TRAC targeting sequence
ggacacaugcccuacucucc

SEQ ID NO: 20598 - RNA, 20 nt, Artificial Sequence
  TRAC targeting sequence
agagaagucccuucuacaac

SEQ ID NO: 20599 - RNA, 20 nt, Artificial Sequence
  TRAC targeting sequence
cccaaaagacuuaagcacag

SEQ ID NO: 20600 - RNA, 20 nt, Artificial Sequence
  TRAC targeting sequence
caaaagacuuaagcacaggc

SEQ ID NO: 20601 - RNA, 20 nt, Artificial Sequence
  TRAC targeting sequence
uuugggagaguagggcaugu

SEQ ID NO: 20602 - RNA, 20 nt, Artificial Sequence
  TRAC targeting sequence
caaaggcagaagaauggacu

SEQ ID NO: 20603 - RNA, 20 nt, Artificial Sequence
  TRAC targeting sequence
gccuuugggacuggccugug

SEQ ID NO: 20604 - RNA, 20 nt, Artificial Sequence
  TRAC targeting sequence
ucugccuuugggacuggccu

SEQ ID NO: 20605 - RNA, 20 nt, Artificial Sequence
  TRAC targeting sequence
auucuucugccuuugggacu

SEQ ID NO: 20606 - RNA, 20 nt, Artificial Sequence
  TRAC targeting sequence
uuuaguccauucuucugccu

SEQ ID NO: 20607 - RNA, 20 nt, Artificial Sequence
  TRAC targeting sequence
uguggccccagcccuaagau

SEQ ID NO: 20608 - RNA, 20 nt, Artificial Sequence
  TRAC targeting sequence
uagggcuggggccacaagag

SEQ ID NO: 20609 - RNA, 20 nt, Artificial Sequence
  TRAC targeting sequence
agaggacucucugaaacuuc

SEQ ID NO: 20610 - RNA, 20 nt, Artificial Sequence
  TRAC targeting sequence
agaaucuuagggcuggggcc

SEQ ID NO: 20611 - RNA, 20 nt, Artificial Sequence
  TRAC targeting sequence
ucuagaaucuuagggcuggg

SEQ ID NO: 20612 - RNA, 20 nt, Artificial Sequence
  TRAC targeting sequence
cugaaacuucacuugaagac

SEQ ID NO: 20613 - RNA, 20 nt, Artificial Sequence
  TRAC targeting sequence
gaaacuucacuugaagacuu

SEQ ID NO: 20614 - RNA, 20 nt, Artificial Sequence
  TRAC targeting sequence
gagaguccucuagaaucuua

SEQ ID NO: 20615 - RNA, 20 nt, Artificial Sequence
  TRAC targeting sequence
cuugaagacuugaccucuga

SEQ ID NO: 20616 - RNA, 20 nt, Artificial Sequence
  TRAC targeting sequence
agugaaguuucagagagucc

SEQ ID NO: 20617 - RNA, 20 nt, Artificial Sequence
  TRAC targeting sequence
ucaagugaaguuucagagag

SEQ ID NO: 20618 - RNA, 20 nt, Artificial Sequence
  TRAC targeting sequence
agucuucaagugaaguuuca

SEQ ID NO: 20619 - RNA, 20 nt, Artificial Sequence
  TRAC targeting sequence
gagugcaacuggagucacag

SEQ ID NO: 20620 - RNA, 20 nt, Artificial Sequence
  TRAC targeting sequence
gaggucaagucuucaaguga

SEQ ID NO: 20621 - RNA, 20 nt, Artificial Sequence
  TRAC targeting sequence
aguugcacucagaggucaag

SEQ ID NO: 20622 - RNA, 20 nt, Artificial Sequence
  TRAC targeting sequence
cagccacucaggagaaaggg

SEQ ID NO: 20623 - RNA, 20 nt, Artificial Sequence
  TRAC targeting sequence
ggagaaagggcaggcuaugc

SEQ ID NO: 20624 - RNA, 20 nt, Artificial Sequence
  TRAC targeting sequence
ugaguggcugugacuccagu

SEQ ID NO: 20625 - RNA, 20 nt, Artificial Sequence
  TRAC targeting sequence
ccugaguggcugugacucca

SEQ ID NO: 20626 - RNA, 20 nt, Artificial Sequence
  TRAC targeting sequence
ggagcauccuggugaggucu

SEQ ID NO: 20627 - RNA, 20 nt, Artificial Sequence
  TRAC targeting sequence
ugaagcacgugcuugcauag

SEQ ID NO: 20628 - RNA, 20 nt, Artificial Sequence
  TRAC targeting sequence
uggugaggucuucagcucug

SEQ ID NO: 20629 - RNA, 20 nt, Artificial Sequence
  TRAC targeting sequence
ccaggaugcuccugaagcac

SEQ ID NO: 20630 - RNA, 20 nt, Artificial Sequence
  TRAC targeting sequence
ucagcucugacagagcaacc

SEQ ID NO: 20631 - RNA, 20 nt, Artificial Sequence
  TRAC targeting sequence
gcucugacagagcaaccccu

SEQ ID NO: 20632 - RNA, 20 nt, Artificial Sequence
  TRAC targeting sequence
gacagagcaaccccucugcu

SEQ ID NO: 20633 - RNA, 20 nt, Artificial Sequence
  TRAC targeting sequence
gagcugaagaccucaccagg

SEQ ID NO: 20634 - RNA, 20 nt, Artificial Sequence
  TRAC targeting sequence
gucagagcugaagaccucac

SEQ ID NO: 20635 - RNA, 20 nt, Artificial Sequence
  TRAC targeting sequence
gcugcuacccucacuggggg

SEQ ID NO: 20636 - RNA, 20 nt, Artificial Sequence
  TRAC targeting sequence
cugggggcagccaucugagu

SEQ ID NO: 20637 - RNA, 20 nt, Artificial Sequence
  TRAC targeting sequence
gagucuuaaggaguugcuua

SEQ ID NO: 20638 - RNA, 20 nt, Artificial Sequence
  TRAC targeting sequence
gauggcugcccccagugagg

SEQ ID NO: 20639 - RNA, 20 nt, Artificial Sequence
  TRAC targeting sequence
uaaggaguugcuuauuuuuu

SEQ ID NO: 20640 - RNA, 20 nt, Artificial Sequence
  TRAC targeting sequence
uuaagacucagauggcugcc

SEQ ID NO: 20641 - RNA, 20 nt, Artificial Sequence
  TRAC targeting sequence
aaacauaaaauucaacuccc

SEQ ID NO: 20642 - RNA, 20 nt, Artificial Sequence
  TRAC targeting sequence
acuccccugggaucacguau

SEQ ID NO: 20643 - RNA, 20 nt, Artificial Sequence
  TRAC targeting sequence
ccugggaucacguauacaga

SEQ ID NO: 20644 - RNA, 20 nt, Artificial Sequence
  TRAC targeting sequence
caggggaguugaauuuuaug

SEQ ID NO: 20645 - RNA, 20 nt, Artificial Sequence
  TRAC targeting sequence
cguauacagacaggccuaua

SEQ ID NO: 20646 - RNA, 20 nt, Artificial Sequence
  TRAC targeting sequence
guauacgugaucccagggga

SEQ ID NO: 20647 - RNA, 20 nt, Artificial Sequence
  TRAC targeting sequence
gguaccauccuaguguggaa

SEQ ID NO: 20648 - RNA, 20 nt, Artificial Sequence
  TRAC targeting sequence
uaguguggaaguccccuggc

SEQ ID NO: 20649 - RNA, 20 nt, Artificial Sequence
  TRAC targeting sequence
acacuaggaugguaccugau

SEQ ID NO: 20650 - RNA, 20 nt, Artificial Sequence
  TRAC targeting sequence
ccuggccugugugcucugug

SEQ ID NO: 20651 - RNA, 20 nt, Artificial Sequence
  TRAC targeting sequence
gugggaugggaaugucccuu

SEQ ID NO: 20652 - RNA, 20 nt, Artificial Sequence
  TRAC targeting sequence
cacagagcacacaggccagg

SEQ ID NO: 20653 - RNA, 20 nt, Artificial Sequence
  TRAC targeting sequence
caucccacagagcacacagg

SEQ ID NO: 20654 - RNA, 20 nt, Artificial Sequence
  TRAC targeting sequence
cuugucaucaaugugucccc

SEQ ID NO: 20655 - RNA, 20 nt, Artificial Sequence
  TRAC targeting sequence
ucaauguguccccaggaacu

SEQ ID NO: 20656 - RNA, 20 nt, Artificial Sequence
  TRAC targeting sequence
auguguccccaggaacuaga

SEQ ID NO: 20657 - RNA, 20 nt, Artificial Sequence
  TRAC targeting sequence
ccaggaacuagaacagugcc

SEQ ID NO: 20658 - RNA, 20 nt, Artificial Sequence
  TRAC targeting sequence
uggggacacauugaugacaa

SEQ ID NO: 20659 - RNA, 20 nt, Artificial Sequence
  TRAC targeting sequence
aguuccuggggacacauuga

SEQ ID NO: 20660 - RNA, 20 nt, Artificial Sequence
  TRAC targeting sequence
guugugugccaggcacuguu

SEQ ID NO: 20661 - RNA, 20 nt, Artificial Sequence
  TRAC targeting sequence
uuuaacggcaucuguugugu

SEQ ID NO: 20662 - RNA, 20 nt, Artificial Sequence
  TRAC targeting sequence
cuuauucauuuaacggcauc

SEQ ID NO: 20663 - RNA, 20 nt, Artificial Sequence
  TRAC targeting sequence
uucacuuauucauuuaacgg

SEQ ID NO: 20664 - RNA, 20 nt, Artificial Sequence
  TRAC targeting sequence
ugcaguuaggcucugggugg

SEQ ID NO: 20665 - RNA, 20 nt, Artificial Sequence
  TRAC targeting sequence
ggguggggggagcugagugu

SEQ ID NO: 20666 - RNA, 20 nt, Artificial Sequence
  TRAC targeting sequence
ccccacccagagccuaacug

SEQ ID NO: 20667 - RNA, 20 nt, Artificial Sequence
  TRAC targeting sequence
gcuccccccacccagagccu

SEQ ID NO: 20668 - RNA, 20 nt, Artificial Sequence
  TRAC targeting sequence
cacucagcuccccccaccca

SEQ ID NO: 20669 - RNA, 20 nt, Artificial Sequence
  TRAC targeting sequence
ucacacucagcuccccccac

SEQ ID NO: 20670 - RNA, 20 nt, Artificial Sequence
  TRAC targeting sequence
ccacuccucacacucagcuc

SEQ ID NO: 20671 - RNA, 20 nt, Artificial Sequence
  TRAC targeting sequence
uguacuccccacuccucaca

SEQ ID NO: 20672 - RNA, 20 nt, Artificial Sequence
  TRAC targeting sequence
ccuguacuccccacuccuca

SEQ ID NO: 20673 - RNA, 20 nt, Artificial Sequence
  TRAC targeting sequence
uuucuccuguacuccccacu

SEQ ID NO: 20674 - RNA, 20 nt, Artificial Sequence
  TRAC targeting sequence
ccacuuuccuuucuccugua

SEQ ID NO: 20675 - RNA, 20 nt, Artificial Sequence
  TRAC targeting sequence
acuaauccccacuuuccuuu

SEQ ID NO: 20676 - RNA, 20 nt, Artificial Sequence
  TRAC targeting sequence
ucuacuaauccccacuuucc

SEQ ID NO: 20677 - RNA, 20 nt, Artificial Sequence
  TRAC targeting sequence
ggugagucaaugcuucacag

SEQ ID NO: 20678 - RNA, 20 nt, Artificial Sequence
  TRAC targeting sequence
ccugaccacuuccucuacua

SEQ ID NO: 20679 - RNA, 20 nt, Artificial Sequence
  TRAC targeting sequence
augcuucacaguuuugccaa

SEQ ID NO: 20680 - RNA, 20 nt, Artificial Sequence
  TRAC targeting sequence
caguuuugccaagagcuaaa

SEQ ID NO: 20681 - RNA, 20 nt, Artificial Sequence
  TRAC targeting sequence
uggcaaaacugugaagcauu

SEQ ID NO: 20682 - RNA, 20 nt, Artificial Sequence
  TRAC targeting sequence
agaacuucagaacaaggaaa

SEQ ID NO: 20683 - RNA, 20 nt, Artificial Sequence
  TRAC targeting sequence
ugacaaguuacuuuagcucu

SEQ ID NO: 20684 - RNA, 20 nt, Artificial Sequence
  TRAC targeting sequence
gaacaaggaaagccugagug

SEQ ID NO: 20685 - RNA, 20 nt, Artificial Sequence
  TRAC targeting sequence
gaaguucuugacaaguuacu

SEQ ID NO: 20686 - RNA, 20 nt, Artificial Sequence
  TRAC targeting sequence
uuguucugaaguucuugaca

SEQ ID NO: 20687 - RNA, 20 nt, Artificial Sequence
  TRAC targeting sequence
ggcuuuccuuguucugaagu

SEQ ID NO: 20688 - RNA, 20 nt, Artificial Sequence
  TRAC targeting sequence
gggcagcccccaggcaggca

SEQ ID NO: 20689 - RNA, 20 nt, Artificial Sequence
  TRAC targeting sequence
auccaacaaagccuggagga

SEQ ID NO: 20690 - RNA, 20 nt, Artificial Sequence
  TRAC targeting sequence
aacaaagccuggaggacagg

SEQ ID NO: 20691 - RNA, 20 nt, Artificial Sequence
  TRAC targeting sequence
aggcuuuguuggauagaugu

SEQ ID NO: 20692 - RNA, 20 nt, Artificial Sequence
  TRAC targeting sequence
uccaggcuuuguuggauaga

SEQ ID NO: 20693 - RNA, 20 nt, Artificial Sequence
  TRAC targeting sequence
cuguccuccaggcuuuguug

SEQ ID NO: 20694 - RNA, 20 nt, Artificial Sequence
  TRAC targeting sequence
cgcaggguaccugggagucu

SEQ ID NO: 20695 - RNA, 20 nt, Artificial Sequence
  TRAC targeting sequence
cagguacccugcgugauuua

SEQ ID NO: 20696 - RNA, 20 nt, Artificial Sequence
  TRAC targeting sequence
gaccucacugugugaccaca

SEQ ID NO: 20697 - RNA, 20 nt, Artificial Sequence
  TRAC targeting sequence
gacucccagguacccugcgu

SEQ ID NO: 20698 - RNA, 20 nt, Artificial Sequence
  TRAC targeting sequence
cugugugaccacacugaggu

SEQ ID NO: 20699 - RNA, 20 nt, Artificial Sequence
  TRAC targeting sequence
cacagugaggucagacuccc

SEQ ID NO: 20700 - RNA, 20 nt, Artificial Sequence
  TRAC targeting sequence
guguggucacacagugaggu

SEQ ID NO: 20701 - RNA, 20 nt, Artificial Sequence
  TRAC targeting sequence
agagccaacagucacuuuau

SEQ ID NO: 20702 - RNA, 20 nt, Artificial Sequence
  TRAC targeting sequence
ggaccucaguguggucacac

SEQ ID NO: 20703 - RNA, 20 nt, Artificial Sequence
  TRAC targeting sequence
cuuuauguggguucgccuca

SEQ ID NO: 20704 - RNA, 20 nt, Artificial Sequence
  TRAC targeting sequence
ccucaguuucuccaugaguc

SEQ ID NO: 20705 - RNA, 20 nt, Artificial Sequence
  TRAC targeting sequence
guuucuccaugaguccuacu

SEQ ID NO: 20706 - RNA, 20 nt, Artificial Sequence
  TRAC targeting sequence
ccaugaguccuacucuaaaa

SEQ ID NO: 20707 - RNA, 20 nt, Artificial Sequence
  TRAC targeting sequence
augaguccuacucuaaaacc

SEQ ID NO: 20708 - RNA, 20 nt, Artificial Sequence
  TRAC targeting sequence
uggagaaacugaggcgaacc

SEQ ID NO: 20709 - RNA, 20 nt, Artificial Sequence
  TRAC targeting sequence
uacucuaaaacccaucuacc

SEQ ID NO: 20710 - RNA, 20 nt, Artificial Sequence
  TRAC targeting sequence
aaaacccaucuaccuccgug

SEQ ID NO: 20711 - RNA, 20 nt, Artificial Sequence
  TRAC targeting sequence
accuccgugagccaugugug

SEQ ID NO: 20712 - RNA, 20 nt, Artificial Sequence
  TRAC targeting sequence
gugagccaugugugggaaga

SEQ ID NO: 20713 - RNA, 20 nt, Artificial Sequence
  TRAC targeting sequence
cggagguagauggguuuuag

SEQ ID NO: 20714 - RNA, 20 nt, Artificial Sequence
  TRAC targeting sequence
cacacauggcucacggaggu

SEQ ID NO: 20715 - RNA, 20 nt, Artificial Sequence
  TRAC targeting sequence
ucccacacauggcucacgga

SEQ ID NO: 20716 - RNA, 20 nt, Artificial Sequence
  TRAC targeting sequence
ucuucccacacauggcucac

SEQ ID NO: 20717 - RNA, 20 nt, Artificial Sequence
  TRAC targeting sequence
gacugggaugagucuggggg

SEQ ID NO: 20718 - RNA, 20 nt, Artificial Sequence
  TRAC targeting sequence
gaagcucgucuucccacaca

SEQ ID NO: 20719 - RNA, 20 nt, Artificial Sequence
  TRAC targeting sequence
cagucagaagcucgucuucc

SEQ ID NO: 20720 - RNA, 20 nt, Artificial Sequence
  TRAC targeting sequence
ucccagucagaagcucgucu

SEQ ID NO: 20721 - RNA, 20 nt, Artificial Sequence
  TRAC targeting sequence
gggggagcaagcacauggag

SEQ ID NO: 20722 - RNA, 20 nt, Artificial Sequence
  TRAC targeting sequence
cccagacucaucccagucag

SEQ ID NO: 20723 - RNA, 20 nt, Artificial Sequence
  TRAC targeting sequence
augugcuugcucccccagac

SEQ ID NO: 20724 - RNA, 20 nt, Artificial Sequence
  TRAC targeting sequence
ccaugugcuugcucccccag

SEQ ID NO: 20725 - RNA, 20 nt, Artificial Sequence
  TRAC targeting sequence
uucuggcugccggaaggcug

SEQ ID NO: 20726 - RNA, 20 nt, Artificial Sequence
  TRAC targeting sequence
ggcugccggaaggcugcagg

SEQ ID NO: 20727 - RNA, 20 nt, Artificial Sequence
  TRAC targeting sequence
ggcagccagaaugacagcac

SEQ ID NO: 20728 - RNA, 20 nt, Artificial Sequence
  TRAC targeting sequence
ugcagccuuccggcagccag

SEQ ID NO: 20729 - RNA, 20 nt, Artificial Sequence
  TRAC targeting sequence
gugucaaggccaccugggca

SEQ ID NO: 20730 - RNA, 20 nt, Artificial Sequence
  TRAC targeting sequence
aggccaccugggcaacgcgg

SEQ ID NO: 20731 - RNA, 20 nt, Artificial Sequence
  TRAC targeting sequence
ccgcguugcccagguggccu

SEQ ID NO: 20732 - RNA, 20 nt, Artificial Sequence
  TRAC targeting sequence
ccaccccucgccgcguugcc

SEQ ID NO: 20733 - RNA, 20 nt, Artificial Sequence
  TRAC targeting sequence
uuucacacagagacacacag

SEQ ID NO: 20734 - RNA, 20 nt, Artificial Sequence
  TRAC targeting sequence
cacagagacacacaggccug

SEQ ID NO: 20735 - RNA, 20 nt, Artificial Sequence
  TRAC targeting sequence
gugugaaaggaggccugcac

SEQ ID NO: 20736 - RNA, 20 nt, Artificial Sequence
  TRAC targeting sequence
cugugugaaaggaggccugc

SEQ ID NO: 20737 - RNA, 20 nt, Artificial Sequence
  TRAC targeting sequence
ggccugugugucucugugug

SEQ ID NO: 20738 - RNA, 20 nt, Artificial Sequence
  TRAC targeting sequence
cuggguagcacacauagagc

SEQ ID NO: 20739 - RNA, 20 nt, Artificial Sequence
  TRAC targeting sequence
ggguagcacacauagagcua

SEQ ID NO: 20740 - RNA, 20 nt, Artificial Sequence
  TRAC targeting sequence
augugugcuacccagagagg

SEQ ID NO: 20741 - RNA, 20 nt, Artificial Sequence
  TRAC targeting sequence
gacauugagucaguagccac

SEQ ID NO: 20742 - RNA, 20 nt, Artificial Sequence
  TRAC targeting sequence
gaccuguuuauuaauugcaa

SEQ ID NO: 20743 - RNA, 20 nt, Artificial Sequence
  TRAC targeting sequence
augucugaccuguuuauuaa

SEQ ID NO: 20744 - RNA, 20 nt, Artificial Sequence
  TRAC targeting sequence
guagccacaaguagaacagg

SEQ ID NO: 20745 - RNA, 20 nt, Artificial Sequence
  TRAC targeting sequence
acuuguggcuacugacucaa

SEQ ID NO: 20746 - RNA, 20 nt, Artificial Sequence
  TRAC targeting sequence
uguucuacuuguggcuacug

SEQ ID NO: 20747 - RNA, 20 nt, Artificial Sequence
  TRAC targeting sequence
acuuccuguucuacuugugg

SEQ ID NO: 20748 - RNA, 20 nt, Artificial Sequence
  TRAC targeting sequence
cccacuucccuccagguguu

SEQ ID NO: 20749 - RNA, 20 nt, Artificial Sequence
  TRAC targeting sequence
cacuucccuccagguguuug

SEQ ID NO: 20750 - RNA, 20 nt, Artificial Sequence
  TRAC targeting sequence
cuccagguguuugggggcug

SEQ ID NO: 20751 - RNA, 20 nt, Artificial Sequence
  TRAC targeting sequence
agguguuugggggcuggggc

SEQ ID NO: 20752 - RNA, 20 nt, Artificial Sequence
  TRAC targeting sequence
ccucccauuuccaugacguc

SEQ ID NO: 20753 - RNA, 20 nt, Artificial Sequence
  TRAC targeting sequence
cauuuccaugacgucauggu

SEQ ID NO: 20754 - RNA, 20 nt, Artificial Sequence
  TRAC targeting sequence
augacgucaugguuaccaag

SEQ ID NO: 20755 - RNA, 20 nt, Artificial Sequence
  TRAC targeting sequence
uggaaaugggaggggaccgc

SEQ ID NO: 20756 - RNA, 20 nt, Artificial Sequence
  TRAC targeting sequence
ugguuaccaagaggggcaag

SEQ ID NO: 20757 - RNA, 20 nt, Artificial Sequence
  TRAC targeting sequence
ugguaaccaugacgucaugg

SEQ ID NO: 20758 - RNA, 20 nt, Artificial Sequence
  TRAC targeting sequence
aagggugcccuacuugcccc

SEQ ID NO: 20759 - RNA, 20 nt, Artificial Sequence
  TRAC targeting sequence
cccgcagaagccacauccuc

SEQ ID NO: 20760 - RNA, 20 nt, Artificial Sequence
  TRAC targeting sequence
cgcagaagccacauccucug

SEQ ID NO: 20761 - RNA, 20 nt, Artificial Sequence
  TRAC targeting sequence
gcgggagagcuucaaagggu

SEQ ID NO: 20762 - RNA, 20 nt, Artificial Sequence
  TRAC targeting sequence
ucuggaaagaagaguuuaaa

SEQ ID NO: 20763 - RNA, 20 nt, Artificial Sequence
  TRAC targeting sequence
ggaaagaagaguuuaaaaua

SEQ ID NO: 20764 - RNA, 20 nt, Artificial Sequence
  TRAC targeting sequence
agaggauguggcuucugcgg

SEQ ID NO: 20765 - RNA, 20 nt, Artificial Sequence
  TRAC targeting sequence
uuccagaggauguggcuucu

SEQ ID NO: 20766 - RNA, 20 nt, Artificial Sequence
  TRAC targeting sequence
ucuuuccagaggauguggcu

SEQ ID NO: 20767 - RNA, 20 nt, Artificial Sequence
  TRAC targeting sequence
guauuuuaaacucuucuuuc

SEQ ID NO: 20768 - RNA, 20 nt, Artificial Sequence
  TRAC targeting sequence
aacucaguauuuuaaacucu

SEQ ID NO: 20769 - RNA, 20 nt, Artificial Sequence
  TRAC targeting sequence
cuaacucaguauuuuaaacu

SEQ ID NO: 20770 - RNA, 20 nt, Artificial Sequence
  TRAC targeting sequence
ccccaggccacgugccgagg

SEQ ID NO: 20771 - RNA, 20 nt, Artificial Sequence
  TRAC targeting sequence
gcacguggccuggggcgaug

SEQ ID NO: 20772 - RNA, 20 nt, Artificial Sequence
  TRAC targeting sequence
ccucggcacguggccugggg

SEQ ID NO: 20773 - RNA, 20 nt, Artificial Sequence
  TRAC targeting sequence
cagccuggcauguuggccuu

SEQ ID NO: 20774 - RNA, 20 nt, Artificial Sequence
  TRAC targeting sequence
gugacuugcaccgggcccgc

SEQ ID NO: 20775 - RNA, 20 nt, Artificial Sequence
  TRAC targeting sequence
ccgaggggccggcagccccu

SEQ ID NO: 20776 - RNA, 20 nt, Artificial Sequence
  TRAC targeting sequence
ccagccugcuugcgggcccg

SEQ ID NO: 20777 - RNA, 20 nt, Artificial Sequence
  TRAC targeting sequence
gcgguggggccagcagcacc

SEQ ID NO: 20778 - RNA, 20 nt, Artificial Sequence
  TRAC targeting sequence
cucaccgcaccucugcugcc

SEQ ID NO: 20779 - RNA, 20 nt, Artificial Sequence
  TRAC targeting sequence
ccgcaccucugcugccccuc

SEQ ID NO: 20780 - RNA, 20 nt, Artificial Sequence
  TRAC targeting sequence
gcugccccuccaaaccagcc

SEQ ID NO: 20781 - RNA, 20 nt, Artificial Sequence
  TRAC targeting sequence
aaaccagccaagaucagacc

SEQ ID NO: 20782 - RNA, 20 nt, Artificial Sequence
  TRAC targeting sequence
uggcugguuuggaggggcag

SEQ ID NO: 20783 - RNA, 20 nt, Artificial Sequence
  TRAC targeting sequence
gaccuugaucucaccugauu

SEQ ID NO: 20784 - RNA, 20 nt, Artificial Sequence
  TRAC targeting sequence
gaucuuggcugguuuggagg

SEQ ID NO: 20785 - RNA, 20 nt, Artificial Sequence
  TRAC targeting sequence
aggucugaucuuggcugguu

SEQ ID NO: 20786 - RNA, 20 nt, Artificial Sequence
  TRAC targeting sequence
caccugauuaagcgcuugcu

SEQ ID NO: 20787 - RNA, 20 nt, Artificial Sequence
  TRAC targeting sequence
ccugauuaagcgcuugcuua

SEQ ID NO: 20788 - RNA, 20 nt, Artificial Sequence
  TRAC targeting sequence
ggugagaucaaggucugauc

SEQ ID NO: 20789 - RNA, 20 nt, Artificial Sequence
  TRAC targeting sequence
gcccuguacuaagcaagcgc

SEQ ID NO: 20790 - RNA, 20 nt, Artificial Sequence
  TRAC targeting sequence
agacuuaugcucaggccagu

SEQ ID NO: 20791 - RNA, 20 nt, Artificial Sequence
  TRAC targeting sequence
agggucugcccuguacuaag

SEQ ID NO: 20792 - RNA, 20 nt, Artificial Sequence
  TRAC targeting sequence
cgagggucugcccuguacua

SEQ ID NO: 20793 - RNA, 20 nt, Artificial Sequence
  TRAC targeting sequence
ggccagugucuccugggagg

SEQ ID NO: 20794 - RNA, 20 nt, Artificial Sequence
  TRAC targeting sequence
ccugggagggaaggaggugg

SEQ ID NO: 20795 - RNA, 20 nt, Artificial Sequence
  TRAC targeting sequence
ugggagggaaggaggugggg

SEQ ID NO: 20796 - RNA, 20 nt, Artificial Sequence
  TRAC targeting sequence
caggagacacuggccugagc

SEQ ID NO: 20797 - RNA, 20 nt, Artificial Sequence
  TRAC targeting sequence
cucccaggagacacuggccu

SEQ ID NO: 20798 - RNA, 20 nt, Artificial Sequence
  TRAC targeting sequence
uucccucccaggagacacug

SEQ ID NO: 20799 - RNA, 20 nt, Artificial Sequence
  TRAC targeting sequence
ccaccuccuucccucccagg

SEQ ID NO: 20800 - RNA, 20 nt, Artificial Sequence
  TRAC targeting sequence
gugugggggcaaauacggcc

SEQ ID NO: 20801 - RNA, 20 nt, Artificial Sequence
  TRAC targeting sequence
gcccuagcucuguguggggg

SEQ ID NO: 20802 - RNA, 20 nt, Artificial Sequence
  TRAC targeting sequence
cugagggacccccccccaau

SEQ ID NO: 20803 - RNA, 20 nt, Artificial Sequence
  TRAC targeting sequence
gagggacccccccccaauag

SEQ ID NO: 20804 - RNA, 20 nt, Artificial Sequence
  TRAC targeting sequence
gagaaucagcccuagcucug

SEQ ID NO: 20805 - RNA, 20 nt, Artificial Sequence
  TRAC targeting sequence
cucagagaaucagcccuagc

SEQ ID NO: 20806 - RNA, 20 nt, Artificial Sequence
  TRAC targeting sequence
ccccuuacccugaugcuugu

SEQ ID NO: 20807 - RNA, 20 nt, Artificial Sequence
  TRAC targeting sequence
ggguaaggggggaggugcua

SEQ ID NO: 20808 - RNA, 20 nt, Artificial Sequence
  TRAC targeting sequence
auuaggugauggcccuaaug

SEQ ID NO: 20809 - RNA, 20 nt, Artificial Sequence
  TRAC targeting sequence
ccuaauggacaagcaucagg

SEQ ID NO: 20810 - RNA, 20 nt, Artificial Sequence
  TRAC targeting sequence
auuagggccaucaccuaaug

SEQ ID NO: 20811 - RNA, 20 nt, Artificial Sequence
  TRAC targeting sequence
aggcguccauuagggccauc

SEQ ID NO: 20812 - RNA, 20 nt, Artificial Sequence
  TRAC targeting sequence
aucaaggcguccauuagggc

SEQ ID NO: 20813 - RNA, 20 nt, Artificial Sequence
  TRAC targeting sequence
gggacccagggacccggaga

SEQ ID NO: 20814 - RNA, 20 nt, Artificial Sequence
  TRAC targeting sequence
cggacguguccaucaaggcg

SEQ ID NO: 20815 - RNA, 20 nt, Artificial Sequence
  TRAC targeting sequence
cugggucccggacgugucca

SEQ ID NO: 20816 - RNA, 20 nt, Artificial Sequence
  TRAC targeting sequence
gggucccugggucccggacg

SEQ ID NO: 20817 - RNA, 20 nt, Artificial Sequence
  TRAC targeting sequence
ccgggucccugggucccgga

SEQ ID NO: 20818 - RNA, 20 nt, Artificial Sequence
  TRAC targeting sequence
uggucuccgggucccugggu

SEQ ID NO: 20819 - RNA, 20 nt, Artificial Sequence
  TRAC targeting sequence
gcuggucucagggagccgca

SEQ ID NO: 20820 - RNA, 20 nt, Artificial Sequence
  TRAC targeting sequence
cagggagccgcagaaccuga

SEQ ID NO: 20821 - RNA, 20 nt, Artificial Sequence
  TRAC targeting sequence
gggagccgcagaaccugaaa

SEQ ID NO: 20822 - RNA, 20 nt, Artificial Sequence
  TRAC targeting sequence
cugagaccagcagauuccug

SEQ ID NO: 20823 - RNA, 20 nt, Artificial Sequence
  TRAC targeting sequence
gcggcucccugagaccagca

SEQ ID NO: 20824 - RNA, 20 nt, Artificial Sequence
  TRAC targeting sequence
gguucugcggcucccugaga

SEQ ID NO: 20825 - RNA, 20 nt, Artificial Sequence
  TRAC targeting sequence
agccugguauuuuuggguuu

SEQ ID NO: 20826 - RNA, 20 nt, Artificial Sequence
  TRAC targeting sequence
ccugcucuucgguagugucg

SEQ ID NO: 20827 - RNA, 20 nt, Artificial Sequence
  TRAC targeting sequence
ucgguagugucgccauccac

SEQ ID NO: 20828 - RNA, 20 nt, Artificial Sequence
  TRAC targeting sequence
guagugucgccauccacccg

SEQ ID NO: 20829 - RNA, 20 nt, Artificial Sequence
  TRAC targeting sequence
ccauccacccgcaugggggc

SEQ ID NO: 20830 - RNA, 20 nt, Artificial Sequence
  TRAC targeting sequence
acccgcaugggggcagcagc

SEQ ID NO: 20831 - RNA, 20 nt, Artificial Sequence
  TRAC targeting sequence
accaaaaagaccucuucucc

SEQ ID NO: 20832 - RNA, 20 nt, Artificial Sequence
  TRAC targeting sequence
uuuugguggagcgcugcugc

SEQ ID NO: 20833 - RNA, 20 nt, Artificial Sequence
  TRAC targeting sequence
ucucccuuugucuguuaauu

SEQ ID NO: 20834 - RNA, 20 nt, Artificial Sequence
  TRAC targeting sequence
cccuuugucuguuaauucug

SEQ ID NO: 20835 - RNA, 20 nt, Artificial Sequence
  TRAC targeting sequence
cuuugucuguuaauucugga

SEQ ID NO: 20836 - RNA, 20 nt, Artificial Sequence
  TRAC targeting sequence
guuaauucuggagauagaaa

SEQ ID NO: 20837 - RNA, 20 nt, Artificial Sequence
  TRAC targeting sequence
ggagauagaaagcccccaaa

SEQ ID NO: 20838 - RNA, 20 nt, Artificial Sequence
  TRAC targeting sequence
agaauuaacagacaaaggga

SEQ ID NO: 20839 - RNA, 20 nt, Artificial Sequence
  TRAC targeting sequence
ccagaauuaacagacaaagg

SEQ ID NO: 20840 - RNA, 20 nt, Artificial Sequence
  TRAC targeting sequence
aucuccagaauuaacagaca

SEQ ID NO: 20841 - RNA, 20 nt, Artificial Sequence
  TRAC targeting sequence
uaaacuuugggggcuuucua

SEQ ID NO: 20842 - RNA, 20 nt, Artificial Sequence
  TRAC targeting sequence
uuuccgaggaaaauaaaagg

SEQ ID NO: 20843 - RNA, 20 nt, Artificial Sequence
  TRAC targeting sequence
gaggaaaauaaaagggcagg

SEQ ID NO: 20844 - RNA, 20 nt, Artificial Sequence
  TRAC targeting sequence
gaaaagagcuuuuccuaaac

SEQ ID NO: 20845 - RNA, 20 nt, Artificial Sequence
  TRAC targeting sequence
ucggaaaagagcuuuuccua

SEQ ID NO: 20846 - RNA, 20 nt, Artificial Sequence
  TRAC targeting sequence
ccugcccuuuuauuuuccuc

SEQ ID NO: 20847 - RNA, 20 nt, Artificial Sequence
  TRAC targeting sequence
cacaagucccugcccugugc

SEQ ID NO: 20848 - RNA, 20 nt, Artificial Sequence
  TRAC targeting sequence
cugcccugugcccgucacug

SEQ ID NO: 20849 - RNA, 20 nt, Artificial Sequence
  TRAC targeting sequence
cugcgcugggcgcaaggccu

SEQ ID NO: 20850 - RNA, 20 nt, Artificial Sequence
  TRAC targeting sequence
uccugucacaucccccccca

SEQ ID NO: 20851 - RNA, 20 nt, Artificial Sequence
  TRAC targeting sequence
ugucacauccccccccaaag

SEQ ID NO: 20852 - RNA, 20 nt, Artificial Sequence
  TRAC targeting sequence
cauccccccccaaaggagag

SEQ ID NO: 20853 - RNA, 20 nt, Artificial Sequence
  TRAC targeting sequence
ccccccaaaggagaggaggg

SEQ ID NO: 20854 - RNA, 20 nt, Artificial Sequence
  TRAC targeting sequence
uuuggggggggaugugacag

SEQ ID NO: 20855 - RNA, 20 nt, Artificial Sequence
  TRAC targeting sequence
ccuuuggggggggaugugac

SEQ ID NO: 20856 - RNA, 20 nt, Artificial Sequence
  TRAC targeting sequence
ucuccuuuggggggggaugu

SEQ ID NO: 20857 - RNA, 20 nt, Artificial Sequence
  TRAC targeting sequence
uccgggaucgucagacccgc

SEQ ID NO: 20858 - RNA, 20 nt, Artificial Sequence
  TRAC targeting sequence
gggaucgucagacccgcucc

SEQ ID NO: 20859 - RNA, 20 nt, Artificial Sequence
  TRAC targeting sequence
cggacgaacagcgcccccug

SEQ ID NO: 20860 - RNA, 20 nt, Artificial Sequence
  TRAC targeting sequence
ucagacccgcuccacccgga

SEQ ID NO: 20861 - RNA, 20 nt, Artificial Sequence
  TRAC targeting sequence
gacccgcuccacccggagcc

SEQ ID NO: 20862 - RNA, 20 nt, Artificial Sequence
  TRAC targeting sequence
gacgaucccggacgaacagc

SEQ ID NO: 20863 - RNA, 20 nt, Artificial Sequence
  TRAC targeting sequence
acccggagcccuggaggaag

SEQ ID NO: 20864 - RNA, 20 nt, Artificial Sequence
  TRAC targeting sequence
ggguggagcgggucugacga

SEQ ID NO: 20865 - RNA, 20 nt, Artificial Sequence
  TRAC targeting sequence
agggcuccggguggagcggg

SEQ ID NO: 20866 - RNA, 20 nt, Artificial Sequence
  TRAC targeting sequence
uccagggcuccggguggagc

SEQ ID NO: 20867 - RNA, 20 nt, Artificial Sequence
  TRAC targeting sequence
cugggcacuuccuccagggc

SEQ ID NO: 20868 - RNA, 20 nt, Artificial Sequence
  TRAC targeting sequence
gggcccccagcccucccugg

SEQ ID NO: 20869 - RNA, 20 nt, Artificial Sequence
  TRAC targeting sequence
uccgggcccccagcccuccc

SEQ ID NO: 20870 - RNA, 20 nt, Artificial Sequence
  TRAC targeting sequence
gaauuaggcuggcuggaguc

SEQ ID NO: 20871 - RNA, 20 nt, Artificial Sequence
  TRAC targeting sequence
gaacccaaggccuccuccgg

SEQ ID NO: 20872 - RNA, 20 nt, Artificial Sequence
  TRAC targeting sequence
agccagccuaauuccgaacc

SEQ ID NO: 20873 - RNA, 20 nt, Artificial Sequence
  TRAC targeting sequence
gggauccaccacaucauaca

SEQ ID NO: 20874 - RNA, 20 nt, Artificial Sequence
  TRAC targeting sequence
cggacuccagccagccuaau

SEQ ID NO: 20875 - RNA, 20 nt, Artificial Sequence
  TRAC targeting sequence
accacaucauacacucgugc

SEQ ID NO: 20876 - RNA, 20 nt, Artificial Sequence
  TRAC targeting sequence
uacacucgugccuuuggcag

SEQ ID NO: 20877 - RNA, 20 nt, Artificial Sequence
  TRAC targeting sequence
ugccuuuggcaggucacuaa

SEQ ID NO: 20878 - RNA, 20 nt, Artificial Sequence
  TRAC targeting sequence
cuaaccgcccaccgccucag

SEQ ID NO: 20879 - RNA, 20 nt, Artificial Sequence
  TRAC targeting sequence
guuucccggugggacgaacu

SEQ ID NO: 20880 - RNA, 20 nt, Artificial Sequence
  TRAC targeting sequence
cggugggacgaacucucucu

SEQ ID NO: 20881 - RNA, 20 nt, Artificial Sequence
  TRAC targeting sequence
caccgggaaacugaggcggu

SEQ ID NO: 20882 - RNA, 20 nt, Artificial Sequence
  TRAC targeting sequence
ucccaccgggaaacugaggc

SEQ ID NO: 20883 - RNA, 20 nt, Artificial Sequence
  TRAC targeting sequence
cucucacagguaguuuaaga

SEQ ID NO: 20884 - RNA, 20 nt, Artificial Sequence
  TRAC targeting sequence
cucacagguaguuuaagaac

SEQ ID NO: 20885 - RNA, 20 nt, Artificial Sequence
  TRAC targeting sequence
cacagguaguuuaagaacca

SEQ ID NO: 20886 - RNA, 20 nt, Artificial Sequence
  TRAC targeting sequence
cagguaguuuaagaaccagg

SEQ ID NO: 20887 - RNA, 20 nt, Artificial Sequence
  TRAC targeting sequence
uaaacuaccugugagagaga

SEQ ID NO: 20888 - RNA, 20 nt, Artificial Sequence
  TRAC targeting sequence
uuggcauuguauaccugcca

SEQ ID NO: 20889 - RNA, 20 nt, Artificial Sequence
  TRAC targeting sequence
ugcucuggggauucagucuc

SEQ ID NO: 20890 - RNA, 20 nt, Artificial Sequence
  TRAC targeting sequence
ggggauucagucucugugca

SEQ ID NO: 20891 - RNA, 20 nt, Artificial Sequence
  TRAC targeting sequence
ccagagcacgacacagccug

SEQ ID NO: 20892 - RNA, 20 nt, Artificial Sequence
  TRAC targeting sequence
gucucugugcaaacuaugac

SEQ ID NO: 20893 - RNA, 20 nt, Artificial Sequence
  TRAC targeting sequence
cugugcaaacuaugacucca

SEQ ID NO: 20894 - RNA, 20 nt, Artificial Sequence
  TRAC targeting sequence
gugcaaacuaugacuccaua

SEQ ID NO: 20895 - RNA, 20 nt, Artificial Sequence
  TRAC targeting sequence
uaguuugcacagagacugaa

SEQ ID NO: 20896 - RNA, 20 nt, Artificial Sequence
  TRAC targeting sequence
auacagaugaaguccaagaa

SEQ ID NO: 20897 - RNA, 20 nt, Artificial Sequence
  TRAC targeting sequence
guauggagucauaguuugca

SEQ ID NO: 20898 - RNA, 20 nt, Artificial Sequence
  TRAC targeting sequence
ucuguauggagucauaguuu

SEQ ID NO: 20899 - RNA, 20 nt, Artificial Sequence
  TRAC targeting sequence
aagaacaggcaaaacgcauc

SEQ ID NO: 20900 - RNA, 20 nt, Artificial Sequence
  TRAC targeting sequence
uggacuucaucuguauggag

SEQ ID NO: 20901 - RNA, 20 nt, Artificial Sequence
  TRAC targeting sequence
caggugauagaaauuagggc

SEQ ID NO: 20902 - RNA, 20 nt, Artificial Sequence
  TRAC targeting sequence
ccugugaugcguuuugccug

SEQ ID NO: 20903 - RNA, 20 nt, Artificial Sequence
  TRAC targeting sequence
aucaccugugaugcguuuug

SEQ ID NO: 20904 - RNA, 20 nt, Artificial Sequence
  TRAC targeting sequence
gggguagaaggauggauuga

SEQ ID NO: 20905 - RNA, 20 nt, Artificial Sequence
  TRAC targeting sequence
accccagaggcaaacagugc

SEQ ID NO: 20906 - RNA, 20 nt, Artificial Sequence
  TRAC targeting sequence
uucuaccccagaggcaaaca

SEQ ID NO: 20907 - RNA, 20 nt, Artificial Sequence
  TRAC targeting sequence
auccuucuaccccagaggca

SEQ ID NO: 20908 - RNA, 20 nt, Artificial Sequence
  TRAC targeting sequence
auccauccuucuaccccaga

SEQ ID NO: 20909 - RNA, 20 nt, Artificial Sequence
  TRAC targeting sequence
ugccccuuuucaauccaucc

SEQ ID NO: 20910 - RNA, 20 nt, Artificial Sequence
  TRAC targeting sequence
ucgugccccuuuucaaucca

SEQ ID NO: 20911 - RNA, 20 nt, Artificial Sequence
  TRAC targeting sequence
ggggugguggaaauguucca

SEQ ID NO: 20912 - RNA, 20 nt, Artificial Sequence
  TRAC targeting sequence
accaccccugaagguuuccu

SEQ ID NO: 20913 - RNA, 20 nt, Artificial Sequence
  TRAC targeting sequence
auaucuuuaucuugggugau

SEQ ID NO: 20914 - RNA, 20 nt, Artificial Sequence
  TRAC targeting sequence
uuaucuugggugauggcuau

SEQ ID NO: 20915 - RNA, 20 nt, Artificial Sequence
  TRAC targeting sequence
ugggugauggcuauauauau

SEQ ID NO: 20916 - RNA, 20 nt, Artificial Sequence
  TRAC targeting sequence
cccaagauaaagauauggaa

SEQ ID NO: 20917 - RNA, 20 nt, Artificial Sequence
  TRAC targeting sequence
aaugcaucauuaguguauuu

SEQ ID NO: 20918 - RNA, 20 nt, Artificial Sequence
  TRAC targeting sequence
uuaguguauuuucauguaau

SEQ ID NO: 20919 - RNA, 20 nt, Artificial Sequence
  TRAC targeting sequence
uguaauuaugccucaagaaa

SEQ ID NO: 20920 - RNA, 20 nt, Artificial Sequence
  TRAC targeting sequence
agaaaguacugcucccauua

SEQ ID NO: 20921 - RNA, 20 nt, Artificial Sequence
  TRAC targeting sequence
ugaggcauaauuacaugaaa

SEQ ID NO: 20922 - RNA, 20 nt, Artificial Sequence
  TRAC targeting sequence
cauuaaauacacacacacac

SEQ ID NO: 20923 - RNA, 20 nt, Artificial Sequence
  TRAC targeting sequence
gugugugugugugugugugu

SEQ ID NO: 20924 - RNA, 20 nt, Artificial Sequence
  TRAC targeting sequence
gucuucaaggaguuaacagu

SEQ ID NO: 20925 - RNA, 20 nt, Artificial Sequence
  TRAC targeting sequence
ucaaggaguuaacaguccag

SEQ ID NO: 20926 - RNA, 20 nt, Artificial Sequence
  TRAC targeting sequence
aggaguuaacaguccaguga

SEQ ID NO: 20927 - RNA, 20 nt, Artificial Sequence
  TRAC targeting sequence
uugaagacagaaacucugug

SEQ ID NO: 20928 - RNA, 20 nt, Artificial Sequence
  TRAC targeting sequence
agugaguaguggguaugaaa

SEQ ID NO: 20929 - RNA, 20 nt, Artificial Sequence
  TRAC targeting sequence
cuggacuguuaacuccuuga

SEQ ID NO: 20930 - RNA, 20 nt, Artificial Sequence
  TRAC targeting sequence
uacccacuacucacuggacu

SEQ ID NO: 20931 - RNA, 20 nt, Artificial Sequence
  TRAC targeting sequence
uucauacccacuacucacug

SEQ ID NO: 20932 - RNA, 20 nt, Artificial Sequence
  TRAC targeting sequence
cuuucauacccacuacucac

SEQ ID NO: 20933 - RNA, 20 nt, Artificial Sequence
  TRAC targeting sequence
ugcaauugcagccauuaaca

SEQ ID NO: 20934 - RNA, 20 nt, Artificial Sequence
  TRAC targeting sequence
gucuugcaauugcagccauu

SEQ ID NO: 20935 - RNA, 20 nt, Artificial Sequence
  TRAC targeting sequence
ccucaggcaggaguccucag

SEQ ID NO: 20936 - RNA, 20 nt, Artificial Sequence
  TRAC targeting sequence
ucaggcaggaguccucaggc

SEQ ID NO: 20937 - RNA, 20 nt, Artificial Sequence
  TRAC targeting sequence
ggcaggaguccucaggcagg

SEQ ID NO: 20938 - RNA, 20 nt, Artificial Sequence
  TRAC targeting sequence
ugccugaggagaauauagua

SEQ ID NO: 20939 - RNA, 20 nt, Artificial Sequence
  TRAC targeting sequence
ucaggcaggaggcaggagaa

SEQ ID NO: 20940 - RNA, 20 nt, Artificial Sequence
  TRAC targeting sequence
ggcaggaggcaggagaacca

SEQ ID NO: 20941 - RNA, 20 nt, Artificial Sequence
  TRAC targeting sequence
ugccugaggacuccugccug

SEQ ID NO: 20942 - RNA, 20 nt, Artificial Sequence
  TRAC targeting sequence
ugccuccugccugaggacuc

SEQ ID NO: 20943 - RNA, 20 nt, Artificial Sequence
  TRAC targeting sequence
ccugccuccugccugaggac

SEQ ID NO: 20944 - RNA, 20 nt, Artificial Sequence
  TRAC targeting sequence
cuaagcgucacugccccuca

SEQ ID NO: 20945 - RNA, 20 nt, Artificial Sequence
  TRAC targeting sequence
cugccccucacuagccuucu

SEQ ID NO: 20946 - RNA, 20 nt, Artificial Sequence
  TRAC targeting sequence
cuagccuucucuccuggggc

SEQ ID NO: 20947 - RNA, 20 nt, Artificial Sequence
  TRAC targeting sequence
cuccuggggccuuuaauuuu

SEQ ID NO: 20948 - RNA, 20 nt, Artificial Sequence
  TRAC targeting sequence
ccuggggccuuuaauuuuuc

SEQ ID NO: 20949 - RNA, 20 nt, Artificial Sequence
  TRAC targeting sequence
uggggccuuuaauuuuucug

SEQ ID NO: 20950 - RNA, 20 nt, Artificial Sequence
  TRAC targeting sequence
gaguccccauguguuauuau

SEQ ID NO: 20951 - RNA, 20 nt, Artificial Sequence
  TRAC targeting sequence
gaaaaauuaaaggccccagg

SEQ ID NO: 20952 - RNA, 20 nt, Artificial Sequence
  TRAC targeting sequence
ccauguguuauuauucacau

SEQ ID NO: 20953 - RNA, 20 nt, Artificial Sequence
  TRAC targeting sequence
cauagagauaaaaauaccug

SEQ ID NO: 20954 - RNA, 20 nt, Artificial Sequence
  TRAC targeting sequence
augugaauaauaacacaugg

SEQ ID NO: 20955 - RNA, 20 nt, Artificial Sequence
  TRAC targeting sequence
cuaugugaauaauaacacau

SEQ ID NO: 20956 - RNA, 20 nt, Artificial Sequence
  TRAC targeting sequence
caguguuguugaagggauug

SEQ ID NO: 20957 - RNA, 20 nt, Artificial Sequence
  TRAC targeting sequence
guguuguugaagggauugaa

SEQ ID NO: 20958 - RNA, 20 nt, Artificial Sequence
  TRAC targeting sequence
acaacacugagaauaggugg

SEQ ID NO: 20959 - RNA, 20 nt, Artificial Sequence
  TRAC targeting sequence
cuucaacaacacugagaaua

SEQ ID NO: 20960 - RNA, 20 nt, Artificial Sequence
  TRAC targeting sequence
aucccuucaacaacacugag

SEQ ID NO: 20961 - RNA, 20 nt, Artificial Sequence
  TRAC targeting sequence
acacccauuacugcuuucaa

SEQ ID NO: 20962 - RNA, 20 nt, Artificial Sequence
  TRAC targeting sequence
guuuacuaagcauuccacac

SEQ ID NO: 20963 - RNA, 20 nt, Artificial Sequence
  TRAC targeting sequence
cagugcaaauaugaaguggg

SEQ ID NO: 20964 - RNA, 20 nt, Artificial Sequence
  TRAC targeting sequence
uauuugcacugggauuucag

SEQ ID NO: 20965 - RNA, 20 nt, Artificial Sequence
  TRAC targeting sequence
cacuucauauuugcacuggg

SEQ ID NO: 20966 - RNA, 20 nt, Artificial Sequence
  TRAC targeting sequence
gaaugcccaggaagacgaac

SEQ ID NO: 20967 - RNA, 20 nt, Artificial Sequence
  TRAC targeting sequence
gaugcauucccacuucauau

SEQ ID NO: 20968 - RNA, 20 nt, Artificial Sequence
  TRAC targeting sequence
ugggcauucugaugcauucc

SEQ ID NO: 20969 - RNA, 20 nt, Artificial Sequence
  TRAC targeting sequence
uccugggcauucugaugcau

SEQ ID NO: 20970 - RNA, 20 nt, Artificial Sequence
  TRAC targeting sequence
ucuuccugggcauucugaug

SEQ ID NO: 20971 - RNA, 20 nt, Artificial Sequence
  TRAC targeting sequence
ugguucgucuuccugggcau

SEQ ID NO: 20972 - RNA, 20 nt, Artificial Sequence
  TRAC targeting sequence
ggucaugguucgucuuccug

SEQ ID NO: 20973 - RNA, 20 nt, Artificial Sequence
  TRAC targeting sequence
uguucgggucaugguucguc

SEQ ID NO: 20974 - RNA, 20 nt, Artificial Sequence
  TRAC targeting sequence
gauggcacugccauacugag

SEQ ID NO: 20975 - RNA, 20 nt, Artificial Sequence
  TRAC targeting sequence
gaccuggcccagcccaucuu

SEQ ID NO: 20976 - RNA, 20 nt, Artificial Sequence
  TRAC targeting sequence
guauggcagugccaucugac

SEQ ID NO: 20977 - RNA, 20 nt, Artificial Sequence
  TRAC targeting sequence
caguauggcagugccaucug

SEQ ID NO: 20978 - RNA, 20 nt, Artificial Sequence
  TRAC targeting sequence
cacagcccgggagagcucag

SEQ ID NO: 20979 - RNA, 20 nt, Artificial Sequence
  TRAC targeting sequence
cgggcugugugaagccgcag

SEQ ID NO: 20980 - RNA, 20 nt, Artificial Sequence
  TRAC targeting sequence
cccgggcugugugaagccgc

SEQ ID NO: 20981 - RNA, 20 nt, Artificial Sequence
  TRAC targeting sequence
gaacuccccaggcccugccg

SEQ ID NO: 20982 - RNA, 20 nt, Artificial Sequence
  TRAC targeting sequence
gagcucucccgggcugugug

SEQ ID NO: 20983 - RNA, 20 nt, Artificial Sequence
  TRAC targeting sequence
ccaggcccugccggugcgcu

SEQ ID NO: 20984 - RNA, 20 nt, Artificial Sequence
  TRAC targeting sequence
cauaguauguggccaccucu

SEQ ID NO: 20985 - RNA, 20 nt, Artificial Sequence
  TRAC targeting sequence
uaguauguggccaccucucc

SEQ ID NO: 20986 - RNA, 20 nt, Artificial Sequence
  TRAC targeting sequence
ccagucacuucggcccuagg

SEQ ID NO: 20987 - RNA, 20 nt, Artificial Sequence
  TRAC targeting sequence
agucacuucggcccuaggag

SEQ ID NO: 20988 - RNA, 20 nt, Artificial Sequence
  TRAC targeting sequence
cuucggcccuaggagcuucu

SEQ ID NO: 20989 - RNA, 20 nt, Artificial Sequence
  TRAC targeting sequence
gcccuaggagcuucuuguua

SEQ ID NO: 20990 - RNA, 20 nt, Artificial Sequence
  TRAC targeting sequence
uagggccgaagugacuggag

SEQ ID NO: 20991 - RNA, 20 nt, Artificial Sequence
  TRAC targeting sequence
uguuacaccaugauuuuguc

SEQ ID NO: 20992 - RNA, 20 nt, Artificial Sequence
  TRAC targeting sequence
ugguguaacaagaagcuccu

SEQ ID NO: 20993 - RNA, 20 nt, Artificial Sequence
  TRAC targeting sequence
cuaccuccgcagcuucccac

SEQ ID NO: 20994 - RNA, 20 nt, Artificial Sequence
  TRAC targeting sequence
gcagcuucccaccuccugcu

SEQ ID NO: 20995 - RNA, 20 nt, Artificial Sequence
  TRAC targeting sequence
caccuccugcuuccggcuuc

SEQ ID NO: 20996 - RNA, 20 nt, Artificial Sequence
  TRAC targeting sequence
ugcuuccggcuuccagaagg

SEQ ID NO: 20997 - RNA, 20 nt, Artificial Sequence
  TRAC targeting sequence
ggcuuccagaaggaagcgcg

SEQ ID NO: 20998 - RNA, 20 nt, Artificial Sequence
  TRAC targeting sequence
agaaggaagcgcgugaugga

SEQ ID NO: 20999 - RNA, 20 nt, Artificial Sequence
  TRAC targeting sequence
ggaagccggaagcaggaggu

SEQ ID NO: 21000 - RNA, 20 nt, Artificial Sequence
  TRAC targeting sequence
uucuggaagccggaagcagg

SEQ ID NO: 21001 - RNA, 20 nt, Artificial Sequence
  TRAC targeting sequence
cgcgcuuccuucuggaagcc

SEQ ID NO: 21002 - RNA, 20 nt, Artificial Sequence
  TRAC targeting sequence
aucacgcgcuuccuucugga

SEQ ID NO: 21003 - RNA, 20 nt, Artificial Sequence
  TRAC targeting sequence
ccuccaucacgcgcuuccuu

SEQ ID NO: 21004 - RNA, 20 nt, Artificial Sequence
  TRAC targeting sequence
uuuccccuccaucacgcgcu

SEQ ID NO: 21005 - RNA, 20 nt, Artificial Sequence
  TRAC targeting sequence
uggcccugucauuuccccuc

SEQ ID NO: 21006 - RNA, 20 nt, Artificial Sequence
  TRAC targeting sequence
ggcugggccgaguuucugac

SEQ ID NO: 21007 - RNA, 20 nt, Artificial Sequence
  TRAC targeting sequence
gcccagccugaccgcugccu

SEQ ID NO: 21008 - RNA, 20 nt, Artificial Sequence
  TRAC targeting sequence
gacagaagccaacacuucug

SEQ ID NO: 21009 - RNA, 20 nt, Artificial Sequence
  TRAC targeting sequence
gaaacucggcccagccugac

SEQ ID NO: 21010 - RNA, 20 nt, Artificial Sequence
  TRAC targeting sequence
gucagaaacucggcccagcc

SEQ ID NO: 21011 - RNA, 20 nt, Artificial Sequence
  TRAC targeting sequence
ggccccacagugcucacggc

SEQ ID NO: 21012 - RNA, 20 nt, Artificial Sequence
  TRAC targeting sequence
cggccucccugacuccucac

SEQ ID NO: 21013 - RNA, 20 nt, Artificial Sequence
  TRAC targeting sequence
cugacuccucaccacaucac

SEQ ID NO: 21014 - RNA, 20 nt, Artificial Sequence
  TRAC targeting sequence
gggaggccgugagcacugug

SEQ ID NO: 21015 - RNA, 20 nt, Artificial Sequence
  TRAC targeting sequence
ucaccacaucacagcugaaa

SEQ ID NO: 21016 - RNA, 20 nt, Artificial Sequence
  TRAC targeting sequence
ccacaucacagcugaaaagg

SEQ ID NO: 21017 - RNA, 20 nt, Artificial Sequence
  TRAC targeting sequence
cagcugaaaaggcucacguc

SEQ ID NO: 21018 - RNA, 20 nt, Artificial Sequence
  TRAC targeting sequence
gcugugauguggugaggagu

SEQ ID NO: 21019 - RNA, 20 nt, Artificial Sequence
  TRAC targeting sequence
cgucuuaucuccccucucaa

SEQ ID NO: 21020 - RNA, 20 nt, Artificial Sequence
  TRAC targeting sequence
uaucuccccucucaaccucu

SEQ ID NO: 21021 - RNA, 20 nt, Artificial Sequence
  TRAC targeting sequence
ccccucucaaccucuggggg

SEQ ID NO: 21022 - RNA, 20 nt, Artificial Sequence
  TRAC targeting sequence
ccucucaaccucugggggcu

SEQ ID NO: 21023 - RNA, 20 nt, Artificial Sequence
  TRAC targeting sequence
caaccucugggggcuucucu

SEQ ID NO: 21024 - RNA, 20 nt, Artificial Sequence
  TRAC targeting sequence
accucugggggcuucucugc

SEQ ID NO: 21025 - RNA, 20 nt, Artificial Sequence
  TRAC targeting sequence
gggggcuucucugcuuucag

SEQ ID NO: 21026 - RNA, 20 nt, Artificial Sequence
  TRAC targeting sequence
cugcuuucagaaggagcccc

SEQ ID NO: 21027 - RNA, 20 nt, Artificial Sequence
  TRAC targeting sequence
gcuuucagaaggagccccug

SEQ ID NO: 21028 - RNA, 20 nt, Artificial Sequence
  TRAC targeting sequence
gaaggagccccuggagcccc

SEQ ID NO: 21029 - RNA, 20 nt, Artificial Sequence
  TRAC targeting sequence
gaaagcagagaagcccccag

SEQ ID NO: 21030 - RNA, 20 nt, Artificial Sequence
  TRAC targeting sequence
uucugaaagcagagaagccc

SEQ ID NO: 21031 - RNA, 20 nt, Artificial Sequence
  TRAC targeting sequence
aggggcuccuucugaaagca

SEQ ID NO: 21032 - RNA, 20 nt, Artificial Sequence
  TRAC targeting sequence
gccaggggcuccaggggcuc

SEQ ID NO: 21033 - RNA, 20 nt, Artificial Sequence
  TRAC targeting sequence
gaaagcacggagccagaccu

SEQ ID NO: 21034 - RNA, 20 nt, Artificial Sequence
  TRAC targeting sequence
gauguguucggccaggggcu

SEQ ID NO: 21035 - RNA, 20 nt, Artificial Sequence
  TRAC targeting sequence
gugcuuucagauguguucgg

SEQ ID NO: 21036 - RNA, 20 nt, Artificial Sequence
  TRAC targeting sequence
ggcuccgugcuuucagaugu

SEQ ID NO: 21037 - RNA, 20 nt, Artificial Sequence
  TRAC targeting sequence
gcagcgcccuccagcgggca

SEQ ID NO: 21038 - RNA, 20 nt, Artificial Sequence
  TRAC targeting sequence
agcgggcagguucugcgggc

SEQ ID NO: 21039 - RNA, 20 nt, Artificial Sequence
  TRAC targeting sequence
gcgggcagccaucuccucgc

SEQ ID NO: 21040 - RNA, 20 nt, Artificial Sequence
  TRAC targeting sequence
ccucgcaggccagaacaccc

SEQ ID NO: 21041 - RNA, 20 nt, Artificial Sequence
  TRAC targeting sequence
ucgcaggccagaacacccca

SEQ ID NO: 21042 - RNA, 20 nt, Artificial Sequence
  TRAC targeting sequence
caggccagaacaccccacgu

SEQ ID NO: 21043 - RNA, 20 nt, Artificial Sequence
  TRAC targeting sequence
ggccugcgaggagauggcug

SEQ ID NO: 21044 - RNA, 20 nt, Artificial Sequence
  TRAC targeting sequence
cuccaggacgguucgccacc

SEQ ID NO: 21045 - RNA, 20 nt, Artificial Sequence
  TRAC targeting sequence
aggacgguucgccaccuuug

SEQ ID NO: 21046 - RNA, 20 nt, Artificial Sequence
  TRAC targeting sequence
uggagugacgugggguguuc

SEQ ID NO: 21047 - RNA, 20 nt, Artificial Sequence
  TRAC targeting sequence
ccaccuuugagaagagagga

SEQ ID NO: 21048 - RNA, 20 nt, Artificial Sequence
  TRAC targeting sequence
aagguggcgaaccguccugg

SEQ ID NO: 21049 - RNA, 20 nt, Artificial Sequence
  TRAC targeting sequence
caaagguggcgaaccguccu

SEQ ID NO: 21050 - RNA, 20 nt, Artificial Sequence
  TRAC targeting sequence
ucucaaagguggcgaaccgu

SEQ ID NO: 21051 - RNA, 20 nt, Artificial Sequence
  TRAC targeting sequence
cuucucaaagguggcgaacc

SEQ ID NO: 21052 - RNA, 20 nt, Artificial Sequence
  TRAC targeting sequence
ucucuucucaaagguggcga

SEQ ID NO: 21053 - RNA, 20 nt, Artificial Sequence
  TRAC targeting sequence
agugucuguucgcucuggaa

SEQ ID NO: 21054 - RNA, 20 nt, Artificial Sequence
  TRAC targeting sequence
guucgcucuggaaauguggg

SEQ ID NO: 21055 - RNA, 20 nt, Artificial Sequence
  TRAC targeting sequence
cucuggaaaugugggcaugu

SEQ ID NO: 21056 - RNA, 20 nt, Artificial Sequence
  TRAC targeting sequence
ggaaaugugggcauguuccc

SEQ ID NO: 21057 - RNA, 20 nt, Artificial Sequence
  TRAC targeting sequence
agagcgaacagacacuggag

SEQ ID NO: 21058 - RNA, 20 nt, Artificial Sequence
  TRAC targeting sequence
cauuccaaaggugauaggau

SEQ ID NO: 21059 - RNA, 20 nt, Artificial Sequence
  TRAC targeting sequence
aaaggugauaggaucugagg

SEQ ID NO: 21060 - RNA, 20 nt, Artificial Sequence
  TRAC targeting sequence
ccuuuggaaugggaacaugc

SEQ ID NO: 21061 - RNA, 20 nt, Artificial Sequence
  TRAC targeting sequence
uaucaccuuuggaaugggaa

SEQ ID NO: 21062 - RNA, 20 nt, Artificial Sequence
  TRAC targeting sequence
gaggggaggauccuucccau

SEQ ID NO: 21063 - RNA, 20 nt, Artificial Sequence
  TRAC targeting sequence
gauccuaucaccuuuggaau

SEQ ID NO: 21064 - RNA, 20 nt, Artificial Sequence
  TRAC targeting sequence
ccucagauccuaucaccuuu

SEQ ID NO: 21065 - RNA, 20 nt, Artificial Sequence
  TRAC targeting sequence
uccccucagauccuaucacc

SEQ ID NO: 21066 - RNA, 20 nt, Artificial Sequence
  TRAC targeting sequence
uucccauuuucaaagccuuc

SEQ ID NO: 21067 - RNA, 20 nt, Artificial Sequence
  TRAC targeting sequence
cauuuucaaagccuuccuaa

SEQ ID NO: 21068 - RNA, 20 nt, Artificial Sequence
  TRAC targeting sequence
aagccuuccuaaaaucccac

SEQ ID NO: 21069 - RNA, 20 nt, Artificial Sequence
  TRAC targeting sequence
uaaaaucccacugauuagug

SEQ ID NO: 21070 - RNA, 20 nt, Artificial Sequence
  TRAC targeting sequence
cacugauuaguggggaggag

SEQ ID NO: 21071 - RNA, 20 nt, Artificial Sequence
  TRAC targeting sequence
gugggauuuuaggaaggcuu

SEQ ID NO: 21072 - RNA, 20 nt, Artificial Sequence
  TRAC targeting sequence
ccacuaaucagugggauuuu

SEQ ID NO: 21073 - RNA, 20 nt, Artificial Sequence
  TRAC targeting sequence
uccccacuaaucagugggau

SEQ ID NO: 21074 - RNA, 20 nt, Artificial Sequence
  TRAC targeting sequence
acccuuuccccgaaccaccc

SEQ ID NO: 21075 - RNA, 20 nt, Artificial Sequence
  TRAC targeting sequence
ccgaaccacccacaugaaau

SEQ ID NO: 21076 - RNA, 20 nt, Artificial Sequence
  TRAC targeting sequence
gggaaaggguagacuugcac

SEQ ID NO: 21077 - RNA, 20 nt, Artificial Sequence
  TRAC targeting sequence
ugugggugguucggggaaag

SEQ ID NO: 21078 - RNA, 20 nt, Artificial Sequence
  TRAC targeting sequence
uuuuuuguuguuguuguugc

SEQ ID NO: 21079 - RNA, 20 nt, Artificial Sequence
  TRAC targeting sequence
aauauuuuccuuuuuuguug

SEQ ID NO: 21080 - RNA, 20 nt, Artificial Sequence
  TRAC targeting sequence
ucuaauauuuuccuuuuuug

SEQ ID NO: 21081 - RNA, 20 nt, Artificial Sequence
  TRAC targeting sequence
uccucuaauauuuuccuuuu

SEQ ID NO: 21082 - RNA, 20 nt, Artificial Sequence
  TRAC targeting sequence
uauaaguguaagaagacaag

SEQ ID NO: 21083 - RNA, 20 nt, Artificial Sequence
  TRAC targeting sequence
uacacuuauaugaucuuccu

SEQ ID NO: 21084 - RNA, 20 nt, Artificial Sequence
  TRAC targeting sequence
ucuuacacuuauaugaucuu

SEQ ID NO: 21085 - RNA, 20 nt, Artificial Sequence
  TRAC targeting sequence
ugccagccuugucuucuuac

SEQ ID NO: 21086 - RNA, 20 nt, Artificial Sequence
  TRAC targeting sequence
uagguccugccagccuuguc

SEQ ID NO: 21087 - RNA, 20 nt, Artificial Sequence
  TRAC targeting sequence
cuuagguccugccagccuug

SEQ ID NO: 21088 - RNA, 20 nt, Artificial Sequence
  TRAC targeting sequence
agguagaugaaggaauaugg

SEQ ID NO: 21089 - RNA, 20 nt, Artificial Sequence
  TRAC targeting sequence
accuagacucucuuaggucc

SEQ ID NO: 21090 - RNA, 20 nt, Artificial Sequence
  TRAC targeting sequence
ucuaccuagacucucuuagg

SEQ ID NO: 21091 - RNA, 20 nt, Artificial Sequence
  TRAC targeting sequence
uucaucuaccuagacucucu

SEQ ID NO: 21092 - RNA, 20 nt, Artificial Sequence
  TRAC targeting sequence
ccauuauguaaaccauauuc

SEQ ID NO: 21093 - RNA, 20 nt, Artificial Sequence
  TRAC targeting sequence
ccauuucaugcuuccagccu

SEQ ID NO: 21094 - RNA, 20 nt, Artificial Sequence
  TRAC targeting sequence
auuucaugcuuccagccuug

SEQ ID NO: 21095 - RNA, 20 nt, Artificial Sequence
  TRAC targeting sequence
ugcuuccagccuugauggga

SEQ ID NO: 21096 - RNA, 20 nt, Artificial Sequence
  TRAC targeting sequence
agccuugaugggaggaaagu

SEQ ID NO: 21097 - RNA, 20 nt, Artificial Sequence
  TRAC targeting sequence
aggcuggaagcaugaaaugg

SEQ ID NO: 21098 - RNA, 20 nt, Artificial Sequence
  TRAC targeting sequence
caucaaggcuggaagcauga

SEQ ID NO: 21099 - RNA, 20 nt, Artificial Sequence
  TRAC targeting sequence
ucccaucaaggcuggaagca

SEQ ID NO: 21100 - RNA, 20 nt, Artificial Sequence
  TRAC targeting sequence
cuuuuaagguuuaccuacuu

SEQ ID NO: 21101 - RNA, 20 nt, Artificial Sequence
  TRAC targeting sequence
uuccaguggaggcugcaaga

SEQ ID NO: 21102 - RNA, 20 nt, Artificial Sequence
  TRAC targeting sequence
aguggaggcugcaagauucu

SEQ ID NO: 21103 - RNA, 20 nt, Artificial Sequence
  TRAC targeting sequence
acuggaaagaagucccuuuu

SEQ ID NO: 21104 - RNA, 20 nt, Artificial Sequence
  TRAC targeting sequence
ugcagccuccacuggaaaga

SEQ ID NO: 21105 - RNA, 20 nt, Artificial Sequence
  TRAC targeting sequence
auuuuuaccaaccucuaagg

SEQ ID NO: 21106 - RNA, 20 nt, Artificial Sequence
  TRAC targeting sequence
aagguguccaccuuauccuu

SEQ ID NO: 21107 - RNA, 20 nt, Artificial Sequence
  TRAC targeting sequence
accuuauccuugcugaccca

SEQ ID NO: 21108 - RNA, 20 nt, Artificial Sequence
  TRAC targeting sequence
uugcugacccaaguuauucc

SEQ ID NO: 21109 - RNA, 20 nt, Artificial Sequence
  TRAC targeting sequence
gcaaggauaagguggacacc

SEQ ID NO: 21110 - RNA, 20 nt, Artificial Sequence
  TRAC targeting sequence
agugauuuaccaagggaaau

SEQ ID NO: 21111 - RNA, 20 nt, Artificial Sequence
  TRAC targeting sequence
cuggaauaacuugggucagc

SEQ ID NO: 21112 - RNA, 20 nt, Artificial Sequence
  TRAC targeting sequence
cuugguaaaucacuggaaua

SEQ ID NO: 21113 - RNA, 20 nt, Artificial Sequence
  TRAC targeting sequence
acccauuucccuugguaaau

SEQ ID NO: 21114 - RNA, 20 nt, Artificial Sequence
  TRAC targeting sequence
uuccacccauuucccuuggu

SEQ ID NO: 21115 - RNA, 20 nt, Artificial Sequence
  TRAC targeting sequence
uuaucuggacuccuuauuaa

SEQ ID NO: 21116 - RNA, 20 nt, Artificial Sequence
  TRAC targeting sequence
ggacuccuuauuaacaauau

SEQ ID NO: 21117 - RNA, 20 nt, Artificial Sequence
  TRAC targeting sequence
agauaaggaugucguuccac

SEQ ID NO: 21118 - RNA, 20 nt, Artificial Sequence
  TRAC targeting sequence
uuauuaacaauauccuacau

SEQ ID NO: 21119 - RNA, 20 nt, Artificial Sequence
  TRAC targeting sequence
uacaucuguacaacaccaaa

SEQ ID NO: 21120 - RNA, 20 nt, Artificial Sequence
  TRAC targeting sequence
guacaacaccaaagcaaaca

SEQ ID NO: 21121 - RNA, 20 nt, Artificial Sequence
  TRAC targeting sequence
acucuuuugaucaaaaugau

SEQ ID NO: 21122 - RNA, 20 nt, Artificial Sequence
  TRAC targeting sequence
uuugaucaaaaugauaaacc

SEQ ID NO: 21123 - RNA, 20 nt, Artificial Sequence
  TRAC targeting sequence
aaagaguugauguuugcuuu

SEQ ID NO: 21124 - RNA, 20 nt, Artificial Sequence
  TRAC targeting sequence
aaaugauaaaccccaguggu

SEQ ID NO: 21125 - RNA, 20 nt, Artificial Sequence
  TRAC targeting sequence
uuuugaucaaaagaguugau

SEQ ID NO: 21126 - RNA, 20 nt, Artificial Sequence
  TRAC targeting sequence
accacugggguuuaucauuu

SEQ ID NO: 21127 - RNA, 20 nt, Artificial Sequence
  TRAC targeting sequence
gucuaccacugggguuuauc

SEQ ID NO: 21128 - RNA, 20 nt, Artificial Sequence
  TRAC targeting sequence
cuccucuuuuacaaaucaga

SEQ ID NO: 21129 - RNA, 20 nt, Artificial Sequence
  TRAC targeting sequence
ccucuuuuacaaaucagaag

SEQ ID NO: 21130 - RNA, 20 nt, Artificial Sequence
  TRAC targeting sequence
ucuuuuacaaaucagaaggc

SEQ ID NO: 21131 - RNA, 20 nt, Artificial Sequence
  TRAC targeting sequence
uuuacaaaucagaaggcaca

SEQ ID NO: 21132 - RNA, 20 nt, Artificial Sequence
  TRAC targeting sequence
gaaggcacauggagcggcuu

SEQ ID NO: 21133 - RNA, 20 nt, Artificial Sequence
  TRAC targeting sequence
gauuuguaaaagaggagaga

SEQ ID NO: 21134 - RNA, 20 nt, Artificial Sequence
  TRAC targeting sequence
augugccuucugauuuguaa

SEQ ID NO: 21135 - RNA, 20 nt, Artificial Sequence
  TRAC targeting sequence
ugugcaagccgcuccaugug

SEQ ID NO: 21136 - RNA, 20 nt, Artificial Sequence
  TRAC targeting sequence
cggugaacuaggcccugauc

SEQ ID NO: 21137 - RNA, 20 nt, Artificial Sequence
  TRAC targeting sequence
ccgugauccugugcaagccg

SEQ ID NO: 21138 - RNA, 20 nt, Artificial Sequence
  TRAC targeting sequence
gggccuaguucaccgugauc

SEQ ID NO: 21139 - RNA, 20 nt, Artificial Sequence
  TRAC targeting sequence
ccaccagacucggaucccag

SEQ ID NO: 21140 - RNA, 20 nt, Artificial Sequence
  TRAC targeting sequence
gguggggaucagggccuagu

SEQ ID NO: 21141 - RNA, 20 nt, Artificial Sequence
  TRAC targeting sequence
gaucccaggcuuuccaccaa

SEQ ID NO: 21142 - RNA, 20 nt, Artificial Sequence
  TRAC targeting sequence
gagucugguggggaucaggg

SEQ ID NO: 21143 - RNA, 20 nt, Artificial Sequence
  TRAC targeting sequence
caggcuuuccaccaagcucu

SEQ ID NO: 21144 - RNA, 20 nt, Artificial Sequence
  TRAC targeting sequence
accaagcucuguggacucag

SEQ ID NO: 21145 - RNA, 20 nt, Artificial Sequence
  TRAC targeting sequence
guggacucagaaauaccaag

SEQ ID NO: 21146 - RNA, 20 nt, Artificial Sequence
  TRAC targeting sequence
acagagcuugguggaaagcc

SEQ ID NO: 21147 - RNA, 20 nt, Artificial Sequence
  TRAC targeting sequence
gaaauaccaagugguuccag

SEQ ID NO: 21148 - RNA, 20 nt, Artificial Sequence
  TRAC targeting sequence
gaguccacagagcuuggugg

SEQ ID NO: 21149 - RNA, 20 nt, Artificial Sequence
  TRAC targeting sequence
agauucagccaucagaggaa

SEQ ID NO: 21150 - RNA, 20 nt, Artificial Sequence
  TRAC targeting sequence
ggaaccacuugguauuucug

SEQ ID NO: 21151 - RNA, 20 nt, Artificial Sequence
  TRAC targeting sequence
gccaucagaggaaggagcau

SEQ ID NO: 21152 - RNA, 20 nt, Artificial Sequence
  TRAC targeting sequence
gaggaaggagcaugaauuga

SEQ ID NO: 21153 - RNA, 20 nt, Artificial Sequence
  TRAC targeting sequence
gauggcugaaucuggaacca

SEQ ID NO: 21154 - RNA, 20 nt, Artificial Sequence
  TRAC targeting sequence
ucugauggcugaaucuggaa

SEQ ID NO: 21155 - RNA, 20 nt, Artificial Sequence
  TRAC targeting sequence
uuccucugauggcugaaucu

SEQ ID NO: 21156 - RNA, 20 nt, Artificial Sequence
  TRAC targeting sequence
ugcuccuuccucugauggcu

SEQ ID NO: 21157 - RNA, 20 nt, Artificial Sequence
  TRAC targeting sequence
auucaugcuccuuccucuga

SEQ ID NO: 21158 - RNA, 20 nt, Artificial Sequence
  TRAC targeting sequence
caggcccccuaagacuaagu

SEQ ID NO: 21159 - RNA, 20 nt, Artificial Sequence
  TRAC targeting sequence
uagggggccugggaaugcca

SEQ ID NO: 21160 - RNA, 20 nt, Artificial Sequence
  TRAC targeting sequence
uguuuccugccuccguggcc

SEQ ID NO: 21161 - RNA, 20 nt, Artificial Sequence
  TRAC targeting sequence
ugccuccguggcccuucccu

SEQ ID NO: 21162 - RNA, 20 nt, Artificial Sequence
  TRAC targeting sequence
guggcccuucccucuuccug

SEQ ID NO: 21163 - RNA, 20 nt, Artificial Sequence
  TRAC targeting sequence
cucuuccugacucugccugc

SEQ ID NO: 21164 - RNA, 20 nt, Artificial Sequence
  TRAC targeting sequence
uccugacucugccugcaugg

SEQ ID NO: 21165 - RNA, 20 nt, Artificial Sequence
  TRAC targeting sequence
ugacucugccugcauggauu

SEQ ID NO: 21166 - RNA, 20 nt, Artificial Sequence
  TRAC targeting sequence
ggaagagggaagggccacgg

SEQ ID NO: 21167 - RNA, 20 nt, Artificial Sequence
  TRAC targeting sequence
gccugcauggauuugauccc

SEQ ID NO: 21168 - RNA, 20 nt, Artificial Sequence
  TRAC targeting sequence
augcaggcagagucaggaag

SEQ ID NO: 21169 - RNA, 20 nt, Artificial Sequence
  TRAC targeting sequence
aauccaugcaggcagaguca

SEQ ID NO: 21170 - RNA, 20 nt, Artificial Sequence
  TRAC targeting sequence
cccuucaggaugagaucaga

SEQ ID NO: 21171 - RNA, 20 nt, Artificial Sequence
  TRAC targeting sequence
ggaugagaucagaauggcaa

SEQ ID NO: 21172 - RNA, 20 nt, Artificial Sequence
  TRAC targeting sequence
ugaagggggaucaaauccau

SEQ ID NO: 21173 - RNA, 20 nt, Artificial Sequence
  TRAC targeting sequence
uccugaagggggaucaaauc

SEQ ID NO: 21174 - RNA, 20 nt, Artificial Sequence
  TRAC targeting sequence
cauccugaagggggaucaaa

SEQ ID NO: 21175 - RNA, 20 nt, Artificial Sequence
  TRAC targeting sequence
gaauggcaaggcagagcucu

SEQ ID NO: 21176 - RNA, 20 nt, Artificial Sequence
  TRAC targeting sequence
gaucucauccugaaggggga

SEQ ID NO: 21177 - RNA, 20 nt, Artificial Sequence
  TRAC targeting sequence
gccuugccauucugaucuca

SEQ ID NO: 21178 - RNA, 20 nt, Artificial Sequence
  TRAC targeting sequence
guaccuuuaggaggcacucc

SEQ ID NO: 21179 - RNA, 20 nt, Artificial Sequence
  TRAC targeting sequence
uaaagguacagagcucugcc

SEQ ID NO: 21180 - RNA, 20 nt, Artificial Sequence
  TRAC targeting sequence
cucaauaaauauuugauguu

SEQ ID NO: 21181 - RNA, 20 nt, Artificial Sequence
  TRAC targeting sequence
auaaauauuugauguugccg

SEQ ID NO: 21182 - RNA, 20 nt, Artificial Sequence
  TRAC targeting sequence
aauauuuauugagggagugc

SEQ ID NO: 21183 - RNA, 20 nt, Artificial Sequence
  TRAC targeting sequence
cgccuguaaucccagcacuu

SEQ ID NO: 21184 - RNA, 20 nt, Artificial Sequence
  TRAC targeting sequence
cagcacuuugggaagccaag

SEQ ID NO: 21185 - RNA, 20 nt, Artificial Sequence
  TRAC targeting sequence
caaagugcugggauuacagg

SEQ ID NO: 21186 - RNA, 20 nt, Artificial Sequence
  TRAC targeting sequence
gcccgccuuggcuucccaaa

SEQ ID NO: 21187 - RNA, 20 nt, Artificial Sequence
  TRAC targeting sequence
cuugaggucaggaguucaag

SEQ ID NO: 21188 - RNA, 20 nt, Artificial Sequence
  TRAC targeting sequence
agugaucugcccgccuuggc

SEQ ID NO: 21189 - RNA, 20 nt, Artificial Sequence
  TRAC targeting sequence
ggaguucaagacuagccugg

SEQ ID NO: 21190 - RNA, 20 nt, Artificial Sequence
  TRAC targeting sequence
ugaccucaagugaucugccc

SEQ ID NO: 21191 - RNA, 20 nt, Artificial Sequence
  TRAC targeting sequence
agacuagccuggcaaacaug

SEQ ID NO: 21192 - RNA, 20 nt, Artificial Sequence
  TRAC targeting sequence
ugaacuccugaccucaagug

SEQ ID NO: 21193 - RNA, 20 nt, Artificial Sequence
  TRAC targeting sequence
ccauguuugccaggcuaguc

SEQ ID NO: 21194 - RNA, 20 nt, Artificial Sequence
  TRAC targeting sequence
cuaguaaaaauacaaaaaau

SEQ ID NO: 21195 - RNA, 20 nt, Artificial Sequence
  TRAC targeting sequence
aguaaaaauacaaaaaauua

SEQ ID NO: 21196 - RNA, 20 nt, Artificial Sequence
  TRAC targeting sequence
cagcuacuagggaggcugag

SEQ ID NO: 21197 - RNA, 20 nt, Artificial Sequence
  TRAC targeting sequence
cuaguagcugggauuacagg

SEQ ID NO: 21198 - RNA, 20 nt, Artificial Sequence
  TRAC targeting sequence
gccucccuaguagcugggau

SEQ ID NO: 21199 - RNA, 20 nt, Artificial Sequence
  TRAC targeting sequence
ugccucagccucccuaguag

SEQ ID NO: 21200 - RNA, 20 nt, Artificial Sequence
  TRAC targeting sequence
ccugccucagccucccuagu

SEQ ID NO: 21201 - RNA, 20 nt, Artificial Sequence
  TRAC targeting sequence
agcaauucuccugccucagc

SEQ ID NO: 21202 - RNA, 20 nt, Artificial Sequence
  TRAC targeting sequence
uggguucaagcaauucuccu

SEQ ID NO: 21203 - RNA, 20 nt, Artificial Sequence
  TRAC targeting sequence
acuuccuggguucaagcaau

SEQ ID NO: 21204 - RNA, 20 nt, Artificial Sequence
  TRAC targeting sequence
ccacuuccuggguucaagca

SEQ ID NO: 21205 - RNA, 20 nt, Artificial Sequence
  TRAC targeting sequence
cugcaaucuccacuuccugg

SEQ ID NO: 21206 - RNA, 20 nt, Artificial Sequence
  TRAC targeting sequence
gcucacugcaaucuccacuu

SEQ ID NO: 21207 - RNA, 20 nt, Artificial Sequence
  TRAC targeting sequence
cggcucacugcaaucuccac

SEQ ID NO: 21208 - RNA, 20 nt, Artificial Sequence
  TRAC targeting sequence
cgccauugcacuccagccug

SEQ ID NO: 21209 - RNA, 20 nt, Artificial Sequence
  TRAC targeting sequence
agccugggcaacagagcaag

SEQ ID NO: 21210 - RNA, 20 nt, Artificial Sequence
  TRAC targeting sequence
guugcccaggcuggagugca

SEQ ID NO: 21211 - RNA, 20 nt, Artificial Sequence
  TRAC targeting sequence
ugcucuguugcccaggcugg

SEQ ID NO: 21212 - RNA, 20 nt, Artificial Sequence
  TRAC targeting sequence
aucuaaaaaaaaaaaaaauu

SEQ ID NO: 21213 - RNA, 20 nt, Artificial Sequence
  TRAC targeting sequence
aaaaaaaaaaaaaauugaug

SEQ ID NO: 21214 - RNA, 20 nt, Artificial Sequence
  TRAC targeting sequence
auuuuuuuuuuuuuuagaug

SEQ ID NO: 21215 - RNA, 20 nt, Artificial Sequence
  TRAC targeting sequence
aggcaauacuuauccacuac

SEQ ID NO: 21216 - RNA, 20 nt, Artificial Sequence
  TRAC targeting sequence
acuacucaagcauaugccaa

SEQ ID NO: 21217 - RNA, 20 nt, Artificial Sequence
  TRAC targeting sequence
agcauaugccaauggggaua

SEQ ID NO: 21218 - RNA, 20 nt, Artificial Sequence
  TRAC targeting sequence
ccauuggcauaugcuugagu

SEQ ID NO: 21219 - RNA, 20 nt, Artificial Sequence
  TRAC targeting sequence
agacacacuccccauggcug

SEQ ID NO: 21220 - RNA, 20 nt, Artificial Sequence
  TRAC targeting sequence
ggauauuaguuauccccauu

SEQ ID NO: 21221 - RNA, 20 nt, Artificial Sequence
  TRAC targeting sequence
ccauggcuggucccuucgcu

SEQ ID NO: 21222 - RNA, 20 nt, Artificial Sequence
  TRAC targeting sequence
cuucgcugacucuuucuuag

SEQ ID NO: 21223 - RNA, 20 nt, Artificial Sequence
  TRAC targeting sequence
cugacucuuucuuagcuguc

SEQ ID NO: 21224 - RNA, 20 nt, Artificial Sequence
  TRAC targeting sequence
gcgaagggaccagccauggg

SEQ ID NO: 21225 - RNA, 20 nt, Artificial Sequence
  TRAC targeting sequence
uucuuagcugucagaucuca

SEQ ID NO: 21226 - RNA, 20 nt, Artificial Sequence
  TRAC targeting sequence
uagcugucagaucucagccu

SEQ ID NO: 21227 - RNA, 20 nt, Artificial Sequence
  TRAC targeting sequence
gaucucagccuaaaggucac

SEQ ID NO: 21228 - RNA, 20 nt, Artificial Sequence
  TRAC targeting sequence
gacagcuaagaaagagucag

SEQ ID NO: 21229 - RNA, 20 nt, Artificial Sequence
  TRAC targeting sequence
cagccuaaaggucaccuggu

SEQ ID NO: 21230 - RNA, 20 nt, Artificial Sequence
  TRAC targeting sequence
gccuaaaggucaccugguca

SEQ ID NO: 21231 - RNA, 20 nt, Artificial Sequence
  TRAC targeting sequence
ccuggucagagagguccuuc

SEQ ID NO: 21232 - RNA, 20 nt, Artificial Sequence
  TRAC targeting sequence
gagagguccuuccuaaccac

SEQ ID NO: 21233 - RNA, 20 nt, Artificial Sequence
  TRAC targeting sequence
gaccaggugaccuuuaggcu

SEQ ID NO: 21234 - RNA, 20 nt, Artificial Sequence
  TRAC targeting sequence
cugaccaggugaccuuuagg

SEQ ID NO: 21235 - RNA, 20 nt, Artificial Sequence
  TRAC targeting sequence
uuccuaaccacccuaagcag

SEQ ID NO: 21236 - RNA, 20 nt, Artificial Sequence
  TRAC targeting sequence
uaaccacccuaagcagcucc

SEQ ID NO: 21237 - RNA, 20 nt, Artificial Sequence
  TRAC targeting sequence
cuccccagccccauuuacug

SEQ ID NO: 21238 - RNA, 20 nt, Artificial Sequence
  TRAC targeting sequence
ccagccccauuuacugucac

SEQ ID NO: 21239 - RNA, 20 nt, Artificial Sequence
  TRAC targeting sequence
cauuauauuguuuacuguuu

SEQ ID NO: 21240 - RNA, 20 nt, Artificial Sequence
  TRAC targeting sequence
uuccuucacuccacucacaa

SEQ ID NO: 21241 - RNA, 20 nt, Artificial Sequence
  TRAC targeting sequence
uucacuccacucacaacaaa

SEQ ID NO: 21242 - RNA, 20 nt, Artificial Sequence
  TRAC targeting sequence
cuccacucacaacaaaauua

SEQ ID NO: 21243 - RNA, 20 nt, Artificial Sequence
  TRAC targeting sequence
acucacaacaaaauuauuuc

SEQ ID NO: 21244 - RNA, 20 nt, Artificial Sequence
  TRAC targeting sequence
caacaaaauuauuucauuua

SEQ ID NO: 21245 - RNA, 20 nt, Artificial Sequence
  TRAC targeting sequence
uuuauguaauaauuuggcuc

SEQ ID NO: 21246 - RNA, 20 nt, Artificial Sequence
  TRAC targeting sequence
cuucccuacuggaauuuaag

SEQ ID NO: 21247 - RNA, 20 nt, Artificial Sequence
  TRAC targeting sequence
ucccuacuggaauuuaaggc

SEQ ID NO: 21248 - RNA, 20 nt, Artificial Sequence
  TRAC targeting sequence
cuacuggaauuuaaggcuca

SEQ ID NO: 21249 - RNA, 20 nt, Artificial Sequence
  TRAC targeting sequence
aguagggaagagagccaaau

SEQ ID NO: 21250 - RNA, 20 nt, Artificial Sequence
  TRAC targeting sequence
gaaagugaggcgucuugucc

SEQ ID NO: 21251 - RNA, 20 nt, Artificial Sequence
  TRAC targeting sequence
gagccuuaaauuccaguagg

SEQ ID NO: 21252 - RNA, 20 nt, Artificial Sequence
  TRAC targeting sequence
cuuucugagccuuaaauucc

SEQ ID NO: 21253 - RNA, 20 nt, Artificial Sequence
  TRAC targeting sequence
uguccguucuguucauuucu

SEQ ID NO: 21254 - RNA, 20 nt, Artificial Sequence
  TRAC targeting sequence
guucuguucauuucuguagc

SEQ ID NO: 21255 - RNA, 20 nt, Artificial Sequence
  TRAC targeting sequence
guucauuucuguagcacuua

SEQ ID NO: 21256 - RNA, 20 nt, Artificial Sequence
  TRAC targeting sequence
uuucuguagcacuuaacuca

SEQ ID NO: 21257 - RNA, 20 nt, Artificial Sequence
  TRAC targeting sequence
guagcacuuaacucauggua

SEQ ID NO: 21258 - RNA, 20 nt, Artificial Sequence
  TRAC targeting sequence
ugguaagcaaaaauuuaaag

SEQ ID NO: 21259 - RNA, 20 nt, Artificial Sequence
  TRAC targeting sequence
uuuaaauuuuugcuuaccau

SEQ ID NO: 21260 - RNA, 20 nt, Artificial Sequence
  TRAC targeting sequence
uuccuuuaaauuuuugcuua

SEQ ID NO: 21261 - RNA, 20 nt, Artificial Sequence
  TRAC targeting sequence
guuauuacuccuuccuuuaa

SEQ ID NO: 21262 - RNA, 20 nt, Artificial Sequence
  TRAC targeting sequence
uucuguuauuacuccuuccu

SEQ ID NO: 21263 - RNA, 20 nt, Artificial Sequence
  TRAC targeting sequence
uucuuucuguuauuacuccu

SEQ ID NO: 21264 - RNA, 20 nt, Artificial Sequence
  TRAC targeting sequence
gccaucagaugccccuuauu

SEQ ID NO: 21265 - RNA, 20 nt, Artificial Sequence
  TRAC targeting sequence
gaugccccuuauuuauaccc

SEQ ID NO: 21266 - RNA, 20 nt, Artificial Sequence
  TRAC targeting sequence
gauggcagagcucauucuuu

SEQ ID NO: 21267 - RNA, 20 nt, Artificial Sequence
  TRAC targeting sequence
ggguauaaauaaggggcauc

SEQ ID NO: 21268 - RNA, 20 nt, Artificial Sequence
  TRAC targeting sequence
agugucaggguauaaauaag

SEQ ID NO: 21269 - RNA, 20 nt, Artificial Sequence
  TRAC targeting sequence
acauuuaaccccaaucuagu

SEQ ID NO: 21270 - RNA, 20 nt, Artificial Sequence
  TRAC targeting sequence
uugaagcuguuagacauaug

SEQ ID NO: 21271 - RNA, 20 nt, Artificial Sequence
  TRAC targeting sequence
augauugucaacauuuaacc

SEQ ID NO: 21272 - RNA, 20 nt, Artificial Sequence
  TRAC targeting sequence
aacagcuucaaugauuguca

SEQ ID NO: 21273 - RNA, 20 nt, Artificial Sequence
  TRAC targeting sequence
cauaugucuaacagcuucaa

SEQ ID NO: 21274 - RNA, 20 nt, Artificial Sequence
  TRAC targeting sequence
ugacgugcauguauacgcac

SEQ ID NO: 21275 - RNA, 20 nt, Artificial Sequence
  TRAC targeting sequence
agaggccagcaagcucccau

SEQ ID NO: 21276 - RNA, 20 nt, Artificial Sequence
  TRAC targeting sequence
ugcgugcguauacaugcacg

SEQ ID NO: 21277 - RNA, 20 nt, Artificial Sequence
  TRAC targeting sequence
cucaugcgugcguauacaug

SEQ ID NO: 21278 - RNA, 20 nt, Artificial Sequence
  TRAC targeting sequence
auuaaaaguuaaaaacaaag

SEQ ID NO: 21279 - RNA, 20 nt, Artificial Sequence
  TRAC targeting sequence
cugggauuuaacaggccuga

SEQ ID NO: 21280 - RNA, 20 nt, Artificial Sequence
  TRAC targeting sequence
cagggauaaacaacuuuguu

SEQ ID NO: 21281 - RNA, 20 nt, Artificial Sequence
  TRAC targeting sequence
ggccuguuaaaucccaggga

SEQ ID NO: 21282 - RNA, 20 nt, Artificial Sequence
  TRAC targeting sequence
caaacggggcuccuagggag

SEQ ID NO: 21283 - RNA, 20 nt, Artificial Sequence
  TRAC targeting sequence
aacggggcuccuagggaggu

SEQ ID NO: 21284 - RNA, 20 nt, Artificial Sequence
  TRAC targeting sequence
uagggaggucucuccgcuuc

SEQ ID NO: 21285 - RNA, 20 nt, Artificial Sequence
  TRAC targeting sequence
cuaggagccccguuugagac

SEQ ID NO: 21286 - RNA, 20 nt, Artificial Sequence
  TRAC targeting sequence
cuccgcuucucccaggaaga

SEQ ID NO: 21287 - RNA, 20 nt, Artificial Sequence
  TRAC targeting sequence
ccgcuucucccaggaagagc

SEQ ID NO: 21288 - RNA, 20 nt, Artificial Sequence
  TRAC targeting sequence
gcuucucccaggaagagcca

SEQ ID NO: 21289 - RNA, 20 nt, Artificial Sequence
  TRAC targeting sequence
cccaggaagagccaggccug

SEQ ID NO: 21290 - RNA, 20 nt, Artificial Sequence
  TRAC targeting sequence
caggaagagccaggccugcc

SEQ ID NO: 21291 - RNA, 20 nt, Artificial Sequence
  TRAC targeting sequence
ugggagaagcggagagaccu

SEQ ID NO: 21292 - RNA, 20 nt, Artificial Sequence
  TRAC targeting sequence
uccugggagaagcggagaga

SEQ ID NO: 21293 - RNA, 20 nt, Artificial Sequence
  TRAC targeting sequence
ccacagugcuuuagcugaga

SEQ ID NO: 21294 - RNA, 20 nt, Artificial Sequence
  TRAC targeting sequence
gcuaaagcacuguggugacc

SEQ ID NO: 21295 - RNA, 20 nt, Artificial Sequence
  TRAC targeting sequence
cagcuaaagcacugugguga

SEQ ID NO: 21296 - RNA, 20 nt, Artificial Sequence
  TRAC targeting sequence
gugaaacggaugugcagcug

SEQ ID NO: 21297 - RNA, 20 nt, Artificial Sequence
  TRAC targeting sequence
cugacucucagcuaaagcac

SEQ ID NO: 21298 - RNA, 20 nt, Artificial Sequence
  TRAC targeting sequence
guuucacugacucucagcua

SEQ ID NO: 21299 - RNA, 20 nt, Artificial Sequence
  TRAC targeting sequence
gcugcacauccguuucacug

SEQ ID NO: 21300 - RNA, 20 nt, Artificial Sequence
  TRAC targeting sequence
cucagcugcacauccguuuc

SEQ ID NO: 21301 - RNA, 20 nt, Artificial Sequence
  TRAC targeting sequence
cccucagcugcacauccguu

SEQ ID NO: 21302 - RNA, 20 nt, Artificial Sequence
  TRAC targeting sequence
uggaacccucagagcuucug

SEQ ID NO: 21303 - RNA, 20 nt, Artificial Sequence
  TRAC targeting sequence
augacauacugcuuuucucc

SEQ ID NO: 21304 - RNA, 20 nt, Artificial Sequence
  TRAC targeting sequence
gagcuucuggugagcacuga

SEQ ID NO: 21305 - RNA, 20 nt, Artificial Sequence
  TRAC targeting sequence
gaggguuccaugacauacug

SEQ ID NO: 21306 - RNA, 20 nt, Artificial Sequence
  TRAC targeting sequence
ggugagcacugaaaggaaug

SEQ ID NO: 21307 - RNA, 20 nt, Artificial Sequence
  TRAC targeting sequence
ccagaagcucugaggguucc

SEQ ID NO: 21308 - RNA, 20 nt, Artificial Sequence
  TRAC targeting sequence
gugcucaccagaagcucuga

SEQ ID NO: 21309 - RNA, 20 nt, Artificial Sequence
  TRAC targeting sequence
uuucagugcucaccagaagc

SEQ ID NO: 21310 - RNA, 20 nt, Artificial Sequence
  TRAC targeting sequence
uuccuuucagugcucaccag

SEQ ID NO: 21311 - RNA, 20 nt, Artificial Sequence
  TRAC targeting sequence
acaaauguaucauuccuuuc

SEQ ID NO: 21312 - RNA, 20 nt, Artificial Sequence
  TRAC targeting sequence
gauauuuucacuuaacguuu

SEQ ID NO: 21313 - RNA, 20 nt, Artificial Sequence
  TRAC targeting sequence
gaauguaauugcucuacaaa

SEQ ID NO: 21314 - RNA, 20 nt, Artificial Sequence
  TRAC targeting sequence
cuuaacguuuuguugggaua

SEQ ID NO: 21315 - RNA, 20 nt, Artificial Sequence
  TRAC targeting sequence
caacaaaacguuaagugaaa

SEQ ID NO: 21316 - RNA, 20 nt, Artificial Sequence
  TRAC targeting sequence
uacugcgguuaucccaacaa

SEQ ID NO: 21317 - RNA, 20 nt, Artificial Sequence
  TRAC targeting sequence
ccaugcugaguuuaugacuu

SEQ ID NO: 21318 - RNA, 20 nt, Artificial Sequence
  TRAC targeting sequence
gcauggggauaauaauacuu

SEQ ID NO: 21319 - RNA, 20 nt, Artificial Sequence
  TRAC targeting sequence
uaaacucagcauggggauaa

SEQ ID NO: 21320 - RNA, 20 nt, Artificial Sequence
  TRAC targeting sequence
cauucaaagcguaacccaaa

SEQ ID NO: 21321 - RNA, 20 nt, Artificial Sequence
  TRAC targeting sequence
uucaaagcguaacccaaacg

SEQ ID NO: 21322 - RNA, 20 nt, Artificial Sequence
  TRAC targeting sequence
aagcguaacccaaacgcuuu

SEQ ID NO: 21323 - RNA, 20 nt, Artificial Sequence
  TRAC targeting sequence
gcuagacagaaauaagauuc

SEQ ID NO: 21324 - RNA, 20 nt, Artificial Sequence
  TRAC targeting sequence
agcugaaagcguuuggguua

SEQ ID NO: 21325 - RNA, 20 nt, Artificial Sequence
  TRAC targeting sequence
gucuagcugaaagcguuugg

SEQ ID NO: 21326 - RNA, 20 nt, Artificial Sequence
  TRAC targeting sequence
uauuucugucuagcugaaag

SEQ ID NO: 21327 - RNA, 20 nt, Artificial Sequence
  TRAC targeting sequence
agccuaacacuugcugaguc

SEQ ID NO: 21328 - RNA, 20 nt, Artificial Sequence
  TRAC targeting sequence
gcaaguguuaggcuugaauc

SEQ ID NO: 21329 - RNA, 20 nt, Artificial Sequence
  TRAC targeting sequence
ccauuuccucaucaggaaga

SEQ ID NO: 21330 - RNA, 20 nt, Artificial Sequence
  TRAC targeting sequence
auuuccucaucaggaagaua

SEQ ID NO: 21331 - RNA, 20 nt, Artificial Sequence
  TRAC targeting sequence
ucaucaggaagauaagaaug

SEQ ID NO: 21332 - RNA, 20 nt, Artificial Sequence
  TRAC targeting sequence
ucaggaagauaagaaugcca

SEQ ID NO: 21333 - RNA, 20 nt, Artificial Sequence
  TRAC targeting sequence
ggaagauaagaaugccaccc

SEQ ID NO: 21334 - RNA, 20 nt, Artificial Sequence
  TRAC targeting sequence
ugaugaggaaauggagacuc

SEQ ID NO: 21335 - RNA, 20 nt, Artificial Sequence
  TRAC targeting sequence
uccugaugaggaaauggaga

SEQ ID NO: 21336 - RNA, 20 nt, Artificial Sequence
  TRAC targeting sequence
uaucuuccugaugaggaaau

SEQ ID NO: 21337 - RNA, 20 nt, Artificial Sequence
  TRAC targeting sequence
uucaugcaaugauagggaaa

SEQ ID NO: 21338 - RNA, 20 nt, Artificial Sequence
  TRAC targeting sequence
ugcaaugauagggaaacgca

SEQ ID NO: 21339 - RNA, 20 nt, Artificial Sequence
  TRAC targeting sequence
uugcaugaaggaggugggug

SEQ ID NO: 21340 - RNA, 20 nt, Artificial Sequence
  TRAC targeting sequence
cuaucauugcaugaaggagg

SEQ ID NO: 21341 - RNA, 20 nt, Artificial Sequence
  TRAC targeting sequence
uguuacuugcguuucccuau

SEQ ID NO: 21342 - RNA, 20 nt, Artificial Sequence
  TRAC targeting sequence
ggcaaacuguuaagcgcccu

SEQ ID NO: 21343 - RNA, 20 nt, Artificial Sequence
  TRAC targeting sequence
cucacuccuggacaggauag

SEQ ID NO: 21344 - RNA, 20 nt, Artificial Sequence
  TRAC targeting sequence
cuccuggacaggauagggcu

SEQ ID NO: 21345 - RNA, 20 nt, Artificial Sequence
  TRAC targeting sequence
uggacaggauagggcugugu

SEQ ID NO: 21346 - RNA, 20 nt, Artificial Sequence
  TRAC targeting sequence
aggagugagcgagcgugggc

SEQ ID NO: 21347 - RNA, 20 nt, Artificial Sequence
  TRAC targeting sequence
uguccaggagugagcgagcg

SEQ ID NO: 21348 - RNA, 20 nt, Artificial Sequence
  TRAC targeting sequence
uaucuuuucuaaugccaugc

SEQ ID NO: 21349 - RNA, 20 nt, Artificial Sequence
  TRAC targeting sequence
uuucuaaugccaugcacuac

SEQ ID NO: 21350 - RNA, 20 nt, Artificial Sequence
  TRAC targeting sequence
aaugccaugcacuaccuagc

SEQ ID NO: 21351 - RNA, 20 nt, Artificial Sequence
  TRAC targeting sequence
gugcuagguagugcauggca

SEQ ID NO: 21352 - RNA, 20 nt, Artificial Sequence
  TRAC targeting sequence
cuaaaauuuagcaaauaauu

SEQ ID NO: 21353 - RNA, 20 nt, Artificial Sequence
  TRAC targeting sequence
acagacaguaaguggcagaa

SEQ ID NO: 21354 - RNA, 20 nt, Artificial Sequence
  TRAC targeting sequence
guugaccuuuugucgcuaaa

SEQ ID NO: 21355 - RNA, 20 nt, Artificial Sequence
  TRAC targeting sequence
gccacuuacugucuguugac

SEQ ID NO: 21356 - RNA, 20 nt, Artificial Sequence
  TRAC targeting sequence
uugaaucaacacuuucagau

SEQ ID NO: 21357 - RNA, 20 nt, Artificial Sequence
  TRAC targeting sequence
aggacuuguucugccacuua

SEQ ID NO: 21358 - RNA, 20 nt, Artificial Sequence
  TRAC targeting sequence
acacuuucagaucaaagugu

SEQ ID NO: 21359 - RNA, 20 nt, Artificial Sequence
  TRAC targeting sequence
gaucaaaguguuuuccgcaa

SEQ ID NO: 21360 - RNA, 20 nt, Artificial Sequence
  TRAC targeting sequence
gaaaguguugauucaaggac

SEQ ID NO: 21361 - RNA, 20 nt, Artificial Sequence
  TRAC targeting sequence
aaguguuuuccgcaacacca

SEQ ID NO: 21362 - RNA, 20 nt, Artificial Sequence
  TRAC targeting sequence
gcaacaccaggcugccucuc

SEQ ID NO: 21363 - RNA, 20 nt, Artificial Sequence
  TRAC targeting sequence
cuggugguuugaaaauacuu

SEQ ID NO: 21364 - RNA, 20 nt, Artificial Sequence
  TRAC targeting sequence
ggugguuugaaaauacuuuu

SEQ ID NO: 21365 - RNA, 20 nt, Artificial Sequence
  TRAC targeting sequence
aaccaccagagaggcagccu

SEQ ID NO: 21366 - RNA, 20 nt, Artificial Sequence
  TRAC targeting sequence
cauugacagaacuuggaccu

SEQ ID NO: 21367 - RNA, 20 nt, Artificial Sequence
  TRAC targeting sequence
augggauuuuuaaaaaguau

SEQ ID NO: 21368 - RNA, 20 nt, Artificial Sequence
  TRAC targeting sequence
gucaaugggauuuuuaaaaa

SEQ ID NO: 21369 - RNA, 20 nt, Artificial Sequence
  TRAC targeting sequence
aaguucugucaaugggauuu

SEQ ID NO: 21370 - RNA, 20 nt, Artificial Sequence
  TRAC targeting sequence
auguaagcaaauaaaauacu

SEQ ID NO: 21371 - RNA, 20 nt, Artificial Sequence
  TRAC targeting sequence
uucuucauaagcuuccuccc

SEQ ID NO: 21372 - RNA, 20 nt, Artificial Sequence
  TRAC targeting sequence
ucauaagcuuccucccacuu

SEQ ID NO: 21373 - RNA, 20 nt, Artificial Sequence
  TRAC targeting sequence
uaagcuuccucccacuuuuu

SEQ ID NO: 21374 - RNA, 20 nt, Artificial Sequence
  TRAC targeting sequence
ucccacuuuuuuccuacucu

SEQ ID NO: 21375 - RNA, 20 nt, Artificial Sequence
  TRAC targeting sequence
cacuuuuuuccuacucucuc

SEQ ID NO: 21376 - RNA, 20 nt, Artificial Sequence
  TRAC targeting sequence
uacucucuccucuaagaucc

SEQ ID NO: 21377 - RNA, 20 nt, Artificial Sequence
  TRAC targeting sequence
cuccucuaagauccuuguuc

SEQ ID NO: 21378 - RNA, 20 nt, Artificial Sequence
  TRAC targeting sequence
ccucuaagauccuuguucua

SEQ ID NO: 21379 - RNA, 20 nt, Artificial Sequence
  TRAC targeting sequence
ucuaagauccuuguucuaga

SEQ ID NO: 21380 - RNA, 20 nt, Artificial Sequence
  TRAC targeting sequence
aagauccuuguucuagaaag

SEQ ID NO: 21381 - RNA, 20 nt, Artificial Sequence
  TRAC targeting sequence
uagaggagagaguaggaaaa

SEQ ID NO: 21382 - RNA, 20 nt, Artificial Sequence
  TRAC targeting sequence
uuguucuagaaaguguuuuc

SEQ ID NO: 21383 - RNA, 20 nt, Artificial Sequence
  TRAC targeting sequence
agaaaguguuuucucccaca

SEQ ID NO: 21384 - RNA, 20 nt, Artificial Sequence
  TRAC targeting sequence
agaacaaggaucuuagagga

SEQ ID NO: 21385 - RNA, 20 nt, Artificial Sequence
  TRAC targeting sequence
cccacaggagaaaucuauuu

SEQ ID NO: 21386 - RNA, 20 nt, Artificial Sequence
  TRAC targeting sequence
cacaggagaaaucuauuuuu

SEQ ID NO: 21387 - RNA, 20 nt, Artificial Sequence
  TRAC targeting sequence
ugugggagaaaacacuuucu

SEQ ID NO: 21388 - RNA, 20 nt, Artificial Sequence
  TRAC targeting sequence
ccugugggagaaaacacuuu

SEQ ID NO: 21389 - RNA, 20 nt, Artificial Sequence
  TRAC targeting sequence
auuuuuuauauuuguuaaaa

SEQ ID NO: 21390 - RNA, 20 nt, Artificial Sequence
  TRAC targeting sequence
uuucacacacaaacuuuuau

SEQ ID NO: 21391 - RNA, 20 nt, Artificial Sequence
  TRAC targeting sequence
cacacaaacuuuuauuacag

SEQ ID NO: 21392 - RNA, 20 nt, Artificial Sequence
  TRAC targeting sequence
guaauaaaaguuugugugug

SEQ ID NO: 21393 - RNA, 20 nt, Artificial Sequence
  TRAC targeting sequence
gggcgucuguaauaaaaguu

SEQ ID NO: 21394 - RNA, 20 nt, Artificial Sequence
  TRAC targeting sequence
gcucugggcgucuguaauaa

SEQ ID NO: 21395 - RNA, 20 nt, Artificial Sequence
  TRAC targeting sequence
uguuggguugcagcucagcu

SEQ ID NO: 21396 - RNA, 20 nt, Artificial Sequence
  TRAC targeting sequence
uaucuuguuggguugcagcu

SEQ ID NO: 21397 - RNA, 20 nt, Artificial Sequence
  TRAC targeting sequence
ccuaucuuguuggguugcag

SEQ ID NO: 21398 - RNA, 20 nt, Artificial Sequence
  TRAC targeting sequence
gcugcucuccuaucuuguug

SEQ ID NO: 21399 - RNA, 20 nt, Artificial Sequence
  TRAC targeting sequence
cccgcuaaguuugcaaacaa

SEQ ID NO: 21400 - RNA, 20 nt, Artificial Sequence
  TRAC targeting sequence
cgcuaaguuugcaaacaagc

SEQ ID NO: 21401 - RNA, 20 nt, Artificial Sequence
  TRAC targeting sequence
cuggccucuauaaccuccaa

SEQ ID NO: 21402 - RNA, 20 nt, Artificial Sequence
  TRAC targeting sequence
auaaccuccaacaccaggga

SEQ ID NO: 21403 - RNA, 20 nt, Artificial Sequence
  TRAC targeting sequence
aacaccagggagcacgccuc

SEQ ID NO: 21404 - RNA, 20 nt, Artificial Sequence
  TRAC targeting sequence
cugguguuggagguuauaga

SEQ ID NO: 21405 - RNA, 20 nt, Artificial Sequence
  TRAC targeting sequence
gugaccuccccaaguauuuu

SEQ ID NO: 21406 - RNA, 20 nt, Artificial Sequence
  TRAC targeting sequence
cagaggcgugcucccuggug

SEQ ID NO: 21407 - RNA, 20 nt, Artificial Sequence
  TRAC targeting sequence
ccaaguauuuucuagccauc

SEQ ID NO: 21408 - RNA, 20 nt, Artificial Sequence
  TRAC targeting sequence
agccaucacaacaaaagugu

SEQ ID NO: 21409 - RNA, 20 nt, Artificial Sequence
  TRAC targeting sequence
caacaaaaguguuuugaagc

SEQ ID NO: 21410 - RNA, 20 nt, Artificial Sequence
  TRAC targeting sequence
aaacacuuuuguugugaugg

SEQ ID NO: 21411 - RNA, 20 nt, Artificial Sequence
  TRAC targeting sequence
ugggcuucaaaacacuuuug

SEQ ID NO: 21412 - RNA, 20 nt, Artificial Sequence
  TRAC targeting sequence
ucuugggcuucaaaacacuu

SEQ ID NO: 21413 - RNA, 20 nt, Artificial Sequence
  TRAC targeting sequence
uuucaucuugggcuucaaaa

SEQ ID NO: 21414 - RNA, 20 nt, Artificial Sequence
  TRAC targeting sequence
caucauuucaucuugggcuu

SEQ ID NO: 21415 - RNA, 20 nt, Artificial Sequence
  TRAC targeting sequence
caagaggccgaagguauagg

SEQ ID NO: 21416 - RNA, 20 nt, Artificial Sequence
  TRAC targeting sequence
ugugaucacaucauuucauc

SEQ ID NO: 21417 - RNA, 20 nt, Artificial Sequence
  TRAC targeting sequence
gccucuugugaucacaucau

SEQ ID NO: 21418 - RNA, 20 nt, Artificial Sequence
  TRAC targeting sequence
uagcagccuauaccuucggc

SEQ ID NO: 21419 - RNA, 20 nt, Artificial Sequence
  TRAC targeting sequence
cuuagcagccuauaccuucg

SEQ ID NO: 21420 - RNA, 20 nt, Artificial Sequence
  TRAC targeting sequence
ucucuuagcagccuauaccu

SEQ ID NO: 21421 - RNA, 20 nt, Artificial Sequence
  TRAC targeting sequence
uguuuucuucucuuagcagc

SEQ ID NO: 21422 - RNA, 20 nt, Artificial Sequence
  TRAC targeting sequence
cuuguuuucuucucuuagca

SEQ ID NO: 21423 - RNA, 20 nt, Artificial Sequence
  TRAC targeting sequence
cucuuguuuucuucucuuag

SEQ ID NO: 21424 - RNA, 20 nt, Artificial Sequence
  TRAC targeting sequence
augugauaggggccaggaaa

SEQ ID NO: 21425 - RNA, 20 nt, Artificial Sequence
  TRAC targeting sequence
cauggaaaccaucucucuug

SEQ ID NO: 21426 - RNA, 20 nt, Artificial Sequence
  TRAC targeting sequence
uggccccuaucacauggaaa

SEQ ID NO: 21427 - RNA, 20 nt, Artificial Sequence
  TRAC targeting sequence
ugcccacacauuuccuggcc

SEQ ID NO: 21428 - RNA, 20 nt, Artificial Sequence
  TRAC targeting sequence
gggcugggcuucccaccacu

SEQ ID NO: 21429 - RNA, 20 nt, Artificial Sequence
  TRAC targeting sequence
caccacugcaaagaauggca

SEQ ID NO: 21430 - RNA, 20 nt, Artificial Sequence
  TRAC targeting sequence
uugcaguggugggaagccca

SEQ ID NO: 21431 - RNA, 20 nt, Artificial Sequence
  TRAC targeting sequence
cugccauucuuugcaguggu

SEQ ID NO: 21432 - RNA, 20 nt, Artificial Sequence
  TRAC targeting sequence
auucccugccauucuuugca

SEQ ID NO: 21433 - RNA, 20 nt, Artificial Sequence
  TRAC targeting sequence
acaguguuuguggugaaugg

SEQ ID NO: 21434 - RNA, 20 nt, Artificial Sequence
  TRAC targeting sequence
ccacaaacacuguggaaagu

SEQ ID NO: 21435 - RNA, 20 nt, Artificial Sequence
  TRAC targeting sequence
ggccccauaaaagagcacag

SEQ ID NO: 21436 - RNA, 20 nt, Artificial Sequence
  TRAC targeting sequence
uuuauggggccggaagccau

SEQ ID NO: 21437 - RNA, 20 nt, Artificial Sequence
  TRAC targeting sequence
gugcucuuuuauggggccgg

SEQ ID NO: 21438 - RNA, 20 nt, Artificial Sequence
  TRAC targeting sequence
auggggugguuuauuuuuau

SEQ ID NO: 21439 - RNA, 20 nt, Artificial Sequence
  TRAC targeting sequence
acaccucuauggggugguuu

SEQ ID NO: 21440 - RNA, 20 nt, Artificial Sequence
  TRAC targeting sequence
cccuugcucaacaccucuau

SEQ ID NO: 21441 - RNA, 20 nt, Artificial Sequence
  TRAC targeting sequence
ugcucccccuugcucaacac

SEQ ID NO: 21442 - RNA, 20 nt, Artificial Sequence
  TRAC targeting sequence
accucacucuccaugcagua

SEQ ID NO: 21443 - RNA, 20 nt, Artificial Sequence
  TRAC targeting sequence
cucuccaugcaguaguacuc

SEQ ID NO: 21444 - RNA, 20 nt, Artificial Sequence
  TRAC targeting sequence
ccaugcaguaguacucaaaa

SEQ ID NO: 21445 - RNA, 20 nt, Artificial Sequence
  TRAC targeting sequence
augcaguaguacucaaaauc

SEQ ID NO: 21446 - RNA, 20 nt, Artificial Sequence
  TRAC targeting sequence
aaaucaacuccuucaacaua

SEQ ID NO: 21447 - RNA, 20 nt, Artificial Sequence
  TRAC targeting sequence
acuccuucaacauacuucag

SEQ ID NO: 21448 - RNA, 20 nt, Artificial Sequence
  TRAC targeting sequence
uucaacauacuucagcugaa

SEQ ID NO: 21449 - RNA, 20 nt, Artificial Sequence
  TRAC targeting sequence
acauacuucagcugaaaaaa

SEQ ID NO: 21450 - RNA, 20 nt, Artificial Sequence
  TRAC targeting sequence
gcugaaaaaacaccuaagaa

SEQ ID NO: 21451 - RNA, 20 nt, Artificial Sequence
  TRAC targeting sequence
gcugaaguauguugaaggag

SEQ ID NO: 21452 - RNA, 20 nt, Artificial Sequence
  TRAC targeting sequence
uagguguuuuuucagcugaa

SEQ ID NO: 21453 - RNA, 20 nt, Artificial Sequence
  TRAC targeting sequence
gaaacgcaauggggcuuggg

SEQ ID NO: 21454 - RNA, 20 nt, Artificial Sequence
  TRAC targeting sequence
gauucuuagguguuuuuuca

SEQ ID NO: 21455 - RNA, 20 nt, Artificial Sequence
  TRAC targeting sequence
uuaaguucaagacagggucu

SEQ ID NO: 21456 - RNA, 20 nt, Artificial Sequence
  TRAC targeting sequence
agacagggucuuguucuguu

SEQ ID NO: 21457 - RNA, 20 nt, Artificial Sequence
  TRAC targeting sequence
ugaacuuaaagacacacccc

SEQ ID NO: 21458 - RNA, 20 nt, Artificial Sequence
  TRAC targeting sequence
uguucuguugcccagacuga

SEQ ID NO: 21459 - RNA, 20 nt, Artificial Sequence
  TRAC targeting sequence
guugcccagacugaagcgca

SEQ ID NO: 21460 - RNA, 20 nt, Artificial Sequence
  TRAC targeting sequence
gggcaacagaacaagacccu

SEQ ID NO: 21461 - RNA, 20 nt, Artificial Sequence
  TRAC targeting sequence
gucugggcaacagaacaaga

SEQ ID NO: 21462 - RNA, 20 nt, Artificial Sequence
  TRAC targeting sequence
ugcagucucuaccuccuggg

SEQ ID NO: 21463 - RNA, 20 nt, Artificial Sequence
  TRAC targeting sequence
cuaccuccugggaucaagug

SEQ ID NO: 21464 - RNA, 20 nt, Artificial Sequence
  TRAC targeting sequence
accuccugggaucaagugac

SEQ ID NO: 21465 - RNA, 20 nt, Artificial Sequence
  TRAC targeting sequence
ugggaucaagugacucucca

SEQ ID NO: 21466 - RNA, 20 nt, Artificial Sequence
  TRAC targeting sequence
caggagguagagacugcaug

SEQ ID NO: 21467 - RNA, 20 nt, Artificial Sequence
  TRAC targeting sequence
agugacucuccaaacucagc

SEQ ID NO: 21468 - RNA, 20 nt, Artificial Sequence
  TRAC targeting sequence
cuugaucccaggagguagag

SEQ ID NO: 21469 - RNA, 20 nt, Artificial Sequence
  TRAC targeting sequence
ccaaacucagccucccgagu

SEQ ID NO: 21470 - RNA, 20 nt, Artificial Sequence
  TRAC targeting sequence
aaacucagccucccgaguag

SEQ ID NO: 21471 - RNA, 20 nt, Artificial Sequence
  TRAC targeting sequence
gccucccgaguagcugggac

SEQ ID NO: 21472 - RNA, 20 nt, Artificial Sequence
  TRAC targeting sequence
cgaguagcugggacuacaga

SEQ ID NO: 21473 - RNA, 20 nt, Artificial Sequence
  TRAC targeting sequence
ggaggcugaguuuggagagu

SEQ ID NO: 21474 - RNA, 20 nt, Artificial Sequence
  TRAC targeting sequence
cagcuacucgggaggcugag

SEQ ID NO: 21475 - RNA, 20 nt, Artificial Sequence
  TRAC targeting sequence
guagucccagcuacucggga

SEQ ID NO: 21476 - RNA, 20 nt, Artificial Sequence
  TRAC targeting sequence
acaaaaauuaaaaaaauuag

SEQ ID NO: 21477 - RNA, 20 nt, Artificial Sequence
  TRAC targeting sequence
cuacaaaaauuaaaaaaauu

SEQ ID NO: 21478 - RNA, 20 nt, Artificial Sequence
  TRAC targeting sequence
cugucucuacaaaaauuaaa

SEQ ID NO: 21479 - RNA, 20 nt, Artificial Sequence
  TRAC targeting sequence
cuguguugcccaggcugguc

SEQ ID NO: 21480 - RNA, 20 nt, Artificial Sequence
  TRAC targeting sequence
ugaacuccuggguucaagcc

SEQ ID NO: 21481 - RNA, 20 nt, Artificial Sequence
  TRAC targeting sequence
agaccagccugggcaacaca

SEQ ID NO: 21482 - RNA, 20 nt, Artificial Sequence
  TRAC targeting sequence
uggguucaagccauucuucc

SEQ ID NO: 21483 - RNA, 20 nt, Artificial Sequence
  TRAC targeting sequence
agccauucuuccaccuuggc

SEQ ID NO: 21484 - RNA, 20 nt, Artificial Sequence
  TRAC targeting sequence
uccaccuuggccucccaaag

SEQ ID NO: 21485 - RNA, 20 nt, Artificial Sequence
  TRAC targeting sequence
accuuggccucccaaaguuc

SEQ ID NO: 21486 - RNA, 20 nt, Artificial Sequence
  TRAC targeting sequence
caaaguucugggauuacagg

SEQ ID NO: 21487 - RNA, 20 nt, Artificial Sequence
  TRAC targeting sequence
gggauuacagguguaagcca

SEQ ID NO: 21488 - RNA, 20 nt, Artificial Sequence
  TRAC targeting sequence
cagaacuuugggaggccaag

SEQ ID NO: 21489 - RNA, 20 nt, Artificial Sequence
  TRAC targeting sequence
guggcuuacaccuguaaucc

SEQ ID NO: 21490 - RNA, 20 nt, Artificial Sequence
  TRAC targeting sequence
guguugucuuuuuuuuuuuu

SEQ ID NO: 21491 - RNA, 20 nt, Artificial Sequence
  TRAC targeting sequence
uuuuuuuuuuucuuuuugug

SEQ ID NO: 21492 - RNA, 20 nt, Artificial Sequence
  TRAC targeting sequence
uuuugugaugaaguuucgcu

SEQ ID NO: 21493 - RNA, 20 nt, Artificial Sequence
  TRAC targeting sequence
caaaaagaaaaaaaaaaaag

SEQ ID NO: 21494 - RNA, 20 nt, Artificial Sequence
  TRAC targeting sequence
ucacaaaaagaaaaaaaaaa

SEQ ID NO: 21495 - RNA, 20 nt, Artificial Sequence
  TRAC targeting sequence
cuucuguugcccagggugga

SEQ ID NO: 21496 - RNA, 20 nt, Artificial Sequence
  TRAC targeting sequence
guugcccaggguggagugca

SEQ ID NO: 21497 - RNA, 20 nt, Artificial Sequence
  TRAC targeting sequence
acccugggcaacagaagcga

SEQ ID NO: 21498 - RNA, 20 nt, Artificial Sequence
  TRAC targeting sequence
cggcucacugcaaccuccgc

SEQ ID NO: 21499 - RNA, 20 nt, Artificial Sequence
  TRAC targeting sequence
gcucacugcaaccuccgccu

SEQ ID NO: 21500 - RNA, 20 nt, Artificial Sequence
  TRAC targeting sequence
cugcaaccuccgccuaccag

SEQ ID NO: 21501 - RNA, 20 nt, Artificial Sequence
  TRAC targeting sequence
gccuaccagguucuagcaau

SEQ ID NO: 21502 - RNA, 20 nt, Artificial Sequence
  TRAC targeting sequence
agcaauucuccugucucaga

SEQ ID NO: 21503 - RNA, 20 nt, Artificial Sequence
  TRAC targeting sequence
ccugucucagacuccugagu

SEQ ID NO: 21504 - RNA, 20 nt, Artificial Sequence
  TRAC targeting sequence
ugucucagacuccugaguag

SEQ ID NO: 21505 - RNA, 20 nt, Artificial Sequence
  TRAC targeting sequence
cagacuccugaguagcuggg

SEQ ID NO: 21506 - RNA, 20 nt, Artificial Sequence
  TRAC targeting sequence
gacuccugaguagcugggau

SEQ ID NO: 21507 - RNA, 20 nt, Artificial Sequence
  TRAC targeting sequence
gagacaggagaauugcuaga

SEQ ID NO: 21508 - RNA, 20 nt, Artificial Sequence
  TRAC targeting sequence
ugaguagcugggauuacagg

SEQ ID NO: 21509 - RNA, 20 nt, Artificial Sequence
  TRAC targeting sequence
ggagucugagacaggagaau

SEQ ID NO: 21510 - RNA, 20 nt, Artificial Sequence
  TRAC targeting sequence
cagcuacucaggagucugag

SEQ ID NO: 21511 - RNA, 20 nt, Artificial Sequence
  TRAC targeting sequence
ugccaccacgccuggcuaau

SEQ ID NO: 21512 - RNA, 20 nt, Artificial Sequence
  TRAC targeting sequence
acuaaaaauacaaaaauuag

SEQ ID NO: 21513 - RNA, 20 nt, Artificial Sequence
  TRAC targeting sequence
cuacuaaaaauacaaaaauu

SEQ ID NO: 21514 - RNA, 20 nt, Artificial Sequence
  TRAC targeting sequence
ucauauuggucaggcugguc

SEQ ID NO: 21515 - RNA, 20 nt, Artificial Sequence
  TRAC targeting sequence
uauuggucaggcuggucucc

SEQ ID NO: 21516 - RNA, 20 nt, Artificial Sequence
  TRAC targeting sequence
ggcuggucuccugaccucag

SEQ ID NO: 21517 - RNA, 20 nt, Artificial Sequence
  TRAC targeting sequence
ccugaccucaggugauccac

SEQ ID NO: 21518 - RNA, 20 nt, Artificial Sequence
  TRAC targeting sequence
ugaccucaggugauccaccc

SEQ ID NO: 21519 - RNA, 20 nt, Artificial Sequence
  TRAC targeting sequence
ggagaccagccugaccaaua

SEQ ID NO: 21520 - RNA, 20 nt, Artificial Sequence
  TRAC targeting sequence
ggugauccacccaccucggc

SEQ ID NO: 21521 - RNA, 20 nt, Artificial Sequence
  TRAC targeting sequence
ccugaggucaggagaccagc

SEQ ID NO: 21522 - RNA, 20 nt, Artificial Sequence
  TRAC targeting sequence
acccaccucggccucccaaa

SEQ ID NO: 21523 - RNA, 20 nt, Artificial Sequence
  TRAC targeting sequence
gccucccaaagugcugggau

SEQ ID NO: 21524 - RNA, 20 nt, Artificial Sequence
  TRAC targeting sequence
caaagugcugggauuuacag

SEQ ID NO: 21525 - RNA, 20 nt, Artificial Sequence
  TRAC targeting sequence
cagcacuuugggaggccgag

SEQ ID NO: 21526 - RNA, 20 nt, Artificial Sequence
  TRAC targeting sequence
ugccuguaaaucccagcacu

SEQ ID NO: 21527 - RNA, 20 nt, Artificial Sequence
  TRAC targeting sequence
uuuaagaacagggucuuaca

SEQ ID NO: 21528 - RNA, 20 nt, Artificial Sequence
  TRAC targeting sequence
uaaaagaggccaggcauggu

SEQ ID NO: 21529 - RNA, 20 nt, Artificial Sequence
  TRAC targeting sequence
uacauuguugcccaggcugg

SEQ ID NO: 21530 - RNA, 20 nt, Artificial Sequence
  TRAC targeting sequence
agccugggcaacaauguaag

SEQ ID NO: 21531 - RNA, 20 nt, Artificial Sequence
  TRAC targeting sequence
cagguccacagcuaauucuu

SEQ ID NO: 21532 - RNA, 20 nt, Artificial Sequence
  TRAC targeting sequence
acagcuaauucuucaguaca

SEQ ID NO: 21533 - RNA, 20 nt, Artificial Sequence
  TRAC targeting sequence
ucaguacaugucaaauugag

SEQ ID NO: 21534 - RNA, 20 nt, Artificial Sequence
  TRAC targeting sequence
guacaugucaaauugagaac

SEQ ID NO: 21535 - RNA, 20 nt, Artificial Sequence
  TRAC targeting sequence
aauugagaaccauaaagcaa

SEQ ID NO: 21536 - RNA, 20 nt, Artificial Sequence
  TRAC targeting sequence
auuugacauguacugaagaa

SEQ ID NO: 21537 - RNA, 20 nt, Artificial Sequence
  TRAC targeting sequence
caauuugacauguacugaag

SEQ ID NO: 21538 - RNA, 20 nt, Artificial Sequence
  TRAC targeting sequence
acagaagcauaaaaacaaga

SEQ ID NO: 21539 - RNA, 20 nt, Artificial Sequence
  TRAC targeting sequence
guugauuugcuuuaugguuc

SEQ ID NO: 21540 - RNA, 20 nt, Artificial Sequence
  TRAC targeting sequence
uguuuuuaugcuucuguuga

SEQ ID NO: 21541 - RNA, 20 nt, Artificial Sequence
  TRAC targeting sequence
uuauagguaacucuuguuuu

SEQ ID NO: 21542 - RNA, 20 nt, Artificial Sequence
  TRAC targeting sequence
aaucccaacacuccaaaagc

SEQ ID NO: 21543 - RNA, 20 nt, Artificial Sequence
  TRAC targeting sequence
caacacuccaaaagcagucu

SEQ ID NO: 21544 - RNA, 20 nt, Artificial Sequence
  TRAC targeting sequence
aaaagcagucuguagguuuu

SEQ ID NO: 21545 - RNA, 20 nt, Artificial Sequence
  TRAC targeting sequence
guagguuuuagccccgaagc

SEQ ID NO: 21546 - RNA, 20 nt, Artificial Sequence
  TRAC targeting sequence
gggcuaaaaccuacagacug

SEQ ID NO: 21547 - RNA, 20 nt, Artificial Sequence
  TRAC targeting sequence
auauuugcuucggggcuaaa

SEQ ID NO: 21548 - RNA, 20 nt, Artificial Sequence
  TRAC targeting sequence
uuucaauauuugcuucgggg

SEQ ID NO: 21549 - RNA, 20 nt, Artificial Sequence
  TRAC targeting sequence
uuggugugucuuuucaauau

SEQ ID NO: 21550 - RNA, 20 nt, Artificial Sequence
  TRAC targeting sequence
ucuuuggugugucuuuucaa

SEQ ID NO: 21551 - RNA, 20 nt, Artificial Sequence
  TRAC targeting sequence
uguugaugguaacuggcuug

SEQ ID NO: 21552 - RNA, 20 nt, Artificial Sequence
  TRAC targeting sequence
acaggaaacauucuucuuug

SEQ ID NO: 21553 - RNA, 20 nt, Artificial Sequence
  TRAC targeting sequence
caaccucugagacaauagcu

SEQ ID NO: 21554 - RNA, 20 nt, Artificial Sequence
  TRAC targeting sequence
gagacaauagcugaccuggu

SEQ ID NO: 21555 - RNA, 20 nt, Artificial Sequence
  TRAC targeting sequence
gagguugugauuuacccaag

SEQ ID NO: 21556 - RNA, 20 nt, Artificial Sequence
  TRAC targeting sequence
cagagguugugauuuaccca

SEQ ID NO: 21557 - RNA, 20 nt, Artificial Sequence
  TRAC targeting sequence
gcuauugucucagagguugu

SEQ ID NO: 21558 - RNA, 20 nt, Artificial Sequence
  TRAC targeting sequence
cauuuaccaggucagcuauu

SEQ ID NO: 21559 - RNA, 20 nt, Artificial Sequence
  TRAC targeting sequence
cauguaucucaagaucauua

SEQ ID NO: 21560 - RNA, 20 nt, Artificial Sequence
  TRAC targeting sequence
caagaucauuaugaaaaauu

SEQ ID NO: 21561 - RNA, 20 nt, Artificial Sequence
  TRAC targeting sequence
agaucauuaugaaaaauuaa

SEQ ID NO: 21562 - RNA, 20 nt, Artificial Sequence
  TRAC targeting sequence
ugagauacaugggacaggua

SEQ ID NO: 21563 - RNA, 20 nt, Artificial Sequence
  TRAC targeting sequence
uuaugaaaaauuaaacaaaa

SEQ ID NO: 21564 - RNA, 20 nt, Artificial Sequence
  TRAC targeting sequence
uaaugaucuugagauacaug

SEQ ID NO: 21565 - RNA, 20 nt, Artificial Sequence
  TRAC targeting sequence
uuaauacauagguuuuguuu

SEQ ID NO: 21566 - RNA, 20 nt, Artificial Sequence
  TRAC targeting sequence
uccuucauaaaauuacuauu

SEQ ID NO: 21567 - RNA, 20 nt, Artificial Sequence
  TRAC targeting sequence
uucauaaaauuacuauuauu

SEQ ID NO: 21568 - RNA, 20 nt, Artificial Sequence
  TRAC targeting sequence
uaaaauuacuauuauuccca

SEQ ID NO: 21569 - RNA, 20 nt, Artificial Sequence
  TRAC targeting sequence
caguuuucaacccgugucuc

SEQ ID NO: 21570 - RNA, 20 nt, Artificial Sequence
  TRAC targeting sequence
acccgugucucaaaguccag

SEQ ID NO: 21571 - RNA, 20 nt, Artificial Sequence
  TRAC targeting sequence
caaaguccagaugcuuuucu

SEQ ID NO: 21572 - RNA, 20 nt, Artificial Sequence
  TRAC targeting sequence
aaguccagaugcuuuucuua

SEQ ID NO: 21573 - RNA, 20 nt, Artificial Sequence
  TRAC targeting sequence
agaugcuuuucuuauucaaa

SEQ ID NO: 21574 - RNA, 20 nt, Artificial Sequence
  TRAC targeting sequence
ggacuuugagacacggguug

SEQ ID NO: 21575 - RNA, 20 nt, Artificial Sequence
  TRAC targeting sequence
uauucaaaauuccaauuucu

SEQ ID NO: 21576 - RNA, 20 nt, Artificial Sequence
  TRAC targeting sequence
aaauuccaauuucucuagac

SEQ ID NO: 21577 - RNA, 20 nt, Artificial Sequence
  TRAC targeting sequence
aauuucucuagacuaaaaau

SEQ ID NO: 21578 - RNA, 20 nt, Artificial Sequence
  TRAC targeting sequence
cuagacuaaaaauuauccag

SEQ ID NO: 21579 - RNA, 20 nt, Artificial Sequence
  TRAC targeting sequence
agacuaaaaauuauccagaa

SEQ ID NO: 21580 - RNA, 20 nt, Artificial Sequence
  TRAC targeting sequence
agagaaauuggaauuuugaa

SEQ ID NO: 21581 - RNA, 20 nt, Artificial Sequence
  TRAC targeting sequence
agaagccuccugauaggguc

SEQ ID NO: 21582 - RNA, 20 nt, Artificial Sequence
  TRAC targeting sequence
ggauaauuuuuagucuagag

SEQ ID NO: 21583 - RNA, 20 nt, Artificial Sequence
  TRAC targeting sequence
ugauagggucugugacaucu

SEQ ID NO: 21584 - RNA, 20 nt, Artificial Sequence
  TRAC targeting sequence
ggaggcuucuggauaauuuu

SEQ ID NO: 21585 - RNA, 20 nt, Artificial Sequence
  TRAC targeting sequence
gugacaucuguauauaaguu

SEQ ID NO: 21586 - RNA, 20 nt, Artificial Sequence
  TRAC targeting sequence
cagacccuaucaggaggcuu

SEQ ID NO: 21587 - RNA, 20 nt, Artificial Sequence
  TRAC targeting sequence
guauauaaguuuuagaacag

SEQ ID NO: 21588 - RNA, 20 nt, Artificial Sequence
  TRAC targeting sequence
aaaacuuauauacagauguc

SEQ ID NO: 21589 - RNA, 20 nt, Artificial Sequence
  TRAC targeting sequence
guucuaaaacuuauauacag

SEQ ID NO: 21590 - RNA, 20 nt, Artificial Sequence
  TRAC targeting sequence
cgccuauaaucccagcacuu

SEQ ID NO: 21591 - RNA, 20 nt, Artificial Sequence
  TRAC targeting sequence
cagcacuuugggaggcugag

SEQ ID NO: 21592 - RNA, 20 nt, Artificial Sequence
  TRAC targeting sequence
caaagugcugggauuauagg

SEQ ID NO: 21593 - RNA, 20 nt, Artificial Sequence
  TRAC targeting sequence
gccucccaaagugcugggau

SEQ ID NO: 21594 - RNA, 20 nt, Artificial Sequence
  TRAC targeting sequence
gcccgccucagccucccaaa

SEQ ID NO: 21595 - RNA, 20 nt, Artificial Sequence
  TRAC targeting sequence
ccugaggucaggaguuugag

SEQ ID NO: 21596 - RNA, 20 nt, Artificial Sequence
  TRAC targeting sequence
ggugaucugcccgccucagc

SEQ ID NO: 21597 - RNA, 20 nt, Artificial Sequence
  TRAC targeting sequence
ggaguuugagaccagccuga

SEQ ID NO: 21598 - RNA, 20 nt, Artificial Sequence
  TRAC targeting sequence
ugaccucaggugaucugccc

SEQ ID NO: 21599 - RNA, 20 nt, Artificial Sequence
  TRAC targeting sequence
aacuccugaccucaggugau

SEQ ID NO: 21600 - RNA, 20 nt, Artificial Sequence
  TRAC targeting sequence
caaacuccugaccucaggug

SEQ ID NO: 21601 - RNA, 20 nt, Artificial Sequence
  TRAC targeting sequence
ggcuggucucaaacuccuga

SEQ ID NO: 21602 - RNA, 20 nt, Artificial Sequence
  TRAC targeting sequence
auguuggucaggcuggucuc

SEQ ID NO: 21603 - RNA, 20 nt, Artificial Sequence
  TRAC targeting sequence
ccauguuggucaggcugguc

SEQ ID NO: 21604 - RNA, 20 nt, Artificial Sequence
  TRAC targeting sequence
cuacuaaaaauacaaaaauu

SEQ ID NO: 21605 - RNA, 20 nt, Artificial Sequence
  TRAC targeting sequence
acuaaaaauacaaaaauuag

SEQ ID NO: 21606 - RNA, 20 nt, Artificial Sequence
  TRAC targeting sequence
cagcuacucgggaggcuggg

SEQ ID NO: 21607 - RNA, 20 nt, Artificial Sequence
  TRAC targeting sequence
ggaggcuggggugggagaau

SEQ ID NO: 21608 - RNA, 20 nt, Artificial Sequence
  TRAC targeting sequence
cgaguagcugggauuauagg

SEQ ID NO: 21609 - RNA, 20 nt, Artificial Sequence
  TRAC targeting sequence
caccccagccucccgaguag

SEQ ID NO: 21610 - RNA, 20 nt, Artificial Sequence
  TRAC targeting sequence
cccaccccagccucccgagu

SEQ ID NO: 21611 - RNA, 20 nt, Artificial Sequence
  TRAC targeting sequence
agcaauucucccaccccagc

SEQ ID NO: 21612 - RNA, 20 nt, Artificial Sequence
  TRAC targeting sequence
uggguucaagcaauucuccc

SEQ ID NO: 21613 - RNA, 20 nt, Artificial Sequence
  TRAC targeting sequence
gccuccuggguucaagcaau

SEQ ID NO: 21614 - RNA, 20 nt, Artificial Sequence
  TRAC targeting sequence
cugcaaccuccgccuccugg

SEQ ID NO: 21615 - RNA, 20 nt, Artificial Sequence
  TRAC targeting sequence
gcucacugcaaccuccgccu

SEQ ID NO: 21616 - RNA, 20 nt, Artificial Sequence
  TRAC targeting sequence
cggcucacugcaaccuccgc

SEQ ID NO: 21617 - RNA, 20 nt, Artificial Sequence
  TRAC targeting sequence
caccauugcacuccagccug

SEQ ID NO: 21618 - RNA, 20 nt, Artificial Sequence
  TRAC targeting sequence
agccuggguaacgagagcaa

SEQ ID NO: 21619 - RNA, 20 nt, Artificial Sequence
  TRAC targeting sequence
uuacccaggcuggagugcaa

SEQ ID NO: 21620 - RNA, 20 nt, Artificial Sequence
  TRAC targeting sequence
cguuacccaggcuggagugc

SEQ ID NO: 21621 - RNA, 20 nt, Artificial Sequence
  TRAC targeting sequence
aucucacaaaaacaaaaaag

SEQ ID NO: 21622 - RNA, 20 nt, Artificial Sequence
  TRAC targeting sequence
cacaaaaacaaaaaagaaaa

SEQ ID NO: 21623 - RNA, 20 nt, Artificial Sequence
  TRAC targeting sequence
caaaaacaaaaaagaaaaaa

SEQ ID NO: 21624 - RNA, 20 nt, Artificial Sequence
  TRAC targeting sequence
uuuuuguuuuugugagaugg

SEQ ID NO: 21625 - RNA, 20 nt, Artificial Sequence
  TRAC targeting sequence
gcacuuuuuuuuuucuuuuu

SEQ ID NO: 21626 - RNA, 20 nt, Artificial Sequence
  TRAC targeting sequence
guuauaaucucaaugaacua

SEQ ID NO: 21627 - RNA, 20 nt, Artificial Sequence
  TRAC targeting sequence
caaugaacuaguaucacuua

SEQ ID NO: 21628 - RNA, 20 nt, Artificial Sequence
  TRAC targeting sequence
augaacuaguaucacuuaag

SEQ ID NO: 21629 - RNA, 20 nt, Artificial Sequence
  TRAC targeting sequence
uugagauuauaacugagcag

SEQ ID NO: 21630 - RNA, 20 nt, Artificial Sequence
  TRAC targeting sequence
cuuaagaauggcaaaccaug

SEQ ID NO: 21631 - RNA, 20 nt, Artificial Sequence
  TRAC targeting sequence
uaagugauacuaguucauug

SEQ ID NO: 21632 - RNA, 20 nt, Artificial Sequence
  TRAC targeting sequence
ugguuugccauucuuaagug

SEQ ID NO: 21633 - RNA, 20 nt, Artificial Sequence
  TRAC targeting sequence
cuuuauuuauaaaaauuggu

SEQ ID NO: 21634 - RNA, 20 nt, Artificial Sequence
  TRAC targeting sequence
acuaucacuuuauuuauaaa

SEQ ID NO: 21635 - RNA, 20 nt, Artificial Sequence
  TRAC targeting sequence
uuaaacaaaugggcauggcu

SEQ ID NO: 21636 - RNA, 20 nt, Artificial Sequence
  TRAC targeting sequence
gcaagcuuuuccuuaaacaa

SEQ ID NO: 21637 - RNA, 20 nt, Artificial Sequence
  TRAC targeting sequence
ugacucaguguguuaccagu

SEQ ID NO: 21638 - RNA, 20 nt, Artificial Sequence
  TRAC targeting sequence
ggaguccgcaagcuuuuccu

SEQ ID NO: 21639 - RNA, 20 nt, Artificial Sequence
  TRAC targeting sequence
guguguuaccaguuaggcag

SEQ ID NO: 21640 - RNA, 20 nt, Artificial Sequence
  TRAC targeting sequence
gccuaacugguaacacacug

SEQ ID NO: 21641 - RNA, 20 nt, Artificial Sequence
  TRAC targeting sequence
cugccuaacugguaacacac

SEQ ID NO: 21642 - RNA, 20 nt, Artificial Sequence
  TRAC targeting sequence
uauuagcucucugccuaacu

SEQ ID NO: 21643 - RNA, 20 nt, Artificial Sequence
  TRAC targeting sequence
ccaaguuccuagguaaucuu

SEQ ID NO: 21644 - RNA, 20 nt, Artificial Sequence
  TRAC targeting sequence
uagguaaucuugagacaugc

SEQ ID NO: 21645 - RNA, 20 nt, Artificial Sequence
  TRAC targeting sequence
ugagacaugccaaacuuuga

SEQ ID NO: 21646 - RNA, 20 nt, Artificial Sequence
  TRAC targeting sequence
agauuaccuaggaacuuggu

SEQ ID NO: 21647 - RNA, 20 nt, Artificial Sequence
  TRAC targeting sequence
caagauuaccuaggaacuug

SEQ ID NO: 21648 - RNA, 20 nt, Artificial Sequence
  TRAC targeting sequence
aaguuuggcaugucucaaga

SEQ ID NO: 21649 - RNA, 20 nt, Artificial Sequence
  TRAC targeting sequence
caaaguuuggcaugucucaa

SEQ ID NO: 21650 - RNA, 20 nt, Artificial Sequence
  TRAC targeting sequence
acagcagugguucucaaagu

SEQ ID NO: 21651 - RNA, 20 nt, Artificial Sequence
  TRAC targeting sequence
ucuacagcagugguucucaa

SEQ ID NO: 21652 - RNA, 20 nt, Artificial Sequence
  TRAC targeting sequence
caucuacagcagugguucuc

SEQ ID NO: 21653 - RNA, 20 nt, Artificial Sequence
  TRAC targeting sequence
cucaucuacagcagugguuc

SEQ ID NO: 21654 - RNA, 20 nt, Artificial Sequence
  TRAC targeting sequence
caaaucuuauugugcacaua

SEQ ID NO: 21655 - RNA, 20 nt, Artificial Sequence
  TRAC targeting sequence
aaucuuauugugcacauaaa

SEQ ID NO: 21656 - RNA, 20 nt, Artificial Sequence
  TRAC targeting sequence
uauugugcacauaaaucacc

SEQ ID NO: 21657 - RNA, 20 nt, Artificial Sequence
  TRAC targeting sequence
ccggaggaccuuguuaaaau

SEQ ID NO: 21658 - RNA, 20 nt, Artificial Sequence
  TRAC targeting sequence
ggugauuuaugugcacaaua

SEQ ID NO: 21659 - RNA, 20 nt, Artificial Sequence
  TRAC targeting sequence
uccggugauuuaugugcaca

SEQ ID NO: 21660 - RNA, 20 nt, Artificial Sequence
  TRAC targeting sequence
uuuuaacaagguccuccggu

SEQ ID NO: 21661 - RNA, 20 nt, Artificial Sequence
  TRAC targeting sequence
ucauuuuaacaagguccucc

SEQ ID NO: 21662 - RNA, 20 nt, Artificial Sequence
  TRAC targeting sequence
guagguuuggggugaggccu

SEQ ID NO: 21663 - RNA, 20 nt, Artificial Sequence
  TRAC targeting sequence
ccccaaaccuacagaagcaa

SEQ ID NO: 21664 - RNA, 20 nt, Artificial Sequence
  TRAC targeting sequence
caggcgaugccaauacuggu

SEQ ID NO: 21665 - RNA, 20 nt, Artificial Sequence
  TRAC targeting sequence
ccugggagcacaggccucac

SEQ ID NO: 21666 - RNA, 20 nt, Artificial Sequence
  TRAC targeting sequence
augacuacauuuugaguagc

SEQ ID NO: 21667 - RNA, 20 nt, Artificial Sequence
  TRAC targeting sequence
uugacuaccaguauuggcau

SEQ ID NO: 21668 - RNA, 20 nt, Artificial Sequence
  TRAC targeting sequence
aaauguagucauugacuacc

SEQ ID NO: 21669 - RNA, 20 nt, Artificial Sequence
  TRAC targeting sequence
ugcuacucaaaauguaguca

SEQ ID NO: 21670 - RNA, 20 nt, Artificial Sequence
  TRAC targeting sequence
agagcaguguuucuccaauu

SEQ ID NO: 21671 - RNA, 20 nt, Artificial Sequence
  TRAC targeting sequence
ggauucuugcuacucaaaau

SEQ ID NO: 21672 - RNA, 20 nt, Artificial Sequence
  TRAC targeting sequence
ccaauuugcugugcucugga

SEQ ID NO: 21673 - RNA, 20 nt, Artificial Sequence
  TRAC targeting sequence
aauuugcugugcucuggaau

SEQ ID NO: 21674 - RNA, 20 nt, Artificial Sequence
  TRAC targeting sequence
ggaaucaccuggguagcuuu

SEQ ID NO: 21675 - RNA, 20 nt, Artificial Sequence
  TRAC targeting sequence
agagcacagcaaauuggaga

SEQ ID NO: 21676 - RNA, 20 nt, Artificial Sequence
  TRAC targeting sequence
ccuggguagcuuuacaaacu

SEQ ID NO: 21677 - RNA, 20 nt, Artificial Sequence
  TRAC targeting sequence
guaguuuguaaagcuaccca

SEQ ID NO: 21678 - RNA, 20 nt, Artificial Sequence
  TRAC targeting sequence
ugggguggcuucuguaguuu

SEQ ID NO: 21679 - RNA, 20 nt, Artificial Sequence
  TRAC targeting sequence
cuugggguggcuucuguagu

SEQ ID NO: 21680 - RNA, 20 nt, Artificial Sequence
  TRAC targeting sequence
aggccacaacccacaccaau

SEQ ID NO: 21681 - RNA, 20 nt, Artificial Sequence
  TRAC targeting sequence
caacguccaggccacaaccc

SEQ ID NO: 21682 - RNA, 20 nt, Artificial Sequence
  TRAC targeting sequence
uuuuacauuacccaagucau

SEQ ID NO: 21683 - RNA, 20 nt, Artificial Sequence
  TRAC targeting sequence
ugcuaacgugcagccaaguu

SEQ ID NO: 21684 - RNA, 20 nt, Artificial Sequence
  TRAC targeting sequence
aacuuggcugcacguuagca

SEQ ID NO: 21685 - RNA, 20 nt, Artificial Sequence
  TRAC targeting sequence
ccaacuuggcugcacguuag

SEQ ID NO: 21686 - RNA, 20 nt, Artificial Sequence
  TRAC targeting sequence
agcuucuccaacuuggcugc

SEQ ID NO: 21687 - RNA, 20 nt, Artificial Sequence
  TRAC targeting sequence
ucauucucgguaguuggcua

SEQ ID NO: 21688 - RNA, 20 nt, Artificial Sequence
  TRAC targeting sequence
uucucgguaguuggcuaaau

SEQ ID NO: 21689 - RNA, 20 nt, Artificial Sequence
  TRAC targeting sequence
cgguaguuggcuaaauuuaa

SEQ ID NO: 21690 - RNA, 20 nt, Artificial Sequence
  TRAC targeting sequence
guaguuggcuaaauuuaagu

SEQ ID NO: 21691 - RNA, 20 nt, Artificial Sequence
  TRAC targeting sequence
caacauagcuuccgccccau

SEQ ID NO: 21692 - RNA, 20 nt, Artificial Sequence
  TRAC targeting sequence
acauagcuuccgccccauau

SEQ ID NO: 21693 - RNA, 20 nt, Artificial Sequence
  TRAC targeting sequence
gccccauauauagcaaccca

SEQ ID NO: 21694 - RNA, 20 nt, Artificial Sequence
  TRAC targeting sequence
ugggugcuguuggguugcua

SEQ ID NO: 21695 - RNA, 20 nt, Artificial Sequence
  TRAC targeting sequence
ucuugggugcuguuggguug

SEQ ID NO: 21696 - RNA, 20 nt, Artificial Sequence
  TRAC targeting sequence
cagcccuguuuucaucuugg

SEQ ID NO: 21697 - RNA, 20 nt, Artificial Sequence
  TRAC targeting sequence
uguucgcagcccuguuuuca

SEQ ID NO: 21698 - RNA, 20 nt, Artificial Sequence
  TRAC targeting sequence
gucauguucgcagcccuguu

SEQ ID NO: 21699 - RNA, 20 nt, Artificial Sequence
  TRAC targeting sequence
gccagcagaccuacauucca

SEQ ID NO: 21700 - RNA, 20 nt, Artificial Sequence
  TRAC targeting sequence
gcuggcugaagucugucaug

SEQ ID NO: 21701 - RNA, 20 nt, Artificial Sequence
  TRAC targeting sequence
auccaagcuuugucaugaac

SEQ ID NO: 21702 - RNA, 20 nt, Artificial Sequence
  TRAC targeting sequence
aagcuuugucaugaacucug

SEQ ID NO: 21703 - RNA, 20 nt, Artificial Sequence
  TRAC targeting sequence
ugaacucugaucuuaagcaa

SEQ ID NO: 21704 - RNA, 20 nt, Artificial Sequence
  TRAC targeting sequence
ugacaaagcuuggauggaau

SEQ ID NO: 21705 - RNA, 20 nt, Artificial Sequence
  TRAC targeting sequence
gaucuuaagcaagucacaaa

SEQ ID NO: 21706 - RNA, 20 nt, Artificial Sequence
  TRAC targeting sequence
gaguucaugacaaagcuugg

SEQ ID NO: 21707 - RNA, 20 nt, Artificial Sequence
  TRAC targeting sequence
uaagcaagucacaaaucuga

SEQ ID NO: 21708 - RNA, 20 nt, Artificial Sequence
  TRAC targeting sequence
caaaucugaguuucaauuuc

SEQ ID NO: 21709 - RNA, 20 nt, Artificial Sequence
  TRAC targeting sequence
gaguuucaauuucuucaccu

SEQ ID NO: 21710 - RNA, 20 nt, Artificial Sequence
  TRAC targeting sequence
gauuugugacuugcuuaaga

SEQ ID NO: 21711 - RNA, 20 nt, Artificial Sequence
  TRAC targeting sequence
auuucuucaccuaacuaaug

SEQ ID NO: 21712 - RNA, 20 nt, Artificial Sequence
  TRAC targeting sequence
ucaccuaacuaaugaggaca

SEQ ID NO: 21713 - RNA, 20 nt, Artificial Sequence
  TRAC targeting sequence
ccuaacuaaugaggacagga

SEQ ID NO: 21714 - RNA, 20 nt, Artificial Sequence
  TRAC targeting sequence
uuaguuaggugaagaaauug

SEQ ID NO: 21715 - RNA, 20 nt, Artificial Sequence
  TRAC targeting sequence
ucauuaguuaggugaagaaa

SEQ ID NO: 21716 - RNA, 20 nt, Artificial Sequence
  TRAC targeting sequence
uguccucauuaguuagguga

SEQ ID NO: 21717 - RNA, 20 nt, Artificial Sequence
  TRAC targeting sequence
uagggguuccuguccucauu

SEQ ID NO: 21718 - RNA, 20 nt, Artificial Sequence
  TRAC targeting sequence
ugcaauuaucuuagggguuc

SEQ ID NO: 21719 - RNA, 20 nt, Artificial Sequence
  TRAC targeting sequence
uuuuauucuugcaauuaucu

SEQ ID NO: 21720 - RNA, 20 nt, Artificial Sequence
  TRAC targeting sequence
cauuuuauucuugcaauuau

SEQ ID NO: 21721 - RNA, 20 nt, Artificial Sequence
  TRAC targeting sequence
cucauuuuauucuugcaauu

SEQ ID NO: 21722 - RNA, 20 nt, Artificial Sequence
  TRAC targeting sequence
caaauauucucucauuuuau

SEQ ID NO: 21723 - RNA, 20 nt, Artificial Sequence
  TRAC targeting sequence
aaagcaccuucacaaauauu

SEQ ID NO: 21724 - RNA, 20 nt, Artificial Sequence
  TRAC targeting sequence
uauaagucaacacauacaua

SEQ ID NO: 21725 - RNA, 20 nt, Artificial Sequence
  TRAC targeting sequence
acacauacauaacccccauu

SEQ ID NO: 21726 - RNA, 20 nt, Artificial Sequence
  TRAC targeting sequence
cucugucuacauugccuaag

SEQ ID NO: 21727 - RNA, 20 nt, Artificial Sequence
  TRAC targeting sequence
gucuacauugccuaagagaa

SEQ ID NO: 21728 - RNA, 20 nt, Artificial Sequence
  TRAC targeting sequence
acauugccuaagagaaauau

SEQ ID NO: 21729 - RNA, 20 nt, Artificial Sequence
  TRAC targeting sequence
uaggcaauguagacagagug

SEQ ID NO: 21730 - RNA, 20 nt, Artificial Sequence
  TRAC targeting sequence
cuuaggcaauguagacagag

SEQ ID NO: 21731 - RNA, 20 nt, Artificial Sequence
  TRAC targeting sequence
cuuuuaccacuaaaacaugu

SEQ ID NO: 21732 - RNA, 20 nt, Artificial Sequence
  TRAC targeting sequence
acauguuuuagugguaaaag

SEQ ID NO: 21733 - RNA, 20 nt, Artificial Sequence
  TRAC targeting sequence
guuucaacauguuuuagugg

SEQ ID NO: 21734 - RNA, 20 nt, Artificial Sequence
  TRAC targeting sequence
auuucuagcagagugcauaa

SEQ ID NO: 21735 - RNA, 20 nt, Artificial Sequence
  TRAC targeting sequence
agcagagugcauaaugaugc

SEQ ID NO: 21736 - RNA, 20 nt, Artificial Sequence
  TRAC targeting sequence
gcuagaaauugaacuaagua

SEQ ID NO: 21737 - RNA, 20 nt, Artificial Sequence
  TRAC targeting sequence
uuaugcacucugcuagaaau

SEQ ID NO: 21738 - RNA, 20 nt, Artificial Sequence
  TRAC targeting sequence
aggaaugcacugucauaaga

SEQ ID NO: 21739 - RNA, 20 nt, Artificial Sequence
  TRAC targeting sequence
uggaacugcaucauuaugca

SEQ ID NO: 21740 - RNA, 20 nt, Artificial Sequence
  TRAC targeting sequence
uaagaguggaagcaccugua

SEQ ID NO: 21741 - RNA, 20 nt, Artificial Sequence
  TRAC targeting sequence
uaugacagugcauuccugga

SEQ ID NO: 21742 - RNA, 20 nt, Artificial Sequence
  TRAC targeting sequence
acucuuaugacagugcauuc

SEQ ID NO: 21743 - RNA, 20 nt, Artificial Sequence
  TRAC targeting sequence
aaggauuaguaaaggauuac

SEQ ID NO: 21744 - RNA, 20 nt, Artificial Sequence
  TRAC targeting sequence
auuguuacaggugcuuccac

SEQ ID NO: 21745 - RNA, 20 nt, Artificial Sequence
  TRAC targeting sequence
uucgauuguuacaggugcuu

SEQ ID NO: 21746 - RNA, 20 nt, Artificial Sequence
  TRAC targeting sequence
uuuacuaauccuucgauugu

SEQ ID NO: 21747 - RNA, 20 nt, Artificial Sequence
  TRAC targeting sequence
aggaagaagacaaaggacug

SEQ ID NO: 21748 - RNA, 20 nt, Artificial Sequence
  TRAC targeting sequence
uggagcagguaauccuuuac

SEQ ID NO: 21749 - RNA, 20 nt, Artificial Sequence
  TRAC targeting sequence
uccuggagcagguaauccuu

SEQ ID NO: 21750 - RNA, 20 nt, Artificial Sequence
  TRAC targeting sequence
ucuuccuggagcagguaauc

SEQ ID NO: 21751 - RNA, 20 nt, Artificial Sequence
  TRAC targeting sequence
uuugucuucuuccuggagca

SEQ ID NO: 21752 - RNA, 20 nt, Artificial Sequence
  TRAC targeting sequence
caggguugucagcacugccu

SEQ ID NO: 21753 - RNA, 20 nt, Artificial Sequence
  TRAC targeting sequence
gcacugccuuuugccauuaa

SEQ ID NO: 21754 - RNA, 20 nt, Artificial Sequence
  TRAC targeting sequence
aauauacuuaaugaaaacaa

SEQ ID NO: 21755 - RNA, 20 nt, Artificial Sequence
  TRAC targeting sequence
uuaaguauauuugaaguuaa

SEQ ID NO: 21756 - RNA, 20 nt, Artificial Sequence
  TRAC targeting sequence
uuguuuucauuaaguauauu

SEQ ID NO: 21757 - RNA, 20 nt, Artificial Sequence
  TRAC targeting sequence
cagcuguaaguuaccaacuc

SEQ ID NO: 21758 - RNA, 20 nt, Artificial Sequence
  TRAC targeting sequence
uaaagaguucagcacagagg

SEQ ID NO: 21759 - RNA, 20 nt, Artificial Sequence
  TRAC targeting sequence
uuaugaguugguaacuuaca

SEQ ID NO: 21760 - RNA, 20 nt, Artificial Sequence
  TRAC targeting sequence
gcacagaggacugaagagaa

SEQ ID NO: 21761 - RNA, 20 nt, Artificial Sequence
  TRAC targeting sequence
gugcugaacucuuuaugagu

SEQ ID NO: 21762 - RNA, 20 nt, Artificial Sequence
  TRAC targeting sequence
ucugugcugaacucuuuaug

SEQ ID NO: 21763 - RNA, 20 nt, Artificial Sequence
  TRAC targeting sequence
guccucugugcugaacucuu

SEQ ID NO: 21764 - RNA, 20 nt, Artificial Sequence
  TRAC targeting sequence
ucaguccucugugcugaacu

SEQ ID NO: 21765 - RNA, 20 nt, Artificial Sequence
  TRAC targeting sequence
cuucaguccucugugcugaa

SEQ ID NO: 21766 - RNA, 20 nt, Artificial Sequence
  TRAC targeting sequence
uuuuuuucucuucaguccuc

SEQ ID NO: 21767 - RNA, 20 nt, Artificial Sequence
  TRAC targeting sequence
gauaccagcaaagaauaaaa

SEQ ID NO: 21768 - RNA, 20 nt, Artificial Sequence
  TRAC targeting sequence
gaauccuuuuuuucucuuca

SEQ ID NO: 21769 - RNA, 20 nt, Artificial Sequence
  TRAC targeting sequence
uugcugguaucagaauccuu

SEQ ID NO: 21770 - RNA, 20 nt, Artificial Sequence
  TRAC targeting sequence
guuuuuauucuuugcuggua

SEQ ID NO: 21771 - RNA, 20 nt, Artificial Sequence
  TRAC targeting sequence
ggcucuguuuuuauucuuug

SEQ ID NO: 21772 - RNA, 20 nt, Artificial Sequence
  TRAC targeting sequence
auaugccucuggcucuguuu

SEQ ID NO: 21773 - RNA, 20 nt, Artificial Sequence
  TRAC targeting sequence
uccauaugccucuggcucug

SEQ ID NO: 21774 - RNA, 20 nt, Artificial Sequence
  TRAC targeting sequence
augccacuccuccauaugcc

SEQ ID NO: 21775 - RNA, 20 nt, Artificial Sequence
  TRAC targeting sequence
uuaauuuggaaggcaaaagg

SEQ ID NO: 21776 - RNA, 20 nt, Artificial Sequence
  TRAC targeting sequence
aaauuaaagaacuccaugcc

SEQ ID NO: 21777 - RNA, 20 nt, Artificial Sequence
  TRAC targeting sequence
uuaaauguaaccuuuugccu

SEQ ID NO: 21778 - RNA, 20 nt, Artificial Sequence
  TRAC targeting sequence
gccuuucauuaaauguaacc

SEQ ID NO: 21779 - RNA, 20 nt, Artificial Sequence
  TRAC targeting sequence
agccucugccuuucauuaaa

SEQ ID NO: 21780 - RNA, 20 nt, Artificial Sequence
  TRAC targeting sequence
aacaaacauuuauuaaucca

SEQ ID NO: 21781 - RNA, 20 nt, Artificial Sequence
  TRAC targeting sequence
gacacacagugaacucuggg

SEQ ID NO: 21782 - RNA, 20 nt, Artificial Sequence
  TRAC targeting sequence
gaacaacuuucuaacaaaca

SEQ ID NO: 21783 - RNA, 20 nt, Artificial Sequence
  TRAC targeting sequence
cugugugucagaacaacuuu

SEQ ID NO: 21784 - RNA, 20 nt, Artificial Sequence
  TRAC targeting sequence
gggcuuuucuccugcauaaa

SEQ ID NO: 21785 - RNA, 20 nt, Artificial Sequence
  TRAC targeting sequence
ccugcauaaaaagcagagcu

SEQ ID NO: 21786 - RNA, 20 nt, Artificial Sequence
  TRAC targeting sequence
ugcauaaaaagcagagcuag

SEQ ID NO: 21787 - RNA, 20 nt, Artificial Sequence
  TRAC targeting sequence
gcuuuuuaugcaggagaaaa

SEQ ID NO: 21788 - RNA, 20 nt, Artificial Sequence
  TRAC targeting sequence
gaagaaaauccaugugucca

SEQ ID NO: 21789 - RNA, 20 nt, Artificial Sequence
  TRAC targeting sequence
gauuugcacuuacugcuagc

SEQ ID NO: 21790 - RNA, 20 nt, Artificial Sequence
  TRAC targeting sequence
ucagauuugcacuuacugcu

SEQ ID NO: 21791 - RNA, 20 nt, Artificial Sequence
  TRAC targeting sequence
auguguccaauaagcugcca

SEQ ID NO: 21792 - RNA, 20 nt, Artificial Sequence
  TRAC targeting sequence
aauaagcugccaucuccaga

SEQ ID NO: 21793 - RNA, 20 nt, Artificial Sequence
  TRAC targeting sequence
ccagaacucuuauccaggaa

SEQ ID NO: 21794 - RNA, 20 nt, Artificial Sequence
  TRAC targeting sequence
agaacucuuauccaggaaau

SEQ ID NO: 21795 - RNA, 20 nt, Artificial Sequence
  TRAC targeting sequence
ggagauggcagcuuauugga

SEQ ID NO: 21796 - RNA, 20 nt, Artificial Sequence
  TRAC targeting sequence
uauccaggaaauucaaagag

SEQ ID NO: 21797 - RNA, 20 nt, Artificial Sequence
  TRAC targeting sequence
aggaaauucaaagagugaac

SEQ ID NO: 21798 - RNA, 20 nt, Artificial Sequence
  TRAC targeting sequence
uggauaagaguucuggagau

SEQ ID NO: 21799 - RNA, 20 nt, Artificial Sequence
  TRAC targeting sequence
aagagugaaccuagaagaaa

SEQ ID NO: 21800 - RNA, 20 nt, Artificial Sequence
  TRAC targeting sequence
uugaauuuccuggauaagag

SEQ ID NO: 21801 - RNA, 20 nt, Artificial Sequence
  TRAC targeting sequence
cucuuugaauuuccuggaua

SEQ ID NO: 21802 - RNA, 20 nt, Artificial Sequence
  TRAC targeting sequence
agguucacucuuugaauuuc

SEQ ID NO: 21803 - RNA, 20 nt, Artificial Sequence
  TRAC targeting sequence
ucuagguucacucuuugaau

SEQ ID NO: 21804 - RNA, 20 nt, Artificial Sequence
  TRAC targeting sequence
uaugauacuagagacagggc

SEQ ID NO: 21805 - RNA, 20 nt, Artificial Sequence
  TRAC targeting sequence
uaagacauuuaaccuugcug

SEQ ID NO: 21806 - RNA, 20 nt, Artificial Sequence
  TRAC targeting sequence
aguaucauaagacauuuaac

SEQ ID NO: 21807 - RNA, 20 nt, Artificial Sequence
  TRAC targeting sequence
cuaguaucauaagacauuua

SEQ ID NO: 21808 - RNA, 20 nt, Artificial Sequence
  TRAC targeting sequence
uuccaucuaaauucuaaccc

SEQ ID NO: 21809 - RNA, 20 nt, Artificial Sequence
  TRAC targeting sequence
aucuaaauucuaacccacaa

SEQ ID NO: 21810 - RNA, 20 nt, Artificial Sequence
  TRAC targeting sequence
aaauucuaacccacaagaca

SEQ ID NO: 21811 - RNA, 20 nt, Artificial Sequence
  TRAC targeting sequence
aacccacaagacaguuaugg

SEQ ID NO: 21812 - RNA, 20 nt, Artificial Sequence
  TRAC targeting sequence
uguggguuagaauuuagaug

SEQ ID NO: 21813 - RNA, 20 nt, Artificial Sequence
  TRAC targeting sequence
cacacucaggacaauauuua

SEQ ID NO: 21814 - RNA, 20 nt, Artificial Sequence
  TRAC targeting sequence
ggacaauauuuaaaccaggc

SEQ ID NO: 21815 - RNA, 20 nt, Artificial Sequence
  TRAC targeting sequence
ugagugugggaaccccauaa

SEQ ID NO: 21816 - RNA, 20 nt, Artificial Sequence
  TRAC targeting sequence
ccugguuuaaauauuguccu

SEQ ID NO: 21817 - RNA, 20 nt, Artificial Sequence
  TRAC targeting sequence
cgccugguuuaaauauuguc

SEQ ID NO: 21818 - RNA, 20 nt, Artificial Sequence
  TRAC targeting sequence
aguuuuucucgccugguuua

SEQ ID NO: 21819 - RNA, 20 nt, Artificial Sequence
  TRAC targeting sequence
uucuaguuuuucucgccugg

SEQ ID NO: 21820 - RNA, 20 nt, Artificial Sequence
  TRAC targeting sequence
aagaacauuuuaugggagua

SEQ ID NO: 21821 - RNA, 20 nt, Artificial Sequence
  TRAC targeting sequence
uugaaaaauacuugcuucuu

SEQ ID NO: 21822 - RNA, 20 nt, Artificial Sequence
  TRAC targeting sequence
cauaaaauguucuuugaaaa

SEQ ID NO: 21823 - RNA, 20 nt, Artificial Sequence
  TRAC targeting sequence
agaaaaauuaaugucaaaac

SEQ ID NO: 21824 - RNA, 20 nt, Artificial Sequence
  TRAC targeting sequence
ggauacuacucccauaaaau

SEQ ID NO: 21825 - RNA, 20 nt, Artificial Sequence
  TRAC targeting sequence
aaacugaauuucaagcacau

SEQ ID NO: 21826 - RNA, 20 nt, Artificial Sequence
  TRAC targeting sequence
guuuugacauuaauuuuucu

SEQ ID NO: 21827 - RNA, 20 nt, Artificial Sequence
  TRAC targeting sequence
agcacaucaaagcaaaacga

SEQ ID NO: 21828 - RNA, 20 nt, Artificial Sequence
  TRAC targeting sequence
aagcaaaacgaacuaggaac

SEQ ID NO: 21829 - RNA, 20 nt, Artificial Sequence
  TRAC targeting sequence
uuuugcuuugaugugcuuga

SEQ ID NO: 21830 - RNA, 20 nt, Artificial Sequence
  TRAC targeting sequence
uaguucguuuugcuuugaug

SEQ ID NO: 21831 - RNA, 20 nt, Artificial Sequence
  TRAC targeting sequence
caguuccuaguucguuuugc

SEQ ID NO: 21832 - RNA, 20 nt, Artificial Sequence
  TRAC targeting sequence
cacaguuccuaguucguuuu

SEQ ID NO: 21833 - RNA, 20 nt, Artificial Sequence
  TRAC targeting sequence
uaacuccagcucuaccauua

SEQ ID NO: 21834 - RNA, 20 nt, Artificial Sequence
  TRAC targeting sequence
agcucuaccauuaauuagcc

SEQ ID NO: 21835 - RNA, 20 nt, Artificial Sequence
  TRAC targeting sequence
accauuaauuagccgcaaga

SEQ ID NO: 21836 - RNA, 20 nt, Artificial Sequence
  TRAC targeting sequence
ugcggcuaauuaaugguaga

SEQ ID NO: 21837 - RNA, 20 nt, Artificial Sequence
  TRAC targeting sequence
cauaagucacugacuucccu

SEQ ID NO: 21838 - RNA, 20 nt, Artificial Sequence
  TRAC targeting sequence
cugacuucccuggcccacaa

SEQ ID NO: 21839 - RNA, 20 nt, Artificial Sequence
  TRAC targeting sequence
gugacuuaugugaagucuug

SEQ ID NO: 21840 - RNA, 20 nt, Artificial Sequence
  TRAC targeting sequence
cuggcccacaaauucuuuga

SEQ ID NO: 21841 - RNA, 20 nt, Artificial Sequence
  TRAC targeting sequence
uugaggugagaggguuguag

SEQ ID NO: 21842 - RNA, 20 nt, Artificial Sequence
  TRAC targeting sequence
aagaauuugugggccaggga

SEQ ID NO: 21843 - RNA, 20 nt, Artificial Sequence
  TRAC targeting sequence
ccucaaagaauuugugggcc

SEQ ID NO: 21844 - RNA, 20 nt, Artificial Sequence
  TRAC targeting sequence
caccucaaagaauuuguggg

SEQ ID NO: 21845 - RNA, 20 nt, Artificial Sequence
  TRAC targeting sequence
uuagguuaaacuacaacccu

SEQ ID NO: 21846 - RNA, 20 nt, Artificial Sequence
  TRAC targeting sequence
ggaaucuaaaaugcuuauga

SEQ ID NO: 21847 - RNA, 20 nt, Artificial Sequence
  TRAC targeting sequence
agaaagcucuuuagguuaaa

SEQ ID NO: 21848 - RNA, 20 nt, Artificial Sequence
  TRAC targeting sequence
aaaaugcuuaugaagcacag

SEQ ID NO: 21849 - RNA, 20 nt, Artificial Sequence
  TRAC targeting sequence
uaagcauuuuagauuccaga

SEQ ID NO: 21850 - RNA, 20 nt, Artificial Sequence
  TRAC targeting sequence
gugcuucauaagcauuuuag

SEQ ID NO: 21851 - RNA, 20 nt, Artificial Sequence
  TRAC targeting sequence
auugguggggaggcagggua

SEQ ID NO: 21852 - RNA, 20 nt, Artificial Sequence
  TRAC targeting sequence
ccaccaauggaaaucugugc

SEQ ID NO: 21853 - RNA, 20 nt, Artificial Sequence
  TRAC targeting sequence
cuacccugccuccccaccaa

SEQ ID NO: 21854 - RNA, 20 nt, Artificial Sequence
  TRAC targeting sequence
uuacuucccuacccugccuc

SEQ ID NO: 21855 - RNA, 20 nt, Artificial Sequence
  TRAC targeting sequence
agaaagaaagaaaaauuccc

SEQ ID NO: 21856 - RNA, 20 nt, Artificial Sequence
  TRAC targeting sequence
ugaauccuuacuucccuacc

SEQ ID NO: 21857 - RNA, 20 nt, Artificial Sequence
  TRAC targeting sequence
uucuugaauccuuacuuccc

SEQ ID NO: 21858 - RNA, 20 nt, Artificial Sequence
  TRAC targeting sequence
uucuuucuugaauccuuacu

SEQ ID NO: 21859 - RNA, 20 nt, Artificial Sequence
  TRAC targeting sequence
caaucucagcuauaacaaag

SEQ ID NO: 21860 - RNA, 20 nt, Artificial Sequence
  TRAC targeting sequence
cagcuauaacaaaggaccaa

SEQ ID NO: 21861 - RNA, 20 nt, Artificial Sequence
  TRAC targeting sequence
gcuauaacaaaggaccaaaa

SEQ ID NO: 21862 - RNA, 20 nt, Artificial Sequence
  TRAC targeting sequence
uuuguuauagcugagauugg

SEQ ID NO: 21863 - RNA, 20 nt, Artificial Sequence
  TRAC targeting sequence
uauauuuugguccuuuguua

SEQ ID NO: 21864 - RNA, 20 nt, Artificial Sequence
  TRAC targeting sequence
uuuaaagauaaguuuauuuu

SEQ ID NO: 21865 - RNA, 20 nt, Artificial Sequence
  TRAC targeting sequence
uuaaaugaaaacuaaauuau

SEQ ID NO: 21866 - RNA, 20 nt, Artificial Sequence
  TRAC targeting sequence
ugccaaaaauaaacuuaucu

SEQ ID NO: 21867 - RNA, 20 nt, Artificial Sequence
  TRAC targeting sequence
ccuuuuucuugccaaaaaua

SEQ ID NO: 21868 - RNA, 20 nt, Artificial Sequence
  TRAC targeting sequence
ucaccuuuuucuugccaaaa

SEQ ID NO: 21869 - RNA, 20 nt, Artificial Sequence
  TRAC targeting sequence
uucuucaccuuuuucuugcc

SEQ ID NO: 21870 - RNA, 20 nt, Artificial Sequence
  TRAC targeting sequence
guugcgguuacucuuucuuc

SEQ ID NO: 21871 - RNA, 20 nt, Artificial Sequence
  TRAC targeting sequence
agcagcaauguggccacuuc

SEQ ID NO: 21872 - RNA, 20 nt, Artificial Sequence
  TRAC targeting sequence
auuuggcucuagcagcaaug

SEQ ID NO: 21873 - RNA, 20 nt, Artificial Sequence
  TRAC targeting sequence
guuccauuuggcucuagcag

SEQ ID NO: 21874 - RNA, 20 nt, Artificial Sequence
  TRAC targeting sequence
caguuccauuuggcucuagc

SEQ ID NO: 21875 - RNA, 20 nt, Artificial Sequence
  TRAC targeting sequence
guaacuugugagguggaacc

SEQ ID NO: 21876 - RNA, 20 nt, Artificial Sequence
  TRAC targeting sequence
caaguuacagaucucaguuc

SEQ ID NO: 21877 - RNA, 20 nt, Artificial Sequence
  TRAC targeting sequence
accucacaaguuacagaucu

SEQ ID NO: 21878 - RNA, 20 nt, Artificial Sequence
  TRAC targeting sequence
ccacaagauacaggcuuccu

SEQ ID NO: 21879 - RNA, 20 nt, Artificial Sequence
  TRAC targeting sequence
uguggugaggguuccaccuc

SEQ ID NO: 21880 - RNA, 20 nt, Artificial Sequence
  TRAC targeting sequence
uuuagucccucaaagcacag

SEQ ID NO: 21881 - RNA, 20 nt, Artificial Sequence
  TRAC targeting sequence
cucaaagcacagccucccac

SEQ ID NO: 21882 - RNA, 20 nt, Artificial Sequence
  TRAC targeting sequence
aagcacagccucccaccuac

SEQ ID NO: 21883 - RNA, 20 nt, Artificial Sequence
  TRAC targeting sequence
caccuacuggacuccagcac

SEQ ID NO: 21884 - RNA, 20 nt, Artificial Sequence
  TRAC targeting sequence
aguaggugggaggcugugcu

SEQ ID NO: 21885 - RNA, 20 nt, Artificial Sequence
  TRAC targeting sequence
agcacagcucugguuggaaa

SEQ ID NO: 21886 - RNA, 20 nt, Artificial Sequence
  TRAC targeting sequence
gguuggaaagugaccuccag

SEQ ID NO: 21887 - RNA, 20 nt, Artificial Sequence
  TRAC targeting sequence
aaccagagcugugcuggagu

SEQ ID NO: 21888 - RNA, 20 nt, Artificial Sequence
  TRAC targeting sequence
cuuuccaaccagagcugugc

SEQ ID NO: 21889 - RNA, 20 nt, Artificial Sequence
  TRAC targeting sequence
agccuuaggggcuccaaugu

SEQ ID NO: 21890 - RNA, 20 nt, Artificial Sequence
  TRAC targeting sequence
aaugucuccagcuauaagca

SEQ ID NO: 21891 - RNA, 20 nt, Artificial Sequence
  TRAC targeting sequence
ccagcuauaagcaacugauu

SEQ ID NO: 21892 - RNA, 20 nt, Artificial Sequence
  TRAC targeting sequence
agcuauaagcaacugauuuu

SEQ ID NO: 21893 - RNA, 20 nt, Artificial Sequence
  TRAC targeting sequence
guugcuuauagcuggagaca

SEQ ID NO: 21894 - RNA, 20 nt, Artificial Sequence
  TRAC targeting sequence
cagugugccauaaaaauacu

SEQ ID NO: 21895 - RNA, 20 nt, Artificial Sequence
  TRAC targeting sequence
ccuacguguaccaugacuca

SEQ ID NO: 21896 - RNA, 20 nt, Artificial Sequence
  TRAC targeting sequence
uacguguaccaugacucaaa

SEQ ID NO: 21897 - RNA, 20 nt, Artificial Sequence
  TRAC targeting sequence
ugguacacguaggagauugc

SEQ ID NO: 21898 - RNA, 20 nt, Artificial Sequence
  TRAC targeting sequence
aaagaggcugggaaauacua

SEQ ID NO: 21899 - RNA, 20 nt, Artificial Sequence
  TRAC targeting sequence
uuugagucaugguacacgua

SEQ ID NO: 21900 - RNA, 20 nt, Artificial Sequence
  TRAC targeting sequence
cagccucuuuugagucaugg

SEQ ID NO: 21901 - RNA, 20 nt, Artificial Sequence
  TRAC targeting sequence
gaagaaccgggcugccccag

SEQ ID NO: 21902 - RNA, 20 nt, Artificial Sequence
  TRAC targeting sequence
gaaagguaguauuucccagc

SEQ ID NO: 21903 - RNA, 20 nt, Artificial Sequence
  TRAC targeting sequence
ucugaaagguaguauuuccc

SEQ ID NO: 21904 - RNA, 20 nt, Artificial Sequence
  TRAC targeting sequence
uggggcagcccgguucuucu

SEQ ID NO: 21905 - RNA, 20 nt, Artificial Sequence
  TRAC targeting sequence
uccuggggcagcccgguucu

SEQ ID NO: 21906 - RNA, 20 nt, Artificial Sequence
  TRAC targeting sequence
aguaaguaaccuggagauuc

SEQ ID NO: 21907 - RNA, 20 nt, Artificial Sequence
  TRAC targeting sequence
agguuacuuacuugacccaa

SEQ ID NO: 21908 - RNA, 20 nt, Artificial Sequence
  TRAC targeting sequence
ccagguuacuuacuugaccc

SEQ ID NO: 21909 - RNA, 20 nt, Artificial Sequence
  TRAC targeting sequence
ggcaucagaacuuaaaggag

SEQ ID NO: 21910 - RNA, 20 nt, Artificial Sequence
  TRAC targeting sequence
gaacuuaaaggagagauuuu

SEQ ID NO: 21911 - RNA, 20 nt, Artificial Sequence
  TRAC targeting sequence
gaugccagaaucuccagguu

SEQ ID NO: 21912 - RNA, 20 nt, Artificial Sequence
  TRAC targeting sequence
uuuaaguucugaugccagaa

SEQ ID NO: 21913 - RNA, 20 nt, Artificial Sequence
  TRAC targeting sequence
ccuuuaaguucugaugccag

SEQ ID NO: 21914 - RNA, 20 nt, Artificial Sequence
  TRAC targeting sequence
cuccuuuaaguucugaugcc

SEQ ID NO: 21915 - RNA, 20 nt, Artificial Sequence
  TRAC targeting sequence
aaaaucucuccuuuaaguuc

SEQ ID NO: 21916 - RNA, 20 nt, Artificial Sequence
  TRAC targeting sequence
gccagaaugcuuuuauuuca

SEQ ID NO: 21917 - RNA, 20 nt, Artificial Sequence
  TRAC targeting sequence
ggcugaaaguccaaaaucuc

SEQ ID NO: 21918 - RNA, 20 nt, Artificial Sequence
  TRAC targeting sequence
cuaacacugguauuuacaga

SEQ ID NO: 21919 - RNA, 20 nt, Artificial Sequence
  TRAC targeting sequence
guaaauaccaguguuaguga

SEQ ID NO: 21920 - RNA, 20 nt, Artificial Sequence
  TRAC targeting sequence
gcaauuauguagcauuucug

SEQ ID NO: 21921 - RNA, 20 nt, Artificial Sequence
  TRAC targeting sequence
ugaaucagugguauuauaag

SEQ ID NO: 21922 - RNA, 20 nt, Artificial Sequence
  TRAC targeting sequence
ggaauguucugcaauuaugu

SEQ ID NO: 21923 - RNA, 20 nt, Artificial Sequence
  TRAC targeting sequence
gugguauuauaagaaaugua

SEQ ID NO: 21924 - RNA, 20 nt, Artificial Sequence
  TRAC targeting sequence
uauaauaccacugauucagg

SEQ ID NO: 21925 - RNA, 20 nt, Artificial Sequence
  TRAC targeting sequence
uuuauacauuucuuauaaua

SEQ ID NO: 21926 - RNA, 20 nt, Artificial Sequence
  TRAC targeting sequence
uucuuuuauacauuucuuau

SEQ ID NO: 21927 - RNA, 20 nt, Artificial Sequence
  TRAC targeting sequence
uguuauugcucuuucuuuua

SEQ ID NO: 21928 - RNA, 20 nt, Artificial Sequence
  TRAC targeting sequence
cagugccaaacaaaaccaaa

SEQ ID NO: 21929 - RNA, 20 nt, Artificial Sequence
  TRAC targeting sequence
guuugguuuuguuuggcacu

SEQ ID NO: 21930 - RNA, 20 nt, Artificial Sequence
  TRAC targeting sequence
aacucaccuauucauuccau

SEQ ID NO: 21931 - RNA, 20 nt, Artificial Sequence
  TRAC targeting sequence
ccuauucauuccaucaaauu

SEQ ID NO: 21932 - RNA, 20 nt, Artificial Sequence
  TRAC targeting sequence
uuccaucaaauuucuuaaag

SEQ ID NO: 21933 - RNA, 20 nt, Artificial Sequence
  TRAC targeting sequence
aucaaauuucuuaaagcaaa

SEQ ID NO: 21934 - RNA, 20 nt, Artificial Sequence
  TRAC targeting sequence
aauuucuuaaagcaaacucu

SEQ ID NO: 21935 - RNA, 20 nt, Artificial Sequence
  TRAC targeting sequence
uaaagcaaacucucuggcaa

SEQ ID NO: 21936 - RNA, 20 nt, Artificial Sequence
  TRAC targeting sequence
cuggcaauagacuaucagcc

SEQ ID NO: 21937 - RNA, 20 nt, Artificial Sequence
  TRAC targeting sequence
ggcaauagacuaucagccaa

SEQ ID NO: 21938 - RNA, 20 nt, Artificial Sequence
  TRAC targeting sequence
auugccagagaguuugcuuu

SEQ ID NO: 21939 - RNA, 20 nt, Artificial Sequence
  TRAC targeting sequence
gccaauauaacauuacagcu

SEQ ID NO: 21940 - RNA, 20 nt, Artificial Sequence
  TRAC targeting sequence
agacagaguuuugugcuugu

SEQ ID NO: 21941 - RNA, 20 nt, Artificial Sequence
  TRAC targeting sequence
ugaaaaaaaaaaaagcugua

SEQ ID NO: 21942 - RNA, 20 nt, Artificial Sequence
  TRAC targeting sequence
gucuugaaaaaaaaaaaagc

SEQ ID NO: 21943 - RNA, 20 nt, Artificial Sequence
  TRAC targeting sequence
aggcuggagugcaauggcgu

SEQ ID NO: 21944 - RNA, 20 nt, Artificial Sequence
  TRAC targeting sequence
agccuggacaacaagcacaa

SEQ ID NO: 21945 - RNA, 20 nt, Artificial Sequence
  TRAC targeting sequence
cgccauugcacuccagccug

SEQ ID NO: 21946 - RNA, 20 nt, Artificial Sequence
  TRAC targeting sequence
cgggucaccgcaaccuccgc

SEQ ID NO: 21947 - RNA, 20 nt, Artificial Sequence
  TRAC targeting sequence
ggucaccgcaaccuccgccu

SEQ ID NO: 21948 - RNA, 20 nt, Artificial Sequence
  TRAC targeting sequence
ccgcaaccuccgccucccgg

SEQ ID NO: 21949 - RNA, 20 nt, Artificial Sequence
  TRAC targeting sequence
gccucccggguucaggcgau

SEQ ID NO: 21950 - RNA, 20 nt, Artificial Sequence
  TRAC targeting sequence
cggguucaggcgauucucug

SEQ ID NO: 21951 - RNA, 20 nt, Artificial Sequence
  TRAC targeting sequence
ggcgauucucugcuucaacc

SEQ ID NO: 21952 - RNA, 20 nt, Artificial Sequence
  TRAC targeting sequence
ccugaacccgggaggcggag

SEQ ID NO: 21953 - RNA, 20 nt, Artificial Sequence
  TRAC targeting sequence
cugcuucaaccugcugagua

SEQ ID NO: 21954 - RNA, 20 nt, Artificial Sequence
  TRAC targeting sequence
gcuucaaccugcugaguagc

SEQ ID NO: 21955 - RNA, 20 nt, Artificial Sequence
  TRAC targeting sequence
accugcugaguagcugggau

SEQ ID NO: 21956 - RNA, 20 nt, Artificial Sequence
  TRAC targeting sequence
gcagguugaagcagagaauc

SEQ ID NO: 21957 - RNA, 20 nt, Artificial Sequence
  TRAC targeting sequence
cagcuacucagcagguugaa

SEQ ID NO: 21958 - RNA, 20 nt, Artificial Sequence
  TRAC targeting sequence
acuaaaaaugcaaaaauuag

SEQ ID NO: 21959 - RNA, 20 nt, Artificial Sequence
  TRAC targeting sequence
cuacuaaaaaugcaaaaauu

SEQ ID NO: 21960 - RNA, 20 nt, Artificial Sequence
  TRAC targeting sequence
ccauguuggucaggcugguc

SEQ ID NO: 21961 - RNA, 20 nt, Artificial Sequence
  TRAC targeting sequence
ggcuggucucgaacuccuga

SEQ ID NO: 21962 - RNA, 20 nt, Artificial Sequence
  TRAC targeting sequence
cgaacuccugaccucaggug

SEQ ID NO: 21963 - RNA, 20 nt, Artificial Sequence
  TRAC targeting sequence
aacuccugaccucaggugau

SEQ ID NO: 21964 - RNA, 20 nt, Artificial Sequence
  TRAC targeting sequence
agaccagccugaccaacaug

SEQ ID NO: 21965 - RNA, 20 nt, Artificial Sequence
  TRAC targeting sequence
ugaccucaggugauccaccc

SEQ ID NO: 21966 - RNA, 20 nt, Artificial Sequence
  TRAC targeting sequence
ggaguucgagaccagccuga

SEQ ID NO: 21967 - RNA, 20 nt, Artificial Sequence
  TRAC targeting sequence
ggugauccacccgccccagc

SEQ ID NO: 21968 - RNA, 20 nt, Artificial Sequence
  TRAC targeting sequence
ccugaggucaggaguucgag

SEQ ID NO: 21969 - RNA, 20 nt, Artificial Sequence
  TRAC targeting sequence
acccgccccagccucccaaa

SEQ ID NO: 21970 - RNA, 20 nt, Artificial Sequence
  TRAC targeting sequence
caaagugcugggaucacagg

SEQ ID NO: 21971 - RNA, 20 nt, Artificial Sequence
  TRAC targeting sequence
cagcacuuugggaggcuggg

SEQ ID NO: 21972 - RNA, 20 nt, Artificial Sequence
  TRAC targeting sequence
caggccaccaugccuggcua

SEQ ID NO: 21973 - RNA, 20 nt, Artificial Sequence
  TRAC targeting sequence
aauggccaaggugagagagg

SEQ ID NO: 21974 - RNA, 20 nt, Artificial Sequence
  TRAC targeting sequence
ccuuggccauuagaaaugua

SEQ ID NO: 21975 - RNA, 20 nt, Artificial Sequence
  TRAC targeting sequence
caccuuggccauuagaaaug

SEQ ID NO: 21976 - RNA, 20 nt, Artificial Sequence
  TRAC targeting sequence
cucaccuuggccauuagaaa

SEQ ID NO: 21977 - RNA, 20 nt, Artificial Sequence
  TRAC targeting sequence
ucucucaccuuggccauuag

SEQ ID NO: 21978 - RNA, 20 nt, Artificial Sequence
  TRAC targeting sequence
aguccucucucaccuuggcc

SEQ ID NO: 21979 - RNA, 20 nt, Artificial Sequence
  TRAC targeting sequence
uaaugccauuuucagugaac

SEQ ID NO: 21980 - RNA, 20 nt, Artificial Sequence
  TRAC targeting sequence
gugaacaaagccuugacacu

SEQ ID NO: 21981 - RNA, 20 nt, Artificial Sequence
  TRAC targeting sequence
cugaaaauggcauuaugauc

SEQ ID NO: 21982 - RNA, 20 nt, Artificial Sequence
  TRAC targeting sequence
aggcuuuguucacugaaaau

SEQ ID NO: 21983 - RNA, 20 nt, Artificial Sequence
  TRAC targeting sequence
aaaagugucaaggcuuuguu

SEQ ID NO: 21984 - RNA, 20 nt, Artificial Sequence
  TRAC targeting sequence
uuuauauuucuaaaaguguc

SEQ ID NO: 21985 - RNA, 20 nt, Artificial Sequence
  TRAC targeting sequence
uaguuuaguacaaaaucaaa

SEQ ID NO: 21986 - RNA, 20 nt, Artificial Sequence
  TRAC targeting sequence
aaguuuaaagauuuuauuau

SEQ ID NO: 21987 - RNA, 20 nt, Artificial Sequence
  TRAC targeting sequence
uuaaacuuugauuuuguacu

SEQ ID NO: 21988 - RNA, 20 nt, Artificial Sequence
  TRAC targeting sequence
aagaugcugaggccagucca

SEQ ID NO: 21989 - RNA, 20 nt, Artificial Sequence
  TRAC targeting sequence
uagauuuaaauguuuuaaua

SEQ ID NO: 21990 - RNA, 20 nt, Artificial Sequence
  TRAC targeting sequence
gcaucuuagauuuaaauguu

SEQ ID NO: 21991 - RNA, 20 nt, Artificial Sequence
  TRAC targeting sequence
acgugaaaggcaaaaauuga

SEQ ID NO: 21992 - RNA, 20 nt, Artificial Sequence
  TRAC targeting sequence
cguggacuggccucagcauc

SEQ ID NO: 21993 - RNA, 20 nt, Artificial Sequence
  TRAC targeting sequence
auuuuugccuuucacgugga

SEQ ID NO: 21994 - RNA, 20 nt, Artificial Sequence
  TRAC targeting sequence
ugagaguaagucucuuugau

SEQ ID NO: 21995 - RNA, 20 nt, Artificial Sequence
  TRAC targeting sequence
ugagucaauuuuugccuuuc

SEQ ID NO: 21996 - RNA, 20 nt, Artificial Sequence
  TRAC targeting sequence
caugagucaauuuuugccuu

SEQ ID NO: 21997 - RNA, 20 nt, Artificial Sequence
  TRAC targeting sequence
cuuugauagugguuuucaga

SEQ ID NO: 21998 - RNA, 20 nt, Artificial Sequence
  TRAC targeting sequence
uugauagugguuuucagaaa

SEQ ID NO: 21999 - RNA, 20 nt, Artificial Sequence
  TRAC targeting sequence
aagagacuuacucucaugag

SEQ ID NO: 22000 - RNA, 20 nt, Artificial Sequence
  TRAC targeting sequence
gaaaauucuguuuacaaaga

SEQ ID NO: 22001 - RNA, 20 nt, Artificial Sequence
  TRAC targeting sequence
gaaaaccacuaucaaagaga

SEQ ID NO: 22002 - RNA, 20 nt, Artificial Sequence
  TRAC targeting sequence
guuuacaaagaucugcuucc

SEQ ID NO: 22003 - RNA, 20 nt, Artificial Sequence
  TRAC targeting sequence
uuguaaacagaauuuucuga

SEQ ID NO: 22004 - RNA, 20 nt, Artificial Sequence
  TRAC targeting sequence
gcuuccccucuuuuaaagca

SEQ ID NO: 22005 - RNA, 20 nt, Artificial Sequence
  TRAC targeting sequence
ccucuuuuaaagcagaucua

SEQ ID NO: 22006 - RNA, 20 nt, Artificial Sequence
  TRAC targeting sequence
uuuaaagcagaucuauuuac

SEQ ID NO: 22007 - RNA, 20 nt, Artificial Sequence
  TRAC targeting sequence
gcuuuaaaagaggggaagca

SEQ ID NO: 22008 - RNA, 20 nt, Artificial Sequence
  TRAC targeting sequence
auuuaccagacacuauucua

SEQ ID NO: 22009 - RNA, 20 nt, Artificial Sequence
  TRAC targeting sequence
gguaaauagaucugcuuuaa

SEQ ID NO: 22010 - RNA, 20 nt, Artificial Sequence
  TRAC targeting sequence
aaaagcagagguucuaggau

SEQ ID NO: 22011 - RNA, 20 nt, Artificial Sequence
  TRAC targeting sequence
gcuuuuagaauagugucugg

SEQ ID NO: 22012 - RNA, 20 nt, Artificial Sequence
  TRAC targeting sequence
aggauucuuugaaauauuag

SEQ ID NO: 22013 - RNA, 20 nt, Artificial Sequence
  TRAC targeting sequence
uagaaccucugcuuuuagaa

SEQ ID NO: 22014 - RNA, 20 nt, Artificial Sequence
  TRAC targeting sequence
uugaaauauuagcucacaca

SEQ ID NO: 22015 - RNA, 20 nt, Artificial Sequence
  TRAC targeting sequence
aagaauccuagaaccucugc

SEQ ID NO: 22016 - RNA, 20 nt, Artificial Sequence
  TRAC targeting sequence
cacaauugacuacucaacag

SEQ ID NO: 22017 - RNA, 20 nt, Artificial Sequence
  TRAC targeting sequence
auugugugagcuaauauuuc

SEQ ID NO: 22018 - RNA, 20 nt, Artificial Sequence
  TRAC targeting sequence
acagcuaagaagaaugguuu

SEQ ID NO: 22019 - RNA, 20 nt, Artificial Sequence
  TRAC targeting sequence
uagcuguugaguagucaauu

SEQ ID NO: 22020 - RNA, 20 nt, Artificial Sequence
  TRAC targeting sequence
ucuuagcuguugaguaguca

SEQ ID NO: 22021 - RNA, 20 nt, Artificial Sequence
  TRAC targeting sequence
acuauuaaccagggcauaaa

SEQ ID NO: 22022 - RNA, 20 nt, Artificial Sequence
  TRAC targeting sequence
ggaaacugacuaauaaaauc

SEQ ID NO: 22023 - RNA, 20 nt, Artificial Sequence
  TRAC targeting sequence
ugaaaccuuuaugcccuggu

SEQ ID NO: 22024 - RNA, 20 nt, Artificial Sequence
  TRAC targeting sequence
guuuccugaaaccuuuaugc

SEQ ID NO: 22025 - RNA, 20 nt, Artificial Sequence
  TRAC targeting sequence
ccuccccugauaucaagaca

SEQ ID NO: 22026 - RNA, 20 nt, Artificial Sequence
  TRAC targeting sequence
uccccugauaucaagacaug

SEQ ID NO: 22027 - RNA, 20 nt, Artificial Sequence
  TRAC targeting sequence
ccugauaucaagacaugcaa

SEQ ID NO: 22028 - RNA, 20 nt, Artificial Sequence
  TRAC targeting sequence
ggggaggagauuuuauuagu

SEQ ID NO: 22029 - RNA, 20 nt, Artificial Sequence
  TRAC targeting sequence
agacaugcaaaaugaagaca

SEQ ID NO: 22030 - RNA, 20 nt, Artificial Sequence
  TRAC targeting sequence
ugauaucaggggaggagauu

SEQ ID NO: 22031 - RNA, 20 nt, Artificial Sequence
  TRAC targeting sequence
uuuugcaugucuugauauca

SEQ ID NO: 22032 - RNA, 20 nt, Artificial Sequence
  TRAC targeting sequence
ucauuuugcaugucuugaua

SEQ ID NO: 22033 - RNA, 20 nt, Artificial Sequence
  TRAC targeting sequence
guaggugucuucauuuugca

SEQ ID NO: 22034 - RNA, 20 nt, Artificial Sequence
  TRAC targeting sequence
caguaggugucuucauuuug

SEQ ID NO: 22035 - RNA, 20 nt, Artificial Sequence
  TRAC targeting sequence
cgcuaacuuuucucaguagg

SEQ ID NO: 22036 - RNA, 20 nt, Artificial Sequence
  TRAC targeting sequence
gucuauuucaccugggcaga

SEQ ID NO: 22037 - RNA, 20 nt, Artificial Sequence
  TRAC targeting sequence
auuucaccugggcagaagac

SEQ ID NO: 22038 - RNA, 20 nt, Artificial Sequence
  TRAC targeting sequence
ccugggcagaagacagugcc

SEQ ID NO: 22039 - RNA, 20 nt, Artificial Sequence
  TRAC targeting sequence
gcccaggugaaauagacuga

SEQ ID NO: 22040 - RNA, 20 nt, Artificial Sequence
  TRAC targeting sequence
ucugcccaggugaaauagac

SEQ ID NO: 22041 - RNA, 20 nt, Artificial Sequence
  TRAC targeting sequence
guuuguucuaaucaucuaaa

SEQ ID NO: 22042 - RNA, 20 nt, Artificial Sequence
  TRAC targeting sequence
aaucaucuaaaaagaaagca

SEQ ID NO: 22043 - RNA, 20 nt, Artificial Sequence
  TRAC targeting sequence
ucuaaaaagaaagcaaggca

SEQ ID NO: 22044 - RNA, 20 nt, Artificial Sequence
  TRAC targeting sequence
aaaaagaaagcaaggcauaa

SEQ ID NO: 22045 - RNA, 20 nt, Artificial Sequence
  TRAC targeting sequence
uuuuagaugauuagaacaaa

SEQ ID NO: 22046 - RNA, 20 nt, Artificial Sequence
  TRAC targeting sequence
uuguguuaugccuugcuuuc

SEQ ID NO: 22047 - RNA, 20 nt, Artificial Sequence
  TRAC targeting sequence
uuuuuaacaguucuuugugu

SEQ ID NO: 22048 - RNA, 20 nt, Artificial Sequence
  TRAC targeting sequence
acagcgucauuuuuaacagu

SEQ ID NO: 22049 - RNA, 20 nt, Artificial Sequence
  TRAC targeting sequence
cuacagcgucauuuuuaaca

SEQ ID NO: 22050 - RNA, 20 nt, Artificial Sequence
  TRAC targeting sequence
aucucuacagcgucauuuuu

SEQ ID NO: 22051 - RNA, 20 nt, Artificial Sequence
  TRAC targeting sequence
uuucuaucucuacagcguca

SEQ ID NO: 22052 - RNA, 20 nt, Artificial Sequence
  TRAC targeting sequence
uuucuauuuggaaucuguau

SEQ ID NO: 22053 - RNA, 20 nt, Artificial Sequence
  TRAC targeting sequence
auuuggaaucuguauucuuc

SEQ ID NO: 22054 - RNA, 20 nt, Artificial Sequence
  TRAC targeting sequence
aaauagaaaugacccuggcu

SEQ ID NO: 22055 - RNA, 20 nt, Artificial Sequence
  TRAC targeting sequence
guauucuucuccagcaauau

SEQ ID NO: 22056 - RNA, 20 nt, Artificial Sequence
  TRAC targeting sequence
ucuccagcaauaucucuauu

SEQ ID NO: 22057 - RNA, 20 nt, Artificial Sequence
  TRAC targeting sequence
ccagcaauaucucuauucag

SEQ ID NO: 22058 - RNA, 20 nt, Artificial Sequence
  TRAC targeting sequence
agcaauaucucuauucagac

SEQ ID NO: 22059 - RNA, 20 nt, Artificial Sequence
  TRAC targeting sequence
cuauucagacacuagcacug

SEQ ID NO: 22060 - RNA, 20 nt, Artificial Sequence
  TRAC targeting sequence
auucagacacuagcacuggg

SEQ ID NO: 22061 - RNA, 20 nt, Artificial Sequence
  TRAC targeting sequence
gacacuagcacugggcagau

SEQ ID NO: 22062 - RNA, 20 nt, Artificial Sequence
  TRAC targeting sequence
gaauagagauauugcuggag

SEQ ID NO: 22063 - RNA, 20 nt, Artificial Sequence
  TRAC targeting sequence
gcccagugcuagugucugaa

SEQ ID NO: 22064 - RNA, 20 nt, Artificial Sequence
  TRAC targeting sequence
aauacugauuuuccuucaaa

SEQ ID NO: 22065 - RNA, 20 nt, Artificial Sequence
  TRAC targeting sequence
guauuugaacauaucugccc

SEQ ID NO: 22066 - RNA, 20 nt, Artificial Sequence
  TRAC targeting sequence
uucaaauucaucucauccug

SEQ ID NO: 22067 - RNA, 20 nt, Artificial Sequence
  TRAC targeting sequence
aauucaucucauccuggauu

SEQ ID NO: 22068 - RNA, 20 nt, Artificial Sequence
  TRAC targeting sequence
ucucauccuggauucuaguc

SEQ ID NO: 22069 - RNA, 20 nt, Artificial Sequence
  TRAC targeting sequence
cauccuggauucuagucacc

SEQ ID NO: 22070 - RNA, 20 nt, Artificial Sequence
  TRAC targeting sequence
uccuggauucuagucaccca

SEQ ID NO: 22071 - RNA, 20 nt, Artificial Sequence
  TRAC targeting sequence
uggauucuagucacccaauu

SEQ ID NO: 22072 - RNA, 20 nt, Artificial Sequence
  TRAC targeting sequence
aggaugagaugaauuugaag

SEQ ID NO: 22073 - RNA, 20 nt, Artificial Sequence
  TRAC targeting sequence
agucacccaauuaaaacuga

SEQ ID NO: 22074 - RNA, 20 nt, Artificial Sequence
  TRAC targeting sequence
cccaauuaaaacugaaauua

SEQ ID NO: 22075 - RNA, 20 nt, Artificial Sequence
  TRAC targeting sequence
guuuuaauugggugacuaga

SEQ ID NO: 22076 - RNA, 20 nt, Artificial Sequence
  TRAC targeting sequence
aauuucaguuuuaauugggu

SEQ ID NO: 22077 - RNA, 20 nt, Artificial Sequence
  TRAC targeting sequence
cauuauuucuaauuucaguu

SEQ ID NO: 22078 - RNA, 20 nt, Artificial Sequence
  TRAC targeting sequence
aagaccauucugcagaaauu

SEQ ID NO: 22079 - RNA, 20 nt, Artificial Sequence
  TRAC targeting sequence
uugauucacauuauuucuaa

SEQ ID NO: 22080 - RNA, 20 nt, Artificial Sequence
  TRAC targeting sequence
gcagaaauucuagguuuaca

SEQ ID NO: 22081 - RNA, 20 nt, Artificial Sequence
  TRAC targeting sequence
gcagaauggucuuugauuca

SEQ ID NO: 22082 - RNA, 20 nt, Artificial Sequence
  TRAC targeting sequence
agguuuacagcucaauuuga

SEQ ID NO: 22083 - RNA, 20 nt, Artificial Sequence
  TRAC targeting sequence
auuugaaucaccaguuuuag

SEQ ID NO: 22084 - RNA, 20 nt, Artificial Sequence
  TRAC targeting sequence
aauugagcuguaaaccuaga

SEQ ID NO: 22085 - RNA, 20 nt, Artificial Sequence
  TRAC targeting sequence
ccaguuuuagaaggcacaga

SEQ ID NO: 22086 - RNA, 20 nt, Artificial Sequence
  TRAC targeting sequence
aaaacuggugauucaaauug

SEQ ID NO: 22087 - RNA, 20 nt, Artificial Sequence
  TRAC targeting sequence
gugccuucuaaaacugguga

SEQ ID NO: 22088 - RNA, 20 nt, Artificial Sequence
  TRAC targeting sequence
aaaaaaugaaaggagcuuua

SEQ ID NO: 22089 - RNA, 20 nt, Artificial Sequence
  TRAC targeting sequence
uuuuuuagaaauacacaguc

SEQ ID NO: 22090 - RNA, 20 nt, Artificial Sequence
  TRAC targeting sequence
uuucauuuuuuagaaauaca

SEQ ID NO: 22091 - RNA, 20 nt, Artificial Sequence
  TRAC targeting sequence
aaagcuccuuucauuuuuua

SEQ ID NO: 22092 - RNA, 20 nt, Artificial Sequence
  TRAC targeting sequence
cuaaagcuccuuucauuuuu

SEQ ID NO: 22093 - RNA, 20 nt, Artificial Sequence
  TRAC targeting sequence
gcuucuuuaauccuuucauu

SEQ ID NO: 22094 - RNA, 20 nt, Artificial Sequence
  TRAC targeting sequence
uuaauccuuucauuacagag

SEQ ID NO: 22095 - RNA, 20 nt, Artificial Sequence
  TRAC targeting sequence
uuucauuacagagaugagaa

SEQ ID NO: 22096 - RNA, 20 nt, Artificial Sequence
  TRAC targeting sequence
uuacagagaugagaaaacug

SEQ ID NO: 22097 - RNA, 20 nt, Artificial Sequence
  TRAC targeting sequence
guaaugaaaggauuaaagaa

SEQ ID NO: 22098 - RNA, 20 nt, Artificial Sequence
  TRAC targeting sequence
cuguaaugaaaggauuaaag

SEQ ID NO: 22099 - RNA, 20 nt, Artificial Sequence
  TRAC targeting sequence
ucucuguaaugaaaggauua

SEQ ID NO: 22100 - RNA, 20 nt, Artificial Sequence
  TRAC targeting sequence
caucucuguaaugaaaggau

SEQ ID NO: 22101 - RNA, 20 nt, Artificial Sequence
  TRAC targeting sequence
gguuacaguuuucucaucuc

SEQ ID NO: 22102 - RNA, 20 nt, Artificial Sequence
  TRAC targeting sequence
acacuaucagguuacaguuu

SEQ ID NO: 22103 - RNA, 20 nt, Artificial Sequence
  TRAC targeting sequence
guccagagcugugcugucca

SEQ ID NO: 22104 - RNA, 20 nt, Artificial Sequence
  TRAC targeting sequence
agagcugugcuguccaacac

SEQ ID NO: 22105 - RNA, 20 nt, Artificial Sequence
  TRAC targeting sequence
ggacagauuugucaacacua

SEQ ID NO: 22106 - RNA, 20 nt, Artificial Sequence
  TRAC targeting sequence
aacaccacagccacuagaca

SEQ ID NO: 22107 - RNA, 20 nt, Artificial Sequence
  TRAC targeting sequence
aguggcugugguguuggaca

SEQ ID NO: 22108 - RNA, 20 nt, Artificial Sequence
  TRAC targeting sequence
ccugugucuaguggcugugg

SEQ ID NO: 22109 - RNA, 20 nt, Artificial Sequence
  TRAC targeting sequence
aaguuaaauuaaaaauucag

SEQ ID NO: 22110 - RNA, 20 nt, Artificial Sequence
  TRAC targeting sequence
guucuucagucuguuagcca

SEQ ID NO: 22111 - RNA, 20 nt, Artificial Sequence
  TRAC targeting sequence
ucagucuguuagccacauuu

SEQ ID NO: 22112 - RNA, 20 nt, Artificial Sequence
  TRAC targeting sequence
gucuguuagccacauuucaa

SEQ ID NO: 22113 - RNA, 20 nt, Artificial Sequence
  TRAC targeting sequence
guuagccacauuucaaaugu

SEQ ID NO: 22114 - RNA, 20 nt, Artificial Sequence
  TRAC targeting sequence
aauguucaauaaccacaugu

SEQ ID NO: 22115 - RNA, 20 nt, Artificial Sequence
  TRAC targeting sequence
auaaccacauguggcuagug

SEQ ID NO: 22116 - RNA, 20 nt, Artificial Sequence
  TRAC targeting sequence
gcaccgcccauuaugguaac

SEQ ID NO: 22117 - RNA, 20 nt, Artificial Sequence
  TRAC targeting sequence
gggucugcaccgcccauuau

SEQ ID NO: 22118 - RNA, 20 nt, Artificial Sequence
  TRAC targeting sequence
ccacugcaaaaagcucuguu

SEQ ID NO: 22119 - RNA, 20 nt, Artificial Sequence
  TRAC targeting sequence
guuggacagugcugguccag

SEQ ID NO: 22120 - RNA, 20 nt, Artificial Sequence
  TRAC targeting sequence
aacagagcuuuuugcagugg

SEQ ID NO: 22121 - RNA, 20 nt, Artificial Sequence
  TRAC targeting sequence
aggaucacccucccuagcca

SEQ ID NO: 22122 - RNA, 20 nt, Artificial Sequence
  TRAC targeting sequence
uggaccagcacuguccaaca

SEQ ID NO: 22123 - RNA, 20 nt, Artificial Sequence
  TRAC targeting sequence
cccucccuagccaaagucag

SEQ ID NO: 22124 - RNA, 20 nt, Artificial Sequence
  TRAC targeting sequence
cuagccaaagucaggucucc

SEQ ID NO: 22125 - RNA, 20 nt, Artificial Sequence
  TRAC targeting sequence
ggucuccugaccugcauucu

SEQ ID NO: 22126 - RNA, 20 nt, Artificial Sequence
  TRAC targeting sequence
ccugaccugcauucuccucc

SEQ ID NO: 22127 - RNA, 20 nt, Artificial Sequence
  TRAC targeting sequence
ugaccugcauucuccuccau

SEQ ID NO: 22128 - RNA, 20 nt, Artificial Sequence
  TRAC targeting sequence
ggagaccugacuuuggcuag

SEQ ID NO: 22129 - RNA, 20 nt, Artificial Sequence
  TRAC targeting sequence
ccuccauuucuccuggacca

SEQ ID NO: 22130 - RNA, 20 nt, Artificial Sequence
  TRAC targeting sequence
uccauuucuccuggaccaua

SEQ ID NO: 22131 - RNA, 20 nt, Artificial Sequence
  TRAC targeting sequence
auuucuccuggaccauauua

SEQ ID NO: 22132 - RNA, 20 nt, Artificial Sequence
  TRAC targeting sequence
ccuggaccauauuaaguaug

SEQ ID NO: 22133 - RNA, 20 nt, Artificial Sequence
  TRAC targeting sequence
uggaccauauuaaguauggc

SEQ ID NO: 22134 - RNA, 20 nt, Artificial Sequence
  TRAC targeting sequence
aggagaaauggaggagaaug

SEQ ID NO: 22135 - RNA, 20 nt, Artificial Sequence
  TRAC targeting sequence
gcauaguuggccauacuuaa

SEQ ID NO: 22136 - RNA, 20 nt, Artificial Sequence
  TRAC targeting sequence
aauguuucugcauaguuggc

SEQ ID NO: 22137 - RNA, 20 nt, Artificial Sequence
  TRAC targeting sequence
caaauguuucugcauaguug

SEQ ID NO: 22138 - RNA, 20 nt, Artificial Sequence
  TRAC targeting sequence
uccuuuccuaucaaucucug

SEQ ID NO: 22139 - RNA, 20 nt, Artificial Sequence
  TRAC targeting sequence
uuuccuaucaaucucugcca

SEQ ID NO: 22140 - RNA, 20 nt, Artificial Sequence
  TRAC targeting sequence
uaucaaucucugccaaauuu

SEQ ID NO: 22141 - RNA, 20 nt, Artificial Sequence
  TRAC targeting sequence
aucucugccaaauuuuuccc

SEQ ID NO: 22142 - RNA, 20 nt, Artificial Sequence
  TRAC targeting sequence
cugccaaauuuuucccauuu

SEQ ID NO: 22143 - RNA, 20 nt, Artificial Sequence
  TRAC targeting sequence
gccaaauuuuucccauuuaa

SEQ ID NO: 22144 - RNA, 20 nt, Artificial Sequence
  TRAC targeting sequence
cauuuaaaaaagaaaagaau

SEQ ID NO: 22145 - RNA, 20 nt, Artificial Sequence
  TRAC targeting sequence
uuuuuaaaugggaaaaauuu

SEQ ID NO: 22146 - RNA, 20 nt, Artificial Sequence
  TRAC targeting sequence
uuucuuuuuuaaaugggaaa

SEQ ID NO: 22147 - RNA, 20 nt, Artificial Sequence
  TRAC targeting sequence
agucugauggcucugaugaa

SEQ ID NO: 22148 - RNA, 20 nt, Artificial Sequence
  TRAC targeting sequence
gauggcucugaugaaaauuu

SEQ ID NO: 22149 - RNA, 20 nt, Artificial Sequence
  TRAC targeting sequence
gacuggauucuuuucuuuuu

SEQ ID NO: 22150 - RNA, 20 nt, Artificial Sequence
  TRAC targeting sequence
gaugaaaauuuaaaauaaau

SEQ ID NO: 22151 - RNA, 20 nt, Artificial Sequence
  TRAC targeting sequence
gagccaucagacuggauucu

SEQ ID NO: 22152 - RNA, 20 nt, Artificial Sequence
  TRAC targeting sequence
ucagagccaucagacuggau

SEQ ID NO: 22153 - RNA, 20 nt, Artificial Sequence
  TRAC targeting sequence
uaaaaagaaaaguuuaauau

SEQ ID NO: 22154 - RNA, 20 nt, Artificial Sequence
  TRAC targeting sequence
uuuuaagaaauuuuuauuua

SEQ ID NO: 22155 - RNA, 20 nt, Artificial Sequence
  TRAC targeting sequence
uuaaaaauauuaaacuuuuc

SEQ ID NO: 22156 - RNA, 20 nt, Artificial Sequence
  TRAC targeting sequence
aacaugacauauauauaaag

SEQ ID NO: 22157 - RNA, 20 nt, Artificial Sequence
  TRAC targeting sequence
uguuagaggguuuucauuaa

SEQ ID NO: 22158 - RNA, 20 nt, Artificial Sequence
  TRAC targeting sequence
ucugagaguccuaaacauaa

SEQ ID NO: 22159 - RNA, 20 nt, Artificial Sequence
  TRAC targeting sequence
gagaguccuaaacauaacag

SEQ ID NO: 22160 - RNA, 20 nt, Artificial Sequence
  TRAC targeting sequence
gaugauggcuuuauauauau

SEQ ID NO: 22161 - RNA, 20 nt, Artificial Sequence
  TRAC targeting sequence
cagaugauggcuuuauauau

SEQ ID NO: 22162 - RNA, 20 nt, Artificial Sequence
  TRAC targeting sequence
uaaacauaacaggaaggaau

SEQ ID NO: 22163 - RNA, 20 nt, Artificial Sequence
  TRAC targeting sequence
uguuauguuuaggacucuca

SEQ ID NO: 22164 - RNA, 20 nt, Artificial Sequence
  TRAC targeting sequence
uuccuguuauguuuaggacu

SEQ ID NO: 22165 - RNA, 20 nt, Artificial Sequence
  TRAC targeting sequence
aaaccuuuauauuccuuccu

SEQ ID NO: 22166 - RNA, 20 nt, Artificial Sequence
  TRAC targeting sequence
aaaugucuguuauccaguuc

SEQ ID NO: 22167 - RNA, 20 nt, Artificial Sequence
  TRAC targeting sequence
guuauccaguucccccucag

SEQ ID NO: 22168 - RNA, 20 nt, Artificial Sequence
  TRAC targeting sequence
aguucccccucagucacuua

SEQ ID NO: 22169 - RNA, 20 nt, Artificial Sequence
  TRAC targeting sequence
cccucagucacuuauuaguu

SEQ ID NO: 22170 - RNA, 20 nt, Artificial Sequence
  TRAC targeting sequence
gucacuuauuaguuccaggg

SEQ ID NO: 22171 - RNA, 20 nt, Artificial Sequence
  TRAC targeting sequence
cuuauuaguuccagggccug

SEQ ID NO: 22172 - RNA, 20 nt, Artificial Sequence
  TRAC targeting sequence
agggccuggauacaucaacu

SEQ ID NO: 22173 - RNA, 20 nt, Artificial Sequence
  TRAC targeting sequence
aggcccuggaacuaauaagu

SEQ ID NO: 22174 - RNA, 20 nt, Artificial Sequence
  TRAC targeting sequence
acuaaaguuucaccaaggug

SEQ ID NO: 22175 - RNA, 20 nt, Artificial Sequence
  TRAC targeting sequence
ccaagguguaauuaccucaa

SEQ ID NO: 22176 - RNA, 20 nt, Artificial Sequence
  TRAC targeting sequence
aguguaaaauaggaauacua

SEQ ID NO: 22177 - RNA, 20 nt, Artificial Sequence
  TRAC targeting sequence
uauuuuacacuugagguaau

SEQ ID NO: 22178 - RNA, 20 nt, Artificial Sequence
  TRAC targeting sequence
gucuccacaucacuggguag

SEQ ID NO: 22179 - RNA, 20 nt, Artificial Sequence
  TRAC targeting sequence
ccacaucacuggguaggaag

SEQ ID NO: 22180 - RNA, 20 nt, Artificial Sequence
  TRAC targeting sequence
acaucacuggguaggaagga

SEQ ID NO: 22181 - RNA, 20 nt, Artificial Sequence
  TRAC targeting sequence
cuggguaggaaggaaggauc

SEQ ID NO: 22182 - RNA, 20 nt, Artificial Sequence
  TRAC targeting sequence
uacccagugauguggagaca

SEQ ID NO: 22183 - RNA, 20 nt, Artificial Sequence
  TRAC targeting sequence
uuccuacccagugaugugga

SEQ ID NO: 22184 - RNA, 20 nt, Artificial Sequence
  TRAC targeting sequence
uuccuuccuacccagugaug

SEQ ID NO: 22185 - RNA, 20 nt, Artificial Sequence
  TRAC targeting sequence
caugagcugauguauguaaa

SEQ ID NO: 22186 - RNA, 20 nt, Artificial Sequence
  TRAC targeting sequence
ugugauccuuccuuccuacc

SEQ ID NO: 22187 - RNA, 20 nt, Artificial Sequence
  TRAC targeting sequence
gcucaugugauccuuccuuc

SEQ ID NO: 22188 - RNA, 20 nt, Artificial Sequence
  TRAC targeting sequence
acauauacuuuuacauacau

SEQ ID NO: 22189 - RNA, 20 nt, Artificial Sequence
  TRAC targeting sequence
cauacauuccacauauacuu

SEQ ID NO: 22190 - RNA, 20 nt, Artificial Sequence
  TRAC targeting sequence
uacaagccuguuaacguggg

SEQ ID NO: 22191 - RNA, 20 nt, Artificial Sequence
  TRAC targeting sequence
cacguuaacaggcuuguagg

SEQ ID NO: 22192 - RNA, 20 nt, Artificial Sequence
  TRAC targeting sequence
aguucccacguuaacaggcu

SEQ ID NO: 22193 - RNA, 20 nt, Artificial Sequence
  TRAC targeting sequence
ucuaguucccacguuaacag

SEQ ID NO: 22194 - RNA, 20 nt, Artificial Sequence
  TRAC targeting sequence
uacaaauaugugcaucuugu

SEQ ID NO: 22195 - RNA, 20 nt, Artificial Sequence
  TRAC targeting sequence
uguuauaaucauuuaacuuu

SEQ ID NO: 22196 - RNA, 20 nt, Artificial Sequence
  TRAC targeting sequence
uuuaacuuucugccuccuau

SEQ ID NO: 22197 - RNA, 20 nt, Artificial Sequence
  TRAC targeting sequence
gccuccuauaaauggauaau

SEQ ID NO: 22198 - RNA, 20 nt, Artificial Sequence
  TRAC targeting sequence
uauaaauggauaaugggaau

SEQ ID NO: 22199 - RNA, 20 nt, Artificial Sequence
  TRAC targeting sequence
auuuauaggaggcagaaagu

SEQ ID NO: 22200 - RNA, 20 nt, Artificial Sequence
  TRAC targeting sequence
cauuauccauuuauaggagg

SEQ ID NO: 22201 - RNA, 20 nt, Artificial Sequence
  TRAC targeting sequence
gaaaauaugaauaaaaagca

SEQ ID NO: 22202 - RNA, 20 nt, Artificial Sequence
  TRAC targeting sequence
gauucccauuauccauuuau

SEQ ID NO: 22203 - RNA, 20 nt, Artificial Sequence
  TRAC targeting sequence
uauuuucagauucccauuau

SEQ ID NO: 22204 - RNA, 20 nt, Artificial Sequence
  TRAC targeting sequence
uugcuuuuuauucauauuuu

SEQ ID NO: 22205 - RNA, 20 nt, Artificial Sequence
  TRAC targeting sequence
uuaaucguugcuuuuuauuc

SEQ ID NO: 22206 - RNA, 20 nt, Artificial Sequence
  TRAC targeting sequence
ccuuaaucguugcuuuuuau

SEQ ID NO: 22207 - RNA, 20 nt, Artificial Sequence
  TRAC targeting sequence
guuuucuccuuaaucguugc

SEQ ID NO: 22208 - RNA, 20 nt, Artificial Sequence
  TRAC targeting sequence
uuugggcuuugcuuucuguu

SEQ ID NO: 22209 - RNA, 20 nt, Artificial Sequence
  TRAC targeting sequence
ucauuugggcuuugcuuucu

SEQ ID NO: 22210 - RNA, 20 nt, Artificial Sequence
  TRAC targeting sequence
acaaaaacaguacaauccuc

SEQ ID NO: 22211 - RNA, 20 nt, Artificial Sequence
  TRAC targeting sequence
uccucaaacacaaaagaacc

SEQ ID NO: 22212 - RNA, 20 nt, Artificial Sequence
  TRAC targeting sequence
ucaaacacaaaagaaccauc

SEQ ID NO: 22213 - RNA, 20 nt, Artificial Sequence
  TRAC targeting sequence
aacacaaaagaaccaucaag

SEQ ID NO: 22214 - RNA, 20 nt, Artificial Sequence
  TRAC targeting sequence
uuuguguuugaggaggauug

SEQ ID NO: 22215 - RNA, 20 nt, Artificial Sequence
  TRAC targeting sequence
agaaucaugcugagaggcau

SEQ ID NO: 22216 - RNA, 20 nt, Artificial Sequence
  TRAC targeting sequence
ugaugguucuuuuguguuug

SEQ ID NO: 22217 - RNA, 20 nt, Artificial Sequence
  TRAC targeting sequence
ugcugagaggcauuaacagu

SEQ ID NO: 22218 - RNA, 20 nt, Artificial Sequence
  TRAC targeting sequence
gcaugauucuugaugguucu

SEQ ID NO: 22219 - RNA, 20 nt, Artificial Sequence
  TRAC targeting sequence
cagcaugauucuugaugguu

SEQ ID NO: 22220 - RNA, 20 nt, Artificial Sequence
  TRAC targeting sequence
ugccacuguuaaugccucuc

SEQ ID NO: 22221 - RNA, 20 nt, Artificial Sequence
  TRAC targeting sequence
cuugccacuguuaaugccuc

SEQ ID NO: 22222 - RNA, 20 nt, Artificial Sequence
  TRAC targeting sequence
aagucucuugccacuguuaa

SEQ ID NO: 22223 - RNA, 20 nt, Artificial Sequence
  TRAC targeting sequence
ucaaagucucuugccacugu

SEQ ID NO: 22224 - RNA, 20 nt, Artificial Sequence
  TRAC targeting sequence
agaccaauccucucacaaca

SEQ ID NO: 22225 - RNA, 20 nt, Artificial Sequence
  TRAC targeting sequence
ggauguucaucaaagucucu

SEQ ID NO: 22226 - RNA, 20 nt, Artificial Sequence
  TRAC targeting sequence
ucucacaacacagacagaga

SEQ ID NO: 22227 - RNA, 20 nt, Artificial Sequence
  TRAC targeting sequence
cacaacacagacagagaaac

SEQ ID NO: 22228 - RNA, 20 nt, Artificial Sequence
  TRAC targeting sequence
caacacagacagagaaacug

SEQ ID NO: 22229 - RNA, 20 nt, Artificial Sequence
  TRAC targeting sequence
guguugugagaggauugguc

SEQ ID NO: 22230 - RNA, 20 nt, Artificial Sequence
  TRAC targeting sequence
gucuguguugugagaggauu

SEQ ID NO: 22231 - RNA, 20 nt, Artificial Sequence
  TRAC targeting sequence
cugucuguguugugagagga

SEQ ID NO: 22232 - RNA, 20 nt, Artificial Sequence
  TRAC targeting sequence
guuucucugucuguguugug

SEQ ID NO: 22233 - RNA, 20 nt, Artificial Sequence
  TRAC targeting sequence
gagguaaguuuauuugucca

SEQ ID NO: 22234 - RNA, 20 nt, Artificial Sequence
  TRAC targeting sequence
gagccucaguuucucugucu

SEQ ID NO: 22235 - RNA, 20 nt, Artificial Sequence
  TRAC targeting sequence
auucaacuaguuaacagagc

SEQ ID NO: 22236 - RNA, 20 nt, Artificial Sequence
  TRAC targeting sequence
acuaguuaacagagcaaagc

SEQ ID NO: 22237 - RNA, 20 nt, Artificial Sequence
  TRAC targeting sequence
guuaacuaguugaauggaca

SEQ ID NO: 22238 - RNA, 20 nt, Artificial Sequence
  TRAC targeting sequence
ucugauuuuuuuuuuuuuuu

SEQ ID NO: 22239 - RNA, 20 nt, Artificial Sequence
  TRAC targeting sequence
gauuuuuuuuuuuuuuuuuu

SEQ ID NO: 22240 - RNA, 20 nt, Artificial Sequence
  TRAC targeting sequence
gaagacuuguauuguaggcu

SEQ ID NO: 22241 - RNA, 20 nt, Artificial Sequence
  TRAC targeting sequence
aaaaaaaaaaaaaaaaaauc

SEQ ID NO: 22242 - RNA, 20 nt, Artificial Sequence
  TRAC targeting sequence
caaaaaaaaaaaaaaaaaaa

SEQ ID NO: 22243 - RNA, 20 nt, Artificial Sequence
  TRAC targeting sequence
cacucugucacucaggcugg

SEQ ID NO: 22244 - RNA, 20 nt, Artificial Sequence
  TRAC targeting sequence
cucugucacucaggcuggag

SEQ ID NO: 22245 - RNA, 20 nt, Artificial Sequence
  TRAC targeting sequence
gucacucaggcuggagugca

SEQ ID NO: 22246 - RNA, 20 nt, Artificial Sequence
  TRAC targeting sequence
cucaggcuggagugcaagug

SEQ ID NO: 22247 - RNA, 20 nt, Artificial Sequence
  TRAC targeting sequence
ggcuggagugcaaguggcau

SEQ ID NO: 22248 - RNA, 20 nt, Artificial Sequence
  TRAC targeting sequence
agccugagugacagagugag

SEQ ID NO: 22249 - RNA, 20 nt, Artificial Sequence
  TRAC targeting sequence
ugccacuugcacuccagccu

SEQ ID NO: 22250 - RNA, 20 nt, Artificial Sequence
  TRAC targeting sequence
caguucacugcagccgugac

SEQ ID NO: 22251 - RNA, 20 nt, Artificial Sequence
  TRAC targeting sequence
cugcagccgugaccucccac

SEQ ID NO: 22252 - RNA, 20 nt, Artificial Sequence
  TRAC targeting sequence
cggcugcagugaacugugau

SEQ ID NO: 22253 - RNA, 20 nt, Artificial Sequence
  TRAC targeting sequence
cacgcucaagcaauccuucc

SEQ ID NO: 22254 - RNA, 20 nt, Artificial Sequence
  TRAC targeting sequence
agcaauccuuccaccucagc

SEQ ID NO: 22255 - RNA, 20 nt, Artificial Sequence
  TRAC targeting sequence
uuccaccucagccuucugag

SEQ ID NO: 22256 - RNA, 20 nt, Artificial Sequence
  TRAC targeting sequence
accucagccuucugaguagc

SEQ ID NO: 22257 - RNA, 20 nt, Artificial Sequence
  TRAC targeting sequence
gccuucugaguagcugggac

SEQ ID NO: 22258 - RNA, 20 nt, Artificial Sequence
  TRAC targeting sequence
gaguagcugggaccacaggc

SEQ ID NO: 22259 - RNA, 20 nt, Artificial Sequence
  TRAC targeting sequence
gaaggcugagguggaaggau

SEQ ID NO: 22260 - RNA, 20 nt, Artificial Sequence
  TRAC targeting sequence
cagcuacucagaaggcugag

SEQ ID NO: 22261 - RNA, 20 nt, Artificial Sequence
  TRAC targeting sequence
aauucuuuugauuuuuggua

SEQ ID NO: 22262 - RNA, 20 nt, Artificial Sequence
  TRAC targeting sequence
uuugauuuuugguagagaca

SEQ ID NO: 22263 - RNA, 20 nt, Artificial Sequence
  TRAC targeting sequence
aaagaauuagaggggcgugg

SEQ ID NO: 22264 - RNA, 20 nt, Artificial Sequence
  TRAC targeting sequence
accaaaaaucaaaagaauua

SEQ ID NO: 22265 - RNA, 20 nt, Artificial Sequence
  TRAC targeting sequence
cuaccaaaaaucaaaagaau

SEQ ID NO: 22266 - RNA, 20 nt, Artificial Sequence
  TRAC targeting sequence
ugcuauaucacccaugcugg

SEQ ID NO: 22267 - RNA, 20 nt, Artificial Sequence
  TRAC targeting sequence
cccaugcuggucucaaacuc

SEQ ID NO: 22268 - RNA, 20 nt, Artificial Sequence
  TRAC targeting sequence
caaacuccugggcucaagcg

SEQ ID NO: 22269 - RNA, 20 nt, Artificial Sequence
  TRAC targeting sequence
aacuccugggcucaagcgau

SEQ ID NO: 22270 - RNA, 20 nt, Artificial Sequence
  TRAC targeting sequence
ugggcucaagcgauccuccc

SEQ ID NO: 22271 - RNA, 20 nt, Artificial Sequence
  TRAC targeting sequence
agcgauccucccaccuuggc

SEQ ID NO: 22272 - RNA, 20 nt, Artificial Sequence
  TRAC targeting sequence
cuugagcccaggaguuugag

SEQ ID NO: 22273 - RNA, 20 nt, Artificial Sequence
  TRAC targeting sequence
ucccaccuuggccuccccaa

SEQ ID NO: 22274 - RNA, 20 nt, Artificial Sequence
  TRAC targeting sequence
caccuuggccuccccaagug

SEQ ID NO: 22275 - RNA, 20 nt, Artificial Sequence
  TRAC targeting sequence
ccaagugcugggauuacagg

SEQ ID NO: 22276 - RNA, 20 nt, Artificial Sequence
  TRAC targeting sequence
cagcacuuggggaggccaag

SEQ ID NO: 22277 - RNA, 20 nt, Artificial Sequence
  TRAC targeting sequence
ucugacuucuugucucaugc

SEQ ID NO: 22278 - RNA, 20 nt, Artificial Sequence
  TRAC targeting sequence
gacuucuugucucaugcucu

SEQ ID NO: 22279 - RNA, 20 nt, Artificial Sequence
  TRAC targeting sequence
gaggaggggcuggugcggug

SEQ ID NO: 22280 - RNA, 20 nt, Artificial Sequence
  TRAC targeting sequence
ugucucaugcucuuccccac

SEQ ID NO: 22281 - RNA, 20 nt, Artificial Sequence
  TRAC targeting sequence
caugcucuuccccaccccac

SEQ ID NO: 22282 - RNA, 20 nt, Artificial Sequence
  TRAC targeting sequence
ugcucuuccccaccccacag

SEQ ID NO: 22283 - RNA, 20 nt, Artificial Sequence
  TRAC targeting sequence
uccccaccccacagccucuc

SEQ ID NO: 22284 - RNA, 20 nt, Artificial Sequence
  TRAC targeting sequence
ccaccccacagccucuccua

SEQ ID NO: 22285 - RNA, 20 nt, Artificial Sequence
  TRAC targeting sequence
ccuaugaaucuuugccuugg

SEQ ID NO: 22286 - RNA, 20 nt, Artificial Sequence
  TRAC targeting sequence
uaugaaucuuugccuuggcu

SEQ ID NO: 22287 - RNA, 20 nt, Artificial Sequence
  TRAC targeting sequence
uaggagaggcuguggggugg

SEQ ID NO: 22288 - RNA, 20 nt, Artificial Sequence
  TRAC targeting sequence
uugccuuggcuuuuuuucuu

SEQ ID NO: 22289 - RNA, 20 nt, Artificial Sequence
  TRAC targeting sequence
uucguaccacuuuccauguu

SEQ ID NO: 22290 - RNA, 20 nt, Artificial Sequence
  TRAC targeting sequence
uaccacuuuccauguuuuag

SEQ ID NO: 22291 - RNA, 20 nt, Artificial Sequence
  TRAC targeting sequence
auguuuuagcauccaaguaa

SEQ ID NO: 22292 - RNA, 20 nt, Artificial Sequence
  TRAC targeting sequence
aaguaacuuaauaacauaac

SEQ ID NO: 22293 - RNA, 20 nt, Artificial Sequence
  TRAC targeting sequence
ugcaguuaaaaaguguuuau

SEQ ID NO: 22294 - RNA, 20 nt, Artificial Sequence
  TRAC targeting sequence
ugccuguaauuccagcacuu

SEQ ID NO: 22295 - RNA, 20 nt, Artificial Sequence
  TRAC targeting sequence
agcacuuugggaggcuaagg

SEQ ID NO: 22296 - RNA, 20 nt, Artificial Sequence
  TRAC targeting sequence
caaagugcuggaauuacagg

SEQ ID NO: 22297 - RNA, 20 nt, Artificial Sequence
  TRAC targeting sequence
gccuaccuuagccucccaaa

SEQ ID NO: 22298 - RNA, 20 nt, Artificial Sequence
  TRAC targeting sequence
caaagucaaaagauagagac

SEQ ID NO: 22299 - RNA, 20 nt, Artificial Sequence
  TRAC targeting sequence
aaagauagagaccauacugg

SEQ ID NO: 22300 - RNA, 20 nt, Artificial Sequence
  TRAC targeting sequence
uuugacuuugugaucugccu

SEQ ID NO: 22301 - RNA, 20 nt, Artificial Sequence
  TRAC targeting sequence
aucuuuugacuuugugaucu

SEQ ID NO: 22302 - RNA, 20 nt, Artificial Sequence
  TRAC targeting sequence
cuaucuuuugacuuugugau

SEQ ID NO: 22303 - RNA, 20 nt, Artificial Sequence
  TRAC targeting sequence
ccauguuggccaguaugguc

SEQ ID NO: 22304 - RNA, 20 nt, Artificial Sequence
  TRAC targeting sequence
cuccuaaaaauacaaaaauu

SEQ ID NO: 22305 - RNA, 20 nt, Artificial Sequence
  TRAC targeting sequence
ccuaaaaauacaaaaauuag

SEQ ID NO: 22306 - RNA, 20 nt, Artificial Sequence
  TRAC targeting sequence
uaaaaauacaaaaauuagcc

SEQ ID NO: 22307 - RNA, 20 nt, Artificial Sequence
  TRAC targeting sequence
cacgccuggcuaauuuuugu

SEQ ID NO: 22308 - RNA, 20 nt, Artificial Sequence
  TRAC targeting sequence
cagcuacucaagaggcugag

SEQ ID NO: 22309 - RNA, 20 nt, Artificial Sequence
  TRAC targeting sequence
agaggcugaggcaggagaac

SEQ ID NO: 22310 - RNA, 20 nt, Artificial Sequence
  TRAC targeting sequence
ugaguagcugggacuacaag

SEQ ID NO: 22311 - RNA, 20 nt, Artificial Sequence
  TRAC targeting sequence
gccucuugaguagcugggac

SEQ ID NO: 22312 - RNA, 20 nt, Artificial Sequence
  TRAC targeting sequence
ugccucagccucuugaguag

SEQ ID NO: 22313 - RNA, 20 nt, Artificial Sequence
  TRAC targeting sequence
ccugccucagccucuugagu

SEQ ID NO: 22314 - RNA, 20 nt, Artificial Sequence
  TRAC targeting sequence
uggguuuaagcaguucuccu

SEQ ID NO: 22315 - RNA, 20 nt, Artificial Sequence
  TRAC targeting sequence
gccuccuggguuuaagcagu

SEQ ID NO: 22316 - RNA, 20 nt, Artificial Sequence
  TRAC targeting sequence
cuauaaccuccgccuccugg

SEQ ID NO: 22317 - RNA, 20 nt, Artificial Sequence
  TRAC targeting sequence
uggcucacuauaaccuccgc

SEQ ID NO: 22318 - RNA, 20 nt, Artificial Sequence
  TRAC targeting sequence
ugccacugcacuacagccug

SEQ ID NO: 22319 - RNA, 20 nt, Artificial Sequence
  TRAC targeting sequence
aggcuguagugcaguggcau

SEQ ID NO: 22320 - RNA, 20 nt, Artificial Sequence
  TRAC targeting sequence
cuuuguuguccaggcuguag

SEQ ID NO: 22321 - RNA, 20 nt, Artificial Sequence
  TRAC targeting sequence
cgcuuuguuguccaggcugu

SEQ ID NO: 22322 - RNA, 20 nt, Artificial Sequence
  TRAC targeting sequence
gucucaaaaaaaaaaaaaaa

SEQ ID NO: 22323 - RNA, 20 nt, Artificial Sequence
  TRAC targeting sequence
caaaaaaaaaaaaaaagguu

SEQ ID NO: 22324 - RNA, 20 nt, Artificial Sequence
  TRAC targeting sequence
aaaaaaaaaaaaaagguuua

SEQ ID NO: 22325 - RNA, 20 nt, Artificial Sequence
  TRAC targeting sequence
uucauacacucauucaacaa

SEQ ID NO: 22326 - RNA, 20 nt, Artificial Sequence
  TRAC targeting sequence
uacacucauucaacaaacac

SEQ ID NO: 22327 - RNA, 20 nt, Artificial Sequence
  TRAC targeting sequence
uucaacaaacacacacuguu

SEQ ID NO: 22328 - RNA, 20 nt, Artificial Sequence
  TRAC targeting sequence
acaaacacacacuguuacug

SEQ ID NO: 22329 - RNA, 20 nt, Artificial Sequence
  TRAC targeting sequence
caauugaguccagugggaga

SEQ ID NO: 22330 - RNA, 20 nt, Artificial Sequence
  TRAC targeting sequence
auugugaacaguaacagugu

SEQ ID NO: 22331 - RNA, 20 nt, Artificial Sequence
  TRAC targeting sequence
agugggagagagaagaaagu

SEQ ID NO: 22332 - RNA, 20 nt, Artificial Sequence
  TRAC targeting sequence
cacuggacucaauugugaac

SEQ ID NO: 22333 - RNA, 20 nt, Artificial Sequence
  TRAC targeting sequence
cccacuggacucaauuguga

SEQ ID NO: 22334 - RNA, 20 nt, Artificial Sequence
  TRAC targeting sequence
cucccacuggacucaauugu

SEQ ID NO: 22335 - RNA, 20 nt, Artificial Sequence
  TRAC targeting sequence
cucucccacuggacucaauu

SEQ ID NO: 22336 - RNA, 20 nt, Artificial Sequence
  TRAC targeting sequence
ucucucucccacuggacuca

SEQ ID NO: 22337 - RNA, 20 nt, Artificial Sequence
  TRAC targeting sequence
cuuucuucucucucccacug

SEQ ID NO: 22338 - RNA, 20 nt, Artificial Sequence
  TRAC targeting sequence
uucacuuucuucucucuccc

SEQ ID NO: 22339 - RNA, 20 nt, Artificial Sequence
  TRAC targeting sequence
uaacaaugugauaagugcag

SEQ ID NO: 22340 - RNA, 20 nt, Artificial Sequence
  TRAC targeting sequence
cauuguuaugaaacuauuca

SEQ ID NO: 22341 - RNA, 20 nt, Artificial Sequence
  TRAC targeting sequence
agugcugcacuuaucacauu

SEQ ID NO: 22342 - RNA, 20 nt, Artificial Sequence
  TRAC targeting sequence
uccagugcugcacuuaucac

SEQ ID NO: 22343 - RNA, 20 nt, Artificial Sequence
  TRAC targeting sequence
acugcauuccuccagugcug

SEQ ID NO: 22344 - RNA, 20 nt, Artificial Sequence
  TRAC targeting sequence
uaugcaaccugagggguggg

SEQ ID NO: 22345 - RNA, 20 nt, Artificial Sequence
  TRAC targeting sequence
gguugcauaggagcccuuag

SEQ ID NO: 22346 - RNA, 20 nt, Artificial Sequence
  TRAC targeting sequence
caccccucagguugcauagg

SEQ ID NO: 22347 - RNA, 20 nt, Artificial Sequence
  TRAC targeting sequence
uucccaccccucagguugca

SEQ ID NO: 22348 - RNA, 20 nt, Artificial Sequence
  TRAC targeting sequence
aagucauucccaccccucag

SEQ ID NO: 22349 - RNA, 20 nt, Artificial Sequence
  TRAC targeting sequence
uauuccaagucauucccacc

SEQ ID NO: 22350 - RNA, 20 nt, Artificial Sequence
  TRAC targeting sequence
uccaagcugggaggauggag

SEQ ID NO: 22351 - RNA, 20 nt, Artificial Sequence
  TRAC targeting sequence
aagcugggaggauggagaaa

SEQ ID NO: 22352 - RNA, 20 nt, Artificial Sequence
  TRAC targeting sequence
cagcuuggaugacuccuauu

SEQ ID NO: 22353 - RNA, 20 nt, Artificial Sequence
  TRAC targeting sequence
ucccagcuuggaugacuccu

SEQ ID NO: 22354 - RNA, 20 nt, Artificial Sequence
  TRAC targeting sequence
auccucccagcuuggaugac

SEQ ID NO: 22355 - RNA, 20 nt, Artificial Sequence
  TRAC targeting sequence
ccauccucccagcuuggaug

SEQ ID NO: 22356 - RNA, 20 nt, Artificial Sequence
  TRAC targeting sequence
uugcugcccuaacuuacugc

SEQ ID NO: 22357 - RNA, 20 nt, Artificial Sequence
  TRAC targeting sequence
uaaauauaaaucuauuucga

SEQ ID NO: 22358 - RNA, 20 nt, Artificial Sequence
  TRAC targeting sequence
uuccaucaaauuucuuaaag

SEQ ID NO: 22359 - RNA, 20 nt, Artificial Sequence
  TRAC targeting sequence
aucaaauuucuuaaagcaaa

SEQ ID NO: 22360 - RNA, 20 nt, Artificial Sequence
  TRAC targeting sequence
aauuucuuaaagcaaacucu

SEQ ID NO: 22361 - RNA, 20 nt, Artificial Sequence
  TRAC targeting sequence
uaaagcaaacucucuggcaa

SEQ ID NO: 22362 - RNA, 20 nt, Artificial Sequence
  TRAC targeting sequence
cuggcaauagacuaucagcc

SEQ ID NO: 22363 - RNA, 20 nt, Artificial Sequence
  TRAC targeting sequence
ggcaauagacuaucagccaa

SEQ ID NO: 22364 - RNA, 20 nt, Artificial Sequence
  TRAC targeting sequence
auugccagagaguuugcuuu

SEQ ID NO: 22365 - RNA, 20 nt, Artificial Sequence
  TRAC targeting sequence
gccaauauaacauuacagcu

SEQ ID NO: 22366 - RNA, 20 nt, Artificial Sequence
  TRAC targeting sequence
agacagaguuuugugcuugu

SEQ ID NO: 22367 - RNA, 20 nt, Artificial Sequence
  TRAC targeting sequence
ugaaaaaaaaaaaagcugua

SEQ ID NO: 22368 - RNA, 20 nt, Artificial Sequence
  TRAC targeting sequence
gucuugaaaaaaaaaaaagc

SEQ ID NO: 22369 - RNA, 20 nt, Artificial Sequence
  TRAC targeting sequence
aggcuggagugcaauggcgu

SEQ ID NO: 22370 - RNA, 20 nt, Artificial Sequence
  TRAC targeting sequence
agccuggacaacaagcacaa

SEQ ID NO: 22371 - RNA, 20 nt, Artificial Sequence
  TRAC targeting sequence
cgccauugcacuccagccug

SEQ ID NO: 22372 - RNA, 20 nt, Artificial Sequence
  TRAC targeting sequence
cgggucaccgcaaccuccgc

SEQ ID NO: 22373 - RNA, 20 nt, Artificial Sequence
  TRAC targeting sequence
ggucaccgcaaccuccgccu

SEQ ID NO: 22374 - RNA, 20 nt, Artificial Sequence
  TRAC targeting sequence
ccgcaaccuccgccucccgg

SEQ ID NO: 22375 - RNA, 20 nt, Artificial Sequence
  TRAC targeting sequence
gccucccggguucaggcgau

SEQ ID NO: 22376 - RNA, 20 nt, Artificial Sequence
  TRAC targeting sequence
cggguucaggcgauucucug

SEQ ID NO: 22377 - RNA, 20 nt, Artificial Sequence
  TRAC targeting sequence
ggcgauucucugcuucaacc

SEQ ID NO: 22378 - RNA, 20 nt, Artificial Sequence
  TRAC targeting sequence
ccugaacccgggaggcggag

SEQ ID NO: 22379 - RNA, 20 nt, Artificial Sequence
  TRAC targeting sequence
cugcuucaaccugcugagua

SEQ ID NO: 22380 - RNA, 20 nt, Artificial Sequence
  TRAC targeting sequence
gcuucaaccugcugaguagc

SEQ ID NO: 22381 - RNA, 20 nt, Artificial Sequence
  TRAC targeting sequence
accugcugaguagcugggau

SEQ ID NO: 22382 - RNA, 20 nt, Artificial Sequence
  TRAC targeting sequence
gcagguugaagcagagaauc

SEQ ID NO: 22383 - RNA, 20 nt, Artificial Sequence
  TRAC targeting sequence
cagcuacucagcagguugaa

SEQ ID NO: 22384 - RNA, 20 nt, Artificial Sequence
  TRAC targeting sequence
acuaaaaaugcaaaaauuag

SEQ ID NO: 22385 - RNA, 20 nt, Artificial Sequence
  TRAC targeting sequence
cuacuaaaaaugcaaaaauu

SEQ ID NO: 22386 - RNA, 20 nt, Artificial Sequence
  TRAC targeting sequence
ccauguuggucaggcugguc

SEQ ID NO: 22387 - RNA, 20 nt, Artificial Sequence
  TRAC targeting sequence
ggcuggucucgaacuccuga

SEQ ID NO: 22388 - RNA, 20 nt, Artificial Sequence
  TRAC targeting sequence
cgaacuccugaccucaggug

SEQ ID NO: 22389 - RNA, 20 nt, Artificial Sequence
  TRAC targeting sequence
aacuccugaccucaggugau

SEQ ID NO: 22390 - RNA, 20 nt, Artificial Sequence
  TRAC targeting sequence
agaccagccugaccaacaug

SEQ ID NO: 22391 - RNA, 20 nt, Artificial Sequence
  TRAC targeting sequence
ugaccucaggugauccaccc

SEQ ID NO: 22392 - RNA, 20 nt, Artificial Sequence
  TRAC targeting sequence
ggaguucgagaccagccuga

SEQ ID NO: 22393 - RNA, 20 nt, Artificial Sequence
  TRAC targeting sequence
ggugauccacccgccccagc

SEQ ID NO: 22394 - RNA, 20 nt, Artificial Sequence
  TRAC targeting sequence
ccugaggucaggaguucgag

SEQ ID NO: 22395 - RNA, 20 nt, Artificial Sequence
  TRAC targeting sequence
acccgccccagccucccaaa

SEQ ID NO: 22396 - RNA, 20 nt, Artificial Sequence
  TRAC targeting sequence
caaagugcugggaucacagg

SEQ ID NO: 22397 - RNA, 20 nt, Artificial Sequence
  TRAC targeting sequence
cagcacuuugggaggcuggg

SEQ ID NO: 22398 - RNA, 20 nt, Artificial Sequence
  TRAC targeting sequence
caggccaccaugccuggcua

SEQ ID NO: 22399 - RNA, 20 nt, Artificial Sequence
  TRAC targeting sequence
aauggccaaggugagagagg

SEQ ID NO: 22400 - RNA, 20 nt, Artificial Sequence
  TRAC targeting sequence
ccuuggccauuagaaaugua

SEQ ID NO: 22401 - RNA, 20 nt, Artificial Sequence
  TRAC targeting sequence
caccuuggccauuagaaaug

SEQ ID NO: 22402 - RNA, 20 nt, Artificial Sequence
  TRAC targeting sequence
cucaccuuggccauuagaaa

SEQ ID NO: 22403 - RNA, 20 nt, Artificial Sequence
  TRAC targeting sequence
ucucucaccuuggccauuag

SEQ ID NO: 22404 - RNA, 20 nt, Artificial Sequence
  TRAC targeting sequence
aguccucucucaccuuggcc

SEQ ID NO: 22405 - RNA, 20 nt, Artificial Sequence
  TRAC targeting sequence
uaaugccauuuucagugaac

SEQ ID NO: 22406 - RNA, 20 nt, Artificial Sequence
  TRAC targeting sequence
gugaacaaagccuugacacu

SEQ ID NO: 22407 - RNA, 20 nt, Artificial Sequence
  TRAC targeting sequence
cugaaaauggcauuaugauc

SEQ ID NO: 22408 - RNA, 20 nt, Artificial Sequence
  TRAC targeting sequence
aggcuuuguucacugaaaau

SEQ ID NO: 22409 - RNA, 20 nt, Artificial Sequence
  TRAC targeting sequence
aaaagugucaaggcuuuguu

SEQ ID NO: 22410 - RNA, 20 nt, Artificial Sequence
  TRAC targeting sequence
uuuauauuucuaaaaguguc

SEQ ID NO: 22411 - RNA, 20 nt, Artificial Sequence
  TRAC targeting sequence
uaguuuaguacaaaaucaaa

SEQ ID NO: 22412 - RNA, 20 nt, Artificial Sequence
  TRAC targeting sequence
aaguuuaaagauuuuauuau

SEQ ID NO: 22413 - RNA, 20 nt, Artificial Sequence
  TRAC targeting sequence
uuaaacuuugauuuuguacu

SEQ ID NO: 22414 - RNA, 20 nt, Artificial Sequence
  TRAC targeting sequence
aagaugcugaggccagucca

SEQ ID NO: 22415 - RNA, 20 nt, Artificial Sequence
  TRAC targeting sequence
uagauuuaaauguuuuaaua

SEQ ID NO: 22416 - RNA, 20 nt, Artificial Sequence
  TRAC targeting sequence
gcaucuuagauuuaaauguu

SEQ ID NO: 22417 - RNA, 20 nt, Artificial Sequence
  TRAC targeting sequence
acgugaaaggcaaaaauuga

SEQ ID NO: 22418 - RNA, 20 nt, Artificial Sequence
  TRAC targeting sequence
cguggacuggccucagcauc

SEQ ID NO: 22419 - RNA, 20 nt, Artificial Sequence
  TRAC targeting sequence
auuuuugccuuucacgugga

SEQ ID NO: 22420 - RNA, 20 nt, Artificial Sequence
  TRAC targeting sequence
ugagaguaagucucuuugau

SEQ ID NO: 22421 - RNA, 20 nt, Artificial Sequence
  TRAC targeting sequence
ugagucaauuuuugccuuuc

SEQ ID NO: 22422 - RNA, 20 nt, Artificial Sequence
  TRAC targeting sequence
caugagucaauuuuugccuu

SEQ ID NO: 22423 - RNA, 20 nt, Artificial Sequence
  TRAC targeting sequence
cuuugauagugguuuucaga

SEQ ID NO: 22424 - RNA, 20 nt, Artificial Sequence
  TRAC targeting sequence
uugauagugguuuucagaaa

SEQ ID NO: 22425 - RNA, 20 nt, Artificial Sequence
  TRAC targeting sequence
aagagacuuacucucaugag

SEQ ID NO: 22426 - RNA, 20 nt, Artificial Sequence
  TRAC targeting sequence
gaaaauucuguuuacaaaga

SEQ ID NO: 22427 - RNA, 20 nt, Artificial Sequence
  TRAC targeting sequence
gaaaaccacuaucaaagaga

SEQ ID NO: 22428 - RNA, 20 nt, Artificial Sequence
  TRAC targeting sequence
guuuacaaagaucugcuucc

SEQ ID NO: 22429 - RNA, 20 nt, Artificial Sequence
  TRAC targeting sequence
uuguaaacagaauuuucuga

SEQ ID NO: 22430 - RNA, 20 nt, Artificial Sequence
  TRAC targeting sequence
gcuuccccucuuuuaaagca

SEQ ID NO: 22431 - RNA, 20 nt, Artificial Sequence
  TRAC targeting sequence
ccucuuuuaaagcagaucua

SEQ ID NO: 22432 - RNA, 20 nt, Artificial Sequence
  TRAC targeting sequence
uuuaaagcagaucuauuuac

SEQ ID NO: 22433 - RNA, 20 nt, Artificial Sequence
  TRAC targeting sequence
gcuuuaaaagaggggaagca

SEQ ID NO: 22434 - RNA, 20 nt, Artificial Sequence
  TRAC targeting sequence
auuuaccagacacuauucua

SEQ ID NO: 22435 - RNA, 20 nt, Artificial Sequence
  TRAC targeting sequence
gguaaauagaucugcuuuaa

SEQ ID NO: 22436 - RNA, 20 nt, Artificial Sequence
  TRAC targeting sequence
aaaagcagagguucuaggau

SEQ ID NO: 22437 - RNA, 20 nt, Artificial Sequence
  TRAC targeting sequence
gcuuuuagaauagugucugg

SEQ ID NO: 22438 - RNA, 20 nt, Artificial Sequence
  TRAC targeting sequence
aggauucuuugaaauauuag

SEQ ID NO: 22439 - RNA, 20 nt, Artificial Sequence
  TRAC targeting sequence
uagaaccucugcuuuuagaa

SEQ ID NO: 22440 - RNA, 20 nt, Artificial Sequence
  TRAC targeting sequence
uugaaauauuagcucacaca

SEQ ID NO: 22441 - RNA, 20 nt, Artificial Sequence
  TRAC targeting sequence
aagaauccuagaaccucugc

SEQ ID NO: 22442 - RNA, 20 nt, Artificial Sequence
  TRAC targeting sequence
cacaauugacuacucaacag

SEQ ID NO: 22443 - RNA, 20 nt, Artificial Sequence
  TRAC targeting sequence
auugugugagcuaauauuuc

SEQ ID NO: 22444 - RNA, 20 nt, Artificial Sequence
  TRAC targeting sequence
acagcuaagaagaaugguuu

SEQ ID NO: 22445 - RNA, 20 nt, Artificial Sequence
  TRAC targeting sequence
uagcuguugaguagucaauu

SEQ ID NO: 22446 - RNA, 20 nt, Artificial Sequence
  TRAC targeting sequence
ucuuagcuguugaguaguca

SEQ ID NO: 22447 - RNA, 20 nt, Artificial Sequence
  TRAC targeting sequence
acuauuaaccagggcauaaa

SEQ ID NO: 22448 - RNA, 20 nt, Artificial Sequence
  TRAC targeting sequence
ggaaacugacuaauaaaauc

SEQ ID NO: 22449 - RNA, 20 nt, Artificial Sequence
  TRAC targeting sequence
ugaaaccuuuaugcccuggu

SEQ ID NO: 22450 - RNA, 20 nt, Artificial Sequence
  TRAC targeting sequence
guuuccugaaaccuuuaugc

SEQ ID NO: 22451 - RNA, 20 nt, Artificial Sequence
  TRAC targeting sequence
ccuccccugauaucaagaca

SEQ ID NO: 22452 - RNA, 20 nt, Artificial Sequence
  TRAC targeting sequence
uccccugauaucaagacaug

SEQ ID NO: 22453 - RNA, 20 nt, Artificial Sequence
  TRAC targeting sequence
ccugauaucaagacaugcaa

SEQ ID NO: 22454 - RNA, 20 nt, Artificial Sequence
  TRAC targeting sequence
ggggaggagauuuuauuagu

SEQ ID NO: 22455 - RNA, 20 nt, Artificial Sequence
  TRAC targeting sequence
agacaugcaaaaugaagaca

SEQ ID NO: 22456 - RNA, 20 nt, Artificial Sequence
  TRAC targeting sequence
ugauaucaggggaggagauu

SEQ ID NO: 22457 - RNA, 20 nt, Artificial Sequence
  TRAC targeting sequence
uuuugcaugucuugauauca

SEQ ID NO: 22458 - RNA, 20 nt, Artificial Sequence
  TRAC targeting sequence
ucauuuugcaugucuugaua

SEQ ID NO: 22459 - RNA, 20 nt, Artificial Sequence
  TRAC targeting sequence
guaggugucuucauuuugca

SEQ ID NO: 22460 - RNA, 20 nt, Artificial Sequence
  TRAC targeting sequence
caguaggugucuucauuuug

SEQ ID NO: 22461 - RNA, 20 nt, Artificial Sequence
  TRAC targeting sequence
cgcuaacuuuucucaguagg

SEQ ID NO: 22462 - RNA, 20 nt, Artificial Sequence
  TRAC targeting sequence
gucuauuucaccugggcaga

SEQ ID NO: 22463 - RNA, 20 nt, Artificial Sequence
  TRAC targeting sequence
auuucaccugggcagaagac

SEQ ID NO: 22464 - RNA, 20 nt, Artificial Sequence
  TRAC targeting sequence
ccugggcagaagacagugcc

SEQ ID NO: 22465 - RNA, 20 nt, Artificial Sequence
  TRAC targeting sequence
gcccaggugaaauagacuga

SEQ ID NO: 22466 - RNA, 20 nt, Artificial Sequence
  TRAC targeting sequence
ucugcccaggugaaauagac

SEQ ID NO: 22467 - RNA, 20 nt, Artificial Sequence
  TRAC targeting sequence
guuuguucuaaucaucuaaa

SEQ ID NO: 22468 - RNA, 20 nt, Artificial Sequence
  TRAC targeting sequence
aaucaucuaaaaagaaagca

SEQ ID NO: 22469 - RNA, 20 nt, Artificial Sequence
  TRAC targeting sequence
ucuaaaaagaaagcaaggca

SEQ ID NO: 22470 - RNA, 20 nt, Artificial Sequence
  TRAC targeting sequence
aaaaagaaagcaaggcauaa

SEQ ID NO: 22471 - RNA, 20 nt, Artificial Sequence
  TRAC targeting sequence
uuuuagaugauuagaacaaa

SEQ ID NO: 22472 - RNA, 20 nt, Artificial Sequence
  TRAC targeting sequence
uuguguuaugccuugcuuuc

SEQ ID NO: 22473 - RNA, 20 nt, Artificial Sequence
  TRAC targeting sequence
uuuuuaacaguucuuugugu

SEQ ID NO: 22474 - RNA, 20 nt, Artificial Sequence
  TRAC targeting sequence
acagcgucauuuuuaacagu

SEQ ID NO: 22475 - RNA, 20 nt, Artificial Sequence
  TRAC targeting sequence
cuacagcgucauuuuuaaca

SEQ ID NO: 22476 - RNA, 20 nt, Artificial Sequence
  TRAC targeting sequence
aucucuacagcgucauuuuu

SEQ ID NO: 22477 - RNA, 20 nt, Artificial Sequence
  TRAC targeting sequence
uuucuaucucuacagcguca

SEQ ID NO: 22478 - RNA, 20 nt, Artificial Sequence
  TRAC targeting sequence
uuucuauuuggaaucuguau

SEQ ID NO: 22479 - RNA, 20 nt, Artificial Sequence
  TRAC targeting sequence
auuuggaaucuguauucuuc

SEQ ID NO: 22480 - RNA, 20 nt, Artificial Sequence
  TRAC targeting sequence
aaauagaaaugacccuggcu

SEQ ID NO: 22481 - RNA, 20 nt, Artificial Sequence
  TRAC targeting sequence
guauucuucuccagcaauau

SEQ ID NO: 22482 - RNA, 20 nt, Artificial Sequence
  TRAC targeting sequence
ucuccagcaauaucucuauu

SEQ ID NO: 22483 - RNA, 20 nt, Artificial Sequence
  TRAC targeting sequence
ccagcaauaucucuauucag

SEQ ID NO: 22484 - RNA, 20 nt, Artificial Sequence
  TRAC targeting sequence
agcaauaucucuauucagac

SEQ ID NO: 22485 - RNA, 20 nt, Artificial Sequence
  TRAC targeting sequence
cuauucagacacuagcacug

SEQ ID NO: 22486 - RNA, 20 nt, Artificial Sequence
  TRAC targeting sequence
auucagacacuagcacuggg

SEQ ID NO: 22487 - RNA, 20 nt, Artificial Sequence
  TRAC targeting sequence
gacacuagcacugggcagau

SEQ ID NO: 22488 - RNA, 20 nt, Artificial Sequence
  TRAC targeting sequence
gaauagagauauugcuggag

SEQ ID NO: 22489 - RNA, 20 nt, Artificial Sequence
  TRAC targeting sequence
gcccagugcuagugucugaa

SEQ ID NO: 22490 - RNA, 20 nt, Artificial Sequence
  TRAC targeting sequence
aauacugauuuuccuucaaa

SEQ ID NO: 22491 - RNA, 20 nt, Artificial Sequence
  TRAC targeting sequence
guauuugaacauaucugccc

SEQ ID NO: 22492 - RNA, 20 nt, Artificial Sequence
  TRAC targeting sequence
uucaaauucaucucauccug

SEQ ID NO: 22493 - RNA, 20 nt, Artificial Sequence
  TRAC targeting sequence
aauucaucucauccuggauu

SEQ ID NO: 22494 - RNA, 20 nt, Artificial Sequence
  TRAC targeting sequence
ucucauccuggauucuaguc

SEQ ID NO: 22495 - RNA, 20 nt, Artificial Sequence
  TRAC targeting sequence
cauccuggauucuagucacc

SEQ ID NO: 22496 - RNA, 20 nt, Artificial Sequence
  TRAC targeting sequence
uccuggauucuagucaccca

SEQ ID NO: 22497 - RNA, 20 nt, Artificial Sequence
  TRAC targeting sequence
uggauucuagucacccaauu

SEQ ID NO: 22498 - RNA, 20 nt, Artificial Sequence
  TRAC targeting sequence
aggaugagaugaauuugaag

SEQ ID NO: 22499 - RNA, 20 nt, Artificial Sequence
  TRAC targeting sequence
agucacccaauuaaaacuga

SEQ ID NO: 22500 - RNA, 20 nt, Artificial Sequence
  TRAC targeting sequence
cccaauuaaaacugaaauua

SEQ ID NO: 22501 - RNA, 20 nt, Artificial Sequence
  TRAC targeting sequence
guuuuaauugggugacuaga

SEQ ID NO: 22502 - RNA, 20 nt, Artificial Sequence
  TRAC targeting sequence
aauuucaguuuuaauugggu

SEQ ID NO: 22503 - RNA, 20 nt, Artificial Sequence
  TRAC targeting sequence
cauuauuucuaauuucaguu

SEQ ID NO: 22504 - RNA, 20 nt, Artificial Sequence
  TRAC targeting sequence
aagaccauucugcagaaauu

SEQ ID NO: 22505 - RNA, 20 nt, Artificial Sequence
  TRAC targeting sequence
uugauucacauuauuucuaa

SEQ ID NO: 22506 - RNA, 20 nt, Artificial Sequence
  TRAC targeting sequence
gcagaaauucuagguuuaca

SEQ ID NO: 22507 - RNA, 20 nt, Artificial Sequence
  TRAC targeting sequence
gcagaauggucuuugauuca

SEQ ID NO: 22508 - RNA, 20 nt, Artificial Sequence
  TRAC targeting sequence
agguuuacagcucaauuuga

SEQ ID NO: 22509 - RNA, 20 nt, Artificial Sequence
  TRAC targeting sequence
auuugaaucaccaguuuuag

SEQ ID NO: 22510 - RNA, 20 nt, Artificial Sequence
  TRAC targeting sequence
aauugagcuguaaaccuaga

SEQ ID NO: 22511 - RNA, 20 nt, Artificial Sequence
  TRAC targeting sequence
ccaguuuuagaaggcacaga

SEQ ID NO: 22512 - RNA, 20 nt, Artificial Sequence
  TRAC targeting sequence
aaaacuggugauucaaauug

SEQ ID NO: 22513 - RNA, 20 nt, Artificial Sequence
  TRAC targeting sequence
gugccuucuaaaacugguga

SEQ ID NO: 22514 - RNA, 20 nt, Artificial Sequence
  TRAC targeting sequence
aaaaaaugaaaggagcuuua

SEQ ID NO: 22515 - RNA, 20 nt, Artificial Sequence
  TRAC targeting sequence
uuuuuuagaaauacacaguc

SEQ ID NO: 22516 - RNA, 20 nt, Artificial Sequence
  TRAC targeting sequence
uuucauuuuuuagaaauaca

SEQ ID NO: 22517 - RNA, 20 nt, Artificial Sequence
  TRAC targeting sequence
aaagcuccuuucauuuuuua

SEQ ID NO: 22518 - RNA, 20 nt, Artificial Sequence
  TRAC targeting sequence
cuaaagcuccuuucauuuuu

SEQ ID NO: 22519 - RNA, 20 nt, Artificial Sequence
  TRAC targeting sequence
gcuucuuuaauccuuucauu

SEQ ID NO: 22520 - RNA, 20 nt, Artificial Sequence
  TRAC targeting sequence
uuaauccuuucauuacagag

SEQ ID NO: 22521 - RNA, 20 nt, Artificial Sequence
  TRAC targeting sequence
uuucauuacagagaugagaa

SEQ ID NO: 22522 - RNA, 20 nt, Artificial Sequence
  TRAC targeting sequence
uuacagagaugagaaaacug

SEQ ID NO: 22523 - RNA, 20 nt, Artificial Sequence
  TRAC targeting sequence
guaaugaaaggauuaaagaa

SEQ ID NO: 22524 - RNA, 20 nt, Artificial Sequence
  TRAC targeting sequence
cuguaaugaaaggauuaaag

SEQ ID NO: 22525 - RNA, 20 nt, Artificial Sequence
  TRAC targeting sequence
ucucuguaaugaaaggauua

SEQ ID NO: 22526 - RNA, 20 nt, Artificial Sequence
  TRAC targeting sequence
caucucuguaaugaaaggau

SEQ ID NO: 22527 - RNA, 20 nt, Artificial Sequence
  TRAC targeting sequence
gguuacaguuuucucaucuc

SEQ ID NO: 22528 - RNA, 20 nt, Artificial Sequence
  TRAC targeting sequence
acacuaucagguuacaguuu

SEQ ID NO: 22529 - RNA, 20 nt, Artificial Sequence
  TRAC targeting sequence
guccagagcugugcugucca

SEQ ID NO: 22530 - RNA, 20 nt, Artificial Sequence
  TRAC targeting sequence
agagcugugcuguccaacac

SEQ ID NO: 22531 - RNA, 20 nt, Artificial Sequence
  TRAC targeting sequence
ggacagauuugucaacacua

SEQ ID NO: 22532 - RNA, 20 nt, Artificial Sequence
  TRAC targeting sequence
aacaccacagccacuagaca

SEQ ID NO: 22533 - RNA, 20 nt, Artificial Sequence
  TRAC targeting sequence
aguggcugugguguuggaca

SEQ ID NO: 22534 - RNA, 20 nt, Artificial Sequence
  TRAC targeting sequence
ccugugucuaguggcugugg

SEQ ID NO: 22535 - RNA, 20 nt, Artificial Sequence
  TRAC targeting sequence
aaguuaaauuaaaaauucag

SEQ ID NO: 22536 - RNA, 20 nt, Artificial Sequence
  TRAC targeting sequence
guucuucagucuguuagcca

SEQ ID NO: 22537 - RNA, 20 nt, Artificial Sequence
  TRAC targeting sequence
ucagucuguuagccacauuu

SEQ ID NO: 22538 - RNA, 20 nt, Artificial Sequence
  TRAC targeting sequence
gucuguuagccacauuucaa

SEQ ID NO: 22539 - RNA, 20 nt, Artificial Sequence
  TRAC targeting sequence
guuagccacauuucaaaugu

SEQ ID NO: 22540 - RNA, 20 nt, Artificial Sequence
  TRAC targeting sequence
aauguucaauaaccacaugu

SEQ ID NO: 22541 - RNA, 20 nt, Artificial Sequence
  TRAC targeting sequence
auaaccacauguggcuagug

SEQ ID NO: 22542 - RNA, 20 nt, Artificial Sequence
  TRAC targeting sequence
gcaccgcccauuaugguaac

SEQ ID NO: 22543 - RNA, 20 nt, Artificial Sequence
  TRAC targeting sequence
gggucugcaccgcccauuau

SEQ ID NO: 22544 - RNA, 20 nt, Artificial Sequence
  TRAC targeting sequence
ccacugcaaaaagcucuguu

SEQ ID NO: 22545 - RNA, 20 nt, Artificial Sequence
  TRAC targeting sequence
guuggacagugcugguccag

SEQ ID NO: 22546 - RNA, 20 nt, Artificial Sequence
  TRAC targeting sequence
aacagagcuuuuugcagugg

SEQ ID NO: 22547 - RNA, 20 nt, Artificial Sequence
  TRAC targeting sequence
aggaucacccucccuagcca

SEQ ID NO: 22548 - RNA, 20 nt, Artificial Sequence
  TRAC targeting sequence
uggaccagcacuguccaaca

SEQ ID NO: 22549 - RNA, 20 nt, Artificial Sequence
  TRAC targeting sequence
cccucccuagccaaagucag

SEQ ID NO: 22550 - RNA, 20 nt, Artificial Sequence
  TRAC targeting sequence
cuagccaaagucaggucucc

SEQ ID NO: 22551 - RNA, 20 nt, Artificial Sequence
  TRAC targeting sequence
ggucuccugaccugcauucu

SEQ ID NO: 22552 - RNA, 20 nt, Artificial Sequence
  TRAC targeting sequence
ccugaccugcauucuccucc

SEQ ID NO: 22553 - RNA, 20 nt, Artificial Sequence
  TRAC targeting sequence
ugaccugcauucuccuccau

SEQ ID NO: 22554 - RNA, 20 nt, Artificial Sequence
  TRAC targeting sequence
ggagaccugacuuuggcuag

SEQ ID NO: 22555 - RNA, 20 nt, Artificial Sequence
  TRAC targeting sequence
ccuccauuucuccuggacca

SEQ ID NO: 22556 - RNA, 20 nt, Artificial Sequence
  TRAC targeting sequence
uccauuucuccuggaccaua

SEQ ID NO: 22557 - RNA, 20 nt, Artificial Sequence
  TRAC targeting sequence
auuucuccuggaccauauua

SEQ ID NO: 22558 - RNA, 20 nt, Artificial Sequence
  TRAC targeting sequence
ccuggaccauauuaaguaug

SEQ ID NO: 22559 - RNA, 20 nt, Artificial Sequence
  TRAC targeting sequence
uggaccauauuaaguauggc

SEQ ID NO: 22560 - RNA, 20 nt, Artificial Sequence
  TRAC targeting sequence
aggagaaauggaggagaaug

SEQ ID NO: 22561 - RNA, 20 nt, Artificial Sequence
  TRAC targeting sequence
gcauaguuggccauacuuaa

SEQ ID NO: 22562 - RNA, 20 nt, Artificial Sequence
  TRAC targeting sequence
aauguuucugcauaguuggc

SEQ ID NO: 22563 - RNA, 20 nt, Artificial Sequence
  TRAC targeting sequence
caaauguuucugcauaguug

SEQ ID NO: 22564 - RNA, 20 nt, Artificial Sequence
  TRAC targeting sequence
uccuuuccuaucaaucucug

SEQ ID NO: 22565 - RNA, 20 nt, Artificial Sequence
  TRAC targeting sequence
uuuccuaucaaucucugcca

SEQ ID NO: 22566 - RNA, 20 nt, Artificial Sequence
  TRAC targeting sequence
uaucaaucucugccaaauuu

SEQ ID NO: 22567 - RNA, 20 nt, Artificial Sequence
  TRAC targeting sequence
aucucugccaaauuuuuccc

SEQ ID NO: 22568 - RNA, 20 nt, Artificial Sequence
  TRAC targeting sequence
cugccaaauuuuucccauuu

SEQ ID NO: 22569 - RNA, 20 nt, Artificial Sequence
  TRAC targeting sequence
gccaaauuuuucccauuuaa

SEQ ID NO: 22570 - RNA, 20 nt, Artificial Sequence
  TRAC targeting sequence
cauuuaaaaaagaaaagaau

SEQ ID NO: 22571 - RNA, 20 nt, Artificial Sequence
  TRAC targeting sequence
uuuuuaaaugggaaaaauuu

SEQ ID NO: 22572 - RNA, 20 nt, Artificial Sequence
  TRAC targeting sequence
uuucuuuuuuaaaugggaaa

SEQ ID NO: 22573 - RNA, 20 nt, Artificial Sequence
  TRAC targeting sequence
agucugauggcucugaugaa

SEQ ID NO: 22574 - RNA, 20 nt, Artificial Sequence
  TRAC targeting sequence
gauggcucugaugaaaauuu

SEQ ID NO: 22575 - RNA, 20 nt, Artificial Sequence
  TRAC targeting sequence
gacuggauucuuuucuuuuu

SEQ ID NO: 22576 - RNA, 20 nt, Artificial Sequence
  TRAC targeting sequence
gaugaaaauuuaaaauaaau

SEQ ID NO: 22577 - RNA, 20 nt, Artificial Sequence
  TRAC targeting sequence
gagccaucagacuggauucu

SEQ ID NO: 22578 - RNA, 20 nt, Artificial Sequence
  TRAC targeting sequence
ucagagccaucagacuggau

SEQ ID NO: 22579 - RNA, 20 nt, Artificial Sequence
  TRAC targeting sequence
uaaaaagaaaaguuuaauau

SEQ ID NO: 22580 - RNA, 20 nt, Artificial Sequence
  TRAC targeting sequence
uuuuaagaaauuuuuauuua

SEQ ID NO: 22581 - RNA, 20 nt, Artificial Sequence
  TRAC targeting sequence
uuaaaaauauuaaacuuuuc

SEQ ID NO: 22582 - RNA, 20 nt, Artificial Sequence
  TRAC targeting sequence
aacaugacauauauauaaag

SEQ ID NO: 22583 - RNA, 20 nt, Artificial Sequence
  TRAC targeting sequence
uguuagaggguuuucauuaa

SEQ ID NO: 22584 - RNA, 20 nt, Artificial Sequence
  TRAC targeting sequence
ucugagaguccuaaacauaa

SEQ ID NO: 22585 - RNA, 20 nt, Artificial Sequence
  TRAC targeting sequence
gagaguccuaaacauaacag

SEQ ID NO: 22586 - RNA, 20 nt, Artificial Sequence
  TRAC targeting sequence
gaugauggcuuuauauauau

SEQ ID NO: 22587 - RNA, 20 nt, Artificial Sequence
  TRAC targeting sequence
cagaugauggcuuuauauau

SEQ ID NO: 22588 - RNA, 20 nt, Artificial Sequence
  TRAC targeting sequence
uaaacauaacaggaaggaau

SEQ ID NO: 22589 - RNA, 20 nt, Artificial Sequence
  TRAC targeting sequence
uguuauguuuaggacucuca

SEQ ID NO: 22590 - RNA, 20 nt, Artificial Sequence
  TRAC targeting sequence
uuccuguuauguuuaggacu

SEQ ID NO: 22591 - RNA, 20 nt, Artificial Sequence
  TRAC targeting sequence
aaaccuuuauauuccuuccu

SEQ ID NO: 22592 - RNA, 20 nt, Artificial Sequence
  TRAC targeting sequence
aaaugucuguuauccaguuc

SEQ ID NO: 22593 - RNA, 20 nt, Artificial Sequence
  TRAC targeting sequence
guuauccaguucccccucag

SEQ ID NO: 22594 - RNA, 20 nt, Artificial Sequence
  TRAC targeting sequence
aguucccccucagucacuua

SEQ ID NO: 22595 - RNA, 20 nt, Artificial Sequence
  TRAC targeting sequence
cccucagucacuuauuaguu

SEQ ID NO: 22596 - RNA, 20 nt, Artificial Sequence
  TRAC targeting sequence
gucacuuauuaguuccaggg

SEQ ID NO: 22597 - RNA, 20 nt, Artificial Sequence
  TRAC targeting sequence
cuuauuaguuccagggccug

SEQ ID NO: 22598 - RNA, 20 nt, Artificial Sequence
  TRAC targeting sequence
agggccuggauacaucaacu

SEQ ID NO: 22599 - RNA, 20 nt, Artificial Sequence
  TRAC targeting sequence
aggcccuggaacuaauaagu

SEQ ID NO: 22600 - RNA, 20 nt, Artificial Sequence
  TRAC targeting sequence
acuaaaguuucaccaaggug

SEQ ID NO: 22601 - RNA, 20 nt, Artificial Sequence
  TRAC targeting sequence
ccaagguguaauuaccucaa

SEQ ID NO: 22602 - RNA, 20 nt, Artificial Sequence
  TRAC targeting sequence
aguguaaaauaggaauacua

SEQ ID NO: 22603 - RNA, 20 nt, Artificial Sequence
  TRAC targeting sequence
uauuuuacacuugagguaau

SEQ ID NO: 22604 - RNA, 20 nt, Artificial Sequence
  TRAC targeting sequence
gucuccacaucacuggguag

SEQ ID NO: 22605 - RNA, 20 nt, Artificial Sequence
  TRAC targeting sequence
ccacaucacuggguaggaag

SEQ ID NO: 22606 - RNA, 20 nt, Artificial Sequence
  TRAC targeting sequence
acaucacuggguaggaagga

SEQ ID NO: 22607 - RNA, 20 nt, Artificial Sequence
  TRAC targeting sequence
cuggguaggaaggaaggauc

SEQ ID NO: 22608 - RNA, 20 nt, Artificial Sequence
  TRAC targeting sequence
uacccagugauguggagaca

SEQ ID NO: 22609 - RNA, 20 nt, Artificial Sequence
  TRAC targeting sequence
uuccuacccagugaugugga

SEQ ID NO: 22610 - RNA, 20 nt, Artificial Sequence
  TRAC targeting sequence
uuccuuccuacccagugaug

SEQ ID NO: 22611 - RNA, 20 nt, Artificial Sequence
  TRAC targeting sequence
caugagcugauguauguaaa

SEQ ID NO: 22612 - RNA, 20 nt, Artificial Sequence
  TRAC targeting sequence
ugugauccuuccuuccuacc

SEQ ID NO: 22613 - RNA, 20 nt, Artificial Sequence
  TRAC targeting sequence
gcucaugugauccuuccuuc

SEQ ID NO: 22614 - RNA, 20 nt, Artificial Sequence
  TRAC targeting sequence
acauauacuuuuacauacau

SEQ ID NO: 22615 - RNA, 20 nt, Artificial Sequence
  TRAC targeting sequence
cauacauuccacauauacuu

SEQ ID NO: 22616 - RNA, 20 nt, Artificial Sequence
  TRAC targeting sequence
uacaagccuguuaacguggg

SEQ ID NO: 22617 - RNA, 20 nt, Artificial Sequence
  TRAC targeting sequence
cacguuaacaggcuuguagg

SEQ ID NO: 22618 - RNA, 20 nt, Artificial Sequence
  TRAC targeting sequence
aguucccacguuaacaggcu

SEQ ID NO: 22619 - RNA, 20 nt, Artificial Sequence
  TRAC targeting sequence
ucuaguucccacguuaacag

SEQ ID NO: 22620 - RNA, 20 nt, Artificial Sequence
  TRAC targeting sequence
uacaaauaugugcaucuugu

SEQ ID NO: 22621 - RNA, 20 nt, Artificial Sequence
  TRAC targeting sequence
uguuauaaucauuuaacuuu

SEQ ID NO: 22622 - RNA, 20 nt, Artificial Sequence
  TRAC targeting sequence
uuuaacuuucugccuccuau

SEQ ID NO: 22623 - RNA, 20 nt, Artificial Sequence
  TRAC targeting sequence
gccuccuauaaauggauaau

SEQ ID NO: 22624 - RNA, 20 nt, Artificial Sequence
  TRAC targeting sequence
uauaaauggauaaugggaau

SEQ ID NO: 22625 - RNA, 20 nt, Artificial Sequence
  TRAC targeting sequence
auuuauaggaggcagaaagu

SEQ ID NO: 22626 - RNA, 20 nt, Artificial Sequence
  TRAC targeting sequence
cauuauccauuuauaggagg

SEQ ID NO: 22627 - RNA, 20 nt, Artificial Sequence
  TRAC targeting sequence
gaaaauaugaauaaaaagca

SEQ ID NO: 22628 - RNA, 20 nt, Artificial Sequence
  TRAC targeting sequence
gauucccauuauccauuuau

SEQ ID NO: 22629 - RNA, 20 nt, Artificial Sequence
  TRAC targeting sequence
uauuuucagauucccauuau

SEQ ID NO: 22630 - RNA, 20 nt, Artificial Sequence
  TRAC targeting sequence
uugcuuuuuauucauauuuu

SEQ ID NO: 22631 - RNA, 20 nt, Artificial Sequence
  TRAC targeting sequence
uuaaucguugcuuuuuauuc

SEQ ID NO: 22632 - RNA, 20 nt, Artificial Sequence
  TRAC targeting sequence
ccuuaaucguugcuuuuuau

SEQ ID NO: 22633 - RNA, 20 nt, Artificial Sequence
  TRAC targeting sequence
guuuucuccuuaaucguugc

SEQ ID NO: 22634 - RNA, 20 nt, Artificial Sequence
  TRAC targeting sequence
uuugggcuuugcuuucuguu

SEQ ID NO: 22635 - RNA, 20 nt, Artificial Sequence
  TRAC targeting sequence
ucauuugggcuuugcuuucu

SEQ ID NO: 22636 - RNA, 20 nt, Artificial Sequence
  TRAC targeting sequence
acaaaaacaguacaauccuc

SEQ ID NO: 22637 - RNA, 20 nt, Artificial Sequence
  TRAC targeting sequence
uccucaaacacaaaagaacc

SEQ ID NO: 22638 - RNA, 20 nt, Artificial Sequence
  TRAC targeting sequence
ucaaacacaaaagaaccauc

SEQ ID NO: 22639 - RNA, 20 nt, Artificial Sequence
  TRAC targeting sequence
aacacaaaagaaccaucaag

SEQ ID NO: 22640 - RNA, 20 nt, Artificial Sequence
  TRAC targeting sequence
uuuguguuugaggaggauug

SEQ ID NO: 22641 - RNA, 20 nt, Artificial Sequence
  TRAC targeting sequence
agaaucaugcugagaggcau

SEQ ID NO: 22642 - RNA, 20 nt, Artificial Sequence
  TRAC targeting sequence
ugaugguucuuuuguguuug

SEQ ID NO: 22643 - RNA, 20 nt, Artificial Sequence
  TRAC targeting sequence
ugcugagaggcauuaacagu

SEQ ID NO: 22644 - RNA, 20 nt, Artificial Sequence
  TRAC targeting sequence
gcaugauucuugaugguucu

SEQ ID NO: 22645 - RNA, 20 nt, Artificial Sequence
  TRAC targeting sequence
cagcaugauucuugaugguu

SEQ ID NO: 22646 - RNA, 20 nt, Artificial Sequence
  TRAC targeting sequence
ugccacuguuaaugccucuc

SEQ ID NO: 22647 - RNA, 20 nt, Artificial Sequence
  TRAC targeting sequence
cuugccacuguuaaugccuc

SEQ ID NO: 22648 - RNA, 20 nt, Artificial Sequence
  TRAC targeting sequence
aagucucuugccacuguuaa

SEQ ID NO: 22649 - RNA, 20 nt, Artificial Sequence
  TRAC targeting sequence
ucaaagucucuugccacugu

SEQ ID NO: 22650 - RNA, 20 nt, Artificial Sequence
  TRAC targeting sequence
agaccaauccucucacaaca

SEQ ID NO: 22651 - RNA, 20 nt, Artificial Sequence
  TRAC targeting sequence
ggauguucaucaaagucucu

SEQ ID NO: 22652 - RNA, 20 nt, Artificial Sequence
  TRAC targeting sequence
ucucacaacacagacagaga

SEQ ID NO: 22653 - RNA, 20 nt, Artificial Sequence
  TRAC targeting sequence
cacaacacagacagagaaac

SEQ ID NO: 22654 - RNA, 20 nt, Artificial Sequence
  TRAC targeting sequence
caacacagacagagaaacug

SEQ ID NO: 22655 - RNA, 20 nt, Artificial Sequence
  TRAC targeting sequence
guguugugagaggauugguc

SEQ ID NO: 22656 - RNA, 20 nt, Artificial Sequence
  TRAC targeting sequence
gucuguguugugagaggauu

SEQ ID NO: 22657 - RNA, 20 nt, Artificial Sequence
  TRAC targeting sequence
cugucuguguugugagagga

SEQ ID NO: 22658 - RNA, 20 nt, Artificial Sequence
  TRAC targeting sequence
guuucucugucuguguugug

SEQ ID NO: 22659 - RNA, 20 nt, Artificial Sequence
  TRAC targeting sequence
gagguaaguuuauuugucca

SEQ ID NO: 22660 - RNA, 20 nt, Artificial Sequence
  TRAC targeting sequence
gagccucaguuucucugucu

SEQ ID NO: 22661 - RNA, 20 nt, Artificial Sequence
  TRAC targeting sequence
auucaacuaguuaacagagc

SEQ ID NO: 22662 - RNA, 20 nt, Artificial Sequence
  TRAC targeting sequence
acuaguuaacagagcaaagc

SEQ ID NO: 22663 - RNA, 20 nt, Artificial Sequence
  TRAC targeting sequence
guuaacuaguugaauggaca

SEQ ID NO: 22664 - RNA, 20 nt, Artificial Sequence
  TRAC targeting sequence
ucugauuuuuuuuuuuuuuu

SEQ ID NO: 22665 - RNA, 20 nt, Artificial Sequence
  TRAC targeting sequence
gauuuuuuuuuuuuuuuuuu

SEQ ID NO: 22666 - RNA, 20 nt, Artificial Sequence
  TRAC targeting sequence
gaagacuuguauuguaggcu

SEQ ID NO: 22667 - RNA, 20 nt, Artificial Sequence
  TRAC targeting sequence
aaaaaaaaaaaaaaaaaauc

SEQ ID NO: 22668 - RNA, 20 nt, Artificial Sequence
  TRAC targeting sequence
caaaaaaaaaaaaaaaaaaa

SEQ ID NO: 22669 - RNA, 20 nt, Artificial Sequence
  TRAC targeting sequence
cacucugucacucaggcugg

SEQ ID NO: 22670 - RNA, 20 nt, Artificial Sequence
  TRAC targeting sequence
cucugucacucaggcuggag

SEQ ID NO: 22671 - RNA, 20 nt, Artificial Sequence
  TRAC targeting sequence
gucacucaggcuggagugca

SEQ ID NO: 22672 - RNA, 20 nt, Artificial Sequence
  TRAC targeting sequence
cucaggcuggagugcaagug

SEQ ID NO: 22673 - RNA, 20 nt, Artificial Sequence
  TRAC targeting sequence
ggcuggagugcaaguggcau

SEQ ID NO: 22674 - RNA, 20 nt, Artificial Sequence
  TRAC targeting sequence
agccugagugacagagugag

SEQ ID NO: 22675 - RNA, 20 nt, Artificial Sequence
  TRAC targeting sequence
ugccacuugcacuccagccu

SEQ ID NO: 22676 - RNA, 20 nt, Artificial Sequence
  TRAC targeting sequence
caguucacugcagccgugac

SEQ ID NO: 22677 - RNA, 20 nt, Artificial Sequence
  TRAC targeting sequence
cugcagccgugaccucccac

SEQ ID NO: 22678 - RNA, 20 nt, Artificial Sequence
  TRAC targeting sequence
cggcugcagugaacugugau

SEQ ID NO: 22679 - RNA, 20 nt, Artificial Sequence
  TRAC targeting sequence
cacgcucaagcaauccuucc

SEQ ID NO: 22680 - RNA, 20 nt, Artificial Sequence
  TRAC targeting sequence
agcaauccuuccaccucagc

SEQ ID NO: 22681 - RNA, 20 nt, Artificial Sequence
  TRAC targeting sequence
uuccaccucagccuucugag

SEQ ID NO: 22682 - RNA, 20 nt, Artificial Sequence
  TRAC targeting sequence
accucagccuucugaguagc

SEQ ID NO: 22683 - RNA, 20 nt, Artificial Sequence
  TRAC targeting sequence
gccuucugaguagcugggac

SEQ ID NO: 22684 - RNA, 20 nt, Artificial Sequence
  TRAC targeting sequence
gaguagcugggaccacaggc

SEQ ID NO: 22685 - RNA, 20 nt, Artificial Sequence
  TRAC targeting sequence
gaaggcugagguggaaggau

SEQ ID NO: 22686 - RNA, 20 nt, Artificial Sequence
  TRAC targeting sequence
cagcuacucagaaggcugag

SEQ ID NO: 22687 - RNA, 20 nt, Artificial Sequence
  TRAC targeting sequence
aauucuuuugauuuuuggua

SEQ ID NO: 22688 - RNA, 20 nt, Artificial Sequence
  TRAC targeting sequence
uuugauuuuugguagagaca

SEQ ID NO: 22689 - RNA, 20 nt, Artificial Sequence
  TRAC targeting sequence
aaagaauuagaggggcgugg

SEQ ID NO: 22690 - RNA, 20 nt, Artificial Sequence
  TRAC targeting sequence
accaaaaaucaaaagaauua

SEQ ID NO: 22691 - RNA, 20 nt, Artificial Sequence
  TRAC targeting sequence
cuaccaaaaaucaaaagaau

SEQ ID NO: 22692 - RNA, 20 nt, Artificial Sequence
  TRAC targeting sequence
ugcuauaucacccaugcugg

SEQ ID NO: 22693 - RNA, 20 nt, Artificial Sequence
  TRAC targeting sequence
cccaugcuggucucaaacuc

SEQ ID NO: 22694 - RNA, 20 nt, Artificial Sequence
  TRAC targeting sequence
caaacuccugggcucaagcg

SEQ ID NO: 22695 - RNA, 20 nt, Artificial Sequence
  TRAC targeting sequence
aacuccugggcucaagcgau

SEQ ID NO: 22696 - RNA, 20 nt, Artificial Sequence
  TRAC targeting sequence
ugggcucaagcgauccuccc

SEQ ID NO: 22697 - RNA, 20 nt, Artificial Sequence
  TRAC targeting sequence
agcgauccucccaccuuggc

SEQ ID NO: 22698 - RNA, 20 nt, Artificial Sequence
  TRAC targeting sequence
cuugagcccaggaguuugag

SEQ ID NO: 22699 - RNA, 20 nt, Artificial Sequence
  TRAC targeting sequence
ucccaccuuggccuccccaa

SEQ ID NO: 22700 - RNA, 20 nt, Artificial Sequence
  TRAC targeting sequence
caccuuggccuccccaagug

SEQ ID NO: 22701 - RNA, 20 nt, Artificial Sequence
  TRAC targeting sequence
ccaagugcugggauuacagg

SEQ ID NO: 22702 - RNA, 20 nt, Artificial Sequence
  TRAC targeting sequence
cagcacuuggggaggccaag

SEQ ID NO: 22703 - RNA, 20 nt, Artificial Sequence
  TRAC targeting sequence
ucugacuucuugucucaugc

SEQ ID NO: 22704 - RNA, 20 nt, Artificial Sequence
  TRAC targeting sequence
gacuucuugucucaugcucu

SEQ ID NO: 22705 - RNA, 20 nt, Artificial Sequence
  TRAC targeting sequence
gaggaggggcuggugcggug

SEQ ID NO: 22706 - RNA, 20 nt, Artificial Sequence
  TRAC targeting sequence
ugucucaugcucuuccccac

SEQ ID NO: 22707 - RNA, 20 nt, Artificial Sequence
  TRAC targeting sequence
caugcucuuccccaccccac

SEQ ID NO: 22708 - RNA, 20 nt, Artificial Sequence
  TRAC targeting sequence
ugcucuuccccaccccacag

SEQ ID NO: 22709 - RNA, 20 nt, Artificial Sequence
  TRAC targeting sequence
uccccaccccacagccucuc

SEQ ID NO: 22710 - RNA, 20 nt, Artificial Sequence
  TRAC targeting sequence
ccaccccacagccucuccua

SEQ ID NO: 22711 - RNA, 20 nt, Artificial Sequence
  TRAC targeting sequence
ccuaugaaucuuugccuugg

SEQ ID NO: 22712 - RNA, 20 nt, Artificial Sequence
  TRAC targeting sequence
uaugaaucuuugccuuggcu

SEQ ID NO: 22713 - RNA, 20 nt, Artificial Sequence
  TRAC targeting sequence
uaggagaggcuguggggugg

SEQ ID NO: 22714 - RNA, 20 nt, Artificial Sequence
  TRAC targeting sequence
uugccuuggcuuuuuuucuu

SEQ ID NO: 22715 - RNA, 20 nt, Artificial Sequence
  TRAC targeting sequence
uucguaccacuuuccauguu

SEQ ID NO: 22716 - RNA, 20 nt, Artificial Sequence
  TRAC targeting sequence
uaccacuuuccauguuuuag

SEQ ID NO: 22717 - RNA, 20 nt, Artificial Sequence
  TRAC targeting sequence
auguuuuagcauccaaguaa

SEQ ID NO: 22718 - RNA, 20 nt, Artificial Sequence
  TRAC targeting sequence
aaguaacuuaauaacauaac

SEQ ID NO: 22719 - RNA, 20 nt, Artificial Sequence
  TRAC targeting sequence
ugcaguuaaaaaguguuuau

SEQ ID NO: 22720 - RNA, 20 nt, Artificial Sequence
  TRAC targeting sequence
ugccuguaauuccagcacuu

SEQ ID NO: 22721 - RNA, 20 nt, Artificial Sequence
  TRAC targeting sequence
agcacuuugggaggcuaagg

SEQ ID NO: 22722 - RNA, 20 nt, Artificial Sequence
  TRAC targeting sequence
caaagugcuggaauuacagg

SEQ ID NO: 22723 - RNA, 20 nt, Artificial Sequence
  TRAC targeting sequence
gccuaccuuagccucccaaa

SEQ ID NO: 22724 - RNA, 20 nt, Artificial Sequence
  TRAC targeting sequence
caaagucaaaagauagagac

SEQ ID NO: 22725 - RNA, 20 nt, Artificial Sequence
  TRAC targeting sequence
aaagauagagaccauacugg

SEQ ID NO: 22726 - RNA, 20 nt, Artificial Sequence
  TRAC targeting sequence
uuugacuuugugaucugccu

SEQ ID NO: 22727 - RNA, 20 nt, Artificial Sequence
  TRAC targeting sequence
aucuuuugacuuugugaucu

SEQ ID NO: 22728 - RNA, 20 nt, Artificial Sequence
  TRAC targeting sequence
cuaucuuuugacuuugugau

SEQ ID NO: 22729 - RNA, 20 nt, Artificial Sequence
  TRAC targeting sequence
ccauguuggccaguaugguc

SEQ ID NO: 22730 - RNA, 20 nt, Artificial Sequence
  TRAC targeting sequence
cuccuaaaaauacaaaaauu

SEQ ID NO: 22731 - RNA, 20 nt, Artificial Sequence
  TRAC targeting sequence
ccuaaaaauacaaaaauuag

SEQ ID NO: 22732 - RNA, 20 nt, Artificial Sequence
  TRAC targeting sequence
uaaaaauacaaaaauuagcc

SEQ ID NO: 22733 - RNA, 20 nt, Artificial Sequence
  TRAC targeting sequence
cacgccuggcuaauuuuugu

SEQ ID NO: 22734 - RNA, 20 nt, Artificial Sequence
  TRAC targeting sequence
cagcuacucaagaggcugag

SEQ ID NO: 22735 - RNA, 20 nt, Artificial Sequence
  TRAC targeting sequence
agaggcugaggcaggagaac

SEQ ID NO: 22736 - RNA, 20 nt, Artificial Sequence
  TRAC targeting sequence
ugaguagcugggacuacaag

SEQ ID NO: 22737 - RNA, 20 nt, Artificial Sequence
  TRAC targeting sequence
gccucuugaguagcugggac

SEQ ID NO: 22738 - RNA, 20 nt, Artificial Sequence
  TRAC targeting sequence
ugccucagccucuugaguag

SEQ ID NO: 22739 - RNA, 20 nt, Artificial Sequence
  TRAC targeting sequence
ccugccucagccucuugagu

SEQ ID NO: 22740 - RNA, 20 nt, Artificial Sequence
  TRAC targeting sequence
uggguuuaagcaguucuccu

SEQ ID NO: 22741 - RNA, 20 nt, Artificial Sequence
  TRAC targeting sequence
gccuccuggguuuaagcagu

SEQ ID NO: 22742 - RNA, 20 nt, Artificial Sequence
  TRAC targeting sequence
cuauaaccuccgccuccugg

SEQ ID NO: 22743 - RNA, 20 nt, Artificial Sequence
  TRAC targeting sequence
uggcucacuauaaccuccgc

SEQ ID NO: 22744 - RNA, 20 nt, Artificial Sequence
  TRAC targeting sequence
ugccacugcacuacagccug

SEQ ID NO: 22745 - RNA, 20 nt, Artificial Sequence
  TRAC targeting sequence
aggcuguagugcaguggcau

SEQ ID NO: 22746 - RNA, 20 nt, Artificial Sequence
  TRAC targeting sequence
cuuuguuguccaggcuguag

SEQ ID NO: 22747 - RNA, 20 nt, Artificial Sequence
  TRAC targeting sequence
cgcuuuguuguccaggcugu

SEQ ID NO: 22748 - RNA, 20 nt, Artificial Sequence
  TRAC targeting sequence
gucucaaaaaaaaaaaaaaa

SEQ ID NO: 22749 - RNA, 20 nt, Artificial Sequence
  TRAC targeting sequence
caaaaaaaaaaaaaaagguu

SEQ ID NO: 22750 - RNA, 20 nt, Artificial Sequence
  TRAC targeting sequence
aaaaaaaaaaaaaagguuua

SEQ ID NO: 22751 - RNA, 20 nt, Artificial Sequence
  TRAC targeting sequence
uucauacacucauucaacaa

SEQ ID NO: 22752 - RNA, 20 nt, Artificial Sequence
  TRAC targeting sequence
uacacucauucaacaaacac

SEQ ID NO: 22753 - RNA, 20 nt, Artificial Sequence
  TRAC targeting sequence
uucaacaaacacacacuguu

SEQ ID NO: 22754 - RNA, 20 nt, Artificial Sequence
  TRAC targeting sequence
acaaacacacacuguuacug

SEQ ID NO: 22755 - RNA, 20 nt, Artificial Sequence
  TRAC targeting sequence
caauugaguccagugggaga

SEQ ID NO: 22756 - RNA, 20 nt, Artificial Sequence
  TRAC targeting sequence
auugugaacaguaacagugu

SEQ ID NO: 22757 - RNA, 20 nt, Artificial Sequence
  TRAC targeting sequence
agugggagagagaagaaagu

SEQ ID NO: 22758 - RNA, 20 nt, Artificial Sequence
  TRAC targeting sequence
cacuggacucaauugugaac

SEQ ID NO: 22759 - RNA, 20 nt, Artificial Sequence
  TRAC targeting sequence
cccacuggacucaauuguga

SEQ ID NO: 22760 - RNA, 20 nt, Artificial Sequence
  TRAC targeting sequence
cucccacuggacucaauugu

SEQ ID NO: 22761 - RNA, 20 nt, Artificial Sequence
  TRAC targeting sequence
cucucccacuggacucaauu

SEQ ID NO: 22762 - RNA, 20 nt, Artificial Sequence
  TRAC targeting sequence
ucucucucccacuggacuca

SEQ ID NO: 22763 - RNA, 20 nt, Artificial Sequence
  TRAC targeting sequence
cuuucuucucucucccacug

SEQ ID NO: 22764 - RNA, 20 nt, Artificial Sequence
  TRAC targeting sequence
uucacuuucuucucucuccc

SEQ ID NO: 22765 - RNA, 20 nt, Artificial Sequence
  TRAC targeting sequence
uaacaaugugauaagugcag

SEQ ID NO: 22766 - RNA, 20 nt, Artificial Sequence
  TRAC targeting sequence
cauuguuaugaaacuauuca

SEQ ID NO: 22767 - RNA, 20 nt, Artificial Sequence
  TRAC targeting sequence
agugcugcacuuaucacauu

SEQ ID NO: 22768 - RNA, 20 nt, Artificial Sequence
  TRAC targeting sequence
uccagugcugcacuuaucac

SEQ ID NO: 22769 - RNA, 20 nt, Artificial Sequence
  TRAC targeting sequence
acugcauuccuccagugcug

SEQ ID NO: 22770 - RNA, 20 nt, Artificial Sequence
  TRAC targeting sequence
uaugcaaccugagggguggg

SEQ ID NO: 22771 - RNA, 20 nt, Artificial Sequence
  TRAC targeting sequence
gguugcauaggagcccuuag

SEQ ID NO: 22772 - RNA, 20 nt, Artificial Sequence
  TRAC targeting sequence
caccccucagguugcauagg

SEQ ID NO: 22773 - RNA, 20 nt, Artificial Sequence
  TRAC targeting sequence
uucccaccccucagguugca

SEQ ID NO: 22774 - RNA, 20 nt, Artificial Sequence
  TRAC targeting sequence
aagucauucccaccccucag

SEQ ID NO: 22775 - RNA, 20 nt, Artificial Sequence
  TRAC targeting sequence
uauuccaagucauucccacc

SEQ ID NO: 22776 - RNA, 20 nt, Artificial Sequence
  TRAC targeting sequence
uccaagcugggaggauggag

SEQ ID NO: 22777 - RNA, 20 nt, Artificial Sequence
  TRAC targeting sequence
aagcugggaggauggagaaa

SEQ ID NO: 22778 - RNA, 20 nt, Artificial Sequence
  TRAC targeting sequence
cagcuuggaugacuccuauu

SEQ ID NO: 22779 - RNA, 20 nt, Artificial Sequence
  TRAC targeting sequence
ucccagcuuggaugacuccu

SEQ ID NO: 22780 - RNA, 20 nt, Artificial Sequence
  TRAC targeting sequence
auccucccagcuuggaugac

SEQ ID NO: 22781 - RNA, 20 nt, Artificial Sequence
  TRAC targeting sequence
ccauccucccagcuuggaug

SEQ ID NO: 22782 - RNA, 20 nt, Artificial Sequence
  TRAC targeting sequence
uugcugcccuaacuuacugc

SEQ ID NO: 22783 - RNA, 20 nt, Artificial Sequence
  TRAC targeting sequence
uaaauauaaaucuauuucga

SEQ ID NO: 22784 - RNA, 20 nt, Artificial Sequence
  TRAC targeting sequence
auuucgauauucuuuuuucu

SEQ ID NO: 22785 - RNA, 20 nt, Artificial Sequence
  TRAC targeting sequence
auauucuuuuuucuuuggua

SEQ ID NO: 22786 - RNA, 20 nt, Artificial Sequence
  TRAC targeting sequence
aaauagauuuauauuuauga

SEQ ID NO: 22787 - RNA, 20 nt, Artificial Sequence
  TRAC targeting sequence
uuuuucuuugguagccuuaa

SEQ ID NO: 22788 - RNA, 20 nt, Artificial Sequence
  TRAC targeting sequence
uugguagccuuaaauacacc

SEQ ID NO: 22789 - RNA, 20 nt, Artificial Sequence
  TRAC targeting sequence
auuuuauauuugguguauuu

SEQ ID NO: 22790 - RNA, 20 nt, Artificial Sequence
  TRAC targeting sequence
auaaacaaguaaagucauca

SEQ ID NO: 22791 - RNA, 20 nt, Artificial Sequence
  TRAC targeting sequence
ucaauuagcacuuuuuagca

SEQ ID NO: 22792 - RNA, 20 nt, Artificial Sequence
  TRAC targeting sequence
auuagcacuuuuuagcaaau

SEQ ID NO: 22793 - RNA, 20 nt, Artificial Sequence
  TRAC targeting sequence
acuuauuuuauuugcuaaaa

SEQ ID NO: 22794 - RNA, 20 nt, Artificial Sequence
  TRAC targeting sequence
aaguuuuaagaaugaaaggu

SEQ ID NO: 22795 - RNA, 20 nt, Artificial Sequence
  TRAC targeting sequence
uaaaacuuugaaucuacuua

SEQ ID NO: 22796 - RNA, 20 nt, Artificial Sequence
  TRAC targeting sequence
uucuuaaaacuuugaaucua

SEQ ID NO: 22797 - RNA, 20 nt, Artificial Sequence
  TRAC targeting sequence
uuaccuuucauucuuaaaac

SEQ ID NO: 22798 - RNA, 20 nt, Artificial Sequence
  TRAC targeting sequence
cagagccaggcacugugaca

SEQ ID NO: 22799 - RNA, 20 nt, Artificial Sequence
  TRAC targeting sequence
gagccaggcacugugacaca

SEQ ID NO: 22800 - RNA, 20 nt, Artificial Sequence
  TRAC targeting sequence
gagauuaguucuuuaccuuu

SEQ ID NO: 22801 - RNA, 20 nt, Artificial Sequence
  TRAC targeting sequence
cagugccuggcucugagauu

SEQ ID NO: 22802 - RNA, 20 nt, Artificial Sequence
  TRAC targeting sequence
agcuacacagaagccucagg

SEQ ID NO: 22803 - RNA, 20 nt, Artificial Sequence
  TRAC targeting sequence
guguagcuggaccuacaggu

SEQ ID NO: 22804 - RNA, 20 nt, Artificial Sequence
  TRAC targeting sequence
ggcaggaggaucacuugacc

SEQ ID NO: 22805 - RNA, 20 nt, Artificial Sequence
  TRAC targeting sequence
ugccugaggcuucuguguag

SEQ ID NO: 22806 - RNA, 20 nt, Artificial Sequence
  TRAC targeting sequence
uccugccugaggcuucugug

SEQ ID NO: 22807 - RNA, 20 nt, Artificial Sequence
  TRAC targeting sequence
cuugaccccagggaguuccc

SEQ ID NO: 22808 - RNA, 20 nt, Artificial Sequence
  TRAC targeting sequence
agugauccuccugccugagg

SEQ ID NO: 22809 - RNA, 20 nt, Artificial Sequence
  TRAC targeting sequence
cuggggucaagugauccucc

SEQ ID NO: 22810 - RNA, 20 nt, Artificial Sequence
  TRAC targeting sequence
cagcuugggcaacguagcga

SEQ ID NO: 22811 - RNA, 20 nt, Artificial Sequence
  TRAC targeting sequence
cuacguugcccaagcuggga

SEQ ID NO: 22812 - RNA, 20 nt, Artificial Sequence
  TRAC targeting sequence
cgcuacguugcccaagcugg

SEQ ID NO: 22813 - RNA, 20 nt, Artificial Sequence
  TRAC targeting sequence
caccuucuaaacagagaaaa

SEQ ID NO: 22814 - RNA, 20 nt, Artificial Sequence
  TRAC targeting sequence
ccuucuaaacagagaaaaau

SEQ ID NO: 22815 - RNA, 20 nt, Artificial Sequence
  TRAC targeting sequence
aaacagagaaaaaugaguug

SEQ ID NO: 22816 - RNA, 20 nt, Artificial Sequence
  TRAC targeting sequence
guuuagaaggugagauuaau

SEQ ID NO: 22817 - RNA, 20 nt, Artificial Sequence
  TRAC targeting sequence
cuguuuagaaggugagauua

SEQ ID NO: 22818 - RNA, 20 nt, Artificial Sequence
  TRAC targeting sequence
uuuuucucuguuuagaaggu

SEQ ID NO: 22819 - RNA, 20 nt, Artificial Sequence
  TRAC targeting sequence
acucauuuuucucuguuuag

SEQ ID NO: 22820 - RNA, 20 nt, Artificial Sequence
  TRAC targeting sequence
uaacuuuuuucaacucauuu

SEQ ID NO: 22821 - RNA, 20 nt, Artificial Sequence
  TRAC targeting sequence
caucauaacuuuuuucaacu

SEQ ID NO: 22822 - RNA, 20 nt, Artificial Sequence
  TRAC targeting sequence
gauuuccuacaaauguagga

SEQ ID NO: 22823 - RNA, 20 nt, Artificial Sequence
  TRAC targeting sequence
gagguagucacaucauaacu

SEQ ID NO: 22824 - RNA, 20 nt, Artificial Sequence
  TRAC targeting sequence
uacaaauguaggacaguucc

SEQ ID NO: 22825 - RNA, 20 nt, Artificial Sequence
  TRAC targeting sequence
uacauuuguaggaaaucuga

SEQ ID NO: 22826 - RNA, 20 nt, Artificial Sequence
  TRAC targeting sequence
cucugagagagcuuauuugg

SEQ ID NO: 22827 - RNA, 20 nt, Artificial Sequence
  TRAC targeting sequence
gagagagcuuauuuggcggc

SEQ ID NO: 22828 - RNA, 20 nt, Artificial Sequence
  TRAC targeting sequence
gagggaacuguccuacauuu

SEQ ID NO: 22829 - RNA, 20 nt, Artificial Sequence
  TRAC targeting sequence
cagagggaacuguccuacau

SEQ ID NO: 22830 - RNA, 20 nt, Artificial Sequence
  TRAC targeting sequence
cucagagggaacuguccuac

SEQ ID NO: 22831 - RNA, 20 nt, Artificial Sequence
  TRAC targeting sequence
ugccgccaaauaagcucucu

SEQ ID NO: 22832 - RNA, 20 nt, Artificial Sequence
  TRAC targeting sequence
auauaagguggaaauaucaa

SEQ ID NO: 22833 - RNA, 20 nt, Artificial Sequence
  TRAC targeting sequence
accuuauauugaauuagguc

SEQ ID NO: 22834 - RNA, 20 nt, Artificial Sequence
  TRAC targeting sequence
aagagaaaaugaaauaaaaa

SEQ ID NO: 22835 - RNA, 20 nt, Artificial Sequence
  TRAC targeting sequence
uugauauuuccaccuuauau

SEQ ID NO: 22836 - RNA, 20 nt, Artificial Sequence
  TRAC targeting sequence
cuuugauauuuccaccuuau

SEQ ID NO: 22837 - RNA, 20 nt, Artificial Sequence
  TRAC targeting sequence
uuuucucuuugauauuucca

SEQ ID NO: 22838 - RNA, 20 nt, Artificial Sequence
  TRAC targeting sequence
accaacaaaaaauuaaagau

SEQ ID NO: 22839 - RNA, 20 nt, Artificial Sequence
  TRAC targeting sequence
uuaauuuuuuguugguggag

SEQ ID NO: 22840 - RNA, 20 nt, Artificial Sequence
  TRAC targeting sequence
cacgcaauaaucuuuaauuu

SEQ ID NO: 22841 - RNA, 20 nt, Artificial Sequence
  TRAC targeting sequence
ccauugagaauaaaagacgu

SEQ ID NO: 22842 - RNA, 20 nt, Artificial Sequence
  TRAC targeting sequence
auggugaccucccacgcaau

SEQ ID NO: 22843 - RNA, 20 nt, Artificial Sequence
  TRAC targeting sequence
caauggugaccucccacgca

SEQ ID NO: 22844 - RNA, 20 nt, Artificial Sequence
  TRAC targeting sequence
uuuauucucaauggugaccu

SEQ ID NO: 22845 - RNA, 20 nt, Artificial Sequence
  TRAC targeting sequence
acgucuuuuauucucaaugg

SEQ ID NO: 22846 - RNA, 20 nt, Artificial Sequence
  TRAC targeting sequence
uuuuuugguuuguucuacgu

SEQ ID NO: 22847 - RNA, 20 nt, Artificial Sequence
  TRAC targeting sequence
caaacuaaggaggugaaaaa

SEQ ID NO: 22848 - RNA, 20 nt, Artificial Sequence
  TRAC targeting sequence
aacuaaggaggugaaaaaaa

SEQ ID NO: 22849 - RNA, 20 nt, Artificial Sequence
  TRAC targeting sequence
uuaguuugagagcuucuuuu

SEQ ID NO: 22850 - RNA, 20 nt, Artificial Sequence
  TRAC targeting sequence
ccuccuuaguuugagagcuu

SEQ ID NO: 22851 - RNA, 20 nt, Artificial Sequence
  TRAC targeting sequence
uuuuuucaccuccuuaguuu

SEQ ID NO: 22852 - RNA, 20 nt, Artificial Sequence
  TRAC targeting sequence
aacgggaaaccugcgggucu

SEQ ID NO: 22853 - RNA, 20 nt, Artificial Sequence
  TRAC targeting sequence
cguuugauuucuuuuuuuca

SEQ ID NO: 22854 - RNA, 20 nt, Artificial Sequence
  TRAC targeting sequence
augugcacagucuuggucuu

SEQ ID NO: 22855 - RNA, 20 nt, Artificial Sequence
  TRAC targeting sequence
uggucuucccccacacaaca

SEQ ID NO: 22856 - RNA, 20 nt, Artificial Sequence
  TRAC targeting sequence
ucccccacacaacaaaaucu

SEQ ID NO: 22857 - RNA, 20 nt, Artificial Sequence
  TRAC targeting sequence
cccacacaacaaaaucuagg

SEQ ID NO: 22858 - RNA, 20 nt, Artificial Sequence
  TRAC targeting sequence
agggccacuuuaggguucua

SEQ ID NO: 22859 - RNA, 20 nt, Artificial Sequence
  TRAC targeting sequence
augcccuuuuguuccuaacu

SEQ ID NO: 22860 - RNA, 20 nt, Artificial Sequence
  TRAC targeting sequence
uaacucgacauugcccacuu

SEQ ID NO: 22861 - RNA, 20 nt, Artificial Sequence
  TRAC targeting sequence
acauugcccacuucuggcca

SEQ ID NO: 22862 - RNA, 20 nt, Artificial Sequence
  TRAC targeting sequence
aguuaggaacaaaagggcau

SEQ ID NO: 22863 - RNA, 20 nt, Artificial Sequence
  TRAC targeting sequence
ggccagaauguaaagcaacc

SEQ ID NO: 22864 - RNA, 20 nt, Artificial Sequence
  TRAC targeting sequence
ggccagaagugggcaauguc

SEQ ID NO: 22865 - RNA, 20 nt, Artificial Sequence
  TRAC targeting sequence
aaacccuccuggaccucugc

SEQ ID NO: 22866 - RNA, 20 nt, Artificial Sequence
  TRAC targeting sequence
uggaccucugcugcccccca

SEQ ID NO: 22867 - RNA, 20 nt, Artificial Sequence
  TRAC targeting sequence
aggaggguuuagaugcuggg

SEQ ID NO: 22868 - RNA, 20 nt, Artificial Sequence
  TRAC targeting sequence
gcugccccccaaugacugga

SEQ ID NO: 22869 - RNA, 20 nt, Artificial Sequence
  TRAC targeting sequence
uuggggggcagcagaggucc

SEQ ID NO: 22870 - RNA, 20 nt, Artificial Sequence
  TRAC targeting sequence
agucauuggggggcagcaga

SEQ ID NO: 22871 - RNA, 20 nt, Artificial Sequence
  TRAC targeting sequence
uuccagucauuggggggcag

SEQ ID NO: 22872 - RNA, 20 nt, Artificial Sequence
  TRAC targeting sequence
guagcuucuucccccaaacu

SEQ ID NO: 22873 - RNA, 20 nt, Artificial Sequence
  TRAC targeting sequence
ucccccaaacucaacuccuc

SEQ ID NO: 22874 - RNA, 20 nt, Artificial Sequence
  TRAC targeting sequence
cccaaacucaacuccucaug

SEQ ID NO: 22875 - RNA, 20 nt, Artificial Sequence
  TRAC targeting sequence
acuccucauguuuuguagua

SEQ ID NO: 22876 - RNA, 20 nt, Artificial Sequence
  TRAC targeting sequence
ucauguuuuguaguagccgc

SEQ ID NO: 22877 - RNA, 20 nt, Artificial Sequence
  TRAC targeting sequence
uguuuuguaguagccgcuca

SEQ ID NO: 22878 - RNA, 20 nt, Artificial Sequence
  TRAC targeting sequence
acacaugaaacauaccaucc

SEQ ID NO: 22879 - RNA, 20 nt, Artificial Sequence
  TRAC targeting sequence
uguguugagcggcuacuaca

SEQ ID NO: 22880 - RNA, 20 nt, Artificial Sequence
  TRAC targeting sequence
acuagguggcagcaaagccc

SEQ ID NO: 22881 - RNA, 20 nt, Artificial Sequence
  TRAC targeting sequence
gugggcuuugcugccaccua

SEQ ID NO: 22882 - RNA, 20 nt, Artificial Sequence
  TRAC targeting sequence
aguuccccuucccgagguaa

SEQ ID NO: 22883 - RNA, 20 nt, Artificial Sequence
  TRAC targeting sequence
ccuucccgagguaauuuucu

SEQ ID NO: 22884 - RNA, 20 nt, Artificial Sequence
  TRAC targeting sequence
cgagguaauuuucuagauua

SEQ ID NO: 22885 - RNA, 20 nt, Artificial Sequence
  TRAC targeting sequence
ggaaggggaacuugauguua

SEQ ID NO: 22886 - RNA, 20 nt, Artificial Sequence
  TRAC targeting sequence
agauuacuauacuuuaacug

SEQ ID NO: 22887 - RNA, 20 nt, Artificial Sequence
  TRAC targeting sequence
agaaaauuaccucgggaagg

SEQ ID NO: 22888 - RNA, 20 nt, Artificial Sequence
  TRAC targeting sequence
guuaaaguauaguaaucuag

SEQ ID NO: 22889 - RNA, 20 nt, Artificial Sequence
  TRAC targeting sequence
aaaagccaacauaauuucau

SEQ ID NO: 22890 - RNA, 20 nt, Artificial Sequence
  TRAC targeting sequence
aauucaguuaaaguauagua

SEQ ID NO: 22891 - RNA, 20 nt, Artificial Sequence
  TRAC targeting sequence
uguuuguaaacagugcugcc

SEQ ID NO: 22892 - RNA, 20 nt, Artificial Sequence
  TRAC targeting sequence
gaguuuaaaauguucugccc

SEQ ID NO: 22893 - RNA, 20 nt, Artificial Sequence
  TRAC targeting sequence
gacuggcagcacuguuuaca

SEQ ID NO: 22894 - RNA, 20 nt, Artificial Sequence
  TRAC targeting sequence
gcccaacccuguagcccccu

SEQ ID NO: 22895 - RNA, 20 nt, Artificial Sequence
  TRAC targeting sequence
agcuaggaucaaacacugaa

SEQ ID NO: 22896 - RNA, 20 nt, Artificial Sequence
  TRAC targeting sequence
uagcuggaacaagggggcua

SEQ ID NO: 22897 - RNA, 20 nt, Artificial Sequence
  TRAC targeting sequence
aacacugaauuuuuuaagac

SEQ ID NO: 22898 - RNA, 20 nt, Artificial Sequence
  TRAC targeting sequence
guguuugauccuagcuggaa

SEQ ID NO: 22899 - RNA, 20 nt, Artificial Sequence
  TRAC targeting sequence
uaaaaaauucaguguuugau

SEQ ID NO: 22900 - RNA, 20 nt, Artificial Sequence
  TRAC targeting sequence
caagucuuaaaaaauucagu

SEQ ID NO: 22901 - RNA, 20 nt, Artificial Sequence
  TRAC targeting sequence
cacaagucuuaaaaaauuca

SEQ ID NO: 22902 - RNA, 20 nt, Artificial Sequence
  TRAC targeting sequence
cucacaagucuuaaaaaauu

SEQ ID NO: 22903 - RNA, 20 nt, Artificial Sequence
  TRAC targeting sequence
ccauuauaaaaacaaaacaa

SEQ ID NO: 22904 - RNA, 20 nt, Artificial Sequence
  TRAC targeting sequence
auuauaaaaacaaaacaaug

SEQ ID NO: 22905 - RNA, 20 nt, Artificial Sequence
  TRAC targeting sequence
cccugggagcugagcacauu

SEQ ID NO: 22906 - RNA, 20 nt, Artificial Sequence
  TRAC targeting sequence
cugggagcugagcacauuuu

SEQ ID NO: 22907 - RNA, 20 nt, Artificial Sequence
  TRAC targeting sequence
cagggagauaguugccaaau

SEQ ID NO: 22908 - RNA, 20 nt, Artificial Sequence
  TRAC targeting sequence
gcucccagggagauaguugc

SEQ ID NO: 22909 - RNA, 20 nt, Artificial Sequence
  TRAC targeting sequence
agcaagguuuugucccuuug

SEQ ID NO: 22910 - RNA, 20 nt, Artificial Sequence
  TRAC targeting sequence
cuuugggcccaguucacccu

SEQ ID NO: 22911 - RNA, 20 nt, Artificial Sequence
  TRAC targeting sequence
cccuuccuucugacccaggg

SEQ ID NO: 22912 - RNA, 20 nt, Artificial Sequence
  TRAC targeting sequence
uucugacccagggcccaauu

SEQ ID NO: 22913 - RNA, 20 nt, Artificial Sequence
  TRAC targeting sequence
gacccagggcccaauucauc

SEQ ID NO: 22914 - RNA, 20 nt, Artificial Sequence
  TRAC targeting sequence
gaaggaagggugaacugggc

SEQ ID NO: 22915 - RNA, 20 nt, Artificial Sequence
  TRAC targeting sequence
ucaggaacuuuaauucucaa

SEQ ID NO: 22916 - RNA, 20 nt, Artificial Sequence
  TRAC targeting sequence
ggaacuuuaauucucaaacu

SEQ ID NO: 22917 - RNA, 20 nt, Artificial Sequence
  TRAC targeting sequence
ugaugaauugggcccugggu

SEQ ID NO: 22918 - RNA, 20 nt, Artificial Sequence
  TRAC targeting sequence
caaacugugauccaauacag

SEQ ID NO: 22919 - RNA, 20 nt, Artificial Sequence
  TRAC targeting sequence
aacugugauccaauacaguu

SEQ ID NO: 22920 - RNA, 20 nt, Artificial Sequence
  TRAC targeting sequence
caguuugagaauuaaaguuc

SEQ ID NO: 22921 - RNA, 20 nt, Artificial Sequence
  TRAC targeting sequence
aauacaguucuguccuucuu

SEQ ID NO: 22922 - RNA, 20 nt, Artificial Sequence
  TRAC targeting sequence
guccuucuuuuccucauuac

SEQ ID NO: 22923 - RNA, 20 nt, Artificial Sequence
  TRAC targeting sequence
uucuuuuccucauuacccuu

SEQ ID NO: 22924 - RNA, 20 nt, Artificial Sequence
  TRAC targeting sequence
uuuccucauuacccuucaga

SEQ ID NO: 22925 - RNA, 20 nt, Artificial Sequence
  TRAC targeting sequence
ucauuacccuucagaacacc

SEQ ID NO: 22926 - RNA, 20 nt, Artificial Sequence
  TRAC targeting sequence
uuacccuucagaacaccuga

SEQ ID NO: 22927 - RNA, 20 nt, Artificial Sequence
  TRAC targeting sequence
gaacaccugagauggacuga

SEQ ID NO: 22928 - RNA, 20 nt, Artificial Sequence
  TRAC targeting sequence
gaaggguaaugaggaaaaga

SEQ ID NO: 22929 - RNA, 20 nt, Artificial Sequence
  TRAC targeting sequence
gguguucugaaggguaauga

SEQ ID NO: 22930 - RNA, 20 nt, Artificial Sequence
  TRAC targeting sequence
cagguguucugaaggguaau

SEQ ID NO: 22931 - RNA, 20 nt, Artificial Sequence
  TRAC targeting sequence
aucucagguguucugaaggg

SEQ ID NO: 22932 - RNA, 20 nt, Artificial Sequence
  TRAC targeting sequence
guccaucucagguguucuga

SEQ ID NO: 22933 - RNA, 20 nt, Artificial Sequence
  TRAC targeting sequence
caguccaucucagguguucu

SEQ ID NO: 22934 - RNA, 20 nt, Artificial Sequence
  TRAC targeting sequence
uuuuuaaaaaaaaaaaaaaa

SEQ ID NO: 22935 - RNA, 20 nt, Artificial Sequence
  TRAC targeting sequence
aauguucaauaaccacaugu

SEQ ID NO: 22936 - RNA, 20 nt, Artificial Sequence
  TRAC targeting sequence
auaaccacauguggcuagug

SEQ ID NO: 22937 - RNA, 20 nt, Artificial Sequence
  TRAC targeting sequence
gcaccgcccauuaugguaac

SEQ ID NO: 22938 - RNA, 20 nt, Artificial Sequence
  TRAC targeting sequence
gggucugcaccgcccauuau

SEQ ID NO: 22939 - RNA, 20 nt, Artificial Sequence
  TRAC targeting sequence
ccacugcaaaaagcucuguu

SEQ ID NO: 22940 - RNA, 20 nt, Artificial Sequence
  TRAC targeting sequence
guuggacagugcugguccag

SEQ ID NO: 22941 - RNA, 20 nt, Artificial Sequence
  TRAC targeting sequence
aacagagcuuuuugcagugg

SEQ ID NO: 22942 - RNA, 20 nt, Artificial Sequence
  TRAC targeting sequence
aggaucacccucccuagcca

SEQ ID NO: 22943 - RNA, 20 nt, Artificial Sequence
  TRAC targeting sequence
uggaccagcacuguccaaca

SEQ ID NO: 22944 - RNA, 20 nt, Artificial Sequence
  TRAC targeting sequence
cccucccuagccaaagucag

SEQ ID NO: 22945 - RNA, 20 nt, Artificial Sequence
  TRAC targeting sequence
cuagccaaagucaggucucc

SEQ ID NO: 22946 - RNA, 20 nt, Artificial Sequence
  TRAC targeting sequence
ggucuccugaccugcauucu

SEQ ID NO: 22947 - RNA, 20 nt, Artificial Sequence
  TRAC targeting sequence
ccugaccugcauucuccucc

SEQ ID NO: 22948 - RNA, 20 nt, Artificial Sequence
  TRAC targeting sequence
ugaccugcauucuccuccau

SEQ ID NO: 22949 - RNA, 20 nt, Artificial Sequence
  TRAC targeting sequence
ggagaccugacuuuggcuag

SEQ ID NO: 22950 - RNA, 20 nt, Artificial Sequence
  TRAC targeting sequence
ccuccauuucuccuggacca

SEQ ID NO: 22951 - RNA, 20 nt, Artificial Sequence
  TRAC targeting sequence
uccauuucuccuggaccaua

SEQ ID NO: 22952 - RNA, 20 nt, Artificial Sequence
  TRAC targeting sequence
auuucuccuggaccauauua

SEQ ID NO: 22953 - RNA, 20 nt, Artificial Sequence
  TRAC targeting sequence
ccuggaccauauuaaguaug

SEQ ID NO: 22954 - RNA, 20 nt, Artificial Sequence
  TRAC targeting sequence
uggaccauauuaaguauggc

SEQ ID NO: 22955 - RNA, 20 nt, Artificial Sequence
  TRAC targeting sequence
aggagaaauggaggagaaug

SEQ ID NO: 22956 - RNA, 20 nt, Artificial Sequence
  TRAC targeting sequence
gcauaguuggccauacuuaa

SEQ ID NO: 22957 - RNA, 20 nt, Artificial Sequence
  TRAC targeting sequence
aauguuucugcauaguuggc

SEQ ID NO: 22958 - RNA, 20 nt, Artificial Sequence
  TRAC targeting sequence
caaauguuucugcauaguug

SEQ ID NO: 22959 - RNA, 20 nt, Artificial Sequence
  TRAC targeting sequence
uccuuuccuaucaaucucug

SEQ ID NO: 22960 - RNA, 20 nt, Artificial Sequence
  TRAC targeting sequence
uuuccuaucaaucucugcca

SEQ ID NO: 22961 - RNA, 20 nt, Artificial Sequence
  TRAC targeting sequence
uaucaaucucugccaaauuu

SEQ ID NO: 22962 - RNA, 20 nt, Artificial Sequence
  TRAC targeting sequence
aucucugccaaauuuuuccc

SEQ ID NO: 22963 - RNA, 20 nt, Artificial Sequence
  TRAC targeting sequence
cugccaaauuuuucccauuu

SEQ ID NO: 22964 - RNA, 20 nt, Artificial Sequence
  TRAC targeting sequence
gccaaauuuuucccauuuaa

SEQ ID NO: 22965 - RNA, 20 nt, Artificial Sequence
  TRAC targeting sequence
cauuuaaaaaagaaaagaau

SEQ ID NO: 22966 - RNA, 20 nt, Artificial Sequence
  TRAC targeting sequence
uuuuuaaaugggaaaaauuu

SEQ ID NO: 22967 - RNA, 20 nt, Artificial Sequence
  TRAC targeting sequence
uuucuuuuuuaaaugggaaa

SEQ ID NO: 22968 - RNA, 20 nt, Artificial Sequence
  TRAC targeting sequence
agucugauggcucugaugaa

SEQ ID NO: 22969 - RNA, 20 nt, Artificial Sequence
  TRAC targeting sequence
gauggcucugaugaaaauuu

SEQ ID NO: 22970 - RNA, 20 nt, Artificial Sequence
  TRAC targeting sequence
gacuggauucuuuucuuuuu

SEQ ID NO: 22971 - RNA, 20 nt, Artificial Sequence
  TRAC targeting sequence
gaugaaaauuuaaaauaaau

SEQ ID NO: 22972 - RNA, 20 nt, Artificial Sequence
  TRAC targeting sequence
gagccaucagacuggauucu

SEQ ID NO: 22973 - RNA, 20 nt, Artificial Sequence
  TRAC targeting sequence
ucagagccaucagacuggau

SEQ ID NO: 22974 - RNA, 20 nt, Artificial Sequence
  TRAC targeting sequence
uaaaaagaaaaguuuaauau

SEQ ID NO: 22975 - RNA, 20 nt, Artificial Sequence
  TRAC targeting sequence
uuuuaagaaauuuuuauuua

SEQ ID NO: 22976 - RNA, 20 nt, Artificial Sequence
  TRAC targeting sequence
uuaaaaauauuaaacuuuuc

SEQ ID NO: 22977 - RNA, 20 nt, Artificial Sequence
  TRAC targeting sequence
aacaugacauauauauaaag

SEQ ID NO: 22978 - RNA, 20 nt, Artificial Sequence
  TRAC targeting sequence
uguuagaggguuuucauuaa

SEQ ID NO: 22979 - RNA, 20 nt, Artificial Sequence
  TRAC targeting sequence
ucugagaguccuaaacauaa

SEQ ID NO: 22980 - RNA, 20 nt, Artificial Sequence
  TRAC targeting sequence
gagaguccuaaacauaacag

SEQ ID NO: 22981 - RNA, 20 nt, Artificial Sequence
  TRAC targeting sequence
gaugauggcuuuauauauau

SEQ ID NO: 22982 - RNA, 20 nt, Artificial Sequence
  TRAC targeting sequence
cagaugauggcuuuauauau

SEQ ID NO: 22983 - RNA, 20 nt, Artificial Sequence
  TRAC targeting sequence
uaaacauaacaggaaggaau

SEQ ID NO: 22984 - RNA, 20 nt, Artificial Sequence
  TRAC targeting sequence
uguuauguuuaggacucuca

SEQ ID NO: 22985 - RNA, 20 nt, Artificial Sequence
  TRAC targeting sequence
uuccuguuauguuuaggacu

SEQ ID NO: 22986 - RNA, 20 nt, Artificial Sequence
  TRAC targeting sequence
aaaccuuuauauuccuuccu

SEQ ID NO: 22987 - RNA, 20 nt, Artificial Sequence
  TRAC targeting sequence
aaaugucuguuauccaguuc

SEQ ID NO: 22988 - RNA, 20 nt, Artificial Sequence
  TRAC targeting sequence
guuauccaguucccccucag

SEQ ID NO: 22989 - RNA, 20 nt, Artificial Sequence
  TRAC targeting sequence
aguucccccucagucacuua

SEQ ID NO: 22990 - RNA, 20 nt, Artificial Sequence
  TRAC targeting sequence
cccucagucacuuauuaguu

SEQ ID NO: 22991 - RNA, 20 nt, Artificial Sequence
  TRAC targeting sequence
gucacuuauuaguuccaggg

SEQ ID NO: 22992 - RNA, 20 nt, Artificial Sequence
  TRAC targeting sequence
cuuauuaguuccagggccug

SEQ ID NO: 22993 - RNA, 20 nt, Artificial Sequence
  TRAC targeting sequence
agggccuggauacaucaacu

SEQ ID NO: 22994 - RNA, 20 nt, Artificial Sequence
  TRAC targeting sequence
aggcccuggaacuaauaagu

SEQ ID NO: 22995 - RNA, 20 nt, Artificial Sequence
  TRAC targeting sequence
acuaaaguuucaccaaggug

SEQ ID NO: 22996 - RNA, 20 nt, Artificial Sequence
  TRAC targeting sequence
ccaagguguaauuaccucaa

SEQ ID NO: 22997 - RNA, 20 nt, Artificial Sequence
  TRAC targeting sequence
aguguaaaauaggaauacua

SEQ ID NO: 22998 - RNA, 20 nt, Artificial Sequence
  TRAC targeting sequence
uauuuuacacuugagguaau

SEQ ID NO: 22999 - RNA, 20 nt, Artificial Sequence
  TRAC targeting sequence
gucuccacaucacuggguag

SEQ ID NO: 23000 - RNA, 20 nt, Artificial Sequence
  TRAC targeting sequence
ccacaucacuggguaggaag

SEQ ID NO: 23001 - RNA, 20 nt, Artificial Sequence
  TRAC targeting sequence
acaucacuggguaggaagga

SEQ ID NO: 23002 - RNA, 20 nt, Artificial Sequence
  TRAC targeting sequence
cuggguaggaaggaaggauc

SEQ ID NO: 23003 - RNA, 20 nt, Artificial Sequence
  TRAC targeting sequence
uacccagugauguggagaca

SEQ ID NO: 23004 - RNA, 20 nt, Artificial Sequence
  TRAC targeting sequence
uuccuacccagugaugugga

SEQ ID NO: 23005 - RNA, 20 nt, Artificial Sequence
  TRAC targeting sequence
uuccuuccuacccagugaug

SEQ ID NO: 23006 - RNA, 20 nt, Artificial Sequence
  TRAC targeting sequence
caugagcugauguauguaaa

SEQ ID NO: 23007 - RNA, 20 nt, Artificial Sequence
  TRAC targeting sequence
ugugauccuuccuuccuacc

SEQ ID NO: 23008 - RNA, 20 nt, Artificial Sequence
  TRAC targeting sequence
gcucaugugauccuuccuuc

SEQ ID NO: 23009 - RNA, 20 nt, Artificial Sequence
  TRAC targeting sequence
acauauacuuuuacauacau

SEQ ID NO: 23010 - RNA, 20 nt, Artificial Sequence
  TRAC targeting sequence
cauacauuccacauauacuu

SEQ ID NO: 23011 - RNA, 20 nt, Artificial Sequence
  TRAC targeting sequence
uacaagccuguuaacguggg

SEQ ID NO: 23012 - RNA, 20 nt, Artificial Sequence
  TRAC targeting sequence
cacguuaacaggcuuguagg

SEQ ID NO: 23013 - RNA, 20 nt, Artificial Sequence
  TRAC targeting sequence
aguucccacguuaacaggcu

SEQ ID NO: 23014 - RNA, 20 nt, Artificial Sequence
  TRAC targeting sequence
ucuaguucccacguuaacag

SEQ ID NO: 23015 - RNA, 20 nt, Artificial Sequence
  TRAC targeting sequence
uacaaauaugugcaucuugu

SEQ ID NO: 23016 - RNA, 20 nt, Artificial Sequence
  TRAC targeting sequence
uguuauaaucauuuaacuuu

SEQ ID NO: 23017 - RNA, 20 nt, Artificial Sequence
  TRAC targeting sequence
uuuaacuuucugccuccuau

SEQ ID NO: 23018 - RNA, 20 nt, Artificial Sequence
  TRAC targeting sequence
gccuccuauaaauggauaau

SEQ ID NO: 23019 - RNA, 20 nt, Artificial Sequence
  TRAC targeting sequence
uauaaauggauaaugggaau

SEQ ID NO: 23020 - RNA, 20 nt, Artificial Sequence
  TRAC targeting sequence
auuuauaggaggcagaaagu

SEQ ID NO: 23021 - RNA, 20 nt, Artificial Sequence
  TRAC targeting sequence
cauuauccauuuauaggagg

SEQ ID NO: 23022 - RNA, 20 nt, Artificial Sequence
  TRAC targeting sequence
gaaaauaugaauaaaaagca

SEQ ID NO: 23023 - RNA, 20 nt, Artificial Sequence
  TRAC targeting sequence
gauucccauuauccauuuau

SEQ ID NO: 23024 - RNA, 20 nt, Artificial Sequence
  TRAC targeting sequence
uauuuucagauucccauuau

SEQ ID NO: 23025 - RNA, 20 nt, Artificial Sequence
  TRAC targeting sequence
uugcuuuuuauucauauuuu

SEQ ID NO: 23026 - RNA, 20 nt, Artificial Sequence
  TRAC targeting sequence
uuaaucguugcuuuuuauuc

SEQ ID NO: 23027 - RNA, 20 nt, Artificial Sequence
  TRAC targeting sequence
ccuuaaucguugcuuuuuau

SEQ ID NO: 23028 - RNA, 20 nt, Artificial Sequence
  TRAC targeting sequence
guuuucuccuuaaucguugc

SEQ ID NO: 23029 - RNA, 20 nt, Artificial Sequence
  TRAC targeting sequence
uuugggcuuugcuuucuguu

SEQ ID NO: 23030 - RNA, 20 nt, Artificial Sequence
  TRAC targeting sequence
ucauuugggcuuugcuuucu

SEQ ID NO: 23031 - RNA, 20 nt, Artificial Sequence
  TRAC targeting sequence
acaaaaacaguacaauccuc

SEQ ID NO: 23032 - RNA, 20 nt, Artificial Sequence
  TRAC targeting sequence
uccucaaacacaaaagaacc

SEQ ID NO: 23033 - RNA, 20 nt, Artificial Sequence
  TRAC targeting sequence
ucaaacacaaaagaaccauc

SEQ ID NO: 23034 - RNA, 20 nt, Artificial Sequence
  TRAC targeting sequence
aacacaaaagaaccaucaag

SEQ ID NO: 23035 - RNA, 20 nt, Artificial Sequence
  TRAC targeting sequence
uuuguguuugaggaggauug

SEQ ID NO: 23036 - RNA, 20 nt, Artificial Sequence
  TRAC targeting sequence
agaaucaugcugagaggcau

SEQ ID NO: 23037 - RNA, 20 nt, Artificial Sequence
  TRAC targeting sequence
ugaugguucuuuuguguuug

SEQ ID NO: 23038 - RNA, 20 nt, Artificial Sequence
  TRAC targeting sequence
ugcugagaggcauuaacagu

SEQ ID NO: 23039 - RNA, 20 nt, Artificial Sequence
  TRAC targeting sequence
gcaugauucuugaugguucu

SEQ ID NO: 23040 - RNA, 20 nt, Artificial Sequence
  TRAC targeting sequence
cagcaugauucuugaugguu

SEQ ID NO: 23041 - RNA, 20 nt, Artificial Sequence
  TRAC targeting sequence
ugccacuguuaaugccucuc

SEQ ID NO: 23042 - RNA, 20 nt, Artificial Sequence
  TRAC targeting sequence
cuugccacuguuaaugccuc

SEQ ID NO: 23043 - RNA, 20 nt, Artificial Sequence
  TRAC targeting sequence
aagucucuugccacuguuaa

SEQ ID NO: 23044 - RNA, 20 nt, Artificial Sequence
  TRAC targeting sequence
ucaaagucucuugccacugu

SEQ ID NO: 23045 - RNA, 20 nt, Artificial Sequence
  TRAC targeting sequence
agaccaauccucucacaaca

SEQ ID NO: 23046 - RNA, 20 nt, Artificial Sequence
  TRAC targeting sequence
ggauguucaucaaagucucu

SEQ ID NO: 23047 - RNA, 20 nt, Artificial Sequence
  TRAC targeting sequence
ucucacaacacagacagaga

SEQ ID NO: 23048 - RNA, 20 nt, Artificial Sequence
  TRAC targeting sequence
cacaacacagacagagaaac

SEQ ID NO: 23049 - RNA, 20 nt, Artificial Sequence
  TRAC targeting sequence
caacacagacagagaaacug

SEQ ID NO: 23050 - RNA, 20 nt, Artificial Sequence
  TRAC targeting sequence
guguugugagaggauugguc

SEQ ID NO: 23051 - RNA, 20 nt, Artificial Sequence
  TRAC targeting sequence
gucuguguugugagaggauu

SEQ ID NO: 23052 - RNA, 20 nt, Artificial Sequence
  TRAC targeting sequence
cugucuguguugugagagga

SEQ ID NO: 23053 - RNA, 20 nt, Artificial Sequence
  TRAC targeting sequence
guuucucugucuguguugug

SEQ ID NO: 23054 - RNA, 20 nt, Artificial Sequence
  TRAC targeting sequence
gagguaaguuuauuugucca

SEQ ID NO: 23055 - RNA, 20 nt, Artificial Sequence
  TRAC targeting sequence
gagccucaguuucucugucu

SEQ ID NO: 23056 - RNA, 20 nt, Artificial Sequence
  TRAC targeting sequence
auucaacuaguuaacagagc

SEQ ID NO: 23057 - RNA, 20 nt, Artificial Sequence
  TRAC targeting sequence
acuaguuaacagagcaaagc

SEQ ID NO: 23058 - RNA, 20 nt, Artificial Sequence
  TRAC targeting sequence
guuaacuaguugaauggaca

SEQ ID NO: 23059 - RNA, 20 nt, Artificial Sequence
  TRAC targeting sequence
ucugauuuuuuuuuuuuuuu

SEQ ID NO: 23060 - RNA, 20 nt, Artificial Sequence
  TRAC targeting sequence
gauuuuuuuuuuuuuuuuuu

SEQ ID NO: 23061 - RNA, 20 nt, Artificial Sequence
  TRAC targeting sequence
gaagacuuguauuguaggcu

SEQ ID NO: 23062 - RNA, 20 nt, Artificial Sequence
  TRAC targeting sequence
aaaaaaaaaaaaaaaaaauc

SEQ ID NO: 23063 - RNA, 20 nt, Artificial Sequence
  TRAC targeting sequence
caaaaaaaaaaaaaaaaaaa

SEQ ID NO: 23064 - RNA, 20 nt, Artificial Sequence
  TRAC targeting sequence
cacucugucacucaggcugg

SEQ ID NO: 23065 - RNA, 20 nt, Artificial Sequence
  TRAC targeting sequence
cucugucacucaggcuggag

SEQ ID NO: 23066 - RNA, 20 nt, Artificial Sequence
  TRAC targeting sequence
gucacucaggcuggagugca

SEQ ID NO: 23067 - RNA, 20 nt, Artificial Sequence
  TRAC targeting sequence
cucaggcuggagugcaagug

SEQ ID NO: 23068 - RNA, 20 nt, Artificial Sequence
  TRAC targeting sequence
ggcuggagugcaaguggcau

SEQ ID NO: 23069 - RNA, 20 nt, Artificial Sequence
  TRAC targeting sequence
agccugagugacagagugag

SEQ ID NO: 23070 - RNA, 20 nt, Artificial Sequence
  TRAC targeting sequence
ugccacuugcacuccagccu

SEQ ID NO: 23071 - RNA, 20 nt, Artificial Sequence
  TRAC targeting sequence
caguucacugcagccgugac

SEQ ID NO: 23072 - RNA, 20 nt, Artificial Sequence
  TRAC targeting sequence
cugcagccgugaccucccac

SEQ ID NO: 23073 - RNA, 20 nt, Artificial Sequence
  TRAC targeting sequence
cggcugcagugaacugugau

SEQ ID NO: 23074 - RNA, 20 nt, Artificial Sequence
  TRAC targeting sequence
cacgcucaagcaauccuucc

SEQ ID NO: 23075 - RNA, 20 nt, Artificial Sequence
  TRAC targeting sequence
agcaauccuuccaccucagc

SEQ ID NO: 23076 - RNA, 20 nt, Artificial Sequence
  TRAC targeting sequence
uuccaccucagccuucugag

SEQ ID NO: 23077 - RNA, 20 nt, Artificial Sequence
  TRAC targeting sequence
accucagccuucugaguagc

SEQ ID NO: 23078 - RNA, 20 nt, Artificial Sequence
  TRAC targeting sequence
gccuucugaguagcugggac

SEQ ID NO: 23079 - RNA, 20 nt, Artificial Sequence
  TRAC targeting sequence
gaguagcugggaccacaggc

SEQ ID NO: 23080 - RNA, 20 nt, Artificial Sequence
  TRAC targeting sequence
gaaggcugagguggaaggau

SEQ ID NO: 23081 - RNA, 20 nt, Artificial Sequence
  TRAC targeting sequence
cagcuacucagaaggcugag

SEQ ID NO: 23082 - RNA, 20 nt, Artificial Sequence
  TRAC targeting sequence
aauucuuuugauuuuuggua

SEQ ID NO: 23083 - RNA, 20 nt, Artificial Sequence
  TRAC targeting sequence
uuugauuuuugguagagaca

SEQ ID NO: 23084 - RNA, 20 nt, Artificial Sequence
  TRAC targeting sequence
aaagaauuagaggggcgugg

SEQ ID NO: 23085 - RNA, 20 nt, Artificial Sequence
  TRAC targeting sequence
accaaaaaucaaaagaauua

SEQ ID NO: 23086 - RNA, 20 nt, Artificial Sequence
  TRAC targeting sequence
cuaccaaaaaucaaaagaau

SEQ ID NO: 23087 - RNA, 20 nt, Artificial Sequence
  TRAC targeting sequence
ugcuauaucacccaugcugg

SEQ ID NO: 23088 - RNA, 20 nt, Artificial Sequence
  TRAC targeting sequence
cccaugcuggucucaaacuc

SEQ ID NO: 23089 - RNA, 20 nt, Artificial Sequence
  TRAC targeting sequence
caaacuccugggcucaagcg

SEQ ID NO: 23090 - RNA, 20 nt, Artificial Sequence
  TRAC targeting sequence
aacuccugggcucaagcgau

SEQ ID NO: 23091 - RNA, 20 nt, Artificial Sequence
  TRAC targeting sequence
ugggcucaagcgauccuccc

SEQ ID NO: 23092 - RNA, 20 nt, Artificial Sequence
  TRAC targeting sequence
agcgauccucccaccuuggc

SEQ ID NO: 23093 - RNA, 20 nt, Artificial Sequence
  TRAC targeting sequence
cuugagcccaggaguuugag

SEQ ID NO: 23094 - RNA, 20 nt, Artificial Sequence
  TRAC targeting sequence
ucccaccuuggccuccccaa

SEQ ID NO: 23095 - RNA, 20 nt, Artificial Sequence
  TRAC targeting sequence
caccuuggccuccccaagug

SEQ ID NO: 23096 - RNA, 20 nt, Artificial Sequence
  TRAC targeting sequence
ccaagugcugggauuacagg

SEQ ID NO: 23097 - RNA, 20 nt, Artificial Sequence
  TRAC targeting sequence
cagcacuuggggaggccaag

SEQ ID NO: 23098 - RNA, 20 nt, Artificial Sequence
  TRAC targeting sequence
ucugacuucuugucucaugc

SEQ ID NO: 23099 - RNA, 20 nt, Artificial Sequence
  TRAC targeting sequence
gacuucuugucucaugcucu

SEQ ID NO: 23100 - RNA, 20 nt, Artificial Sequence
  TRAC targeting sequence
gaggaggggcuggugcggug

SEQ ID NO: 23101 - RNA, 20 nt, Artificial Sequence
  TRAC targeting sequence
ugucucaugcucuuccccac

SEQ ID NO: 23102 - RNA, 20 nt, Artificial Sequence
  TRAC targeting sequence
caugcucuuccccaccccac

SEQ ID NO: 23103 - RNA, 20 nt, Artificial Sequence
  TRAC targeting sequence
ugcucuuccccaccccacag

SEQ ID NO: 23104 - RNA, 20 nt, Artificial Sequence
  TRAC targeting sequence
uccccaccccacagccucuc

SEQ ID NO: 23105 - RNA, 20 nt, Artificial Sequence
  TRAC targeting sequence
ccaccccacagccucuccua

SEQ ID NO: 23106 - RNA, 20 nt, Artificial Sequence
  TRAC targeting sequence
ccuaugaaucuuugccuugg

SEQ ID NO: 23107 - RNA, 20 nt, Artificial Sequence
  TRAC targeting sequence
uaugaaucuuugccuuggcu

SEQ ID NO: 23108 - RNA, 20 nt, Artificial Sequence
  TRAC targeting sequence
uaggagaggcuguggggugg

SEQ ID NO: 23109 - RNA, 20 nt, Artificial Sequence
  TRAC targeting sequence
uugccuuggcuuuuuuucuu

SEQ ID NO: 23110 - RNA, 20 nt, Artificial Sequence
  TRAC targeting sequence
uucguaccacuuuccauguu

SEQ ID NO: 23111 - RNA, 20 nt, Artificial Sequence
  TRAC targeting sequence
uaccacuuuccauguuuuag

SEQ ID NO: 23112 - RNA, 20 nt, Artificial Sequence
  TRAC targeting sequence
auguuuuagcauccaaguaa

SEQ ID NO: 23113 - RNA, 20 nt, Artificial Sequence
  TRAC targeting sequence
aaguaacuuaauaacauaac

SEQ ID NO: 23114 - RNA, 20 nt, Artificial Sequence
  TRAC targeting sequence
ugcaguuaaaaaguguuuau

SEQ ID NO: 23115 - RNA, 20 nt, Artificial Sequence
  TRAC targeting sequence
ugccuguaauuccagcacuu

SEQ ID NO: 23116 - RNA, 20 nt, Artificial Sequence
  TRAC targeting sequence
agcacuuugggaggcuaagg

SEQ ID NO: 23117 - RNA, 20 nt, Artificial Sequence
  TRAC targeting sequence
caaagugcuggaauuacagg

SEQ ID NO: 23118 - RNA, 20 nt, Artificial Sequence
  TRAC targeting sequence
gccuaccuuagccucccaaa

SEQ ID NO: 23119 - RNA, 20 nt, Artificial Sequence
  TRAC targeting sequence
caaagucaaaagauagagac

SEQ ID NO: 23120 - RNA, 20 nt, Artificial Sequence
  TRAC targeting sequence
aaagauagagaccauacugg

SEQ ID NO: 23121 - RNA, 20 nt, Artificial Sequence
  TRAC targeting sequence
uuugacuuugugaucugccu

SEQ ID NO: 23122 - RNA, 20 nt, Artificial Sequence
  TRAC targeting sequence
aucuuuugacuuugugaucu

SEQ ID NO: 23123 - RNA, 20 nt, Artificial Sequence
  TRAC targeting sequence
cuaucuuuugacuuugugau

SEQ ID NO: 23124 - RNA, 20 nt, Artificial Sequence
  TRAC targeting sequence
ccauguuggccaguaugguc

SEQ ID NO: 23125 - RNA, 20 nt, Artificial Sequence
  TRAC targeting sequence
cuccuaaaaauacaaaaauu

SEQ ID NO: 23126 - RNA, 20 nt, Artificial Sequence
  TRAC targeting sequence
ccuaaaaauacaaaaauuag

SEQ ID NO: 23127 - RNA, 20 nt, Artificial Sequence
  TRAC targeting sequence
uaaaaauacaaaaauuagcc

SEQ ID NO: 23128 - RNA, 20 nt, Artificial Sequence
  TRAC targeting sequence
cacgccuggcuaauuuuugu

SEQ ID NO: 23129 - RNA, 20 nt, Artificial Sequence
  TRAC targeting sequence
cagcuacucaagaggcugag

SEQ ID NO: 23130 - RNA, 20 nt, Artificial Sequence
  TRAC targeting sequence
agaggcugaggcaggagaac

SEQ ID NO: 23131 - RNA, 20 nt, Artificial Sequence
  TRAC targeting sequence
ugaguagcugggacuacaag

SEQ ID NO: 23132 - RNA, 20 nt, Artificial Sequence
  TRAC targeting sequence
gccucuugaguagcugggac

SEQ ID NO: 23133 - RNA, 20 nt, Artificial Sequence
  TRAC targeting sequence
ugccucagccucuugaguag

SEQ ID NO: 23134 - RNA, 20 nt, Artificial Sequence
  TRAC targeting sequence
ccugccucagccucuugagu

SEQ ID NO: 23135 - RNA, 20 nt, Artificial Sequence
  TRAC targeting sequence
uggguuuaagcaguucuccu

SEQ ID NO: 23136 - RNA, 20 nt, Artificial Sequence
  TRAC targeting sequence
gccuccuggguuuaagcagu

SEQ ID NO: 23137 - RNA, 20 nt, Artificial Sequence
  TRAC targeting sequence
cuauaaccuccgccuccugg

SEQ ID NO: 23138 - RNA, 20 nt, Artificial Sequence
  TRAC targeting sequence
uggcucacuauaaccuccgc

SEQ ID NO: 23139 - RNA, 20 nt, Artificial Sequence
  TRAC targeting sequence
ugccacugcacuacagccug

SEQ ID NO: 23140 - RNA, 20 nt, Artificial Sequence
  TRAC targeting sequence
aggcuguagugcaguggcau

SEQ ID NO: 23141 - RNA, 20 nt, Artificial Sequence
  TRAC targeting sequence
cuuuguuguccaggcuguag

SEQ ID NO: 23142 - RNA, 20 nt, Artificial Sequence
  TRAC targeting sequence
cgcuuuguuguccaggcugu

SEQ ID NO: 23143 - RNA, 20 nt, Artificial Sequence
  TRAC targeting sequence
gucucaaaaaaaaaaaaaaa

SEQ ID NO: 23144 - RNA, 20 nt, Artificial Sequence
  TRAC targeting sequence
caaaaaaaaaaaaaaagguu

SEQ ID NO: 23145 - RNA, 20 nt, Artificial Sequence
  TRAC targeting sequence
aaaaaaaaaaaaaagguuua

SEQ ID NO: 23146 - RNA, 20 nt, Artificial Sequence
  TRAC targeting sequence
uucauacacucauucaacaa

SEQ ID NO: 23147 - RNA, 20 nt, Artificial Sequence
  TRAC targeting sequence
uacacucauucaacaaacac

SEQ ID NO: 23148 - RNA, 20 nt, Artificial Sequence
  TRAC targeting sequence
uucaacaaacacacacuguu

SEQ ID NO: 23149 - RNA, 20 nt, Artificial Sequence
  TRAC targeting sequence
acaaacacacacuguuacug

SEQ ID NO: 23150 - RNA, 20 nt, Artificial Sequence
  TRAC targeting sequence
caauugaguccagugggaga

SEQ ID NO: 23151 - RNA, 20 nt, Artificial Sequence
  TRAC targeting sequence
auugugaacaguaacagugu

SEQ ID NO: 23152 - RNA, 20 nt, Artificial Sequence
  TRAC targeting sequence
agugggagagagaagaaagu

SEQ ID NO: 23153 - RNA, 20 nt, Artificial Sequence
  TRAC targeting sequence
cacuggacucaauugugaac

SEQ ID NO: 23154 - RNA, 20 nt, Artificial Sequence
  TRAC targeting sequence
cccacuggacucaauuguga

SEQ ID NO: 23155 - RNA, 20 nt, Artificial Sequence
  TRAC targeting sequence
cucccacuggacucaauugu

SEQ ID NO: 23156 - RNA, 20 nt, Artificial Sequence
  TRAC targeting sequence
cucucccacuggacucaauu

SEQ ID NO: 23157 - RNA, 20 nt, Artificial Sequence
  TRAC targeting sequence
ucucucucccacuggacuca

SEQ ID NO: 23158 - RNA, 20 nt, Artificial Sequence
  TRAC targeting sequence
cuuucuucucucucccacug

SEQ ID NO: 23159 - RNA, 20 nt, Artificial Sequence
  TRAC targeting sequence
uucacuuucuucucucuccc

SEQ ID NO: 23160 - RNA, 20 nt, Artificial Sequence
  TRAC targeting sequence
uaacaaugugauaagugcag

SEQ ID NO: 23161 - RNA, 20 nt, Artificial Sequence
  TRAC targeting sequence
cauuguuaugaaacuauuca

SEQ ID NO: 23162 - RNA, 20 nt, Artificial Sequence
  TRAC targeting sequence
agugcugcacuuaucacauu

SEQ ID NO: 23163 - RNA, 20 nt, Artificial Sequence
  TRAC targeting sequence
uccagugcugcacuuaucac

SEQ ID NO: 23164 - RNA, 20 nt, Artificial Sequence
  TRAC targeting sequence
acugcauuccuccagugcug

SEQ ID NO: 23165 - RNA, 20 nt, Artificial Sequence
  TRAC targeting sequence
uaugcaaccugagggguggg

SEQ ID NO: 23166 - RNA, 20 nt, Artificial Sequence
  TRAC targeting sequence
gguugcauaggagcccuuag

SEQ ID NO: 23167 - RNA, 20 nt, Artificial Sequence
  TRAC targeting sequence
caccccucagguugcauagg

SEQ ID NO: 23168 - RNA, 20 nt, Artificial Sequence
  TRAC targeting sequence
uucccaccccucagguugca

SEQ ID NO: 23169 - RNA, 20 nt, Artificial Sequence
  TRAC targeting sequence
aagucauucccaccccucag

SEQ ID NO: 23170 - RNA, 20 nt, Artificial Sequence
  TRAC targeting sequence
uauuccaagucauucccacc

SEQ ID NO: 23171 - RNA, 20 nt, Artificial Sequence
  TRAC targeting sequence
uccaagcugggaggauggag

SEQ ID NO: 23172 - RNA, 20 nt, Artificial Sequence
  TRAC targeting sequence
aagcugggaggauggagaaa

SEQ ID NO: 23173 - RNA, 20 nt, Artificial Sequence
  TRAC targeting sequence
cagcuuggaugacuccuauu

SEQ ID NO: 23174 - RNA, 20 nt, Artificial Sequence
  TRAC targeting sequence
ucccagcuuggaugacuccu

SEQ ID NO: 23175 - RNA, 20 nt, Artificial Sequence
  TRAC targeting sequence
auccucccagcuuggaugac

SEQ ID NO: 23176 - RNA, 20 nt, Artificial Sequence
  TRAC targeting sequence
ccauccucccagcuuggaug

SEQ ID NO: 23177 - RNA, 20 nt, Artificial Sequence
  TRAC targeting sequence
uugcugcccuaacuuacugc

SEQ ID NO: 23178 - RNA, 20 nt, Artificial Sequence
  TRAC targeting sequence
uaaauauaaaucuauuucga

SEQ ID NO: 23179 - RNA, 20 nt, Artificial Sequence
  TRAC targeting sequence
auuucgauauucuuuuuucu

SEQ ID NO: 23180 - RNA, 20 nt, Artificial Sequence
  TRAC targeting sequence
auauucuuuuuucuuuggua

SEQ ID NO: 23181 - RNA, 20 nt, Artificial Sequence
  TRAC targeting sequence
aaauagauuuauauuuauga

SEQ ID NO: 23182 - RNA, 20 nt, Artificial Sequence
  TRAC targeting sequence
uuuuucuuugguagccuuaa

SEQ ID NO: 23183 - RNA, 20 nt, Artificial Sequence
  TRAC targeting sequence
uugguagccuuaaauacacc

SEQ ID NO: 23184 - RNA, 20 nt, Artificial Sequence
  TRAC targeting sequence
auuuuauauuugguguauuu

SEQ ID NO: 23185 - RNA, 20 nt, Artificial Sequence
  TRAC targeting sequence
auaaacaaguaaagucauca

SEQ ID NO: 23186 - RNA, 20 nt, Artificial Sequence
  TRAC targeting sequence
ucaauuagcacuuuuuagca

SEQ ID NO: 23187 - RNA, 20 nt, Artificial Sequence
  TRAC targeting sequence
auuagcacuuuuuagcaaau

SEQ ID NO: 23188 - RNA, 20 nt, Artificial Sequence
  TRAC targeting sequence
acuuauuuuauuugcuaaaa

SEQ ID NO: 23189 - RNA, 20 nt, Artificial Sequence
  TRAC targeting sequence
aaguuuuaagaaugaaaggu

SEQ ID NO: 23190 - RNA, 20 nt, Artificial Sequence
  TRAC targeting sequence
uaaaacuuugaaucuacuua

SEQ ID NO: 23191 - RNA, 20 nt, Artificial Sequence
  TRAC targeting sequence
uucuuaaaacuuugaaucua

SEQ ID NO: 23192 - RNA, 20 nt, Artificial Sequence
  TRAC targeting sequence
uuaccuuucauucuuaaaac

SEQ ID NO: 23193 - RNA, 20 nt, Artificial Sequence
  TRAC targeting sequence
cagagccaggcacugugaca

SEQ ID NO: 23194 - RNA, 20 nt, Artificial Sequence
  TRAC targeting sequence
gagccaggcacugugacaca

SEQ ID NO: 23195 - RNA, 20 nt, Artificial Sequence
  TRAC targeting sequence
gagauuaguucuuuaccuuu

SEQ ID NO: 23196 - RNA, 20 nt, Artificial Sequence
  TRAC targeting sequence
cagugccuggcucugagauu

SEQ ID NO: 23197 - RNA, 20 nt, Artificial Sequence
  TRAC targeting sequence
agcuacacagaagccucagg

SEQ ID NO: 23198 - RNA, 20 nt, Artificial Sequence
  TRAC targeting sequence
guguagcuggaccuacaggu

SEQ ID NO: 23199 - RNA, 20 nt, Artificial Sequence
  TRAC targeting sequence
ggcaggaggaucacuugacc

SEQ ID NO: 23200 - RNA, 20 nt, Artificial Sequence
  TRAC targeting sequence
ugccugaggcuucuguguag

SEQ ID NO: 23201 - RNA, 20 nt, Artificial Sequence
  TRAC targeting sequence
uccugccugaggcuucugug

SEQ ID NO: 23202 - RNA, 20 nt, Artificial Sequence
  TRAC targeting sequence
cuugaccccagggaguuccc

SEQ ID NO: 23203 - RNA, 20 nt, Artificial Sequence
  TRAC targeting sequence
agugauccuccugccugagg

SEQ ID NO: 23204 - RNA, 20 nt, Artificial Sequence
  TRAC targeting sequence
cuggggucaagugauccucc

SEQ ID NO: 23205 - RNA, 20 nt, Artificial Sequence
  TRAC targeting sequence
cagcuugggcaacguagcga

SEQ ID NO: 23206 - RNA, 20 nt, Artificial Sequence
  TRAC targeting sequence
cuacguugcccaagcuggga

SEQ ID NO: 23207 - RNA, 20 nt, Artificial Sequence
  TRAC targeting sequence
cgcuacguugcccaagcugg

SEQ ID NO: 23208 - RNA, 20 nt, Artificial Sequence
  TRAC targeting sequence
caccuucuaaacagagaaaa

SEQ ID NO: 23209 - RNA, 20 nt, Artificial Sequence
  TRAC targeting sequence
ccuucuaaacagagaaaaau

SEQ ID NO: 23210 - RNA, 20 nt, Artificial Sequence
  TRAC targeting sequence
aaacagagaaaaaugaguug

SEQ ID NO: 23211 - RNA, 20 nt, Artificial Sequence
  TRAC targeting sequence
guuuagaaggugagauuaau

SEQ ID NO: 23212 - RNA, 20 nt, Artificial Sequence
  TRAC targeting sequence
cuguuuagaaggugagauua

SEQ ID NO: 23213 - RNA, 20 nt, Artificial Sequence
  TRAC targeting sequence
uuuuucucuguuuagaaggu

SEQ ID NO: 23214 - RNA, 20 nt, Artificial Sequence
  TRAC targeting sequence
acucauuuuucucuguuuag

SEQ ID NO: 23215 - RNA, 20 nt, Artificial Sequence
  TRAC targeting sequence
uaacuuuuuucaacucauuu

SEQ ID NO: 23216 - RNA, 20 nt, Artificial Sequence
  TRAC targeting sequence
caucauaacuuuuuucaacu

SEQ ID NO: 23217 - RNA, 20 nt, Artificial Sequence
  TRAC targeting sequence
gauuuccuacaaauguagga

SEQ ID NO: 23218 - RNA, 20 nt, Artificial Sequence
  TRAC targeting sequence
gagguagucacaucauaacu

SEQ ID NO: 23219 - RNA, 20 nt, Artificial Sequence
  TRAC targeting sequence
uacaaauguaggacaguucc

SEQ ID NO: 23220 - RNA, 20 nt, Artificial Sequence
  TRAC targeting sequence
uacauuuguaggaaaucuga

SEQ ID NO: 23221 - RNA, 20 nt, Artificial Sequence
  TRAC targeting sequence
cucugagagagcuuauuugg

SEQ ID NO: 23222 - RNA, 20 nt, Artificial Sequence
  TRAC targeting sequence
gagagagcuuauuuggcggc

SEQ ID NO: 23223 - RNA, 20 nt, Artificial Sequence
  TRAC targeting sequence
gagggaacuguccuacauuu

SEQ ID NO: 23224 - RNA, 20 nt, Artificial Sequence
  TRAC targeting sequence
cagagggaacuguccuacau

SEQ ID NO: 23225 - RNA, 20 nt, Artificial Sequence
  TRAC targeting sequence
cucagagggaacuguccuac

SEQ ID NO: 23226 - RNA, 20 nt, Artificial Sequence
  TRAC targeting sequence
ugccgccaaauaagcucucu

SEQ ID NO: 23227 - RNA, 20 nt, Artificial Sequence
  TRAC targeting sequence
auauaagguggaaauaucaa

SEQ ID NO: 23228 - RNA, 20 nt, Artificial Sequence
  TRAC targeting sequence
accuuauauugaauuagguc

SEQ ID NO: 23229 - RNA, 20 nt, Artificial Sequence
  TRAC targeting sequence
aagagaaaaugaaauaaaaa

SEQ ID NO: 23230 - RNA, 20 nt, Artificial Sequence
  TRAC targeting sequence
uugauauuuccaccuuauau

SEQ ID NO: 23231 - RNA, 20 nt, Artificial Sequence
  TRAC targeting sequence
cuuugauauuuccaccuuau

SEQ ID NO: 23232 - RNA, 20 nt, Artificial Sequence
  TRAC targeting sequence
uuuucucuuugauauuucca

SEQ ID NO: 23233 - RNA, 20 nt, Artificial Sequence
  TRAC targeting sequence
accaacaaaaaauuaaagau

SEQ ID NO: 23234 - RNA, 20 nt, Artificial Sequence
  TRAC targeting sequence
uuaauuuuuuguugguggag

SEQ ID NO: 23235 - RNA, 20 nt, Artificial Sequence
  TRAC targeting sequence
cacgcaauaaucuuuaauuu

SEQ ID NO: 23236 - RNA, 20 nt, Artificial Sequence
  TRAC targeting sequence
ccauugagaauaaaagacgu

SEQ ID NO: 23237 - RNA, 20 nt, Artificial Sequence
  TRAC targeting sequence
auggugaccucccacgcaau

SEQ ID NO: 23238 - RNA, 20 nt, Artificial Sequence
  TRAC targeting sequence
caauggugaccucccacgca

SEQ ID NO: 23239 - RNA, 20 nt, Artificial Sequence
  TRAC targeting sequence
uuuauucucaauggugaccu

SEQ ID NO: 23240 - RNA, 20 nt, Artificial Sequence
  TRAC targeting sequence
acgucuuuuauucucaaugg

SEQ ID NO: 23241 - RNA, 20 nt, Artificial Sequence
  TRAC targeting sequence
uuuuuugguuuguucuacgu

SEQ ID NO: 23242 - RNA, 20 nt, Artificial Sequence
  TRAC targeting sequence
caaacuaaggaggugaaaaa

SEQ ID NO: 23243 - RNA, 20 nt, Artificial Sequence
  TRAC targeting sequence
aacuaaggaggugaaaaaaa

SEQ ID NO: 23244 - RNA, 20 nt, Artificial Sequence
  TRAC targeting sequence
uuaguuugagagcuucuuuu

SEQ ID NO: 23245 - RNA, 20 nt, Artificial Sequence
  TRAC targeting sequence
ccuccuuaguuugagagcuu

SEQ ID NO: 23246 - RNA, 20 nt, Artificial Sequence
  TRAC targeting sequence
uuuuuucaccuccuuaguuu

SEQ ID NO: 23247 - RNA, 20 nt, Artificial Sequence
  TRAC targeting sequence
aacgggaaaccugcgggucu

SEQ ID NO: 23248 - RNA, 20 nt, Artificial Sequence
  TRAC targeting sequence
cguuugauuucuuuuuuuca

SEQ ID NO: 23249 - RNA, 20 nt, Artificial Sequence
  TRAC targeting sequence
augugcacagucuuggucuu

SEQ ID NO: 23250 - RNA, 20 nt, Artificial Sequence
  TRAC targeting sequence
uggucuucccccacacaaca

SEQ ID NO: 23251 - RNA, 20 nt, Artificial Sequence
  TRAC targeting sequence
ucccccacacaacaaaaucu

SEQ ID NO: 23252 - RNA, 20 nt, Artificial Sequence
  TRAC targeting sequence
cccacacaacaaaaucuagg

SEQ ID NO: 23253 - RNA, 20 nt, Artificial Sequence
  TRAC targeting sequence
agggccacuuuaggguucua

SEQ ID NO: 23254 - RNA, 20 nt, Artificial Sequence
  TRAC targeting sequence
augcccuuuuguuccuaacu

SEQ ID NO: 23255 - RNA, 20 nt, Artificial Sequence
  TRAC targeting sequence
uaacucgacauugcccacuu

SEQ ID NO: 23256 - RNA, 20 nt, Artificial Sequence
  TRAC targeting sequence
acauugcccacuucuggcca

SEQ ID NO: 23257 - RNA, 20 nt, Artificial Sequence
  TRAC targeting sequence
aguuaggaacaaaagggcau

SEQ ID NO: 23258 - RNA, 20 nt, Artificial Sequence
  TRAC targeting sequence
ggccagaauguaaagcaacc

SEQ ID NO: 23259 - RNA, 20 nt, Artificial Sequence
  TRAC targeting sequence
ggccagaagugggcaauguc

SEQ ID NO: 23260 - RNA, 20 nt, Artificial Sequence
  TRAC targeting sequence
aaacccuccuggaccucugc

SEQ ID NO: 23261 - RNA, 20 nt, Artificial Sequence
  TRAC targeting sequence
uggaccucugcugcccccca

SEQ ID NO: 23262 - RNA, 20 nt, Artificial Sequence
  TRAC targeting sequence
aggaggguuuagaugcuggg

SEQ ID NO: 23263 - RNA, 20 nt, Artificial Sequence
  TRAC targeting sequence
gcugccccccaaugacugga

SEQ ID NO: 23264 - RNA, 20 nt, Artificial Sequence
  TRAC targeting sequence
uuggggggcagcagaggucc

SEQ ID NO: 23265 - RNA, 20 nt, Artificial Sequence
  TRAC targeting sequence
agucauuggggggcagcaga

SEQ ID NO: 23266 - RNA, 20 nt, Artificial Sequence
  TRAC targeting sequence
uuccagucauuggggggcag

SEQ ID NO: 23267 - RNA, 20 nt, Artificial Sequence
  TRAC targeting sequence
guagcuucuucccccaaacu

SEQ ID NO: 23268 - RNA, 20 nt, Artificial Sequence
  TRAC targeting sequence
ucccccaaacucaacuccuc

SEQ ID NO: 23269 - RNA, 20 nt, Artificial Sequence
  TRAC targeting sequence
cccaaacucaacuccucaug

SEQ ID NO: 23270 - RNA, 20 nt, Artificial Sequence
  TRAC targeting sequence
acuccucauguuuuguagua

SEQ ID NO: 23271 - RNA, 20 nt, Artificial Sequence
  TRAC targeting sequence
ucauguuuuguaguagccgc

SEQ ID NO: 23272 - RNA, 20 nt, Artificial Sequence
  TRAC targeting sequence
uguuuuguaguagccgcuca

SEQ ID NO: 23273 - RNA, 20 nt, Artificial Sequence
  TRAC targeting sequence
acacaugaaacauaccaucc

SEQ ID NO: 23274 - RNA, 20 nt, Artificial Sequence
  TRAC targeting sequence
uguguugagcggcuacuaca

SEQ ID NO: 23275 - RNA, 20 nt, Artificial Sequence
  TRAC targeting sequence
acuagguggcagcaaagccc

SEQ ID NO: 23276 - RNA, 20 nt, Artificial Sequence
  TRAC targeting sequence
gugggcuuugcugccaccua

SEQ ID NO: 23277 - RNA, 20 nt, Artificial Sequence
  TRAC targeting sequence
aguuccccuucccgagguaa

SEQ ID NO: 23278 - RNA, 20 nt, Artificial Sequence
  TRAC targeting sequence
ccuucccgagguaauuuucu

SEQ ID NO: 23279 - RNA, 20 nt, Artificial Sequence
  TRAC targeting sequence
cgagguaauuuucuagauua

SEQ ID NO: 23280 - RNA, 20 nt, Artificial Sequence
  TRAC targeting sequence
ggaaggggaacuugauguua

SEQ ID NO: 23281 - RNA, 20 nt, Artificial Sequence
  TRAC targeting sequence
agauuacuauacuuuaacug

SEQ ID NO: 23282 - RNA, 20 nt, Artificial Sequence
  TRAC targeting sequence
agaaaauuaccucgggaagg

SEQ ID NO: 23283 - RNA, 20 nt, Artificial Sequence
  TRAC targeting sequence
guuaaaguauaguaaucuag

SEQ ID NO: 23284 - RNA, 20 nt, Artificial Sequence
  TRAC targeting sequence
aaaagccaacauaauuucau

SEQ ID NO: 23285 - RNA, 20 nt, Artificial Sequence
  TRAC targeting sequence
aauucaguuaaaguauagua

SEQ ID NO: 23286 - RNA, 20 nt, Artificial Sequence
  TRAC targeting sequence
uguuuguaaacagugcugcc

SEQ ID NO: 23287 - RNA, 20 nt, Artificial Sequence
  TRAC targeting sequence
gaguuuaaaauguucugccc

SEQ ID NO: 23288 - RNA, 20 nt, Artificial Sequence
  TRAC targeting sequence
gacuggcagcacuguuuaca

SEQ ID NO: 23289 - RNA, 20 nt, Artificial Sequence
  TRAC targeting sequence
gcccaacccuguagcccccu

SEQ ID NO: 23290 - RNA, 20 nt, Artificial Sequence
  TRAC targeting sequence
agcuaggaucaaacacugaa

SEQ ID NO: 23291 - RNA, 20 nt, Artificial Sequence
  TRAC targeting sequence
uagcuggaacaagggggcua

SEQ ID NO: 23292 - RNA, 20 nt, Artificial Sequence
  TRAC targeting sequence
aacacugaauuuuuuaagac

SEQ ID NO: 23293 - RNA, 20 nt, Artificial Sequence
  TRAC targeting sequence
guguuugauccuagcuggaa

SEQ ID NO: 23294 - RNA, 20 nt, Artificial Sequence
  TRAC targeting sequence
uaaaaaauucaguguuugau

SEQ ID NO: 23295 - RNA, 20 nt, Artificial Sequence
  TRAC targeting sequence
caagucuuaaaaaauucagu

SEQ ID NO: 23296 - RNA, 20 nt, Artificial Sequence
  TRAC targeting sequence
cacaagucuuaaaaaauuca

SEQ ID NO: 23297 - RNA, 20 nt, Artificial Sequence
  TRAC targeting sequence
cucacaagucuuaaaaaauu

SEQ ID NO: 23298 - RNA, 20 nt, Artificial Sequence
  TRAC targeting sequence
ccauuauaaaaacaaaacaa

SEQ ID NO: 23299 - RNA, 20 nt, Artificial Sequence
  TRAC targeting sequence
auuauaaaaacaaaacaaug

SEQ ID NO: 23300 - RNA, 20 nt, Artificial Sequence
  TRAC targeting sequence
cccugggagcugagcacauu

SEQ ID NO: 23301 - RNA, 20 nt, Artificial Sequence
  TRAC targeting sequence
cugggagcugagcacauuuu

SEQ ID NO: 23302 - RNA, 20 nt, Artificial Sequence
  TRAC targeting sequence
cagggagauaguugccaaau

SEQ ID NO: 23303 - RNA, 20 nt, Artificial Sequence
  TRAC targeting sequence
gcucccagggagauaguugc

SEQ ID NO: 23304 - RNA, 20 nt, Artificial Sequence
  TRAC targeting sequence
agcaagguuuugucccuuug

SEQ ID NO: 23305 - RNA, 20 nt, Artificial Sequence
  TRAC targeting sequence
cuuugggcccaguucacccu

SEQ ID NO: 23306 - RNA, 20 nt, Artificial Sequence
  TRAC targeting sequence
cccuuccuucugacccaggg

SEQ ID NO: 23307 - RNA, 20 nt, Artificial Sequence
  TRAC targeting sequence
uucugacccagggcccaauu

SEQ ID NO: 23308 - RNA, 20 nt, Artificial Sequence
  TRAC targeting sequence
gacccagggcccaauucauc

SEQ ID NO: 23309 - RNA, 20 nt, Artificial Sequence
  TRAC targeting sequence
gaaggaagggugaacugggc

SEQ ID NO: 23310 - RNA, 20 nt, Artificial Sequence
  TRAC targeting sequence
ucaggaacuuuaauucucaa

SEQ ID NO: 23311 - RNA, 20 nt, Artificial Sequence
  TRAC targeting sequence
ggaacuuuaauucucaaacu

SEQ ID NO: 23312 - RNA, 20 nt, Artificial Sequence
  TRAC targeting sequence
ugaugaauugggcccugggu

SEQ ID NO: 23313 - RNA, 20 nt, Artificial Sequence
  TRAC targeting sequence
caaacugugauccaauacag

SEQ ID NO: 23314 - RNA, 20 nt, Artificial Sequence
  TRAC targeting sequence
aacugugauccaauacaguu

SEQ ID NO: 23315 - RNA, 20 nt, Artificial Sequence
  TRAC targeting sequence
caguuugagaauuaaaguuc

SEQ ID NO: 23316 - RNA, 20 nt, Artificial Sequence
  TRAC targeting sequence
aauacaguucuguccuucuu

SEQ ID NO: 23317 - RNA, 20 nt, Artificial Sequence
  TRAC targeting sequence
guccuucuuuuccucauuac

SEQ ID NO: 23318 - RNA, 20 nt, Artificial Sequence
  TRAC targeting sequence
uucuuuuccucauuacccuu

SEQ ID NO: 23319 - RNA, 20 nt, Artificial Sequence
  TRAC targeting sequence
uuuccucauuacccuucaga

SEQ ID NO: 23320 - RNA, 20 nt, Artificial Sequence
  TRAC targeting sequence
ucauuacccuucagaacacc

SEQ ID NO: 23321 - RNA, 20 nt, Artificial Sequence
  TRAC targeting sequence
uuacccuucagaacaccuga

SEQ ID NO: 23322 - RNA, 20 nt, Artificial Sequence
  TRAC targeting sequence
gaacaccugagauggacuga

SEQ ID NO: 23323 - RNA, 20 nt, Artificial Sequence
  TRAC targeting sequence
gaaggguaaugaggaaaaga

SEQ ID NO: 23324 - RNA, 20 nt, Artificial Sequence
  TRAC targeting sequence
gguguucugaaggguaauga

SEQ ID NO: 23325 - RNA, 20 nt, Artificial Sequence
  TRAC targeting sequence
cagguguucugaaggguaau

SEQ ID NO: 23326 - RNA, 20 nt, Artificial Sequence
  TRAC targeting sequence
aucucagguguucugaaggg

SEQ ID NO: 23327 - RNA, 20 nt, Artificial Sequence
  TRAC targeting sequence
guccaucucagguguucuga

SEQ ID NO: 23328 - RNA, 20 nt, Artificial Sequence
  TRAC targeting sequence
caguccaucucagguguucu

SEQ ID NO: 23329 - RNA, 20 nt, Artificial Sequence
  TRAC targeting sequence
uuuuuaaaaaaaaaaaaaaa

SEQ ID NO: 23330 - RNA, 20 nt, Artificial Sequence
  TRAC targeting sequence
caggccaggugcaguggcuc

SEQ ID NO: 23331 - RNA, 20 nt, Artificial Sequence
  TRAC targeting sequence
cgccuguaaucccagcacuu

SEQ ID NO: 23332 - RNA, 20 nt, Artificial Sequence
  TRAC targeting sequence
cagcacuuugggaggccaag

SEQ ID NO: 23333 - RNA, 20 nt, Artificial Sequence
  TRAC targeting sequence
caaagugcugggauuacagg

SEQ ID NO: 23334 - RNA, 20 nt, Artificial Sequence
  TRAC targeting sequence
ccuuggccucccaaagugcu

SEQ ID NO: 23335 - RNA, 20 nt, Artificial Sequence
  TRAC targeting sequence
acucgccuuggccucccaaa

SEQ ID NO: 23336 - RNA, 20 nt, Artificial Sequence
  TRAC targeting sequence
cgaggacaggaguucaacac

SEQ ID NO: 23337 - RNA, 20 nt, Artificial Sequence
  TRAC targeting sequence
ugauccacucgccuuggccu

SEQ ID NO: 23338 - RNA, 20 nt, Artificial Sequence
  TRAC targeting sequence
ucgugauccacucgccuugg

SEQ ID NO: 23339 - RNA, 20 nt, Artificial Sequence
  TRAC targeting sequence
uguccucgugauccacucgc

SEQ ID NO: 23340 - RNA, 20 nt, Artificial Sequence
  TRAC targeting sequence
acaccagccuagccaacaga

SEQ ID NO: 23341 - RNA, 20 nt, Artificial Sequence
  TRAC targeting sequence
guuggcuaggcugguguuga

SEQ ID NO: 23342 - RNA, 20 nt, Artificial Sequence
  TRAC targeting sequence
cucuguuggcuaggcuggug

SEQ ID NO: 23343 - RNA, 20 nt, Artificial Sequence
  TRAC targeting sequence
cuacuaaaaauacaaaaacu

SEQ ID NO: 23344 - RNA, 20 nt, Artificial Sequence
  TRAC targeting sequence
acuaaaaauacaaaaacuag

SEQ ID NO: 23345 - RNA, 20 nt, Artificial Sequence
  TRAC targeting sequence
cagcuacucggggaggcugc

SEQ ID NO: 23346 - RNA, 20 nt, Artificial Sequence
  TRAC targeting sequence
gggaggcugcggcaggagaa

SEQ ID NO: 23347 - RNA, 20 nt, Artificial Sequence
  TRAC targeting sequence
ccgaguagcugggacuacag

SEQ ID NO: 23348 - RNA, 20 nt, Artificial Sequence
  TRAC targeting sequence
ugccgcagccuccccgagua

SEQ ID NO: 23349 - RNA, 20 nt, Artificial Sequence
  TRAC targeting sequence
ccugccgcagccuccccgag

SEQ ID NO: 23350 - RNA, 20 nt, Artificial Sequence
  TRAC targeting sequence
agcaauucuccugccgcagc

SEQ ID NO: 23351 - RNA, 20 nt, Artificial Sequence
  TRAC targeting sequence
cggguucaagcaauucuccu

SEQ ID NO: 23352 - RNA, 20 nt, Artificial Sequence
  TRAC targeting sequence
cugcaacccugccucccggg

SEQ ID NO: 23353 - RNA, 20 nt, Artificial Sequence
  TRAC targeting sequence
uggcucacugcaacccugcc

SEQ ID NO: 23354 - RNA, 20 nt, Artificial Sequence
  TRAC targeting sequence
agccugggcaagacaguaag

SEQ ID NO: 23355 - RNA, 20 nt, Artificial Sequence
  TRAC targeting sequence
ugcccaggcuagagugcagu

SEQ ID NO: 23356 - RNA, 20 nt, Artificial Sequence
  TRAC targeting sequence
uacugucuugcccaggcuag

SEQ ID NO: 23357 - RNA, 20 nt, Artificial Sequence
  TRAC targeting sequence
gucucaaaaaaaaaaaaaaa

SEQ ID NO: 23358 - RNA, 20 nt, Artificial Sequence
  TRAC targeting sequence
caaaaaaaaaaaaaaaagaa

SEQ ID NO: 23359 - RNA, 20 nt, Artificial Sequence
  TRAC targeting sequence
aaaaaaaaaaaaaaagaauu

SEQ ID NO: 23360 - RNA, 20 nt, Artificial Sequence
  TRAC targeting sequence
uuuuuuuuuuuuuuugagac

SEQ ID NO: 23361 - RNA, 20 nt, Artificial Sequence
  TRAC targeting sequence
caaagaaacacagaagaaca

SEQ ID NO: 23362 - RNA, 20 nt, Artificial Sequence
  TRAC targeting sequence
uugugaaauucuuuuuuuuu

SEQ ID NO: 23363 - RNA, 20 nt, Artificial Sequence
  TRAC targeting sequence
guguuucuuugugaaauucu

SEQ ID NO: 23364 - RNA, 20 nt, Artificial Sequence
  TRAC targeting sequence
ucuguguuucuuugugaaau

SEQ ID NO: 23365 - RNA, 20 nt, Artificial Sequence
  TRAC targeting sequence
auguuuguucuucuguguuu

SEQ ID NO: 23366 - RNA, 20 nt, Artificial Sequence
  TRAC targeting sequence
guauuuaaaaauguauauac

SEQ ID NO: 23367 - RNA, 20 nt, Artificial Sequence
  TRAC targeting sequence
acugagcuucuuucugucau

SEQ ID NO: 23368 - RNA, 20 nt, Artificial Sequence
  TRAC targeting sequence
guggauuucaguauuuaaaa

SEQ ID NO: 23369 - RNA, 20 nt, Artificial Sequence
  TRAC targeting sequence
uucugucauggauucauuca

SEQ ID NO: 23370 - RNA, 20 nt, Artificial Sequence
  TRAC targeting sequence
gucauggauucauucaaaaa

SEQ ID NO: 23371 - RNA, 20 nt, Artificial Sequence
  TRAC targeting sequence
uggauucauucaaaaauaug

SEQ ID NO: 23372 - RNA, 20 nt, Artificial Sequence
  TRAC targeting sequence
cauuauccauuuauaggagg

SEQ ID NO: 23373 - RNA, 20 nt, Artificial Sequence
  TRAC targeting sequence
gaaaauaugaauaaaaagca

SEQ ID NO: 23374 - RNA, 20 nt, Artificial Sequence
  TRAC targeting sequence
gauucccauuauccauuuau

SEQ ID NO: 23375 - RNA, 20 nt, Artificial Sequence
  TRAC targeting sequence
uauuuucagauucccauuau

SEQ ID NO: 23376 - RNA, 20 nt, Artificial Sequence
  TRAC targeting sequence
uugcuuuuuauucauauuuu

SEQ ID NO: 23377 - RNA, 20 nt, Artificial Sequence
  TRAC targeting sequence
uuaaucguugcuuuuuauuc

SEQ ID NO: 23378 - RNA, 20 nt, Artificial Sequence
  TRAC targeting sequence
ccuuaaucguugcuuuuuau

SEQ ID NO: 23379 - RNA, 20 nt, Artificial Sequence
  TRAC targeting sequence
guuuucuccuuaaucguugc

SEQ ID NO: 23380 - RNA, 20 nt, Artificial Sequence
  TRAC targeting sequence
uuugggcuuugcuuucuguu

SEQ ID NO: 23381 - RNA, 20 nt, Artificial Sequence
  TRAC targeting sequence
ucauuugggcuuugcuuucu

SEQ ID NO: 23382 - RNA, 20 nt, Artificial Sequence
  TRAC targeting sequence
acaaaaacaguacaauccuc

SEQ ID NO: 23383 - RNA, 20 nt, Artificial Sequence
  TRAC targeting sequence
uccucaaacacaaaagaacc

SEQ ID NO: 23384 - RNA, 20 nt, Artificial Sequence
  TRAC targeting sequence
ucaaacacaaaagaaccauc

SEQ ID NO: 23385 - RNA, 20 nt, Artificial Sequence
  TRAC targeting sequence
aacacaaaagaaccaucaag

SEQ ID NO: 23386 - RNA, 20 nt, Artificial Sequence
  TRAC targeting sequence
uuuguguuugaggaggauug

SEQ ID NO: 23387 - RNA, 20 nt, Artificial Sequence
  TRAC targeting sequence
agaaucaugcugagaggcau

SEQ ID NO: 23388 - RNA, 20 nt, Artificial Sequence
  TRAC targeting sequence
ugaugguucuuuuguguuug

SEQ ID NO: 23389 - RNA, 20 nt, Artificial Sequence
  TRAC targeting sequence
ugcugagaggcauuaacagu

SEQ ID NO: 23390 - RNA, 20 nt, Artificial Sequence
  TRAC targeting sequence
gcaugauucuugaugguucu

SEQ ID NO: 23391 - RNA, 20 nt, Artificial Sequence
  TRAC targeting sequence
cagcaugauucuugaugguu

SEQ ID NO: 23392 - RNA, 20 nt, Artificial Sequence
  TRAC targeting sequence
ugccacuguuaaugccucuc

SEQ ID NO: 23393 - RNA, 20 nt, Artificial Sequence
  TRAC targeting sequence
cuugccacuguuaaugccuc

SEQ ID NO: 23394 - RNA, 20 nt, Artificial Sequence
  TRAC targeting sequence
aagucucuugccacuguuaa

SEQ ID NO: 23395 - RNA, 20 nt, Artificial Sequence
  TRAC targeting sequence
ucaaagucucuugccacugu

SEQ ID NO: 23396 - RNA, 20 nt, Artificial Sequence
  TRAC targeting sequence
agaccaauccucucacaaca

SEQ ID NO: 23397 - RNA, 20 nt, Artificial Sequence
  TRAC targeting sequence
ggauguucaucaaagucucu

SEQ ID NO: 23398 - RNA, 20 nt, Artificial Sequence
  TRAC targeting sequence
ucucacaacacagacagaga

SEQ ID NO: 23399 - RNA, 20 nt, Artificial Sequence
  TRAC targeting sequence
cacaacacagacagagaaac

SEQ ID NO: 23400 - RNA, 20 nt, Artificial Sequence
  TRAC targeting sequence
caacacagacagagaaacug

SEQ ID NO: 23401 - RNA, 20 nt, Artificial Sequence
  TRAC targeting sequence
guguugugagaggauugguc

SEQ ID NO: 23402 - RNA, 20 nt, Artificial Sequence
  TRAC targeting sequence
gucuguguugugagaggauu

SEQ ID NO: 23403 - RNA, 20 nt, Artificial Sequence
  TRAC targeting sequence
cugucuguguugugagagga

SEQ ID NO: 23404 - RNA, 20 nt, Artificial Sequence
  TRAC targeting sequence
guuucucugucuguguugug

SEQ ID NO: 23405 - RNA, 20 nt, Artificial Sequence
  TRAC targeting sequence
gagguaaguuuauuugucca

SEQ ID NO: 23406 - RNA, 20 nt, Artificial Sequence
  TRAC targeting sequence
gagccucaguuucucugucu

SEQ ID NO: 23407 - RNA, 20 nt, Artificial Sequence
  TRAC targeting sequence
auucaacuaguuaacagagc

SEQ ID NO: 23408 - RNA, 20 nt, Artificial Sequence
  TRAC targeting sequence
acuaguuaacagagcaaagc

SEQ ID NO: 23409 - RNA, 20 nt, Artificial Sequence
  TRAC targeting sequence
guuaacuaguugaauggaca

SEQ ID NO: 23410 - RNA, 20 nt, Artificial Sequence
  TRAC targeting sequence
ucugauuuuuuuuuuuuuuu

SEQ ID NO: 23411 - RNA, 20 nt, Artificial Sequence
  TRAC targeting sequence
gauuuuuuuuuuuuuuuuuu

SEQ ID NO: 23412 - RNA, 20 nt, Artificial Sequence
  TRAC targeting sequence
gaagacuuguauuguaggcu

SEQ ID NO: 23413 - RNA, 20 nt, Artificial Sequence
  TRAC targeting sequence
aaaaaaaaaaaaaaaaaauc

SEQ ID NO: 23414 - RNA, 20 nt, Artificial Sequence
  TRAC targeting sequence
caaaaaaaaaaaaaaaaaaa

SEQ ID NO: 23415 - RNA, 20 nt, Artificial Sequence
  TRAC targeting sequence
cacucugucacucaggcugg

SEQ ID NO: 23416 - RNA, 20 nt, Artificial Sequence
  TRAC targeting sequence
cucugucacucaggcuggag

SEQ ID NO: 23417 - RNA, 20 nt, Artificial Sequence
  TRAC targeting sequence
gucacucaggcuggagugca

SEQ ID NO: 23418 - RNA, 20 nt, Artificial Sequence
  TRAC targeting sequence
cucaggcuggagugcaagug

SEQ ID NO: 23419 - RNA, 20 nt, Artificial Sequence
  TRAC targeting sequence
ggcuggagugcaaguggcau

SEQ ID NO: 23420 - RNA, 20 nt, Artificial Sequence
  TRAC targeting sequence
agccugagugacagagugag

SEQ ID NO: 23421 - RNA, 20 nt, Artificial Sequence
  TRAC targeting sequence
ugccacuugcacuccagccu

SEQ ID NO: 23422 - RNA, 20 nt, Artificial Sequence
  TRAC targeting sequence
caguucacugcagccgugac

SEQ ID NO: 23423 - RNA, 20 nt, Artificial Sequence
  TRAC targeting sequence
cugcagccgugaccucccac

SEQ ID NO: 23424 - RNA, 20 nt, Artificial Sequence
  TRAC targeting sequence
cggcugcagugaacugugau

SEQ ID NO: 23425 - RNA, 20 nt, Artificial Sequence
  TRAC targeting sequence
cacgcucaagcaauccuucc

SEQ ID NO: 23426 - RNA, 20 nt, Artificial Sequence
  TRAC targeting sequence
agcaauccuuccaccucagc

SEQ ID NO: 23427 - RNA, 20 nt, Artificial Sequence
  TRAC targeting sequence
uuccaccucagccuucugag

SEQ ID NO: 23428 - RNA, 20 nt, Artificial Sequence
  TRAC targeting sequence
accucagccuucugaguagc

SEQ ID NO: 23429 - RNA, 20 nt, Artificial Sequence
  TRAC targeting sequence
gccuucugaguagcugggac

SEQ ID NO: 23430 - RNA, 20 nt, Artificial Sequence
  TRAC targeting sequence
gaguagcugggaccacaggc

SEQ ID NO: 23431 - RNA, 20 nt, Artificial Sequence
  TRAC targeting sequence
gaaggcugagguggaaggau

SEQ ID NO: 23432 - RNA, 20 nt, Artificial Sequence
  TRAC targeting sequence
cagcuacucagaaggcugag

SEQ ID NO: 23433 - RNA, 20 nt, Artificial Sequence
  TRAC targeting sequence
aauucuuuugauuuuuggua

SEQ ID NO: 23434 - RNA, 20 nt, Artificial Sequence
  TRAC targeting sequence
uuugauuuuugguagagaca

SEQ ID NO: 23435 - RNA, 20 nt, Artificial Sequence
  TRAC targeting sequence
aaagaauuagaggggcgugg

SEQ ID NO: 23436 - RNA, 20 nt, Artificial Sequence
  TRAC targeting sequence
accaaaaaucaaaagaauua

SEQ ID NO: 23437 - RNA, 20 nt, Artificial Sequence
  TRAC targeting sequence
cuaccaaaaaucaaaagaau

SEQ ID NO: 23438 - RNA, 20 nt, Artificial Sequence
  TRAC targeting sequence
ugcuauaucacccaugcugg

SEQ ID NO: 23439 - RNA, 20 nt, Artificial Sequence
  TRAC targeting sequence
cccaugcuggucucaaacuc

SEQ ID NO: 23440 - RNA, 20 nt, Artificial Sequence
  TRAC targeting sequence
caaacuccugggcucaagcg

SEQ ID NO: 23441 - RNA, 20 nt, Artificial Sequence
  TRAC targeting sequence
aacuccugggcucaagcgau

SEQ ID NO: 23442 - RNA, 20 nt, Artificial Sequence
  TRAC targeting sequence
ugggcucaagcgauccuccc

SEQ ID NO: 23443 - RNA, 20 nt, Artificial Sequence
  TRAC targeting sequence
agcgauccucccaccuuggc

SEQ ID NO: 23444 - RNA, 20 nt, Artificial Sequence
  TRAC targeting sequence
cuugagcccaggaguuugag

SEQ ID NO: 23445 - RNA, 20 nt, Artificial Sequence
  TRAC targeting sequence
ucccaccuuggccuccccaa

SEQ ID NO: 23446 - RNA, 20 nt, Artificial Sequence
  TRAC targeting sequence
caccuuggccuccccaagug

SEQ ID NO: 23447 - RNA, 20 nt, Artificial Sequence
  TRAC targeting sequence
ccaagugcugggauuacagg

SEQ ID NO: 23448 - RNA, 20 nt, Artificial Sequence
  TRAC targeting sequence
cagcacuuggggaggccaag

SEQ ID NO: 23449 - RNA, 20 nt, Artificial Sequence
  TRAC targeting sequence
ucugacuucuugucucaugc

SEQ ID NO: 23450 - RNA, 20 nt, Artificial Sequence
  TRAC targeting sequence
gacuucuugucucaugcucu

SEQ ID NO: 23451 - RNA, 20 nt, Artificial Sequence
  TRAC targeting sequence
gaggaggggcuggugcggug

SEQ ID NO: 23452 - RNA, 20 nt, Artificial Sequence
  TRAC targeting sequence
ugucucaugcucuuccccac

SEQ ID NO: 23453 - RNA, 20 nt, Artificial Sequence
  TRAC targeting sequence
caugcucuuccccaccccac

SEQ ID NO: 23454 - RNA, 20 nt, Artificial Sequence
  TRAC targeting sequence
ugcucuuccccaccccacag

SEQ ID NO: 23455 - RNA, 20 nt, Artificial Sequence
  TRAC targeting sequence
uccccaccccacagccucuc

SEQ ID NO: 23456 - RNA, 20 nt, Artificial Sequence
  TRAC targeting sequence
ccaccccacagccucuccua

SEQ ID NO: 23457 - RNA, 20 nt, Artificial Sequence
  TRAC targeting sequence
ccuaugaaucuuugccuugg

SEQ ID NO: 23458 - RNA, 20 nt, Artificial Sequence
  TRAC targeting sequence
uaugaaucuuugccuuggcu

SEQ ID NO: 23459 - RNA, 20 nt, Artificial Sequence
  TRAC targeting sequence
uaggagaggcuguggggugg

SEQ ID NO: 23460 - RNA, 20 nt, Artificial Sequence
  TRAC targeting sequence
uugccuuggcuuuuuuucuu

SEQ ID NO: 23461 - RNA, 20 nt, Artificial Sequence
  TRAC targeting sequence
uucguaccacuuuccauguu

SEQ ID NO: 23462 - RNA, 20 nt, Artificial Sequence
  TRAC targeting sequence
uaccacuuuccauguuuuag

SEQ ID NO: 23463 - RNA, 20 nt, Artificial Sequence
  TRAC targeting sequence
auguuuuagcauccaaguaa

SEQ ID NO: 23464 - RNA, 20 nt, Artificial Sequence
  TRAC targeting sequence
aaguaacuuaauaacauaac

SEQ ID NO: 23465 - RNA, 20 nt, Artificial Sequence
  TRAC targeting sequence
ugcaguuaaaaaguguuuau

SEQ ID NO: 23466 - RNA, 20 nt, Artificial Sequence
  TRAC targeting sequence
ugccuguaauuccagcacuu

SEQ ID NO: 23467 - RNA, 20 nt, Artificial Sequence
  TRAC targeting sequence
agcacuuugggaggcuaagg

SEQ ID NO: 23468 - RNA, 20 nt, Artificial Sequence
  TRAC targeting sequence
caaagugcuggaauuacagg

SEQ ID NO: 23469 - RNA, 20 nt, Artificial Sequence
  TRAC targeting sequence
gccuaccuuagccucccaaa

SEQ ID NO: 23470 - RNA, 20 nt, Artificial Sequence
  TRAC targeting sequence
caaagucaaaagauagagac

SEQ ID NO: 23471 - RNA, 20 nt, Artificial Sequence
  TRAC targeting sequence
aaagauagagaccauacugg

SEQ ID NO: 23472 - RNA, 20 nt, Artificial Sequence
  TRAC targeting sequence
uuugacuuugugaucugccu

SEQ ID NO: 23473 - RNA, 20 nt, Artificial Sequence
  TRAC targeting sequence
aucuuuugacuuugugaucu

SEQ ID NO: 23474 - RNA, 20 nt, Artificial Sequence
  TRAC targeting sequence
cuaucuuuugacuuugugau

SEQ ID NO: 23475 - RNA, 20 nt, Artificial Sequence
  TRAC targeting sequence
ccauguuggccaguaugguc

SEQ ID NO: 23476 - RNA, 20 nt, Artificial Sequence
  TRAC targeting sequence
cuccuaaaaauacaaaaauu

SEQ ID NO: 23477 - RNA, 20 nt, Artificial Sequence
  TRAC targeting sequence
ccuaaaaauacaaaaauuag

SEQ ID NO: 23478 - RNA, 20 nt, Artificial Sequence
  TRAC targeting sequence
uaaaaauacaaaaauuagcc

SEQ ID NO: 23479 - RNA, 20 nt, Artificial Sequence
  TRAC targeting sequence
cacgccuggcuaauuuuugu

SEQ ID NO: 23480 - RNA, 20 nt, Artificial Sequence
  TRAC targeting sequence
cagcuacucaagaggcugag

SEQ ID NO: 23481 - RNA, 20 nt, Artificial Sequence
  TRAC targeting sequence
agaggcugaggcaggagaac

SEQ ID NO: 23482 - RNA, 20 nt, Artificial Sequence
  TRAC targeting sequence
ugaguagcugggacuacaag

SEQ ID NO: 23483 - RNA, 20 nt, Artificial Sequence
  TRAC targeting sequence
gccucuugaguagcugggac

SEQ ID NO: 23484 - RNA, 20 nt, Artificial Sequence
  TRAC targeting sequence
ugccucagccucuugaguag

SEQ ID NO: 23485 - RNA, 20 nt, Artificial Sequence
  TRAC targeting sequence
ccugccucagccucuugagu

SEQ ID NO: 23486 - RNA, 20 nt, Artificial Sequence
  TRAC targeting sequence
uggguuuaagcaguucuccu

SEQ ID NO: 23487 - RNA, 20 nt, Artificial Sequence
  TRAC targeting sequence
gccuccuggguuuaagcagu

SEQ ID NO: 23488 - RNA, 20 nt, Artificial Sequence
  TRAC targeting sequence
cuauaaccuccgccuccugg

SEQ ID NO: 23489 - RNA, 20 nt, Artificial Sequence
  TRAC targeting sequence
uggcucacuauaaccuccgc

SEQ ID NO: 23490 - RNA, 20 nt, Artificial Sequence
  TRAC targeting sequence
ugccacugcacuacagccug

SEQ ID NO: 23491 - RNA, 20 nt, Artificial Sequence
  TRAC targeting sequence
aggcuguagugcaguggcau

SEQ ID NO: 23492 - RNA, 20 nt, Artificial Sequence
  TRAC targeting sequence
cuuuguuguccaggcuguag

SEQ ID NO: 23493 - RNA, 20 nt, Artificial Sequence
  TRAC targeting sequence
cgcuuuguuguccaggcugu

SEQ ID NO: 23494 - RNA, 20 nt, Artificial Sequence
  TRAC targeting sequence
gucucaaaaaaaaaaaaaaa

SEQ ID NO: 23495 - RNA, 20 nt, Artificial Sequence
  TRAC targeting sequence
caaaaaaaaaaaaaaagguu

SEQ ID NO: 23496 - RNA, 20 nt, Artificial Sequence
  TRAC targeting sequence
aaaaaaaaaaaaaagguuua

SEQ ID NO: 23497 - RNA, 20 nt, Artificial Sequence
  TRAC targeting sequence
uucauacacucauucaacaa

SEQ ID NO: 23498 - RNA, 20 nt, Artificial Sequence
  TRAC targeting sequence
uacacucauucaacaaacac

SEQ ID NO: 23499 - RNA, 20 nt, Artificial Sequence
  TRAC targeting sequence
uucaacaaacacacacuguu

SEQ ID NO: 23500 - RNA, 20 nt, Artificial Sequence
  TRAC targeting sequence
acaaacacacacuguuacug

SEQ ID NO: 23501 - RNA, 20 nt, Artificial Sequence
  TRAC targeting sequence
caauugaguccagugggaga

SEQ ID NO: 23502 - RNA, 20 nt, Artificial Sequence
  TRAC targeting sequence
auugugaacaguaacagugu

SEQ ID NO: 23503 - RNA, 20 nt, Artificial Sequence
  TRAC targeting sequence
agugggagagagaagaaagu

SEQ ID NO: 23504 - RNA, 20 nt, Artificial Sequence
  TRAC targeting sequence
cacuggacucaauugugaac

SEQ ID NO: 23505 - RNA, 20 nt, Artificial Sequence
  TRAC targeting sequence
cccacuggacucaauuguga

SEQ ID NO: 23506 - RNA, 20 nt, Artificial Sequence
  TRAC targeting sequence
cucccacuggacucaauugu

SEQ ID NO: 23507 - RNA, 20 nt, Artificial Sequence
  TRAC targeting sequence
cucucccacuggacucaauu

SEQ ID NO: 23508 - RNA, 20 nt, Artificial Sequence
  TRAC targeting sequence
ucucucucccacuggacuca

SEQ ID NO: 23509 - RNA, 20 nt, Artificial Sequence
  TRAC targeting sequence
cuuucuucucucucccacug

SEQ ID NO: 23510 - RNA, 20 nt, Artificial Sequence
  TRAC targeting sequence
uucacuuucuucucucuccc

SEQ ID NO: 23511 - RNA, 20 nt, Artificial Sequence
  TRAC targeting sequence
uaacaaugugauaagugcag

SEQ ID NO: 23512 - RNA, 20 nt, Artificial Sequence
  TRAC targeting sequence
cauuguuaugaaacuauuca

SEQ ID NO: 23513 - RNA, 20 nt, Artificial Sequence
  TRAC targeting sequence
agugcugcacuuaucacauu

SEQ ID NO: 23514 - RNA, 20 nt, Artificial Sequence
  TRAC targeting sequence
uccagugcugcacuuaucac

SEQ ID NO: 23515 - RNA, 20 nt, Artificial Sequence
  TRAC targeting sequence
acugcauuccuccagugcug

SEQ ID NO: 23516 - RNA, 20 nt, Artificial Sequence
  TRAC targeting sequence
uaugcaaccugagggguggg

SEQ ID NO: 23517 - RNA, 20 nt, Artificial Sequence
  TRAC targeting sequence
gguugcauaggagcccuuag

SEQ ID NO: 23518 - RNA, 20 nt, Artificial Sequence
  TRAC targeting sequence
caccccucagguugcauagg

SEQ ID NO: 23519 - RNA, 20 nt, Artificial Sequence
  TRAC targeting sequence
uucccaccccucagguugca

SEQ ID NO: 23520 - RNA, 20 nt, Artificial Sequence
  TRAC targeting sequence
aagucauucccaccccucag

SEQ ID NO: 23521 - RNA, 20 nt, Artificial Sequence
  TRAC targeting sequence
uauuccaagucauucccacc

SEQ ID NO: 23522 - RNA, 20 nt, Artificial Sequence
  TRAC targeting sequence
uccaagcugggaggauggag

SEQ ID NO: 23523 - RNA, 20 nt, Artificial Sequence
  TRAC targeting sequence
aagcugggaggauggagaaa

SEQ ID NO: 23524 - RNA, 20 nt, Artificial Sequence
  TRAC targeting sequence
cagcuuggaugacuccuauu

SEQ ID NO: 23525 - RNA, 20 nt, Artificial Sequence
  TRAC targeting sequence
ucccagcuuggaugacuccu

SEQ ID NO: 23526 - RNA, 20 nt, Artificial Sequence
  TRAC targeting sequence
auccucccagcuuggaugac

SEQ ID NO: 23527 - RNA, 20 nt, Artificial Sequence
  TRAC targeting sequence
ccauccucccagcuuggaug

SEQ ID NO: 23528 - RNA, 20 nt, Artificial Sequence
  TRAC targeting sequence
uugcugcccuaacuuacugc

SEQ ID NO: 23529 - RNA, 20 nt, Artificial Sequence
  TRAC targeting sequence
uaaauauaaaucuauuucga

SEQ ID NO: 23530 - RNA, 20 nt, Artificial Sequence
  TRAC targeting sequence
auuucgauauucuuuuuucu

SEQ ID NO: 23531 - RNA, 20 nt, Artificial Sequence
  TRAC targeting sequence
auauucuuuuuucuuuggua

SEQ ID NO: 23532 - RNA, 20 nt, Artificial Sequence
  TRAC targeting sequence
aaauagauuuauauuuauga

SEQ ID NO: 23533 - RNA, 20 nt, Artificial Sequence
  TRAC targeting sequence
uuuuucuuugguagccuuaa

SEQ ID NO: 23534 - RNA, 20 nt, Artificial Sequence
  TRAC targeting sequence
uugguagccuuaaauacacc

SEQ ID NO: 23535 - RNA, 20 nt, Artificial Sequence
  TRAC targeting sequence
auuuuauauuugguguauuu

SEQ ID NO: 23536 - RNA, 20 nt, Artificial Sequence
  TRAC targeting sequence
auaaacaaguaaagucauca

SEQ ID NO: 23537 - RNA, 20 nt, Artificial Sequence
  TRAC targeting sequence
ucaauuagcacuuuuuagca

SEQ ID NO: 23538 - RNA, 20 nt, Artificial Sequence
  TRAC targeting sequence
auuagcacuuuuuagcaaau

SEQ ID NO: 23539 - RNA, 20 nt, Artificial Sequence
  TRAC targeting sequence
acuuauuuuauuugcuaaaa

SEQ ID NO: 23540 - RNA, 20 nt, Artificial Sequence
  TRAC targeting sequence
aaguuuuaagaaugaaaggu

SEQ ID NO: 23541 - RNA, 20 nt, Artificial Sequence
  TRAC targeting sequence
uaaaacuuugaaucuacuua

SEQ ID NO: 23542 - RNA, 20 nt, Artificial Sequence
  TRAC targeting sequence
uucuuaaaacuuugaaucua

SEQ ID NO: 23543 - RNA, 20 nt, Artificial Sequence
  TRAC targeting sequence
uuaccuuucauucuuaaaac

SEQ ID NO: 23544 - RNA, 20 nt, Artificial Sequence
  TRAC targeting sequence
cagagccaggcacugugaca

SEQ ID NO: 23545 - RNA, 20 nt, Artificial Sequence
  TRAC targeting sequence
gagccaggcacugugacaca

SEQ ID NO: 23546 - RNA, 20 nt, Artificial Sequence
  TRAC targeting sequence
gagauuaguucuuuaccuuu

SEQ ID NO: 23547 - RNA, 20 nt, Artificial Sequence
  TRAC targeting sequence
cagugccuggcucugagauu

SEQ ID NO: 23548 - RNA, 20 nt, Artificial Sequence
  TRAC targeting sequence
agcuacacagaagccucagg

SEQ ID NO: 23549 - RNA, 20 nt, Artificial Sequence
  TRAC targeting sequence
guguagcuggaccuacaggu

SEQ ID NO: 23550 - RNA, 20 nt, Artificial Sequence
  TRAC targeting sequence
ggcaggaggaucacuugacc

SEQ ID NO: 23551 - RNA, 20 nt, Artificial Sequence
  TRAC targeting sequence
ugccugaggcuucuguguag

SEQ ID NO: 23552 - RNA, 20 nt, Artificial Sequence
  TRAC targeting sequence
uccugccugaggcuucugug

SEQ ID NO: 23553 - RNA, 20 nt, Artificial Sequence
  TRAC targeting sequence
cuugaccccagggaguuccc

SEQ ID NO: 23554 - RNA, 20 nt, Artificial Sequence
  TRAC targeting sequence
agugauccuccugccugagg

SEQ ID NO: 23555 - RNA, 20 nt, Artificial Sequence
  TRAC targeting sequence
cuggggucaagugauccucc

SEQ ID NO: 23556 - RNA, 20 nt, Artificial Sequence
  TRAC targeting sequence
cagcuugggcaacguagcga

SEQ ID NO: 23557 - RNA, 20 nt, Artificial Sequence
  TRAC targeting sequence
cuacguugcccaagcuggga

SEQ ID NO: 23558 - RNA, 20 nt, Artificial Sequence
  TRAC targeting sequence
cgcuacguugcccaagcugg

SEQ ID NO: 23559 - RNA, 20 nt, Artificial Sequence
  TRAC targeting sequence
caccuucuaaacagagaaaa

SEQ ID NO: 23560 - RNA, 20 nt, Artificial Sequence
  TRAC targeting sequence
ccuucuaaacagagaaaaau

SEQ ID NO: 23561 - RNA, 20 nt, Artificial Sequence
  TRAC targeting sequence
aaacagagaaaaaugaguug

SEQ ID NO: 23562 - RNA, 20 nt, Artificial Sequence
  TRAC targeting sequence
guuuagaaggugagauuaau

SEQ ID NO: 23563 - RNA, 20 nt, Artificial Sequence
  TRAC targeting sequence
cuguuuagaaggugagauua

SEQ ID NO: 23564 - RNA, 20 nt, Artificial Sequence
  TRAC targeting sequence
uuuuucucuguuuagaaggu

SEQ ID NO: 23565 - RNA, 20 nt, Artificial Sequence
  TRAC targeting sequence
acucauuuuucucuguuuag

SEQ ID NO: 23566 - RNA, 20 nt, Artificial Sequence
  TRAC targeting sequence
uaacuuuuuucaacucauuu

SEQ ID NO: 23567 - RNA, 20 nt, Artificial Sequence
  TRAC targeting sequence
caucauaacuuuuuucaacu

SEQ ID NO: 23568 - RNA, 20 nt, Artificial Sequence
  TRAC targeting sequence
gauuuccuacaaauguagga

SEQ ID NO: 23569 - RNA, 20 nt, Artificial Sequence
  TRAC targeting sequence
gagguagucacaucauaacu

SEQ ID NO: 23570 - RNA, 20 nt, Artificial Sequence
  TRAC targeting sequence
uacaaauguaggacaguucc

SEQ ID NO: 23571 - RNA, 20 nt, Artificial Sequence
  TRAC targeting sequence
uacauuuguaggaaaucuga

SEQ ID NO: 23572 - RNA, 20 nt, Artificial Sequence
  TRAC targeting sequence
cucugagagagcuuauuugg

SEQ ID NO: 23573 - RNA, 20 nt, Artificial Sequence
  TRAC targeting sequence
gagagagcuuauuuggcggc

SEQ ID NO: 23574 - RNA, 20 nt, Artificial Sequence
  TRAC targeting sequence
gagggaacuguccuacauuu

SEQ ID NO: 23575 - RNA, 20 nt, Artificial Sequence
  TRAC targeting sequence
cagagggaacuguccuacau

SEQ ID NO: 23576 - RNA, 20 nt, Artificial Sequence
  TRAC targeting sequence
cucagagggaacuguccuac

SEQ ID NO: 23577 - RNA, 20 nt, Artificial Sequence
  TRAC targeting sequence
ugccgccaaauaagcucucu

SEQ ID NO: 23578 - RNA, 20 nt, Artificial Sequence
  TRAC targeting sequence
auauaagguggaaauaucaa

SEQ ID NO: 23579 - RNA, 20 nt, Artificial Sequence
  TRAC targeting sequence
accuuauauugaauuagguc

SEQ ID NO: 23580 - RNA, 20 nt, Artificial Sequence
  TRAC targeting sequence
aagagaaaaugaaauaaaaa

SEQ ID NO: 23581 - RNA, 20 nt, Artificial Sequence
  TRAC targeting sequence
uugauauuuccaccuuauau

SEQ ID NO: 23582 - RNA, 20 nt, Artificial Sequence
  TRAC targeting sequence
cuuugauauuuccaccuuau

SEQ ID NO: 23583 - RNA, 20 nt, Artificial Sequence
  TRAC targeting sequence
uuuucucuuugauauuucca

SEQ ID NO: 23584 - RNA, 20 nt, Artificial Sequence
  TRAC targeting sequence
accaacaaaaaauuaaagau

SEQ ID NO: 23585 - RNA, 20 nt, Artificial Sequence
  TRAC targeting sequence
uuaauuuuuuguugguggag

SEQ ID NO: 23586 - RNA, 20 nt, Artificial Sequence
  TRAC targeting sequence
cacgcaauaaucuuuaauuu

SEQ ID NO: 23587 - RNA, 20 nt, Artificial Sequence
  TRAC targeting sequence
ccauugagaauaaaagacgu

SEQ ID NO: 23588 - RNA, 20 nt, Artificial Sequence
  TRAC targeting sequence
auggugaccucccacgcaau

SEQ ID NO: 23589 - RNA, 20 nt, Artificial Sequence
  TRAC targeting sequence
caauggugaccucccacgca

SEQ ID NO: 23590 - RNA, 20 nt, Artificial Sequence
  TRAC targeting sequence
uuuauucucaauggugaccu

SEQ ID NO: 23591 - RNA, 20 nt, Artificial Sequence
  TRAC targeting sequence
acgucuuuuauucucaaugg

SEQ ID NO: 23592 - RNA, 20 nt, Artificial Sequence
  TRAC targeting sequence
uuuuuugguuuguucuacgu

SEQ ID NO: 23593 - RNA, 20 nt, Artificial Sequence
  TRAC targeting sequence
caaacuaaggaggugaaaaa

SEQ ID NO: 23594 - RNA, 20 nt, Artificial Sequence
  TRAC targeting sequence
aacuaaggaggugaaaaaaa

SEQ ID NO: 23595 - RNA, 20 nt, Artificial Sequence
  TRAC targeting sequence
uuaguuugagagcuucuuuu

SEQ ID NO: 23596 - RNA, 20 nt, Artificial Sequence
  TRAC targeting sequence
ccuccuuaguuugagagcuu

SEQ ID NO: 23597 - RNA, 20 nt, Artificial Sequence
  TRAC targeting sequence
uuuuuucaccuccuuaguuu

SEQ ID NO: 23598 - RNA, 20 nt, Artificial Sequence
  TRAC targeting sequence
aacgggaaaccugcgggucu

SEQ ID NO: 23599 - RNA, 20 nt, Artificial Sequence
  TRAC targeting sequence
cguuugauuucuuuuuuuca

SEQ ID NO: 23600 - RNA, 20 nt, Artificial Sequence
  TRAC targeting sequence
augugcacagucuuggucuu

SEQ ID NO: 23601 - RNA, 20 nt, Artificial Sequence
  TRAC targeting sequence
uggucuucccccacacaaca

SEQ ID NO: 23602 - RNA, 20 nt, Artificial Sequence
  TRAC targeting sequence
ucccccacacaacaaaaucu

SEQ ID NO: 23603 - RNA, 20 nt, Artificial Sequence
  TRAC targeting sequence
cccacacaacaaaaucuagg

SEQ ID NO: 23604 - RNA, 20 nt, Artificial Sequence
  TRAC targeting sequence
agggccacuuuaggguucua

SEQ ID NO: 23605 - RNA, 20 nt, Artificial Sequence
  TRAC targeting sequence
augcccuuuuguuccuaacu

SEQ ID NO: 23606 - RNA, 20 nt, Artificial Sequence
  TRAC targeting sequence
uaacucgacauugcccacuu

SEQ ID NO: 23607 - RNA, 20 nt, Artificial Sequence
  TRAC targeting sequence
acauugcccacuucuggcca

SEQ ID NO: 23608 - RNA, 20 nt, Artificial Sequence
  TRAC targeting sequence
aguuaggaacaaaagggcau

SEQ ID NO: 23609 - RNA, 20 nt, Artificial Sequence
  TRAC targeting sequence
ggccagaauguaaagcaacc

SEQ ID NO: 23610 - RNA, 20 nt, Artificial Sequence
  TRAC targeting sequence
ggccagaagugggcaauguc

SEQ ID NO: 23611 - RNA, 20 nt, Artificial Sequence
  TRAC targeting sequence
aaacccuccuggaccucugc

SEQ ID NO: 23612 - RNA, 20 nt, Artificial Sequence
  TRAC targeting sequence
uggaccucugcugcccccca

SEQ ID NO: 23613 - RNA, 20 nt, Artificial Sequence
  TRAC targeting sequence
aggaggguuuagaugcuggg

SEQ ID NO: 23614 - RNA, 20 nt, Artificial Sequence
  TRAC targeting sequence
gcugccccccaaugacugga

SEQ ID NO: 23615 - RNA, 20 nt, Artificial Sequence
  TRAC targeting sequence
uuggggggcagcagaggucc

SEQ ID NO: 23616 - RNA, 20 nt, Artificial Sequence
  TRAC targeting sequence
agucauuggggggcagcaga

SEQ ID NO: 23617 - RNA, 20 nt, Artificial Sequence
  TRAC targeting sequence
uuccagucauuggggggcag

SEQ ID NO: 23618 - RNA, 20 nt, Artificial Sequence
  TRAC targeting sequence
guagcuucuucccccaaacu

SEQ ID NO: 23619 - RNA, 20 nt, Artificial Sequence
  TRAC targeting sequence
ucccccaaacucaacuccuc

SEQ ID NO: 23620 - RNA, 20 nt, Artificial Sequence
  TRAC targeting sequence
cccaaacucaacuccucaug

SEQ ID NO: 23621 - RNA, 20 nt, Artificial Sequence
  TRAC targeting sequence
acuccucauguuuuguagua

SEQ ID NO: 23622 - RNA, 20 nt, Artificial Sequence
  TRAC targeting sequence
ucauguuuuguaguagccgc

SEQ ID NO: 23623 - RNA, 20 nt, Artificial Sequence
  TRAC targeting sequence
uguuuuguaguagccgcuca

SEQ ID NO: 23624 - RNA, 20 nt, Artificial Sequence
  TRAC targeting sequence
acacaugaaacauaccaucc

SEQ ID NO: 23625 - RNA, 20 nt, Artificial Sequence
  TRAC targeting sequence
uguguugagcggcuacuaca

SEQ ID NO: 23626 - RNA, 20 nt, Artificial Sequence
  TRAC targeting sequence
acuagguggcagcaaagccc

SEQ ID NO: 23627 - RNA, 20 nt, Artificial Sequence
  TRAC targeting sequence
gugggcuuugcugccaccua

SEQ ID NO: 23628 - RNA, 20 nt, Artificial Sequence
  TRAC targeting sequence
aguuccccuucccgagguaa

SEQ ID NO: 23629 - RNA, 20 nt, Artificial Sequence
  TRAC targeting sequence
ccuucccgagguaauuuucu

SEQ ID NO: 23630 - RNA, 20 nt, Artificial Sequence
  TRAC targeting sequence
cgagguaauuuucuagauua

SEQ ID NO: 23631 - RNA, 20 nt, Artificial Sequence
  TRAC targeting sequence
ggaaggggaacuugauguua

SEQ ID NO: 23632 - RNA, 20 nt, Artificial Sequence
  TRAC targeting sequence
agauuacuauacuuuaacug

SEQ ID NO: 23633 - RNA, 20 nt, Artificial Sequence
  TRAC targeting sequence
agaaaauuaccucgggaagg

SEQ ID NO: 23634 - RNA, 20 nt, Artificial Sequence
  TRAC targeting sequence
guuaaaguauaguaaucuag

SEQ ID NO: 23635 - RNA, 20 nt, Artificial Sequence
  TRAC targeting sequence
aaaagccaacauaauuucau

SEQ ID NO: 23636 - RNA, 20 nt, Artificial Sequence
  TRAC targeting sequence
aauucaguuaaaguauagua

SEQ ID NO: 23637 - RNA, 20 nt, Artificial Sequence
  TRAC targeting sequence
uguuuguaaacagugcugcc

SEQ ID NO: 23638 - RNA, 20 nt, Artificial Sequence
  TRAC targeting sequence
gaguuuaaaauguucugccc

SEQ ID NO: 23639 - RNA, 20 nt, Artificial Sequence
  TRAC targeting sequence
gacuggcagcacuguuuaca

SEQ ID NO: 23640 - RNA, 20 nt, Artificial Sequence
  TRAC targeting sequence
gcccaacccuguagcccccu

SEQ ID NO: 23641 - RNA, 20 nt, Artificial Sequence
  TRAC targeting sequence
agcuaggaucaaacacugaa

SEQ ID NO: 23642 - RNA, 20 nt, Artificial Sequence
  TRAC targeting sequence
uagcuggaacaagggggcua

SEQ ID NO: 23643 - RNA, 20 nt, Artificial Sequence
  TRAC targeting sequence
aacacugaauuuuuuaagac

SEQ ID NO: 23644 - RNA, 20 nt, Artificial Sequence
  TRAC targeting sequence
guguuugauccuagcuggaa

SEQ ID NO: 23645 - RNA, 20 nt, Artificial Sequence
  TRAC targeting sequence
uaaaaaauucaguguuugau

SEQ ID NO: 23646 - RNA, 20 nt, Artificial Sequence
  TRAC targeting sequence
caagucuuaaaaaauucagu

SEQ ID NO: 23647 - RNA, 20 nt, Artificial Sequence
  TRAC targeting sequence
cacaagucuuaaaaaauuca

SEQ ID NO: 23648 - RNA, 20 nt, Artificial Sequence
  TRAC targeting sequence
cucacaagucuuaaaaaauu

SEQ ID NO: 23649 - RNA, 20 nt, Artificial Sequence
  TRAC targeting sequence
ccauuauaaaaacaaaacaa

SEQ ID NO: 23650 - RNA, 20 nt, Artificial Sequence
  TRAC targeting sequence
auuauaaaaacaaaacaaug

SEQ ID NO: 23651 - RNA, 20 nt, Artificial Sequence
  TRAC targeting sequence
cccugggagcugagcacauu

SEQ ID NO: 23652 - RNA, 20 nt, Artificial Sequence
  TRAC targeting sequence
cugggagcugagcacauuuu

SEQ ID NO: 23653 - RNA, 20 nt, Artificial Sequence
  TRAC targeting sequence
cagggagauaguugccaaau

SEQ ID NO: 23654 - RNA, 20 nt, Artificial Sequence
  TRAC targeting sequence
gcucccagggagauaguugc

SEQ ID NO: 23655 - RNA, 20 nt, Artificial Sequence
  TRAC targeting sequence
agcaagguuuugucccuuug

SEQ ID NO: 23656 - RNA, 20 nt, Artificial Sequence
  TRAC targeting sequence
cuuugggcccaguucacccu

SEQ ID NO: 23657 - RNA, 20 nt, Artificial Sequence
  TRAC targeting sequence
cccuuccuucugacccaggg

SEQ ID NO: 23658 - RNA, 20 nt, Artificial Sequence
  TRAC targeting sequence
uucugacccagggcccaauu

SEQ ID NO: 23659 - RNA, 20 nt, Artificial Sequence
  TRAC targeting sequence
gacccagggcccaauucauc

SEQ ID NO: 23660 - RNA, 20 nt, Artificial Sequence
  TRAC targeting sequence
gaaggaagggugaacugggc

SEQ ID NO: 23661 - RNA, 20 nt, Artificial Sequence
  TRAC targeting sequence
ucaggaacuuuaauucucaa

SEQ ID NO: 23662 - RNA, 20 nt, Artificial Sequence
  TRAC targeting sequence
ggaacuuuaauucucaaacu

SEQ ID NO: 23663 - RNA, 20 nt, Artificial Sequence
  TRAC targeting sequence
ugaugaauugggcccugggu

SEQ ID NO: 23664 - RNA, 20 nt, Artificial Sequence
  TRAC targeting sequence
caaacugugauccaauacag

SEQ ID NO: 23665 - RNA, 20 nt, Artificial Sequence
  TRAC targeting sequence
aacugugauccaauacaguu

SEQ ID NO: 23666 - RNA, 20 nt, Artificial Sequence
  TRAC targeting sequence
caguuugagaauuaaaguuc

SEQ ID NO: 23667 - RNA, 20 nt, Artificial Sequence
  TRAC targeting sequence
aauacaguucuguccuucuu

SEQ ID NO: 23668 - RNA, 20 nt, Artificial Sequence
  TRAC targeting sequence
guccuucuuuuccucauuac

SEQ ID NO: 23669 - RNA, 20 nt, Artificial Sequence
  TRAC targeting sequence
uucuuuuccucauuacccuu

SEQ ID NO: 23670 - RNA, 20 nt, Artificial Sequence
  TRAC targeting sequence
uuuccucauuacccuucaga

SEQ ID NO: 23671 - RNA, 20 nt, Artificial Sequence
  TRAC targeting sequence
ucauuacccuucagaacacc

SEQ ID NO: 23672 - RNA, 20 nt, Artificial Sequence
  TRAC targeting sequence
uuacccuucagaacaccuga

SEQ ID NO: 23673 - RNA, 20 nt, Artificial Sequence
  TRAC targeting sequence
gaacaccugagauggacuga

SEQ ID NO: 23674 - RNA, 20 nt, Artificial Sequence
  TRAC targeting sequence
gaaggguaaugaggaaaaga

SEQ ID NO: 23675 - RNA, 20 nt, Artificial Sequence
  TRAC targeting sequence
gguguucugaaggguaauga

SEQ ID NO: 23676 - RNA, 20 nt, Artificial Sequence
  TRAC targeting sequence
cagguguucugaaggguaau

SEQ ID NO: 23677 - RNA, 20 nt, Artificial Sequence
  TRAC targeting sequence
aucucagguguucugaaggg

SEQ ID NO: 23678 - RNA, 20 nt, Artificial Sequence
  TRAC targeting sequence
guccaucucagguguucuga

SEQ ID NO: 23679 - RNA, 20 nt, Artificial Sequence
  TRAC targeting sequence
caguccaucucagguguucu

SEQ ID NO: 23680 - RNA, 20 nt, Artificial Sequence
  TRAC targeting sequence
uuuuuaaaaaaaaaaaaaaa

SEQ ID NO: 23681 - RNA, 20 nt, Artificial Sequence
  TRAC targeting sequence
caggccaggugcaguggcuc

SEQ ID NO: 23682 - RNA, 20 nt, Artificial Sequence
  TRAC targeting sequence
cgccuguaaucccagcacuu

SEQ ID NO: 23683 - RNA, 20 nt, Artificial Sequence
  TRAC targeting sequence
cagcacuuugggaggccaag

SEQ ID NO: 23684 - RNA, 20 nt, Artificial Sequence
  TRAC targeting sequence
caaagugcugggauuacagg

SEQ ID NO: 23685 - RNA, 20 nt, Artificial Sequence
  TRAC targeting sequence
ccuuggccucccaaagugcu

SEQ ID NO: 23686 - RNA, 20 nt, Artificial Sequence
  TRAC targeting sequence
acucgccuuggccucccaaa

SEQ ID NO: 23687 - RNA, 20 nt, Artificial Sequence
  TRAC targeting sequence
cgaggacaggaguucaacac

SEQ ID NO: 23688 - RNA, 20 nt, Artificial Sequence
  TRAC targeting sequence
ugauccacucgccuuggccu

SEQ ID NO: 23689 - RNA, 20 nt, Artificial Sequence
  TRAC targeting sequence
ucgugauccacucgccuugg

SEQ ID NO: 23690 - RNA, 20 nt, Artificial Sequence
  TRAC targeting sequence
uguccucgugauccacucgc

SEQ ID NO: 23691 - RNA, 20 nt, Artificial Sequence
  TRAC targeting sequence
acaccagccuagccaacaga

SEQ ID NO: 23692 - RNA, 20 nt, Artificial Sequence
  TRAC targeting sequence
guuggcuaggcugguguuga

SEQ ID NO: 23693 - RNA, 20 nt, Artificial Sequence
  TRAC targeting sequence
cucuguuggcuaggcuggug

SEQ ID NO: 23694 - RNA, 20 nt, Artificial Sequence
  TRAC targeting sequence
cuacuaaaaauacaaaaacu

SEQ ID NO: 23695 - RNA, 20 nt, Artificial Sequence
  TRAC targeting sequence
acuaaaaauacaaaaacuag

SEQ ID NO: 23696 - RNA, 20 nt, Artificial Sequence
  TRAC targeting sequence
cagcuacucggggaggcugc

SEQ ID NO: 23697 - RNA, 20 nt, Artificial Sequence
  TRAC targeting sequence
gggaggcugcggcaggagaa

SEQ ID NO: 23698 - RNA, 20 nt, Artificial Sequence
  TRAC targeting sequence
ccgaguagcugggacuacag

SEQ ID NO: 23699 - RNA, 20 nt, Artificial Sequence
  TRAC targeting sequence
ugccgcagccuccccgagua

SEQ ID NO: 23700 - RNA, 20 nt, Artificial Sequence
  TRAC targeting sequence
ccugccgcagccuccccgag

SEQ ID NO: 23701 - RNA, 20 nt, Artificial Sequence
  TRAC targeting sequence
agcaauucuccugccgcagc

SEQ ID NO: 23702 - RNA, 20 nt, Artificial Sequence
  TRAC targeting sequence
cggguucaagcaauucuccu

SEQ ID NO: 23703 - RNA, 20 nt, Artificial Sequence
  TRAC targeting sequence
cugcaacccugccucccggg

SEQ ID NO: 23704 - RNA, 20 nt, Artificial Sequence
  TRAC targeting sequence
uggcucacugcaacccugcc

SEQ ID NO: 23705 - RNA, 20 nt, Artificial Sequence
  TRAC targeting sequence
agccugggcaagacaguaag

SEQ ID NO: 23706 - RNA, 20 nt, Artificial Sequence
  TRAC targeting sequence
ugcccaggcuagagugcagu

SEQ ID NO: 23707 - RNA, 20 nt, Artificial Sequence
  TRAC targeting sequence
uacugucuugcccaggcuag

SEQ ID NO: 23708 - RNA, 20 nt, Artificial Sequence
  TRAC targeting sequence
gucucaaaaaaaaaaaaaaa

SEQ ID NO: 23709 - RNA, 20 nt, Artificial Sequence
  TRAC targeting sequence
caaaaaaaaaaaaaaaagaa

SEQ ID NO: 23710 - RNA, 20 nt, Artificial Sequence
  TRAC targeting sequence
aaaaaaaaaaaaaaagaauu

SEQ ID NO: 23711 - RNA, 20 nt, Artificial Sequence
  TRAC targeting sequence
uuuuuuuuuuuuuuugagac

SEQ ID NO: 23712 - RNA, 20 nt, Artificial Sequence
  TRAC targeting sequence
caaagaaacacagaagaaca

SEQ ID NO: 23713 - RNA, 20 nt, Artificial Sequence
  TRAC targeting sequence
uugugaaauucuuuuuuuuu

SEQ ID NO: 23714 - RNA, 20 nt, Artificial Sequence
  TRAC targeting sequence
guguuucuuugugaaauucu

SEQ ID NO: 23715 - RNA, 20 nt, Artificial Sequence
  TRAC targeting sequence
ucuguguuucuuugugaaau

SEQ ID NO: 23716 - RNA, 20 nt, Artificial Sequence
  TRAC targeting sequence
auguuuguucuucuguguuu

SEQ ID NO: 23717 - RNA, 20 nt, Artificial Sequence
  TRAC targeting sequence
guauuuaaaaauguauauac

SEQ ID NO: 23718 - RNA, 20 nt, Artificial Sequence
  TRAC targeting sequence
acugagcuucuuucugucau

SEQ ID NO: 23719 - RNA, 20 nt, Artificial Sequence
  TRAC targeting sequence
guggauuucaguauuuaaaa

SEQ ID NO: 23720 - RNA, 20 nt, Artificial Sequence
  TRAC targeting sequence
uucugucauggauucauuca

SEQ ID NO: 23721 - RNA, 20 nt, Artificial Sequence
  TRAC targeting sequence
gucauggauucauucaaaaa

SEQ ID NO: 23722 - RNA, 20 nt, Artificial Sequence
  TRAC targeting sequence
uggauucauucaaaaauaug

SEQ ID NO: 23723 - RNA, 20 nt, Artificial Sequence
  TRAC targeting sequence
augacagaaagaagcucagu

SEQ ID NO: 23724 - RNA, 20 nt, Artificial Sequence
  TRAC targeting sequence
uucaaaaauaugccgccacc

SEQ ID NO: 23725 - RNA, 20 nt, Artificial Sequence
  TRAC targeting sequence
aaaauaugccgccaccuaca

SEQ ID NO: 23726 - RNA, 20 nt, Artificial Sequence
  TRAC targeting sequence
guuuuuguuguguagguggc

SEQ ID NO: 23727 - RNA, 20 nt, Artificial Sequence
  TRAC targeting sequence
uuucaggugugcauggauuu

SEQ ID NO: 23728 - RNA, 20 nt, Artificial Sequence
  TRAC targeting sequence
ggugugcauggauuucuggg

SEQ ID NO: 23729 - RNA, 20 nt, Artificial Sequence
  TRAC targeting sequence
augcacaccugaaaugauca

SEQ ID NO: 23730 - RNA, 20 nt, Artificial Sequence
  TRAC targeting sequence
gggggucagaagcucacugg

SEQ ID NO: 23731 - RNA, 20 nt, Artificial Sequence
  TRAC targeting sequence
gaagcucacugggagaauuu

SEQ ID NO: 23732 - RNA, 20 nt, Artificial Sequence
  TRAC targeting sequence
gacccccagaaauccaugca

SEQ ID NO: 23733 - RNA, 20 nt, Artificial Sequence
  TRAC targeting sequence
cugggagaauuuuugcuuuu

SEQ ID NO: 23734 - RNA, 20 nt, Artificial Sequence
  TRAC targeting sequence
cagugagcuucugaccccca

SEQ ID NO: 23735 - RNA, 20 nt, Artificial Sequence
  TRAC targeting sequence
cccagugagcuucugacccc

SEQ ID NO: 23736 - RNA, 20 nt, Artificial Sequence
  TRAC targeting sequence
uuuguauagucuaaaaaaua

SEQ ID NO: 23737 - RNA, 20 nt, Artificial Sequence
  TRAC targeting sequence
aaaaaauaaaaaauauugag

SEQ ID NO: 23738 - RNA, 20 nt, Artificial Sequence
  TRAC targeting sequence
auauuuuuuauuuuuuagac

SEQ ID NO: 23739 - RNA, 20 nt, Artificial Sequence
  TRAC targeting sequence
uucuugaucaccuggauaga

SEQ ID NO: 23740 - RNA, 20 nt, Artificial Sequence
  TRAC targeting sequence
ugaucaccuggauagauaca

SEQ ID NO: 23741 - RNA, 20 nt, Artificial Sequence
  TRAC targeting sequence
agaaagacucaauauuuuuu

SEQ ID NO: 23742 - RNA, 20 nt, Artificial Sequence
  TRAC targeting sequence
ccuggauagauacauuaguu

SEQ ID NO: 23743 - RNA, 20 nt, Artificial Sequence
  TRAC targeting sequence
aggugaucaagaaagacuca

SEQ ID NO: 23744 - RNA, 20 nt, Artificial Sequence
  TRAC targeting sequence
auccaggugaucaagaaaga

SEQ ID NO: 23745 - RNA, 20 nt, Artificial Sequence
  TRAC targeting sequence
uacaacuaauguaucuaucc

SEQ ID NO: 23746 - RNA, 20 nt, Artificial Sequence
  TRAC targeting sequence
agcaaggggcucuuuuuuuu

SEQ ID NO: 23747 - RNA, 20 nt, Artificial Sequence
  TRAC targeting sequence
uuuuuuuuuuuuuuuuuuuu

SEQ ID NO: 23748 - RNA, 20 nt, Artificial Sequence
  TRAC targeting sequence
aaaaaaaaaaaaaaaaaaaa

SEQ ID NO: 23749 - RNA, 20 nt, Artificial Sequence
  TRAC targeting sequence
guuuucuaaaaaaaaaaaaa

SEQ ID NO: 23750 - RNA, 20 nt, Artificial Sequence
  TRAC targeting sequence
uacucuugccaggcuggagu

SEQ ID NO: 23751 - RNA, 20 nt, Artificial Sequence
  TRAC targeting sequence
ugccaggcuggagugcaaug

SEQ ID NO: 23752 - RNA, 20 nt, Artificial Sequence
  TRAC targeting sequence
agccuggcaagaguaagacu

SEQ ID NO: 23753 - RNA, 20 nt, Artificial Sequence
  TRAC targeting sequence
ggcucacugcaaccuccgcc

SEQ ID NO: 23754 - RNA, 20 nt, Artificial Sequence
  TRAC targeting sequence
cugcaaccuccgccucaugg

SEQ ID NO: 23755 - RNA, 20 nt, Artificial Sequence
  TRAC targeting sequence
gccucauggguucaaacgau

SEQ ID NO: 23756 - RNA, 20 nt, Artificial Sequence
  TRAC targeting sequence
uggguucaaacgauucuccu

SEQ ID NO: 23757 - RNA, 20 nt, Artificial Sequence
  TRAC targeting sequence
aacgauucuccugccuuagc

SEQ ID NO: 23758 - RNA, 20 nt, Artificial Sequence
  TRAC targeting sequence
uuugaacccaugaggcggag

SEQ ID NO: 23759 - RNA, 20 nt, Artificial Sequence
  TRAC targeting sequence
ccugccuuagccucccgagu

SEQ ID NO: 23760 - RNA, 20 nt, Artificial Sequence
  TRAC targeting sequence
ugccuuagccucccgaguag

SEQ ID NO: 23761 - RNA, 20 nt, Artificial Sequence
  TRAC targeting sequence
cgaguagcugggauuacagg

SEQ ID NO: 23762 - RNA, 20 nt, Artificial Sequence
  TRAC targeting sequence
ggaggcuaaggcaggagaau

SEQ ID NO: 23763 - RNA, 20 nt, Artificial Sequence
  TRAC targeting sequence
cagcuacucgggaggcuaag

SEQ ID NO: 23764 - RNA, 20 nt, Artificial Sequence
  TRAC targeting sequence
uuuuaguagagacgagguuu

SEQ ID NO: 23765 - RNA, 20 nt, Artificial Sequence
  TRAC targeting sequence
acuaaaaagacaaaaauuag

SEQ ID NO: 23766 - RNA, 20 nt, Artificial Sequence
  TRAC targeting sequence
cuacuaaaaagacaaaaauu

SEQ ID NO: 23767 - RNA, 20 nt, Artificial Sequence
  TRAC targeting sequence
ucucuacuaaaaagacaaaa

SEQ ID NO: 23768 - RNA, 20 nt, Artificial Sequence
  TRAC targeting sequence
ccauguuggccaggcugguc

SEQ ID NO: 23769 - RNA, 20 nt, Artificial Sequence
  TRAC targeting sequence
caaacuccugaccucaggug

SEQ ID NO: 23770 - RNA, 20 nt, Artificial Sequence
  TRAC targeting sequence
aacuccugaccucaggugau

SEQ ID NO: 23771 - RNA, 20 nt, Artificial Sequence
  TRAC targeting sequence
ugaccucaggugauccaccc

SEQ ID NO: 23772 - RNA, 20 nt, Artificial Sequence
  TRAC targeting sequence
ggaguuugagaccagccugg

SEQ ID NO: 23773 - RNA, 20 nt, Artificial Sequence
  TRAC targeting sequence
ggugauccacccaccucggc

SEQ ID NO: 23774 - RNA, 20 nt, Artificial Sequence
  TRAC targeting sequence
ccugaggucaggaguuugag

SEQ ID NO: 23775 - RNA, 20 nt, Artificial Sequence
  TRAC targeting sequence
acccaccucggccucccaaa

SEQ ID NO: 23776 - RNA, 20 nt, Artificial Sequence
  TRAC targeting sequence
gccucccaaaaugcugggau

SEQ ID NO: 23777 - RNA, 20 nt, Artificial Sequence
  TRAC targeting sequence
caaaaugcugggauuacagg

SEQ ID NO: 23778 - RNA, 20 nt, Artificial Sequence
  TRAC targeting sequence
cagcauuuugggaggccgag

SEQ ID NO: 23779 - RNA, 20 nt, Artificial Sequence
  TRAC targeting sequence
gccaccgugcucagccaucc

SEQ ID NO: 23780 - RNA, 20 nt, Artificial Sequence
  TRAC targeting sequence
gccauccuagccaggcucuc

SEQ ID NO: 23781 - RNA, 20 nt, Artificial Sequence
  TRAC targeting sequence
uagccaggcucucucaacuu

SEQ ID NO: 23782 - RNA, 20 nt, Artificial Sequence
  TRAC targeting sequence
cucaacuucaguuccucauc

SEQ ID NO: 23783 - RNA, 20 nt, Artificial Sequence
  TRAC targeting sequence
caacuucaguuccucaucug

SEQ ID NO: 23784 - RNA, 20 nt, Artificial Sequence
  TRAC targeting sequence
acuucaguuccucaucugua

SEQ ID NO: 23785 - RNA, 20 nt, Artificial Sequence
  TRAC targeting sequence
guuccucaucuguaaaugag

SEQ ID NO: 23786 - RNA, 20 nt, Artificial Sequence
  TRAC targeting sequence
ucaucuguaaaugagaacag

SEQ ID NO: 23787 - RNA, 20 nt, Artificial Sequence
  TRAC targeting sequence
ucuguaaaugagaacagcaa

SEQ ID NO: 23788 - RNA, 20 nt, Artificial Sequence
  TRAC targeting sequence
guaaaugagaacagcaagcc

SEQ ID NO: 23789 - RNA, 20 nt, Artificial Sequence
  TRAC targeting sequence
uuuacagaugaggaacugaa

SEQ ID NO: 23790 - RNA, 20 nt, Artificial Sequence
  TRAC targeting sequence
cauuuacagaugaggaacug

SEQ ID NO: 23791 - RNA, 20 nt, Artificial Sequence
  TRAC targeting sequence
ucgugaaauuauucugaaaa

SEQ ID NO: 23792 - RNA, 20 nt, Artificial Sequence
  TRAC targeting sequence
ugaaauuauucugaaaauaa

SEQ ID NO: 23793 - RNA, 20 nt, Artificial Sequence
  TRAC targeting sequence
cgaggauaggcuugcuguuc

SEQ ID NO: 23794 - RNA, 20 nt, Artificial Sequence
  TRAC targeting sequence
gaaaauaaaaugauauagaa

SEQ ID NO: 23795 - RNA, 20 nt, Artificial Sequence
  TRAC targeting sequence
gaauaauuucacgaggauag

SEQ ID NO: 23796 - RNA, 20 nt, Artificial Sequence
  TRAC targeting sequence
uuuuauuuucagaauaauuu

SEQ ID NO: 23797 - RNA, 20 nt, Artificial Sequence
  TRAC targeting sequence
auaucauuuuauuuucagaa

SEQ ID NO: 23798 - RNA, 20 nt, Artificial Sequence
  TRAC targeting sequence
uguucuauaucauuuuauuu

SEQ ID NO: 23799 - RNA, 20 nt, Artificial Sequence
  TRAC targeting sequence
gugugugcuaugcuuuaagu

SEQ ID NO: 23800 - RNA, 20 nt, Artificial Sequence
  TRAC targeting sequence
uuaucuguuaacuuccuuac

SEQ ID NO: 23801 - RNA, 20 nt, Artificial Sequence
  TRAC targeting sequence
guuaacuuccuuacuucccc

SEQ ID NO: 23802 - RNA, 20 nt, Artificial Sequence
  TRAC targeting sequence
uuacuuccccuugaauuguu

SEQ ID NO: 23803 - RNA, 20 nt, Artificial Sequence
  TRAC targeting sequence
ccuugaauuguuuauuuuuu

SEQ ID NO: 23804 - RNA, 20 nt, Artificial Sequence
  TRAC targeting sequence
aggggaaguaaggaaguuaa

SEQ ID NO: 23805 - RNA, 20 nt, Artificial Sequence
  TRAC targeting sequence
uuugaccugccucuuucaga

SEQ ID NO: 23806 - RNA, 20 nt, Artificial Sequence
  TRAC targeting sequence
aaagaaaauggcauuggguu

SEQ ID NO: 23807 - RNA, 20 nt, Artificial Sequence
  TRAC targeting sequence
uucagaguagguuagaguuu

SEQ ID NO: 23808 - RNA, 20 nt, Artificial Sequence
  TRAC targeting sequence
gaguagguuagaguuuguca

SEQ ID NO: 23809 - RNA, 20 nt, Artificial Sequence
  TRAC targeting sequence
gaaagaggcaggucaaaaga

SEQ ID NO: 23810 - RNA, 20 nt, Artificial Sequence
  TRAC targeting sequence
aaccuacucugaaagaggca

SEQ ID NO: 23811 - RNA, 20 nt, Artificial Sequence
  TRAC targeting sequence
cccccaaauucauguaagau

SEQ ID NO: 23812 - RNA, 20 nt, Artificial Sequence
  TRAC targeting sequence
uguaagaucagcuauauuac

SEQ ID NO: 23813 - RNA, 20 nt, Artificial Sequence
  TRAC targeting sequence
uacaugaauuugggggugac

SEQ ID NO: 23814 - RNA, 20 nt, Artificial Sequence
  TRAC targeting sequence
gcuauauuacagaauuuuuu

SEQ ID NO: 23815 - RNA, 20 nt, Artificial Sequence
  TRAC targeting sequence
guaauauagcugaucuuaca

SEQ ID NO: 23816 - RNA, 20 nt, Artificial Sequence
  TRAC targeting sequence
aacucucaacuuaguuggaa

SEQ ID NO: 23817 - RNA, 20 nt, Artificial Sequence
  TRAC targeting sequence
caacuuaguuggaaaauaua

SEQ ID NO: 23818 - RNA, 20 nt, Artificial Sequence
  TRAC targeting sequence
acuuaguuggaaaauauaaa

SEQ ID NO: 23819 - RNA, 20 nt, Artificial Sequence
  TRAC targeting sequence
aacuaaguugagaguuugau

SEQ ID NO: 23820 - RNA, 20 nt, Artificial Sequence
  TRAC targeting sequence
uuauauuuuccaacuaaguu

SEQ ID NO: 23821 - RNA, 20 nt, Artificial Sequence
  TRAC targeting sequence
aucuguuuuguucuaccuuc

SEQ ID NO: 23822 - RNA, 20 nt, Artificial Sequence
  TRAC targeting sequence
guuuuguucuaccuucugag

SEQ ID NO: 23823 - RNA, 20 nt, Artificial Sequence
  TRAC targeting sequence
accuucugagcugguauaaa

SEQ ID NO: 23824 - RNA, 20 nt, Artificial Sequence
  TRAC targeting sequence
gagcugguauaaauauugag

SEQ ID NO: 23825 - RNA, 20 nt, Artificial Sequence
  TRAC targeting sequence
gaagguagaacaaaacagau

SEQ ID NO: 23826 - RNA, 20 nt, Artificial Sequence
  TRAC targeting sequence
auauuuauaccagcucagaa

SEQ ID NO: 23827 - RNA, 20 nt, Artificial Sequence
  TRAC targeting sequence
caauauuuauaccagcucag

SEQ ID NO: 23828 - RNA, 20 nt, Artificial Sequence
  TRAC targeting sequence
aaguaaauucucaauauuua

SEQ ID NO: 23829 - RNA, 20 nt, Artificial Sequence
  TRAC targeting sequence
gcuauaugugcacugugcca

SEQ ID NO: 23830 - RNA, 20 nt, Artificial Sequence
  TRAC targeting sequence
aacucagcuauaugugcacu

SEQ ID NO: 23831 - RNA, 20 nt, Artificial Sequence
  TRAC targeting sequence
uuuuaugugcuucuaacuca

SEQ ID NO: 23832 - RNA, 20 nt, Artificial Sequence
  TRAC targeting sequence
guuuuuaaaaauauacauuu

SEQ ID NO: 23833 - RNA, 20 nt, Artificial Sequence
  TRAC targeting sequence
caguuuuuaaaaauauacau

SEQ ID NO: 23834 - RNA, 20 nt, Artificial Sequence
  TRAC targeting sequence
ugcucucaguuuuuaaaaau

SEQ ID NO: 23835 - RNA, 20 nt, Artificial Sequence
  TRAC targeting sequence
aaugaaggaucucuaugaaa

SEQ ID NO: 23836 - RNA, 20 nt, Artificial Sequence
  TRAC targeting sequence
uuugaauuauacuauacugu

SEQ ID NO: 23837 - RNA, 20 nt, Artificial Sequence
  TRAC targeting sequence
uucauuugaauuauacuaua

SEQ ID NO: 23838 - RNA, 20 nt, Artificial Sequence
  TRAC targeting sequence
cuaugaaaaacaaucugggc

SEQ ID NO: 23839 - RNA, 20 nt, Artificial Sequence
  TRAC targeting sequence
augaaaaacaaucugggcaa

SEQ ID NO: 23840 - RNA, 20 nt, Artificial Sequence
  TRAC targeting sequence
uagagauccuucauuugaau

SEQ ID NO: 23841 - RNA, 20 nt, Artificial Sequence
  TRAC targeting sequence
gggcaaucccccagagagaa

SEQ ID NO: 23842 - RNA, 20 nt, Artificial Sequence
  TRAC targeting sequence
cccagagagaaagauuuuuc

SEQ ID NO: 23843 - RNA, 20 nt, Artificial Sequence
  TRAC targeting sequence
gggggauugcccagauuguu

SEQ ID NO: 23844 - RNA, 20 nt, Artificial Sequence
  TRAC targeting sequence
cugggggauugcccagauug

SEQ ID NO: 23845 - RNA, 20 nt, Artificial Sequence
  TRAC targeting sequence
cucugggggauugcccagau

SEQ ID NO: 23846 - RNA, 20 nt, Artificial Sequence
  TRAC targeting sequence
uucucucugggggauugccc

SEQ ID NO: 23847 - RNA, 20 nt, Artificial Sequence
  TRAC targeting sequence
gggauugaggauuuugcuau

SEQ ID NO: 23848 - RNA, 20 nt, Artificial Sequence
  TRAC targeting sequence
cagauugcaguguuaaaucu

SEQ ID NO: 23849 - RNA, 20 nt, Artificial Sequence
  TRAC targeting sequence
aucccagauugcaguguuaa

SEQ ID NO: 23850 - RNA, 20 nt, Artificial Sequence
  TRAC targeting sequence
ucaaucccagauugcagugu

SEQ ID NO: 23851 - RNA, 20 nt, Artificial Sequence
  TRAC targeting sequence
cagcugagcaggugguccua

SEQ ID NO: 23852 - RNA, 20 nt, Artificial Sequence
  TRAC targeting sequence
gcugggaauuaugggcccaa

SEQ ID NO: 23853 - RNA, 20 nt, Artificial Sequence
  TRAC targeting sequence
uagguuguuaauauggucug

SEQ ID NO: 23854 - RNA, 20 nt, Artificial Sequence
  TRAC targeting sequence
gcaguacacaguuucugcug

SEQ ID NO: 23855 - RNA, 20 nt, Artificial Sequence
  TRAC targeting sequence
gcugagacugcuuuuuuguc

SEQ ID NO: 23856 - RNA, 20 nt, Artificial Sequence
  TRAC targeting sequence
gcagaaacuguguacugcag

SEQ ID NO: 23857 - RNA, 20 nt, Artificial Sequence
  TRAC targeting sequence
cagcagaaacuguguacugc

SEQ ID NO: 23858 - RNA, 20 nt, Artificial Sequence
  TRAC targeting sequence
uugcuuuugucauaauuuug

SEQ ID NO: 23859 - RNA, 20 nt, Artificial Sequence
  TRAC targeting sequence
uaauuuugaaauacuaagcu

SEQ ID NO: 23860 - RNA, 20 nt, Artificial Sequence
  TRAC targeting sequence
aaauuaugacaaaagcaaag

SEQ ID NO: 23861 - RNA, 20 nt, Artificial Sequence
  TRAC targeting sequence
cugcaguagagucuuccucc

SEQ ID NO: 23862 - RNA, 20 nt, Artificial Sequence
  TRAC targeting sequence
gcaguagagucuuccuccaa

SEQ ID NO: 23863 - RNA, 20 nt, Artificial Sequence
  TRAC targeting sequence
acugcagagagcuuaguauu

SEQ ID NO: 23864 - RNA, 20 nt, Artificial Sequence
  TRAC targeting sequence
uccuccaaucaugacagccc

SEQ ID NO: 23865 - RNA, 20 nt, Artificial Sequence
  TRAC targeting sequence
uccaaucaugacagcccuaa

SEQ ID NO: 23866 - RNA, 20 nt, Artificial Sequence
  TRAC targeting sequence
aaucaugacagcccuaagaa

SEQ ID NO: 23867 - RNA, 20 nt, Artificial Sequence
  TRAC targeting sequence
ugacagcccuaagaaauaau

SEQ ID NO: 23868 - RNA, 20 nt, Artificial Sequence
  TRAC targeting sequence
ugauuggaggaagacucuac

SEQ ID NO: 23869 - RNA, 20 nt, Artificial Sequence
  TRAC targeting sequence
uagggcugucaugauuggag

SEQ ID NO: 23870 - RNA, 20 nt, Artificial Sequence
  TRAC targeting sequence
augauuugguaucucccuga

SEQ ID NO: 23871 - RNA, 20 nt, Artificial Sequence
  TRAC targeting sequence
uggaaaauuauuucuuaggg

SEQ ID NO: 23872 - RNA, 20 nt, Artificial Sequence
  TRAC targeting sequence
cccugagccuagaaaacauc

SEQ ID NO: 23873 - RNA, 20 nt, Artificial Sequence
  TRAC targeting sequence
cugagccuagaaaacauccu

SEQ ID NO: 23874 - RNA, 20 nt, Artificial Sequence
  TRAC targeting sequence
gggagauaccaaaucaugga

SEQ ID NO: 23875 - RNA, 20 nt, Artificial Sequence
  TRAC targeting sequence
aggcucagggagauaccaaa

SEQ ID NO: 23876 - RNA, 20 nt, Artificial Sequence
  TRAC targeting sequence
uugaaauguuugcugugucc

SEQ ID NO: 23877 - RNA, 20 nt, Artificial Sequence
  TRAC targeting sequence
aggauguuuucuaggcucag

SEQ ID NO: 23878 - RNA, 20 nt, Artificial Sequence
  TRAC targeting sequence
ccuuccuaaguacacaccau

SEQ ID NO: 23879 - RNA, 20 nt, Artificial Sequence
  TRAC targeting sequence
uaaguacacaccaugacuca

SEQ ID NO: 23880 - RNA, 20 nt, Artificial Sequence
  TRAC targeting sequence
ugguguguacuuaggaaggg

SEQ ID NO: 23881 - RNA, 20 nt, Artificial Sequence
  TRAC targeting sequence
ucuagaaaaaaagaacuuca

SEQ ID NO: 23882 - RNA, 20 nt, Artificial Sequence
  TRAC targeting sequence
agaaaaaaagaacuucagaa

SEQ ID NO: 23883 - RNA, 20 nt, Artificial Sequence
  TRAC targeting sequence
agaugagucaugguguguac

SEQ ID NO: 23884 - RNA, 20 nt, Artificial Sequence
  TRAC targeting sequence
uuuuuucuagaugagucaug

SEQ ID NO: 23885 - RNA, 20 nt, Artificial Sequence
  TRAC targeting sequence
gaaaucuagaguaagcaauc

SEQ ID NO: 23886 - RNA, 20 nt, Artificial Sequence
  TRAC targeting sequence
gaaguucuuuuuuucuagau

SEQ ID NO: 23887 - RNA, 20 nt, Artificial Sequence
  TRAC targeting sequence
agaguaagcaaucagaagac

SEQ ID NO: 23888 - RNA, 20 nt, Artificial Sequence
  TRAC targeting sequence
agauuucugaaguucuuuuu

SEQ ID NO: 23889 - RNA, 20 nt, Artificial Sequence
  TRAC targeting sequence
gaagacaugaccuuuccaga

SEQ ID NO: 23890 - RNA, 20 nt, Artificial Sequence
  TRAC targeting sequence
gauugcuuacucuagauuuc

SEQ ID NO: 23891 - RNA, 20 nt, Artificial Sequence
  TRAC targeting sequence
ucugauugcuuacucuagau

SEQ ID NO: 23892 - RNA, 20 nt, Artificial Sequence
  TRAC targeting sequence
ugucuucugauugcuuacuc

SEQ ID NO: 23893 - RNA, 20 nt, Artificial Sequence
  TRAC targeting sequence
agaaggcucuaucaggaagc

SEQ ID NO: 23894 - RNA, 20 nt, Artificial Sequence
  TRAC targeting sequence
ggaaaggucaugucuucuga

SEQ ID NO: 23895 - RNA, 20 nt, Artificial Sequence
  TRAC targeting sequence
aucaggaagcccaaggguua

SEQ ID NO: 23896 - RNA, 20 nt, Artificial Sequence
  TRAC targeting sequence
ggaagcccaaggguuacuca

SEQ ID NO: 23897 - RNA, 20 nt, Artificial Sequence
  TRAC targeting sequence
ugauagagccuucuggaaag

SEQ ID NO: 23898 - RNA, 20 nt, Artificial Sequence
  TRAC targeting sequence
aaccuauagcgaggcccuaa

SEQ ID NO: 23899 - RNA, 20 nt, Artificial Sequence
  TRAC targeting sequence
cuauagguuugaacaaagug

SEQ ID NO: 23900 - RNA, 20 nt, Artificial Sequence
  TRAC targeting sequence
ccccuacuagacuguacaug

SEQ ID NO: 23901 - RNA, 20 nt, Artificial Sequence
  TRAC targeting sequence
ccuacuagacuguacauguc

SEQ ID NO: 23902 - RNA, 20 nt, Artificial Sequence
  TRAC targeting sequence
aguaggggagaauacguaaa

SEQ ID NO: 23903 - RNA, 20 nt, Artificial Sequence
  TRAC targeting sequence
guuuuuuuuuuuuuuuuuuu

SEQ ID NO: 23904 - RNA, 20 nt, Artificial Sequence
  TRAC targeting sequence
uuucuguuuuuuuuuuuuuu

SEQ ID NO: 23905 - RNA, 20 nt, Artificial Sequence
  TRAC targeting sequence
cugaaauaaaccucacuguc

SEQ ID NO: 23906 - RNA, 20 nt, Artificial Sequence
  TRAC targeting sequence
gugaaaaacuuuuuuuuuuu

SEQ ID NO: 23907 - RNA, 20 nt, Artificial Sequence
  TRAC targeting sequence
cugucaacuuaccacuacca

SEQ ID NO: 23908 - RNA, 20 nt, Artificial Sequence
  TRAC targeting sequence
acuuaccacuaccaaaauga

SEQ ID NO: 23909 - RNA, 20 nt, Artificial Sequence
  TRAC targeting sequence
uuuugguagugguaaguuga

SEQ ID NO: 23910 - RNA, 20 nt, Artificial Sequence
  TRAC targeting sequence
gguaagguaucauuuuggua

SEQ ID NO: 23911 - RNA, 20 nt, Artificial Sequence
  TRAC targeting sequence
guuaguucagguaagguauc

SEQ ID NO: 23912 - RNA, 20 nt, Artificial Sequence
  TRAC targeting sequence
aaaacaguucuguuaguuca

SEQ ID NO: 23913 - RNA, 20 nt, Artificial Sequence
  TRAC targeting sequence
caucuuauauuuuaaagucu

SEQ ID NO: 23914 - RNA, 20 nt, Artificial Sequence
  TRAC targeting sequence
uauauuuuaaagucuucucc

SEQ ID NO: 23915 - RNA, 20 nt, Artificial Sequence
  TRAC targeting sequence
ucucccaaguuaacccaauu

SEQ ID NO: 23916 - RNA, 20 nt, Artificial Sequence
  TRAC targeting sequence
cccaaguuaacccaauuucc

SEQ ID NO: 23917 - RNA, 20 nt, Artificial Sequence
  TRAC targeting sequence
caaguuaacccaauuucccc

SEQ ID NO: 23918 - RNA, 20 nt, Artificial Sequence
  TRAC targeting sequence
ccauuuauuucuacuuuaag

SEQ ID NO: 23919 - RNA, 20 nt, Artificial Sequence
  TRAC targeting sequence
acuuuaaggcacauauuagc

SEQ ID NO: 23920 - RNA, 20 nt, Artificial Sequence
  TRAC targeting sequence
uucauccaacauacacugga

SEQ ID NO: 23921 - RNA, 20 nt, Artificial Sequence
  TRAC targeting sequence
uccaacauacacuggaugcu

SEQ ID NO: 23922 - RNA, 20 nt, Artificial Sequence
  TRAC targeting sequence
aacauacacuggaugcuauc

SEQ ID NO: 23923 - RNA, 20 nt, Artificial Sequence
  TRAC targeting sequence
aguguauguuggaugaauga

SEQ ID NO: 23924 - RNA, 20 nt, Artificial Sequence
  TRAC targeting sequence
aauuuaagugcuaugaaaac

SEQ ID NO: 23925 - RNA, 20 nt, Artificial Sequence
  TRAC targeting sequence
agcauuaaaagucaucugag

SEQ ID NO: 23926 - RNA, 20 nt, Artificial Sequence
  TRAC targeting sequence
ucugagaucaaaaucagaaa

SEQ ID NO: 23927 - RNA, 20 nt, Artificial Sequence
  TRAC targeting sequence
gagaucaaaaucagaaaaaa

SEQ ID NO: 23928 - RNA, 20 nt, Artificial Sequence
  TRAC targeting sequence
gaugacuuuuaaugcuggac

SEQ ID NO: 23929 - RNA, 20 nt, Artificial Sequence
  TRAC targeting sequence
cagaugacuuuuaaugcugg

SEQ ID NO: 23930 - RNA, 20 nt, Artificial Sequence
  TRAC targeting sequence
aaaucagaaaaaaauuaacu

SEQ ID NO: 23931 - RNA, 20 nt, Artificial Sequence
  TRAC targeting sequence
gaaaaaaauuaacuaacaaa

SEQ ID NO: 23932 - RNA, 20 nt, Artificial Sequence
  TRAC targeting sequence
gauuuugaucucagaugacu

SEQ ID NO: 23933 - RNA, 20 nt, Artificial Sequence
  TRAC targeting sequence
aaaggcaaaaccuaccauuu

SEQ ID NO: 23934 - RNA, 20 nt, Artificial Sequence
  TRAC targeting sequence
cuuccaaaaucuccgaguua

SEQ ID NO: 23935 - RNA, 20 nt, Artificial Sequence
  TRAC targeting sequence
uccaaaaucuccgaguuauu

SEQ ID NO: 23936 - RNA, 20 nt, Artificial Sequence
  TRAC targeting sequence
aaaaucuccgaguuauuuuc

SEQ ID NO: 23937 - RNA, 20 nt, Artificial Sequence
  TRAC targeting sequence
ccgaguuauuuucguggagu

SEQ ID NO: 23938 - RNA, 20 nt, Artificial Sequence
  TRAC targeting sequence
gaguuauuuucguggaguua

SEQ ID NO: 23939 - RNA, 20 nt, Artificial Sequence
  TRAC targeting sequence
gagauuuuggaagagacaua

SEQ ID NO: 23940 - RNA, 20 nt, Artificial Sequence
  TRAC targeting sequence
uggaguuauugguacagaaa

SEQ ID NO: 23941 - RNA, 20 nt, Artificial Sequence
  TRAC targeting sequence
acgaaaauaacucggagauu

SEQ ID NO: 23942 - RNA, 20 nt, Artificial Sequence
  TRAC targeting sequence
guaccaauaacuccacgaaa

SEQ ID NO: 23943 - RNA, 20 nt, Artificial Sequence
  TRAC targeting sequence
auuaccuuaaugauuugaag

SEQ ID NO: 23944 - RNA, 20 nt, Artificial Sequence
  TRAC targeting sequence
uuaagguaauagaaaauuaa

SEQ ID NO: 23945 - RNA, 20 nt, Artificial Sequence
  TRAC targeting sequence
aaucauuaagguaauagaaa

SEQ ID NO: 23946 - RNA, 20 nt, Artificial Sequence
  TRAC targeting sequence
ucaaaucauuaagguaauag

SEQ ID NO: 23947 - RNA, 20 nt, Artificial Sequence
  TRAC targeting sequence
guucuucaaaucauuaaggu

SEQ ID NO: 23948 - RNA, 20 nt, Artificial Sequence
  TRAC targeting sequence
uucuguucuucaaaucauua

SEQ ID NO: 23949 - RNA, 20 nt, Artificial Sequence
  TRAC targeting sequence
uugccuugucuuucuguucu

SEQ ID NO: 23950 - RNA, 20 nt, Artificial Sequence
  TRAC targeting sequence
uggucauugccuugucuuuc

SEQ ID NO: 23951 - RNA, 20 nt, Artificial Sequence
  TRAC targeting sequence
gugcuacugcucuuggucau

SEQ ID NO: 23952 - RNA, 20 nt, Artificial Sequence
  TRAC targeting sequence
ucagugcuacugcucuuggu

SEQ ID NO: 23953 - RNA, 20 nt, Artificial Sequence
  TRAC targeting sequence
uaauucaucagugcuacugc

SEQ ID NO: 23954 - RNA, 20 nt, Artificial Sequence
  TRAC targeting sequence
ucauaauucaucagugcuac

SEQ ID NO: 23955 - RNA, 20 nt, Artificial Sequence
  TRAC targeting sequence
gcaaaguaugcauuaauauc

SEQ ID NO: 23956 - RNA, 20 nt, Artificial Sequence
  TRAC targeting sequence
auuggucugcaaaguaugca

SEQ ID NO: 23957 - RNA, 20 nt, Artificial Sequence
  TRAC targeting sequence
gcaaaugucaauagcaguau

SEQ ID NO: 23958 - RNA, 20 nt, Artificial Sequence
  TRAC targeting sequence
auagcaguaugggagccugg

SEQ ID NO: 23959 - RNA, 20 nt, Artificial Sequence
  TRAC targeting sequence
cauacugcuauugacauuug

SEQ ID NO: 23960 - RNA, 20 nt, Artificial Sequence
  TRAC targeting sequence
ugguuggccaggcucccaua

SEQ ID NO: 23961 - RNA, 20 nt, Artificial Sequence
  TRAC targeting sequence
aaaccagucccauccaauuu

SEQ ID NO: 23962 - RNA, 20 nt, Artificial Sequence
  TRAC targeting sequence
cauccaauuucucuuccuaa

SEQ ID NO: 23963 - RNA, 20 nt, Artificial Sequence
  TRAC targeting sequence
aauuucucuuccuaaaauca

SEQ ID NO: 23964 - RNA, 20 nt, Artificial Sequence
  TRAC targeting sequence
cuuccuaaaaucaacauuau

SEQ ID NO: 23965 - RNA, 20 nt, Artificial Sequence
  TRAC targeting sequence
uccuaaaaucaacauuauag

SEQ ID NO: 23966 - RNA, 20 nt, Artificial Sequence
  TRAC targeting sequence
uaaaaucaacauuauaggac

SEQ ID NO: 23967 - RNA, 20 nt, Artificial Sequence
  TRAC targeting sequence
acauuauaggacaaggacua

SEQ ID NO: 23968 - RNA, 20 nt, Artificial Sequence
  TRAC targeting sequence
uauaauguugauuuuaggaa

SEQ ID NO: 23969 - RNA, 20 nt, Artificial Sequence
  TRAC targeting sequence
uuguccuauaauguugauuu

SEQ ID NO: 23970 - RNA, 20 nt, Artificial Sequence
  TRAC targeting sequence
uaguccuuguccuauaaugu

SEQ ID NO: 23971 - RNA, 20 nt, Artificial Sequence
  TRAC targeting sequence
ucacuuacauucuuuuaguc

SEQ ID NO: 23972 - RNA, 20 nt, Artificial Sequence
  TRAC targeting sequence
cuuacauucuuuuagucucc

SEQ ID NO: 23973 - RNA, 20 nt, Artificial Sequence
  TRAC targeting sequence
uuuagucuccuacuccucaa

SEQ ID NO: 23974 - RNA, 20 nt, Artificial Sequence
  TRAC targeting sequence
ccuacuccucaauuaaguaa

SEQ ID NO: 23975 - RNA, 20 nt, Artificial Sequence
  TRAC targeting sequence
uacuccucaauuaaguaaau

SEQ ID NO: 23976 - RNA, 20 nt, Artificial Sequence
  TRAC targeting sequence
ucaauuaaguaaaugagaau

SEQ ID NO: 23977 - RNA, 20 nt, Artificial Sequence
  TRAC targeting sequence
auuaaguaaaugagaaugau

SEQ ID NO: 23978 - RNA, 20 nt, Artificial Sequence
  TRAC targeting sequence
uuuacuuaauugaggaguag

SEQ ID NO: 23979 - RNA, 20 nt, Artificial Sequence
  TRAC targeting sequence
cauuuacuuaauugaggagu

SEQ ID NO: 23980 - RNA, 20 nt, Artificial Sequence
  TRAC targeting sequence
uucucauuuacuuaauugag

SEQ ID NO: 23981 - RNA, 20 nt, Artificial Sequence
  TRAC targeting sequence
gccaacaaaguucaugacaa

SEQ ID NO: 23982 - RNA, 20 nt, Artificial Sequence
  TRAC targeting sequence
ugacaacaaggugcaggaug

SEQ ID NO: 23983 - RNA, 20 nt, Artificial Sequence
  TRAC targeting sequence
ugaacuuuguuggcugaauc

SEQ ID NO: 23984 - RNA, 20 nt, Artificial Sequence
  TRAC targeting sequence
ugcaccuuguugucaugaac

SEQ ID NO: 23985 - RNA, 20 nt, Artificial Sequence
  TRAC targeting sequence
uugccagcaccauccugcac

SEQ ID NO: 23986 - RNA, 20 nt, Artificial Sequence
  TRAC targeting sequence
cuuugccagcaccauccugc

SEQ ID NO: 23987 - RNA, 20 nt, Artificial Sequence
  TRAC targeting sequence
gcaaaggcucgcucugggga

SEQ ID NO: 23988 - RNA, 20 nt, Artificial Sequence
  TRAC targeting sequence
cucuggggagaugccuugga

SEQ ID NO: 23989 - RNA, 20 nt, Artificial Sequence
  TRAC targeting sequence
ggggagaugccuuggaaauc

SEQ ID NO: 23990 - RNA, 20 nt, Artificial Sequence
  TRAC targeting sequence
ccagagcgagccuuugcuga

SEQ ID NO: 23991 - RNA, 20 nt, Artificial Sequence
  TRAC targeting sequence
ccccagagcgagccuuugcu

SEQ ID NO: 23992 - RNA, 20 nt, Artificial Sequence
  TRAC targeting sequence
aaggcaucuccccagagcga

SEQ ID NO: 23993 - RNA, 20 nt, Artificial Sequence
  TRAC targeting sequence
gcuuuguucuguggguugau

SEQ ID NO: 23994 - RNA, 20 nt, Artificial Sequence
  TRAC targeting sequence
guggguugaucuguauucuc

SEQ ID NO: 23995 - RNA, 20 nt, Artificial Sequence
  TRAC targeting sequence
acccacagaacaaagcggau

SEQ ID NO: 23996 - RNA, 20 nt, Artificial Sequence
  TRAC targeting sequence
guauucucaggcaaacugca

SEQ ID NO: 23997 - RNA, 20 nt, Artificial Sequence
  TRAC targeting sequence
caggcaaacugcacaagaag

SEQ ID NO: 23998 - RNA, 20 nt, Artificial Sequence
  TRAC targeting sequence
ggcaaacugcacaagaagca

SEQ ID NO: 23999 - RNA, 20 nt, Artificial Sequence
  TRAC targeting sequence
ugugcaguuugccugagaau

SEQ ID NO: 24000 - RNA, 20 nt, Artificial Sequence
  TRAC targeting sequence
uuuuuuuguguuuugcuucu

SEQ ID NO: 24001 - RNA, 20 nt, Artificial Sequence
  TRAC targeting sequence
auauaaucauuuuuuugugu

SEQ ID NO: 24002 - RNA, 20 nt, Artificial Sequence
  TRAC targeting sequence
guguucauuagcauauuuau

SEQ ID NO: 24003 - RNA, 20 nt, Artificial Sequence
  TRAC targeting sequence
gguaugucuguguucauuag

SEQ ID NO: 24004 - RNA, 20 nt, Artificial Sequence
  TRAC targeting sequence
ucggguaugucuguguucau

SEQ ID NO: 24005 - RNA, 20 nt, Artificial Sequence
  TRAC targeting sequence
acucuaacagaaaugaaugc

SEQ ID NO: 24006 - RNA, 20 nt, Artificial Sequence
  TRAC targeting sequence
aacagaaaugaaugcauaua

SEQ ID NO: 24007 - RNA, 20 nt, Artificial Sequence
  TRAC targeting sequence
guuagaguagaauuguuggg

SEQ ID NO: 24008 - RNA, 20 nt, Artificial Sequence
  TRAC targeting sequence
uuucuguuagaguagaauug

SEQ ID NO: 24009 - RNA, 20 nt, Artificial Sequence
  TRAC targeting sequence
aagggcauacacagaaauga

SEQ ID NO: 24010 - RNA, 20 nt, Artificial Sequence
  TRAC targeting sequence
guguaugcccuuugauguau

SEQ ID NO: 24011 - RNA, 20 nt, Artificial Sequence
  TRAC targeting sequence
gaauauauuaaaguaccccu

SEQ ID NO: 24012 - RNA, 20 nt, Artificial Sequence
  TRAC targeting sequence
gauauuaacccuuuaucaga

SEQ ID NO: 24013 - RNA, 20 nt, Artificial Sequence
  TRAC targeting sequence
gguuauuauuuuguuguuaa

SEQ ID NO: 24014 - RNA, 20 nt, Artificial Sequence
  TRAC targeting sequence
uuugcccauuuuaaaaucug

SEQ ID NO: 24015 - RNA, 20 nt, Artificial Sequence
  TRAC targeting sequence
aguccuuugcccauuuuaaa

SEQ ID NO: 24016 - RNA, 20 nt, Artificial Sequence
  TRAC targeting sequence
auucaaguccuuugcccauu

SEQ ID NO: 24017 - RNA, 20 nt, Artificial Sequence
  TRAC targeting sequence
ccaaagaagauauaggaaug

SEQ ID NO: 24018 - RNA, 20 nt, Artificial Sequence
  TRAC targeting sequence
uuggggaaaugucuauucaa

SEQ ID NO: 24019 - RNA, 20 nt, Artificial Sequence
  TRAC targeting sequence
ucuuuggggaaaugucuauu

SEQ ID NO: 24020 - RNA, 20 nt, Artificial Sequence
  TRAC targeting sequence
uauaucuucuuuggggaaau

SEQ ID NO: 24021 - RNA, 20 nt, Artificial Sequence
  TRAC targeting sequence
cacuggcuacccuauuugau

SEQ ID NO: 24022 - RNA, 20 nt, Artificial Sequence
  TRAC targeting sequence
ucaaaaaaauuaaaaacaga

SEQ ID NO: 24023 - RNA, 20 nt, Artificial Sequence
  TRAC targeting sequence
aaaaaauuaaaaacagaauu

SEQ ID NO: 24024 - RNA, 20 nt, Artificial Sequence
  TRAC targeting sequence
guuuuuaauuuuuuugagga

SEQ ID NO: 24025 - RNA, 20 nt, Artificial Sequence
  TRAC targeting sequence
uauaauccagcaauuccacu

SEQ ID NO: 24026 - RNA, 20 nt, Artificial Sequence
  TRAC targeting sequence
agcaauuccacuucugggua

SEQ ID NO: 24027 - RNA, 20 nt, Artificial Sequence
  TRAC targeting sequence
acuucuggguacauauccaa

SEQ ID NO: 24028 - RNA, 20 nt, Artificial Sequence
  TRAC targeting sequence
ggguacauauccaaaagaag

SEQ ID NO: 24029 - RNA, 20 nt, Artificial Sequence
  TRAC targeting sequence
aaaagaagugaaagcaggau

SEQ ID NO: 24030 - RNA, 20 nt, Artificial Sequence
  TRAC targeting sequence
uuuggauauguacccagaag

SEQ ID NO: 24031 - RNA, 20 nt, Artificial Sequence
  TRAC targeting sequence
cuucuuuuggauauguaccc

SEQ ID NO: 24032 - RNA, 20 nt, Artificial Sequence
  TRAC targeting sequence
ugcuuucacuucuuuuggau

SEQ ID NO: 24033 - RNA, 20 nt, Artificial Sequence
  TRAC targeting sequence
cggccaggcacagugguuca

SEQ ID NO: 24034 - RNA, 20 nt, Artificial Sequence
  TRAC targeting sequence
gccaggcacagugguucaca

SEQ ID NO: 24035 - RNA, 20 nt, Artificial Sequence
  TRAC targeting sequence
cgaacuccugaccucgggug

SEQ ID NO: 24036 - RNA, 20 nt, Artificial Sequence
  TRAC targeting sequence
ccauguuggccaggcugguc

SEQ ID NO: 24037 - RNA, 20 nt, Artificial Sequence
  TRAC targeting sequence
cuacuaaaaauacaaaaauu

SEQ ID NO: 24038 - RNA, 20 nt, Artificial Sequence
  TRAC targeting sequence
acuaaaaauacaaaaauuag

SEQ ID NO: 24039 - RNA, 20 nt, Artificial Sequence
  TRAC targeting sequence
cagcuacuagggaagcugag

SEQ ID NO: 24040 - RNA, 20 nt, Artificial Sequence
  TRAC targeting sequence
uggcuuaugucacuuaaaau

SEQ ID NO: 24041 - RNA, 20 nt, Artificial Sequence
  TRAC targeting sequence
cuuugucauggcuuauguca

SEQ ID NO: 24042 - RNA, 20 nt, Artificial Sequence
  TRAC targeting sequence
cuuauaugacaucaagagua

SEQ ID NO: 24043 - RNA, 20 nt, Artificial Sequence
  TRAC targeting sequence
uauaagugaaaccacauggu

SEQ ID NO: 24044 - RNA, 20 nt, Artificial Sequence
  TRAC targeting sequence
agaguagucaaacuccuaga

SEQ ID NO: 24045 - RNA, 20 nt, Artificial Sequence
  TRAC targeting sequence
ugaugucauauaagugaaac

SEQ ID NO: 24046 - RNA, 20 nt, Artificial Sequence
  TRAC targeting sequence
aacuccuagaaacagaaagu

SEQ ID NO: 24047 - RNA, 20 nt, Artificial Sequence
  TRAC targeting sequence
uagaaacagaaaguggaaug

SEQ ID NO: 24048 - RNA, 20 nt, Artificial Sequence
  TRAC targeting sequence
aggaguuugacuacucuuga

SEQ ID NO: 24049 - RNA, 20 nt, Artificial Sequence
  TRAC targeting sequence
guuucuaggaguuugacuac

SEQ ID NO: 24050 - RNA, 20 nt, Artificial Sequence
  TRAC targeting sequence
acuuucuguuucuaggaguu

SEQ ID NO: 24051 - RNA, 20 nt, Artificial Sequence
  TRAC targeting sequence
accauuccacuuucuguuuc

SEQ ID NO: 24052 - RNA, 20 nt, Artificial Sequence
  TRAC targeting sequence
cuggcaucuaccauuccacu

SEQ ID NO: 24053 - RNA, 20 nt, Artificial Sequence
  TRAC targeting sequence
gucccuggcaucuaccauuc

SEQ ID NO: 24054 - RNA, 20 nt, Artificial Sequence
  TRAC targeting sequence
ugcccaggcuggagugcagu

SEQ ID NO: 24055 - RNA, 20 nt, Artificial Sequence
  TRAC targeting sequence
cuugcccaggcuggagugca

SEQ ID NO: 24056 - RNA, 20 nt, Artificial Sequence
  TRAC targeting sequence
cucuugcccaggcuggagug

SEQ ID NO: 24057 - RNA, 20 nt, Artificial Sequence
  TRAC targeting sequence
gucucaaaacaaaacaaaac

SEQ ID NO: 24058 - RNA, 20 nt, Artificial Sequence
  TRAC targeting sequence
caaaacaaaacaaaacaaaa

SEQ ID NO: 24059 - RNA, 20 nt, Artificial Sequence
  TRAC targeting sequence
aaacaaaacaaaacaaaaaa

SEQ ID NO: 24060 - RNA, 20 nt, Artificial Sequence
  TRAC targeting sequence
uauagcauauacuuuuuugu

SEQ ID NO: 24061 - RNA, 20 nt, Artificial Sequence
  TRAC targeting sequence
auguacaaaaagcuuaaaac

SEQ ID NO: 24062 - RNA, 20 nt, Artificial Sequence
  TRAC targeting sequence
ugaucuggauagugguuaga

SEQ ID NO: 24063 - RNA, 20 nt, Artificial Sequence
  TRAC targeting sequence
agaugcaggacauuaccagc

SEQ ID NO: 24064 - RNA, 20 nt, Artificial Sequence
  TRAC targeting sequence
ggauagugguuagacaggua

SEQ ID NO: 24065 - RNA, 20 nt, Artificial Sequence
  TRAC targeting sequence
agaucaagaugcaggacauu

SEQ ID NO: 24066 - RNA, 20 nt, Artificial Sequence
  TRAC targeting sequence
aaccacuauccagaucaaga

SEQ ID NO: 24067 - RNA, 20 nt, Artificial Sequence
  TRAC targeting sequence
aguuguacaauuaaauuucg

SEQ ID NO: 24068 - RNA, 20 nt, Artificial Sequence
  TRAC targeting sequence
cacucuguuaaaggaaaaaa

SEQ ID NO: 24069 - RNA, 20 nt, Artificial Sequence
  TRAC targeting sequence
guuaaaggaaaaaaaauauu

SEQ ID NO: 24070 - RNA, 20 nt, Artificial Sequence
  TRAC targeting sequence
uuuaacagagugcgaaauuu

SEQ ID NO: 24071 - RNA, 20 nt, Artificial Sequence
  TRAC targeting sequence
cagaguuacacugaaaccua

SEQ ID NO: 24072 - RNA, 20 nt, Artificial Sequence
  TRAC targeting sequence
gaguuacacugaaaccuaga

SEQ ID NO: 24073 - RNA, 20 nt, Artificial Sequence
  TRAC targeting sequence
gagaaguaauauuuuuuuuc

SEQ ID NO: 24074 - RNA, 20 nt, Artificial Sequence
  TRAC targeting sequence
guguaacucugagaaguaau

SEQ ID NO: 24075 - RNA, 20 nt, Artificial Sequence
  TRAC targeting sequence
agguuucaguguaacucuga

SEQ ID NO: 24076 - RNA, 20 nt, Artificial Sequence
  TRAC targeting sequence
caaagaaaaaaauauauaac

SEQ ID NO: 24077 - RNA, 20 nt, Artificial Sequence
  TRAC targeting sequence
aagaaaaaaauauauaacca

SEQ ID NO: 24078 - RNA, 20 nt, Artificial Sequence
  TRAC targeting sequence
uugagaaagccucuagguuu

SEQ ID NO: 24079 - RNA, 20 nt, Artificial Sequence
  TRAC targeting sequence
cuuaucugcugauuuaaagg

SEQ ID NO: 24080 - RNA, 20 nt, Artificial Sequence
  TRAC targeting sequence
uaucugcugauuuaaagguu

SEQ ID NO: 24081 - RNA, 20 nt, Artificial Sequence
  TRAC targeting sequence
gcugauuuaaagguuucuaa

SEQ ID NO: 24082 - RNA, 20 nt, Artificial Sequence
  TRAC targeting sequence
gcagauaagagagcuuugug

SEQ ID NO: 24083 - RNA, 20 nt, Artificial Sequence
  TRAC targeting sequence
aauuauaccuagauggggau

SEQ ID NO: 24084 - RNA, 20 nt, Artificial Sequence
  TRAC targeting sequence
agguauaauuagaaaccuuu

SEQ ID NO: 24085 - RNA, 20 nt, Artificial Sequence
  TRAC targeting sequence
ccaucuagguauaauuagaa

SEQ ID NO: 24086 - RNA, 20 nt, Artificial Sequence
  TRAC targeting sequence
agugcauccccaucuaggua

SEQ ID NO: 24087 - RNA, 20 nt, Artificial Sequence
  TRAC targeting sequence
gggcugaaugauaaaaaguu

SEQ ID NO: 24088 - RNA, 20 nt, Artificial Sequence
  TRAC targeting sequence
gcccggacccuuuguuguug

SEQ ID NO: 24089 - RNA, 20 nt, Artificial Sequence
  TRAC targeting sequence
uucagcccggacccuuuguu

SEQ ID NO: 24090 - RNA, 20 nt, Artificial Sequence
  TRAC targeting sequence
cauuuuuauaacuuuuuauc

SEQ ID NO: 24091 - RNA, 20 nt, Artificial Sequence
  TRAC targeting sequence
aauagaauauucauuuaaug

SEQ ID NO: 24092 - RNA, 20 nt, Artificial Sequence
  TRAC targeting sequence
caguucucgauaaacuaucu

SEQ ID NO: 24093 - RNA, 20 nt, Artificial Sequence
  TRAC targeting sequence
cgauaaacuaucuuugaucu

SEQ ID NO: 24094 - RNA, 20 nt, Artificial Sequence
  TRAC targeting sequence
auaaacuaucuuugaucucg

SEQ ID NO: 24095 - RNA, 20 nt, Artificial Sequence
  TRAC targeting sequence
agaacugugagguucucaag

SEQ ID NO: 24096 - RNA, 20 nt, Artificial Sequence
  TRAC targeting sequence
uugaucucgaaguucuagca

SEQ ID NO: 24097 - RNA, 20 nt, Artificial Sequence
  TRAC targeting sequence
aagauaguuuaucgagaacu

SEQ ID NO: 24098 - RNA, 20 nt, Artificial Sequence
  TRAC targeting sequence
cgaaguucuagcagcugcuu

SEQ ID NO: 24099 - RNA, 20 nt, Artificial Sequence
  TRAC targeting sequence
aaguucuagcagcugcuuau

SEQ ID NO: 24100 - RNA, 20 nt, Artificial Sequence
  TRAC targeting sequence
agaucaaagauaguuuaucg

SEQ ID NO: 24101 - RNA, 20 nt, Artificial Sequence
  TRAC targeting sequence
agcagcugcuuauuugucuc

SEQ ID NO: 24102 - RNA, 20 nt, Artificial Sequence
  TRAC targeting sequence
caaaaaaggcagaagaccua

SEQ ID NO: 24103 - RNA, 20 nt, Artificial Sequence
  TRAC targeting sequence
aaaaaggcagaagaccuaag

SEQ ID NO: 24104 - RNA, 20 nt, Artificial Sequence
  TRAC targeting sequence
gccuuuuuugagacaaauaa

SEQ ID NO: 24105 - RNA, 20 nt, Artificial Sequence
  TRAC targeting sequence
ucugccuuuuuugagacaaa

SEQ ID NO: 24106 - RNA, 20 nt, Artificial Sequence
  TRAC targeting sequence
uaggucuucugccuuuuuug

SEQ ID NO: 24107 - RNA, 20 nt, Artificial Sequence
  TRAC targeting sequence
cuuaggucuucugccuuuuu

SEQ ID NO: 24108 - RNA, 20 nt, Artificial Sequence
  TRAC targeting sequence
cucuuaggucuucugccuuu

SEQ ID NO: 24109 - RNA, 20 nt, Artificial Sequence
  TRAC targeting sequence
ugagaacucuccacugccac

SEQ ID NO: 24110 - RNA, 20 nt, Artificial Sequence
  TRAC targeting sequence
ugaguuaucucucuuagguc

SEQ ID NO: 24111 - RNA, 20 nt, Artificial Sequence
  TRAC targeting sequence
caugaguuaucucucuuagg

SEQ ID NO: 24112 - RNA, 20 nt, Artificial Sequence
  TRAC targeting sequence
ccacugccacacuccauccc

SEQ ID NO: 24113 - RNA, 20 nt, Artificial Sequence
  TRAC targeting sequence
acugccacacuccauccccu

SEQ ID NO: 24114 - RNA, 20 nt, Artificial Sequence
  TRAC targeting sequence
auccccuugaagauucuaac

SEQ ID NO: 24115 - RNA, 20 nt, Artificial Sequence
  TRAC targeting sequence
ccuugaagauucuaacaguc

SEQ ID NO: 24116 - RNA, 20 nt, Artificial Sequence
  TRAC targeting sequence
aggggauggaguguggcagu

SEQ ID NO: 24117 - RNA, 20 nt, Artificial Sequence
  TRAC targeting sequence
ucaaggggauggaguguggc

SEQ ID NO: 24118 - RNA, 20 nt, Artificial Sequence
  TRAC targeting sequence
aacagucaccauugacaaaa

SEQ ID NO: 24119 - RNA, 20 nt, Artificial Sequence
  TRAC targeting sequence
ccauugacaaaaaaaaaaaa

SEQ ID NO: 24120 - RNA, 20 nt, Artificial Sequence
  TRAC targeting sequence
auggugacuguuagaaucuu

SEQ ID NO: 24121 - RNA, 20 nt, Artificial Sequence
  TRAC targeting sequence
aggaauacacucuuccgaag

SEQ ID NO: 24122 - RNA, 20 nt, Artificial Sequence
  TRAC targeting sequence
uggaacugccuguuuuuuuu

SEQ ID NO: 24123 - RNA, 20 nt, Artificial Sequence
  TRAC targeting sequence
uccgaaguaucuuuaugccu

SEQ ID NO: 24124 - RNA, 20 nt, Artificial Sequence
  TRAC targeting sequence
gaaguaucuuuaugccugug

SEQ ID NO: 24125 - RNA, 20 nt, Artificial Sequence
  TRAC targeting sequence
gaagaguguauuccuggaac

SEQ ID NO: 24126 - RNA, 20 nt, Artificial Sequence
  TRAC targeting sequence
uuaugccugugauaaauuau

SEQ ID NO: 24127 - RNA, 20 nt, Artificial Sequence
  TRAC targeting sequence
caggcauaaagauacuucgg

SEQ ID NO: 24128 - RNA, 20 nt, Artificial Sequence
  TRAC targeting sequence
uaagcaauguaauaauuuau

SEQ ID NO: 24129 - RNA, 20 nt, Artificial Sequence
  TRAC targeting sequence
cuucaggcuagcaucauccc

SEQ ID NO: 24130 - RNA, 20 nt, Artificial Sequence
  TRAC targeting sequence
ggcuagcaucaucccaucau

SEQ ID NO: 24131 - RNA, 20 nt, Artificial Sequence
  TRAC targeting sequence
ucccaucauuaacuaagaaa

SEQ ID NO: 24132 - RNA, 20 nt, Artificial Sequence
  TRAC targeting sequence
caucauuaacuaagaaaaag

SEQ ID NO: 24133 - RNA, 20 nt, Artificial Sequence
  TRAC targeting sequence
uuaacuaagaaaaagcaaca

SEQ ID NO: 24134 - RNA, 20 nt, Artificial Sequence
  TRAC targeting sequence
uaguuaaugaugggaugaug

SEQ ID NO: 24135 - RNA, 20 nt, Artificial Sequence
  TRAC targeting sequence
aauccaaaggccagaaaacu

SEQ ID NO: 24136 - RNA, 20 nt, Artificial Sequence
  TRAC targeting sequence
aaaggccagaaaacuaucag

SEQ ID NO: 24137 - RNA, 20 nt, Artificial Sequence
  TRAC targeting sequence
ggccuuuggauuagauuugu

SEQ ID NO: 24138 - RNA, 20 nt, Artificial Sequence
  TRAC targeting sequence
gacuaguucuccagagccug

SEQ ID NO: 24139 - RNA, 20 nt, Artificial Sequence
  TRAC targeting sequence
gauaguuuucuggccuuugg

SEQ ID NO: 24140 - RNA, 20 nt, Artificial Sequence
  TRAC targeting sequence
ccagagccugucaccauggc

SEQ ID NO: 24141 - RNA, 20 nt, Artificial Sequence
  TRAC targeting sequence
agagccugucaccauggcaa

SEQ ID NO: 24142 - RNA, 20 nt, Artificial Sequence
  TRAC targeting sequence
ggagaacuagucugauaguu

SEQ ID NO: 24143 - RNA, 20 nt, Artificial Sequence
  TRAC targeting sequence
ccauggcaacaguuuucauu

SEQ ID NO: 24144 - RNA, 20 nt, Artificial Sequence
  TRAC targeting sequence
uuaugcuuaaacauguaaac

SEQ ID NO: 24145 - RNA, 20 nt, Artificial Sequence
  TRAC targeting sequence
augguguuuacauguuuaag

SEQ ID NO: 24146 - RNA, 20 nt, Artificial Sequence
  TRAC targeting sequence
auggugcuuccaugguguuu

SEQ ID NO: 24147 - RNA, 20 nt, Artificial Sequence
  TRAC targeting sequence
uuucagguauccagacccuu

SEQ ID NO: 24148 - RNA, 20 nt, Artificial Sequence
  TRAC targeting sequence
gguauccagacccuuaaaaa

SEQ ID NO: 24149 - RNA, 20 nt, Artificial Sequence
  TRAC targeting sequence
agacccuuaaaaauauuaaa

SEQ ID NO: 24150 - RNA, 20 nt, Artificial Sequence
  TRAC targeting sequence
ggauaccugaaaggaucaau

SEQ ID NO: 24151 - RNA, 20 nt, Artificial Sequence
  TRAC targeting sequence
uuaauauuuuuaagggucug

SEQ ID NO: 24152 - RNA, 20 nt, Artificial Sequence
  TRAC targeting sequence
uugucuuuaauauuuuuaag

SEQ ID NO: 24153 - RNA, 20 nt, Artificial Sequence
  TRAC targeting sequence
gucauugucuuuaauauuuu

SEQ ID NO: 24154 - RNA, 20 nt, Artificial Sequence
  TRAC targeting sequence
acagcagggguuuacacugg

SEQ ID NO: 24155 - RNA, 20 nt, Artificial Sequence
  TRAC targeting sequence
guacuuucuacagcaggggu

SEQ ID NO: 24156 - RNA, 20 nt, Artificial Sequence
  TRAC targeting sequence
uucauccacuugggagagca

SEQ ID NO: 24157 - RNA, 20 nt, Artificial Sequence
  TRAC targeting sequence
uccacuugggagagcaacua

SEQ ID NO: 24158 - RNA, 20 nt, Artificial Sequence
  TRAC targeting sequence
acuugggagagcaacuagca

SEQ ID NO: 24159 - RNA, 20 nt, Artificial Sequence
  TRAC targeting sequence
caaguggaugaaugaaucug

SEQ ID NO: 24160 - RNA, 20 nt, Artificial Sequence
  TRAC targeting sequence
cccaaguggaugaaugaauc

SEQ ID NO: 24161 - RNA, 20 nt, Artificial Sequence
  TRAC targeting sequence
auuaauauuuaaaaugauuu

SEQ ID NO: 24162 - RNA, 20 nt, Artificial Sequence
  TRAC targeting sequence
uuuuaaauauuaauggauau

SEQ ID NO: 24163 - RNA, 20 nt, Artificial Sequence
  TRAC targeting sequence
aaagguaaaaucauuuuaaa

SEQ ID NO: 24164 - RNA, 20 nt, Artificial Sequence
  TRAC targeting sequence
uuugucaaaagguaaaauca

SEQ ID NO: 24165 - RNA, 20 nt, Artificial Sequence
  TRAC targeting sequence
uacagaacaaagacauucug

SEQ ID NO: 24166 - RNA, 20 nt, Artificial Sequence
  TRAC targeting sequence
guaagauaaauuccuuuguc

SEQ ID NO: 24167 - RNA, 20 nt, Artificial Sequence
  TRAC targeting sequence
uuguucuguaagauaaauuc

SEQ ID NO: 24168 - RNA, 20 nt, Artificial Sequence
  TRAC targeting sequence
gaaaguauguuuguaaaguu

SEQ ID NO: 24169 - RNA, 20 nt, Artificial Sequence
  TRAC targeting sequence
gaaugucuuuguucuguaag

SEQ ID NO: 24170 - RNA, 20 nt, Artificial Sequence
  TRAC targeting sequence
acuuuacaaacauacuuuca

SEQ ID NO: 24171 - RNA, 20 nt, Artificial Sequence
  TRAC targeting sequence
aaacaucaaggggauuaaac

SEQ ID NO: 24172 - RNA, 20 nt, Artificial Sequence
  TRAC targeting sequence
aggggauuaaacuauacaac

SEQ ID NO: 24173 - RNA, 20 nt, Artificial Sequence
  TRAC targeting sequence
ccuugauguuuagacuguuu

SEQ ID NO: 24174 - RNA, 20 nt, Artificial Sequence
  TRAC targeting sequence
uugcaugucaguuguauagu

SEQ ID NO: 24175 - RNA, 20 nt, Artificial Sequence
  TRAC targeting sequence
caugcaauuauucaaaagaa

SEQ ID NO: 24176 - RNA, 20 nt, Artificial Sequence
  TRAC targeting sequence
aaagaauaagguaaauucuc

SEQ ID NO: 24177 - RNA, 20 nt, Artificial Sequence
  TRAC targeting sequence
uuugaauaauugcaugggau

SEQ ID NO: 24178 - RNA, 20 nt, Artificial Sequence
  TRAC targeting sequence
cuguacauugacagcaaaca

SEQ ID NO: 24179 - RNA, 20 nt, Artificial Sequence
  TRAC targeting sequence
guacauugacagcaaacaua

SEQ ID NO: 24180 - RNA, 20 nt, Artificial Sequence
  TRAC targeting sequence
auguacagagaauuuaccuu

SEQ ID NO: 24181 - RNA, 20 nt, Artificial Sequence
  TRAC targeting sequence
aagacuuauuaagugaaaaa

SEQ ID NO: 24182 - RNA, 20 nt, Artificial Sequence
  TRAC targeting sequence
uagauauguuugcugucaau

SEQ ID NO: 24183 - RNA, 20 nt, Artificial Sequence
  TRAC targeting sequence
acaccguguucuuuacucca

SEQ ID NO: 24184 - RNA, 20 nt, Artificial Sequence
  TRAC targeting sequence
aaacucaacaccguguucuu

SEQ ID NO: 24185 - RNA, 20 nt, Artificial Sequence
  TRAC targeting sequence
ucaaaacucaacaccguguu

SEQ ID NO: 24186 - RNA, 20 nt, Artificial Sequence
  TRAC targeting sequence
uauuuccucaaaacucaaca

SEQ ID NO: 24187 - RNA, 20 nt, Artificial Sequence
  TRAC targeting sequence
cucauauuuccucaaaacuc

SEQ ID NO: 24188 - RNA, 20 nt, Artificial Sequence
  TRAC targeting sequence
uuuuuucccucauauuuccu

SEQ ID NO: 24189 - RNA, 20 nt, Artificial Sequence
  TRAC targeting sequence
augaagguggauaagguaau

SEQ ID NO: 24190 - RNA, 20 nt, Artificial Sequence
  TRAC targeting sequence
uggauaauuuuucuuuuuuu

SEQ ID NO: 24191 - RNA, 20 nt, Artificial Sequence
  TRAC targeting sequence
accuucauggauaauuuuuc

SEQ ID NO: 24192 - RNA, 20 nt, Artificial Sequence
  TRAC targeting sequence
auuuauuaccuuauccaccu

SEQ ID NO: 24193 - RNA, 20 nt, Artificial Sequence
  TRAC targeting sequence
ccaagcauggccacccccua

SEQ ID NO: 24194 - RNA, 20 nt, Artificial Sequence
  TRAC targeting sequence
cgugggaagcuuuccaaagu

SEQ ID NO: 24195 - RNA, 20 nt, Artificial Sequence
  TRAC targeting sequence
cacgugauuaguacgccucc

SEQ ID NO: 24196 - RNA, 20 nt, Artificial Sequence
  TRAC targeting sequence
aaaguauacucaccacuuac

SEQ ID NO: 24197 - RNA, 20 nt, Artificial Sequence
  TRAC targeting sequence
ccacuuacagaaucugguaa

SEQ ID NO: 24198 - RNA, 20 nt, Artificial Sequence
  TRAC targeting sequence
guaaguggugaguauacuuu

SEQ ID NO: 24199 - RNA, 20 nt, Artificial Sequence
  TRAC targeting sequence
gguaagccaccuccagaugg

SEQ ID NO: 24200 - RNA, 20 nt, Artificial Sequence
  TRAC targeting sequence
agauggagaauuaucaacuu

SEQ ID NO: 24201 - RNA, 20 nt, Artificial Sequence
  TRAC targeting sequence
aaaugcuccacuaccaauga

SEQ ID NO: 24202 - RNA, 20 nt, Artificial Sequence
  TRAC targeting sequence
acuaccaaugauccuucagu

SEQ ID NO: 24203 - RNA, 20 nt, Artificial Sequence
  TRAC targeting sequence
uugguaguggagcauuuuga

SEQ ID NO: 24204 - RNA, 20 nt, Artificial Sequence
  TRAC targeting sequence
uucagucucucccugggcac

SEQ ID NO: 24205 - RNA, 20 nt, Artificial Sequence
  TRAC targeting sequence
gucucucccugggcacuucc

SEQ ID NO: 24206 - RNA, 20 nt, Artificial Sequence
  TRAC targeting sequence
cucccugggcacuuccaaag

SEQ ID NO: 24207 - RNA, 20 nt, Artificial Sequence
  TRAC targeting sequence
cccugggcacuuccaaagau

SEQ ID NO: 24208 - RNA, 20 nt, Artificial Sequence
  TRAC targeting sequence
cugggcacuuccaaagaugg

SEQ ID NO: 24209 - RNA, 20 nt, Artificial Sequence
  TRAC targeting sequence
aaagauggaaauuuacuacc

SEQ ID NO: 24210 - RNA, 20 nt, Artificial Sequence
  TRAC targeting sequence
uuggaagugcccagggagag

SEQ ID NO: 24211 - RNA, 20 nt, Artificial Sequence
  TRAC targeting sequence
aucuuuggaagugcccaggg

SEQ ID NO: 24212 - RNA, 20 nt, Artificial Sequence
  TRAC targeting sequence
ucaagcagucuguuccauuu

SEQ ID NO: 24213 - RNA, 20 nt, Artificial Sequence
  TRAC targeting sequence
agcagucuguuccauuuuag

SEQ ID NO: 24214 - RNA, 20 nt, Artificial Sequence
  TRAC targeting sequence
guuccauuuuagcaauucug

SEQ ID NO: 24215 - RNA, 20 nt, Artificial Sequence
  TRAC targeting sequence
auuuuagcaauucugauuua

SEQ ID NO: 24216 - RNA, 20 nt, Artificial Sequence
  TRAC targeting sequence
gauuuacucuauccccuuaa

SEQ ID NO: 24217 - RNA, 20 nt, Artificial Sequence
  TRAC targeting sequence
gaauugcuaaaauggaacag

SEQ ID NO: 24218 - RNA, 20 nt, Artificial Sequence
  TRAC targeting sequence
auccccuuaaauguccauuu

SEQ ID NO: 24219 - RNA, 20 nt, Artificial Sequence
  TRAC targeting sequence
ccuuaaauguccauuuauuc

SEQ ID NO: 24220 - RNA, 20 nt, Artificial Sequence
  TRAC targeting sequence
auuuauuccauaaaauauuu

SEQ ID NO: 24221 - RNA, 20 nt, Artificial Sequence
  TRAC targeting sequence
auaaaauauuuacuaaacau

SEQ ID NO: 24222 - RNA, 20 nt, Artificial Sequence
  TRAC targeting sequence
acuacaugacaagcaucauu

SEQ ID NO: 24223 - RNA, 20 nt, Artificial Sequence
  TRAC targeting sequence
uguaguagauguuuaguaaa

SEQ ID NO: 24224 - RNA, 20 nt, Artificial Sequence
  TRAC targeting sequence
uuucaggugcuaggaauaug

SEQ ID NO: 24225 - RNA, 20 nt, Artificial Sequence
  TRAC targeting sequence
ggugcuaggaauauggcaca

SEQ ID NO: 24226 - RNA, 20 nt, Artificial Sequence
  TRAC targeting sequence
uagcaccugaaaugaugcuu

SEQ ID NO: 24227 - RNA, 20 nt, Artificial Sequence
  TRAC targeting sequence
gugccauauuccuagcaccu

SEQ ID NO: 24228 - RNA, 20 nt, Artificial Sequence
  TRAC targeting sequence
ggcucucaaggaacuuacac

SEQ ID NO: 24229 - RNA, 20 nt, Artificial Sequence
  TRAC targeting sequence
caaggaacuuacacuccuau

SEQ ID NO: 24230 - RNA, 20 nt, Artificial Sequence
  TRAC targeting sequence
aggaacuuacacuccuaugg

SEQ ID NO: 24231 - RNA, 20 nt, Artificial Sequence
  TRAC targeting sequence
uugagagccagacuguuuug

SEQ ID NO: 24232 - RNA, 20 nt, Artificial Sequence
  TRAC targeting sequence
uauggagagaaacauauaau

SEQ ID NO: 24233 - RNA, 20 nt, Artificial Sequence
  TRAC targeting sequence
auaggaguguaaguuccuug

SEQ ID NO: 24234 - RNA, 20 nt, Artificial Sequence
  TRAC targeting sequence
ccauaggaguguaaguuccu

SEQ ID NO: 24235 - RNA, 20 nt, Artificial Sequence
  TRAC targeting sequence
cuccauaggaguguaaguuc

SEQ ID NO: 24236 - RNA, 20 nt, Artificial Sequence
  TRAC targeting sequence
uaaauagcaagcucuuaaag

SEQ ID NO: 24237 - RNA, 20 nt, Artificial Sequence
  TRAC targeting sequence
aauauuggucuuaaauagca

SEQ ID NO: 24238 - RNA, 20 nt, Artificial Sequence
  TRAC targeting sequence
uucaaauauuggucuuaaau

SEQ ID NO: 24239 - RNA, 20 nt, Artificial Sequence
  TRAC targeting sequence
uuaucuuucaaauauugguc

SEQ ID NO: 24240 - RNA, 20 nt, Artificial Sequence
  TRAC targeting sequence
gggggcagagcauucuagac

SEQ ID NO: 24241 - RNA, 20 nt, Artificial Sequence
  TRAC targeting sequence
gcccccagauuuuuacaugg

SEQ ID NO: 24242 - RNA, 20 nt, Artificial Sequence
  TRAC targeting sequence
agacaguaagaacaaucuug

SEQ ID NO: 24243 - RNA, 20 nt, Artificial Sequence
  TRAC targeting sequence
agaaugcucugcccccagau

SEQ ID NO: 24244 - RNA, 20 nt, Artificial Sequence
  TRAC targeting sequence
uacugucuagaaugcucugc

SEQ ID NO: 24245 - RNA, 20 nt, Artificial Sequence
  TRAC targeting sequence
aucucaaaaaaaaaaaaaaa

SEQ ID NO: 24246 - RNA, 20 nt, Artificial Sequence
  TRAC targeting sequence
caaaaaaaaaaaaaaaaaaa

SEQ ID NO: 24247 - RNA, 20 nt, Artificial Sequence
  TRAC targeting sequence
aaaaaaaaaaaaaaaaaaaa

SEQ ID NO: 24248 - RNA, 20 nt, Artificial Sequence
  TRAC targeting sequence
aggacagaccaacaagacua

SEQ ID NO: 24249 - RNA, 20 nt, Artificial Sequence
  TRAC targeting sequence
uugauuuuuuuuuuuuuuuu

SEQ ID NO: 24250 - RNA, 20 nt, Artificial Sequence
  TRAC targeting sequence
guccuugauuuuuuuuuuuu

SEQ ID NO: 24251 - RNA, 20 nt, Artificial Sequence
  TRAC targeting sequence
uguuggucuguccuugauuu

SEQ ID NO: 24252 - RNA, 20 nt, Artificial Sequence
  TRAC targeting sequence
cuauagucuuguuggucugu

SEQ ID NO: 24253 - RNA, 20 nt, Artificial Sequence
  TRAC targeting sequence
aggggaaggacacaagggcc

SEQ ID NO: 24254 - RNA, 20 nt, Artificial Sequence
  TRAC targeting sequence
ccuugaucacuauagucuug

SEQ ID NO: 24255 - RNA, 20 nt, Artificial Sequence
  TRAC targeting sequence
uuccccuugaucacuauagu

SEQ ID NO: 24256 - RNA, 20 nt, Artificial Sequence
  TRAC targeting sequence
auuuuuacuaccauuccccu

SEQ ID NO: 24257 - RNA, 20 nt, Artificial Sequence
  TRAC targeting sequence
guccauuuuuacuaccauuc

SEQ ID NO: 24258 - RNA, 20 nt, Artificial Sequence
  TRAC targeting sequence
uuauuucuguccauuuuuac

SEQ ID NO: 24259 - RNA, 20 nt, Artificial Sequence
  TRAC targeting sequence
aaaauauagccuguaugucu

SEQ ID NO: 24260 - RNA, 20 nt, Artificial Sequence
  TRAC targeting sequence
ccaaaauauagccuguaugu

SEQ ID NO: 24261 - RNA, 20 nt, Artificial Sequence
  TRAC targeting sequence
ucuccaaaauauagccugua

SEQ ID NO: 24262 - RNA, 20 nt, Artificial Sequence
  TRAC targeting sequence
gucuucuccaaaauauagcc

SEQ ID NO: 24263 - RNA, 20 nt, Artificial Sequence
  TRAC targeting sequence
gcaagcucugucuucuccaa

SEQ ID NO: 24264 - RNA, 20 nt, Artificial Sequence
  TRAC targeting sequence
ucagcaagcucugucuucuc

SEQ ID NO: 24265 - RNA, 20 nt, Artificial Sequence
  TRAC targeting sequence
guuucaucagcaagcucugu

SEQ ID NO: 24266 - RNA, 20 nt, Artificial Sequence
  TRAC targeting sequence
ugcaucuguuucaucagcaa

SEQ ID NO: 24267 - RNA, 20 nt, Artificial Sequence
  TRAC targeting sequence
ccugcaucuguuucaucagc

SEQ ID NO: 24268 - RNA, 20 nt, Artificial Sequence
  TRAC targeting sequence
uaucuccugcaucuguuuca

SEQ ID NO: 24269 - RNA, 20 nt, Artificial Sequence
  TRAC targeting sequence
cuuaucuccugcaucuguuu

SEQ ID NO: 24270 - RNA, 20 nt, Artificial Sequence
  TRAC targeting sequence
agggaccccggaaacuuaaa

SEQ ID NO: 24271 - RNA, 20 nt, Artificial Sequence
  TRAC targeting sequence
cuugauuucucuuaucuccu

SEQ ID NO: 24272 - RNA, 20 nt, Artificial Sequence
  TRAC targeting sequence
ggggucccuugauuucucuu

SEQ ID NO: 24273 - RNA, 20 nt, Artificial Sequence
  TRAC targeting sequence
ucauuuaaaaacacaaccgg

SEQ ID NO: 24274 - RNA, 20 nt, Artificial Sequence
  TRAC targeting sequence
uuuaaaaacacaaccggccg

SEQ ID NO: 24275 - RNA, 20 nt, Artificial Sequence
  TRAC targeting sequence
cccaugcccggcuaauuuuu

SEQ ID NO: 24276 - RNA, 20 nt, Artificial Sequence
  TRAC targeting sequence
cagcuacucaggaggcugag

SEQ ID NO: 24277 - RNA, 20 nt, Artificial Sequence
  TRAC targeting sequence
ggaggcugaggcaggagaau

SEQ ID NO: 24278 - RNA, 20 nt, Artificial Sequence
  TRAC targeting sequence
ugaguagcugggauuacagg

SEQ ID NO: 24279 - RNA, 20 nt, Artificial Sequence
  TRAC targeting sequence
gccuccugaguagcugggau

SEQ ID NO: 24280 - RNA, 20 nt, Artificial Sequence
  TRAC targeting sequence
ugccucagccuccugaguag

SEQ ID NO: 24281 - RNA, 20 nt, Artificial Sequence
  TRAC targeting sequence
ccugccucagccuccugagu

SEQ ID NO: 24282 - RNA, 20 nt, Artificial Sequence
  TRAC targeting sequence
cggguuuaagcaauucuccu

SEQ ID NO: 24283 - RNA, 20 nt, Artificial Sequence
  TRAC targeting sequence
cccggguuuaagcaauucuc

SEQ ID NO: 24284 - RNA, 20 nt, Artificial Sequence
  TRAC targeting sequence
agccugggugacagagugag

SEQ ID NO: 24285 - RNA, 20 nt, Artificial Sequence
  TRAC targeting sequence
cccaggcuggagugcagugg

SEQ ID NO: 24286 - RNA, 20 nt, Artificial Sequence
  TRAC targeting sequence
gucacccaggcuggagugca

SEQ ID NO: 24287 - RNA, 20 nt, Artificial Sequence
  TRAC targeting sequence
cucugucacccaggcuggag

SEQ ID NO: 24288 - RNA, 20 nt, Artificial Sequence
  TRAC targeting sequence
cacucugucacccaggcugg

SEQ ID NO: 24289 - RNA, 20 nt, Artificial Sequence
  TRAC targeting sequence
caaaaaaaaaaaaaaaaaaa

SEQ ID NO: 24290 - RNA, 20 nt, Artificial Sequence
  TRAC targeting sequence
aaaaaaaaaaaaaaaaaacc

SEQ ID NO: 24291 - RNA, 20 nt, Artificial Sequence
  TRAC targeting sequence
auguugguugugguuuuuuu

SEQ ID NO: 24292 - RNA, 20 nt, Artificial Sequence
  TRAC targeting sequence
aaauuaguaaauccaguugc

SEQ ID NO: 24293 - RNA, 20 nt, Artificial Sequence
  TRAC targeting sequence
ggggacaguucaaaacuaaa

SEQ ID NO: 24294 - RNA, 20 nt, Artificial Sequence
  TRAC targeting sequence
cccgaauuccaaauuaguaa

SEQ ID NO: 24295 - RNA, 20 nt, Artificial Sequence
  TRAC targeting sequence
aaacuaaaaauauaaaggag

SEQ ID NO: 24296 - RNA, 20 nt, Artificial Sequence
  TRAC targeting sequence
uuuauauuuuuaguuuugaa

SEQ ID NO: 24297 - RNA, 20 nt, Artificial Sequence
  TRAC targeting sequence
acaaccaugcucucagucag

SEQ ID NO: 24298 - RNA, 20 nt, Artificial Sequence
  TRAC targeting sequence
cagucagagaagcgcccagc

SEQ ID NO: 24299 - RNA, 20 nt, Artificial Sequence
  TRAC targeting sequence
gucagagaagcgcccagcac

SEQ ID NO: 24300 - RNA, 20 nt, Artificial Sequence
  TRAC targeting sequence
gagaagcgcccagcacaaaa

SEQ ID NO: 24301 - RNA, 20 nt, Artificial Sequence
  TRAC targeting sequence
gacugagagcaugguuguag

SEQ ID NO: 24302 - RNA, 20 nt, Artificial Sequence
  TRAC targeting sequence
cugacugagagcaugguugu

SEQ ID NO: 24303 - RNA, 20 nt, Artificial Sequence
  TRAC targeting sequence
gcuguuuugugcugggcgcu

SEQ ID NO: 24304 - RNA, 20 nt, Artificial Sequence
  TRAC targeting sequence
uuucugcuguuuugugcugg

SEQ ID NO: 24305 - RNA, 20 nt, Artificial Sequence
  TRAC targeting sequence
cugcuuuuuccuuucugcug

SEQ ID NO: 24306 - RNA, 20 nt, Artificial Sequence
  TRAC targeting sequence
ccucacugcuuuuuccuuuc

SEQ ID NO: 24307 - RNA, 20 nt, Artificial Sequence
  TRAC targeting sequence
caccucacugcuuuuuccuu

SEQ ID NO: 24308 - RNA, 20 nt, Artificial Sequence
  TRAC targeting sequence
gucucaccucacugcuuuuu

SEQ ID NO: 24309 - RNA, 20 nt, Artificial Sequence
  TRAC targeting sequence
ugcuuguucugucucaccuc

SEQ ID NO: 24310 - RNA, 20 nt, Artificial Sequence
  TRAC targeting sequence
ccugcuuguucugucucacc

SEQ ID NO: 24311 - RNA, 20 nt, Artificial Sequence
  TRAC targeting sequence
agaaaaaacuuuccuuuuac

SEQ ID NO: 24312 - RNA, 20 nt, Artificial Sequence
  TRAC targeting sequence
ugaauacaacacucuccugc

SEQ ID NO: 24313 - RNA, 20 nt, Artificial Sequence
  TRAC targeting sequence
gugaaguaauucagugaagu

SEQ ID NO: 24314 - RNA, 20 nt, Artificial Sequence
  TRAC targeting sequence
cugaaacuacucuugccaug

SEQ ID NO: 24315 - RNA, 20 nt, Artificial Sequence
  TRAC targeting sequence
gugaaguagugaggacagac

SEQ ID NO: 24316 - RNA, 20 nt, Artificial Sequence
  TRAC targeting sequence
cugaauuacuucacugaaac

SEQ ID NO: 24317 - RNA, 20 nt, Artificial Sequence
  TRAC targeting sequence
cuacuucacugaauuacuuc

SEQ ID NO: 24318 - RNA, 20 nt, Artificial Sequence
  TRAC targeting sequence
ucacuacuucacugaauuac

SEQ ID NO: 24319 - RNA, 20 nt, Artificial Sequence
  TRAC targeting sequence
guccucacuacuucacugaa

SEQ ID NO: 24320 - RNA, 20 nt, Artificial Sequence
  TRAC targeting sequence
ugguauuggucuguccucac

SEQ ID NO: 24321 - RNA, 20 nt, Artificial Sequence
  TRAC targeting sequence
uuaacccacucuugguauug

SEQ ID NO: 24322 - RNA, 20 nt, Artificial Sequence
  TRAC targeting sequence
uuccuuaacccacucuuggu

SEQ ID NO: 24323 - RNA, 20 nt, Artificial Sequence
  TRAC targeting sequence
uucaagaaauucuguaauga

SEQ ID NO: 24324 - RNA, 20 nt, Artificial Sequence
  TRAC targeting sequence
agaaauucuguaaugaugga

SEQ ID NO: 24325 - RNA, 20 nt, Artificial Sequence
  TRAC targeting sequence
ugaaagaauaauuaauguuc

SEQ ID NO: 24326 - RNA, 20 nt, Artificial Sequence
  TRAC targeting sequence
guaaugauggaaaggaaaug

SEQ ID NO: 24327 - RNA, 20 nt, Artificial Sequence
  TRAC targeting sequence
uuacagaauuucuugaaaga

SEQ ID NO: 24328 - RNA, 20 nt, Artificial Sequence
  TRAC targeting sequence
aucauuacagaauuucuuga

SEQ ID NO: 24329 - RNA, 20 nt, Artificial Sequence
  TRAC targeting sequence
uuuccaucauuacagaauuu

SEQ ID NO: 24330 - RNA, 20 nt, Artificial Sequence
  TRAC targeting sequence
cauuuccuuuccaucauuac

SEQ ID NO: 24331 - RNA, 20 nt, Artificial Sequence
  TRAC targeting sequence
agcuaccaucccauuuccuu

SEQ ID NO: 24332 - RNA, 20 nt, Artificial Sequence
  TRAC targeting sequence
ucuagcuaccaucccauuuc

SEQ ID NO: 24333 - RNA, 20 nt, Artificial Sequence
  TRAC targeting sequence
guggucaaacggauuuuuuu

SEQ ID NO: 24334 - RNA, 20 nt, Artificial Sequence
  TRAC targeting sequence
aacggauuuuuuuuaaauag

SEQ ID NO: 24335 - RNA, 20 nt, Artificial Sequence
  TRAC targeting sequence
uacaaacauguucuaauauu

SEQ ID NO: 24336 - RNA, 20 nt, Artificial Sequence
  TRAC targeting sequence
caucauacaaacauguucua

SEQ ID NO: 24337 - RNA, 20 nt, Artificial Sequence
  TRAC targeting sequence
uucccaucauacaaacaugu

SEQ ID NO: 24338 - RNA, 20 nt, Artificial Sequence
  TRAC targeting sequence
aggagagaaacagaaauuaa

SEQ ID NO: 24339 - RNA, 20 nt, Artificial Sequence
  TRAC targeting sequence
uggaucauucccaucauaca

SEQ ID NO: 24340 - RNA, 20 nt, Artificial Sequence
  TRAC targeting sequence
ccuggaucauucccaucaua

SEQ ID NO: 24341 - RNA, 20 nt, Artificial Sequence
  TRAC targeting sequence
cuccuggaucauucccauca

SEQ ID NO: 24342 - RNA, 20 nt, Artificial Sequence
  TRAC targeting sequence
guuucucuccuggaucauuc

SEQ ID NO: 24343 - RNA, 20 nt, Artificial Sequence
  TRAC targeting sequence
uuaauuucuguuucucuccu

SEQ ID NO: 24344 - RNA, 20 nt, Artificial Sequence
  TRAC targeting sequence
gugucauuaauuucuguuuc

SEQ ID NO: 24345 - RNA, 20 nt, Artificial Sequence
  TRAC targeting sequence
guuccgugucauuaauuucu

SEQ ID NO: 24346 - RNA, 20 nt, Artificial Sequence
  TRAC targeting sequence
ucuguuccgugucauuaauu

SEQ ID NO: 24347 - RNA, 20 nt, Artificial Sequence
  TRAC targeting sequence
gcaauuauuccucuguuccg

SEQ ID NO: 24348 - RNA, 20 nt, Artificial Sequence
  TRAC targeting sequence
cuaaaaaaaagaaguagaua

SEQ ID NO: 24349 - RNA, 20 nt, Artificial Sequence
  TRAC targeting sequence
ugcuuuuauuuuuucacuaa

SEQ ID NO: 24350 - RNA, 20 nt, Artificial Sequence
  TRAC targeting sequence
ccaacuaagaauaaaggaaa

SEQ ID NO: 24351 - RNA, 20 nt, Artificial Sequence
  TRAC targeting sequence
uaguuggugaucuugcuuuu

SEQ ID NO: 24352 - RNA, 20 nt, Artificial Sequence
  TRAC targeting sequence
uuuauucuuaguuggugauc

SEQ ID NO: 24353 - RNA, 20 nt, Artificial Sequence
  TRAC targeting sequence
uuuccuuuauucuuaguugg

SEQ ID NO: 24354 - RNA, 20 nt, Artificial Sequence
  TRAC targeting sequence
ucuuuuccuuuauucuuagu

SEQ ID NO: 24355 - RNA, 20 nt, Artificial Sequence
  TRAC targeting sequence
auuuuuccucuuuuccuuua

SEQ ID NO: 24356 - RNA, 20 nt, Artificial Sequence
  TRAC targeting sequence
cucuauuuuuccucuuuucc

SEQ ID NO: 24357 - RNA, 20 nt, Artificial Sequence
  TRAC targeting sequence
uaaaucacucuauuuuuccu

SEQ ID NO: 24358 - RNA, 20 nt, Artificial Sequence
  TRAC targeting sequence
uaaaguaggcuucauaaauc

SEQ ID NO: 24359 - RNA, 20 nt, Artificial Sequence
  TRAC targeting sequence
ccuuccuaaaguaggcuuca

SEQ ID NO: 24360 - RNA, 20 nt, Artificial Sequence
  TRAC targeting sequence
uauacauucgccuuccuaaa

SEQ ID NO: 24361 - RNA, 20 nt, Artificial Sequence
  TRAC targeting sequence
cuuauacauucgccuuccua

SEQ ID NO: 24362 - RNA, 20 nt, Artificial Sequence
  TRAC targeting sequence
caguugaauucccagcaccu

SEQ ID NO: 24363 - RNA, 20 nt, Artificial Sequence
  TRAC targeting sequence
acugugaagcacacagacgu

SEQ ID NO: 24364 - RNA, 20 nt, Artificial Sequence
  TRAC targeting sequence
cagcaccuuggcagagaacc

SEQ ID NO: 24365 - RNA, 20 nt, Artificial Sequence
  TRAC targeting sequence
gccaaggugcugggaauuca

SEQ ID NO: 24366 - RNA, 20 nt, Artificial Sequence
  TRAC targeting sequence
cugccaaggugcugggaauu

SEQ ID NO: 24367 - RNA, 20 nt, Artificial Sequence
  TRAC targeting sequence
uugcucacuauuccugacau

SEQ ID NO: 24368 - RNA, 20 nt, Artificial Sequence
  TRAC targeting sequence
cuauuccugacaugacuaua

SEQ ID NO: 24369 - RNA, 20 nt, Artificial Sequence
  TRAC targeting sequence
ugacaugacuauaggccugc

SEQ ID NO: 24370 - RNA, 20 nt, Artificial Sequence
  TRAC targeting sequence
ggaauagugagcaaugaugu

SEQ ID NO: 24371 - RNA, 20 nt, Artificial Sequence
  TRAC targeting sequence
ugucaggaauagugagcaau

SEQ ID NO: 24372 - RNA, 20 nt, Artificial Sequence
  TRAC targeting sequence
caucucuccauccucagugc

SEQ ID NO: 24373 - RNA, 20 nt, Artificial Sequence
  TRAC targeting sequence
ucucaucucuccauccucag

SEQ ID NO: 24374 - RNA, 20 nt, Artificial Sequence
  TRAC targeting sequence
agggcucaccuuccagagag

SEQ ID NO: 24375 - RNA, 20 nt, Artificial Sequence
  TRAC targeting sequence
ccuuccagagagaaggcaga

SEQ ID NO: 24376 - RNA, 20 nt, Artificial Sequence
  TRAC targeting sequence
agagagaaggcagacaccca

SEQ ID NO: 24377 - RNA, 20 nt, Artificial Sequence
  TRAC targeting sequence
ggaaggugagcccuugaggg

SEQ ID NO: 24378 - RNA, 20 nt, Artificial Sequence
  TRAC targeting sequence
cuggaaggugagcccuugag

SEQ ID NO: 24379 - RNA, 20 nt, Artificial Sequence
  TRAC targeting sequence
cucuggaaggugagcccuug

SEQ ID NO: 24380 - RNA, 20 nt, Artificial Sequence
  TRAC targeting sequence
gccuucucucuggaagguga

SEQ ID NO: 24381 - RNA, 20 nt, Artificial Sequence
  TRAC targeting sequence
uuccucuguauuccuuuuuc

SEQ ID NO: 24382 - RNA, 20 nt, Artificial Sequence
  TRAC targeting sequence
aucugcuggagagucaggga

SEQ ID NO: 24383 - RNA, 20 nt, Artificial Sequence
  TRAC targeting sequence
gcuggagagucagggaaggg

SEQ ID NO: 24384 - RNA, 20 nt, Artificial Sequence
  TRAC targeting sequence
agcagauugaggucuuuccu

SEQ ID NO: 24385 - RNA, 20 nt, Artificial Sequence
  TRAC targeting sequence
ccagcagauugaggucuuuc

SEQ ID NO: 24386 - RNA, 20 nt, Artificial Sequence
  TRAC targeting sequence
gggaaggguuccaaagggca

SEQ ID NO: 24387 - RNA, 20 nt, Artificial Sequence
  TRAC targeting sequence
cugacucuccagcagauuga

SEQ ID NO: 24388 - RNA, 20 nt, Artificial Sequence
  TRAC targeting sequence
aaagggcaauaagccaggca

SEQ ID NO: 24389 - RNA, 20 nt, Artificial Sequence
  TRAC targeting sequence
uuuuuuuuuuguuacuguuu

SEQ ID NO: 24390 - RNA, 20 nt, Artificial Sequence
  TRAC targeting sequence
agugcaauuuccuuuuuuuu

SEQ ID NO: 24391 - RNA, 20 nt, Artificial Sequence
  TRAC targeting sequence
gcucaagugcaauuuccuuu

SEQ ID NO: 24392 - RNA, 20 nt, Artificial Sequence
  TRAC targeting sequence
cagcucaagugcaauuuccu

SEQ ID NO: 24393 - RNA, 20 nt, Artificial Sequence
  TRAC targeting sequence
aaaaagugaaggaauuuuga

SEQ ID NO: 24394 - RNA, 20 nt, Artificial Sequence
  TRAC targeting sequence
cuuuuuagacuucucagcuc

SEQ ID NO: 24395 - RNA, 20 nt, Artificial Sequence
  TRAC targeting sequence
uucacuuuuuagacuucuca

SEQ ID NO: 24396 - RNA, 20 nt, Artificial Sequence
  TRAC targeting sequence
aaauuccuucacuuuuuaga

SEQ ID NO: 24397 - RNA, 20 nt, Artificial Sequence
  TRAC targeting sequence
agcaaaggcaaauaguuuga

SEQ ID NO: 24398 - RNA, 20 nt, Artificial Sequence
  TRAC targeting sequence
aacuauuugccuuugcuuga

SEQ ID NO: 24399 - RNA, 20 nt, Artificial Sequence
  TRAC targeting sequence
ugugucaaacuauuugccuu

SEQ ID NO: 24400 - RNA, 20 nt, Artificial Sequence
  TRAC targeting sequence
caugugucaaacuauuugcc

SEQ ID NO: 24401 - RNA, 20 nt, Artificial Sequence
  TRAC targeting sequence
cauguacaauuuguguuucc

SEQ ID NO: 24402 - RNA, 20 nt, Artificial Sequence
  TRAC targeting sequence
cucccauguacaauuugugu

SEQ ID NO: 24403 - RNA, 20 nt, Artificial Sequence
  TRAC targeting sequence
gauuugcaagucaaaucaag

SEQ ID NO: 24404 - RNA, 20 nt, Artificial Sequence
  TRAC targeting sequence
gauugugucacucccaugua

SEQ ID NO: 24405 - RNA, 20 nt, Artificial Sequence
  TRAC targeting sequence
aaucaagccugcaaacacaa

SEQ ID NO: 24406 - RNA, 20 nt, Artificial Sequence
  TRAC targeting sequence
agccugcaaacacaauagaa

SEQ ID NO: 24407 - RNA, 20 nt, Artificial Sequence
  TRAC targeting sequence
auuguguuugcaggcuugau

SEQ ID NO: 24408 - RNA, 20 nt, Artificial Sequence
  TRAC targeting sequence
ucuauuguguuugcaggcuu

SEQ ID NO: 24409 - RNA, 20 nt, Artificial Sequence
  TRAC targeting sequence
aucuucuauuguguuugcag

SEQ ID NO: 24410 - RNA, 20 nt, Artificial Sequence
  TRAC targeting sequence
aguccaucuucuauuguguu

SEQ ID NO: 24411 - RNA, 20 nt, Artificial Sequence
  TRAC targeting sequence
guuuuagccucucaauaucu

SEQ ID NO: 24412 - RNA, 20 nt, Artificial Sequence
  TRAC targeting sequence
ucuguuuuagccucucaaua

SEQ ID NO: 24413 - RNA, 20 nt, Artificial Sequence
  TRAC targeting sequence
uccucuguuuuagccucuca

SEQ ID NO: 24414 - RNA, 20 nt, Artificial Sequence
  TRAC targeting sequence
uugcuacuuuuucauccucu

SEQ ID NO: 24415 - RNA, 20 nt, Artificial Sequence
  TRAC targeting sequence
uaucauugcuacuuuuucau

SEQ ID NO: 24416 - RNA, 20 nt, Artificial Sequence
  TRAC targeting sequence
uucauaucauugcuacuuuu

SEQ ID NO: 24417 - RNA, 20 nt, Artificial Sequence
  TRAC targeting sequence
aaauaucuuucauaucauug

SEQ ID NO: 24418 - RNA, 20 nt, Artificial Sequence
  TRAC targeting sequence
uguuucuaaauaucuuucau

SEQ ID NO: 24419 - RNA, 20 nt, Artificial Sequence
  TRAC targeting sequence
ggcacauggguggcaaacuu

SEQ ID NO: 24420 - RNA, 20 nt, Artificial Sequence
  TRAC targeting sequence
aaucucucggauaacaguua

SEQ ID NO: 24421 - RNA, 20 nt, Artificial Sequence
  TRAC targeting sequence
acaacagccuaauagcuccc

SEQ ID NO: 24422 - RNA, 20 nt, Artificial Sequence
  TRAC targeting sequence
cgugagacagaaaacucugg

SEQ ID NO: 24423 - RNA, 20 nt, Artificial Sequence
  TRAC targeting sequence
cgggagcuauuaggcuguug

SEQ ID NO: 24424 - RNA, 20 nt, Artificial Sequence
  TRAC targeting sequence
cacgggagcuauuaggcugu

SEQ ID NO: 24425 - RNA, 20 nt, Artificial Sequence
  TRAC targeting sequence
gucucacgggagcuauuagg

SEQ ID NO: 24426 - RNA, 20 nt, Artificial Sequence
  TRAC targeting sequence
ggacuaggccuccuugccuu

SEQ ID NO: 24427 - RNA, 20 nt, Artificial Sequence
  TRAC targeting sequence
agaguuuucugucucacggg

SEQ ID NO: 24428 - RNA, 20 nt, Artificial Sequence
  TRAC targeting sequence
uugccuuacagauucaaacu

SEQ ID NO: 24429 - RNA, 20 nt, Artificial Sequence
  TRAC targeting sequence
guaaggcaaggaggccuagu

SEQ ID NO: 24430 - RNA, 20 nt, Artificial Sequence
  TRAC targeting sequence
aacugguuuugaauuuguaa

SEQ ID NO: 24431 - RNA, 20 nt, Artificial Sequence
  TRAC targeting sequence
aaaccaguuugaaucuguaa

SEQ ID NO: 24432 - RNA, 20 nt, Artificial Sequence
  TRAC targeting sequence
uaguuuacaaauucaaaacc

SEQ ID NO: 24433 - RNA, 20 nt, Artificial Sequence
  TRAC targeting sequence
uauagauuagagaacagaac

SEQ ID NO: 24434 - RNA, 20 nt, Artificial Sequence
  TRAC targeting sequence
auaugagguaauuuugucuu

SEQ ID NO: 24435 - RNA, 20 nt, Artificial Sequence
  TRAC targeting sequence
aaucuauaugagguaauuuu

SEQ ID NO: 24436 - RNA, 20 nt, Artificial Sequence
  TRAC targeting sequence
cuaaucuauaugagguaauu

SEQ ID NO: 24437 - RNA, 20 nt, Artificial Sequence
  TRAC targeting sequence
guucucuaaucuauaugagg

SEQ ID NO: 24438 - RNA, 20 nt, Artificial Sequence
  TRAC targeting sequence
guucuguucucuaaucuaua

SEQ ID NO: 24439 - RNA, 20 nt, Artificial Sequence
  TRAC targeting sequence
ucuguucuguucucuaaucu

SEQ ID NO: 24440 - RNA, 20 nt, Artificial Sequence
  TRAC targeting sequence
caacuuucaucuguucuguu

SEQ ID NO: 24441 - RNA, 20 nt, Artificial Sequence
  TRAC targeting sequence
uuucccaacuuucaucuguu

SEQ ID NO: 24442 - RNA, 20 nt, Artificial Sequence
  TRAC targeting sequence
agaccaaagacuuauuuuga

SEQ ID NO: 24443 - RNA, 20 nt, Artificial Sequence
  TRAC targeting sequence
ugaaacaaguuuuaauucau

SEQ ID NO: 24444 - RNA, 20 nt, Artificial Sequence
  TRAC targeting sequence
uuggucuugaaacaaguuuu

SEQ ID NO: 24445 - RNA, 20 nt, Artificial Sequence
  TRAC targeting sequence
aaauaagucuuuggucuuga

SEQ ID NO: 24446 - RNA, 20 nt, Artificial Sequence
  TRAC targeting sequence
ucaaaauaagucuuuggucu

SEQ ID NO: 24447 - RNA, 20 nt, Artificial Sequence
  TRAC targeting sequence
uaauguuuucuacuuauccc

SEQ ID NO: 24448 - RNA, 20 nt, Artificial Sequence
  TRAC targeting sequence
acuuaucccuccuaaauagc

SEQ ID NO: 24449 - RNA, 20 nt, Artificial Sequence
  TRAC targeting sequence
cuccuaaauagcacuuuaaa

SEQ ID NO: 24450 - RNA, 20 nt, Artificial Sequence
  TRAC targeting sequence
uaaauagcacuuuaaaugag

SEQ ID NO: 24451 - RNA, 20 nt, Artificial Sequence
  TRAC targeting sequence
uuuaaagugcuauuuaggag

SEQ ID NO: 24452 - RNA, 20 nt, Artificial Sequence
  TRAC targeting sequence
guugggcaaaaaaggaaacu

SEQ ID NO: 24453 - RNA, 20 nt, Artificial Sequence
  TRAC targeting sequence
uuuuuugcccaacugaaagc

SEQ ID NO: 24454 - RNA, 20 nt, Artificial Sequence
  TRAC targeting sequence
aguguuggcaacccuuuagu

SEQ ID NO: 24455 - RNA, 20 nt, Artificial Sequence
  TRAC targeting sequence
aaaaaagggacagauguccu

SEQ ID NO: 24456 - RNA, 20 nt, Artificial Sequence
  TRAC targeting sequence
cuuuuuuagaguuauauucc

SEQ ID NO: 24457 - RNA, 20 nt, Artificial Sequence
  TRAC targeting sequence
gucccuuuuuuagaguuaua

SEQ ID NO: 24458 - RNA, 20 nt, Artificial Sequence
  TRAC targeting sequence
ucuucuagagauaucuaacu

SEQ ID NO: 24459 - RNA, 20 nt, Artificial Sequence
  TRAC targeting sequence
ucuagagauaucuaacuaca

SEQ ID NO: 24460 - RNA, 20 nt, Artificial Sequence
  TRAC targeting sequence
agagauaucuaacuacaaga

SEQ ID NO: 24461 - RNA, 20 nt, Artificial Sequence
  TRAC targeting sequence
agaagaggacaucugucccu

SEQ ID NO: 24462 - RNA, 20 nt, Artificial Sequence
  TRAC targeting sequence
cuagaagaggacaucugucc

SEQ ID NO: 24463 - RNA, 20 nt, Artificial Sequence
  TRAC targeting sequence
aacuacaagauaaacaguca

SEQ ID NO: 24464 - RNA, 20 nt, Artificial Sequence
  TRAC targeting sequence
uguaguuagauaucucuaga

SEQ ID NO: 24465 - RNA, 20 nt, Artificial Sequence
  TRAC targeting sequence
gcuacuggauguuugaaauc

SEQ ID NO: 24466 - RNA, 20 nt, Artificial Sequence
  TRAC targeting sequence
aguagcugacuguuuaucuu

SEQ ID NO: 24467 - RNA, 20 nt, Artificial Sequence
  TRAC targeting sequence
aacauccaguagcugacugu

SEQ ID NO: 24468 - RNA, 20 nt, Artificial Sequence
  TRAC targeting sequence
gucucaaauagaaaaauauu

SEQ ID NO: 24469 - RNA, 20 nt, Artificial Sequence
  TRAC targeting sequence
caaauagaaaaauauucuac

SEQ ID NO: 24470 - RNA, 20 nt, Artificial Sequence
  TRAC targeting sequence
aauagaaaaauauucuaccu

SEQ ID NO: 24471 - RNA, 20 nt, Artificial Sequence
  TRAC targeting sequence
auuugagacagauuucaaac

SEQ ID NO: 24472 - RNA, 20 nt, Artificial Sequence
  TRAC targeting sequence
uuuuuuguguguguuuugga

SEQ ID NO: 24473 - RNA, 20 nt, Artificial Sequence
  TRAC targeting sequence
cucaaugacaacuuucuacc

SEQ ID NO: 24474 - RNA, 20 nt, Artificial Sequence
  TRAC targeting sequence
caaugacaacuuucuaccuc

SEQ ID NO: 24475 - RNA, 20 nt, Artificial Sequence
  TRAC targeting sequence
augacaacuuucuaccucug

SEQ ID NO: 24476 - RNA, 20 nt, Artificial Sequence
  TRAC targeting sequence
uugagagaucuuuuuuugug

SEQ ID NO: 24477 - RNA, 20 nt, Artificial Sequence
  TRAC targeting sequence
accucugguuccuucuugaa

SEQ ID NO: 24478 - RNA, 20 nt, Artificial Sequence
  TRAC targeting sequence
gguuccuucuugaaaccaug

SEQ ID NO: 24479 - RNA, 20 nt, Artificial Sequence
  TRAC targeting sequence
uucuugaaaccaugguuaag

SEQ ID NO: 24480 - RNA, 20 nt, Artificial Sequence
  TRAC targeting sequence
ugaaaccaugguuaagucuc

SEQ ID NO: 24481 - RNA, 20 nt, Artificial Sequence
  TRAC targeting sequence
agaaggaaccagagguagaa

SEQ ID NO: 24482 - RNA, 20 nt, Artificial Sequence
  TRAC targeting sequence
cucagcuaugagggaauaga

SEQ ID NO: 24483 - RNA, 20 nt, Artificial Sequence
  TRAC targeting sequence
cagcuaugagggaauagaag

SEQ ID NO: 24484 - RNA, 20 nt, Artificial Sequence
  TRAC targeting sequence
gcuaugagggaauagaagaa

SEQ ID NO: 24485 - RNA, 20 nt, Artificial Sequence
  TRAC targeting sequence
uagcugagagacuuaaccau

SEQ ID NO: 24486 - RNA, 20 nt, Artificial Sequence
  TRAC targeting sequence
cucauagcugagagacuuaa

SEQ ID NO: 24487 - RNA, 20 nt, Artificial Sequence
  TRAC targeting sequence
auucccucauagcugagaga

SEQ ID NO: 24488 - RNA, 20 nt, Artificial Sequence
  TRAC targeting sequence
cuccaauucauccuacaugc

SEQ ID NO: 24489 - RNA, 20 nt, Artificial Sequence
  TRAC targeting sequence
aauucauccuacaugcuaac

SEQ ID NO: 24490 - RNA, 20 nt, Artificial Sequence
  TRAC targeting sequence
uccuacaugcuaacaccaau

SEQ ID NO: 24491 - RNA, 20 nt, Artificial Sequence
  TRAC targeting sequence
uacaugcuaacaccaauuuu

SEQ ID NO: 24492 - RNA, 20 nt, Artificial Sequence
  TRAC targeting sequence
uuuccuuucuuuaaaaaagc

SEQ ID NO: 24493 - RNA, 20 nt, Artificial Sequence
  TRAC targeting sequence
uuucuuuaaaaaagcacccu

SEQ ID NO: 24494 - RNA, 20 nt, Artificial Sequence
  TRAC targeting sequence
uuaaaaaagcacccucagug

SEQ ID NO: 24495 - RNA, 20 nt, Artificial Sequence
  TRAC targeting sequence
gugccgggugugguggcuca

SEQ ID NO: 24496 - RNA, 20 nt, Artificial Sequence
  TRAC targeting sequence
ucagaagcuuuacuauuacc

SEQ ID NO: 24497 - RNA, 20 nt, Artificial Sequence
  TRAC targeting sequence
gaagcuuuacuauuaccuac

SEQ ID NO: 24498 - RNA, 20 nt, Artificial Sequence
  TRAC targeting sequence
gaagaugcuuuuuuuuuuuu

SEQ ID NO: 24499 - RNA, 20 nt, Artificial Sequence
  TRAC targeting sequence
uguagguaauaguaaagcuu

SEQ ID NO: 24500 - RNA, 20 nt, Artificial Sequence
  TRAC targeting sequence
aaauuccuggccgggcacag

SEQ ID NO: 24501 - RNA, 20 nt, Artificial Sequence
  TRAC targeting sequence
uggccgggcacagugacuca

SEQ ID NO: 24502 - RNA, 20 nt, Artificial Sequence
  TRAC targeting sequence
cugugcccggccaggaauuu

SEQ ID NO: 24503 - RNA, 20 nt, Artificial Sequence
  TRAC targeting sequence
caccuguaaucccagcacuu

SEQ ID NO: 24504 - RNA, 20 nt, Artificial Sequence
  TRAC targeting sequence
aacuuuccuguggaauuucc

SEQ ID NO: 24505 - RNA, 20 nt, Artificial Sequence
  TRAC targeting sequence
uuuuuauggugcugggguuu

SEQ ID NO: 24506 - RNA, 20 nt, Artificial Sequence
  TRAC targeting sequence
aaacaaaggauaagcgucca

SEQ ID NO: 24507 - RNA, 20 nt, Artificial Sequence
  TRAC targeting sequence
uuuguuuugauuguuggcaa

SEQ ID NO: 24508 - RNA, 20 nt, Artificial Sequence
  TRAC targeting sequence
aaauuucccauuaaaaccag

SEQ ID NO: 24509 - RNA, 20 nt, Artificial Sequence
  TRAC targeting sequence
gccauuuguuagccuagauc

SEQ ID NO: 24510 - RNA, 20 nt, Artificial Sequence
  TRAC targeting sequence
ucugccauuuguuagccuag

SEQ ID NO: 24511 - RNA, 20 nt, Artificial Sequence
  TRAC targeting sequence
ugccucuucugccauuuguu

SEQ ID NO: 24512 - RNA, 20 nt, Artificial Sequence
  TRAC targeting sequence
uaaauccugccucuucugcc

SEQ ID NO: 24513 - RNA, 20 nt, Artificial Sequence
  TRAC targeting sequence
augcugucaaaagaagggua

SEQ ID NO: 24514 - RNA, 20 nt, Artificial Sequence
  TRAC targeting sequence
aaagaaggguaaaucauacc

SEQ ID NO: 24515 - RNA, 20 nt, Artificial Sequence
  TRAC targeting sequence
uuugacagcauugacuuucc

SEQ ID NO: 24516 - RNA, 20 nt, Artificial Sequence
  TRAC targeting sequence
uacccuucuguggcaacuaa

SEQ ID NO: 24517 - RNA, 20 nt, Artificial Sequence
  TRAC targeting sequence
guggcaacuaagaauuauca

SEQ ID NO: 24518 - RNA, 20 nt, Artificial Sequence
  TRAC targeting sequence
uaguugccacagaaggguau

SEQ ID NO: 24519 - RNA, 20 nt, Artificial Sequence
  TRAC targeting sequence
ugaaucccuucuuuucuuga

SEQ ID NO: 24520 - RNA, 20 nt, Artificial Sequence
  TRAC targeting sequence
ugauaauucuuaguugccac

SEQ ID NO: 24521 - RNA, 20 nt, Artificial Sequence
  TRAC targeting sequence
cuucuuuucuugaaguugcu

SEQ ID NO: 24522 - RNA, 20 nt, Artificial Sequence
  TRAC targeting sequence
uuucuugaaguugcuuucau

SEQ ID NO: 24523 - RNA, 20 nt, Artificial Sequence
  TRAC targeting sequence
uacucuuccagaccuggaaa

SEQ ID NO: 24524 - RNA, 20 nt, Artificial Sequence
  TRAC targeting sequence
uccagaccuggaaacaaaaa

SEQ ID NO: 24525 - RNA, 20 nt, Artificial Sequence
  TRAC targeting sequence
agaccuggaaacaaaaacau

SEQ ID NO: 24526 - RNA, 20 nt, Artificial Sequence
  TRAC targeting sequence
ggaagaguaggagcaaggca

SEQ ID NO: 24527 - RNA, 20 nt, Artificial Sequence
  TRAC targeting sequence
aggucuggaagaguaggagc

SEQ ID NO: 24528 - RNA, 20 nt, Artificial Sequence
  TRAC targeting sequence
aacaaaauuaaaucaaaagu

SEQ ID NO: 24529 - RNA, 20 nt, Artificial Sequence
  TRAC targeting sequence
aaaguucucaucaagguucc

SEQ ID NO: 24530 - RNA, 20 nt, Artificial Sequence
  TRAC targeting sequence
caucaagguuccuucuccgg

SEQ ID NO: 24531 - RNA, 20 nt, Artificial Sequence
  TRAC targeting sequence
ucaagguuccuucuccgggc

SEQ ID NO: 24532 - RNA, 20 nt, Artificial Sequence
  TRAC targeting sequence
agguuccuucuccgggcugg

SEQ ID NO: 24533 - RNA, 20 nt, Artificial Sequence
  TRAC targeting sequence
ggauguguuaaccaucaucc

SEQ ID NO: 24534 - RNA, 20 nt, Artificial Sequence
  TRAC targeting sequence
uugccuucaggauguguuaa

SEQ ID NO: 24535 - RNA, 20 nt, Artificial Sequence
  TRAC targeting sequence
gugguggcguccuugccuuc

SEQ ID NO: 24536 - RNA, 20 nt, Artificial Sequence
  TRAC targeting sequence
uggucaucuaggacaaaagu

SEQ ID NO: 24537 - RNA, 20 nt, Artificial Sequence
  TRAC targeting sequence
ucuaggacaaaagucaaaga

SEQ ID NO: 24538 - RNA, 20 nt, Artificial Sequence
  TRAC targeting sequence
aggacaaaagucaaagaugg

SEQ ID NO: 24539 - RNA, 20 nt, Artificial Sequence
  TRAC targeting sequence
uagaugaccaagaccuaguu

SEQ ID NO: 24540 - RNA, 20 nt, Artificial Sequence
  TRAC targeting sequence
aagaugguaacuaaauaucc

SEQ ID NO: 24541 - RNA, 20 nt, Artificial Sequence
  TRAC targeting sequence
uugacuuuuguccuagauga

SEQ ID NO: 24542 - RNA, 20 nt, Artificial Sequence
  TRAC targeting sequence
guacacaagucauuagaucc

SEQ ID NO: 24543 - RNA, 20 nt, Artificial Sequence
  TRAC targeting sequence
uuagauccucagaccuguuu

SEQ ID NO: 24544 - RNA, 20 nt, Artificial Sequence
  TRAC targeting sequence
aaugacuuguguacugaagu

SEQ ID NO: 24545 - RNA, 20 nt, Artificial Sequence
  TRAC targeting sequence
ucagaccuguuuuaaauucu

SEQ ID NO: 24546 - RNA, 20 nt, Artificial Sequence
  TRAC targeting sequence
gaccuguuuuaaauucuaag

SEQ ID NO: 24547 - RNA, 20 nt, Artificial Sequence
  TRAC targeting sequence
gaggaucuaaugacuugugu

SEQ ID NO: 24548 - RNA, 20 nt, Artificial Sequence
  TRAC targeting sequence
aagaaauaucucuggugugu

SEQ ID NO: 24549 - RNA, 20 nt, Artificial Sequence
  TRAC targeting sequence
uagaauuuaaaacaggucug

SEQ ID NO: 24550 - RNA, 20 nt, Artificial Sequence
  TRAC targeting sequence
cuggugugucagaacaaugu

SEQ ID NO: 24551 - RNA, 20 nt, Artificial Sequence
  TRAC targeting sequence
ggugugucagaacaauguaa

SEQ ID NO: 24552 - RNA, 20 nt, Artificial Sequence
  TRAC targeting sequence
gaacaauguaaauguacaau

SEQ ID NO: 24553 - RNA, 20 nt, Artificial Sequence
  TRAC targeting sequence
gacacaccagagauauuucu

SEQ ID NO: 24554 - RNA, 20 nt, Artificial Sequence
  TRAC targeting sequence
auaggucuguaacuuuaagc

SEQ ID NO: 24555 - RNA, 20 nt, Artificial Sequence
  TRAC targeting sequence
guaacuuuaagcacagcacc

SEQ ID NO: 24556 - RNA, 20 nt, Artificial Sequence
  TRAC targeting sequence
ccagacuuuuuuuuuuuuuu

SEQ ID NO: 24557 - RNA, 20 nt, Artificial Sequence
  TRAC targeting sequence
ggugacaguggugcugugcu

SEQ ID NO: 24558 - RNA, 20 nt, Artificial Sequence
  TRAC targeting sequence
ucagucaggucaucaguugu

SEQ ID NO: 24559 - RNA, 20 nt, Artificial Sequence
  TRAC targeting sequence
cacugaaaagaaaccaugaa

SEQ ID NO: 24560 - RNA, 20 nt, Artificial Sequence
  TRAC targeting sequence
gugugaucaucagucagguc

SEQ ID NO: 24561 - RNA, 20 nt, Artificial Sequence
  TRAC targeting sequence
uuucagugugaucaucaguc

SEQ ID NO: 24562 - RNA, 20 nt, Artificial Sequence
  TRAC targeting sequence
ugguuucuuuucagugugau

SEQ ID NO: 24563 - RNA, 20 nt, Artificial Sequence
  TRAC targeting sequence
aagucaaaguagcaggugau

SEQ ID NO: 24564 - RNA, 20 nt, Artificial Sequence
  TRAC targeting sequence
aaguagcaggugauaccagu

SEQ ID NO: 24565 - RNA, 20 nt, Artificial Sequence
  TRAC targeting sequence
ccugcuacuuugacuuugaa

SEQ ID NO: 24566 - RNA, 20 nt, Artificial Sequence
  TRAC targeting sequence
cugguaucaccugcuacuuu

SEQ ID NO: 24567 - RNA, 20 nt, Artificial Sequence
  TRAC targeting sequence
aucacugguaucaccugcua

SEQ ID NO: 24568 - RNA, 20 nt, Artificial Sequence
  TRAC targeting sequence
ccguugggcaagaaaaguca

SEQ ID NO: 24569 - RNA, 20 nt, Artificial Sequence
  TRAC targeting sequence
ugcccaacggggauucagug

SEQ ID NO: 24570 - RNA, 20 nt, Artificial Sequence
  TRAC targeting sequence
gauuuuaacaaaaauugaug

SEQ ID NO: 24571 - RNA, 20 nt, Artificial Sequence
  TRAC targeting sequence
gacuuuucuugcccaacggg

SEQ ID NO: 24572 - RNA, 20 nt, Artificial Sequence
  TRAC targeting sequence
auuuuuguuaaaaucugacu

SEQ ID NO: 24573 - RNA, 20 nt, Artificial Sequence
  TRAC targeting sequence
aucaauuuuuguuaaaaucu

SEQ ID NO: 24574 - RNA, 20 nt, Artificial Sequence
  TRAC targeting sequence
ccaucaauuuuuguuaaaau

SEQ ID NO: 24575 - RNA, 20 nt, Artificial Sequence
  TRAC targeting sequence
cgcuaaauauagcagucuac

SEQ ID NO: 24576 - RNA, 20 nt, Artificial Sequence
  TRAC targeting sequence
cuaaauauagcagucuacaa

SEQ ID NO: 24577 - RNA, 20 nt, Artificial Sequence
  TRAC targeting sequence
acaagguuaccaaauccugg

SEQ ID NO: 24578 - RNA, 20 nt, Artificial Sequence
  TRAC targeting sequence
uggaaucaaaaggaaaaaua

SEQ ID NO: 24579 - RNA, 20 nt, Artificial Sequence
  TRAC targeting sequence
aggauuugguaaccuuguag

SEQ ID NO: 24580 - RNA, 20 nt, Artificial Sequence
  TRAC targeting sequence
aaaggaaaaauaaggcuaaa

SEQ ID NO: 24581 - RNA, 20 nt, Artificial Sequence
  TRAC targeting sequence
uuuugauuccaggauuuggu

SEQ ID NO: 24582 - RNA, 20 nt, Artificial Sequence
  TRAC targeting sequence
auuuuagccuuauuuuuccu

SEQ ID NO: 24583 - RNA, 20 nt, Artificial Sequence
  TRAC targeting sequence
cauaacucuauuuuagccuu

SEQ ID NO: 24584 - RNA, 20 nt, Artificial Sequence
  TRAC targeting sequence
uuugaaaagucuacuaauuu

SEQ ID NO: 24585 - RNA, 20 nt, Artificial Sequence
  TRAC targeting sequence
aaugaaaaacccaaccuuga

SEQ ID NO: 24586 - RNA, 20 nt, Artificial Sequence
  TRAC targeting sequence
acuaauuuuagaguuguguu

SEQ ID NO: 24587 - RNA, 20 nt, Artificial Sequence
  TRAC targeting sequence
aaaauuaguagacuuuucaa

SEQ ID NO: 24588 - RNA, 20 nt, Artificial Sequence
  TRAC targeting sequence
aacuuuaacuuagguuuaac

SEQ ID NO: 24589 - RNA, 20 nt, Artificial Sequence
  TRAC targeting sequence
ccggaccaauauuaagugaa

SEQ ID NO: 24590 - RNA, 20 nt, Artificial Sequence
  TRAC targeting sequence
aggggcgguggucugauaua

SEQ ID NO: 24591 - RNA, 20 nt, Artificial Sequence
  TRAC targeting sequence
gauauagaguacuaugaaaa

SEQ ID NO: 24592 - RNA, 20 nt, Artificial Sequence
  TRAC targeting sequence
gaccaccgccccuugaaguu

SEQ ID NO: 24593 - RNA, 20 nt, Artificial Sequence
  TRAC targeting sequence
auaucagaccaccgccccuu

SEQ ID NO: 24594 - RNA, 20 nt, Artificial Sequence
  TRAC targeting sequence
uaguacucuauaucagacca

SEQ ID NO: 24595 - RNA, 20 nt, Artificial Sequence
  TRAC targeting sequence
uaauaauaauguguuacuuu

SEQ ID NO: 24596 - RNA, 20 nt, Artificial Sequence
  TRAC targeting sequence
cuuauagaaccauuacccgc

SEQ ID NO: 24597 - RNA, 20 nt, Artificial Sequence
  TRAC targeting sequence
auaagugaucauaauaauaa

SEQ ID NO: 24598 - RNA, 20 nt, Artificial Sequence
  TRAC targeting sequence
uagcggguaaugguucuaua

SEQ ID NO: 24599 - RNA, 20 nt, Artificial Sequence
  TRAC targeting sequence
uccuagcggguaaugguucu

SEQ ID NO: 24600 - RNA, 20 nt, Artificial Sequence
  TRAC targeting sequence
ccacacaagagaugaagccc

SEQ ID NO: 24601 - RNA, 20 nt, Artificial Sequence
  TRAC targeting sequence
uguguggggaguuucauccu

SEQ ID NO: 24602 - RNA, 20 nt, Artificial Sequence
  TRAC targeting sequence
cuuguguggggaguuucauc

SEQ ID NO: 24603 - RNA, 20 nt, Artificial Sequence
  TRAC targeting sequence
ucucuuguguggggaguuuc

SEQ ID NO: 24604 - RNA, 20 nt, Artificial Sequence
  TRAC targeting sequence
ggcuucaucucuuguguggg

SEQ ID NO: 24605 - RNA, 20 nt, Artificial Sequence
  TRAC targeting sequence
cgggcuucaucucuugugug

SEQ ID NO: 24606 - RNA, 20 nt, Artificial Sequence
  TRAC targeting sequence
cucgggcuucaucucuugug

SEQ ID NO: 24607 - RNA, 20 nt, Artificial Sequence
  TRAC targeting sequence
uuucucucgggcuucaucuc

SEQ ID NO: 24608 - RNA, 20 nt, Artificial Sequence
  TRAC targeting sequence
acucuuuucucucgggcuuc

SEQ ID NO: 24609 - RNA, 20 nt, Artificial Sequence
  TRAC targeting sequence
ccuucaacucuuuucucucg

SEQ ID NO: 24610 - RNA, 20 nt, Artificial Sequence
  TRAC targeting sequence
ccacgaggagacaguaaccg

SEQ ID NO: 24611 - RNA, 20 nt, Artificial Sequence
  TRAC targeting sequence
uggggaccuuccccuucaac

SEQ ID NO: 24612 - RNA, 20 nt, Artificial Sequence
  TRAC targeting sequence
ucguggggaccuuccccuuc

SEQ ID NO: 24613 - RNA, 20 nt, Artificial Sequence
  TRAC targeting sequence
ccucguggggaccuuccccu

SEQ ID NO: 24614 - RNA, 20 nt, Artificial Sequence
  TRAC targeting sequence
guuacugucuccucgugggg

SEQ ID NO: 24615 - RNA, 20 nt, Artificial Sequence
  TRAC targeting sequence
gcaguauauacagcagguac

SEQ ID NO: 24616 - RNA, 20 nt, Artificial Sequence
  TRAC targeting sequence
agcaacuucagacgcugcgg

SEQ ID NO: 24617 - RNA, 20 nt, Artificial Sequence
  TRAC targeting sequence
gacgcugcggaguggagcuc

SEQ ID NO: 24618 - RNA, 20 nt, Artificial Sequence
  TRAC targeting sequence
gaaguugcuggacgcguacc

SEQ ID NO: 24619 - RNA, 20 nt, Artificial Sequence
  TRAC targeting sequence
gcagcgucugaaguugcugg

SEQ ID NO: 24620 - RNA, 20 nt, Artificial Sequence
  TRAC targeting sequence
acuccgcagcgucugaaguu

SEQ ID NO: 24621 - RNA, 20 nt, Artificial Sequence
  TRAC targeting sequence
aguacucuucuaagaaccgc

SEQ ID NO: 24622 - RNA, 20 nt, Artificial Sequence
  TRAC targeting sequence
ucuaagaaccgcgaaaugac

SEQ ID NO: 24623 - RNA, 20 nt, Artificial Sequence
  TRAC targeting sequence
aagaaccgcgaaaugacaga

SEQ ID NO: 24624 - RNA, 20 nt, Artificial Sequence
  TRAC targeting sequence
uagaagaguacuugagcucc

SEQ ID NO: 24625 - RNA, 20 nt, Artificial Sequence
  TRAC targeting sequence
cgguucuuagaagaguacuu

SEQ ID NO: 24626 - RNA, 20 nt, Artificial Sequence
  TRAC targeting sequence
uuucgcgguucuuagaagag

SEQ ID NO: 24627 - RNA, 20 nt, Artificial Sequence
  TRAC targeting sequence
gucauuucgcgguucuuaga

SEQ ID NO: 24628 - RNA, 20 nt, Artificial Sequence
  TRAC targeting sequence
guagugucugucauuucgcg

SEQ ID NO: 24629 - RNA, 20 nt, Artificial Sequence
  TRAC targeting sequence
gcgucgguagugucugucau

SEQ ID NO: 24630 - RNA, 20 nt, Artificial Sequence
  TRAC targeting sequence
gguccgcgccccaaacucuu

SEQ ID NO: 24631 - RNA, 20 nt, Artificial Sequence
  TRAC targeting sequence
gcgccccaaacucuuggagg

SEQ ID NO: 24632 - RNA, 20 nt, Artificial Sequence
  TRAC targeting sequence
uggaggacccgucgaccaca

SEQ ID NO: 24633 - RNA, 20 nt, Artificial Sequence
  TRAC targeting sequence
aagaguuuggggcgcggacc

SEQ ID NO: 24634 - RNA, 20 nt, Artificial Sequence
  TRAC targeting sequence
uccaagaguuuggggcgcgg

SEQ ID NO: 24635 - RNA, 20 nt, Artificial Sequence
  TRAC targeting sequence
accacaccggaugugcuguu

SEQ ID NO: 24636 - RNA, 20 nt, Artificial Sequence
  TRAC targeting sequence
acggguccuccaagaguuug

SEQ ID NO: 24637 - RNA, 20 nt, Artificial Sequence
  TRAC targeting sequence
gguguggucgacggguccuc

SEQ ID NO: 24638 - RNA, 20 nt, Artificial Sequence
  TRAC targeting sequence
ugaccuaacuccgcccuccc

SEQ ID NO: 24639 - RNA, 20 nt, Artificial Sequence
  TRAC targeting sequence
cgagggugcgcaugcgcaaa

SEQ ID NO: 24640 - RNA, 20 nt, Artificial Sequence
  TRAC targeting sequence
gcccuccccggugugccaau

SEQ ID NO: 24641 - RNA, 20 nt, Artificial Sequence
  TRAC targeting sequence
ccggugugccaauuugcgca

SEQ ID NO: 24642 - RNA, 20 nt, Artificial Sequence
  TRAC targeting sequence
gcgccugcgcaaauuggcac

SEQ ID NO: 24643 - RNA, 20 nt, Artificial Sequence
  TRAC targeting sequence
gcgcauuaguuguuacgcgc

SEQ ID NO: 24644 - RNA, 20 nt, Artificial Sequence
  TRAC targeting sequence
gcgucugcgcauuaguuguu

SEQ ID NO: 24645 - RNA, 20 nt, Artificial Sequence
  TRAC targeting sequence
acagacucaacuacaacuca

SEQ ID NO: 24646 - RNA, 20 nt, Artificial Sequence
  TRAC targeting sequence
guugaugcaguccgcgucug

SEQ ID NO: 24647 - RNA, 20 nt, Artificial Sequence
  TRAC targeting sequence
acuacaacucagaaaaguua

SEQ ID NO: 24648 - RNA, 20 nt, Artificial Sequence
  TRAC targeting sequence
gaaaaguuaaugcgucugcg

SEQ ID NO: 24649 - RNA, 20 nt, Artificial Sequence
  TRAC targeting sequence
gaguuguaguugagucuguu

SEQ ID NO: 24650 - RNA, 20 nt, Artificial Sequence
  TRAC targeting sequence
gcgcaauggcccuaucaaug

SEQ ID NO: 24651 - RNA, 20 nt, Artificial Sequence
  TRAC targeting sequence
augagcuggggacguguacu

SEQ ID NO: 24652 - RNA, 20 nt, Artificial Sequence
  TRAC targeting sequence
uugauagggccauugcgcag

SEQ ID NO: 24653 - RNA, 20 nt, Artificial Sequence
  TRAC targeting sequence
ccagcucauugauagggcca

SEQ ID NO: 24654 - RNA, 20 nt, Artificial Sequence
  TRAC targeting sequence
uucuguucuguuuccgcccg

SEQ ID NO: 24655 - RNA, 20 nt, Artificial Sequence
  TRAC targeting sequence
guucuguuuccgcccgucag

SEQ ID NO: 24656 - RNA, 20 nt, Artificial Sequence
  TRAC targeting sequence
guuuccgcccgucagcucgg

SEQ ID NO: 24657 - RNA, 20 nt, Artificial Sequence
  TRAC targeting sequence
gcccgucagcucggugacgc

SEQ ID NO: 24658 - RNA, 20 nt, Artificial Sequence
  TRAC targeting sequence
gcucggugacgcccacaguu

SEQ ID NO: 24659 - RNA, 20 nt, Artificial Sequence
  TRAC targeting sequence
gugacgcccacaguugcucu

SEQ ID NO: 24660 - RNA, 20 nt, Artificial Sequence
  TRAC targeting sequence
ccgagcugacgggcggaaac

SEQ ID NO: 24661 - RNA, 20 nt, Artificial Sequence
  TRAC targeting sequence
ggcaacaagacacacuggga

SEQ ID NO: 24662 - RNA, 20 nt, Artificial Sequence
  TRAC targeting sequence
uguugccagagcaacugugg

SEQ ID NO: 24663 - RNA, 20 nt, Artificial Sequence
  TRAC targeting sequence
cagugugucuuguugccaga

SEQ ID NO: 24664 - RNA, 20 nt, Artificial Sequence
  TRAC targeting sequence
ucccagugugucuuguugcc

SEQ ID NO: 24665 - RNA, 20 nt, Artificial Sequence
  TRAC targeting sequence
uccucccagugugucuuguu

SEQ ID NO: 24666 - RNA, 20 nt, Artificial Sequence
  TRAC targeting sequence
ccucuuccucccaguguguc

SEQ ID NO: 24667 - RNA, 20 nt, Artificial Sequence
  TRAC targeting sequence
ccaguaaagcuuauuccccu

SEQ ID NO: 24668 - RNA, 20 nt, Artificial Sequence
  TRAC targeting sequence
uucgggccuuucgacgcuga

SEQ ID NO: 24669 - RNA, 20 nt, Artificial Sequence
  TRAC targeting sequence
acccuacucucuccaacuca

SEQ ID NO: 24670 - RNA, 20 nt, Artificial Sequence
  TRAC targeting sequence
cuccaacucauuuugcagaa

SEQ ID NO: 24671 - RNA, 20 nt, Artificial Sequence
  TRAC targeting sequence
ccaacucauuuugcagaaga

SEQ ID NO: 24672 - RNA, 20 nt, Artificial Sequence
  TRAC targeting sequence
aacucauuuugcagaagaaa

SEQ ID NO: 24673 - RNA, 20 nt, Artificial Sequence
  TRAC targeting sequence
uuuugcagaagaaacugaaa

SEQ ID NO: 24674 - RNA, 20 nt, Artificial Sequence
  TRAC targeting sequence
gcaaaaugaguuggagagag

SEQ ID NO: 24675 - RNA, 20 nt, Artificial Sequence
  TRAC targeting sequence
ucugcaaaaugaguuggaga

SEQ ID NO: 24676 - RNA, 20 nt, Artificial Sequence
  TRAC targeting sequence
guuucuucugcaaaaugagu

SEQ ID NO: 24677 - RNA, 20 nt, Artificial Sequence
  TRAC targeting sequence
gguuuuguauuuuaacaagu

SEQ ID NO: 24678 - RNA, 20 nt, Artificial Sequence
  TRAC targeting sequence
cacuuguuaaaauacaaaac

SEQ ID NO: 24679 - RNA, 20 nt, Artificial Sequence
  TRAC targeting sequence
aaauaaucccacuuguuaaa

SEQ ID NO: 24680 - RNA, 20 nt, Artificial Sequence
  TRAC targeting sequence
cuccuauaaucccagcacuu

SEQ ID NO: 24681 - RNA, 20 nt, Artificial Sequence
  TRAC targeting sequence
cuuuuuauuugccuuuagac

SEQ ID NO: 24682 - RNA, 20 nt, Artificial Sequence
  TRAC targeting sequence
aaaggcaaauaaaaagugaa

SEQ ID NO: 24683 - RNA, 20 nt, Artificial Sequence
  TRAC targeting sequence
agucuaaaggcaaauaaaaa

SEQ ID NO: 24684 - RNA, 20 nt, Artificial Sequence
  TRAC targeting sequence
acacgcauuaacuaacggau

SEQ ID NO: 24685 - RNA, 20 nt, Artificial Sequence
  TRAC targeting sequence
guuaguuaaugcguguagag

SEQ ID NO: 24686 - RNA, 20 nt, Artificial Sequence
  TRAC targeting sequence
ugccauauuauauugaaaua

SEQ ID NO: 24687 - RNA, 20 nt, Artificial Sequence
  TRAC targeting sequence
auuucucugacaaguugaac

SEQ ID NO: 24688 - RNA, 20 nt, Artificial Sequence
  TRAC targeting sequence
cugacaaguugaaccuuucu

SEQ ID NO: 24689 - RNA, 20 nt, Artificial Sequence
  TRAC targeting sequence
gacaaguugaaccuuucucu

SEQ ID NO: 24690 - RNA, 20 nt, Artificial Sequence
  TRAC targeting sequence
gagaaauugaugcuuccugc

SEQ ID NO: 24691 - RNA, 20 nt, Artificial Sequence
  TRAC targeting sequence
acuugucagagaaauugaug

SEQ ID NO: 24692 - RNA, 20 nt, Artificial Sequence
  TRAC targeting sequence
cucugccucaucaacaagua

SEQ ID NO: 24693 - RNA, 20 nt, Artificial Sequence
  TRAC targeting sequence
cugccucaucaacaaguagg

SEQ ID NO: 24694 - RNA, 20 nt, Artificial Sequence
  TRAC targeting sequence
gccucaucaacaaguaggag

SEQ ID NO: 24695 - RNA, 20 nt, Artificial Sequence
  TRAC targeting sequence
ucaacaaguaggaggguagc

SEQ ID NO: 24696 - RNA, 20 nt, Artificial Sequence
  TRAC targeting sequence
acaaguaggaggguagcuuc

SEQ ID NO: 24697 - RNA, 20 nt, Artificial Sequence
  TRAC targeting sequence
uacuuguugaugaggcagag

SEQ ID NO: 24698 - RNA, 20 nt, Artificial Sequence
  TRAC targeting sequence
ucacgaauauucaacuucaa

SEQ ID NO: 24699 - RNA, 20 nt, Artificial Sequence
  TRAC targeting sequence
acuucaaacuuuacaggcua

SEQ ID NO: 24700 - RNA, 20 nt, Artificial Sequence
  TRAC targeting sequence
aacuuuacaggcuaggcuga

SEQ ID NO: 24701 - RNA, 20 nt, Artificial Sequence
  TRAC targeting sequence
gccuagccuguaaaguuuga

SEQ ID NO: 24702 - RNA, 20 nt, Artificial Sequence
  TRAC targeting sequence
uucagguguggauucuucag

SEQ ID NO: 24703 - RNA, 20 nt, Artificial Sequence
  TRAC targeting sequence
gguguggauucuucagggag

SEQ ID NO: 24704 - RNA, 20 nt, Artificial Sequence
  TRAC targeting sequence
acaccugaaugauuaaaaag

SEQ ID NO: 24705 - RNA, 20 nt, Artificial Sequence
  TRAC targeting sequence
ucagggaguuucuguuccau

SEQ ID NO: 24706 - RNA, 20 nt, Artificial Sequence
  TRAC targeting sequence
gggaguuucuguuccaucag

SEQ ID NO: 24707 - RNA, 20 nt, Artificial Sequence
  TRAC targeting sequence
cugaagaauccacaccugaa

SEQ ID NO: 24708 - RNA, 20 nt, Artificial Sequence
  TRAC targeting sequence
guuccaucagccaggcuccu

SEQ ID NO: 24709 - RNA, 20 nt, Artificial Sequence
  TRAC targeting sequence
aucagccaggcuccuuccag

SEQ ID NO: 24710 - RNA, 20 nt, Artificial Sequence
  TRAC targeting sequence
gccaggcuccuuccaguguu

SEQ ID NO: 24711 - RNA, 20 nt, Artificial Sequence
  TRAC targeting sequence
uuccaguguuuucucccuua

SEQ ID NO: 24712 - RNA, 20 nt, Artificial Sequence
  TRAC targeting sequence
aguguuuucucccuuauguu

SEQ ID NO: 24713 - RNA, 20 nt, Artificial Sequence
  TRAC targeting sequence
cccuuauguuuugucugccu

SEQ ID NO: 24714 - RNA, 20 nt, Artificial Sequence
  TRAC targeting sequence
cuuauguuuugucugccuuu

SEQ ID NO: 24715 - RNA, 20 nt, Artificial Sequence
  TRAC targeting sequence
gccuuugauccaugucaacu

SEQ ID NO: 24716 - RNA, 20 nt, Artificial Sequence
  TRAC targeting sequence
aaggcagacaaaacauaagg

SEQ ID NO: 24717 - RNA, 20 nt, Artificial Sequence
  TRAC targeting sequence
augucaacuaucaucauuaa

SEQ ID NO: 24718 - RNA, 20 nt, Artificial Sequence
  TRAC targeting sequence
acuaucaucauuaagaucuc

SEQ ID NO: 24719 - RNA, 20 nt, Artificial Sequence
  TRAC targeting sequence
ucauuaagaucuccccagga

SEQ ID NO: 24720 - RNA, 20 nt, Artificial Sequence
  TRAC targeting sequence
uuaagaucuccccaggaacu

SEQ ID NO: 24721 - RNA, 20 nt, Artificial Sequence
  TRAC targeting sequence
uaaugaugauaguugacaug

SEQ ID NO: 24722 - RNA, 20 nt, Artificial Sequence
  TRAC targeting sequence
ccccaggaacucucacagga

SEQ ID NO: 24723 - RNA, 20 nt, Artificial Sequence
  TRAC targeting sequence
ccaggaacucucacaggaga

SEQ ID NO: 24724 - RNA, 20 nt, Artificial Sequence
  TRAC targeting sequence
uggggagaucuuaaugauga

SEQ ID NO: 24725 - RNA, 20 nt, Artificial Sequence
  TRAC targeting sequence
cacaggagagaagaagagau

SEQ ID NO: 24726 - RNA, 20 nt, Artificial Sequence
  TRAC targeting sequence
caggagagaagaagagauga

SEQ ID NO: 24727 - RNA, 20 nt, Artificial Sequence
  TRAC targeting sequence
ugugagaguuccuggggaga

SEQ ID NO: 24728 - RNA, 20 nt, Artificial Sequence
  TRAC targeting sequence
ccugugagaguuccugggga

SEQ ID NO: 24729 - RNA, 20 nt, Artificial Sequence
  TRAC targeting sequence
cuccugugagaguuccuggg

SEQ ID NO: 24730 - RNA, 20 nt, Artificial Sequence
  TRAC targeting sequence
ucucuccugugagaguuccu

SEQ ID NO: 24731 - RNA, 20 nt, Artificial Sequence
  TRAC targeting sequence
ucuucucuccugugagaguu

SEQ ID NO: 24732 - RNA, 20 nt, Artificial Sequence
  TRAC targeting sequence
cuucuucucuccugugagag

SEQ ID NO: 24733 - RNA, 20 nt, Artificial Sequence
  TRAC targeting sequence
ucucuucuucucuccuguga

SEQ ID NO: 24734 - RNA, 20 nt, Artificial Sequence
  TRAC targeting sequence
auuugguguuuuucaucucu

SEQ ID NO: 24735 - RNA, 20 nt, Artificial Sequence
  TRAC targeting sequence
auaaguccauuugguguuuu

SEQ ID NO: 24736 - RNA, 20 nt, Artificial Sequence
  TRAC targeting sequence
gagaccugcuagucacacca

SEQ ID NO: 24737 - RNA, 20 nt, Artificial Sequence
  TRAC targeting sequence
gaaacaaaugcauucaauaa

SEQ ID NO: 24738 - RNA, 20 nt, Artificial Sequence
  TRAC targeting sequence
cagaaacaaaugcauucaau

SEQ ID NO: 24739 - RNA, 20 nt, Artificial Sequence
  TRAC targeting sequence
caccaauauacuacacuagg

SEQ ID NO: 24740 - RNA, 20 nt, Artificial Sequence
  TRAC targeting sequence
gaacuacuuaaaacagcaag

SEQ ID NO: 24741 - RNA, 20 nt, Artificial Sequence
  TRAC targeting sequence
gaaaagcccuaguguaguau

SEQ ID NO: 24742 - RNA, 20 nt, Artificial Sequence
  TRAC targeting sequence
ugcuguuuuaaguaguucag

SEQ ID NO: 24743 - RNA, 20 nt, Artificial Sequence
  TRAC targeting sequence
cuauucgguuuaugauucua

SEQ ID NO: 24744 - RNA, 20 nt, Artificial Sequence
  TRAC targeting sequence
auucgguuuaugauucuaua

SEQ ID NO: 24745 - RNA, 20 nt, Artificial Sequence
  TRAC targeting sequence
guuuaugauucuauaaucau

SEQ ID NO: 24746 - RNA, 20 nt, Artificial Sequence
  TRAC targeting sequence
uaaaccgaauagagaaguag

SEQ ID NO: 24747 - RNA, 20 nt, Artificial Sequence
  TRAC targeting sequence
auaaucauugaaacauuuuu

SEQ ID NO: 24748 - RNA, 20 nt, Artificial Sequence
  TRAC targeting sequence
uugaaacauuuuuaacugau

SEQ ID NO: 24749 - RNA, 20 nt, Artificial Sequence
  TRAC targeting sequence
augauuauagaaucauaaac

SEQ ID NO: 24750 - RNA, 20 nt, Artificial Sequence
  TRAC targeting sequence
guuaaaaauguuucaaugau

SEQ ID NO: 24751 - RNA, 20 nt, Artificial Sequence
  TRAC targeting sequence
gucaauaggaaauugcuaac

SEQ ID NO: 24752 - RNA, 20 nt, Artificial Sequence
  TRAC targeting sequence
auaggaaauugcuaacacua

SEQ ID NO: 24753 - RNA, 20 nt, Artificial Sequence
  TRAC targeting sequence
uauugacagaucaguuaaaa

SEQ ID NO: 24754 - RNA, 20 nt, Artificial Sequence
  TRAC targeting sequence
acacuaguguuagcaauuuc

SEQ ID NO: 24755 - RNA, 20 nt, Artificial Sequence
  TRAC targeting sequence
auuaguuuaaaucagaauau

SEQ ID NO: 24756 - RNA, 20 nt, Artificial Sequence
  TRAC targeting sequence
gaauauuaauauaguuuaaa

SEQ ID NO: 24757 - RNA, 20 nt, Artificial Sequence
  TRAC targeting sequence
gauuuaaacuaauugaaauc

SEQ ID NO: 24758 - RNA, 20 nt, Artificial Sequence
  TRAC targeting sequence
uguccagaguaguggauaag

SEQ ID NO: 24759 - RNA, 20 nt, Artificial Sequence
  TRAC targeting sequence
agaguaguggauaagagugc

SEQ ID NO: 24760 - RNA, 20 nt, Artificial Sequence
  TRAC targeting sequence
ggacaagaauuuuaaacuau

SEQ ID NO: 24761 - RNA, 20 nt, Artificial Sequence
  TRAC targeting sequence
acuacucuggacaagaauuu

SEQ ID NO: 24762 - RNA, 20 nt, Artificial Sequence
  TRAC targeting sequence
uauccacuacucuggacaag

SEQ ID NO: 24763 - RNA, 20 nt, Artificial Sequence
  TRAC targeting sequence
aaucuggaacaaguuacuca

SEQ ID NO: 24764 - RNA, 20 nt, Artificial Sequence
  TRAC targeting sequence
ggaacaaguuacucagucug

SEQ ID NO: 24765 - RNA, 20 nt, Artificial Sequence
  TRAC targeting sequence
agauuagacaacuaguaaac

SEQ ID NO: 24766 - RNA, 20 nt, Artificial Sequence
  TRAC targeting sequence
gucugacagucucauuuucc

SEQ ID NO: 24767 - RNA, 20 nt, Artificial Sequence
  TRAC targeting sequence
gacagucucauuuuccuuuu

SEQ ID NO: 24768 - RNA, 20 nt, Artificial Sequence
  TRAC targeting sequence
gacugaguaacuuguuccag

SEQ ID NO: 24769 - RNA, 20 nt, Artificial Sequence
  TRAC targeting sequence
cauuuuccuuuucuauaaaa

SEQ ID NO: 24770 - RNA, 20 nt, Artificial Sequence
  TRAC targeting sequence
uuuuccuuuucuauaaaaca

SEQ ID NO: 24771 - RNA, 20 nt, Artificial Sequence
  TRAC targeting sequence
uuuucuauaaaacagaaaua

SEQ ID NO: 24772 - RNA, 20 nt, Artificial Sequence
  TRAC targeting sequence
auaaaacagaaauaacaaua

SEQ ID NO: 24773 - RNA, 20 nt, Artificial Sequence
  TRAC targeting sequence
guuuuauagaaaaggaaaau

SEQ ID NO: 24774 - RNA, 20 nt, Artificial Sequence
  TRAC targeting sequence
uugaaauuaugugaggauua

SEQ ID NO: 24775 - RNA, 20 nt, Artificial Sequence
  TRAC targeting sequence
augagccagguauuguuauu

SEQ ID NO: 24776 - RNA, 20 nt, Artificial Sequence
  TRAC targeting sequence
cauaauuucaaugagccagg

SEQ ID NO: 24777 - RNA, 20 nt, Artificial Sequence
  TRAC targeting sequence
ucacauaauuucaaugagcc

SEQ ID NO: 24778 - RNA, 20 nt, Artificial Sequence
  TRAC targeting sequence
uuuaauccucacauaauuuc

SEQ ID NO: 24779 - RNA, 20 nt, Artificial Sequence
  TRAC targeting sequence
cauuuaauccucacauaauu

SEQ ID NO: 24780 - RNA, 20 nt, Artificial Sequence
  TRAC targeting sequence
uaguaauuaaccaugucugc

SEQ ID NO: 24781 - RNA, 20 nt, Artificial Sequence
  TRAC targeting sequence
gcuucuccuaguucucugaa

SEQ ID NO: 24782 - RNA, 20 nt, Artificial Sequence
  TRAC targeting sequence
ccuaguucucugaaugauua

SEQ ID NO: 24783 - RNA, 20 nt, Artificial Sequence
  TRAC targeting sequence
uaguucucugaaugauuaaa

SEQ ID NO: 24784 - RNA, 20 nt, Artificial Sequence
  TRAC targeting sequence
cugaaugauuaaaaguuagc

SEQ ID NO: 24785 - RNA, 20 nt, Artificial Sequence
  TRAC targeting sequence
gaaugauuaaaaguuagcca

SEQ ID NO: 24786 - RNA, 20 nt, Artificial Sequence
  TRAC targeting sequence
gagaacuaggagaagcagac

SEQ ID NO: 24787 - RNA, 20 nt, Artificial Sequence
  TRAC targeting sequence
uucagagaacuaggagaagc

SEQ ID NO: 24788 - RNA, 20 nt, Artificial Sequence
  TRAC targeting sequence
uuugcauacccaaauuauug

SEQ ID NO: 24789 - RNA, 20 nt, Artificial Sequence
  TRAC targeting sequence
agugcuaucuuuugcauacc

SEQ ID NO: 24790 - RNA, 20 nt, Artificial Sequence
  TRAC targeting sequence
cuccagugcuaucuuuugca

SEQ ID NO: 24791 - RNA, 20 nt, Artificial Sequence
  TRAC targeting sequence
aauggcucuuaaagggcaga

SEQ ID NO: 24792 - RNA, 20 nt, Artificial Sequence
  TRAC targeting sequence
uaaagggcagaucuaauuua

SEQ ID NO: 24793 - RNA, 20 nt, Artificial Sequence
  TRAC targeting sequence
gcccuuuaagagccauuuga

SEQ ID NO: 24794 - RNA, 20 nt, Artificial Sequence
  TRAC targeting sequence
aauuuauaagcugaaacuga

SEQ ID NO: 24795 - RNA, 20 nt, Artificial Sequence
  TRAC targeting sequence
gcuuauaaauuagaucugcc

SEQ ID NO: 24796 - RNA, 20 nt, Artificial Sequence
  TRAC targeting sequence
guuucagcuuauaaauuaga

SEQ ID NO: 24797 - RNA, 20 nt, Artificial Sequence
  TRAC targeting sequence
gaguauacuuuagggguuuc

SEQ ID NO: 24798 - RNA, 20 nt, Artificial Sequence
  TRAC targeting sequence
gacuucaguuucagcuuaua

SEQ ID NO: 24799 - RNA, 20 nt, Artificial Sequence
  TRAC targeting sequence
uuacauaaaacaauggaaga

SEQ ID NO: 24800 - RNA, 20 nt, Artificial Sequence
  TRAC targeting sequence
augcggagauuuccuuuaga

SEQ ID NO: 24801 - RNA, 20 nt, Artificial Sequence
  TRAC targeting sequence
uuuccaugcggagauuuccu

SEQ ID NO: 24802 - RNA, 20 nt, Artificial Sequence
  TRAC targeting sequence
uuuccauuuccuuucccuug

SEQ ID NO: 24803 - RNA, 20 nt, Artificial Sequence
  TRAC targeting sequence
auuuccuuucccuugcauug

SEQ ID NO: 24804 - RNA, 20 nt, Artificial Sequence
  TRAC targeting sequence
uuucccuugcauugucacgu

SEQ ID NO: 24805 - RNA, 20 nt, Artificial Sequence
  TRAC targeting sequence
cuugcauugucacguuugcc

SEQ ID NO: 24806 - RNA, 20 nt, Artificial Sequence
  TRAC targeting sequence
cguuugccuuaagauucccc

SEQ ID NO: 24807 - RNA, 20 nt, Artificial Sequence
  TRAC targeting sequence
uaaggcaaacgugacaaugc

SEQ ID NO: 24808 - RNA, 20 nt, Artificial Sequence
  TRAC targeting sequence
ccucuuugcuucuguuaacu

SEQ ID NO: 24809 - RNA, 20 nt, Artificial Sequence
  TRAC targeting sequence
uugcuucuguuaacugcuau

SEQ ID NO: 24810 - RNA, 20 nt, Artificial Sequence
  TRAC targeting sequence
guuaacugcuauugcauaua

SEQ ID NO: 24811 - RNA, 20 nt, Artificial Sequence
  TRAC targeting sequence
gaaaauaauaaccuauuuua

SEQ ID NO: 24812 - RNA, 20 nt, Artificial Sequence
  TRAC targeting sequence
uuaaauuuuuauuucugaaa

SEQ ID NO: 24813 - RNA, 20 nt, Artificial Sequence
  TRAC targeting sequence
ccuuaaauuuuuauuucuga

SEQ ID NO: 24814 - RNA, 20 nt, Artificial Sequence
  TRAC targeting sequence
aguugcaaacagcacaaagu

SEQ ID NO: 24815 - RNA, 20 nt, Artificial Sequence
  TRAC targeting sequence
aauuuuuaaaguaucaaguu

SEQ ID NO: 24816 - RNA, 20 nt, Artificial Sequence
  TRAC targeting sequence
aguuucugaucaaguccuag

SEQ ID NO: 24817 - RNA, 20 nt, Artificial Sequence
  TRAC targeting sequence
gaucaaguccuaguaaagca

SEQ ID NO: 24818 - RNA, 20 nt, Artificial Sequence
  TRAC targeting sequence
gaaacuugauacuuuaaaaa

SEQ ID NO: 24819 - RNA, 20 nt, Artificial Sequence
  TRAC targeting sequence
aguccuaguaaagcaguaaa

SEQ ID NO: 24820 - RNA, 20 nt, Artificial Sequence
  TRAC targeting sequence
uaguaaagcaguaaauaucu

SEQ ID NO: 24821 - RNA, 20 nt, Artificial Sequence
  TRAC targeting sequence
gccccauguuguggugagug

SEQ ID NO: 24822 - RNA, 20 nt, Artificial Sequence
  TRAC targeting sequence
ucagugccugagcaacagug

SEQ ID NO: 24823 - RNA, 20 nt, Artificial Sequence
  TRAC targeting sequence
gugccugagcaacagugugc

SEQ ID NO: 24824 - RNA, 20 nt, Artificial Sequence
  TRAC targeting sequence
ggcacugaugauuucagccc

SEQ ID NO: 24825 - RNA, 20 nt, Artificial Sequence
  TRAC targeting sequence
auugcacacuguugcucagg

SEQ ID NO: 24826 - RNA, 20 nt, Artificial Sequence
  TRAC targeting sequence
gugauaaugucucugcacug

SEQ ID NO: 24827 - RNA, 20 nt, Artificial Sequence
  TRAC targeting sequence
cagaaaauucuauugcacac

SEQ ID NO: 24828 - RNA, 20 nt, Artificial Sequence
  TRAC targeting sequence
cugcacugcccaguauagua

SEQ ID NO: 24829 - RNA, 20 nt, Artificial Sequence
  TRAC targeting sequence
gcacugcccaguauaguaac

SEQ ID NO: 24830 - RNA, 20 nt, Artificial Sequence
  TRAC targeting sequence
gcaagcagcgagagagugaa

SEQ ID NO: 24831 - RNA, 20 nt, Artificial Sequence
  TRAC targeting sequence
acuuaacaagagugagaucu

SEQ ID NO: 24832 - RNA, 20 nt, Artificial Sequence
  TRAC targeting sequence
uguuaaguggacucugcaag

SEQ ID NO: 24833 - RNA, 20 nt, Artificial Sequence
  TRAC targeting sequence
cucuuguuaaguggacucug

SEQ ID NO: 24834 - RNA, 20 nt, Artificial Sequence
  TRAC targeting sequence
cacucuuguuaaguggacuc

SEQ ID NO: 24835 - RNA, 20 nt, Artificial Sequence
  TRAC targeting sequence
gguauaaagaaaaugauauu

SEQ ID NO: 24836 - RNA, 20 nt, Artificial Sequence
  TRAC targeting sequence
uuauaccagaucucacucuu

SEQ ID NO: 24837 - RNA, 20 nt, Artificial Sequence
  TRAC targeting sequence
uuuucuuuauaccagaucuc

SEQ ID NO: 24838 - RNA, 20 nt, Artificial Sequence
  TRAC targeting sequence
aaagcuaccuuaggggagga

SEQ ID NO: 24839 - RNA, 20 nt, Artificial Sequence
  TRAC targeting sequence
ccuaagguagcuuuggaaua

SEQ ID NO: 24840 - RNA, 20 nt, Artificial Sequence
  TRAC targeting sequence
uccccuaagguagcuuugga

SEQ ID NO: 24841 - RNA, 20 nt, Artificial Sequence
  TRAC targeting sequence
gccuuaaggguaccauuuca

SEQ ID NO: 24842 - RNA, 20 nt, Artificial Sequence
  TRAC targeting sequence
auguucagucaaagagauau

SEQ ID NO: 24843 - RNA, 20 nt, Artificial Sequence
  TRAC targeting sequence
gucaaagagauauaccuugu

SEQ ID NO: 24844 - RNA, 20 nt, Artificial Sequence
  TRAC targeting sequence
aagagauauaccuuguucac

SEQ ID NO: 24845 - RNA, 20 nt, Artificial Sequence
  TRAC targeting sequence
uugacugaacauagaaauga

SEQ ID NO: 24846 - RNA, 20 nt, Artificial Sequence
  TRAC targeting sequence
cuuugacugaacauagaaau

SEQ ID NO: 24847 - RNA, 20 nt, Artificial Sequence
  TRAC targeting sequence
caguuuauucaaauggcagu

SEQ ID NO: 24848 - RNA, 20 nt, Artificial Sequence
  TRAC targeting sequence
aauggcagugauacccauuu

SEQ ID NO: 24849 - RNA, 20 nt, Artificial Sequence
  TRAC targeting sequence
cugccauuugaauaaacugu

SEQ ID NO: 24850 - RNA, 20 nt, Artificial Sequence
  TRAC targeting sequence
aauggguaucacugccauuu

SEQ ID NO: 24851 - RNA, 20 nt, Artificial Sequence
  TRAC targeting sequence
uguuucaaauggguaucacu

SEQ ID NO: 24852 - RNA, 20 nt, Artificial Sequence
  TRAC targeting sequence
auagcugccaggccugagcu

SEQ ID NO: 24853 - RNA, 20 nt, Artificial Sequence
  TRAC targeting sequence
ggccuggcagcuauagauua

SEQ ID NO: 24854 - RNA, 20 nt, Artificial Sequence
  TRAC targeting sequence
guuuaucagcuccaccuacu

SEQ ID NO: 24855 - RNA, 20 nt, Artificial Sequence
  TRAC targeting sequence
gcuccaccuacuuuuggaau

SEQ ID NO: 24856 - RNA, 20 nt, Artificial Sequence
  TRAC targeting sequence
accuacuuuuggaauacuca

SEQ ID NO: 24857 - RNA, 20 nt, Artificial Sequence
  TRAC targeting sequence
aaaaguagguggagcugaua

SEQ ID NO: 24858 - RNA, 20 nt, Artificial Sequence
  TRAC targeting sequence
gugaugacuuacagucauag

SEQ ID NO: 24859 - RNA, 20 nt, Artificial Sequence
  TRAC targeting sequence
cugaguauuccaaaaguagg

SEQ ID NO: 24860 - RNA, 20 nt, Artificial Sequence
  TRAC targeting sequence
ucacugaguauuccaaaagu

SEQ ID NO: 24861 - RNA, 20 nt, Artificial Sequence
  TRAC targeting sequence
uagaaagaggguuuguaacc

SEQ ID NO: 24862 - RNA, 20 nt, Artificial Sequence
  TRAC targeting sequence
augacuguaagucaucacug

SEQ ID NO: 24863 - RNA, 20 nt, Artificial Sequence
  TRAC targeting sequence
uucuaugacuguaagucauc

SEQ ID NO: 24864 - RNA, 20 nt, Artificial Sequence
  TRAC targeting sequence
caaggaguucaccuugcccg

SEQ ID NO: 24865 - RNA, 20 nt, Artificial Sequence
  TRAC targeting sequence
uugggagguuacaaacccuc

SEQ ID NO: 24866 - RNA, 20 nt, Artificial Sequence
  TRAC targeting sequence
ccuugcccgcugccuagaca

SEQ ID NO: 24867 - RNA, 20 nt, Artificial Sequence
  TRAC targeting sequence
cggggcugacuuccuuguug

SEQ ID NO: 24868 - RNA, 20 nt, Artificial Sequence
  TRAC targeting sequence
gucacaaaccacaaacuaua

SEQ ID NO: 24869 - RNA, 20 nt, Artificial Sequence
  TRAC targeting sequence
caaaccacaaacuauaaacu

SEQ ID NO: 24870 - RNA, 20 nt, Artificial Sequence
  TRAC targeting sequence
cccaaaguuaguucagccua

SEQ ID NO: 24871 - RNA, 20 nt, Artificial Sequence
  TRAC targeting sequence
caaaguuaguucagccuaug

SEQ ID NO: 24872 - RNA, 20 nt, Artificial Sequence
  TRAC targeting sequence
gccuaugcccaggaaugaac

SEQ ID NO: 24873 - RNA, 20 nt, Artificial Sequence
  TRAC targeting sequence
ugggcauaggcugaacuaac

SEQ ID NO: 24874 - RNA, 20 nt, Artificial Sequence
  TRAC targeting sequence
uuccugggcauaggcugaac

SEQ ID NO: 24875 - RNA, 20 nt, Artificial Sequence
  TRAC targeting sequence
uuguucauuccugggcauag

SEQ ID NO: 24876 - RNA, 20 nt, Artificial Sequence
  TRAC targeting sequence
aaccagguuguccuuguuca

SEQ ID NO: 24877 - RNA, 20 nt, Artificial Sequence
  TRAC targeting sequence
cuucuaaccagguuguccuu

SEQ ID NO: 24878 - RNA, 20 nt, Artificial Sequence
  TRAC targeting sequence
cgcuucuaaccagguugucc

SEQ ID NO: 24879 - RNA, 20 nt, Artificial Sequence
  TRAC targeting sequence
aucucgcuucuaaccagguu

SEQ ID NO: 24880 - RNA, 20 nt, Artificial Sequence
  TRAC targeting sequence
guuaaguuagaucucuuuca

SEQ ID NO: 24881 - RNA, 20 nt, Artificial Sequence
  TRAC targeting sequence
aacuuaacugacuccaucuc

SEQ ID NO: 24882 - RNA, 20 nt, Artificial Sequence
  TRAC targeting sequence
cuuucacugucucagucaua

SEQ ID NO: 24883 - RNA, 20 nt, Artificial Sequence
  TRAC targeting sequence
uucacugucucagucauaau

SEQ ID NO: 24884 - RNA, 20 nt, Artificial Sequence
  TRAC targeting sequence
cugucucagucauaauuuug

SEQ ID NO: 24885 - RNA, 20 nt, Artificial Sequence
  TRAC targeting sequence
cagucauaauuuugcaaaga

SEQ ID NO: 24886 - RNA, 20 nt, Artificial Sequence
  TRAC targeting sequence
gucauaauuuugcaaagaug

SEQ ID NO: 24887 - RNA, 20 nt, Artificial Sequence
  TRAC targeting sequence
uaauuuugcaaagaugguuu

SEQ ID NO: 24888 - RNA, 20 nt, Artificial Sequence
  TRAC targeting sequence
uugcaaaauuaugacugaga

SEQ ID NO: 24889 - RNA, 20 nt, Artificial Sequence
  TRAC targeting sequence
gauuugucaaauuaauuucc

SEQ ID NO: 24890 - RNA, 20 nt, Artificial Sequence
  TRAC targeting sequence
gaaaccaucuuugcaaaauu

SEQ ID NO: 24891 - RNA, 20 nt, Artificial Sequence
  TRAC targeting sequence
aauuaauuuccauccacacu

SEQ ID NO: 24892 - RNA, 20 nt, Artificial Sequence
  TRAC targeting sequence
auccacacuuguuggagucu

SEQ ID NO: 24893 - RNA, 20 nt, Artificial Sequence
  TRAC targeting sequence
acacuuguuggagucucaua

SEQ ID NO: 24894 - RNA, 20 nt, Artificial Sequence
  TRAC targeting sequence
aacaaguguggauggaaauu

SEQ ID NO: 24895 - RNA, 20 nt, Artificial Sequence
  TRAC targeting sequence
cauacuugcucauggugugc

SEQ ID NO: 24896 - RNA, 20 nt, Artificial Sequence
  TRAC targeting sequence
uacuugcucauggugugcuu

SEQ ID NO: 24897 - RNA, 20 nt, Artificial Sequence
  TRAC targeting sequence
uggugugcuuuguccugaug

SEQ ID NO: 24898 - RNA, 20 nt, Artificial Sequence
  TRAC targeting sequence
ggacaaagcacaccaugagc

SEQ ID NO: 24899 - RNA, 20 nt, Artificial Sequence
  TRAC targeting sequence
ucaggacaaagcacaccaug

SEQ ID NO: 24900 - RNA, 20 nt, Artificial Sequence
  TRAC targeting sequence
uuaucaucaggacaaagcac

SEQ ID NO: 24901 - RNA, 20 nt, Artificial Sequence
  TRAC targeting sequence
ccuuaucaucaggacaaagc

SEQ ID NO: 24902 - RNA, 20 nt, Artificial Sequence
  TRAC targeting sequence
ccccagaggccugccuuaga

SEQ ID NO: 24903 - RNA, 20 nt, Artificial Sequence
  TRAC targeting sequence
ccagaggccugccuuagagu

SEQ ID NO: 24904 - RNA, 20 nt, Artificial Sequence
  TRAC targeting sequence
ggggagaaaauguaaguuau

SEQ ID NO: 24905 - RNA, 20 nt, Artificial Sequence
  TRAC targeting sequence
aaggcaggccucuggggaga

SEQ ID NO: 24906 - RNA, 20 nt, Artificial Sequence
  TRAC targeting sequence
gagaguccucuuuacucugu

SEQ ID NO: 24907 - RNA, 20 nt, Artificial Sequence
  TRAC targeting sequence
gagccuacucuaaggcaggc

SEQ ID NO: 24908 - RNA, 20 nt, Artificial Sequence
  TRAC targeting sequence
cggagccuacucuaaggcag

SEQ ID NO: 24909 - RNA, 20 nt, Artificial Sequence
  TRAC targeting sequence
ucuuuacucuguguaauucu

SEQ ID NO: 24910 - RNA, 20 nt, Artificial Sequence
  TRAC targeting sequence
aguuuccuacuuccaagaaa

SEQ ID NO: 24911 - RNA, 20 nt, Artificial Sequence
  TRAC targeting sequence
uacuuccaagaaaccucuac

SEQ ID NO: 24912 - RNA, 20 nt, Artificial Sequence
  TRAC targeting sequence
aagaaaccucuacuuuaaag

SEQ ID NO: 24913 - RNA, 20 nt, Artificial Sequence
  TRAC targeting sequence
uggaaguaggaaacuugaau

SEQ ID NO: 24914 - RNA, 20 nt, Artificial Sequence
  TRAC targeting sequence
acuuuaaagcugauuucgca

SEQ ID NO: 24915 - RNA, 20 nt, Artificial Sequence
  TRAC targeting sequence
gcuuuaaaguagagguuucu

SEQ ID NO: 24916 - RNA, 20 nt, Artificial Sequence
  TRAC targeting sequence
cacaugaaaacaaaauacaa

SEQ ID NO: 24917 - RNA, 20 nt, Artificial Sequence
  TRAC targeting sequence
ugugcgaaaucagcuuuaaa

SEQ ID NO: 24918 - RNA, 20 nt, Artificial Sequence
  TRAC targeting sequence
cugcacuccugagaaauggu

SEQ ID NO: 24919 - RNA, 20 nt, Artificial Sequence
  TRAC targeting sequence
ugucugggagugauacagua

SEQ ID NO: 24920 - RNA, 20 nt, Artificial Sequence
  TRAC targeting sequence
gggagugauacaguauggaa

SEQ ID NO: 24921 - RNA, 20 nt, Artificial Sequence
  TRAC targeting sequence
cagacaggacaauaaaaucu

SEQ ID NO: 24922 - RNA, 20 nt, Artificial Sequence
  TRAC targeting sequence
cucccagacaggacaauaaa

SEQ ID NO: 24923 - RNA, 20 nt, Artificial Sequence
  TRAC targeting sequence
auacuguaucacucccagac

SEQ ID NO: 24924 - RNA, 20 nt, Artificial Sequence
  TRAC targeting sequence
auuugguacaauuuagaaug

SEQ ID NO: 24925 - RNA, 20 nt, Artificial Sequence
  TRAC targeting sequence
aaauuguaccaaauagaaaa

SEQ ID NO: 24926 - RNA, 20 nt, Artificial Sequence
  TRAC targeting sequence
caaagccuuugacacuuagu

SEQ ID NO: 24927 - RNA, 20 nt, Artificial Sequence
  TRAC targeting sequence
aaggcuuugggagcuacauu

SEQ ID NO: 24928 - RNA, 20 nt, Artificial Sequence
  TRAC targeting sequence
uagguaauuguuuaugcuuc

SEQ ID NO: 24929 - RNA, 20 nt, Artificial Sequence
  TRAC targeting sequence
gccucuucacuagacuuuuc

SEQ ID NO: 24930 - RNA, 20 nt, Artificial Sequence
  TRAC targeting sequence
ucacuagacuuuucuucauu

SEQ ID NO: 24931 - RNA, 20 nt, Artificial Sequence
  TRAC targeting sequence
cuagacuuuucuucauuuac

SEQ ID NO: 24932 - RNA, 20 nt, Artificial Sequence
  TRAC targeting sequence
agugaagaggcagaagcaua

SEQ ID NO: 24933 - RNA, 20 nt, Artificial Sequence
  TRAC targeting sequence
auauuuguuggguaaaugaa

SEQ ID NO: 24934 - RNA, 20 nt, Artificial Sequence
  TRAC targeting sequence
gccacacuuuguucuaggug

SEQ ID NO: 24935 - RNA, 20 nt, Artificial Sequence
  TRAC targeting sequence
agguguugggagcacagcag

SEQ ID NO: 24936 - RNA, 20 nt, Artificial Sequence
  TRAC targeting sequence
caacaccuagaacaaagugu

SEQ ID NO: 24937 - RNA, 20 nt, Artificial Sequence
  TRAC targeting sequence
gcugugcucccaacaccuag

SEQ ID NO: 24938 - RNA, 20 nt, Artificial Sequence
  TRAC targeting sequence
uguuaucugcugugcuccca

SEQ ID NO: 24939 - RNA, 20 nt, Artificial Sequence
  TRAC targeting sequence
gucuuguuaucugcugugcu

SEQ ID NO: 24940 - RNA, 20 nt, Artificial Sequence
  TRAC targeting sequence
cugucuuguuaucugcugug

SEQ ID NO: 24941 - RNA, 20 nt, Artificial Sequence
  TRAC targeting sequence
cccaggaaauuuauucucua

SEQ ID NO: 24942 - RNA, 20 nt, Artificial Sequence
  TRAC targeting sequence
ugggggacccucucugucuu

SEQ ID NO: 24943 - RNA, 20 nt, Artificial Sequence
  TRAC targeting sequence
ugcauuguuuuuacucauuu

SEQ ID NO: 24944 - RNA, 20 nt, Artificial Sequence
  TRAC targeting sequence
gauaauguuauguguuauga

SEQ ID NO: 24945 - RNA, 20 nt, Artificial Sequence
  TRAC targeting sequence
gaaauuaucuugcauuguuu

SEQ ID NO: 24946 - RNA, 20 nt, Artificial Sequence
  TRAC targeting sequence
uaacacauaacauuaucuga

SEQ ID NO: 24947 - RNA, 20 nt, Artificial Sequence
  TRAC targeting sequence
ucauaacacauaacauuauc

SEQ ID NO: 24948 - RNA, 20 nt, Artificial Sequence
  TRAC targeting sequence
cauuacccuauuuuuauuuu

SEQ ID NO: 24949 - RNA, 20 nt, Artificial Sequence
  TRAC targeting sequence
gucacauuacccuauuuuua

SEQ ID NO: 24950 - RNA, 20 nt, Artificial Sequence
  TRAC targeting sequence
cucugucacauuacccuauu

SEQ ID NO: 24951 - RNA, 20 nt, Artificial Sequence
  TRAC targeting sequence
gaggcauuucuugaccacag

SEQ ID NO: 24952 - RNA, 20 nt, Artificial Sequence
  TRAC targeting sequence
ucugaggcauuucuugacca

SEQ ID NO: 24953 - RNA, 20 nt, Artificial Sequence
  TRAC targeting sequence
ccucaucugaggcauuucuu

SEQ ID NO: 24954 - RNA, 20 nt, Artificial Sequence
  TRAC targeting sequence
aacuuccccucaucugaggc

SEQ ID NO: 24955 - RNA, 20 nt, Artificial Sequence
  TRAC targeting sequence
gcucaaacuuccccucaucu

SEQ ID NO: 24956 - RNA, 20 nt, Artificial Sequence
  TRAC targeting sequence
gaauacaaaguuaucagcuc

SEQ ID NO: 24957 - RNA, 20 nt, Artificial Sequence
  TRAC targeting sequence
gagcucagcucaaacuuccc

SEQ ID NO: 24958 - RNA, 20 nt, Artificial Sequence
  TRAC targeting sequence
gcucugcaaagccaagaaca

SEQ ID NO: 24959 - RNA, 20 nt, Artificial Sequence
  TRAC targeting sequence
gcaaagccaagaacagccua

SEQ ID NO: 24960 - RNA, 20 nt, Artificial Sequence
  TRAC targeting sequence
uggcuuugcagagcugauaa

SEQ ID NO: 24961 - RNA, 20 nt, Artificial Sequence
  TRAC targeting sequence
guugcuacccuaggcuguuc

SEQ ID NO: 24962 - RNA, 20 nt, Artificial Sequence
  TRAC targeting sequence
acaaaaaugaaaaaaauuag

SEQ ID NO: 24963 - RNA, 20 nt, Artificial Sequence
  TRAC targeting sequence
cuacaaaaaugaaaaaaauu

SEQ ID NO: 24964 - RNA, 20 nt, Artificial Sequence
  TRAC targeting sequence
aucucuacaaaaaugaaaaa

SEQ ID NO: 24965 - RNA, 20 nt, Artificial Sequence
  TRAC targeting sequence
ugcuaugaugcccaggcugg

SEQ ID NO: 24966 - RNA, 20 nt, Artificial Sequence
  TRAC targeting sequence
uagcaagacucuaucucuac

SEQ ID NO: 24967 - RNA, 20 nt, Artificial Sequence
  TRAC targeting sequence
agccugggcaucauagcaag

SEQ ID NO: 24968 - RNA, 20 nt, Artificial Sequence
  TRAC targeting sequence
acauaauucuuggcauugaa

SEQ ID NO: 24969 - RNA, 20 nt, Artificial Sequence
  TRAC targeting sequence
uggcauugaauaacagcaac

SEQ ID NO: 24970 - RNA, 20 nt, Artificial Sequence
  TRAC targeting sequence
augccaagaauuauguugag

SEQ ID NO: 24971 - RNA, 20 nt, Artificial Sequence
  TRAC targeting sequence
uaucacaaauaaguguacca

SEQ ID NO: 24972 - RNA, 20 nt, Artificial Sequence
  TRAC targeting sequence
caaauaaguguaccacaugu

SEQ ID NO: 24973 - RNA, 20 nt, Artificial Sequence
  TRAC targeting sequence
aauaaacaugugguacacuu

SEQ ID NO: 24974 - RNA, 20 nt, Artificial Sequence
  TRAC targeting sequence
ugguuaguucucacaagaua

SEQ ID NO: 24975 - RNA, 20 nt, Artificial Sequence
  TRAC targeting sequence
cacaagauacaagccagagg

SEQ ID NO: 24976 - RNA, 20 nt, Artificial Sequence
  TRAC targeting sequence
caagauacaagccagaggaa

SEQ ID NO: 24977 - RNA, 20 nt, Artificial Sequence
  TRAC targeting sequence
ugugagaacuaaccaagaua

SEQ ID NO: 24978 - RNA, 20 nt, Artificial Sequence
  TRAC targeting sequence
ggcuuguaucuugugagaac

SEQ ID NO: 24979 - RNA, 20 nt, Artificial Sequence
  TRAC targeting sequence
ucuggcuuguaucuugugag

SEQ ID NO: 24980 - RNA, 20 nt, Artificial Sequence
  TRAC targeting sequence
uccucuggcuuguaucuugu

SEQ ID NO: 24981 - RNA, 20 nt, Artificial Sequence
  TRAC targeting sequence
uaauuucuuccucuggcuug

SEQ ID NO: 24982 - RNA, 20 nt, Artificial Sequence
  TRAC targeting sequence
cuuaauuucuuccucuggcu

SEQ ID NO: 24983 - RNA, 20 nt, Artificial Sequence
  TRAC targeting sequence
uuggccaaguuauuuagcau

SEQ ID NO: 24984 - RNA, 20 nt, Artificial Sequence
  TRAC targeting sequence
gcggugcuuccuaaaaaugc

SEQ ID NO: 24985 - RNA, 20 nt, Artificial Sequence
  TRAC targeting sequence
uaaaaaugcggcuuucuagc

SEQ ID NO: 24986 - RNA, 20 nt, Artificial Sequence
  TRAC targeting sequence
agcaucaagccaaaccagcu

SEQ ID NO: 24987 - RNA, 20 nt, Artificial Sequence
  TRAC targeting sequence
agccaaaccagcugaaucug

SEQ ID NO: 24988 - RNA, 20 nt, Artificial Sequence
  TRAC targeting sequence
gcugguuuggcuugaugcua

SEQ ID NO: 24989 - RNA, 20 nt, Artificial Sequence
  TRAC targeting sequence
gaaucucagaggguaggugc

SEQ ID NO: 24990 - RNA, 20 nt, Artificial Sequence
  TRAC targeting sequence
gauucagcugguuuggcuug

SEQ ID NO: 24991 - RNA, 20 nt, Artificial Sequence
  TRAC targeting sequence
cagaggguaggugcuagaaa

SEQ ID NO: 24992 - RNA, 20 nt, Artificial Sequence
  TRAC targeting sequence
gaggguaggugcuagaaauc

SEQ ID NO: 24993 - RNA, 20 nt, Artificial Sequence
  TRAC targeting sequence
gagauucagauucagcuggu

SEQ ID NO: 24994 - RNA, 20 nt, Artificial Sequence
  TRAC targeting sequence
uaagccccuaaacucuauaa

SEQ ID NO: 24995 - RNA, 20 nt, Artificial Sequence
  TRAC targeting sequence
auaaaugcugguucuccuaa

SEQ ID NO: 24996 - RNA, 20 nt, Artificial Sequence
  TRAC targeting sequence
ccuaaacguuaagucuuuau

SEQ ID NO: 24997 - RNA, 20 nt, Artificial Sequence
  TRAC targeting sequence
uaaacguuaagucuuuauaa

SEQ ID NO: 24998 - RNA, 20 nt, Artificial Sequence
  TRAC targeting sequence
uuauaaugaucagcuuaaca

SEQ ID NO: 24999 - RNA, 20 nt, Artificial Sequence
  TRAC targeting sequence
uuauaaagacuuaacguuua

SEQ ID NO: 25000 - RNA, 20 nt, Artificial Sequence
  TRAC targeting sequence
gcuuaacacuguguugcuac

SEQ ID NO: 25001 - RNA, 20 nt, Artificial Sequence
  TRAC targeting sequence
uuguagcaacacaguguuaa

SEQ ID NO: 25002 - RNA, 20 nt, Artificial Sequence
  TRAC targeting sequence
ucuuuguagcaacacagugu

SEQ ID NO: 25003 - RNA, 20 nt, Artificial Sequence
  TRAC targeting sequence
cagaaucaucuggguccugc

SEQ ID NO: 25004 - RNA, 20 nt, Artificial Sequence
  TRAC targeting sequence
gaaucaucuggguccugcag

SEQ ID NO: 25005 - RNA, 20 nt, Artificial Sequence
  TRAC targeting sequence
gagauuucuucuuuguagca

SEQ ID NO: 25006 - RNA, 20 nt, Artificial Sequence
  TRAC targeting sequence
ucuggguccugcaggaaggc

SEQ ID NO: 25007 - RNA, 20 nt, Artificial Sequence
  TRAC targeting sequence
ggguccugcaggaaggcuaa

SEQ ID NO: 25008 - RNA, 20 nt, Artificial Sequence
  TRAC targeting sequence
ugcaggaaggcuaaagaaaa

SEQ ID NO: 25009 - RNA, 20 nt, Artificial Sequence
  TRAC targeting sequence
ugcaggacccagaugauucu

SEQ ID NO: 25010 - RNA, 20 nt, Artificial Sequence
  TRAC targeting sequence
uuagccuuccugcaggaccc

SEQ ID NO: 25011 - RNA, 20 nt, Artificial Sequence
  TRAC targeting sequence
cgccuguaaucccugcaccu

SEQ ID NO: 25012 - RNA, 20 nt, Artificial Sequence
  TRAC targeting sequence
gguuuuaacuaaggggauga

SEQ ID NO: 25013 - RNA, 20 nt, Artificial Sequence
  TRAC targeting sequence
ccuuaguuaaaaccagacua

SEQ ID NO: 25014 - RNA, 20 nt, Artificial Sequence
  TRAC targeting sequence
uccccuuaguuaaaaccaga

SEQ ID NO: 25015 - RNA, 20 nt, Artificial Sequence
  TRAC targeting sequence
gaaaucugacaguuccaggg

SEQ ID NO: 25016 - RNA, 20 nt, Artificial Sequence
  TRAC targeting sequence
gaucauccccuuaguuaaaa

SEQ ID NO: 25017 - RNA, 20 nt, Artificial Sequence
  TRAC targeting sequence
gacaguuccagggaggucag

SEQ ID NO: 25018 - RNA, 20 nt, Artificial Sequence
  TRAC targeting sequence
gauuucagaucauccccuua

SEQ ID NO: 25019 - RNA, 20 nt, Artificial Sequence
  TRAC targeting sequence
agggaggucaggcccuguuu

SEQ ID NO: 25020 - RNA, 20 nt, Artificial Sequence
  TRAC targeting sequence
aaacucugcaacuugguuuc

SEQ ID NO: 25021 - RNA, 20 nt, Artificial Sequence
  TRAC targeting sequence
caccgccgaccgccggcccg

SEQ ID NO: 25022 - RNA, 20 nt, Artificial Sequence
  TRAC targeting sequence
gcggugggacccucaaaacu

SEQ ID NO: 25023 - RNA, 20 nt, Artificial Sequence
  TRAC targeting sequence
cggcgggccggcggucggcg

SEQ ID NO: 25024 - RNA, 20 nt, Artificial Sequence
  TRAC targeting sequence
ccgcggccucccgggucagc

SEQ ID NO: 25025 - RNA, 20 nt, Artificial Sequence
  TRAC targeting sequence
cgggucagcuggugcuggcg

SEQ ID NO: 25026 - RNA, 20 nt, Artificial Sequence
  TRAC targeting sequence
gcuggugcuggcgucaggcg

SEQ ID NO: 25027 - RNA, 20 nt, Artificial Sequence
  TRAC targeting sequence
ggcgcugggcgggcucgcca

SEQ ID NO: 25028 - RNA, 20 nt, Artificial Sequence
  TRAC targeting sequence
ccaggaccuggcaaggcuug

SEQ ID NO: 25029 - RNA, 20 nt, Artificial Sequence
  TRAC targeting sequence
uggcgagcccgcccagcgcc

SEQ ID NO: 25030 - RNA, 20 nt, Artificial Sequence
  TRAC targeting sequence
gccauaguaaacaagccuug

SEQ ID NO: 25031 - RNA, 20 nt, Artificial Sequence
  TRAC targeting sequence
ucggccauaguaaacaagcc

SEQ ID NO: 25032 - RNA, 20 nt, Artificial Sequence
  TRAC targeting sequence
ggagcagcagugaguuaauc

SEQ ID NO: 25033 - RNA, 20 nt, Artificial Sequence
  TRAC targeting sequence
agaucaucggccauaguaaa

SEQ ID NO: 25034 - RNA, 20 nt, Artificial Sequence
  TRAC targeting sequence
cugcugcuccagaucaucgg

SEQ ID NO: 25035 - RNA, 20 nt, Artificial Sequence
  TRAC targeting sequence
ugucccuuucucucuuucuc

SEQ ID NO: 25036 - RNA, 20 nt, Artificial Sequence
  TRAC targeting sequence
cuuucucucuuucucucucu

SEQ ID NO: 25037 - RNA, 20 nt, Artificial Sequence
  TRAC targeting sequence
cucuuucucucucucucucu

SEQ ID NO: 25038 - RNA, 20 nt, Artificial Sequence
  TRAC targeting sequence
cuuucucucucucucucugg

SEQ ID NO: 25039 - RNA, 20 nt, Artificial Sequence
  TRAC targeting sequence
uucucucucucucucugggc

SEQ ID NO: 25040 - RNA, 20 nt, Artificial Sequence
  TRAC targeting sequence
cucucucucucugggccaug

SEQ ID NO: 25041 - RNA, 20 nt, Artificial Sequence
  TRAC targeting sequence
cucucucucugggccaugau

SEQ ID NO: 25042 - RNA, 20 nt, Artificial Sequence
  TRAC targeting sequence
cucucucugggccaugaucc

SEQ ID NO: 25043 - RNA, 20 nt, Artificial Sequence
  TRAC targeting sequence
cucucugggccaugauccug

SEQ ID NO: 25044 - RNA, 20 nt, Artificial Sequence
  TRAC targeting sequence
cucugggccaugauccuggg

SEQ ID NO: 25045 - RNA, 20 nt, Artificial Sequence
  TRAC targeting sequence
cugggccaugauccugggac

SEQ ID NO: 25046 - RNA, 20 nt, Artificial Sequence
  TRAC targeting sequence
gggccaugauccugggacug

SEQ ID NO: 25047 - RNA, 20 nt, Artificial Sequence
  TRAC targeting sequence
uggcccagagagagagagag

SEQ ID NO: 25048 - RNA, 20 nt, Artificial Sequence
  TRAC targeting sequence
ugggacugucuguggcugag

SEQ ID NO: 25049 - RNA, 20 nt, Artificial Sequence
  TRAC targeting sequence
caggaucauggcccagagag

SEQ ID NO: 25050 - RNA, 20 nt, Artificial Sequence
  TRAC targeting sequence
guggcugaggaacaguugua

SEQ ID NO: 25051 - RNA, 20 nt, Artificial Sequence
  TRAC targeting sequence
gccacagacagucccaggau

SEQ ID NO: 25052 - RNA, 20 nt, Artificial Sequence
  TRAC targeting sequence
ucagccacagacagucccag

SEQ ID NO: 25053 - RNA, 20 nt, Artificial Sequence
  TRAC targeting sequence
acaacuguuccucagccaca

SEQ ID NO: 25054 - RNA, 20 nt, Artificial Sequence
  TRAC targeting sequence
cgcucuuccuuuuccagguc

SEQ ID NO: 25055 - RNA, 20 nt, Artificial Sequence
  TRAC targeting sequence
uccuuuuccaggucggccuc

SEQ ID NO: 25056 - RNA, 20 nt, Artificial Sequence
  TRAC targeting sequence
uuuuccaggucggccuccgg

SEQ ID NO: 25057 - RNA, 20 nt, Artificial Sequence
  TRAC targeting sequence
aggucggccuccggggaggg

SEQ ID NO: 25058 - RNA, 20 nt, Artificial Sequence
  TRAC targeting sequence
gccuccggggagggcggggg

SEQ ID NO: 25059 - RNA, 20 nt, Artificial Sequence
  TRAC targeting sequence
ggggagggcggggggugggu

SEQ ID NO: 25060 - RNA, 20 nt, Artificial Sequence
  TRAC targeting sequence
ccggaggccgaccuggaaaa

SEQ ID NO: 25061 - RNA, 20 nt, Artificial Sequence
  TRAC targeting sequence
gggcaaaugcaaagcaagca

SEQ ID NO: 25062 - RNA, 20 nt, Artificial Sequence
  TRAC targeting sequence
ucugggcaaaugcaaagcaa

SEQ ID NO: 25063 - RNA, 20 nt, Artificial Sequence
  TRAC targeting sequence
gccgcugccucuucugggca

SEQ ID NO: 25064 - RNA, 20 nt, Artificial Sequence
  TRAC targeting sequence
ccaggcucagccgcugccuc

SEQ ID NO: 25065 - RNA, 20 nt, Artificial Sequence
  TRAC targeting sequence
cauggcuccccaggcucagc

SEQ ID NO: 25066 - RNA, 20 nt, Artificial Sequence
  TRAC targeting sequence
cccauggcuccccaggcuca

SEQ ID NO: 25067 - RNA, 20 nt, Artificial Sequence
  TRAC targeting sequence
cccgcagcccggggauccug

SEQ ID NO: 25068 - RNA, 20 nt, Artificial Sequence
  TRAC targeting sequence
gaaaccauugcauuaaagau

SEQ ID NO: 25069 - RNA, 20 nt, Artificial Sequence
  TRAC targeting sequence
aaaucugaaaccauugcauu

SEQ ID NO: 25070 - RNA, 20 nt, Artificial Sequence
  TRAC targeting sequence
caauagcucuaaaucugaaa

SEQ ID NO: 25071 - RNA, 20 nt, Artificial Sequence
  TRAC targeting sequence
uucaagggcaucagguuugg

SEQ ID NO: 25072 - RNA, 20 nt, Artificial Sequence
  TRAC targeting sequence
agggcaucagguuugggaua

SEQ ID NO: 25073 - RNA, 20 nt, Artificial Sequence
  TRAC targeting sequence
gguuugggauaccaccugua

SEQ ID NO: 25074 - RNA, 20 nt, Artificial Sequence
  TRAC targeting sequence
caaaccugaugcccuugaaa

SEQ ID NO: 25075 - RNA, 20 nt, Artificial Sequence
  TRAC targeting sequence
caccaccuacaggugguauc

SEQ ID NO: 25076 - RNA, 20 nt, Artificial Sequence
  TRAC targeting sequence
caaucugauaggaguaagaa

SEQ ID NO: 25077 - RNA, 20 nt, Artificial Sequence
  TRAC targeting sequence
gauaggaguaagaaaaaguu

SEQ ID NO: 25078 - RNA, 20 nt, Artificial Sequence
  TRAC targeting sequence
gauugcgaacugcuagucac

SEQ ID NO: 25079 - RNA, 20 nt, Artificial Sequence
  TRAC targeting sequence
uaucagauugcgaacugcua

SEQ ID NO: 25080 - RNA, 20 nt, Artificial Sequence
  TRAC targeting sequence
uacuccuaucagauugcgaa

SEQ ID NO: 25081 - RNA, 20 nt, Artificial Sequence
  TRAC targeting sequence
uagcaacuuuuucuuacucc

SEQ ID NO: 25082 - RNA, 20 nt, Artificial Sequence
  TRAC targeting sequence
cguagcaacuuuuucuuacu

SEQ ID NO: 25083 - RNA, 20 nt, Artificial Sequence
  TRAC targeting sequence
ucucguagcaacuuuuucuu

SEQ ID NO: 25084 - RNA, 20 nt, Artificial Sequence
  TRAC targeting sequence
uucuucucguagcaacuuuu

SEQ ID NO: 25085 - RNA, 20 nt, Artificial Sequence
  TRAC targeting sequence
gcucccagccgagccuuggu

SEQ ID NO: 25086 - RNA, 20 nt, Artificial Sequence
  TRAC targeting sequence
cagccgagccuugguuucac

SEQ ID NO: 25087 - RNA, 20 nt, Artificial Sequence
  TRAC targeting sequence
gcugggagcugagucauucu

SEQ ID NO: 25088 - RNA, 20 nt, Artificial Sequence
  TRAC targeting sequence
ccagaacugggccuuuccug

SEQ ID NO: 25089 - RNA, 20 nt, Artificial Sequence
  TRAC targeting sequence
ggugaaaccaaggcucggcu

SEQ ID NO: 25090 - RNA, 20 nt, Artificial Sequence
  TRAC targeting sequence
uggacccaguaauccuguuu

SEQ ID NO: 25091 - RNA, 20 nt, Artificial Sequence
  TRAC targeting sequence
aggaaaggcccaguucuggu

SEQ ID NO: 25092 - RNA, 20 nt, Artificial Sequence
  TRAC targeting sequence
uguuuuucagaccuguagaa

SEQ ID NO: 25093 - RNA, 20 nt, Artificial Sequence
  TRAC targeting sequence
gaccuguagaacuggaaguc

SEQ ID NO: 25094 - RNA, 20 nt, Artificial Sequence
  TRAC targeting sequence
gaaaaacaggauuacugggu

SEQ ID NO: 25095 - RNA, 20 nt, Artificial Sequence
  TRAC targeting sequence
acaggucugaaaaacaggau

SEQ ID NO: 25096 - RNA, 20 nt, Artificial Sequence
  TRAC targeting sequence
aggggaauguuuuacuuucu

SEQ ID NO: 25097 - RNA, 20 nt, Artificial Sequence
  TRAC targeting sequence
ccuggacauuucuuucaagc

SEQ ID NO: 25098 - RNA, 20 nt, Artificial Sequence
  TRAC targeting sequence
aagaugacuuuuccaagagg

SEQ ID NO: 25099 - RNA, 20 nt, Artificial Sequence
  TRAC targeting sequence
uagaaaguaaaacauucccc

SEQ ID NO: 25100 - RNA, 20 nt, Artificial Sequence
  TRAC targeting sequence
ucuuagaaaguaaaacauuc

SEQ ID NO: 25101 - RNA, 20 nt, Artificial Sequence
  TRAC targeting sequence
aagaggaaauuugcaaugcu

SEQ ID NO: 25102 - RNA, 20 nt, Artificial Sequence
  TRAC targeting sequence
uggaaaagucaucuuagaaa

SEQ ID NO: 25103 - RNA, 20 nt, Artificial Sequence
  TRAC targeting sequence
ucuuggaaaagucaucuuag

SEQ ID NO: 25104 - RNA, 20 nt, Artificial Sequence
  TRAC targeting sequence
uuuaaagcauugcaaauuuc

SEQ ID NO: 25105 - RNA, 20 nt, Artificial Sequence
  TRAC targeting sequence
cuaaguccuuuaaagcauug

SEQ ID NO: 25106 - RNA, 20 nt, Artificial Sequence
  TRAC targeting sequence
gccucccuaaguccuuuaaa

SEQ ID NO: 25107 - RNA, 20 nt, Artificial Sequence
  TRAC targeting sequence
agcucuaauauucugccucc

SEQ ID NO: 25108 - RNA, 20 nt, Artificial Sequence
  TRAC targeting sequence
uccagcucuaauauucugcc

SEQ ID NO: 25109 - RNA, 20 nt, Artificial Sequence
  TRAC targeting sequence
gcuccuuuuuaaaaaugaag

SEQ ID NO: 25110 - RNA, 20 nt, Artificial Sequence
  TRAC targeting sequence
uuuuuaaaaaugaagaagcu

SEQ ID NO: 25111 - RNA, 20 nt, Artificial Sequence
  TRAC targeting sequence
uuuuuaaaaaggagcugaac

SEQ ID NO: 25112 - RNA, 20 nt, Artificial Sequence
  TRAC targeting sequence
ucauuuuuaaaaaggagcug

SEQ ID NO: 25113 - RNA, 20 nt, Artificial Sequence
  TRAC targeting sequence
auagaaauuaggagacuugc

SEQ ID NO: 25114 - RNA, 20 nt, Artificial Sequence
  TRAC targeting sequence
auggacaccagcuucuucau

SEQ ID NO: 25115 - RNA, 20 nt, Artificial Sequence
  TRAC targeting sequence
uaauuucuauggacaccagc

SEQ ID NO: 25116 - RNA, 20 nt, Artificial Sequence
  TRAC targeting sequence
ccuaauuucuauggacacca

SEQ ID NO: 25117 - RNA, 20 nt, Artificial Sequence
  TRAC targeting sequence
aguguuuacuuguaacauuu

SEQ ID NO: 25118 - RNA, 20 nt, Artificial Sequence
  TRAC targeting sequence
ccaaaaauguuacaaguaaa

SEQ ID NO: 25119 - RNA, 20 nt, Artificial Sequence
  TRAC targeting sequence
ucaccaaaaauguuacaagu

SEQ ID NO: 25120 - RNA, 20 nt, Artificial Sequence
  TRAC targeting sequence
uucuucaccaaaaauguuac

SEQ ID NO: 25121 - RNA, 20 nt, Artificial Sequence
  TRAC targeting sequence
cccaccaaggacucucugcu

SEQ ID NO: 25122 - RNA, 20 nt, Artificial Sequence
  TRAC targeting sequence
caccaaggacucucugcuga

SEQ ID NO: 25123 - RNA, 20 nt, Artificial Sequence
  TRAC targeting sequence
uuggugggagaauuacuuug

SEQ ID NO: 25124 - RNA, 20 nt, Artificial Sequence
  TRAC targeting sequence
cugcugagcagucuaugaug

SEQ ID NO: 25125 - RNA, 20 nt, Artificial Sequence
  TRAC targeting sequence
gcugagcagucuaugaugcu

SEQ ID NO: 25126 - RNA, 20 nt, Artificial Sequence
  TRAC targeting sequence
ugaacucugcuuuguacagu

SEQ ID NO: 25127 - RNA, 20 nt, Artificial Sequence
  TRAC targeting sequence
ggagaaacgcuacccaagga

SEQ ID NO: 25128 - RNA, 20 nt, Artificial Sequence
  TRAC targeting sequence
gcuuuguacaguaacaggac

SEQ ID NO: 25129 - RNA, 20 nt, Artificial Sequence
  TRAC targeting sequence
uguuacuguacaaagcagag

SEQ ID NO: 25130 - RNA, 20 nt, Artificial Sequence
  TRAC targeting sequence
cacauuguccuguuacugua

SEQ ID NO: 25131 - RNA, 20 nt, Artificial Sequence
  TRAC targeting sequence
agguguuaugaucugacuug

SEQ ID NO: 25132 - RNA, 20 nt, Artificial Sequence
  TRAC targeting sequence
uaacaccuggaucccacauu

SEQ ID NO: 25133 - RNA, 20 nt, Artificial Sequence
  TRAC targeting sequence
gacuugucacagucugugau

SEQ ID NO: 25134 - RNA, 20 nt, Artificial Sequence
  TRAC targeting sequence
gaucauaacaccuggauccc

SEQ ID NO: 25135 - RNA, 20 nt, Artificial Sequence
  TRAC targeting sequence
cagucugugauuuagagaga

SEQ ID NO: 25136 - RNA, 20 nt, Artificial Sequence
  TRAC targeting sequence
gugauuuagagagaaaauuu

SEQ ID NO: 25137 - RNA, 20 nt, Artificial Sequence
  TRAC targeting sequence
ugguccccgugcuucaagcc

SEQ ID NO: 25138 - RNA, 20 nt, Artificial Sequence
  TRAC targeting sequence
ccgugcuucaagccuacaag

SEQ ID NO: 25139 - RNA, 20 nt, Artificial Sequence
  TRAC targeting sequence
agccuacaaggaauuccagu

SEQ ID NO: 25140 - RNA, 20 nt, Artificial Sequence
  TRAC targeting sequence
uuguaggcuugaagcacggg

SEQ ID NO: 25141 - RNA, 20 nt, Artificial Sequence
  TRAC targeting sequence
aguagaauauuaaaaggauu

SEQ ID NO: 25142 - RNA, 20 nt, Artificial Sequence
  TRAC targeting sequence
acuggaauuccuuguaggcu

SEQ ID NO: 25143 - RNA, 20 nt, Artificial Sequence
  TRAC targeting sequence
uuuuaauauucuacuggaau

SEQ ID NO: 25144 - RNA, 20 nt, Artificial Sequence
  TRAC targeting sequence
gagucucccuaggauuagau

SEQ ID NO: 25145 - RNA, 20 nt, Artificial Sequence
  TRAC targeting sequence
gaauccuuuuaauauucuac

SEQ ID NO: 25146 - RNA, 20 nt, Artificial Sequence
  TRAC targeting sequence
cccuaggauuagaucgauug

SEQ ID NO: 25147 - RNA, 20 nt, Artificial Sequence
  TRAC targeting sequence
cuaggauuagaucgauugau

SEQ ID NO: 25148 - RNA, 20 nt, Artificial Sequence
  TRAC targeting sequence
augguuuuagccagaugaga

SEQ ID NO: 25149 - RNA, 20 nt, Artificial Sequence
  TRAC targeting sequence
cucccagcugcaaccccagu

SEQ ID NO: 25150 - RNA, 20 nt, Artificial Sequence
  TRAC targeting sequence
cagcugcaaccccaguuuuu

SEQ ID NO: 25151 - RNA, 20 nt, Artificial Sequence
  TRAC targeting sequence
uucaaacuucaaacauccac

SEQ ID NO: 25152 - RNA, 20 nt, Artificial Sequence
  TRAC targeting sequence
aacuucaaacauccacugag

SEQ ID NO: 25153 - RNA, 20 nt, Artificial Sequence
  TRAC targeting sequence
aacauccacugagaguugcu

SEQ ID NO: 25154 - RNA, 20 nt, Artificial Sequence
  TRAC targeting sequence
acugagaguugcuacuugca

SEQ ID NO: 25155 - RNA, 20 nt, Artificial Sequence
  TRAC targeting sequence
guggauguuugaaguuugaa

SEQ ID NO: 25156 - RNA, 20 nt, Artificial Sequence
  TRAC targeting sequence
caguggauguuugaaguuug

SEQ ID NO: 25157 - RNA, 20 nt, Artificial Sequence
  TRAC targeting sequence
augugcuuuagaugcauuaa

SEQ ID NO: 25158 - RNA, 20 nt, Artificial Sequence
  TRAC targeting sequence
aaagcacauagaauauugcc

SEQ ID NO: 25159 - RNA, 20 nt, Artificial Sequence
  TRAC targeting sequence
uuauagcaacccuaugaggu

SEQ ID NO: 25160 - RNA, 20 nt, Artificial Sequence
  TRAC targeting sequence
uaggguugcuauaaagauua

SEQ ID NO: 25161 - RNA, 20 nt, Artificial Sequence
  TRAC targeting sequence
accucauaggguugcuauaa

SEQ ID NO: 25162 - RNA, 20 nt, Artificial Sequence
  TRAC targeting sequence
ggccuucagaguuuagauca

SEQ ID NO: 25163 - RNA, 20 nt, Artificial Sequence
  TRAC targeting sequence
gaguuuagaucacaccuccc

SEQ ID NO: 25164 - RNA, 20 nt, Artificial Sequence
  TRAC targeting sequence
gaaggccagaguuccaauuu

SEQ ID NO: 25165 - RNA, 20 nt, Artificial Sequence
  TRAC targeting sequence
aaacucugaaggccagaguu

SEQ ID NO: 25166 - RNA, 20 nt, Artificial Sequence
  TRAC targeting sequence
caccucccuugagaaaacag

SEQ ID NO: 25167 - RNA, 20 nt, Artificial Sequence
  TRAC targeting sequence
cuugagaaaacagacauaaa

SEQ ID NO: 25168 - RNA, 20 nt, Artificial Sequence
  TRAC targeting sequence
agggaggugugaucuaaacu

SEQ ID NO: 25169 - RNA, 20 nt, Artificial Sequence
  TRAC targeting sequence
caagggaggugugaucuaaa

SEQ ID NO: 25170 - RNA, 20 nt, Artificial Sequence
  TRAC targeting sequence
guuuucucaagggaggugug

SEQ ID NO: 25171 - RNA, 20 nt, Artificial Sequence
  TRAC targeting sequence
gugaauauuuguacaugacc

SEQ ID NO: 25172 - RNA, 20 nt, Artificial Sequence
  TRAC targeting sequence
agccucagcuuuucaagguc

SEQ ID NO: 25173 - RNA, 20 nt, Artificial Sequence
  TRAC targeting sequence
gggagagaaaccuggauuug

SEQ ID NO: 25174 - RNA, 20 nt, Artificial Sequence
  TRAC targeting sequence
cugaaccuuccagccucagc

SEQ ID NO: 25175 - RNA, 20 nt, Artificial Sequence
  TRAC targeting sequence
cccugaaccuuccagccuca

SEQ ID NO: 25176 - RNA, 20 nt, Artificial Sequence
  TRAC targeting sequence
cucccugaaccuuccagccu

SEQ ID NO: 25177 - RNA, 20 nt, Artificial Sequence
  TRAC targeting sequence
agguuucucucccugaaccu

SEQ ID NO: 25178 - RNA, 20 nt, Artificial Sequence
  TRAC targeting sequence
aauccagguuucucucccug

SEQ ID NO: 25179 - RNA, 20 nt, Artificial Sequence
  TRAC targeting sequence
caaauccagguuucucuccc

SEQ ID NO: 25180 - RNA, 20 nt, Artificial Sequence
  TRAC targeting sequence
aguucugguucuuuuuuucu

SEQ ID NO: 25181 - RNA, 20 nt, Artificial Sequence
  TRAC targeting sequence
gguucuuuuuuucuaacuug

SEQ ID NO: 25182 - RNA, 20 nt, Artificial Sequence
  TRAC targeting sequence
uuuuuucuaacuuguaugac

SEQ ID NO: 25183 - RNA, 20 nt, Artificial Sequence
  TRAC targeting sequence
aacuuguaugaccucuuugg

SEQ ID NO: 25184 - RNA, 20 nt, Artificial Sequence
  TRAC targeting sequence
uacaaguuagaaaaaaagaa

SEQ ID NO: 25185 - RNA, 20 nt, Artificial Sequence
  TRAC targeting sequence
uugggcaucaguuugcucau

SEQ ID NO: 25186 - RNA, 20 nt, Artificial Sequence
  TRAC targeting sequence
guuugcucaucuguaaaaua

SEQ ID NO: 25187 - RNA, 20 nt, Artificial Sequence
  TRAC targeting sequence
ucuguaaaauacagaggcua

SEQ ID NO: 25188 - RNA, 20 nt, Artificial Sequence
  TRAC targeting sequence
uauagcuguagauaucuguc

SEQ ID NO: 25189 - RNA, 20 nt, Artificial Sequence
  TRAC targeting sequence
acagcuauaggaagggccug

SEQ ID NO: 25190 - RNA, 20 nt, Artificial Sequence
  TRAC targeting sequence
guccuguaacucaggcagag

SEQ ID NO: 25191 - RNA, 20 nt, Artificial Sequence
  TRAC targeting sequence
uguaacucaggcagaguuca

SEQ ID NO: 25192 - RNA, 20 nt, Artificial Sequence
  TRAC targeting sequence
ggcagaguucaagaaaagag

SEQ ID NO: 25193 - RNA, 20 nt, Artificial Sequence
  TRAC targeting sequence
gccugaguuacaggacagau

SEQ ID NO: 25194 - RNA, 20 nt, Artificial Sequence
  TRAC targeting sequence
agaaaagagaaauaucauau

SEQ ID NO: 25195 - RNA, 20 nt, Artificial Sequence
  TRAC targeting sequence
ugaacucugccugaguuaca

SEQ ID NO: 25196 - RNA, 20 nt, Artificial Sequence
  TRAC targeting sequence
uuucuugaacucugccugag

SEQ ID NO: 25197 - RNA, 20 nt, Artificial Sequence
  TRAC targeting sequence
cuuuucuugaacucugccug

SEQ ID NO: 25198 - RNA, 20 nt, Artificial Sequence
  TRAC targeting sequence
uaugggguuaacaaggaaua

SEQ ID NO: 25199 - RNA, 20 nt, Artificial Sequence
  TRAC targeting sequence
uuguuaaccccauaugauau

SEQ ID NO: 25200 - RNA, 20 nt, Artificial Sequence
  TRAC targeting sequence
uucauugagcaucucauuug

SEQ ID NO: 25201 - RNA, 20 nt, Artificial Sequence
  TRAC targeting sequence
uugagcaucucauuuguacu

SEQ ID NO: 25202 - RNA, 20 nt, Artificial Sequence
  TRAC targeting sequence
augaaugacaguuuguauua

SEQ ID NO: 25203 - RNA, 20 nt, Artificial Sequence
  TRAC targeting sequence
cauuuguacugggcaucuua

SEQ ID NO: 25204 - RNA, 20 nt, Artificial Sequence
  TRAC targeting sequence
uuuguacugggcaucuuaca

SEQ ID NO: 25205 - RNA, 20 nt, Artificial Sequence
  TRAC targeting sequence
uacaaguguccuuacauaua

SEQ ID NO: 25206 - RNA, 20 nt, Artificial Sequence
  TRAC targeting sequence
uuacauauacagaugcucaa

SEQ ID NO: 25207 - RNA, 20 nt, Artificial Sequence
  TRAC targeting sequence
uacccagggaccuuaaguca

SEQ ID NO: 25208 - RNA, 20 nt, Artificial Sequence
  TRAC targeting sequence
uucauacccagggaccuuaa

SEQ ID NO: 25209 - RNA, 20 nt, Artificial Sequence
  TRAC targeting sequence
ccuucauacccagggaccuu

SEQ ID NO: 25210 - RNA, 20 nt, Artificial Sequence
  TRAC targeting sequence
cguuuucuccuucauaccca

SEQ ID NO: 25211 - RNA, 20 nt, Artificial Sequence
  TRAC targeting sequence
ucccguuuucuccuucauac

SEQ ID NO: 25212 - RNA, 20 nt, Artificial Sequence
  TRAC targeting sequence
guguuaccgcaugucauuag

SEQ ID NO: 25213 - RNA, 20 nt, Artificial Sequence
  TRAC targeting sequence
uuagaggugaggacauaggu

SEQ ID NO: 25214 - RNA, 20 nt, Artificial Sequence
  TRAC targeting sequence
aaugacaugcgguaacacag

SEQ ID NO: 25215 - RNA, 20 nt, Artificial Sequence
  TRAC targeting sequence
ccucuaaugacaugcgguaa

SEQ ID NO: 25216 - RNA, 20 nt, Artificial Sequence
  TRAC targeting sequence
ucaccucuaaugacaugcgg

SEQ ID NO: 25217 - RNA, 20 nt, Artificial Sequence
  TRAC targeting sequence
ccuauguccucaccucuaau

SEQ ID NO: 25218 - RNA, 20 nt, Artificial Sequence
  TRAC targeting sequence
acucauuuuacaaucuagaa

SEQ ID NO: 25219 - RNA, 20 nt, Artificial Sequence
  TRAC targeting sequence
uuuuacaaucuagaaaacaa

SEQ ID NO: 25220 - RNA, 20 nt, Artificial Sequence
  TRAC targeting sequence
agaaaacaagaccagaggga

SEQ ID NO: 25221 - RNA, 20 nt, Artificial Sequence
  TRAC targeting sequence
agauuguaaaaugaguagaa

SEQ ID NO: 25222 - RNA, 20 nt, Artificial Sequence
  TRAC targeting sequence
uguuuucuagauuguaaaau

SEQ ID NO: 25223 - RNA, 20 nt, Artificial Sequence
  TRAC targeting sequence
ggucuuguuuucuagauugu

SEQ ID NO: 25224 - RNA, 20 nt, Artificial Sequence
  TRAC targeting sequence
cucuggucuuguuuucuaga

SEQ ID NO: 25225 - RNA, 20 nt, Artificial Sequence
  TRAC targeting sequence
ugucagugaaccauaacaga

SEQ ID NO: 25226 - RNA, 20 nt, Artificial Sequence
  TRAC targeting sequence
gugaaccauaacagaacuug

SEQ ID NO: 25227 - RNA, 20 nt, Artificial Sequence
  TRAC targeting sequence
cugacaggacacagguuccc

SEQ ID NO: 25228 - RNA, 20 nt, Artificial Sequence
  TRAC targeting sequence
guuaugguucacugacagga

SEQ ID NO: 25229 - RNA, 20 nt, Artificial Sequence
  TRAC targeting sequence
aguucuguuaugguucacug

SEQ ID NO: 25230 - RNA, 20 nt, Artificial Sequence
  TRAC targeting sequence
aggucucucaccuccuccuc

SEQ ID NO: 25231 - RNA, 20 nt, Artificial Sequence
  TRAC targeting sequence
cucaccuccuccucccugcc

SEQ ID NO: 25232 - RNA, 20 nt, Artificial Sequence
  TRAC targeting sequence
caccuccuccucccugccua

SEQ ID NO: 25233 - RNA, 20 nt, Artificial Sequence
  TRAC targeting sequence
ccuccuccucccugccuacc

SEQ ID NO: 25234 - RNA, 20 nt, Artificial Sequence
  TRAC targeting sequence
uccucccugccuaccccauc

SEQ ID NO: 25235 - RNA, 20 nt, Artificial Sequence
  TRAC targeting sequence
ucccugccuaccccaucucc

SEQ ID NO: 25236 - RNA, 20 nt, Artificial Sequence
  TRAC targeting sequence
cugccuaccccaucuccaug

SEQ ID NO: 25237 - RNA, 20 nt, Artificial Sequence
  TRAC targeting sequence
aagccccuagaaguguggaa

SEQ ID NO: 25238 - RNA, 20 nt, Artificial Sequence
  TRAC targeting sequence
uccaagccccuagaagugug

SEQ ID NO: 25239 - RNA, 20 nt, Artificial Sequence
  TRAC targeting sequence
gcccuacuggcagggcacug

SEQ ID NO: 25240 - RNA, 20 nt, Artificial Sequence
  TRAC targeting sequence
caugccaucugcccuacugg

SEQ ID NO: 25241 - RNA, 20 nt, Artificial Sequence
  TRAC targeting sequence
uacuguuaaggaacagcuag

SEQ ID NO: 25242 - RNA, 20 nt, Artificial Sequence
  TRAC targeting sequence
uuaacaguaggacaaauucc

SEQ ID NO: 25243 - RNA, 20 nt, Artificial Sequence
  TRAC targeting sequence
ccaguacuagcuguuccuua

SEQ ID NO: 25244 - RNA, 20 nt, Artificial Sequence
  TRAC targeting sequence
uuugcuguccccaguacuag

SEQ ID NO: 25245 - RNA, 20 nt, Artificial Sequence
  TRAC targeting sequence
guuauccuuugcugucccca

SEQ ID NO: 25246 - RNA, 20 nt, Artificial Sequence
  TRAC targeting sequence
uuuaacuaauguuucaguua

SEQ ID NO: 25247 - RNA, 20 nt, Artificial Sequence
  TRAC targeting sequence
cccuuuaaucuccuugaaca

SEQ ID NO: 25248 - RNA, 20 nt, Artificial Sequence
  TRAC targeting sequence
cuuuaaucuccuugaacaua

SEQ ID NO: 25249 - RNA, 20 nt, Artificial Sequence
  TRAC targeting sequence
ccuugaacauaaauuaugau

SEQ ID NO: 25250 - RNA, 20 nt, Artificial Sequence
  TRAC targeting sequence
uugaacauaaauuaugauaa

SEQ ID NO: 25251 - RNA, 20 nt, Artificial Sequence
  TRAC targeting sequence
aggagauuaaagggagaggc

SEQ ID NO: 25252 - RNA, 20 nt, Artificial Sequence
  TRAC targeting sequence
uaauuuauguucaaggagau

SEQ ID NO: 25253 - RNA, 20 nt, Artificial Sequence
  TRAC targeting sequence
guaacaaggagaaauuagaa

SEQ ID NO: 25254 - RNA, 20 nt, Artificial Sequence
  TRAC targeting sequence
uuguuacugauuaucauaau

SEQ ID NO: 25255 - RNA, 20 nt, Artificial Sequence
  TRAC targeting sequence
ccuuguuacugauuaucaua

SEQ ID NO: 25256 - RNA, 20 nt, Artificial Sequence
  TRAC targeting sequence
aauuucuccuuguuacugau

SEQ ID NO: 25257 - RNA, 20 nt, Artificial Sequence
  TRAC targeting sequence
gcuuucuaauuucuccuugu

SEQ ID NO: 25258 - RNA, 20 nt, Artificial Sequence
  TRAC targeting sequence
cagcuuucuaauuucuccuu

SEQ ID NO: 25259 - RNA, 20 nt, Artificial Sequence
  TRAC targeting sequence
cauuuauuaucucagcuuuc

SEQ ID NO: 25260 - RNA, 20 nt, Artificial Sequence
  TRAC targeting sequence
gucacauuuauuaucucagc

SEQ ID NO: 25261 - RNA, 20 nt, Artificial Sequence
  TRAC targeting sequence
aaaguauuauauacaggaug

SEQ ID NO: 25262 - RNA, 20 nt, Artificial Sequence
  TRAC targeting sequence
uguauauaauacuuuagagu

SEQ ID NO: 25263 - RNA, 20 nt, Artificial Sequence
  TRAC targeting sequence
gaauaucuauugaaacaagg

SEQ ID NO: 25264 - RNA, 20 nt, Artificial Sequence
  TRAC targeting sequence
gaacauccuguauauaauac

SEQ ID NO: 25265 - RNA, 20 nt, Artificial Sequence
  TRAC targeting sequence
auugaaacaaggggcauguu

SEQ ID NO: 25266 - RNA, 20 nt, Artificial Sequence
  TRAC targeting sequence
auagauauucagaacauccu

SEQ ID NO: 25267 - RNA, 20 nt, Artificial Sequence
  TRAC targeting sequence
uuuugguaaauggguauuaa

SEQ ID NO: 25268 - RNA, 20 nt, Artificial Sequence
  TRAC targeting sequence
aucagguagcuagggaacug

SEQ ID NO: 25269 - RNA, 20 nt, Artificial Sequence
  TRAC targeting sequence
gguagcuagggaacugcugc

SEQ ID NO: 25270 - RNA, 20 nt, Artificial Sequence
  TRAC targeting sequence
cuagcuaccugauagauugu

SEQ ID NO: 25271 - RNA, 20 nt, Artificial Sequence
  TRAC targeting sequence
cucaaggcuaggaaacaccc

SEQ ID NO: 25272 - RNA, 20 nt, Artificial Sequence
  TRAC targeting sequence
caaggcuaggaaacacccug

SEQ ID NO: 25273 - RNA, 20 nt, Artificial Sequence
  TRAC targeting sequence
aggcuaggaaacacccugcu

SEQ ID NO: 25274 - RNA, 20 nt, Artificial Sequence
  TRAC targeting sequence
uagccuugagagaccugccc

SEQ ID NO: 25275 - RNA, 20 nt, Artificial Sequence
  TRAC targeting sequence
ugagaacucuuuuguaacuc

SEQ ID NO: 25276 - RNA, 20 nt, Artificial Sequence
  TRAC targeting sequence
ggaagcaggguguuuccuag

SEQ ID NO: 25277 - RNA, 20 nt, Artificial Sequence
  TRAC targeting sequence
caggaagcaggguguuuccu

SEQ ID NO: 25278 - RNA, 20 nt, Artificial Sequence
  TRAC targeting sequence
uuuguaacucucagcaaggc

SEQ ID NO: 25279 - RNA, 20 nt, Artificial Sequence
  TRAC targeting sequence
cagcaaggcuaagagcauca

SEQ ID NO: 25280 - RNA, 20 nt, Artificial Sequence
  TRAC targeting sequence
gcaaggcuaagagcaucaau

SEQ ID NO: 25281 - RNA, 20 nt, Artificial Sequence
  TRAC targeting sequence
uagccuugcugagaguuaca

SEQ ID NO: 25282 - RNA, 20 nt, Artificial Sequence
  TRAC targeting sequence
auguuucuuuccaauguugc

SEQ ID NO: 25283 - RNA, 20 nt, Artificial Sequence
  TRAC targeting sequence
uuccaauguugccaaugagu

SEQ ID NO: 25284 - RNA, 20 nt, Artificial Sequence
  TRAC targeting sequence
aauguugccaaugagugucu

SEQ ID NO: 25285 - RNA, 20 nt, Artificial Sequence
  TRAC targeting sequence
uuggcaacauuggaaagaaa

SEQ ID NO: 25286 - RNA, 20 nt, Artificial Sequence
  TRAC targeting sequence
cugucuccuccucccagguc

SEQ ID NO: 25287 - RNA, 20 nt, Artificial Sequence
  TRAC targeting sequence
gucuccuccucccaggucuc

SEQ ID NO: 25288 - RNA, 20 nt, Artificial Sequence
  TRAC targeting sequence
ccuccucccaggucucaagg

SEQ ID NO: 25289 - RNA, 20 nt, Artificial Sequence
  TRAC targeting sequence
uccucccaggucucaaggcu

SEQ ID NO: 25290 - RNA, 20 nt, Artificial Sequence
  TRAC targeting sequence
ucccaggucucaaggcuggc

SEQ ID NO: 25291 - RNA, 20 nt, Artificial Sequence
  TRAC targeting sequence
caggucucaaggcuggcuga

SEQ ID NO: 25292 - RNA, 20 nt, Artificial Sequence
  TRAC targeting sequence
caaggcuggcugaguagcug

SEQ ID NO: 25293 - RNA, 20 nt, Artificial Sequence
  TRAC targeting sequence
aggcuggcugaguagcuggc

SEQ ID NO: 25294 - RNA, 20 nt, Artificial Sequence
  TRAC targeting sequence
gccagccuugagaccuggga

SEQ ID NO: 25295 - RNA, 20 nt, Artificial Sequence
  TRAC targeting sequence
augucucagcugaagaaugu

SEQ ID NO: 25296 - RNA, 20 nt, Artificial Sequence
  TRAC targeting sequence
cagcugaagaauguggaagc

SEQ ID NO: 25297 - RNA, 20 nt, Artificial Sequence
  TRAC targeting sequence
gcugaagaauguggaagcca

SEQ ID NO: 25298 - RNA, 20 nt, Artificial Sequence
  TRAC targeting sequence
gcugagacauggaagugggg

SEQ ID NO: 25299 - RNA, 20 nt, Artificial Sequence
  TRAC targeting sequence
ucagcugagacauggaagug

SEQ ID NO: 25300 - RNA, 20 nt, Artificial Sequence
  TRAC targeting sequence
acauucuucagcugagacau

SEQ ID NO: 25301 - RNA, 20 nt, Artificial Sequence
  TRAC targeting sequence
uggcuuccacauucuucagc

SEQ ID NO: 25302 - RNA, 20 nt, Artificial Sequence
  TRAC targeting sequence
uccaguguaaguagaaugga

SEQ ID NO: 25303 - RNA, 20 nt, Artificial Sequence
  TRAC targeting sequence
aguguaaguagaauggacag

SEQ ID NO: 25304 - RNA, 20 nt, Artificial Sequence
  TRAC targeting sequence
acuuacacuggaggauccug

SEQ ID NO: 25305 - RNA, 20 nt, Artificial Sequence
  TRAC targeting sequence
auucuacuuacacuggagga

SEQ ID NO: 25306 - RNA, 20 nt, Artificial Sequence
  TRAC targeting sequence
caccucccucauggagccca

SEQ ID NO: 25307 - RNA, 20 nt, Artificial Sequence
  TRAC targeting sequence
cucauggagcccaagaagga

SEQ ID NO: 25308 - RNA, 20 nt, Artificial Sequence
  TRAC targeting sequence
uggagcccaagaaggauuca

SEQ ID NO: 25309 - RNA, 20 nt, Artificial Sequence
  TRAC targeting sequence
augagggaggugggacaagc

SEQ ID NO: 25310 - RNA, 20 nt, Artificial Sequence
  TRAC targeting sequence
auaaguguuuccugacggca

SEQ ID NO: 25311 - RNA, 20 nt, Artificial Sequence
  TRAC targeting sequence
caugguaagucaauaagugu

SEQ ID NO: 25312 - RNA, 20 nt, Artificial Sequence
  TRAC targeting sequence
uuccuccccaggucuccaga

SEQ ID NO: 25313 - RNA, 20 nt, Artificial Sequence
  TRAC targeting sequence
uccccaggucuccagaauaa

SEQ ID NO: 25314 - RNA, 20 nt, Artificial Sequence
  TRAC targeting sequence
ccaggucuccagaauaaguu

SEQ ID NO: 25315 - RNA, 20 nt, Artificial Sequence
  TRAC targeting sequence
ccagaauaaguuccuggcca

SEQ ID NO: 25316 - RNA, 20 nt, Artificial Sequence
  TRAC targeting sequence
agaauaaguuccuggccaga

SEQ ID NO: 25317 - RNA, 20 nt, Artificial Sequence
  TRAC targeting sequence
ggagaccuggggaggaaaga

SEQ ID NO: 25318 - RNA, 20 nt, Artificial Sequence
  TRAC targeting sequence
uggccagauauguaucccuc

SEQ ID NO: 25319 - RNA, 20 nt, Artificial Sequence
  TRAC targeting sequence
ggccaggaacuuauucugga

SEQ ID NO: 25320 - RNA, 20 nt, Artificial Sequence
  TRAC targeting sequence
cucccaaaccagaauaagau

SEQ ID NO: 25321 - RNA, 20 nt, Artificial Sequence
  TRAC targeting sequence
caaaccagaauaagaucugg

SEQ ID NO: 25322 - RNA, 20 nt, Artificial Sequence
  TRAC targeting sequence
gguuugggagggauacauau

SEQ ID NO: 25323 - RNA, 20 nt, Artificial Sequence
  TRAC targeting sequence
uauucugguuugggagggau

SEQ ID NO: 25324 - RNA, 20 nt, Artificial Sequence
  TRAC targeting sequence
ggacggugacugugagcccc

SEQ ID NO: 25325 - RNA, 20 nt, Artificial Sequence
  TRAC targeting sequence
agaucuuauucugguuuggg

SEQ ID NO: 25326 - RNA, 20 nt, Artificial Sequence
  TRAC targeting sequence
ccguccagaucuuauucugg

SEQ ID NO: 25327 - RNA, 20 nt, Artificial Sequence
  TRAC targeting sequence
cagucaccguccagaucuua

SEQ ID NO: 25328 - RNA, 20 nt, Artificial Sequence
  TRAC targeting sequence
gggcucacagucaccgucca

SEQ ID NO: 25329 - RNA, 20 nt, Artificial Sequence
  TRAC targeting sequence
uuuugcucggggcucacagu

SEQ ID NO: 25330 - RNA, 20 nt, Artificial Sequence
  TRAC targeting sequence
ccaagggggugcggucguuu

SEQ ID NO: 25331 - RNA, 20 nt, Artificial Sequence
  TRAC targeting sequence
cuggauccucaacauggacu

SEQ ID NO: 25332 - RNA, 20 nt, Artificial Sequence
  TRAC targeting sequence
ggauccucaacauggacuca

SEQ ID NO: 25333 - RNA, 20 nt, Artificial Sequence
  TRAC targeting sequence
agagacccacgccgccccca

SEQ ID NO: 25334 - RNA, 20 nt, Artificial Sequence
  TRAC targeting sequence
ucaacauggacucacugagu

SEQ ID NO: 25335 - RNA, 20 nt, Artificial Sequence
  TRAC targeting sequence
acauggacucacugagugcc

SEQ ID NO: 25336 - RNA, 20 nt, Artificial Sequence
  TRAC targeting sequence
auguugaggauccagagacc

SEQ ID NO: 25337 - RNA, 20 nt, Artificial Sequence
  TRAC targeting sequence
cugagugcccgccgcacacu

SEQ ID NO: 25338 - RNA, 20 nt, Artificial Sequence
  TRAC targeting sequence
gugaguccauguugaggauc

SEQ ID NO: 25339 - RNA, 20 nt, Artificial Sequence
  TRAC targeting sequence
aucugcuuggcuucgggcga

SEQ ID NO: 25340 - RNA, 20 nt, Artificial Sequence
  TRAC targeting sequence
aaggugugcagugugcggcg

SEQ ID NO: 25341 - RNA, 20 nt, Artificial Sequence
  TRAC targeting sequence
gcuuggcuucgggcgaagcu

SEQ ID NO: 25342 - RNA, 20 nt, Artificial Sequence
  TRAC targeting sequence
ggcgaagcucaaggccagca

SEQ ID NO: 25343 - RNA, 20 nt, Artificial Sequence
  TRAC targeting sequence
cccgaagccaagcagaucga

SEQ ID NO: 25344 - RNA, 20 nt, Artificial Sequence
  TRAC targeting sequence
aggccagcauucccaaggga

SEQ ID NO: 25345 - RNA, 20 nt, Artificial Sequence
  TRAC targeting sequence
caagggacccggagggggcu

SEQ ID NO: 25346 - RNA, 20 nt, Artificial Sequence
  TRAC targeting sequence
cuugggaaugcuggccuuga

SEQ ID NO: 25347 - RNA, 20 nt, Artificial Sequence
  TRAC targeting sequence
gggucccuugggaaugcugg

SEQ ID NO: 25348 - RNA, 20 nt, Artificial Sequence
  TRAC targeting sequence
gcccccuccgggucccuugg

SEQ ID NO: 25349 - RNA, 20 nt, Artificial Sequence
  TRAC targeting sequence
ucagcccccuccgggucccu

SEQ ID NO: 25350 - RNA, 20 nt, Artificial Sequence
  TRAC targeting sequence
uccucagcccccuccggguc

SEQ ID NO: 25351 - RNA, 20 nt, Artificial Sequence
  TRAC targeting sequence
caaacucauccucagccccc

SEQ ID NO: 25352 - RNA, 20 nt, Artificial Sequence
  TRAC targeting sequence
auagagacauggcgggagac

SEQ ID NO: 25353 - RNA, 20 nt, Artificial Sequence
  TRAC targeting sequence
augucacaaacucauccuca

SEQ ID NO: 25354 - RNA, 20 nt, Artificial Sequence
  TRAC targeting sequence
aucgaugucacaaacucauc

SEQ ID NO: 25355 - RNA, 20 nt, Artificial Sequence
  TRAC targeting sequence
cuaucgaugucacaaacuca

SEQ ID NO: 25356 - RNA, 20 nt, Artificial Sequence
  TRAC targeting sequence
cgccaugucucuaucgaugu

SEQ ID NO: 25357 - RNA, 20 nt, Artificial Sequence
  TRAC targeting sequence
cccgccaugucucuaucgau

SEQ ID NO: 25358 - RNA, 20 nt, Artificial Sequence
  TRAC targeting sequence
ccauggucucccgccauguc

SEQ ID NO: 25359 - RNA, 20 nt, Artificial Sequence
  TRAC targeting sequence
ccagcaugauccuccugggg

SEQ ID NO: 25360 - RNA, 20 nt, Artificial Sequence
  TRAC targeting sequence
ugcuggggauccccaugguc

SEQ ID NO: 25361 - RNA, 20 nt, Artificial Sequence
  TRAC targeting sequence
uccuggggcacaguuuggga

SEQ ID NO: 25362 - RNA, 20 nt, Artificial Sequence
  TRAC targeting sequence
uggggcacaguuugggagga

SEQ ID NO: 25363 - RNA, 20 nt, Artificial Sequence
  TRAC targeting sequence
caaacugugccccaggagga

SEQ ID NO: 25364 - RNA, 20 nt, Artificial Sequence
  TRAC targeting sequence
ucccaaacugugccccagga

SEQ ID NO: 25365 - RNA, 20 nt, Artificial Sequence
  TRAC targeting sequence
uggccacuucuuacucaauc

SEQ ID NO: 25366 - RNA, 20 nt, Artificial Sequence
  TRAC targeting sequence
uacucaaucaaguacccuga

SEQ ID NO: 25367 - RNA, 20 nt, Artificial Sequence
  TRAC targeting sequence
aucaaguacccugauaggua

SEQ ID NO: 25368 - RNA, 20 nt, Artificial Sequence
  TRAC targeting sequence
aguacccugauagguaauaa

SEQ ID NO: 25369 - RNA, 20 nt, Artificial Sequence
  TRAC targeting sequence
ggguacuugauugaguaaga

SEQ ID NO: 25370 - RNA, 20 nt, Artificial Sequence
  TRAC targeting sequence
uuauuaccuaucaggguacu

SEQ ID NO: 25371 - RNA, 20 nt, Artificial Sequence
  TRAC targeting sequence
ccuuauuaccuaucagggua

SEQ ID NO: 25372 - RNA, 20 nt, Artificial Sequence
  TRAC targeting sequence
aucccucgugaccuaauucc

SEQ ID NO: 25373 - RNA, 20 nt, Artificial Sequence
  TRAC targeting sequence
cucgugaccuaauuccuggc

SEQ ID NO: 25374 - RNA, 20 nt, Artificial Sequence
  TRAC targeting sequence
ugaccuaauuccuggccuua

SEQ ID NO: 25375 - RNA, 20 nt, Artificial Sequence
  TRAC targeting sequence
cgagggauggagccaucucc

SEQ ID NO: 25376 - RNA, 20 nt, Artificial Sequence
  TRAC targeting sequence
uggccuuacugggaacuuuc

SEQ ID NO: 25377 - RNA, 20 nt, Artificial Sequence
  TRAC targeting sequence
caguaaggccaggaauuagg

SEQ ID NO: 25378 - RNA, 20 nt, Artificial Sequence
  TRAC targeting sequence
aguauucauuuccaaacuuc

SEQ ID NO: 25379 - RNA, 20 nt, Artificial Sequence
  TRAC targeting sequence
uuuccaaacuucucucauuc

SEQ ID NO: 25380 - RNA, 20 nt, Artificial Sequence
  TRAC targeting sequence
aaacuucucucauucccagg

SEQ ID NO: 25381 - RNA, 20 nt, Artificial Sequence
  TRAC targeting sequence
cucauucccaggcgauuuaa

SEQ ID NO: 25382 - RNA, 20 nt, Artificial Sequence
  TRAC targeting sequence
cauucccaggcgauuuaagg

SEQ ID NO: 25383 - RNA, 20 nt, Artificial Sequence
  TRAC targeting sequence
uucccaggcgauuuaagggg

SEQ ID NO: 25384 - RNA, 20 nt, Artificial Sequence
  TRAC targeting sequence
caggcgauuuaaggggcuau

SEQ ID NO: 25385 - RNA, 20 nt, Artificial Sequence
  TRAC targeting sequence
ccugggaaugagagaaguuu

SEQ ID NO: 25386 - RNA, 20 nt, Artificial Sequence
  TRAC targeting sequence
ucuccucuuuccgccuuuaa

SEQ ID NO: 25387 - RNA, 20 nt, Artificial Sequence
  TRAC targeting sequence
ccucuuuccgccuuuaacau

SEQ ID NO: 25388 - RNA, 20 nt, Artificial Sequence
  TRAC targeting sequence
ucuuuccgccuuuaacauag

SEQ ID NO: 25389 - RNA, 20 nt, Artificial Sequence
  TRAC targeting sequence
uuccgccuuuaacauagagu

SEQ ID NO: 25390 - RNA, 20 nt, Artificial Sequence
  TRAC targeting sequence
gccuuuaacauagaguuaaa

SEQ ID NO: 25391 - RNA, 20 nt, Artificial Sequence
  TRAC targeting sequence
auguuaaaggcggaaagagg

SEQ ID NO: 25392 - RNA, 20 nt, Artificial Sequence
  TRAC targeting sequence
uccugguggacccauggggc

SEQ ID NO: 25393 - RNA, 20 nt, Artificial Sequence
  TRAC targeting sequence
ugguggacccauggggcuuu

SEQ ID NO: 25394 - RNA, 20 nt, Artificial Sequence
  TRAC targeting sequence
accaggaugagguguuuaac

SEQ ID NO: 25395 - RNA, 20 nt, Artificial Sequence
  TRAC targeting sequence
ccuccgaccaacuaacccca

SEQ ID NO: 25396 - RNA, 20 nt, Artificial Sequence
  TRAC targeting sequence
gaccaacuaaccccagugag

SEQ ID NO: 25397 - RNA, 20 nt, Artificial Sequence
  TRAC targeting sequence
gaggggaaagccccaugggu

SEQ ID NO: 25398 - RNA, 20 nt, Artificial Sequence
  TRAC targeting sequence
cugggguuaguuggucggag

SEQ ID NO: 25399 - RNA, 20 nt, Artificial Sequence
  TRAC targeting sequence
cacugggguuaguuggucgg

SEQ ID NO: 25400 - RNA, 20 nt, Artificial Sequence
  TRAC targeting sequence
gugcacccccagccuggguc

SEQ ID NO: 25401 - RNA, 20 nt, Artificial Sequence
  TRAC targeting sequence
aagccguggcaucuguccua

SEQ ID NO: 25402 - RNA, 20 nt, Artificial Sequence
  TRAC targeting sequence
guccuaggacguuccaaucc

SEQ ID NO: 25403 - RNA, 20 nt, Artificial Sequence
  TRAC targeting sequence
uaggacguuccaauccauug

SEQ ID NO: 25404 - RNA, 20 nt, Artificial Sequence
  TRAC targeting sequence
uaggacagaugccacggcuu

SEQ ID NO: 25405 - RNA, 20 nt, Artificial Sequence
  TRAC targeting sequence
aauccauuggcuguucuucg

SEQ ID NO: 25406 - RNA, 20 nt, Artificial Sequence
  TRAC targeting sequence
auuggcuguucuucgaguag

SEQ ID NO: 25407 - RNA, 20 nt, Artificial Sequence
  TRAC targeting sequence
ucgaguagcugggcccuggg

SEQ ID NO: 25408 - RNA, 20 nt, Artificial Sequence
  TRAC targeting sequence
aguagcugggcccuggggug

SEQ ID NO: 25409 - RNA, 20 nt, Artificial Sequence
  TRAC targeting sequence
aagaacagccaauggauugg

SEQ ID NO: 25410 - RNA, 20 nt, Artificial Sequence
  TRAC targeting sequence
ccccagggcccagcuacucg

SEQ ID NO: 25411 - RNA, 20 nt, Artificial Sequence
  TRAC targeting sequence
ccuuaaaggaaggcuauaac

SEQ ID NO: 25412 - RNA, 20 nt, Artificial Sequence
  TRAC targeting sequence
uuaaaggaaggcuauaacgu

SEQ ID NO: 25413 - RNA, 20 nt, Artificial Sequence
  TRAC targeting sequence
uuuaaggagauacuacaggc

SEQ ID NO: 25414 - RNA, 20 nt, Artificial Sequence
  TRAC targeting sequence
agaaggcccacagugucuuu

SEQ ID NO: 25415 - RNA, 20 nt, Artificial Sequence
  TRAC targeting sequence
agaacguuauagccuuccuu

SEQ ID NO: 25416 - RNA, 20 nt, Artificial Sequence
  TRAC targeting sequence
uucccacuuauuccuaaaaa

SEQ ID NO: 25417 - RNA, 20 nt, Artificial Sequence
  TRAC targeting sequence
cacuuauuccuaaaaagugg

SEQ ID NO: 25418 - RNA, 20 nt, Artificial Sequence
  TRAC targeting sequence
uaaaaaguggaaauuggccu

SEQ ID NO: 25419 - RNA, 20 nt, Artificial Sequence
  TRAC targeting sequence
gaaccagaucacuuuguuca

SEQ ID NO: 25420 - RNA, 20 nt, Artificial Sequence
  TRAC targeting sequence
gauuaacagcuuuaaauaac

SEQ ID NO: 25421 - RNA, 20 nt, Artificial Sequence
  TRAC targeting sequence
gguucagauuaacagcuuua

SEQ ID NO: 25422 - RNA, 20 nt, Artificial Sequence
  TRAC targeting sequence
cuuuguucaagguuugagaa

SEQ ID NO: 25423 - RNA, 20 nt, Artificial Sequence
  TRAC targeting sequence
agguuugagaagguuuuuug

SEQ ID NO: 25424 - RNA, 20 nt, Artificial Sequence
  TRAC targeting sequence
aaccuugaacaaagugaucu

SEQ ID NO: 25425 - RNA, 20 nt, Artificial Sequence
  TRAC targeting sequence
caaaccuugaacaaagugau

SEQ ID NO: 25426 - RNA, 20 nt, Artificial Sequence
  TRAC targeting sequence
ucaucggcaugggaaaagcu

SEQ ID NO: 25427 - RNA, 20 nt, Artificial Sequence
  TRAC targeting sequence
ucggcaugggaaaagcuuuu

SEQ ID NO: 25428 - RNA, 20 nt, Artificial Sequence
  TRAC targeting sequence
gcaugggaaaagcuuuuccu

SEQ ID NO: 25429 - RNA, 20 nt, Artificial Sequence
  TRAC targeting sequence
caugccgaugaagagaaaaa

SEQ ID NO: 25430 - RNA, 20 nt, Artificial Sequence
  TRAC targeting sequence
uaugccaggaacagguggag

SEQ ID NO: 25431 - RNA, 20 nt, Artificial Sequence
  TRAC targeting sequence
uggcauaggaaaagcuuuuc

SEQ ID NO: 25432 - RNA, 20 nt, Artificial Sequence
  TRAC targeting sequence
accuguuccuggcauaggaa

SEQ ID NO: 25433 - RNA, 20 nt, Artificial Sequence
  TRAC targeting sequence
gcuccaccuguuccuggcau

SEQ ID NO: 25434 - RNA, 20 nt, Artificial Sequence
  TRAC targeting sequence
gguagcuauucugcuccacc

SEQ ID NO: 25435 - RNA, 20 nt, Artificial Sequence
  TRAC targeting sequence
cacucuaucucccaggcuga

SEQ ID NO: 25436 - RNA, 20 nt, Artificial Sequence
  TRAC targeting sequence
cucuaucucccaggcugaug

SEQ ID NO: 25437 - RNA, 20 nt, Artificial Sequence
  TRAC targeting sequence
aucucccaggcugaugugca

SEQ ID NO: 25438 - RNA, 20 nt, Artificial Sequence
  TRAC targeting sequence
cccaggcugaugugcagugg

SEQ ID NO: 25439 - RNA, 20 nt, Artificial Sequence
  TRAC targeting sequence
caggcugaugugcaguggug

SEQ ID NO: 25440 - RNA, 20 nt, Artificial Sequence
  TRAC targeting sequence
gccugggagauagagugaga

SEQ ID NO: 25441 - RNA, 20 nt, Artificial Sequence
  TRAC targeting sequence
caccacugcacaucagccug

SEQ ID NO: 25442 - RNA, 20 nt, Artificial Sequence
  TRAC targeting sequence
cagcucacugcaaccuccgc

SEQ ID NO: 25443 - RNA, 20 nt, Artificial Sequence
  TRAC targeting sequence
gcucacugcaaccuccgccu

SEQ ID NO: 25444 - RNA, 20 nt, Artificial Sequence
  TRAC targeting sequence
cugcaaccuccgccuccugg

SEQ ID NO: 25445 - RNA, 20 nt, Artificial Sequence
  TRAC targeting sequence
agugguuacugggcaugaau

SEQ ID NO: 25446 - RNA, 20 nt, Artificial Sequence
  TRAC targeting sequence
caucccugugguucacccaa

SEQ ID NO: 25447 - RNA, 20 nt, Artificial Sequence
  TRAC targeting sequence
cugugguucacccaacaccu

SEQ ID NO: 25448 - RNA, 20 nt, Artificial Sequence
  TRAC targeting sequence
cccaacaccugcagcaggga

SEQ ID NO: 25449 - RNA, 20 nt, Artificial Sequence
  TRAC targeting sequence
cugcugcagguguuggguga

SEQ ID NO: 25450 - RNA, 20 nt, Artificial Sequence
  TRAC targeting sequence
cccugcugcagguguugggu

SEQ ID NO: 25451 - RNA, 20 nt, Artificial Sequence
  TRAC targeting sequence
gaaccaaagccuccaacaua

SEQ ID NO: 25452 - RNA, 20 nt, Artificial Sequence
  TRAC targeting sequence
gaccucucccugcugcaggu

SEQ ID NO: 25453 - RNA, 20 nt, Artificial Sequence
  TRAC targeting sequence
aacauaacccacaguggcag

SEQ ID NO: 25454 - RNA, 20 nt, Artificial Sequence
  TRAC targeting sequence
uaauaauuggcuauugaaua

SEQ ID NO: 25455 - RNA, 20 nt, Artificial Sequence
  TRAC targeting sequence
gcaauuaacucauaauaauu

SEQ ID NO: 25456 - RNA, 20 nt, Artificial Sequence
  TRAC targeting sequence
uacuuagccaucagcaauua

SEQ ID NO: 25457 - RNA, 20 nt, Artificial Sequence
  TRAC targeting sequence
cucuagguccuucaagaaaa

SEQ ID NO: 25458 - RNA, 20 nt, Artificial Sequence
  TRAC targeting sequence
cuagguccuucaagaaaaac

SEQ ID NO: 25459 - RNA, 20 nt, Artificial Sequence
  TRAC targeting sequence
agguccuucaagaaaaacag

SEQ ID NO: 25460 - RNA, 20 nt, Artificial Sequence
  TRAC targeting sequence
uucaagaaaaacagaaugau

SEQ ID NO: 25461 - RNA, 20 nt, Artificial Sequence
  TRAC targeting sequence
agaaaaacagaaugauucca

SEQ ID NO: 25462 - RNA, 20 nt, Artificial Sequence
  TRAC targeting sequence
ugaaggaccuagagagauaa

SEQ ID NO: 25463 - RNA, 20 nt, Artificial Sequence
  TRAC targeting sequence
guuuuucuugaaggaccuag

SEQ ID NO: 25464 - RNA, 20 nt, Artificial Sequence
  TRAC targeting sequence
uucuguuuuucuugaaggac

SEQ ID NO: 25465 - RNA, 20 nt, Artificial Sequence
  TRAC targeting sequence
agauaaagaaaaaaagcauu

SEQ ID NO: 25466 - RNA, 20 nt, Artificial Sequence
  TRAC targeting sequence
ggaaucauucuguuuuucuu

SEQ ID NO: 25467 - RNA, 20 nt, Artificial Sequence
  TRAC targeting sequence
uuaucuggaaucauucuguu

SEQ ID NO: 25468 - RNA, 20 nt, Artificial Sequence
  TRAC targeting sequence
aaugcuuuuuuucuuuaucu

SEQ ID NO: 25469 - RNA, 20 nt, Artificial Sequence
  TRAC targeting sequence
aaucaaaugcuuuuuuucuu

SEQ ID NO: 25470 - RNA, 20 nt, Artificial Sequence
  TRAC targeting sequence
ucuaaucaaaugcuuuuuuu

SEQ ID NO: 25471 - RNA, 20 nt, Artificial Sequence
  TRAC targeting sequence
uaucuucuaaucaaaugcuu

SEQ ID NO: 25472 - RNA, 20 nt, Artificial Sequence
  TRAC targeting sequence
gcucgagcuacucuccccua

SEQ ID NO: 25473 - RNA, 20 nt, Artificial Sequence
  TRAC targeting sequence
agcuacucuccccuauucuc

SEQ ID NO: 25474 - RNA, 20 nt, Artificial Sequence
  TRAC targeting sequence
agcagaccuucuuuuuggca

SEQ ID NO: 25475 - RNA, 20 nt, Artificial Sequence
  TRAC targeting sequence
ccccuauucucaccucuggc

SEQ ID NO: 25476 - RNA, 20 nt, Artificial Sequence
  TRAC targeting sequence
ccuauucucaccucuggcca

SEQ ID NO: 25477 - RNA, 20 nt, Artificial Sequence
  TRAC targeting sequence
caccucuggccaggcucaug

SEQ ID NO: 25478 - RNA, 20 nt, Artificial Sequence
  TRAC targeting sequence
ccucuggccaggcucaugca

SEQ ID NO: 25479 - RNA, 20 nt, Artificial Sequence
  TRAC targeting sequence
ggccaggcucaugcaggagc

SEQ ID NO: 25480 - RNA, 20 nt, Artificial Sequence
  TRAC targeting sequence
ugcaggagcaucagagcuau

SEQ ID NO: 25481 - RNA, 20 nt, Artificial Sequence
  TRAC targeting sequence
ugcaugagccuggccagagg

SEQ ID NO: 25482 - RNA, 20 nt, Artificial Sequence
  TRAC targeting sequence
gagcuaucauaguuggggaa

SEQ ID NO: 25483 - RNA, 20 nt, Artificial Sequence
  TRAC targeting sequence
gaugcuccugcaugagccug

SEQ ID NO: 25484 - RNA, 20 nt, Artificial Sequence
  TRAC targeting sequence
uaguuggggaaguuggccag

SEQ ID NO: 25485 - RNA, 20 nt, Artificial Sequence
  TRAC targeting sequence
ccaacuaugauagcucugau

SEQ ID NO: 25486 - RNA, 20 nt, Artificial Sequence
  TRAC targeting sequence
uggcugcuggccaacuuccc

SEQ ID NO: 25487 - RNA, 20 nt, Artificial Sequence
  TRAC targeting sequence
cucauggcugcuggccaacu

SEQ ID NO: 25488 - RNA, 20 nt, Artificial Sequence
  TRAC targeting sequence
ugcauagucccucauggcug

SEQ ID NO: 25489 - RNA, 20 nt, Artificial Sequence
  TRAC targeting sequence
cuccugcauagucccucaug

SEQ ID NO: 25490 - RNA, 20 nt, Artificial Sequence
  TRAC targeting sequence
uaccucccucuugcuucuca

SEQ ID NO: 25491 - RNA, 20 nt, Artificial Sequence
  TRAC targeting sequence
cucuugcuucucauaaacag

SEQ ID NO: 25492 - RNA, 20 nt, Artificial Sequence
  TRAC targeting sequence
ugcuucucauaaacagagag

SEQ ID NO: 25493 - RNA, 20 nt, Artificial Sequence
  TRAC targeting sequence
cauaaacagagagaagacca

SEQ ID NO: 25494 - RNA, 20 nt, Artificial Sequence
  TRAC targeting sequence
uaaacagagagaagaccaga

SEQ ID NO: 25495 - RNA, 20 nt, Artificial Sequence
  TRAC targeting sequence
guuuaugagaagcaagaggg

SEQ ID NO: 25496 - RNA, 20 nt, Artificial Sequence
  TRAC targeting sequence
cuguuuaugagaagcaagag

SEQ ID NO: 25497 - RNA, 20 nt, Artificial Sequence
  TRAC targeting sequence
cucuguuuaugagaagcaag

SEQ ID NO: 25498 - RNA, 20 nt, Artificial Sequence
  TRAC targeting sequence
ucucucuguuuaugagaagc

SEQ ID NO: 25499 - RNA, 20 nt, Artificial Sequence
  TRAC targeting sequence
ggucuucucucuguuuauga

SEQ ID NO: 25500 - RNA, 20 nt, Artificial Sequence
  TRAC targeting sequence
cuggucuucucucuguuuau

SEQ ID NO: 25501 - RNA, 20 nt, Artificial Sequence
  TRAC targeting sequence
cucuggucuucucucuguuu

SEQ ID NO: 25502 - RNA, 20 nt, Artificial Sequence
  TRAC targeting sequence
uucucucuggucuucucucu

SEQ ID NO: 25503 - RNA, 20 nt, Artificial Sequence
  TRAC targeting sequence
cuuucucucuggucuucucu

SEQ ID NO: 25504 - RNA, 20 nt, Artificial Sequence
  TRAC targeting sequence
cucuuucucucuggucuucu

SEQ ID NO: 25505 - RNA, 20 nt, Artificial Sequence
  TRAC targeting sequence
cucucuuucucucuggucuu

SEQ ID NO: 25506 - RNA, 20 nt, Artificial Sequence
  TRAC targeting sequence
gggaucagaaguugaccagu

SEQ ID NO: 25507 - RNA, 20 nt, Artificial Sequence
  TRAC targeting sequence
cugaucucucucuuucucuc

SEQ ID NO: 25508 - RNA, 20 nt, Artificial Sequence
  TRAC targeting sequence
gaaguugaccaguagaccuc

SEQ ID NO: 25509 - RNA, 20 nt, Artificial Sequence
  TRAC targeting sequence
gaucccugaucucucucuuu

SEQ ID NO: 25510 - RNA, 20 nt, Artificial Sequence
  TRAC targeting sequence
acuucugaucccugaucucu

SEQ ID NO: 25511 - RNA, 20 nt, Artificial Sequence
  TRAC targeting sequence
acuggucaacuucugauccc

SEQ ID NO: 25512 - RNA, 20 nt, Artificial Sequence
  TRAC targeting sequence
uuuuuacagucuguuguugc

SEQ ID NO: 25513 - RNA, 20 nt, Artificial Sequence
  TRAC targeting sequence
ccucuccacauauucuaaua

SEQ ID NO: 25514 - RNA, 20 nt, Artificial Sequence
  TRAC targeting sequence
ccacauauucuaauacaggc

SEQ ID NO: 25515 - RNA, 20 nt, Artificial Sequence
  TRAC targeting sequence
acauauucuaauacaggccu

SEQ ID NO: 25516 - RNA, 20 nt, Artificial Sequence
  TRAC targeting sequence
aauacaggccugaaaaugag

SEQ ID NO: 25517 - RNA, 20 nt, Artificial Sequence
  TRAC targeting sequence
ggccuguauuagaauaugug

SEQ ID NO: 25518 - RNA, 20 nt, Artificial Sequence
  TRAC targeting sequence
uuuucaggccuguauuagaa

SEQ ID NO: 25519 - RNA, 20 nt, Artificial Sequence
  TRAC targeting sequence
cauuuucaggccuguauuag

SEQ ID NO: 25520 - RNA, 20 nt, Artificial Sequence
  TRAC targeting sequence
ggagguggucuaguuccauc

SEQ ID NO: 25521 - RNA, 20 nt, Artificial Sequence
  TRAC targeting sequence
cgacagcgcucucauuuuca

SEQ ID NO: 25522 - RNA, 20 nt, Artificial Sequence
  TRAC targeting sequence
aguuccauccgcuaccauca

SEQ ID NO: 25523 - RNA, 20 nt, Artificial Sequence
  TRAC targeting sequence
auccgcuaccaucagaagau

SEQ ID NO: 25524 - RNA, 20 nt, Artificial Sequence
  TRAC targeting sequence
gcuaccaucagaagauuaaa

SEQ ID NO: 25525 - RNA, 20 nt, Artificial Sequence
  TRAC targeting sequence
gaagauuaaaaggccauaag

SEQ ID NO: 25526 - RNA, 20 nt, Artificial Sequence
  TRAC targeting sequence
gaugguagcggauggaacua

SEQ ID NO: 25527 - RNA, 20 nt, Artificial Sequence
  TRAC targeting sequence
ucugaugguagcggauggaa

SEQ ID NO: 25528 - RNA, 20 nt, Artificial Sequence
  TRAC targeting sequence
gggagaaggagaacauagcu

SEQ ID NO: 25529 - RNA, 20 nt, Artificial Sequence
  TRAC targeting sequence
cagacacccuuauggccuuu

SEQ ID NO: 25530 - RNA, 20 nt, Artificial Sequence
  TRAC targeting sequence
cccagacacccuuauggccu

SEQ ID NO: 25531 - RNA, 20 nt, Artificial Sequence
  TRAC targeting sequence
ucucuuauagccugagcuau

SEQ ID NO: 25532 - RNA, 20 nt, Artificial Sequence
  TRAC targeting sequence
cagccauggauucugauggg

SEQ ID NO: 25533 - RNA, 20 nt, Artificial Sequence
  TRAC targeting sequence
gccauggauucugaugggga

SEQ ID NO: 25534 - RNA, 20 nt, Artificial Sequence
  TRAC targeting sequence
auggcugagaugcucuucuc

SEQ ID NO: 25535 - RNA, 20 nt, Artificial Sequence
  TRAC targeting sequence
gauggggagggcuugugauu

SEQ ID NO: 25536 - RNA, 20 nt, Artificial Sequence
  TRAC targeting sequence
gaauccauggcugagaugcu

SEQ ID NO: 25537 - RNA, 20 nt, Artificial Sequence
  TRAC targeting sequence
ccaucagaauccauggcuga

SEQ ID NO: 25538 - RNA, 20 nt, Artificial Sequence
  TRAC targeting sequence
caagcccuccccaucagaau

SEQ ID NO: 25539 - RNA, 20 nt, Artificial Sequence
  TRAC targeting sequence
ugcagggaaagaucucgggg

SEQ ID NO: 25540 - RNA, 20 nt, Artificial Sequence
  TRAC targeting sequence
cugcaagaaucacaagcccu

SEQ ID NO: 25541 - RNA, 20 nt, Artificial Sequence
  TRAC targeting sequence
uucccugcaagaaucacaag

SEQ ID NO: 25542 - RNA, 20 nt, Artificial Sequence
  TRAC targeting sequence
cggggcuucauugagcugaa

SEQ ID NO: 25543 - RNA, 20 nt, Artificial Sequence
  TRAC targeting sequence
gggcuucauugagcugaaaa

SEQ ID NO: 25544 - RNA, 20 nt, Artificial Sequence
  TRAC targeting sequence
uugagcugaaaacaaccugg

SEQ ID NO: 25545 - RNA, 20 nt, Artificial Sequence
  TRAC targeting sequence
augaagccccgagaucuuuc

SEQ ID NO: 25546 - RNA, 20 nt, Artificial Sequence
  TRAC targeting sequence
uuuaacacuacagcggcaga

SEQ ID NO: 25547 - RNA, 20 nt, Artificial Sequence
  TRAC targeting sequence
uaaggguuuguuugcuuuau

SEQ ID NO: 25548 - RNA, 20 nt, Artificial Sequence
  TRAC targeting sequence
ccuaaggguuuguuugcuuu

SEQ ID NO: 25549 - RNA, 20 nt, Artificial Sequence
  TRAC targeting sequence
caaaacauacacaggcagga

SEQ ID NO: 25550 - RNA, 20 nt, Artificial Sequence
  TRAC targeting sequence
aaacauacacaggcaggagu

SEQ ID NO: 25551 - RNA, 20 nt, Artificial Sequence
  TRAC targeting sequence
guguuuuucuauccccuccc

SEQ ID NO: 25552 - RNA, 20 nt, Artificial Sequence
  TRAC targeting sequence
auccccucccagggccuggu

SEQ ID NO: 25553 - RNA, 20 nt, Artificial Sequence
  TRAC targeting sequence
ccucccagggccuggucugg

SEQ ID NO: 25554 - RNA, 20 nt, Artificial Sequence
  TRAC targeting sequence
cagggccuggucuggugcag

SEQ ID NO: 25555 - RNA, 20 nt, Artificial Sequence
  TRAC targeting sequence
ggugcagcgauuccggccgg

SEQ ID NO: 25556 - RNA, 20 nt, Artificial Sequence
  TRAC targeting sequence
cugcaccagaccaggcccug

SEQ ID NO: 25557 - RNA, 20 nt, Artificial Sequence
  TRAC targeting sequence
ggccggacuucaaacgcaag

SEQ ID NO: 25558 - RNA, 20 nt, Artificial Sequence
  TRAC targeting sequence
ggccggaaucgcugcaccag

SEQ ID NO: 25559 - RNA, 20 nt, Artificial Sequence
  TRAC targeting sequence
aacgcaaguuugcagacuuc

SEQ ID NO: 25560 - RNA, 20 nt, Artificial Sequence
  TRAC targeting sequence
gcaaacuugcguuugaaguc

SEQ ID NO: 25561 - RNA, 20 nt, Artificial Sequence
  TRAC targeting sequence
uugaagaugauaccauauca

SEQ ID NO: 25562 - RNA, 20 nt, Artificial Sequence
  TRAC targeting sequence
aagaagucugcaaacuugcg

SEQ ID NO: 25563 - RNA, 20 nt, Artificial Sequence
  TRAC targeting sequence
ucaaagaagucugcaaacuu

SEQ ID NO: 25564 - RNA, 20 nt, Artificial Sequence
  TRAC targeting sequence
ucuucaaagaagucugcaaa

SEQ ID NO: 25565 - RNA, 20 nt, Artificial Sequence
  TRAC targeting sequence
gaguauauuuaccacugcaa

SEQ ID NO: 25566 - RNA, 20 nt, Artificial Sequence
  TRAC targeting sequence
gauaugguaucaucuucaaa

SEQ ID NO: 25567 - RNA, 20 nt, Artificial Sequence
  TRAC targeting sequence
gugcguugcagugguaaaua

SEQ ID NO: 25568 - RNA, 20 nt, Artificial Sequence
  TRAC targeting sequence
caggugagggccgcucccca

SEQ ID NO: 25569 - RNA, 20 nt, Artificial Sequence
  TRAC targeting sequence
ccugggauucugugcguugc

SEQ ID NO: 25570 - RNA, 20 nt, Artificial Sequence
  TRAC targeting sequence
ccaggccagcuuggggcaga

SEQ ID NO: 25571 - RNA, 20 nt, Artificial Sequence
  TRAC targeting sequence
gccccaagcuggccugggga

SEQ ID NO: 25572 - RNA, 20 nt, Artificial Sequence
  TRAC targeting sequence
uaacaacugucugccccaag

SEQ ID NO: 25573 - RNA, 20 nt, Artificial Sequence
  TRAC targeting sequence
ccuaacaacugucugcccca

SEQ ID NO: 25574 - RNA, 20 nt, Artificial Sequence
  TRAC targeting sequence
uagcugcuggaguucugggc

SEQ ID NO: 25575 - RNA, 20 nt, Artificial Sequence
  TRAC targeting sequence
agcagcuaagaguuuuaucu

SEQ ID NO: 25576 - RNA, 20 nt, Artificial Sequence
  TRAC targeting sequence
gggcuuuauuucuucuucaa

SEQ ID NO: 25577 - RNA, 20 nt, Artificial Sequence
  TRAC targeting sequence
ggcuugcuagugccuguguu

SEQ ID NO: 25578 - RNA, 20 nt, Artificial Sequence
  TRAC targeting sequence
uuuccagagaguuccccagg

SEQ ID NO: 25579 - RNA, 20 nt, Artificial Sequence
  TRAC targeting sequence
agagaguuccccagggacag

SEQ ID NO: 25580 - RNA, 20 nt, Artificial Sequence
  TRAC targeting sequence
ggaaaugaucaggcuugcua

SEQ ID NO: 25581 - RNA, 20 nt, Artificial Sequence
  TRAC targeting sequence
cuggaaaugaucaggcuugc

SEQ ID NO: 25582 - RNA, 20 nt, Artificial Sequence
  TRAC targeting sequence
ccagggacagacacaaagga

SEQ ID NO: 25583 - RNA, 20 nt, Artificial Sequence
  TRAC targeting sequence
cuggggaacucucuggaaau

SEQ ID NO: 25584 - RNA, 20 nt, Artificial Sequence
  TRAC targeting sequence
gucccuggggaacucucugg

SEQ ID NO: 25585 - RNA, 20 nt, Artificial Sequence
  TRAC targeting sequence
uuugugucugucccugggga

SEQ ID NO: 25586 - RNA, 20 nt, Artificial Sequence
  TRAC targeting sequence
guauuccuuugugucugucc

SEQ ID NO: 25587 - RNA, 20 nt, Artificial Sequence
  TRAC targeting sequence
ucuguauuccuuugugucug

SEQ ID NO: 25588 - RNA, 20 nt, Artificial Sequence
  TRAC targeting sequence
auuaucuucuguauuccuuu

SEQ ID NO: 25589 - RNA, 20 nt, Artificial Sequence
  TRAC targeting sequence
cuagaggaaggcccucccug

SEQ ID NO: 25590 - RNA, 20 nt, Artificial Sequence
  TRAC targeting sequence
agaggaaggcccucccuguu

SEQ ID NO: 25591 - RNA, 20 nt, Artificial Sequence
  TRAC targeting sequence
agagaugggcagcauguuua

SEQ ID NO: 25592 - RNA, 20 nt, Artificial Sequence
  TRAC targeting sequence
ucuagagaugggcagcaugu

SEQ ID NO: 25593 - RNA, 20 nt, Artificial Sequence
  TRAC targeting sequence
cuguucccuacagguaugca

SEQ ID NO: 25594 - RNA, 20 nt, Artificial Sequence
  TRAC targeting sequence
cuacagguaugcaauuggcc

SEQ ID NO: 25595 - RNA, 20 nt, Artificial Sequence
  TRAC targeting sequence
ggccaauugcauaccuguag

SEQ ID NO: 25596 - RNA, 20 nt, Artificial Sequence
  TRAC targeting sequence
ucaggccaauugcauaccug

SEQ ID NO: 25597 - RNA, 20 nt, Artificial Sequence
  TRAC targeting sequence
uguucaucaggccaauugca

SEQ ID NO: 25598 - RNA, 20 nt, Artificial Sequence
  TRAC targeting sequence
ggaaaauauuaauauuuuaa

SEQ ID NO: 25599 - RNA, 20 nt, Artificial Sequence
  TRAC targeting sequence
agacucuuguucaucaggcc

SEQ ID NO: 25600 - RNA, 20 nt, Artificial Sequence
  TRAC targeting sequence
uuuaaaauauuaauauuuuc

SEQ ID NO: 25601 - RNA, 20 nt, Artificial Sequence
  TRAC targeting sequence
guuaaaaaaaucuuuuaaaa

SEQ ID NO: 25602 - RNA, 20 nt, Artificial Sequence
  TRAC targeting sequence
auuuuucaguuaaaaaaauc

SEQ ID NO: 25603 - RNA, 20 nt, Artificial Sequence
  TRAC targeting sequence
uuuuuuaggucaaaaauaau

SEQ ID NO: 25604 - RNA, 20 nt, Artificial Sequence
  TRAC targeting sequence
ucuuauguggaagugcccug

SEQ ID NO: 25605 - RNA, 20 nt, Artificial Sequence
  TRAC targeting sequence
uauguggaagugcccuguga

SEQ ID NO: 25606 - RNA, 20 nt, Artificial Sequence
  TRAC targeting sequence
acauaagaggauuaccuccc

SEQ ID NO: 25607 - RNA, 20 nt, Artificial Sequence
  TRAC targeting sequence
cagggcacuuccacauaaga

SEQ ID NO: 25608 - RNA, 20 nt, Artificial Sequence
  TRAC targeting sequence
gccagucacagggcacuucc

SEQ ID NO: 25609 - RNA, 20 nt, Artificial Sequence
  TRAC targeting sequence
ugguaucagccagucacagg

SEQ ID NO: 25610 - RNA, 20 nt, Artificial Sequence
  TRAC targeting sequence
ccaacauggccucgugguau

SEQ ID NO: 25611 - RNA, 20 nt, Artificial Sequence
  TRAC targeting sequence
gggugucaccaacauggccu

SEQ ID NO: 25612 - RNA, 20 nt, Artificial Sequence
  TRAC targeting sequence
caacaagugacuuggacagc

SEQ ID NO: 25613 - RNA, 20 nt, Artificial Sequence
  TRAC targeting sequence
uggcuuugggcucccaacaa

SEQ ID NO: 25614 - RNA, 20 nt, Artificial Sequence
  TRAC targeting sequence
cauggcuuugggcucccaac

SEQ ID NO: 25615 - RNA, 20 nt, Artificial Sequence
  TRAC targeting sequence
gccuuucucauggcuuuggg

SEQ ID NO: 25616 - RNA, 20 nt, Artificial Sequence
  TRAC targeting sequence
cugccuuucucauggcuuug

SEQ ID NO: 25617 - RNA, 20 nt, Artificial Sequence
  TRAC targeting sequence
agcaauacugucugaacauu

SEQ ID NO: 25618 - RNA, 20 nt, Artificial Sequence
  TRAC targeting sequence
gaacauuaaccucaaacccc

SEQ ID NO: 25619 - RNA, 20 nt, Artificial Sequence
  TRAC targeting sequence
gacaguauugcuggaaugca

SEQ ID NO: 25620 - RNA, 20 nt, Artificial Sequence
  TRAC targeting sequence
aaccccaacagcuguugggc

SEQ ID NO: 25621 - RNA, 20 nt, Artificial Sequence
  TRAC targeting sequence
cacacugcccaacagcuguu

SEQ ID NO: 25622 - RNA, 20 nt, Artificial Sequence
  TRAC targeting sequence
guccagcauuccacaugagc

SEQ ID NO: 25623 - RNA, 20 nt, Artificial Sequence
  TRAC targeting sequence
agcauuccacaugagcucag

SEQ ID NO: 25624 - RNA, 20 nt, Artificial Sequence
  TRAC targeting sequence
acaugagcucagcuaauuga

SEQ ID NO: 25625 - RNA, 20 nt, Artificial Sequence
  TRAC targeting sequence
uguggaaugcuggacagaca

SEQ ID NO: 25626 - RNA, 20 nt, Artificial Sequence
  TRAC targeting sequence
gcuaauugaagaacccugau

SEQ ID NO: 25627 - RNA, 20 nt, Artificial Sequence
  TRAC targeting sequence
auuagcugagcucaugugga

SEQ ID NO: 25628 - RNA, 20 nt, Artificial Sequence
  TRAC targeting sequence
ucaauuagcugagcucaugu

SEQ ID NO: 25629 - RNA, 20 nt, Artificial Sequence
  TRAC targeting sequence
ggguucuucaauuagcugag

SEQ ID NO: 25630 - RNA, 20 nt, Artificial Sequence
  TRAC targeting sequence
aacaguaguauagaaacucc

SEQ ID NO: 25631 - RNA, 20 nt, Artificial Sequence
  TRAC targeting sequence
auacuacuguuugaucaggg

SEQ ID NO: 25632 - RNA, 20 nt, Artificial Sequence
  TRAC targeting sequence
cagcucagcagucaaaucag

SEQ ID NO: 25633 - RNA, 20 nt, Artificial Sequence
  TRAC targeting sequence
gcagucaaaucagguucccc

SEQ ID NO: 25634 - RNA, 20 nt, Artificial Sequence
  TRAC targeting sequence
aaucagguuccccugucuuc

SEQ ID NO: 25635 - RNA, 20 nt, Artificial Sequence
  TRAC targeting sequence
gguuccccugucuuccugcc

SEQ ID NO: 25636 - RNA, 20 nt, Artificial Sequence
  TRAC targeting sequence
ccugucuuccugccguuggc

SEQ ID NO: 25637 - RNA, 20 nt, Artificial Sequence
  TRAC targeting sequence
uccugccguuggcccuucuc

SEQ ID NO: 25638 - RNA, 20 nt, Artificial Sequence
  TRAC targeting sequence
ugccguuggcccuucucuca

SEQ ID NO: 25639 - RNA, 20 nt, Artificial Sequence
  TRAC targeting sequence
cucagcccccaugggcucag

SEQ ID NO: 25640 - RNA, 20 nt, Artificial Sequence
  TRAC targeting sequence
cagcccccaugggcucagug

SEQ ID NO: 25641 - RNA, 20 nt, Artificial Sequence
  TRAC targeting sequence
gcccccaugggcucagugcc

SEQ ID NO: 25642 - RNA, 20 nt, Artificial Sequence
  TRAC targeting sequence
gugccugucucauacccacc

SEQ ID NO: 25643 - RNA, 20 nt, Artificial Sequence
  TRAC targeting sequence
cauacccaccugaggcccca

SEQ ID NO: 25644 - RNA, 20 nt, Artificial Sequence
  TRAC targeting sequence
uacccaccugaggccccaca

SEQ ID NO: 25645 - RNA, 20 nt, Artificial Sequence
  TRAC targeting sequence
ggguuacaaagucaaaaaac

SEQ ID NO: 25646 - RNA, 20 nt, Artificial Sequence
  TRAC targeting sequence
ugguaacucuuaucauuucc

SEQ ID NO: 25647 - RNA, 20 nt, Artificial Sequence
  TRAC targeting sequence
uaucauuuccuuggaaaaca

SEQ ID NO: 25648 - RNA, 20 nt, Artificial Sequence
  TRAC targeting sequence
uuuccuuggaaaacaugaaa

SEQ ID NO: 25649 - RNA, 20 nt, Artificial Sequence
  TRAC targeting sequence
uuggaaaacaugaaauuuga

SEQ ID NO: 25650 - RNA, 20 nt, Artificial Sequence
  TRAC targeting sequence
aaggaaaugauaagaguuac

SEQ ID NO: 25651 - RNA, 20 nt, Artificial Sequence
  TRAC targeting sequence
uguuuuccaaggaaaugaua

SEQ ID NO: 25652 - RNA, 20 nt, Artificial Sequence
  TRAC targeting sequence
aauuucauguuuuccaagga

SEQ ID NO: 25653 - RNA, 20 nt, Artificial Sequence
  TRAC targeting sequence
aacauguuggucaaauuuca

SEQ ID NO: 25654 - RNA, 20 nt, Artificial Sequence
  TRAC targeting sequence
acuucaucucaccuaaacuu

SEQ ID NO: 25655 - RNA, 20 nt, Artificial Sequence
  TRAC targeting sequence
gcugugaaguuuauugcugu

SEQ ID NO: 25656 - RNA, 20 nt, Artificial Sequence
  TRAC targeting sequence
cagcagaauaugucaacuug

SEQ ID NO: 25657 - RNA, 20 nt, Artificial Sequence
  TRAC targeting sequence
aaagcaaaacagcaauaaac

SEQ ID NO: 25658 - RNA, 20 nt, Artificial Sequence
  TRAC targeting sequence
ccacugucaaaagcaaaaca

SEQ ID NO: 25659 - RNA, 20 nt, Artificial Sequence
  TRAC targeting sequence
caccacugucaaaagcaaaa

SEQ ID NO: 25660 - RNA, 20 nt, Artificial Sequence
  TRAC targeting sequence
aagccaugauggaguccuuu

SEQ ID NO: 25661 - RNA, 20 nt, Artificial Sequence
  TRAC targeting sequence
uggcuuugaaugcugucuca

SEQ ID NO: 25662 - RNA, 20 nt, Artificial Sequence
  TRAC targeting sequence
aucauggcuuugaaugcugu

SEQ ID NO: 25663 - RNA, 20 nt, Artificial Sequence
  TRAC targeting sequence
uuuggcugggcccggcgccc

SEQ ID NO: 25664 - RNA, 20 nt, Artificial Sequence
  TRAC targeting sequence
agcauagggcgccgggccca

SEQ ID NO: 25665 - RNA, 20 nt, Artificial Sequence
  TRAC targeting sequence
cuccagcauagggcgccggg

SEQ ID NO: 25666 - RNA, 20 nt, Artificial Sequence
  TRAC targeting sequence
cuugauucgaaaagaugugc

SEQ ID NO: 25667 - RNA, 20 nt, Artificial Sequence
  TRAC targeting sequence
agugaauucgcuccagcaua

SEQ ID NO: 25668 - RNA, 20 nt, Artificial Sequence
  TRAC targeting sequence
aaaagaugugccuaucacua

SEQ ID NO: 25669 - RNA, 20 nt, Artificial Sequence
  TRAC targeting sequence
aaucaagugaauucgcucca

SEQ ID NO: 25670 - RNA, 20 nt, Artificial Sequence
  TRAC targeting sequence
uuucgaaucaagugaauucg

SEQ ID NO: 25671 - RNA, 20 nt, Artificial Sequence
  TRAC targeting sequence
cuaugaucuacggguccgac

SEQ ID NO: 25672 - RNA, 20 nt, Artificial Sequence
  TRAC targeting sequence
uagugauaggcacaucuuuu

SEQ ID NO: 25673 - RNA, 20 nt, Artificial Sequence
  TRAC targeting sequence
acggguccgacaccuggaua

SEQ ID NO: 25674 - RNA, 20 nt, Artificial Sequence
  TRAC targeting sequence
gacaccuggauagauaccag

SEQ ID NO: 25675 - RNA, 20 nt, Artificial Sequence
  TRAC targeting sequence
gacccguagaucauagugau

SEQ ID NO: 25676 - RNA, 20 nt, Artificial Sequence
  TRAC targeting sequence
aggugucggacccguagauc

SEQ ID NO: 25677 - RNA, 20 nt, Artificial Sequence
  TRAC targeting sequence
auccaggugucggacccgua

SEQ ID NO: 25678 - RNA, 20 nt, Artificial Sequence
  TRAC targeting sequence
cguacugguaucuauccagg

SEQ ID NO: 25679 - RNA, 20 nt, Artificial Sequence
  TRAC targeting sequence
ccuuuuuucccguacuggua

SEQ ID NO: 25680 - RNA, 20 nt, Artificial Sequence
  TRAC targeting sequence
ucaccuuuuuucccguacug

SEQ ID NO: 25681 - RNA, 20 nt, Artificial Sequence
  TRAC targeting sequence
ggccgcugcaucuucaccuu

SEQ ID NO: 25682 - RNA, 20 nt, Artificial Sequence
  TRAC targeting sequence
uauguccgagacaugguaug

SEQ ID NO: 25683 - RNA, 20 nt, Artificial Sequence
  TRAC targeting sequence
gagacaugguauguugcacc

SEQ ID NO: 25684 - RNA, 20 nt, Artificial Sequence
  TRAC targeting sequence
gacauaggaauccggccgcu

SEQ ID NO: 25685 - RNA, 20 nt, Artificial Sequence
  TRAC targeting sequence
cggacauaggaauccggccg

SEQ ID NO: 25686 - RNA, 20 nt, Artificial Sequence
  TRAC targeting sequence
uuggguggugcaacauacca

SEQ ID NO: 25687 - RNA, 20 nt, Artificial Sequence
  TRAC targeting sequence
acuccuuggguggugcaaca

SEQ ID NO: 25688 - RNA, 20 nt, Artificial Sequence
  TRAC targeting sequence
uuuccacuccuuggguggug

SEQ ID NO: 25689 - RNA, 20 nt, Artificial Sequence
  TRAC targeting sequence
ucauuuccacuccuugggug

SEQ ID NO: 25690 - RNA, 20 nt, Artificial Sequence
  TRAC targeting sequence
gucaucauuuccacuccuug

SEQ ID NO: 25691 - RNA, 20 nt, Artificial Sequence
  TRAC targeting sequence
cagucaucauuuccacuccu

SEQ ID NO: 25692 - RNA, 20 nt, Artificial Sequence
  TRAC targeting sequence
uucuccuugaucacccuucu

SEQ ID NO: 25693 - RNA, 20 nt, Artificial Sequence
  TRAC targeting sequence
ucuuucuccuugaucacccu

SEQ ID NO: 25694 - RNA, 20 nt, Artificial Sequence
  TRAC targeting sequence
auuccucuuucuccuugauc

SEQ ID NO: 25695 - RNA, 20 nt, Artificial Sequence
  TRAC targeting sequence
guccauuccucuuucuccuu

SEQ ID NO: 25696 - RNA, 20 nt, Artificial Sequence
  TRAC targeting sequence
gucuguccauuccucuuucu

SEQ ID NO: 25697 - RNA, 20 nt, Artificial Sequence
  TRAC targeting sequence
cagucuguccauuccucuuu

SEQ ID NO: 25698 - RNA, 20 nt, Artificial Sequence
  TRAC targeting sequence
aucucagucuguccauuccu

SEQ ID NO: 25699 - RNA, 20 nt, Artificial Sequence
  TRAC targeting sequence
acugcucuaucucagucugu

SEQ ID NO: 25700 - RNA, 20 nt, Artificial Sequence
  TRAC targeting sequence
aaucuacugcucuaucucag

SEQ ID NO: 25701 - RNA, 20 nt, Artificial Sequence
  TRAC targeting sequence
caaaucuacugcucuaucuc

SEQ ID NO: 25702 - RNA, 20 nt, Artificial Sequence
  TRAC targeting sequence
aaacuucucaaaucuacugc

SEQ ID NO: 25703 - RNA, 20 nt, Artificial Sequence
  TRAC targeting sequence
cuuuggaauaucuuuuuuuu

SEQ ID NO: 25704 - RNA, 20 nt, Artificial Sequence
  TRAC targeting sequence
uuggaauaucuuuuuuuuuu

SEQ ID NO: 25705 - RNA, 20 nt, Artificial Sequence
  TRAC targeting sequence
aaagagaguuuccaaacuuc

SEQ ID NO: 25706 - RNA, 20 nt, Artificial Sequence
  TRAC targeting sequence
uuuuuuuuucgugauggagu

SEQ ID NO: 25707 - RNA, 20 nt, Artificial Sequence
  TRAC targeting sequence
uccccuuuuuucuuaccccu

SEQ ID NO: 25708 - RNA, 20 nt, Artificial Sequence
  TRAC targeting sequence
ccuuuuuucuuaccccucuc

SEQ ID NO: 25709 - RNA, 20 nt, Artificial Sequence
  TRAC targeting sequence
acauucuucagcugagacau

SEQ ID NO: 25710 - RNA, 20 nt, Artificial Sequence
  TRAC targeting sequence
uggcuuccacauucuucagc

SEQ ID NO: 25711 - RNA, 20 nt, Artificial Sequence
  TRAC targeting sequence
uccaguguaaguagaaugga

SEQ ID NO: 25712 - RNA, 20 nt, Artificial Sequence
  TRAC targeting sequence
aguguaaguagaauggacag

SEQ ID NO: 25713 - RNA, 20 nt, Artificial Sequence
  TRAC targeting sequence
acuuacacuggaggauccug

SEQ ID NO: 25714 - RNA, 20 nt, Artificial Sequence
  TRAC targeting sequence
auucuacuuacacuggagga

SEQ ID NO: 25715 - RNA, 20 nt, Artificial Sequence
  TRAC targeting sequence
caccucccucauggagccca

SEQ ID NO: 25716 - RNA, 20 nt, Artificial Sequence
  TRAC targeting sequence
cucauggagcccaagaagga

SEQ ID NO: 25717 - RNA, 20 nt, Artificial Sequence
  TRAC targeting sequence
uggagcccaagaaggauuca

SEQ ID NO: 25718 - RNA, 20 nt, Artificial Sequence
  TRAC targeting sequence
augagggaggugggacaagc

SEQ ID NO: 25719 - RNA, 20 nt, Artificial Sequence
  TRAC targeting sequence
auaaguguuuccugacggca

SEQ ID NO: 25720 - RNA, 20 nt, Artificial Sequence
  TRAC targeting sequence
caugguaagucaauaagugu

SEQ ID NO: 25721 - RNA, 20 nt, Artificial Sequence
  TRAC targeting sequence
uuccuccccaggucuccaga

SEQ ID NO: 25722 - RNA, 20 nt, Artificial Sequence
  TRAC targeting sequence
uccccaggucuccagaauaa

SEQ ID NO: 25723 - RNA, 20 nt, Artificial Sequence
  TRAC targeting sequence
ccaggucuccagaauaaguu

SEQ ID NO: 25724 - RNA, 20 nt, Artificial Sequence
  TRAC targeting sequence
ccagaauaaguuccuggcca

SEQ ID NO: 25725 - RNA, 20 nt, Artificial Sequence
  TRAC targeting sequence
agaauaaguuccuggccaga

SEQ ID NO: 25726 - RNA, 20 nt, Artificial Sequence
  TRAC targeting sequence
ggagaccuggggaggaaaga

SEQ ID NO: 25727 - RNA, 20 nt, Artificial Sequence
  TRAC targeting sequence
uggccagauauguaucccuc

SEQ ID NO: 25728 - RNA, 20 nt, Artificial Sequence
  TRAC targeting sequence
ggccaggaacuuauucugga

SEQ ID NO: 25729 - RNA, 20 nt, Artificial Sequence
  TRAC targeting sequence
cucccaaaccagaauaagau

SEQ ID NO: 25730 - RNA, 20 nt, Artificial Sequence
  TRAC targeting sequence
caaaccagaauaagaucugg

SEQ ID NO: 25731 - RNA, 20 nt, Artificial Sequence
  TRAC targeting sequence
gguuugggagggauacauau

SEQ ID NO: 25732 - RNA, 20 nt, Artificial Sequence
  TRAC targeting sequence
uauucugguuugggagggau

SEQ ID NO: 25733 - RNA, 20 nt, Artificial Sequence
  TRAC targeting sequence
ggacggugacugugagcccc

SEQ ID NO: 25734 - RNA, 20 nt, Artificial Sequence
  TRAC targeting sequence
agaucuuauucugguuuggg

SEQ ID NO: 25735 - RNA, 20 nt, Artificial Sequence
  TRAC targeting sequence
ccguccagaucuuauucugg

SEQ ID NO: 25736 - RNA, 20 nt, Artificial Sequence
  TRAC targeting sequence
cagucaccguccagaucuua

SEQ ID NO: 25737 - RNA, 20 nt, Artificial Sequence
  TRAC targeting sequence
gggcucacagucaccgucca

SEQ ID NO: 25738 - RNA, 20 nt, Artificial Sequence
  TRAC targeting sequence
uuuugcucggggcucacagu

SEQ ID NO: 25739 - RNA, 20 nt, Artificial Sequence
  TRAC targeting sequence
ccaagggggugcggucguuu

SEQ ID NO: 25740 - RNA, 20 nt, Artificial Sequence
  TRAC targeting sequence
cuggauccucaacauggacu

SEQ ID NO: 25741 - RNA, 20 nt, Artificial Sequence
  TRAC targeting sequence
ggauccucaacauggacuca

SEQ ID NO: 25742 - RNA, 20 nt, Artificial Sequence
  TRAC targeting sequence
agagacccacgccgccccca

SEQ ID NO: 25743 - RNA, 20 nt, Artificial Sequence
  TRAC targeting sequence
ucaacauggacucacugagu

SEQ ID NO: 25744 - RNA, 20 nt, Artificial Sequence
  TRAC targeting sequence
acauggacucacugagugcc

SEQ ID NO: 25745 - RNA, 20 nt, Artificial Sequence
  TRAC targeting sequence
auguugaggauccagagacc

SEQ ID NO: 25746 - RNA, 20 nt, Artificial Sequence
  TRAC targeting sequence
cugagugcccgccgcacacu

SEQ ID NO: 25747 - RNA, 20 nt, Artificial Sequence
  TRAC targeting sequence
gugaguccauguugaggauc

SEQ ID NO: 25748 - RNA, 20 nt, Artificial Sequence
  TRAC targeting sequence
aucugcuuggcuucgggcga

SEQ ID NO: 25749 - RNA, 20 nt, Artificial Sequence
  TRAC targeting sequence
aaggugugcagugugcggcg

SEQ ID NO: 25750 - RNA, 20 nt, Artificial Sequence
  TRAC targeting sequence
gcuuggcuucgggcgaagcu

SEQ ID NO: 25751 - RNA, 20 nt, Artificial Sequence
  TRAC targeting sequence
ggcgaagcucaaggccagca

SEQ ID NO: 25752 - RNA, 20 nt, Artificial Sequence
  TRAC targeting sequence
cccgaagccaagcagaucga

SEQ ID NO: 25753 - RNA, 20 nt, Artificial Sequence
  TRAC targeting sequence
aggccagcauucccaaggga

SEQ ID NO: 25754 - RNA, 20 nt, Artificial Sequence
  TRAC targeting sequence
caagggacccggagggggcu

SEQ ID NO: 25755 - RNA, 20 nt, Artificial Sequence
  TRAC targeting sequence
cuugggaaugcuggccuuga

SEQ ID NO: 25756 - RNA, 20 nt, Artificial Sequence
  TRAC targeting sequence
gggucccuugggaaugcugg

SEQ ID NO: 25757 - RNA, 20 nt, Artificial Sequence
  TRAC targeting sequence
gcccccuccgggucccuugg

SEQ ID NO: 25758 - RNA, 20 nt, Artificial Sequence
  TRAC targeting sequence
ucagcccccuccgggucccu

SEQ ID NO: 25759 - RNA, 20 nt, Artificial Sequence
  TRAC targeting sequence
uccucagcccccuccggguc

SEQ ID NO: 25760 - RNA, 20 nt, Artificial Sequence
  TRAC targeting sequence
caaacucauccucagccccc

SEQ ID NO: 25761 - RNA, 20 nt, Artificial Sequence
  TRAC targeting sequence
auagagacauggcgggagac

SEQ ID NO: 25762 - RNA, 20 nt, Artificial Sequence
  TRAC targeting sequence
augucacaaacucauccuca

SEQ ID NO: 25763 - RNA, 20 nt, Artificial Sequence
  TRAC targeting sequence
aucgaugucacaaacucauc

SEQ ID NO: 25764 - RNA, 20 nt, Artificial Sequence
  TRAC targeting sequence
cuaucgaugucacaaacuca

SEQ ID NO: 25765 - RNA, 20 nt, Artificial Sequence
  TRAC targeting sequence
cgccaugucucuaucgaugu

SEQ ID NO: 25766 - RNA, 20 nt, Artificial Sequence
  TRAC targeting sequence
cccgccaugucucuaucgau

SEQ ID NO: 25767 - RNA, 20 nt, Artificial Sequence
  TRAC targeting sequence
ccauggucucccgccauguc

SEQ ID NO: 25768 - RNA, 20 nt, Artificial Sequence
  TRAC targeting sequence
ccagcaugauccuccugggg

SEQ ID NO: 25769 - RNA, 20 nt, Artificial Sequence
  TRAC targeting sequence
ugcuggggauccccaugguc

SEQ ID NO: 25770 - RNA, 20 nt, Artificial Sequence
  TRAC targeting sequence
uccuggggcacaguuuggga

SEQ ID NO: 25771 - RNA, 20 nt, Artificial Sequence
  TRAC targeting sequence
uggggcacaguuugggagga

SEQ ID NO: 25772 - RNA, 20 nt, Artificial Sequence
  TRAC targeting sequence
caaacugugccccaggagga

SEQ ID NO: 25773 - RNA, 20 nt, Artificial Sequence
  TRAC targeting sequence
ucccaaacugugccccagga

SEQ ID NO: 25774 - RNA, 20 nt, Artificial Sequence
  TRAC targeting sequence
uggccacuucuuacucaauc

SEQ ID NO: 25775 - RNA, 20 nt, Artificial Sequence
  TRAC targeting sequence
uacucaaucaaguacccuga

SEQ ID NO: 25776 - RNA, 20 nt, Artificial Sequence
  TRAC targeting sequence
aucaaguacccugauaggua

SEQ ID NO: 25777 - RNA, 20 nt, Artificial Sequence
  TRAC targeting sequence
aguacccugauagguaauaa

SEQ ID NO: 25778 - RNA, 20 nt, Artificial Sequence
  TRAC targeting sequence
ggguacuugauugaguaaga

SEQ ID NO: 25779 - RNA, 20 nt, Artificial Sequence
  TRAC targeting sequence
uuauuaccuaucaggguacu

SEQ ID NO: 25780 - RNA, 20 nt, Artificial Sequence
  TRAC targeting sequence
ccuuauuaccuaucagggua

SEQ ID NO: 25781 - RNA, 20 nt, Artificial Sequence
  TRAC targeting sequence
aucccucgugaccuaauucc

SEQ ID NO: 25782 - RNA, 20 nt, Artificial Sequence
  TRAC targeting sequence
cucgugaccuaauuccuggc

SEQ ID NO: 25783 - RNA, 20 nt, Artificial Sequence
  TRAC targeting sequence
ugaccuaauuccuggccuua

SEQ ID NO: 25784 - RNA, 20 nt, Artificial Sequence
  TRAC targeting sequence
cgagggauggagccaucucc

SEQ ID NO: 25785 - RNA, 20 nt, Artificial Sequence
  TRAC targeting sequence
uggccuuacugggaacuuuc

SEQ ID NO: 25786 - RNA, 20 nt, Artificial Sequence
  TRAC targeting sequence
caguaaggccaggaauuagg

SEQ ID NO: 25787 - RNA, 20 nt, Artificial Sequence
  TRAC targeting sequence
aguauucauuuccaaacuuc

SEQ ID NO: 25788 - RNA, 20 nt, Artificial Sequence
  TRAC targeting sequence
uuuccaaacuucucucauuc

SEQ ID NO: 25789 - RNA, 20 nt, Artificial Sequence
  TRAC targeting sequence
aaacuucucucauucccagg

SEQ ID NO: 25790 - RNA, 20 nt, Artificial Sequence
  TRAC targeting sequence
cucauucccaggcgauuuaa

SEQ ID NO: 25791 - RNA, 20 nt, Artificial Sequence
  TRAC targeting sequence
cauucccaggcgauuuaagg

SEQ ID NO: 25792 - RNA, 20 nt, Artificial Sequence
  TRAC targeting sequence
uucccaggcgauuuaagggg

SEQ ID NO: 25793 - RNA, 20 nt, Artificial Sequence
  TRAC targeting sequence
caggcgauuuaaggggcuau

SEQ ID NO: 25794 - RNA, 20 nt, Artificial Sequence
  TRAC targeting sequence
ccugggaaugagagaaguuu

SEQ ID NO: 25795 - RNA, 20 nt, Artificial Sequence
  TRAC targeting sequence
ucuccucuuuccgccuuuaa

SEQ ID NO: 25796 - RNA, 20 nt, Artificial Sequence
  TRAC targeting sequence
ccucuuuccgccuuuaacau

SEQ ID NO: 25797 - RNA, 20 nt, Artificial Sequence
  TRAC targeting sequence
ucuuuccgccuuuaacauag

SEQ ID NO: 25798 - RNA, 20 nt, Artificial Sequence
  TRAC targeting sequence
uuccgccuuuaacauagagu

SEQ ID NO: 25799 - RNA, 20 nt, Artificial Sequence
  TRAC targeting sequence
gccuuuaacauagaguuaaa

SEQ ID NO: 25800 - RNA, 20 nt, Artificial Sequence
  TRAC targeting sequence
auguuaaaggcggaaagagg

SEQ ID NO: 25801 - RNA, 20 nt, Artificial Sequence
  TRAC targeting sequence
uccugguggacccauggggc

SEQ ID NO: 25802 - RNA, 20 nt, Artificial Sequence
  TRAC targeting sequence
ugguggacccauggggcuuu

SEQ ID NO: 25803 - RNA, 20 nt, Artificial Sequence
  TRAC targeting sequence
accaggaugagguguuuaac

SEQ ID NO: 25804 - RNA, 20 nt, Artificial Sequence
  TRAC targeting sequence
ccuccgaccaacuaacccca

SEQ ID NO: 25805 - RNA, 20 nt, Artificial Sequence
  TRAC targeting sequence
gaccaacuaaccccagugag

SEQ ID NO: 25806 - RNA, 20 nt, Artificial Sequence
  TRAC targeting sequence
gaggggaaagccccaugggu

SEQ ID NO: 25807 - RNA, 20 nt, Artificial Sequence
  TRAC targeting sequence
cugggguuaguuggucggag

SEQ ID NO: 25808 - RNA, 20 nt, Artificial Sequence
  TRAC targeting sequence
cacugggguuaguuggucgg

SEQ ID NO: 25809 - RNA, 20 nt, Artificial Sequence
  TRAC targeting sequence
gugcacccccagccuggguc

SEQ ID NO: 25810 - RNA, 20 nt, Artificial Sequence
  TRAC targeting sequence
aagccguggcaucuguccua

SEQ ID NO: 25811 - RNA, 20 nt, Artificial Sequence
  TRAC targeting sequence
guccuaggacguuccaaucc

SEQ ID NO: 25812 - RNA, 20 nt, Artificial Sequence
  TRAC targeting sequence
uaggacguuccaauccauug

SEQ ID NO: 25813 - RNA, 20 nt, Artificial Sequence
  TRAC targeting sequence
uaggacagaugccacggcuu

SEQ ID NO: 25814 - RNA, 20 nt, Artificial Sequence
  TRAC targeting sequence
aauccauuggcuguucuucg

SEQ ID NO: 25815 - RNA, 20 nt, Artificial Sequence
  TRAC targeting sequence
auuggcuguucuucgaguag

SEQ ID NO: 25816 - RNA, 20 nt, Artificial Sequence
  TRAC targeting sequence
ucgaguagcugggcccuggg

SEQ ID NO: 25817 - RNA, 20 nt, Artificial Sequence
  TRAC targeting sequence
aguagcugggcccuggggug

SEQ ID NO: 25818 - RNA, 20 nt, Artificial Sequence
  TRAC targeting sequence
aagaacagccaauggauugg

SEQ ID NO: 25819 - RNA, 20 nt, Artificial Sequence
  TRAC targeting sequence
ccccagggcccagcuacucg

SEQ ID NO: 25820 - RNA, 20 nt, Artificial Sequence
  TRAC targeting sequence
ccuuaaaggaaggcuauaac

SEQ ID NO: 25821 - RNA, 20 nt, Artificial Sequence
  TRAC targeting sequence
uuaaaggaaggcuauaacgu

SEQ ID NO: 25822 - RNA, 20 nt, Artificial Sequence
  TRAC targeting sequence
uuuaaggagauacuacaggc

SEQ ID NO: 25823 - RNA, 20 nt, Artificial Sequence
  TRAC targeting sequence
agaaggcccacagugucuuu

SEQ ID NO: 25824 - RNA, 20 nt, Artificial Sequence
  TRAC targeting sequence
agaacguuauagccuuccuu

SEQ ID NO: 25825 - RNA, 20 nt, Artificial Sequence
  TRAC targeting sequence
uucccacuuauuccuaaaaa

SEQ ID NO: 25826 - RNA, 20 nt, Artificial Sequence
  TRAC targeting sequence
cacuuauuccuaaaaagugg

SEQ ID NO: 25827 - RNA, 20 nt, Artificial Sequence
  TRAC targeting sequence
uaaaaaguggaaauuggccu

SEQ ID NO: 25828 - RNA, 20 nt, Artificial Sequence
  TRAC targeting sequence
gaaccagaucacuuuguuca

SEQ ID NO: 25829 - RNA, 20 nt, Artificial Sequence
  TRAC targeting sequence
gauuaacagcuuuaaauaac

SEQ ID NO: 25830 - RNA, 20 nt, Artificial Sequence
  TRAC targeting sequence
gguucagauuaacagcuuua

SEQ ID NO: 25831 - RNA, 20 nt, Artificial Sequence
  TRAC targeting sequence
cuuuguucaagguuugagaa

SEQ ID NO: 25832 - RNA, 20 nt, Artificial Sequence
  TRAC targeting sequence
agguuugagaagguuuuuug

SEQ ID NO: 25833 - RNA, 20 nt, Artificial Sequence
  TRAC targeting sequence
aaccuugaacaaagugaucu

SEQ ID NO: 25834 - RNA, 20 nt, Artificial Sequence
  TRAC targeting sequence
caaaccuugaacaaagugau

SEQ ID NO: 25835 - RNA, 20 nt, Artificial Sequence
  TRAC targeting sequence
ucaucggcaugggaaaagcu

SEQ ID NO: 25836 - RNA, 20 nt, Artificial Sequence
  TRAC targeting sequence
ucggcaugggaaaagcuuuu

SEQ ID NO: 25837 - RNA, 20 nt, Artificial Sequence
  TRAC targeting sequence
gcaugggaaaagcuuuuccu

SEQ ID NO: 25838 - RNA, 20 nt, Artificial Sequence
  TRAC targeting sequence
caugccgaugaagagaaaaa

SEQ ID NO: 25839 - RNA, 20 nt, Artificial Sequence
  TRAC targeting sequence
uaugccaggaacagguggag

SEQ ID NO: 25840 - RNA, 20 nt, Artificial Sequence
  TRAC targeting sequence
uggcauaggaaaagcuuuuc

SEQ ID NO: 25841 - RNA, 20 nt, Artificial Sequence
  TRAC targeting sequence
accuguuccuggcauaggaa

SEQ ID NO: 25842 - RNA, 20 nt, Artificial Sequence
  TRAC targeting sequence
gcuccaccuguuccuggcau

SEQ ID NO: 25843 - RNA, 20 nt, Artificial Sequence
  TRAC targeting sequence
gguagcuauucugcuccacc

SEQ ID NO: 25844 - RNA, 20 nt, Artificial Sequence
  TRAC targeting sequence
cacucuaucucccaggcuga

SEQ ID NO: 25845 - RNA, 20 nt, Artificial Sequence
  TRAC targeting sequence
cucuaucucccaggcugaug

SEQ ID NO: 25846 - RNA, 20 nt, Artificial Sequence
  TRAC targeting sequence
aucucccaggcugaugugca

SEQ ID NO: 25847 - RNA, 20 nt, Artificial Sequence
  TRAC targeting sequence
cccaggcugaugugcagugg

SEQ ID NO: 25848 - RNA, 20 nt, Artificial Sequence
  TRAC targeting sequence
caggcugaugugcaguggug

SEQ ID NO: 25849 - RNA, 20 nt, Artificial Sequence
  TRAC targeting sequence
gccugggagauagagugaga

SEQ ID NO: 25850 - RNA, 20 nt, Artificial Sequence
  TRAC targeting sequence
caccacugcacaucagccug

SEQ ID NO: 25851 - RNA, 20 nt, Artificial Sequence
  TRAC targeting sequence
cagcucacugcaaccuccgc

SEQ ID NO: 25852 - RNA, 20 nt, Artificial Sequence
  TRAC targeting sequence
gcucacugcaaccuccgccu

SEQ ID NO: 25853 - RNA, 20 nt, Artificial Sequence
  TRAC targeting sequence
cugcaaccuccgccuccugg

SEQ ID NO: 25854 - RNA, 20 nt, Artificial Sequence
  TRAC targeting sequence
agugguuacugggcaugaau

SEQ ID NO: 25855 - RNA, 20 nt, Artificial Sequence
  TRAC targeting sequence
caucccugugguucacccaa

SEQ ID NO: 25856 - RNA, 20 nt, Artificial Sequence
  TRAC targeting sequence
cugugguucacccaacaccu

SEQ ID NO: 25857 - RNA, 20 nt, Artificial Sequence
  TRAC targeting sequence
cccaacaccugcagcaggga

SEQ ID NO: 25858 - RNA, 20 nt, Artificial Sequence
  TRAC targeting sequence
cugcugcagguguuggguga

SEQ ID NO: 25859 - RNA, 20 nt, Artificial Sequence
  TRAC targeting sequence
cccugcugcagguguugggu

SEQ ID NO: 25860 - RNA, 20 nt, Artificial Sequence
  TRAC targeting sequence
gaaccaaagccuccaacaua

SEQ ID NO: 25861 - RNA, 20 nt, Artificial Sequence
  TRAC targeting sequence
gaccucucccugcugcaggu

SEQ ID NO: 25862 - RNA, 20 nt, Artificial Sequence
  TRAC targeting sequence
aacauaacccacaguggcag

SEQ ID NO: 25863 - RNA, 20 nt, Artificial Sequence
  TRAC targeting sequence
uaauaauuggcuauugaaua

SEQ ID NO: 25864 - RNA, 20 nt, Artificial Sequence
  TRAC targeting sequence
gcaauuaacucauaauaauu

SEQ ID NO: 25865 - RNA, 20 nt, Artificial Sequence
  TRAC targeting sequence
uacuuagccaucagcaauua

SEQ ID NO: 25866 - RNA, 20 nt, Artificial Sequence
  TRAC targeting sequence
cucuagguccuucaagaaaa

SEQ ID NO: 25867 - RNA, 20 nt, Artificial Sequence
  TRAC targeting sequence
cuagguccuucaagaaaaac

SEQ ID NO: 25868 - RNA, 20 nt, Artificial Sequence
  TRAC targeting sequence
agguccuucaagaaaaacag

SEQ ID NO: 25869 - RNA, 20 nt, Artificial Sequence
  TRAC targeting sequence
uucaagaaaaacagaaugau

SEQ ID NO: 25870 - RNA, 20 nt, Artificial Sequence
  TRAC targeting sequence
agaaaaacagaaugauucca

SEQ ID NO: 25871 - RNA, 20 nt, Artificial Sequence
  TRAC targeting sequence
ugaaggaccuagagagauaa

SEQ ID NO: 25872 - RNA, 20 nt, Artificial Sequence
  TRAC targeting sequence
guuuuucuugaaggaccuag

SEQ ID NO: 25873 - RNA, 20 nt, Artificial Sequence
  TRAC targeting sequence
uucuguuuuucuugaaggac

SEQ ID NO: 25874 - RNA, 20 nt, Artificial Sequence
  TRAC targeting sequence
agauaaagaaaaaaagcauu

SEQ ID NO: 25875 - RNA, 20 nt, Artificial Sequence
  TRAC targeting sequence
ggaaucauucuguuuuucuu

SEQ ID NO: 25876 - RNA, 20 nt, Artificial Sequence
  TRAC targeting sequence
uuaucuggaaucauucuguu

SEQ ID NO: 25877 - RNA, 20 nt, Artificial Sequence
  TRAC targeting sequence
aaugcuuuuuuucuuuaucu

SEQ ID NO: 25878 - RNA, 20 nt, Artificial Sequence
  TRAC targeting sequence
aaucaaaugcuuuuuuucuu

SEQ ID NO: 25879 - RNA, 20 nt, Artificial Sequence
  TRAC targeting sequence
ucuaaucaaaugcuuuuuuu

SEQ ID NO: 25880 - RNA, 20 nt, Artificial Sequence
  TRAC targeting sequence
uaucuucuaaucaaaugcuu

SEQ ID NO: 25881 - RNA, 20 nt, Artificial Sequence
  TRAC targeting sequence
gcucgagcuacucuccccua

SEQ ID NO: 25882 - RNA, 20 nt, Artificial Sequence
  TRAC targeting sequence
agcuacucuccccuauucuc

SEQ ID NO: 25883 - RNA, 20 nt, Artificial Sequence
  TRAC targeting sequence
agcagaccuucuuuuuggca

SEQ ID NO: 25884 - RNA, 20 nt, Artificial Sequence
  TRAC targeting sequence
ccccuauucucaccucuggc

SEQ ID NO: 25885 - RNA, 20 nt, Artificial Sequence
  TRAC targeting sequence
ccuauucucaccucuggcca

SEQ ID NO: 25886 - RNA, 20 nt, Artificial Sequence
  TRAC targeting sequence
caccucuggccaggcucaug

SEQ ID NO: 25887 - RNA, 20 nt, Artificial Sequence
  TRAC targeting sequence
ccucuggccaggcucaugca

SEQ ID NO: 25888 - RNA, 20 nt, Artificial Sequence
  TRAC targeting sequence
ggccaggcucaugcaggagc

SEQ ID NO: 25889 - RNA, 20 nt, Artificial Sequence
  TRAC targeting sequence
ugcaggagcaucagagcuau

SEQ ID NO: 25890 - RNA, 20 nt, Artificial Sequence
  TRAC targeting sequence
ugcaugagccuggccagagg

SEQ ID NO: 25891 - RNA, 20 nt, Artificial Sequence
  TRAC targeting sequence
gagcuaucauaguuggggaa

SEQ ID NO: 25892 - RNA, 20 nt, Artificial Sequence
  TRAC targeting sequence
gaugcuccugcaugagccug

SEQ ID NO: 25893 - RNA, 20 nt, Artificial Sequence
  TRAC targeting sequence
uaguuggggaaguuggccag

SEQ ID NO: 25894 - RNA, 20 nt, Artificial Sequence
  TRAC targeting sequence
ccaacuaugauagcucugau

SEQ ID NO: 25895 - RNA, 20 nt, Artificial Sequence
  TRAC targeting sequence
uggcugcuggccaacuuccc

SEQ ID NO: 25896 - RNA, 20 nt, Artificial Sequence
  TRAC targeting sequence
cucauggcugcuggccaacu

SEQ ID NO: 25897 - RNA, 20 nt, Artificial Sequence
  TRAC targeting sequence
ugcauagucccucauggcug

SEQ ID NO: 25898 - RNA, 20 nt, Artificial Sequence
  TRAC targeting sequence
cuccugcauagucccucaug

SEQ ID NO: 25899 - RNA, 20 nt, Artificial Sequence
  TRAC targeting sequence
uaccucccucuugcuucuca

SEQ ID NO: 25900 - RNA, 20 nt, Artificial Sequence
  TRAC targeting sequence
cucuugcuucucauaaacag

SEQ ID NO: 25901 - RNA, 20 nt, Artificial Sequence
  TRAC targeting sequence
ugcuucucauaaacagagag

SEQ ID NO: 25902 - RNA, 20 nt, Artificial Sequence
  TRAC targeting sequence
cauaaacagagagaagacca

SEQ ID NO: 25903 - RNA, 20 nt, Artificial Sequence
  TRAC targeting sequence
uaaacagagagaagaccaga

SEQ ID NO: 25904 - RNA, 20 nt, Artificial Sequence
  TRAC targeting sequence
guuuaugagaagcaagaggg

SEQ ID NO: 25905 - RNA, 20 nt, Artificial Sequence
  TRAC targeting sequence
cuguuuaugagaagcaagag

SEQ ID NO: 25906 - RNA, 20 nt, Artificial Sequence
  TRAC targeting sequence
cucuguuuaugagaagcaag

SEQ ID NO: 25907 - RNA, 20 nt, Artificial Sequence
  TRAC targeting sequence
ucucucuguuuaugagaagc

SEQ ID NO: 25908 - RNA, 20 nt, Artificial Sequence
  TRAC targeting sequence
ggucuucucucuguuuauga

SEQ ID NO: 25909 - RNA, 20 nt, Artificial Sequence
  TRAC targeting sequence
cuggucuucucucuguuuau

SEQ ID NO: 25910 - RNA, 20 nt, Artificial Sequence
  TRAC targeting sequence
cucuggucuucucucuguuu

SEQ ID NO: 25911 - RNA, 20 nt, Artificial Sequence
  TRAC targeting sequence
uucucucuggucuucucucu

SEQ ID NO: 25912 - RNA, 20 nt, Artificial Sequence
  TRAC targeting sequence
cuuucucucuggucuucucu

SEQ ID NO: 25913 - RNA, 20 nt, Artificial Sequence
  TRAC targeting sequence
cucuuucucucuggucuucu

SEQ ID NO: 25914 - RNA, 20 nt, Artificial Sequence
  TRAC targeting sequence
cucucuuucucucuggucuu

SEQ ID NO: 25915 - RNA, 20 nt, Artificial Sequence
  TRAC targeting sequence
gggaucagaaguugaccagu

SEQ ID NO: 25916 - RNA, 20 nt, Artificial Sequence
  TRAC targeting sequence
cugaucucucucuuucucuc

SEQ ID NO: 25917 - RNA, 20 nt, Artificial Sequence
  TRAC targeting sequence
gaaguugaccaguagaccuc

SEQ ID NO: 25918 - RNA, 20 nt, Artificial Sequence
  TRAC targeting sequence
gaucccugaucucucucuuu

SEQ ID NO: 25919 - RNA, 20 nt, Artificial Sequence
  TRAC targeting sequence
acuucugaucccugaucucu

SEQ ID NO: 25920 - RNA, 20 nt, Artificial Sequence
  TRAC targeting sequence
acuggucaacuucugauccc

SEQ ID NO: 25921 - RNA, 20 nt, Artificial Sequence
  TRAC targeting sequence
uuuuuacagucuguuguugc

SEQ ID NO: 25922 - RNA, 20 nt, Artificial Sequence
  TRAC targeting sequence
ccucuccacauauucuaaua

SEQ ID NO: 25923 - RNA, 20 nt, Artificial Sequence
  TRAC targeting sequence
ccacauauucuaauacaggc

SEQ ID NO: 25924 - RNA, 20 nt, Artificial Sequence
  TRAC targeting sequence
acauauucuaauacaggccu

SEQ ID NO: 25925 - RNA, 20 nt, Artificial Sequence
  TRAC targeting sequence
aauacaggccugaaaaugag

SEQ ID NO: 25926 - RNA, 20 nt, Artificial Sequence
  TRAC targeting sequence
ggccuguauuagaauaugug

SEQ ID NO: 25927 - RNA, 20 nt, Artificial Sequence
  TRAC targeting sequence
uuuucaggccuguauuagaa

SEQ ID NO: 25928 - RNA, 20 nt, Artificial Sequence
  TRAC targeting sequence
cauuuucaggccuguauuag

SEQ ID NO: 25929 - RNA, 20 nt, Artificial Sequence
  TRAC targeting sequence
ggagguggucuaguuccauc

SEQ ID NO: 25930 - RNA, 20 nt, Artificial Sequence
  TRAC targeting sequence
cgacagcgcucucauuuuca

SEQ ID NO: 25931 - RNA, 20 nt, Artificial Sequence
  TRAC targeting sequence
aguuccauccgcuaccauca

SEQ ID NO: 25932 - RNA, 20 nt, Artificial Sequence
  TRAC targeting sequence
auccgcuaccaucagaagau

SEQ ID NO: 25933 - RNA, 20 nt, Artificial Sequence
  TRAC targeting sequence
gcuaccaucagaagauuaaa

SEQ ID NO: 25934 - RNA, 20 nt, Artificial Sequence
  TRAC targeting sequence
gaagauuaaaaggccauaag

SEQ ID NO: 25935 - RNA, 20 nt, Artificial Sequence
  TRAC targeting sequence
gaugguagcggauggaacua

SEQ ID NO: 25936 - RNA, 20 nt, Artificial Sequence
  TRAC targeting sequence
ucugaugguagcggauggaa

SEQ ID NO: 25937 - RNA, 20 nt, Artificial Sequence
  TRAC targeting sequence
gggagaaggagaacauagcu

SEQ ID NO: 25938 - RNA, 20 nt, Artificial Sequence
  TRAC targeting sequence
cagacacccuuauggccuuu

SEQ ID NO: 25939 - RNA, 20 nt, Artificial Sequence
  TRAC targeting sequence
cccagacacccuuauggccu

SEQ ID NO: 25940 - RNA, 20 nt, Artificial Sequence
  TRAC targeting sequence
ucucuuauagccugagcuau

SEQ ID NO: 25941 - RNA, 20 nt, Artificial Sequence
  TRAC targeting sequence
cagccauggauucugauggg

SEQ ID NO: 25942 - RNA, 20 nt, Artificial Sequence
  TRAC targeting sequence
gccauggauucugaugggga

SEQ ID NO: 25943 - RNA, 20 nt, Artificial Sequence
  TRAC targeting sequence
auggcugagaugcucuucuc

SEQ ID NO: 25944 - RNA, 20 nt, Artificial Sequence
  TRAC targeting sequence
gauggggagggcuugugauu

SEQ ID NO: 25945 - RNA, 20 nt, Artificial Sequence
  TRAC targeting sequence
gaauccauggcugagaugcu

SEQ ID NO: 25946 - RNA, 20 nt, Artificial Sequence
  TRAC targeting sequence
ccaucagaauccauggcuga

SEQ ID NO: 25947 - RNA, 20 nt, Artificial Sequence
  TRAC targeting sequence
caagcccuccccaucagaau

SEQ ID NO: 25948 - RNA, 20 nt, Artificial Sequence
  TRAC targeting sequence
ugcagggaaagaucucgggg

SEQ ID NO: 25949 - RNA, 20 nt, Artificial Sequence
  TRAC targeting sequence
cugcaagaaucacaagcccu

SEQ ID NO: 25950 - RNA, 20 nt, Artificial Sequence
  TRAC targeting sequence
uucccugcaagaaucacaag

SEQ ID NO: 25951 - RNA, 20 nt, Artificial Sequence
  TRAC targeting sequence
cggggcuucauugagcugaa

SEQ ID NO: 25952 - RNA, 20 nt, Artificial Sequence
  TRAC targeting sequence
gggcuucauugagcugaaaa

SEQ ID NO: 25953 - RNA, 20 nt, Artificial Sequence
  TRAC targeting sequence
uugagcugaaaacaaccugg

SEQ ID NO: 25954 - RNA, 20 nt, Artificial Sequence
  TRAC targeting sequence
augaagccccgagaucuuuc

SEQ ID NO: 25955 - RNA, 20 nt, Artificial Sequence
  TRAC targeting sequence
uuuaacacuacagcggcaga

SEQ ID NO: 25956 - RNA, 20 nt, Artificial Sequence
  TRAC targeting sequence
uaaggguuuguuugcuuuau

SEQ ID NO: 25957 - RNA, 20 nt, Artificial Sequence
  TRAC targeting sequence
ccuaaggguuuguuugcuuu

SEQ ID NO: 25958 - RNA, 20 nt, Artificial Sequence
  TRAC targeting sequence
caaaacauacacaggcagga

SEQ ID NO: 25959 - RNA, 20 nt, Artificial Sequence
  TRAC targeting sequence
aaacauacacaggcaggagu

SEQ ID NO: 25960 - RNA, 20 nt, Artificial Sequence
  TRAC targeting sequence
guguuuuucuauccccuccc

SEQ ID NO: 25961 - RNA, 20 nt, Artificial Sequence
  TRAC targeting sequence
auccccucccagggccuggu

SEQ ID NO: 25962 - RNA, 20 nt, Artificial Sequence
  TRAC targeting sequence
ccucccagggccuggucugg

SEQ ID NO: 25963 - RNA, 20 nt, Artificial Sequence
  TRAC targeting sequence
cagggccuggucuggugcag

SEQ ID NO: 25964 - RNA, 20 nt, Artificial Sequence
  TRAC targeting sequence
ggugcagcgauuccggccgg

SEQ ID NO: 25965 - RNA, 20 nt, Artificial Sequence
  TRAC targeting sequence
cugcaccagaccaggcccug

SEQ ID NO: 25966 - RNA, 20 nt, Artificial Sequence
  TRAC targeting sequence
ggccggacuucaaacgcaag

SEQ ID NO: 25967 - RNA, 20 nt, Artificial Sequence
  TRAC targeting sequence
ggccggaaucgcugcaccag

SEQ ID NO: 25968 - RNA, 20 nt, Artificial Sequence
  TRAC targeting sequence
aacgcaaguuugcagacuuc

SEQ ID NO: 25969 - RNA, 20 nt, Artificial Sequence
  TRAC targeting sequence
gcaaacuugcguuugaaguc

SEQ ID NO: 25970 - RNA, 20 nt, Artificial Sequence
  TRAC targeting sequence
uugaagaugauaccauauca

SEQ ID NO: 25971 - RNA, 20 nt, Artificial Sequence
  TRAC targeting sequence
aagaagucugcaaacuugcg

SEQ ID NO: 25972 - RNA, 20 nt, Artificial Sequence
  TRAC targeting sequence
ucaaagaagucugcaaacuu

SEQ ID NO: 25973 - RNA, 20 nt, Artificial Sequence
  TRAC targeting sequence
ucuucaaagaagucugcaaa

SEQ ID NO: 25974 - RNA, 20 nt, Artificial Sequence
  TRAC targeting sequence
gaguauauuuaccacugcaa

SEQ ID NO: 25975 - RNA, 20 nt, Artificial Sequence
  TRAC targeting sequence
gauaugguaucaucuucaaa

SEQ ID NO: 25976 - RNA, 20 nt, Artificial Sequence
  TRAC targeting sequence
gugcguugcagugguaaaua

SEQ ID NO: 25977 - RNA, 20 nt, Artificial Sequence
  TRAC targeting sequence
caggugagggccgcucccca

SEQ ID NO: 25978 - RNA, 20 nt, Artificial Sequence
  TRAC targeting sequence
ccugggauucugugcguugc

SEQ ID NO: 25979 - RNA, 20 nt, Artificial Sequence
  TRAC targeting sequence
ccaggccagcuuggggcaga

SEQ ID NO: 25980 - RNA, 20 nt, Artificial Sequence
  TRAC targeting sequence
gccccaagcuggccugggga

SEQ ID NO: 25981 - RNA, 20 nt, Artificial Sequence
  TRAC targeting sequence
uaacaacugucugccccaag

SEQ ID NO: 25982 - RNA, 20 nt, Artificial Sequence
  TRAC targeting sequence
ccuaacaacugucugcccca

SEQ ID NO: 25983 - RNA, 20 nt, Artificial Sequence
  TRAC targeting sequence
uagcugcuggaguucugggc

SEQ ID NO: 25984 - RNA, 20 nt, Artificial Sequence
  TRAC targeting sequence
agcagcuaagaguuuuaucu

SEQ ID NO: 25985 - RNA, 20 nt, Artificial Sequence
  TRAC targeting sequence
gggcuuuauuucuucuucaa

SEQ ID NO: 25986 - RNA, 20 nt, Artificial Sequence
  TRAC targeting sequence
ggcuugcuagugccuguguu

SEQ ID NO: 25987 - RNA, 20 nt, Artificial Sequence
  TRAC targeting sequence
uuuccagagaguuccccagg

SEQ ID NO: 25988 - RNA, 20 nt, Artificial Sequence
  TRAC targeting sequence
agagaguuccccagggacag

SEQ ID NO: 25989 - RNA, 20 nt, Artificial Sequence
  TRAC targeting sequence
ggaaaugaucaggcuugcua

SEQ ID NO: 25990 - RNA, 20 nt, Artificial Sequence
  TRAC targeting sequence
cuggaaaugaucaggcuugc

SEQ ID NO: 25991 - RNA, 20 nt, Artificial Sequence
  TRAC targeting sequence
ccagggacagacacaaagga

SEQ ID NO: 25992 - RNA, 20 nt, Artificial Sequence
  TRAC targeting sequence
cuggggaacucucuggaaau

SEQ ID NO: 25993 - RNA, 20 nt, Artificial Sequence
  TRAC targeting sequence
gucccuggggaacucucugg

SEQ ID NO: 25994 - RNA, 20 nt, Artificial Sequence
  TRAC targeting sequence
uuugugucugucccugggga

SEQ ID NO: 25995 - RNA, 20 nt, Artificial Sequence
  TRAC targeting sequence
guauuccuuugugucugucc

SEQ ID NO: 25996 - RNA, 20 nt, Artificial Sequence
  TRAC targeting sequence
ucuguauuccuuugugucug

SEQ ID NO: 25997 - RNA, 20 nt, Artificial Sequence
  TRAC targeting sequence
auuaucuucuguauuccuuu

SEQ ID NO: 25998 - RNA, 20 nt, Artificial Sequence
  TRAC targeting sequence
cuagaggaaggcccucccug

SEQ ID NO: 25999 - RNA, 20 nt, Artificial Sequence
  TRAC targeting sequence
agaggaaggcccucccuguu

SEQ ID NO: 26000 - RNA, 20 nt, Artificial Sequence
  TRAC targeting sequence
agagaugggcagcauguuua

SEQ ID NO: 26001 - RNA, 20 nt, Artificial Sequence
  TRAC targeting sequence
ucuagagaugggcagcaugu

SEQ ID NO: 26002 - RNA, 20 nt, Artificial Sequence
  TRAC targeting sequence
cuguucccuacagguaugca

SEQ ID NO: 26003 - RNA, 20 nt, Artificial Sequence
  TRAC targeting sequence
cuacagguaugcaauuggcc

SEQ ID NO: 26004 - RNA, 20 nt, Artificial Sequence
  TRAC targeting sequence
ggccaauugcauaccuguag

SEQ ID NO: 26005 - RNA, 20 nt, Artificial Sequence
  TRAC targeting sequence
ucaggccaauugcauaccug

SEQ ID NO: 26006 - RNA, 20 nt, Artificial Sequence
  TRAC targeting sequence
uguucaucaggccaauugca

SEQ ID NO: 26007 - RNA, 20 nt, Artificial Sequence
  TRAC targeting sequence
ggaaaauauuaauauuuuaa

SEQ ID NO: 26008 - RNA, 20 nt, Artificial Sequence
  TRAC targeting sequence
agacucuuguucaucaggcc

SEQ ID NO: 26009 - RNA, 20 nt, Artificial Sequence
  TRAC targeting sequence
uuuaaaauauuaauauuuuc

SEQ ID NO: 26010 - RNA, 20 nt, Artificial Sequence
  TRAC targeting sequence
guuaaaaaaaucuuuuaaaa

SEQ ID NO: 26011 - RNA, 20 nt, Artificial Sequence
  TRAC targeting sequence
auuuuucaguuaaaaaaauc

SEQ ID NO: 26012 - RNA, 20 nt, Artificial Sequence
  TRAC targeting sequence
uuuuuuaggucaaaaauaau

SEQ ID NO: 26013 - RNA, 20 nt, Artificial Sequence
  TRAC targeting sequence
ucuuauguggaagugcccug

SEQ ID NO: 26014 - RNA, 20 nt, Artificial Sequence
  TRAC targeting sequence
uauguggaagugcccuguga

SEQ ID NO: 26015 - RNA, 20 nt, Artificial Sequence
  TRAC targeting sequence
acauaagaggauuaccuccc

SEQ ID NO: 26016 - RNA, 20 nt, Artificial Sequence
  TRAC targeting sequence
cagggcacuuccacauaaga

SEQ ID NO: 26017 - RNA, 20 nt, Artificial Sequence
  TRAC targeting sequence
gccagucacagggcacuucc

SEQ ID NO: 26018 - RNA, 20 nt, Artificial Sequence
  TRAC targeting sequence
ugguaucagccagucacagg

SEQ ID NO: 26019 - RNA, 20 nt, Artificial Sequence
  TRAC targeting sequence
ccaacauggccucgugguau

SEQ ID NO: 26020 - RNA, 20 nt, Artificial Sequence
  TRAC targeting sequence
gggugucaccaacauggccu

SEQ ID NO: 26021 - RNA, 20 nt, Artificial Sequence
  TRAC targeting sequence
caacaagugacuuggacagc

SEQ ID NO: 26022 - RNA, 20 nt, Artificial Sequence
  TRAC targeting sequence
uggcuuugggcucccaacaa

SEQ ID NO: 26023 - RNA, 20 nt, Artificial Sequence
  TRAC targeting sequence
cauggcuuugggcucccaac

SEQ ID NO: 26024 - RNA, 20 nt, Artificial Sequence
  TRAC targeting sequence
gccuuucucauggcuuuggg

SEQ ID NO: 26025 - RNA, 20 nt, Artificial Sequence
  TRAC targeting sequence
cugccuuucucauggcuuug

SEQ ID NO: 26026 - RNA, 20 nt, Artificial Sequence
  TRAC targeting sequence
agcaauacugucugaacauu

SEQ ID NO: 26027 - RNA, 20 nt, Artificial Sequence
  TRAC targeting sequence
gaacauuaaccucaaacccc

SEQ ID NO: 26028 - RNA, 20 nt, Artificial Sequence
  TRAC targeting sequence
gacaguauugcuggaaugca

SEQ ID NO: 26029 - RNA, 20 nt, Artificial Sequence
  TRAC targeting sequence
aaccccaacagcuguugggc

SEQ ID NO: 26030 - RNA, 20 nt, Artificial Sequence
  TRAC targeting sequence
cacacugcccaacagcuguu

SEQ ID NO: 26031 - RNA, 20 nt, Artificial Sequence
  TRAC targeting sequence
guccagcauuccacaugagc

SEQ ID NO: 26032 - RNA, 20 nt, Artificial Sequence
  TRAC targeting sequence
agcauuccacaugagcucag

SEQ ID NO: 26033 - RNA, 20 nt, Artificial Sequence
  TRAC targeting sequence
acaugagcucagcuaauuga

SEQ ID NO: 26034 - RNA, 20 nt, Artificial Sequence
  TRAC targeting sequence
uguggaaugcuggacagaca

SEQ ID NO: 26035 - RNA, 20 nt, Artificial Sequence
  TRAC targeting sequence
gcuaauugaagaacccugau

SEQ ID NO: 26036 - RNA, 20 nt, Artificial Sequence
  TRAC targeting sequence
auuagcugagcucaugugga

SEQ ID NO: 26037 - RNA, 20 nt, Artificial Sequence
  TRAC targeting sequence
ucaauuagcugagcucaugu

SEQ ID NO: 26038 - RNA, 20 nt, Artificial Sequence
  TRAC targeting sequence
ggguucuucaauuagcugag

SEQ ID NO: 26039 - RNA, 20 nt, Artificial Sequence
  TRAC targeting sequence
aacaguaguauagaaacucc

SEQ ID NO: 26040 - RNA, 20 nt, Artificial Sequence
  TRAC targeting sequence
auacuacuguuugaucaggg

SEQ ID NO: 26041 - RNA, 20 nt, Artificial Sequence
  TRAC targeting sequence
cagcucagcagucaaaucag

SEQ ID NO: 26042 - RNA, 20 nt, Artificial Sequence
  TRAC targeting sequence
gcagucaaaucagguucccc

SEQ ID NO: 26043 - RNA, 20 nt, Artificial Sequence
  TRAC targeting sequence
aaucagguuccccugucuuc

SEQ ID NO: 26044 - RNA, 20 nt, Artificial Sequence
  TRAC targeting sequence
gguuccccugucuuccugcc

SEQ ID NO: 26045 - RNA, 20 nt, Artificial Sequence
  TRAC targeting sequence
ccugucuuccugccguuggc

SEQ ID NO: 26046 - RNA, 20 nt, Artificial Sequence
  TRAC targeting sequence
uccugccguuggcccuucuc

SEQ ID NO: 26047 - RNA, 20 nt, Artificial Sequence
  TRAC targeting sequence
ugccguuggcccuucucuca

SEQ ID NO: 26048 - RNA, 20 nt, Artificial Sequence
  TRAC targeting sequence
cucagcccccaugggcucag

SEQ ID NO: 26049 - RNA, 20 nt, Artificial Sequence
  TRAC targeting sequence
cagcccccaugggcucagug

SEQ ID NO: 26050 - RNA, 20 nt, Artificial Sequence
  TRAC targeting sequence
gcccccaugggcucagugcc

SEQ ID NO: 26051 - RNA, 20 nt, Artificial Sequence
  TRAC targeting sequence
gugccugucucauacccacc

SEQ ID NO: 26052 - RNA, 20 nt, Artificial Sequence
  TRAC targeting sequence
cauacccaccugaggcccca

SEQ ID NO: 26053 - RNA, 20 nt, Artificial Sequence
  TRAC targeting sequence
uacccaccugaggccccaca

SEQ ID NO: 26054 - RNA, 20 nt, Artificial Sequence
  TRAC targeting sequence
ggguuacaaagucaaaaaac

SEQ ID NO: 26055 - RNA, 20 nt, Artificial Sequence
  TRAC targeting sequence
ugguaacucuuaucauuucc

SEQ ID NO: 26056 - RNA, 20 nt, Artificial Sequence
  TRAC targeting sequence
uaucauuuccuuggaaaaca

SEQ ID NO: 26057 - RNA, 20 nt, Artificial Sequence
  TRAC targeting sequence
uuuccuuggaaaacaugaaa

SEQ ID NO: 26058 - RNA, 20 nt, Artificial Sequence
  TRAC targeting sequence
uuggaaaacaugaaauuuga

SEQ ID NO: 26059 - RNA, 20 nt, Artificial Sequence
  TRAC targeting sequence
aaggaaaugauaagaguuac

SEQ ID NO: 26060 - RNA, 20 nt, Artificial Sequence
  TRAC targeting sequence
uguuuuccaaggaaaugaua

SEQ ID NO: 26061 - RNA, 20 nt, Artificial Sequence
  TRAC targeting sequence
aauuucauguuuuccaagga

SEQ ID NO: 26062 - RNA, 20 nt, Artificial Sequence
  TRAC targeting sequence
aacauguuggucaaauuuca

SEQ ID NO: 26063 - RNA, 20 nt, Artificial Sequence
  TRAC targeting sequence
acuucaucucaccuaaacuu

SEQ ID NO: 26064 - RNA, 20 nt, Artificial Sequence
  TRAC targeting sequence
gcugugaaguuuauugcugu

SEQ ID NO: 26065 - RNA, 20 nt, Artificial Sequence
  TRAC targeting sequence
cagcagaauaugucaacuug

SEQ ID NO: 26066 - RNA, 20 nt, Artificial Sequence
  TRAC targeting sequence
aaagcaaaacagcaauaaac

SEQ ID NO: 26067 - RNA, 20 nt, Artificial Sequence
  TRAC targeting sequence
ccacugucaaaagcaaaaca

SEQ ID NO: 26068 - RNA, 20 nt, Artificial Sequence
  TRAC targeting sequence
caccacugucaaaagcaaaa

SEQ ID NO: 26069 - RNA, 20 nt, Artificial Sequence
  TRAC targeting sequence
aagccaugauggaguccuuu

SEQ ID NO: 26070 - RNA, 20 nt, Artificial Sequence
  TRAC targeting sequence
uggcuuugaaugcugucuca

SEQ ID NO: 26071 - RNA, 20 nt, Artificial Sequence
  TRAC targeting sequence
aucauggcuuugaaugcugu

SEQ ID NO: 26072 - RNA, 20 nt, Artificial Sequence
  TRAC targeting sequence
uuuggcugggcccggcgccc

SEQ ID NO: 26073 - RNA, 20 nt, Artificial Sequence
  TRAC targeting sequence
agcauagggcgccgggccca

SEQ ID NO: 26074 - RNA, 20 nt, Artificial Sequence
  TRAC targeting sequence
cuccagcauagggcgccggg

SEQ ID NO: 26075 - RNA, 20 nt, Artificial Sequence
  TRAC targeting sequence
cuugauucgaaaagaugugc

SEQ ID NO: 26076 - RNA, 20 nt, Artificial Sequence
  TRAC targeting sequence
agugaauucgcuccagcaua

SEQ ID NO: 26077 - RNA, 20 nt, Artificial Sequence
  TRAC targeting sequence
aaaagaugugccuaucacua

SEQ ID NO: 26078 - RNA, 20 nt, Artificial Sequence
  TRAC targeting sequence
aaucaagugaauucgcucca

SEQ ID NO: 26079 - RNA, 20 nt, Artificial Sequence
  TRAC targeting sequence
uuucgaaucaagugaauucg

SEQ ID NO: 26080 - RNA, 20 nt, Artificial Sequence
  TRAC targeting sequence
cuaugaucuacggguccgac

SEQ ID NO: 26081 - RNA, 20 nt, Artificial Sequence
  TRAC targeting sequence
uagugauaggcacaucuuuu

SEQ ID NO: 26082 - RNA, 20 nt, Artificial Sequence
  TRAC targeting sequence
acggguccgacaccuggaua

SEQ ID NO: 26083 - RNA, 20 nt, Artificial Sequence
  TRAC targeting sequence
gacaccuggauagauaccag

SEQ ID NO: 26084 - RNA, 20 nt, Artificial Sequence
  TRAC targeting sequence
gacccguagaucauagugau

SEQ ID NO: 26085 - RNA, 20 nt, Artificial Sequence
  TRAC targeting sequence
aggugucggacccguagauc

SEQ ID NO: 26086 - RNA, 20 nt, Artificial Sequence
  TRAC targeting sequence
auccaggugucggacccgua

SEQ ID NO: 26087 - RNA, 20 nt, Artificial Sequence
  TRAC targeting sequence
cguacugguaucuauccagg

SEQ ID NO: 26088 - RNA, 20 nt, Artificial Sequence
  TRAC targeting sequence
ccuuuuuucccguacuggua

SEQ ID NO: 26089 - RNA, 20 nt, Artificial Sequence
  TRAC targeting sequence
ucaccuuuuuucccguacug

SEQ ID NO: 26090 - RNA, 20 nt, Artificial Sequence
  TRAC targeting sequence
ggccgcugcaucuucaccuu

SEQ ID NO: 26091 - RNA, 20 nt, Artificial Sequence
  TRAC targeting sequence
uauguccgagacaugguaug

SEQ ID NO: 26092 - RNA, 20 nt, Artificial Sequence
  TRAC targeting sequence
gagacaugguauguugcacc

SEQ ID NO: 26093 - RNA, 20 nt, Artificial Sequence
  TRAC targeting sequence
gacauaggaauccggccgcu

SEQ ID NO: 26094 - RNA, 20 nt, Artificial Sequence
  TRAC targeting sequence
cggacauaggaauccggccg

SEQ ID NO: 26095 - RNA, 20 nt, Artificial Sequence
  TRAC targeting sequence
uuggguggugcaacauacca

SEQ ID NO: 26096 - RNA, 20 nt, Artificial Sequence
  TRAC targeting sequence
acuccuuggguggugcaaca

SEQ ID NO: 26097 - RNA, 20 nt, Artificial Sequence
  TRAC targeting sequence
uuuccacuccuuggguggug

SEQ ID NO: 26098 - RNA, 20 nt, Artificial Sequence
  TRAC targeting sequence
ucauuuccacuccuugggug

SEQ ID NO: 26099 - RNA, 20 nt, Artificial Sequence
  TRAC targeting sequence
gucaucauuuccacuccuug

SEQ ID NO: 26100 - RNA, 20 nt, Artificial Sequence
  TRAC targeting sequence
cagucaucauuuccacuccu

SEQ ID NO: 26101 - RNA, 20 nt, Artificial Sequence
  TRAC targeting sequence
uucuccuugaucacccuucu

SEQ ID NO: 26102 - RNA, 20 nt, Artificial Sequence
  TRAC targeting sequence
ucuuucuccuugaucacccu

SEQ ID NO: 26103 - RNA, 20 nt, Artificial Sequence
  TRAC targeting sequence
auuccucuuucuccuugauc

SEQ ID NO: 26104 - RNA, 20 nt, Artificial Sequence
  TRAC targeting sequence
guccauuccucuuucuccuu

SEQ ID NO: 26105 - RNA, 20 nt, Artificial Sequence
  TRAC targeting sequence
gucuguccauuccucuuucu

SEQ ID NO: 26106 - RNA, 20 nt, Artificial Sequence
  TRAC targeting sequence
cagucuguccauuccucuuu

SEQ ID NO: 26107 - RNA, 20 nt, Artificial Sequence
  TRAC targeting sequence
aucucagucuguccauuccu

SEQ ID NO: 26108 - RNA, 20 nt, Artificial Sequence
  TRAC targeting sequence
acugcucuaucucagucugu

SEQ ID NO: 26109 - RNA, 20 nt, Artificial Sequence
  TRAC targeting sequence
aaucuacugcucuaucucag

SEQ ID NO: 26110 - RNA, 20 nt, Artificial Sequence
  TRAC targeting sequence
caaaucuacugcucuaucuc

SEQ ID NO: 26111 - RNA, 20 nt, Artificial Sequence
  TRAC targeting sequence
aaacuucucaaaucuacugc

SEQ ID NO: 26112 - RNA, 20 nt, Artificial Sequence
  TRAC targeting sequence
cuuuggaauaucuuuuuuuu

SEQ ID NO: 26113 - RNA, 20 nt, Artificial Sequence
  TRAC targeting sequence
uuggaauaucuuuuuuuuuu

SEQ ID NO: 26114 - RNA, 20 nt, Artificial Sequence
  TRAC targeting sequence
aaagagaguuuccaaacuuc

SEQ ID NO: 26115 - RNA, 20 nt, Artificial Sequence
  TRAC targeting sequence
uuuuuuuuucgugauggagu

SEQ ID NO: 26116 - RNA, 20 nt, Artificial Sequence
  TRAC targeting sequence
uccccuuuuuucuuaccccu

SEQ ID NO: 26117 - RNA, 20 nt, Artificial Sequence
  TRAC targeting sequence
ccuuuuuucuuaccccucuc

SEQ ID NO: 26118 - RNA, 20 nt, Artificial Sequence
  TRAC targeting sequence
uaccccucuccgccaugugc

SEQ ID NO: 26119 - RNA, 20 nt, Artificial Sequence
  TRAC targeting sequence
ccgccaugugccaaugagug

SEQ ID NO: 26120 - RNA, 20 nt, Artificial Sequence
  TRAC targeting sequence
gccaugugccaaugagugug

SEQ ID NO: 26121 - RNA, 20 nt, Artificial Sequence
  TRAC targeting sequence
uuggcacauggcggagaggg

SEQ ID NO: 26122 - RNA, 20 nt, Artificial Sequence
  TRAC targeting sequence
uuaagcacacucauuggcac

SEQ ID NO: 26123 - RNA, 20 nt, Artificial Sequence
  TRAC targeting sequence
uuuaauccaaagguccagua

SEQ ID NO: 26124 - RNA, 20 nt, Artificial Sequence
  TRAC targeting sequence
gcucauuuaauccaaagguc

SEQ ID NO: 26125 - RNA, 20 nt, Artificial Sequence
  TRAC targeting sequence
gugguggggcuaacacagaa

SEQ ID NO: 26126 - RNA, 20 nt, Artificial Sequence
  TRAC targeting sequence
guguuagccccaccacugau

SEQ ID NO: 26127 - RNA, 20 nt, Artificial Sequence
  TRAC targeting sequence
uucuguguuagccccaccac

SEQ ID NO: 26128 - RNA, 20 nt, Artificial Sequence
  TRAC targeting sequence
uuccuucuguguuagcccca

SEQ ID NO: 26129 - RNA, 20 nt, Artificial Sequence
  TRAC targeting sequence
cugugucuuuccuucugugu

SEQ ID NO: 26130 - RNA, 20 nt, Artificial Sequence
  TRAC targeting sequence
aguaaguagaaugggaaagc

SEQ ID NO: 26131 - RNA, 20 nt, Artificial Sequence
  TRAC targeting sequence
acuuacuugauaaacauuca

SEQ ID NO: 26132 - RNA, 20 nt, Artificial Sequence
  TRAC targeting sequence
cauucuacuuacuugauaaa

SEQ ID NO: 26133 - RNA, 20 nt, Artificial Sequence
  TRAC targeting sequence
aaggaaaauaccaagaucca

SEQ ID NO: 26134 - RNA, 20 nt, Artificial Sequence
  TRAC targeting sequence
uuugacagccaaugcuuucc

SEQ ID NO: 26135 - RNA, 20 nt, Artificial Sequence
  TRAC targeting sequence
ugguauuuuccuuugacagc

SEQ ID NO: 26136 - RNA, 20 nt, Artificial Sequence
  TRAC targeting sequence
aagcgagaaagguggagcau

SEQ ID NO: 26137 - RNA, 20 nt, Artificial Sequence
  TRAC targeting sequence
uuuccccuuagacuugcuug

SEQ ID NO: 26138 - RNA, 20 nt, Artificial Sequence
  TRAC targeting sequence
cgcuauuucuuuuccccuua

SEQ ID NO: 26139 - RNA, 20 nt, Artificial Sequence
  TRAC targeting sequence
cagcaccaggaauaaaaggc

SEQ ID NO: 26140 - RNA, 20 nt, Artificial Sequence
  TRAC targeting sequence
uggugcugggaagccuucac

SEQ ID NO: 26141 - RNA, 20 nt, Artificial Sequence
  TRAC targeting sequence
caccccugcggguucucucu

SEQ ID NO: 26142 - RNA, 20 nt, Artificial Sequence
  TRAC targeting sequence
cucuccacaggagauuaagg

SEQ ID NO: 26143 - RNA, 20 nt, Artificial Sequence
  TRAC targeting sequence
cuccacaggagauuaagggu

SEQ ID NO: 26144 - RNA, 20 nt, Artificial Sequence
  TRAC targeting sequence
ccacaggagauuaagggugc

SEQ ID NO: 26145 - RNA, 20 nt, Artificial Sequence
  TRAC targeting sequence
acaggagauuaagggugccu

SEQ ID NO: 26146 - RNA, 20 nt, Artificial Sequence
  TRAC targeting sequence
uguggagagagaacccgcag

SEQ ID NO: 26147 - RNA, 20 nt, Artificial Sequence
  TRAC targeting sequence
ccuguggagagagaacccgc

SEQ ID NO: 26148 - RNA, 20 nt, Artificial Sequence
  TRAC targeting sequence
caccaugucuaugcugacca

SEQ ID NO: 26149 - RNA, 20 nt, Artificial Sequence
  TRAC targeting sequence
augcugaccagccacacauc

SEQ ID NO: 26150 - RNA, 20 nt, Artificial Sequence
  TRAC targeting sequence
gcauagacauggugggaggc

SEQ ID NO: 26151 - RNA, 20 nt, Artificial Sequence
  TRAC targeting sequence
ucaaugcugugguggaggag

SEQ ID NO: 26152 - RNA, 20 nt, Artificial Sequence
  TRAC targeting sequence
augcugugguggaggagauc

SEQ ID NO: 26153 - RNA, 20 nt, Artificial Sequence
  TRAC targeting sequence
accacagcauugaagaugug

SEQ ID NO: 26154 - RNA, 20 nt, Artificial Sequence
  TRAC targeting sequence
uccaccacagcauugaagau

SEQ ID NO: 26155 - RNA, 20 nt, Artificial Sequence
  TRAC targeting sequence
ccuccaccacagcauugaag

SEQ ID NO: 26156 - RNA, 20 nt, Artificial Sequence
  TRAC targeting sequence
gcgacucaguugauugagcu

SEQ ID NO: 26157 - RNA, 20 nt, Artificial Sequence
  TRAC targeting sequence
cagaucuccuccaccacagc

SEQ ID NO: 26158 - RNA, 20 nt, Artificial Sequence
  TRAC targeting sequence
guugauugagcugcucucug

SEQ ID NO: 26159 - RNA, 20 nt, Artificial Sequence
  TRAC targeting sequence
acugagucgcagaucuccuc

SEQ ID NO: 26160 - RNA, 20 nt, Artificial Sequence
  TRAC targeting sequence
aucaacugagucgcagaucu

SEQ ID NO: 26161 - RNA, 20 nt, Artificial Sequence
  TRAC targeting sequence
cugaagaggaagaggagaaa

SEQ ID NO: 26162 - RNA, 20 nt, Artificial Sequence
  TRAC targeting sequence
gaagaggaagaggagaaagc

SEQ ID NO: 26163 - RNA, 20 nt, Artificial Sequence
  TRAC targeting sequence
gagagcagcucaaucaacug

SEQ ID NO: 26164 - RNA, 20 nt, Artificial Sequence
  TRAC targeting sequence
ucagagagcagcucaaucaa

SEQ ID NO: 26165 - RNA, 20 nt, Artificial Sequence
  TRAC targeting sequence
ucuucagagagcagcucaau

SEQ ID NO: 26166 - RNA, 20 nt, Artificial Sequence
  TRAC targeting sequence
uccucuucagagagcagcuc

SEQ ID NO: 26167 - RNA, 20 nt, Artificial Sequence
  TRAC targeting sequence
ucuuccucuucagagagcag

SEQ ID NO: 26168 - RNA, 20 nt, Artificial Sequence
  TRAC targeting sequence
ccucuuccucuucagagagc

SEQ ID NO: 26169 - RNA, 20 nt, Artificial Sequence
  TRAC targeting sequence
ggcuuucuccucuuccucuu

SEQ ID NO: 26170 - RNA, 20 nt, Artificial Sequence
  TRAC targeting sequence
cuggcuuucuccucuuccuc

SEQ ID NO: 26171 - RNA, 20 nt, Artificial Sequence
  TRAC targeting sequence
cucuuaccucccugucugcu

SEQ ID NO: 26172 - RNA, 20 nt, Artificial Sequence
  TRAC targeting sequence
uaccucccugucugcuuacu

SEQ ID NO: 26173 - RNA, 20 nt, Artificial Sequence
  TRAC targeting sequence
cugucugcuuacucacccac

SEQ ID NO: 26174 - RNA, 20 nt, Artificial Sequence
  TRAC targeting sequence
gcuuacucacccacucuguc

SEQ ID NO: 26175 - RNA, 20 nt, Artificial Sequence
  TRAC targeting sequence
cccacucuguccuuuccuca

SEQ ID NO: 26176 - RNA, 20 nt, Artificial Sequence
  TRAC targeting sequence
guccuuuccucaccaacuaa

SEQ ID NO: 26177 - RNA, 20 nt, Artificial Sequence
  TRAC targeting sequence
uuuccucaccaacuaacaug

SEQ ID NO: 26178 - RNA, 20 nt, Artificial Sequence
  TRAC targeting sequence
ucaccaacuaacaugugcca

SEQ ID NO: 26179 - RNA, 20 nt, Artificial Sequence
  TRAC targeting sequence
ccaacuaacaugugccagcc

SEQ ID NO: 26180 - RNA, 20 nt, Artificial Sequence
  TRAC targeting sequence
gccuggcuggcacauguuag

SEQ ID NO: 26181 - RNA, 20 nt, Artificial Sequence
  TRAC targeting sequence
ugugcuguucccagaacagg

SEQ ID NO: 26182 - RNA, 20 nt, Artificial Sequence
  TRAC targeting sequence
cagaacaggacgacagugaa

SEQ ID NO: 26183 - RNA, 20 nt, Artificial Sequence
  TRAC targeting sequence
gggaacagcacaagacucug

SEQ ID NO: 26184 - RNA, 20 nt, Artificial Sequence
  TRAC targeting sequence
uguucugggaacagcacaag

SEQ ID NO: 26185 - RNA, 20 nt, Artificial Sequence
  TRAC targeting sequence
uccuguucugggaacagcac

SEQ ID NO: 26186 - RNA, 20 nt, Artificial Sequence
  TRAC targeting sequence
cugucguccuguucugggaa

SEQ ID NO: 26187 - RNA, 20 nt, Artificial Sequence
  TRAC targeting sequence
uuucacugucguccuguucu

SEQ ID NO: 26188 - RNA, 20 nt, Artificial Sequence
  TRAC targeting sequence
ugacccuacacugaaggcug

SEQ ID NO: 26189 - RNA, 20 nt, Artificial Sequence
  TRAC targeting sequence
agaguguucuuuucacuguc

SEQ ID NO: 26190 - RNA, 20 nt, Artificial Sequence
  TRAC targeting sequence
guguagggucaagaguguuc

SEQ ID NO: 26191 - RNA, 20 nt, Artificial Sequence
  TRAC targeting sequence
gccuucaguguagggucaag

SEQ ID NO: 26192 - RNA, 20 nt, Artificial Sequence
  TRAC targeting sequence
gccuucagccuucaguguag

SEQ ID NO: 26193 - RNA, 20 nt, Artificial Sequence
  TRAC targeting sequence
uguggcuucugccuucagcc

SEQ ID NO: 26194 - RNA, 20 nt, Artificial Sequence
  TRAC targeting sequence
aggccucuuguggcuucugc

SEQ ID NO: 26195 - RNA, 20 nt, Artificial Sequence
  TRAC targeting sequence
cuggggguggcacucaaggc

SEQ ID NO: 26196 - RNA, 20 nt, Artificial Sequence
  TRAC targeting sequence
ucccuggggguggcacucaa

SEQ ID NO: 26197 - RNA, 20 nt, Artificial Sequence
  TRAC targeting sequence
acuccuugccaaguguuacc

SEQ ID NO: 26198 - RNA, 20 nt, Artificial Sequence
  TRAC targeting sequence
uugccaaguguuacccagau

SEQ ID NO: 26199 - RNA, 20 nt, Artificial Sequence
  TRAC targeting sequence
ggguaacacuuggcaaggag

SEQ ID NO: 26200 - RNA, 20 nt, Artificial Sequence
  TRAC targeting sequence
accaucuggguaacacuugg

SEQ ID NO: 26201 - RNA, 20 nt, Artificial Sequence
  TRAC targeting sequence
uccaccaucuggguaacacu

SEQ ID NO: 26202 - RNA, 20 nt, Artificial Sequence
  TRAC targeting sequence
cauccuccaccaucugggua

SEQ ID NO: 26203 - RNA, 20 nt, Artificial Sequence
  TRAC targeting sequence
cuucacauccuccaccaucu

SEQ ID NO: 26204 - RNA, 20 nt, Artificial Sequence
  TRAC targeting sequence
gcaggugaagggaacuccag

SEQ ID NO: 26205 - RNA, 20 nt, Artificial Sequence
  TRAC targeting sequence
uuuucaugaccuaggagguc

SEQ ID NO: 26206 - RNA, 20 nt, Artificial Sequence
  TRAC targeting sequence
ugaccuaggaggucuuauuc

SEQ ID NO: 26207 - RNA, 20 nt, Artificial Sequence
  TRAC targeting sequence
ugaaaaggacucugcaggug

SEQ ID NO: 26208 - RNA, 20 nt, Artificial Sequence
  TRAC targeting sequence
uaggucaugaaaaggacucu

SEQ ID NO: 26209 - RNA, 20 nt, Artificial Sequence
  TRAC targeting sequence
uauucaaagcccucauugac

SEQ ID NO: 26210 - RNA, 20 nt, Artificial Sequence
  TRAC targeting sequence
aagcccucauugacagagga

SEQ ID NO: 26211 - RNA, 20 nt, Artificial Sequence
  TRAC targeting sequence
uugacagaggaggaaacagg

SEQ ID NO: 26212 - RNA, 20 nt, Artificial Sequence
  TRAC targeting sequence
augagggcuuugaauaagac

SEQ ID NO: 26213 - RNA, 20 nt, Artificial Sequence
  TRAC targeting sequence
gucaaugagggcuuugaaua

SEQ ID NO: 26214 - RNA, 20 nt, Artificial Sequence
  TRAC targeting sequence
ucugucaaugagggcuuuga

SEQ ID NO: 26215 - RNA, 20 nt, Artificial Sequence
  TRAC targeting sequence
uccucugucaaugagggcuu

SEQ ID NO: 26216 - RNA, 20 nt, Artificial Sequence
  TRAC targeting sequence
ugccuuggccuguuuccucc

SEQ ID NO: 26217 - RNA, 20 nt, Artificial Sequence
  TRAC targeting sequence
agccauguccugccuuggcc

SEQ ID NO: 26218 - RNA, 20 nt, Artificial Sequence
  TRAC targeting sequence
ccaugguccagccauguccu

SEQ ID NO: 26219 - RNA, 20 nt, Artificial Sequence
  TRAC targeting sequence
gugugauucaaguucuggca

SEQ ID NO: 26220 - RNA, 20 nt, Artificial Sequence
  TRAC targeting sequence
cacagagcuguaucaccaug

SEQ ID NO: 26221 - RNA, 20 nt, Artificial Sequence
  TRAC targeting sequence
aguucuggcagagcuuguaa

SEQ ID NO: 26222 - RNA, 20 nt, Artificial Sequence
  TRAC targeting sequence
ggcagagcuuguaaggcuag

SEQ ID NO: 26223 - RNA, 20 nt, Artificial Sequence
  TRAC targeting sequence
gccagaacuugaaucacaca

SEQ ID NO: 26224 - RNA, 20 nt, Artificial Sequence
  TRAC targeting sequence
agccuuacaagcucugccag

SEQ ID NO: 26225 - RNA, 20 nt, Artificial Sequence
  TRAC targeting sequence
gccgacacccugugcuuguu

SEQ ID NO: 26226 - RNA, 20 nt, Artificial Sequence
  TRAC targeting sequence
gcagaccugggcucuagccu

SEQ ID NO: 26227 - RNA, 20 nt, Artificial Sequence
  TRAC targeting sequence
agugugcaacaagcacaggg

SEQ ID NO: 26228 - RNA, 20 nt, Artificial Sequence
  TRAC targeting sequence
agccuuagcaaaucaagugu

SEQ ID NO: 26229 - RNA, 20 nt, Artificial Sequence
  TRAC targeting sequence
ccagccuuagcaaaucaagu

SEQ ID NO: 26230 - RNA, 20 nt, Artificial Sequence
  TRAC targeting sequence
uagucacuggccgaggauaa

SEQ ID NO: 26231 - RNA, 20 nt, Artificial Sequence
  TRAC targeting sequence
cuggccgaggauaagcccgu

SEQ ID NO: 26232 - RNA, 20 nt, Artificial Sequence
  TRAC targeting sequence
gccagugacuaggaccagcc

SEQ ID NO: 26233 - RNA, 20 nt, Artificial Sequence
  TRAC targeting sequence
ucggccagugacuaggacca

SEQ ID NO: 26234 - RNA, 20 nt, Artificial Sequence
  TRAC targeting sequence
cugucccacauucuagcccc

SEQ ID NO: 26235 - RNA, 20 nt, Artificial Sequence
  TRAC targeting sequence
ugccugugucucauccccgg

SEQ ID NO: 26236 - RNA, 20 nt, Artificial Sequence
  TRAC targeting sequence
cauccccggcugccuaagcu

SEQ ID NO: 26237 - RNA, 20 nt, Artificial Sequence
  TRAC targeting sequence
uccccggcugccuaagcuag

SEQ ID NO: 26238 - RNA, 20 nt, Artificial Sequence
  TRAC targeting sequence
ccggcugccuaagcuaggga

SEQ ID NO: 26239 - RNA, 20 nt, Artificial Sequence
  TRAC targeting sequence
cuagcuuaggcagccgggga

SEQ ID NO: 26240 - RNA, 20 nt, Artificial Sequence
  TRAC targeting sequence
agugcuuccuuccuugcccc

SEQ ID NO: 26241 - RNA, 20 nt, Artificial Sequence
  TRAC targeting sequence
uuccuugccccaucuuccuc

SEQ ID NO: 26242 - RNA, 20 nt, Artificial Sequence
  TRAC targeting sequence
uugccccaucuuccucccaa

SEQ ID NO: 26243 - RNA, 20 nt, Artificial Sequence
  TRAC targeting sequence
uccucccaacuggaggccuc

SEQ ID NO: 26244 - RNA, 20 nt, Artificial Sequence
  TRAC targeting sequence
ucccaacuggaggccucuga

SEQ ID NO: 26245 - RNA, 20 nt, Artificial Sequence
  TRAC targeting sequence
caacuggaggccucugagcc

SEQ ID NO: 26246 - RNA, 20 nt, Artificial Sequence
  TRAC targeting sequence
aguugggaggaagauggggc

SEQ ID NO: 26247 - RNA, 20 nt, Artificial Sequence
  TRAC targeting sequence
gagccuccccugugccuugg

SEQ ID NO: 26248 - RNA, 20 nt, Artificial Sequence
  TRAC targeting sequence
gaggccuccaguugggagga

SEQ ID NO: 26249 - RNA, 20 nt, Artificial Sequence
  TRAC targeting sequence
ccugugccuugggcccugaa

SEQ ID NO: 26250 - RNA, 20 nt, Artificial Sequence
  TRAC targeting sequence
gggcccaaggcacaggggag

SEQ ID NO: 26251 - RNA, 20 nt, Artificial Sequence
  TRAC targeting sequence
auacuacauauggggcuuca

SEQ ID NO: 26252 - RNA, 20 nt, Artificial Sequence
  TRAC targeting sequence
uggugaagagaggguggaaa

SEQ ID NO: 26253 - RNA, 20 nt, Artificial Sequence
  TRAC targeting sequence
ccaggagccaccuuugcucu

SEQ ID NO: 26254 - RNA, 20 nt, Artificial Sequence
  TRAC targeting sequence
ucaccaggagccaccuuugc

SEQ ID NO: 26255 - RNA, 20 nt, Artificial Sequence
  TRAC targeting sequence
cuucaccaggagccaccuuu

SEQ ID NO: 26256 - RNA, 20 nt, Artificial Sequence
  TRAC targeting sequence
acccucucuucaccaggagc

SEQ ID NO: 26257 - RNA, 20 nt, Artificial Sequence
  TRAC targeting sequence
gccccagggccaugucuggg

SEQ ID NO: 26258 - RNA, 20 nt, Artificial Sequence
  TRAC targeting sequence
ggguucuccaugcccaucag

SEQ ID NO: 26259 - RNA, 20 nt, Artificial Sequence
  TRAC targeting sequence
ccaugcccaucagucucugc

SEQ ID NO: 26260 - RNA, 20 nt, Artificial Sequence
  TRAC targeting sequence
augcccaucagucucugcag

SEQ ID NO: 26261 - RNA, 20 nt, Artificial Sequence
  TRAC targeting sequence
gucucugcaguuucucuacc

SEQ ID NO: 26262 - RNA, 20 nt, Artificial Sequence
  TRAC targeting sequence
cugcaguuucucuaccugcc

SEQ ID NO: 26263 - RNA, 20 nt, Artificial Sequence
  TRAC targeting sequence
gcaguuucucuaccugcccc

SEQ ID NO: 26264 - RNA, 20 nt, Artificial Sequence
  TRAC targeting sequence
cuaccugcccccagagcuga

SEQ ID NO: 26265 - RNA, 20 nt, Artificial Sequence
  TRAC targeting sequence
accugcccccagagcugagg

SEQ ID NO: 26266 - RNA, 20 nt, Artificial Sequence
  TRAC targeting sequence
gggggcagguagagaaacug

SEQ ID NO: 26267 - RNA, 20 nt, Artificial Sequence
  TRAC targeting sequence
gcucugggggcagguagaga

SEQ ID NO: 26268 - RNA, 20 nt, Artificial Sequence
  TRAC targeting sequence
gcaagccccugcccauggcc

SEQ ID NO: 26269 - RNA, 20 nt, Artificial Sequence
  TRAC targeting sequence
ccauugggccaugggcaggg

SEQ ID NO: 26270 - RNA, 20 nt, Artificial Sequence
  TRAC targeting sequence
agccacaaguucccuguccu

SEQ ID NO: 26271 - RNA, 20 nt, Artificial Sequence
  TRAC targeting sequence
cuguccuuaucagccacugg

SEQ ID NO: 26272 - RNA, 20 nt, Artificial Sequence
  TRAC targeting sequence
uuaucagccacugggugguu

SEQ ID NO: 26273 - RNA, 20 nt, Artificial Sequence
  TRAC targeting sequence
gccacugggugguucccacu

SEQ ID NO: 26274 - RNA, 20 nt, Artificial Sequence
  TRAC targeting sequence
cacugcaugacccucuaucc

SEQ ID NO: 26275 - RNA, 20 nt, Artificial Sequence
  TRAC targeting sequence
ugcagugggaaccacccagu

SEQ ID NO: 26276 - RNA, 20 nt, Artificial Sequence
  TRAC targeting sequence
aucccugccaucugucccca

SEQ ID NO: 26277 - RNA, 20 nt, Artificial Sequence
  TRAC targeting sequence
cugccaucuguccccauggu

SEQ ID NO: 26278 - RNA, 20 nt, Artificial Sequence
  TRAC targeting sequence
guccccaugguuuccagcuc

SEQ ID NO: 26279 - RNA, 20 nt, Artificial Sequence
  TRAC targeting sequence
ccaugguuuccagcucaauc

SEQ ID NO: 26280 - RNA, 20 nt, Artificial Sequence
  TRAC targeting sequence
agcucaauccaccccugacc

SEQ ID NO: 26281 - RNA, 20 nt, Artificial Sequence
  TRAC targeting sequence
auccaccccugacccaucug

SEQ ID NO: 26282 - RNA, 20 nt, Artificial Sequence
  TRAC targeting sequence
accccugacccaucugucag

SEQ ID NO: 26283 - RNA, 20 nt, Artificial Sequence
  TRAC targeting sequence
gggguggauugagcuggaaa

SEQ ID NO: 26284 - RNA, 20 nt, Artificial Sequence
  TRAC targeting sequence
gucagcuuuuucccagggag

SEQ ID NO: 26285 - RNA, 20 nt, Artificial Sequence
  TRAC targeting sequence
gcuuuuucccagggagccgu

SEQ ID NO: 26286 - RNA, 20 nt, Artificial Sequence
  TRAC targeting sequence
cagggagccguuucaggggu

SEQ ID NO: 26287 - RNA, 20 nt, Artificial Sequence
  TRAC targeting sequence
cugggaaaaagcugacagau

SEQ ID NO: 26288 - RNA, 20 nt, Artificial Sequence
  TRAC targeting sequence
gggguucugggcaguaggcu

SEQ ID NO: 26289 - RNA, 20 nt, Artificial Sequence
  TRAC targeting sequence
gggcaguaggcugggccugg

SEQ ID NO: 26290 - RNA, 20 nt, Artificial Sequence
  TRAC targeting sequence
gaaccugguggcuccugccu

SEQ ID NO: 26291 - RNA, 20 nt, Artificial Sequence
  TRAC targeting sequence
gaggccaggcccagccuacu

SEQ ID NO: 26292 - RNA, 20 nt, Artificial Sequence
  TRAC targeting sequence
ugccugcuccuucacuuuug

SEQ ID NO: 26293 - RNA, 20 nt, Artificial Sequence
  TRAC targeting sequence
uucacuuuuguaaaaccauc

SEQ ID NO: 26294 - RNA, 20 nt, Artificial Sequence
  TRAC targeting sequence
cuuuuguaaaaccauccccu

SEQ ID NO: 26295 - RNA, 20 nt, Artificial Sequence
  TRAC targeting sequence
ccuucaccagaaugguauua

SEQ ID NO: 26296 - RNA, 20 nt, Artificial Sequence
  TRAC targeting sequence
ccagaaugguauuaacuccu

SEQ ID NO: 26297 - RNA, 20 nt, Artificial Sequence
  TRAC targeting sequence
ggugaaggggaugguuuuac

SEQ ID NO: 26298 - RNA, 20 nt, Artificial Sequence
  TRAC targeting sequence
uggugcuuuguacuacuggu

SEQ ID NO: 26299 - RNA, 20 nt, Artificial Sequence
  TRAC targeting sequence
agcugcccugggcuccuuuu

SEQ ID NO: 26300 - RNA, 20 nt, Artificial Sequence
  TRAC targeting sequence
uuuucuauauuaauaaagaa

SEQ ID NO: 26301 - RNA, 20 nt, Artificial Sequence
  TRAC targeting sequence
auauuaauaaagaaacgagu

SEQ ID NO: 26302 - RNA, 20 nt, Artificial Sequence
  TRAC targeting sequence
uuauuaauauagaaaaggag

SEQ ID NO: 26303 - RNA, 20 nt, Artificial Sequence
  TRAC targeting sequence
uuucuuuauuaauauagaaa

SEQ ID NO: 26304 - RNA, 20 nt, Artificial Sequence
  TRAC targeting sequence
ccaccgguaauuuuuacucg

SEQ ID NO: 26305 - RNA, 20 nt, Artificial Sequence
  TRAC targeting sequence
uccccaccgguaauuuuuac

SEQ ID NO: 26306 - RNA, 20 nt, Artificial Sequence
  TRAC targeting sequence
gaucacugguggugcugaau

SEQ ID NO: 26307 - RNA, 20 nt, Artificial Sequence
  TRAC targeting sequence
uuauguugcuuauggucugg

SEQ ID NO: 26308 - RNA, 20 nt, Artificial Sequence
  TRAC targeting sequence
agcacauaguucguguucaa

SEQ ID NO: 26309 - RNA, 20 nt, Artificial Sequence
  TRAC targeting sequence
uguucaauaaauguuuguuu

SEQ ID NO: 26310 - RNA, 20 nt, Artificial Sequence
  TRAC targeting sequence
auaaauguuuguuuucauca

SEQ ID NO: 26311 - RNA, 20 nt, Artificial Sequence
  TRAC targeting sequence
ucaugccacgggaagugaga

SEQ ID NO: 26312 - RNA, 20 nt, Artificial Sequence
  TRAC targeting sequence
ugccacgggaagugagauau

SEQ ID NO: 26313 - RNA, 20 nt, Artificial Sequence
  TRAC targeting sequence
ggcacagcugccaucacuuc

SEQ ID NO: 26314 - RNA, 20 nt, Artificial Sequence
  TRAC targeting sequence
ugccuucaggcacagcugcc

SEQ ID NO: 26315 - RNA, 20 nt, Artificial Sequence
  TRAC targeting sequence
cugguccugccuucaggcac

SEQ ID NO: 26316 - RNA, 20 nt, Artificial Sequence
  TRAC targeting sequence
ccuuucccugguccugccuu

SEQ ID NO: 26317 - RNA, 20 nt, Artificial Sequence
  TRAC targeting sequence
uuccccuuucccugguccug

SEQ ID NO: 26318 - RNA, 20 nt, Artificial Sequence
  TRAC targeting sequence
ggagagaggggcgacugcaa

SEQ ID NO: 26319 - RNA, 20 nt, Artificial Sequence
  TRAC targeting sequence
agacaguccuuccccuuucc

SEQ ID NO: 26320 - RNA, 20 nt, Artificial Sequence
  TRAC targeting sequence
ccagacaguccuuccccuuu

SEQ ID NO: 26321 - RNA, 20 nt, Artificial Sequence
  TRAC targeting sequence
cuccagacaguccuuccccu

SEQ ID NO: 26322 - RNA, 20 nt, Artificial Sequence
  TRAC targeting sequence
ccccucucuccagacagucc

SEQ ID NO: 26323 - RNA, 20 nt, Artificial Sequence
  TRAC targeting sequence
cagccaccugccuuugcagu

SEQ ID NO: 26324 - RNA, 20 nt, Artificial Sequence
  TRAC targeting sequence
cccagccaccugccuuugca

SEQ ID NO: 26325 - RNA, 20 nt, Artificial Sequence
  TRAC targeting sequence
gcagauccucuggccacaug

SEQ ID NO: 26326 - RNA, 20 nt, Artificial Sequence
  TRAC targeting sequence
gcugagcuggucccuacuga

SEQ ID NO: 26327 - RNA, 20 nt, Artificial Sequence
  TRAC targeting sequence
ucuggccacaugaagaaugu

SEQ ID NO: 26328 - RNA, 20 nt, Artificial Sequence
  TRAC targeting sequence
ggccacaugaagaauguugu

SEQ ID NO: 26329 - RNA, 20 nt, Artificial Sequence
  TRAC targeting sequence
uguggccagaggaucugcug

SEQ ID NO: 26330 - RNA, 20 nt, Artificial Sequence
  TRAC targeting sequence
ucauguggccagaggaucug

SEQ ID NO: 26331 - RNA, 20 nt, Artificial Sequence
  TRAC targeting sequence
uucuaaaaagcaauggaagg

SEQ ID NO: 26332 - RNA, 20 nt, Artificial Sequence
  TRAC targeting sequence
aaaaagcaauggaaggaaau

SEQ ID NO: 26333 - RNA, 20 nt, Artificial Sequence
  TRAC targeting sequence
auugcuuuuuagaaugaaca

SEQ ID NO: 26334 - RNA, 20 nt, Artificial Sequence
  TRAC targeting sequence
uuccauugcuuuuuagaaug

SEQ ID NO: 26335 - RNA, 20 nt, Artificial Sequence
  TRAC targeting sequence
uuuccuuccauugcuuuuua

SEQ ID NO: 26336 - RNA, 20 nt, Artificial Sequence
  TRAC targeting sequence
ugaagaacgggccaagugag

SEQ ID NO: 26337 - RNA, 20 nt, Artificial Sequence
  TRAC targeting sequence
agagggugguagggucaugc

SEQ ID NO: 26338 - RNA, 20 nt, Artificial Sequence
  TRAC targeting sequence
ucaagagggugguaggguca

SEQ ID NO: 26339 - RNA, 20 nt, Artificial Sequence
  TRAC targeting sequence
cuuggcccguucuucaagag

SEQ ID NO: 26340 - RNA, 20 nt, Artificial Sequence
  TRAC targeting sequence
cauaacaaaacaaccugggg

SEQ ID NO: 26341 - RNA, 20 nt, Artificial Sequence
  TRAC targeting sequence
gguuaaccagaucaaacucu

SEQ ID NO: 26342 - RNA, 20 nt, Artificial Sequence
  TRAC targeting sequence
auucagguuaaccagaucaa

SEQ ID NO: 26343 - RNA, 20 nt, Artificial Sequence
  TRAC targeting sequence
gaccgugaaaucuacauuua

SEQ ID NO: 26344 - RNA, 20 nt, Artificial Sequence
  TRAC targeting sequence
gacuccauucagguuaacca

SEQ ID NO: 26345 - RNA, 20 nt, Artificial Sequence
  TRAC targeting sequence
cggucagacuccauucaggu

SEQ ID NO: 26346 - RNA, 20 nt, Artificial Sequence
  TRAC targeting sequence
acauuuaaacacauuccuag

SEQ ID NO: 26347 - RNA, 20 nt, Artificial Sequence
  TRAC targeting sequence
uaggagauucuggugcccug

SEQ ID NO: 26348 - RNA, 20 nt, Artificial Sequence
  TRAC targeting sequence
uaggaauguguuuaaaugua

SEQ ID NO: 26349 - RNA, 20 nt, Artificial Sequence
  TRAC targeting sequence
ccuaggaauguguuuaaaug

SEQ ID NO: 26350 - RNA, 20 nt, Artificial Sequence
  TRAC targeting sequence
ggugcccugugucugcagga

SEQ ID NO: 26351 - RNA, 20 nt, Artificial Sequence
  TRAC targeting sequence
aacucaacacgaggcaaaca

SEQ ID NO: 26352 - RNA, 20 nt, Artificial Sequence
  TRAC targeting sequence
acacgaggcaaacacauucu

SEQ ID NO: 26353 - RNA, 20 nt, Artificial Sequence
  TRAC targeting sequence
uguugaguuggaaaaagcag

SEQ ID NO: 26354 - RNA, 20 nt, Artificial Sequence
  TRAC targeting sequence
ucaggagcagacgcaagaag

SEQ ID NO: 26355 - RNA, 20 nt, Artificial Sequence
  TRAC targeting sequence
ggagcagacgcaagaagagu

SEQ ID NO: 26356 - RNA, 20 nt, Artificial Sequence
  TRAC targeting sequence
ugaagaauguguuugccucg

SEQ ID NO: 26357 - RNA, 20 nt, Artificial Sequence
  TRAC targeting sequence
gcuccugaagaauguguuug

SEQ ID NO: 26358 - RNA, 20 nt, Artificial Sequence
  TRAC targeting sequence
ugcgucugcuccugaagaau

SEQ ID NO: 26359 - RNA, 20 nt, Artificial Sequence
  TRAC targeting sequence
ucuugcgucugcuccugaag

SEQ ID NO: 26360 - RNA, 20 nt, Artificial Sequence
  TRAC targeting sequence
gagaaaggucacccagaguc

SEQ ID NO: 26361 - RNA, 20 nt, Artificial Sequence
  TRAC targeting sequence
gacucuucuugcgucugcuc

SEQ ID NO: 26362 - RNA, 20 nt, Artificial Sequence
  TRAC targeting sequence
cagacucuucuugcgucugc

SEQ ID NO: 26363 - RNA, 20 nt, Artificial Sequence
  TRAC targeting sequence
cccagaguccccuguuuaua

SEQ ID NO: 26364 - RNA, 20 nt, Artificial Sequence
  TRAC targeting sequence
gggugaccuuucucagacuc

SEQ ID NO: 26365 - RNA, 20 nt, Artificial Sequence
  TRAC targeting sequence
ugucagaugggguguguguc

SEQ ID NO: 26366 - RNA, 20 nt, Artificial Sequence
  TRAC targeting sequence
uaacauuccacuagguggga

SEQ ID NO: 26367 - RNA, 20 nt, Artificial Sequence
  TRAC targeting sequence
acuaggugggacuaagaaau

SEQ ID NO: 26368 - RNA, 20 nt, Artificial Sequence
  TRAC targeting sequence
caccuaguggaauguuagga

SEQ ID NO: 26369 - RNA, 20 nt, Artificial Sequence
  TRAC targeting sequence
uagucccaccuaguggaaug

SEQ ID NO: 26370 - RNA, 20 nt, Artificial Sequence
  TRAC targeting sequence
uaguaauuucuuagucccac

SEQ ID NO: 26371 - RNA, 20 nt, Artificial Sequence
  TRAC targeting sequence
acccaaucagcacaguuucu

SEQ ID NO: 26372 - RNA, 20 nt, Artificial Sequence
  TRAC targeting sequence
gcacaguuucugggugggca

SEQ ID NO: 26373 - RNA, 20 nt, Artificial Sequence
  TRAC targeting sequence
aggcuccucaaaugccuagc

SEQ ID NO: 26374 - RNA, 20 nt, Artificial Sequence
  TRAC targeting sequence
ucaaaugccuagcaguuuaa

SEQ ID NO: 26375 - RNA, 20 nt, Artificial Sequence
  TRAC targeting sequence
aaugccuagcaguuuaaaag

SEQ ID NO: 26376 - RNA, 20 nt, Artificial Sequence
  TRAC targeting sequence
uuuuaaacugcuaggcauuu

SEQ ID NO: 26377 - RNA, 20 nt, Artificial Sequence
  TRAC targeting sequence
ccuuuuaaacugcuaggcau

SEQ ID NO: 26378 - RNA, 20 nt, Artificial Sequence
  TRAC targeting sequence
cuccuuuuaaacugcuaggc

SEQ ID NO: 26379 - RNA, 20 nt, Artificial Sequence
  TRAC targeting sequence
acagacagacauuaaaagga

SEQ ID NO: 26380 - RNA, 20 nt, Artificial Sequence
  TRAC targeting sequence
guggaaucucuccuuuuaaa

SEQ ID NO: 26381 - RNA, 20 nt, Artificial Sequence
  TRAC targeting sequence
gucuguggaaucucuccuuu

SEQ ID NO: 26382 - RNA, 20 nt, Artificial Sequence
  TRAC targeting sequence
uuuuaaugucugucugugga

SEQ ID NO: 26383 - RNA, 20 nt, Artificial Sequence
  TRAC targeting sequence
caguccuuuuaaugucuguc

SEQ ID NO: 26384 - RNA, 20 nt, Artificial Sequence
  TRAC targeting sequence
acuuaagacccaggugguac

SEQ ID NO: 26385 - RNA, 20 nt, Artificial Sequence
  TRAC targeting sequence
uaaguugagucacaguccuu

SEQ ID NO: 26386 - RNA, 20 nt, Artificial Sequence
  TRAC targeting sequence
gcgacuagcagaaaaugugc

SEQ ID NO: 26387 - RNA, 20 nt, Artificial Sequence
  TRAC targeting sequence
cugaauacugcaguaccacc

SEQ ID NO: 26388 - RNA, 20 nt, Artificial Sequence
  TRAC targeting sequence
gcuagucgcugaauacugca

SEQ ID NO: 26389 - RNA, 20 nt, Artificial Sequence
  TRAC targeting sequence
uccucgguauagacaccaaa

SEQ ID NO: 26390 - RNA, 20 nt, Artificial Sequence
  TRAC targeting sequence
ucgguauagacaccaaagua

SEQ ID NO: 26391 - RNA, 20 nt, Artificial Sequence
  TRAC targeting sequence
guauagacaccaaaguaugu

SEQ ID NO: 26392 - RNA, 20 nt, Artificial Sequence
  TRAC targeting sequence
auaccgaggaggaaguuaaa

SEQ ID NO: 26393 - RNA, 20 nt, Artificial Sequence
  TRAC targeting sequence
gguuucauugccaaaacggu

SEQ ID NO: 26394 - RNA, 20 nt, Artificial Sequence
  TRAC targeting sequence
uugccaaaacgguggugaaa

SEQ ID NO: 26395 - RNA, 20 nt, Artificial Sequence
  TRAC targeting sequence
ccaccguuuuggcaaugaaa

SEQ ID NO: 26396 - RNA, 20 nt, Artificial Sequence
  TRAC targeting sequence
ugaugaguaccucuuuccau

SEQ ID NO: 26397 - RNA, 20 nt, Artificial Sequence
  TRAC targeting sequence
agauuucaccaccguuuugg

SEQ ID NO: 26398 - RNA, 20 nt, Artificial Sequence
  TRAC targeting sequence
ucaagauuucaccaccguuu

SEQ ID NO: 26399 - RNA, 20 nt, Artificial Sequence
  TRAC targeting sequence
uuccauucugauccaugacc

SEQ ID NO: 26400 - RNA, 20 nt, Artificial Sequence
  TRAC targeting sequence
auucugauccaugacccugc

SEQ ID NO: 26401 - RNA, 20 nt, Artificial Sequence
  TRAC targeting sequence
gauccaugacccugcaggua

SEQ ID NO: 26402 - RNA, 20 nt, Artificial Sequence
  TRAC targeting sequence
gaauggaaagagguacucau

SEQ ID NO: 26403 - RNA, 20 nt, Artificial Sequence
  TRAC targeting sequence
augacccugcagguacaguu

SEQ ID NO: 26404 - RNA, 20 nt, Artificial Sequence
  TRAC targeting sequence
uggaucagaauggaaagagg

SEQ ID NO: 26405 - RNA, 20 nt, Artificial Sequence
  TRAC targeting sequence
uggccagauagaaaagacuc

SEQ ID NO: 26406 - RNA, 20 nt, Artificial Sequence
  TRAC targeting sequence
ggccaugaacuguaccugca

SEQ ID NO: 26407 - RNA, 20 nt, Artificial Sequence
  TRAC targeting sequence
aucuggccaugaacuguacc

SEQ ID NO: 26408 - RNA, 20 nt, Artificial Sequence
  TRAC targeting sequence
uuucuaucuggccaugaacu

SEQ ID NO: 26409 - RNA, 20 nt, Artificial Sequence
  TRAC targeting sequence
uacucuuuuuuuuuuuuuuu

SEQ ID NO: 26410 - RNA, 20 nt, Artificial Sequence
  TRAC targeting sequence
uggucuaucuggcagaagca

SEQ ID NO: 26411 - RNA, 20 nt, Artificial Sequence
  TRAC targeting sequence
aucuggcagaagcaagaaag

SEQ ID NO: 26412 - RNA, 20 nt, Artificial Sequence
  TRAC targeting sequence
ggcagaagcaagaaagccac

SEQ ID NO: 26413 - RNA, 20 nt, Artificial Sequence
  TRAC targeting sequence
gccagauagaccaggacccu

SEQ ID NO: 26414 - RNA, 20 nt, Artificial Sequence
  TRAC targeting sequence
ugcuucugccagauagacca

SEQ ID NO: 26415 - RNA, 20 nt, Artificial Sequence
  TRAC targeting sequence
aguggcuuucuugcuucugc

SEQ ID NO: 26416 - RNA, 20 nt, Artificial Sequence
  TRAC targeting sequence
caaguggcuuucuugcuucu

SEQ ID NO: 26417 - RNA, 20 nt, Artificial Sequence
  TRAC targeting sequence
gagggucugucucaacccca

SEQ ID NO: 26418 - RNA, 20 nt, Artificial Sequence
  TRAC targeting sequence
gaaucucaaguggcuuucuu

SEQ ID NO: 26419 - RNA, 20 nt, Artificial Sequence
  TRAC targeting sequence
gucucaaccccauccuggug

SEQ ID NO: 26420 - RNA, 20 nt, Artificial Sequence
  TRAC targeting sequence
caaccccauccuggugaaau

SEQ ID NO: 26421 - RNA, 20 nt, Artificial Sequence
  TRAC targeting sequence
accccauccuggugaaauau

SEQ ID NO: 26422 - RNA, 20 nt, Artificial Sequence
  TRAC targeting sequence
uggugaaauaucucaagaua

SEQ ID NO: 26423 - RNA, 20 nt, Artificial Sequence
  TRAC targeting sequence
ccaggaugggguugagacag

SEQ ID NO: 26424 - RNA, 20 nt, Artificial Sequence
  TRAC targeting sequence
caagauaaacauucuccucu

SEQ ID NO: 26425 - RNA, 20 nt, Artificial Sequence
  TRAC targeting sequence
cagcuacucgggaggcugag

SEQ ID NO: 26426 - RNA, 20 nt, Artificial Sequence
  TRAC targeting sequence
ggaggcugaggcaggagaau

SEQ ID NO: 26427 - RNA, 20 nt, Artificial Sequence
  TRAC targeting sequence
cgaguagcugggacuacagg

SEQ ID NO: 26428 - RNA, 20 nt, Artificial Sequence
  TRAC targeting sequence
gccucccgaguagcugggac

SEQ ID NO: 26429 - RNA, 20 nt, Artificial Sequence
  TRAC targeting sequence
ugccucagccucccgaguag

SEQ ID NO: 26430 - RNA, 20 nt, Artificial Sequence
  TRAC targeting sequence
ccugccucagccucccgagu

SEQ ID NO: 26431 - RNA, 20 nt, Artificial Sequence
  TRAC targeting sequence
cuugaacccgggaggccgag

SEQ ID NO: 26432 - RNA, 20 nt, Artificial Sequence
  TRAC targeting sequence
agcgauucuccugccucagc

SEQ ID NO: 26433 - RNA, 20 nt, Artificial Sequence
  TRAC targeting sequence
cggguucaagcgauucuccu

SEQ ID NO: 26434 - RNA, 20 nt, Artificial Sequence
  TRAC targeting sequence
gccucccggguucaagcgau

SEQ ID NO: 26435 - RNA, 20 nt, Artificial Sequence
  TRAC targeting sequence
cugcagccucggccucccgg

SEQ ID NO: 26436 - RNA, 20 nt, Artificial Sequence
  TRAC targeting sequence
uuauagcagcauguuuuaua

SEQ ID NO: 26437 - RNA, 20 nt, Artificial Sequence
  TRAC targeting sequence
uuuggguauauacccaguaa

SEQ ID NO: 26438 - RNA, 20 nt, Artificial Sequence
  TRAC targeting sequence
cauuacuggguauauaccca

SEQ ID NO: 26439 - RNA, 20 nt, Artificial Sequence
  TRAC targeting sequence
aaugguauuucuaguucuag

SEQ ID NO: 26440 - RNA, 20 nt, Artificial Sequence
  TRAC targeting sequence
acccagccaucccauuacug

SEQ ID NO: 26441 - RNA, 20 nt, Artificial Sequence
  TRAC targeting sequence
aguucuagaucccugaggaa

SEQ ID NO: 26442 - RNA, 20 nt, Artificial Sequence
  TRAC targeting sequence
agaucccugaggaaucgcca

SEQ ID NO: 26443 - RNA, 20 nt, Artificial Sequence
  TRAC targeting sequence
agaacuagaaauaccauucg

SEQ ID NO: 26444 - RNA, 20 nt, Artificial Sequence
  TRAC targeting sequence
cugaggaaucgccacaccga

SEQ ID NO: 26445 - RNA, 20 nt, Artificial Sequence
  TRAC targeting sequence
gggaucuagaacuagaaaua

SEQ ID NO: 26446 - RNA, 20 nt, Artificial Sequence
  TRAC targeting sequence
ucagggaucuagaacuagaa

SEQ ID NO: 26447 - RNA, 20 nt, Artificial Sequence
  TRAC targeting sequence
ccacaccgacuuccacaaug

SEQ ID NO: 26448 - RNA, 20 nt, Artificial Sequence
  TRAC targeting sequence
guguggcgauuccucaggga

SEQ ID NO: 26449 - RNA, 20 nt, Artificial Sequence
  TRAC targeting sequence
caccaacacuguaaaagugu

SEQ ID NO: 26450 - RNA, 20 nt, Artificial Sequence
  TRAC targeting sequence
uauuucuccacauccucucc

SEQ ID NO: 26451 - RNA, 20 nt, Artificial Sequence
  TRAC targeting sequence
ccacauccucuccagcaccu

SEQ ID NO: 26452 - RNA, 20 nt, Artificial Sequence
  TRAC targeting sequence
acauccucuccagcaccugu

SEQ ID NO: 26453 - RNA, 20 nt, Artificial Sequence
  TRAC targeting sequence
ucuccagcaccuguuguuuc

SEQ ID NO: 26454 - RNA, 20 nt, Artificial Sequence
  TRAC targeting sequence
ccagcaccuguuguuuccug

SEQ ID NO: 26455 - RNA, 20 nt, Artificial Sequence
  TRAC targeting sequence
agcaccuguuguuuccugac

SEQ ID NO: 26456 - RNA, 20 nt, Artificial Sequence
  TRAC targeting sequence
ugacuuuuuaaugaucgcca

SEQ ID NO: 26457 - RNA, 20 nt, Artificial Sequence
  TRAC targeting sequence
ggaaacaacaggugcuggag

SEQ ID NO: 26458 - RNA, 20 nt, Artificial Sequence
  TRAC targeting sequence
uuaaaaagucaggaaacaac

SEQ ID NO: 26459 - RNA, 20 nt, Artificial Sequence
  TRAC targeting sequence
ccauucuaacuggugugaga

SEQ ID NO: 26460 - RNA, 20 nt, Artificial Sequence
  TRAC targeting sequence
aacuggugugagaugguauc

SEQ ID NO: 26461 - RNA, 20 nt, Artificial Sequence
  TRAC targeting sequence
caccaguuagaauggcgauc

SEQ ID NO: 26462 - RNA, 20 nt, Artificial Sequence
  TRAC targeting sequence
cacaccaguuagaauggcga

SEQ ID NO: 26463 - RNA, 20 nt, Artificial Sequence
  TRAC targeting sequence
cacugugguuuugauuugca

SEQ ID NO: 26464 - RNA, 20 nt, Artificial Sequence
  TRAC targeting sequence
cugugguuuugauuugcauu

SEQ ID NO: 26465 - RNA, 20 nt, Artificial Sequence
  TRAC targeting sequence
aaaccacagugagauaccau

SEQ ID NO: 26466 - RNA, 20 nt, Artificial Sequence
  TRAC targeting sequence
cugauggccagugaugauga

SEQ ID NO: 26467 - RNA, 20 nt, Artificial Sequence
  TRAC targeting sequence
gauggccagugaugaugagc

SEQ ID NO: 26468 - RNA, 20 nt, Artificial Sequence
  TRAC targeting sequence
gagaaaugcaaaucaaaacc

SEQ ID NO: 26469 - RNA, 20 nt, Artificial Sequence
  TRAC targeting sequence
cuggccaucagagaaaugca

SEQ ID NO: 26470 - RNA, 20 nt, Artificial Sequence
  TRAC targeting sequence
ucacuggccaucagagaaau

SEQ ID NO: 26471 - RNA, 20 nt, Artificial Sequence
  TRAC targeting sequence
ucaucacuggccaucagaga

SEQ ID NO: 26472 - RNA, 20 nt, Artificial Sequence
  TRAC targeting sequence
cgugucuuuuggcugcauaa

SEQ ID NO: 26473 - RNA, 20 nt, Artificial Sequence
  TRAC targeting sequence
uuuggcugcauaaauugucu

SEQ ID NO: 26474 - RNA, 20 nt, Artificial Sequence
  TRAC targeting sequence
cucaugauuuggcuuucugu

SEQ ID NO: 26475 - RNA, 20 nt, Artificial Sequence
  TRAC targeting sequence
ugauuuggcuuucugucugu

SEQ ID NO: 26476 - RNA, 20 nt, Artificial Sequence
  TRAC targeting sequence
ugagugaacucccauucaca

SEQ ID NO: 26477 - RNA, 20 nt, Artificial Sequence
  TRAC targeting sequence
gucuguuauugguguauagg

SEQ ID NO: 26478 - RNA, 20 nt, Artificial Sequence
  TRAC targeting sequence
guuauugguguauaggaaug

SEQ ID NO: 26479 - RNA, 20 nt, Artificial Sequence
  TRAC targeting sequence
uauacaccaauaacagacag

SEQ ID NO: 26480 - RNA, 20 nt, Artificial Sequence
  TRAC targeting sequence
caagcauuccuauacaccaa

SEQ ID NO: 26481 - RNA, 20 nt, Artificial Sequence
  TRAC targeting sequence
augugcaaaaaucacaagca

SEQ ID NO: 26482 - RNA, 20 nt, Artificial Sequence
  TRAC targeting sequence
ugagacuuugcugaaguugc

SEQ ID NO: 26483 - RNA, 20 nt, Artificial Sequence
  TRAC targeting sequence
ggauacaaaaucaaugugca

SEQ ID NO: 26484 - RNA, 20 nt, Artificial Sequence
  TRAC targeting sequence
caggauacaaaaucaaugug

SEQ ID NO: 26485 - RNA, 20 nt, Artificial Sequence
  TRAC targeting sequence
gcaaagucucaggauacaaa

SEQ ID NO: 26486 - RNA, 20 nt, Artificial Sequence
  TRAC targeting sequence
gcuuaaggagauuuugggcu

SEQ ID NO: 26487 - RNA, 20 nt, Artificial Sequence
  TRAC targeting sequence
uuaagcugauaggcaacuuc

SEQ ID NO: 26488 - RNA, 20 nt, Artificial Sequence
  TRAC targeting sequence
ccuuaagcugauaggcaacu

SEQ ID NO: 26489 - RNA, 20 nt, Artificial Sequence
  TRAC targeting sequence
gcccaaaaucuccuuaagcu

SEQ ID NO: 26490 - RNA, 20 nt, Artificial Sequence
  TRAC targeting sequence
cagcccaaaaucuccuuaag

SEQ ID NO: 26491 - RNA, 20 nt, Artificial Sequence
  TRAC targeting sequence
ucucagcccaaaaucuccuu

SEQ ID NO: 26492 - RNA, 20 nt, Artificial Sequence
  TRAC targeting sequence
agauauacaaucacguaauc

SEQ ID NO: 26493 - RNA, 20 nt, Artificial Sequence
  TRAC targeting sequence
agaaaaccccaucgucucag

SEQ ID NO: 26494 - RNA, 20 nt, Artificial Sequence
  TRAC targeting sequence
cguaaucugcaaacacggac

SEQ ID NO: 26495 - RNA, 20 nt, Artificial Sequence
  TRAC targeting sequence
gcaaacacggacaauuugac

SEQ ID NO: 26496 - RNA, 20 nt, Artificial Sequence
  TRAC targeting sequence
cuggcaggcuuugguaucag

SEQ ID NO: 26497 - RNA, 20 nt, Artificial Sequence
  TRAC targeting sequence
ggcaggcuuugguaucagga

SEQ ID NO: 26498 - RNA, 20 nt, Artificial Sequence
  TRAC targeting sequence
ggaugaugcuggccucauaa

SEQ ID NO: 26499 - RNA, 20 nt, Artificial Sequence
  TRAC targeting sequence
ugauaccaaagccugccaga

SEQ ID NO: 26500 - RNA, 20 nt, Artificial Sequence
  TRAC targeting sequence
uccugauaccaaagccugcc

SEQ ID NO: 26501 - RNA, 20 nt, Artificial Sequence
  TRAC targeting sequence
uaaaaugaguuagggaggau

SEQ ID NO: 26502 - RNA, 20 nt, Artificial Sequence
  TRAC targeting sequence
uuuuaugaggccagcaucau

SEQ ID NO: 26503 - RNA, 20 nt, Artificial Sequence
  TRAC targeting sequence
cuaacucauuuuaugaggcc

SEQ ID NO: 26504 - RNA, 20 nt, Artificial Sequence
  TRAC targeting sequence
ucccuaacucauuuuaugag

SEQ ID NO: 26505 - RNA, 20 nt, Artificial Sequence
  TRAC targeting sequence
cucuuuuucuauugauugga

SEQ ID NO: 26506 - RNA, 20 nt, Artificial Sequence
  TRAC targeting sequence
uuuucuauugauuggaauag

SEQ ID NO: 26507 - RNA, 20 nt, Artificial Sequence
  TRAC targeting sequence
auugauuggaauaguuucag

SEQ ID NO: 26508 - RNA, 20 nt, Artificial Sequence
  TRAC targeting sequence
auagaaaaagagggaauccu

SEQ ID NO: 26509 - RNA, 20 nt, Artificial Sequence
  TRAC targeting sequence
aaucaauagaaaaagaggga

SEQ ID NO: 26510 - RNA, 20 nt, Artificial Sequence
  TRAC targeting sequence
gaaggaaugguaccagcucc

SEQ ID NO: 26511 - RNA, 20 nt, Artificial Sequence
  TRAC targeting sequence
gaaacuauuccaaucaauag

SEQ ID NO: 26512 - RNA, 20 nt, Artificial Sequence
  TRAC targeting sequence
uucugaaacuauuccaauca

SEQ ID NO: 26513 - RNA, 20 nt, Artificial Sequence
  TRAC targeting sequence
uccuuguaccucugguagaa

SEQ ID NO: 26514 - RNA, 20 nt, Artificial Sequence
  TRAC targeting sequence
uuguaccucugguagaauuc

SEQ ID NO: 26515 - RNA, 20 nt, Artificial Sequence
  TRAC targeting sequence
gguagaauucagcugugaau

SEQ ID NO: 26516 - RNA, 20 nt, Artificial Sequence
  TRAC targeting sequence
accagagguacaaggaggag

SEQ ID NO: 26517 - RNA, 20 nt, Artificial Sequence
  TRAC targeting sequence
gcugugaauccaucuggucc

SEQ ID NO: 26518 - RNA, 20 nt, Artificial Sequence
  TRAC targeting sequence
cagcugaauucuaccagagg

SEQ ID NO: 26519 - RNA, 20 nt, Artificial Sequence
  TRAC targeting sequence
aucugguccuggacuuuuuu

SEQ ID NO: 26520 - RNA, 20 nt, Artificial Sequence
  TRAC targeting sequence
gguccuggacuuuuuuuggu

SEQ ID NO: 26521 - RNA, 20 nt, Artificial Sequence
  TRAC targeting sequence
uggacuuuuuuugguuggua

SEQ ID NO: 26522 - RNA, 20 nt, Artificial Sequence
  TRAC targeting sequence
aggaccagauggauucacag

SEQ ID NO: 26523 - RNA, 20 nt, Artificial Sequence
  TRAC targeting sequence
auuucagacccuguuauugg

SEQ ID NO: 26524 - RNA, 20 nt, Artificial Sequence
  TRAC targeting sequence
gacccuguuauuggucuauc

SEQ ID NO: 26525 - RNA, 20 nt, Artificial Sequence
  TRAC targeting sequence
gaaauugaggcaauaauagc

SEQ ID NO: 26526 - RNA, 20 nt, Artificial Sequence
  TRAC targeting sequence
aucagagauucaacuucuuc

SEQ ID NO: 26527 - RNA, 20 nt, Artificial Sequence
  TRAC targeting sequence
gagauucaacuucuuccugg

SEQ ID NO: 26528 - RNA, 20 nt, Artificial Sequence
  TRAC targeting sequence
gauagaccaauaacaggguc

SEQ ID NO: 26529 - RNA, 20 nt, Artificial Sequence
  TRAC targeting sequence
cugauagaccaauaacaggg

SEQ ID NO: 26530 - RNA, 20 nt, Artificial Sequence
  TRAC targeting sequence
acuucuuccuggguuagucu

SEQ ID NO: 26531 - RNA, 20 nt, Artificial Sequence
  TRAC targeting sequence
cauacaauaauaaugggaga

SEQ ID NO: 26532 - RNA, 20 nt, Artificial Sequence
  TRAC targeting sequence
aagucucuuuguaggucucu

SEQ ID NO: 26533 - RNA, 20 nt, Artificial Sequence
  TRAC targeting sequence
cuuuguaggucucuaaggac

SEQ ID NO: 26534 - RNA, 20 nt, Artificial Sequence
  TRAC targeting sequence
uuguaggucucuaaggacuu

SEQ ID NO: 26535 - RNA, 20 nt, Artificial Sequence
  TRAC targeting sequence
cuaaggacuugcuuuaugaa

SEQ ID NO: 26536 - RNA, 20 nt, Artificial Sequence
  TRAC targeting sequence
aaggacuugcuuuaugaauc

SEQ ID NO: 26537 - RNA, 20 nt, Artificial Sequence
  TRAC targeting sequence
uuagagaccuacaaagagac

SEQ ID NO: 26538 - RNA, 20 nt, Artificial Sequence
  TRAC targeting sequence
uaaagcaaguccuuagagac

SEQ ID NO: 26539 - RNA, 20 nt, Artificial Sequence
  TRAC targeting sequence
gggugcucuuguauugggug

SEQ ID NO: 26540 - RNA, 20 nt, Artificial Sequence
  TRAC targeting sequence
uguauugggugcauauauau

SEQ ID NO: 26541 - RNA, 20 nt, Artificial Sequence
  TRAC targeting sequence
uaaauauauaugcacccaau

SEQ ID NO: 26542 - RNA, 20 nt, Artificial Sequence
  TRAC targeting sequence
ucuuguugaauugaucccuu

SEQ ID NO: 26543 - RNA, 20 nt, Artificial Sequence
  TRAC targeting sequence
uguugaauugaucccuuuac

SEQ ID NO: 26544 - RNA, 20 nt, Artificial Sequence
  TRAC targeting sequence
acaagaagagcuaacuaucc

SEQ ID NO: 26545 - RNA, 20 nt, Artificial Sequence
  TRAC targeting sequence
auucaacaagaagagcuaac

SEQ ID NO: 26546 - RNA, 20 nt, Artificial Sequence
  TRAC targeting sequence
cuuuaccacuauguaauggc

SEQ ID NO: 26547 - RNA, 20 nt, Artificial Sequence
  TRAC targeting sequence
uugucucuuuugaucuuugu

SEQ ID NO: 26548 - RNA, 20 nt, Artificial Sequence
  TRAC targeting sequence
cuuuugaucuuuguugguuu

SEQ ID NO: 26549 - RNA, 20 nt, Artificial Sequence
  TRAC targeting sequence
uuugaucuuuguugguuuaa

SEQ ID NO: 26550 - RNA, 20 nt, Artificial Sequence
  TRAC targeting sequence
aaagagacaaagaaagccau

SEQ ID NO: 26551 - RNA, 20 nt, Artificial Sequence
  TRAC targeting sequence
uuguugguuuaaagucuguu

SEQ ID NO: 26552 - RNA, 20 nt, Artificial Sequence
  TRAC targeting sequence
guuuuaucagaaacuaggau

SEQ ID NO: 26553 - RNA, 20 nt, Artificial Sequence
  TRAC targeting sequence
gaaacuaggauugcaacccc

SEQ ID NO: 26554 - RNA, 20 nt, Artificial Sequence
  TRAC targeting sequence
gauaaaacagacuuuaaacc

SEQ ID NO: 26555 - RNA, 20 nt, Artificial Sequence
  TRAC targeting sequence
uaguuucugauaaaacagac

SEQ ID NO: 26556 - RNA, 20 nt, Artificial Sequence
  TRAC targeting sequence
guugcuggugaggagcucca

SEQ ID NO: 26557 - RNA, 20 nt, Artificial Sequence
  TRAC targeting sequence
ccagcaacggaacaaagcug

SEQ ID NO: 26558 - RNA, 20 nt, Artificial Sequence
  TRAC targeting sequence
ucaccagcaacggaacaaag

SEQ ID NO: 26559 - RNA, 20 nt, Artificial Sequence
  TRAC targeting sequence
auuccuuuggaggaggagag

SEQ ID NO: 26560 - RNA, 20 nt, Artificial Sequence
  TRAC targeting sequence
uuuggaggaggagaggcacu

SEQ ID NO: 26561 - RNA, 20 nt, Artificial Sequence
  TRAC targeting sequence
aaaggaauggagcuccucac

SEQ ID NO: 26562 - RNA, 20 nt, Artificial Sequence
  TRAC targeting sequence
uccaaaggaauggagcuccu

SEQ ID NO: 26563 - RNA, 20 nt, Artificial Sequence
  TRAC targeting sequence
uccuccaaaggaauggagcu

SEQ ID NO: 26564 - RNA, 20 nt, Artificial Sequence
  TRAC targeting sequence
ccuccuccaaaggaauggag

SEQ ID NO: 26565 - RNA, 20 nt, Artificial Sequence
  TRAC targeting sequence
gauuuuuaaaguuuccaguu

SEQ ID NO: 26566 - RNA, 20 nt, Artificial Sequence
  TRAC targeting sequence
gagugccucuccuccuccaa

SEQ ID NO: 26567 - RNA, 20 nt, Artificial Sequence
  TRAC targeting sequence
aguuuuucucccaucuuugu

SEQ ID NO: 26568 - RNA, 20 nt, Artificial Sequence
  TRAC targeting sequence
cccaucuuugugguuuuauc

SEQ ID NO: 26569 - RNA, 20 nt, Artificial Sequence
  TRAC targeting sequence
caucuuugugguuuuaucua

SEQ ID NO: 26570 - RNA, 20 nt, Artificial Sequence
  TRAC targeting sequence
uugugguuuuaucuaccuuu

SEQ ID NO: 26571 - RNA, 20 nt, Artificial Sequence
  TRAC targeting sequence
accuuuggucuuugaugaug

SEQ ID NO: 26572 - RNA, 20 nt, Artificial Sequence
  TRAC targeting sequence
uugaugauggugauguacag

SEQ ID NO: 26573 - RNA, 20 nt, Artificial Sequence
  TRAC targeting sequence
aagaccaaagguagauaaaa

SEQ ID NO: 26574 - RNA, 20 nt, Artificial Sequence
  TRAC targeting sequence
ucaaagaccaaagguagaua

SEQ ID NO: 26575 - RNA, 20 nt, Artificial Sequence
  TRAC targeting sequence
ccaucaucaaagaccaaagg

SEQ ID NO: 26576 - RNA, 20 nt, Artificial Sequence
  TRAC targeting sequence
guacaucaccaucaucaaag

SEQ ID NO: 26577 - RNA, 20 nt, Artificial Sequence
  TRAC targeting sequence
acaccaaaaccccaucugua

SEQ ID NO: 26578 - RNA, 20 nt, Artificial Sequence
  TRAC targeting sequence
uuucuguuuguuaguuuucc

SEQ ID NO: 26579 - RNA, 20 nt, Artificial Sequence
  TRAC targeting sequence
guuuguuaguuuuccuucua

SEQ ID NO: 26580 - RNA, 20 nt, Artificial Sequence
  TRAC targeting sequence
uucuaacagucaggacccuc

SEQ ID NO: 26581 - RNA, 20 nt, Artificial Sequence
  TRAC targeting sequence
aacagucaggacccucagcu

SEQ ID NO: 26582 - RNA, 20 nt, Artificial Sequence
  TRAC targeting sequence
ggacccucagcugcaugucu

SEQ ID NO: 26583 - RNA, 20 nt, Artificial Sequence
  TRAC targeting sequence
ugacuguuagaaggaaaacu

SEQ ID NO: 26584 - RNA, 20 nt, Artificial Sequence
  TRAC targeting sequence
gcugcaugucuguuggagua

SEQ ID NO: 26585 - RNA, 20 nt, Artificial Sequence
  TRAC targeting sequence
guuggaguaugcuggagguc

SEQ ID NO: 26586 - RNA, 20 nt, Artificial Sequence
  TRAC targeting sequence
aacagacaugcagcugaggg

SEQ ID NO: 26587 - RNA, 20 nt, Artificial Sequence
  TRAC targeting sequence
agcauacuccaacagacaug

SEQ ID NO: 26588 - RNA, 20 nt, Artificial Sequence
  TRAC targeting sequence
uauucggccaucuuggcucc

SEQ ID NO: 26589 - RNA, 20 nt, Artificial Sequence
  TRAC targeting sequence
gccaucuuggcuccacccca

SEQ ID NO: 26590 - RNA, 20 nt, Artificial Sequence
  TRAC targeting sequence
uggcuccaccccaaguguuu

SEQ ID NO: 26591 - RNA, 20 nt, Artificial Sequence
  TRAC targeting sequence
accccaaguguuuuucauag

SEQ ID NO: 26592 - RNA, 20 nt, Artificial Sequence
  TRAC targeting sequence
uaguauaaguucagcauugu

SEQ ID NO: 26593 - RNA, 20 nt, Artificial Sequence
  TRAC targeting sequence
gcauuguuaugcuagacaga

SEQ ID NO: 26594 - RNA, 20 nt, Artificial Sequence
  TRAC targeting sequence
agcauaacaaugcugaacuu

SEQ ID NO: 26595 - RNA, 20 nt, Artificial Sequence
  TRAC targeting sequence
gucuagcauaacaaugcuga

SEQ ID NO: 26596 - RNA, 20 nt, Artificial Sequence
  TRAC targeting sequence
uugucaucauccugcuaaau

SEQ ID NO: 26597 - RNA, 20 nt, Artificial Sequence
  TRAC targeting sequence
ucauccugcuaaauaucacu

SEQ ID NO: 26598 - RNA, 20 nt, Artificial Sequence
  TRAC targeting sequence
uccugcuaaauaucacucuu

SEQ ID NO: 26599 - RNA, 20 nt, Artificial Sequence
  TRAC targeting sequence
ugcuaaauaucacucuucac

SEQ ID NO: 26600 - RNA, 20 nt, Artificial Sequence
  TRAC targeting sequence
cucuucacuaggguuaagga

SEQ ID NO: 26601 - RNA, 20 nt, Artificial Sequence
  TRAC targeting sequence
ucacuaggguuaaggaggaa

SEQ ID NO: 26602 - RNA, 20 nt, Artificial Sequence
  TRAC targeting sequence
cuaggguuaaggaggaaaga

SEQ ID NO: 26603 - RNA, 20 nt, Artificial Sequence
  TRAC targeting sequence
uuaacccuagugaagaguga

SEQ ID NO: 26604 - RNA, 20 nt, Artificial Sequence
  TRAC targeting sequence
uccuuaacccuagugaagag

SEQ ID NO: 26605 - RNA, 20 nt, Artificial Sequence
  TRAC targeting sequence
uuccuccuuaacccuaguga

SEQ ID NO: 26606 - RNA, 20 nt, Artificial Sequence
  TRAC targeting sequence
ucauuccuggagagaauacu

SEQ ID NO: 26607 - RNA, 20 nt, Artificial Sequence
  TRAC targeting sequence
uuccuggagagaauacuaag

SEQ ID NO: 26608 - RNA, 20 nt, Artificial Sequence
  TRAC targeting sequence
uggagagaauacuaaggagg

SEQ ID NO: 26609 - RNA, 20 nt, Artificial Sequence
  TRAC targeting sequence
aggaaugaggaaggucuuuc

SEQ ID NO: 26610 - RNA, 20 nt, Artificial Sequence
  TRAC targeting sequence
ccaggaaugaggaaggucuu

SEQ ID NO: 26611 - RNA, 20 nt, Artificial Sequence
  TRAC targeting sequence
cuccaggaaugaggaagguc

SEQ ID NO: 26612 - RNA, 20 nt, Artificial Sequence
  TRAC targeting sequence
uuaguauucucuccaggaau

SEQ ID NO: 26613 - RNA, 20 nt, Artificial Sequence
  TRAC targeting sequence
uccuuaguauucucuccagg

SEQ ID NO: 26614 - RNA, 20 nt, Artificial Sequence
  TRAC targeting sequence
guaaggugaagucuacagau

SEQ ID NO: 26615 - RNA, 20 nt, Artificial Sequence
  TRAC targeting sequence
gccaucaguaaggugaaguc

SEQ ID NO: 26616 - RNA, 20 nt, Artificial Sequence
  TRAC targeting sequence
uucuuccuggaauauucuga

SEQ ID NO: 26617 - RNA, 20 nt, Artificial Sequence
  TRAC targeting sequence
uccuggaauauucugaggcc

SEQ ID NO: 26618 - RNA, 20 nt, Artificial Sequence
  TRAC targeting sequence
uggaauauucugaggccuaa

SEQ ID NO: 26619 - RNA, 20 nt, Artificial Sequence
  TRAC targeting sequence
aggaagaaggagcaucagcc

SEQ ID NO: 26620 - RNA, 20 nt, Artificial Sequence
  TRAC targeting sequence
gaggccuaauggagaguuug

SEQ ID NO: 26621 - RNA, 20 nt, Artificial Sequence
  TRAC targeting sequence
gaauauuccaggaagaagga

SEQ ID NO: 26622 - RNA, 20 nt, Artificial Sequence
  TRAC targeting sequence
auuaggccucagaauauucc

SEQ ID NO: 26623 - RNA, 20 nt, Artificial Sequence
  TRAC targeting sequence
ccauuaggccucagaauauu

SEQ ID NO: 26624 - RNA, 20 nt, Artificial Sequence
  TRAC targeting sequence
caaacucuccauuaggccuc

SEQ ID NO: 26625 - RNA, 20 nt, Artificial Sequence
  TRAC targeting sequence
gcaaccacauauuuuaguug

SEQ ID NO: 26626 - RNA, 20 nt, Artificial Sequence
  TRAC targeting sequence
uagucuguuucuucugcuau

SEQ ID NO: 26627 - RNA, 20 nt, Artificial Sequence
  TRAC targeting sequence
guuucuucugcuauaaagga

SEQ ID NO: 26628 - RNA, 20 nt, Artificial Sequence
  TRAC targeting sequence
ucugcuauaaaggaauaccu

SEQ ID NO: 26629 - RNA, 20 nt, Artificial Sequence
  TRAC targeting sequence
gcuauaaaggaauaccugag

SEQ ID NO: 26630 - RNA, 20 nt, Artificial Sequence
  TRAC targeting sequence
aacgccauauccuucaggau

SEQ ID NO: 26631 - RNA, 20 nt, Artificial Sequence
  TRAC targeting sequence
ccucuaacgccauauccuuc

SEQ ID NO: 26632 - RNA, 20 nt, Artificial Sequence
  TRAC targeting sequence
ucuucucaguuugaccagcu

SEQ ID NO: 26633 - RNA, 20 nt, Artificial Sequence
  TRAC targeting sequence
ucucaguuugaccagcugac

SEQ ID NO: 26634 - RNA, 20 nt, Artificial Sequence
  TRAC targeting sequence
caguuugaccagcugacacc

SEQ ID NO: 26635 - RNA, 20 nt, Artificial Sequence
  TRAC targeting sequence
guuugaccagcugacaccau

SEQ ID NO: 26636 - RNA, 20 nt, Artificial Sequence
  TRAC targeting sequence
aacugagaagaugaaaauau

SEQ ID NO: 26637 - RNA, 20 nt, Artificial Sequence
  TRAC targeting sequence
gcuggucaaacugagaagau

SEQ ID NO: 26638 - RNA, 20 nt, Artificial Sequence
  TRAC targeting sequence
gggaaaagaauuuuugagag

SEQ ID NO: 26639 - RNA, 20 nt, Artificial Sequence
  TRAC targeting sequence
cagacacaacacaugguguc

SEQ ID NO: 26640 - RNA, 20 nt, Artificial Sequence
  TRAC targeting sequence
uuucccagacacaacacaug

SEQ ID NO: 26641 - RNA, 20 nt, Artificial Sequence
  TRAC targeting sequence
auuuuagaauuuuuuccugu

SEQ ID NO: 26642 - RNA, 20 nt, Artificial Sequence
  TRAC targeting sequence
aaaauugauauguuuggaaa

SEQ ID NO: 26643 - RNA, 20 nt, Artificial Sequence
  TRAC targeting sequence
uguauuuguaauuaauauua

SEQ ID NO: 26644 - RNA, 20 nt, Artificial Sequence
  TRAC targeting sequence
uaaagucuggggagugcugg

SEQ ID NO: 26645 - RNA, 20 nt, Artificial Sequence
  TRAC targeting sequence
ggggagugcuggcuauauua

SEQ ID NO: 26646 - RNA, 20 nt, Artificial Sequence
  TRAC targeting sequence
ccagacuuuaggauuuuaau

SEQ ID NO: 26647 - RNA, 20 nt, Artificial Sequence
  TRAC targeting sequence
guaauauagccagcacuccc

SEQ ID NO: 26648 - RNA, 20 nt, Artificial Sequence
  TRAC targeting sequence
ucuguaauauagccagcacu

SEQ ID NO: 26649 - RNA, 20 nt, Artificial Sequence
  TRAC targeting sequence
ggucuucuguaauauagcca

SEQ ID NO: 26650 - RNA, 20 nt, Artificial Sequence
  TRAC targeting sequence
cacucuggucuucuguaaua

SEQ ID NO: 26651 - RNA, 20 nt, Artificial Sequence
  TRAC targeting sequence
cccacucuggucuucuguaa

SEQ ID NO: 26652 - RNA, 20 nt, Artificial Sequence
  TRAC targeting sequence
ucucccacucuggucuucug

SEQ ID NO: 26653 - RNA, 20 nt, Artificial Sequence
  TRAC targeting sequence
aguuccucucccacucuggu

SEQ ID NO: 26654 - RNA, 20 nt, Artificial Sequence
  TRAC targeting sequence
uaaaauucaaguuccucucc

SEQ ID NO: 26655 - RNA, 20 nt, Artificial Sequence
  TRAC targeting sequence
ugucauaaaauucaaguucc

SEQ ID NO: 26656 - RNA, 20 nt, Artificial Sequence
  TRAC targeting sequence
ucuugucauaaaauucaagu

SEQ ID NO: 26657 - RNA, 20 nt, Artificial Sequence
  TRAC targeting sequence
aucuucuugucauaaaauuc

SEQ ID NO: 26658 - RNA, 20 nt, Artificial Sequence
  TRAC targeting sequence
aucauguggaucccaugacu

SEQ ID NO: 26659 - RNA, 20 nt, Artificial Sequence
  TRAC targeting sequence
uguggaucccaugacuggag

SEQ ID NO: 26660 - RNA, 20 nt, Artificial Sequence
  TRAC targeting sequence
acaugauugacuuaucuauc

SEQ ID NO: 26661 - RNA, 20 nt, Artificial Sequence
  TRAC targeting sequence
caugacuggaggggaccgug

SEQ ID NO: 26662 - RNA, 20 nt, Artificial Sequence
  TRAC targeting sequence
auuagauucacuuccucuga

SEQ ID NO: 26663 - RNA, 20 nt, Artificial Sequence
  TRAC targeting sequence
cuucaauuagauucacuucc

SEQ ID NO: 26664 - RNA, 20 nt, Artificial Sequence
  TRAC targeting sequence
acaauagcauguaugccaaa

SEQ ID NO: 26665 - RNA, 20 nt, Artificial Sequence
  TRAC targeting sequence
uuuuuggcauacaugcuauu

SEQ ID NO: 26666 - RNA, 20 nt, Artificial Sequence
  TRAC targeting sequence
gugguuuccuuuuuggcaua

SEQ ID NO: 26667 - RNA, 20 nt, Artificial Sequence
  TRAC targeting sequence
guucugugguuuccuuuuug

SEQ ID NO: 26668 - RNA, 20 nt, Artificial Sequence
  TRAC targeting sequence
accuucaguucugugguuuc

SEQ ID NO: 26669 - RNA, 20 nt, Artificial Sequence
  TRAC targeting sequence
aaacauuuccaccuucaguu

SEQ ID NO: 26670 - RNA, 20 nt, Artificial Sequence
  TRAC targeting sequence
ccauccaaacauuuccaccu

SEQ ID NO: 26671 - RNA, 20 nt, Artificial Sequence
  TRAC targeting sequence
uuuuauccccauccaaacau

SEQ ID NO: 26672 - RNA, 20 nt, Artificial Sequence
  TRAC targeting sequence
uuuuucaauauucuaguaaa

SEQ ID NO: 26673 - RNA, 20 nt, Artificial Sequence
  TRAC targeting sequence
gauguaauuuuuauagauuu

SEQ ID NO: 26674 - RNA, 20 nt, Artificial Sequence
  TRAC targeting sequence
gacaaucuuuuuucaauauu

SEQ ID NO: 26675 - RNA, 20 nt, Artificial Sequence
  TRAC targeting sequence
auaaaaauuacaucugacaa

SEQ ID NO: 26676 - RNA, 20 nt, Artificial Sequence
  TRAC targeting sequence
ggaagucagauuucagaaug

SEQ ID NO: 26677 - RNA, 20 nt, Artificial Sequence
  TRAC targeting sequence
ugaaaucuauaaaaauuaca

SEQ ID NO: 26678 - RNA, 20 nt, Artificial Sequence
  TRAC targeting sequence
gauuucagaauguuccaagg

SEQ ID NO: 26679 - RNA, 20 nt, Artificial Sequence
  TRAC targeting sequence
gacuuccugaaaucuauaaa

SEQ ID NO: 26680 - RNA, 20 nt, Artificial Sequence
  TRAC targeting sequence
gaauguuccaaggaaaauua

SEQ ID NO: 26681 - RNA, 20 nt, Artificial Sequence
  TRAC targeting sequence
gaaaucugacuuccugaaau

SEQ ID NO: 26682 - RNA, 20 nt, Artificial Sequence
  TRAC targeting sequence
aaggaaaauuaucuauagug

SEQ ID NO: 26683 - RNA, 20 nt, Artificial Sequence
  TRAC targeting sequence
uuggaacauucugaaaucug

SEQ ID NO: 26684 - RNA, 20 nt, Artificial Sequence
  TRAC targeting sequence
auagugcuuaaaagggacag

SEQ ID NO: 26685 - RNA, 20 nt, Artificial Sequence
  TRAC targeting sequence
caaacaugaaguuucaauug

SEQ ID NO: 26686 - RNA, 20 nt, Artificial Sequence
  TRAC targeting sequence
aacaugaaguuucaauugua

SEQ ID NO: 26687 - RNA, 20 nt, Artificial Sequence
  TRAC targeting sequence
uguuugagaaugcccugucc

SEQ ID NO: 26688 - RNA, 20 nt, Artificial Sequence
  TRAC targeting sequence
auuguaucucaaaggguccu

SEQ ID NO: 26689 - RNA, 20 nt, Artificial Sequence
  TRAC targeting sequence
caaaggguccugcugaggaa

SEQ ID NO: 26690 - RNA, 20 nt, Artificial Sequence
  TRAC targeting sequence
aaggguccugcugaggaaga

SEQ ID NO: 26691 - RNA, 20 nt, Artificial Sequence
  TRAC targeting sequence
ugcugaggaagaaugaagcg

SEQ ID NO: 26692 - RNA, 20 nt, Artificial Sequence
  TRAC targeting sequence
gcaggacccuuugagauaca

SEQ ID NO: 26693 - RNA, 20 nt, Artificial Sequence
  TRAC targeting sequence
ucagcaggacccuuugagau

SEQ ID NO: 26694 - RNA, 20 nt, Artificial Sequence
  TRAC targeting sequence
uccucagcaggacccuuuga

SEQ ID NO: 26695 - RNA, 20 nt, Artificial Sequence
  TRAC targeting sequence
uucuuccucagcaggacccu

SEQ ID NO: 26696 - RNA, 20 nt, Artificial Sequence
  TRAC targeting sequence
gcaaucagaaagcggcugca

SEQ ID NO: 26697 - RNA, 20 nt, Artificial Sequence
  TRAC targeting sequence
gaaagcggcugcacagguug

SEQ ID NO: 26698 - RNA, 20 nt, Artificial Sequence
  TRAC targeting sequence
gauugcugaagccgcuucau

SEQ ID NO: 26699 - RNA, 20 nt, Artificial Sequence
  TRAC targeting sequence
cuguaaccugauuugagugu

SEQ ID NO: 26700 - RNA, 20 nt, Artificial Sequence
  TRAC targeting sequence
gguuacagugaaaccauuga

SEQ ID NO: 26701 - RNA, 20 nt, Artificial Sequence
  TRAC targeting sequence
aaucagguuacagugaaacc

SEQ ID NO: 26702 - RNA, 20 nt, Artificial Sequence
  TRAC targeting sequence
auucugagaacauuuuuccu

SEQ ID NO: 26703 - RNA, 20 nt, Artificial Sequence
  TRAC targeting sequence
gagaacauuuuuccuuuuuu

SEQ ID NO: 26704 - RNA, 20 nt, Artificial Sequence
  TRAC targeting sequence
gaauugaacccaacacucaa

SEQ ID NO: 26705 - RNA, 20 nt, Artificial Sequence
  TRAC targeting sequence
cagaauugaacccaacacuc

SEQ ID NO: 26706 - RNA, 20 nt, Artificial Sequence
  TRAC targeting sequence
uuuuuuuaaauguaaacaaa

SEQ ID NO: 26707 - RNA, 20 nt, Artificial Sequence
  TRAC targeting sequence
cuuguacguacauauuugca

SEQ ID NO: 26708 - RNA, 20 nt, Artificial Sequence
  TRAC targeting sequence
aauaugcaaauauguacgua

SEQ ID NO: 26709 - RNA, 20 nt, Artificial Sequence
  TRAC targeting sequence
uuccuugagguaagauugca

SEQ ID NO: 26710 - RNA, 20 nt, Artificial Sequence
  TRAC targeting sequence
uugagguaagauugcaggau

SEQ ID NO: 26711 - RNA, 20 nt, Artificial Sequence
  TRAC targeting sequence
aggaaggaaauaauugguca

SEQ ID NO: 26712 - RNA, 20 nt, Artificial Sequence
  TRAC targeting sequence
uaccucaaggaaggaaauaa

SEQ ID NO: 26713 - RNA, 20 nt, Artificial Sequence
  TRAC targeting sequence
ugcaaucuuaccucaaggaa

SEQ ID NO: 26714 - RNA, 20 nt, Artificial Sequence
  TRAC targeting sequence
auccugcaaucuuaccucaa

SEQ ID NO: 26715 - RNA, 20 nt, Artificial Sequence
  TRAC targeting sequence
aaaagcuuuauuuugccggg

SEQ ID NO: 26716 - RNA, 20 nt, Artificial Sequence
  TRAC targeting sequence
uugcuuaucaaaaagcuuua

SEQ ID NO: 26717 - RNA, 20 nt, Artificial Sequence
  TRAC targeting sequence
cauugcuuaucaaaaagcuu

SEQ ID NO: 26718 - RNA, 20 nt, Artificial Sequence
  TRAC targeting sequence
cuuguuauaaacuauucuca

SEQ ID NO: 26719 - RNA, 20 nt, Artificial Sequence
  TRAC targeting sequence
gaaaaagaaaagcaacccag

SEQ ID NO: 26720 - RNA, 20 nt, Artificial Sequence
  TRAC targeting sequence
gaucacuuguuauaaacuau

SEQ ID NO: 26721 - RNA, 20 nt, Artificial Sequence
  TRAC targeting sequence
uuuucugaucacuuguuaua

SEQ ID NO: 26722 - RNA, 20 nt, Artificial Sequence
  TRAC targeting sequence
ggguugcuuuucuuuuucug

SEQ ID NO: 26723 - RNA, 20 nt, Artificial Sequence
  TRAC targeting sequence
cuggguugcuuuucuuuuuc

SEQ ID NO: 26724 - RNA, 20 nt, Artificial Sequence
  TRAC targeting sequence
ugccauguacacaaaaauaa

SEQ ID NO: 26725 - RNA, 20 nt, Artificial Sequence
  TRAC targeting sequence
uauuucuugccauguacaca

SEQ ID NO: 26726 - RNA, 20 nt, Artificial Sequence
  TRAC targeting sequence
guaaauuacuuauucauauu

SEQ ID NO: 26727 - RNA, 20 nt, Artificial Sequence
  TRAC targeting sequence
ucuguaaauuacuuauucau

SEQ ID NO: 26728 - RNA, 20 nt, Artificial Sequence
  TRAC targeting sequence
ucuucuguaaauuacuuauu

SEQ ID NO: 26729 - RNA, 20 nt, Artificial Sequence
  TRAC targeting sequence
uuugcauaucuucuucugua

SEQ ID NO: 26730 - RNA, 20 nt, Artificial Sequence
  TRAC targeting sequence
uuggucauuugcauaucuuc

SEQ ID NO: 26731 - RNA, 20 nt, Artificial Sequence
  TRAC targeting sequence
uucauuggucauuugcauau

SEQ ID NO: 26732 - RNA, 20 nt, Artificial Sequence
  TRAC targeting sequence
cuucucggccuuuuggcucu

SEQ ID NO: 26733 - RNA, 20 nt, Artificial Sequence
  TRAC targeting sequence
cggccuuuuggcucugauaa

SEQ ID NO: 26734 - RNA, 20 nt, Artificial Sequence
  TRAC targeting sequence
gccuuuuggcucugauaaag

SEQ ID NO: 26735 - RNA, 20 nt, Artificial Sequence
  TRAC targeting sequence
accucacuagcaauagaaga

SEQ ID NO: 26736 - RNA, 20 nt, Artificial Sequence
  TRAC targeting sequence
cuagcaauagaagaaauaca

SEQ ID NO: 26737 - RNA, 20 nt, Artificial Sequence
  TRAC targeting sequence
auugcuagugagguugagua

SEQ ID NO: 26738 - RNA, 20 nt, Artificial Sequence
  TRAC targeting sequence
ucuauugcuagugagguuga

SEQ ID NO: 26739 - RNA, 20 nt, Artificial Sequence
  TRAC targeting sequence
uauuguuauguauuucuucu

SEQ ID NO: 26740 - RNA, 20 nt, Artificial Sequence
  TRAC targeting sequence
accugcauguaaaaaauagu

SEQ ID NO: 26741 - RNA, 20 nt, Artificial Sequence
  TRAC targeting sequence
uuaaaauuuuugucaaccug

SEQ ID NO: 26742 - RNA, 20 nt, Artificial Sequence
  TRAC targeting sequence
aucuuuaaaauuuuugucaa

SEQ ID NO: 26743 - RNA, 20 nt, Artificial Sequence
  TRAC targeting sequence
cuuuuugccauuacuagcua

SEQ ID NO: 26744 - RNA, 20 nt, Artificial Sequence
  TRAC targeting sequence
ucacuuuuugccauuacuag

SEQ ID NO: 26745 - RNA, 20 nt, Artificial Sequence
  TRAC targeting sequence
aacuucuucacuuuuugcca

SEQ ID NO: 26746 - RNA, 20 nt, Artificial Sequence
  TRAC targeting sequence
caccaacauuguauaaaaaa

SEQ ID NO: 26747 - RNA, 20 nt, Artificial Sequence
  TRAC targeting sequence
cccaccaacauuguauaaaa

SEQ ID NO: 26748 - RNA, 20 nt, Artificial Sequence
  TRAC targeting sequence
ucucccaccaacauuguaua

SEQ ID NO: 26749 - RNA, 20 nt, Artificial Sequence
  TRAC targeting sequence
acauuuuuggaggcaacuug

SEQ ID NO: 26750 - RNA, 20 nt, Artificial Sequence
  TRAC targeting sequence
aaaaauguggaaacaauuuc

SEQ ID NO: 26751 - RNA, 20 nt, Artificial Sequence
  TRAC targeting sequence
gccaaguugccuccaaaaau

SEQ ID NO: 26752 - RNA, 20 nt, Artificial Sequence
  TRAC targeting sequence
aaauaauuacugaaauuuaa

SEQ ID NO: 26753 - RNA, 20 nt, Artificial Sequence
  TRAC targeting sequence
guaauuauuuugauaaauuc

SEQ ID NO: 26754 - RNA, 20 nt, Artificial Sequence
  TRAC targeting sequence
uacacuauuagccauaaguc

SEQ ID NO: 26755 - RNA, 20 nt, Artificial Sequence
  TRAC targeting sequence
uaauagcaggaauuuaugcc

SEQ ID NO: 26756 - RNA, 20 nt, Artificial Sequence
  TRAC targeting sequence
ugcuauuaggacuuauggcu

SEQ ID NO: 26757 - RNA, 20 nt, Artificial Sequence
  TRAC targeting sequence
auuuuguuacuggugcuaaa

SEQ ID NO: 26758 - RNA, 20 nt, Artificial Sequence
  TRAC targeting sequence
ucuauuuuguuacuggugcu

SEQ ID NO: 26759 - RNA, 20 nt, Artificial Sequence
  TRAC targeting sequence
uugguuauaaaugugacauc

SEQ ID NO: 26760 - RNA, 20 nt, Artificial Sequence
  TRAC targeting sequence
cauuuauaaccaaugaacac

SEQ ID NO: 26761 - RNA, 20 nt, Artificial Sequence
  TRAC targeting sequence
aaaaaugaauuauggaauuu

SEQ ID NO: 26762 - RNA, 20 nt, Artificial Sequence
  TRAC targeting sequence
uuuuuagaugucacauuuau

SEQ ID NO: 26763 - RNA, 20 nt, Artificial Sequence
  TRAC targeting sequence
auaauucauuuuuagauguc

SEQ ID NO: 26764 - RNA, 20 nt, Artificial Sequence
  TRAC targeting sequence
gggugcuuagaauuuuauuu

SEQ ID NO: 26765 - RNA, 20 nt, Artificial Sequence
  TRAC targeting sequence
ucucgaccaagggcauucua

SEQ ID NO: 26766 - RNA, 20 nt, Artificial Sequence
  TRAC targeting sequence
cgaccaagggcauucuaaag

SEQ ID NO: 26767 - RNA, 20 nt, Artificial Sequence
  TRAC targeting sequence
accaagggcauucuaaagua

SEQ ID NO: 26768 - RNA, 20 nt, Artificial Sequence
  TRAC targeting sequence
agaggaggggcccauuuagu

SEQ ID NO: 26769 - RNA, 20 nt, Artificial Sequence
  TRAC targeting sequence
aaaguaaacuugaaacacua

SEQ ID NO: 26770 - RNA, 20 nt, Artificial Sequence
  TRAC targeting sequence
aguuuacuuuagaaugcccu

SEQ ID NO: 26771 - RNA, 20 nt, Artificial Sequence
  TRAC targeting sequence
ggccaugaugagaaugggug

SEQ ID NO: 26772 - RNA, 20 nt, Artificial Sequence
  TRAC targeting sequence
uggccugaacuaguguuuca

SEQ ID NO: 26773 - RNA, 20 nt, Artificial Sequence
  TRAC targeting sequence
ucauggccugaacuaguguu

SEQ ID NO: 26774 - RNA, 20 nt, Artificial Sequence
  TRAC targeting sequence
caucauggccugaacuagug

SEQ ID NO: 26775 - RNA, 20 nt, Artificial Sequence
  TRAC targeting sequence
gacaugccuccuuaaaccuu

SEQ ID NO: 26776 - RNA, 20 nt, Artificial Sequence
  TRAC targeting sequence
gaccacccauucucaucaug

SEQ ID NO: 26777 - RNA, 20 nt, Artificial Sequence
  TRAC targeting sequence
uuaaaccuuccucccuuugg

SEQ ID NO: 26778 - RNA, 20 nt, Artificial Sequence
  TRAC targeting sequence
ucccuuuggaauucaggcac

SEQ ID NO: 26779 - RNA, 20 nt, Artificial Sequence
  TRAC targeting sequence
cuuuggaauucaggcacagc

SEQ ID NO: 26780 - RNA, 20 nt, Artificial Sequence
  TRAC targeting sequence
aaagggaggaagguuuaagg

SEQ ID NO: 26781 - RNA, 20 nt, Artificial Sequence
  TRAC targeting sequence
ggcacagcugaccagcauua

SEQ ID NO: 26782 - RNA, 20 nt, Artificial Sequence
  TRAC targeting sequence
gcugugccugaauuccaaag

SEQ ID NO: 26783 - RNA, 20 nt, Artificial Sequence
  TRAC targeting sequence
uauaccuuaagacaggcagc

SEQ ID NO: 26784 - RNA, 20 nt, Artificial Sequence
  TRAC targeting sequence
uaagguauaagacuguuuua

SEQ ID NO: 26785 - RNA, 20 nt, Artificial Sequence
  TRAC targeting sequence
gugcugccugucuuaaggua

SEQ ID NO: 26786 - RNA, 20 nt, Artificial Sequence
  TRAC targeting sequence
ugguagcaauaagauaacaa

SEQ ID NO: 26787 - RNA, 20 nt, Artificial Sequence
  TRAC targeting sequence
uauugcuaccaagaaucugu

SEQ ID NO: 26788 - RNA, 20 nt, Artificial Sequence
  TRAC targeting sequence
gcauauuguuaucuuauugc

SEQ ID NO: 26789 - RNA, 20 nt, Artificial Sequence
  TRAC targeting sequence
uggucugcauauuguuaucu

SEQ ID NO: 26790 - RNA, 20 nt, Artificial Sequence
  TRAC targeting sequence
gggccugcuaucuuggucug

SEQ ID NO: 26791 - RNA, 20 nt, Artificial Sequence
  TRAC targeting sequence
uucagggccugcuaucuugg

SEQ ID NO: 26792 - RNA, 20 nt, Artificial Sequence
  TRAC targeting sequence
guuucuuucagggccugcua

SEQ ID NO: 26793 - RNA, 20 nt, Artificial Sequence
  TRAC targeting sequence
aaaauauauugcuuugacau

SEQ ID NO: 26794 - RNA, 20 nt, Artificial Sequence
  TRAC targeting sequence
aagcaauauauuuuggagca

SEQ ID NO: 26795 - RNA, 20 nt, Artificial Sequence
  TRAC targeting sequence
aaauaugucaaagcaauaua

SEQ ID NO: 26796 - RNA, 20 nt, Artificial Sequence
  TRAC targeting sequence
cuuuaagucugauguucucu

SEQ ID NO: 26797 - RNA, 20 nt, Artificial Sequence
  TRAC targeting sequence
uuaagucugauguucucucu

SEQ ID NO: 26798 - RNA, 20 nt, Artificial Sequence
  TRAC targeting sequence
ggcuacagcuuguuuuuaua

SEQ ID NO: 26799 - RNA, 20 nt, Artificial Sequence
  TRAC targeting sequence
ucaggaucuccuggggcugu

SEQ ID NO: 26800 - RNA, 20 nt, Artificial Sequence
  TRAC targeting sequence
ggaucuccuggggcuguguc

SEQ ID NO: 26801 - RNA, 20 nt, Artificial Sequence
  TRAC targeting sequence
ugaugacauaugcccaaggu

SEQ ID NO: 26802 - RNA, 20 nt, Artificial Sequence
  TRAC targeting sequence
ccuggggcugugucacaggc

SEQ ID NO: 26803 - RNA, 20 nt, Artificial Sequence
  TRAC targeting sequence
uggggcugugucacaggccg

SEQ ID NO: 26804 - RNA, 20 nt, Artificial Sequence
  TRAC targeting sequence
caggccguggucacucacau

SEQ ID NO: 26805 - RNA, 20 nt, Artificial Sequence
  TRAC targeting sequence
cucacauuuggcucagaaua

SEQ ID NO: 26806 - RNA, 20 nt, Artificial Sequence
  TRAC targeting sequence
cauuuggcucagaauaaauc

SEQ ID NO: 26807 - RNA, 20 nt, Artificial Sequence
  TRAC targeting sequence
gaauaaaucucuucaauuau

SEQ ID NO: 26808 - RNA, 20 nt, Artificial Sequence
  TRAC targeting sequence
gagccaaaugugagugacca

SEQ ID NO: 26809 - RNA, 20 nt, Artificial Sequence
  TRAC targeting sequence
cuucaauuauucuacaguuu

SEQ ID NO: 26810 - RNA, 20 nt, Artificial Sequence
  TRAC targeting sequence
ucaauuauucuacaguuuga

SEQ ID NO: 26811 - RNA, 20 nt, Artificial Sequence
  TRAC targeting sequence
auuauucuacaguuugacuc

SEQ ID NO: 26812 - RNA, 20 nt, Artificial Sequence
  TRAC targeting sequence
acaguuugacucuuucuguu

SEQ ID NO: 26813 - RNA, 20 nt, Artificial Sequence
  TRAC targeting sequence
aacuguagaauaauugaaga

SEQ ID NO: 26814 - RNA, 20 nt, Artificial Sequence
  TRAC targeting sequence
uucuguugacaguauugaca

SEQ ID NO: 26815 - RNA, 20 nt, Artificial Sequence
  TRAC targeting sequence
guugacaguauugacauggg

SEQ ID NO: 26816 - RNA, 20 nt, Artificial Sequence
  TRAC targeting sequence
acagaaagagucaaacugua

SEQ ID NO: 26817 - RNA, 20 nt, Artificial Sequence
  TRAC targeting sequence
auacugucaacagaaagagu

SEQ ID NO: 26818 - RNA, 20 nt, Artificial Sequence
  TRAC targeting sequence
caugucaauacugucaacag

SEQ ID NO: 26819 - RNA, 20 nt, Artificial Sequence
  TRAC targeting sequence
ucccaugucaauacugucaa

SEQ ID NO: 26820 - RNA, 20 nt, Artificial Sequence
  TRAC targeting sequence
aguugcagacaauucauaua

SEQ ID NO: 26821 - RNA, 20 nt, Artificial Sequence
  TRAC targeting sequence
gcaacuugauuuuuaaaauc

SEQ ID NO: 26822 - RNA, 20 nt, Artificial Sequence
  TRAC targeting sequence
uauaacgcuuucuuuuuugu

SEQ ID NO: 26823 - RNA, 20 nt, Artificial Sequence
  TRAC targeting sequence
uuuuuguaaaacaaaaguua

SEQ ID NO: 26824 - RNA, 20 nt, Artificial Sequence
  TRAC targeting sequence
cacauauaacuuuuguuuua

SEQ ID NO: 26825 - RNA, 20 nt, Artificial Sequence
  TRAC targeting sequence
uauucacacauauaacuuuu

SEQ ID NO: 26826 - RNA, 20 nt, Artificial Sequence
  TRAC targeting sequence
uucauauucacacauauaac

SEQ ID NO: 26827 - RNA, 20 nt, Artificial Sequence
  TRAC targeting sequence
cccaggcuggagugcagugg

SEQ ID NO: 26828 - RNA, 20 nt, Artificial Sequence
  TRAC targeting sequence
gucgcccaggcuggagugca

SEQ ID NO: 26829 - RNA, 20 nt, Artificial Sequence
  TRAC targeting sequence
cucggucgcccaggcuggag

SEQ ID NO: 26830 - RNA, 20 nt, Artificial Sequence
  TRAC targeting sequence
cgcucggucgcccaggcugg

SEQ ID NO: 26831 - RNA, 20 nt, Artificial Sequence
  TRAC targeting sequence
gucucaaaaaaaaaaaaaaa

SEQ ID NO: 26832 - RNA, 20 nt, Artificial Sequence
  TRAC targeting sequence
caaaaaaaaaaaaaaaaaaa

SEQ ID NO: 26833 - RNA, 20 nt, Artificial Sequence
  TRAC targeting sequence
aaaaaaaaaaaaaaaaaaaa

SEQ ID NO: 26834 - RNA, 20 nt, Artificial Sequence
  TRAC targeting sequence
cuguaaaauuuuagccagua

SEQ ID NO: 26835 - RNA, 20 nt, Artificial Sequence
  TRAC targeting sequence
acauucacuguaaaauuuua

SEQ ID NO: 26836 - RNA, 20 nt, Artificial Sequence
  TRAC targeting sequence
uaauuaaaaauauuaaaaac

SEQ ID NO: 26837 - RNA, 20 nt, Artificial Sequence
  TRAC targeting sequence
aaaauugauucuaacuuugg

SEQ ID NO: 26838 - RNA, 20 nt, Artificial Sequence
  TRAC targeting sequence
auuuuggaaaacuuuuuugu

SEQ ID NO: 26839 - RNA, 20 nt, Artificial Sequence
  TRAC targeting sequence
aacuuugguuuacaccugug

SEQ ID NO: 26840 - RNA, 20 nt, Artificial Sequence
  TRAC targeting sequence
aaaaauauaugaguucuuuc

SEQ ID NO: 26841 - RNA, 20 nt, Artificial Sequence
  TRAC targeting sequence
uauauuuuuugagguaaaug

SEQ ID NO: 26842 - RNA, 20 nt, Artificial Sequence
  TRAC targeting sequence
uucucugucucuuugaacua

SEQ ID NO: 26843 - RNA, 20 nt, Artificial Sequence
  TRAC targeting sequence
cugucucuuugaacuauaaa

SEQ ID NO: 26844 - RNA, 20 nt, Artificial Sequence
  TRAC targeting sequence
gucucuuugaacuauaaaua

SEQ ID NO: 26845 - RNA, 20 nt, Artificial Sequence
  TRAC targeting sequence
cuuugaacuauaaauaaaac

SEQ ID NO: 26846 - RNA, 20 nt, Artificial Sequence
  TRAC targeting sequence
uugaacuauaaauaaaacuu

SEQ ID NO: 26847 - RNA, 20 nt, Artificial Sequence
  TRAC targeting sequence
aagagacagagaaagaacuc

SEQ ID NO: 26848 - RNA, 20 nt, Artificial Sequence
  TRAC targeting sequence
ucugaacagcauuacaaccc

SEQ ID NO: 26849 - RNA, 20 nt, Artificial Sequence
  TRAC targeting sequence
gaacagcauuacaacccagg

SEQ ID NO: 26850 - RNA, 20 nt, Artificial Sequence
  TRAC targeting sequence
gaggauuaguuaacauuuaa

SEQ ID NO: 26851 - RNA, 20 nt, Artificial Sequence
  TRAC targeting sequence
uggguuguaaugcuguucag

SEQ ID NO: 26852 - RNA, 20 nt, Artificial Sequence
  TRAC targeting sequence
uucuuaaggaccugggaaau

SEQ ID NO: 26853 - RNA, 20 nt, Artificial Sequence
  TRAC targeting sequence
uaaggaccugggaaauaucu

SEQ ID NO: 26854 - RNA, 20 nt, Artificial Sequence
  TRAC targeting sequence
uuaagaaagacauuccuggg

SEQ ID NO: 26855 - RNA, 20 nt, Artificial Sequence
  TRAC targeting sequence
cagguccuuaagaaagacau

SEQ ID NO: 26856 - RNA, 20 nt, Artificial Sequence
  TRAC targeting sequence
cuuugaaaucaucaaggaag

SEQ ID NO: 26857 - RNA, 20 nt, Artificial Sequence
  TRAC targeting sequence
uugaaaucaucaaggaagau

SEQ ID NO: 26858 - RNA, 20 nt, Artificial Sequence
  TRAC targeting sequence
aagagauauuucccaggucc

SEQ ID NO: 26859 - RNA, 20 nt, Artificial Sequence
  TRAC targeting sequence
ucaaggaagauagcaccugu

SEQ ID NO: 26860 - RNA, 20 nt, Artificial Sequence
  TRAC targeting sequence
aggaagauagcaccuguaug

SEQ ID NO: 26861 - RNA, 20 nt, Artificial Sequence
  TRAC targeting sequence
uugaugauuucaaagagaua

SEQ ID NO: 26862 - RNA, 20 nt, Artificial Sequence
  TRAC targeting sequence
uccuugaugauuucaaagag

SEQ ID NO: 26863 - RNA, 20 nt, Artificial Sequence
  TRAC targeting sequence
uaaacuaccuccuguuauaa

SEQ ID NO: 26864 - RNA, 20 nt, Artificial Sequence
  TRAC targeting sequence
uguuauaaagauauguaaag

SEQ ID NO: 26865 - RNA, 20 nt, Artificial Sequence
  TRAC targeting sequence
uuauaacaggagguaguuua

SEQ ID NO: 26866 - RNA, 20 nt, Artificial Sequence
  TRAC targeting sequence
uugucauaaagccaauuaga

SEQ ID NO: 26867 - RNA, 20 nt, Artificial Sequence
  TRAC targeting sequence
uaaagccaauuagauagaac

SEQ ID NO: 26868 - RNA, 20 nt, Artificial Sequence
  TRAC targeting sequence
aauuggcuuuaugacaagga

SEQ ID NO: 26869 - RNA, 20 nt, Artificial Sequence
  TRAC targeting sequence
aucuaauuggcuuuaugaca

SEQ ID NO: 26870 - RNA, 20 nt, Artificial Sequence
  TRAC targeting sequence
guucuaucuaauuggcuuua

SEQ ID NO: 26871 - RNA, 20 nt, Artificial Sequence
  TRAC targeting sequence
ucuguucuaucuaauuggcu

SEQ ID NO: 26872 - RNA, 20 nt, Artificial Sequence
  TRAC targeting sequence
ccccaauuaccaagugaacu

SEQ ID NO: 26873 - RNA, 20 nt, Artificial Sequence
  TRAC targeting sequence
cuugguaauuggggugaauc

SEQ ID NO: 26874 - RNA, 20 nt, Artificial Sequence
  TRAC targeting sequence
guucacuugguaauuggggu

SEQ ID NO: 26875 - RNA, 20 nt, Artificial Sequence
  TRAC targeting sequence
ucaguucacuugguaauugg

SEQ ID NO: 26876 - RNA, 20 nt, Artificial Sequence
  TRAC targeting sequence
aguccuuuuacuugaggacu

SEQ ID NO: 26877 - RNA, 20 nt, Artificial Sequence
  TRAC targeting sequence
uuuuacuugaggacuaguug

SEQ ID NO: 26878 - RNA, 20 nt, Artificial Sequence
  TRAC targeting sequence
aguaaaaggacuugacaacc

SEQ ID NO: 26879 - RNA, 20 nt, Artificial Sequence
  TRAC targeting sequence
ucaaguaaaaggacuugaca

SEQ ID NO: 26880 - RNA, 20 nt, Artificial Sequence
  TRAC targeting sequence
agagaaaauguauggaauua

SEQ ID NO: 26881 - RNA, 20 nt, Artificial Sequence
  TRAC targeting sequence
agauaaacaacaacuagucc

SEQ ID NO: 26882 - RNA, 20 nt, Artificial Sequence
  TRAC targeting sequence
cuagauaaacaacaacuagu

SEQ ID NO: 26883 - RNA, 20 nt, Artificial Sequence
  TRAC targeting sequence
auacauuuucucuagauaaa

SEQ ID NO: 26884 - RNA, 20 nt, Artificial Sequence
  TRAC targeting sequence
uuauaaaagggugaaauuuc

SEQ ID NO: 26885 - RNA, 20 nt, Artificial Sequence
  TRAC targeting sequence
ugucauagacuagagagguc

SEQ ID NO: 26886 - RNA, 20 nt, Artificial Sequence
  TRAC targeting sequence
uagacuagagaggucuguga

SEQ ID NO: 26887 - RNA, 20 nt, Artificial Sequence
  TRAC targeting sequence
augacaugauuuuuauucuu

SEQ ID NO: 26888 - RNA, 20 nt, Artificial Sequence
  TRAC targeting sequence
agucuaugacaugauuuuua

SEQ ID NO: 26889 - RNA, 20 nt, Artificial Sequence
  TRAC targeting sequence
cuagucuaugacaugauuuu

SEQ ID NO: 26890 - RNA, 20 nt, Artificial Sequence
  TRAC targeting sequence
gugacacuuugacaugcucc

SEQ ID NO: 26891 - RNA, 20 nt, Artificial Sequence
  TRAC targeting sequence
cagaccucucuagucuauga

SEQ ID NO: 26892 - RNA, 20 nt, Artificial Sequence
  TRAC targeting sequence
aagugucacagaccucucua

SEQ ID NO: 26893 - RNA, 20 nt, Artificial Sequence
  TRAC targeting sequence
cccaauccccagacuuucug

SEQ ID NO: 26894 - RNA, 20 nt, Artificial Sequence
  TRAC targeting sequence
ccagacuuucugggacugga

SEQ ID NO: 26895 - RNA, 20 nt, Artificial Sequence
  TRAC targeting sequence
ggggauugggggagcauguc

SEQ ID NO: 26896 - RNA, 20 nt, Artificial Sequence
  TRAC targeting sequence
gggacuggaccacuggccau

SEQ ID NO: 26897 - RNA, 20 nt, Artificial Sequence
  TRAC targeting sequence
cagaaagucuggggauuggg

SEQ ID NO: 26898 - RNA, 20 nt, Artificial Sequence
  TRAC targeting sequence
agucccagaaagucugggga

SEQ ID NO: 26899 - RNA, 20 nt, Artificial Sequence
  TRAC targeting sequence
uaauaugcaugcccaaaaag

SEQ ID NO: 26900 - RNA, 20 nt, Artificial Sequence
  TRAC targeting sequence
cuuaauaugcaugcccaaaa

SEQ ID NO: 26901 - RNA, 20 nt, Artificial Sequence
  TRAC targeting sequence
gccauuuugucucuuaauau

SEQ ID NO: 26902 - RNA, 20 nt, Artificial Sequence
  TRAC targeting sequence
uacuccgccauuuugucucu

SEQ ID NO: 26903 - RNA, 20 nt, Artificial Sequence
  TRAC targeting sequence
aggggcacuccaccggaaaa

SEQ ID NO: 26904 - RNA, 20 nt, Artificial Sequence
  TRAC targeting sequence
accggaaaagggaagaaagc

SEQ ID NO: 26905 - RNA, 20 nt, Artificial Sequence
  TRAC targeting sequence
gguggagugccccuggaagg

SEQ ID NO: 26906 - RNA, 20 nt, Artificial Sequence
  TRAC targeting sequence
cuuuuccgguggagugcccc

SEQ ID NO: 26907 - RNA, 20 nt, Artificial Sequence
  TRAC targeting sequence
ucccuuuuccgguggagugc

SEQ ID NO: 26908 - RNA, 20 nt, Artificial Sequence
  TRAC targeting sequence
guugggcguggguacaacuu

SEQ ID NO: 26909 - RNA, 20 nt, Artificial Sequence
  TRAC targeting sequence
uaaacacaaugugugugcuc

SEQ ID NO: 26910 - RNA, 20 nt, Artificial Sequence
  TRAC targeting sequence
auaagaaggaaguguuugcu

SEQ ID NO: 26911 - RNA, 20 nt, Artificial Sequence
  TRAC targeting sequence
uauagaccuuuucaugcuuu

SEQ ID NO: 26912 - RNA, 20 nt, Artificial Sequence
  TRAC targeting sequence
uucuuauagaccuuuucaug

SEQ ID NO: 26913 - RNA, 20 nt, Artificial Sequence
  TRAC targeting sequence
gcccacagcaaacacuuccu

SEQ ID NO: 26914 - RNA, 20 nt, Artificial Sequence
  TRAC targeting sequence
cagcccacagcaaacacuuc

SEQ ID NO: 26915 - RNA, 20 nt, Artificial Sequence
  TRAC targeting sequence
auucucagcccacagcaaac

SEQ ID NO: 26916 - RNA, 20 nt, Artificial Sequence
  TRAC targeting sequence
ccaguggaaacuuggacgua

SEQ ID NO: 26917 - RNA, 20 nt, Artificial Sequence
  TRAC targeting sequence
acuggugaacccuuagccua

SEQ ID NO: 26918 - RNA, 20 nt, Artificial Sequence
  TRAC targeting sequence
aagcuuagaagcuuuugguc

SEQ ID NO: 26919 - RNA, 20 nt, Artificial Sequence
  TRAC targeting sequence
aagcuuggauuuaaaaccag

SEQ ID NO: 26920 - RNA, 20 nt, Artificial Sequence
  TRAC targeting sequence
gugguuugaaagacuucuga

SEQ ID NO: 26921 - RNA, 20 nt, Artificial Sequence
  TRAC targeting sequence
aaccacugaccaaaagcuuc

SEQ ID NO: 26922 - RNA, 20 nt, Artificial Sequence
  TRAC targeting sequence
uucaaaccacugaccaaaag

SEQ ID NO: 26923 - RNA, 20 nt, Artificial Sequence
  TRAC targeting sequence
gagacagucuaugaguucuc

SEQ ID NO: 26924 - RNA, 20 nt, Artificial Sequence
  TRAC targeting sequence
gaagucuuucaaaccacuga

SEQ ID NO: 26925 - RNA, 20 nt, Artificial Sequence
  TRAC targeting sequence
cagaagucuuucaaaccacu

SEQ ID NO: 26926 - RNA, 20 nt, Artificial Sequence
  TRAC targeting sequence
augaguucucaaauauuuua

SEQ ID NO: 26927 - RNA, 20 nt, Artificial Sequence
  TRAC targeting sequence
uagacugucucagaagucuu

SEQ ID NO: 26928 - RNA, 20 nt, Artificial Sequence
  TRAC targeting sequence
caaauauuuuaagugaaaca

SEQ ID NO: 26929 - RNA, 20 nt, Artificial Sequence
  TRAC targeting sequence
aauauuuuaagugaaacacu

SEQ ID NO: 26930 - RNA, 20 nt, Artificial Sequence
  TRAC targeting sequence
cuuaaaauauuugagaacuc

SEQ ID NO: 26931 - RNA, 20 nt, Artificial Sequence
  TRAC targeting sequence
gguagaaagagcauggguuc

SEQ ID NO: 26932 - RNA, 20 nt, Artificial Sequence
  TRAC targeting sequence
accagaaguguuucacuuaa

SEQ ID NO: 26933 - RNA, 20 nt, Artificial Sequence
  TRAC targeting sequence
uucuaccagaaguguuucac

SEQ ID NO: 26934 - RNA, 20 nt, Artificial Sequence
  TRAC targeting sequence
gaggccaucucagagucuua

SEQ ID NO: 26935 - RNA, 20 nt, Artificial Sequence
  TRAC targeting sequence
gaacccaugcucuuucuacc

SEQ ID NO: 26936 - RNA, 20 nt, Artificial Sequence
  TRAC targeting sequence
cagagucuuacacagggaau

SEQ ID NO: 26937 - RNA, 20 nt, Artificial Sequence
  TRAC targeting sequence
gagucuuacacagggaauca

SEQ ID NO: 26938 - RNA, 20 nt, Artificial Sequence
  TRAC targeting sequence
gagauggccucagaacccau

SEQ ID NO: 26939 - RNA, 20 nt, Artificial Sequence
  TRAC targeting sequence
uacacagggaaucacagagg

SEQ ID NO: 26940 - RNA, 20 nt, Artificial Sequence
  TRAC targeting sequence
cuguguaagacucugagaug

SEQ ID NO: 26941 - RNA, 20 nt, Artificial Sequence
  TRAC targeting sequence
cagaggucuagcuucuuccu

SEQ ID NO: 26942 - RNA, 20 nt, Artificial Sequence
  TRAC targeting sequence
gugauucccuguguaagacu

SEQ ID NO: 26943 - RNA, 20 nt, Artificial Sequence
  TRAC targeting sequence
agcuucuuccucuccacuaa

SEQ ID NO: 26944 - RNA, 20 nt, Artificial Sequence
  TRAC targeting sequence
ccaacaacgcuccguuuacc

SEQ ID NO: 26945 - RNA, 20 nt, Artificial Sequence
  TRAC targeting sequence
guuuaccugagcucaccuuu

SEQ ID NO: 26946 - RNA, 20 nt, Artificial Sequence
  TRAC targeting sequence
gguaaacggagcguuguugg

SEQ ID NO: 26947 - RNA, 20 nt, Artificial Sequence
  TRAC targeting sequence
ccuuucaucaucuguucuca

SEQ ID NO: 26948 - RNA, 20 nt, Artificial Sequence
  TRAC targeting sequence
ucaucuguucucaugggauc

SEQ ID NO: 26949 - RNA, 20 nt, Artificial Sequence
  TRAC targeting sequence
ucuguucucaugggaucuag

SEQ ID NO: 26950 - RNA, 20 nt, Artificial Sequence
  TRAC targeting sequence
guucucaugggaucuaguuu

SEQ ID NO: 26951 - RNA, 20 nt, Artificial Sequence
  TRAC targeting sequence
caugggaucuaguuuuccac

SEQ ID NO: 26952 - RNA, 20 nt, Artificial Sequence
  TRAC targeting sequence
ugggaucuaguuuuccacuu

SEQ ID NO: 26953 - RNA, 20 nt, Artificial Sequence
  TRAC targeting sequence
caugagaacagaugaugaaa

SEQ ID NO: 26954 - RNA, 20 nt, Artificial Sequence
  TRAC targeting sequence
aguuuuccacuuugggagga

SEQ ID NO: 26955 - RNA, 20 nt, Artificial Sequence
  TRAC targeting sequence
gaagcacuuggcccagaaug

SEQ ID NO: 26956 - RNA, 20 nt, Artificial Sequence
  TRAC targeting sequence
gagguuugguugugguuugg

SEQ ID NO: 26957 - RNA, 20 nt, Artificial Sequence
  TRAC targeting sequence
gggccaagugcuucagaggu

SEQ ID NO: 26958 - RNA, 20 nt, Artificial Sequence
  TRAC targeting sequence
uggccauucugggccaagug

SEQ ID NO: 26959 - RNA, 20 nt, Artificial Sequence
  TRAC targeting sequence
ugacugcucacuuuccuguu

SEQ ID NO: 26960 - RNA, 20 nt, Artificial Sequence
  TRAC targeting sequence
cgaacaagucuuggccauuc

SEQ ID NO: 26961 - RNA, 20 nt, Artificial Sequence
  TRAC targeting sequence
cuuuccuguuuucugaagcu

SEQ ID NO: 26962 - RNA, 20 nt, Artificial Sequence
  TRAC targeting sequence
uguuuucugaagcuccccuc

SEQ ID NO: 26963 - RNA, 20 nt, Artificial Sequence
  TRAC targeting sequence
gaagcuccccuccccuucca

SEQ ID NO: 26964 - RNA, 20 nt, Artificial Sequence
  TRAC targeting sequence
gaaaacaggaaagugagcag

SEQ ID NO: 26965 - RNA, 20 nt, Artificial Sequence
  TRAC targeting sequence
uucaaacucaagaccaauca

SEQ ID NO: 26966 - RNA, 20 nt, Artificial Sequence
  TRAC targeting sequence
aacucaagaccaaucacaua

SEQ ID NO: 26967 - RNA, 20 nt, Artificial Sequence
  TRAC targeting sequence
agaccaaucacauaaaguca

SEQ ID NO: 26968 - RNA, 20 nt, Artificial Sequence
  TRAC targeting sequence
ugaguuugaaagaagugugg

SEQ ID NO: 26969 - RNA, 20 nt, Artificial Sequence
  TRAC targeting sequence
cauaaagucaaauaugcuuc

SEQ ID NO: 26970 - RNA, 20 nt, Artificial Sequence
  TRAC targeting sequence
aauaugcuucccaaaccaau

SEQ ID NO: 26971 - RNA, 20 nt, Artificial Sequence
  TRAC targeting sequence
caaaccaauccccuaagaug

SEQ ID NO: 26972 - RNA, 20 nt, Artificial Sequence
  TRAC targeting sequence
ccuaagauguccugcuucua

SEQ ID NO: 26973 - RNA, 20 nt, Artificial Sequence
  TRAC targeting sequence
uaggggauugguuugggaag

SEQ ID NO: 26974 - RNA, 20 nt, Artificial Sequence
  TRAC targeting sequence
ugcuucuaguuuaucagaga

SEQ ID NO: 26975 - RNA, 20 nt, Artificial Sequence
  TRAC targeting sequence
aguuuaucagagaaccugcc

SEQ ID NO: 26976 - RNA, 20 nt, Artificial Sequence
  TRAC targeting sequence
gagaaccugccccauuaguc

SEQ ID NO: 26977 - RNA, 20 nt, Artificial Sequence
  TRAC targeting sequence
gauaaacuagaagcaggaca

SEQ ID NO: 26978 - RNA, 20 nt, Artificial Sequence
  TRAC targeting sequence
aaggcaggcaggggagugga

SEQ ID NO: 26979 - RNA, 20 nt, Artificial Sequence
  TRAC targeting sequence
cugccaaaugcaagugaugg

SEQ ID NO: 26980 - RNA, 20 nt, Artificial Sequence
  TRAC targeting sequence
gccaaaugcaagugauggug

SEQ ID NO: 26981 - RNA, 20 nt, Artificial Sequence
  TRAC targeting sequence
cuugcauuuggcagagaguc

SEQ ID NO: 26982 - RNA, 20 nt, Artificial Sequence
  TRAC targeting sequence
gccaccaucacuugcauuug

SEQ ID NO: 26983 - RNA, 20 nt, Artificial Sequence
  TRAC targeting sequence
ccugauauagcuagcucuga

SEQ ID NO: 26984 - RNA, 20 nt, Artificial Sequence
  TRAC targeting sequence
ggggagucagccaccaucac

SEQ ID NO: 26985 - RNA, 20 nt, Artificial Sequence
  TRAC targeting sequence
gaauaaguggcaucugugcu

SEQ ID NO: 26986 - RNA, 20 nt, Artificial Sequence
  TRAC targeting sequence
gagcuagcuauaucagggga

SEQ ID NO: 26987 - RNA, 20 nt, Artificial Sequence
  TRAC targeting sequence
gugcucauuuaaguagucuu

SEQ ID NO: 26988 - RNA, 20 nt, Artificial Sequence
  TRAC targeting sequence
uuuaaguagucuucauuuau

SEQ ID NO: 26989 - RNA, 20 nt, Artificial Sequence
  TRAC targeting sequence
ucauuuauguccacagaacu

SEQ ID NO: 26990 - RNA, 20 nt, Artificial Sequence
  TRAC targeting sequence
uuuauguccacagaacucug

SEQ ID NO: 26991 - RNA, 20 nt, Artificial Sequence
  TRAC targeting sequence
acagaacucugcagcaguuc

SEQ ID NO: 26992 - RNA, 20 nt, Artificial Sequence
  TRAC targeting sequence
guggacauaaaugaagacua

SEQ ID NO: 26993 - RNA, 20 nt, Artificial Sequence
  TRAC targeting sequence
gcagcaguuccuuagguaug

SEQ ID NO: 26994 - RNA, 20 nt, Artificial Sequence
  TRAC targeting sequence
uuagguaugcauguguccuu

SEQ ID NO: 26995 - RNA, 20 nt, Artificial Sequence
  TRAC targeting sequence
uucugaccaguuccacgcag

SEQ ID NO: 26996 - RNA, 20 nt, Artificial Sequence
  TRAC targeting sequence
gaccaguuccacgcagagca

SEQ ID NO: 26997 - RNA, 20 nt, Artificial Sequence
  TRAC targeting sequence
gaaggacacaugcauaccua

SEQ ID NO: 26998 - RNA, 20 nt, Artificial Sequence
  TRAC targeting sequence
acgcagagcauagggguuaa

SEQ ID NO: 26999 - RNA, 20 nt, Artificial Sequence
  TRAC targeting sequence
gcguggaacuggucagaagg

SEQ ID NO: 27000 - RNA, 20 nt, Artificial Sequence
  TRAC targeting sequence
gggccugugguucagcucag

SEQ ID NO: 27001 - RNA, 20 nt, Artificial Sequence
  TRAC targeting sequence
aaguaagcaucccagacagu

SEQ ID NO: 27002 - RNA, 20 nt, Artificial Sequence
  TRAC targeting sequence
cagacaguguuugggcacca

SEQ ID NO: 27003 - RNA, 20 nt, Artificial Sequence
  TRAC targeting sequence
gggaugcuuacuuggaccca

SEQ ID NO: 27004 - RNA, 20 nt, Artificial Sequence
  TRAC targeting sequence
uggugcccaaacacugucug

SEQ ID NO: 27005 - RNA, 20 nt, Artificial Sequence
  TRAC targeting sequence
gacuaggaaugcaguuaaaa

SEQ ID NO: 27006 - RNA, 20 nt, Artificial Sequence
  TRAC targeting sequence
gaauucuuggugcccaaaca

SEQ ID NO: 27007 - RNA, 20 nt, Artificial Sequence
  TRAC targeting sequence
uagucugaauucuuggugcc

SEQ ID NO: 27008 - RNA, 20 nt, Artificial Sequence
  TRAC targeting sequence
auuuuuuuuucgggcauuug

SEQ ID NO: 27009 - RNA, 20 nt, Artificial Sequence
  TRAC targeting sequence
uauccauuuuuuuuucgggc

SEQ ID NO: 27010 - RNA, 20 nt, Artificial Sequence
  TRAC targeting sequence
acuaucauauccauuuuuuu

SEQ ID NO: 27011 - RNA, 20 nt, Artificial Sequence
  TRAC targeting sequence
aauccacuaucauauccauu

SEQ ID NO: 27012 - RNA, 20 nt, Artificial Sequence
  TRAC targeting sequence
cuaauccacuaucauaucca

SEQ ID NO: 27013 - RNA, 20 nt, Artificial Sequence
  TRAC targeting sequence
uuauucucuaauccacuauc

SEQ ID NO: 27014 - RNA, 20 nt, Artificial Sequence
  TRAC targeting sequence
aaaaagauccugcagaggau

SEQ ID NO: 27015 - RNA, 20 nt, Artificial Sequence
  TRAC targeting sequence
uuuuagaaauaaccuucauu

SEQ ID NO: 27016 - RNA, 20 nt, Artificial Sequence
  TRAC targeting sequence
ugcagaggauggaaagaaag

SEQ ID NO: 27017 - RNA, 20 nt, Artificial Sequence
  TRAC targeting sequence
gcaggaucuuuuuagaaaua

SEQ ID NO: 27018 - RNA, 20 nt, Artificial Sequence
  TRAC targeting sequence
ucugcaggaucuuuuuagaa

SEQ ID NO: 27019 - RNA, 20 nt, Artificial Sequence
  TRAC targeting sequence
auccucugcaggaucuuuuu

SEQ ID NO: 27020 - RNA, 20 nt, Artificial Sequence
  TRAC targeting sequence
uuccauccucugcaggaucu

SEQ ID NO: 27021 - RNA, 20 nt, Artificial Sequence
  TRAC targeting sequence
uucuuuccauccucugcagg

SEQ ID NO: 27022 - RNA, 20 nt, Artificial Sequence
  TRAC targeting sequence
gugcagagaaguucaggaag

SEQ ID NO: 27023 - RNA, 20 nt, Artificial Sequence
  TRAC targeting sequence
cugaggacucccugcacugu

SEQ ID NO: 27024 - RNA, 20 nt, Artificial Sequence
  TRAC targeting sequence
gggaugugugggucaggguu

SEQ ID NO: 27025 - RNA, 20 nt, Artificial Sequence
  TRAC targeting sequence
ucagggaugugugggucagg

SEQ ID NO: 27026 - RNA, 20 nt, Artificial Sequence
  TRAC targeting sequence
cugcacugugucauuccuca

SEQ ID NO: 27027 - RNA, 20 nt, Artificial Sequence
  TRAC targeting sequence
uuccucagaguauauauaaa

SEQ ID NO: 27028 - RNA, 20 nt, Artificial Sequence
  TRAC targeting sequence
ucagaguauauauaaagggg

SEQ ID NO: 27029 - RNA, 20 nt, Artificial Sequence
  TRAC targeting sequence
gaguauauauaaagggguug

SEQ ID NO: 27030 - RNA, 20 nt, Artificial Sequence
  TRAC targeting sequence
gaggaaugacacagugcagg

SEQ ID NO: 27031 - RNA, 20 nt, Artificial Sequence
  TRAC targeting sequence
accccuuuauauauacucug

SEQ ID NO: 27032 - RNA, 20 nt, Artificial Sequence
  TRAC targeting sequence
ucaaccccuuuauauauacu

SEQ ID NO: 27033 - RNA, 20 nt, Artificial Sequence
  TRAC targeting sequence
auuccucaaccccuuuauau

SEQ ID NO: 27034 - RNA, 20 nt, Artificial Sequence
  TRAC targeting sequence
ccacacugcucagaaccaaa

SEQ ID NO: 27035 - RNA, 20 nt, Artificial Sequence
  TRAC targeting sequence
gaaccaaagggaucuuguug

SEQ ID NO: 27036 - RNA, 20 nt, Artificial Sequence
  TRAC targeting sequence
gagcaguguggugacuccau

SEQ ID NO: 27037 - RNA, 20 nt, Artificial Sequence
  TRAC targeting sequence
cuuugguucugagcagugug

SEQ ID NO: 27038 - RNA, 20 nt, Artificial Sequence
  TRAC targeting sequence
uguugaucuccagauauucu

SEQ ID NO: 27039 - RNA, 20 nt, Artificial Sequence
  TRAC targeting sequence
acaagaucccuuugguucug

SEQ ID NO: 27040 - RNA, 20 nt, Artificial Sequence
  TRAC targeting sequence
cuguguuuaucuaugugacu

SEQ ID NO: 27041 - RNA, 20 nt, Artificial Sequence
  TRAC targeting sequence
aguggcaucacuguguuuau

SEQ ID NO: 27042 - RNA, 20 nt, Artificial Sequence
  TRAC targeting sequence
uuucuaguggcaucacugug

SEQ ID NO: 27043 - RNA, 20 nt, Artificial Sequence
  TRAC targeting sequence
ucauuucuaguggcaucacu

SEQ ID NO: 27044 - RNA, 20 nt, Artificial Sequence
  TRAC targeting sequence
ggugggaagcacagguauua

SEQ ID NO: 27045 - RNA, 20 nt, Artificial Sequence
  TRAC targeting sequence
caccugaccauagucaucau

SEQ ID NO: 27046 - RNA, 20 nt, Artificial Sequence
  TRAC targeting sequence
uccuuccacuugcagaagga

SEQ ID NO: 27047 - RNA, 20 nt, Artificial Sequence
  TRAC targeting sequence
uuccacuugcagaaggaaug

SEQ ID NO: 27048 - RNA, 20 nt, Artificial Sequence
  TRAC targeting sequence
acuugcagaaggaaugcgca

SEQ ID NO: 27049 - RNA, 20 nt, Artificial Sequence
  TRAC targeting sequence
gcaaguggaaggaagaaggc

SEQ ID NO: 27050 - RNA, 20 nt, Artificial Sequence
  TRAC targeting sequence
uucugcaaguggaaggaaga

SEQ ID NO: 27051 - RNA, 20 nt, Artificial Sequence
  TRAC targeting sequence
agaugauguacguauaggaa

SEQ ID NO: 27052 - RNA, 20 nt, Artificial Sequence
  TRAC targeting sequence
ugaccauagugcgcauuccu

SEQ ID NO: 27053 - RNA, 20 nt, Artificial Sequence
  TRAC targeting sequence
ucuugaccauagugcgcauu

SEQ ID NO: 27054 - RNA, 20 nt, Artificial Sequence
  TRAC targeting sequence
uauacguacaucaucuugac

SEQ ID NO: 27055 - RNA, 20 nt, Artificial Sequence
  TRAC targeting sequence
uggccuauuccuauacguac

SEQ ID NO: 27056 - RNA, 20 nt, Artificial Sequence
  TRAC targeting sequence
ucguggccuauuccuauacg

SEQ ID NO: 27057 - RNA, 20 nt, Artificial Sequence
  TRAC targeting sequence
gcugcauaguccucguggcc

SEQ ID NO: 27058 - RNA, 20 nt, Artificial Sequence
  TRAC targeting sequence
ucugcugcauaguccucgug

SEQ ID NO: 27059 - RNA, 20 nt, Artificial Sequence
  TRAC targeting sequence
uccucugcugcauaguccuc

SEQ ID NO: 27060 - RNA, 20 nt, Artificial Sequence
  TRAC targeting sequence
aucagcucgauggcaguggu

SEQ ID NO: 27061 - RNA, 20 nt, Artificial Sequence
  TRAC targeting sequence
gcucgauggcaguggugucu

SEQ ID NO: 27062 - RNA, 20 nt, Artificial Sequence
  TRAC targeting sequence
auggcaguggugucugcaca

SEQ ID NO: 27063 - RNA, 20 nt, Artificial Sequence
  TRAC targeting sequence
agcugauggauuuuaugcuu

SEQ ID NO: 27064 - RNA, 20 nt, Artificial Sequence
  TRAC targeting sequence
gcacaggccagggccagcaa

SEQ ID NO: 27065 - RNA, 20 nt, Artificial Sequence
  TRAC targeting sequence
acugucacagaagaaguggu

SEQ ID NO: 27066 - RNA, 20 nt, Artificial Sequence
  TRAC targeting sequence
cagaagaagugguuaaugau

SEQ ID NO: 27067 - RNA, 20 nt, Artificial Sequence
  TRAC targeting sequence
gugacaguggacccuugcug

SEQ ID NO: 27068 - RNA, 20 nt, Artificial Sequence
  TRAC targeting sequence
ucugugacaguggacccuug

SEQ ID NO: 27069 - RNA, 20 nt, Artificial Sequence
  TRAC targeting sequence
uuaaccacuucuucugugac

SEQ ID NO: 27070 - RNA, 20 nt, Artificial Sequence
  TRAC targeting sequence
aauaucauuaaccacuucuu

SEQ ID NO: 27071 - RNA, 20 nt, Artificial Sequence
  TRAC targeting sequence
guggcuccaauaucauuaac

SEQ ID NO: 27072 - RNA, 20 nt, Artificial Sequence
  TRAC targeting sequence
cagcugcccuucuguggcuc

SEQ ID NO: 27073 - RNA, 20 nt, Artificial Sequence
  TRAC targeting sequence
cccagcugcccuucuguggc

SEQ ID NO: 27074 - RNA, 20 nt, Artificial Sequence
  TRAC targeting sequence
ucucccagcugcccuucugu

SEQ ID NO: 27075 - RNA, 20 nt, Artificial Sequence
  TRAC targeting sequence
ucaucucccagcugcccuuc

SEQ ID NO: 27076 - RNA, 20 nt, Artificial Sequence
  TRAC targeting sequence
aaccauccucaucucccagc

SEQ ID NO: 27077 - RNA, 20 nt, Artificial Sequence
  TRAC targeting sequence
uuccaaccauccucaucucc

SEQ ID NO: 27078 - RNA, 20 nt, Artificial Sequence
  TRAC targeting sequence
gcauugggaccguuguauuc

SEQ ID NO: 27079 - RNA, 20 nt, Artificial Sequence
  TRAC targeting sequence
gucugcauugggaccguugu

SEQ ID NO: 27080 - RNA, 20 nt, Artificial Sequence
  TRAC targeting sequence
caugauggugguguaccgca

SEQ ID NO: 27081 - RNA, 20 nt, Artificial Sequence
  TRAC targeting sequence
ugauggugguguaccgcagg

SEQ ID NO: 27082 - RNA, 20 nt, Artificial Sequence
  TRAC targeting sequence
ugagaccuucugucugcauu

SEQ ID NO: 27083 - RNA, 20 nt, Artificial Sequence
  TRAC targeting sequence
gcugcccccugcgguacacc

SEQ ID NO: 27084 - RNA, 20 nt, Artificial Sequence
  TRAC targeting sequence
uaggacaugaccgucagcag

SEQ ID NO: 27085 - RNA, 20 nt, Artificial Sequence
  TRAC targeting sequence
uaugaccguuaugccaccau

SEQ ID NO: 27086 - RNA, 20 nt, Artificial Sequence
  TRAC targeting sequence
uguccuaugaccguuaugcc

SEQ ID NO: 27087 - RNA, 20 nt, Artificial Sequence
  TRAC targeting sequence
gcaggaggaacucaacugug

SEQ ID NO: 27088 - RNA, 20 nt, Artificial Sequence
  TRAC targeting sequence
ugcugacggucauguccuau

SEQ ID NO: 27089 - RNA, 20 nt, Artificial Sequence
  TRAC targeting sequence
uccugcugacggucaugucc

SEQ ID NO: 27090 - RNA, 20 nt, Artificial Sequence
  TRAC targeting sequence
acugugcccaagaaaaagua

SEQ ID NO: 27091 - RNA, 20 nt, Artificial Sequence
  TRAC targeting sequence
ugggcacaguugaguuccuc

SEQ ID NO: 27092 - RNA, 20 nt, Artificial Sequence
  TRAC targeting sequence
acuuuuucuugggcacaguu

SEQ ID NO: 27093 - RNA, 20 nt, Artificial Sequence
  TRAC targeting sequence
cccagugcuauuucuacuuu

SEQ ID NO: 27094 - RNA, 20 nt, Artificial Sequence
  TRAC targeting sequence
ggcaaaggagaugguuuuau

SEQ ID NO: 27095 - RNA, 20 nt, Artificial Sequence
  TRAC targeting sequence
uuugccggauguaucaccca

SEQ ID NO: 27096 - RNA, 20 nt, Artificial Sequence
  TRAC targeting sequence
ccuuugccggauguaucacc

SEQ ID NO: 27097 - RNA, 20 nt, Artificial Sequence
  TRAC targeting sequence
cuagauccuaaguuggccaa

SEQ ID NO: 27098 - RNA, 20 nt, Artificial Sequence
  TRAC targeting sequence
agggauaaaaccaucuccuu

SEQ ID NO: 27099 - RNA, 20 nt, Artificial Sequence
  TRAC targeting sequence
uaaguuggccaacacuuuug

SEQ ID NO: 27100 - RNA, 20 nt, Artificial Sequence
  TRAC targeting sequence
aaaaguguuggccaacuuag

SEQ ID NO: 27101 - RNA, 20 nt, Artificial Sequence
  TRAC targeting sequence
ccaaaaguguuggccaacuu

SEQ ID NO: 27102 - RNA, 20 nt, Artificial Sequence
  TRAC targeting sequence
cuccaaaaguguuggccaac

SEQ ID NO: 27103 - RNA, 20 nt, Artificial Sequence
  TRAC targeting sequence
ucucuccaaaaguguuggcc

SEQ ID NO: 27104 - RNA, 20 nt, Artificial Sequence
  TRAC targeting sequence
gucaucucuccaaaaguguu

SEQ ID NO: 27105 - RNA, 20 nt, Artificial Sequence
  TRAC targeting sequence
ccucagucaucucuccaaaa

SEQ ID NO: 27106 - RNA, 20 nt, Artificial Sequence
  TRAC targeting sequence
ucaccucagucaucucucca

SEQ ID NO: 27107 - RNA, 20 nt, Artificial Sequence
  TRAC targeting sequence
ucuucaccucagucaucucu

SEQ ID NO: 27108 - RNA, 20 nt, Artificial Sequence
  TRAC targeting sequence
aggauagagagguugcacaa

SEQ ID NO: 27109 - RNA, 20 nt, Artificial Sequence
  TRAC targeting sequence
uggacauccucuucaccuca

SEQ ID NO: 27110 - RNA, 20 nt, Artificial Sequence
  TRAC targeting sequence
auccuggacauccucuucac

SEQ ID NO: 27111 - RNA, 20 nt, Artificial Sequence
  TRAC targeting sequence
cuauccuggacauccucuuc

SEQ ID NO: 27112 - RNA, 20 nt, Artificial Sequence
  TRAC targeting sequence
ugugcaaccucucuauccug

SEQ ID NO: 27113 - RNA, 20 nt, Artificial Sequence
  TRAC targeting sequence
ucuugugcaaccucucuauc

SEQ ID NO: 27114 - RNA, 20 nt, Artificial Sequence
  TRAC targeting sequence
acacccccauguacuucuuc

SEQ ID NO: 27115 - RNA, 20 nt, Artificial Sequence
  TRAC targeting sequence
cgccuccacacccccaugua

SEQ ID NO: 27116 - RNA, 20 nt, Artificial Sequence
  TRAC targeting sequence
ugcucccgccuccacacccc

SEQ ID NO: 27117 - RNA, 20 nt, Artificial Sequence
  TRAC targeting sequence
acugugcuguccugcucccg

SEQ ID NO: 27118 - RNA, 20 nt, Artificial Sequence
  TRAC targeting sequence
ccacugugcuguccugcucc

SEQ ID NO: 27119 - RNA, 20 nt, Artificial Sequence
  TRAC targeting sequence
ucuccacugugcuguccugc

SEQ ID NO: 27120 - RNA, 20 nt, Artificial Sequence
  TRAC targeting sequence
ucaucuccacugugcugucc

SEQ ID NO: 27121 - RNA, 20 nt, Artificial Sequence
  TRAC targeting sequence
ccagaagagucagcaggaac

SEQ ID NO: 27122 - RNA, 20 nt, Artificial Sequence
  TRAC targeting sequence
ggggaaccugcucaucaucu

SEQ ID NO: 27123 - RNA, 20 nt, Artificial Sequence
  TRAC targeting sequence
ucuggggaaccugcucauca

SEQ ID NO: 27124 - RNA, 20 nt, Artificial Sequence
  TRAC targeting sequence
gcaggaacgugggcagcagg

SEQ ID NO: 27125 - RNA, 20 nt, Artificial Sequence
  TRAC targeting sequence
ugcugacucuucuggggaac

SEQ ID NO: 27126 - RNA, 20 nt, Artificial Sequence
  TRAC targeting sequence
ugcugcccacguuccugcug

SEQ ID NO: 27127 - RNA, 20 nt, Artificial Sequence
  TRAC targeting sequence
uggugcuccugcugcccacg

SEQ ID NO: 27128 - RNA, 20 nt, Artificial Sequence
  TRAC targeting sequence
accucccugcucagggaaaa

SEQ ID NO: 27129 - RNA, 20 nt, Artificial Sequence
  TRAC targeting sequence
cugcucagggaaaaccccag

SEQ ID NO: 27130 - RNA, 20 nt, Artificial Sequence
  TRAC targeting sequence
gggaaaaccccagcagaaca

SEQ ID NO: 27131 - RNA, 20 nt, Artificial Sequence
  TRAC targeting sequence
cugagcagggagguggagcu

SEQ ID NO: 27132 - RNA, 20 nt, Artificial Sequence
  TRAC targeting sequence
gcugggguuuucccugagca

SEQ ID NO: 27133 - RNA, 20 nt, Artificial Sequence
  TRAC targeting sequence
gucaccgcugcaguccaguu

SEQ ID NO: 27134 - RNA, 20 nt, Artificial Sequence
  TRAC targeting sequence
ccgcugcaguccaguuaccc

SEQ ID NO: 27135 - RNA, 20 nt, Artificial Sequence
  TRAC targeting sequence
aguuacccaugggccuggug

SEQ ID NO: 27136 - RNA, 20 nt, Artificial Sequence
  TRAC targeting sequence
gggaaggagcuugcauuggc

SEQ ID NO: 27137 - RNA, 20 nt, Artificial Sequence
  TRAC targeting sequence
cugacuuucuucuucagcaa

SEQ ID NO: 27138 - RNA, 20 nt, Artificial Sequence
  TRAC targeting sequence
uucccugacuuucuucuuca

SEQ ID NO: 27139 - RNA, 20 nt, Artificial Sequence
  TRAC targeting sequence
gccaaugcaagcuccuuccc

SEQ ID NO: 27140 - RNA, 20 nt, Artificial Sequence
  TRAC targeting sequence
auaucugccaaugcaagcuc

SEQ ID NO: 27141 - RNA, 20 nt, Artificial Sequence
  TRAC targeting sequence
caauaucugccaaugcaagc

SEQ ID NO: 27142 - RNA, 20 nt, Artificial Sequence
  TRAC targeting sequence
aauuuuauaagucucaauau

SEQ ID NO: 27143 - RNA, 20 nt, Artificial Sequence
  TRAC targeting sequence
uuccaauuuuauaagucuca

SEQ ID NO: 27144 - RNA, 20 nt, Artificial Sequence
  TRAC targeting sequence
ugccuuaaucauuccaauuu

SEQ ID NO: 27145 - RNA, 20 nt, Artificial Sequence
  TRAC targeting sequence
gacacauaucacuguuccac

SEQ ID NO: 27146 - RNA, 20 nt, Artificial Sequence
  TRAC targeting sequence
cuucugacacauaucacugu

SEQ ID NO: 27147 - RNA, 20 nt, Artificial Sequence
  TRAC targeting sequence
uucacuucugacacauauca

SEQ ID NO: 27148 - RNA, 20 nt, Artificial Sequence
  TRAC targeting sequence
auaggggaaaaaguaaaauu

SEQ ID NO: 27149 - RNA, 20 nt, Artificial Sequence
  TRAC targeting sequence
ccuauggacaagcagcagua

SEQ ID NO: 27150 - RNA, 20 nt, Artificial Sequence
  TRAC targeting sequence
auuuuacuuuuuccccuaug

SEQ ID NO: 27151 - RNA, 20 nt, Artificial Sequence
  TRAC targeting sequence
caaucucauaucagacacua

SEQ ID NO: 27152 - RNA, 20 nt, Artificial Sequence
  TRAC targeting sequence
cauaucagacacuaacaucc

SEQ ID NO: 27153 - RNA, 20 nt, Artificial Sequence
  TRAC targeting sequence
uaucagacacuaacauccac

SEQ ID NO: 27154 - RNA, 20 nt, Artificial Sequence
  TRAC targeting sequence
gacacuaacauccacuccag

SEQ ID NO: 27155 - RNA, 20 nt, Artificial Sequence
  TRAC targeting sequence
gauaugagauugggaaucaa

SEQ ID NO: 27156 - RNA, 20 nt, Artificial Sequence
  TRAC targeting sequence
acuccagauggacaaaaaac

SEQ ID NO: 27157 - RNA, 20 nt, Artificial Sequence
  TRAC targeting sequence
agauggacaaaaaacuuuug

SEQ ID NO: 27158 - RNA, 20 nt, Artificial Sequence
  TRAC targeting sequence
ggaguggauguuagugucug

SEQ ID NO: 27159 - RNA, 20 nt, Artificial Sequence
  TRAC targeting sequence
aucuggaguggauguuagug

SEQ ID NO: 27160 - RNA, 20 nt, Artificial Sequence
  TRAC targeting sequence
uuacacaaaaguuuuuuguc

SEQ ID NO: 27161 - RNA, 20 nt, Artificial Sequence
  TRAC targeting sequence
aaacuuuuagaagaaaagau

SEQ ID NO: 27162 - RNA, 20 nt, Artificial Sequence
  TRAC targeting sequence
uuucuucuaaaaguuuugau

SEQ ID NO: 27163 - RNA, 20 nt, Artificial Sequence
  TRAC targeting sequence
aucuuuucuucuaaaaguuu

SEQ ID NO: 27164 - RNA, 20 nt, Artificial Sequence
  TRAC targeting sequence
ucuaucuuuucuucuaaaag

SEQ ID NO: 27165 - RNA, 20 nt, Artificial Sequence
  TRAC targeting sequence
gaguagaaaagaaccuacua

SEQ ID NO: 27166 - RNA, 20 nt, Artificial Sequence
  TRAC targeting sequence
gaggccaaaaacaacauucu

SEQ ID NO: 27167 - RNA, 20 nt, Artificial Sequence
  TRAC targeting sequence
acucugaggccaaaaacaac

SEQ ID NO: 27168 - RNA, 20 nt, Artificial Sequence
  TRAC targeting sequence
uuucuacucugaggccaaaa

SEQ ID NO: 27169 - RNA, 20 nt, Artificial Sequence
  TRAC targeting sequence
uauuuaguagguucuuuucu

SEQ ID NO: 27170 - RNA, 20 nt, Artificial Sequence
  TRAC targeting sequence
guuuagcacuuuuuuggguc

SEQ ID NO: 27171 - RNA, 20 nt, Artificial Sequence
  TRAC targeting sequence
uuucuguuuagcacuuuuuu

SEQ ID NO: 27172 - RNA, 20 nt, Artificial Sequence
  TRAC targeting sequence
uuuuaauguagcuuaauuua

SEQ ID NO: 27173 - RNA, 20 nt, Artificial Sequence
  TRAC targeting sequence
ucauuuuaauguagcuuaau

SEQ ID NO: 27174 - RNA, 20 nt, Artificial Sequence
  TRAC targeting sequence
auuuauuaaaagagccuuca

SEQ ID NO: 27175 - RNA, 20 nt, Artificial Sequence
  TRAC targeting sequence
gguagcauguuuggcccauc

SEQ ID NO: 27176 - RNA, 20 nt, Artificial Sequence
  TRAC targeting sequence
auuaaagaggaaaaauaaau

SEQ ID NO: 27177 - RNA, 20 nt, Artificial Sequence
  TRAC targeting sequence
uuaauggaguucagguagca

SEQ ID NO: 27178 - RNA, 20 nt, Artificial Sequence
  TRAC targeting sequence
ucuuuaauggaguucaggua

SEQ ID NO: 27179 - RNA, 20 nt, Artificial Sequence
  TRAC targeting sequence
uuuuguacauuuauuuuucc

SEQ ID NO: 27180 - RNA, 20 nt, Artificial Sequence
  TRAC targeting sequence
agcaucuuuuuguacauuua

SEQ ID NO: 27181 - RNA, 20 nt, Artificial Sequence
  TRAC targeting sequence
cauuaguaauuaaggaaaua

SEQ ID NO: 27182 - RNA, 20 nt, Artificial Sequence
  TRAC targeting sequence
uuaguaauuaaggaaauaua

SEQ ID NO: 27183 - RNA, 20 nt, Artificial Sequence
  TRAC targeting sequence
uuaauuacuaaugagaucaa

SEQ ID NO: 27184 - RNA, 20 nt, Artificial Sequence
  TRAC targeting sequence
uaauuuauauuuccuuaauu

SEQ ID NO: 27185 - RNA, 20 nt, Artificial Sequence
  TRAC targeting sequence
cccucucccucucccucucc

SEQ ID NO: 27186 - RNA, 20 nt, Artificial Sequence
  TRAC targeting sequence
cucucccucucccucucccu

SEQ ID NO: 27187 - RNA, 20 nt, Artificial Sequence
  TRAC targeting sequence
cccucucccucucccucucc

SEQ ID NO: 27188 - RNA, 20 nt, Artificial Sequence
  TRAC targeting sequence
cucucccucucccucucccu

SEQ ID NO: 27189 - RNA, 20 nt, Artificial Sequence
  TRAC targeting sequence
cccucucccucucccucucc

SEQ ID NO: 27190 - RNA, 20 nt, Artificial Sequence
  TRAC targeting sequence
cucucccucucccucucccu

SEQ ID NO: 27191 - RNA, 20 nt, Artificial Sequence
  TRAC targeting sequence
cccucucccucucccucucc

SEQ ID NO: 27192 - RNA, 20 nt, Artificial Sequence
  TRAC targeting sequence
cucucccucucccucucccu

SEQ ID NO: 27193 - RNA, 20 nt, Artificial Sequence
  TRAC targeting sequence
cccucucccucucccucucc

SEQ ID NO: 27194 - RNA, 20 nt, Artificial Sequence
  TRAC targeting sequence
cucucccucucccucucccu

SEQ ID NO: 27195 - RNA, 20 nt, Artificial Sequence
  TRAC targeting sequence
cacuagcaguguaaauuuuu

SEQ ID NO: 27196 - RNA, 20 nt, Artificial Sequence
  TRAC targeting sequence
aaagcaauuauauaaauuua

SEQ ID NO: 27197 - RNA, 20 nt, Artificial Sequence
  TRAC targeting sequence
uuaccuuguaaagaugaaca

SEQ ID NO: 27198 - RNA, 20 nt, Artificial Sequence
  TRAC targeting sequence
uuacaagguaaugacaaauu

SEQ ID NO: 27199 - RNA, 20 nt, Artificial Sequence
  TRAC targeting sequence
ucuuuacaagguaaugacaa

SEQ ID NO: 27200 - RNA, 20 nt, Artificial Sequence
  TRAC targeting sequence
cauacucugugacccaauaa

SEQ ID NO: 27201 - RNA, 20 nt, Artificial Sequence
  TRAC targeting sequence
gugacccaauaauucuacuc

SEQ ID NO: 27202 - RNA, 20 nt, Artificial Sequence
  TRAC targeting sequence
uggggcauaugugcaaguuu

SEQ ID NO: 27203 - RNA, 20 nt, Artificial Sequence
  TRAC targeting sequence
ccuggggcauaugugcaagu

SEQ ID NO: 27204 - RNA, 20 nt, Artificial Sequence
  TRAC targeting sequence
uguuugucuccuggggcaua

SEQ ID NO: 27205 - RNA, 20 nt, Artificial Sequence
  TRAC targeting sequence
cuauacauauucuuguuugu

SEQ ID NO: 27206 - RNA, 20 nt, Artificial Sequence
  TRAC targeting sequence
cccuucccuauacauauucu

SEQ ID NO: 27207 - RNA, 20 nt, Artificial Sequence
  TRAC targeting sequence
cccccuucccuauacauauu

SEQ ID NO: 27208 - RNA, 20 nt, Artificial Sequence
  TRAC targeting sequence
cccucucccccuucccuaua

SEQ ID NO: 27209 - RNA, 20 nt, Artificial Sequence
  TRAC targeting sequence
cucccccucucccccuuccc

SEQ ID NO: 27210 - RNA, 20 nt, Artificial Sequence
  TRAC targeting sequence
cucccucccccucucccccu

SEQ ID NO: 27211 - RNA, 20 nt, Artificial Sequence
  TRAC targeting sequence
uuucccucccucccccucuc

SEQ ID NO: 27212 - RNA, 20 nt, Artificial Sequence
  TRAC targeting sequence
cuuuucccucccucccccuc

SEQ ID NO: 27213 - RNA, 20 nt, Artificial Sequence
  TRAC targeting sequence
cucuuuucccucccuccccc

SEQ ID NO: 27214 - RNA, 20 nt, Artificial Sequence
  TRAC targeting sequence
cucucucuuuucccucccuc

SEQ ID NO: 27215 - RNA, 20 nt, Artificial Sequence
  TRAC targeting sequence
uuucuuuauuguauauucaa

SEQ ID NO: 27216 - RNA, 20 nt, Artificial Sequence
  TRAC targeting sequence
gcucaaccaacagugagaau

SEQ ID NO: 27217 - RNA, 20 nt, Artificial Sequence
  TRAC targeting sequence
accaacagugagaauguauu

SEQ ID NO: 27218 - RNA, 20 nt, Artificial Sequence
  TRAC targeting sequence
cuguugguugagcugaaguu

SEQ ID NO: 27219 - RNA, 20 nt, Artificial Sequence
  TRAC targeting sequence
cacuguugguugagcugaag

SEQ ID NO: 27220 - RNA, 20 nt, Artificial Sequence
  TRAC targeting sequence
aaaaaaaaaaaaaaaaaaaa

SEQ ID NO: 27221 - RNA, 20 nt, Artificial Sequence
  TRAC targeting sequence
ccaaaaaaaaaaaaaaaaaa

SEQ ID NO: 27222 - RNA, 20 nt, Artificial Sequence
  TRAC targeting sequence
uacucugucacccaggcugg

SEQ ID NO: 27223 - RNA, 20 nt, Artificial Sequence
  TRAC targeting sequence
gucacccaggcuggagugca

SEQ ID NO: 27224 - RNA, 20 nt, Artificial Sequence
  TRAC targeting sequence
cccaggcuggagugcaguag

SEQ ID NO: 27225 - RNA, 20 nt, Artificial Sequence
  TRAC targeting sequence
ugccuaugaucccaacacuu

SEQ ID NO: 27226 - RNA, 20 nt, Artificial Sequence
  TRAC targeting sequence
ucuugauauuuucaguauuu

SEQ ID NO: 27227 - RNA, 20 nt, Artificial Sequence
  TRAC targeting sequence
ugauauuuucaguauuuuuu

SEQ ID NO: 27228 - RNA, 20 nt, Artificial Sequence
  TRAC targeting sequence
agaagaggcuggguguggug

SEQ ID NO: 27229 - RNA, 20 nt, Artificial Sequence
  TRAC targeting sequence
guauuuuuuuuuacaaugaa

SEQ ID NO: 27230 - RNA, 20 nt, Artificial Sequence
  TRAC targeting sequence
uuguaaaaaaaaauacugaa

SEQ ID NO: 27231 - RNA, 20 nt, Artificial Sequence
  TRAC targeting sequence
uuuuauauaaaagaaguuaa

SEQ ID NO: 27232 - RNA, 20 nt, Artificial Sequence
  TRAC targeting sequence
uuuauauaaaaggaauauuu

SEQ ID NO: 27233 - RNA, 20 nt, Artificial Sequence
  TRAC targeting sequence
cagcacuauggaaggccgag

SEQ ID NO: 27234 - RNA, 20 nt, Artificial Sequence
  TRAC targeting sequence
auagugcugggauuacacgc

SEQ ID NO: 27235 - RNA, 20 nt, Artificial Sequence
  TRAC targeting sequence
gccuuccauagugcugggau

SEQ ID NO: 27236 - RNA, 20 nt, Artificial Sequence
  TRAC targeting sequence
caccucggccuuccauagug

SEQ ID NO: 27237 - RNA, 20 nt, Artificial Sequence
  TRAC targeting sequence
ucccaccucggccuuccaua

SEQ ID NO: 27238 - RNA, 20 nt, Artificial Sequence
  TRAC targeting sequence
uccucccaccucggccuucc

SEQ ID NO: 27239 - RNA, 20 nt, Artificial Sequence
  TRAC targeting sequence
ggaguuugagacuagccugg

SEQ ID NO: 27240 - RNA, 20 nt, Artificial Sequence
  TRAC targeting sequence
ugaccuuaagucauccuccc

SEQ ID NO: 27241 - RNA, 20 nt, Artificial Sequence
  TRAC targeting sequence
aacuccugaccuuaagucau

SEQ ID NO: 27242 - RNA, 20 nt, Artificial Sequence
  TRAC targeting sequence
caaacuccugaccuuaaguc

SEQ ID NO: 27243 - RNA, 20 nt, Artificial Sequence
  TRAC targeting sequence
ccauguugcccaggcuaguc

SEQ ID NO: 27244 - RNA, 20 nt, Artificial Sequence
  TRAC targeting sequence
gccucuaugaaaaauacaaa

SEQ ID NO: 27245 - RNA, 20 nt, Artificial Sequence
  TRAC targeting sequence
augaaaaauacaaaaauuag

SEQ ID NO: 27246 - RNA, 20 nt, Artificial Sequence
  TRAC targeting sequence
uagaggcagaguuucaccau

SEQ ID NO: 27247 - RNA, 20 nt, Artificial Sequence
  TRAC targeting sequence
cagcuacuugugaagcaaag

SEQ ID NO: 27248 - RNA, 20 nt, Artificial Sequence
  TRAC targeting sequence
caaguagcugggacaacagc

SEQ ID NO: 27249 - RNA, 20 nt, Artificial Sequence
  TRAC targeting sequence
caccuuugcuucacaaguag

SEQ ID NO: 27250 - RNA, 20 nt, Artificial Sequence
  TRAC targeting sequence
cccaccuuugcuucacaagu

SEQ ID NO: 27251 - RNA, 20 nt, Artificial Sequence
  TRAC targeting sequence
ccugagcccaggagcuucag

SEQ ID NO: 27252 - RNA, 20 nt, Artificial Sequence
  TRAC targeting sequence
ggugauucucccaccuuugc

SEQ ID NO: 27253 - RNA, 20 nt, Artificial Sequence
  TRAC targeting sequence
ugggcucaggugauucuccc

SEQ ID NO: 27254 - RNA, 20 nt, Artificial Sequence
  TRAC targeting sequence
gugagccaugaucacacagc

SEQ ID NO: 27255 - RNA, 20 nt, Artificial Sequence
  TRAC targeting sequence
cugaagcuccugggcucagg

SEQ ID NO: 27256 - RNA, 20 nt, Artificial Sequence
  TRAC targeting sequence
uggcucacugaagcuccugg

SEQ ID NO: 27257 - RNA, 20 nt, Artificial Sequence
  TRAC targeting sequence
cacagcacugcacuccagcc

SEQ ID NO: 27258 - RNA, 20 nt, Artificial Sequence
  TRAC targeting sequence
agccuaggugacagagugag

SEQ ID NO: 27259 - RNA, 20 nt, Artificial Sequence
  TRAC targeting sequence
ccuaggcuggagugcagugc

SEQ ID NO: 27260 - RNA, 20 nt, Artificial Sequence
  TRAC targeting sequence
gucaccuaggcuggagugca

SEQ ID NO: 27261 - RNA, 20 nt, Artificial Sequence
  TRAC targeting sequence
cucugucaccuaggcuggag

SEQ ID NO: 27262 - RNA, 20 nt, Artificial Sequence
  TRAC targeting sequence
cacucugucaccuaggcugg

SEQ ID NO: 27263 - RNA, 20 nt, Artificial Sequence
  TRAC targeting sequence
gaagaaagaaagagagagag

SEQ ID NO: 27264 - RNA, 20 nt, Artificial Sequence
  TRAC targeting sequence
gagucucacucugucaccua

SEQ ID NO: 27265 - RNA, 20 nt, Artificial Sequence
  TRAC targeting sequence
ucagagucucacucugucac

SEQ ID NO: 27266 - RNA, 20 nt, Artificial Sequence
  TRAC targeting sequence
uucuucagagucucacucug

SEQ ID NO: 27267 - RNA, 20 nt, Artificial Sequence
  TRAC targeting sequence
uucuuucuucagagucucac

SEQ ID NO: 27268 - RNA, 20 nt, Artificial Sequence
  TRAC targeting sequence
cuuucuuucuucagagucuc

SEQ ID NO: 27269 - RNA, 20 nt, Artificial Sequence
  TRAC targeting sequence
cucuuucuuucuucagaguc

SEQ ID NO: 27270 - RNA, 20 nt, Artificial Sequence
  TRAC targeting sequence
cucucuuucuuucuucagag

SEQ ID NO: 27271 - RNA, 20 nt, Artificial Sequence
  TRAC targeting sequence
cucucucuuucuuucuucag

SEQ ID NO: 27272 - RNA, 20 nt, Artificial Sequence
  TRAC targeting sequence
cucucucucuuucuuucuuc

SEQ ID NO: 27273 - RNA, 20 nt, Artificial Sequence
  TRAC targeting sequence
cucucucucucuuucuuucu

SEQ ID NO: 27274 - RNA, 20 nt, Artificial Sequence
  TRAC targeting sequence
uucucucucucucucuuucu

SEQ ID NO: 27275 - RNA, 20 nt, Artificial Sequence
  TRAC targeting sequence
cuuucucucucucucucuuu

SEQ ID NO: 27276 - RNA, 20 nt, Artificial Sequence
  TRAC targeting sequence
cucuuucucucucucucucu

SEQ ID NO: 27277 - RNA, 20 nt, Artificial Sequence
  TRAC targeting sequence
gucucucuuucucucucucu

SEQ ID NO: 27278 - RNA, 20 nt, Artificial Sequence
  TRAC targeting sequence
cugucucucuuucucucucu

SEQ ID NO: 27279 - RNA, 20 nt, Artificial Sequence
  TRAC targeting sequence
cucucugucucucuuucucu

SEQ ID NO: 27280 - RNA, 20 nt, Artificial Sequence
  TRAC targeting sequence
cccucucugucucucuuucu

SEQ ID NO: 27281 - RNA, 20 nt, Artificial Sequence
  TRAC targeting sequence
cucccucucugucucucuuu

SEQ ID NO: 27282 - RNA, 20 nt, Artificial Sequence
  TRAC targeting sequence
uucucucccucucugucucu

SEQ ID NO: 27283 - RNA, 20 nt, Artificial Sequence
  TRAC targeting sequence
uaucuuucucucccucucug

SEQ ID NO: 27284 - RNA, 20 nt, Artificial Sequence
  TRAC targeting sequence
uucuuaucuuucucucccuc

SEQ ID NO: 27285 - RNA, 20 nt, Artificial Sequence
  TRAC targeting sequence
uucuuucuuaucuuucucuc

SEQ ID NO: 27286 - RNA, 20 nt, Artificial Sequence
  TRAC targeting sequence
uucuuucuuucuuaucuuuc

SEQ ID NO: 27287 - RNA, 20 nt, Artificial Sequence
  TRAC targeting sequence
uucuuucuuucuuucuuauc

SEQ ID NO: 27288 - RNA, 20 nt, Artificial Sequence
  TRAC targeting sequence
uucuuucuuucuuucuuucu

SEQ ID NO: 27289 - RNA, 20 nt, Artificial Sequence
  TRAC targeting sequence
uucuuucuuucuuucuuucu

SEQ ID NO: 27290 - RNA, 20 nt, Artificial Sequence
  TRAC targeting sequence
uucuuucuuucuuucuuucu

SEQ ID NO: 27291 - RNA, 20 nt, Artificial Sequence
  TRAC targeting sequence
uucuuucuuucuuucuuucu

SEQ ID NO: 27292 - RNA, 20 nt, Artificial Sequence
  TRAC targeting sequence
uucuuucuuucuuucuuucu

SEQ ID NO: 27293 - RNA, 20 nt, Artificial Sequence
  TRAC targeting sequence
uucuuucuuucuuucuuucu

SEQ ID NO: 27294 - RNA, 20 nt, Artificial Sequence
  TRAC targeting sequence
uucuuucuuucuuucuuucu

SEQ ID NO: 27295 - RNA, 20 nt, Artificial Sequence
  TRAC targeting sequence
uucuuucuuucuuucuuucu

SEQ ID NO: 27296 - RNA, 20 nt, Artificial Sequence
  TRAC targeting sequence
cacagcuuucagucuaaaag

SEQ ID NO: 27297 - RNA, 20 nt, Artificial Sequence
  TRAC targeting sequence
gucuaaaagagaugugaaga

SEQ ID NO: 27298 - RNA, 20 nt, Artificial Sequence
  TRAC targeting sequence
aaaagagaugugaagaaacc

SEQ ID NO: 27299 - RNA, 20 nt, Artificial Sequence
  TRAC targeting sequence
uuuagacugaaagcugugcg

SEQ ID NO: 27300 - RNA, 20 nt, Artificial Sequence
  TRAC targeting sequence
cuuuuagacugaaagcugug

SEQ ID NO: 27301 - RNA, 20 nt, Artificial Sequence
  TRAC targeting sequence
caucucuuuuagacugaaag

SEQ ID NO: 27302 - RNA, 20 nt, Artificial Sequence
  TRAC targeting sequence
ucacaucucuuuuagacuga

SEQ ID NO: 27303 - RNA, 20 nt, Artificial Sequence
  TRAC targeting sequence
gguuucuucacaucucuuuu

SEQ ID NO: 27304 - RNA, 20 nt, Artificial Sequence
  TRAC targeting sequence
gaaaaaucacagaaacagag

SEQ ID NO: 27305 - RNA, 20 nt, Artificial Sequence
  TRAC targeting sequence
gaaaucagguuucuucacau

SEQ ID NO: 27306 - RNA, 20 nt, Artificial Sequence
  TRAC targeting sequence
cagaaacagaggaaaaauua

SEQ ID NO: 27307 - RNA, 20 nt, Artificial Sequence
  TRAC targeting sequence
gugauuuuucugaaaucagg

SEQ ID NO: 27308 - RNA, 20 nt, Artificial Sequence
  TRAC targeting sequence
guuucugugauuuuucugaa

SEQ ID NO: 27309 - RNA, 20 nt, Artificial Sequence
  TRAC targeting sequence
ucuguuucugugauuuuucu

SEQ ID NO: 27310 - RNA, 20 nt, Artificial Sequence
  TRAC targeting sequence
cuuaauuuuuccucuguuuc

SEQ ID NO: 27311 - RNA, 20 nt, Artificial Sequence
  TRAC targeting sequence
uggauauuuguccugggcca

SEQ ID NO: 27312 - RNA, 20 nt, Artificial Sequence
  TRAC targeting sequence
augaaaaaacuuugccgucc

SEQ ID NO: 27313 - RNA, 20 nt, Artificial Sequence
  TRAC targeting sequence
ugggccauuagucuggaaag

SEQ ID NO: 27314 - RNA, 20 nt, Artificial Sequence
  TRAC targeting sequence
ggaaagcaaaccaacuacca

SEQ ID NO: 27315 - RNA, 20 nt, Artificial Sequence
  TRAC targeting sequence
agacuaauggcccaggacaa

SEQ ID NO: 27316 - RNA, 20 nt, Artificial Sequence
  TRAC targeting sequence
ugguaguugguuugcuuucc

SEQ ID NO: 27317 - RNA, 20 nt, Artificial Sequence
  TRAC targeting sequence
guuuuccugguaguugguuu

SEQ ID NO: 27318 - RNA, 20 nt, Artificial Sequence
  TRAC targeting sequence
aucaguuuuccugguaguug

SEQ ID NO: 27319 - RNA, 20 nt, Artificial Sequence
  TRAC targeting sequence
agggacaaggucaaauaggg

SEQ ID NO: 27320 - RNA, 20 nt, Artificial Sequence
  TRAC targeting sequence
cuggaaucuaucaguuuucc

SEQ ID NO: 27321 - RNA, 20 nt, Artificial Sequence
  TRAC targeting sequence
aauagggcuucuauaccuag

SEQ ID NO: 27322 - RNA, 20 nt, Artificial Sequence
  TRAC targeting sequence
auaccuaggaaggacucugg

SEQ ID NO: 27323 - RNA, 20 nt, Artificial Sequence
  TRAC targeting sequence
caaaacuguguguccaucac

SEQ ID NO: 27324 - RNA, 20 nt, Artificial Sequence
  TRAC targeting sequence
aucaccacaaucaacuuaag

SEQ ID NO: 27325 - RNA, 20 nt, Artificial Sequence
  TRAC targeting sequence
ccacaaucaacuuaagaaua

SEQ ID NO: 27326 - RNA, 20 nt, Artificial Sequence
  TRAC targeting sequence
acuuaagaauauauauauau

SEQ ID NO: 27327 - RNA, 20 nt, Artificial Sequence
  TRAC targeting sequence
uaaguugauuguggugaugg

SEQ ID NO: 27328 - RNA, 20 nt, Artificial Sequence
  TRAC targeting sequence
aauauauauauauauauaua

SEQ ID NO: 27329 - RNA, 20 nt, Artificial Sequence
  TRAC targeting sequence
caaauauauauauauauaua

SEQ ID NO: 27330 - RNA, 20 nt, Artificial Sequence
  TRAC targeting sequence
aucucaaauauauauauaua

SEQ ID NO: 27331 - RNA, 20 nt, Artificial Sequence
  TRAC targeting sequence
cgcucugucacccaggcugg

SEQ ID NO: 27332 - RNA, 20 nt, Artificial Sequence
  TRAC targeting sequence
cucugucacccaggcuggag

SEQ ID NO: 27333 - RNA, 20 nt, Artificial Sequence
  TRAC targeting sequence
gucacccaggcuggagugca

SEQ ID NO: 27334 - RNA, 20 nt, Artificial Sequence
  TRAC targeting sequence
cccaggcuggagugcagugg

SEQ ID NO: 27335 - RNA, 20 nt, Artificial Sequence
  TRAC targeting sequence
acuuucugacuauggauuug

SEQ ID NO: 27336 - RNA, 20 nt, Artificial Sequence
  TRAC targeting sequence
gacuauggauuugccuauuc

SEQ ID NO: 27337 - RNA, 20 nt, Artificial Sequence
  TRAC targeting sequence
gaaaguagaaaaauaguuuc

SEQ ID NO: 27338 - RNA, 20 nt, Artificial Sequence
  TRAC targeting sequence
auagucagaaaguagaaaaa

SEQ ID NO: 27339 - RNA, 20 nt, Artificial Sequence
  TRAC targeting sequence
ggacauuucauauaaaugaa

SEQ ID NO: 27340 - RNA, 20 nt, Artificial Sequence
  TRAC targeting sequence
agaauaggcaaauccauagu

SEQ ID NO: 27341 - RNA, 20 nt, Artificial Sequence
  TRAC targeting sequence
uauaaaugaaucauaccaua

SEQ ID NO: 27342 - RNA, 20 nt, Artificial Sequence
  TRAC targeting sequence
uuuauaugaaauguccagaa

SEQ ID NO: 27343 - RNA, 20 nt, Artificial Sequence
  TRAC targeting sequence
uaccauaugugguccuuugu

SEQ ID NO: 27344 - RNA, 20 nt, Artificial Sequence
  TRAC targeting sequence
uuuguaucuagcuucuuuca

SEQ ID NO: 27345 - RNA, 20 nt, Artificial Sequence
  TRAC targeting sequence
agcuucuuucacuuacuaua

SEQ ID NO: 27346 - RNA, 20 nt, Artificial Sequence
  TRAC targeting sequence
uucacuuacuauaauauuuu

SEQ ID NO: 27347 - RNA, 20 nt, Artificial Sequence
  TRAC targeting sequence
cuuacuauaauauuuucuuu

SEQ ID NO: 27348 - RNA, 20 nt, Artificial Sequence
  TRAC targeting sequence
agugggugcaguugcaccuu

SEQ ID NO: 27349 - RNA, 20 nt, Artificial Sequence
  TRAC targeting sequence
uuuccucacaucagaaauau

SEQ ID NO: 27350 - RNA, 20 nt, Artificial Sequence
  TRAC targeting sequence
ucacaucagaaauauuaaga

SEQ ID NO: 27351 - RNA, 20 nt, Artificial Sequence
  TRAC targeting sequence
caucagaaauauuaagaagc

SEQ ID NO: 27352 - RNA, 20 nt, Artificial Sequence
  TRAC targeting sequence
gaaauauuaagaagcuuaau

SEQ ID NO: 27353 - RNA, 20 nt, Artificial Sequence
  TRAC targeting sequence
gaugugaggaaaugauuuuc

SEQ ID NO: 27354 - RNA, 20 nt, Artificial Sequence
  TRAC targeting sequence
uaauauuucugaugugagga

SEQ ID NO: 27355 - RNA, 20 nt, Artificial Sequence
  TRAC targeting sequence
uuaagcuucuuaauauuucu

SEQ ID NO: 27356 - RNA, 20 nt, Artificial Sequence
  TRAC targeting sequence
uugccuucauuaagcuucuu

SEQ ID NO: 27357 - RNA, 20 nt, Artificial Sequence
  TRAC targeting sequence
gguguguaucuuugccuuca

SEQ ID NO: 27358 - RNA, 20 nt, Artificial Sequence
  TRAC targeting sequence
cagguguguaucuuugccuu

SEQ ID NO: 27359 - RNA, 20 nt, Artificial Sequence
  TRAC targeting sequence
uguuauaaucucaggugugu

SEQ ID NO: 27360 - RNA, 20 nt, Artificial Sequence
  TRAC targeting sequence
gguaacacaguguuucuuuu

SEQ ID NO: 27361 - RNA, 20 nt, Artificial Sequence
  TRAC targeting sequence
aucagguaacacaguguuuc

SEQ ID NO: 27362 - RNA, 20 nt, Artificial Sequence
  TRAC targeting sequence
accugcuucuuccucugucc

SEQ ID NO: 27363 - RNA, 20 nt, Artificial Sequence
  TRAC targeting sequence
uccucuguccccucaaccca

SEQ ID NO: 27364 - RNA, 20 nt, Artificial Sequence
  TRAC targeting sequence
ucuguccccucaacccaacg

SEQ ID NO: 27365 - RNA, 20 nt, Artificial Sequence
  TRAC targeting sequence
guccccucaacccaacgugc

SEQ ID NO: 27366 - RNA, 20 nt, Artificial Sequence
  TRAC targeting sequence
ccucaacccaacgugcacua

SEQ ID NO: 27367 - RNA, 20 nt, Artificial Sequence
  TRAC targeting sequence
acccaacgugcacuaccacc

SEQ ID NO: 27368 - RNA, 20 nt, Artificial Sequence
  TRAC targeting sequence
ccaucauauuuuuuucagag

SEQ ID NO: 27369 - RNA, 20 nt, Artificial Sequence
  TRAC targeting sequence
uauuuuuuucagagacuggc

SEQ ID NO: 27370 - RNA, 20 nt, Artificial Sequence
  TRAC targeting sequence
gagacuggcaggccaagcgu

SEQ ID NO: 27371 - RNA, 20 nt, Artificial Sequence
  TRAC targeting sequence
gaaaaaaauaugauggggau

SEQ ID NO: 27372 - RNA, 20 nt, Artificial Sequence
  TRAC targeting sequence
cugaaaaaaauaugaugggg

SEQ ID NO: 27373 - RNA, 20 nt, Artificial Sequence
  TRAC targeting sequence
caaggacuaaacuuccucua

SEQ ID NO: 27374 - RNA, 20 nt, Artificial Sequence
  TRAC targeting sequence
uugggacgcuuggccugcca

SEQ ID NO: 27375 - RNA, 20 nt, Artificial Sequence
  TRAC targeting sequence
ucuaggguuacugcaggaua

SEQ ID NO: 27376 - RNA, 20 nt, Artificial Sequence
  TRAC targeting sequence
aggguuacugcaggauaguc

SEQ ID NO: 27377 - RNA, 20 nt, Artificial Sequence
  TRAC targeting sequence
uccucuuccucaugagguug

SEQ ID NO: 27378 - RNA, 20 nt, Artificial Sequence
  TRAC targeting sequence
ucuuccucaugagguugaga

SEQ ID NO: 27379 - RNA, 20 nt, Artificial Sequence
  TRAC targeting sequence
uccucaugagguugagaagc

SEQ ID NO: 27380 - RNA, 20 nt, Artificial Sequence
  TRAC targeting sequence
ucaugagguugagaagcaca

SEQ ID NO: 27381 - RNA, 20 nt, Artificial Sequence
  TRAC targeting sequence
ugagguugagaagcacaaaa

SEQ ID NO: 27382 - RNA, 20 nt, Artificial Sequence
  TRAC targeting sequence
ugaggaagaggaggaaaaga

SEQ ID NO: 27383 - RNA, 20 nt, Artificial Sequence
  TRAC targeting sequence
accucaugaggaagaggagg

SEQ ID NO: 27384 - RNA, 20 nt, Artificial Sequence
  TRAC targeting sequence
caaccucaugaggaagagga

SEQ ID NO: 27385 - RNA, 20 nt, Artificial Sequence
  TRAC targeting sequence
guuuugugcuucucaaccuc

SEQ ID NO: 27386 - RNA, 20 nt, Artificial Sequence
  TRAC targeting sequence
uauuuuccguuuugugcuuc

SEQ ID NO: 27387 - RNA, 20 nt, Artificial Sequence
  TRAC targeting sequence
uaugauaaucgaucauugcc

SEQ ID NO: 27388 - RNA, 20 nt, Artificial Sequence
  TRAC targeting sequence
uaugaguuaucuuauuuucc

SEQ ID NO: 27389 - RNA, 20 nt, Artificial Sequence
  TRAC targeting sequence
aucauugccaaggaucguga

SEQ ID NO: 27390 - RNA, 20 nt, Artificial Sequence
  TRAC targeting sequence
auuaucauaugaguuaucuu

SEQ ID NO: 27391 - RNA, 20 nt, Artificial Sequence
  TRAC targeting sequence
uugccaaggaucgugaagaa

SEQ ID NO: 27392 - RNA, 20 nt, Artificial Sequence
  TRAC targeting sequence
uuggcaaugaucgauuauca

SEQ ID NO: 27393 - RNA, 20 nt, Artificial Sequence
  TRAC targeting sequence
ugaagaacaaauguaugaua

SEQ ID NO: 27394 - RNA, 20 nt, Artificial Sequence
  TRAC targeting sequence
agaaccccuccuauucugca

SEQ ID NO: 27395 - RNA, 20 nt, Artificial Sequence
  TRAC targeting sequence
agaaaauaaagcaauauggu

SEQ ID NO: 27396 - RNA, 20 nt, Artificial Sequence
  TRAC targeting sequence
uauucugcaauacuggaaaa

SEQ ID NO: 27397 - RNA, 20 nt, Artificial Sequence
  TRAC targeting sequence
gcaauacuggaaaagaacaa

SEQ ID NO: 27398 - RNA, 20 nt, Artificial Sequence
  TRAC targeting sequence
aguauugcagaauaggaggg

SEQ ID NO: 27399 - RNA, 20 nt, Artificial Sequence
  TRAC targeting sequence
uuuccaguauugcagaauag

SEQ ID NO: 27400 - RNA, 20 nt, Artificial Sequence
  TRAC targeting sequence
uccuugucccuacugagaua

SEQ ID NO: 27401 - RNA, 20 nt, Artificial Sequence
  TRAC targeting sequence
uugucccuacugagauauug

SEQ ID NO: 27402 - RNA, 20 nt, Artificial Sequence
  TRAC targeting sequence
cuacugagauauugaucauc

SEQ ID NO: 27403 - RNA, 20 nt, Artificial Sequence
  TRAC targeting sequence
guagggacaaggaagauaag

SEQ ID NO: 27404 - RNA, 20 nt, Artificial Sequence
  TRAC targeting sequence
caguagggacaaggaagaua

SEQ ID NO: 27405 - RNA, 20 nt, Artificial Sequence
  TRAC targeting sequence
auaucucaguagggacaagg

SEQ ID NO: 27406 - RNA, 20 nt, Artificial Sequence
  TRAC targeting sequence
ucccacccuagagggaagaa

SEQ ID NO: 27407 - RNA, 20 nt, Artificial Sequence
  TRAC targeting sequence
cacccuagagggaagaauac

SEQ ID NO: 27408 - RNA, 20 nt, Artificial Sequence
  TRAC targeting sequence
agggugggaugaucaauauc

SEQ ID NO: 27409 - RNA, 20 nt, Artificial Sequence
  TRAC targeting sequence
cucuagggugggaugaucaa

SEQ ID NO: 27410 - RNA, 20 nt, Artificial Sequence
  TRAC targeting sequence
ucccucuagggugggaugau

SEQ ID NO: 27411 - RNA, 20 nt, Artificial Sequence
  TRAC targeting sequence
cuucuggcucuggaauacau

SEQ ID NO: 27412 - RNA, 20 nt, Artificial Sequence
  TRAC targeting sequence
agcuuacugacuccucugua

SEQ ID NO: 27413 - RNA, 20 nt, Artificial Sequence
  TRAC targeting sequence
cuuccagcuuacugacuccu

SEQ ID NO: 27414 - RNA, 20 nt, Artificial Sequence
  TRAC targeting sequence
gcgggaggacucagaaauac

SEQ ID NO: 27415 - RNA, 20 nt, Artificial Sequence
  TRAC targeting sequence
cgcugaaucccuuccagcuu

SEQ ID NO: 27416 - RNA, 20 nt, Artificial Sequence
  TRAC targeting sequence
ucccgcugaaucccuuccag

SEQ ID NO: 27417 - RNA, 20 nt, Artificial Sequence
  TRAC targeting sequence
gaaauacucacauuugccua

SEQ ID NO: 27418 - RNA, 20 nt, Artificial Sequence
  TRAC targeting sequence
gaguccucccgcugaauccc

SEQ ID NO: 27419 - RNA, 20 nt, Artificial Sequence
  TRAC targeting sequence
cauuugccuaaauaagguag

SEQ ID NO: 27420 - RNA, 20 nt, Artificial Sequence
  TRAC targeting sequence
accuuauuuaggcaaaugug

SEQ ID NO: 27421 - RNA, 20 nt, Artificial Sequence
  TRAC targeting sequence
aaacauggggcacuccucag

SEQ ID NO: 27422 - RNA, 20 nt, Artificial Sequence
  TRAC targeting sequence
ucaggggcacauuacgaagc

SEQ ID NO: 27423 - RNA, 20 nt, Artificial Sequence
  TRAC targeting sequence
ggggcacauuacgaagcugu

SEQ ID NO: 27424 - RNA, 20 nt, Artificial Sequence
  TRAC targeting sequence
uaaugugccccugaggagug

SEQ ID NO: 27425 - RNA, 20 nt, Artificial Sequence
  TRAC targeting sequence
cugaacaccaagccugaguc

SEQ ID NO: 27426 - RNA, 20 nt, Artificial Sequence
  TRAC targeting sequence
gggacagcuucguaaugugc

SEQ ID NO: 27427 - RNA, 20 nt, Artificial Sequence
  TRAC targeting sequence
ggcuugguguucagggacag

SEQ ID NO: 27428 - RNA, 20 nt, Artificial Sequence
  TRAC targeting sequence
gaugccccugaggcccacuu

SEQ ID NO: 27429 - RNA, 20 nt, Artificial Sequence
  TRAC targeting sequence
gacucaggcuugguguucag

SEQ ID NO: 27430 - RNA, 20 nt, Artificial Sequence
  TRAC targeting sequence
ggggcaucagacucaggcuu

SEQ ID NO: 27431 - RNA, 20 nt, Artificial Sequence
  TRAC targeting sequence
uaagugggccucaggggcau

SEQ ID NO: 27432 - RNA, 20 nt, Artificial Sequence
  TRAC targeting sequence
uuuccuaagugggccucagg

SEQ ID NO: 27433 - RNA, 20 nt, Artificial Sequence
  TRAC targeting sequence
acacuaacaagaacugggaa

SEQ ID NO: 27434 - RNA, 20 nt, Artificial Sequence
  TRAC targeting sequence
uguuaguguagauguuuagg

SEQ ID NO: 27435 - RNA, 20 nt, Artificial Sequence
  TRAC targeting sequence
cccucuuuagauauccuuuu

SEQ ID NO: 27436 - RNA, 20 nt, Artificial Sequence
  TRAC targeting sequence
cucuuuagauauccuuuucu

SEQ ID NO: 27437 - RNA, 20 nt, Artificial Sequence
  TRAC targeting sequence
uuagauauccuuuucuugca

SEQ ID NO: 27438 - RNA, 20 nt, Artificial Sequence
  TRAC targeting sequence
aaagagggagaaccuagcuu

SEQ ID NO: 27439 - RNA, 20 nt, Artificial Sequence
  TRAC targeting sequence
uuuucuugcacuuggaauca

SEQ ID NO: 27440 - RNA, 20 nt, Artificial Sequence
  TRAC targeting sequence
ugcacuuggaaucaggaauc

SEQ ID NO: 27441 - RNA, 20 nt, Artificial Sequence
  TRAC targeting sequence
aagugcaagaaaaggauauc

SEQ ID NO: 27442 - RNA, 20 nt, Artificial Sequence
  TRAC targeting sequence
ggaauccacaguguagaacu

SEQ ID NO: 27443 - RNA, 20 nt, Artificial Sequence
  TRAC targeting sequence
ugauuccaagugcaagaaaa

SEQ ID NO: 27444 - RNA, 20 nt, Artificial Sequence
  TRAC targeting sequence
acaguguagaacuggagugu

SEQ ID NO: 27445 - RNA, 20 nt, Artificial Sequence
  TRAC targeting sequence
acacuguggauuccugauuc

SEQ ID NO: 27446 - RNA, 20 nt, Artificial Sequence
  TRAC targeting sequence
aguucuacacuguggauucc

SEQ ID NO: 27447 - RNA, 20 nt, Artificial Sequence
  TRAC targeting sequence
uaaaauuauuuuugaauccc

SEQ ID NO: 27448 - RNA, 20 nt, Artificial Sequence
  TRAC targeting sequence
aaaauaauuuuaugaaaaaa

SEQ ID NO: 27449 - RNA, 20 nt, Artificial Sequence
  TRAC targeting sequence
ccauaaugccuaacuggaaa

SEQ ID NO: 27450 - RNA, 20 nt, Artificial Sequence
  TRAC targeting sequence
aguuaggcauuauggggauu

SEQ ID NO: 27451 - RNA, 20 nt, Artificial Sequence
  TRAC targeting sequence
guauauaugaauuuuagucc

SEQ ID NO: 27452 - RNA, 20 nt, Artificial Sequence
  TRAC targeting sequence
uauauacugagcaacuuuug

SEQ ID NO: 27453 - RNA, 20 nt, Artificial Sequence
  TRAC targeting sequence
aaaaagcuucuaauuucaau

SEQ ID NO: 27454 - RNA, 20 nt, Artificial Sequence
  TRAC targeting sequence
aauuucaaucucacaucaua

SEQ ID NO: 27455 - RNA, 20 nt, Artificial Sequence
  CIITA targeting sequence
guuuccuuauccaaaaaugg

SEQ ID NO: 27456 - RNA, 20 nt, Artificial Sequence
  CIITA targeting sequence
uuauccaaaaauggagacag

SEQ ID NO: 27457 - RNA, 20 nt, Artificial Sequence
  CIITA targeting sequence
aaaaauggagacaguaggac

SEQ ID NO: 27458 - RNA, 20 nt, Artificial Sequence
  CIITA targeting sequence
auuuuuggauaaggaaacug

SEQ ID NO: 27459 - RNA, 20 nt, Artificial Sequence
  CIITA targeting sequence
ccauuuuuggauaaggaaac

SEQ ID NO: 27460 - RNA, 20 nt, Artificial Sequence
  CIITA targeting sequence
uacugucuccauuuuuggau

SEQ ID NO: 27461 - RNA, 20 nt, Artificial Sequence
  CIITA targeting sequence
uaguccuacugucuccauuu

SEQ ID NO: 27462 - RNA, 20 nt, Artificial Sequence
  CIITA targeting sequence
uuucauaguccuacugucuc

SEQ ID NO: 27463 - RNA, 20 nt, Artificial Sequence
  CIITA targeting sequence
caugaaagcacaaagaugac

SEQ ID NO: 27464 - RNA, 20 nt, Artificial Sequence
  CIITA targeting sequence
ugugaauuaccuaauuuaug

SEQ ID NO: 27465 - RNA, 20 nt, Artificial Sequence
  CIITA targeting sequence
uugugcuuucaugugaauua

SEQ ID NO: 27466 - RNA, 20 nt, Artificial Sequence
  CIITA targeting sequence
ucuuugugcuuucaugugaa

SEQ ID NO: 27467 - RNA, 20 nt, Artificial Sequence
  CIITA targeting sequence
acaaaaugcuggcuauaauu

SEQ ID NO: 27468 - RNA, 20 nt, Artificial Sequence
  CIITA targeting sequence
cuaccacuaauuauagccag

SEQ ID NO: 27469 - RNA, 20 nt, Artificial Sequence
  CIITA targeting sequence
gcugccugucacuaccacua

SEQ ID NO: 27470 - RNA, 20 nt, Artificial Sequence
  CIITA targeting sequence
gaggccgggugcgguggcuc

SEQ ID NO: 27471 - RNA, 20 nt, Artificial Sequence
  CIITA targeting sequence
gaaacauuuauuaaacagca

SEQ ID NO: 27472 - RNA, 20 nt, Artificial Sequence
  CIITA targeting sequence
ugccuguaaucccaacacuu

SEQ ID NO: 27473 - RNA, 20 nt, Artificial Sequence
  CIITA targeting sequence
caacacuuugggaggccaag

SEQ ID NO: 27474 - RNA, 20 nt, Artificial Sequence
  CIITA targeting sequence
caaaguguugggauuacagg

SEQ ID NO: 27475 - RNA, 20 nt, Artificial Sequence
  CIITA targeting sequence
gcccgccuuggccucccaaa

SEQ ID NO: 27476 - RNA, 20 nt, Artificial Sequence
  CIITA targeting sequence
cgaggucaggagaucgagac

SEQ ID NO: 27477 - RNA, 20 nt, Artificial Sequence
  CIITA targeting sequence
ugaucugcccgccuuggccu

SEQ ID NO: 27478 - RNA, 20 nt, Artificial Sequence
  CIITA targeting sequence
ggagaucgagaccauucugg

SEQ ID NO: 27479 - RNA, 20 nt, Artificial Sequence
  CIITA targeting sequence
ugaccucgugaucugcccgc

SEQ ID NO: 27480 - RNA, 20 nt, Artificial Sequence
  CIITA targeting sequence
ccugaccucgugaucugccc

SEQ ID NO: 27481 - RNA, 20 nt, Artificial Sequence
  CIITA targeting sequence
agaccauucuggcuaacaug

SEQ ID NO: 27482 - RNA, 20 nt, Artificial Sequence
  CIITA targeting sequence
aucuccugaccucgugaucu

SEQ ID NO: 27483 - RNA, 20 nt, Artificial Sequence
  CIITA targeting sequence
cgaucuccugaccucgugau

SEQ ID NO: 27484 - RNA, 20 nt, Artificial Sequence
  CIITA targeting sequence
ggcuaacauggugaaacccu

SEQ ID NO: 27485 - RNA, 20 nt, Artificial Sequence
  CIITA targeting sequence
ccauguuagccagaaugguc

SEQ ID NO: 27486 - RNA, 20 nt, Artificial Sequence
  CIITA targeting sequence
cuacuaaaaauacaaaaaau

SEQ ID NO: 27487 - RNA, 20 nt, Artificial Sequence
  CIITA targeting sequence
acuaaaaauacaaaaaauua

SEQ ID NO: 27488 - RNA, 20 nt, Artificial Sequence
  CIITA targeting sequence
cagcuacucggguggcugag

SEQ ID NO: 27489 - RNA, 20 nt, Artificial Sequence
  CIITA targeting sequence
gcuacucggguggcugaggc

SEQ ID NO: 27490 - RNA, 20 nt, Artificial Sequence
  CIITA targeting sequence
gguggcugaggcaggagaau

SEQ ID NO: 27491 - RNA, 20 nt, Artificial Sequence
  CIITA targeting sequence
gccacccgaguagcugagac

SEQ ID NO: 27492 - RNA, 20 nt, Artificial Sequence
  CIITA targeting sequence
ugccucagccacccgaguag

SEQ ID NO: 27493 - RNA, 20 nt, Artificial Sequence
  CIITA targeting sequence
ccugccucagccacccgagu

SEQ ID NO: 27494 - RNA, 20 nt, Artificial Sequence
  CIITA targeting sequence
uucuccugccucagccaccc

SEQ ID NO: 27495 - RNA, 20 nt, Artificial Sequence
  CIITA targeting sequence
cgucauucuccugccucagc

SEQ ID NO: 27496 - RNA, 20 nt, Artificial Sequence
  CIITA targeting sequence
ggguucacgucauucuccug

SEQ ID NO: 27497 - RNA, 20 nt, Artificial Sequence
  CIITA targeting sequence
gccuucuggguucacgucau

SEQ ID NO: 27498 - RNA, 20 nt, Artificial Sequence
  CIITA targeting sequence
cugcaagcuccgccuucugg

SEQ ID NO: 27499 - RNA, 20 nt, Artificial Sequence
  CIITA targeting sequence
gcucacugcaagcuccgccu

SEQ ID NO: 27500 - RNA, 20 nt, Artificial Sequence
  CIITA targeting sequence
cggcucacugcaagcuccgc

SEQ ID NO: 27501 - RNA, 20 nt, Artificial Sequence
  CIITA targeting sequence
caccacugcacuccagccug

SEQ ID NO: 27502 - RNA, 20 nt, Artificial Sequence
  CIITA targeting sequence
agccugggugacagagcgag

SEQ ID NO: 27503 - RNA, 20 nt, Artificial Sequence
  CIITA targeting sequence
cccaggcuggagugcagugg

SEQ ID NO: 27504 - RNA, 20 nt, Artificial Sequence
  CIITA targeting sequence
gucacccaggcuggagugca

SEQ ID NO: 27505 - RNA, 20 nt, Artificial Sequence
  CIITA targeting sequence
cucugucacccaggcuggag

SEQ ID NO: 27506 - RNA, 20 nt, Artificial Sequence
  CIITA targeting sequence
cgcucugucacccaggcugg

SEQ ID NO: 27507 - RNA, 20 nt, Artificial Sequence
  CIITA targeting sequence
gccucaaaaauaaauaaaua

SEQ ID NO: 27508 - RNA, 20 nt, Artificial Sequence
  CIITA targeting sequence
aaaauaaauaaauaaauaaa

SEQ ID NO: 27509 - RNA, 20 nt, Artificial Sequence
  CIITA targeting sequence
auauucuuagugucuggggc

SEQ ID NO: 27510 - RNA, 20 nt, Artificial Sequence
  CIITA targeting sequence
uagugucuggggcuagguaa

SEQ ID NO: 27511 - RNA, 20 nt, Artificial Sequence
  CIITA targeting sequence
ggggcuagguaaaguuuguu

SEQ ID NO: 27512 - RNA, 20 nt, Artificial Sequence
  CIITA targeting sequence
cucauuaauauuccaggugc

SEQ ID NO: 27513 - RNA, 20 nt, Artificial Sequence
  CIITA targeting sequence
uuaauauuccaggugccaaa

SEQ ID NO: 27514 - RNA, 20 nt, Artificial Sequence
  CIITA targeting sequence
aggugccaaaccugugagca

SEQ ID NO: 27515 - RNA, 20 nt, Artificial Sequence
  CIITA targeting sequence
cagguuuggcaccuggaaua

SEQ ID NO: 27516 - RNA, 20 nt, Artificial Sequence
  CIITA targeting sequence
uugcucacagguuuggcacc

SEQ ID NO: 27517 - RNA, 20 nt, Artificial Sequence
  CIITA targeting sequence
aguagcaaugagcauuugug

SEQ ID NO: 27518 - RNA, 20 nt, Artificial Sequence
  CIITA targeting sequence
uugcuacuggagugucauug

SEQ ID NO: 27519 - RNA, 20 nt, Artificial Sequence
  CIITA targeting sequence
acaucuugguuucugaacug

SEQ ID NO: 27520 - RNA, 20 nt, Artificial Sequence
  CIITA targeting sequence
ugguuucugaacuguugucu

SEQ ID NO: 27521 - RNA, 20 nt, Artificial Sequence
  CIITA targeting sequence
gaacuguugucugcuaaaaa

SEQ ID NO: 27522 - RNA, 20 nt, Artificial Sequence
  CIITA targeting sequence
gaaaccaagauguggaugcc

SEQ ID NO: 27523 - RNA, 20 nt, Artificial Sequence
  CIITA targeting sequence
gcuaaaaaguaaccaaggcu

SEQ ID NO: 27524 - RNA, 20 nt, Artificial Sequence
  CIITA targeting sequence
cugaagaaaugacugcagca

SEQ ID NO: 27525 - RNA, 20 nt, Artificial Sequence
  CIITA targeting sequence
gggagccuugguuacuuuuu

SEQ ID NO: 27526 - RNA, 20 nt, Artificial Sequence
  CIITA targeting sequence
ucagggagccuugguuacuu

SEQ ID NO: 27527 - RNA, 20 nt, Artificial Sequence
  CIITA targeting sequence
uuucuucagggagccuuggu

SEQ ID NO: 27528 - RNA, 20 nt, Artificial Sequence
  CIITA targeting sequence
cugcugcagucauuucuuca

SEQ ID NO: 27529 - RNA, 20 nt, Artificial Sequence
  CIITA targeting sequence
cccugcugcagucauuucuu

SEQ ID NO: 27530 - RNA, 20 nt, Artificial Sequence
  CIITA targeting sequence
cuucucccugcugcagucau

SEQ ID NO: 27531 - RNA, 20 nt, Artificial Sequence
  CIITA targeting sequence
ucccuucucccugcugcagu

SEQ ID NO: 27532 - RNA, 20 nt, Artificial Sequence
  CIITA targeting sequence
gucaucccuucucccugcug

SEQ ID NO: 27533 - RNA, 20 nt, Artificial Sequence
  CIITA targeting sequence
uguaucagaaagcaagaaaa

SEQ ID NO: 27534 - RNA, 20 nt, Artificial Sequence
  CIITA targeting sequence
gaaagcaagaaaaugcucaa

SEQ ID NO: 27535 - RNA, 20 nt, Artificial Sequence
  CIITA targeting sequence
gauacaagauguuucaguca

SEQ ID NO: 27536 - RNA, 20 nt, Artificial Sequence
  CIITA targeting sequence
ugcuuucugauacaagaugu

SEQ ID NO: 27537 - RNA, 20 nt, Artificial Sequence
  CIITA targeting sequence
aagaagcuggauuagugccc

SEQ ID NO: 27538 - RNA, 20 nt, Artificial Sequence
  CIITA targeting sequence
uugagcauuuucuugcuuuc

SEQ ID NO: 27539 - RNA, 20 nt, Artificial Sequence
  CIITA targeting sequence
agcuucuuugagcauuuucu

SEQ ID NO: 27540 - RNA, 20 nt, Artificial Sequence
  CIITA targeting sequence
uugggcacuaauccagcuuc

SEQ ID NO: 27541 - RNA, 20 nt, Artificial Sequence
  CIITA targeting sequence
uauguucuuugggcacuaau

SEQ ID NO: 27542 - RNA, 20 nt, Artificial Sequence
  CIITA targeting sequence
ugaaggggcuucacuggcca

SEQ ID NO: 27543 - RNA, 20 nt, Artificial Sequence
  CIITA targeting sequence
agacaguucuuauguucuuu

SEQ ID NO: 27544 - RNA, 20 nt, Artificial Sequence
  CIITA targeting sequence
cuggccacaucugggggaaa

SEQ ID NO: 27545 - RNA, 20 nt, Artificial Sequence
  CIITA targeting sequence
gggggaaaaaaaaucgacca

SEQ ID NO: 27546 - RNA, 20 nt, Artificial Sequence
  CIITA targeting sequence
cccagauguggccagugaag

SEQ ID NO: 27547 - RNA, 20 nt, Artificial Sequence
  CIITA targeting sequence
accagaaagaauaauaauug

SEQ ID NO: 27548 - RNA, 20 nt, Artificial Sequence
  CIITA targeting sequence
auuuuuuuucccccagaugu

SEQ ID NO: 27549 - RNA, 20 nt, Artificial Sequence
  CIITA targeting sequence
ggucgauuuuuuuuccccca

SEQ ID NO: 27550 - RNA, 20 nt, Artificial Sequence
  CIITA targeting sequence
uucuggucgauuuuuuuucc

SEQ ID NO: 27551 - RNA, 20 nt, Artificial Sequence
  CIITA targeting sequence
auuauuauucuuucuggucg

SEQ ID NO: 27552 - RNA, 20 nt, Artificial Sequence
  CIITA targeting sequence
uuuauaaucaauuauuauuc

SEQ ID NO: 27553 - RNA, 20 nt, Artificial Sequence
  CIITA targeting sequence
aggaauccauagugagucuu

SEQ ID NO: 27554 - RNA, 20 nt, Artificial Sequence
  CIITA targeting sequence
uggauuuuuuaaaauugucu

SEQ ID NO: 27555 - RNA, 20 nt, Artificial Sequence
  CIITA targeting sequence
auagugagucuucgaaaaaa

SEQ ID NO: 27556 - RNA, 20 nt, Artificial Sequence
  CIITA targeting sequence
cuauggauuccuggauuuuu

SEQ ID NO: 27557 - RNA, 20 nt, Artificial Sequence
  CIITA targeting sequence
ucgaaaaaaaagaaaaaaag

SEQ ID NO: 27558 - RNA, 20 nt, Artificial Sequence
  CIITA targeting sequence
aaaaaaaagaaaaaaagaga

SEQ ID NO: 27559 - RNA, 20 nt, Artificial Sequence
  CIITA targeting sequence
aagacucacuauggauuccu

SEQ ID NO: 27560 - RNA, 20 nt, Artificial Sequence
  CIITA targeting sequence
uuuuuuucgaagacucacua

SEQ ID NO: 27561 - RNA, 20 nt, Artificial Sequence
  CIITA targeting sequence
uuuuuucuuuuuuuucgaag

SEQ ID NO: 27562 - RNA, 20 nt, Artificial Sequence
  CIITA targeting sequence
cuuuuuuucuuuuuuuucga

SEQ ID NO: 27563 - RNA, 20 nt, Artificial Sequence
  CIITA targeting sequence
guuuuauacccucucuuuuu

SEQ ID NO: 27564 - RNA, 20 nt, Artificial Sequence
  CIITA targeting sequence
uauauauaaucuauaguuuu

SEQ ID NO: 27565 - RNA, 20 nt, Artificial Sequence
  CIITA targeting sequence
auaguuuuauauauauauau

SEQ ID NO: 27566 - RNA, 20 nt, Artificial Sequence
  CIITA targeting sequence
cugagugaaaggcugauaga

SEQ ID NO: 27567 - RNA, 20 nt, Artificial Sequence
  CIITA targeting sequence
gugauuuuagcagcauuuau

SEQ ID NO: 27568 - RNA, 20 nt, Artificial Sequence
  CIITA targeting sequence
cucagugauuuuagcagcau

SEQ ID NO: 27569 - RNA, 20 nt, Artificial Sequence
  CIITA targeting sequence
gccuuucacucagugauuuu

SEQ ID NO: 27570 - RNA, 20 nt, Artificial Sequence
  CIITA targeting sequence
aucagccuuucacucaguga

SEQ ID NO: 27571 - RNA, 20 nt, Artificial Sequence
  CIITA targeting sequence
cuaucagccuuucacucagu

SEQ ID NO: 27572 - RNA, 20 nt, Artificial Sequence
  CIITA targeting sequence
ucucuaucagccuuucacuc

SEQ ID NO: 27573 - RNA, 20 nt, Artificial Sequence
  CIITA targeting sequence
ucuucucuaucagccuuuca

SEQ ID NO: 27574 - RNA, 20 nt, Artificial Sequence
  CIITA targeting sequence
cagagaguaccuguuaauua

SEQ ID NO: 27575 - RNA, 20 nt, Artificial Sequence
  CIITA targeting sequence
gggaccaucuucuucucuau

SEQ ID NO: 27576 - RNA, 20 nt, Artificial Sequence
  CIITA targeting sequence
cugggaccaucuucuucucu

SEQ ID NO: 27577 - RNA, 20 nt, Artificial Sequence
  CIITA targeting sequence
auuuguaauuaacagguacu

SEQ ID NO: 27578 - RNA, 20 nt, Artificial Sequence
  CIITA targeting sequence
uccauuuguaauuaacaggu

SEQ ID NO: 27579 - RNA, 20 nt, Artificial Sequence
  CIITA targeting sequence
uucuuccauuuguaauuaac

SEQ ID NO: 27580 - RNA, 20 nt, Artificial Sequence
  CIITA targeting sequence
auuuaauguuuccuucuucc

SEQ ID NO: 27581 - RNA, 20 nt, Artificial Sequence
  CIITA targeting sequence
ccauuuaauguuuccuucuu

SEQ ID NO: 27582 - RNA, 20 nt, Artificial Sequence
  CIITA targeting sequence
gccccauuucuccauuuaau

SEQ ID NO: 27583 - RNA, 20 nt, Artificial Sequence
  CIITA targeting sequence
cuugcuaaagguggugucug

SEQ ID NO: 27584 - RNA, 20 nt, Artificial Sequence
  CIITA targeting sequence
agcuucacauuaccaaaaac

SEQ ID NO: 27585 - RNA, 20 nt, Artificial Sequence
  CIITA targeting sequence
cauuaccaaaaacgggacaa

SEQ ID NO: 27586 - RNA, 20 nt, Artificial Sequence
  CIITA targeting sequence
cguuuuugguaaugugaagc

SEQ ID NO: 27587 - RNA, 20 nt, Artificial Sequence
  CIITA targeting sequence
guuugucccguuuuugguaa

SEQ ID NO: 27588 - RNA, 20 nt, Artificial Sequence
  CIITA targeting sequence
aaguguguucugcaggaaaa

SEQ ID NO: 27589 - RNA, 20 nt, Artificial Sequence
  CIITA targeting sequence
gcaggaaaaaagaaaaauua

SEQ ID NO: 27590 - RNA, 20 nt, Artificial Sequence
  CIITA targeting sequence
ugcagaacacacuuggauaa

SEQ ID NO: 27591 - RNA, 20 nt, Artificial Sequence
  CIITA targeting sequence
uuuuuccugcagaacacacu

SEQ ID NO: 27592 - RNA, 20 nt, Artificial Sequence
  CIITA targeting sequence
aauuacaaggcaagagggag

SEQ ID NO: 27593 - RNA, 20 nt, Artificial Sequence
  CIITA targeting sequence
ugccuuguaauuagauaaag

SEQ ID NO: 27594 - RNA, 20 nt, Artificial Sequence
  CIITA targeting sequence
cucuugccuuguaauuagau

SEQ ID NO: 27595 - RNA, 20 nt, Artificial Sequence
  CIITA targeting sequence
ccucccucuugccuuguaau

SEQ ID NO: 27596 - RNA, 20 nt, Artificial Sequence
  CIITA targeting sequence
uccccucccucuugccuugu

SEQ ID NO: 27597 - RNA, 20 nt, Artificial Sequence
  CIITA targeting sequence
aauccuccccucccucuugc

SEQ ID NO: 27598 - RNA, 20 nt, Artificial Sequence
  CIITA targeting sequence
agaauaugggauauucuauu

SEQ ID NO: 27599 - RNA, 20 nt, Artificial Sequence
  CIITA targeting sequence
ugauuugucuaauccucccc

SEQ ID NO: 27600 - RNA, 20 nt, Artificial Sequence
  CIITA targeting sequence
cauauucuugauuugucuaa

SEQ ID NO: 27601 - RNA, 20 nt, Artificial Sequence
  CIITA targeting sequence
auuacacaacuggucuggac

SEQ ID NO: 27602 - RNA, 20 nt, Artificial Sequence
  CIITA targeting sequence
ggacccgucaaaauuaucaa

SEQ ID NO: 27603 - RNA, 20 nt, Artificial Sequence
  CIITA targeting sequence
agaccaguuguguaauagaa

SEQ ID NO: 27604 - RNA, 20 nt, Artificial Sequence
  CIITA targeting sequence
aaauuaucaaggugaugaga

SEQ ID NO: 27605 - RNA, 20 nt, Artificial Sequence
  CIITA targeting sequence
aggugaugagacccccccua

SEQ ID NO: 27606 - RNA, 20 nt, Artificial Sequence
  CIITA targeting sequence
ccuugauaauuuugacgggu

SEQ ID NO: 27607 - RNA, 20 nt, Artificial Sequence
  CIITA targeting sequence
ucaccuugauaauuuugacg

SEQ ID NO: 27608 - RNA, 20 nt, Artificial Sequence
  CIITA targeting sequence
caucaccuugauaauuuuga

SEQ ID NO: 27609 - RNA, 20 nt, Artificial Sequence
  CIITA targeting sequence
uuuuuuagggggggucucau

SEQ ID NO: 27610 - RNA, 20 nt, Artificial Sequence
  CIITA targeting sequence
uucuuuuuuuaggggggguc

SEQ ID NO: 27611 - RNA, 20 nt, Artificial Sequence
  CIITA targeting sequence
guccuucuuuuuuuaggggg

SEQ ID NO: 27612 - RNA, 20 nt, Artificial Sequence
  CIITA targeting sequence
gaauuaaaggagaccgaaga

SEQ ID NO: 27613 - RNA, 20 nt, Artificial Sequence
  CIITA targeting sequence
gaucaguccuucuuuuuuua

SEQ ID NO: 27614 - RNA, 20 nt, Artificial Sequence
  CIITA targeting sequence
uuuaauucagaucaguccuu

SEQ ID NO: 27615 - RNA, 20 nt, Artificial Sequence
  CIITA targeting sequence
ccuuuaauucagaucagucc

SEQ ID NO: 27616 - RNA, 20 nt, Artificial Sequence
  CIITA targeting sequence
gucuccuuuaauucagauca

SEQ ID NO: 27617 - RNA, 20 nt, Artificial Sequence
  CIITA targeting sequence
ucggucuccuuuaauucaga

SEQ ID NO: 27618 - RNA, 20 nt, Artificial Sequence
  CIITA targeting sequence
cuucggucuccuuuaauuca

SEQ ID NO: 27619 - RNA, 20 nt, Artificial Sequence
  CIITA targeting sequence
aggcagugagugaauccagc

SEQ ID NO: 27620 - RNA, 20 nt, Artificial Sequence
  CIITA targeting sequence
cugccuggaguuauuucucu

SEQ ID NO: 27621 - RNA, 20 nt, Artificial Sequence
  CIITA targeting sequence
cucacugccuggaguuauuu

SEQ ID NO: 27622 - RNA, 20 nt, Artificial Sequence
  CIITA targeting sequence
agcaggggagggggucuaac

SEQ ID NO: 27623 - RNA, 20 nt, Artificial Sequence
  CIITA targeting sequence
ccugcuggauucacucacug

SEQ ID NO: 27624 - RNA, 20 nt, Artificial Sequence
  CIITA targeting sequence
aacaacugaaauugaaauau

SEQ ID NO: 27625 - RNA, 20 nt, Artificial Sequence
  CIITA targeting sequence
guuguuagacccccuccccu

SEQ ID NO: 27626 - RNA, 20 nt, Artificial Sequence
  CIITA targeting sequence
auuucaguuguuagaccccc

SEQ ID NO: 27627 - RNA, 20 nt, Artificial Sequence
  CIITA targeting sequence
auuggcuaauacugcauugg

SEQ ID NO: 27628 - RNA, 20 nt, Artificial Sequence
  CIITA targeting sequence
auauuaaaucucuuggguau

SEQ ID NO: 27629 - RNA, 20 nt, Artificial Sequence
  CIITA targeting sequence
augcaguacuagccaaugca

SEQ ID NO: 27630 - RNA, 20 nt, Artificial Sequence
  CIITA targeting sequence
cuuggguaugaaaauggcac

SEQ ID NO: 27631 - RNA, 20 nt, Artificial Sequence
  CIITA targeting sequence
uggguaugaaaauggcacug

SEQ ID NO: 27632 - RNA, 20 nt, Artificial Sequence
  CIITA targeting sequence
uacccaagagauuuaauauc

SEQ ID NO: 27633 - RNA, 20 nt, Artificial Sequence
  CIITA targeting sequence
gugccauuuucauacccaag

SEQ ID NO: 27634 - RNA, 20 nt, Artificial Sequence
  CIITA targeting sequence
ugaagaauggcuuuguucuu

SEQ ID NO: 27635 - RNA, 20 nt, Artificial Sequence
  CIITA targeting sequence
ugacaucagugccauuuuca

SEQ ID NO: 27636 - RNA, 20 nt, Artificial Sequence
  CIITA targeting sequence
ucaugacaucagugccauuu

SEQ ID NO: 27637 - RNA, 20 nt, Artificial Sequence
  CIITA targeting sequence
uaggagaugcacugcagaag

SEQ ID NO: 27638 - RNA, 20 nt, Artificial Sequence
  CIITA targeting sequence
uaagaacaaagccauucuuc

SEQ ID NO: 27639 - RNA, 20 nt, Artificial Sequence
  CIITA targeting sequence
ccuaagaacaaagccauucu

SEQ ID NO: 27640 - RNA, 20 nt, Artificial Sequence
  CIITA targeting sequence
gcagugcaucuccuaagaac

SEQ ID NO: 27641 - RNA, 20 nt, Artificial Sequence
  CIITA targeting sequence
uaaauacuucugcagugcau

SEQ ID NO: 27642 - RNA, 20 nt, Artificial Sequence
  CIITA targeting sequence
uaucauaaauacuucugcag

SEQ ID NO: 27643 - RNA, 20 nt, Artificial Sequence
  CIITA targeting sequence
cugaaaaggaacagacguug

SEQ ID NO: 27644 - RNA, 20 nt, Artificial Sequence
  CIITA targeting sequence
gaaaaggaacagacguugag

SEQ ID NO: 27645 - RNA, 20 nt, Artificial Sequence
  CIITA targeting sequence
gagauuuccuaucauaaaua

SEQ ID NO: 27646 - RNA, 20 nt, Artificial Sequence
  CIITA targeting sequence
uuuucagagauuuccuauca

SEQ ID NO: 27647 - RNA, 20 nt, Artificial Sequence
  CIITA targeting sequence
guuccuuuucagagauuucc

SEQ ID NO: 27648 - RNA, 20 nt, Artificial Sequence
  CIITA targeting sequence
acgucuguuccuuuucagag

SEQ ID NO: 27649 - RNA, 20 nt, Artificial Sequence
  CIITA targeting sequence
cagucuuucggcccaagguu

SEQ ID NO: 27650 - RNA, 20 nt, Artificial Sequence
  CIITA targeting sequence
uucggcccaagguucgcgcg

SEQ ID NO: 27651 - RNA, 20 nt, Artificial Sequence
  CIITA targeting sequence
gcccaagguucgcgcgugcg

SEQ ID NO: 27652 - RNA, 20 nt, Artificial Sequence
  CIITA targeting sequence
cgcgugcgcacagcccccuu

SEQ ID NO: 27653 - RNA, 20 nt, Artificial Sequence
  CIITA targeting sequence
gagacuuauuucgcgcgguc

SEQ ID NO: 27654 - RNA, 20 nt, Artificial Sequence
  CIITA targeting sequence
gaaagggggcugugcgcacg

SEQ ID NO: 27655 - RNA, 20 nt, Artificial Sequence
  CIITA targeting sequence
cggaaagggggcugugcgca

SEQ ID NO: 27656 - RNA, 20 nt, Artificial Sequence
  CIITA targeting sequence
cgcggucggagaaucagauu

SEQ ID NO: 27657 - RNA, 20 nt, Artificial Sequence
  CIITA targeting sequence
gagaaucagauugugcccac

SEQ ID NO: 27658 - RNA, 20 nt, Artificial Sequence
  CIITA targeting sequence
gaccgcgcgaaauaagucuc

SEQ ID NO: 27659 - RNA, 20 nt, Artificial Sequence
  CIITA targeting sequence
ccgaccgcgcgaaauaaguc

SEQ ID NO: 27660 - RNA, 20 nt, Artificial Sequence
  CIITA targeting sequence
gauugugcccacaaggcgga

SEQ ID NO: 27661 - RNA, 20 nt, Artificial Sequence
  CIITA targeting sequence
gauucuccgaccgcgcgaaa

SEQ ID NO: 27662 - RNA, 20 nt, Artificial Sequence
  CIITA targeting sequence
gccuugugggcacaaucuga

SEQ ID NO: 27663 - RNA, 20 nt, Artificial Sequence
  CIITA targeting sequence
uacauuuccgccuugugggc

SEQ ID NO: 27664 - RNA, 20 nt, Artificial Sequence
  CIITA targeting sequence
ggugaccacgaaggcggcaa

SEQ ID NO: 27665 - RNA, 20 nt, Artificial Sequence
  CIITA targeting sequence
ccggaacccgcugucguaca

SEQ ID NO: 27666 - RNA, 20 nt, Artificial Sequence
  CIITA targeting sequence
uggucaccggaacccgcugu

SEQ ID NO: 27667 - RNA, 20 nt, Artificial Sequence
  CIITA targeting sequence
ccuuugccgccuucgugguc

SEQ ID NO: 27668 - RNA, 20 nt, Artificial Sequence
  CIITA targeting sequence
gucgccuuugccgccuucgu

SEQ ID NO: 27669 - RNA, 20 nt, Artificial Sequence
  CIITA targeting sequence
auuccgucgccuuugccgcc

SEQ ID NO: 27670 - RNA, 20 nt, Artificial Sequence
  CIITA targeting sequence
uccauuccgucgccuuugcc

SEQ ID NO: 27671 - RNA, 20 nt, Artificial Sequence
  CIITA targeting sequence
cgguaagcucgcggaggggg

SEQ ID NO: 27672 - RNA, 20 nt, Artificial Sequence
  CIITA targeting sequence
cggagggggcgugggucgcg

SEQ ID NO: 27673 - RNA, 20 nt, Artificial Sequence
  CIITA targeting sequence
gcgagcuuaccgugaggcac

SEQ ID NO: 27674 - RNA, 20 nt, Artificial Sequence
  CIITA targeting sequence
cggggcgaaagugucgggag

SEQ ID NO: 27675 - RNA, 20 nt, Artificial Sequence
  CIITA targeting sequence
ccccgcgacccacgcccccu

SEQ ID NO: 27676 - RNA, 20 nt, Artificial Sequence
  CIITA targeting sequence
ggagcugcucuaacuguggu

SEQ ID NO: 27677 - RNA, 20 nt, Artificial Sequence
  CIITA targeting sequence
cgacacuuucgccccgcgac

SEQ ID NO: 27678 - RNA, 20 nt, Artificial Sequence
  CIITA targeting sequence
aacuguggucuugucucugc

SEQ ID NO: 27679 - RNA, 20 nt, Artificial Sequence
  CIITA targeting sequence
ugucucugcgcagacugucc

SEQ ID NO: 27680 - RNA, 20 nt, Artificial Sequence
  CIITA targeting sequence
cugcgcagacuguccagggg

SEQ ID NO: 27681 - RNA, 20 nt, Artificial Sequence
  CIITA targeting sequence
gcgcagacuguccaggggcc

SEQ ID NO: 27682 - RNA, 20 nt, Artificial Sequence
  CIITA targeting sequence
gcgcagagacaagaccacag

SEQ ID NO: 27683 - RNA, 20 nt, Artificial Sequence
  CIITA targeting sequence
aggggccgacagcgcccagg

SEQ ID NO: 27684 - RNA, 20 nt, Artificial Sequence
  CIITA targeting sequence
gccccuggacagucugcgca

SEQ ID NO: 27685 - RNA, 20 nt, Artificial Sequence
  CIITA targeting sequence
gcccgccugggcgcugucgg

SEQ ID NO: 27686 - RNA, 20 nt, Artificial Sequence
  CIITA targeting sequence
ugucagggaugccccaacca

SEQ ID NO: 27687 - RNA, 20 nt, Artificial Sequence
  CIITA targeting sequence
gggaugccccaaccagcggc

SEQ ID NO: 27688 - RNA, 20 nt, Artificial Sequence
  CIITA targeting sequence
cugacaugaagccccucugc

SEQ ID NO: 27689 - RNA, 20 nt, Artificial Sequence
  CIITA targeting sequence
ggagcgggggccacuccgga

SEQ ID NO: 27690 - RNA, 20 nt, Artificial Sequence
  CIITA targeting sequence
agaagcgcacagccgcuggu

SEQ ID NO: 27691 - RNA, 20 nt, Artificial Sequence
  CIITA targeting sequence
ggacacgggugagaaaaggg

SEQ ID NO: 27692 - RNA, 20 nt, Artificial Sequence
  CIITA targeting sequence
ggaguggcccccgcuccaga

SEQ ID NO: 27693 - RNA, 20 nt, Artificial Sequence
  CIITA targeting sequence
cccguguccggaguggcccc

SEQ ID NO: 27694 - RNA, 20 nt, Artificial Sequence
  CIITA targeting sequence
cacccguguccggaguggcc

SEQ ID NO: 27695 - RNA, 20 nt, Artificial Sequence
  CIITA targeting sequence
acaggaacuuagaggcgcag

SEQ ID NO: 27696 - RNA, 20 nt, Artificial Sequence
  CIITA targeting sequence
uguugaggccuugcccuuuu

SEQ ID NO: 27697 - RNA, 20 nt, Artificial Sequence
  CIITA targeting sequence
aaguuccuguugaggccuug

SEQ ID NO: 27698 - RNA, 20 nt, Artificial Sequence
  CIITA targeting sequence
gggccugcgccucuaaguuc

SEQ ID NO: 27699 - RNA, 20 nt, Artificial Sequence
  CIITA targeting sequence
cacgccccgccuuuuccggg

SEQ ID NO: 27700 - RNA, 20 nt, Artificial Sequence
  CIITA targeting sequence
cucccacgccccgccuuuuc

SEQ ID NO: 27701 - RNA, 20 nt, Artificial Sequence
  CIITA targeting sequence
cgcccccucccucccacgcc

SEQ ID NO: 27702 - RNA, 20 nt, Artificial Sequence
  CIITA targeting sequence
gcagaaugacugacagcggc

SEQ ID NO: 27703 - RNA, 20 nt, Artificial Sequence
  CIITA targeting sequence
gcagaucccgcccccucccu

SEQ ID NO: 27704 - RNA, 20 nt, Artificial Sequence
  CIITA targeting sequence
uucugcagaucccgcccccu

SEQ ID NO: 27705 - RNA, 20 nt, Artificial Sequence
  CIITA targeting sequence
gucauucugcagaucccgcc

SEQ ID NO: 27706 - RNA, 20 nt, Artificial Sequence
  CIITA targeting sequence
agccugccgcugucagucau

SEQ ID NO: 27707 - RNA, 20 nt, Artificial Sequence
  CIITA targeting sequence
gagagggguggggcccagaa

SEQ ID NO: 27708 - RNA, 20 nt, Artificial Sequence
  CIITA targeting sequence
gaauacaauaccuucuagcc

SEQ ID NO: 27709 - RNA, 20 nt, Artificial Sequence
  CIITA targeting sequence
ccgaauacaauaccuucuag

SEQ ID NO: 27710 - RNA, 20 nt, Artificial Sequence
  CIITA targeting sequence
gggccccaccccucuccgaa

SEQ ID NO: 27711 - RNA, 20 nt, Artificial Sequence
  CIITA targeting sequence
acgccccgccccuucugggc

SEQ ID NO: 27712 - RNA, 20 nt, Artificial Sequence
  CIITA targeting sequence
cccugcccacuuuccacgcc

SEQ ID NO: 27713 - RNA, 20 nt, Artificial Sequence
  CIITA targeting sequence
gcccucacccugcccacuuu

SEQ ID NO: 27714 - RNA, 20 nt, Artificial Sequence
  CIITA targeting sequence
aagcuccgcccucacccugc

SEQ ID NO: 27715 - RNA, 20 nt, Artificial Sequence
  CIITA targeting sequence
uuccaagcuccgcccucacc

SEQ ID NO: 27716 - RNA, 20 nt, Artificial Sequence
  CIITA targeting sequence
gucauuccaagcuccgcccu

SEQ ID NO: 27717 - RNA, 20 nt, Artificial Sequence
  CIITA targeting sequence
ugucagucauuccaagcucc

SEQ ID NO: 27718 - RNA, 20 nt, Artificial Sequence
  CIITA targeting sequence
uuccugucagucauuccaag

SEQ ID NO: 27719 - RNA, 20 nt, Artificial Sequence
  CIITA targeting sequence
aaaggccucguuccugucag

SEQ ID NO: 27720 - RNA, 20 nt, Artificial Sequence
  CIITA targeting sequence
ccuucuaaaggccucguucc

SEQ ID NO: 27721 - RNA, 20 nt, Artificial Sequence
  CIITA targeting sequence
cgcucgccuucuaaaggccu

SEQ ID NO: 27722 - RNA, 20 nt, Artificial Sequence
  CIITA targeting sequence
uucgcgcucgccuucuaaag

SEQ ID NO: 27723 - RNA, 20 nt, Artificial Sequence
  CIITA targeting sequence
gcgccagguccuucgcgcuc

SEQ ID NO: 27724 - RNA, 20 nt, Artificial Sequence
  CIITA targeting sequence
auccgcgccagguccuucgc

SEQ ID NO: 27725 - RNA, 20 nt, Artificial Sequence
  CIITA targeting sequence
acccuccauccgcgccaggu

SEQ ID NO: 27726 - RNA, 20 nt, Artificial Sequence
  CIITA targeting sequence
ccacccuccauccgcgccag

SEQ ID NO: 27727 - RNA, 20 nt, Artificial Sequence
  CIITA targeting sequence
gucuccacccuccauccgcg

SEQ ID NO: 27728 - RNA, 20 nt, Artificial Sequence
  CIITA targeting sequence
gcgccggucagucuccaccc

SEQ ID NO: 27729 - RNA, 20 nt, Artificial Sequence
  CIITA targeting sequence
aaagggacauuaauuaagag

SEQ ID NO: 27730 - RNA, 20 nt, Artificial Sequence
  CIITA targeting sequence
acuccgcgccggucagucuc

SEQ ID NO: 27731 - RNA, 20 nt, Artificial Sequence
  CIITA targeting sequence
cuuucgacuccgcgccgguc

SEQ ID NO: 27732 - RNA, 20 nt, Artificial Sequence
  CIITA targeting sequence
uaauuaaugucccuuucgac

SEQ ID NO: 27733 - RNA, 20 nt, Artificial Sequence
  CIITA targeting sequence
gggccagagguuugagugac

SEQ ID NO: 27734 - RNA, 20 nt, Artificial Sequence
  CIITA targeting sequence
ggccccgacccucuuaauua

SEQ ID NO: 27735 - RNA, 20 nt, Artificial Sequence
  CIITA targeting sequence
aaccucuggccccgacccuc

SEQ ID NO: 27736 - RNA, 20 nt, Artificial Sequence
  CIITA targeting sequence
cucaaaccucuggccccgac

SEQ ID NO: 27737 - RNA, 20 nt, Artificial Sequence
  CIITA targeting sequence
guuauugucacucaaaccuc

SEQ ID NO: 27738 - RNA, 20 nt, Artificial Sequence
  CIITA targeting sequence
gcggucuguuauugucacuc

SEQ ID NO: 27739 - RNA, 20 nt, Artificial Sequence
  CIITA targeting sequence
cugcggucuguuauugucac

SEQ ID NO: 27740 - RNA, 20 nt, Artificial Sequence
  CIITA targeting sequence
cguuuuucucugcggucugu

SEQ ID NO: 27741 - RNA, 20 nt, Artificial Sequence
  CIITA targeting sequence
aagucggggagucuucggac

SEQ ID NO: 27742 - RNA, 20 nt, Artificial Sequence
  CIITA targeting sequence
aagcuuaucccguuuuucuc

SEQ ID NO: 27743 - RNA, 20 nt, Artificial Sequence
  CIITA targeting sequence
gggagucuucggacuuacau

SEQ ID NO: 27744 - RNA, 20 nt, Artificial Sequence
  CIITA targeting sequence
ccgacuucgaagcuuauccc

SEQ ID NO: 27745 - RNA, 20 nt, Artificial Sequence
  CIITA targeting sequence
ucggacuuacauccuggcuc

SEQ ID NO: 27746 - RNA, 20 nt, Artificial Sequence
  CIITA targeting sequence
gacuuacauccuggcucugc

SEQ ID NO: 27747 - RNA, 20 nt, Artificial Sequence
  CIITA targeting sequence
gaagacuccccgacuucgaa

SEQ ID NO: 27748 - RNA, 20 nt, Artificial Sequence
  CIITA targeting sequence
uggcucugccagcuacuuuc

SEQ ID NO: 27749 - RNA, 20 nt, Artificial Sequence
  CIITA targeting sequence
gccagcuacuuucuugacac

SEQ ID NO: 27750 - RNA, 20 nt, Artificial Sequence
  CIITA targeting sequence
ugacacaauuuucuuccuuu

SEQ ID NO: 27751 - RNA, 20 nt, Artificial Sequence
  CIITA targeting sequence
agaaaguagcuggcagagcc

SEQ ID NO: 27752 - RNA, 20 nt, Artificial Sequence
  CIITA targeting sequence
uccuuuugaggagugauucu

SEQ ID NO: 27753 - RNA, 20 nt, Artificial Sequence
  CIITA targeting sequence
uuuugaggagugauucuccc

SEQ ID NO: 27754 - RNA, 20 nt, Artificial Sequence
  CIITA targeting sequence
aaaggaagaaaauuguguca

SEQ ID NO: 27755 - RNA, 20 nt, Artificial Sequence
  CIITA targeting sequence
ucaaaaggaagaaaauugug

SEQ ID NO: 27756 - RNA, 20 nt, Artificial Sequence
  CIITA targeting sequence
cuccucaaaaggaagaaaau

SEQ ID NO: 27757 - RNA, 20 nt, Artificial Sequence
  CIITA targeting sequence
cccacucauucagcagaaau

SEQ ID NO: 27758 - RNA, 20 nt, Artificial Sequence
  CIITA targeting sequence
cacucauucagcagaaaugu

SEQ ID NO: 27759 - RNA, 20 nt, Artificial Sequence
  CIITA targeting sequence
uucagcagaaauguguugau

SEQ ID NO: 27760 - RNA, 20 nt, Artificial Sequence
  CIITA targeting sequence
gcagaaauguguugaucgcc

SEQ ID NO: 27761 - RNA, 20 nt, Artificial Sequence
  CIITA targeting sequence
gcugaaugagugggagaauc

SEQ ID NO: 27762 - RNA, 20 nt, Artificial Sequence
  CIITA targeting sequence
acacauuucugcugaaugag

SEQ ID NO: 27763 - RNA, 20 nt, Artificial Sequence
  CIITA targeting sequence
ccucguagguuuggugcugu

SEQ ID NO: 27764 - RNA, 20 nt, Artificial Sequence
  CIITA targeting sequence
uagguuuggugcuguccugg

SEQ ID NO: 27765 - RNA, 20 nt, Artificial Sequence
  CIITA targeting sequence
uggggacacagcuggggauc

SEQ ID NO: 27766 - RNA, 20 nt, Artificial Sequence
  CIITA targeting sequence
ccaggacagcaccaaaccua

SEQ ID NO: 27767 - RNA, 20 nt, Artificial Sequence
  CIITA targeting sequence
ccagcuguguccccaggaca

SEQ ID NO: 27768 - RNA, 20 nt, Artificial Sequence
  CIITA targeting sequence
ggcguggucacugcucuagu

SEQ ID NO: 27769 - RNA, 20 nt, Artificial Sequence
  CIITA targeting sequence
cugcucuaguggaguuuagc

SEQ ID NO: 27770 - RNA, 20 nt, Artificial Sequence
  CIITA targeting sequence
aguggaguuuagcuuuacug

SEQ ID NO: 27771 - RNA, 20 nt, Artificial Sequence
  CIITA targeting sequence
acuagagcagugaccacgcc

SEQ ID NO: 27772 - RNA, 20 nt, Artificial Sequence
  CIITA targeting sequence
ccaguaaagcuaaacuccac

SEQ ID NO: 27773 - RNA, 20 nt, Artificial Sequence
  CIITA targeting sequence
cguguuuguuuccccaguaa

SEQ ID NO: 27774 - RNA, 20 nt, Artificial Sequence
  CIITA targeting sequence
cagcacuuaaagcugcggug

SEQ ID NO: 27775 - RNA, 20 nt, Artificial Sequence
  CIITA targeting sequence
gugcuucacagcacuuaaag

SEQ ID NO: 27776 - RNA, 20 nt, Artificial Sequence
  CIITA targeting sequence
aggaugagaggacccaggga

SEQ ID NO: 27777 - RNA, 20 nt, Artificial Sequence
  CIITA targeting sequence
uggaaucugugcuucacagc

SEQ ID NO: 27778 - RNA, 20 nt, Artificial Sequence
  CIITA targeting sequence
uccuggaaucugugcuucac

SEQ ID NO: 27779 - RNA, 20 nt, Artificial Sequence
  CIITA targeting sequence
cauccuggaaucugugcuuc

SEQ ID NO: 27780 - RNA, 20 nt, Artificial Sequence
  CIITA targeting sequence
ucucauccuggaaucugugc

SEQ ID NO: 27781 - RNA, 20 nt, Artificial Sequence
  CIITA targeting sequence
cuggguccucucauccugga

SEQ ID NO: 27782 - RNA, 20 nt, Artificial Sequence
  CIITA targeting sequence
gaaggaccuuaaaaagcagg

SEQ ID NO: 27783 - RNA, 20 nt, Artificial Sequence
  CIITA targeting sequence
gagcaggcucccuggguccu

SEQ ID NO: 27784 - RNA, 20 nt, Artificial Sequence
  CIITA targeting sequence
uucugagcaggcucccuggg

SEQ ID NO: 27785 - RNA, 20 nt, Artificial Sequence
  CIITA targeting sequence
ugcuuuuuaagguccuucug

SEQ ID NO: 27786 - RNA, 20 nt, Artificial Sequence
  CIITA targeting sequence
ugccuccugcuuuuuaaggu

SEQ ID NO: 27787 - RNA, 20 nt, Artificial Sequence
  CIITA targeting sequence
uccugccuccugcuuuuuaa

SEQ ID NO: 27788 - RNA, 20 nt, Artificial Sequence
  CIITA targeting sequence
uuuuuuucccccuuuuuuuu

SEQ ID NO: 27789 - RNA, 20 nt, Artificial Sequence
  CIITA targeting sequence
cccuuuuuuuuuagacagag

SEQ ID NO: 27790 - RNA, 20 nt, Artificial Sequence
  CIITA targeting sequence
aaaaaaaaagggggaaaaaa

SEQ ID NO: 27791 - RNA, 20 nt, Artificial Sequence
  CIITA targeting sequence
gucuaaaaaaaaagggggaa

SEQ ID NO: 27792 - RNA, 20 nt, Artificial Sequence
  CIITA targeting sequence
ugcuguguagcccagaccag

SEQ ID NO: 27793 - RNA, 20 nt, Artificial Sequence
  CIITA targeting sequence
gggcuacacagcaagacucu

SEQ ID NO: 27794 - RNA, 20 nt, Artificial Sequence
  CIITA targeting sequence
ggucugggcuacacagcaag

SEQ ID NO: 27795 - RNA, 20 nt, Artificial Sequence
  CIITA targeting sequence
caccacugcacucuggucug

SEQ ID NO: 27796 - RNA, 20 nt, Artificial Sequence
  CIITA targeting sequence
cggcucacugcaacuuucac

SEQ ID NO: 27797 - RNA, 20 nt, Artificial Sequence
  CIITA targeting sequence
gcucacugcaacuuucaccu

SEQ ID NO: 27798 - RNA, 20 nt, Artificial Sequence
  CIITA targeting sequence
cugcaacuuucaccucucag

SEQ ID NO: 27799 - RNA, 20 nt, Artificial Sequence
  CIITA targeting sequence
ccucucagguucaagcgauu

SEQ ID NO: 27800 - RNA, 20 nt, Artificial Sequence
  CIITA targeting sequence
cagguucaagcgauucucgu

SEQ ID NO: 27801 - RNA, 20 nt, Artificial Sequence
  CIITA targeting sequence
gguucaagcgauucucgugc

SEQ ID NO: 27802 - RNA, 20 nt, Artificial Sequence
  CIITA targeting sequence
agcgauucucgugccucagu

SEQ ID NO: 27803 - RNA, 20 nt, Artificial Sequence
  CIITA targeting sequence
cuugaaccugagaggugaaa

SEQ ID NO: 27804 - RNA, 20 nt, Artificial Sequence
  CIITA targeting sequence
cgugccucagucucccgagu

SEQ ID NO: 27805 - RNA, 20 nt, Artificial Sequence
  CIITA targeting sequence
ugccucagucucccgaguac

SEQ ID NO: 27806 - RNA, 20 nt, Artificial Sequence
  CIITA targeting sequence
gucucccgaguaccugggac

SEQ ID NO: 27807 - RNA, 20 nt, Artificial Sequence
  CIITA targeting sequence
cccgaguaccugggacuaca

SEQ ID NO: 27808 - RNA, 20 nt, Artificial Sequence
  CIITA targeting sequence
cgaguaccugggacuacagg

SEQ ID NO: 27809 - RNA, 20 nt, Artificial Sequence
  CIITA targeting sequence
ggagacugaggcacgagaau

SEQ ID NO: 27810 - RNA, 20 nt, Artificial Sequence
  CIITA targeting sequence
cagguacucgggagacugag

SEQ ID NO: 27811 - RNA, 20 nt, Artificial Sequence
  CIITA targeting sequence
acuaaaaauauaaaaauuag

SEQ ID NO: 27812 - RNA, 20 nt, Artificial Sequence
  CIITA targeting sequence
gguucuacuaaaaauauaaa

SEQ ID NO: 27813 - RNA, 20 nt, Artificial Sequence
  CIITA targeting sequence
ccauguugaccagguugguc

SEQ ID NO: 27814 - RNA, 20 nt, Artificial Sequence
  CIITA targeting sequence
acauggugaaacucugguuc

SEQ ID NO: 27815 - RNA, 20 nt, Artificial Sequence
  CIITA targeting sequence
cgaacuccugaccucaagug

SEQ ID NO: 27816 - RNA, 20 nt, Artificial Sequence
  CIITA targeting sequence
aacuccugaccucaagugau

SEQ ID NO: 27817 - RNA, 20 nt, Artificial Sequence
  CIITA targeting sequence
agaccaaccuggucaacaug

SEQ ID NO: 27818 - RNA, 20 nt, Artificial Sequence
  CIITA targeting sequence
ugaccucaagugaugcaucu

SEQ ID NO: 27819 - RNA, 20 nt, Artificial Sequence
  CIITA targeting sequence
ggaguucgagaccaaccugg

SEQ ID NO: 27820 - RNA, 20 nt, Artificial Sequence
  CIITA targeting sequence
agugaugcaucugccugggc

SEQ ID NO: 27821 - RNA, 20 nt, Artificial Sequence
  CIITA targeting sequence
cuugaggucaggaguucgag

SEQ ID NO: 27822 - RNA, 20 nt, Artificial Sequence
  CIITA targeting sequence
gccugggccucccaaagugc

SEQ ID NO: 27823 - RNA, 20 nt, Artificial Sequence
  CIITA targeting sequence
caaagugcugggauuacagg

SEQ ID NO: 27824 - RNA, 20 nt, Artificial Sequence
  CIITA targeting sequence
cagcacuuugggaggcccag

SEQ ID NO: 27825 - RNA, 20 nt, Artificial Sequence
  CIITA targeting sequence
ugccuguaaucccagcacuu

SEQ ID NO: 27826 - RNA, 20 nt, Artificial Sequence
  CIITA targeting sequence
cccuuggccaggugcagugg

SEQ ID NO: 27827 - RNA, 20 nt, Artificial Sequence
  CIITA targeting sequence
cccccuuggccaggugcagu

SEQ ID NO: 27828 - RNA, 20 nt, Artificial Sequence
  CIITA targeting sequence
ugaaggaguucagagagaga

SEQ ID NO: 27829 - RNA, 20 nt, Artificial Sequence
  CIITA targeting sequence
agauucucccccuuggccag

SEQ ID NO: 27830 - RNA, 20 nt, Artificial Sequence
  CIITA targeting sequence
uucaagauucucccccuugg

SEQ ID NO: 27831 - RNA, 20 nt, Artificial Sequence
  CIITA targeting sequence
gagagagacuuggauuugau

SEQ ID NO: 27832 - RNA, 20 nt, Artificial Sequence
  CIITA targeting sequence
gaacuccuucaagauucucc

SEQ ID NO: 27833 - RNA, 20 nt, Artificial Sequence
  CIITA targeting sequence
cugaacuccuucaagauucu

SEQ ID NO: 27834 - RNA, 20 nt, Artificial Sequence
  CIITA targeting sequence
cucugaacuccuucaagauu

SEQ ID NO: 27835 - RNA, 20 nt, Artificial Sequence
  CIITA targeting sequence
cucucugaacuccuucaaga

SEQ ID NO: 27836 - RNA, 20 nt, Artificial Sequence
  CIITA targeting sequence
aagucucucucugaacuccu

SEQ ID NO: 27837 - RNA, 20 nt, Artificial Sequence
  CIITA targeting sequence
aauccaagucucucucugaa

SEQ ID NO: 27838 - RNA, 20 nt, Artificial Sequence
  CIITA targeting sequence
uggauccaugcggugugacc

SEQ ID NO: 27839 - RNA, 20 nt, Artificial Sequence
  CIITA targeting sequence
aagaaucaaauccaagucuc

SEQ ID NO: 27840 - RNA, 20 nt, Artificial Sequence
  CIITA targeting sequence
augcggugugaccuucagca

SEQ ID NO: 27841 - RNA, 20 nt, Artificial Sequence
  CIITA targeting sequence
caccgcauggauccaagaau

SEQ ID NO: 27842 - RNA, 20 nt, Artificial Sequence
  CIITA targeting sequence
gcaauaguccuaaccucucu

SEQ ID NO: 27843 - RNA, 20 nt, Artificial Sequence
  CIITA targeting sequence
uaaccucucugagcuucugg

SEQ ID NO: 27844 - RNA, 20 nt, Artificial Sequence
  CIITA targeting sequence
cugagcuucugguuccucau

SEQ ID NO: 27845 - RNA, 20 nt, Artificial Sequence
  CIITA targeting sequence
gagcuucugguuccucauca

SEQ ID NO: 27846 - RNA, 20 nt, Artificial Sequence
  CIITA targeting sequence
gagagguuaggacuauugcu

SEQ ID NO: 27847 - RNA, 20 nt, Artificial Sequence
  CIITA targeting sequence
gguuccucaucaaaaaugga

SEQ ID NO: 27848 - RNA, 20 nt, Artificial Sequence
  CIITA targeting sequence
ucaucaaaaauggagacagg

SEQ ID NO: 27849 - RNA, 20 nt, Artificial Sequence
  CIITA targeting sequence
ucaaaaauggagacaggccg

SEQ ID NO: 27850 - RNA, 20 nt, Artificial Sequence
  CIITA targeting sequence
aaaauggagacaggccgggu

SEQ ID NO: 27851 - RNA, 20 nt, Artificial Sequence
  CIITA targeting sequence
auuuuugaugaggaaccaga

SEQ ID NO: 27852 - RNA, 20 nt, Artificial Sequence
  CIITA targeting sequence
ccauuuuugaugaggaacca

SEQ ID NO: 27853 - RNA, 20 nt, Artificial Sequence
  CIITA targeting sequence
cgccuguaaucccagcacuu

SEQ ID NO: 27854 - RNA, 20 nt, Artificial Sequence
  CIITA targeting sequence
cagcacuuugggaggccgag

SEQ ID NO: 27855 - RNA, 20 nt, Artificial Sequence
  CIITA targeting sequence
caaagugcugggauuacagg

SEQ ID NO: 27856 - RNA, 20 nt, Artificial Sequence
  CIITA targeting sequence
gccucccaaagugcugggau

SEQ ID NO: 27857 - RNA, 20 nt, Artificial Sequence
  CIITA targeting sequence
acccgccucggccucccaaa

SEQ ID NO: 27858 - RNA, 20 nt, Artificial Sequence
  CIITA targeting sequence
auccacccgccucggccucc

SEQ ID NO: 27859 - RNA, 20 nt, Artificial Sequence
  CIITA targeting sequence
cuugaggucaggaguucgag

SEQ ID NO: 27860 - RNA, 20 nt, Artificial Sequence
  CIITA targeting sequence
agugauccauccacccgccu

SEQ ID NO: 27861 - RNA, 20 nt, Artificial Sequence
  CIITA targeting sequence
ggaguucgagaccagccugg

SEQ ID NO: 27862 - RNA, 20 nt, Artificial Sequence
  CIITA targeting sequence
ugaccucaagugauccaucc

SEQ ID NO: 27863 - RNA, 20 nt, Artificial Sequence
  CIITA targeting sequence
agaccagccuggccaacaug

SEQ ID NO: 27864 - RNA, 20 nt, Artificial Sequence
  CIITA targeting sequence
aacuccugaccucaagugau

SEQ ID NO: 27865 - RNA, 20 nt, Artificial Sequence
  CIITA targeting sequence
cgaacuccugaccucaagug

SEQ ID NO: 27866 - RNA, 20 nt, Artificial Sequence
  CIITA targeting sequence
ccauguuggccaggcugguc

SEQ ID NO: 27867 - RNA, 20 nt, Artificial Sequence
  CIITA targeting sequence
cuacuaaaaauacaaaaauu

SEQ ID NO: 27868 - RNA, 20 nt, Artificial Sequence
  CIITA targeting sequence
acuaaaaauacaaaaauuag

SEQ ID NO: 27869 - RNA, 20 nt, Artificial Sequence
  CIITA targeting sequence
aggcugaggugggaggauca

SEQ ID NO: 27870 - RNA, 20 nt, Artificial Sequence
  CIITA targeting sequence
agggcgggcaugcaccacca

SEQ ID NO: 27871 - RNA, 20 nt, Artificial Sequence
  CIITA targeting sequence
gccucgagggcgggcaugca

SEQ ID NO: 27872 - RNA, 20 nt, Artificial Sequence
  CIITA targeting sequence
caccucagccucgagggcgg

SEQ ID NO: 27873 - RNA, 20 nt, Artificial Sequence
  CIITA targeting sequence
ucccaccucagccucgaggg

SEQ ID NO: 27874 - RNA, 20 nt, Artificial Sequence
  CIITA targeting sequence
cuugaacccgggagguggag

SEQ ID NO: 27875 - RNA, 20 nt, Artificial Sequence
  CIITA targeting sequence
agugauccucccaccucagc

SEQ ID NO: 27876 - RNA, 20 nt, Artificial Sequence
  CIITA targeting sequence
cggguucaagugauccuccc

SEQ ID NO: 27877 - RNA, 20 nt, Artificial Sequence
  CIITA targeting sequence
accucccggguucaagugau

SEQ ID NO: 27878 - RNA, 20 nt, Artificial Sequence
  CIITA targeting sequence
cugcaaccuccaccucccgg

SEQ ID NO: 27879 - RNA, 20 nt, Artificial Sequence
  CIITA targeting sequence
gcucacugcaaccuccaccu

SEQ ID NO: 27880 - RNA, 20 nt, Artificial Sequence
  CIITA targeting sequence
cagcucacugcaaccuccac

SEQ ID NO: 27881 - RNA, 20 nt, Artificial Sequence
  CIITA targeting sequence
ugccacugcacuccagccug

SEQ ID NO: 27882 - RNA, 20 nt, Artificial Sequence
  CIITA targeting sequence
agccugggugacagagugag

SEQ ID NO: 27883 - RNA, 20 nt, Artificial Sequence
  CIITA targeting sequence
cccaggcuggagugcagugg

SEQ ID NO: 27884 - RNA, 20 nt, Artificial Sequence
  CIITA targeting sequence
gucacccaggcuggagugca

SEQ ID NO: 27885 - RNA, 20 nt, Artificial Sequence
  CIITA targeting sequence
cucugucacccaggcuggag

SEQ ID NO: 27886 - RNA, 20 nt, Artificial Sequence
  CIITA targeting sequence
cacucugucacccaggcugg

SEQ ID NO: 27887 - RNA, 20 nt, Artificial Sequence
  CIITA targeting sequence
caaagaaaaaaaaaaaugaa

SEQ ID NO: 27888 - RNA, 20 nt, Artificial Sequence
  CIITA targeting sequence
aagaaaaaaaaaaaugaaga

SEQ ID NO: 27889 - RNA, 20 nt, Artificial Sequence
  CIITA targeting sequence
uugagacagggucucacucu

SEQ ID NO: 27890 - RNA, 20 nt, Artificial Sequence
  CIITA targeting sequence
uuuuuuuuuuucuuugagac

SEQ ID NO: 27891 - RNA, 20 nt, Artificial Sequence
  CIITA targeting sequence
ucauuuuuuuuuuucuuuga

SEQ ID NO: 27892 - RNA, 20 nt, Artificial Sequence
  CIITA targeting sequence
cuucauuuuuuuuuuucuuu

SEQ ID NO: 27893 - RNA, 20 nt, Artificial Sequence
  CIITA targeting sequence
cugucaaugcaauggagaga

SEQ ID NO: 27894 - RNA, 20 nt, Artificial Sequence
  CIITA targeting sequence
gucaaugcaauggagagacu

SEQ ID NO: 27895 - RNA, 20 nt, Artificial Sequence
  CIITA targeting sequence
augcaauggagagacugaac

SEQ ID NO: 27896 - RNA, 20 nt, Artificial Sequence
  CIITA targeting sequence
auugcauugacagagauaac

SEQ ID NO: 27897 - RNA, 20 nt, Artificial Sequence
  CIITA targeting sequence
ccauugcauugacagagaua

SEQ ID NO: 27898 - RNA, 20 nt, Artificial Sequence
  CIITA targeting sequence
cuccauugcauugacagaga

SEQ ID NO: 27899 - RNA, 20 nt, Artificial Sequence
  CIITA targeting sequence
gucucuccauugcauugaca

SEQ ID NO: 27900 - RNA, 20 nt, Artificial Sequence
  CIITA targeting sequence
guucagucucuccauugcau

SEQ ID NO: 27901 - RNA, 20 nt, Artificial Sequence
  CIITA targeting sequence
guggagguuuauugggccag

SEQ ID NO: 27902 - RNA, 20 nt, Artificial Sequence
  CIITA targeting sequence
acugaggcucaguucagucu

SEQ ID NO: 27903 - RNA, 20 nt, Artificial Sequence
  CIITA targeting sequence
ggcccaauaaaccuccacug

SEQ ID NO: 27904 - RNA, 20 nt, Artificial Sequence
  CIITA targeting sequence
agcucuggcccaauaaaccu

SEQ ID NO: 27905 - RNA, 20 nt, Artificial Sequence
  CIITA targeting sequence
agggcacgcccucaagcucu

SEQ ID NO: 27906 - RNA, 20 nt, Artificial Sequence
  CIITA targeting sequence
cuuguauuuuccagggcacg

SEQ ID NO: 27907 - RNA, 20 nt, Artificial Sequence
  CIITA targeting sequence
gucacuuguauuuuccaggg

SEQ ID NO: 27908 - RNA, 20 nt, Artificial Sequence
  CIITA targeting sequence
guggccugugcucgauggag

SEQ ID NO: 27909 - RNA, 20 nt, Artificial Sequence
  CIITA targeting sequence
auggagugguuccagaaggc

SEQ ID NO: 27910 - RNA, 20 nt, Artificial Sequence
  CIITA targeting sequence
agcacaggccacagauguuu

SEQ ID NO: 27911 - RNA, 20 nt, Artificial Sequence
  CIITA targeting sequence
aucgagcacaggccacagau

SEQ ID NO: 27912 - RNA, 20 nt, Artificial Sequence
  CIITA targeting sequence
agaaggcugguguuuauaua

SEQ ID NO: 27913 - RNA, 20 nt, Artificial Sequence
  CIITA targeting sequence
ggaaccacuccaucgagcac

SEQ ID NO: 27914 - RNA, 20 nt, Artificial Sequence
  CIITA targeting sequence
uuaaaaggggaaaaagcaug

SEQ ID NO: 27915 - RNA, 20 nt, Artificial Sequence
  CIITA targeting sequence
ccuuuuaaugaaauauauaa

SEQ ID NO: 27916 - RNA, 20 nt, Artificial Sequence
  CIITA targeting sequence
ugcaugcuuuuuccccuuuu

SEQ ID NO: 27917 - RNA, 20 nt, Artificial Sequence
  CIITA targeting sequence
uggcagguaguuacauucuu

SEQ ID NO: 27918 - RNA, 20 nt, Artificial Sequence
  CIITA targeting sequence
ugugagguuuuaauucgugc

SEQ ID NO: 27919 - RNA, 20 nt, Artificial Sequence
  CIITA targeting sequence
caagaauguaacuaccugcc

SEQ ID NO: 27920 - RNA, 20 nt, Artificial Sequence
  CIITA targeting sequence
ugcccaguauaucuacacua

SEQ ID NO: 27921 - RNA, 20 nt, Artificial Sequence
  CIITA targeting sequence
acacuauucagaaaauaaag

SEQ ID NO: 27922 - RNA, 20 nt, Artificial Sequence
  CIITA targeting sequence
gaaaauaaaguaaacauuca

SEQ ID NO: 27923 - RNA, 20 nt, Artificial Sequence
  CIITA targeting sequence
gaauaguguagauauacugg

SEQ ID NO: 27924 - RNA, 20 nt, Artificial Sequence
  CIITA targeting sequence
aaagagggaauaaaggaaga

SEQ ID NO: 27925 - RNA, 20 nt, Artificial Sequence
  CIITA targeting sequence
uuugaauguuuacuuuauuu

SEQ ID NO: 27926 - RNA, 20 nt, Artificial Sequence
  CIITA targeting sequence
cucuuuugaauguuuacuuu

SEQ ID NO: 27927 - RNA, 20 nt, Artificial Sequence
  CIITA targeting sequence
uuuauucccucuuuugaaug

SEQ ID NO: 27928 - RNA, 20 nt, Artificial Sequence
  CIITA targeting sequence
uccuuuauucccucuuuuga

SEQ ID NO: 27929 - RNA, 20 nt, Artificial Sequence
  CIITA targeting sequence
gccuaauuaauucuuccuuu

SEQ ID NO: 27930 - RNA, 20 nt, Artificial Sequence
  CIITA targeting sequence
caggguaggagaggaaggac

SEQ ID NO: 27931 - RNA, 20 nt, Artificial Sequence
  CIITA targeting sequence
ggguaggagaggaaggacua

SEQ ID NO: 27932 - RNA, 20 nt, Artificial Sequence
  CIITA targeting sequence
uacccugagacgucugccua

SEQ ID NO: 27933 - RNA, 20 nt, Artificial Sequence
  CIITA targeting sequence
ccuacccugagacgucugcc

SEQ ID NO: 27934 - RNA, 20 nt, Artificial Sequence
  CIITA targeting sequence
ucuccuacccugagacgucu

SEQ ID NO: 27935 - RNA, 20 nt, Artificial Sequence
  CIITA targeting sequence
uuccucuccuacccugagac

SEQ ID NO: 27936 - RNA, 20 nt, Artificial Sequence
  CIITA targeting sequence
caucccaucuuuguuuggca

SEQ ID NO: 27937 - RNA, 20 nt, Artificial Sequence
  CIITA targeting sequence
ucccaucuuuguuuggcaug

SEQ ID NO: 27938 - RNA, 20 nt, Artificial Sequence
  CIITA targeting sequence
caucuuuguuuggcaugugg

SEQ ID NO: 27939 - RNA, 20 nt, Artificial Sequence
  CIITA targeting sequence
uuguuuggcaugugggagga

SEQ ID NO: 27940 - RNA, 20 nt, Artificial Sequence
  CIITA targeting sequence
cacaugccaaacaaagaugg

SEQ ID NO: 27941 - RNA, 20 nt, Artificial Sequence
  CIITA targeting sequence
ucccacaugccaaacaaaga

SEQ ID NO: 27942 - RNA, 20 nt, Artificial Sequence
  CIITA targeting sequence
auuacaagcuuauccuccca

SEQ ID NO: 27943 - RNA, 20 nt, Artificial Sequence
  CIITA targeting sequence
guguggcguuuaacagacau

SEQ ID NO: 27944 - RNA, 20 nt, Artificial Sequence
  CIITA targeting sequence
guuaaacgccacacugacca

SEQ ID NO: 27945 - RNA, 20 nt, Artificial Sequence
  CIITA targeting sequence
guaauagggaaggaguuaga

SEQ ID NO: 27946 - RNA, 20 nt, Artificial Sequence
  CIITA targeting sequence
cuauuacugaugucuguuaa

SEQ ID NO: 27947 - RNA, 20 nt, Artificial Sequence
  CIITA targeting sequence
uucccuauuacugaugucug

SEQ ID NO: 27948 - RNA, 20 nt, Artificial Sequence
  CIITA targeting sequence
aacuccuucccuauuacuga

SEQ ID NO: 27949 - RNA, 20 nt, Artificial Sequence
  CIITA targeting sequence
gucuaacuccuucccuauua

SEQ ID NO: 27950 - RNA, 20 nt, Artificial Sequence
  CIITA targeting sequence
uaaaguuacaguuggcaugu

SEQ ID NO: 27951 - RNA, 20 nt, Artificial Sequence
  CIITA targeting sequence
uuguuuaugggaggauacuc

SEQ ID NO: 27952 - RNA, 20 nt, Artificial Sequence
  CIITA targeting sequence
cauaaacaaggacaugccaa

SEQ ID NO: 27953 - RNA, 20 nt, Artificial Sequence
  CIITA targeting sequence
ucccauaaacaaggacaugc

SEQ ID NO: 27954 - RNA, 20 nt, Artificial Sequence
  CIITA targeting sequence
ucuucaaagauuuaggggcc

SEQ ID NO: 27955 - RNA, 20 nt, Artificial Sequence
  CIITA targeting sequence
ucaaagauuuaggggccagc

SEQ ID NO: 27956 - RNA, 20 nt, Artificial Sequence
  CIITA targeting sequence
aagauuuaggggccagcaaa

SEQ ID NO: 27957 - RNA, 20 nt, Artificial Sequence
  CIITA targeting sequence
uugaagaugaguauccuccc

SEQ ID NO: 27958 - RNA, 20 nt, Artificial Sequence
  CIITA targeting sequence
uuugcuggccccuaaaucuu

SEQ ID NO: 27959 - RNA, 20 nt, Artificial Sequence
  CIITA targeting sequence
uuaggagcaacuugugaggg

SEQ ID NO: 27960 - RNA, 20 nt, Artificial Sequence
  CIITA targeting sequence
uaaggaacuccuuugcuggc

SEQ ID NO: 27961 - RNA, 20 nt, Artificial Sequence
  CIITA targeting sequence
caaguugcuccuaaggaacu

SEQ ID NO: 27962 - RNA, 20 nt, Artificial Sequence
  CIITA targeting sequence
ucccacaauggauugcaugg

SEQ ID NO: 27963 - RNA, 20 nt, Artificial Sequence
  CIITA targeting sequence
cacaauggauugcauggggc

SEQ ID NO: 27964 - RNA, 20 nt, Artificial Sequence
  CIITA targeting sequence
auugugggaugacugcccuc

SEQ ID NO: 27965 - RNA, 20 nt, Artificial Sequence
  CIITA targeting sequence
gguuaauguagaaugcuuug

SEQ ID NO: 27966 - RNA, 20 nt, Artificial Sequence
  CIITA targeting sequence
acauuaaccagacaccugca

SEQ ID NO: 27967 - RNA, 20 nt, Artificial Sequence
  CIITA targeting sequence
aagcauucuacauuaaccag

SEQ ID NO: 27968 - RNA, 20 nt, Artificial Sequence
  CIITA targeting sequence
caaccuugugucaaagcauu

SEQ ID NO: 27969 - RNA, 20 nt, Artificial Sequence
  CIITA targeting sequence
guugauggggaggaggacag

SEQ ID NO: 27970 - RNA, 20 nt, Artificial Sequence
  CIITA targeting sequence
acagacagcuguuacuuccc

SEQ ID NO: 27971 - RNA, 20 nt, Artificial Sequence
  CIITA targeting sequence
ccaucaacagacagcuguua

SEQ ID NO: 27972 - RNA, 20 nt, Artificial Sequence
  CIITA targeting sequence
uccccaucaacagacagcug

SEQ ID NO: 27973 - RNA, 20 nt, Artificial Sequence
  CIITA targeting sequence
uccuccccaucaacagacag

SEQ ID NO: 27974 - RNA, 20 nt, Artificial Sequence
  CIITA targeting sequence
acaccacugcugugaccuug

SEQ ID NO: 27975 - RNA, 20 nt, Artificial Sequence
  CIITA targeting sequence
cagcagugguguagauggag

SEQ ID NO: 27976 - RNA, 20 nt, Artificial Sequence
  CIITA targeting sequence
gccuccguuuucucaucuau

SEQ ID NO: 27977 - RNA, 20 nt, Artificial Sequence
  CIITA targeting sequence
guuuucucaucuauaaaaug

SEQ ID NO: 27978 - RNA, 20 nt, Artificial Sequence
  CIITA targeting sequence
caucuauaaaaugggacucc

SEQ ID NO: 27979 - RNA, 20 nt, Artificial Sequence
  CIITA targeting sequence
ucuauaaaaugggacuccaa

SEQ ID NO: 27980 - RNA, 20 nt, Artificial Sequence
  CIITA targeting sequence
auaaaaugggacuccaagga

SEQ ID NO: 27981 - RNA, 20 nt, Artificial Sequence
  CIITA targeting sequence
cauuuuauagaugagaaaac

SEQ ID NO: 27982 - RNA, 20 nt, Artificial Sequence
  CIITA targeting sequence
aaggacugagugagauggca

SEQ ID NO: 27983 - RNA, 20 nt, Artificial Sequence
  CIITA targeting sequence
uuggagucccauuuuauaga

SEQ ID NO: 27984 - RNA, 20 nt, Artificial Sequence
  CIITA targeting sequence
guccuuggagucccauuuua

SEQ ID NO: 27985 - RNA, 20 nt, Artificial Sequence
  CIITA targeting sequence
cucaguccuuggagucccau

SEQ ID NO: 27986 - RNA, 20 nt, Artificial Sequence
  CIITA targeting sequence
cacucaguccuuggaguccc

SEQ ID NO: 27987 - RNA, 20 nt, Artificial Sequence
  CIITA targeting sequence
ggccccgugcuaagugcuuu

SEQ ID NO: 27988 - RNA, 20 nt, Artificial Sequence
  CIITA targeting sequence
ucgggccccgugcuaagugc

SEQ ID NO: 27989 - RNA, 20 nt, Artificial Sequence
  CIITA targeting sequence
augcucaguaaaggucugug

SEQ ID NO: 27990 - RNA, 20 nt, Artificial Sequence
  CIITA targeting sequence
guaaaggucugugauggcca

SEQ ID NO: 27991 - RNA, 20 nt, Artificial Sequence
  CIITA targeting sequence
gugauggccaccauuuuuau

SEQ ID NO: 27992 - RNA, 20 nt, Artificial Sequence
  CIITA targeting sequence
cagaccuuuacugagcauug

SEQ ID NO: 27993 - RNA, 20 nt, Artificial Sequence
  CIITA targeting sequence
cucucuggauaugaagggau

SEQ ID NO: 27994 - RNA, 20 nt, Artificial Sequence
  CIITA targeting sequence
cuggauaugaagggaugaug

SEQ ID NO: 27995 - RNA, 20 nt, Artificial Sequence
  CIITA targeting sequence
ggauaugaagggaugaugau

SEQ ID NO: 27996 - RNA, 20 nt, Artificial Sequence
  CIITA targeting sequence
agagagugaaauaaaguaau

SEQ ID NO: 27997 - RNA, 20 nt, Artificial Sequence
  CIITA targeting sequence
uauccagagagugaaauaaa

SEQ ID NO: 27998 - RNA, 20 nt, Artificial Sequence
  CIITA targeting sequence
cuucauauccagagagugaa

SEQ ID NO: 27999 - RNA, 20 nt, Artificial Sequence
  CIITA targeting sequence
ucccuucauauccagagagu

SEQ ID NO: 28000 - RNA, 20 nt, Artificial Sequence
  CIITA targeting sequence
ucaucccuucauauccagag

SEQ ID NO: 28001 - RNA, 20 nt, Artificial Sequence
  CIITA targeting sequence
gccuuagagaugaguuugua

SEQ ID NO: 28002 - RNA, 20 nt, Artificial Sequence
  CIITA targeting sequence
aaggcagauguaaucaucau

SEQ ID NO: 28003 - RNA, 20 nt, Artificial Sequence
  CIITA targeting sequence
cuaaggcagauguaaucauc

SEQ ID NO: 28004 - RNA, 20 nt, Artificial Sequence
  CIITA targeting sequence
ucucuaaggcagauguaauc

SEQ ID NO: 28005 - RNA, 20 nt, Artificial Sequence
  CIITA targeting sequence
gcccaguacuauaccuuggg

SEQ ID NO: 28006 - RNA, 20 nt, Artificial Sequence
  CIITA targeting sequence
aaauacacuuguugggcagg

SEQ ID NO: 28007 - RNA, 20 nt, Artificial Sequence
  CIITA targeting sequence
cagcacuuugggaggcugag

SEQ ID NO: 28008 - RNA, 20 nt, Artificial Sequence
  CIITA targeting sequence
caaagugcugugauuacagu

SEQ ID NO: 28009 - RNA, 20 nt, Artificial Sequence
  CIITA targeting sequence
gccucccaaagugcugugau

SEQ ID NO: 28010 - RNA, 20 nt, Artificial Sequence
  CIITA targeting sequence
gccugccucagccucccaaa

SEQ ID NO: 28011 - RNA, 20 nt, Artificial Sequence
  CIITA targeting sequence
cuugaggucaggaguuugag

SEQ ID NO: 28012 - RNA, 20 nt, Artificial Sequence
  CIITA targeting sequence
agugauccgccugccucagc

SEQ ID NO: 28013 - RNA, 20 nt, Artificial Sequence
  CIITA targeting sequence
ggaguuugagaccagccugg

SEQ ID NO: 28014 - RNA, 20 nt, Artificial Sequence
  CIITA targeting sequence
ugaccucaagugauccgccu

SEQ ID NO: 28015 - RNA, 20 nt, Artificial Sequence
  CIITA targeting sequence
aacuccugaccucaagugau

SEQ ID NO: 28016 - RNA, 20 nt, Artificial Sequence
  CIITA targeting sequence
caaacuccugaccucaagug

SEQ ID NO: 28017 - RNA, 20 nt, Artificial Sequence
  CIITA targeting sequence
ccauguuggccaggcugguc

SEQ ID NO: 28018 - RNA, 20 nt, Artificial Sequence
  CIITA targeting sequence
ccacuaaaaaauacaaaaau

SEQ ID NO: 28019 - RNA, 20 nt, Artificial Sequence
  CIITA targeting sequence
acuaaaaaauacaaaaauua

SEQ ID NO: 28020 - RNA, 20 nt, Artificial Sequence
  CIITA targeting sequence
uagcuacucgggaggccgag

SEQ ID NO: 28021 - RNA, 20 nt, Artificial Sequence
  CIITA targeting sequence
ggaggccgaggcaugagaau

SEQ ID NO: 28022 - RNA, 20 nt, Artificial Sequence
  CIITA targeting sequence
cgaguagcuaagacuacagg

SEQ ID NO: 28023 - RNA, 20 nt, Artificial Sequence
  CIITA targeting sequence
gccucccgaguagcuaagac

SEQ ID NO: 28024 - RNA, 20 nt, Artificial Sequence
  CIITA targeting sequence
ugccucggccucccgaguag

SEQ ID NO: 28025 - RNA, 20 nt, Artificial Sequence
  CIITA targeting sequence
caugccucggccucccgagu

SEQ ID NO: 28026 - RNA, 20 nt, Artificial Sequence
  CIITA targeting sequence
uuugaacccaggaggcggag

SEQ ID NO: 28027 - RNA, 20 nt, Artificial Sequence
  CIITA targeting sequence
aacgauucucaugccucggc

SEQ ID NO: 28028 - RNA, 20 nt, Artificial Sequence
  CIITA targeting sequence
uggguucaaacgauucucau

SEQ ID NO: 28029 - RNA, 20 nt, Artificial Sequence
  CIITA targeting sequence
gccuccuggguucaaacgau

SEQ ID NO: 28030 - RNA, 20 nt, Artificial Sequence
  CIITA targeting sequence
cggugggccaagauugcccu

SEQ ID NO: 28031 - RNA, 20 nt, Artificial Sequence
  CIITA targeting sequence
uggcccaccgcgaccuccgc

SEQ ID NO: 28032 - RNA, 20 nt, Artificial Sequence
  CIITA targeting sequence
agccugggugacagacaaga

SEQ ID NO: 28033 - RNA, 20 nt, Artificial Sequence
  CIITA targeting sequence
cccaggcuggagugcaguag

SEQ ID NO: 28034 - RNA, 20 nt, Artificial Sequence
  CIITA targeting sequence
gucacccaggcuggagugca

SEQ ID NO: 28035 - RNA, 20 nt, Artificial Sequence
  CIITA targeting sequence
ugucugucacccaggcugga

SEQ ID NO: 28036 - RNA, 20 nt, Artificial Sequence
  CIITA targeting sequence
auuuaaaaaaaaaaaaggau

SEQ ID NO: 28037 - RNA, 20 nt, Artificial Sequence
  CIITA targeting sequence
uuuuuuuuuuuuaaauggag

SEQ ID NO: 28038 - RNA, 20 nt, Artificial Sequence
  CIITA targeting sequence
auauccuuuuuuuuuuuuaa

SEQ ID NO: 28039 - RNA, 20 nt, Artificial Sequence
  CIITA targeting sequence
aucuauauccuuuuuuuuuu

SEQ ID NO: 28040 - RNA, 20 nt, Artificial Sequence
  CIITA targeting sequence
guguaucuaucuauauccuu

SEQ ID NO: 28041 - RNA, 20 nt, Artificial Sequence
  CIITA targeting sequence
acgugugugugugugugugu

SEQ ID NO: 28042 - RNA, 20 nt, Artificial Sequence
  CIITA targeting sequence
ucauucugugagucagcgau

SEQ ID NO: 28043 - RNA, 20 nt, Artificial Sequence
  CIITA targeting sequence
uucugugagucagcgaucuc

SEQ ID NO: 28044 - RNA, 20 nt, Artificial Sequence
  CIITA targeting sequence
gugagucagcgaucucuugc

SEQ ID NO: 28045 - RNA, 20 nt, Artificial Sequence
  CIITA targeting sequence
cagaaugacgaaucaacgug

SEQ ID NO: 28046 - RNA, 20 nt, Artificial Sequence
  CIITA targeting sequence
gcgaucucuugccauuugag

SEQ ID NO: 28047 - RNA, 20 nt, Artificial Sequence
  CIITA targeting sequence
cugacucacagaaugacgaa

SEQ ID NO: 28048 - RNA, 20 nt, Artificial Sequence
  CIITA targeting sequence
cuugccauuugagggucaaa

SEQ ID NO: 28049 - RNA, 20 nt, Artificial Sequence
  CIITA targeting sequence
ugccauuugagggucaaauc

SEQ ID NO: 28050 - RNA, 20 nt, Artificial Sequence
  CIITA targeting sequence
aauggcaagagaucgcugac

SEQ ID NO: 28051 - RNA, 20 nt, Artificial Sequence
  CIITA targeting sequence
aaucuguacuggccuagugg

SEQ ID NO: 28052 - RNA, 20 nt, Artificial Sequence
  CIITA targeting sequence
guacuggccuagugggcugg

SEQ ID NO: 28053 - RNA, 20 nt, Artificial Sequence
  CIITA targeting sequence
uggccagcccacuaggccag

SEQ ID NO: 28054 - RNA, 20 nt, Artificial Sequence
  CIITA targeting sequence
gcuuucucagauugucugua

SEQ ID NO: 28055 - RNA, 20 nt, Artificial Sequence
  CIITA targeting sequence
cagauugucuguaucguuua

SEQ ID NO: 28056 - RNA, 20 nt, Artificial Sequence
  CIITA targeting sequence
gauugucuguaucguuuaga

SEQ ID NO: 28057 - RNA, 20 nt, Artificial Sequence
  CIITA targeting sequence
gagaaagcagauuucuuggc

SEQ ID NO: 28058 - RNA, 20 nt, Artificial Sequence
  CIITA targeting sequence
guaucguuuagaagaaucuu

SEQ ID NO: 28059 - RNA, 20 nt, Artificial Sequence
  CIITA targeting sequence
uuuagaagaaucuuugcuuu

SEQ ID NO: 28060 - RNA, 20 nt, Artificial Sequence
  CIITA targeting sequence
aaacgauacagacaaucuga

SEQ ID NO: 28061 - RNA, 20 nt, Artificial Sequence
  CIITA targeting sequence
ucuaaacgauacagacaauc

SEQ ID NO: 28062 - RNA, 20 nt, Artificial Sequence
  CIITA targeting sequence
uugcuuuucgaagcugucag

SEQ ID NO: 28063 - RNA, 20 nt, Artificial Sequence
  CIITA targeting sequence
aagcugucaggaauauuccu

SEQ ID NO: 28064 - RNA, 20 nt, Artificial Sequence
  CIITA targeting sequence
aaaagcaaagauucuucuaa

SEQ ID NO: 28065 - RNA, 20 nt, Artificial Sequence
  CIITA targeting sequence
ggaauauuccuaaacagcuc

SEQ ID NO: 28066 - RNA, 20 nt, Artificial Sequence
  CIITA targeting sequence
ugacagcuucgaaaagcaaa

SEQ ID NO: 28067 - RNA, 20 nt, Artificial Sequence
  CIITA targeting sequence
uaaacagcucacuggagaug

SEQ ID NO: 28068 - RNA, 20 nt, Artificial Sequence
  CIITA targeting sequence
cuggagaugggcuuucaucu

SEQ ID NO: 28069 - RNA, 20 nt, Artificial Sequence
  CIITA targeting sequence
agugagcuguuuaggaauau

SEQ ID NO: 28070 - RNA, 20 nt, Artificial Sequence
  CIITA targeting sequence
ccagugagcuguuuaggaau

SEQ ID NO: 28071 - RNA, 20 nt, Artificial Sequence
  CIITA targeting sequence
ucucaccacuugcaaguaac

SEQ ID NO: 28072 - RNA, 20 nt, Artificial Sequence
  CIITA targeting sequence
caccacuugcaaguaaccac

SEQ ID NO: 28073 - RNA, 20 nt, Artificial Sequence
  CIITA targeting sequence
ccacuugcaaguaaccacuu

SEQ ID NO: 28074 - RNA, 20 nt, Artificial Sequence
  CIITA targeting sequence
caagugguuacuugcaagug

SEQ ID NO: 28075 - RNA, 20 nt, Artificial Sequence
  CIITA targeting sequence
acucacaagugguuacuugc

SEQ ID NO: 28076 - RNA, 20 nt, Artificial Sequence
  CIITA targeting sequence
uucacuuucauguaauuacg

SEQ ID NO: 28077 - RNA, 20 nt, Artificial Sequence
  CIITA targeting sequence
cuuucauguaauuacguucu

SEQ ID NO: 28078 - RNA, 20 nt, Artificial Sequence
  CIITA targeting sequence
uguaauuacguucugaaguc

SEQ ID NO: 28079 - RNA, 20 nt, Artificial Sequence
  CIITA targeting sequence
gaagucuuugcugcaugccu

SEQ ID NO: 28080 - RNA, 20 nt, Artificial Sequence
  CIITA targeting sequence
gaacguaauuacaugaaagu

SEQ ID NO: 28081 - RNA, 20 nt, Artificial Sequence
  CIITA targeting sequence
uugcugcaugccugucuaga

SEQ ID NO: 28082 - RNA, 20 nt, Artificial Sequence
  CIITA targeting sequence
agacuuugcaguauacagaa

SEQ ID NO: 28083 - RNA, 20 nt, Artificial Sequence
  CIITA targeting sequence
agacaggcaugcagcaaaga

SEQ ID NO: 28084 - RNA, 20 nt, Artificial Sequence
  CIITA targeting sequence
guauacugcaaagucuagac

SEQ ID NO: 28085 - RNA, 20 nt, Artificial Sequence
  CIITA targeting sequence
uucuguauacugcaaagucu

SEQ ID NO: 28086 - RNA, 20 nt, Artificial Sequence
  CIITA targeting sequence
guguggaaauauggcuagau

SEQ ID NO: 28087 - RNA, 20 nt, Artificial Sequence
  CIITA targeting sequence
acacugaauggugugcuuuc

SEQ ID NO: 28088 - RNA, 20 nt, Artificial Sequence
  CIITA targeting sequence
agccauauuuccacacugaa

SEQ ID NO: 28089 - RNA, 20 nt, Artificial Sequence
  CIITA targeting sequence
gcuguauuuuuuuaugcagu

SEQ ID NO: 28090 - RNA, 20 nt, Artificial Sequence
  CIITA targeting sequence
uuuuuuuuuaaaccaccacu

SEQ ID NO: 28091 - RNA, 20 nt, Artificial Sequence
  CIITA targeting sequence
gcauuuaggaaaguguguuu

SEQ ID NO: 28092 - RNA, 20 nt, Artificial Sequence
  CIITA targeting sequence
uaaaugcugacuucuuuuuu

SEQ ID NO: 28093 - RNA, 20 nt, Artificial Sequence
  CIITA targeting sequence
ccaggcagaccuacucauga

SEQ ID NO: 28094 - RNA, 20 nt, Artificial Sequence
  CIITA targeting sequence
gccuggggaaaacacacuuu

SEQ ID NO: 28095 - RNA, 20 nt, Artificial Sequence
  CIITA targeting sequence
ugacagugacaucacuaucu

SEQ ID NO: 28096 - RNA, 20 nt, Artificial Sequence
  CIITA targeting sequence
ugaguaggucugccugggga

SEQ ID NO: 28097 - RNA, 20 nt, Artificial Sequence
  CIITA targeting sequence
cugucaugaguaggucugcc

SEQ ID NO: 28098 - RNA, 20 nt, Artificial Sequence
  CIITA targeting sequence
cuaucugcaaagugucaaca

SEQ ID NO: 28099 - RNA, 20 nt, Artificial Sequence
  CIITA targeting sequence
gcaaagugucaacacaugga

SEQ ID NO: 28100 - RNA, 20 nt, Artificial Sequence
  CIITA targeting sequence
acacauggaaaaugcugaau

SEQ ID NO: 28101 - RNA, 20 nt, Artificial Sequence
  CIITA targeting sequence
auguguugacacuuugcaga

SEQ ID NO: 28102 - RNA, 20 nt, Artificial Sequence
  CIITA targeting sequence
gcauuuuccauguguugaca

SEQ ID NO: 28103 - RNA, 20 nt, Artificial Sequence
  CIITA targeting sequence
ugauuaaagucaagcagcac

SEQ ID NO: 28104 - RNA, 20 nt, Artificial Sequence
  CIITA targeting sequence
agacauauucagcauuuucc

SEQ ID NO: 28105 - RNA, 20 nt, Artificial Sequence
  CIITA targeting sequence
agcagcacagauuucucccu

SEQ ID NO: 28106 - RNA, 20 nt, Artificial Sequence
  CIITA targeting sequence
gugcugcuugacuuuaauca

SEQ ID NO: 28107 - RNA, 20 nt, Artificial Sequence
  CIITA targeting sequence
cccugcccuaaauccagcag

SEQ ID NO: 28108 - RNA, 20 nt, Artificial Sequence
  CIITA targeting sequence
cugcccuaaauccagcaggg

SEQ ID NO: 28109 - RNA, 20 nt, Artificial Sequence
  CIITA targeting sequence
agcaggguggugggacaugc

SEQ ID NO: 28110 - RNA, 20 nt, Artificial Sequence
  CIITA targeting sequence
caccacccugcuggauuuag

SEQ ID NO: 28111 - RNA, 20 nt, Artificial Sequence
  CIITA targeting sequence
gggcaugucccaccacccug

SEQ ID NO: 28112 - RNA, 20 nt, Artificial Sequence
  CIITA targeting sequence
gccugccaucugguggaagc

SEQ ID NO: 28113 - RNA, 20 nt, Artificial Sequence
  CIITA targeting sequence
gguggaagcuuggcucuaac

SEQ ID NO: 28114 - RNA, 20 nt, Artificial Sequence
  CIITA targeting sequence
accagauggcaggcagaaaa

SEQ ID NO: 28115 - RNA, 20 nt, Artificial Sequence
  CIITA targeting sequence
aacucugugcaagaccauuc

SEQ ID NO: 28116 - RNA, 20 nt, Artificial Sequence
  CIITA targeting sequence
gugcaagaccauuccauguu

SEQ ID NO: 28117 - RNA, 20 nt, Artificial Sequence
  CIITA targeting sequence
ugcacagaguuagagccaag

SEQ ID NO: 28118 - RNA, 20 nt, Artificial Sequence
  CIITA targeting sequence
auguuagcgcuugaggcagg

SEQ ID NO: 28119 - RNA, 20 nt, Artificial Sequence
  CIITA targeting sequence
agcgcuaacauggaaugguc

SEQ ID NO: 28120 - RNA, 20 nt, Artificial Sequence
  CIITA targeting sequence
ucucauuggcacaaagggcc

SEQ ID NO: 28121 - RNA, 20 nt, Artificial Sequence
  CIITA targeting sequence
cauuggcacaaagggccuug

SEQ ID NO: 28122 - RNA, 20 nt, Artificial Sequence
  CIITA targeting sequence
uuggcacaaagggccuugga

SEQ ID NO: 28123 - RNA, 20 nt, Artificial Sequence
  CIITA targeting sequence
aaggcccuuugugccaauga

SEQ ID NO: 28124 - RNA, 20 nt, Artificial Sequence
  CIITA targeting sequence
agagagagcagaauuagaaa

SEQ ID NO: 28125 - RNA, 20 nt, Artificial Sequence
  CIITA targeting sequence
ugauccaaggcccuuugugc

SEQ ID NO: 28126 - RNA, 20 nt, Artificial Sequence
  CIITA targeting sequence
cuugauccaaggcccuuugu

SEQ ID NO: 28127 - RNA, 20 nt, Artificial Sequence
  CIITA targeting sequence
cucuugauccaaggcccuuu

SEQ ID NO: 28128 - RNA, 20 nt, Artificial Sequence
  CIITA targeting sequence
gcucucucuugauccaaggc

SEQ ID NO: 28129 - RNA, 20 nt, Artificial Sequence
  CIITA targeting sequence
aauucugcucucucuugauc

SEQ ID NO: 28130 - RNA, 20 nt, Artificial Sequence
  CIITA targeting sequence
gggguguuuucuaauucugc

SEQ ID NO: 28131 - RNA, 20 nt, Artificial Sequence
  CIITA targeting sequence
ucagggguguuuucuaauuc

SEQ ID NO: 28132 - RNA, 20 nt, Artificial Sequence
  CIITA targeting sequence
caggcugcccagggagugug

SEQ ID NO: 28133 - RNA, 20 nt, Artificial Sequence
  CIITA targeting sequence
cugggcagccugugacucgu

SEQ ID NO: 28134 - RNA, 20 nt, Artificial Sequence
  CIITA targeting sequence
ccacaacuuacacacucccu

SEQ ID NO: 28135 - RNA, 20 nt, Artificial Sequence
  CIITA targeting sequence
gccuucaccacaacuuacac

SEQ ID NO: 28136 - RNA, 20 nt, Artificial Sequence
  CIITA targeting sequence
uucugccuucaccacaacuu

SEQ ID NO: 28137 - RNA, 20 nt, Artificial Sequence
  CIITA targeting sequence
guagcauaagccugagccau

SEQ ID NO: 28138 - RNA, 20 nt, Artificial Sequence
  CIITA targeting sequence
ggcuuaugcuacagaggcuc

SEQ ID NO: 28139 - RNA, 20 nt, Artificial Sequence
  CIITA targeting sequence
uggcucaggcuuaugcuaca

SEQ ID NO: 28140 - RNA, 20 nt, Artificial Sequence
  CIITA targeting sequence
cauggcucaggcuuaugcua

SEQ ID NO: 28141 - RNA, 20 nt, Artificial Sequence
  CIITA targeting sequence
uggcugucucauggcucagg

SEQ ID NO: 28142 - RNA, 20 nt, Artificial Sequence
  CIITA targeting sequence
uacacugucuuccacugcaa

SEQ ID NO: 28143 - RNA, 20 nt, Artificial Sequence
  CIITA targeting sequence
uccacugcaaaagucaccga

SEQ ID NO: 28144 - RNA, 20 nt, Artificial Sequence
  CIITA targeting sequence
acugcaaaagucaccgacuc

SEQ ID NO: 28145 - RNA, 20 nt, Artificial Sequence
  CIITA targeting sequence
ccgacucccagccugggcuu

SEQ ID NO: 28146 - RNA, 20 nt, Artificial Sequence
  CIITA targeting sequence
gugacuuuugcaguggaaga

SEQ ID NO: 28147 - RNA, 20 nt, Artificial Sequence
  CIITA targeting sequence
cagccugggcuucaaaguga

SEQ ID NO: 28148 - RNA, 20 nt, Artificial Sequence
  CIITA targeting sequence
aagugagaccccugucucua

SEQ ID NO: 28149 - RNA, 20 nt, Artificial Sequence
  CIITA targeting sequence
cuuugaagcccaggcuggga

SEQ ID NO: 28150 - RNA, 20 nt, Artificial Sequence
  CIITA targeting sequence
cacuuugaagcccaggcugg

SEQ ID NO: 28151 - RNA, 20 nt, Artificial Sequence
  CIITA targeting sequence
cuacaaaacauaaaacauaa

SEQ ID NO: 28152 - RNA, 20 nt, Artificial Sequence
  CIITA targeting sequence
acaaaacauaaaacauaaaa

SEQ ID NO: 28153 - RNA, 20 nt, Artificial Sequence
  CIITA targeting sequence
cagcuacucaggagacugag

SEQ ID NO: 28154 - RNA, 20 nt, Artificial Sequence
  CIITA targeting sequence
ggagacugagguaggaggau

SEQ ID NO: 28155 - RNA, 20 nt, Artificial Sequence
  CIITA targeting sequence
ugaguagcugggacuacagg

SEQ ID NO: 28156 - RNA, 20 nt, Artificial Sequence
  CIITA targeting sequence
ccugaguagcugggacuaca

SEQ ID NO: 28157 - RNA, 20 nt, Artificial Sequence
  CIITA targeting sequence
cucccuuggggagugaaucu

SEQ ID NO: 28158 - RNA, 20 nt, Artificial Sequence
  CIITA targeting sequence
ucuaaagggaauugauuaaa

SEQ ID NO: 28159 - RNA, 20 nt, Artificial Sequence
  CIITA targeting sequence
aaagggaauugauuaaauug

SEQ ID NO: 28160 - RNA, 20 nt, Artificial Sequence
  CIITA targeting sequence
cuuuagaggaauuucacucc

SEQ ID NO: 28161 - RNA, 20 nt, Artificial Sequence
  CIITA targeting sequence
auucccuuuagaggaauuuc

SEQ ID NO: 28162 - RNA, 20 nt, Artificial Sequence
  CIITA targeting sequence
cuaaaggaagggcauggaga

SEQ ID NO: 28163 - RNA, 20 nt, Artificial Sequence
  CIITA targeting sequence
uuuagggaacaauuuaauca

SEQ ID NO: 28164 - RNA, 20 nt, Artificial Sequence
  CIITA targeting sequence
augcccuuccuuuagggaac

SEQ ID NO: 28165 - RNA, 20 nt, Artificial Sequence
  CIITA targeting sequence
ccaugcccuuccuuuaggga

SEQ ID NO: 28166 - RNA, 20 nt, Artificial Sequence
  CIITA targeting sequence
gucuccaugcccuuccuuua

SEQ ID NO: 28167 - RNA, 20 nt, Artificial Sequence
  CIITA targeting sequence
cuagaaaccugagaguaucg

SEQ ID NO: 28168 - RNA, 20 nt, Artificial Sequence
  CIITA targeting sequence
agugacucugucuccaugcc

SEQ ID NO: 28169 - RNA, 20 nt, Artificial Sequence
  CIITA targeting sequence
gguuucuagugacucugucu

SEQ ID NO: 28170 - RNA, 20 nt, Artificial Sequence
  CIITA targeting sequence
cagguuucuagugacucugu

SEQ ID NO: 28171 - RNA, 20 nt, Artificial Sequence
  CIITA targeting sequence
aggaaagucucuaucacagu

SEQ ID NO: 28172 - RNA, 20 nt, Artificial Sequence
  CIITA targeting sequence
auacucucagguuucuagug

SEQ ID NO: 28173 - RNA, 20 nt, Artificial Sequence
  CIITA targeting sequence
ucgauacucucagguuucua

SEQ ID NO: 28174 - RNA, 20 nt, Artificial Sequence
  CIITA targeting sequence
cuaucacagucauagugaua

SEQ ID NO: 28175 - RNA, 20 nt, Artificial Sequence
  CIITA targeting sequence
aucacagucauagugauagu

SEQ ID NO: 28176 - RNA, 20 nt, Artificial Sequence
  CIITA targeting sequence
cagucauagugauaguguca

SEQ ID NO: 28177 - RNA, 20 nt, Artificial Sequence
  CIITA targeting sequence
uagugauagugucauuuccc

SEQ ID NO: 28178 - RNA, 20 nt, Artificial Sequence
  CIITA targeting sequence
cuaugacugugauagagacu

SEQ ID NO: 28179 - RNA, 20 nt, Artificial Sequence
  CIITA targeting sequence
uuuccccguggaucauugac

SEQ ID NO: 28180 - RNA, 20 nt, Artificial Sequence
  CIITA targeting sequence
ccguggaucauugacacauc

SEQ ID NO: 28181 - RNA, 20 nt, Artificial Sequence
  CIITA targeting sequence
acggggaaaugacacuauca

SEQ ID NO: 28182 - RNA, 20 nt, Artificial Sequence
  CIITA targeting sequence
uugacacaucagucccaagu

SEQ ID NO: 28183 - RNA, 20 nt, Artificial Sequence
  CIITA targeting sequence
augauccacggggaaaugac

SEQ ID NO: 28184 - RNA, 20 nt, Artificial Sequence
  CIITA targeting sequence
gucccaaguaucaagguccg

SEQ ID NO: 28185 - RNA, 20 nt, Artificial Sequence
  CIITA targeting sequence
caaguaucaagguccggaga

SEQ ID NO: 28186 - RNA, 20 nt, Artificial Sequence
  CIITA targeting sequence
agguccggagagagcaaguc

SEQ ID NO: 28187 - RNA, 20 nt, Artificial Sequence
  CIITA targeting sequence
ggagagagcaagucagguuu

SEQ ID NO: 28188 - RNA, 20 nt, Artificial Sequence
  CIITA targeting sequence
ggaccuugauacuugggacu

SEQ ID NO: 28189 - RNA, 20 nt, Artificial Sequence
  CIITA targeting sequence
ccggaccuugauacuuggga

SEQ ID NO: 28190 - RNA, 20 nt, Artificial Sequence
  CIITA targeting sequence
cuccggaccuugauacuugg

SEQ ID NO: 28191 - RNA, 20 nt, Artificial Sequence
  CIITA targeting sequence
gguuuuccgaugaugucgcu

SEQ ID NO: 28192 - RNA, 20 nt, Artificial Sequence
  CIITA targeting sequence
gaugaugucgcucugcuguu

SEQ ID NO: 28193 - RNA, 20 nt, Artificial Sequence
  CIITA targeting sequence
gaaaaccugacuugcucucu

SEQ ID NO: 28194 - RNA, 20 nt, Artificial Sequence
  CIITA targeting sequence
ucggaaaaccugacuugcuc

SEQ ID NO: 28195 - RNA, 20 nt, Artificial Sequence
  CIITA targeting sequence
cucugcuguucuccccggau

SEQ ID NO: 28196 - RNA, 20 nt, Artificial Sequence
  CIITA targeting sequence
gcuguucuccccggauggcu

SEQ ID NO: 28197 - RNA, 20 nt, Artificial Sequence
  CIITA targeting sequence
ccccggauggcuccauagag

SEQ ID NO: 28198 - RNA, 20 nt, Artificial Sequence
  CIITA targeting sequence
ccggauggcuccauagaggg

SEQ ID NO: 28199 - RNA, 20 nt, Artificial Sequence
  CIITA targeting sequence
ggggagaacagcagagcgac

SEQ ID NO: 28200 - RNA, 20 nt, Artificial Sequence
  CIITA targeting sequence
auagagggcaccugaggcca

SEQ ID NO: 28201 - RNA, 20 nt, Artificial Sequence
  CIITA targeting sequence
auggagccauccggggagaa

SEQ ID NO: 28202 - RNA, 20 nt, Artificial Sequence
  CIITA targeting sequence
ggugcccucuauggagccau

SEQ ID NO: 28203 - RNA, 20 nt, Artificial Sequence
  CIITA targeting sequence
guggauggcguuuucccgug

SEQ ID NO: 28204 - RNA, 20 nt, Artificial Sequence
  CIITA targeting sequence
acagaccagcacuggccuca

SEQ ID NO: 28205 - RNA, 20 nt, Artificial Sequence
  CIITA targeting sequence
cgugcacaaguuugagacag

SEQ ID NO: 28206 - RNA, 20 nt, Artificial Sequence
  CIITA targeting sequence
aacuugugcacgggaaaacg

SEQ ID NO: 28207 - RNA, 20 nt, Artificial Sequence
  CIITA targeting sequence
caaacuugugcacgggaaaa

SEQ ID NO: 28208 - RNA, 20 nt, Artificial Sequence
  CIITA targeting sequence
gcacccagcgcugucucaaa

SEQ ID NO: 28209 - RNA, 20 nt, Artificial Sequence
  CIITA targeting sequence
ucagcacccagcgcugucuc

SEQ ID NO: 28210 - RNA, 20 nt, Artificial Sequence
  CIITA targeting sequence
uacuuccucagcacccagcg

SEQ ID NO: 28211 - RNA, 20 nt, Artificial Sequence
  CIITA targeting sequence
acaaacccagccuccuacuu

SEQ ID NO: 28212 - RNA, 20 nt, Artificial Sequence
  CIITA targeting sequence
caacaaacccagccuccuac

SEQ ID NO: 28213 - RNA, 20 nt, Artificial Sequence
  CIITA targeting sequence
ucucaacaaacccagccucc

SEQ ID NO: 28214 - RNA, 20 nt, Artificial Sequence
  CIITA targeting sequence
auccucucaacaaacccagc

SEQ ID NO: 28215 - RNA, 20 nt, Artificial Sequence
  CIITA targeting sequence
ucaauccucucaacaaaccc

SEQ ID NO: 28216 - RNA, 20 nt, Artificial Sequence
  CIITA targeting sequence
ugccacccucuucaauccuc

SEQ ID NO: 28217 - RNA, 20 nt, Artificial Sequence
  CIITA targeting sequence
gggcaaguuaaaaagugacg

SEQ ID NO: 28218 - RNA, 20 nt, Artificial Sequence
  CIITA targeting sequence
cuuuuuaacuugcccugaau

SEQ ID NO: 28219 - RNA, 20 nt, Artificial Sequence
  CIITA targeting sequence
gcgucacuuuuuaacuugcc

SEQ ID NO: 28220 - RNA, 20 nt, Artificial Sequence
  CIITA targeting sequence
aaagugcugcaccuccgcgu

SEQ ID NO: 28221 - RNA, 20 nt, Artificial Sequence
  CIITA targeting sequence
gagucauugcagcuuucaag

SEQ ID NO: 28222 - RNA, 20 nt, Artificial Sequence
  CIITA targeting sequence
gauccaaagugcugcaccuc

SEQ ID NO: 28223 - RNA, 20 nt, Artificial Sequence
  CIITA targeting sequence
uugcagcuuucaagaugaau

SEQ ID NO: 28224 - RNA, 20 nt, Artificial Sequence
  CIITA targeting sequence
cauuaucuugggaaucgaug

SEQ ID NO: 28225 - RNA, 20 nt, Artificial Sequence
  CIITA targeting sequence
aaucccauuaucuugggaau

SEQ ID NO: 28226 - RNA, 20 nt, Artificial Sequence
  CIITA targeting sequence
uuccaaucccauuaucuugg

SEQ ID NO: 28227 - RNA, 20 nt, Artificial Sequence
  CIITA targeting sequence
ccuuccaaucccauuaucuu

SEQ ID NO: 28228 - RNA, 20 nt, Artificial Sequence
  CIITA targeting sequence
guaaccggcuauuaccugcu

SEQ ID NO: 28229 - RNA, 20 nt, Artificial Sequence
  CIITA targeting sequence
ggaaauuauucucuuaaggc

SEQ ID NO: 28230 - RNA, 20 nt, Artificial Sequence
  CIITA targeting sequence
ugaguucuguaaccggcuau

SEQ ID NO: 28231 - RNA, 20 nt, Artificial Sequence
  CIITA targeting sequence
cuuaaggcaaacucuguagc

SEQ ID NO: 28232 - RNA, 20 nt, Artificial Sequence
  CIITA targeting sequence
uaaggcaaacucuguagcac

SEQ ID NO: 28233 - RNA, 20 nt, Artificial Sequence
  CIITA targeting sequence
guagcacugaacugucaaac

SEQ ID NO: 28234 - RNA, 20 nt, Artificial Sequence
  CIITA targeting sequence
gugcuacagaguuugccuua

SEQ ID NO: 28235 - RNA, 20 nt, Artificial Sequence
  CIITA targeting sequence
aaccucaacaaagaggcaug

SEQ ID NO: 28236 - RNA, 20 nt, Artificial Sequence
  CIITA targeting sequence
acaaagaggcaugcggagcc

SEQ ID NO: 28237 - RNA, 20 nt, Artificial Sequence
  CIITA targeting sequence
uuguugagguuugacaguuc

SEQ ID NO: 28238 - RNA, 20 nt, Artificial Sequence
  CIITA targeting sequence
gcaugccucuuuguugaggu

SEQ ID NO: 28239 - RNA, 20 nt, Artificial Sequence
  CIITA targeting sequence
aaaacaacaaaacaaaacaa

SEQ ID NO: 28240 - RNA, 20 nt, Artificial Sequence
  CIITA targeting sequence
caaaaacaacaaaacaaaac

SEQ ID NO: 28241 - RNA, 20 nt, Artificial Sequence
  CIITA targeting sequence
cacucuugucgcccgggcug

SEQ ID NO: 28242 - RNA, 20 nt, Artificial Sequence
  CIITA targeting sequence
cucuugucgcccgggcugga

SEQ ID NO: 28243 - RNA, 20 nt, Artificial Sequence
  CIITA targeting sequence
ugucgcccgggcuggagugc

SEQ ID NO: 28244 - RNA, 20 nt, Artificial Sequence
  CIITA targeting sequence
cccgggcuggagugcagugg

SEQ ID NO: 28245 - RNA, 20 nt, Artificial Sequence
  CIITA targeting sequence
agcccgggcgacaagaguga

SEQ ID NO: 28246 - RNA, 20 nt, Artificial Sequence
  CIITA targeting sequence
gcucacugcaaccuccaccu

SEQ ID NO: 28247 - RNA, 20 nt, Artificial Sequence
  CIITA targeting sequence
cugcaaccuccaccuccugg

SEQ ID NO: 28248 - RNA, 20 nt, Artificial Sequence
  CIITA targeting sequence
accuccuggguucaagcgau

SEQ ID NO: 28249 - RNA, 20 nt, Artificial Sequence
  CIITA targeting sequence
uggguucaagcgauucuugu

SEQ ID NO: 28250 - RNA, 20 nt, Artificial Sequence
  CIITA targeting sequence
agcgauucuugugcucagcc

SEQ ID NO: 28251 - RNA, 20 nt, Artificial Sequence
  CIITA targeting sequence
cuugaacccaggagguggag

SEQ ID NO: 28252 - RNA, 20 nt, Artificial Sequence
  CIITA targeting sequence
ugugcucagccuccugagua

SEQ ID NO: 28253 - RNA, 20 nt, Artificial Sequence
  CIITA targeting sequence
gccuccugaguagcugggac

SEQ ID NO: 28254 - RNA, 20 nt, Artificial Sequence
  CIITA targeting sequence
ugaguagcugggacuacagu

SEQ ID NO: 28255 - RNA, 20 nt, Artificial Sequence
  CIITA targeting sequence
ggaggcugagcacaagaauc

SEQ ID NO: 28256 - RNA, 20 nt, Artificial Sequence
  CIITA targeting sequence
cagcuacucaggaggcugag

SEQ ID NO: 28257 - RNA, 20 nt, Artificial Sequence
  CIITA targeting sequence
ugcccaacuaauuuuuguau

SEQ ID NO: 28258 - RNA, 20 nt, Artificial Sequence
  CIITA targeting sequence
accaaaaauacaaaaauuag

SEQ ID NO: 28259 - RNA, 20 nt, Artificial Sequence
  CIITA targeting sequence
cuaccaaaaauacaaaaauu

SEQ ID NO: 28260 - RNA, 20 nt, Artificial Sequence
  CIITA targeting sequence
cuacguuggccaagcugggc

SEQ ID NO: 28261 - RNA, 20 nt, Artificial Sequence
  CIITA targeting sequence
accuccugaccucuagugau

SEQ ID NO: 28262 - RNA, 20 nt, Artificial Sequence
  CIITA targeting sequence
ugaccucuagugaucaccug

SEQ ID NO: 28263 - RNA, 20 nt, Artificial Sequence
  CIITA targeting sequence
ggagguggagcccagcuugg

SEQ ID NO: 28264 - RNA, 20 nt, Artificial Sequence
  CIITA targeting sequence
agugaucaccugccucagcc

SEQ ID NO: 28265 - RNA, 20 nt, Artificial Sequence
  CIITA targeting sequence
cuagaggucaggagguggag

SEQ ID NO: 28266 - RNA, 20 nt, Artificial Sequence
  CIITA targeting sequence
ccugccucagccucccaaag

SEQ ID NO: 28267 - RNA, 20 nt, Artificial Sequence
  CIITA targeting sequence
gccucccaaagugcuaggau

SEQ ID NO: 28268 - RNA, 20 nt, Artificial Sequence
  CIITA targeting sequence
caaagugcuaggauuacagg

SEQ ID NO: 28269 - RNA, 20 nt, Artificial Sequence
  CIITA targeting sequence
uagcacuuugggaggcugag

SEQ ID NO: 28270 - RNA, 20 nt, Artificial Sequence
  CIITA targeting sequence
cgccuguaauccuagcacuu

SEQ ID NO: 28271 - RNA, 20 nt, Artificial Sequence
  CIITA targeting sequence
acauaaacauuuacaggcca

SEQ ID NO: 28272 - RNA, 20 nt, Artificial Sequence
  CIITA targeting sequence
uguccacauaaacauuuaca

SEQ ID NO: 28273 - RNA, 20 nt, Artificial Sequence
  CIITA targeting sequence
ucauguccacauaaacauuu

SEQ ID NO: 28274 - RNA, 20 nt, Artificial Sequence
  CIITA targeting sequence
uacaugcucaguaguccauc

SEQ ID NO: 28275 - RNA, 20 nt, Artificial Sequence
  CIITA targeting sequence
guaguccaucugucuacuuu

SEQ ID NO: 28276 - RNA, 20 nt, Artificial Sequence
  CIITA targeting sequence
aucugucuacuuuuaacaac

SEQ ID NO: 28277 - RNA, 20 nt, Artificial Sequence
  CIITA targeting sequence
gucuacuuuuaacaacaacu

SEQ ID NO: 28278 - RNA, 20 nt, Artificial Sequence
  CIITA targeting sequence
acuuuuaacaacaacuguga

SEQ ID NO: 28279 - RNA, 20 nt, Artificial Sequence
  CIITA targeting sequence
caguuguuguuaaaaguaga

SEQ ID NO: 28280 - RNA, 20 nt, Artificial Sequence
  CIITA targeting sequence
uggcgggggaggggcgggau

SEQ ID NO: 28281 - RNA, 20 nt, Artificial Sequence
  CIITA targeting sequence
cccgccaagacucacaguug

SEQ ID NO: 28282 - RNA, 20 nt, Artificial Sequence
  CIITA targeting sequence
cgccccucccccgccaagac

SEQ ID NO: 28283 - RNA, 20 nt, Artificial Sequence
  CIITA targeting sequence
uauacaaucccgccccuccc

SEQ ID NO: 28284 - RNA, 20 nt, Artificial Sequence
  CIITA targeting sequence
gucuacaccauuggagaagc

SEQ ID NO: 28285 - RNA, 20 nt, Artificial Sequence
  CIITA targeting sequence
acaccauuggagaagcauug

SEQ ID NO: 28286 - RNA, 20 nt, Artificial Sequence
  CIITA targeting sequence
aaugguguagacagacuuca

SEQ ID NO: 28287 - RNA, 20 nt, Artificial Sequence
  CIITA targeting sequence
ccaaugguguagacagacuu

SEQ ID NO: 28288 - RNA, 20 nt, Artificial Sequence
  CIITA targeting sequence
augccuccucagaggggaag

SEQ ID NO: 28289 - RNA, 20 nt, Artificial Sequence
  CIITA targeting sequence
aaaccaaugcuucuccaaug

SEQ ID NO: 28290 - RNA, 20 nt, Artificial Sequence
  CIITA targeting sequence
ucagaggggaagggaaacag

SEQ ID NO: 28291 - RNA, 20 nt, Artificial Sequence
  CIITA targeting sequence
gaggggaagggaaacagcca

SEQ ID NO: 28292 - RNA, 20 nt, Artificial Sequence
  CIITA targeting sequence
gaggaggcaucgaaaccaau

SEQ ID NO: 28293 - RNA, 20 nt, Artificial Sequence
  CIITA targeting sequence
ccucugaggaggcaucgaaa

SEQ ID NO: 28294 - RNA, 20 nt, Artificial Sequence
  CIITA targeting sequence
cuuccccucugaggaggcau

SEQ ID NO: 28295 - RNA, 20 nt, Artificial Sequence
  CIITA targeting sequence
cuggcuguuucccuuccccu

SEQ ID NO: 28296 - RNA, 20 nt, Artificial Sequence
  CIITA targeting sequence
gcauuucacuggcuguuucc

SEQ ID NO: 28297 - RNA, 20 nt, Artificial Sequence
  CIITA targeting sequence
uacuucugcauuucacuggc

SEQ ID NO: 28298 - RNA, 20 nt, Artificial Sequence
  CIITA targeting sequence
gugucuuacuucugcauuuc

SEQ ID NO: 28299 - RNA, 20 nt, Artificial Sequence
  CIITA targeting sequence
gacugggaacauuagaccag

SEQ ID NO: 28300 - RNA, 20 nt, Artificial Sequence
  CIITA targeting sequence
gagcuaaauuuccgugucuu

SEQ ID NO: 28301 - RNA, 20 nt, Artificial Sequence
  CIITA targeting sequence
cagucagagcuaaauuuccg

SEQ ID NO: 28302 - RNA, 20 nt, Artificial Sequence
  CIITA targeting sequence
aauguucccagucagagcua

SEQ ID NO: 28303 - RNA, 20 nt, Artificial Sequence
  CIITA targeting sequence
guacccuggaagcaagggaa

SEQ ID NO: 28304 - RNA, 20 nt, Artificial Sequence
  CIITA targeting sequence
aggguacagacccauagcaa

SEQ ID NO: 28305 - RNA, 20 nt, Artificial Sequence
  CIITA targeting sequence
cuugcuuccaggguacagac

SEQ ID NO: 28306 - RNA, 20 nt, Artificial Sequence
  CIITA targeting sequence
gcccuuguggucuccccugg

SEQ ID NO: 28307 - RNA, 20 nt, Artificial Sequence
  CIITA targeting sequence
ccccuggggaacugagacug

SEQ ID NO: 28308 - RNA, 20 nt, Artificial Sequence
  CIITA targeting sequence
ccuggggaacugagacugca

SEQ ID NO: 28309 - RNA, 20 nt, Artificial Sequence
  CIITA targeting sequence
ccaggggagaccacaagggc

SEQ ID NO: 28310 - RNA, 20 nt, Artificial Sequence
  CIITA targeting sequence
guuccccaggggagaccaca

SEQ ID NO: 28311 - RNA, 20 nt, Artificial Sequence
  CIITA targeting sequence
caguuccccaggggagacca

SEQ ID NO: 28312 - RNA, 20 nt, Artificial Sequence
  CIITA targeting sequence
cccgcccugcagucucaguu

SEQ ID NO: 28313 - RNA, 20 nt, Artificial Sequence
  CIITA targeting sequence
cucacccgcccugcagucuc

SEQ ID NO: 28314 - RNA, 20 nt, Artificial Sequence
  CIITA targeting sequence
auguaguugcuggccucuuc

SEQ ID NO: 28315 - RNA, 20 nt, Artificial Sequence
  CIITA targeting sequence
ucuugcuagcaagaagcucu

SEQ ID NO: 28316 - RNA, 20 nt, Artificial Sequence
  CIITA targeting sequence
ugcuagcaagaagcucucca

SEQ ID NO: 28317 - RNA, 20 nt, Artificial Sequence
  CIITA targeting sequence
ugcuagcaagaagaggccag

SEQ ID NO: 28318 - RNA, 20 nt, Artificial Sequence
  CIITA targeting sequence
ccaagagaggauucccccaa

SEQ ID NO: 28319 - RNA, 20 nt, Artificial Sequence
  CIITA targeting sequence
aagagaggauucccccaagg

SEQ ID NO: 28320 - RNA, 20 nt, Artificial Sequence
  CIITA targeting sequence
uggagagcuucuugcuagca

SEQ ID NO: 28321 - RNA, 20 nt, Artificial Sequence
  CIITA targeting sequence
cuuggagagcuucuugcuag

SEQ ID NO: 28322 - RNA, 20 nt, Artificial Sequence
  CIITA targeting sequence
ucucuuggagagcuucuugc

SEQ ID NO: 28323 - RNA, 20 nt, Artificial Sequence
  CIITA targeting sequence
cccaagggcagugcauggaa

SEQ ID NO: 28324 - RNA, 20 nt, Artificial Sequence
  CIITA targeting sequence
augcacugcccuugggggaa

SEQ ID NO: 28325 - RNA, 20 nt, Artificial Sequence
  CIITA targeting sequence
cagcacccccagccccagcu

SEQ ID NO: 28326 - RNA, 20 nt, Artificial Sequence
  CIITA targeting sequence
cgagagucucaagauugguu

SEQ ID NO: 28327 - RNA, 20 nt, Artificial Sequence
  CIITA targeting sequence
ggacaucccagcacccccag

SEQ ID NO: 28328 - RNA, 20 nt, Artificial Sequence
  CIITA targeting sequence
cgggacaucccagcaccccc

SEQ ID NO: 28329 - RNA, 20 nt, Artificial Sequence
  CIITA targeting sequence
caagauugguucuuucuuua

SEQ ID NO: 28330 - RNA, 20 nt, Artificial Sequence
  CIITA targeting sequence
agauugguucuuucuuuaau

SEQ ID NO: 28331 - RNA, 20 nt, Artificial Sequence
  CIITA targeting sequence
ugagacucucgggacauccc

SEQ ID NO: 28332 - RNA, 20 nt, Artificial Sequence
  CIITA targeting sequence
uucuuuaauuagugccagga

SEQ ID NO: 28333 - RNA, 20 nt, Artificial Sequence
  CIITA targeting sequence
uuaauuagugccaggaaugc

SEQ ID NO: 28334 - RNA, 20 nt, Artificial Sequence
  CIITA targeting sequence
uggcacuaauuaaagaaaga

SEQ ID NO: 28335 - RNA, 20 nt, Artificial Sequence
  CIITA targeting sequence
uguuuuggggaugcaguggu

SEQ ID NO: 28336 - RNA, 20 nt, Artificial Sequence
  CIITA targeting sequence
ccaaaacaggauuaaugcau

SEQ ID NO: 28337 - RNA, 20 nt, Artificial Sequence
  CIITA targeting sequence
ccacugcauccccaaaacag

SEQ ID NO: 28338 - RNA, 20 nt, Artificial Sequence
  CIITA targeting sequence
augaagaccccugucugggu

SEQ ID NO: 28339 - RNA, 20 nt, Artificial Sequence
  CIITA targeting sequence
uggaccuuguucaccacugc

SEQ ID NO: 28340 - RNA, 20 nt, Artificial Sequence
  CIITA targeting sequence
ucauggaccuuguucaccac

SEQ ID NO: 28341 - RNA, 20 nt, Artificial Sequence
  CIITA targeting sequence
gggugggagaaggcagaugc

SEQ ID NO: 28342 - RNA, 20 nt, Artificial Sequence
  CIITA targeting sequence
cacccagacaggggucuuca

SEQ ID NO: 28343 - RNA, 20 nt, Artificial Sequence
  CIITA targeting sequence
cccacccagacaggggucuu

SEQ ID NO: 28344 - RNA, 20 nt, Artificial Sequence
  CIITA targeting sequence
gccuucucccacccagacag

SEQ ID NO: 28345 - RNA, 20 nt, Artificial Sequence
  CIITA targeting sequence
agcaucugccuucucccacc

SEQ ID NO: 28346 - RNA, 20 nt, Artificial Sequence
  CIITA targeting sequence
cauuaucuagcaucugccuu

SEQ ID NO: 28347 - RNA, 20 nt, Artificial Sequence
  CIITA targeting sequence
ggguugguuucacauuaucu

SEQ ID NO: 28348 - RNA, 20 nt, Artificial Sequence
  CIITA targeting sequence
cucuggguugguuucacauu

SEQ ID NO: 28349 - RNA, 20 nt, Artificial Sequence
  CIITA targeting sequence
ccucacucuggguugguuuc

SEQ ID NO: 28350 - RNA, 20 nt, Artificial Sequence
  CIITA targeting sequence
auccccucacucuggguugg

SEQ ID NO: 28351 - RNA, 20 nt, Artificial Sequence
  CIITA targeting sequence
gcccuacuguccauccccuc

SEQ ID NO: 28352 - RNA, 20 nt, Artificial Sequence
  CIITA targeting sequence
gaggggcugaggggugguca

SEQ ID NO: 28353 - RNA, 20 nt, Artificial Sequence
  CIITA targeting sequence
gacucugcccuacuguccau

SEQ ID NO: 28354 - RNA, 20 nt, Artificial Sequence
  CIITA targeting sequence
gccccucugacucugcccua

SEQ ID NO: 28355 - RNA, 20 nt, Artificial Sequence
  CIITA targeting sequence
aaggugcccucacugaggga

SEQ ID NO: 28356 - RNA, 20 nt, Artificial Sequence
  CIITA targeting sequence
cugagggauagcauuugagc

SEQ ID NO: 28357 - RNA, 20 nt, Artificial Sequence
  CIITA targeting sequence
gugagggcaccuuugaccac

SEQ ID NO: 28358 - RNA, 20 nt, Artificial Sequence
  CIITA targeting sequence
cucagugagggcaccuuuga

SEQ ID NO: 28359 - RNA, 20 nt, Artificial Sequence
  CIITA targeting sequence
aaugcuaucccucagugagg

SEQ ID NO: 28360 - RNA, 20 nt, Artificial Sequence
  CIITA targeting sequence
gcucaaaugcuaucccucag

SEQ ID NO: 28361 - RNA, 20 nt, Artificial Sequence
  CIITA targeting sequence
ucugcucaaaugcuaucccu

SEQ ID NO: 28362 - RNA, 20 nt, Artificial Sequence
  CIITA targeting sequence
uccucugcucaaaugcuauc

SEQ ID NO: 28363 - RNA, 20 nt, Artificial Sequence
  CIITA targeting sequence
ugucauccucugcucaaaug

SEQ ID NO: 28364 - RNA, 20 nt, Artificial Sequence
  CIITA targeting sequence
ccuccugucauccucugcuc

SEQ ID NO: 28365 - RNA, 20 nt, Artificial Sequence
  CIITA targeting sequence
ccccuccugucauccucugc

SEQ ID NO: 28366 - RNA, 20 nt, Artificial Sequence
  CIITA targeting sequence
cccagcucuccccuccuguc

SEQ ID NO: 28367 - RNA, 20 nt, Artificial Sequence
  CIITA targeting sequence
gggcuaagggagcaacugca

SEQ ID NO: 28368 - RNA, 20 nt, Artificial Sequence
  CIITA targeting sequence
cuuagcccagaaugcccuuc

SEQ ID NO: 28369 - RNA, 20 nt, Artificial Sequence
  CIITA targeting sequence
gcggcccaugcaguugcucc

SEQ ID NO: 28370 - RNA, 20 nt, Artificial Sequence
  CIITA targeting sequence
uuguguccucaguggaguga

SEQ ID NO: 28371 - RNA, 20 nt, Artificial Sequence
  CIITA targeting sequence
ucaguggagugaccagaggg

SEQ ID NO: 28372 - RNA, 20 nt, Artificial Sequence
  CIITA targeting sequence
guggagugaccagaggggcu

SEQ ID NO: 28373 - RNA, 20 nt, Artificial Sequence
  CIITA targeting sequence
acugaggacacaaggacacc

SEQ ID NO: 28374 - RNA, 20 nt, Artificial Sequence
  CIITA targeting sequence
cuccacugaggacacaagga

SEQ ID NO: 28375 - RNA, 20 nt, Artificial Sequence
  CIITA targeting sequence
ggucacuccacugaggacac

SEQ ID NO: 28376 - RNA, 20 nt, Artificial Sequence
  CIITA targeting sequence
agccccucuggucacuccac

SEQ ID NO: 28377 - RNA, 20 nt, Artificial Sequence
  CIITA targeting sequence
ggccacccuccagccccucu

SEQ ID NO: 28378 - RNA, 20 nt, Artificial Sequence
  CIITA targeting sequence
gcuucgggccacccuccagc

SEQ ID NO: 28379 - RNA, 20 nt, Artificial Sequence
  CIITA targeting sequence
aaggccuugggguuugcuuc

SEQ ID NO: 28380 - RNA, 20 nt, Artificial Sequence
  CIITA targeting sequence
gagggaguagggaaggagag

SEQ ID NO: 28381 - RNA, 20 nt, Artificial Sequence
  CIITA targeting sequence
gaagcaaaccccaaggccuu

SEQ ID NO: 28382 - RNA, 20 nt, Artificial Sequence
  CIITA targeting sequence
cucggaagcaaaccccaagg

SEQ ID NO: 28383 - RNA, 20 nt, Artificial Sequence
  CIITA targeting sequence
cuacucccucggaagcaaac

SEQ ID NO: 28384 - RNA, 20 nt, Artificial Sequence
  CIITA targeting sequence
uucccuacucccucggaagc

SEQ ID NO: 28385 - RNA, 20 nt, Artificial Sequence
  CIITA targeting sequence
ccuucccuacucccucggaa

SEQ ID NO: 28386 - RNA, 20 nt, Artificial Sequence
  CIITA targeting sequence
cucuccuucccuacucccuc

SEQ ID NO: 28387 - RNA, 20 nt, Artificial Sequence
  CIITA targeting sequence
cccugugaggcuuggucaca

SEQ ID NO: 28388 - RNA, 20 nt, Artificial Sequence
  CIITA targeting sequence
cagggugacaucgcucuccu

SEQ ID NO: 28389 - RNA, 20 nt, Artificial Sequence
  CIITA targeting sequence
cauaccccaauggauuuggu

SEQ ID NO: 28390 - RNA, 20 nt, Artificial Sequence
  CIITA targeting sequence
auugggguaugugaccaagc

SEQ ID NO: 28391 - RNA, 20 nt, Artificial Sequence
  CIITA targeting sequence
cuguggcgugugcuaccaaa

SEQ ID NO: 28392 - RNA, 20 nt, Artificial Sequence
  CIITA targeting sequence
ucacacguaauuauuucaug

SEQ ID NO: 28393 - RNA, 20 nt, Artificial Sequence
  CIITA targeting sequence
cacguaauuauuucaugaaa

SEQ ID NO: 28394 - RNA, 20 nt, Artificial Sequence
  CIITA targeting sequence
ugaaacagaaaauuuuaaaa

SEQ ID NO: 28395 - RNA, 20 nt, Artificial Sequence
  CIITA targeting sequence
ugaaauaauuacgugugaug

SEQ ID NO: 28396 - RNA, 20 nt, Artificial Sequence
  CIITA targeting sequence
guuucaugaaauaauuacgu

SEQ ID NO: 28397 - RNA, 20 nt, Artificial Sequence
  CIITA targeting sequence
uuuauuuuaaaauuuucugu

SEQ ID NO: 28398 - RNA, 20 nt, Artificial Sequence
  CIITA targeting sequence
auuuucuuuuauuuuaaaau

SEQ ID NO: 28399 - RNA, 20 nt, Artificial Sequence
  CIITA targeting sequence
cuauuuucuucuccugcacu

SEQ ID NO: 28400 - RNA, 20 nt, Artificial Sequence
  CIITA targeting sequence
ucuccugcacuauuggauca

SEQ ID NO: 28401 - RNA, 20 nt, Artificial Sequence
  CIITA targeting sequence
ccugcacuauuggaucaucc

SEQ ID NO: 28402 - RNA, 20 nt, Artificial Sequence
  CIITA targeting sequence
ugcacuauuggaucauccug

SEQ ID NO: 28403 - RNA, 20 nt, Artificial Sequence
  CIITA targeting sequence
aauagugcaggagaagaaaa

SEQ ID NO: 28404 - RNA, 20 nt, Artificial Sequence
  CIITA targeting sequence
uccuguuuaccccucuuuua

SEQ ID NO: 28405 - RNA, 20 nt, Artificial Sequence
  CIITA targeting sequence
uguuuaccccucuuuuaaga

SEQ ID NO: 28406 - RNA, 20 nt, Artificial Sequence
  CIITA targeting sequence
acagggcaagaccccaucuc

SEQ ID NO: 28407 - RNA, 20 nt, Artificial Sequence
  CIITA targeting sequence
accaggcuggagugcagugg

SEQ ID NO: 28408 - RNA, 20 nt, Artificial Sequence
  CIITA targeting sequence
ugcccugucgaccaggcugg

SEQ ID NO: 28409 - RNA, 20 nt, Artificial Sequence
  CIITA targeting sequence
caaaaauaaaaauaaaaaau

SEQ ID NO: 28410 - RNA, 20 nt, Artificial Sequence
  CIITA targeting sequence
aaaauaaaaauaaaaaauaa

SEQ ID NO: 28411 - RNA, 20 nt, Artificial Sequence
  CIITA targeting sequence
ccacaguuuuauuuuuuauu

SEQ ID NO: 28412 - RNA, 20 nt, Artificial Sequence
  CIITA targeting sequence
caagcaugcagccaucacca

SEQ ID NO: 28413 - RNA, 20 nt, Artificial Sequence
  CIITA targeting sequence
guacagucacaagcaugcag

SEQ ID NO: 28414 - RNA, 20 nt, Artificial Sequence
  CIITA targeting sequence
uucaaugggugagucauauu

SEQ ID NO: 28415 - RNA, 20 nt, Artificial Sequence
  CIITA targeting sequence
augggugagucauauugucu

SEQ ID NO: 28416 - RNA, 20 nt, Artificial Sequence
  CIITA targeting sequence
cccauugaaugaguggcuuu

SEQ ID NO: 28417 - RNA, 20 nt, Artificial Sequence
  CIITA targeting sequence
uauugucuaugaaucauguc

SEQ ID NO: 28418 - RNA, 20 nt, Artificial Sequence
  CIITA targeting sequence
augaaucaugucucaguaaa

SEQ ID NO: 28419 - RNA, 20 nt, Artificial Sequence
  CIITA targeting sequence
uagacaauaugacucaccca

SEQ ID NO: 28420 - RNA, 20 nt, Artificial Sequence
  CIITA targeting sequence
ugucucaguaaaucuguuga

SEQ ID NO: 28421 - RNA, 20 nt, Artificial Sequence
  CIITA targeting sequence
caguaaaucuguugagaaaa

SEQ ID NO: 28422 - RNA, 20 nt, Artificial Sequence
  CIITA targeting sequence
guaaaucuguugagaaaagu

SEQ ID NO: 28423 - RNA, 20 nt, Artificial Sequence
  CIITA targeting sequence
guugagaaaaguaaggcuuc

SEQ ID NO: 28424 - RNA, 20 nt, Artificial Sequence
  CIITA targeting sequence
acagauuuacugagacauga

SEQ ID NO: 28425 - RNA, 20 nt, Artificial Sequence
  CIITA targeting sequence
caacagauuuacugagacau

SEQ ID NO: 28426 - RNA, 20 nt, Artificial Sequence
  CIITA targeting sequence
ucaagaaaauuaaacuuuca

SEQ ID NO: 28427 - RNA, 20 nt, Artificial Sequence
  CIITA targeting sequence
agaaaauuaaacuuucagug

SEQ ID NO: 28428 - RNA, 20 nt, Artificial Sequence
  CIITA targeting sequence
ugaugaagccuuacuuuucu

SEQ ID NO: 28429 - RNA, 20 nt, Artificial Sequence
  CIITA targeting sequence
gugugcgcuuugugugcugc

SEQ ID NO: 28430 - RNA, 20 nt, Artificial Sequence
  CIITA targeting sequence
agcagcacacaaagcgcaca

SEQ ID NO: 28431 - RNA, 20 nt, Artificial Sequence
  CIITA targeting sequence
ccccagcagguguccagcag

SEQ ID NO: 28432 - RNA, 20 nt, Artificial Sequence
  CIITA targeting sequence
uccccccagcagguguccag

SEQ ID NO: 28433 - RNA, 20 nt, Artificial Sequence
  CIITA targeting sequence
gaaucuuguugccccaggaa

SEQ ID NO: 28434 - RNA, 20 nt, Artificial Sequence
  CIITA targeting sequence
gaccucuuccccccagcagg

SEQ ID NO: 28435 - RNA, 20 nt, Artificial Sequence
  CIITA targeting sequence
uguugccccaggaagcuccc

SEQ ID NO: 28436 - RNA, 20 nt, Artificial Sequence
  CIITA targeting sequence
cacacagccaaauagcaaga

SEQ ID NO: 28437 - RNA, 20 nt, Artificial Sequence
  CIITA targeting sequence
aacaaacagggcuuagcacu

SEQ ID NO: 28438 - RNA, 20 nt, Artificial Sequence
  CIITA targeting sequence
aggugcuauuuacuucccac

SEQ ID NO: 28439 - RNA, 20 nt, Artificial Sequence
  CIITA targeting sequence
auauuuauuuaguaccuacu

SEQ ID NO: 28440 - RNA, 20 nt, Artificial Sequence
  CIITA targeting sequence
gccaaauccauauuuauuua

SEQ ID NO: 28441 - RNA, 20 nt, Artificial Sequence
  CIITA targeting sequence
uuuucacacugcuguaaaga

SEQ ID NO: 28442 - RNA, 20 nt, Artificial Sequence
  CIITA targeting sequence
cacugcuguaaagaacugcc

SEQ ID NO: 28443 - RNA, 20 nt, Artificial Sequence
  CIITA targeting sequence
uuacagcagugugaaaauga

SEQ ID NO: 28444 - RNA, 20 nt, Artificial Sequence
  CIITA targeting sequence
ggcaguucuuuacagcagug

SEQ ID NO: 28445 - RNA, 20 nt, Artificial Sequence
  CIITA targeting sequence
caggcaguucuuuacagcag

SEQ ID NO: 28446 - RNA, 20 nt, Artificial Sequence
  CIITA targeting sequence
cuuauagguuacccagucuc

SEQ ID NO: 28447 - RNA, 20 nt, Artificial Sequence
  CIITA targeting sequence
uucccuuauagguuacccag

SEQ ID NO: 28448 - RNA, 20 nt, Artificial Sequence
  CIITA targeting sequence
uugauucacaguucugcaug

SEQ ID NO: 28449 - RNA, 20 nt, Artificial Sequence
  CIITA targeting sequence
augaaaccucuuucccuuau

SEQ ID NO: 28450 - RNA, 20 nt, Artificial Sequence
  CIITA targeting sequence
caguucugcauggcugggaa

SEQ ID NO: 28451 - RNA, 20 nt, Artificial Sequence
  CIITA targeting sequence
gcauggcugggaaggcccca

SEQ ID NO: 28452 - RNA, 20 nt, Artificial Sequence
  CIITA targeting sequence
cagccaugcagaacugugaa

SEQ ID NO: 28453 - RNA, 20 nt, Artificial Sequence
  CIITA targeting sequence
uggggccuucccagccaugc

SEQ ID NO: 28454 - RNA, 20 nt, Artificial Sequence
  CIITA targeting sequence
ugguggaaggcaaagcaggc

SEQ ID NO: 28455 - RNA, 20 nt, Artificial Sequence
  CIITA targeting sequence
accaugauuguuaaguuucc

SEQ ID NO: 28456 - RNA, 20 nt, Artificial Sequence
  CIITA targeting sequence
cugcugccacuguguaacau

SEQ ID NO: 28457 - RNA, 20 nt, Artificial Sequence
  CIITA targeting sequence
cacugcugccacuguguaac

SEQ ID NO: 28458 - RNA, 20 nt, Artificial Sequence
  CIITA targeting sequence
cucacugcugccacugugua

SEQ ID NO: 28459 - RNA, 20 nt, Artificial Sequence
  CIITA targeting sequence
cucucacugcugccacugug

SEQ ID NO: 28460 - RNA, 20 nt, Artificial Sequence
  CIITA targeting sequence
cucucucacugcugccacug

SEQ ID NO: 28461 - RNA, 20 nt, Artificial Sequence
  CIITA targeting sequence
uacacacucucucucucacu

SEQ ID NO: 28462 - RNA, 20 nt, Artificial Sequence
  CIITA targeting sequence
uccuacacacucucucucuc

SEQ ID NO: 28463 - RNA, 20 nt, Artificial Sequence
  CIITA targeting sequence
aacacuuacaaaaccaucag

SEQ ID NO: 28464 - RNA, 20 nt, Artificial Sequence
  CIITA targeting sequence
gaucucgugaaaacucacua

SEQ ID NO: 28465 - RNA, 20 nt, Artificial Sequence
  CIITA targeting sequence
gaugguuuuguaaguguuug

SEQ ID NO: 28466 - RNA, 20 nt, Artificial Sequence
  CIITA targeting sequence
cgugaaaacucacuaucgag

SEQ ID NO: 28467 - RNA, 20 nt, Artificial Sequence
  CIITA targeting sequence
ugaaaacucacuaucgagac

SEQ ID NO: 28468 - RNA, 20 nt, Artificial Sequence
  CIITA targeting sequence
cgagaucugaugguuuugua

SEQ ID NO: 28469 - RNA, 20 nt, Artificial Sequence
  CIITA targeting sequence
cuaucgagaccagcaugggg

SEQ ID NO: 28470 - RNA, 20 nt, Artificial Sequence
  CIITA targeting sequence
agaccagcaugggggaaacu

SEQ ID NO: 28471 - RNA, 20 nt, Artificial Sequence
  CIITA targeting sequence
auagugaguuuucacgagau

SEQ ID NO: 28472 - RNA, 20 nt, Artificial Sequence
  CIITA targeting sequence
cgauagugaguuuucacgag

SEQ ID NO: 28473 - RNA, 20 nt, Artificial Sequence
  CIITA targeting sequence
cccaugcuggucucgauagu

SEQ ID NO: 28474 - RNA, 20 nt, Artificial Sequence
  CIITA targeting sequence
ugggggcaguuucccccaug

SEQ ID NO: 28475 - RNA, 20 nt, Artificial Sequence
  CIITA targeting sequence
aaucaccucccaccaggaac

SEQ ID NO: 28476 - RNA, 20 nt, Artificial Sequence
  CIITA targeting sequence
ccucccaccaggaacugccu

SEQ ID NO: 28477 - RNA, 20 nt, Artificial Sequence
  CIITA targeting sequence
caccaggaacugccuguucc

SEQ ID NO: 28478 - RNA, 20 nt, Artificial Sequence
  CIITA targeting sequence
uggugggaggugauuggauc

SEQ ID NO: 28479 - RNA, 20 nt, Artificial Sequence
  CIITA targeting sequence
uguagggauguagggaugau

SEQ ID NO: 28480 - RNA, 20 nt, Artificial Sequence
  CIITA targeting sequence
cuacaggaacaggcaguucc

SEQ ID NO: 28481 - RNA, 20 nt, Artificial Sequence
  CIITA targeting sequence
cuacaucccuacaggaacag

SEQ ID NO: 28482 - RNA, 20 nt, Artificial Sequence
  CIITA targeting sequence
ucccuacaucccuacaggaa

SEQ ID NO: 28483 - RNA, 20 nt, Artificial Sequence
  CIITA targeting sequence
ccaucaucccuacaucccua

SEQ ID NO: 28484 - RNA, 20 nt, Artificial Sequence
  CIITA targeting sequence
agcugagauuuggaugggga

SEQ ID NO: 28485 - RNA, 20 nt, Artificial Sequence
  CIITA targeting sequence
aacuguaauccccaucaucc

SEQ ID NO: 28486 - RNA, 20 nt, Artificial Sequence
  CIITA targeting sequence
gcucgaacuguaauccccau

SEQ ID NO: 28487 - RNA, 20 nt, Artificial Sequence
  CIITA targeting sequence
cagcucgaacuguaaucccc

SEQ ID NO: 28488 - RNA, 20 nt, Artificial Sequence
  CIITA targeting sequence
aaaucucagcucgaacugua

SEQ ID NO: 28489 - RNA, 20 nt, Artificial Sequence
  CIITA targeting sequence
ccauccaaaucucagcucga

SEQ ID NO: 28490 - RNA, 20 nt, Artificial Sequence
  CIITA targeting sequence
guguccccauccaaaucuca

SEQ ID NO: 28491 - RNA, 20 nt, Artificial Sequence
  CIITA targeting sequence
gggcagaaaccucuaaggcu

SEQ ID NO: 28492 - RNA, 20 nt, Artificial Sequence
  CIITA targeting sequence
gcccugauaggguuuggcuc

SEQ ID NO: 28493 - RNA, 20 nt, Artificial Sequence
  CIITA targeting sequence
aaggcuuuaugaucgcagau

SEQ ID NO: 28494 - RNA, 20 nt, Artificial Sequence
  CIITA targeting sequence
uaaagccuuagagguuucug

SEQ ID NO: 28495 - RNA, 20 nt, Artificial Sequence
  CIITA targeting sequence
cagauccacugcauugcagc

SEQ ID NO: 28496 - RNA, 20 nt, Artificial Sequence
  CIITA targeting sequence
gcgaucauaaagccuuagag

SEQ ID NO: 28497 - RNA, 20 nt, Artificial Sequence
  CIITA targeting sequence
acugcauugcagccaucccc

SEQ ID NO: 28498 - RNA, 20 nt, Artificial Sequence
  CIITA targeting sequence
ccucgguugcacagacauuc

SEQ ID NO: 28499 - RNA, 20 nt, Artificial Sequence
  CIITA targeting sequence
guugcacagacauucccuuu

SEQ ID NO: 28500 - RNA, 20 nt, Artificial Sequence
  CIITA targeting sequence
gugcaaccgaggggauggcu

SEQ ID NO: 28501 - RNA, 20 nt, Artificial Sequence
  CIITA targeting sequence
cuuucucgcacuuugaugcu

SEQ ID NO: 28502 - RNA, 20 nt, Artificial Sequence
  CIITA targeting sequence
cgcacuuugaugcuggaauc

SEQ ID NO: 28503 - RNA, 20 nt, Artificial Sequence
  CIITA targeting sequence
cacuuugaugcuggaaucac

SEQ ID NO: 28504 - RNA, 20 nt, Artificial Sequence
  CIITA targeting sequence
aagugcgagaaagggaaugu

SEQ ID NO: 28505 - RNA, 20 nt, Artificial Sequence
  CIITA targeting sequence
agcaucaaagugcgagaaag

SEQ ID NO: 28506 - RNA, 20 nt, Artificial Sequence
  CIITA targeting sequence
cuggucuuuucaccuucgua

SEQ ID NO: 28507 - RNA, 20 nt, Artificial Sequence
  CIITA targeting sequence
uuucaccuucguaggaggug

SEQ ID NO: 28508 - RNA, 20 nt, Artificial Sequence
  CIITA targeting sequence
ccuucguaggaggugucacu

SEQ ID NO: 28509 - RNA, 20 nt, Artificial Sequence
  CIITA targeting sequence
uaggaggugucacuccagga

SEQ ID NO: 28510 - RNA, 20 nt, Artificial Sequence
  CIITA targeting sequence
uacgaaggugaaaagaccag

SEQ ID NO: 28511 - RNA, 20 nt, Artificial Sequence
  CIITA targeting sequence
cuccaggauguccggaaaga

SEQ ID NO: 28512 - RNA, 20 nt, Artificial Sequence
  CIITA targeting sequence
aggauguccggaaagaaauc

SEQ ID NO: 28513 - RNA, 20 nt, Artificial Sequence
  CIITA targeting sequence
uggagugacaccuccuacga

SEQ ID NO: 28514 - RNA, 20 nt, Artificial Sequence
  CIITA targeting sequence
ggaaagaaaucaacuucugc

SEQ ID NO: 28515 - RNA, 20 nt, Artificial Sequence
  CIITA targeting sequence
ggacauccuggagugacacc

SEQ ID NO: 28516 - RNA, 20 nt, Artificial Sequence
  CIITA targeting sequence
uuccggacauccuggaguga

SEQ ID NO: 28517 - RNA, 20 nt, Artificial Sequence
  CIITA targeting sequence
acuucugccgcaaggugaag

SEQ ID NO: 28518 - RNA, 20 nt, Artificial Sequence
  CIITA targeting sequence
gccgcaaggugaagcugccc

SEQ ID NO: 28519 - RNA, 20 nt, Artificial Sequence
  CIITA targeting sequence
ccuugcggcagaaguugauu

SEQ ID NO: 28520 - RNA, 20 nt, Artificial Sequence
  CIITA targeting sequence
ucggggugguggagaacaug

SEQ ID NO: 28521 - RNA, 20 nt, Artificial Sequence
  CIITA targeting sequence
gggugguggagaacaugagu

SEQ ID NO: 28522 - RNA, 20 nt, Artificial Sequence
  CIITA targeting sequence
accaccccgaugaugggcag

SEQ ID NO: 28523 - RNA, 20 nt, Artificial Sequence
  CIITA targeting sequence
ccaccaccccgaugaugggc

SEQ ID NO: 28524 - RNA, 20 nt, Artificial Sequence
  CIITA targeting sequence
uguucuccaccaccccgaug

SEQ ID NO: 28525 - RNA, 20 nt, Artificial Sequence
  CIITA targeting sequence
ucuguccuaagugcaaggug

SEQ ID NO: 28526 - RNA, 20 nt, Artificial Sequence
  CIITA targeting sequence
guccuaagugcaaggugagg

SEQ ID NO: 28527 - RNA, 20 nt, Artificial Sequence
  CIITA targeting sequence
uaagugcaaggugagggcgc

SEQ ID NO: 28528 - RNA, 20 nt, Artificial Sequence
  CIITA targeting sequence
ccuugcacuuaggacagaug

SEQ ID NO: 28529 - RNA, 20 nt, Artificial Sequence
  CIITA targeting sequence
ccuggcagccccacgcgccc

SEQ ID NO: 28530 - RNA, 20 nt, Artificial Sequence
  CIITA targeting sequence
ugcucgccuggcagccccac

SEQ ID NO: 28531 - RNA, 20 nt, Artificial Sequence
  CIITA targeting sequence
ugcucucauggaugaggaaa

SEQ ID NO: 28532 - RNA, 20 nt, Artificial Sequence
  CIITA targeting sequence
cauggaugaggaaacgaucg

SEQ ID NO: 28533 - RNA, 20 nt, Artificial Sequence
  CIITA targeting sequence
uggaugaggaaacgaucgga

SEQ ID NO: 28534 - RNA, 20 nt, Artificial Sequence
  CIITA targeting sequence
augagagcaagaucuugcuc

SEQ ID NO: 28535 - RNA, 20 nt, Artificial Sequence
  CIITA targeting sequence
uccaugagagcaagaucuug

SEQ ID NO: 28536 - RNA, 20 nt, Artificial Sequence
  CIITA targeting sequence
ucauccaugagagcaagauc

SEQ ID NO: 28537 - RNA, 20 nt, Artificial Sequence
  CIITA targeting sequence
uuuccucauccaugagagca

SEQ ID NO: 28538 - RNA, 20 nt, Artificial Sequence
  CIITA targeting sequence
gaaggcugcucugcaaacua

SEQ ID NO: 28539 - RNA, 20 nt, Artificial Sequence
  CIITA targeting sequence
gaucguuuccucauccauga

SEQ ID NO: 28540 - RNA, 20 nt, Artificial Sequence
  CIITA targeting sequence
gcaaacuauuucugcuuucc

SEQ ID NO: 28541 - RNA, 20 nt, Artificial Sequence
  CIITA targeting sequence
gcuuucccugucauuuuggg

SEQ ID NO: 28542 - RNA, 20 nt, Artificial Sequence
  CIITA targeting sequence
cugucauuuugggaagugga

SEQ ID NO: 28543 - RNA, 20 nt, Artificial Sequence
  CIITA targeting sequence
uuuugggaaguggaaucaca

SEQ ID NO: 28544 - RNA, 20 nt, Artificial Sequence
  CIITA targeting sequence
caaaaugacagggaaagcag

SEQ ID NO: 28545 - RNA, 20 nt, Artificial Sequence
  CIITA targeting sequence
acuucccaaaaugacaggga

SEQ ID NO: 28546 - RNA, 20 nt, Artificial Sequence
  CIITA targeting sequence
caauuaaaaucccuuucugc

SEQ ID NO: 28547 - RNA, 20 nt, Artificial Sequence
  CIITA targeting sequence
cuuucugcugacuaaaggaa

SEQ ID NO: 28548 - RNA, 20 nt, Artificial Sequence
  CIITA targeting sequence
gcugacuaaaggaaaguucu

SEQ ID NO: 28549 - RNA, 20 nt, Artificial Sequence
  CIITA targeting sequence
gcagaaagggauuuuaauug

SEQ ID NO: 28550 - RNA, 20 nt, Artificial Sequence
  CIITA targeting sequence
uuuagucagcagaaagggau

SEQ ID NO: 28551 - RNA, 20 nt, Artificial Sequence
  CIITA targeting sequence
uuagguguuaaggguuccac

SEQ ID NO: 28552 - RNA, 20 nt, Artificial Sequence
  CIITA targeting sequence
acauucaaacuaagccuuuu

SEQ ID NO: 28553 - RNA, 20 nt, Artificial Sequence
  CIITA targeting sequence
aacuaagccuuuuuuuuuuu

SEQ ID NO: 28554 - RNA, 20 nt, Artificial Sequence
  CIITA targeting sequence
uuaaaaugugguccauccuu

SEQ ID NO: 28555 - RNA, 20 nt, Artificial Sequence
  CIITA targeting sequence
auccuugugauucugcaaaa

SEQ ID NO: 28556 - RNA, 20 nt, Artificial Sequence
  CIITA targeting sequence
uugugauucugcaaaaaaau

SEQ ID NO: 28557 - RNA, 20 nt, Artificial Sequence
  CIITA targeting sequence
caaggauggaccacauuuua

SEQ ID NO: 28558 - RNA, 20 nt, Artificial Sequence
  CIITA targeting sequence
gcaaaaaaauuauguuuccu

SEQ ID NO: 28559 - RNA, 20 nt, Artificial Sequence
  CIITA targeting sequence
uccccuuugaauuugccuug

SEQ ID NO: 28560 - RNA, 20 nt, Artificial Sequence
  CIITA targeting sequence
ccuuugaauuugccuugcag

SEQ ID NO: 28561 - RNA, 20 nt, Artificial Sequence
  CIITA targeting sequence
aaggggaggaaacauaauuu

SEQ ID NO: 28562 - RNA, 20 nt, Artificial Sequence
  CIITA targeting sequence
gcaaggcaaauucaaagggg

SEQ ID NO: 28563 - RNA, 20 nt, Artificial Sequence
  CIITA targeting sequence
uucugcaaggcaaauucaaa

SEQ ID NO: 28564 - RNA, 20 nt, Artificial Sequence
  CIITA targeting sequence
cagauauucccucccacaac

SEQ ID NO: 28565 - RNA, 20 nt, Artificial Sequence
  CIITA targeting sequence
gauauucccucccacaaccg

SEQ ID NO: 28566 - RNA, 20 nt, Artificial Sequence
  CIITA targeting sequence
gagauucuuucugcaaggca

SEQ ID NO: 28567 - RNA, 20 nt, Artificial Sequence
  CIITA targeting sequence
cucccacaaccgggggcgcg

SEQ ID NO: 28568 - RNA, 20 nt, Artificial Sequence
  CIITA targeting sequence
cacaaccgggggcgcggagc

SEQ ID NO: 28569 - RNA, 20 nt, Artificial Sequence
  CIITA targeting sequence
gcgcccccgguugugggagg

SEQ ID NO: 28570 - RNA, 20 nt, Artificial Sequence
  CIITA targeting sequence
ugugccaggacuuggagguc

SEQ ID NO: 28571 - RNA, 20 nt, Artificial Sequence
  CIITA targeting sequence
uggcacaugagcuccgcgcc

SEQ ID NO: 28572 - RNA, 20 nt, Artificial Sequence
  CIITA targeting sequence
aaguccuggcacaugagcuc

SEQ ID NO: 28573 - RNA, 20 nt, Artificial Sequence
  CIITA targeting sequence
cucuccucggcagagugccc

SEQ ID NO: 28574 - RNA, 20 nt, Artificial Sequence
  CIITA targeting sequence
ccucggcagagugccccugg

SEQ ID NO: 28575 - RNA, 20 nt, Artificial Sequence
  CIITA targeting sequence
ucggcagagugccccuggau

SEQ ID NO: 28576 - RNA, 20 nt, Artificial Sequence
  CIITA targeting sequence
gcagagugccccuggauccg

SEQ ID NO: 28577 - RNA, 20 nt, Artificial Sequence
  CIITA targeting sequence
gccgaggagagggaccucca

SEQ ID NO: 28578 - RNA, 20 nt, Artificial Sequence
  CIITA targeting sequence
aggggcacucugccgaggag

SEQ ID NO: 28579 - RNA, 20 nt, Artificial Sequence
  CIITA targeting sequence
gcucauaggugggugacccc

SEQ ID NO: 28580 - RNA, 20 nt, Artificial Sequence
  CIITA targeting sequence
uaggugggugaccccagugu

SEQ ID NO: 28581 - RNA, 20 nt, Artificial Sequence
  CIITA targeting sequence
cccaccuaugagcggaucca

SEQ ID NO: 28582 - RNA, 20 nt, Artificial Sequence
  CIITA targeting sequence
cuccucggucagccccacag

SEQ ID NO: 28583 - RNA, 20 nt, Artificial Sequence
  CIITA targeting sequence
ucggucagccccacaggcac

SEQ ID NO: 28584 - RNA, 20 nt, Artificial Sequence
  CIITA targeting sequence
gucagccccacaggcacggg

SEQ ID NO: 28585 - RNA, 20 nt, Artificial Sequence
  CIITA targeting sequence
gccccacaggcacgggucgg

SEQ ID NO: 28586 - RNA, 20 nt, Artificial Sequence
  CIITA targeting sequence
ggcacaacagggggcggcua

SEQ ID NO: 28587 - RNA, 20 nt, Artificial Sequence
  CIITA targeting sequence
guagccgcccccuguugugc

SEQ ID NO: 28588 - RNA, 20 nt, Artificial Sequence
  CIITA targeting sequence
cuguagccgcccccuguugu

SEQ ID NO: 28589 - RNA, 20 nt, Artificial Sequence
  CIITA targeting sequence
auugccccucucuguagccg

SEQ ID NO: 28590 - RNA, 20 nt, Artificial Sequence
  CIITA targeting sequence
uuccauugccccucucugua

SEQ ID NO: 28591 - RNA, 20 nt, Artificial Sequence
  CIITA targeting sequence
uccuuccauugccccucucu

SEQ ID NO: 28592 - RNA, 20 nt, Artificial Sequence
  CIITA targeting sequence
auggggcgcuggagccagac

SEQ ID NO: 28593 - RNA, 20 nt, Artificial Sequence
  CIITA targeting sequence
agcgccccauugacccuccu

SEQ ID NO: 28594 - RNA, 20 nt, Artificial Sequence
  CIITA targeting sequence
ggcuccagcgccccauugac

SEQ ID NO: 28595 - RNA, 20 nt, Artificial Sequence
  CIITA targeting sequence
agcuggcaccccaagaggcc

SEQ ID NO: 28596 - RNA, 20 nt, Artificial Sequence
  CIITA targeting sequence
uggggugccagcuggagggu

SEQ ID NO: 28597 - RNA, 20 nt, Artificial Sequence
  CIITA targeting sequence
cgguggccucuuggggugcc

SEQ ID NO: 28598 - RNA, 20 nt, Artificial Sequence
  CIITA targeting sequence
cccgguggccucuuggggug

SEQ ID NO: 28599 - RNA, 20 nt, Artificial Sequence
  CIITA targeting sequence
cucccgguggccucuugggg

SEQ ID NO: 28600 - RNA, 20 nt, Artificial Sequence
  CIITA targeting sequence
gccucucucccgguggccuc

SEQ ID NO: 28601 - RNA, 20 nt, Artificial Sequence
  CIITA targeting sequence
cggccucucucccgguggcc

SEQ ID NO: 28602 - RNA, 20 nt, Artificial Sequence
  CIITA targeting sequence
cgcuaccugcccgcaggggu

SEQ ID NO: 28603 - RNA, 20 nt, Artificial Sequence
  CIITA targeting sequence
ggcagaggggugaggccugg

SEQ ID NO: 28604 - RNA, 20 nt, Artificial Sequence
  CIITA targeting sequence
gccugaggccugcuugcucc

SEQ ID NO: 28605 - RNA, 20 nt, Artificial Sequence
  CIITA targeting sequence
ccccucugccugaggccugc

SEQ ID NO: 28606 - RNA, 20 nt, Artificial Sequence
  CIITA targeting sequence
aggccucaccccucugccug

SEQ ID NO: 28607 - RNA, 20 nt, Artificial Sequence
  CIITA targeting sequence
uccaggccucaccccucugc

SEQ ID NO: 28608 - RNA, 20 nt, Artificial Sequence
  CIITA targeting sequence
accccauucuuccaggccuc

SEQ ID NO: 28609 - RNA, 20 nt, Artificial Sequence
  CIITA targeting sequence
ccaaccucuaccccauucuu

SEQ ID NO: 28610 - RNA, 20 nt, Artificial Sequence
  CIITA targeting sequence
ccugccaccaccacccucac

SEQ ID NO: 28611 - RNA, 20 nt, Artificial Sequence
  CIITA targeting sequence
guccccugccaccaccaccc

SEQ ID NO: 28612 - RNA, 20 nt, Artificial Sequence
  CIITA targeting sequence
ucaguccccugccaccacca

SEQ ID NO: 28613 - RNA, 20 nt, Artificial Sequence
  CIITA targeting sequence
ggugcccuccucaguccccu

SEQ ID NO: 28614 - RNA, 20 nt, Artificial Sequence
  CIITA targeting sequence
aucgggugcccuccucaguc

SEQ ID NO: 28615 - RNA, 20 nt, Artificial Sequence
  CIITA targeting sequence
aggggaugcacauggcgucc

SEQ ID NO: 28616 - RNA, 20 nt, Artificial Sequence
  CIITA targeting sequence
ccuggagccgccccucuauc

SEQ ID NO: 28617 - RNA, 20 nt, Artificial Sequence
  CIITA targeting sequence
agguuacagaggaaggcggc

SEQ ID NO: 28618 - RNA, 20 nt, Artificial Sequence
  CIITA targeting sequence
guaaccuggacgccaugugc

SEQ ID NO: 28619 - RNA, 20 nt, Artificial Sequence
  CIITA targeting sequence
ucuguaaccuggacgccaug

SEQ ID NO: 28620 - RNA, 20 nt, Artificial Sequence
  CIITA targeting sequence
ggccgccuuccucuguaacc

SEQ ID NO: 28621 - RNA, 20 nt, Artificial Sequence
  CIITA targeting sequence
ccucaggccgccuuccucug

SEQ ID NO: 28622 - RNA, 20 nt, Artificial Sequence
  CIITA targeting sequence
cuuaggaaggggccgggccu

SEQ ID NO: 28623 - RNA, 20 nt, Artificial Sequence
  CIITA targeting sequence
uaagggauuuucaccucagg

SEQ ID NO: 28624 - RNA, 20 nt, Artificial Sequence
  CIITA targeting sequence
ugugcccggagaagccagca

SEQ ID NO: 28625 - RNA, 20 nt, Artificial Sequence
  CIITA targeting sequence
gggcacaggaggcccggccc

SEQ ID NO: 28626 - RNA, 20 nt, Artificial Sequence
  CIITA targeting sequence
ccgggcacaggaggcccggc

SEQ ID NO: 28627 - RNA, 20 nt, Artificial Sequence
  CIITA targeting sequence
gugccgugcuggcuucuccg

SEQ ID NO: 28628 - RNA, 20 nt, Artificial Sequence
  CIITA targeting sequence
ucugugccgugcuggcuucu

SEQ ID NO: 28629 - RNA, 20 nt, Artificial Sequence
  CIITA targeting sequence
ccagcaccgggacagaccgg

SEQ ID NO: 28630 - RNA, 20 nt, Artificial Sequence
  CIITA targeting sequence
agcaccgggacagaccggaa

SEQ ID NO: 28631 - RNA, 20 nt, Artificial Sequence
  CIITA targeting sequence
cggugcuggagacaaagggg

SEQ ID NO: 28632 - RNA, 20 nt, Artificial Sequence
  CIITA targeting sequence
gucccggugcuggagacaaa

SEQ ID NO: 28633 - RNA, 20 nt, Artificial Sequence
  CIITA targeting sequence
ggucugucccggugcuggag

SEQ ID NO: 28634 - RNA, 20 nt, Artificial Sequence
  CIITA targeting sequence
gcguuccggucugucccggu

SEQ ID NO: 28635 - RNA, 20 nt, Artificial Sequence
  CIITA targeting sequence
cuggccugcgagcaggggcc

SEQ ID NO: 28636 - RNA, 20 nt, Artificial Sequence
  CIITA targeting sequence
caggccagugauccgcguuc

SEQ ID NO: 28637 - RNA, 20 nt, Artificial Sequence
  CIITA targeting sequence
caaaaaaugcucuucuuaag

SEQ ID NO: 28638 - RNA, 20 nt, Artificial Sequence
  CIITA targeting sequence
ucuuaaguacgugggucucc

SEQ ID NO: 28639 - RNA, 20 nt, Artificial Sequence
  CIITA targeting sequence
uaaguacgugggucucccag

SEQ ID NO: 28640 - RNA, 20 nt, Artificial Sequence
  CIITA targeting sequence
cccaggaucccaagagaugc

SEQ ID NO: 28641 - RNA, 20 nt, Artificial Sequence
  CIITA targeting sequence
caggaucccaagagaugccc

SEQ ID NO: 28642 - RNA, 20 nt, Artificial Sequence
  CIITA targeting sequence
ugggagacccacguacuuaa

SEQ ID NO: 28643 - RNA, 20 nt, Artificial Sequence
  CIITA targeting sequence
caagagaugcccacucccug

SEQ ID NO: 28644 - RNA, 20 nt, Artificial Sequence
  CIITA targeting sequence
ugggauccugggagacccac

SEQ ID NO: 28645 - RNA, 20 nt, Artificial Sequence
  CIITA targeting sequence
cuugggauccugggagaccc

SEQ ID NO: 28646 - RNA, 20 nt, Artificial Sequence
  CIITA targeting sequence
cugaguggcccugaggcuga

SEQ ID NO: 28647 - RNA, 20 nt, Artificial Sequence
  CIITA targeting sequence
gggagugggcaucucuuggg

SEQ ID NO: 28648 - RNA, 20 nt, Artificial Sequence
  CIITA targeting sequence
gggccacucagggagugggc

SEQ ID NO: 28649 - RNA, 20 nt, Artificial Sequence
  CIITA targeting sequence
gccucagggccacucaggga

SEQ ID NO: 28650 - RNA, 20 nt, Artificial Sequence
  CIITA targeting sequence
uucagccucagggccacuca

SEQ ID NO: 28651 - RNA, 20 nt, Artificial Sequence
  CIITA targeting sequence
cuccuucagccucagggcca

SEQ ID NO: 28652 - RNA, 20 nt, Artificial Sequence
  CIITA targeting sequence
cgucuccacccacacgcccg

SEQ ID NO: 28653 - RNA, 20 nt, Artificial Sequence
  CIITA targeting sequence
ccacccacacgcccgccggg

SEQ ID NO: 28654 - RNA, 20 nt, Artificial Sequence
  CIITA targeting sequence
acccacacgcccgccgggcg

SEQ ID NO: 28655 - RNA, 20 nt, Artificial Sequence
  CIITA targeting sequence
ccgcggggcgcugggcaggg

SEQ ID NO: 28656 - RNA, 20 nt, Artificial Sequence
  CIITA targeting sequence
aagcugcucccccaggaggc

SEQ ID NO: 28657 - RNA, 20 nt, Artificial Sequence
  CIITA targeting sequence
aguguaggcccugcccagcg

SEQ ID NO: 28658 - RNA, 20 nt, Artificial Sequence
  CIITA targeting sequence
cccaggaggcugcugucccc

SEQ ID NO: 28659 - RNA, 20 nt, Artificial Sequence
  CIITA targeting sequence
ugggggagcagcuucgagug

SEQ ID NO: 28660 - RNA, 20 nt, Artificial Sequence
  CIITA targeting sequence
cccaggaccgcggagccggg

SEQ ID NO: 28661 - RNA, 20 nt, Artificial Sequence
  CIITA targeting sequence
ugggggacagcagccuccug

SEQ ID NO: 28662 - RNA, 20 nt, Artificial Sequence
  CIITA targeting sequence
gcgguccugggggacagcag

SEQ ID NO: 28663 - RNA, 20 nt, Artificial Sequence
  CIITA targeting sequence
guuacuggggcccuuuagug

SEQ ID NO: 28664 - RNA, 20 nt, Artificial Sequence
  CIITA targeting sequence
ugcggggcguccagcacucg

SEQ ID NO: 28665 - RNA, 20 nt, Artificial Sequence
  CIITA targeting sequence
agcacucgccuuuaggucug

SEQ ID NO: 28666 - RNA, 20 nt, Artificial Sequence
  CIITA targeting sequence
ccuuuaggucugaggggaga

SEQ ID NO: 28667 - RNA, 20 nt, Artificial Sequence
  CIITA targeting sequence
gaggggagaacagagagaga

SEQ ID NO: 28668 - RNA, 20 nt, Artificial Sequence
  CIITA targeting sequence
gaccuaaaggcgagugcugg

SEQ ID NO: 28669 - RNA, 20 nt, Artificial Sequence
  CIITA targeting sequence
ccucagaccuaaaggcgagu

SEQ ID NO: 28670 - RNA, 20 nt, Artificial Sequence
  CIITA targeting sequence
ccccucagaccuaaaggcga

SEQ ID NO: 28671 - RNA, 20 nt, Artificial Sequence
  CIITA targeting sequence
guucuccccucagaccuaaa

SEQ ID NO: 28672 - RNA, 20 nt, Artificial Sequence
  CIITA targeting sequence
cuguucuccccucagaccua

SEQ ID NO: 28673 - RNA, 20 nt, Artificial Sequence
  CIITA targeting sequence
cucuguucuccccucagacc

SEQ ID NO: 28674 - RNA, 20 nt, Artificial Sequence
  CIITA targeting sequence
cucucuguucuccccucaga

SEQ ID NO: 28675 - RNA, 20 nt, Artificial Sequence
  CIITA targeting sequence
agccuucucucucuguucuc

SEQ ID NO: 28676 - RNA, 20 nt, Artificial Sequence
  CIITA targeting sequence
ccuccagccuucucucucug

SEQ ID NO: 28677 - RNA, 20 nt, Artificial Sequence
  CIITA targeting sequence
cggccuccccuccagccuuc

SEQ ID NO: 28678 - RNA, 20 nt, Artificial Sequence
  CIITA targeting sequence
aggagugccggcugcaccca

SEQ ID NO: 28679 - RNA, 20 nt, Artificial Sequence
  CIITA targeting sequence
uggaucccggccuccccucc

SEQ ID NO: 28680 - RNA, 20 nt, Artificial Sequence
  CIITA targeting sequence
gaacuuccacuccauuuguc

SEQ ID NO: 28681 - RNA, 20 nt, Artificial Sequence
  CIITA targeting sequence
gaggcaugggugcagccggc

SEQ ID NO: 28682 - RNA, 20 nt, Artificial Sequence
  CIITA targeting sequence
acuccauuugucagggaacc

SEQ ID NO: 28683 - RNA, 20 nt, Artificial Sequence
  CIITA targeting sequence
auuugucagggaaccaaggc

SEQ ID NO: 28684 - RNA, 20 nt, Artificial Sequence
  CIITA targeting sequence
gggaaccaaggccaguguga

SEQ ID NO: 28685 - RNA, 20 nt, Artificial Sequence
  CIITA targeting sequence
cugacaaauggaguggaagu

SEQ ID NO: 28686 - RNA, 20 nt, Artificial Sequence
  CIITA targeting sequence
cacuggccuugguucccuga

SEQ ID NO: 28687 - RNA, 20 nt, Artificial Sequence
  CIITA targeting sequence
gugccgggacaggagagagg

SEQ ID NO: 28688 - RNA, 20 nt, Artificial Sequence
  CIITA targeting sequence
cggcacagacaccucacacu

SEQ ID NO: 28689 - RNA, 20 nt, Artificial Sequence
  CIITA targeting sequence
ugucccggcacagacaccuc

SEQ ID NO: 28690 - RNA, 20 nt, Artificial Sequence
  CIITA targeting sequence
ccugucccggcacagacacc

SEQ ID NO: 28691 - RNA, 20 nt, Artificial Sequence
  CIITA targeting sequence
cuccugucccggcacagaca

SEQ ID NO: 28692 - RNA, 20 nt, Artificial Sequence
  CIITA targeting sequence
cccgcccggccccucucucc

SEQ ID NO: 28693 - RNA, 20 nt, Artificial Sequence
  CIITA targeting sequence
uggccaggccauacuucacc

SEQ ID NO: 28694 - RNA, 20 nt, Artificial Sequence
  CIITA targeting sequence
ccuggccaggccauacuuca

SEQ ID NO: 28695 - RNA, 20 nt, Artificial Sequence
  CIITA targeting sequence
ccaagcacgcggcccccacc

SEQ ID NO: 28696 - RNA, 20 nt, Artificial Sequence
  CIITA targeting sequence
ccccaagcacgcggccccca

SEQ ID NO: 28697 - RNA, 20 nt, Artificial Sequence
  CIITA targeting sequence
acgggccccgcccucucccc

SEQ ID NO: 28698 - RNA, 20 nt, Artificial Sequence
  CIITA targeting sequence
ccacgggccccgcccucucc

SEQ ID NO: 28699 - RNA, 20 nt, Artificial Sequence
  CIITA targeting sequence
aggcucuccacgggccccgc

SEQ ID NO: 28700 - RNA, 20 nt, Artificial Sequence
  CIITA targeting sequence
ccgccuccaggcucuccacg

SEQ ID NO: 28701 - RNA, 20 nt, Artificial Sequence
  CIITA targeting sequence
gcccuccccgccuccaggcu

SEQ ID NO: 28702 - RNA, 20 nt, Artificial Sequence
  CIITA targeting sequence
ccacguggccuccgcccucc

SEQ ID NO: 28703 - RNA, 20 nt, Artificial Sequence
  CIITA targeting sequence
ccaaggcuccccacguggcc

SEQ ID NO: 28704 - RNA, 20 nt, Artificial Sequence
  CIITA targeting sequence
ccaugcagcccuuccccaag

SEQ ID NO: 28705 - RNA, 20 nt, Artificial Sequence
  CIITA targeting sequence
ccccaugcagcccuucccca

SEQ ID NO: 28706 - RNA, 20 nt, Artificial Sequence
  CIITA targeting sequence
cauucuccccaugcagcccu

SEQ ID NO: 28707 - RNA, 20 nt, Artificial Sequence
  CIITA targeting sequence
cacaggcucccauucucccc

SEQ ID NO: 28708 - RNA, 20 nt, Artificial Sequence
  CIITA targeting sequence
uuucccacaggcucccauuc

SEQ ID NO: 28709 - RNA, 20 nt, Artificial Sequence
  CIITA targeting sequence
gugucaugugccugggaaca

SEQ ID NO: 28710 - RNA, 20 nt, Artificial Sequence
  CIITA targeting sequence
ugugccugggaacaggaggc

SEQ ID NO: 28711 - RNA, 20 nt, Artificial Sequence
  CIITA targeting sequence
caggcacaugacacugacag

SEQ ID NO: 28712 - RNA, 20 nt, Artificial Sequence
  CIITA targeting sequence
uguucccaggcacaugacac

SEQ ID NO: 28713 - RNA, 20 nt, Artificial Sequence
  CIITA targeting sequence
ggaguggcugcccugggaua

SEQ ID NO: 28714 - RNA, 20 nt, Artificial Sequence
  CIITA targeting sequence
ugagccuccuguucccaggc

SEQ ID NO: 28715 - RNA, 20 nt, Artificial Sequence
  CIITA targeting sequence
cagggcagccacuccugagc

SEQ ID NO: 28716 - RNA, 20 nt, Artificial Sequence
  CIITA targeting sequence
ggaugaggcccuggguucug

SEQ ID NO: 28717 - RNA, 20 nt, Artificial Sequence
  CIITA targeting sequence
ugaaccccuaucccagggca

SEQ ID NO: 28718 - RNA, 20 nt, Artificial Sequence
  CIITA targeting sequence
uccugaaccccuaucccagg

SEQ ID NO: 28719 - RNA, 20 nt, Artificial Sequence
  CIITA targeting sequence
ggcguugguguagaaaggaa

SEQ ID NO: 28720 - RNA, 20 nt, Artificial Sequence
  CIITA targeting sequence
acaccaacgccagaacccag

SEQ ID NO: 28721 - RNA, 20 nt, Artificial Sequence
  CIITA targeting sequence
uuucuacaccaacgccagaa

SEQ ID NO: 28722 - RNA, 20 nt, Artificial Sequence
  CIITA targeting sequence
cuuccuuucuacaccaacgc

SEQ ID NO: 28723 - RNA, 20 nt, Artificial Sequence
  CIITA targeting sequence
ugugugugucccuuccuuuc

SEQ ID NO: 28724 - RNA, 20 nt, Artificial Sequence
  CIITA targeting sequence
cuugugugugucccuuccuu

SEQ ID NO: 28725 - RNA, 20 nt, Artificial Sequence
  CIITA targeting sequence
cucuugugugugucccuucc

SEQ ID NO: 28726 - RNA, 20 nt, Artificial Sequence
  CIITA targeting sequence
cuuucucucuuguguguguc

SEQ ID NO: 28727 - RNA, 20 nt, Artificial Sequence
  CIITA targeting sequence
gagggucaagguugucccug

SEQ ID NO: 28728 - RNA, 20 nt, Artificial Sequence
  CIITA targeting sequence
gaugccgucacuuucucucu

SEQ ID NO: 28729 - RNA, 20 nt, Artificial Sequence
  CIITA targeting sequence
agguugucccugcugccagu

SEQ ID NO: 28730 - RNA, 20 nt, Artificial Sequence
  CIITA targeting sequence
cugcugccaguacaagucac

SEQ ID NO: 28731 - RNA, 20 nt, Artificial Sequence
  CIITA targeting sequence
ccuggaggaggguccguccc

SEQ ID NO: 28732 - RNA, 20 nt, Artificial Sequence
  CIITA targeting sequence
aggugacuuguacuggcagc

SEQ ID NO: 28733 - RNA, 20 nt, Artificial Sequence
  CIITA targeting sequence
uccaggugacuuguacuggc

SEQ ID NO: 28734 - RNA, 20 nt, Artificial Sequence
  CIITA targeting sequence
gucccucagagacagugaag

SEQ ID NO: 28735 - RNA, 20 nt, Artificial Sequence
  CIITA targeting sequence
cucagagacagugaagcagg

SEQ ID NO: 28736 - RNA, 20 nt, Artificial Sequence
  CIITA targeting sequence
gagacagugaagcaggggug

SEQ ID NO: 28737 - RNA, 20 nt, Artificial Sequence
  CIITA targeting sequence
gagggacggacccuccucca

SEQ ID NO: 28738 - RNA, 20 nt, Artificial Sequence
  CIITA targeting sequence
cugagggacggacccuccuc

SEQ ID NO: 28739 - RNA, 20 nt, Artificial Sequence
  CIITA targeting sequence
cugucucugagggacggacc

SEQ ID NO: 28740 - RNA, 20 nt, Artificial Sequence
  CIITA targeting sequence
accaccccugcuucacuguc

SEQ ID NO: 28741 - RNA, 20 nt, Artificial Sequence
  CIITA targeting sequence
cucuaccaccccugcuucac

SEQ ID NO: 28742 - RNA, 20 nt, Artificial Sequence
  CIITA targeting sequence
ggggugcugcggcuaagggg

SEQ ID NO: 28743 - RNA, 20 nt, Artificial Sequence
  CIITA targeting sequence
ggggcucagguugucagcag

SEQ ID NO: 28744 - RNA, 20 nt, Artificial Sequence
  CIITA targeting sequence
gguugucagcagguucuggg

SEQ ID NO: 28745 - RNA, 20 nt, Artificial Sequence
  CIITA targeting sequence
gcagguucugggguccguca

SEQ ID NO: 28746 - RNA, 20 nt, Artificial Sequence
  CIITA targeting sequence
gggguccgucaggagaaggu

SEQ ID NO: 28747 - RNA, 20 nt, Artificial Sequence
  CIITA targeting sequence
gucaggagaaggugguucau

SEQ ID NO: 28748 - RNA, 20 nt, Artificial Sequence
  CIITA targeting sequence
ggagaaggugguucaugucc

SEQ ID NO: 28749 - RNA, 20 nt, Artificial Sequence
  CIITA targeting sequence
ugacggaccccagaaccugc

SEQ ID NO: 28750 - RNA, 20 nt, Artificial Sequence
  CIITA targeting sequence
ccugacggaccccagaaccu

SEQ ID NO: 28751 - RNA, 20 nt, Artificial Sequence
  CIITA targeting sequence
uguccgugcaguugaguuuu

SEQ ID NO: 28752 - RNA, 20 nt, Artificial Sequence
  CIITA targeting sequence
gugcaguugaguuuugaagc

SEQ ID NO: 28753 - RNA, 20 nt, Artificial Sequence
  CIITA targeting sequence
acugcacggacaugaaccac

SEQ ID NO: 28754 - RNA, 20 nt, Artificial Sequence
  CIITA targeting sequence
aaacucaacugcacggacau

SEQ ID NO: 28755 - RNA, 20 nt, Artificial Sequence
  CIITA targeting sequence
uguggcuucaaaacucaacu

SEQ ID NO: 28756 - RNA, 20 nt, Artificial Sequence
  CIITA targeting sequence
auguccuguggcuucaaaac

SEQ ID NO: 28757 - RNA, 20 nt, Artificial Sequence
  CIITA targeting sequence
uguccauguccuguggcuuc

SEQ ID NO: 28758 - RNA, 20 nt, Artificial Sequence
  CIITA targeting sequence
gcacggccccuuggcaaucc

SEQ ID NO: 28759 - RNA, 20 nt, Artificial Sequence
  CIITA targeting sequence
cgcuuucugcacggccccuu

SEQ ID NO: 28760 - RNA, 20 nt, Artificial Sequence
  CIITA targeting sequence
uggcucccgcuuucugcacg

SEQ ID NO: 28761 - RNA, 20 nt, Artificial Sequence
  CIITA targeting sequence
uccuggcucccgcuuucugc

SEQ ID NO: 28762 - RNA, 20 nt, Artificial Sequence
  CIITA targeting sequence
cccaacacuguccuccuggc

SEQ ID NO: 28763 - RNA, 20 nt, Artificial Sequence
  CIITA targeting sequence
aggaagugguagggggguag

SEQ ID NO: 28764 - RNA, 20 nt, Artificial Sequence
  CIITA targeting sequence
aggcagccaucccccaacac

SEQ ID NO: 28765 - RNA, 20 nt, Artificial Sequence
  CIITA targeting sequence
ucgaggcagccaucccccaa

SEQ ID NO: 28766 - RNA, 20 nt, Artificial Sequence
  CIITA targeting sequence
cacccuaccccccuaccacu

SEQ ID NO: 28767 - RNA, 20 nt, Artificial Sequence
  CIITA targeting sequence
gaagaugggaacagcccggg

SEQ ID NO: 28768 - RNA, 20 nt, Artificial Sequence
  CIITA targeting sequence
gaguggcccucgcacccuac

SEQ ID NO: 28769 - RNA, 20 nt, Artificial Sequence
  CIITA targeting sequence
ucagaguggcccucgcaccc

SEQ ID NO: 28770 - RNA, 20 nt, Artificial Sequence
  CIITA targeting sequence
caucuucagaguggcccucg

SEQ ID NO: 28771 - RNA, 20 nt, Artificial Sequence
  CIITA targeting sequence
cgggcuguucccaucuucag

SEQ ID NO: 28772 - RNA, 20 nt, Artificial Sequence
  CIITA targeting sequence
cccgggcuguucccaucuuc

SEQ ID NO: 28773 - RNA, 20 nt, Artificial Sequence
  CIITA targeting sequence
ggcguucucccgggcuguuc

SEQ ID NO: 28774 - RNA, 20 nt, Artificial Sequence
  CIITA targeting sequence
cuggcguucucccgggcugu

SEQ ID NO: 28775 - RNA, 20 nt, Artificial Sequence
  CIITA targeting sequence
ugggcacauggggucucugg

SEQ ID NO: 28776 - RNA, 20 nt, Artificial Sequence
  CIITA targeting sequence
ccaaauccuuuuucccuuau

SEQ ID NO: 28777 - RNA, 20 nt, Artificial Sequence
  CIITA targeting sequence
uuuuucccuuauucccacau

SEQ ID NO: 28778 - RNA, 20 nt, Artificial Sequence
  CIITA targeting sequence
cuuauucccacaucccacaa

SEQ ID NO: 28779 - RNA, 20 nt, Artificial Sequence
  CIITA targeting sequence
cacaucccacaauacuucuc

SEQ ID NO: 28780 - RNA, 20 nt, Artificial Sequence
  CIITA targeting sequence
cacaauacuucucuggcaug

SEQ ID NO: 28781 - RNA, 20 nt, Artificial Sequence
  CIITA targeting sequence
cuggcaugugauuuccccaa

SEQ ID NO: 28782 - RNA, 20 nt, Artificial Sequence
  CIITA targeting sequence
ggcaugugauuuccccaaca

SEQ ID NO: 28783 - RNA, 20 nt, Artificial Sequence
  CIITA targeting sequence
caugccagagaaguauugug

SEQ ID NO: 28784 - RNA, 20 nt, Artificial Sequence
  CIITA targeting sequence
ccaacaacaugcagaaaagu

SEQ ID NO: 28785 - RNA, 20 nt, Artificial Sequence
  CIITA targeting sequence
gcauguuguuggggaaauca

SEQ ID NO: 28786 - RNA, 20 nt, Artificial Sequence
  CIITA targeting sequence
caaccuuccccagcaucaua

SEQ ID NO: 28787 - RNA, 20 nt, Artificial Sequence
  CIITA targeting sequence
accuuccccagcaucauaaa

SEQ ID NO: 28788 - RNA, 20 nt, Artificial Sequence
  CIITA targeting sequence
ccagcaucauaaaacacuca

SEQ ID NO: 28789 - RNA, 20 nt, Artificial Sequence
  CIITA targeting sequence
uaaaacacucaccaggcagc

SEQ ID NO: 28790 - RNA, 20 nt, Artificial Sequence
  CIITA targeting sequence
ccaggcagcuuuugcagugg

SEQ ID NO: 28791 - RNA, 20 nt, Artificial Sequence
  CIITA targeting sequence
ggccacugcaaaagcugccu

SEQ ID NO: 28792 - RNA, 20 nt, Artificial Sequence
  CIITA targeting sequence
ccacuuccggccacugcaaa

SEQ ID NO: 28793 - RNA, 20 nt, Artificial Sequence
  CIITA targeting sequence
ucaccacuuccggccacugc

SEQ ID NO: 28794 - RNA, 20 nt, Artificial Sequence
  CIITA targeting sequence
caucaccacuuccggccacu

SEQ ID NO: 28795 - RNA, 20 nt, Artificial Sequence
  CIITA targeting sequence
gaggccccuggaggcaguug

SEQ ID NO: 28796 - RNA, 20 nt, Artificial Sequence
  CIITA targeting sequence
gagggcagcucucaucacca

SEQ ID NO: 28797 - RNA, 20 nt, Artificial Sequence
  CIITA targeting sequence
aggggccucagagggcagcu

SEQ ID NO: 28798 - RNA, 20 nt, Artificial Sequence
  CIITA targeting sequence
ugcagcccaacugccuccag

SEQ ID NO: 28799 - RNA, 20 nt, Artificial Sequence
  CIITA targeting sequence
auucaugcagcccaacugcc

SEQ ID NO: 28800 - RNA, 20 nt, Artificial Sequence
  CIITA targeting sequence
cauccauucaugcagcccaa

SEQ ID NO: 28801 - RNA, 20 nt, Artificial Sequence
  CIITA targeting sequence
ccaaucacauccauucaugc

SEQ ID NO: 28802 - RNA, 20 nt, Artificial Sequence
  CIITA targeting sequence
uguccccaaucacauccauu

SEQ ID NO: 28803 - RNA, 20 nt, Artificial Sequence
  CIITA targeting sequence
auuccugccagccugcaccu

SEQ ID NO: 28804 - RNA, 20 nt, Artificial Sequence
  CIITA targeting sequence
ugccagccugcaccucugcc

SEQ ID NO: 28805 - RNA, 20 nt, Artificial Sequence
  CIITA targeting sequence
gccacaguucagcucugccg

SEQ ID NO: 28806 - RNA, 20 nt, Artificial Sequence
  CIITA targeting sequence
gcucugccgagaugggauug

SEQ ID NO: 28807 - RNA, 20 nt, Artificial Sequence
  CIITA targeting sequence
gccgagaugggauugguggg

SEQ ID NO: 28808 - RNA, 20 nt, Artificial Sequence
  CIITA targeting sequence
gcagagcugaacuguggcag

SEQ ID NO: 28809 - RNA, 20 nt, Artificial Sequence
  CIITA targeting sequence
cggcagagcugaacuguggc

SEQ ID NO: 28810 - RNA, 20 nt, Artificial Sequence
  CIITA targeting sequence
caucucggcagagcugaacu

SEQ ID NO: 28811 - RNA, 20 nt, Artificial Sequence
  CIITA targeting sequence
ugcccaccaaucccaucucg

SEQ ID NO: 28812 - RNA, 20 nt, Artificial Sequence
  CIITA targeting sequence
ggggaaacaucugugggaga

SEQ ID NO: 28813 - RNA, 20 nt, Artificial Sequence
  CIITA targeting sequence
ccugacaaacguccugccca

SEQ ID NO: 28814 - RNA, 20 nt, Artificial Sequence
  CIITA targeting sequence
gugggagaaaaugacaaggg

SEQ ID NO: 28815 - RNA, 20 nt, Artificial Sequence
  CIITA targeting sequence
cacagauguuuccccugaca

SEQ ID NO: 28816 - RNA, 20 nt, Artificial Sequence
  CIITA targeting sequence
cccacagauguuuccccuga

SEQ ID NO: 28817 - RNA, 20 nt, Artificial Sequence
  CIITA targeting sequence
uuuucucccacagauguuuc

SEQ ID NO: 28818 - RNA, 20 nt, Artificial Sequence
  CIITA targeting sequence
cuugucauuuucucccacag

SEQ ID NO: 28819 - RNA, 20 nt, Artificial Sequence
  CIITA targeting sequence
cccuugucauuuucucccac

SEQ ID NO: 28820 - RNA, 20 nt, Artificial Sequence
  CIITA targeting sequence
ugggcuaacgcucucccuug

SEQ ID NO: 28821 - RNA, 20 nt, Artificial Sequence
  CIITA targeting sequence
ucgugggcuaacgcucuccc

SEQ ID NO: 28822 - RNA, 20 nt, Artificial Sequence
  CIITA targeting sequence
uucaucgugggcuaacgcuc

SEQ ID NO: 28823 - RNA, 20 nt, Artificial Sequence
  CIITA targeting sequence
cccacuccuucaucgugggc

SEQ ID NO: 28824 - RNA, 20 nt, Artificial Sequence
  CIITA targeting sequence
uucccccacuccuucaucgu

SEQ ID NO: 28825 - RNA, 20 nt, Artificial Sequence
  CIITA targeting sequence
gucuauuggagcaucucagu

SEQ ID NO: 28826 - RNA, 20 nt, Artificial Sequence
  CIITA targeting sequence
auuggagcaucucagucugc

SEQ ID NO: 28827 - RNA, 20 nt, Artificial Sequence
  CIITA targeting sequence
aauagacugacauacuccag

SEQ ID NO: 28828 - RNA, 20 nt, Artificial Sequence
  CIITA targeting sequence
cagucugcuggaguauguca

SEQ ID NO: 28829 - RNA, 20 nt, Artificial Sequence
  CIITA targeting sequence
gucugcuggaguaugucagu

SEQ ID NO: 28830 - RNA, 20 nt, Artificial Sequence
  CIITA targeting sequence
gcuggaguaugucagucuau

SEQ ID NO: 28831 - RNA, 20 nt, Artificial Sequence
  CIITA targeting sequence
agcagacugagaugcuccaa

SEQ ID NO: 28832 - RNA, 20 nt, Artificial Sequence
  CIITA targeting sequence
gucuauuggagcaucucagu

SEQ ID NO: 28833 - RNA, 20 nt, Artificial Sequence
  CIITA targeting sequence
auuggagcaucucagucugc

SEQ ID NO: 28834 - RNA, 20 nt, Artificial Sequence
  CIITA targeting sequence
aauagacugacauacuccag

SEQ ID NO: 28835 - RNA, 20 nt, Artificial Sequence
  CIITA targeting sequence
cagucugcuggaguauguca

SEQ ID NO: 28836 - RNA, 20 nt, Artificial Sequence
  CIITA targeting sequence
gucugcuggaguaugucagu

SEQ ID NO: 28837 - RNA, 20 nt, Artificial Sequence
  CIITA targeting sequence
gcuggaguaugucagucuau

SEQ ID NO: 28838 - RNA, 20 nt, Artificial Sequence
  CIITA targeting sequence
agcagacugagaugcuccaa

SEQ ID NO: 28839 - RNA, 20 nt, Artificial Sequence
  CIITA targeting sequence
gucuauuggagcaucucagu

SEQ ID NO: 28840 - RNA, 20 nt, Artificial Sequence
  CIITA targeting sequence
auuggagcaucucagucugc

SEQ ID NO: 28841 - RNA, 20 nt, Artificial Sequence
  CIITA targeting sequence
aauagacugacauacuccag

SEQ ID NO: 28842 - RNA, 20 nt, Artificial Sequence
  CIITA targeting sequence
cagucugcuggaguaggucu

SEQ ID NO: 28843 - RNA, 20 nt, Artificial Sequence
  CIITA targeting sequence
gucugcuggaguaggucuau

SEQ ID NO: 28844 - RNA, 20 nt, Artificial Sequence
  CIITA targeting sequence
gcuggaguaggucuauugga

SEQ ID NO: 28845 - RNA, 20 nt, Artificial Sequence
  CIITA targeting sequence
agcagacugagaugcuccaa

SEQ ID NO: 28846 - RNA, 20 nt, Artificial Sequence
  CIITA targeting sequence
auuggagcaucucagucugc

SEQ ID NO: 28847 - RNA, 20 nt, Artificial Sequence
  CIITA targeting sequence
aauagaccuacuccagcaga

SEQ ID NO: 28848 - RNA, 20 nt, Artificial Sequence
  CIITA targeting sequence
cagucugcuggaguauguca

SEQ ID NO: 28849 - RNA, 20 nt, Artificial Sequence
  CIITA targeting sequence
gucugcuggaguaugucagu

SEQ ID NO: 28850 - RNA, 20 nt, Artificial Sequence
  CIITA targeting sequence
gcuggaguaugucagucugu

SEQ ID NO: 28851 - RNA, 20 nt, Artificial Sequence
  CIITA targeting sequence
agcagacugagaugcuccaa

SEQ ID NO: 28852 - RNA, 20 nt, Artificial Sequence
  CIITA targeting sequence
gucuguuggagcaucucagu

SEQ ID NO: 28853 - RNA, 20 nt, Artificial Sequence
  CIITA targeting sequence
guuggagcaucucagucugc

SEQ ID NO: 28854 - RNA, 20 nt, Artificial Sequence
  CIITA targeting sequence
aacagacugacauacuccag

SEQ ID NO: 28855 - RNA, 20 nt, Artificial Sequence
  CIITA targeting sequence
cagucugcuggaguauguca

SEQ ID NO: 28856 - RNA, 20 nt, Artificial Sequence
  CIITA targeting sequence
gucugcuggaguaugucagu

SEQ ID NO: 28857 - RNA, 20 nt, Artificial Sequence
  CIITA targeting sequence
gcuggaguaugucagucugu

SEQ ID NO: 28858 - RNA, 20 nt, Artificial Sequence
  CIITA targeting sequence
agcagacugagaugcuccaa

SEQ ID NO: 28859 - RNA, 20 nt, Artificial Sequence
  CIITA targeting sequence
gucuguuggagcaucucagu

SEQ ID NO: 28860 - RNA, 20 nt, Artificial Sequence
  CIITA targeting sequence
guuggagcaucucagucugc

SEQ ID NO: 28861 - RNA, 20 nt, Artificial Sequence
  CIITA targeting sequence
aacagacugacauacuccag

SEQ ID NO: 28862 - RNA, 20 nt, Artificial Sequence
  CIITA targeting sequence
cagucugcuggaguauguca

SEQ ID NO: 28863 - RNA, 20 nt, Artificial Sequence
  CIITA targeting sequence
gucugcuggaguaugucagu

SEQ ID NO: 28864 - RNA, 20 nt, Artificial Sequence
  CIITA targeting sequence
gcuggaguaugucagucugu

SEQ ID NO: 28865 - RNA, 20 nt, Artificial Sequence
  CIITA targeting sequence
agcagacugagaugcuccaa

SEQ ID NO: 28866 - RNA, 20 nt, Artificial Sequence
  CIITA targeting sequence
gucuguuggagcaucucagu

SEQ ID NO: 28867 - RNA, 20 nt, Artificial Sequence
  CIITA targeting sequence
guuggagcaucucagucugc

SEQ ID NO: 28868 - RNA, 20 nt, Artificial Sequence
  CIITA targeting sequence
aacagacugacauacuccag

SEQ ID NO: 28869 - RNA, 20 nt, Artificial Sequence
  CIITA targeting sequence
cagucugcuggaguauguca

SEQ ID NO: 28870 - RNA, 20 nt, Artificial Sequence
  CIITA targeting sequence
gucugcuggaguaugucagu

SEQ ID NO: 28871 - RNA, 20 nt, Artificial Sequence
  CIITA targeting sequence
gcuggaguaugucagucugu

SEQ ID NO: 28872 - RNA, 20 nt, Artificial Sequence
  CIITA targeting sequence
agcagacugagaugcuccaa

SEQ ID NO: 28873 - RNA, 20 nt, Artificial Sequence
  CIITA targeting sequence
gucuguuggagcaucugucu

SEQ ID NO: 28874 - RNA, 20 nt, Artificial Sequence
  CIITA targeting sequence
guuggagcaucugucugcug

SEQ ID NO: 28875 - RNA, 20 nt, Artificial Sequence
  CIITA targeting sequence
aacagacugacauacuccag

SEQ ID NO: 28876 - RNA, 20 nt, Artificial Sequence
  CIITA targeting sequence
gucugcuggaguaugucagu

SEQ ID NO: 28877 - RNA, 20 nt, Artificial Sequence
  CIITA targeting sequence
gcuggaguaugucagucugu

SEQ ID NO: 28878 - RNA, 20 nt, Artificial Sequence
  CIITA targeting sequence
agcagacagaugcuccaaca

SEQ ID NO: 28879 - RNA, 20 nt, Artificial Sequence
  CIITA targeting sequence
gucuguuggagcaucucagu

SEQ ID NO: 28880 - RNA, 20 nt, Artificial Sequence
  CIITA targeting sequence
guuggagcaucucagucugc

SEQ ID NO: 28881 - RNA, 20 nt, Artificial Sequence
  CIITA targeting sequence
aacagacugacauacuccag

SEQ ID NO: 28882 - RNA, 20 nt, Artificial Sequence
  CIITA targeting sequence
cagucugcuggaguauguca

SEQ ID NO: 28883 - RNA, 20 nt, Artificial Sequence
  CIITA targeting sequence
gucugcuggaguaugucagu

SEQ ID NO: 28884 - RNA, 20 nt, Artificial Sequence
  CIITA targeting sequence
gcuggaguaugucagucugu

SEQ ID NO: 28885 - RNA, 20 nt, Artificial Sequence
  CIITA targeting sequence
agcagacugagaugcuccaa

SEQ ID NO: 28886 - RNA, 20 nt, Artificial Sequence
  CIITA targeting sequence
gucuguuggagcaucugucu

SEQ ID NO: 28887 - RNA, 20 nt, Artificial Sequence
  CIITA targeting sequence
guuggagcaucugucugcug

SEQ ID NO: 28888 - RNA, 20 nt, Artificial Sequence
  CIITA targeting sequence
aacagacugacauacuccag

SEQ ID NO: 28889 - RNA, 20 nt, Artificial Sequence
  CIITA targeting sequence
gucugcuggagugucuuggc

SEQ ID NO: 28890 - RNA, 20 nt, Artificial Sequence
  CIITA targeting sequence
gcuggagugucuuggcugcu

SEQ ID NO: 28891 - RNA, 20 nt, Artificial Sequence
  CIITA targeting sequence
agcagacagaugcuccaaca

SEQ ID NO: 28892 - RNA, 20 nt, Artificial Sequence
  CIITA targeting sequence
uggcugcugucgaggaaagc

SEQ ID NO: 28893 - RNA, 20 nt, Artificial Sequence
  CIITA targeting sequence
aggaaagcugggcacagcca

SEQ ID NO: 28894 - RNA, 20 nt, Artificial Sequence
  CIITA targeting sequence
acagcagccaagacacucca

SEQ ID NO: 28895 - RNA, 20 nt, Artificial Sequence
  CIITA targeting sequence
ucgacagcagccaagacacu

SEQ ID NO: 28896 - RNA, 20 nt, Artificial Sequence
  CIITA targeting sequence
ugagcccacuuacccaucag

SEQ ID NO: 28897 - RNA, 20 nt, Artificial Sequence
  CIITA targeting sequence
ggaaugcccugguggcugug

SEQ ID NO: 28898 - RNA, 20 nt, Artificial Sequence
  CIITA targeting sequence
gaggggcugcaucucccaga

SEQ ID NO: 28899 - RNA, 20 nt, Artificial Sequence
  CIITA targeting sequence
gauggguaagugggcucagg

SEQ ID NO: 28900 - RNA, 20 nt, Artificial Sequence
  CIITA targeting sequence
cccagaagcgugccugcccg

SEQ ID NO: 28901 - RNA, 20 nt, Artificial Sequence
  CIITA targeting sequence
cagaagcgugccugcccgag

SEQ ID NO: 28902 - RNA, 20 nt, Artificial Sequence
  CIITA targeting sequence
gggagaugcagccccucuga

SEQ ID NO: 28903 - RNA, 20 nt, Artificial Sequence
  CIITA targeting sequence
ggcaggcacgcuucugggag

SEQ ID NO: 28904 - RNA, 20 nt, Artificial Sequence
  CIITA targeting sequence
ucucagucacuagcuaggag

SEQ ID NO: 28905 - RNA, 20 nt, Artificial Sequence
  CIITA targeting sequence
cagucacuagcuaggagcag

SEQ ID NO: 28906 - RNA, 20 nt, Artificial Sequence
  CIITA targeting sequence
gucacuagcuaggagcagcc

SEQ ID NO: 28907 - RNA, 20 nt, Artificial Sequence
  CIITA targeting sequence
cuagcuaggagcagccuggg

SEQ ID NO: 28908 - RNA, 20 nt, Artificial Sequence
  CIITA targeting sequence
uagcuagugacugagacgag

SEQ ID NO: 28909 - RNA, 20 nt, Artificial Sequence
  CIITA targeting sequence
caggcugcuccuagcuagug

SEQ ID NO: 28910 - RNA, 20 nt, Artificial Sequence
  CIITA targeting sequence
acacaaacguggugguggau

SEQ ID NO: 28911 - RNA, 20 nt, Artificial Sequence
  CIITA targeting sequence
accaccacguuuguguugag

SEQ ID NO: 28912 - RNA, 20 nt, Artificial Sequence
  CIITA targeting sequence
aaaauccaccaccacguuug

SEQ ID NO: 28913 - RNA, 20 nt, Artificial Sequence
  CIITA targeting sequence
ggcagcagcugccaugcucc

SEQ ID NO: 28914 - RNA, 20 nt, Artificial Sequence
  CIITA targeting sequence
cuggcagcagcugccaugcu

SEQ ID NO: 28915 - RNA, 20 nt, Artificial Sequence
  CIITA targeting sequence
aagagguguguccuuauggc

SEQ ID NO: 28916 - RNA, 20 nt, Artificial Sequence
  CIITA targeting sequence
uggaucucuggcagcagcug

SEQ ID NO: 28917 - RNA, 20 nt, Artificial Sequence
  CIITA targeting sequence
uuauggccaucacaauugcc

SEQ ID NO: 28918 - RNA, 20 nt, Artificial Sequence
  CIITA targeting sequence
caauugccacauuuuccaag

SEQ ID NO: 28919 - RNA, 20 nt, Artificial Sequence
  CIITA targeting sequence
aagguuuaaugaagagcuag

SEQ ID NO: 28920 - RNA, 20 nt, Artificial Sequence
  CIITA targeting sequence
uuaaaccuuggaaaaugugg

SEQ ID NO: 28921 - RNA, 20 nt, Artificial Sequence
  CIITA targeting sequence
ucauuaaaccuuggaaaaug

SEQ ID NO: 28922 - RNA, 20 nt, Artificial Sequence
  CIITA targeting sequence
agcucuucauuaaaccuugg

SEQ ID NO: 28923 - RNA, 20 nt, Artificial Sequence
  CIITA targeting sequence
auauccuuacccaaagucuc

SEQ ID NO: 28924 - RNA, 20 nt, Artificial Sequence
  CIITA targeting sequence
uuacccaaagucuccugaua

SEQ ID NO: 28925 - RNA, 20 nt, Artificial Sequence
  CIITA targeting sequence
ccugauacuaaaugauagca

SEQ ID NO: 28926 - RNA, 20 nt, Artificial Sequence
  CIITA targeting sequence
ugauacuaaaugauagcaac

SEQ ID NO: 28927 - RNA, 20 nt, Artificial Sequence
  CIITA targeting sequence
ggagacuuuggguaaggaua

SEQ ID NO: 28928 - RNA, 20 nt, Artificial Sequence
  CIITA targeting sequence
uuuaguaucaggagacuuug

SEQ ID NO: 28929 - RNA, 20 nt, Artificial Sequence
  CIITA targeting sequence
auuaaauacacacacacaca

SEQ ID NO: 28930 - RNA, 20 nt, Artificial Sequence
  CIITA targeting sequence
agccuggguaacacaggaag

SEQ ID NO: 28931 - RNA, 20 nt, Artificial Sequence
  CIITA targeting sequence
uguguuacccaggcuagagc

SEQ ID NO: 28932 - RNA, 20 nt, Artificial Sequence
  CIITA targeting sequence
uccuguguuacccaggcuag

SEQ ID NO: 28933 - RNA, 20 nt, Artificial Sequence
  CIITA targeting sequence
ucucuuaaaaaaaaaaaaaa

SEQ ID NO: 28934 - RNA, 20 nt, Artificial Sequence
  CIITA targeting sequence
cuuaaaaaaaaaaaaaaaaa

SEQ ID NO: 28935 - RNA, 20 nt, Artificial Sequence
  CIITA targeting sequence
uaaaaaaaaaaaaaaaaaaa

SEQ ID NO: 28936 - RNA, 20 nt, Artificial Sequence
  CIITA targeting sequence
uuuuuuuuuuuuuuuuuuuu

SEQ ID NO: 28937 - RNA, 20 nt, Artificial Sequence
  CIITA targeting sequence
cccagugugguggcaugugc

SEQ ID NO: 28938 - RNA, 20 nt, Artificial Sequence
  CIITA targeting sequence
cagcuacucaggaggcugag

SEQ ID NO: 28939 - RNA, 20 nt, Artificial Sequence
  CIITA targeting sequence
ggaggcugaguuagcaggau

SEQ ID NO: 28940 - RNA, 20 nt, Artificial Sequence
  CIITA targeting sequence
ugaguagcugggaccacagg

SEQ ID NO: 28941 - RNA, 20 nt, Artificial Sequence
  CIITA targeting sequence
gccuccugaguagcugggac

SEQ ID NO: 28942 - RNA, 20 nt, Artificial Sequence
  CIITA targeting sequence
ugcuaacucagccuccugag

SEQ ID NO: 28943 - RNA, 20 nt, Artificial Sequence
  CIITA targeting sequence
cuugagcccagggagguuga

SEQ ID NO: 28944 - RNA, 20 nt, Artificial Sequence
  CIITA targeting sequence
agugauccugcuaacucagc

SEQ ID NO: 28945 - RNA, 20 nt, Artificial Sequence
  CIITA targeting sequence
cugggcucaagugauccugc

SEQ ID NO: 28946 - RNA, 20 nt, Artificial Sequence
  CIITA targeting sequence
accucccugggcucaaguga

SEQ ID NO: 28947 - RNA, 20 nt, Artificial Sequence
  CIITA targeting sequence
cugcaaccucaaccucccug

SEQ ID NO: 28948 - RNA, 20 nt, Artificial Sequence
  CIITA targeting sequence
uggcucacugcaaccucaac

SEQ ID NO: 28949 - RNA, 20 nt, Artificial Sequence
  CIITA targeting sequence
caccacugcacuccagccug

SEQ ID NO: 28950 - RNA, 20 nt, Artificial Sequence
  CIITA targeting sequence
agccugggcgacagagcaag

SEQ ID NO: 28951 - RNA, 20 nt, Artificial Sequence
  CIITA targeting sequence
cccaggcuggagugcagugg

SEQ ID NO: 28952 - RNA, 20 nt, Artificial Sequence
  CIITA targeting sequence
gucgcccaggcuggagugca

SEQ ID NO: 28953 - RNA, 20 nt, Artificial Sequence
  CIITA targeting sequence
ugcucugucgcccaggcugg

SEQ ID NO: 28954 - RNA, 20 nt, Artificial Sequence
  CIITA targeting sequence
caaaaaaaaauuuaaaaaug

SEQ ID NO: 28955 - RNA, 20 nt, Artificial Sequence
  CIITA targeting sequence
aaaaaaaauuuaaaaauggc

SEQ ID NO: 28956 - RNA, 20 nt, Artificial Sequence
  CIITA targeting sequence
gcaagcaugccauuuuuaaa

SEQ ID NO: 28957 - RNA, 20 nt, Artificial Sequence
  CIITA targeting sequence
acgggcccagccacaggccu

SEQ ID NO: 28958 - RNA, 20 nt, Artificial Sequence
  CIITA targeting sequence
gacagaucaggaagugaccu

SEQ ID NO: 28959 - RNA, 20 nt, Artificial Sequence
  CIITA targeting sequence
gacaauggcaagggcaggcc

SEQ ID NO: 28960 - RNA, 20 nt, Artificial Sequence
  CIITA targeting sequence
gucagacaauggcaagggca

SEQ ID NO: 28961 - RNA, 20 nt, Artificial Sequence
  CIITA targeting sequence
ggaagugaccuuggggcuau

SEQ ID NO: 28962 - RNA, 20 nt, Artificial Sequence
  CIITA targeting sequence
ugaucugucagacaauggca

SEQ ID NO: 28963 - RNA, 20 nt, Artificial Sequence
  CIITA targeting sequence
cuuccugaucugucagacaa

SEQ ID NO: 28964 - RNA, 20 nt, Artificial Sequence
  CIITA targeting sequence
aauagccccaaggucacuuc

SEQ ID NO: 28965 - RNA, 20 nt, Artificial Sequence
  CIITA targeting sequence
ugauacggcuuuucuuccaa

SEQ ID NO: 28966 - RNA, 20 nt, Artificial Sequence
  CIITA targeting sequence
ggaucuaauagccccaaggu

SEQ ID NO: 28967 - RNA, 20 nt, Artificial Sequence
  CIITA targeting sequence
uccaaagagccagcaaccuc

SEQ ID NO: 28968 - RNA, 20 nt, Artificial Sequence
  CIITA targeting sequence
aaagagccagcaaccuccau

SEQ ID NO: 28969 - RNA, 20 nt, Artificial Sequence
  CIITA targeting sequence
uuggaagaaaagccguauca

SEQ ID NO: 28970 - RNA, 20 nt, Artificial Sequence
  CIITA targeting sequence
aucuucccaccucccucaca

SEQ ID NO: 28971 - RNA, 20 nt, Artificial Sequence
  CIITA targeting sequence
ucccaccucccucacaccaa

SEQ ID NO: 28972 - RNA, 20 nt, Artificial Sequence
  CIITA targeting sequence
caccucccucacaccaagcc

SEQ ID NO: 28973 - RNA, 20 nt, Artificial Sequence
  CIITA targeting sequence
cucacaccaagcccuggcau

SEQ ID NO: 28974 - RNA, 20 nt, Artificial Sequence
  CIITA targeting sequence
caccaagcccuggcauuggc

SEQ ID NO: 28975 - RNA, 20 nt, Artificial Sequence
  CIITA targeting sequence
uuccuuucagggccacuuuu

SEQ ID NO: 28976 - RNA, 20 nt, Artificial Sequence
  CIITA targeting sequence
uuucagggccacuuuucaca

SEQ ID NO: 28977 - RNA, 20 nt, Artificial Sequence
  CIITA targeting sequence
gggccacuuuucacaaagaa

SEQ ID NO: 28978 - RNA, 20 nt, Artificial Sequence
  CIITA targeting sequence
caaagaaacaaaguuccagg

SEQ ID NO: 28979 - RNA, 20 nt, Artificial Sequence
  CIITA targeting sequence
uugugaaaaguggcccugaa

SEQ ID NO: 28980 - RNA, 20 nt, Artificial Sequence
  CIITA targeting sequence
aggugguucacaagagcuaa

SEQ ID NO: 28981 - RNA, 20 nt, Artificial Sequence
  CIITA targeting sequence
caagagcuaauuucaaagca

SEQ ID NO: 28982 - RNA, 20 nt, Artificial Sequence
  CIITA targeting sequence
ugugaaccaccuggaacuuu

SEQ ID NO: 28983 - RNA, 20 nt, Artificial Sequence
  CIITA targeting sequence
aagcagaggagccaccagug

SEQ ID NO: 28984 - RNA, 20 nt, Artificial Sequence
  CIITA targeting sequence
gcuuugaaauuagcucuugu

SEQ ID NO: 28985 - RNA, 20 nt, Artificial Sequence
  CIITA targeting sequence
ucugcuuugaaauuagcucu

SEQ ID NO: 28986 - RNA, 20 nt, Artificial Sequence
  CIITA targeting sequence
cugguggcuccucugcuuug

SEQ ID NO: 28987 - RNA, 20 nt, Artificial Sequence
  CIITA targeting sequence
cagcugucacugguggcucc

SEQ ID NO: 28988 - RNA, 20 nt, Artificial Sequence
  CIITA targeting sequence
uucugagcugagaacauuaa

SEQ ID NO: 28989 - RNA, 20 nt, Artificial Sequence
  CIITA targeting sequence
gagcugagaacauuaagugc

SEQ ID NO: 28990 - RNA, 20 nt, Artificial Sequence
  CIITA targeting sequence
gaaugagccucgcagcuguc

SEQ ID NO: 28991 - RNA, 20 nt, Artificial Sequence
  CIITA targeting sequence
gcucagaaugagccucgcag

SEQ ID NO: 28992 - RNA, 20 nt, Artificial Sequence
  CIITA targeting sequence
cagcucagaaugagccucgc

SEQ ID NO: 28993 - RNA, 20 nt, Artificial Sequence
  CIITA targeting sequence
agugggcaugguccugugug

SEQ ID NO: 28994 - RNA, 20 nt, Artificial Sequence
  CIITA targeting sequence
ugugugucaaauggcacauu

SEQ ID NO: 28995 - RNA, 20 nt, Artificial Sequence
  CIITA targeting sequence
aauggcacauugcagaagcu

SEQ ID NO: 28996 - RNA, 20 nt, Artificial Sequence
  CIITA targeting sequence
gcaaugugccauuugacaca

SEQ ID NO: 28997 - RNA, 20 nt, Artificial Sequence
  CIITA targeting sequence
ccuugaggggaagccacaga

SEQ ID NO: 28998 - RNA, 20 nt, Artificial Sequence
  CIITA targeting sequence
aggugagcuucugcaaugug

SEQ ID NO: 28999 - RNA, 20 nt, Artificial Sequence
  CIITA targeting sequence
ccucaaggugagcuucugca

SEQ ID NO: 29000 - RNA, 20 nt, Artificial Sequence
  CIITA targeting sequence
guggcuuccccucaagguga

SEQ ID NO: 29001 - RNA, 20 nt, Artificial Sequence
  CIITA targeting sequence
cuggccuugcuaucuguggc

SEQ ID NO: 29002 - RNA, 20 nt, Artificial Sequence
  CIITA targeting sequence
ggcacucccuggccuugcua

SEQ ID NO: 29003 - RNA, 20 nt, Artificial Sequence
  CIITA targeting sequence
uuucuggcacucccuggccu

SEQ ID NO: 29004 - RNA, 20 nt, Artificial Sequence
  CIITA targeting sequence
cccacccaagaggguggagc

SEQ ID NO: 29005 - RNA, 20 nt, Artificial Sequence
  CIITA targeting sequence
ugggugggugacaguguuaa

SEQ ID NO: 29006 - RNA, 20 nt, Artificial Sequence
  CIITA targeting sequence
acccucuugggugggugaca

SEQ ID NO: 29007 - RNA, 20 nt, Artificial Sequence
  CIITA targeting sequence
ugcuccacccucuugggugg

SEQ ID NO: 29008 - RNA, 20 nt, Artificial Sequence
  CIITA targeting sequence
cuuggcccucaugcuccacc

SEQ ID NO: 29009 - RNA, 20 nt, Artificial Sequence
  CIITA targeting sequence
gucacuuggcccucaugcuc

SEQ ID NO: 29010 - RNA, 20 nt, Artificial Sequence
  CIITA targeting sequence
ggcaaggucacuggggacag

SEQ ID NO: 29011 - RNA, 20 nt, Artificial Sequence
  CIITA targeting sequence
cuggggacagagugggggaa

SEQ ID NO: 29012 - RNA, 20 nt, Artificial Sequence
  CIITA targeting sequence
ccagugaccuugccagaugc

SEQ ID NO: 29013 - RNA, 20 nt, Artificial Sequence
  CIITA targeting sequence
guccccagugaccuugccag

SEQ ID NO: 29014 - RNA, 20 nt, Artificial Sequence
  CIITA targeting sequence
cccacucuguccccagugac

SEQ ID NO: 29015 - RNA, 20 nt, Artificial Sequence
  CIITA targeting sequence
uaggaacagacaggaaggca

SEQ ID NO: 29016 - RNA, 20 nt, Artificial Sequence
  CIITA targeting sequence
uaggaagguggguuuucccc

SEQ ID NO: 29017 - RNA, 20 nt, Artificial Sequence
  CIITA targeting sequence
guuccuaggaagguggguuu

SEQ ID NO: 29018 - RNA, 20 nt, Artificial Sequence
  CIITA targeting sequence
ugucuguuccuaggaaggug

SEQ ID NO: 29019 - RNA, 20 nt, Artificial Sequence
  CIITA targeting sequence
ugccuuccugucuguuccua

SEQ ID NO: 29020 - RNA, 20 nt, Artificial Sequence
  CIITA targeting sequence
ucaugccuuccugucuguuc

SEQ ID NO: 29021 - RNA, 20 nt, Artificial Sequence
  CIITA targeting sequence
gucuccucuggggacauggu

SEQ ID NO: 29022 - RNA, 20 nt, Artificial Sequence
  CIITA targeting sequence
ccucuggggacaugguggca

SEQ ID NO: 29023 - RNA, 20 nt, Artificial Sequence
  CIITA targeting sequence
ucuggggacaugguggcaaa

SEQ ID NO: 29024 - RNA, 20 nt, Artificial Sequence
  CIITA targeting sequence
ggggacaugguggcaaagag

SEQ ID NO: 29025 - RNA, 20 nt, Artificial Sequence
  CIITA targeting sequence
ccagaggagacugaagugcu

SEQ ID NO: 29026 - RNA, 20 nt, Artificial Sequence
  CIITA targeting sequence
uugccaccauguccccagag

SEQ ID NO: 29027 - RNA, 20 nt, Artificial Sequence
  CIITA targeting sequence
guaacucuuugccaccaugu

SEQ ID NO: 29028 - RNA, 20 nt, Artificial Sequence
  CIITA targeting sequence
ggugcuauggguccuggucc

SEQ ID NO: 29029 - RNA, 20 nt, Artificial Sequence
  CIITA targeting sequence
uggucccggugugcugagga

SEQ ID NO: 29030 - RNA, 20 nt, Artificial Sequence
  CIITA targeting sequence
cggugugcugaggaucacag

SEQ ID NO: 29031 - RNA, 20 nt, Artificial Sequence
  CIITA targeting sequence
gcacaccgggaccaggaccc

SEQ ID NO: 29032 - RNA, 20 nt, Artificial Sequence
  CIITA targeting sequence
ucagcacaccgggaccagga

SEQ ID NO: 29033 - RNA, 20 nt, Artificial Sequence
  CIITA targeting sequence
caggaagggcuggccucaga

SEQ ID NO: 29034 - RNA, 20 nt, Artificial Sequence
  CIITA targeting sequence
ugugauccucagcacaccgg

SEQ ID NO: 29035 - RNA, 20 nt, Artificial Sequence
  CIITA targeting sequence
gagcccugcuccgccaccac

SEQ ID NO: 29036 - RNA, 20 nt, Artificial Sequence
  CIITA targeting sequence
gaggccagcccuuccuguga

SEQ ID NO: 29037 - RNA, 20 nt, Artificial Sequence
  CIITA targeting sequence
gccaccacuagcugugggac

SEQ ID NO: 29038 - RNA, 20 nt, Artificial Sequence
  CIITA targeting sequence
cacagcuagugguggcggag

SEQ ID NO: 29039 - RNA, 20 nt, Artificial Sequence
  CIITA targeting sequence
uuuccgcucucagccucgau

SEQ ID NO: 29040 - RNA, 20 nt, Artificial Sequence
  CIITA targeting sequence
gcucucagccucgauggccc

SEQ ID NO: 29041 - RNA, 20 nt, Artificial Sequence
  CIITA targeting sequence
cagccucgauggccccgugu

SEQ ID NO: 29042 - RNA, 20 nt, Artificial Sequence
  CIITA targeting sequence
gccucgauggccccgugugu

SEQ ID NO: 29043 - RNA, 20 nt, Artificial Sequence
  CIITA targeting sequence
auggccccguguguaaaaug

SEQ ID NO: 29044 - RNA, 20 nt, Artificial Sequence
  CIITA targeting sequence
aggcugagagcggaaaugac

SEQ ID NO: 29045 - RNA, 20 nt, Artificial Sequence
  CIITA targeting sequence
ccugcauuuuacacacgggg

SEQ ID NO: 29046 - RNA, 20 nt, Artificial Sequence
  CIITA targeting sequence
cuaggcaccacugucaccug

SEQ ID NO: 29047 - RNA, 20 nt, Artificial Sequence
  CIITA targeting sequence
cacuaggcaccacugucacc

SEQ ID NO: 29048 - RNA, 20 nt, Artificial Sequence
  CIITA targeting sequence
cucucacuaggcaccacugu

SEQ ID NO: 29049 - RNA, 20 nt, Artificial Sequence
  CIITA targeting sequence
gccaggguggggugagagga

SEQ ID NO: 29050 - RNA, 20 nt, Artificial Sequence
  CIITA targeting sequence
ccccacccuggcagaucccu

SEQ ID NO: 29051 - RNA, 20 nt, Artificial Sequence
  CIITA targeting sequence
caccccacccuggcagaucc

SEQ ID NO: 29052 - RNA, 20 nt, Artificial Sequence
  CIITA targeting sequence
ucucaccccacccuggcaga

SEQ ID NO: 29053 - RNA, 20 nt, Artificial Sequence
  CIITA targeting sequence
caggcauccucucaccccac

SEQ ID NO: 29054 - RNA, 20 nt, Artificial Sequence
  CIITA targeting sequence
cuuggaacagggcugugcuc

SEQ ID NO: 29055 - RNA, 20 nt, Artificial Sequence
  CIITA targeting sequence
uggaacagggcugugcucac

SEQ ID NO: 29056 - RNA, 20 nt, Artificial Sequence
  CIITA targeting sequence
aagagaucccaggcauccuc

SEQ ID NO: 29057 - RNA, 20 nt, Artificial Sequence
  CIITA targeting sequence
caccagcuguucugauaaug

SEQ ID NO: 29058 - RNA, 20 nt, Artificial Sequence
  CIITA targeting sequence
gauaaugcugcccguucuug

SEQ ID NO: 29059 - RNA, 20 nt, Artificial Sequence
  CIITA targeting sequence
gaacagcuggugugagcaca

SEQ ID NO: 29060 - RNA, 20 nt, Artificial Sequence
  CIITA targeting sequence
uggagaggugggagcccagg

SEQ ID NO: 29061 - RNA, 20 nt, Artificial Sequence
  CIITA targeting sequence
aagaacgggcagcauuauca

SEQ ID NO: 29062 - RNA, 20 nt, Artificial Sequence
  CIITA targeting sequence
ccaagaacgggcagcauuau

SEQ ID NO: 29063 - RNA, 20 nt, Artificial Sequence
  CIITA targeting sequence
caccucuccaagaacgggca

SEQ ID NO: 29064 - RNA, 20 nt, Artificial Sequence
  CIITA targeting sequence
cccugggcucccaccucucc

SEQ ID NO: 29065 - RNA, 20 nt, Artificial Sequence
  CIITA targeting sequence
uaacugcauuucccccuggg

SEQ ID NO: 29066 - RNA, 20 nt, Artificial Sequence
  CIITA targeting sequence
cuuccuaacugcauuucccc

SEQ ID NO: 29067 - RNA, 20 nt, Artificial Sequence
  CIITA targeting sequence
aguguuuucccuuccuaacu

SEQ ID NO: 29068 - RNA, 20 nt, Artificial Sequence
  CIITA targeting sequence
ccagcccccaacacacauau

SEQ ID NO: 29069 - RNA, 20 nt, Artificial Sequence
  CIITA targeting sequence
ggggaagggagaccugggug

SEQ ID NO: 29070 - RNA, 20 nt, Artificial Sequence
  CIITA targeting sequence
ccagagggcuccccagcccc

SEQ ID NO: 29071 - RNA, 20 nt, Artificial Sequence
  CIITA targeting sequence
cuuccccagagggcucccca

SEQ ID NO: 29072 - RNA, 20 nt, Artificial Sequence
  CIITA targeting sequence
cccuuccccagagggcuccc

SEQ ID NO: 29073 - RNA, 20 nt, Artificial Sequence
  CIITA targeting sequence
cccaggucucccuuccccag

SEQ ID NO: 29074 - RNA, 20 nt, Artificial Sequence
  CIITA targeting sequence
gggacagaaaguagccccag

SEQ ID NO: 29075 - RNA, 20 nt, Artificial Sequence
  CIITA targeting sequence
cugacuuucacccaggucuc

SEQ ID NO: 29076 - RNA, 20 nt, Artificial Sequence
  CIITA targeting sequence
gucccugacuuucacccagg

SEQ ID NO: 29077 - RNA, 20 nt, Artificial Sequence
  CIITA targeting sequence
ugcuggggcuacuuucuguc

SEQ ID NO: 29078 - RNA, 20 nt, Artificial Sequence
  CIITA targeting sequence
gggauccccaaccucccagg

SEQ ID NO: 29079 - RNA, 20 nt, Artificial Sequence
  CIITA targeting sequence
cagaauagucaugcuggggc

SEQ ID NO: 29080 - RNA, 20 nt, Artificial Sequence
  CIITA targeting sequence
ccaaccucccaggucuggcc

SEQ ID NO: 29081 - RNA, 20 nt, Artificial Sequence
  CIITA targeting sequence
caggucuggcccagcgaacg

SEQ ID NO: 29082 - RNA, 20 nt, Artificial Sequence
  CIITA targeting sequence
ggcccagcgaacgugcacuc

SEQ ID NO: 29083 - RNA, 20 nt, Artificial Sequence
  CIITA targeting sequence
cugggccagaccugggaggu

SEQ ID NO: 29084 - RNA, 20 nt, Artificial Sequence
  CIITA targeting sequence
ggggccucccuagcgaguuc

SEQ ID NO: 29085 - RNA, 20 nt, Artificial Sequence
  CIITA targeting sequence
cuagcgaguuccacaugguc

SEQ ID NO: 29086 - RNA, 20 nt, Artificial Sequence
  CIITA targeting sequence
uucuggaaagacaccuagaa

SEQ ID NO: 29087 - RNA, 20 nt, Artificial Sequence
  CIITA targeting sequence
ggaaagacaccuagaacacu

SEQ ID NO: 29088 - RNA, 20 nt, Artificial Sequence
  CIITA targeting sequence
agaaagauuaugcgcauaua

SEQ ID NO: 29089 - RNA, 20 nt, Artificial Sequence
  CIITA targeting sequence
uuccagaaagauuaugcgca

SEQ ID NO: 29090 - RNA, 20 nt, Artificial Sequence
  CIITA targeting sequence
aggugucuuuccagaaagau

SEQ ID NO: 29091 - RNA, 20 nt, Artificial Sequence
  CIITA targeting sequence
gacuuggccuuuuaugccau

SEQ ID NO: 29092 - RNA, 20 nt, Artificial Sequence
  CIITA targeting sequence
gaaaagggcuacuaguguuc

SEQ ID NO: 29093 - RNA, 20 nt, Artificial Sequence
  CIITA targeting sequence
aaagcuaaucucuuaaaaug

SEQ ID NO: 29094 - RNA, 20 nt, Artificial Sequence
  CIITA targeting sequence
cuuaaaaugcagacuccugg

SEQ ID NO: 29095 - RNA, 20 nt, Artificial Sequence
  CIITA targeting sequence
uaaaaugcagacuccugggc

SEQ ID NO: 29096 - RNA, 20 nt, Artificial Sequence
  CIITA targeting sequence
gcauuuuaagagauuagcuu

SEQ ID NO: 29097 - RNA, 20 nt, Artificial Sequence
  CIITA targeting sequence
ugggcccauguggaagcugc

SEQ ID NO: 29098 - RNA, 20 nt, Artificial Sequence
  CIITA targeting sequence
acaugggcccaggagucugc

SEQ ID NO: 29099 - RNA, 20 nt, Artificial Sequence
  CIITA targeting sequence
gcagcuuccacaugggccca

SEQ ID NO: 29100 - RNA, 20 nt, Artificial Sequence
  CIITA targeting sequence
guucucuguagggcccugga

SEQ ID NO: 29101 - RNA, 20 nt, Artificial Sequence
  CIITA targeting sequence
cuguagggcccuggaaccug

SEQ ID NO: 29102 - RNA, 20 nt, Artificial Sequence
  CIITA targeting sequence
guagggcccuggaaccugca

SEQ ID NO: 29103 - RNA, 20 nt, Artificial Sequence
  CIITA targeting sequence
agggcccuacagagaacuga

SEQ ID NO: 29104 - RNA, 20 nt, Artificial Sequence
  CIITA targeting sequence
aagaggaaaacagaauggcc

SEQ ID NO: 29105 - RNA, 20 nt, Artificial Sequence
  CIITA targeting sequence
guccaagaggaaaacagaau

SEQ ID NO: 29106 - RNA, 20 nt, Artificial Sequence
  CIITA targeting sequence
uccguuuguuucuuuuuuaa

SEQ ID NO: 29107 - RNA, 20 nt, Artificial Sequence
  CIITA targeting sequence
guuuguuucuuuuuuaaggu

SEQ ID NO: 29108 - RNA, 20 nt, Artificial Sequence
  CIITA targeting sequence
uuuuuaagguaagaauugug

SEQ ID NO: 29109 - RNA, 20 nt, Artificial Sequence
  CIITA targeting sequence
uaccuuaaaaaagaaacaaa

SEQ ID NO: 29110 - RNA, 20 nt, Artificial Sequence
  CIITA targeting sequence
caauucuuaccuuaaaaaag

SEQ ID NO: 29111 - RNA, 20 nt, Artificial Sequence
  CIITA targeting sequence
uuuuucauugacgccccaga

SEQ ID NO: 29112 - RNA, 20 nt, Artificial Sequence
  CIITA targeting sequence
uugacgccccagauucccca

SEQ ID NO: 29113 - RNA, 20 nt, Artificial Sequence
  CIITA targeting sequence
augaaaaaagacuggccuuu

SEQ ID NO: 29114 - RNA, 20 nt, Artificial Sequence
  CIITA targeting sequence
ggggcgucaaugaaaaaaga

SEQ ID NO: 29115 - RNA, 20 nt, Artificial Sequence
  CIITA targeting sequence
ccagccacguuagccuacag

SEQ ID NO: 29116 - RNA, 20 nt, Artificial Sequence
  CIITA targeting sequence
guaggcuaacguggcugggg

SEQ ID NO: 29117 - RNA, 20 nt, Artificial Sequence
  CIITA targeting sequence
gaguaaguauuuccaugagu

SEQ ID NO: 29118 - RNA, 20 nt, Artificial Sequence
  CIITA targeting sequence
gaauuauacuucuguaggcu

SEQ ID NO: 29119 - RNA, 20 nt, Artificial Sequence
  CIITA targeting sequence
augaguacuaaaugcagaug

SEQ ID NO: 29120 - RNA, 20 nt, Artificial Sequence
  CIITA targeting sequence
uggaaauacuuacucugaau

SEQ ID NO: 29121 - RNA, 20 nt, Artificial Sequence
  CIITA targeting sequence
gcauuuaguacucauggaaa

SEQ ID NO: 29122 - RNA, 20 nt, Artificial Sequence
  CIITA targeting sequence
ccauguuuuuuaaacuauga

SEQ ID NO: 29123 - RNA, 20 nt, Artificial Sequence
  CIITA targeting sequence
cccucaccauguuuuuuaaa

SEQ ID NO: 29124 - RNA, 20 nt, Artificial Sequence
  CIITA targeting sequence
uaagccauaaauuucacccu

SEQ ID NO: 29125 - RNA, 20 nt, Artificial Sequence
  CIITA targeting sequence
caauaaagggauaaaguaau

SEQ ID NO: 29126 - RNA, 20 nt, Artificial Sequence
  CIITA targeting sequence
cuuuauugggauguauuucc

SEQ ID NO: 29127 - RNA, 20 nt, Artificial Sequence
  CIITA targeting sequence
uuuuuaaaaguaacugauaa

SEQ ID NO: 29128 - RNA, 20 nt, Artificial Sequence
  CIITA targeting sequence
augccugucgucuuguuuuc

SEQ ID NO: 29129 - RNA, 20 nt, Artificial Sequence
  CIITA targeting sequence
ucuuguuuuccaggaaucca

SEQ ID NO: 29130 - RNA, 20 nt, Artificial Sequence
  CIITA targeting sequence
uguuuuccaggaauccaaga

SEQ ID NO: 29131 - RNA, 20 nt, Artificial Sequence
  CIITA targeting sequence
aggaauccaagaguuuugua

SEQ ID NO: 29132 - RNA, 20 nt, Artificial Sequence
  CIITA targeting sequence
uggaaaacaagacgacaggc

SEQ ID NO: 29133 - RNA, 20 nt, Artificial Sequence
  CIITA targeting sequence
aagaguuuuguaaucuccau

SEQ ID NO: 29134 - RNA, 20 nt, Artificial Sequence
  CIITA targeting sequence
uggauuccuggaaaacaaga

SEQ ID NO: 29135 - RNA, 20 nt, Artificial Sequence
  CIITA targeting sequence
ccaucagucaaaagaagaga

SEQ ID NO: 29136 - RNA, 20 nt, Artificial Sequence
  CIITA targeting sequence
aucagucaaaagaagagaac

SEQ ID NO: 29137 - RNA, 20 nt, Artificial Sequence
  CIITA targeting sequence
gucaaaagaagagaaccuca

SEQ ID NO: 29138 - RNA, 20 nt, Artificial Sequence
  CIITA targeting sequence
aaagaagagaaccucaucag

SEQ ID NO: 29139 - RNA, 20 nt, Artificial Sequence
  CIITA targeting sequence
uuugacugauggagauuaca

SEQ ID NO: 29140 - RNA, 20 nt, Artificial Sequence
  CIITA targeting sequence
ucuuuugacugauggagauu

SEQ ID NO: 29141 - RNA, 20 nt, Artificial Sequence
  CIITA targeting sequence
cuucuuuugacugauggaga

SEQ ID NO: 29142 - RNA, 20 nt, Artificial Sequence
  CIITA targeting sequence
ucaguuccugaaacgagaga

SEQ ID NO: 29143 - RNA, 20 nt, Artificial Sequence
  CIITA targeting sequence
guuccugaaacgagagaaug

SEQ ID NO: 29144 - RNA, 20 nt, Artificial Sequence
  CIITA targeting sequence
ugaaacgagagaauguucag

SEQ ID NO: 29145 - RNA, 20 nt, Artificial Sequence
  CIITA targeting sequence
ggaacugaugagguucucuu

SEQ ID NO: 29146 - RNA, 20 nt, Artificial Sequence
  CIITA targeting sequence
uuucaggaacugaugagguu

SEQ ID NO: 29147 - RNA, 20 nt, Artificial Sequence
  CIITA targeting sequence
cguuucaggaacugaugagg

SEQ ID NO: 29148 - RNA, 20 nt, Artificial Sequence
  CIITA targeting sequence
cucguuucaggaacugauga

SEQ ID NO: 29149 - RNA, 20 nt, Artificial Sequence
  CIITA targeting sequence
ggaccaagcaguuaccgagc

SEQ ID NO: 29150 - RNA, 20 nt, Artificial Sequence
  CIITA targeting sequence
ugaacauucucucguuucag

SEQ ID NO: 29151 - RNA, 20 nt, Artificial Sequence
  CIITA targeting sequence
guaacugcuugguccugaac

SEQ ID NO: 29152 - RNA, 20 nt, Artificial Sequence
  CIITA targeting sequence
gguccuuuugcugugaccca

SEQ ID NO: 29153 - RNA, 20 nt, Artificial Sequence
  CIITA targeting sequence
gaagccacuuucucagagac

SEQ ID NO: 29154 - RNA, 20 nt, Artificial Sequence
  CIITA targeting sequence
gaccacaccagcaucugguc

SEQ ID NO: 29155 - RNA, 20 nt, Artificial Sequence
  CIITA targeting sequence
cagagacacuuuaaucauug

SEQ ID NO: 29156 - RNA, 20 nt, Artificial Sequence
  CIITA targeting sequence
gagacacuuuaaucauugag

SEQ ID NO: 29157 - RNA, 20 nt, Artificial Sequence
  CIITA targeting sequence
gagaaaguggcuucggacca

SEQ ID NO: 29158 - RNA, 20 nt, Artificial Sequence
  CIITA targeting sequence
cugagaaaguggcuucggac

SEQ ID NO: 29159 - RNA, 20 nt, Artificial Sequence
  CIITA targeting sequence
uugaguauuuguacacuuuu

SEQ ID NO: 29160 - RNA, 20 nt, Artificial Sequence
  CIITA targeting sequence
augauuaaagugucucugag

SEQ ID NO: 29161 - RNA, 20 nt, Artificial Sequence
  CIITA targeting sequence
uuagaacauauauaaagggc

SEQ ID NO: 29162 - RNA, 20 nt, Artificial Sequence
  CIITA targeting sequence
cuacaaaugugccguuuuaa

SEQ ID NO: 29163 - RNA, 20 nt, Artificial Sequence
  CIITA targeting sequence
acaaaugugccguuuuaaga

SEQ ID NO: 29164 - RNA, 20 nt, Artificial Sequence
  CIITA targeting sequence
uaaaacggcacauuuguaga

SEQ ID NO: 29165 - RNA, 20 nt, Artificial Sequence
  CIITA targeting sequence
aaucucucccccgaggccug

SEQ ID NO: 29166 - RNA, 20 nt, Artificial Sequence
  CIITA targeting sequence
cucccccgaggccuguuuca

SEQ ID NO: 29167 - RNA, 20 nt, Artificial Sequence
  CIITA targeting sequence
cccccgaggccuguuucacg

SEQ ID NO: 29168 - RNA, 20 nt, Artificial Sequence
  CIITA targeting sequence
cccgaggccuguuucacgua

SEQ ID NO: 29169 - RNA, 20 nt, Artificial Sequence
  CIITA targeting sequence
ggggagagauuugagggggu

SEQ ID NO: 29170 - RNA, 20 nt, Artificial Sequence
  CIITA targeting sequence
cguaaaaaacaaauggguug

SEQ ID NO: 29171 - RNA, 20 nt, Artificial Sequence
  CIITA targeting sequence
aaaagcaacagagcucaggc

SEQ ID NO: 29172 - RNA, 20 nt, Artificial Sequence
  CIITA targeting sequence
guugcuuuuagauuuuuccu

SEQ ID NO: 29173 - RNA, 20 nt, Artificial Sequence
  CIITA targeting sequence
ggcugggcuucguucuaaaa

SEQ ID NO: 29174 - RNA, 20 nt, Artificial Sequence
  CIITA targeting sequence
uucuaaaaucacugcauaug

SEQ ID NO: 29175 - RNA, 20 nt, Artificial Sequence
  CIITA targeting sequence
aaaaucacugcauaugacac

SEQ ID NO: 29176 - RNA, 20 nt, Artificial Sequence
  CIITA targeting sequence
cugcauaugacacagcuggg

SEQ ID NO: 29177 - RNA, 20 nt, Artificial Sequence
  CIITA targeting sequence
uaugcagugauuuuagaacg

SEQ ID NO: 29178 - RNA, 20 nt, Artificial Sequence
  CIITA targeting sequence
aaucaaaaagcccuugaaga

SEQ ID NO: 29179 - RNA, 20 nt, Artificial Sequence
  CIITA targeting sequence
aaaagcccuugaagaguccu

SEQ ID NO: 29180 - RNA, 20 nt, Artificial Sequence
  CIITA targeting sequence
agggcuuuuugauuugaccc

SEQ ID NO: 29181 - RNA, 20 nt, Artificial Sequence
  CIITA targeting sequence
ucaagggcuuuuugauuuga

SEQ ID NO: 29182 - RNA, 20 nt, Artificial Sequence
  CIITA targeting sequence
uugaaucacccaguaagaca

SEQ ID NO: 29183 - RNA, 20 nt, Artificial Sequence
  CIITA targeting sequence
aggacucuucaagggcuuuu

SEQ ID NO: 29184 - RNA, 20 nt, Artificial Sequence
  CIITA targeting sequence
cccaguaagacagaaugugg

SEQ ID NO: 29185 - RNA, 20 nt, Artificial Sequence
  CIITA targeting sequence
uacugggugauucaaggacu

SEQ ID NO: 29186 - RNA, 20 nt, Artificial Sequence
  CIITA targeting sequence
gucuuacugggugauucaag

SEQ ID NO: 29187 - RNA, 20 nt, Artificial Sequence
  CIITA targeting sequence
guguaaauucccuguguagu

SEQ ID NO: 29188 - RNA, 20 nt, Artificial Sequence
  CIITA targeting sequence
cuguguaguaauaugugcac

SEQ ID NO: 29189 - RNA, 20 nt, Artificial Sequence
  CIITA targeting sequence
aguaauguccagugucaugc

SEQ ID NO: 29190 - RNA, 20 nt, Artificial Sequence
  CIITA targeting sequence
agugucaugcaaaccaacuu

SEQ ID NO: 29191 - RNA, 20 nt, Artificial Sequence
  CIITA targeting sequence
ugcaaaccaacuuucagguu

SEQ ID NO: 29192 - RNA, 20 nt, Artificial Sequence
  CIITA targeting sequence
gguuuuuuaauuauauaaaa

SEQ ID NO: 29193 - RNA, 20 nt, Artificial Sequence
  CIITA targeting sequence
uuuuuauauaauuaaaaaac

SEQ ID NO: 29194 - RNA, 20 nt, Artificial Sequence
  CIITA targeting sequence
cucuuuuuuauauaauuaaa

SEQ ID NO: 29195 - RNA, 20 nt, Artificial Sequence
  CIITA targeting sequence
gucccucuuuuuuauauaau

SEQ ID NO: 29196 - RNA, 20 nt, Artificial Sequence
  CIITA targeting sequence
acgaucauccucuuugccau

SEQ ID NO: 29197 - RNA, 20 nt, Artificial Sequence
  CIITA targeting sequence
uagaguuuacaucugucccu

SEQ ID NO: 29198 - RNA, 20 nt, Artificial Sequence
  CIITA targeting sequence
uccucuuugccaugaggugc

SEQ ID NO: 29199 - RNA, 20 nt, Artificial Sequence
  CIITA targeting sequence
ucuuugccaugaggugcuug

SEQ ID NO: 29200 - RNA, 20 nt, Artificial Sequence
  CIITA targeting sequence
uugccaugaggugcuugcuc

SEQ ID NO: 29201 - RNA, 20 nt, Artificial Sequence
  CIITA targeting sequence
uggcaaagaggaugaucgua

SEQ ID NO: 29202 - RNA, 20 nt, Artificial Sequence
  CIITA targeting sequence
guuugagacacacaggaucu

SEQ ID NO: 29203 - RNA, 20 nt, Artificial Sequence
  CIITA targeting sequence
aacagagcaagcaccucaug

SEQ ID NO: 29204 - RNA, 20 nt, Artificial Sequence
  CIITA targeting sequence
caaacagagcaagcaccuca

SEQ ID NO: 29205 - RNA, 20 nt, Artificial Sequence
  CIITA targeting sequence
ugugugucucaaacagagca

SEQ ID NO: 29206 - RNA, 20 nt, Artificial Sequence
  CIITA targeting sequence
gagaccacgugggagaagag

SEQ ID NO: 29207 - RNA, 20 nt, Artificial Sequence
  CIITA targeting sequence
gauccugugugucucaaaca

SEQ ID NO: 29208 - RNA, 20 nt, Artificial Sequence
  CIITA targeting sequence
cagauccugugugucucaaa

SEQ ID NO: 29209 - RNA, 20 nt, Artificial Sequence
  CIITA targeting sequence
cacguggucucagauccugu

SEQ ID NO: 29210 - RNA, 20 nt, Artificial Sequence
  CIITA targeting sequence
cccacguggucucagauccu

SEQ ID NO: 29211 - RNA, 20 nt, Artificial Sequence
  CIITA targeting sequence
ucucccacguggucucagau

SEQ ID NO: 29212 - RNA, 20 nt, Artificial Sequence
  CIITA targeting sequence
uguuuucccuccacucuggg

SEQ ID NO: 29213 - RNA, 20 nt, Artificial Sequence
  CIITA targeting sequence
cuccacucuggggcauaaaa

SEQ ID NO: 29214 - RNA, 20 nt, Artificial Sequence
  CIITA targeting sequence
acucuggggcauaaaagugg

SEQ ID NO: 29215 - RNA, 20 nt, Artificial Sequence
  CIITA targeting sequence
ggggcauaaaaguggguggg

SEQ ID NO: 29216 - RNA, 20 nt, Artificial Sequence
  CIITA targeting sequence
cacccacccacuuuuaugcc

SEQ ID NO: 29217 - RNA, 20 nt, Artificial Sequence
  CIITA targeting sequence
uguuucccacccacccacuu

SEQ ID NO: 29218 - RNA, 20 nt, Artificial Sequence
  CIITA targeting sequence
ccuuguucuuucccucccuu

SEQ ID NO: 29219 - RNA, 20 nt, Artificial Sequence
  CIITA targeting sequence
uucccucccuugucucuucc

SEQ ID NO: 29220 - RNA, 20 nt, Artificial Sequence
  CIITA targeting sequence
cucccuugucucuucccucc

SEQ ID NO: 29221 - RNA, 20 nt, Artificial Sequence
  CIITA targeting sequence
cuugucucuucccuccccgc

SEQ ID NO: 29222 - RNA, 20 nt, Artificial Sequence
  CIITA targeting sequence
cuucccuccccgcccuuccc

SEQ ID NO: 29223 - RNA, 20 nt, Artificial Sequence
  CIITA targeting sequence
ucccuccccgcccuucccua

SEQ ID NO: 29224 - RNA, 20 nt, Artificial Sequence
  CIITA targeting sequence
cuccccgcccuucccuagga

SEQ ID NO: 29225 - RNA, 20 nt, Artificial Sequence
  CIITA targeting sequence
ccgcccuucccuaggaccau

SEQ ID NO: 29226 - RNA, 20 nt, Artificial Sequence
  CIITA targeting sequence
cuaggaccauacauaugauc

SEQ ID NO: 29227 - RNA, 20 nt, Artificial Sequence
  CIITA targeting sequence
uagggaagggcggggaggga

SEQ ID NO: 29228 - RNA, 20 nt, Artificial Sequence
  CIITA targeting sequence
uauguaugguccuagggaag

SEQ ID NO: 29229 - RNA, 20 nt, Artificial Sequence
  CIITA targeting sequence
gauuugcacauguucagugu

SEQ ID NO: 29230 - RNA, 20 nt, Artificial Sequence
  CIITA targeting sequence
gaucauauguaugguccuag

SEQ ID NO: 29231 - RNA, 20 nt, Artificial Sequence
  CIITA targeting sequence
gugugaggaaggugugaccu

SEQ ID NO: 29232 - RNA, 20 nt, Artificial Sequence
  CIITA targeting sequence
cacugaacaugugcaaaucu

SEQ ID NO: 29233 - RNA, 20 nt, Artificial Sequence
  CIITA targeting sequence
ucacacugaacaugugcaaa

SEQ ID NO: 29234 - RNA, 20 nt, Artificial Sequence
  CIITA targeting sequence
caccuuccucacacugaaca

SEQ ID NO: 29235 - RNA, 20 nt, Artificial Sequence
  CIITA targeting sequence
ccccccgacccccagcuccu

SEQ ID NO: 29236 - RNA, 20 nt, Artificial Sequence
  CIITA targeting sequence
gggggcgaggucacaccuuc

SEQ ID NO: 29237 - RNA, 20 nt, Artificial Sequence
  CIITA targeting sequence
ucacgccaagagcaaugagg

SEQ ID NO: 29238 - RNA, 20 nt, Artificial Sequence
  CIITA targeting sequence
cgccaagagcaaugaggcug

SEQ ID NO: 29239 - RNA, 20 nt, Artificial Sequence
  CIITA targeting sequence
uggcgugaggagcugggggu

SEQ ID NO: 29240 - RNA, 20 nt, Artificial Sequence
  CIITA targeting sequence
uugcucuuggcgugaggagc

SEQ ID NO: 29241 - RNA, 20 nt, Artificial Sequence
  CIITA targeting sequence
gcuuccugccuggucacaug

SEQ ID NO: 29242 - RNA, 20 nt, Artificial Sequence
  CIITA targeting sequence
ugccuggucacaugccuggc

SEQ ID NO: 29243 - RNA, 20 nt, Artificial Sequence
  CIITA targeting sequence
caugccuggccaccccaggg

SEQ ID NO: 29244 - RNA, 20 nt, Artificial Sequence
  CIITA targeting sequence
cugggguggccaggcaugug

SEQ ID NO: 29245 - RNA, 20 nt, Artificial Sequence
  CIITA targeting sequence
ccuguucccugggguggcca

SEQ ID NO: 29246 - RNA, 20 nt, Artificial Sequence
  CIITA targeting sequence
gggugggcuuccccuguucc

SEQ ID NO: 29247 - RNA, 20 nt, Artificial Sequence
  CIITA targeting sequence
uggggcacaggggcccgggg

SEQ ID NO: 29248 - RNA, 20 nt, Artificial Sequence
  CIITA targeting sequence
gaauuccccaguuccuccac

SEQ ID NO: 29249 - RNA, 20 nt, Artificial Sequence
  CIITA targeting sequence
gaaaaaugcagcucuugggg

SEQ ID NO: 29250 - RNA, 20 nt, Artificial Sequence
  CIITA targeting sequence
ccaguuccuccacacgggug

SEQ ID NO: 29251 - RNA, 20 nt, Artificial Sequence
  CIITA targeting sequence
uccacacgggugccaugauc

SEQ ID NO: 29252 - RNA, 20 nt, Artificial Sequence
  CIITA targeting sequence
acacgggugccaugauccau

SEQ ID NO: 29253 - RNA, 20 nt, Artificial Sequence
  CIITA targeting sequence
uggcacccguguggaggaac

SEQ ID NO: 29254 - RNA, 20 nt, Artificial Sequence
  CIITA targeting sequence
auuucucaccuaaugcuggu

SEQ ID NO: 29255 - RNA, 20 nt, Artificial Sequence
  CIITA targeting sequence
caccuaaugcuggugaaucu

SEQ ID NO: 29256 - RNA, 20 nt, Artificial Sequence
  CIITA targeting sequence
ccuaaugcuggugaaucucc

SEQ ID NO: 29257 - RNA, 20 nt, Artificial Sequence
  CIITA targeting sequence
ccagcauuaggugagaaaug

SEQ ID NO: 29258 - RNA, 20 nt, Artificial Sequence
  CIITA targeting sequence
ccagccccucgaggccaggc

SEQ ID NO: 29259 - RNA, 20 nt, Artificial Sequence
  CIITA targeting sequence
agccccucgaggccaggcuu

SEQ ID NO: 29260 - RNA, 20 nt, Artificial Sequence
  CIITA targeting sequence
aggccaggcuucugaaaguc

SEQ ID NO: 29261 - RNA, 20 nt, Artificial Sequence
  CIITA targeting sequence
aggggcuggagauucaccag

SEQ ID NO: 29262 - RNA, 20 nt, Artificial Sequence
  CIITA targeting sequence
gaaagucaccugggcaggcc

SEQ ID NO: 29263 - RNA, 20 nt, Artificial Sequence
  CIITA targeting sequence
gaagccuggccucgaggggc

SEQ ID NO: 29264 - RNA, 20 nt, Artificial Sequence
  CIITA targeting sequence
ccugggcaggccugcaaggg

SEQ ID NO: 29265 - RNA, 20 nt, Artificial Sequence
  CIITA targeting sequence
ccuugcaggccugcccaggu

SEQ ID NO: 29266 - RNA, 20 nt, Artificial Sequence
  CIITA targeting sequence
accaugguuuucuguccuua

SEQ ID NO: 29267 - RNA, 20 nt, Artificial Sequence
  CIITA targeting sequence
guccuuacacgcgagugggg

SEQ ID NO: 29268 - RNA, 20 nt, Artificial Sequence
  CIITA targeting sequence
uuacacgcgaguggggcgau

SEQ ID NO: 29269 - RNA, 20 nt, Artificial Sequence
  CIITA targeting sequence
cguguaaggacagaaaacca

SEQ ID NO: 29270 - RNA, 20 nt, Artificial Sequence
  CIITA targeting sequence
ccccacucgcguguaaggac

SEQ ID NO: 29271 - RNA, 20 nt, Artificial Sequence
  CIITA targeting sequence
ugcugauggaaggccagaga

SEQ ID NO: 29272 - RNA, 20 nt, Artificial Sequence
  CIITA targeting sequence
gcaggaucgccccacucgcg

SEQ ID NO: 29273 - RNA, 20 nt, Artificial Sequence
  CIITA targeting sequence
aucagcaggaucgccccacu

SEQ ID NO: 29274 - RNA, 20 nt, Artificial Sequence
  CIITA targeting sequence
ggccuuccaucagcaggauc

SEQ ID NO: 29275 - RNA, 20 nt, Artificial Sequence
  CIITA targeting sequence
cuggccuuccaucagcagga

SEQ ID NO: 29276 - RNA, 20 nt, Artificial Sequence
  CIITA targeting sequence
guacuuuguggguuuucucu

SEQ ID NO: 29277 - RNA, 20 nt, Artificial Sequence
  CIITA targeting sequence
gcagguuuucuguacuuugu

SEQ ID NO: 29278 - RNA, 20 nt, Artificial Sequence
  CIITA targeting sequence
agcaaccaauuccgcagguu

SEQ ID NO: 29279 - RNA, 20 nt, Artificial Sequence
  CIITA targeting sequence
uggcauaaagcagugcuguu

SEQ ID NO: 29280 - RNA, 20 nt, Artificial Sequence
  CIITA targeting sequence
aauuuaggacgguucuaccc

SEQ ID NO: 29281 - RNA, 20 nt, Artificial Sequence
  CIITA targeting sequence
uaaauuugaacagcacugcu

SEQ ID NO: 29282 - RNA, 20 nt, Artificial Sequence
  CIITA targeting sequence
acccauuucaggaugaaccu

SEQ ID NO: 29283 - RNA, 20 nt, Artificial Sequence
  CIITA targeting sequence
ggaugaaccuggucaaauuu

SEQ ID NO: 29284 - RNA, 20 nt, Artificial Sequence
  CIITA targeting sequence
ugaaauggguagaaccgucc

SEQ ID NO: 29285 - RNA, 20 nt, Artificial Sequence
  CIITA targeting sequence
uccugaaauggguagaaccg

SEQ ID NO: 29286 - RNA, 20 nt, Artificial Sequence
  CIITA targeting sequence
aauuucaaagacuucugucu

SEQ ID NO: 29287 - RNA, 20 nt, Artificial Sequence
  CIITA targeting sequence
aagacuucugucucucacuu

SEQ ID NO: 29288 - RNA, 20 nt, Artificial Sequence
  CIITA targeting sequence
uugaaauuugaccagguuca

SEQ ID NO: 29289 - RNA, 20 nt, Artificial Sequence
  CIITA targeting sequence
gucucucacuuuuagaaaua

SEQ ID NO: 29290 - RNA, 20 nt, Artificial Sequence
  CIITA targeting sequence
cucacuuuuagaaauaucua

SEQ ID NO: 29291 - RNA, 20 nt, Artificial Sequence
  CIITA targeting sequence
cacuuuuagaaauaucuauu

SEQ ID NO: 29292 - RNA, 20 nt, Artificial Sequence
  CIITA targeting sequence
cuuuuagaaauaucuauuaa

SEQ ID NO: 29293 - RNA, 20 nt, Artificial Sequence
  CIITA targeting sequence
aaaagugagagacagaaguc

SEQ ID NO: 29294 - RNA, 20 nt, Artificial Sequence
  CIITA targeting sequence
auuaaguuaaaaaaaaaaaa

SEQ ID NO: 29295 - RNA, 20 nt, Artificial Sequence
  CIITA targeting sequence
cgccuguaauccuagcacuu

SEQ ID NO: 29296 - RNA, 20 nt, Artificial Sequence
  CIITA targeting sequence
uagcacuuugggaggccaag

SEQ ID NO: 29297 - RNA, 20 nt, Artificial Sequence
  CIITA targeting sequence
caaagugcuaggauuacagg

SEQ ID NO: 29298 - RNA, 20 nt, Artificial Sequence
  CIITA targeting sequence
accagccuuggccucccaaa

SEQ ID NO: 29299 - RNA, 20 nt, Artificial Sequence
  CIITA targeting sequence
cuugaggcaaggaguucgag

SEQ ID NO: 29300 - RNA, 20 nt, Artificial Sequence
  CIITA targeting sequence
agugaucuaccagccuuggc

SEQ ID NO: 29301 - RNA, 20 nt, Artificial Sequence
  CIITA targeting sequence
uugccucaagugaucuacca

SEQ ID NO: 29302 - RNA, 20 nt, Artificial Sequence
  CIITA targeting sequence
agaccagccuggucaacaug

SEQ ID NO: 29303 - RNA, 20 nt, Artificial Sequence
  CIITA targeting sequence
aacuccuugccucaagugau

SEQ ID NO: 29304 - RNA, 20 nt, Artificial Sequence
  CIITA targeting sequence
cgaacuccuugccucaagug

SEQ ID NO: 29305 - RNA, 20 nt, Artificial Sequence
  CIITA targeting sequence
acauggagagaccccgucua

SEQ ID NO: 29306 - RNA, 20 nt, Artificial Sequence
  CIITA targeting sequence
auguugaccaggcuggucuc

SEQ ID NO: 29307 - RNA, 20 nt, Artificial Sequence
  CIITA targeting sequence
ccauguugaccaggcugguc

SEQ ID NO: 29308 - RNA, 20 nt, Artificial Sequence
  CIITA targeting sequence
cuccauguugaccaggcugg

SEQ ID NO: 29309 - RNA, 20 nt, Artificial Sequence
  CIITA targeting sequence
acuauaaauacaaaaauuag

SEQ ID NO: 29310 - RNA, 20 nt, Artificial Sequence
  CIITA targeting sequence
cagcuacuugggaggcugag

SEQ ID NO: 29311 - RNA, 20 nt, Artificial Sequence
  CIITA targeting sequence
caaguagcugggauuacagg

SEQ ID NO: 29312 - RNA, 20 nt, Artificial Sequence
  CIITA targeting sequence
gccucccaaguagcugggau

SEQ ID NO: 29313 - RNA, 20 nt, Artificial Sequence
  CIITA targeting sequence
ugccucagccucccaaguag

SEQ ID NO: 29314 - RNA, 20 nt, Artificial Sequence
  CIITA targeting sequence
ccugccucagccucccaagu

SEQ ID NO: 29315 - RNA, 20 nt, Artificial Sequence
  CIITA targeting sequence
cuugaacccggagccggagg

SEQ ID NO: 29316 - RNA, 20 nt, Artificial Sequence
  CIITA targeting sequence
agugauucuccugccucagc

SEQ ID NO: 29317 - RNA, 20 nt, Artificial Sequence
  CIITA targeting sequence
ggguucaagugauucuccug

SEQ ID NO: 29318 - RNA, 20 nt, Artificial Sequence
  CIITA targeting sequence
ggcuccggguucaagugauu

SEQ ID NO: 29319 - RNA, 20 nt, Artificial Sequence
  CIITA targeting sequence
cugcaaccuccggcuccggg

SEQ ID NO: 29320 - RNA, 20 nt, Artificial Sequence
  CIITA targeting sequence
agccugggagcagagugaga

SEQ ID NO: 29321 - RNA, 20 nt, Artificial Sequence
  CIITA targeting sequence
caggcuggagugcaauggca

SEQ ID NO: 29322 - RNA, 20 nt, Artificial Sequence
  CIITA targeting sequence
gcucccaggcuggagugcaa

SEQ ID NO: 29323 - RNA, 20 nt, Artificial Sequence
  CIITA targeting sequence
cucugcucccaggcuggagu

SEQ ID NO: 29324 - RNA, 20 nt, Artificial Sequence
  CIITA targeting sequence
cacucugcucccaggcugga

SEQ ID NO: 29325 - RNA, 20 nt, Artificial Sequence
  CIITA targeting sequence
caucucaaaaaaaaaaaaaa

SEQ ID NO: 29326 - RNA, 20 nt, Artificial Sequence
  CIITA targeting sequence
caaaaaaaaaaaaaaaaaaa

SEQ ID NO: 29327 - RNA, 20 nt, Artificial Sequence
  CIITA targeting sequence
aaaaaaaaaaaaaaaaaaaa

SEQ ID NO: 29328 - RNA, 20 nt, Artificial Sequence
  CIITA targeting sequence
auuuuuuuuuuuuuuuuuuu

SEQ ID NO: 29329 - RNA, 20 nt, Artificial Sequence
  CIITA targeting sequence
caaacgguuuuucaauuuuu

SEQ ID NO: 29330 - RNA, 20 nt, Artificial Sequence
  CIITA targeting sequence
uuccuuaauucuauacuuuu

SEQ ID NO: 29331 - RNA, 20 nt, Artificial Sequence
  CIITA targeting sequence
uuaauucuauacuuuuaaaa

SEQ ID NO: 29332 - RNA, 20 nt, Artificial Sequence
  CIITA targeting sequence
auacuuuuaaaaaucacuga

SEQ ID NO: 29333 - RNA, 20 nt, Artificial Sequence
  CIITA targeting sequence
cugaaaacuaacaauggcag

SEQ ID NO: 29334 - RNA, 20 nt, Artificial Sequence
  CIITA targeting sequence
gugauuuuuaaaaguauaga

SEQ ID NO: 29335 - RNA, 20 nt, Artificial Sequence
  CIITA targeting sequence
caaaaggacaaaaacuauaa

SEQ ID NO: 29336 - RNA, 20 nt, Artificial Sequence
  CIITA targeting sequence
uuuugugacugccauuguua

SEQ ID NO: 29337 - RNA, 20 nt, Artificial Sequence
  CIITA targeting sequence
uauaagugcaauuauaguuu

SEQ ID NO: 29338 - RNA, 20 nt, Artificial Sequence
  CIITA targeting sequence
cuagggcugucaaaccaaua

SEQ ID NO: 29339 - RNA, 20 nt, Artificial Sequence
  CIITA targeting sequence
aaccaauagauacagaaagc

SEQ ID NO: 29340 - RNA, 20 nt, Artificial Sequence
  CIITA targeting sequence
auugguuugacagcccuagg

SEQ ID NO: 29341 - RNA, 20 nt, Artificial Sequence
  CIITA targeting sequence
guaucuauugguuugacagc

SEQ ID NO: 29342 - RNA, 20 nt, Artificial Sequence
  CIITA targeting sequence
gcuuucuguaucuauugguu

SEQ ID NO: 29343 - RNA, 20 nt, Artificial Sequence
  CIITA targeting sequence
uagcccuagcaaccagcauu

SEQ ID NO: 29344 - RNA, 20 nt, Artificial Sequence
  CIITA targeting sequence
ccuccuagcccuagcaacca

SEQ ID NO: 29345 - RNA, 20 nt, Artificial Sequence
  CIITA targeting sequence
ucgccuccuagcccuagcaa

SEQ ID NO: 29346 - RNA, 20 nt, Artificial Sequence
  CIITA targeting sequence
uccucgccuccuagcccuag

SEQ ID NO: 29347 - RNA, 20 nt, Artificial Sequence
  CIITA targeting sequence
cccuccuccucgccuccuag

SEQ ID NO: 29348 - RNA, 20 nt, Artificial Sequence
  CIITA targeting sequence
guacccacaaaacacuaacu

SEQ ID NO: 29349 - RNA, 20 nt, Artificial Sequence
  CIITA targeting sequence
ugcaaaacuuaagcucagua

SEQ ID NO: 29350 - RNA, 20 nt, Artificial Sequence
  CIITA targeting sequence
ucuugcaaaacuuaagcuca

SEQ ID NO: 29351 - RNA, 20 nt, Artificial Sequence
  CIITA targeting sequence
ggagcuggguggggugaagg

SEQ ID NO: 29352 - RNA, 20 nt, Artificial Sequence
  CIITA targeting sequence
agaacugcuuucaucuugca

SEQ ID NO: 29353 - RNA, 20 nt, Artificial Sequence
  CIITA targeting sequence
ccccacccagcuccagaacu

SEQ ID NO: 29354 - RNA, 20 nt, Artificial Sequence
  CIITA targeting sequence
guggcauuaaguauaaccac

SEQ ID NO: 29355 - RNA, 20 nt, Artificial Sequence
  CIITA targeting sequence
uacaauuaaaaaacaaaacu

SEQ ID NO: 29356 - RNA, 20 nt, Artificial Sequence
  CIITA targeting sequence
cucauggcuguaaucccagc

SEQ ID NO: 29357 - RNA, 20 nt, Artificial Sequence
  CIITA targeting sequence
uggcuguaaucccagcacuu

SEQ ID NO: 29358 - RNA, 20 nt, Artificial Sequence
  CIITA targeting sequence
cagcacuuugggaggccaag

SEQ ID NO: 29359 - RNA, 20 nt, Artificial Sequence
  CIITA targeting sequence
caaagugcugggauuacagc

SEQ ID NO: 29360 - RNA, 20 nt, Artificial Sequence
  CIITA targeting sequence
agcagcccgccugccuuggc

SEQ ID NO: 29361 - RNA, 20 nt, Artificial Sequence
  CIITA targeting sequence
ggaguucuagagcagccugg

SEQ ID NO: 29362 - RNA, 20 nt, Artificial Sequence
  CIITA targeting sequence
ugagcucaagcagcccgccu

SEQ ID NO: 29363 - RNA, 20 nt, Artificial Sequence
  CIITA targeting sequence
agagcagccugggcaacaug

SEQ ID NO: 29364 - RNA, 20 nt, Artificial Sequence
  CIITA targeting sequence
agaacuccugagcucaagca

SEQ ID NO: 29365 - RNA, 20 nt, Artificial Sequence
  CIITA targeting sequence
ucucuacaaaaaaaaaaggc

SEQ ID NO: 29366 - RNA, 20 nt, Artificial Sequence
  CIITA targeting sequence
cuacaaaaaaaaaaggccag

SEQ ID NO: 29367 - RNA, 20 nt, Artificial Sequence
  CIITA targeting sequence
acaaaaaaaaaaggccaggc

SEQ ID NO: 29368 - RNA, 20 nt, Artificial Sequence
  CIITA targeting sequence
caacugugccagaggcugag

SEQ ID NO: 29369 - RNA, 20 nt, Artificial Sequence
  CIITA targeting sequence
ggcacaguugggacuacagg

SEQ ID NO: 29370 - RNA, 20 nt, Artificial Sequence
  CIITA targeting sequence
gccucuggcacaguugggac

SEQ ID NO: 29371 - RNA, 20 nt, Artificial Sequence
  CIITA targeting sequence
caccucagccucuggcacag

SEQ ID NO: 29372 - RNA, 20 nt, Artificial Sequence
  CIITA targeting sequence
ucccaccucagccucuggca

SEQ ID NO: 29373 - RNA, 20 nt, Artificial Sequence
  CIITA targeting sequence
cuugagcccaagagauggag

SEQ ID NO: 29374 - RNA, 20 nt, Artificial Sequence
  CIITA targeting sequence
agcgauccucccaccucagc

SEQ ID NO: 29375 - RNA, 20 nt, Artificial Sequence
  CIITA targeting sequence
ugggcucaagcgauccuccc

SEQ ID NO: 29376 - RNA, 20 nt, Artificial Sequence
  CIITA targeting sequence
cuugggcucaagcgauccuc

SEQ ID NO: 29377 - RNA, 20 nt, Artificial Sequence
  CIITA targeting sequence
aucucuugggcucaagcgau

SEQ ID NO: 29378 - RNA, 20 nt, Artificial Sequence
  CIITA targeting sequence
cggccuauugcaaccuccau

SEQ ID NO: 29379 - RNA, 20 nt, Artificial Sequence
  CIITA targeting sequence
caccauugcacucuagccug

SEQ ID NO: 29380 - RNA, 20 nt, Artificial Sequence
  CIITA targeting sequence
agccugggugacagagcgag

SEQ ID NO: 29381 - RNA, 20 nt, Artificial Sequence
  CIITA targeting sequence
cccaggcuagagugcaaugg

SEQ ID NO: 29382 - RNA, 20 nt, Artificial Sequence
  CIITA targeting sequence
gucacccaggcuagagugca

SEQ ID NO: 29383 - RNA, 20 nt, Artificial Sequence
  CIITA targeting sequence
cucugucacccaggcuagag

SEQ ID NO: 29384 - RNA, 20 nt, Artificial Sequence
  CIITA targeting sequence
cgcucugucacccaggcuag

SEQ ID NO: 29385 - RNA, 20 nt, Artificial Sequence
  CIITA targeting sequence
ugucucccaaaaaauauaua

SEQ ID NO: 29386 - RNA, 20 nt, Artificial Sequence
  CIITA targeting sequence
cccaaaaaauauauaaacaa

SEQ ID NO: 29387 - RNA, 20 nt, Artificial Sequence
  CIITA targeting sequence
caaaaaauauauaaacaaua

SEQ ID NO: 29388 - RNA, 20 nt, Artificial Sequence
  CIITA targeting sequence
gccaggcugccaauguuuua

SEQ ID NO: 29389 - RNA, 20 nt, Artificial Sequence
  CIITA targeting sequence
agguggccugcuggcaacug

SEQ ID NO: 29390 - RNA, 20 nt, Artificial Sequence
  CIITA targeting sequence
aagucaagguggccugcugg

SEQ ID NO: 29391 - RNA, 20 nt, Artificial Sequence
  CIITA targeting sequence
agguagucaaagucaaggug

SEQ ID NO: 29392 - RNA, 20 nt, Artificial Sequence
  CIITA targeting sequence
ccagguagucaaagucaagg

SEQ ID NO: 29393 - RNA, 20 nt, Artificial Sequence
  CIITA targeting sequence
ucuccagguagucaaaguca

SEQ ID NO: 29394 - RNA, 20 nt, Artificial Sequence
  CIITA targeting sequence
aagagucagaccucaguuac

SEQ ID NO: 29395 - RNA, 20 nt, Artificial Sequence
  CIITA targeting sequence
uggaccacuccucuccaggu

SEQ ID NO: 29396 - RNA, 20 nt, Artificial Sequence
  CIITA targeting sequence
gaccucaguuacucaccguc

SEQ ID NO: 29397 - RNA, 20 nt, Artificial Sequence
  CIITA targeting sequence
gacucuuggaccacuccucu

SEQ ID NO: 29398 - RNA, 20 nt, Artificial Sequence
  CIITA targeting sequence
guuacucaccgucuggaaca

SEQ ID NO: 29399 - RNA, 20 nt, Artificial Sequence
  CIITA targeting sequence
ccgucuggaacacugucugg

SEQ ID NO: 29400 - RNA, 20 nt, Artificial Sequence
  CIITA targeting sequence
ggaacacugucugggacagg

SEQ ID NO: 29401 - RNA, 20 nt, Artificial Sequence
  CIITA targeting sequence
agacggugaguaacugaggu

SEQ ID NO: 29402 - RNA, 20 nt, Artificial Sequence
  CIITA targeting sequence
gggacaggaaacuggcugug

SEQ ID NO: 29403 - RNA, 20 nt, Artificial Sequence
  CIITA targeting sequence
cagacaguguuccagacggu

SEQ ID NO: 29404 - RNA, 20 nt, Artificial Sequence
  CIITA targeting sequence
ugucccagacaguguuccag

SEQ ID NO: 29405 - RNA, 20 nt, Artificial Sequence
  CIITA targeting sequence
cagccaguuuccugucccag

SEQ ID NO: 29406 - RNA, 20 nt, Artificial Sequence
  CIITA targeting sequence
cuguugccucccaucuuaca

SEQ ID NO: 29407 - RNA, 20 nt, Artificial Sequence
  CIITA targeting sequence
caucuuacaaaggauguagc

SEQ ID NO: 29408 - RNA, 20 nt, Artificial Sequence
  CIITA targeting sequence
uacaaaggauguagccauac

SEQ ID NO: 29409 - RNA, 20 nt, Artificial Sequence
  CIITA targeting sequence
uuuguaagaugggaggcaac

SEQ ID NO: 29410 - RNA, 20 nt, Artificial Sequence
  CIITA targeting sequence
aagcugcaaaccuguauggc

SEQ ID NO: 29411 - RNA, 20 nt, Artificial Sequence
  CIITA targeting sequence
ccaagcugcaaaccuguaug

SEQ ID NO: 29412 - RNA, 20 nt, Artificial Sequence
  CIITA targeting sequence
cuccaagcugcaaaccugua

SEQ ID NO: 29413 - RNA, 20 nt, Artificial Sequence
  CIITA targeting sequence
cucuccaagcugcaaaccug

SEQ ID NO: 29414 - RNA, 20 nt, Artificial Sequence
  CIITA targeting sequence
cagcaaccaccagagccugc

SEQ ID NO: 29415 - RNA, 20 nt, Artificial Sequence
  CIITA targeting sequence
ggugguugcugggaucucuc

SEQ ID NO: 29416 - RNA, 20 nt, Artificial Sequence
  CIITA targeting sequence
gacaaagaaagcaaagguca

SEQ ID NO: 29417 - RNA, 20 nt, Artificial Sequence
  CIITA targeting sequence
gagugcaggcucuggugguu

SEQ ID NO: 29418 - RNA, 20 nt, Artificial Sequence
  CIITA targeting sequence
uugucugagugcaggcucug

SEQ ID NO: 29419 - RNA, 20 nt, Artificial Sequence
  CIITA targeting sequence
cuuuuuuuugagacagaguu

SEQ ID NO: 29420 - RNA, 20 nt, Artificial Sequence
  CIITA targeting sequence
aaaaaaagugaccuuugcuu

SEQ ID NO: 29421 - RNA, 20 nt, Artificial Sequence
  CIITA targeting sequence
caaaaaaaagugaccuuugc

SEQ ID NO: 29422 - RNA, 20 nt, Artificial Sequence
  CIITA targeting sequence
gucucaaaaaaaagugaccu

SEQ ID NO: 29423 - RNA, 20 nt, Artificial Sequence
  CIITA targeting sequence
cucugucgcccaggcugggg

SEQ ID NO: 29424 - RNA, 20 nt, Artificial Sequence
  CIITA targeting sequence
gucgcccaggcuggggugca

SEQ ID NO: 29425 - RNA, 20 nt, Artificial Sequence
  CIITA targeting sequence
cccaggcuggggugcagagg

SEQ ID NO: 29426 - RNA, 20 nt, Artificial Sequence
  CIITA targeting sequence
gcaccccagccugggcgaca

SEQ ID NO: 29427 - RNA, 20 nt, Artificial Sequence
  CIITA targeting sequence
ugccucugcaccccagccug

SEQ ID NO: 29428 - RNA, 20 nt, Artificial Sequence
  CIITA targeting sequence
cagcucacugcaaguuccgc

SEQ ID NO: 29429 - RNA, 20 nt, Artificial Sequence
  CIITA targeting sequence
gcucacugcaaguuccgccu

SEQ ID NO: 29430 - RNA, 20 nt, Artificial Sequence
  CIITA targeting sequence
cugcaaguuccgccucccgg

SEQ ID NO: 29431 - RNA, 20 nt, Artificial Sequence
  CIITA targeting sequence
gccucccggguucacaccau

SEQ ID NO: 29432 - RNA, 20 nt, Artificial Sequence
  CIITA targeting sequence
cggguucacaccauucuccu

SEQ ID NO: 29433 - RNA, 20 nt, Artificial Sequence
  CIITA targeting sequence
caccauucuccugccucagc

SEQ ID NO: 29434 - RNA, 20 nt, Artificial Sequence
  CIITA targeting sequence
ccugccucagccucccgagu

SEQ ID NO: 29435 - RNA, 20 nt, Artificial Sequence
  CIITA targeting sequence
ugccucagccucccgaguag

SEQ ID NO: 29436 - RNA, 20 nt, Artificial Sequence
  CIITA targeting sequence
gccucccgaguagcugggac

SEQ ID NO: 29437 - RNA, 20 nt, Artificial Sequence
  CIITA targeting sequence
cgaguagcugggacuacagg

SEQ ID NO: 29438 - RNA, 20 nt, Artificial Sequence
  CIITA targeting sequence
ggaggcugaggcaggagaau

SEQ ID NO: 29439 - RNA, 20 nt, Artificial Sequence
  CIITA targeting sequence
cagcuacucgggaggcugag

SEQ ID NO: 29440 - RNA, 20 nt, Artificial Sequence
  CIITA targeting sequence
gccaccaggccuggcuaauu

SEQ ID NO: 29441 - RNA, 20 nt, Artificial Sequence
  CIITA targeting sequence
acuaaaaauacaaaaaaauu

SEQ ID NO: 29442 - RNA, 20 nt, Artificial Sequence
  CIITA targeting sequence
cuacuaaaaauacaaaaaaa

SEQ ID NO: 29443 - RNA, 20 nt, Artificial Sequence
  CIITA targeting sequence
ccauguuagccaggaugguc

SEQ ID NO: 29444 - RNA, 20 nt, Artificial Sequence
  CIITA targeting sequence
uggcuaacauggugaaacag

SEQ ID NO: 29445 - RNA, 20 nt, Artificial Sequence
  CIITA targeting sequence
ccaucugacgcaaaggucac

SEQ ID NO: 29446 - RNA, 20 nt, Artificial Sequence
  CIITA targeting sequence
aucugacgcaaaggucacuu

SEQ ID NO: 29447 - RNA, 20 nt, Artificial Sequence
  CIITA targeting sequence
gacgcaaaggucacuuucua

SEQ ID NO: 29448 - RNA, 20 nt, Artificial Sequence
  CIITA targeting sequence
gauggagaccauccuggcua

SEQ ID NO: 29449 - RNA, 20 nt, Artificial Sequence
  CIITA targeting sequence
cuuucuaagagcauuuacag

SEQ ID NO: 29450 - RNA, 20 nt, Artificial Sequence
  CIITA targeting sequence
aagagcauuuacagaaaugc

SEQ ID NO: 29451 - RNA, 20 nt, Artificial Sequence
  CIITA targeting sequence
uagaaagugaccuuugcguc

SEQ ID NO: 29452 - RNA, 20 nt, Artificial Sequence
  CIITA targeting sequence
guaaaugcucuuagaaagug

SEQ ID NO: 29453 - RNA, 20 nt, Artificial Sequence
  CIITA targeting sequence
caagccacguagaaaugcuc

SEQ ID NO: 29454 - RNA, 20 nt, Artificial Sequence
  CIITA targeting sequence
agccacguagaaaugcucua

SEQ ID NO: 29455 - RNA, 20 nt, Artificial Sequence
  CIITA targeting sequence
acguggcuugagaggugcau

SEQ ID NO: 29456 - RNA, 20 nt, Artificial Sequence
  CIITA targeting sequence
agccugcaccuaagaauagu

SEQ ID NO: 29457 - RNA, 20 nt, Artificial Sequence
  CIITA targeting sequence
uaggugcaggcuagagcauu

SEQ ID NO: 29458 - RNA, 20 nt, Artificial Sequence
  CIITA targeting sequence
guaaauguuggcuguuacua

SEQ ID NO: 29459 - RNA, 20 nt, Artificial Sequence
  CIITA targeting sequence
guggguauuugcaaaugcuc

SEQ ID NO: 29460 - RNA, 20 nt, Artificial Sequence
  CIITA targeting sequence
gaaucauuacaacuggagag

SEQ ID NO: 29461 - RNA, 20 nt, Artificial Sequence
  CIITA targeting sequence
gagguguccguggguauuug

SEQ ID NO: 29462 - RNA, 20 nt, Artificial Sequence
  CIITA targeting sequence
uuacaacuggagagguugcc

SEQ ID NO: 29463 - RNA, 20 nt, Artificial Sequence
  CIITA targeting sequence
aguuguaaugauucugaggu

SEQ ID NO: 29464 - RNA, 20 nt, Artificial Sequence
  CIITA targeting sequence
ccaguuguaaugauucugag

SEQ ID NO: 29465 - RNA, 20 nt, Artificial Sequence
  CIITA targeting sequence
ucaucccauuuuacaaagag

SEQ ID NO: 29466 - RNA, 20 nt, Artificial Sequence
  CIITA targeting sequence
ucccauuuuacaaagaggaa

SEQ ID NO: 29467 - RNA, 20 nt, Artificial Sequence
  CIITA targeting sequence
cauuuuacaaagaggaaacu

SEQ ID NO: 29468 - RNA, 20 nt, Artificial Sequence
  CIITA targeting sequence
uuguaaaaugggaugaugau

SEQ ID NO: 29469 - RNA, 20 nt, Artificial Sequence
  CIITA targeting sequence
ucuuuguaaaaugggaugau

SEQ ID NO: 29470 - RNA, 20 nt, Artificial Sequence
  CIITA targeting sequence
guuuccucuuuguaaaaugg

SEQ ID NO: 29471 - RNA, 20 nt, Artificial Sequence
  CIITA targeting sequence
ggaagacgaaagcugcccaa

SEQ ID NO: 29472 - RNA, 20 nt, Artificial Sequence
  CIITA targeting sequence
ugagccucaguuuccucuuu

SEQ ID NO: 29473 - RNA, 20 nt, Artificial Sequence
  CIITA targeting sequence
uccugagccucaguuuccuc

SEQ ID NO: 29474 - RNA, 20 nt, Artificial Sequence
  CIITA targeting sequence
ucuuccugagccucaguuuc

SEQ ID NO: 29475 - RNA, 20 nt, Artificial Sequence
  CIITA targeting sequence
cagagcuggagcguggucga

SEQ ID NO: 29476 - RNA, 20 nt, Artificial Sequence
  CIITA targeting sequence
gugaccuugggcagcuuucg

SEQ ID NO: 29477 - RNA, 20 nt, Artificial Sequence
  CIITA targeting sequence
agcucugugaccuugggcag

SEQ ID NO: 29478 - RNA, 20 nt, Artificial Sequence
  CIITA targeting sequence
agccgggauccaaauuccag

SEQ ID NO: 29479 - RNA, 20 nt, Artificial Sequence
  CIITA targeting sequence
accacgcuccagcucuguga

SEQ ID NO: 29480 - RNA, 20 nt, Artificial Sequence
  CIITA targeting sequence
cggcucgaccacgcuccagc

SEQ ID NO: 29481 - RNA, 20 nt, Artificial Sequence
  CIITA targeting sequence
aaauuccagggcccgcacuu

SEQ ID NO: 29482 - RNA, 20 nt, Artificial Sequence
  CIITA targeting sequence
agggcccgcacuuucauuaa

SEQ ID NO: 29483 - RNA, 20 nt, Artificial Sequence
  CIITA targeting sequence
uuaaaugacacuguuguuuu

SEQ ID NO: 29484 - RNA, 20 nt, Artificial Sequence
  CIITA targeting sequence
uuuaaugaaagugcgggccc

SEQ ID NO: 29485 - RNA, 20 nt, Artificial Sequence
  CIITA targeting sequence
acaaauauuuuguuuucucu

SEQ ID NO: 29486 - RNA, 20 nt, Artificial Sequence
  CIITA targeting sequence
cuauuuauugauuuuuuuua

SEQ ID NO: 29487 - RNA, 20 nt, Artificial Sequence
  CIITA targeting sequence
auuuauugauuuuuuuuaag

SEQ ID NO: 29488 - RNA, 20 nt, Artificial Sequence
  CIITA targeting sequence
auaaauagagaaaacaaaau

SEQ ID NO: 29489 - RNA, 20 nt, Artificial Sequence
  CIITA targeting sequence
uaaaaaaaaucaauaaauag

SEQ ID NO: 29490 - RNA, 20 nt, Artificial Sequence
  CIITA targeting sequence
gucuuaaaaaaaaucaauaa

SEQ ID NO: 29491 - RNA, 20 nt, Artificial Sequence
  CIITA targeting sequence
cucugucacccaggcugaag

SEQ ID NO: 29492 - RNA, 20 nt, Artificial Sequence
  CIITA targeting sequence
gucacccaggcugaagugcu

SEQ ID NO: 29493 - RNA, 20 nt, Artificial Sequence
  CIITA targeting sequence
cccaggcugaagugcugugg

SEQ ID NO: 29494 - RNA, 20 nt, Artificial Sequence
  CIITA targeting sequence
gccugggugacagagugagg

SEQ ID NO: 29495 - RNA, 20 nt, Artificial Sequence
  CIITA targeting sequence
ugccacagcacuucagccug

SEQ ID NO: 29496 - RNA, 20 nt, Artificial Sequence
  CIITA targeting sequence
uggcucacugcaaccuccgc

SEQ ID NO: 29497 - RNA, 20 nt, Artificial Sequence
  CIITA targeting sequence
cugcaaccuccgccuccugg

SEQ ID NO: 29498 - RNA, 20 nt, Artificial Sequence
  CIITA targeting sequence
gccuccuggguucaagcgau

SEQ ID NO: 29499 - RNA, 20 nt, Artificial Sequence
  CIITA targeting sequence
uggguucaagcgauucuccu

SEQ ID NO: 29500 - RNA, 20 nt, Artificial Sequence
  CIITA targeting sequence
agcgauucuccugccucagc

SEQ ID NO: 29501 - RNA, 20 nt, Artificial Sequence
  CIITA targeting sequence
cuugaacccaggaggcggag

SEQ ID NO: 29502 - RNA, 20 nt, Artificial Sequence
  CIITA targeting sequence
ccugccucagccucccaagu

SEQ ID NO: 29503 - RNA, 20 nt, Artificial Sequence
  CIITA targeting sequence
ugccucagccucccaaguag

SEQ ID NO: 29504 - RNA, 20 nt, Artificial Sequence
  CIITA targeting sequence
gccucccaaguagcugagau

SEQ ID NO: 29505 - RNA, 20 nt, Artificial Sequence
  CIITA targeting sequence
caaguagcugagauuacagg

SEQ ID NO: 29506 - RNA, 20 nt, Artificial Sequence
  CIITA targeting sequence
gcuacuugggaggcugaggc

SEQ ID NO: 29507 - RNA, 20 nt, Artificial Sequence
  CIITA targeting sequence
cagcuacuugggaggcugag

SEQ ID NO: 29508 - RNA, 20 nt, Artificial Sequence
  CIITA targeting sequence
auaguacagacaggguuuug

SEQ ID NO: 29509 - RNA, 20 nt, Artificial Sequence
  CIITA targeting sequence
guacuauagauaccaaaauu

SEQ ID NO: 29510 - RNA, 20 nt, Artificial Sequence
  CIITA targeting sequence
caaacuccugaccucaggug

SEQ ID NO: 29511 - RNA, 20 nt, Artificial Sequence
  CIITA targeting sequence
aacuccugaccucaggugau

SEQ ID NO: 29512 - RNA, 20 nt, Artificial Sequence
  CIITA targeting sequence
ugaccucaggugauucaccu

SEQ ID NO: 29513 - RNA, 20 nt, Artificial Sequence
  CIITA targeting sequence
ggaguuugagaccagccugg

SEQ ID NO: 29514 - RNA, 20 nt, Artificial Sequence
  CIITA targeting sequence
ggugauucaccugccacagc

SEQ ID NO: 29515 - RNA, 20 nt, Artificial Sequence
  CIITA targeting sequence
ccugaggucaggaguuugag

SEQ ID NO: 29516 - RNA, 20 nt, Artificial Sequence
  CIITA targeting sequence
ccugccacagccucccaaag

SEQ ID NO: 29517 - RNA, 20 nt, Artificial Sequence
  CIITA targeting sequence
caaagugcugggauuacaga

SEQ ID NO: 29518 - RNA, 20 nt, Artificial Sequence
  CIITA targeting sequence
cagcacuuugggaggcugug

SEQ ID NO: 29519 - RNA, 20 nt, Artificial Sequence
  CIITA targeting sequence
guaaucccagcacuuuggga

SEQ ID NO: 29520 - RNA, 20 nt, Artificial Sequence
  CIITA targeting sequence
caucuguaaucccagcacuu

SEQ ID NO: 29521 - RNA, 20 nt, Artificial Sequence
  CIITA targeting sequence
cacaggcuggcacaguaccu

SEQ ID NO: 29522 - RNA, 20 nt, Artificial Sequence
  CIITA targeting sequence
auuuauaugaaaugcccaga

SEQ ID NO: 29523 - RNA, 20 nt, Artificial Sequence
  CIITA targeting sequence
uauaaauggacucacacagg

SEQ ID NO: 29524 - RNA, 20 nt, Artificial Sequence
  CIITA targeting sequence
gggcauuucauauaaaugga

SEQ ID NO: 29525 - RNA, 20 nt, Artificial Sequence
  CIITA targeting sequence
acagaaacagaaaaauuaau

SEQ ID NO: 29526 - RNA, 20 nt, Artificial Sequence
  CIITA targeting sequence
guggauuugccuauucuggg

SEQ ID NO: 29527 - RNA, 20 nt, Artificial Sequence
  CIITA targeting sequence
guuucuguggauuugccuau

SEQ ID NO: 29528 - RNA, 20 nt, Artificial Sequence
  CIITA targeting sequence
aagcccuggcaccuauuaau

SEQ ID NO: 29529 - RNA, 20 nt, Artificial Sequence
  CIITA targeting sequence
uccaagcccuggcaccuauu

SEQ ID NO: 29530 - RNA, 20 nt, Artificial Sequence
  CIITA targeting sequence
guuccuccaagcccuggcac

SEQ ID NO: 29531 - RNA, 20 nt, Artificial Sequence
  CIITA targeting sequence
cugugcuucuguuccuccaa

SEQ ID NO: 29532 - RNA, 20 nt, Artificial Sequence
  CIITA targeting sequence
aaagggcgcaaggcuucuuc

SEQ ID NO: 29533 - RNA, 20 nt, Artificial Sequence
  CIITA targeting sequence
uccggugaugaaaauuuccu

SEQ ID NO: 29534 - RNA, 20 nt, Artificial Sequence
  CIITA targeting sequence
ggugaugaaaauuuccuaac

SEQ ID NO: 29535 - RNA, 20 nt, Artificial Sequence
  CIITA targeting sequence
ccggaagaagccuugcgccc

SEQ ID NO: 29536 - RNA, 20 nt, Artificial Sequence
  CIITA targeting sequence
ucaccggaagaagccuugcg

SEQ ID NO: 29537 - RNA, 20 nt, Artificial Sequence
  CIITA targeting sequence
uaacauugauggugguuuug

SEQ ID NO: 29538 - RNA, 20 nt, Artificial Sequence
  CIITA targeting sequence
auguuaggaaauuuucauca

SEQ ID NO: 29539 - RNA, 20 nt, Artificial Sequence
  CIITA targeting sequence
gugacugcacuagaagccac

SEQ ID NO: 29540 - RNA, 20 nt, Artificial Sequence
  CIITA targeting sequence
cagaguuguacagccaaaac

SEQ ID NO: 29541 - RNA, 20 nt, Artificial Sequence
  CIITA targeting sequence
agugcagucacagaguugua

SEQ ID NO: 29542 - RNA, 20 nt, Artificial Sequence
  CIITA targeting sequence
guggcuucuagugcagucac

SEQ ID NO: 29543 - RNA, 20 nt, Artificial Sequence
  CIITA targeting sequence
acacuuaguauuuauuuuau

SEQ ID NO: 29544 - RNA, 20 nt, Artificial Sequence
  CIITA targeting sequence
aaaaaauaaaauaaauacua

SEQ ID NO: 29545 - RNA, 20 nt, Artificial Sequence
  CIITA targeting sequence
ccaaaaaauaaaauaaauac

SEQ ID NO: 29546 - RNA, 20 nt, Artificial Sequence
  CIITA targeting sequence
cacucuagcacccaggcugg

SEQ ID NO: 29547 - RNA, 20 nt, Artificial Sequence
  CIITA targeting sequence
cucuagcacccaggcuggag

SEQ ID NO: 29548 - RNA, 20 nt, Artificial Sequence
  CIITA targeting sequence
agcacccaggcuggagugca

SEQ ID NO: 29549 - RNA, 20 nt, Artificial Sequence
  CIITA targeting sequence
agccugggugcuagagugag

SEQ ID NO: 29550 - RNA, 20 nt, Artificial Sequence
  CIITA targeting sequence
uggcucacugcaaccuuugc

SEQ ID NO: 29551 - RNA, 20 nt, Artificial Sequence
  CIITA targeting sequence
cugcaaccuuugcuucccgg

SEQ ID NO: 29552 - RNA, 20 nt, Artificial Sequence
  CIITA targeting sequence
cgggcucaagcgugcacacc

SEQ ID NO: 29553 - RNA, 20 nt, Artificial Sequence
  CIITA targeting sequence
agcgugcacaccaucaugcc

SEQ ID NO: 29554 - RNA, 20 nt, Artificial Sequence
  CIITA targeting sequence
ugccuggcuaauuuuugcau

SEQ ID NO: 29555 - RNA, 20 nt, Artificial Sequence
  CIITA targeting sequence
gcaaaaaaugcaaaaauuag

SEQ ID NO: 29556 - RNA, 20 nt, Artificial Sequence
  CIITA targeting sequence
cugcaaaaaaugcaaaaauu

SEQ ID NO: 29557 - RNA, 20 nt, Artificial Sequence
  CIITA targeting sequence
cgaacuccugagcucaagca

SEQ ID NO: 29558 - RNA, 20 nt, Artificial Sequence
  CIITA targeting sequence
aacuccugagcucaagcaau

SEQ ID NO: 29559 - RNA, 20 nt, Artificial Sequence
  CIITA targeting sequence
agaccagccugggcaacaua

SEQ ID NO: 29560 - RNA, 20 nt, Artificial Sequence
  CIITA targeting sequence
ugagcucaagcaauccuucc

SEQ ID NO: 29561 - RNA, 20 nt, Artificial Sequence
  CIITA targeting sequence
ggaguucgagaccagccugg

SEQ ID NO: 29562 - RNA, 20 nt, Artificial Sequence
  CIITA targeting sequence
agcaauccuuccaccuuggc

SEQ ID NO: 29563 - RNA, 20 nt, Artificial Sequence
  CIITA targeting sequence
uuccaccuuggccucccaaa

SEQ ID NO: 29564 - RNA, 20 nt, Artificial Sequence
  CIITA targeting sequence
accuuggccucccaaaggcc

SEQ ID NO: 29565 - RNA, 20 nt, Artificial Sequence
  CIITA targeting sequence
caaaggccugggauuauagg

SEQ ID NO: 29566 - RNA, 20 nt, Artificial Sequence
  CIITA targeting sequence
caggccuuugggaggccaag

SEQ ID NO: 29567 - RNA, 20 nt, Artificial Sequence
  CIITA targeting sequence
auacaauuuacccauuuaaa

SEQ ID NO: 29568 - RNA, 20 nt, Artificial Sequence
  CIITA targeting sequence
caauaaacuuguuauaauug

SEQ ID NO: 29569 - RNA, 20 nt, Artificial Sequence
  CIITA targeting sequence
auaaacuuguuauaauugau

SEQ ID NO: 29570 - RNA, 20 nt, Artificial Sequence
  CIITA targeting sequence
auuauaacaaguuuauugag

SEQ ID NO: 29571 - RNA, 20 nt, Artificial Sequence
  CIITA targeting sequence
aucaaucaauaacaaauaac

SEQ ID NO: 29572 - RNA, 20 nt, Artificial Sequence
  CIITA targeting sequence
aucaauaacaaauaacaaca

SEQ ID NO: 29573 - RNA, 20 nt, Artificial Sequence
  CIITA targeting sequence
auaacaaauaacaacaaaag

SEQ ID NO: 29574 - RNA, 20 nt, Artificial Sequence
  CIITA targeting sequence
gcaaaaaaaguguuugcacc

SEQ ID NO: 29575 - RNA, 20 nt, Artificial Sequence
  CIITA targeting sequence
cugcaaaaaaaguguuugca

SEQ ID NO: 29576 - RNA, 20 nt, Artificial Sequence
  CIITA targeting sequence
aagcaauguggaagucaaga

SEQ ID NO: 29577 - RNA, 20 nt, Artificial Sequence
  CIITA targeting sequence
acauugcuuugaugucucug

SEQ ID NO: 29578 - RNA, 20 nt, Artificial Sequence
  CIITA targeting sequence
agaucuggccuuaccagcca

SEQ ID NO: 29579 - RNA, 20 nt, Artificial Sequence
  CIITA targeting sequence
ugacuuccacauugcuuuga

SEQ ID NO: 29580 - RNA, 20 nt, Artificial Sequence
  CIITA targeting sequence
ggccuuaccagccacuuuag

SEQ ID NO: 29581 - RNA, 20 nt, Artificial Sequence
  CIITA targeting sequence
aggaaaauaaggugcuaaaa

SEQ ID NO: 29582 - RNA, 20 nt, Artificial Sequence
  CIITA targeting sequence
uugaagcuaaaguggcuggu

SEQ ID NO: 29583 - RNA, 20 nt, Artificial Sequence
  CIITA targeting sequence
auaucauggggcagauuaug

SEQ ID NO: 29584 - RNA, 20 nt, Artificial Sequence
  CIITA targeting sequence
uggggcagauuaugaggccc

SEQ ID NO: 29585 - RNA, 20 nt, Artificial Sequence
  CIITA targeting sequence
gccccaugauauggauugug

SEQ ID NO: 29586 - RNA, 20 nt, Artificial Sequence
  CIITA targeting sequence
uaaucugccccaugauaugg

SEQ ID NO: 29587 - RNA, 20 nt, Artificial Sequence
  CIITA targeting sequence
ggcugggccucauaaucugc

SEQ ID NO: 29588 - RNA, 20 nt, Artificial Sequence
  CIITA targeting sequence
ucuggcugggccucauaauc

SEQ ID NO: 29589 - RNA, 20 nt, Artificial Sequence
  CIITA targeting sequence
ugcuucagcuucuguggcag

SEQ ID NO: 29590 - RNA, 20 nt, Artificial Sequence
  CIITA targeting sequence
gcuucuguggcagcaaugcu

SEQ ID NO: 29591 - RNA, 20 nt, Artificial Sequence
  CIITA targeting sequence
guggcagcaaugcuauucgg

SEQ ID NO: 29592 - RNA, 20 nt, Artificial Sequence
  CIITA targeting sequence
gagagaccuguuaaaggaaa

SEQ ID NO: 29593 - RNA, 20 nt, Artificial Sequence
  CIITA targeting sequence
gaauagcauugcugccacag

SEQ ID NO: 29594 - RNA, 20 nt, Artificial Sequence
  CIITA targeting sequence
ccgaauagcauugcugccac

SEQ ID NO: 29595 - RNA, 20 nt, Artificial Sequence
  CIITA targeting sequence
cuccgaauagcauugcugcc

SEQ ID NO: 29596 - RNA, 20 nt, Artificial Sequence
  CIITA targeting sequence
uuuaacaggucucuccgaau

SEQ ID NO: 29597 - RNA, 20 nt, Artificial Sequence
  CIITA targeting sequence
aaugucaaaacaaguggaaa

SEQ ID NO: 29598 - RNA, 20 nt, Artificial Sequence
  CIITA targeting sequence
aaacaaguggaaaugguugc

SEQ ID NO: 29599 - RNA, 20 nt, Artificial Sequence
  CIITA targeting sequence
acuuguuuugacauuugaau

SEQ ID NO: 29600 - RNA, 20 nt, Artificial Sequence
  CIITA targeting sequence
uuugcaaccauuuccacuug

SEQ ID NO: 29601 - RNA, 20 nt, Artificial Sequence
  CIITA targeting sequence
cauuuucauuuauuuuauuu

SEQ ID NO: 29602 - RNA, 20 nt, Artificial Sequence
  CIITA targeting sequence
uuuauuuuauuuugcagaug

SEQ ID NO: 29603 - RNA, 20 nt, Artificial Sequence
  CIITA targeting sequence
gcaaaauaaaauaaaugaaa

SEQ ID NO: 29604 - RNA, 20 nt, Artificial Sequence
  CIITA targeting sequence
cacagcaacaaaagcaucug

SEQ ID NO: 29605 - RNA, 20 nt, Artificial Sequence
  CIITA targeting sequence
aaaacaaaacaaaacaaaac

SEQ ID NO: 29606 - RNA, 20 nt, Artificial Sequence
  CIITA targeting sequence
caaaaacaaaacaaaacaaa

SEQ ID NO: 29607 - RNA, 20 nt, Artificial Sequence
  CIITA targeting sequence
cauugugucacccaggcugg

SEQ ID NO: 29608 - RNA, 20 nt, Artificial Sequence
  CIITA targeting sequence
uugugucacccaggcuggag

SEQ ID NO: 29609 - RNA, 20 nt, Artificial Sequence
  CIITA targeting sequence
cccaggcuggagugcagugg

SEQ ID NO: 29610 - RNA, 20 nt, Artificial Sequence
  CIITA targeting sequence
agccugggugacacaaugag

SEQ ID NO: 29611 - RNA, 20 nt, Artificial Sequence
  CIITA targeting sequence
cgccacugcacuccagccug

SEQ ID NO: 29612 - RNA, 20 nt, Artificial Sequence
  CIITA targeting sequence
uggcucacuggaaccuccgc

SEQ ID NO: 29613 - RNA, 20 nt, Artificial Sequence
  CIITA targeting sequence
cuggaaccuccgccuccugg

SEQ ID NO: 29614 - RNA, 20 nt, Artificial Sequence
  CIITA targeting sequence
agugagccaagaucacgcca

SEQ ID NO: 29615 - RNA, 20 nt, Artificial Sequence
  CIITA targeting sequence
gccuccuggguucaagugau

SEQ ID NO: 29616 - RNA, 20 nt, Artificial Sequence
  CIITA targeting sequence
uggguucaagugauucuccu

SEQ ID NO: 29617 - RNA, 20 nt, Artificial Sequence
  CIITA targeting sequence
agugauucuccugccucagc

SEQ ID NO: 29618 - RNA, 20 nt, Artificial Sequence
  CIITA targeting sequence
cuugaacccaggaggcggag

SEQ ID NO: 29619 - RNA, 20 nt, Artificial Sequence
  CIITA targeting sequence
ccugccucagccucccgagu

SEQ ID NO: 29620 - RNA, 20 nt, Artificial Sequence
  CIITA targeting sequence
ugccucagccucccgaguag

SEQ ID NO: 29621 - RNA, 20 nt, Artificial Sequence
  CIITA targeting sequence
gccucccgaguagcugggaa

SEQ ID NO: 29622 - RNA, 20 nt, Artificial Sequence
  CIITA targeting sequence
cgaguagcugggaauacagg

SEQ ID NO: 29623 - RNA, 20 nt, Artificial Sequence
  CIITA targeting sequence
ggaggcugaggcaggagaau

SEQ ID NO: 29624 - RNA, 20 nt, Artificial Sequence
  CIITA targeting sequence
cagcuacucgggaggcugag

SEQ ID NO: 29625 - RNA, 20 nt, Artificial Sequence
  CIITA targeting sequence
acuaaaaauacaaaaauuag

SEQ ID NO: 29626 - RNA, 20 nt, Artificial Sequence
  CIITA targeting sequence
cuacuaaaaauacaaaaauu

SEQ ID NO: 29627 - RNA, 20 nt, Artificial Sequence
  CIITA targeting sequence
ccauguugcccaggcuaguc

SEQ ID NO: 29628 - RNA, 20 nt, Artificial Sequence
  CIITA targeting sequence
caaacuccuaaccucaagug

SEQ ID NO: 29629 - RNA, 20 nt, Artificial Sequence
  CIITA targeting sequence
aacuccuaaccucaagugau

SEQ ID NO: 29630 - RNA, 20 nt, Artificial Sequence
  CIITA targeting sequence
uaaccucaagugauccaccc

SEQ ID NO: 29631 - RNA, 20 nt, Artificial Sequence
  CIITA targeting sequence
agugauccacccaccuccgc

SEQ ID NO: 29632 - RNA, 20 nt, Artificial Sequence
  CIITA targeting sequence
cuugagguuaggaguuugag

SEQ ID NO: 29633 - RNA, 20 nt, Artificial Sequence
  CIITA targeting sequence
acccaccuccgccucccaaa

SEQ ID NO: 29634 - RNA, 20 nt, Artificial Sequence
  CIITA targeting sequence
gccucccaaagugcugggau

SEQ ID NO: 29635 - RNA, 20 nt, Artificial Sequence
  CIITA targeting sequence
caaagugcugggauugcagg

SEQ ID NO: 29636 - RNA, 20 nt, Artificial Sequence
  CIITA targeting sequence
cagcacuuugggaggcggag

SEQ ID NO: 29637 - RNA, 20 nt, Artificial Sequence
  CIITA targeting sequence
cgccugcaaucccagcacuu

SEQ ID NO: 29638 - RNA, 20 nt, Artificial Sequence
  CIITA targeting sequence
auuuuggagacacuuuugcc

SEQ ID NO: 29639 - RNA, 20 nt, Artificial Sequence
  CIITA targeting sequence
aaaauagaccgggcguggug

SEQ ID NO: 29640 - RNA, 20 nt, Artificial Sequence
  CIITA targeting sequence
ccaaaauagaccgggcgugg

SEQ ID NO: 29641 - RNA, 20 nt, Artificial Sequence
  CIITA targeting sequence
ccagagcaccuuggcaaugg

SEQ ID NO: 29642 - RNA, 20 nt, Artificial Sequence
  CIITA targeting sequence
ggugaaacauggguguggca

SEQ ID NO: 29643 - RNA, 20 nt, Artificial Sequence
  CIITA targeting sequence
ugccuuacacaaaagccacc

SEQ ID NO: 29644 - RNA, 20 nt, Artificial Sequence
  CIITA targeting sequence
gauaugcacaaaacuccaaa

SEQ ID NO: 29645 - RNA, 20 nt, Artificial Sequence
  CIITA targeting sequence
gauuccugccuuacacaaaa

SEQ ID NO: 29646 - RNA, 20 nt, Artificial Sequence
  CIITA targeting sequence
aaaggaacccacagaaacuu

SEQ ID NO: 29647 - RNA, 20 nt, Artificial Sequence
  CIITA targeting sequence
uuuggaguuuugugcauauc

SEQ ID NO: 29648 - RNA, 20 nt, Artificial Sequence
  CIITA targeting sequence
guggguuccuuuggaguuuu

SEQ ID NO: 29649 - RNA, 20 nt, Artificial Sequence
  CIITA targeting sequence
acacccauuauccccgcucu

SEQ ID NO: 29650 - RNA, 20 nt, Artificial Sequence
  CIITA targeting sequence
ccgcucugguuaguucagcu

SEQ ID NO: 29651 - RNA, 20 nt, Artificial Sequence
  CIITA targeting sequence
gguuaguucagcucgucaug

SEQ ID NO: 29652 - RNA, 20 nt, Artificial Sequence
  CIITA targeting sequence
gcucgucauggagaauaccu

SEQ ID NO: 29653 - RNA, 20 nt, Artificial Sequence
  CIITA targeting sequence
ucauggagaauaccuuccug

SEQ ID NO: 29654 - RNA, 20 nt, Artificial Sequence
  CIITA targeting sequence
uggagaauaccuuccuggcu

SEQ ID NO: 29655 - RNA, 20 nt, Artificial Sequence
  CIITA targeting sequence
augacgagcugaacuaacca

SEQ ID NO: 29656 - RNA, 20 nt, Artificial Sequence
  CIITA targeting sequence
ccaugacgagcugaacuaac

SEQ ID NO: 29657 - RNA, 20 nt, Artificial Sequence
  CIITA targeting sequence
uggcuucaaagauccagugg

SEQ ID NO: 29658 - RNA, 20 nt, Artificial Sequence
  CIITA targeting sequence
aagauccaguggcucuuccc

SEQ ID NO: 29659 - RNA, 20 nt, Artificial Sequence
  CIITA targeting sequence
uugaagccaggaagguauuc

SEQ ID NO: 29660 - RNA, 20 nt, Artificial Sequence
  CIITA targeting sequence
aguggcucuucccaucuuca

SEQ ID NO: 29661 - RNA, 20 nt, Artificial Sequence
  CIITA targeting sequence
ucccaucuucaucuaucugg

SEQ ID NO: 29662 - RNA, 20 nt, Artificial Sequence
  CIITA targeting sequence
caucuucaucuaucugguuc

SEQ ID NO: 29663 - RNA, 20 nt, Artificial Sequence
  CIITA targeting sequence
ucaucuaucugguuccacca

SEQ ID NO: 29664 - RNA, 20 nt, Artificial Sequence
  CIITA targeting sequence
ucuaucugguuccaccaucg

SEQ ID NO: 29665 - RNA, 20 nt, Artificial Sequence
  CIITA targeting sequence
aucugguuccaccaucgaag

SEQ ID NO: 29666 - RNA, 20 nt, Artificial Sequence
  CIITA targeting sequence
gguuccaccaucgaaggccc

SEQ ID NO: 29667 - RNA, 20 nt, Artificial Sequence
  CIITA targeting sequence
accaucgaaggcccaccagg

SEQ ID NO: 29668 - RNA, 20 nt, Artificial Sequence
  CIITA targeting sequence
aaggcccaccaggagucuuc

SEQ ID NO: 29669 - RNA, 20 nt, Artificial Sequence
  CIITA targeting sequence
augguggaaccagauagaug

SEQ ID NO: 29670 - RNA, 20 nt, Artificial Sequence
  CIITA targeting sequence
uggugggccuucgauggugg

SEQ ID NO: 29671 - RNA, 20 nt, Artificial Sequence
  CIITA targeting sequence
uccgguuacauucugagaac

SEQ ID NO: 29672 - RNA, 20 nt, Artificial Sequence
  CIITA targeting sequence
gguuacauucugagaacaau

SEQ ID NO: 29673 - RNA, 20 nt, Artificial Sequence
  CIITA targeting sequence
gagaacaauagacaaaggac

SEQ ID NO: 29674 - RNA, 20 nt, Artificial Sequence
  CIITA targeting sequence
gaauguaaccggaagacucc

SEQ ID NO: 29675 - RNA, 20 nt, Artificial Sequence
  CIITA targeting sequence
cagaauguaaccggaagacu

SEQ ID NO: 29676 - RNA, 20 nt, Artificial Sequence
  CIITA targeting sequence
auuguucucagaauguaacc

SEQ ID NO: 29677 - RNA, 20 nt, Artificial Sequence
  CIITA targeting sequence
uuugucuauuguucucagaa

SEQ ID NO: 29678 - RNA, 20 nt, Artificial Sequence
  CIITA targeting sequence
gagcaggucacaggcaaaga

SEQ ID NO: 29679 - RNA, 20 nt, Artificial Sequence
  CIITA targeting sequence
gaguccuuugucuauuguuc

SEQ ID NO: 29680 - RNA, 20 nt, Artificial Sequence
  CIITA targeting sequence
caggcaaagaggcuuauuca

SEQ ID NO: 29681 - RNA, 20 nt, Artificial Sequence
  CIITA targeting sequence
uugccugugaccugcucaga

SEQ ID NO: 29682 - RNA, 20 nt, Artificial Sequence
  CIITA targeting sequence
cuguauugauaaacaaaagu

SEQ ID NO: 29683 - RNA, 20 nt, Artificial Sequence
  CIITA targeting sequence
auacagugaauaagccucuu

SEQ ID NO: 29684 - RNA, 20 nt, Artificial Sequence
  CIITA targeting sequence
uugauucauuucagacuugu

SEQ ID NO: 29685 - RNA, 20 nt, Artificial Sequence
  CIITA targeting sequence
aggaacuuuuguuuaucaau

SEQ ID NO: 29686 - RNA, 20 nt, Artificial Sequence
  CIITA targeting sequence
uuucagacuuguacugggag

SEQ ID NO: 29687 - RNA, 20 nt, Artificial Sequence
  CIITA targeting sequence
gacuuguacugggagcagga

SEQ ID NO: 29688 - RNA, 20 nt, Artificial Sequence
  CIITA targeting sequence
gaaaugaaucaaggaacuuu

SEQ ID NO: 29689 - RNA, 20 nt, Artificial Sequence
  CIITA targeting sequence
cacuuggcucucauucucuc

SEQ ID NO: 29690 - RNA, 20 nt, Artificial Sequence
  CIITA targeting sequence
cuuggcucucauucucucuc

SEQ ID NO: 29691 - RNA, 20 nt, Artificial Sequence
  CIITA targeting sequence
cauucucucucuuuuuuuuu

SEQ ID NO: 29692 - RNA, 20 nt, Artificial Sequence
  CIITA targeting sequence
uucucucucuuuuuuuuuuu

SEQ ID NO: 29693 - RNA, 20 nt, Artificial Sequence
  CIITA targeting sequence
cucucuuuuuuuuuuuuuuu

SEQ ID NO: 29694 - RNA, 20 nt, Artificial Sequence
  CIITA targeting sequence
cucuuuuuuuuuuuuuuuuu

SEQ ID NO: 29695 - RNA, 20 nt, Artificial Sequence
  CIITA targeting sequence
cuuuuuuuuuuuuuuuuuuu

SEQ ID NO: 29696 - RNA, 20 nt, Artificial Sequence
  CIITA targeting sequence
uuuuuuuuuuuuuuuuuucc

SEQ ID NO: 29697 - RNA, 20 nt, Artificial Sequence
  CIITA targeting sequence
gagacagaguuugacucuug

SEQ ID NO: 29698 - RNA, 20 nt, Artificial Sequence
  CIITA targeting sequence
gaaaaaaaaaaaaaaaaaaa

SEQ ID NO: 29699 - RNA, 20 nt, Artificial Sequence
  CIITA targeting sequence
cggaaaaaaaaaaaaaaaaa

SEQ ID NO: 29700 - RNA, 20 nt, Artificial Sequence
  CIITA targeting sequence
gucucggaaaaaaaaaaaaa

SEQ ID NO: 29701 - RNA, 20 nt, Artificial Sequence
  CIITA targeting sequence
aacucugucucggaaaaaaa

SEQ ID NO: 29702 - RNA, 20 nt, Artificial Sequence
  CIITA targeting sequence
ugucacccaggcuggagugc

SEQ ID NO: 29703 - RNA, 20 nt, Artificial Sequence
  CIITA targeting sequence
cccaggcuggagugcaaugg

SEQ ID NO: 29704 - RNA, 20 nt, Artificial Sequence
  CIITA targeting sequence
cagcuacuugggaggcugag

SEQ ID NO: 29705 - RNA, 20 nt, Artificial Sequence
  CIITA targeting sequence
acuaaaaauacaaaaauuag

SEQ ID NO: 29706 - RNA, 20 nt, Artificial Sequence
  CIITA targeting sequence
cuacuaaaaauacaaaaauu

SEQ ID NO: 29707 - RNA, 20 nt, Artificial Sequence
  CIITA targeting sequence
ccauuccccuuacuuuuaag

SEQ ID NO: 29708 - RNA, 20 nt, Artificial Sequence
  CIITA targeting sequence
auuccccuuacuuuuaagug

SEQ ID NO: 29709 - RNA, 20 nt, Artificial Sequence
  CIITA targeting sequence
ccuuacuuuuaagugacacu

SEQ ID NO: 29710 - RNA, 20 nt, Artificial Sequence
  CIITA targeting sequence
gaagugaugacaucacacga

SEQ ID NO: 29711 - RNA, 20 nt, Artificial Sequence
  CIITA targeting sequence
gaaacacgaggcuugucccc

SEQ ID NO: 29712 - RNA, 20 nt, Artificial Sequence
  CIITA targeting sequence
cuuccgaaacacgaggcuug

SEQ ID NO: 29713 - RNA, 20 nt, Artificial Sequence
  CIITA targeting sequence
ucacuuccgaaacacgaggc

SEQ ID NO: 29714 - RNA, 20 nt, Artificial Sequence
  CIITA targeting sequence
cacgaaagggccucaccuuc

SEQ ID NO: 29715 - RNA, 20 nt, Artificial Sequence
  CIITA targeting sequence
ugugaugucaucacuuccga

SEQ ID NO: 29716 - RNA, 20 nt, Artificial Sequence
  CIITA targeting sequence
ccuucacagaccagaagucc

SEQ ID NO: 29717 - RNA, 20 nt, Artificial Sequence
  CIITA targeting sequence
cagaccagaaguccagggac

SEQ ID NO: 29718 - RNA, 20 nt, Artificial Sequence
  CIITA targeting sequence
gugaaggugaggcccuuucg

SEQ ID NO: 29719 - RNA, 20 nt, Artificial Sequence
  CIITA targeting sequence
ggucugugaaggugaggccc

SEQ ID NO: 29720 - RNA, 20 nt, Artificial Sequence
  CIITA targeting sequence
agggacaggaggagcagcac

SEQ ID NO: 29721 - RNA, 20 nt, Artificial Sequence
  CIITA targeting sequence
cuggacuucuggucugugaa

SEQ ID NO: 29722 - RNA, 20 nt, Artificial Sequence
  CIITA targeting sequence
ugucccuggacuucuggucu

SEQ ID NO: 29723 - RNA, 20 nt, Artificial Sequence
  CIITA targeting sequence
uccugucccuggacuucugg

SEQ ID NO: 29724 - RNA, 20 nt, Artificial Sequence
  CIITA targeting sequence
uggugcugcuccuccugucc

SEQ ID NO: 29725 - RNA, 20 nt, Artificial Sequence
  CIITA targeting sequence
ugcugaaccagucgcagcuc

SEQ ID NO: 29726 - RNA, 20 nt, Artificial Sequence
  CIITA targeting sequence
gcaagagcuuugugggcugu

SEQ ID NO: 29727 - RNA, 20 nt, Artificial Sequence
  CIITA targeting sequence
cagcucacguaggugacgau

SEQ ID NO: 29728 - RNA, 20 nt, Artificial Sequence
  CIITA targeting sequence
cguaggugacgauggcacuc

SEQ ID NO: 29729 - RNA, 20 nt, Artificial Sequence
  CIITA targeting sequence
ccuacgugagcugcgacugg

SEQ ID NO: 29730 - RNA, 20 nt, Artificial Sequence
  CIITA targeting sequence
ucaccuacgugagcugcgac

SEQ ID NO: 29731 - RNA, 20 nt, Artificial Sequence
  CIITA targeting sequence
cucggaaaaacagguggaaa

SEQ ID NO: 29732 - RNA, 20 nt, Artificial Sequence
  CIITA targeting sequence
gaaaaacagguggaaaaagg

SEQ ID NO: 29733 - RNA, 20 nt, Artificial Sequence
  CIITA targeting sequence
gagugagugccaucgucacc

SEQ ID NO: 29734 - RNA, 20 nt, Artificial Sequence
  CIITA targeting sequence
accuguuuuuccgagugagu

SEQ ID NO: 29735 - RNA, 20 nt, Artificial Sequence
  CIITA targeting sequence
aggaaaggacccagaaggcg

SEQ ID NO: 29736 - RNA, 20 nt, Artificial Sequence
  CIITA targeting sequence
uagacaccccuuggccaccu

SEQ ID NO: 29737 - RNA, 20 nt, Artificial Sequence
  CIITA targeting sequence
uuuccuagacaccccuuggc

SEQ ID NO: 29738 - RNA, 20 nt, Artificial Sequence
  CIITA targeting sequence
ggguccuuuccuagacaccc

SEQ ID NO: 29739 - RNA, 20 nt, Artificial Sequence
  CIITA targeting sequence
cuccaagagcuaagcggaug

SEQ ID NO: 29740 - RNA, 20 nt, Artificial Sequence
  CIITA targeting sequence
aagagcuaagcggaugguca

SEQ ID NO: 29741 - RNA, 20 nt, Artificial Sequence
  CIITA targeting sequence
uggagugagggcgccuucug

SEQ ID NO: 29742 - RNA, 20 nt, Artificial Sequence
  CIITA targeting sequence
auugagccacgcuaacaccc

SEQ ID NO: 29743 - RNA, 20 nt, Artificial Sequence
  CIITA targeting sequence
ccccggugcauaugacgcag

SEQ ID NO: 29744 - RNA, 20 nt, Artificial Sequence
  CIITA targeting sequence
ccggugcauaugacgcagaa

SEQ ID NO: 29745 - RNA, 20 nt, Artificial Sequence
  CIITA targeting sequence
uaugcaccggggagaacauu

SEQ ID NO: 29746 - RNA, 20 nt, Artificial Sequence
  CIITA targeting sequence
gcgucauaugcaccggggag

SEQ ID NO: 29747 - RNA, 20 nt, Artificial Sequence
  CIITA targeting sequence
ggcuguagcccuggggacac

SEQ ID NO: 29748 - RNA, 20 nt, Artificial Sequence
  CIITA targeting sequence
ccagggcuacagccugaguu

SEQ ID NO: 29749 - RNA, 20 nt, Artificial Sequence
  CIITA targeting sequence
uuaggucagcaguccccaga

SEQ ID NO: 29750 - RNA, 20 nt, Artificial Sequence
  CIITA targeting sequence
gcaguccccagacagucaug

SEQ ID NO: 29751 - RNA, 20 nt, Artificial Sequence
  CIITA targeting sequence
ugcugacacuguuuuuuuuc

SEQ ID NO: 29752 - RNA, 20 nt, Artificial Sequence
  CIITA targeting sequence
gcaugacugucuggggacug

SEQ ID NO: 29753 - RNA, 20 nt, Artificial Sequence
  CIITA targeting sequence
uccccuucgaagaauccagu

SEQ ID NO: 29754 - RNA, 20 nt, Artificial Sequence
  CIITA targeting sequence
ccuucgaagaauccaguacu

SEQ ID NO: 29755 - RNA, 20 nt, Artificial Sequence
  CIITA targeting sequence
aagaauccaguacuuucccg

SEQ ID NO: 29756 - RNA, 20 nt, Artificial Sequence
  CIITA targeting sequence
aaggggaggaaaaaaaacag

SEQ ID NO: 29757 - RNA, 20 nt, Artificial Sequence
  CIITA targeting sequence
ucgaaggggaggaaaaaaaa

SEQ ID NO: 29758 - RNA, 20 nt, Artificial Sequence
  CIITA targeting sequence
aguacuuucccgccacuuga

SEQ ID NO: 29759 - RNA, 20 nt, Artificial Sequence
  CIITA targeting sequence
cgccacuugacuccaaauau

SEQ ID NO: 29760 - RNA, 20 nt, Artificial Sequence
  CIITA targeting sequence
aguggcgggaaaguacugga

SEQ ID NO: 29761 - RNA, 20 nt, Artificial Sequence
  CIITA targeting sequence
aaauaucacuugcccucuuc

SEQ ID NO: 29762 - RNA, 20 nt, Artificial Sequence
  CIITA targeting sequence
cuugcccucuucgaaacacg

SEQ ID NO: 29763 - RNA, 20 nt, Artificial Sequence
  CIITA targeting sequence
ucgaaacacggucaucuuug

SEQ ID NO: 29764 - RNA, 20 nt, Artificial Sequence
  CIITA targeting sequence
aaacacggucaucuuugaag

SEQ ID NO: 29765 - RNA, 20 nt, Artificial Sequence
  CIITA targeting sequence
aagagggcaagugauauuug

SEQ ID NO: 29766 - RNA, 20 nt, Artificial Sequence
  CIITA targeting sequence
ucuuugaagugaaacgugac

SEQ ID NO: 29767 - RNA, 20 nt, Artificial Sequence
  CIITA targeting sequence
uugaagugaaacgugacagc

SEQ ID NO: 29768 - RNA, 20 nt, Artificial Sequence
  CIITA targeting sequence
aagaugaccguguuucgaag

SEQ ID NO: 29769 - RNA, 20 nt, Artificial Sequence
  CIITA targeting sequence
cuucaaagaugaccguguuu

SEQ ID NO: 29770 - RNA, 20 nt, Artificial Sequence
  CIITA targeting sequence
cguuucacuucaaagaugac

SEQ ID NO: 29771 - RNA, 20 nt, Artificial Sequence
  CIITA targeting sequence
cugccuucccgccuagcaga

SEQ ID NO: 29772 - RNA, 20 nt, Artificial Sequence
  CIITA targeting sequence
cgccuagcagagaugacggc

SEQ ID NO: 29773 - RNA, 20 nt, Artificial Sequence
  CIITA targeting sequence
gcuaggcgggaaggcaguga

SEQ ID NO: 29774 - RNA, 20 nt, Artificial Sequence
  CIITA targeting sequence
cugcuaggcgggaaggcagu

SEQ ID NO: 29775 - RNA, 20 nt, Artificial Sequence
  CIITA targeting sequence
ucucugcuaggcgggaaggc

SEQ ID NO: 29776 - RNA, 20 nt, Artificial Sequence
  CIITA targeting sequence
cuaaagguaaagguuggguu

SEQ ID NO: 29777 - RNA, 20 nt, Artificial Sequence
  CIITA targeting sequence
accaccagucacugagcucc

SEQ ID NO: 29778 - RNA, 20 nt, Artificial Sequence
  CIITA targeting sequence
cugagcuccaagcucacacg

SEQ ID NO: 29779 - RNA, 20 nt, Artificial Sequence
  CIITA targeting sequence
gugacuggugguggaaaaac

SEQ ID NO: 29780 - RNA, 20 nt, Artificial Sequence
  CIITA targeting sequence
aagcucacacgcagcccacg

SEQ ID NO: 29781 - RNA, 20 nt, Artificial Sequence
  CIITA targeting sequence
cacgcagcccacggggcagg

SEQ ID NO: 29782 - RNA, 20 nt, Artificial Sequence
  CIITA targeting sequence
ggaguucaagaccagccugg

SEQ ID NO: 29783 - RNA, 20 nt, Artificial Sequence
  CIITA targeting sequence
ugaccucaggugauccgccc

SEQ ID NO: 29784 - RNA, 20 nt, Artificial Sequence
  CIITA targeting sequence
agaccagccuggccaacaug

SEQ ID NO: 29785 - RNA, 20 nt, Artificial Sequence
  CIITA targeting sequence
ugaacuccugaccucaggug

SEQ ID NO: 29786 - RNA, 20 nt, Artificial Sequence
  CIITA targeting sequence
ccauguuggccaggcugguc

SEQ ID NO: 29787 - RNA, 20 nt, Artificial Sequence
  CIITA targeting sequence
acucaaaauacaaaaauuag

SEQ ID NO: 29788 - RNA, 20 nt, Artificial Sequence
  CIITA targeting sequence
aaauacaaaaauuagcuggg

SEQ ID NO: 29789 - RNA, 20 nt, Artificial Sequence
  CIITA targeting sequence
gaaggcugaggcaggagaau

SEQ ID NO: 29790 - RNA, 20 nt, Artificial Sequence
  CIITA targeting sequence
gaguagcugggguuacaggc

SEQ ID NO: 29791 - RNA, 20 nt, Artificial Sequence
  CIITA targeting sequence
gccuuccgaguagcuggggu

SEQ ID NO: 29792 - RNA, 20 nt, Artificial Sequence
  CIITA targeting sequence
ugccucagccuuccgaguag

SEQ ID NO: 29793 - RNA, 20 nt, Artificial Sequence
  CIITA targeting sequence
ccugccucagccuuccgagu

SEQ ID NO: 29794 - RNA, 20 nt, Artificial Sequence
  CIITA targeting sequence
cuagaaccugggaggcggag

SEQ ID NO: 29795 - RNA, 20 nt, Artificial Sequence
  CIITA targeting sequence
agugauucuccugccucagc

SEQ ID NO: 29796 - RNA, 20 nt, Artificial Sequence
  CIITA targeting sequence
cagguucuagugauucuccu

SEQ ID NO: 29797 - RNA, 20 nt, Artificial Sequence
  CIITA targeting sequence
gccucccagguucuagugau

SEQ ID NO: 29798 - RNA, 20 nt, Artificial Sequence
  CIITA targeting sequence
cugcaaccuccgccucccag

SEQ ID NO: 29799 - RNA, 20 nt, Artificial Sequence
  CIITA targeting sequence
uggcucacugcaaccuccgc

SEQ ID NO: 29800 - RNA, 20 nt, Artificial Sequence
  CIITA targeting sequence
cgccacugcacugcagccug

SEQ ID NO: 29801 - RNA, 20 nt, Artificial Sequence
  CIITA targeting sequence
cccaggcugcagugcagugg

SEQ ID NO: 29802 - RNA, 20 nt, Artificial Sequence
  CIITA targeting sequence
cacccaggcugcagugcagu

SEQ ID NO: 29803 - RNA, 20 nt, Artificial Sequence
  CIITA targeting sequence
gacuccaacucaaaaaauaa

SEQ ID NO: 29804 - RNA, 20 nt, Artificial Sequence
  CIITA targeting sequence
gacuuucucacccaggcugc

SEQ ID NO: 29805 - RNA, 20 nt, Artificial Sequence
  CIITA targeting sequence
aacucaaaaaauaaaaaaau

SEQ ID NO: 29806 - RNA, 20 nt, Artificial Sequence
  CIITA targeting sequence
aaaaauaaaaaaauaaaaaa

SEQ ID NO: 29807 - RNA, 20 nt, Artificial Sequence
  CIITA targeting sequence
uguuuuuauuuuuuuauuuu

SEQ ID NO: 29808 - RNA, 20 nt, Artificial Sequence
  CIITA targeting sequence
uuucuuguuuuuauuuuuuu

SEQ ID NO: 29809 - RNA, 20 nt, Artificial Sequence
  CIITA targeting sequence
auacaauuugguaaccuuuc

SEQ ID NO: 29810 - RNA, 20 nt, Artificial Sequence
  CIITA targeting sequence
ccugcucuauacaauuuggu

SEQ ID NO: 29811 - RNA, 20 nt, Artificial Sequence
  CIITA targeting sequence
cccacugccaucaccugcuc

SEQ ID NO: 29812 - RNA, 20 nt, Artificial Sequence
  CIITA targeting sequence
ggcccacaucacccacugcc

SEQ ID NO: 29813 - RNA, 20 nt, Artificial Sequence
  CIITA targeting sequence
gucuggcccacaucacccac

SEQ ID NO: 29814 - RNA, 20 nt, Artificial Sequence
  CIITA targeting sequence
ucagucuggcccacaucacc

SEQ ID NO: 29815 - RNA, 20 nt, Artificial Sequence
  CIITA targeting sequence
guuucuuucugugguuuccc

SEQ ID NO: 29816 - RNA, 20 nt, Artificial Sequence
  CIITA targeting sequence
uucugugguuucccaguuua

SEQ ID NO: 29817 - RNA, 20 nt, Artificial Sequence
  CIITA targeting sequence
gugguuucccaguuuaaaua

SEQ ID NO: 29818 - RNA, 20 nt, Artificial Sequence
  CIITA targeting sequence
caguuuaaauagagcacaca

SEQ ID NO: 29819 - RNA, 20 nt, Artificial Sequence
  CIITA targeting sequence
auuuaaacugggaaaccaca

SEQ ID NO: 29820 - RNA, 20 nt, Artificial Sequence
  CIITA targeting sequence
accugugugcucuauuuaaa

SEQ ID NO: 29821 - RNA, 20 nt, Artificial Sequence
  CIITA targeting sequence
cuaccugugugcucuauuua

SEQ ID NO: 29822 - RNA, 20 nt, Artificial Sequence
  CIITA targeting sequence
uucucuaccugugugcucua

SEQ ID NO: 29823 - RNA, 20 nt, Artificial Sequence
  CIITA targeting sequence
acuaugaucaggaaaucaau

SEQ ID NO: 29824 - RNA, 20 nt, Artificial Sequence
  CIITA targeting sequence
uaguugaguaucguucucua

SEQ ID NO: 29825 - RNA, 20 nt, Artificial Sequence
  CIITA targeting sequence
ggaaaucaauggcacgagcc

SEQ ID NO: 29826 - RNA, 20 nt, Artificial Sequence
  CIITA targeting sequence
ugaucauaguugaguaucgu

SEQ ID NO: 29827 - RNA, 20 nt, Artificial Sequence
  CIITA targeting sequence
auggcacgagcccaguuguu

SEQ ID NO: 29828 - RNA, 20 nt, Artificial Sequence
  CIITA targeting sequence
ugccauugauuuccugauca

SEQ ID NO: 29829 - RNA, 20 nt, Artificial Sequence
  CIITA targeting sequence
gguauaacaacugggcucgu

SEQ ID NO: 29830 - RNA, 20 nt, Artificial Sequence
  CIITA targeting sequence
gauccagaccccaagagagg

SEQ ID NO: 29831 - RNA, 20 nt, Artificial Sequence
  CIITA targeting sequence
gaaacccuuucugguauaac

SEQ ID NO: 29832 - RNA, 20 nt, Artificial Sequence
  CIITA targeting sequence
agaccccaagagaggguucu

SEQ ID NO: 29833 - RNA, 20 nt, Artificial Sequence
  CIITA targeting sequence
ggaucugaaacccuuucugg

SEQ ID NO: 29834 - RNA, 20 nt, Artificial Sequence
  CIITA targeting sequence
uggggucuggaucugaaacc

SEQ ID NO: 29835 - RNA, 20 nt, Artificial Sequence
  CIITA targeting sequence
cuuggggucuggaucugaaa

SEQ ID NO: 29836 - RNA, 20 nt, Artificial Sequence
  CIITA targeting sequence
uggaucucacccaagaaaga

SEQ ID NO: 29837 - RNA, 20 nt, Artificial Sequence
  CIITA targeting sequence
aagaacccucucuugggguc

SEQ ID NO: 29838 - RNA, 20 nt, Artificial Sequence
  CIITA targeting sequence
cacccaagaaagaauucagg

SEQ ID NO: 29839 - RNA, 20 nt, Artificial Sequence
  CIITA targeting sequence
cccaagaaagaauucagggc

SEQ ID NO: 29840 - RNA, 20 nt, Artificial Sequence
  CIITA targeting sequence
ugggugagauccaagaaccc

SEQ ID NO: 29841 - RNA, 20 nt, Artificial Sequence
  CIITA targeting sequence
uucuugggugagauccaaga

SEQ ID NO: 29842 - RNA, 20 nt, Artificial Sequence
  CIITA targeting sequence
gggcaaguccauugaguaaa

SEQ ID NO: 29843 - RNA, 20 nt, Artificial Sequence
  CIITA targeting sequence
auugaguaaagugaaagcaa

SEQ ID NO: 29844 - RNA, 20 nt, Artificial Sequence
  CIITA targeting sequence
auggacuugcccugaauucu

SEQ ID NO: 29845 - RNA, 20 nt, Artificial Sequence
  CIITA targeting sequence
cuuuacucaauggacuugcc

SEQ ID NO: 29846 - RNA, 20 nt, Artificial Sequence
  CIITA targeting sequence
aaauaaacuugcuuucacuu

SEQ ID NO: 29847 - RNA, 20 nt, Artificial Sequence
  CIITA targeting sequence
uuuacuuuccaaauaaacuu

SEQ ID NO: 29848 - RNA, 20 nt, Artificial Sequence
  CIITA targeting sequence
uuauuccuuuacuuuccaaa

SEQ ID NO: 29849 - RNA, 20 nt, Artificial Sequence
  CIITA targeting sequence
auagauagagcaguccuaag

SEQ ID NO: 29850 - RNA, 20 nt, Artificial Sequence
  CIITA targeting sequence
auagacuagccauucuuuau

SEQ ID NO: 29851 - RNA, 20 nt, Artificial Sequence
  CIITA targeting sequence
aucuauagacuagccauucu

SEQ ID NO: 29852 - RNA, 20 nt, Artificial Sequence
  CIITA targeting sequence
uaagggcugcugguugccca

SEQ ID NO: 29853 - RNA, 20 nt, Artificial Sequence
  CIITA targeting sequence
gguuugcacagcugccuggu

SEQ ID NO: 29854 - RNA, 20 nt, Artificial Sequence
  CIITA targeting sequence
ggcaguacugggucugguuu

SEQ ID NO: 29855 - RNA, 20 nt, Artificial Sequence
  CIITA targeting sequence
uggcucuggcaguacugggu

SEQ ID NO: 29856 - RNA, 20 nt, Artificial Sequence
  CIITA targeting sequence
ugagaagucagaaauccaga

SEQ ID NO: 29857 - RNA, 20 nt, Artificial Sequence
  CIITA targeting sequence
ugaaaaucuuggcucuggca

SEQ ID NO: 29858 - RNA, 20 nt, Artificial Sequence
  CIITA targeting sequence
caugaaaaucuuggcucugg

SEQ ID NO: 29859 - RNA, 20 nt, Artificial Sequence
  CIITA targeting sequence
gaaauccagacuugcaaugg

SEQ ID NO: 29860 - RNA, 20 nt, Artificial Sequence
  CIITA targeting sequence
gacuucucaugaaaaucuug

SEQ ID NO: 29861 - RNA, 20 nt, Artificial Sequence
  CIITA targeting sequence
agacuugcaaugggaaaucu

SEQ ID NO: 29862 - RNA, 20 nt, Artificial Sequence
  CIITA targeting sequence
ggauuucugacuucucauga

SEQ ID NO: 29863 - RNA, 20 nt, Artificial Sequence
  CIITA targeting sequence
cauugcaagucuggauuucu

SEQ ID NO: 29864 - RNA, 20 nt, Artificial Sequence
  CIITA targeting sequence
gauuuuaaaugauggccacu

SEQ ID NO: 29865 - RNA, 20 nt, Artificial Sequence
  CIITA targeting sequence
gauuucccauugcaagucug

SEQ ID NO: 29866 - RNA, 20 nt, Artificial Sequence
  CIITA targeting sequence
ugucuaauucuucgagacag

SEQ ID NO: 29867 - RNA, 20 nt, Artificial Sequence
  CIITA targeting sequence
cauagaacuuaaaaacuucc

SEQ ID NO: 29868 - RNA, 20 nt, Artificial Sequence
  CIITA targeting sequence
augugauccugucuaauucu

SEQ ID NO: 29869 - RNA, 20 nt, Artificial Sequence
  CIITA targeting sequence
uggaguguuccagaagauaa

SEQ ID NO: 29870 - RNA, 20 nt, Artificial Sequence
  CIITA targeting sequence
aggaaguuuuuaaguucuau

SEQ ID NO: 29871 - RNA, 20 nt, Artificial Sequence
  CIITA targeting sequence
agaagauaagacucuugggu

SEQ ID NO: 29872 - RNA, 20 nt, Artificial Sequence
  CIITA targeting sequence
ggaacacuccaggaaguuuu

SEQ ID NO: 29873 - RNA, 20 nt, Artificial Sequence
  CIITA targeting sequence
ucuggaacacuccaggaagu

SEQ ID NO: 29874 - RNA, 20 nt, Artificial Sequence
  CIITA targeting sequence
uaucuucuggaacacuccag

SEQ ID NO: 29875 - RNA, 20 nt, Artificial Sequence
  CIITA targeting sequence
ugggugucucuuuuugcugu

SEQ ID NO: 29876 - RNA, 20 nt, Artificial Sequence
  CIITA targeting sequence
cuuuuugcuguaaaccuaau

SEQ ID NO: 29877 - RNA, 20 nt, Artificial Sequence
  CIITA targeting sequence
uuuugcuguaaaccuaauug

SEQ ID NO: 29878 - RNA, 20 nt, Artificial Sequence
  CIITA targeting sequence
guccucuuuguagaacaaua

SEQ ID NO: 29879 - RNA, 20 nt, Artificial Sequence
  CIITA targeting sequence
ucuuuguagaacaauacaaa

SEQ ID NO: 29880 - RNA, 20 nt, Artificial Sequence
  CIITA targeting sequence
uuguagaacaauacaaaugu

SEQ ID NO: 29881 - RNA, 20 nt, Artificial Sequence
  CIITA targeting sequence
acaaagaggacagauguuuc

SEQ ID NO: 29882 - RNA, 20 nt, Artificial Sequence
  CIITA targeting sequence
uuuuuuuuuuuuuuacauuu

SEQ ID NO: 29883 - RNA, 20 nt, Artificial Sequence
  CIITA targeting sequence
aucuuuuuuuuuuuuuuuac

SEQ ID NO: 29884 - RNA, 20 nt, Artificial Sequence
  CIITA targeting sequence
ggcgcgguggcccaugccua

SEQ ID NO: 29885 - RNA, 20 nt, Artificial Sequence
  CIITA targeting sequence
cagcacuuugggaggcugag

SEQ ID NO: 29886 - RNA, 20 nt, Artificial Sequence
  CIITA targeting sequence
caaagugcugggauuauagg

SEQ ID NO: 29887 - RNA, 20 nt, Artificial Sequence
  CIITA targeting sequence
gccucccaaagugcugggau

SEQ ID NO: 29888 - RNA, 20 nt, Artificial Sequence
  CIITA targeting sequence
agccgccucagccucccaaa

SEQ ID NO: 29889 - RNA, 20 nt, Artificial Sequence
  CIITA targeting sequence
cuugaagucaggaguucgag

SEQ ID NO: 29890 - RNA, 20 nt, Artificial Sequence
  CIITA targeting sequence
agugauccagccgccucagc

SEQ ID NO: 29891 - RNA, 20 nt, Artificial Sequence
  CIITA targeting sequence
ggaguucgagaccagccugg

SEQ ID NO: 29892 - RNA, 20 nt, Artificial Sequence
  CIITA targeting sequence
ugacuucaagugauccagcc

SEQ ID NO: 29893 - RNA, 20 nt, Artificial Sequence
  CIITA targeting sequence
agaccagccuggccaacaug

SEQ ID NO: 29894 - RNA, 20 nt, Artificial Sequence
  CIITA targeting sequence
aacuccugacuucaagugau

SEQ ID NO: 29895 - RNA, 20 nt, Artificial Sequence
  CIITA targeting sequence
cacuuugacauuuuuuugag

SEQ ID NO: 29896 - RNA, 20 nt, Artificial Sequence
  CIITA targeting sequence
gcgcacacuuggcucacacu

SEQ ID NO: 29897 - RNA, 20 nt, Artificial Sequence
  CIITA targeting sequence
acauuuuaccaugggucagc

SEQ ID NO: 29898 - RNA, 20 nt, Artificial Sequence
  CIITA targeting sequence
aauaaaucccuugcccaccc

SEQ ID NO: 29899 - RNA, 20 nt, Artificial Sequence
  CIITA targeting sequence
aaugcauuuacuuccacauu

SEQ ID NO: 29900 - RNA, 20 nt, Artificial Sequence
  CIITA targeting sequence
cuugcccacccgcuucuuuc

SEQ ID NO: 29901 - RNA, 20 nt, Artificial Sequence
  CIITA targeting sequence
uucuuuuuucuuuuuggcug

SEQ ID NO: 29902 - RNA, 20 nt, Artificial Sequence
  CIITA targeting sequence
uuuuucuuuuuggcuguggc

SEQ ID NO: 29903 - RNA, 20 nt, Artificial Sequence
  CIITA targeting sequence
uuuuggcuguggcucuccua

SEQ ID NO: 29904 - RNA, 20 nt, Artificial Sequence
  CIITA targeting sequence
ccuaaaauaaaaugcagaaa

SEQ ID NO: 29905 - RNA, 20 nt, Artificial Sequence
  CIITA targeting sequence
uaaaauaaaaugcagaaaaa

SEQ ID NO: 29906 - RNA, 20 nt, Artificial Sequence
  CIITA targeting sequence
gcauuuuauuuuaggagagc

SEQ ID NO: 29907 - RNA, 20 nt, Artificial Sequence
  CIITA targeting sequence
aguuguugauagcuuccacu

SEQ ID NO: 29908 - RNA, 20 nt, Artificial Sequence
  CIITA targeting sequence
acaacuggaaauuuuucugc

SEQ ID NO: 29909 - RNA, 20 nt, Artificial Sequence
  CIITA targeting sequence
acuuagcugggcccugauua

SEQ ID NO: 29910 - RNA, 20 nt, Artificial Sequence
  CIITA targeting sequence
gggcccagcuaaguggaagc

SEQ ID NO: 29911 - RNA, 20 nt, Artificial Sequence
  CIITA targeting sequence
auaacuaauaucugaguccu

SEQ ID NO: 29912 - RNA, 20 nt, Artificial Sequence
  CIITA targeting sequence
gaguccugaagaccuuccuc

SEQ ID NO: 29913 - RNA, 20 nt, Artificial Sequence
  CIITA targeting sequence
gauauuaguuauagauuaaa

SEQ ID NO: 29914 - RNA, 20 nt, Artificial Sequence
  CIITA targeting sequence
ugaagaccuuccucuggagc

SEQ ID NO: 29915 - RNA, 20 nt, Artificial Sequence
  CIITA targeting sequence
ggacucagauauuaguuaua

SEQ ID NO: 29916 - RNA, 20 nt, Artificial Sequence
  CIITA targeting sequence
ucaggacucagauauuaguu

SEQ ID NO: 29917 - RNA, 20 nt, Artificial Sequence
  CIITA targeting sequence
ucuggagccucaguaaauuu

SEQ ID NO: 29918 - RNA, 20 nt, Artificial Sequence
  CIITA targeting sequence
ggagccucaguaaauuuacu

SEQ ID NO: 29919 - RNA, 20 nt, Artificial Sequence
  CIITA targeting sequence
agaggaaggucuucaggacu

SEQ ID NO: 29920 - RNA, 20 nt, Artificial Sequence
  CIITA targeting sequence
guaaauuuacuuaaucuaaa

SEQ ID NO: 29921 - RNA, 20 nt, Artificial Sequence
  CIITA targeting sequence
aaauggguccaggugcuggg

SEQ ID NO: 29922 - RNA, 20 nt, Artificial Sequence
  CIITA targeting sequence
aggugcuggggugauuaccc

SEQ ID NO: 29923 - RNA, 20 nt, Artificial Sequence
  CIITA targeting sequence
ccccagcaccuggacccauu

SEQ ID NO: 29924 - RNA, 20 nt, Artificial Sequence
  CIITA targeting sequence
ugucuccugcuaaaugaugg

SEQ ID NO: 29925 - RNA, 20 nt, Artificial Sequence
  CIITA targeting sequence
ccugcuaaaugauggagguu

SEQ ID NO: 29926 - RNA, 20 nt, Artificial Sequence
  CIITA targeting sequence
ugcuaaaugauggagguuug

SEQ ID NO: 29927 - RNA, 20 nt, Artificial Sequence
  CIITA targeting sequence
uuuagcaggagacaagauaa

SEQ ID NO: 29928 - RNA, 20 nt, Artificial Sequence
  CIITA targeting sequence
uuccugguccuugaaguaug

SEQ ID NO: 29929 - RNA, 20 nt, Artificial Sequence
  CIITA targeting sequence
aggugggcuuuugucacauu

SEQ ID NO: 29930 - RNA, 20 nt, Artificial Sequence
  CIITA targeting sequence
cauuccagccuuuguauaag

SEQ ID NO: 29931 - RNA, 20 nt, Artificial Sequence
  CIITA targeting sequence
agccuuuguauaagggcacu

SEQ ID NO: 29932 - RNA, 20 nt, Artificial Sequence
  CIITA targeting sequence
cucagcuuuuaauauuuaac

SEQ ID NO: 29933 - RNA, 20 nt, Artificial Sequence
  CIITA targeting sequence
cagcuuuuaauauuuaacuu

SEQ ID NO: 29934 - RNA, 20 nt, Artificial Sequence
  CIITA targeting sequence
gcuuuuaauauuuaacuuca

SEQ ID NO: 29935 - RNA, 20 nt, Artificial Sequence
  CIITA targeting sequence
ccacucauucagugcugaga

SEQ ID NO: 29936 - RNA, 20 nt, Artificial Sequence
  CIITA targeting sequence
uucagugcugagacagcugu

SEQ ID NO: 29937 - RNA, 20 nt, Artificial Sequence
  CIITA targeting sequence
gugcugagacagcuguuaug

SEQ ID NO: 29938 - RNA, 20 nt, Artificial Sequence
  CIITA targeting sequence
gcacugaaugaguggugaag

SEQ ID NO: 29939 - RNA, 20 nt, Artificial Sequence
  CIITA targeting sequence
cagcacugaaugagugguga

SEQ ID NO: 29940 - RNA, 20 nt, Artificial Sequence
  CIITA targeting sequence
auaacagcugucucagcacu

SEQ ID NO: 29941 - RNA, 20 nt, Artificial Sequence
  CIITA targeting sequence
accaccaagagccaaacugu

SEQ ID NO: 29942 - RNA, 20 nt, Artificial Sequence
  CIITA targeting sequence
uggugguggaaccguuguuu

SEQ ID NO: 29943 - RNA, 20 nt, Artificial Sequence
  CIITA targeting sequence
caguuuggcucuugguggug

SEQ ID NO: 29944 - RNA, 20 nt, Artificial Sequence
  CIITA targeting sequence
cccucugaccacaacuuucu

SEQ ID NO: 29945 - RNA, 20 nt, Artificial Sequence
  CIITA targeting sequence
gaccacaacuuucucucacu

SEQ ID NO: 29946 - RNA, 20 nt, Artificial Sequence
  CIITA targeting sequence
gagggggaauuucacaguuu

SEQ ID NO: 29947 - RNA, 20 nt, Artificial Sequence
  CIITA targeting sequence
cucacuccugaggggacuac

SEQ ID NO: 29948 - RNA, 20 nt, Artificial Sequence
  CIITA targeting sequence
cacuccugaggggacuaccu

SEQ ID NO: 29949 - RNA, 20 nt, Artificial Sequence
  CIITA targeting sequence
cuccugaggggacuaccuuu

SEQ ID NO: 29950 - RNA, 20 nt, Artificial Sequence
  CIITA targeting sequence
ugaggggacuaccuuuuguc

SEQ ID NO: 29951 - RNA, 20 nt, Artificial Sequence
  CIITA targeting sequence
ggagugagagaaaguugugg

SEQ ID NO: 29952 - RNA, 20 nt, Artificial Sequence
  CIITA targeting sequence
ccucaggagugagagaaagu

SEQ ID NO: 29953 - RNA, 20 nt, Artificial Sequence
  CIITA targeting sequence
uugcagggaucucccaagac

SEQ ID NO: 29954 - RNA, 20 nt, Artificial Sequence
  CIITA targeting sequence
cugcaaagacaaaagguagu

SEQ ID NO: 29955 - RNA, 20 nt, Artificial Sequence
  CIITA targeting sequence
cccaagacuccugggccccu

SEQ ID NO: 29956 - RNA, 20 nt, Artificial Sequence
  CIITA targeting sequence
caagacuccugggccccuca

SEQ ID NO: 29957 - RNA, 20 nt, Artificial Sequence
  CIITA targeting sequence
ugggagaucccugcaaagac

SEQ ID NO: 29958 - RNA, 20 nt, Artificial Sequence
  CIITA targeting sequence
ugggccccucacauuccccc

SEQ ID NO: 29959 - RNA, 20 nt, Artificial Sequence
  CIITA targeting sequence
cauucccccagaugaaccuu

SEQ ID NO: 29960 - RNA, 20 nt, Artificial Sequence
  CIITA targeting sequence
cccagaugaaccuucaucau

SEQ ID NO: 29961 - RNA, 20 nt, Artificial Sequence
  CIITA targeting sequence
gggggaaugugaggggccca

SEQ ID NO: 29962 - RNA, 20 nt, Artificial Sequence
  CIITA targeting sequence
ucugggggaaugugaggggc

SEQ ID NO: 29963 - RNA, 20 nt, Artificial Sequence
  CIITA targeting sequence
ucagcacacagcacaagcac

SEQ ID NO: 29964 - RNA, 20 nt, Artificial Sequence
  CIITA targeting sequence
gcacacagcacaagcacuau

SEQ ID NO: 29965 - RNA, 20 nt, Artificial Sequence
  CIITA targeting sequence
cagaaaauccccagcaagcc

SEQ ID NO: 29966 - RNA, 20 nt, Artificial Sequence
  CIITA targeting sequence
gggauagugcuugugcugug

SEQ ID NO: 29967 - RNA, 20 nt, Artificial Sequence
  CIITA targeting sequence
ccagcaagccuuuguuuccu

SEQ ID NO: 29968 - RNA, 20 nt, Artificial Sequence
  CIITA targeting sequence
uggcagucagcuccucucuu

SEQ ID NO: 29969 - RNA, 20 nt, Artificial Sequence
  CIITA targeting sequence
gcuccucucuugcuggccug

SEQ ID NO: 29970 - RNA, 20 nt, Artificial Sequence
  CIITA targeting sequence
ucucuugcuggccugccccu

SEQ ID NO: 29971 - RNA, 20 nt, Artificial Sequence
  CIITA targeting sequence
cuugcuggccugccccuugc

SEQ ID NO: 29972 - RNA, 20 nt, Artificial Sequence
  CIITA targeting sequence
ugcuggccugccccuugcuc

SEQ ID NO: 29973 - RNA, 20 nt, Artificial Sequence
  CIITA targeting sequence
uuugaaauguacuuccacac

SEQ ID NO: 29974 - RNA, 20 nt, Artificial Sequence
  CIITA targeting sequence
aaggagcaaggggcaggcca

SEQ ID NO: 29975 - RNA, 20 nt, Artificial Sequence
  CIITA targeting sequence
acacuugccugucuuuaccu

SEQ ID NO: 29976 - RNA, 20 nt, Artificial Sequence
  CIITA targeting sequence
agaguaaacccugauauaaa

SEQ ID NO: 29977 - RNA, 20 nt, Artificial Sequence
  CIITA targeting sequence
ugauguuguacauuuuauga

SEQ ID NO: 29978 - RNA, 20 nt, Artificial Sequence
  CIITA targeting sequence
ggguuuacucuugauguugu

SEQ ID NO: 29979 - RNA, 20 nt, Artificial Sequence
  CIITA targeting sequence
auaguuuauaucaggguuua

SEQ ID NO: 29980 - RNA, 20 nt, Artificial Sequence
  CIITA targeting sequence
ucaaguguaacacauauacc

SEQ ID NO: 29981 - RNA, 20 nt, Artificial Sequence
  CIITA targeting sequence
aguguaacacauauaccaca

SEQ ID NO: 29982 - RNA, 20 nt, Artificial Sequence
  CIITA targeting sequence
cugucccacaacuucuaaag

SEQ ID NO: 29983 - RNA, 20 nt, Artificial Sequence
  CIITA targeting sequence
cacaacuucuaaagcagguc

SEQ ID NO: 29984 - RNA, 20 nt, Artificial Sequence
  CIITA targeting sequence
aaagcaggucugauuugggg

SEQ ID NO: 29985 - RNA, 20 nt, Artificial Sequence
  CIITA targeting sequence
gauuuggggguguaaacccu

SEQ ID NO: 29986 - RNA, 20 nt, Artificial Sequence
  CIITA targeting sequence
gaccugcuuuagaaguugug

SEQ ID NO: 29987 - RNA, 20 nt, Artificial Sequence
  CIITA targeting sequence
ggguuuacacccccaaauca

SEQ ID NO: 29988 - RNA, 20 nt, Artificial Sequence
  CIITA targeting sequence
gagacaggucucaguuauuu

SEQ ID NO: 29989 - RNA, 20 nt, Artificial Sequence
  CIITA targeting sequence
gauauucaggguuuacaccc

SEQ ID NO: 29990 - RNA, 20 nt, Artificial Sequence
  CIITA targeting sequence
cagauauucaggguuuacac

SEQ ID NO: 29991 - RNA, 20 nt, Artificial Sequence
  CIITA targeting sequence
caguuauuuuagaaaguuau

SEQ ID NO: 29992 - RNA, 20 nt, Artificial Sequence
  CIITA targeting sequence
guuauuuuagaaaguuauuu

SEQ ID NO: 29993 - RNA, 20 nt, Artificial Sequence
  CIITA targeting sequence
aaaauaacugagaccugucu

SEQ ID NO: 29994 - RNA, 20 nt, Artificial Sequence
  CIITA targeting sequence
caagguugagaacacacuca

SEQ ID NO: 29995 - RNA, 20 nt, Artificial Sequence
  CIITA targeting sequence
accuugggaaaauaacuuuc

SEQ ID NO: 29996 - RNA, 20 nt, Artificial Sequence
  CIITA targeting sequence
caaccuugggaaaauaacuu

SEQ ID NO: 29997 - RNA, 20 nt, Artificial Sequence
  CIITA targeting sequence
ggagauccugacaacaugug

SEQ ID NO: 29998 - RNA, 20 nt, Artificial Sequence
  CIITA targeting sequence
ugaguguguucucaaccuug

SEQ ID NO: 29999 - RNA, 20 nt, Artificial Sequence
  CIITA targeting sequence
ccugaguguguucucaaccu

SEQ ID NO: 30000 - RNA, 20 nt, Artificial Sequence
  CIITA targeting sequence
ugacaacauguguccaaggu

SEQ ID NO: 30001 - RNA, 20 nt, Artificial Sequence
  CIITA targeting sequence
ggaucuccugaguguguucu

SEQ ID NO: 30002 - RNA, 20 nt, Artificial Sequence
  CIITA targeting sequence
cugaaauguacaaaaccaag

SEQ ID NO: 30003 - RNA, 20 nt, Artificial Sequence
  CIITA targeting sequence
cccugaaauguacaaaacca

SEQ ID NO: 30004 - RNA, 20 nt, Artificial Sequence
  CIITA targeting sequence
ugucucccugaaauguacaa

SEQ ID NO: 30005 - RNA, 20 nt, Artificial Sequence
  CIITA targeting sequence
ccugucucccugaaauguac

SEQ ID NO: 30006 - RNA, 20 nt, Artificial Sequence
  CIITA targeting sequence
acuuauguaagaugaacauu

SEQ ID NO: 30007 - RNA, 20 nt, Artificial Sequence
  CIITA targeting sequence
uacauaaguugauuguuguc

SEQ ID NO: 30008 - RNA, 20 nt, Artificial Sequence
  CIITA targeting sequence
ucuuacauaaguugauuguu

SEQ ID NO: 30009 - RNA, 20 nt, Artificial Sequence
  CIITA targeting sequence
ggaaaggcggaacaccuuuc

SEQ ID NO: 30010 - RNA, 20 nt, Artificial Sequence
  CIITA targeting sequence
agacccaaccaauguucauc

SEQ ID NO: 30011 - RNA, 20 nt, Artificial Sequence
  CIITA targeting sequence
gccuuuccagacccaaccaa

SEQ ID NO: 30012 - RNA, 20 nt, Artificial Sequence
  CIITA targeting sequence
aggcaucugcuucucagauc

SEQ ID NO: 30013 - RNA, 20 nt, Artificial Sequence
  CIITA targeting sequence
gcuucucagaucuaugugau

SEQ ID NO: 30014 - RNA, 20 nt, Artificial Sequence
  CIITA targeting sequence
cagaucuaugugauuguacu

SEQ ID NO: 30015 - RNA, 20 nt, Artificial Sequence
  CIITA targeting sequence
gaucuaugugauuguacuca

SEQ ID NO: 30016 - RNA, 20 nt, Artificial Sequence
  CIITA targeting sequence
gagaagcagaugccuggaaa

SEQ ID NO: 30017 - RNA, 20 nt, Artificial Sequence
  CIITA targeting sequence
augugauuguacucaauaaa

SEQ ID NO: 30018 - RNA, 20 nt, Artificial Sequence
  CIITA targeting sequence
cauagaucugagaagcagau

SEQ ID NO: 30019 - RNA, 20 nt, Artificial Sequence
  CIITA targeting sequence
caaugcccauccccagucau

SEQ ID NO: 30020 - RNA, 20 nt, Artificial Sequence
  CIITA targeting sequence
gguucauuguucucuauacu

SEQ ID NO: 30021 - RNA, 20 nt, Artificial Sequence
  CIITA targeting sequence
uuguucucuauacuuuuacg

SEQ ID NO: 30022 - RNA, 20 nt, Artificial Sequence
  CIITA targeting sequence
cuauacuuuuacguaaauuu

SEQ ID NO: 30023 - RNA, 20 nt, Artificial Sequence
  CIITA targeting sequence
auacuuuuacguaaauuuga

SEQ ID NO: 30024 - RNA, 20 nt, Artificial Sequence
  CIITA targeting sequence
aauuuacguaaaaguauaga

SEQ ID NO: 30025 - RNA, 20 nt, Artificial Sequence
  CIITA targeting sequence
acuuuuaaauucaaauuuac

SEQ ID NO: 30026 - RNA, 20 nt, Artificial Sequence
  CIITA targeting sequence
ucuacuuuuaaauucaaauu

SEQ ID NO: 30027 - RNA, 20 nt, Artificial Sequence
  CIITA targeting sequence
ucuucuacuuuuaaauucaa

SEQ ID NO: 30028 - RNA, 20 nt, Artificial Sequence
  CIITA targeting sequence
uucuucuucuacuuuuaaau

SEQ ID NO: 30029 - RNA, 20 nt, Artificial Sequence
  CIITA targeting sequence
gcagaagcagcccugacuuu

SEQ ID NO: 30030 - RNA, 20 nt, Artificial Sequence
  CIITA targeting sequence
gccgauuucuuucuucuucu

SEQ ID NO: 30031 - RNA, 20 nt, Artificial Sequence
  CIITA targeting sequence
gcccaugagcuugguuuauc

SEQ ID NO: 30032 - RNA, 20 nt, Artificial Sequence
  CIITA targeting sequence
ggguaccuagauggcccagc

SEQ ID NO: 30033 - RNA, 20 nt, Artificial Sequence
  CIITA targeting sequence
agguacccagaauaucagcc

SEQ ID NO: 30034 - RNA, 20 nt, Artificial Sequence
  CIITA targeting sequence
aaaaaaaaaaaaaauuuaga

SEQ ID NO: 30035 - RNA, 20 nt, Artificial Sequence
  CIITA targeting sequence
aaauuuuuuuuuuuuuugga

SEQ ID NO: 30036 - RNA, 20 nt, Artificial Sequence
  CIITA targeting sequence
cccauugaguaauggacugu

SEQ ID NO: 30037 - RNA, 20 nt, Artificial Sequence
  CIITA targeting sequence
augggggauuuuuaggucua

SEQ ID NO: 30038 - RNA, 20 nt, Artificial Sequence
  CIITA targeting sequence
auuacucaaugggggauuuu

SEQ ID NO: 30039 - RNA, 20 nt, Artificial Sequence
  CIITA targeting sequence
agcuguaacaguccauuacu

SEQ ID NO: 30040 - RNA, 20 nt, Artificial Sequence
  CIITA targeting sequence
uguauccagcuguaacaguc

SEQ ID NO: 30041 - RNA, 20 nt, Artificial Sequence
  CIITA targeting sequence
ucauguauccagcuguaaca

SEQ ID NO: 30042 - RNA, 20 nt, Artificial Sequence
  CIITA targeting sequence
agaaagcagguccuuucuuc

SEQ ID NO: 30043 - RNA, 20 nt, Artificial Sequence
  CIITA targeting sequence
ggaauuuucuucauguaucc

SEQ ID NO: 30044 - RNA, 20 nt, Artificial Sequence
  CIITA targeting sequence
uuucuucugggcuuaccagu

SEQ ID NO: 30045 - RNA, 20 nt, Artificial Sequence
  CIITA targeting sequence
ucugggcuuaccaguuccuc

SEQ ID NO: 30046 - RNA, 20 nt, Artificial Sequence
  CIITA targeting sequence
gggcuuaccaguuccucuac

SEQ ID NO: 30047 - RNA, 20 nt, Artificial Sequence
  CIITA targeting sequence
ucuacaaaaaaagaggccac

SEQ ID NO: 30048 - RNA, 20 nt, Artificial Sequence
  CIITA targeting sequence
acaaaaaaagaggccacccc

SEQ ID NO: 30049 - RNA, 20 nt, Artificial Sequence
  CIITA targeting sequence
uuuuuuguagaggaacuggu

SEQ ID NO: 30050 - RNA, 20 nt, Artificial Sequence
  CIITA targeting sequence
ggagauccugagaacaugug

SEQ ID NO: 30051 - RNA, 20 nt, Artificial Sequence
  CIITA targeting sequence
ugaaggcuaugucaugggcu

SEQ ID NO: 30052 - RNA, 20 nt, Artificial Sequence
  CIITA targeting sequence
ccugaaggcuaugucauggg

SEQ ID NO: 30053 - RNA, 20 nt, Artificial Sequence
  CIITA targeting sequence
ugagaacaugugcccaaggu

SEQ ID NO: 30054 - RNA, 20 nt, Artificial Sequence
  CIITA targeting sequence
ggaucuccugaaggcuaugu

SEQ ID NO: 30055 - RNA, 20 nt, Artificial Sequence
  CIITA targeting sequence
caggaucuccugaaggcuau

SEQ ID NO: 30056 - RNA, 20 nt, Artificial Sequence
  CIITA targeting sequence
caaaaauauauaaaaccagg

SEQ ID NO: 30057 - RNA, 20 nt, Artificial Sequence
  CIITA targeting sequence
cccaaaaauauauaaaacca

SEQ ID NO: 30058 - RNA, 20 nt, Artificial Sequence
  CIITA targeting sequence
uaucucccaaaaauauauaa

SEQ ID NO: 30059 - RNA, 20 nt, Artificial Sequence
  CIITA targeting sequence
cauaucucccaaaaauauau

SEQ ID NO: 30060 - RNA, 20 nt, Artificial Sequence
  CIITA targeting sequence
aucaaauacauucaagauau

SEQ ID NO: 30061 - RNA, 20 nt, Artificial Sequence
  CIITA targeting sequence
aauacauucaagauauacau

SEQ ID NO: 30062 - RNA, 20 nt, Artificial Sequence
  CIITA targeting sequence
agauauacauuggggcuggg

SEQ ID NO: 30063 - RNA, 20 nt, Artificial Sequence
  CIITA targeting sequence
ugaauguauuugauugaugu

SEQ ID NO: 30064 - RNA, 20 nt, Artificial Sequence
  CIITA targeting sequence
ccacacccagccccaaugua

SEQ ID NO: 30065 - RNA, 20 nt, Artificial Sequence
  CIITA targeting sequence
caccuguaaucccagcacuu

SEQ ID NO: 30066 - RNA, 20 nt, Artificial Sequence
  CIITA targeting sequence
cagcacuuugggaggcugag

SEQ ID NO: 30067 - RNA, 20 nt, Artificial Sequence
  CIITA targeting sequence
caaagugcugggauuacagg

SEQ ID NO: 30068 - RNA, 20 nt, Artificial Sequence
  CIITA targeting sequence
gccucccaaagugcugggau

SEQ ID NO: 30069 - RNA, 20 nt, Artificial Sequence
  CIITA targeting sequence
accagccucagccucccaaa

SEQ ID NO: 30070 - RNA, 20 nt, Artificial Sequence
  CIITA targeting sequence
ccugaggucaggaguucaag

SEQ ID NO: 30071 - RNA, 20 nt, Artificial Sequence
  CIITA targeting sequence
ggugauccaccagccucagc

SEQ ID NO: 30072 - RNA, 20 nt, Artificial Sequence
  CIITA targeting sequence
ggaguucaagaccagucugg

SEQ ID NO: 30073 - RNA, 20 nt, Artificial Sequence
  CIITA targeting sequence
aaggggccuggauaggaccc

SEQ ID NO: 30074 - RNA, 20 nt, Artificial Sequence
  CIITA targeting sequence
uaucuaaggggccuggauag

SEQ ID NO: 30075 - RNA, 20 nt, Artificial Sequence
  CIITA targeting sequence
ugcccaaauuccuaucuaag

SEQ ID NO: 30076 - RNA, 20 nt, Artificial Sequence
  CIITA targeting sequence
uaucuugcccaaauuccuau

SEQ ID NO: 30077 - RNA, 20 nt, Artificial Sequence
  CIITA targeting sequence
aauuuuuuuccuaucuugcc

SEQ ID NO: 30078 - RNA, 20 nt, Artificial Sequence
  CIITA targeting sequence
ucaaauguaguuugcgguaa

SEQ ID NO: 30079 - RNA, 20 nt, Artificial Sequence
  CIITA targeting sequence
aauguaguuugcgguaaaau

SEQ ID NO: 30080 - RNA, 20 nt, Artificial Sequence
  CIITA targeting sequence
auuucuuucagggccugcua

SEQ ID NO: 30081 - RNA, 20 nt, Artificial Sequence
  CIITA targeting sequence
uucagggccugcuaucugug

SEQ ID NO: 30082 - RNA, 20 nt, Artificial Sequence
  CIITA targeting sequence
gggccugcuaucugugcugu

SEQ ID NO: 30083 - RNA, 20 nt, Artificial Sequence
  CIITA targeting sequence
ccauuguuaaaaauaaguag

SEQ ID NO: 30084 - RNA, 20 nt, Artificial Sequence
  CIITA targeting sequence
uucuuuggccccgacaccca

SEQ ID NO: 30085 - RNA, 20 nt, Artificial Sequence
  CIITA targeting sequence
uuggccccgacacccacuua

SEQ ID NO: 30086 - RNA, 20 nt, Artificial Sequence
  CIITA targeting sequence
gggccaaagaaagaaauagc

SEQ ID NO: 30087 - RNA, 20 nt, Artificial Sequence
  CIITA targeting sequence
gguggcuucucugcuacuga

SEQ ID NO: 30088 - RNA, 20 nt, Artificial Sequence
  CIITA targeting sequence
cugcuacugauguaggaguu

SEQ ID NO: 30089 - RNA, 20 nt, Artificial Sequence
  CIITA targeting sequence
gcuacugauguaggaguuca

SEQ ID NO: 30090 - RNA, 20 nt, Artificial Sequence
  CIITA targeting sequence
guagcagagaagccaccuga

SEQ ID NO: 30091 - RNA, 20 nt, Artificial Sequence
  CIITA targeting sequence
uacaucaguagcagagaagc

SEQ ID NO: 30092 - RNA, 20 nt, Artificial Sequence
  CIITA targeting sequence
gaagaaacuacuuaggcaaa

SEQ ID NO: 30093 - RNA, 20 nt, Artificial Sequence
  CIITA targeting sequence
gaacuccuacaucaguagca

SEQ ID NO: 30094 - RNA, 20 nt, Artificial Sequence
  CIITA targeting sequence
ucugaacuccuacaucagua

SEQ ID NO: 30095 - RNA, 20 nt, Artificial Sequence
  CIITA targeting sequence
uuuuaaugaaaaucagcccc

SEQ ID NO: 30096 - RNA, 20 nt, Artificial Sequence
  CIITA targeting sequence
uuaaaaggaaaaccuuaguu

SEQ ID NO: 30097 - RNA, 20 nt, Artificial Sequence
  CIITA targeting sequence
gcccccaaauuauuuucuuu

SEQ ID NO: 30098 - RNA, 20 nt, Artificial Sequence
  CIITA targeting sequence
uuucuaacaaagagcagccu

SEQ ID NO: 30099 - RNA, 20 nt, Artificial Sequence
  CIITA targeting sequence
aacaaagagcagccuguaaa

SEQ ID NO: 30100 - RNA, 20 nt, Artificial Sequence
  CIITA targeting sequence
uuguuagaaaagaaaauaau

SEQ ID NO: 30101 - RNA, 20 nt, Artificial Sequence
  CIITA targeting sequence
agcugcagacauagacaagc

SEQ ID NO: 30102 - RNA, 20 nt, Artificial Sequence
  CIITA targeting sequence
gcagcuggauuuuacaggcu

SEQ ID NO: 30103 - RNA, 20 nt, Artificial Sequence
  CIITA targeting sequence
augucugcagcuggauuuua

SEQ ID NO: 30104 - RNA, 20 nt, Artificial Sequence
  CIITA targeting sequence
agcuugcuugucuaugucug

SEQ ID NO: 30105 - RNA, 20 nt, Artificial Sequence
  CIITA targeting sequence
agggugaaugccagcagcug

SEQ ID NO: 30106 - RNA, 20 nt, Artificial Sequence
  CIITA targeting sequence
cccuggaagcuuccagcuug

SEQ ID NO: 30107 - RNA, 20 nt, Artificial Sequence
  CIITA targeting sequence
gcucagauaucccaacaguc

SEQ ID NO: 30108 - RNA, 20 nt, Artificial Sequence
  CIITA targeting sequence
gccucugcucagauauccca

SEQ ID NO: 30109 - RNA, 20 nt, Artificial Sequence
  CIITA targeting sequence
guuuccauucaaaggucagc

SEQ ID NO: 30110 - RNA, 20 nt, Artificial Sequence
  CIITA targeting sequence
auucaaaggucagcacaaua

SEQ ID NO: 30111 - RNA, 20 nt, Artificial Sequence
  CIITA targeting sequence
aaggucagcacaauagaggu

SEQ ID NO: 30112 - RNA, 20 nt, Artificial Sequence
  CIITA targeting sequence
gcacaauagagguuuaugug

SEQ ID NO: 30113 - RNA, 20 nt, Artificial Sequence
  CIITA targeting sequence
auugugcugaccuuugaaug

SEQ ID NO: 30114 - RNA, 20 nt, Artificial Sequence
  CIITA targeting sequence
acacauaaaccucuauugug

SEQ ID NO: 30115 - RNA, 20 nt, Artificial Sequence
  CIITA targeting sequence
cuucuacacauaaaccucua

SEQ ID NO: 30116 - RNA, 20 nt, Artificial Sequence
  CIITA targeting sequence
uuuauucacuucuacacaua

SEQ ID NO: 30117 - RNA, 20 nt, Artificial Sequence
  CIITA targeting sequence
cucugguugccacaguuuuu

SEQ ID NO: 30118 - RNA, 20 nt, Artificial Sequence
  CIITA targeting sequence
gguugccacaguuuuuuccu

SEQ ID NO: 30119 - RNA, 20 nt, Artificial Sequence
  CIITA targeting sequence
ucuuguuucuguucuuuauu

SEQ ID NO: 30120 - RNA, 20 nt, Artificial Sequence
  CIITA targeting sequence
uguuucuguucuuuauuucu

SEQ ID NO: 30121 - RNA, 20 nt, Artificial Sequence
  CIITA targeting sequence
guucuuuauuucuuuuuaaa

SEQ ID NO: 30122 - RNA, 20 nt, Artificial Sequence
  CIITA targeting sequence
uuauuucuuuuuaaagagac

SEQ ID NO: 30123 - RNA, 20 nt, Artificial Sequence
  CIITA targeting sequence
uuuuaaagagacauacccag

SEQ ID NO: 30124 - RNA, 20 nt, Artificial Sequence
  CIITA targeting sequence
uuaaaaagaaauaaagaaca

SEQ ID NO: 30125 - RNA, 20 nt, Artificial Sequence
  CIITA targeting sequence
cuuuaaaaagaaauaaagaa

SEQ ID NO: 30126 - RNA, 20 nt, Artificial Sequence
  CIITA targeting sequence
ugccuguaaucccagcacuc

SEQ ID NO: 30127 - RNA, 20 nt, Artificial Sequence
  CIITA targeting sequence
ggaugcugggcccaggcugg

SEQ ID NO: 30128 - RNA, 20 nt, Artificial Sequence
  CIITA targeting sequence
agaggcacccccccaacuug

SEQ ID NO: 30129 - RNA, 20 nt, Artificial Sequence
  CIITA targeting sequence
aacccuucacccuccaccuc

SEQ ID NO: 30130 - RNA, 20 nt, Artificial Sequence
  CIITA targeting sequence
cccuccaccucugggcacug

SEQ ID NO: 30131 - RNA, 20 nt, Artificial Sequence
  CIITA targeting sequence
accucugggcacugcuuggc

SEQ ID NO: 30132 - RNA, 20 nt, Artificial Sequence
  CIITA targeting sequence
gggcacugcuuggcuuguag

SEQ ID NO: 30133 - RNA, 20 nt, Artificial Sequence
  CIITA targeting sequence
caaaaggauauguugacauc

SEQ ID NO: 30134 - RNA, 20 nt, Artificial Sequence
  CIITA targeting sequence
accuauaacaucugccuuag

SEQ ID NO: 30135 - RNA, 20 nt, Artificial Sequence
  CIITA targeting sequence
gccuuagguccaaugagcca

SEQ ID NO: 30136 - RNA, 20 nt, Artificial Sequence
  CIITA targeting sequence
aaugagccagagaaaauaag

SEQ ID NO: 30137 - RNA, 20 nt, Artificial Sequence
  CIITA targeting sequence
uuggaccuaaggcagauguu

SEQ ID NO: 30138 - RNA, 20 nt, Artificial Sequence
  CIITA targeting sequence
ggcucauuggaccuaaggca

SEQ ID NO: 30139 - RNA, 20 nt, Artificial Sequence
  CIITA targeting sequence
cuggcucauuggaccuaagg

SEQ ID NO: 30140 - RNA, 20 nt, Artificial Sequence
  CIITA targeting sequence
cuuauuuucucuggcucauu

SEQ ID NO: 30141 - RNA, 20 nt, Artificial Sequence
  CIITA targeting sequence
uaccucacuuauuuucucug

SEQ ID NO: 30142 - RNA, 20 nt, Artificial Sequence
  CIITA targeting sequence
uccuaccucacuuauuuucu

SEQ ID NO: 30143 - RNA, 20 nt, Artificial Sequence
  CIITA targeting sequence
ucuuccuaccucacuuauuu

SEQ ID NO: 30144 - RNA, 20 nt, Artificial Sequence
  CIITA targeting sequence
uaguuuucaggguaacaucc

SEQ ID NO: 30145 - RNA, 20 nt, Artificial Sequence
  CIITA targeting sequence
ggguaacauccucugggcua

SEQ ID NO: 30146 - RNA, 20 nt, Artificial Sequence
  CIITA targeting sequence
ucugggcuagcagcugcucu

SEQ ID NO: 30147 - RNA, 20 nt, Artificial Sequence
  CIITA targeting sequence
gggcuagcagcugcucugag

SEQ ID NO: 30148 - RNA, 20 nt, Artificial Sequence
  CIITA targeting sequence
gaguggcagaaucaacagga

SEQ ID NO: 30149 - RNA, 20 nt, Artificial Sequence
  CIITA targeting sequence
gagcagcugcuagcccagag

SEQ ID NO: 30150 - RNA, 20 nt, Artificial Sequence
  CIITA targeting sequence
gccacucagagcagcugcua

SEQ ID NO: 30151 - RNA, 20 nt, Artificial Sequence
  CIITA targeting sequence
acaggagguccuaggucccc

SEQ ID NO: 30152 - RNA, 20 nt, Artificial Sequence
  CIITA targeting sequence
uguugauucugccacucaga

SEQ ID NO: 30153 - RNA, 20 nt, Artificial Sequence
  CIITA targeting sequence
uagguccccacucacucuca

SEQ ID NO: 30154 - RNA, 20 nt, Artificial Sequence
  CIITA targeting sequence
uuucaaauuacaguucugcc

SEQ ID NO: 30155 - RNA, 20 nt, Artificial Sequence
  CIITA targeting sequence
aauuacaguucugccauuua

SEQ ID NO: 30156 - RNA, 20 nt, Artificial Sequence
  CIITA targeting sequence
gccauuuacuugugugaccu

SEQ ID NO: 30157 - RNA, 20 nt, Artificial Sequence
  CIITA targeting sequence
cacaaguaaauggcagaacu

SEQ ID NO: 30158 - RNA, 20 nt, Artificial Sequence
  CIITA targeting sequence
aggucacacaaguaaauggc

SEQ ID NO: 30159 - RNA, 20 nt, Artificial Sequence
  CIITA targeting sequence
acauuucugggccuauuucc

SEQ ID NO: 30160 - RNA, 20 nt, Artificial Sequence
  CIITA targeting sequence
gggccuauuuccucaccugc

SEQ ID NO: 30161 - RNA, 20 nt, Artificial Sequence
  CIITA targeting sequence
cauggcuguuggcuggaggc

SEQ ID NO: 30162 - RNA, 20 nt, Artificial Sequence
  CIITA targeting sequence
ucccauggcuguuggcugga

SEQ ID NO: 30163 - RNA, 20 nt, Artificial Sequence
  CIITA targeting sequence
uggacacagcuccuccugcc

SEQ ID NO: 30164 - RNA, 20 nt, Artificial Sequence
  CIITA targeting sequence
aagauggcguccucccaugg

SEQ ID NO: 30165 - RNA, 20 nt, Artificial Sequence
  CIITA targeting sequence
uccugccccagucaagccuu

SEQ ID NO: 30166 - RNA, 20 nt, Artificial Sequence
  CIITA targeting sequence
ugccccagucaagccuucug

SEQ ID NO: 30167 - RNA, 20 nt, Artificial Sequence
  CIITA targeting sequence
agccuucugaugacugcagc

SEQ ID NO: 30168 - RNA, 20 nt, Artificial Sequence
  CIITA targeting sequence
gaugacugcagcucugagca

SEQ ID NO: 30169 - RNA, 20 nt, Artificial Sequence
  CIITA targeting sequence
gaaggcuugacuggggcagg

SEQ ID NO: 30170 - RNA, 20 nt, Artificial Sequence
  CIITA targeting sequence
ucagaaggcuugacuggggc

SEQ ID NO: 30171 - RNA, 20 nt, Artificial Sequence
  CIITA targeting sequence
gagcaaccucugacuacaac

SEQ ID NO: 30172 - RNA, 20 nt, Artificial Sequence
  CIITA targeting sequence
gagcugcagucaucagaagg

SEQ ID NO: 30173 - RNA, 20 nt, Artificial Sequence
  CIITA targeting sequence
ccuguuuugaaaaggugaau

SEQ ID NO: 30174 - RNA, 20 nt, Artificial Sequence
  CIITA targeting sequence
gaguuauuaacugauggaca

SEQ ID NO: 30175 - RNA, 20 nt, Artificial Sequence
  CIITA targeting sequence
gaguccccuguuuugaaaag

SEQ ID NO: 30176 - RNA, 20 nt, Artificial Sequence
  CIITA targeting sequence
guuaauaacuccgagucccc

SEQ ID NO: 30177 - RNA, 20 nt, Artificial Sequence
  CIITA targeting sequence
aucaguuaauaacuccgagu

SEQ ID NO: 30178 - RNA, 20 nt, Artificial Sequence
  CIITA targeting sequence
guccaucaguuaauaacucc

SEQ ID NO: 30179 - RNA, 20 nt, Artificial Sequence
  CIITA targeting sequence
uuucuguccaucaguuaaua

SEQ ID NO: 30180 - RNA, 20 nt, Artificial Sequence
  CIITA targeting sequence
gcucuuuucuguccaucagu

SEQ ID NO: 30181 - RNA, 20 nt, Artificial Sequence
  CIITA targeting sequence
cugcucuuuucuguccauca

SEQ ID NO: 30182 - RNA, 20 nt, Artificial Sequence
  CIITA targeting sequence
ggccucucugcucuuuucug

SEQ ID NO: 30183 - RNA, 20 nt, Artificial Sequence
  CIITA targeting sequence
cgggccucucugcucuuuuc

SEQ ID NO: 30184 - RNA, 20 nt, Artificial Sequence
  CIITA targeting sequence
gucucgggccucucugcucu

SEQ ID NO: 30185 - RNA, 20 nt, Artificial Sequence
  CIITA targeting sequence
agaagucuggagcagaaacc

SEQ ID NO: 30186 - RNA, 20 nt, Artificial Sequence
  CIITA targeting sequence
ggaaagucagucucgggccu

SEQ ID NO: 30187 - RNA, 20 nt, Artificial Sequence
  CIITA targeting sequence
ggagcagaaaccagccagcc

SEQ ID NO: 30188 - RNA, 20 nt, Artificial Sequence
  CIITA targeting sequence
agacuucuggaaagucaguc

SEQ ID NO: 30189 - RNA, 20 nt, Artificial Sequence
  CIITA targeting sequence
gcuccagacuucuggaaagu

SEQ ID NO: 30190 - RNA, 20 nt, Artificial Sequence
  CIITA targeting sequence
caacacuuugggaggccaag

SEQ ID NO: 30191 - RNA, 20 nt, Artificial Sequence
  CIITA targeting sequence
gccacugugccuggccuugu

SEQ ID NO: 30192 - RNA, 20 nt, Artificial Sequence
  CIITA targeting sequence
ucugaagagcuucuagauuc

SEQ ID NO: 30193 - RNA, 20 nt, Artificial Sequence
  CIITA targeting sequence
gaagagcuucuagauucugc

SEQ ID NO: 30194 - RNA, 20 nt, Artificial Sequence
  CIITA targeting sequence
gaagaaaaagcacaaggcca

SEQ ID NO: 30195 - RNA, 20 nt, Artificial Sequence
  CIITA targeting sequence
ucagaagaaaaagcacaagg

SEQ ID NO: 30196 - RNA, 20 nt, Artificial Sequence
  CIITA targeting sequence
agauucugcuagaaacugga

SEQ ID NO: 30197 - RNA, 20 nt, Artificial Sequence
  CIITA targeting sequence
agaagcucuucagaagaaaa

SEQ ID NO: 30198 - RNA, 20 nt, Artificial Sequence
  CIITA targeting sequence
gcuagaaacuggacaagauc

SEQ ID NO: 30199 - RNA, 20 nt, Artificial Sequence
  CIITA targeting sequence
agcagaaucuagaagcucuu

SEQ ID NO: 30200 - RNA, 20 nt, Artificial Sequence
  CIITA targeting sequence
acuaccucuuaccuacaauc

SEQ ID NO: 30201 - RNA, 20 nt, Artificial Sequence
  CIITA targeting sequence
uccacuaccucuuaccuaca

SEQ ID NO: 30202 - RNA, 20 nt, Artificial Sequence
  CIITA targeting sequence
ucauccacuaccucuuaccu

SEQ ID NO: 30203 - RNA, 20 nt, Artificial Sequence
  CIITA targeting sequence
uucgucauccacuaccucuu

SEQ ID NO: 30204 - RNA, 20 nt, Artificial Sequence
  CIITA targeting sequence
cauuuuuuuuuucuuucguc

SEQ ID NO: 30205 - RNA, 20 nt, Artificial Sequence
  CIITA targeting sequence
aggccaucuuuaguaguggc

SEQ ID NO: 30206 - RNA, 20 nt, Artificial Sequence
  CIITA targeting sequence
uuaguaguggcacagcucaa

SEQ ID NO: 30207 - RNA, 20 nt, Artificial Sequence
  CIITA targeting sequence
aaaaaagaaaaugucccuuu

SEQ ID NO: 30208 - RNA, 20 nt, Artificial Sequence
  CIITA targeting sequence
uuuuuugagcugugccacua

SEQ ID NO: 30209 - RNA, 20 nt, Artificial Sequence
  CIITA targeting sequence
cuuuauccuaacaucauuuc

SEQ ID NO: 30210 - RNA, 20 nt, Artificial Sequence
  CIITA targeting sequence
uaacaucauuucugcaguau

SEQ ID NO: 30211 - RNA, 20 nt, Artificial Sequence
  CIITA targeting sequence
guaaauaguaaguuuuguca

SEQ ID NO: 30212 - RNA, 20 nt, Artificial Sequence
  CIITA targeting sequence
uugcuguguguauuuuaggu

SEQ ID NO: 30213 - RNA, 20 nt, Artificial Sequence
  CIITA targeting sequence
auguuuauuuggugcuccac

SEQ ID NO: 30214 - RNA, 20 nt, Artificial Sequence
  CIITA targeting sequence
acauaaucacgaaugcuaaa

SEQ ID NO: 30215 - RNA, 20 nt, Artificial Sequence
  CIITA targeting sequence
cgaaugcuaaauuugagaug

SEQ ID NO: 30216 - RNA, 20 nt, Artificial Sequence
  CIITA targeting sequence
auuaaaaaauguauuuuaaa

SEQ ID NO: 30217 - RNA, 20 nt, Artificial Sequence
  CIITA targeting sequence
uuaaaacaaaauuuaaaaua

SEQ ID NO: 30218 - RNA, 20 nt, Artificial Sequence
  CIITA targeting sequence
aaggacaaauuuaggaagca

SEQ ID NO: 30219 - RNA, 20 nt, Artificial Sequence
  CIITA targeting sequence
uuagaucuuuaaaacaaaau

SEQ ID NO: 30220 - RNA, 20 nt, Artificial Sequence
  CIITA targeting sequence
uaaauuuguccuuagaucuu

SEQ ID NO: 30221 - RNA, 20 nt, Artificial Sequence
  CIITA targeting sequence
ugcuuccuaaauuuguccuu

SEQ ID NO: 30222 - RNA, 20 nt, Artificial Sequence
  CIITA targeting sequence
cuugcuuccuaaauuugucc

SEQ ID NO: 30223 - RNA, 20 nt, Artificial Sequence
  CIITA targeting sequence
ggugcucacagggccgggca

SEQ ID NO: 30224 - RNA, 20 nt, Artificial Sequence
  CIITA targeting sequence
cagggccgggcaaagcuggg

SEQ ID NO: 30225 - RNA, 20 nt, Artificial Sequence
  CIITA targeting sequence
cagcuuugcccggcccugug

SEQ ID NO: 30226 - RNA, 20 nt, Artificial Sequence
  CIITA targeting sequence
gucaacugagugggugaggg

SEQ ID NO: 30227 - RNA, 20 nt, Artificial Sequence
  CIITA targeting sequence
acugagugggugagggccga

SEQ ID NO: 30228 - RNA, 20 nt, Artificial Sequence
  CIITA targeting sequence
guugacugauuucccagcuu

SEQ ID NO: 30229 - RNA, 20 nt, Artificial Sequence
  CIITA targeting sequence
cugcauuaaaguacagaugu

SEQ ID NO: 30230 - RNA, 20 nt, Artificial Sequence
  CIITA targeting sequence
augaacaugauuuguggcug

SEQ ID NO: 30231 - RNA, 20 nt, Artificial Sequence
  CIITA targeting sequence
uggauucccugcauuaaagu

SEQ ID NO: 30232 - RNA, 20 nt, Artificial Sequence
  CIITA targeting sequence
uguucauggauucccugcau

SEQ ID NO: 30233 - RNA, 20 nt, Artificial Sequence
  CIITA targeting sequence
cugagucaucucggaagccg

SEQ ID NO: 30234 - RNA, 20 nt, Artificial Sequence
  CIITA targeting sequence
gagucaucucggaagccggc

SEQ ID NO: 30235 - RNA, 20 nt, Artificial Sequence
  CIITA targeting sequence
gagacagccacaaaucaugu

SEQ ID NO: 30236 - RNA, 20 nt, Artificial Sequence
  CIITA targeting sequence
ucucggaagccggcuugcuc

SEQ ID NO: 30237 - RNA, 20 nt, Artificial Sequence
  CIITA targeting sequence
cggaagccggcuugcuccug

SEQ ID NO: 30238 - RNA, 20 nt, Artificial Sequence
  CIITA targeting sequence
gaagccggcuugcuccuguc

SEQ ID NO: 30239 - RNA, 20 nt, Artificial Sequence
  CIITA targeting sequence
gagaugacucagagacagcc

SEQ ID NO: 30240 - RNA, 20 nt, Artificial Sequence
  CIITA targeting sequence
ugucacgagugaaggguuag

SEQ ID NO: 30241 - RNA, 20 nt, Artificial Sequence
  CIITA targeting sequence
cgagugaaggguuagcaggg

SEQ ID NO: 30242 - RNA, 20 nt, Artificial Sequence
  CIITA targeting sequence
ugacaggagcaagccggcuu

SEQ ID NO: 30243 - RNA, 20 nt, Artificial Sequence
  CIITA targeting sequence
cucgugacaggagcaagccg

SEQ ID NO: 30244 - RNA, 20 nt, Artificial Sequence
  CIITA targeting sequence
ggagacauuuugguugucac

SEQ ID NO: 30245 - RNA, 20 nt, Artificial Sequence
  CIITA targeting sequence
agacauugcugggggacacu

SEQ ID NO: 30246 - RNA, 20 nt, Artificial Sequence
  CIITA targeting sequence
ccagacauugcugggggaca

SEQ ID NO: 30247 - RNA, 20 nt, Artificial Sequence
  CIITA targeting sequence
cagugggggcugcuaccagc

SEQ ID NO: 30248 - RNA, 20 nt, Artificial Sequence
  CIITA targeting sequence
gcaaaacuccuaugauacac

SEQ ID NO: 30249 - RNA, 20 nt, Artificial Sequence
  CIITA targeting sequence
uaugauacacaggacagaua

SEQ ID NO: 30250 - RNA, 20 nt, Artificial Sequence
  CIITA targeting sequence
uaggaguuuugcagaugcug

SEQ ID NO: 30251 - RNA, 20 nt, Artificial Sequence
  CIITA targeting sequence
cagauuaugugggucacagg

SEQ ID NO: 30252 - RNA, 20 nt, Artificial Sequence
  CIITA targeting sequence
gggaaggcauuugggagagg

SEQ ID NO: 30253 - RNA, 20 nt, Artificial Sequence
  CIITA targeting sequence
caggucagcagaaaucacac

SEQ ID NO: 30254 - RNA, 20 nt, Artificial Sequence
  CIITA targeting sequence
gcagaaaucacacuucagau

SEQ ID NO: 30255 - RNA, 20 nt, Artificial Sequence
  CIITA targeting sequence
gcugaccugugacccacaua

SEQ ID NO: 30256 - RNA, 20 nt, Artificial Sequence
  CIITA targeting sequence
cacuucagauuuuauuguuu

SEQ ID NO: 30257 - RNA, 20 nt, Artificial Sequence
  CIITA targeting sequence
gauuuuauuguuuuuuauuu

SEQ ID NO: 30258 - RNA, 20 nt, Artificial Sequence
  CIITA targeting sequence
gaagugugauuucugcugac

SEQ ID NO: 30259 - RNA, 20 nt, Artificial Sequence
  CIITA targeting sequence
gugauuuuguuguggacaca

SEQ ID NO: 30260 - RNA, 20 nt, Artificial Sequence
  CIITA targeting sequence
cugaagggccagguguggug

SEQ ID NO: 30261 - RNA, 20 nt, Artificial Sequence
  CIITA targeting sequence
acaacaaaaucacugaaggg

SEQ ID NO: 30262 - RNA, 20 nt, Artificial Sequence
  CIITA targeting sequence
ugugaacaagaaauauaaau

SEQ ID NO: 30263 - RNA, 20 nt, Artificial Sequence
  CIITA targeting sequence
caugaaauuauugcauaagc

SEQ ID NO: 30264 - RNA, 20 nt, Artificial Sequence
  CIITA targeting sequence
uguucacaugaaauuauugc

SEQ ID NO: 30265 - RNA, 20 nt, Artificial Sequence
  CIITA targeting sequence
uauuuauauuucuuguucac

SEQ ID NO: 30266 - RNA, 20 nt, Artificial Sequence
  CIITA targeting sequence
ucuuauuuauauuucuuguu

SEQ ID NO: 30267 - RNA, 20 nt, Artificial Sequence
  CIITA targeting sequence
aaggcagcuuaacuuccucu

SEQ ID NO: 30268 - RNA, 20 nt, Artificial Sequence
  CIITA targeting sequence
uuacaucuaaggcagcuuaa

SEQ ID NO: 30269 - RNA, 20 nt, Artificial Sequence
  CIITA targeting sequence
aaauacguaauuccgugccc

SEQ ID NO: 30270 - RNA, 20 nt, Artificial Sequence
  CIITA targeting sequence
gugcccuaaucaaagagaac

SEQ ID NO: 30271 - RNA, 20 nt, Artificial Sequence
  CIITA targeting sequence
aagagaacugaaauuugucu

SEQ ID NO: 30272 - RNA, 20 nt, Artificial Sequence
  CIITA targeting sequence
uugauuagggcacggaauua

SEQ ID NO: 30273 - RNA, 20 nt, Artificial Sequence
  CIITA targeting sequence
cuuugauuagggcacggaau

SEQ ID NO: 30274 - RNA, 20 nt, Artificial Sequence
  CIITA targeting sequence
guucucuuugauuagggcac

SEQ ID NO: 30275 - RNA, 20 nt, Artificial Sequence
  CIITA targeting sequence
aguuccgugauucugugggu

SEQ ID NO: 30276 - RNA, 20 nt, Artificial Sequence
  CIITA targeting sequence
gugauucuguggguuauuuu

SEQ ID NO: 30277 - RNA, 20 nt, Artificial Sequence
  CIITA targeting sequence
cggaacuagacaaauuucag

SEQ ID NO: 30278 - RNA, 20 nt, Artificial Sequence
  CIITA targeting sequence
guggguuauuuuccuuggua

SEQ ID NO: 30279 - RNA, 20 nt, Artificial Sequence
  CIITA targeting sequence
uugguaaucauggaccuucc

SEQ ID NO: 30280 - RNA, 20 nt, Artificial Sequence
  CIITA targeting sequence
uggaccuuccuuaaaauuaa

SEQ ID NO: 30281 - RNA, 20 nt, Artificial Sequence
  CIITA targeting sequence
augauuaccaaggaaaauaa

SEQ ID NO: 30282 - RNA, 20 nt, Artificial Sequence
  CIITA targeting sequence
uuaaaauuaaacaaucagcu

SEQ ID NO: 30283 - RNA, 20 nt, Artificial Sequence
  CIITA targeting sequence
gcucuugaugggaccugcuu

SEQ ID NO: 30284 - RNA, 20 nt, Artificial Sequence
  CIITA targeting sequence
ugaugggaccugcuuaugug

SEQ ID NO: 30285 - RNA, 20 nt, Artificial Sequence
  CIITA targeting sequence
agagcugauuguuuaauuuu

SEQ ID NO: 30286 - RNA, 20 nt, Artificial Sequence
  CIITA targeting sequence
caucaagagcugauuguuua

SEQ ID NO: 30287 - RNA, 20 nt, Artificial Sequence
  CIITA targeting sequence
uauuucuauaauuucaaaau

SEQ ID NO: 30288 - RNA, 20 nt, Artificial Sequence
  CIITA targeting sequence
auaauuucaaaauagauuuu

SEQ ID NO: 30289 - RNA, 20 nt, Artificial Sequence
  CIITA targeting sequence
aaauagauuuuagagagccg

SEQ ID NO: 30290 - RNA, 20 nt, Artificial Sequence
  CIITA targeting sequence
auuuugaaauuauagaaaua

SEQ ID NO: 30291 - RNA, 20 nt, Artificial Sequence
  CIITA targeting sequence
aaaaucuauuuugaaauuau

SEQ ID NO: 30292 - RNA, 20 nt, Artificial Sequence
  CIITA targeting sequence
cuaaaaucuauuuugaaauu

SEQ ID NO: 30293 - RNA, 20 nt, Artificial Sequence
  CIITA targeting sequence
ccggcucucuaaaaucuauu

SEQ ID NO: 30294 - RNA, 20 nt, Artificial Sequence
  CIITA targeting sequence
uuuggggaguugugggggga

SEQ ID NO: 30295 - RNA, 20 nt, Artificial Sequence
  CIITA targeting sequence
uuuucuuuuggggaguugug

SEQ ID NO: 30296 - RNA, 20 nt, Artificial Sequence
  CIITA targeting sequence
aaccccacaaacaaaaccag

SEQ ID NO: 30297 - RNA, 20 nt, Artificial Sequence
  CIITA targeting sequence
gacagcugagaccaaaauua

SEQ ID NO: 30298 - RNA, 20 nt, Artificial Sequence
  CIITA targeting sequence
gagcugguuuuguuuguggg

SEQ ID NO: 30299 - RNA, 20 nt, Artificial Sequence
  CIITA targeting sequence
gcugucagagcugguuuugu

SEQ ID NO: 30300 - RNA, 20 nt, Artificial Sequence
  CIITA targeting sequence
cagcugucagagcugguuuu

SEQ ID NO: 30301 - RNA, 20 nt, Artificial Sequence
  CIITA targeting sequence
aauuuuggucucagcuguca

SEQ ID NO: 30302 - RNA, 20 nt, Artificial Sequence
  CIITA targeting sequence
aagaaaucugucuguggcag

SEQ ID NO: 30303 - RNA, 20 nt, Artificial Sequence
  CIITA targeting sequence
uagaucuaauuuuggucuca

SEQ ID NO: 30304 - RNA, 20 nt, Artificial Sequence
  CIITA targeting sequence
accccauuuuacagaaaaga

SEQ ID NO: 30305 - RNA, 20 nt, Artificial Sequence
  CIITA targeting sequence
guaaaaugggguugauguug

SEQ ID NO: 30306 - RNA, 20 nt, Artificial Sequence
  CIITA targeting sequence
uuucuguaaaaugggguuga

SEQ ID NO: 30307 - RNA, 20 nt, Artificial Sequence
  CIITA targeting sequence
ggguacccacuuuucuuuuc

SEQ ID NO: 30308 - RNA, 20 nt, Artificial Sequence
  CIITA targeting sequence
uggucacuguucaaguucaa

SEQ ID NO: 30309 - RNA, 20 nt, Artificial Sequence
  CIITA targeting sequence
cuguucaaguucaaggucac

SEQ ID NO: 30310 - RNA, 20 nt, Artificial Sequence
  CIITA targeting sequence
aguucaaggucacugugagu

SEQ ID NO: 30311 - RNA, 20 nt, Artificial Sequence
  CIITA targeting sequence
guuacaccauuuuacaaucc

SEQ ID NO: 30312 - RNA, 20 nt, Artificial Sequence
  CIITA targeting sequence
acaucaguuacaccauuuua

SEQ ID NO: 30313 - RNA, 20 nt, Artificial Sequence
  CIITA targeting sequence
ucaaaaaauuaaaaauagaa

SEQ ID NO: 30314 - RNA, 20 nt, Artificial Sequence
  CIITA targeting sequence
aaaaauuaaaaauagaacua

SEQ ID NO: 30315 - RNA, 20 nt, Artificial Sequence
  CIITA targeting sequence
auuuuuaauuuuuugaggaa

SEQ ID NO: 30316 - RNA, 20 nt, Artificial Sequence
  CIITA targeting sequence
uaugguaguucuauuuuuaa

SEQ ID NO: 30317 - RNA, 20 nt, Artificial Sequence
  CIITA targeting sequence
agcaaucccacuugugggua

SEQ ID NO: 30318 - RNA, 20 nt, Artificial Sequence
  CIITA targeting sequence
cacuuguggguauauggcca

SEQ ID NO: 30319 - RNA, 20 nt, Artificial Sequence
  CIITA targeting sequence
uuuggccauauacccacaag

SEQ ID NO: 30320 - RNA, 20 nt, Artificial Sequence
  CIITA targeting sequence
auucuuuuggccauauaccc

SEQ ID NO: 30321 - RNA, 20 nt, Artificial Sequence
  CIITA targeting sequence
gcuuucaauucuuuuggcca

SEQ ID NO: 30322 - RNA, 20 nt, Artificial Sequence
  CIITA targeting sequence
caaaaagagauuugcauacc

SEQ ID NO: 30323 - RNA, 20 nt, Artificial Sequence
  CIITA targeting sequence
aaaagagauuugcauaccca

SEQ ID NO: 30324 - RNA, 20 nt, Artificial Sequence
  CIITA targeting sequence
uuuugagauucugcuuucaa

SEQ ID NO: 30325 - RNA, 20 nt, Artificial Sequence
  CIITA targeting sequence
cuuuuugagauucugcuuuc

SEQ ID NO: 30326 - RNA, 20 nt, Artificial Sequence
  CIITA targeting sequence
cccagccccugguaaauacc

SEQ ID NO: 30327 - RNA, 20 nt, Artificial Sequence
  CIITA targeting sequence
uucccccagccccugguaaa

SEQ ID NO: 30328 - RNA, 20 nt, Artificial Sequence
  CIITA targeting sequence
ccuucccccagccccuggua

SEQ ID NO: 30329 - RNA, 20 nt, Artificial Sequence
  CIITA targeting sequence
gugccguuuaacaacucucc

SEQ ID NO: 30330 - RNA, 20 nt, Artificial Sequence
  CIITA targeting sequence
guuuugcaagaugaaaacac

SEQ ID NO: 30331 - RNA, 20 nt, Artificial Sequence
  CIITA targeting sequence
ugcaaaacugaaacucugug

SEQ ID NO: 30332 - RNA, 20 nt, Artificial Sequence
  CIITA targeting sequence
ucuugcaaaacugaaacucu

SEQ ID NO: 30333 - RNA, 20 nt, Artificial Sequence
  CIITA targeting sequence
guuucacaacgugacuauac

SEQ ID NO: 30334 - RNA, 20 nt, Artificial Sequence
  CIITA targeting sequence
caacgugacuauacuugaac

SEQ ID NO: 30335 - RNA, 20 nt, Artificial Sequence
  CIITA targeting sequence
caggccccccaccgcaacac

SEQ ID NO: 30336 - RNA, 20 nt, Artificial Sequence
  CIITA targeting sequence
cugaccuggaaccagggaca

SEQ ID NO: 30337 - RNA, 20 nt, Artificial Sequence
  CIITA targeting sequence
gugaggugcaguguugcggu

SEQ ID NO: 30338 - RNA, 20 nt, Artificial Sequence
  CIITA targeting sequence
aggucagugaggugcagugu

SEQ ID NO: 30339 - RNA, 20 nt, Artificial Sequence
  CIITA targeting sequence
cugguuccaggucagugagg

SEQ ID NO: 30340 - RNA, 20 nt, Artificial Sequence
  CIITA targeting sequence
gucccugguuccaggucagu

SEQ ID NO: 30341 - RNA, 20 nt, Artificial Sequence
  CIITA targeting sequence
uucugucccugguuccaggu

SEQ ID NO: 30342 - RNA, 20 nt, Artificial Sequence
  CIITA targeting sequence
gcucuuucugucccugguuc

SEQ ID NO: 30343 - RNA, 20 nt, Artificial Sequence
  CIITA targeting sequence
cugcucuuucugucccuggu

SEQ ID NO: 30344 - RNA, 20 nt, Artificial Sequence
  CIITA targeting sequence
ggucucugcucuuucugucc

SEQ ID NO: 30345 - RNA, 20 nt, Artificial Sequence
  CIITA targeting sequence
auccccagggcuuagcccag

SEQ ID NO: 30346 - RNA, 20 nt, Artificial Sequence
  CIITA targeting sequence
gccugacuucaccacguggu

SEQ ID NO: 30347 - RNA, 20 nt, Artificial Sequence
  CIITA targeting sequence
ccauuuuaccgacuggccaa

SEQ ID NO: 30348 - RNA, 20 nt, Artificial Sequence
  CIITA targeting sequence
guaaaauggggauaauugua

SEQ ID NO: 30349 - RNA, 20 nt, Artificial Sequence
  CIITA targeting sequence
auuggccagucgguaaaaug

SEQ ID NO: 30350 - RNA, 20 nt, Artificial Sequence
  CIITA targeting sequence
ccuuacuuugcugggccucc

SEQ ID NO: 30351 - RNA, 20 nt, Artificial Sequence
  CIITA targeting sequence
aaaaaucacaaagccagaaa

SEQ ID NO: 30352 - RNA, 20 nt, Artificial Sequence
  CIITA targeting sequence
caaagccagaaagugauaaa

SEQ ID NO: 30353 - RNA, 20 nt, Artificial Sequence
  CIITA targeting sequence
ggcauugccaaauauccucu

SEQ ID NO: 30354 - RNA, 20 nt, Artificial Sequence
  CIITA targeting sequence
caggcauugccaaauauccu

SEQ ID NO: 30355 - RNA, 20 nt, Artificial Sequence
  CIITA targeting sequence
auaaagucucaggcauugcc

SEQ ID NO: 30356 - RNA, 20 nt, Artificial Sequence
  CIITA targeting sequence
ggugaauagaggccaggaau

SEQ ID NO: 30357 - RNA, 20 nt, Artificial Sequence
  CIITA targeting sequence
ccagaugccaguagcagccc

SEQ ID NO: 30358 - RNA, 20 nt, Artificial Sequence
  CIITA targeting sequence
auucaccagaugccaguagc

SEQ ID NO: 30359 - RNA, 20 nt, Artificial Sequence
  CIITA targeting sequence
uggccucuauucaccagaug

SEQ ID NO: 30360 - RNA, 20 nt, Artificial Sequence
  CIITA targeting sequence
uauguguucaauuucuauug

SEQ ID NO: 30361 - RNA, 20 nt, Artificial Sequence
  CIITA targeting sequence
gauguucuagaagauucuuu

SEQ ID NO: 30362 - RNA, 20 nt, Artificial Sequence
  CIITA targeting sequence
gaacucauauguguucaauu

SEQ ID NO: 30363 - RNA, 20 nt, Artificial Sequence
  CIITA targeting sequence
agaagauucuuuacccagga

SEQ ID NO: 30364 - RNA, 20 nt, Artificial Sequence
  CIITA targeting sequence
agaacaucugaacucauaug

SEQ ID NO: 30365 - RNA, 20 nt, Artificial Sequence
  CIITA targeting sequence
ucuagaacaucugaacucau

SEQ ID NO: 30366 - RNA, 20 nt, Artificial Sequence
  CIITA targeting sequence
uuacccaggauuccaguucu

SEQ ID NO: 30367 - RNA, 20 nt, Artificial Sequence
  CIITA targeting sequence
uggguaaagaaucuucuaga

SEQ ID NO: 30368 - RNA, 20 nt, Artificial Sequence
  CIITA targeting sequence
aguucuuuuggaaucuucau

SEQ ID NO: 30369 - RNA, 20 nt, Artificial Sequence
  CIITA targeting sequence
uuuggaaucuucauuugcag

SEQ ID NO: 30370 - RNA, 20 nt, Artificial Sequence
  CIITA targeting sequence
aaaagaacuggaauccuggg

SEQ ID NO: 30371 - RNA, 20 nt, Artificial Sequence
  CIITA targeting sequence
ucauuugcagugucuucccu

SEQ ID NO: 30372 - RNA, 20 nt, Artificial Sequence
  CIITA targeting sequence
uuugcagugucuucccuuaa

SEQ ID NO: 30373 - RNA, 20 nt, Artificial Sequence
  CIITA targeting sequence
ucccuuaaagauaaucauug

SEQ ID NO: 30374 - RNA, 20 nt, Artificial Sequence
  CIITA targeting sequence
cuuaaagauaaucauuggcc

SEQ ID NO: 30375 - RNA, 20 nt, Artificial Sequence
  CIITA targeting sequence
uuaagggaagacacugcaaa

SEQ ID NO: 30376 - RNA, 20 nt, Artificial Sequence
  CIITA targeting sequence
uuggccauuauggugggaug

SEQ ID NO: 30377 - RNA, 20 nt, Artificial Sequence
  CIITA targeting sequence
caccauaauggccaaugauu

SEQ ID NO: 30378 - RNA, 20 nt, Artificial Sequence
  CIITA targeting sequence
ucccaccauaauggccaaug

SEQ ID NO: 30379 - RNA, 20 nt, Artificial Sequence
  CIITA targeting sequence
gaaaauauccagguccugga

SEQ ID NO: 30380 - RNA, 20 nt, Artificial Sequence
  CIITA targeting sequence
gaggcuauuauucaucccac

SEQ ID NO: 30381 - RNA, 20 nt, Artificial Sequence
  CIITA targeting sequence
agguccuggaugggugcagu

SEQ ID NO: 30382 - RNA, 20 nt, Artificial Sequence
  CIITA targeting sequence
uggaugggugcaguggcuca

SEQ ID NO: 30383 - RNA, 20 nt, Artificial Sequence
  CIITA targeting sequence
aggaccuggauauuuucgga

SEQ ID NO: 30384 - RNA, 20 nt, Artificial Sequence
  CIITA targeting sequence
ugccuguaaucccaaggcuu

SEQ ID NO: 30385 - RNA, 20 nt, Artificial Sequence
  CIITA targeting sequence
caaggcuuuaagaggcugac

SEQ ID NO: 30386 - RNA, 20 nt, Artificial Sequence
  CIITA targeting sequence
cugugccucuuucuuuuuuu

SEQ ID NO: 30387 - RNA, 20 nt, Artificial Sequence
  CIITA targeting sequence
cacacacacacacacacaca

SEQ ID NO: 30388 - RNA, 20 nt, Artificial Sequence
  CIITA targeting sequence
ccugaccauggaacagagag

SEQ ID NO: 30389 - RNA, 20 nt, Artificial Sequence
  CIITA targeting sequence
ggugacgugugugugugugu

SEQ ID NO: 30390 - RNA, 20 nt, Artificial Sequence
  CIITA targeting sequence
auggucaggugacgugugug

SEQ ID NO: 30391 - RNA, 20 nt, Artificial Sequence
  CIITA targeting sequence
guuccauggucaggugacgu

SEQ ID NO: 30392 - RNA, 20 nt, Artificial Sequence
  CIITA targeting sequence
cuguuccauggucaggugac

SEQ ID NO: 30393 - RNA, 20 nt, Artificial Sequence
  CIITA targeting sequence
cucuguuccauggucaggug

SEQ ID NO: 30394 - RNA, 20 nt, Artificial Sequence
  CIITA targeting sequence
cucucuguuccauggucagg

SEQ ID NO: 30395 - RNA, 20 nt, Artificial Sequence
  CIITA targeting sequence
ccaaagcugcaaauucauuc

SEQ ID NO: 30396 - RNA, 20 nt, Artificial Sequence
  CIITA targeting sequence
ggcguuccccaaagcugcaa

SEQ ID NO: 30397 - RNA, 20 nt, Artificial Sequence
  CIITA targeting sequence
aucccaacacaccugaucuu

SEQ ID NO: 30398 - RNA, 20 nt, Artificial Sequence
  CIITA targeting sequence
caacacaccugaucuuggcu

SEQ ID NO: 30399 - RNA, 20 nt, Artificial Sequence
  CIITA targeting sequence
gguguguugggauggagcuu

SEQ ID NO: 30400 - RNA, 20 nt, Artificial Sequence
  CIITA targeting sequence
uggcuuuccuaaaggccagc

SEQ ID NO: 30401 - RNA, 20 nt, Artificial Sequence
  CIITA targeting sequence
uaaaggccagcuccuccucg

SEQ ID NO: 30402 - RNA, 20 nt, Artificial Sequence
  CIITA targeting sequence
uccucguuuccaaaguccag

SEQ ID NO: 30403 - RNA, 20 nt, Artificial Sequence
  CIITA targeting sequence
ucguuuccaaaguccaggga

SEQ ID NO: 30404 - RNA, 20 nt, Artificial Sequence
  CIITA targeting sequence
uuuccaaaguccagggacac

SEQ ID NO: 30405 - RNA, 20 nt, Artificial Sequence
  CIITA targeting sequence
aaaguccagggacacauccu

SEQ ID NO: 30406 - RNA, 20 nt, Artificial Sequence
  CIITA targeting sequence
agggacacauccucgguauc

SEQ ID NO: 30407 - RNA, 20 nt, Artificial Sequence
  CIITA targeting sequence
cuggacuuuggaaacgagga

SEQ ID NO: 30408 - RNA, 20 nt, Artificial Sequence
  CIITA targeting sequence
ucgguaucguccaccagggc

SEQ ID NO: 30409 - RNA, 20 nt, Artificial Sequence
  CIITA targeting sequence
guaucguccaccagggccug

SEQ ID NO: 30410 - RNA, 20 nt, Artificial Sequence
  CIITA targeting sequence
uccaccagggccugggagga

SEQ ID NO: 30411 - RNA, 20 nt, Artificial Sequence
  CIITA targeting sequence
accagggccugggaggagag

SEQ ID NO: 30412 - RNA, 20 nt, Artificial Sequence
  CIITA targeting sequence
caggcccugguggacgauac

SEQ ID NO: 30413 - RNA, 20 nt, Artificial Sequence
  CIITA targeting sequence
ucccaggcccugguggacga

SEQ ID NO: 30414 - RNA, 20 nt, Artificial Sequence
  CIITA targeting sequence
ccucccaggcccugguggac

SEQ ID NO: 30415 - RNA, 20 nt, Artificial Sequence
  CIITA targeting sequence
agccccagcauccccgaggc

SEQ ID NO: 30416 - RNA, 20 nt, Artificial Sequence
  CIITA targeting sequence
ccgaggcccuaccugcuuca

SEQ ID NO: 30417 - RNA, 20 nt, Artificial Sequence
  CIITA targeting sequence
gggaugcuggggcuggaggc

SEQ ID NO: 30418 - RNA, 20 nt, Artificial Sequence
  CIITA targeting sequence
ucacccucccaggagcccac

SEQ ID NO: 30419 - RNA, 20 nt, Artificial Sequence
  CIITA targeting sequence
cccucccaggagcccaccug

SEQ ID NO: 30420 - RNA, 20 nt, Artificial Sequence
  CIITA targeting sequence
caggagcccaccuggcgccc

SEQ ID NO: 30421 - RNA, 20 nt, Artificial Sequence
  CIITA targeting sequence
ugggagggugaugaagcagg

SEQ ID NO: 30422 - RNA, 20 nt, Artificial Sequence
  CIITA targeting sequence
gcgcagcuucucgggugggg

SEQ ID NO: 30423 - RNA, 20 nt, Artificial Sequence
  CIITA targeting sequence
cggguggggcggggcgcucg

SEQ ID NO: 30424 - RNA, 20 nt, Artificial Sequence
  CIITA targeting sequence
gguggggcggggcgcucggg

SEQ ID NO: 30425 - RNA, 20 nt, Artificial Sequence
  CIITA targeting sequence
gggccuaaggcgcagucgca

SEQ ID NO: 30426 - RNA, 20 nt, Artificial Sequence
  CIITA targeting sequence
caggcuggggagggggcucg

SEQ ID NO: 30427 - RNA, 20 nt, Artificial Sequence
  CIITA targeting sequence
ccagccugcgacugcgccuu

SEQ ID NO: 30428 - RNA, 20 nt, Artificial Sequence
  CIITA targeting sequence
gcucgccggggacgcgccca

SEQ ID NO: 30429 - RNA, 20 nt, Artificial Sequence
  CIITA targeting sequence
ccggggacgcgcccaggaga

SEQ ID NO: 30430 - RNA, 20 nt, Artificial Sequence
  CIITA targeting sequence
ccggcgagccgagcccccuc

SEQ ID NO: 30431 - RNA, 20 nt, Artificial Sequence
  CIITA targeting sequence
ugggcgcguccccggcgagc

SEQ ID NO: 30432 - RNA, 20 nt, Artificial Sequence
  CIITA targeting sequence
ccugggcgcguccccggcga

SEQ ID NO: 30433 - RNA, 20 nt, Artificial Sequence
  CIITA targeting sequence
cuccugggcgcguccccggc

SEQ ID NO: 30434 - RNA, 20 nt, Artificial Sequence
  CIITA targeting sequence
auaauaguauuaauacuacu

SEQ ID NO: 30435 - RNA, 20 nt, Artificial Sequence
  CIITA targeting sequence
ugaagugaaagucuuccugg

SEQ ID NO: 30436 - RNA, 20 nt, Artificial Sequence
  CIITA targeting sequence
agaaacacuacuauuacugu

SEQ ID NO: 30437 - RNA, 20 nt, Artificial Sequence
  CIITA targeting sequence
cuucaagaaacacuacuauu

SEQ ID NO: 30438 - RNA, 20 nt, Artificial Sequence
  CIITA targeting sequence
uccuggguaccucccaggaa

SEQ ID NO: 30439 - RNA, 20 nt, Artificial Sequence
  CIITA targeting sequence
uggguaccucccaggaaaga

SEQ ID NO: 30440 - RNA, 20 nt, Artificial Sequence
  CIITA targeting sequence
caggaaagaaaacuugucac

SEQ ID NO: 30441 - RNA, 20 nt, Artificial Sequence
  CIITA targeting sequence
ugggagguacccaggaagac

SEQ ID NO: 30442 - RNA, 20 nt, Artificial Sequence
  CIITA targeting sequence
uuccugggagguacccagga

SEQ ID NO: 30443 - RNA, 20 nt, Artificial Sequence
  CIITA targeting sequence
ccugagggucuuuccuggcc

SEQ ID NO: 30444 - RNA, 20 nt, Artificial Sequence
  CIITA targeting sequence
ggugacaaguuuucuuuccu

SEQ ID NO: 30445 - RNA, 20 nt, Artificial Sequence
  CIITA targeting sequence
uuccuggcccaggacacagu

SEQ ID NO: 30446 - RNA, 20 nt, Artificial Sequence
  CIITA targeting sequence
uggcccaggacacagugacu

SEQ ID NO: 30447 - RNA, 20 nt, Artificial Sequence
  CIITA targeting sequence
ugggccaggaaagacccuca

SEQ ID NO: 30448 - RNA, 20 nt, Artificial Sequence
  CIITA targeting sequence
cuguguccugggccaggaaa

SEQ ID NO: 30449 - RNA, 20 nt, Artificial Sequence
  CIITA targeting sequence
ccucuccugcgugcccucuc

SEQ ID NO: 30450 - RNA, 20 nt, Artificial Sequence
  CIITA targeting sequence
ucuccugcgugcccucuccc

SEQ ID NO: 30451 - RNA, 20 nt, Artificial Sequence
  CIITA targeting sequence
ccugcgugcccucucccugu

SEQ ID NO: 30452 - RNA, 20 nt, Artificial Sequence
  CIITA targeting sequence
ugcgugcccucucccugucc

SEQ ID NO: 30453 - RNA, 20 nt, Artificial Sequence
  CIITA targeting sequence
cccuguccugaucccccacc

SEQ ID NO: 30454 - RNA, 20 nt, Artificial Sequence
  CIITA targeting sequence
cuguccugaucccccaccca

SEQ ID NO: 30455 - RNA, 20 nt, Artificial Sequence
  CIITA targeting sequence
ugaucccccacccacggaca

SEQ ID NO: 30456 - RNA, 20 nt, Artificial Sequence
  CIITA targeting sequence
ggacagggagagggcacgca

SEQ ID NO: 30457 - RNA, 20 nt, Artificial Sequence
  CIITA targeting sequence
cccacccacggacagagggc

SEQ ID NO: 30458 - RNA, 20 nt, Artificial Sequence
  CIITA targeting sequence
gugggugggggaucaggaca

SEQ ID NO: 30459 - RNA, 20 nt, Artificial Sequence
  CIITA targeting sequence
guccgugggugggggaucag

SEQ ID NO: 30460 - RNA, 20 nt, Artificial Sequence
  CIITA targeting sequence
gcccucuguccguggguggg

SEQ ID NO: 30461 - RNA, 20 nt, Artificial Sequence
  CIITA targeting sequence
agaugccaaagccagugacc

SEQ ID NO: 30462 - RNA, 20 nt, Artificial Sequence
  CIITA targeting sequence
augcucagcccucuguccgu

SEQ ID NO: 30463 - RNA, 20 nt, Artificial Sequence
  CIITA targeting sequence
cgaugcucagcccucugucc

SEQ ID NO: 30464 - RNA, 20 nt, Artificial Sequence
  CIITA targeting sequence
cuggcuuuggcaucucgaug

SEQ ID NO: 30465 - RNA, 20 nt, Artificial Sequence
  CIITA targeting sequence
caccauggacaauagguacg

SEQ ID NO: 30466 - RNA, 20 nt, Artificial Sequence
  CIITA targeting sequence
auggugggagggcaaagggc

SEQ ID NO: 30467 - RNA, 20 nt, Artificial Sequence
  CIITA targeting sequence
ccugccccuggugaccccaa

SEQ ID NO: 30468 - RNA, 20 nt, Artificial Sequence
  CIITA targeting sequence
ccaggggcaggggacacgua

SEQ ID NO: 30469 - RNA, 20 nt, Artificial Sequence
  CIITA targeting sequence
uuggggucaccaggggcagg

SEQ ID NO: 30470 - RNA, 20 nt, Artificial Sequence
  CIITA targeting sequence
ugggccacaagccccugaca

SEQ ID NO: 30471 - RNA, 20 nt, Artificial Sequence
  CIITA targeting sequence
ggggcuuguggcccaggagc

SEQ ID NO: 30472 - RNA, 20 nt, Artificial Sequence
  CIITA targeting sequence
ccacugcuggucuccauggg

SEQ ID NO: 30473 - RNA, 20 nt, Artificial Sequence
  CIITA targeting sequence
ccaugggcggagguggaggc

SEQ ID NO: 30474 - RNA, 20 nt, Artificial Sequence
  CIITA targeting sequence
augggcggagguggaggcag

SEQ ID NO: 30475 - RNA, 20 nt, Artificial Sequence
  CIITA targeting sequence
gcccauggagaccagcagug

SEQ ID NO: 30476 - RNA, 20 nt, Artificial Sequence
  CIITA targeting sequence
accuccgcccauggagacca

SEQ ID NO: 30477 - RNA, 20 nt, Artificial Sequence
  CIITA targeting sequence
ugccuccaccuccgcccaug

SEQ ID NO: 30478 - RNA, 20 nt, Artificial Sequence
  CIITA targeting sequence
caucucugauccugggccug

SEQ ID NO: 30479 - RNA, 20 nt, Artificial Sequence
  CIITA targeting sequence
ucucugauccugggccuggg

SEQ ID NO: 30480 - RNA, 20 nt, Artificial Sequence
  CIITA targeting sequence
cugauccugggccuggguuc

SEQ ID NO: 30481 - RNA, 20 nt, Artificial Sequence
  CIITA targeting sequence
gauccugggccuggguucca

SEQ ID NO: 30482 - RNA, 20 nt, Artificial Sequence
  CIITA targeting sequence
gagaugagacagcuccugcc

SEQ ID NO: 30483 - RNA, 20 nt, Artificial Sequence
  CIITA targeting sequence
ugggccuggguuccaggcuu

SEQ ID NO: 30484 - RNA, 20 nt, Artificial Sequence
  CIITA targeting sequence
aggcuuucuguccuccgccc

SEQ ID NO: 30485 - RNA, 20 nt, Artificial Sequence
  CIITA targeting sequence
guccuccgcccccaccccaa

SEQ ID NO: 30486 - RNA, 20 nt, Artificial Sequence
  CIITA targeting sequence
uccgcccccaccccaauucc

SEQ ID NO: 30487 - RNA, 20 nt, Artificial Sequence
  CIITA targeting sequence
gcccccaccccaauucccua

SEQ ID NO: 30488 - RNA, 20 nt, Artificial Sequence
  CIITA targeting sequence
cuaagcugaccccacaaggg

SEQ ID NO: 30489 - RNA, 20 nt, Artificial Sequence
  CIITA targeting sequence
gcuuagggaauugggguggg

SEQ ID NO: 30490 - RNA, 20 nt, Artificial Sequence
  CIITA targeting sequence
acacacaccuggcaggcccu

SEQ ID NO: 30491 - RNA, 20 nt, Artificial Sequence
  CIITA targeting sequence
cuccacacacaccuggcagg

SEQ ID NO: 30492 - RNA, 20 nt, Artificial Sequence
  CIITA targeting sequence
ccuaugccauuucucuuuuu

SEQ ID NO: 30493 - RNA, 20 nt, Artificial Sequence
  CIITA targeting sequence
uaugccauuucucuuuuuuu

SEQ ID NO: 30494 - RNA, 20 nt, Artificial Sequence
  CIITA targeting sequence
cuuuuuuuuuuuuuuugaga

SEQ ID NO: 30495 - RNA, 20 nt, Artificial Sequence
  CIITA targeting sequence
uuuuuuuuuuuuuugagaug

SEQ ID NO: 30496 - RNA, 20 nt, Artificial Sequence
  CIITA targeting sequence
aaaaaaaaaaaaaagagaaa

SEQ ID NO: 30497 - RNA, 20 nt, Artificial Sequence
  CIITA targeting sequence
caaaaaaaaaaaaaaagaga

SEQ ID NO: 30498 - RNA, 20 nt, Artificial Sequence
  CIITA targeting sequence
aucucaaaaaaaaaaaaaaa

SEQ ID NO: 30499 - RNA, 20 nt, Artificial Sequence
  CIITA targeting sequence
cucuugucacccaggcugga

SEQ ID NO: 30500 - RNA, 20 nt, Artificial Sequence
  CIITA targeting sequence
ugucacccaggcuggagugc

SEQ ID NO: 30501 - RNA, 20 nt, Artificial Sequence
  CIITA targeting sequence
cccaggcuggagugcaaugg

SEQ ID NO: 30502 - RNA, 20 nt, Artificial Sequence
  CIITA targeting sequence
agccugggugacaagaggga

SEQ ID NO: 30503 - RNA, 20 nt, Artificial Sequence
  CIITA targeting sequence
caccauugcacuccagccug

SEQ ID NO: 30504 - RNA, 20 nt, Artificial Sequence
  CIITA targeting sequence
cggcucacugcaaccccugc

SEQ ID NO: 30505 - RNA, 20 nt, Artificial Sequence
  CIITA targeting sequence
gcucacugcaaccccugccu

SEQ ID NO: 30506 - RNA, 20 nt, Artificial Sequence
  CIITA targeting sequence
cugcaaccccugccucccgg

SEQ ID NO: 30507 - RNA, 20 nt, Artificial Sequence
  CIITA targeting sequence
cggguuccugcaauucuccu

SEQ ID NO: 30508 - RNA, 20 nt, Artificial Sequence
  CIITA targeting sequence
ugcaauucuccugccucagc

SEQ ID NO: 30509 - RNA, 20 nt, Artificial Sequence
  CIITA targeting sequence
ccugccucagccucccaggu

SEQ ID NO: 30510 - RNA, 20 nt, Artificial Sequence
  CIITA targeting sequence
ugccucagccucccagguag

SEQ ID NO: 30511 - RNA, 20 nt, Artificial Sequence
  CIITA targeting sequence
gccucccagguagcugguau

SEQ ID NO: 30512 - RNA, 20 nt, Artificial Sequence
  CIITA targeting sequence
cagguagcugguauuacagg

SEQ ID NO: 30513 - RNA, 20 nt, Artificial Sequence
  CIITA targeting sequence
ggcgccuguaauaccagcua

SEQ ID NO: 30514 - RNA, 20 nt, Artificial Sequence
  CIITA targeting sequence
acccggguaauuuuuguauu

SEQ ID NO: 30515 - RNA, 20 nt, Artificial Sequence
  CIITA targeting sequence
acuaaaaauacaaaauacaa

SEQ ID NO: 30516 - RNA, 20 nt, Artificial Sequence
  CIITA targeting sequence
cuacuaaaaauacaaaauac

SEQ ID NO: 30517 - RNA, 20 nt, Artificial Sequence
  CIITA targeting sequence
ccauguuggccaggcugguc

SEQ ID NO: 30518 - RNA, 20 nt, Artificial Sequence
  CIITA targeting sequence
ccaacuccugaccgcaggug

SEQ ID NO: 30519 - RNA, 20 nt, Artificial Sequence
  CIITA targeting sequence
aacuccugaccgcaggugau

SEQ ID NO: 30520 - RNA, 20 nt, Artificial Sequence
  CIITA targeting sequence
ugaccgcaggugauccaccc

SEQ ID NO: 30521 - RNA, 20 nt, Artificial Sequence
  CIITA targeting sequence
ggaguuggagaccagccugg

SEQ ID NO: 30522 - RNA, 20 nt, Artificial Sequence
  CIITA targeting sequence
ccugcggucaggaguuggag

SEQ ID NO: 30523 - RNA, 20 nt, Artificial Sequence
  CIITA targeting sequence
acccaccuuggccucccaaa

SEQ ID NO: 30524 - RNA, 20 nt, Artificial Sequence
  CIITA targeting sequence
caaagagcugggauuacagg

SEQ ID NO: 30525 - RNA, 20 nt, Artificial Sequence
  CIITA targeting sequence
uugggaggccaaggugggug

SEQ ID NO: 30526 - RNA, 20 nt, Artificial Sequence
  CIITA targeting sequence
cagcucuuugggaggccaag

SEQ ID NO: 30527 - RNA, 20 nt, Artificial Sequence
  CIITA targeting sequence
ugccuguaaucccagcucuu

SEQ ID NO: 30528 - RNA, 20 nt, Artificial Sequence
  CIITA targeting sequence
acuaugcgaucuucaggaac

SEQ ID NO: 30529 - RNA, 20 nt, Artificial Sequence
  CIITA targeting sequence
cauaguagaggcugggugca

SEQ ID NO: 30530 - RNA, 20 nt, Artificial Sequence
  CIITA targeting sequence
ucaggaaccaagauuuauau

SEQ ID NO: 30531 - RNA, 20 nt, Artificial Sequence
  CIITA targeting sequence
ggaaccaagauuuauauaua

SEQ ID NO: 30532 - RNA, 20 nt, Artificial Sequence
  CIITA targeting sequence
ugaagaucgcauaguagagg

SEQ ID NO: 30533 - RNA, 20 nt, Artificial Sequence
  CIITA targeting sequence
ugguuccugaagaucgcaua

SEQ ID NO: 30534 - RNA, 20 nt, Artificial Sequence
  CIITA targeting sequence
gcugcgauuuggauagcuuc

SEQ ID NO: 30535 - RNA, 20 nt, Artificial Sequence
  CIITA targeting sequence
cagcagaguuuggcaaauau

SEQ ID NO: 30536 - RNA, 20 nt, Artificial Sequence
  CIITA targeting sequence
aaaucgcagcagaguuuggc

SEQ ID NO: 30537 - RNA, 20 nt, Artificial Sequence
  CIITA targeting sequence
aaaagacacacugcccagau

SEQ ID NO: 30538 - RNA, 20 nt, Artificial Sequence
  CIITA targeting sequence
uuuagaagcuauccaaaucg

SEQ ID NO: 30539 - RNA, 20 nt, Artificial Sequence
  CIITA targeting sequence
gggcagugugucuuuuagaa

SEQ ID NO: 30540 - RNA, 20 nt, Artificial Sequence
  CIITA targeting sequence
auaacacaaucugggcagug

SEQ ID NO: 30541 - RNA, 20 nt, Artificial Sequence
  CIITA targeting sequence
ggcucucuggggaugggacc

SEQ ID NO: 30542 - RNA, 20 nt, Artificial Sequence
  CIITA targeting sequence
cuggggaugggacccuauac

SEQ ID NO: 30543 - RNA, 20 nt, Artificial Sequence
  CIITA targeting sequence
ggggaugggacccuauacca

SEQ ID NO: 30544 - RNA, 20 nt, Artificial Sequence
  CIITA targeting sequence
ccagagagccugauuuaauu

SEQ ID NO: 30545 - RNA, 20 nt, Artificial Sequence
  CIITA targeting sequence
cauccccagagagccugauu

SEQ ID NO: 30546 - RNA, 20 nt, Artificial Sequence
  CIITA targeting sequence
cagguguugggcugcaaggu

SEQ ID NO: 30547 - RNA, 20 nt, Artificial Sequence
  CIITA targeting sequence
uuaccuugcagcccaacacc

SEQ ID NO: 30548 - RNA, 20 nt, Artificial Sequence
  CIITA targeting sequence
cugguucuuuaccuugcagc

SEQ ID NO: 30549 - RNA, 20 nt, Artificial Sequence
  CIITA targeting sequence
uuuaaaucacugguucuuua

SEQ ID NO: 30550 - RNA, 20 nt, Artificial Sequence
  CIITA targeting sequence
gaccccucaaucugcaaaug

SEQ ID NO: 30551 - RNA, 20 nt, Artificial Sequence
  CIITA targeting sequence
gaagcacucauuuaaaucac

SEQ ID NO: 30552 - RNA, 20 nt, Artificial Sequence
  CIITA targeting sequence
aucugcaaaugaaucuccug

SEQ ID NO: 30553 - RNA, 20 nt, Artificial Sequence
  CIITA targeting sequence
gcaaaugaaucuccuggggu

SEQ ID NO: 30554 - RNA, 20 nt, Artificial Sequence
  CIITA targeting sequence
uuugcagauugaggggucag

SEQ ID NO: 30555 - RNA, 20 nt, Artificial Sequence
  CIITA targeting sequence
ccugggguuggcuuagaagc

SEQ ID NO: 30556 - RNA, 20 nt, Artificial Sequence
  CIITA targeting sequence
ugggguuggcuuagaagcug

SEQ ID NO: 30557 - RNA, 20 nt, Artificial Sequence
  CIITA targeting sequence
aagccaaccccaggagauuc

SEQ ID NO: 30558 - RNA, 20 nt, Artificial Sequence
  CIITA targeting sequence
agcuucuaagccaaccccag

SEQ ID NO: 30559 - RNA, 20 nt, Artificial Sequence
  CIITA targeting sequence
gcauccagcuucuaagccaa

SEQ ID NO: 30560 - RNA, 20 nt, Artificial Sequence
  CIITA targeting sequence
gcguucugggggucuggggg

SEQ ID NO: 30561 - RNA, 20 nt, Artificial Sequence
  CIITA targeting sequence
gggggucugggggucugggc

SEQ ID NO: 30562 - RNA, 20 nt, Artificial Sequence
  CIITA targeting sequence
gggggucugggcaggggcug

SEQ ID NO: 30563 - RNA, 20 nt, Artificial Sequence
  CIITA targeting sequence
gggcaggggcugagauucuu

SEQ ID NO: 30564 - RNA, 20 nt, Artificial Sequence
  CIITA targeting sequence
gccccugcccagacccccag

SEQ ID NO: 30565 - RNA, 20 nt, Artificial Sequence
  CIITA targeting sequence
cagccccugcccagaccccc

SEQ ID NO: 30566 - RNA, 20 nt, Artificial Sequence
  CIITA targeting sequence
uucuuccuuucuuuccuucc

SEQ ID NO: 30567 - RNA, 20 nt, Artificial Sequence
  CIITA targeting sequence
uccuuucuuuccuuccuuuc

SEQ ID NO: 30568 - RNA, 20 nt, Artificial Sequence
  CIITA targeting sequence
uuucuuuccuuccuuucuuu

SEQ ID NO: 30569 - RNA, 20 nt, Artificial Sequence
  CIITA targeting sequence
uuccuuccuuucuuuucuuu

SEQ ID NO: 30570 - RNA, 20 nt, Artificial Sequence
  CIITA targeting sequence
uuccuuucuuuucuuuucuc

SEQ ID NO: 30571 - RNA, 20 nt, Artificial Sequence
  CIITA targeting sequence
uuucuuuucuuuucuccuuc

SEQ ID NO: 30572 - RNA, 20 nt, Artificial Sequence
  CIITA targeting sequence
uuucuuuucuccuuccuucc

SEQ ID NO: 30573 - RNA, 20 nt, Artificial Sequence
  CIITA targeting sequence
uuucuccuuccuuccuuccu

SEQ ID NO: 30574 - RNA, 20 nt, Artificial Sequence
  CIITA targeting sequence
ccuuccuuccuuccuuucuu

SEQ ID NO: 30575 - RNA, 20 nt, Artificial Sequence
  CIITA targeting sequence
uuccuuccuuccuuucuuuc

SEQ ID NO: 30576 - RNA, 20 nt, Artificial Sequence
  CIITA targeting sequence
uuccuuccuuucuuucuuuc

SEQ ID NO: 30577 - RNA, 20 nt, Artificial Sequence
  CIITA targeting sequence
uuccuuucuuucuuucuuga

SEQ ID NO: 30578 - RNA, 20 nt, Artificial Sequence
  CIITA targeting sequence
uuucuuucuuucuugagaug

SEQ ID NO: 30579 - RNA, 20 nt, Artificial Sequence
  CIITA targeting sequence
uucuuucuugagauggaguc

SEQ ID NO: 30580 - RNA, 20 nt, Artificial Sequence
  CIITA targeting sequence
uucuugagauggagucagug

SEQ ID NO: 30581 - RNA, 20 nt, Artificial Sequence
  CIITA targeting sequence
ugagauggagucaguggcua

SEQ ID NO: 30582 - RNA, 20 nt, Artificial Sequence
  CIITA targeting sequence
agaaagaaagaaaggaagga

SEQ ID NO: 30583 - RNA, 20 nt, Artificial Sequence
  CIITA targeting sequence
caagaaagaaagaaaggaag

SEQ ID NO: 30584 - RNA, 20 nt, Artificial Sequence
  CIITA targeting sequence
aucucaagaaagaaagaaag

SEQ ID NO: 30585 - RNA, 20 nt, Artificial Sequence
  CIITA targeting sequence
guggcuagaucucagcucac

SEQ ID NO: 30586 - RNA, 20 nt, Artificial Sequence
  CIITA targeting sequence
agccacugacuccaucucaa

SEQ ID NO: 30587 - RNA, 20 nt, Artificial Sequence
  CIITA targeting sequence
cagcucacugcaaccuccac

SEQ ID NO: 30588 - RNA, 20 nt, Artificial Sequence
  CIITA targeting sequence
gcucacugcaaccuccaccu

SEQ ID NO: 30589 - RNA, 20 nt, Artificial Sequence
  CIITA targeting sequence
cugcaaccuccaccuccugg

SEQ ID NO: 30590 - RNA, 20 nt, Artificial Sequence
  CIITA targeting sequence
accuccuggguucaagugau

SEQ ID NO: 30591 - RNA, 20 nt, Artificial Sequence
  CIITA targeting sequence
uggguucaagugauucuugu

SEQ ID NO: 30592 - RNA, 20 nt, Artificial Sequence
  CIITA targeting sequence
agugauucuugugccucagc

SEQ ID NO: 30593 - RNA, 20 nt, Artificial Sequence
  CIITA targeting sequence
cuugaacccaggagguggag

SEQ ID NO: 30594 - RNA, 20 nt, Artificial Sequence
  CIITA targeting sequence
ugugccucagccccuuaagu

SEQ ID NO: 30595 - RNA, 20 nt, Artificial Sequence
  CIITA targeting sequence
gccccuuaaguagcugggac

SEQ ID NO: 30596 - RNA, 20 nt, Artificial Sequence
  CIITA targeting sequence
cagcuacuuaaggggcugag

SEQ ID NO: 30597 - RNA, 20 nt, Artificial Sequence
  CIITA targeting sequence
uguagucccagcuacuuaag

SEQ ID NO: 30598 - RNA, 20 nt, Artificial Sequence
  CIITA targeting sequence
acuaaaaacacaaaaauuag

SEQ ID NO: 30599 - RNA, 20 nt, Artificial Sequence
  CIITA targeting sequence
cuacuaaaaacacaaaaauu

SEQ ID NO: 30600 - RNA, 20 nt, Artificial Sequence
  CIITA targeting sequence
ccauguuggccaggcugguc

SEQ ID NO: 30601 - RNA, 20 nt, Artificial Sequence
  CIITA targeting sequence
cgaacuccugaccucaagug

SEQ ID NO: 30602 - RNA, 20 nt, Artificial Sequence
  CIITA targeting sequence
aacuccugaccucaagugau

SEQ ID NO: 30603 - RNA, 20 nt, Artificial Sequence
  CIITA targeting sequence
agaccagccuggccaacaug

SEQ ID NO: 30604 - RNA, 20 nt, Artificial Sequence
  CIITA targeting sequence
ugaccucaagugaucugccu

SEQ ID NO: 30605 - RNA, 20 nt, Artificial Sequence
  CIITA targeting sequence
ggaguucgagaccagccugg

SEQ ID NO: 30606 - RNA, 20 nt, Artificial Sequence
  CIITA targeting sequence
agugaucugccugcuucagc

SEQ ID NO: 30607 - RNA, 20 nt, Artificial Sequence
  CIITA targeting sequence
cuugaggucaggaguucgag

SEQ ID NO: 30608 - RNA, 20 nt, Artificial Sequence
  CIITA targeting sequence
gccugcuucagccucccaaa

SEQ ID NO: 30609 - RNA, 20 nt, Artificial Sequence
  CIITA targeting sequence
gccucccaaaaggcuggaau

SEQ ID NO: 30610 - RNA, 20 nt, Artificial Sequence
  CIITA targeting sequence
caaaaggcuggaauuacagc

SEQ ID NO: 30611 - RNA, 20 nt, Artificial Sequence
  CIITA targeting sequence
agccuuuugggaggcugaag

SEQ ID NO: 30612 - RNA, 20 nt, Artificial Sequence
  CIITA targeting sequence
cggcuguaauuccagccuuu

SEQ ID NO: 30613 - RNA, 20 nt, Artificial Sequence
  CIITA targeting sequence
ggcugagauccugcauuucu

SEQ ID NO: 30614 - RNA, 20 nt, Artificial Sequence
  CIITA targeting sequence
gccggaugugguggcucacg

SEQ ID NO: 30615 - RNA, 20 nt, Artificial Sequence
  CIITA targeting sequence
cagccggaugugguggcuca

SEQ ID NO: 30616 - RNA, 20 nt, Artificial Sequence
  CIITA targeting sequence
ugcauuucugagagcccgug

SEQ ID NO: 30617 - RNA, 20 nt, Artificial Sequence
  CIITA targeting sequence
gagagcccgugggagaagcu

SEQ ID NO: 30618 - RNA, 20 nt, Artificial Sequence
  CIITA targeting sequence
gaaaugcaggaucucagccg

SEQ ID NO: 30619 - RNA, 20 nt, Artificial Sequence
  CIITA targeting sequence
cagaaaugcaggaucucagc

SEQ ID NO: 30620 - RNA, 20 nt, Artificial Sequence
  CIITA targeting sequence
cacgggcucucagaaaugca

SEQ ID NO: 30621 - RNA, 20 nt, Artificial Sequence
  CIITA targeting sequence
cccacgggcucucagaaaug

SEQ ID NO: 30622 - RNA, 20 nt, Artificial Sequence
  CIITA targeting sequence
gcuucucccacgggcucuca

SEQ ID NO: 30623 - RNA, 20 nt, Artificial Sequence
  CIITA targeting sequence
cuggaccacccuuugaauug

SEQ ID NO: 30624 - RNA, 20 nt, Artificial Sequence
  CIITA targeting sequence
agggagcagcagcaucagcu

SEQ ID NO: 30625 - RNA, 20 nt, Artificial Sequence
  CIITA targeting sequence
aagggugguccagggagcag

SEQ ID NO: 30626 - RNA, 20 nt, Artificial Sequence
  CIITA targeting sequence
uuacaauucaaagggugguc

SEQ ID NO: 30627 - RNA, 20 nt, Artificial Sequence
  CIITA targeting sequence
aaaccaccaaggccugguuu

SEQ ID NO: 30628 - RNA, 20 nt, Artificial Sequence
  CIITA targeting sequence
agaaaggccugugagcucuu

SEQ ID NO: 30629 - RNA, 20 nt, Artificial Sequence
  CIITA targeting sequence
agaaaaccaggccuuggugg

SEQ ID NO: 30630 - RNA, 20 nt, Artificial Sequence
  CIITA targeting sequence
caggccuuucuagaaaacca

SEQ ID NO: 30631 - RNA, 20 nt, Artificial Sequence
  CIITA targeting sequence
uccugcccagaagggugaac

SEQ ID NO: 30632 - RNA, 20 nt, Artificial Sequence
  CIITA targeting sequence
ugcccagaagggugaacgga

SEQ ID NO: 30633 - RNA, 20 nt, Artificial Sequence
  CIITA targeting sequence
gggcaggaagagcucacagg

SEQ ID NO: 30634 - RNA, 20 nt, Artificial Sequence
  CIITA targeting sequence
cccuucugggcaggaagagc

SEQ ID NO: 30635 - RNA, 20 nt, Artificial Sequence
  CIITA targeting sequence
guucacccuucugggcagga

SEQ ID NO: 30636 - RNA, 20 nt, Artificial Sequence
  CIITA targeting sequence
ccguucacccuucugggcag

SEQ ID NO: 30637 - RNA, 20 nt, Artificial Sequence
  CIITA targeting sequence
cagcggggccccagcagccu

SEQ ID NO: 30638 - RNA, 20 nt, Artificial Sequence
  CIITA targeting sequence
caggcugcuggggccccgcu

SEQ ID NO: 30639 - RNA, 20 nt, Artificial Sequence
  CIITA targeting sequence
ccuucccaggcugcuggggc

SEQ ID NO: 30640 - RNA, 20 nt, Artificial Sequence
  CIITA targeting sequence
caauauccccuucccaggcu

SEQ ID NO: 30641 - RNA, 20 nt, Artificial Sequence
  CIITA targeting sequence
ucccaauauccccuucccag

SEQ ID NO: 30642 - RNA, 20 nt, Artificial Sequence
  CIITA targeting sequence
uuccucccaauauccccuuc

SEQ ID NO: 30643 - RNA, 20 nt, Artificial Sequence
  CIITA targeting sequence
ugccuccuuccucccaauau

SEQ ID NO: 30644 - RNA, 20 nt, Artificial Sequence
  CIITA targeting sequence
agcugcccuccugccuccuu

SEQ ID NO: 30645 - RNA, 20 nt, Artificial Sequence
  CIITA targeting sequence
cuccagcugcccuccugccu

SEQ ID NO: 30646 - RNA, 20 nt, Artificial Sequence
  CIITA targeting sequence
ucccuccagcugcccuccug

SEQ ID NO: 30647 - RNA, 20 nt, Artificial Sequence
  CIITA targeting sequence
gcaacggcuucuucccucca

SEQ ID NO: 30648 - RNA, 20 nt, Artificial Sequence
  CIITA targeting sequence
cugacccuaagaaucaccag

SEQ ID NO: 30649 - RNA, 20 nt, Artificial Sequence
  CIITA targeting sequence
gacccuaagaaucaccagcu

SEQ ID NO: 30650 - RNA, 20 nt, Artificial Sequence
  CIITA targeting sequence
gagaaaaagccccuaaaugu

SEQ ID NO: 30651 - RNA, 20 nt, Artificial Sequence
  CIITA targeting sequence
uagggucagagaaaaagccc

SEQ ID NO: 30652 - RNA, 20 nt, Artificial Sequence
  CIITA targeting sequence
ccagcuguuggugucuguug

SEQ ID NO: 30653 - RNA, 20 nt, Artificial Sequence
  CIITA targeting sequence
guugaguugggguuccugga

SEQ ID NO: 30654 - RNA, 20 nt, Artificial Sequence
  CIITA targeting sequence
acagacaccaacagcuggug

SEQ ID NO: 30655 - RNA, 20 nt, Artificial Sequence
  CIITA targeting sequence
uggagucaugggaaaacccc

SEQ ID NO: 30656 - RNA, 20 nt, Artificial Sequence
  CIITA targeting sequence
aggaaccccaacucaacaga

SEQ ID NO: 30657 - RNA, 20 nt, Artificial Sequence
  CIITA targeting sequence
ugggaaaacccccguggaau

SEQ ID NO: 30658 - RNA, 20 nt, Artificial Sequence
  CIITA targeting sequence
caugacuccaggaaccccaa

SEQ ID NO: 30659 - RNA, 20 nt, Artificial Sequence
  CIITA targeting sequence
acggggguuuucccaugacu

SEQ ID NO: 30660 - RNA, 20 nt, Artificial Sequence
  CIITA targeting sequence
ccagucaggaccaacuguca

SEQ ID NO: 30661 - RNA, 20 nt, Artificial Sequence
  CIITA targeting sequence
ggaccaacugucauucucag

SEQ ID NO: 30662 - RNA, 20 nt, Artificial Sequence
  CIITA targeting sequence
ugacuggggauuccacgggg

SEQ ID NO: 30663 - RNA, 20 nt, Artificial Sequence
  CIITA targeting sequence
uucucagccacuggguugga

SEQ ID NO: 30664 - RNA, 20 nt, Artificial Sequence
  CIITA targeting sequence
cagccacuggguuggagguu

SEQ ID NO: 30665 - RNA, 20 nt, Artificial Sequence
  CIITA targeting sequence
gccacuggguuggagguucc

SEQ ID NO: 30666 - RNA, 20 nt, Artificial Sequence
  CIITA targeting sequence
aacccaguggcugagaauga

SEQ ID NO: 30667 - RNA, 20 nt, Artificial Sequence
  CIITA targeting sequence
uccagaaauauccucagcuc

SEQ ID NO: 30668 - RNA, 20 nt, Artificial Sequence
  CIITA targeting sequence
agaaauauccucagcuccug

SEQ ID NO: 30669 - RNA, 20 nt, Artificial Sequence
  CIITA targeting sequence
ggaggaaccuccaacccagu

SEQ ID NO: 30670 - RNA, 20 nt, Artificial Sequence
  CIITA targeting sequence
ucagcuccugccaucuggag

SEQ ID NO: 30671 - RNA, 20 nt, Artificial Sequence
  CIITA targeting sequence
gcuccugccaucuggaggug

SEQ ID NO: 30672 - RNA, 20 nt, Artificial Sequence
  CIITA targeting sequence
ugccaucuggagguggcucu

SEQ ID NO: 30673 - RNA, 20 nt, Artificial Sequence
  CIITA targeting sequence
ggagguggcucuauaaauac

SEQ ID NO: 30674 - RNA, 20 nt, Artificial Sequence
  CIITA targeting sequence
agauggcaggagcugaggau

SEQ ID NO: 30675 - RNA, 20 nt, Artificial Sequence
  CIITA targeting sequence
auaaauacagggucacuucc

SEQ ID NO: 30676 - RNA, 20 nt, Artificial Sequence
  CIITA targeting sequence
cuuccaucccuccugaccug

SEQ ID NO: 30677 - RNA, 20 nt, Artificial Sequence
  CIITA targeting sequence
aucccuccugaccuguccac

SEQ ID NO: 30678 - RNA, 20 nt, Artificial Sequence
  CIITA targeting sequence
cuccugaccuguccacaugg

SEQ ID NO: 30679 - RNA, 20 nt, Artificial Sequence
  CIITA targeting sequence
ugaccuguccacauggggca

SEQ ID NO: 30680 - RNA, 20 nt, Artificial Sequence
  CIITA targeting sequence
ggagggauggaagugacccu

SEQ ID NO: 30681 - RNA, 20 nt, Artificial Sequence
  CIITA targeting sequence
acauggggcagagggcugag

SEQ ID NO: 30682 - RNA, 20 nt, Artificial Sequence
  CIITA targeting sequence
gccccauguggacaggucag

SEQ ID NO: 30683 - RNA, 20 nt, Artificial Sequence
  CIITA targeting sequence
gcccucugccccauguggac

SEQ ID NO: 30684 - RNA, 20 nt, Artificial Sequence
  CIITA targeting sequence
ucagcccucugccccaugug

SEQ ID NO: 30685 - RNA, 20 nt, Artificial Sequence
  CIITA targeting sequence
guauccucagcccucugccc

SEQ ID NO: 30686 - RNA, 20 nt, Artificial Sequence
  CIITA targeting sequence
uauguggccccagcaucugu

SEQ ID NO: 30687 - RNA, 20 nt, Artificial Sequence
  CIITA targeting sequence
cuccuuggaagaaagcaccc

SEQ ID NO: 30688 - RNA, 20 nt, Artificial Sequence
  CIITA targeting sequence
uuggaagaaagcacccuccc

SEQ ID NO: 30689 - RNA, 20 nt, Artificial Sequence
  CIITA targeting sequence
aaggagggaauaauagggcu

SEQ ID NO: 30690 - RNA, 20 nt, Artificial Sequence
  CIITA targeting sequence
uccaaggagggaauaauagg

SEQ ID NO: 30691 - RNA, 20 nt, Artificial Sequence
  CIITA targeting sequence
cucuacacguggcccagacg

SEQ ID NO: 30692 - RNA, 20 nt, Artificial Sequence
  CIITA targeting sequence
acacguggcccagacggccc

SEQ ID NO: 30693 - RNA, 20 nt, Artificial Sequence
  CIITA targeting sequence
gggccacguguagagggagg

SEQ ID NO: 30694 - RNA, 20 nt, Artificial Sequence
  CIITA targeting sequence
guggggucagcuuccugaau

SEQ ID NO: 30695 - RNA, 20 nt, Artificial Sequence
  CIITA targeting sequence
gcuuccugaaucugaggggu

SEQ ID NO: 30696 - RNA, 20 nt, Artificial Sequence
  CIITA targeting sequence
ugaaucugaggggugggcag

SEQ ID NO: 30697 - RNA, 20 nt, Artificial Sequence
  CIITA targeting sequence
ggaagcugaccccacagagg

SEQ ID NO: 30698 - RNA, 20 nt, Artificial Sequence
  CIITA targeting sequence
gaggggugggcagagggccu

SEQ ID NO: 30699 - RNA, 20 nt, Artificial Sequence
  CIITA targeting sequence
gauucaggaagcugacccca

SEQ ID NO: 30700 - RNA, 20 nt, Artificial Sequence
  CIITA targeting sequence
gcccaccccucagauucagg

SEQ ID NO: 30701 - RNA, 20 nt, Artificial Sequence
  CIITA targeting sequence
ggcccucugcccaccccuca

SEQ ID NO: 30702 - RNA, 20 nt, Artificial Sequence
  CIITA targeting sequence
gugcaacccucaggcccucu

SEQ ID NO: 30703 - RNA, 20 nt, Artificial Sequence
  CIITA targeting sequence
cugugcaacccucaggcccu

SEQ ID NO: 30704 - RNA, 20 nt, Artificial Sequence
  CIITA targeting sequence
ucuugguuuuaaaacuggcu

SEQ ID NO: 30705 - RNA, 20 nt, Artificial Sequence
  CIITA targeting sequence
ugguuuuaaaacuggcugcg

SEQ ID NO: 30706 - RNA, 20 nt, Artificial Sequence
  CIITA targeting sequence
gccgcagccaguuuuaaaac

SEQ ID NO: 30707 - RNA, 20 nt, Artificial Sequence
  CIITA targeting sequence
cugccgcagccaguuuuaaa

SEQ ID NO: 30708 - RNA, 20 nt, Artificial Sequence
  CIITA targeting sequence
accaggugucucugccgcag

SEQ ID NO: 30709 - RNA, 20 nt, Artificial Sequence
  CIITA targeting sequence
accuuucaaccaggugucuc

SEQ ID NO: 30710 - RNA, 20 nt, Artificial Sequence
  CIITA targeting sequence
caccuguaaucccagcacuu

SEQ ID NO: 30711 - RNA, 20 nt, Artificial Sequence
  CIITA targeting sequence
cagcacuuugggaggccgag

SEQ ID NO: 30712 - RNA, 20 nt, Artificial Sequence
  CIITA targeting sequence
caaagugcugggauuacagg

SEQ ID NO: 30713 - RNA, 20 nt, Artificial Sequence
  CIITA targeting sequence
gccucccaaagugcugggau

SEQ ID NO: 30714 - RNA, 20 nt, Artificial Sequence
  CIITA targeting sequence
acccaccucggccucccaaa

SEQ ID NO: 30715 - RNA, 20 nt, Artificial Sequence
  CIITA targeting sequence
cuugaagucaggaguuugag

SEQ ID NO: 30716 - RNA, 20 nt, Artificial Sequence
  CIITA targeting sequence
agugaucuacccaccucggc

SEQ ID NO: 30717 - RNA, 20 nt, Artificial Sequence
  CIITA targeting sequence
ggaguuugagaucagccugg

SEQ ID NO: 30718 - RNA, 20 nt, Artificial Sequence
  CIITA targeting sequence
ugacuucaagugaucuaccc

SEQ ID NO: 30719 - RNA, 20 nt, Artificial Sequence
  CIITA targeting sequence
aacuccugacuucaagugau

SEQ ID NO: 30720 - RNA, 20 nt, Artificial Sequence
  CIITA targeting sequence
caaacuccugacuucaagug

SEQ ID NO: 30721 - RNA, 20 nt, Artificial Sequence
  CIITA targeting sequence
gccuggccaauauggcgaaa

SEQ ID NO: 30722 - RNA, 20 nt, Artificial Sequence
  CIITA targeting sequence
ccauauuggccaggcugauc

SEQ ID NO: 30723 - RNA, 20 nt, Artificial Sequence
  CIITA targeting sequence
cuacuaaaaauacaaaaaau

SEQ ID NO: 30724 - RNA, 20 nt, Artificial Sequence
  CIITA targeting sequence
acuaaaaauacaaaaaauga

SEQ ID NO: 30725 - RNA, 20 nt, Artificial Sequence
  CIITA targeting sequence
uuuuuuguauuuuuaguaga

SEQ ID NO: 30726 - RNA, 20 nt, Artificial Sequence
  CIITA targeting sequence
cagcuacucaggaggcugag

SEQ ID NO: 30727 - RNA, 20 nt, Artificial Sequence
  CIITA targeting sequence
gcuacucaggaggcugaggc

SEQ ID NO: 30728 - RNA, 20 nt, Artificial Sequence
  CIITA targeting sequence
ggaggcugaggcaggagaau

SEQ ID NO: 30729 - RNA, 20 nt, Artificial Sequence
  CIITA targeting sequence
ugaguagcugagauuacagg

SEQ ID NO: 30730 - RNA, 20 nt, Artificial Sequence
  CIITA targeting sequence
gccuccugaguagcugagau

SEQ ID NO: 30731 - RNA, 20 nt, Artificial Sequence
  CIITA targeting sequence
ugccucagccuccugaguag

SEQ ID NO: 30732 - RNA, 20 nt, Artificial Sequence
  CIITA targeting sequence
ccugccucagccuccugagu

SEQ ID NO: 30733 - RNA, 20 nt, Artificial Sequence
  CIITA targeting sequence
cuugaacccgggaaguggag

SEQ ID NO: 30734 - RNA, 20 nt, Artificial Sequence
  CIITA targeting sequence
agcgauucuccugccucagc

SEQ ID NO: 30735 - RNA, 20 nt, Artificial Sequence
  CIITA targeting sequence
cggguucaagcgauucuccu

SEQ ID NO: 30736 - RNA, 20 nt, Artificial Sequence
  CIITA targeting sequence
acuucccggguucaagcgau

SEQ ID NO: 30737 - RNA, 20 nt, Artificial Sequence
  CIITA targeting sequence
ccacaaccuccacuucccgg

SEQ ID NO: 30738 - RNA, 20 nt, Artificial Sequence
  CIITA targeting sequence
cagcucaccacaaccuccac

SEQ ID NO: 30739 - RNA, 20 nt, Artificial Sequence
  CIITA targeting sequence
agccugggccacacagugag

SEQ ID NO: 30740 - RNA, 20 nt, Artificial Sequence
  CIITA targeting sequence
cuguguggcccaggcuggag

SEQ ID NO: 30741 - RNA, 20 nt, Artificial Sequence
  CIITA targeting sequence
cacuguguggcccaggcugg

SEQ ID NO: 30742 - RNA, 20 nt, Artificial Sequence
  CIITA targeting sequence
gucucggaaaaaaaacaaca

SEQ ID NO: 30743 - RNA, 20 nt, Artificial Sequence
  CIITA targeting sequence
cggaaaaaaaacaacaaaca

SEQ ID NO: 30744 - RNA, 20 nt, Artificial Sequence
  CIITA targeting sequence
gaaaaaaaacaacaaacaaa

SEQ ID NO: 30745 - RNA, 20 nt, Artificial Sequence
  CIITA targeting sequence
gagacugaaucucacugugu

SEQ ID NO: 30746 - RNA, 20 nt, Artificial Sequence
  CIITA targeting sequence
acccuuuuguuuguuuguuu

SEQ ID NO: 30747 - RNA, 20 nt, Artificial Sequence
  CIITA targeting sequence
uaaaaucuacccuuuuguuu

SEQ ID NO: 30748 - RNA, 20 nt, Artificial Sequence
  CIITA targeting sequence
cacucuagguuuucugaacc

SEQ ID NO: 30749 - RNA, 20 nt, Artificial Sequence
  CIITA targeting sequence
cucuagguuuucugaaccuc

SEQ ID NO: 30750 - RNA, 20 nt, Artificial Sequence
  CIITA targeting sequence
agguuuucugaaccuccagg

SEQ ID NO: 30751 - RNA, 20 nt, Artificial Sequence
  CIITA targeting sequence
gaaccuccaggguugcggcu

SEQ ID NO: 30752 - RNA, 20 nt, Artificial Sequence
  CIITA targeting sequence
gaaaaccuagagugagaucc

SEQ ID NO: 30753 - RNA, 20 nt, Artificial Sequence
  CIITA targeting sequence
aggguugcggcuuggagauc

SEQ ID NO: 30754 - RNA, 20 nt, Artificial Sequence
  CIITA targeting sequence
aagccgcaacccuggagguu

SEQ ID NO: 30755 - RNA, 20 nt, Artificial Sequence
  CIITA targeting sequence
ccaagccgcaacccuggagg

SEQ ID NO: 30756 - RNA, 20 nt, Artificial Sequence
  CIITA targeting sequence
gccuuaauaagagccgcaga

SEQ ID NO: 30757 - RNA, 20 nt, Artificial Sequence
  CIITA targeting sequence
uauuaaggcagaucuccaag

SEQ ID NO: 30758 - RNA, 20 nt, Artificial Sequence
  CIITA targeting sequence
gcggcucuuauuaaggcaga

SEQ ID NO: 30759 - RNA, 20 nt, Artificial Sequence
  CIITA targeting sequence
cugcggcucuuauuaaggca

SEQ ID NO: 30760 - RNA, 20 nt, Artificial Sequence
  CIITA targeting sequence
aagcccucucugcggcucuu

SEQ ID NO: 30761 - RNA, 20 nt, Artificial Sequence
  CIITA targeting sequence
ggcuuccaagcccucucugc

SEQ ID NO: 30762 - RNA, 20 nt, Artificial Sequence
  CIITA targeting sequence
caaaggucgggcuuccaagc

SEQ ID NO: 30763 - RNA, 20 nt, Artificial Sequence
  CIITA targeting sequence
ccccucccccuacccacacu

SEQ ID NO: 30764 - RNA, 20 nt, Artificial Sequence
  CIITA targeting sequence
ccucccccuacccacacugg

SEQ ID NO: 30765 - RNA, 20 nt, Artificial Sequence
  CIITA targeting sequence
cccuacccacacuggucuug

SEQ ID NO: 30766 - RNA, 20 nt, Artificial Sequence
  CIITA targeting sequence
uggccccugaaggauuuggg

SEQ ID NO: 30767 - RNA, 20 nt, Artificial Sequence
  CIITA targeting sequence
ggggccaagaccaguguggg

SEQ ID NO: 30768 - RNA, 20 nt, Artificial Sequence
  CIITA targeting sequence
uucaggggccaagaccagug

SEQ ID NO: 30769 - RNA, 20 nt, Artificial Sequence
  CIITA targeting sequence
ccaaauccuucaggggccaa

SEQ ID NO: 30770 - RNA, 20 nt, Artificial Sequence
  CIITA targeting sequence
acuccccaaauccuucaggg

SEQ ID NO: 30771 - RNA, 20 nt, Artificial Sequence
  CIITA targeting sequence
caggucuacuccccaaaucc

SEQ ID NO: 30772 - RNA, 20 nt, Artificial Sequence
  CIITA targeting sequence
cacaggucuacuccccaaau

SEQ ID NO: 30773 - RNA, 20 nt, Artificial Sequence
  CIITA targeting sequence
ccgaucccugcagcugggcu

SEQ ID NO: 30774 - RNA, 20 nt, Artificial Sequence
  CIITA targeting sequence
gaucccugcagcugggcuug

SEQ ID NO: 30775 - RNA, 20 nt, Artificial Sequence
  CIITA targeting sequence
gagaugggguugcuucucac

SEQ ID NO: 30776 - RNA, 20 nt, Artificial Sequence
  CIITA targeting sequence
cugcagcugggcuugggacc

SEQ ID NO: 30777 - RNA, 20 nt, Artificial Sequence
  CIITA targeting sequence
caagcccagcugcagggauc

SEQ ID NO: 30778 - RNA, 20 nt, Artificial Sequence
  CIITA targeting sequence
aggucccaagcccagcugca

SEQ ID NO: 30779 - RNA, 20 nt, Artificial Sequence
  CIITA targeting sequence
ggcuucaaggucccaagccc

SEQ ID NO: 30780 - RNA, 20 nt, Artificial Sequence
  CIITA targeting sequence
cugggguuguucuggcuuca

SEQ ID NO: 30781 - RNA, 20 nt, Artificial Sequence
  CIITA targeting sequence
uucccugggguuguucuggc

SEQ ID NO: 30782 - RNA, 20 nt, Artificial Sequence
  CIITA targeting sequence
aggcucagguagccacuggc

SEQ ID NO: 30783 - RNA, 20 nt, Artificial Sequence
  CIITA targeting sequence
gguagccacuggccucuggc

SEQ ID NO: 30784 - RNA, 20 nt, Artificial Sequence
  CIITA targeting sequence
ggcugaccuuggaggucaac

SEQ ID NO: 30785 - RNA, 20 nt, Artificial Sequence
  CIITA targeting sequence
gccagaggccaguggcuacc

SEQ ID NO: 30786 - RNA, 20 nt, Artificial Sequence
  CIITA targeting sequence
aaggucagccagaggccagu

SEQ ID NO: 30787 - RNA, 20 nt, Artificial Sequence
  CIITA targeting sequence
acaucuggagucugcaggcu

SEQ ID NO: 30788 - RNA, 20 nt, Artificial Sequence
  CIITA targeting sequence
ggagucugcaggcuuuguug

SEQ ID NO: 30789 - RNA, 20 nt, Artificial Sequence
  CIITA targeting sequence
agauguugaccuccaagguc

SEQ ID NO: 30790 - RNA, 20 nt, Artificial Sequence
  CIITA targeting sequence
gcaggcuuuguuggggaggg

SEQ ID NO: 30791 - RNA, 20 nt, Artificial Sequence
  CIITA targeting sequence
uuuuuuuuuuuuuuuuuuuu

SEQ ID NO: 30792 - RNA, 20 nt, Artificial Sequence
  CIITA targeting sequence
cuuguguuauuuccaguuca

SEQ ID NO: 30793 - RNA, 20 nt, Artificial Sequence
  CIITA targeting sequence
aguucaaauguaucugggug

SEQ ID NO: 30794 - RNA, 20 nt, Artificial Sequence
  CIITA targeting sequence
aauguaucuggguggccccu

SEQ ID NO: 30795 - RNA, 20 nt, Artificial Sequence
  CIITA targeting sequence
ggguggccccuauuuucugg

SEQ ID NO: 30796 - RNA, 20 nt, Artificial Sequence
  CIITA targeting sequence
ggcaguccuauuguaaccau

SEQ ID NO: 30797 - RNA, 20 nt, Artificial Sequence
  CIITA targeting sequence
uauuguaaccauacacaggc

SEQ ID NO: 30798 - RNA, 20 nt, Artificial Sequence
  CIITA targeting sequence
gcugcugaucacuuacaaag

SEQ ID NO: 30799 - RNA, 20 nt, Artificial Sequence
  CIITA targeting sequence
gcagccgagccuguguaugg

SEQ ID NO: 30800 - RNA, 20 nt, Artificial Sequence
  CIITA targeting sequence
cuuacaaagccaauaacaag

SEQ ID NO: 30801 - RNA, 20 nt, Artificial Sequence
  CIITA targeting sequence
uuguuauuggcuuuguaagu

SEQ ID NO: 30802 - RNA, 20 nt, Artificial Sequence
  CIITA targeting sequence
uccuuguuauuggcuuugua

SEQ ID NO: 30803 - RNA, 20 nt, Artificial Sequence
  CIITA targeting sequence
cguccuuguuauuggcuuug

SEQ ID NO: 30804 - RNA, 20 nt, Artificial Sequence
  CIITA targeting sequence
cugcaucucguccuuguuau

SEQ ID NO: 30805 - RNA, 20 nt, Artificial Sequence
  CIITA targeting sequence
uuucacugcaucucguccuu

SEQ ID NO: 30806 - RNA, 20 nt, Artificial Sequence
  CIITA targeting sequence
cuuuccuuucacugcaucuc

SEQ ID NO: 30807 - RNA, 20 nt, Artificial Sequence
  CIITA targeting sequence
agggcuagugguggggaaau

SEQ ID NO: 30808 - RNA, 20 nt, Artificial Sequence
  CIITA targeting sequence
ccaccacuagcccuggaaua

SEQ ID NO: 30809 - RNA, 20 nt, Artificial Sequence
  CIITA targeting sequence
uguaaacacaagccugggcc

SEQ ID NO: 30810 - RNA, 20 nt, Artificial Sequence
  CIITA targeting sequence
aacuuuagccuggggagagg

SEQ ID NO: 30811 - RNA, 20 nt, Artificial Sequence
  CIITA targeting sequence
ccaggcuaaaguuagaaaug

SEQ ID NO: 30812 - RNA, 20 nt, Artificial Sequence
  CIITA targeting sequence
ccccaggcuaaaguuagaaa

SEQ ID NO: 30813 - RNA, 20 nt, Artificial Sequence
  CIITA targeting sequence
cucuccccaggcuaaaguua

SEQ ID NO: 30814 - RNA, 20 nt, Artificial Sequence
  CIITA targeting sequence
aagugcccuuuuuuuaaguc

SEQ ID NO: 30815 - RNA, 20 nt, Artificial Sequence
  CIITA targeting sequence
cacaugucauuccagcacuu

SEQ ID NO: 30816 - RNA, 20 nt, Artificial Sequence
  CIITA targeting sequence
uuccagcacuuugggcggcc

SEQ ID NO: 30817 - RNA, 20 nt, Artificial Sequence
  CIITA targeting sequence
agcacuuugggcggccaagg

SEQ ID NO: 30818 - RNA, 20 nt, Artificial Sequence
  CIITA targeting sequence
cgccuuggccgcccaaagug

SEQ ID NO: 30819 - RNA, 20 nt, Artificial Sequence
  CIITA targeting sequence
ucccgccuuggccgcccaaa

SEQ ID NO: 30820 - RNA, 20 nt, Artificial Sequence
  CIITA targeting sequence
uuugagcccaggacuucgag

SEQ ID NO: 30821 - RNA, 20 nt, Artificial Sequence
  CIITA targeting sequence
aaugauccucccgccuuggc

SEQ ID NO: 30822 - RNA, 20 nt, Artificial Sequence
  CIITA targeting sequence
ugggcucaaaugauccuccc

SEQ ID NO: 30823 - RNA, 20 nt, Artificial Sequence
  CIITA targeting sequence
agucuagccuaggcaacaug

SEQ ID NO: 30824 - RNA, 20 nt, Artificial Sequence
  CIITA targeting sequence
aaguccugggcucaaaugau

SEQ ID NO: 30825 - RNA, 20 nt, Artificial Sequence
  CIITA targeting sequence
agccuaggcaacauggcgag

SEQ ID NO: 30826 - RNA, 20 nt, Artificial Sequence
  CIITA targeting sequence
ccauguugccuaggcuagac

SEQ ID NO: 30827 - RNA, 20 nt, Artificial Sequence
  CIITA targeting sequence
ugucucuacaaaaauaaaaa

SEQ ID NO: 30828 - RNA, 20 nt, Artificial Sequence
  CIITA targeting sequence
cuacaaaaauaaaaaaauua

SEQ ID NO: 30829 - RNA, 20 nt, Artificial Sequence
  CIITA targeting sequence
acaaaaauaaaaaaauuagc

SEQ ID NO: 30830 - RNA, 20 nt, Artificial Sequence
  CIITA targeting sequence
caacuacucuggaggcugag

SEQ ID NO: 30831 - RNA, 20 nt, Artificial Sequence
  CIITA targeting sequence
ggaggcugaggcaggaggau

SEQ ID NO: 30832 - RNA, 20 nt, Artificial Sequence
  CIITA targeting sequence
agaguaguugggaguacagg

SEQ ID NO: 30833 - RNA, 20 nt, Artificial Sequence
  CIITA targeting sequence
gccuccagaguaguugggag

SEQ ID NO: 30834 - RNA, 20 nt, Artificial Sequence
  CIITA targeting sequence
ugccucagccuccagaguag

SEQ ID NO: 30835 - RNA, 20 nt, Artificial Sequence
  CIITA targeting sequence
uccugccucagccuccagag

SEQ ID NO: 30836 - RNA, 20 nt, Artificial Sequence
  CIITA targeting sequence
cuugagcccaggagguuaag

SEQ ID NO: 30837 - RNA, 20 nt, Artificial Sequence
  CIITA targeting sequence
agugauccuccugccucagc

SEQ ID NO: 30838 - RNA, 20 nt, Artificial Sequence
  CIITA targeting sequence
ugggcucaagugauccuccu

SEQ ID NO: 30839 - RNA, 20 nt, Artificial Sequence
  CIITA targeting sequence
agccugggcgacagagcuag

SEQ ID NO: 30840 - RNA, 20 nt, Artificial Sequence
  CIITA targeting sequence
cccaggcuggaguguaguag

SEQ ID NO: 30841 - RNA, 20 nt, Artificial Sequence
  CIITA targeting sequence
gucgcccaggcuggagugua

SEQ ID NO: 30842 - RNA, 20 nt, Artificial Sequence
  CIITA targeting sequence
agcucugucgcccaggcugg

SEQ ID NO: 30843 - RNA, 20 nt, Artificial Sequence
  CIITA targeting sequence
caaaaaauaaaauauuuuaa

SEQ ID NO: 30844 - RNA, 20 nt, Artificial Sequence
  CIITA targeting sequence
aaaaauaaaauauuuuaaaa

SEQ ID NO: 30845 - RNA, 20 nt, Artificial Sequence
  CIITA targeting sequence
cuuuuuaaaauauuuuauuu

SEQ ID NO: 30846 - RNA, 20 nt, Artificial Sequence
  CIITA targeting sequence
agguucccuuuuuaaaauau

SEQ ID NO: 30847 - RNA, 20 nt, Artificial Sequence
  CIITA targeting sequence
cguucuagguucccuuuuua

SEQ ID NO: 30848 - RNA, 20 nt, Artificial Sequence
  CIITA targeting sequence
uguuccagcggcuaucucga

SEQ ID NO: 30849 - RNA, 20 nt, Artificial Sequence
  CIITA targeting sequence
agcggcuaucucgagccuug

SEQ ID NO: 30850 - RNA, 20 nt, Artificial Sequence
  CIITA targeting sequence
cgagccuugcuccaccugaa

SEQ ID NO: 30851 - RNA, 20 nt, Artificial Sequence
  CIITA targeting sequence
agccuugcuccaccugaagc

SEQ ID NO: 30852 - RNA, 20 nt, Artificial Sequence
  CIITA targeting sequence
agauagccgcuggaacaaga

SEQ ID NO: 30853 - RNA, 20 nt, Artificial Sequence
  CIITA targeting sequence
accugaagcauagccuggca

SEQ ID NO: 30854 - RNA, 20 nt, Artificial Sequence
  CIITA targeting sequence
gguggagcaaggcucgagau

SEQ ID NO: 30855 - RNA, 20 nt, Artificial Sequence
  CIITA targeting sequence
ucccaaccauggccggguug

SEQ ID NO: 30856 - RNA, 20 nt, Artificial Sequence
  CIITA targeting sequence
caaccauggccggguuguug

SEQ ID NO: 30857 - RNA, 20 nt, Artificial Sequence
  CIITA targeting sequence
acaacccggccaugguuggg

SEQ ID NO: 30858 - RNA, 20 nt, Artificial Sequence
  CIITA targeting sequence
aggugguuugucaacaaccc

SEQ ID NO: 30859 - RNA, 20 nt, Artificial Sequence
  CIITA targeting sequence
cuaggugguuugucaacaac

SEQ ID NO: 30860 - RNA, 20 nt, Artificial Sequence
  CIITA targeting sequence
cuggaauuuugcagcugggu

SEQ ID NO: 30861 - RNA, 20 nt, Artificial Sequence
  CIITA targeting sequence
ggaauuuugcagcugggucu

SEQ ID NO: 30862 - RNA, 20 nt, Artificial Sequence
  CIITA targeting sequence
agagauuaucucuagguggu

SEQ ID NO: 30863 - RNA, 20 nt, Artificial Sequence
  CIITA targeting sequence
ccaagacugauauguuucaa

SEQ ID NO: 30864 - RNA, 20 nt, Artificial Sequence
  CIITA targeting sequence
aagacugauauguuucaagg

SEQ ID NO: 30865 - RNA, 20 nt, Artificial Sequence
  CIITA targeting sequence
uggagacccagcugcaaaau

SEQ ID NO: 30866 - RNA, 20 nt, Artificial Sequence
  CIITA targeting sequence
gucuuggagacccagcugca

SEQ ID NO: 30867 - RNA, 20 nt, Artificial Sequence
  CIITA targeting sequence
agguuagcuccuggaacuuc

SEQ ID NO: 30868 - RNA, 20 nt, Artificial Sequence
  CIITA targeting sequence
uggaacuucuaagugaacac

SEQ ID NO: 30869 - RNA, 20 nt, Artificial Sequence
  CIITA targeting sequence
aggagcuaaccuugaaacau

SEQ ID NO: 30870 - RNA, 20 nt, Artificial Sequence
  CIITA targeting sequence
aagugaacacauaauuaaua

SEQ ID NO: 30871 - RNA, 20 nt, Artificial Sequence
  CIITA targeting sequence
cuuagaaguuccaggagcua

SEQ ID NO: 30872 - RNA, 20 nt, Artificial Sequence
  CIITA targeting sequence
ggcuguaugcuuguauuaau

SEQ ID NO: 30873 - RNA, 20 nt, Artificial Sequence
  CIITA targeting sequence
caugcacauuuaucuggcug

SEQ ID NO: 30874 - RNA, 20 nt, Artificial Sequence
  CIITA targeting sequence
cuuaucccaugcacauuuau

SEQ ID NO: 30875 - RNA, 20 nt, Artificial Sequence
  CIITA targeting sequence
cccuuaucccaugcacauuu

SEQ ID NO: 30876 - RNA, 20 nt, Artificial Sequence
  CIITA targeting sequence
cucccuuaucccaugcacau

SEQ ID NO: 30877 - RNA, 20 nt, Artificial Sequence
  CIITA targeting sequence
cucucccuuaucccaugcac

SEQ ID NO: 30878 - RNA, 20 nt, Artificial Sequence
  CIITA targeting sequence
gucucucucccuuaucccau

SEQ ID NO: 30879 - RNA, 20 nt, Artificial Sequence
  CIITA targeting sequence
aacucugucucucucccuua

SEQ ID NO: 30880 - RNA, 20 nt, Artificial Sequence
  CIITA targeting sequence
aggcuauauuuuaagacuaa

SEQ ID NO: 30881 - RNA, 20 nt, Artificial Sequence
  CIITA targeting sequence
uaaaauauagccuugaacug

SEQ ID NO: 30882 - RNA, 20 nt, Artificial Sequence
  CIITA targeting sequence
uuagucuuaaaauauagccu

SEQ ID NO: 30883 - RNA, 20 nt, Artificial Sequence
  CIITA targeting sequence
cuccuuagucuuaaaauaua

SEQ ID NO: 30884 - RNA, 20 nt, Artificial Sequence
  CIITA targeting sequence
gccucccuccuuagucuuaa

SEQ ID NO: 30885 - RNA, 20 nt, Artificial Sequence
  CIITA targeting sequence
ccuucggccucccuccuuag

SEQ ID NO: 30886 - RNA, 20 nt, Artificial Sequence
  CIITA targeting sequence
uccccuucggccucccuccu

SEQ ID NO: 30887 - RNA, 20 nt, Artificial Sequence
  CIITA targeting sequence
caaggucaggaguucgagac

SEQ ID NO: 30888 - RNA, 20 nt, Artificial Sequence
  CIITA targeting sequence
ggaguucgagaccagccugg

SEQ ID NO: 30889 - RNA, 20 nt, Artificial Sequence
  CIITA targeting sequence
ugaccuugugauccuccccu

SEQ ID NO: 30890 - RNA, 20 nt, Artificial Sequence
  CIITA targeting sequence
agaccagccuggccaguaug

SEQ ID NO: 30891 - RNA, 20 nt, Artificial Sequence
  CIITA targeting sequence
aacuccugaccuugugaucc

SEQ ID NO: 30892 - RNA, 20 nt, Artificial Sequence
  CIITA targeting sequence
cgaacuccugaccuugugau

SEQ ID NO: 30893 - RNA, 20 nt, Artificial Sequence
  CIITA targeting sequence
uacuggccaggcuggucucg

SEQ ID NO: 30894 - RNA, 20 nt, Artificial Sequence
  CIITA targeting sequence
ucauacuggccaggcugguc

SEQ ID NO: 30895 - RNA, 20 nt, Artificial Sequence
  CIITA targeting sequence
cuacuaaaaauacaaaaaau

SEQ ID NO: 30896 - RNA, 20 nt, Artificial Sequence
  CIITA targeting sequence
acuaaaaauacaaaaaauua

SEQ ID NO: 30897 - RNA, 20 nt, Artificial Sequence
  CIITA targeting sequence
cagcuauuugggaggcugag

SEQ ID NO: 30898 - RNA, 20 nt, Artificial Sequence
  CIITA targeting sequence
caaauagcugggauuacagg

SEQ ID NO: 30899 - RNA, 20 nt, Artificial Sequence
  CIITA targeting sequence
gccucccaaauagcugggau

SEQ ID NO: 30900 - RNA, 20 nt, Artificial Sequence
  CIITA targeting sequence
ggagaaucacuugaacccag

SEQ ID NO: 30901 - RNA, 20 nt, Artificial Sequence
  CIITA targeting sequence
ugacucagccucccaaauag

SEQ ID NO: 30902 - RNA, 20 nt, Artificial Sequence
  CIITA targeting sequence
ccugacucagccucccaaau

SEQ ID NO: 30903 - RNA, 20 nt, Artificial Sequence
  CIITA targeting sequence
cuugaacccaggagguggag

SEQ ID NO: 30904 - RNA, 20 nt, Artificial Sequence
  CIITA targeting sequence
agugauucuccugacucagc

SEQ ID NO: 30905 - RNA, 20 nt, Artificial Sequence
  CIITA targeting sequence
uggguucaagugauucuccu

SEQ ID NO: 30906 - RNA, 20 nt, Artificial Sequence
  CIITA targeting sequence
accuccuggguucaagugau

SEQ ID NO: 30907 - RNA, 20 nt, Artificial Sequence
  CIITA targeting sequence
cugcaaccuccaccuccugg

SEQ ID NO: 30908 - RNA, 20 nt, Artificial Sequence
  CIITA targeting sequence
gcucacugcaaccuccaccu

SEQ ID NO: 30909 - RNA, 20 nt, Artificial Sequence
  CIITA targeting sequence
cggcucacugcaaccuccac

SEQ ID NO: 30910 - RNA, 20 nt, Artificial Sequence
  CIITA targeting sequence
ugccacugcacuccaggcug

SEQ ID NO: 30911 - RNA, 20 nt, Artificial Sequence
  CIITA targeting sequence
aggcugggcaauagagcgag

SEQ ID NO: 30912 - RNA, 20 nt, Artificial Sequence
  CIITA targeting sequence
auugcccagccuggagugca

SEQ ID NO: 30913 - RNA, 20 nt, Artificial Sequence
  CIITA targeting sequence
cucuauugcccagccuggag

SEQ ID NO: 30914 - RNA, 20 nt, Artificial Sequence
  CIITA targeting sequence
cgcucuauugcccagccugg

SEQ ID NO: 30915 - RNA, 20 nt, Artificial Sequence
  CIITA targeting sequence
gucucaaaaaaaaaaagacu

SEQ ID NO: 30916 - RNA, 20 nt, Artificial Sequence
  CIITA targeting sequence
caaaaaaaaaaagacuaagg

SEQ ID NO: 30917 - RNA, 20 nt, Artificial Sequence
  CIITA targeting sequence
aaaaaaaaaagacuaaggag

SEQ ID NO: 30918 - RNA, 20 nt, Artificial Sequence
  CIITA targeting sequence
aaaugcuuuuuuuuuuugcu

SEQ ID NO: 30919 - RNA, 20 nt, Artificial Sequence
  CIITA targeting sequence
guuacgguaugacuccaggc

SEQ ID NO: 30920 - RNA, 20 nt, Artificial Sequence
  CIITA targeting sequence
uaccguaacugaguagcuug

SEQ ID NO: 30921 - RNA, 20 nt, Artificial Sequence
  CIITA targeting sequence
aggccaggggacauccaggc

SEQ ID NO: 30922 - RNA, 20 nt, Artificial Sequence
  CIITA targeting sequence
ccuggccuggagucauaccg

SEQ ID NO: 30923 - RNA, 20 nt, Artificial Sequence
  CIITA targeting sequence
aggcccacgagguugggggg

SEQ ID NO: 30924 - RNA, 20 nt, Artificial Sequence
  CIITA targeting sequence
ugggccuggauguccccugg

SEQ ID NO: 30925 - RNA, 20 nt, Artificial Sequence
  CIITA targeting sequence
ggcgcagggagugguacaug

SEQ ID NO: 30926 - RNA, 20 nt, Artificial Sequence
  CIITA targeting sequence
cugcgccugacaagguggau

SEQ ID NO: 30927 - RNA, 20 nt, Artificial Sequence
  CIITA targeting sequence
auguaccacucccugcgccu

SEQ ID NO: 30928 - RNA, 20 nt, Artificial Sequence
  CIITA targeting sequence
agggcuauuuccauguacca

SEQ ID NO: 30929 - RNA, 20 nt, Artificial Sequence
  CIITA targeting sequence
acccagacagaccugggugc

SEQ ID NO: 30930 - RNA, 20 nt, Artificial Sequence
  CIITA targeting sequence
ggguagaaauccagggcuau

SEQ ID NO: 30931 - RNA, 20 nt, Artificial Sequence
  CIITA targeting sequence
gucuggguagaaauccaggg

SEQ ID NO: 30932 - RNA, 20 nt, Artificial Sequence
  CIITA targeting sequence
ugacaccagcugugcccagc

SEQ ID NO: 30933 - RNA, 20 nt, Artificial Sequence
  CIITA targeting sequence
ggauuugcacccaggucugu

SEQ ID NO: 30934 - RNA, 20 nt, Artificial Sequence
  CIITA targeting sequence
aguuacagacaaauaaauac

SEQ ID NO: 30935 - RNA, 20 nt, Artificial Sequence
  CIITA targeting sequence
guaacuagaaaguuggccua

SEQ ID NO: 30936 - RNA, 20 nt, Artificial Sequence
  CIITA targeting sequence
cuuggcuguauuuauuuguc

SEQ ID NO: 30937 - RNA, 20 nt, Artificial Sequence
  CIITA targeting sequence
aguuuguuguuuuuucacuu

SEQ ID NO: 30938 - RNA, 20 nt, Artificial Sequence
  CIITA targeting sequence
aaagugcacuaaaugccccc

SEQ ID NO: 30939 - RNA, 20 nt, Artificial Sequence
  CIITA targeting sequence
cagcuacucuggaggcugag

SEQ ID NO: 30940 - RNA, 20 nt, Artificial Sequence
  CIITA targeting sequence
ggaggcugaggcaggacagu

SEQ ID NO: 30941 - RNA, 20 nt, Artificial Sequence
  CIITA targeting sequence
agaguagcugggauuacagg

SEQ ID NO: 30942 - RNA, 20 nt, Artificial Sequence
  CIITA targeting sequence
gccuccagaguagcugggau

SEQ ID NO: 30943 - RNA, 20 nt, Artificial Sequence
  CIITA targeting sequence
ugccucagccuccagaguag

SEQ ID NO: 30944 - RNA, 20 nt, Artificial Sequence
  CIITA targeting sequence
cuugaacccaggaggugaag

SEQ ID NO: 30945 - RNA, 20 nt, Artificial Sequence
  CIITA targeting sequence
agcgacuguccugccucagc

SEQ ID NO: 30946 - RNA, 20 nt, Artificial Sequence
  CIITA targeting sequence
uggguucaagcgacuguccu

SEQ ID NO: 30947 - RNA, 20 nt, Artificial Sequence
  CIITA targeting sequence
ccuccuggguucaagcgacu

SEQ ID NO: 30948 - RNA, 20 nt, Artificial Sequence
  CIITA targeting sequence
gugagccaagaucacaccac

SEQ ID NO: 30949 - RNA, 20 nt, Artificial Sequence
  CIITA targeting sequence
cugacgccuucaccuccugg

SEQ ID NO: 30950 - RNA, 20 nt, Artificial Sequence
  CIITA targeting sequence
uggcucacugacgccuucac

SEQ ID NO: 30951 - RNA, 20 nt, Artificial Sequence
  CIITA targeting sequence
caccacugcacuccagccug

SEQ ID NO: 30952 - RNA, 20 nt, Artificial Sequence
  CIITA targeting sequence
agccugggggacaaagcaaa

SEQ ID NO: 30953 - RNA, 20 nt, Artificial Sequence
  CIITA targeting sequence
cccaggcuggagugcagugg

SEQ ID NO: 30954 - RNA, 20 nt, Artificial Sequence
  CIITA targeting sequence
aaaaaaaaaaaaagguaaaa

SEQ ID NO: 30955 - RNA, 20 nt, Artificial Sequence
  CIITA targeting sequence
cacuauguugcccaggcugg

SEQ ID NO: 30956 - RNA, 20 nt, Artificial Sequence
  CIITA targeting sequence
cuauguugcccaggcugguc

SEQ ID NO: 30957 - RNA, 20 nt, Artificial Sequence
  CIITA targeting sequence
caaaauccugggcucaagug

SEQ ID NO: 30958 - RNA, 20 nt, Artificial Sequence
  CIITA targeting sequence
aaauccugggcucaagugau

SEQ ID NO: 30959 - RNA, 20 nt, Artificial Sequence
  CIITA targeting sequence
ugggcucaagugauccuccc

SEQ ID NO: 30960 - RNA, 20 nt, Artificial Sequence
  CIITA targeting sequence
agugauccucccaccucagc

SEQ ID NO: 30961 - RNA, 20 nt, Artificial Sequence
  CIITA targeting sequence
cuugagcccaggauuuugag

SEQ ID NO: 30962 - RNA, 20 nt, Artificial Sequence
  CIITA targeting sequence
ucccaccucagccuccugua

SEQ ID NO: 30963 - RNA, 20 nt, Artificial Sequence
  CIITA targeting sequence
caccucagccuccuguauag

SEQ ID NO: 30964 - RNA, 20 nt, Artificial Sequence
  CIITA targeting sequence
gccuccuguauaguugggac

SEQ ID NO: 30965 - RNA, 20 nt, Artificial Sequence
  CIITA targeting sequence
uguauaguugggaccauagg

SEQ ID NO: 30966 - RNA, 20 nt, Artificial Sequence
  CIITA targeting sequence
caacuauacaggaggcugag

SEQ ID NO: 30967 - RNA, 20 nt, Artificial Sequence
  CIITA targeting sequence
gccuagcuuauuuuauuuua

SEQ ID NO: 30968 - RNA, 20 nt, Artificial Sequence
  CIITA targeting sequence
auuuugagacagagucuugc

SEQ ID NO: 30969 - RNA, 20 nt, Artificial Sequence
  CIITA targeting sequence
aaauagauaaauaaauaaau

SEQ ID NO: 30970 - RNA, 20 nt, Artificial Sequence
  CIITA targeting sequence
caaaauagauaaauaaauaa

SEQ ID NO: 30971 - RNA, 20 nt, Artificial Sequence
  CIITA targeting sequence
gucucaaaauagauaaauaa

SEQ ID NO: 30972 - RNA, 20 nt, Artificial Sequence
  CIITA targeting sequence
ugcucugucacccaggcugg

SEQ ID NO: 30973 - RNA, 20 nt, Artificial Sequence
  CIITA targeting sequence
gucacccaggcuggagugca

SEQ ID NO: 30974 - RNA, 20 nt, Artificial Sequence
  CIITA targeting sequence
cccaggcuggagugcaaugg

SEQ ID NO: 30975 - RNA, 20 nt, Artificial Sequence
  CIITA targeting sequence
agccugggugacagagcaag

SEQ ID NO: 30976 - RNA, 20 nt, Artificial Sequence
  CIITA targeting sequence
cagcucacugcaacauccgc

SEQ ID NO: 30977 - RNA, 20 nt, Artificial Sequence
  CIITA targeting sequence
gcucacugcaacauccgccu

SEQ ID NO: 30978 - RNA, 20 nt, Artificial Sequence
  CIITA targeting sequence
cugcaacauccgccuccuga

SEQ ID NO: 30979 - RNA, 20 nt, Artificial Sequence
  CIITA targeting sequence
gccuccugaguucaagcaau

SEQ ID NO: 30980 - RNA, 20 nt, Artificial Sequence
  CIITA targeting sequence
ugaguucaagcaauuuccug

SEQ ID NO: 30981 - RNA, 20 nt, Artificial Sequence
  CIITA targeting sequence
ggaggcggauguugcaguga

SEQ ID NO: 30982 - RNA, 20 nt, Artificial Sequence
  CIITA targeting sequence
agcaauuuccugccucagcc

SEQ ID NO: 30983 - RNA, 20 nt, Artificial Sequence
  CIITA targeting sequence
ugccucagccuccugaguag

SEQ ID NO: 30984 - RNA, 20 nt, Artificial Sequence
  CIITA targeting sequence
gccuccugaguagcugggau

SEQ ID NO: 30985 - RNA, 20 nt, Artificial Sequence
  CIITA targeting sequence
ugaguagcugggauuacagg

SEQ ID NO: 30986 - RNA, 20 nt, Artificial Sequence
  CIITA targeting sequence
ggaggcugaggcaggaaauu

SEQ ID NO: 30987 - RNA, 20 nt, Artificial Sequence
  CIITA targeting sequence
cagcuacucaggaggcugag

SEQ ID NO: 30988 - RNA, 20 nt, Artificial Sequence
  CIITA targeting sequence
auuaaaaauacaaaaguuag

SEQ ID NO: 30989 - RNA, 20 nt, Artificial Sequence
  CIITA targeting sequence
cuauuaaaaauacaaaaguu

SEQ ID NO: 30990 - RNA, 20 nt, Artificial Sequence
  CIITA targeting sequence
ccacauuagccaggcugguc

SEQ ID NO: 30991 - RNA, 20 nt, Artificial Sequence
  CIITA targeting sequence
ggaacuccugaccucaagug

SEQ ID NO: 30992 - RNA, 20 nt, Artificial Sequence
  CIITA targeting sequence
agaccagccuggcuaaugug

SEQ ID NO: 30993 - RNA, 20 nt, Artificial Sequence
  CIITA targeting sequence
ugaccucaagugauccuccu

SEQ ID NO: 30994 - RNA, 20 nt, Artificial Sequence
  CIITA targeting sequence
ggaguuccagaccagccugg

SEQ ID NO: 30995 - RNA, 20 nt, Artificial Sequence
  CIITA targeting sequence
agugauccuccugucucggg

SEQ ID NO: 30996 - RNA, 20 nt, Artificial Sequence
  CIITA targeting sequence
cuugaggucaggaguuccag

SEQ ID NO: 30997 - RNA, 20 nt, Artificial Sequence
  CIITA targeting sequence
uccugucucgggcucccaaa

SEQ ID NO: 30998 - RNA, 20 nt, Artificial Sequence
  CIITA targeting sequence
ugucucgggcucccaaaaug

SEQ ID NO: 30999 - RNA, 20 nt, Artificial Sequence
  CIITA targeting sequence
cgggcucccaaaauguuggg

SEQ ID NO: 31000 - RNA, 20 nt, Artificial Sequence
  CIITA targeting sequence
ggcucccaaaauguugggau

SEQ ID NO: 31001 - RNA, 20 nt, Artificial Sequence
  CIITA targeting sequence
caaaauguugggauuacagg

SEQ ID NO: 31002 - RNA, 20 nt, Artificial Sequence
  CIITA targeting sequence
caacauuuugggagcccgag

SEQ ID NO: 31003 - RNA, 20 nt, Artificial Sequence
  CIITA targeting sequence
cacccggccugcuaauuuua

SEQ ID NO: 31004 - RNA, 20 nt, Artificial Sequence
  CIITA targeting sequence
acaaaaaauaaaauuagcag

SEQ ID NO: 31005 - RNA, 20 nt, Artificial Sequence
  CIITA targeting sequence
cuacaaaaaauaaaauuagc

SEQ ID NO: 31006 - RNA, 20 nt, Artificial Sequence
  CIITA targeting sequence
ugucucuacaaaaaauaaaa

SEQ ID NO: 31007 - RNA, 20 nt, Artificial Sequence
  CIITA targeting sequence
ggcauccugucucuacaaaa

SEQ ID NO: 31008 - RNA, 20 nt, Artificial Sequence
  CIITA targeting sequence
gugcuucuggcauccugucu

SEQ ID NO: 31009 - RNA, 20 nt, Artificial Sequence
  CIITA targeting sequence
cugugcuucuggcauccugu

SEQ ID NO: 31010 - RNA, 20 nt, Artificial Sequence
  CIITA targeting sequence
ccucucugugcuucuggcau

SEQ ID NO: 31011 - RNA, 20 nt, Artificial Sequence
  CIITA targeting sequence
agaccagggaacaaaaggga

SEQ ID NO: 31012 - RNA, 20 nt, Artificial Sequence
  CIITA targeting sequence
ggaauuuccccucucugugc

SEQ ID NO: 31013 - RNA, 20 nt, Artificial Sequence
  CIITA targeting sequence
cuggucuggaauuuccccuc

SEQ ID NO: 31014 - RNA, 20 nt, Artificial Sequence
  CIITA targeting sequence
cuuuuguucccuggucugga

SEQ ID NO: 31015 - RNA, 20 nt, Artificial Sequence
  CIITA targeting sequence
aaacuuggcugucccuuuug

SEQ ID NO: 31016 - RNA, 20 nt, Artificial Sequence
  CIITA targeting sequence
ccagcaacacacccugucac

SEQ ID NO: 31017 - RNA, 20 nt, Artificial Sequence
  CIITA targeting sequence
ccagggacguggagaaguca

SEQ ID NO: 31018 - RNA, 20 nt, Artificial Sequence
  CIITA targeting sequence
cuggugacaggguguguugc

SEQ ID NO: 31019 - RNA, 20 nt, Artificial Sequence
  CIITA targeting sequence
acgucccuggugacagggug

SEQ ID NO: 31020 - RNA, 20 nt, Artificial Sequence
  CIITA targeting sequence
ccacgucccuggugacaggg

SEQ ID NO: 31021 - RNA, 20 nt, Artificial Sequence
  CIITA targeting sequence
gcaaacaggccaaagaaggc

SEQ ID NO: 31022 - RNA, 20 nt, Artificial Sequence
  CIITA targeting sequence
uuggccuguuugcugacuuc

SEQ ID NO: 31023 - RNA, 20 nt, Artificial Sequence
  CIITA targeting sequence
ugucacucaagggccuggac

SEQ ID NO: 31024 - RNA, 20 nt, Artificial Sequence
  CIITA targeting sequence
cucaagggccuggacaagag

SEQ ID NO: 31025 - RNA, 20 nt, Artificial Sequence
  CIITA targeting sequence
agggccuggacaagagacag

SEQ ID NO: 31026 - RNA, 20 nt, Artificial Sequence
  CIITA targeting sequence
aggcccuugagugacaagag

SEQ ID NO: 31027 - RNA, 20 nt, Artificial Sequence
  CIITA targeting sequence
uguccaggcccuugagugac

SEQ ID NO: 31028 - RNA, 20 nt, Artificial Sequence
  CIITA targeting sequence
cuuguccaggcccuugagug

SEQ ID NO: 31029 - RNA, 20 nt, Artificial Sequence
  CIITA targeting sequence
gucucuuguccaggcccuug

SEQ ID NO: 31030 - RNA, 20 nt, Artificial Sequence
  CIITA targeting sequence
ggucaacagggccuucucug

SEQ ID NO: 31031 - RNA, 20 nt, Artificial Sequence
  CIITA targeting sequence
acagggccuucucugcggcc

SEQ ID NO: 31032 - RNA, 20 nt, Artificial Sequence
  CIITA targeting sequence
cugcggccagccgggauggg

SEQ ID NO: 31033 - RNA, 20 nt, Artificial Sequence
  CIITA targeting sequence
gcggccagccgggauggggg

SEQ ID NO: 31034 - RNA, 20 nt, Artificial Sequence
  CIITA targeting sequence
cggcuggccgcagagaaggc

SEQ ID NO: 31035 - RNA, 20 nt, Artificial Sequence
  CIITA targeting sequence
cccaucccggcuggccgcag

SEQ ID NO: 31036 - RNA, 20 nt, Artificial Sequence
  CIITA targeting sequence
cagccacugucccccauccc

SEQ ID NO: 31037 - RNA, 20 nt, Artificial Sequence
  CIITA targeting sequence
acuggggucacagccacugu

SEQ ID NO: 31038 - RNA, 20 nt, Artificial Sequence
  CIITA targeting sequence
uguccacuggggucacagcc

SEQ ID NO: 31039 - RNA, 20 nt, Artificial Sequence
  CIITA targeting sequence
agggcccauccuguccacug

SEQ ID NO: 31040 - RNA, 20 nt, Artificial Sequence
  CIITA targeting sequence
gccuccuguuggagcagcca

SEQ ID NO: 31041 - RNA, 20 nt, Artificial Sequence
  CIITA targeting sequence
uguuggagcagccagagguc

SEQ ID NO: 31042 - RNA, 20 nt, Artificial Sequence
  CIITA targeting sequence
aacaggaggcagagguccag

SEQ ID NO: 31043 - RNA, 20 nt, Artificial Sequence
  CIITA targeting sequence
ggcugcuccaacaggaggca

SEQ ID NO: 31044 - RNA, 20 nt, Artificial Sequence
  CIITA targeting sequence
gcaggccccucccauggagg

SEQ ID NO: 31045 - RNA, 20 nt, Artificial Sequence
  CIITA targeting sequence
cauggaggcagggcugggga

SEQ ID NO: 31046 - RNA, 20 nt, Artificial Sequence
  CIITA targeting sequence
augggaggggccugccgacc

SEQ ID NO: 31047 - RNA, 20 nt, Artificial Sequence
  CIITA targeting sequence
ccagcccugccuccauggga

SEQ ID NO: 31048 - RNA, 20 nt, Artificial Sequence
  CIITA targeting sequence
ugacacuggucgcucccuua

SEQ ID NO: 31049 - RNA, 20 nt, Artificial Sequence
  CIITA targeting sequence
ugaccuccccagcccugccu

SEQ ID NO: 31050 - RNA, 20 nt, Artificial Sequence
  CIITA targeting sequence
cucccuuagcagccgggggg

SEQ ID NO: 31051 - RNA, 20 nt, Artificial Sequence
  CIITA targeting sequence
cuuagcagccggggggucug

SEQ ID NO: 31052 - RNA, 20 nt, Artificial Sequence
  CIITA targeting sequence
gaagcuugucccuacuagag

SEQ ID NO: 31053 - RNA, 20 nt, Artificial Sequence
  CIITA targeting sequence
gaccccccggcugcuaaggg

SEQ ID NO: 31054 - RNA, 20 nt, Artificial Sequence
  CIITA targeting sequence
cuacuagagaaagugaccua

SEQ ID NO: 31055 - RNA, 20 nt, Artificial Sequence
  CIITA targeting sequence
aguagggacaagcuucagac

SEQ ID NO: 31056 - RNA, 20 nt, Artificial Sequence
  CIITA targeting sequence
cuaguagggacaagcuucag

SEQ ID NO: 31057 - RNA, 20 nt, Artificial Sequence
  CIITA targeting sequence
cuuucucuaguagggacaag

SEQ ID NO: 31058 - RNA, 20 nt, Artificial Sequence
  CIITA targeting sequence
ggaacugcggaucuuuccca

SEQ ID NO: 31059 - RNA, 20 nt, Artificial Sequence
  CIITA targeting sequence
ugaccaagcagggcccggcu

SEQ ID NO: 31060 - RNA, 20 nt, Artificial Sequence
  CIITA targeting sequence
gcaguuccugaccaagcagg

SEQ ID NO: 31061 - RNA, 20 nt, Artificial Sequence
  CIITA targeting sequence
uucccacuucucccugcacc

SEQ ID NO: 31062 - RNA, 20 nt, Artificial Sequence
  CIITA targeting sequence
cacuucucccugcaccacuc

SEQ ID NO: 31063 - RNA, 20 nt, Artificial Sequence
  CIITA targeting sequence
cccugcaccacucaucaugc

SEQ ID NO: 31064 - RNA, 20 nt, Artificial Sequence
  CIITA targeting sequence
cugcaccacucaucaugcuc

SEQ ID NO: 31065 - RNA, 20 nt, Artificial Sequence
  CIITA targeting sequence
ucaugcucugaccacaaugg

SEQ ID NO: 31066 - RNA, 20 nt, Artificial Sequence
  CIITA targeting sequence
ugcucugaccacaauggcca

SEQ ID NO: 31067 - RNA, 20 nt, Artificial Sequence
  CIITA targeting sequence
gaccacaauggccagacucc

SEQ ID NO: 31068 - RNA, 20 nt, Artificial Sequence
  CIITA targeting sequence
gagcaugaugaguggugcag

SEQ ID NO: 31069 - RNA, 20 nt, Artificial Sequence
  CIITA targeting sequence
ggccauuguggucagagcau

SEQ ID NO: 31070 - RNA, 20 nt, Artificial Sequence
  CIITA targeting sequence
aagauuuucagaaacuucca

SEQ ID NO: 31071 - RNA, 20 nt, Artificial Sequence
  CIITA targeting sequence
uggagucuggccauuguggu

SEQ ID NO: 31072 - RNA, 20 nt, Artificial Sequence
  CIITA targeting sequence
gaaacuuccaagccucuucc

SEQ ID NO: 31073 - RNA, 20 nt, Artificial Sequence
  CIITA targeting sequence
gaaaaucuuggagucuggcc

SEQ ID NO: 31074 - RNA, 20 nt, Artificial Sequence
  CIITA targeting sequence
aagccucuuccuggcucagg

SEQ ID NO: 31075 - RNA, 20 nt, Artificial Sequence
  CIITA targeting sequence
uccuggcucagggccuucgc

SEQ ID NO: 31076 - RNA, 20 nt, Artificial Sequence
  CIITA targeting sequence
uggcucagggccuucgcucc

SEQ ID NO: 31077 - RNA, 20 nt, Artificial Sequence
  CIITA targeting sequence
gggccuucgcuccugcugac

SEQ ID NO: 31078 - RNA, 20 nt, Artificial Sequence
  CIITA targeting sequence
cuccugcugacucccuggcc

SEQ ID NO: 31079 - RNA, 20 nt, Artificial Sequence
  CIITA targeting sequence
ugcugacucccuggccagga

SEQ ID NO: 31080 - RNA, 20 nt, Artificial Sequence
  CIITA targeting sequence
gcaggagcgaaggcccugag

SEQ ID NO: 31081 - RNA, 20 nt, Artificial Sequence
  CIITA targeting sequence
cuggccaggaaagcccuucu

SEQ ID NO: 31082 - RNA, 20 nt, Artificial Sequence
  CIITA targeting sequence
uggccagggagucagcagga

SEQ ID NO: 31083 - RNA, 20 nt, Artificial Sequence
  CIITA targeting sequence
ccuccugauuuucucagggc

SEQ ID NO: 31084 - RNA, 20 nt, Artificial Sequence
  CIITA targeting sequence
uccugauuuucucagggcug

SEQ ID NO: 31085 - RNA, 20 nt, Artificial Sequence
  CIITA targeting sequence
ugauuuucucagggcugaaa

SEQ ID NO: 31086 - RNA, 20 nt, Artificial Sequence
  CIITA targeting sequence
ggaggagaagggcuuuccug

SEQ ID NO: 31087 - RNA, 20 nt, Artificial Sequence
  CIITA targeting sequence
cagggcugaaaauaugaggu

SEQ ID NO: 31088 - RNA, 20 nt, Artificial Sequence
  CIITA targeting sequence
gggcugaaaauaugaggucu

SEQ ID NO: 31089 - RNA, 20 nt, Artificial Sequence
  CIITA targeting sequence
gcccugagaaaaucaggagg

SEQ ID NO: 31090 - RNA, 20 nt, Artificial Sequence
  CIITA targeting sequence
uauuuucagcccugagaaaa

SEQ ID NO: 31091 - RNA, 20 nt, Artificial Sequence
  CIITA targeting sequence
ccccgcaaggggccuucccu

SEQ ID NO: 31092 - RNA, 20 nt, Artificial Sequence
  CIITA targeting sequence
ccgcaaggggccuucccuga

SEQ ID NO: 31093 - RNA, 20 nt, Artificial Sequence
  CIITA targeting sequence
cugaagcccagcucaugucc

SEQ ID NO: 31094 - RNA, 20 nt, Artificial Sequence
  CIITA targeting sequence
gggaaggccccuugcgggga

SEQ ID NO: 31095 - RNA, 20 nt, Artificial Sequence
  CIITA targeting sequence
ugucccacccaguuucucag

SEQ ID NO: 31096 - RNA, 20 nt, Artificial Sequence
  CIITA targeting sequence
cacccaguuucucagucccu

SEQ ID NO: 31097 - RNA, 20 nt, Artificial Sequence
  CIITA targeting sequence
cagucccucuugagggucug

SEQ ID NO: 31098 - RNA, 20 nt, Artificial Sequence
  CIITA targeting sequence
gucccucuugagggucuggg

SEQ ID NO: 31099 - RNA, 20 nt, Artificial Sequence
  CIITA targeting sequence
cucuugagggucugggaucu

SEQ ID NO: 31100 - RNA, 20 nt, Artificial Sequence
  CIITA targeting sequence
ugagggucugggaucuagac

SEQ ID NO: 31101 - RNA, 20 nt, Artificial Sequence
  CIITA targeting sequence
agagggacugagaaacuggg

SEQ ID NO: 31102 - RNA, 20 nt, Artificial Sequence
  CIITA targeting sequence
gggaucuagacuguggccug

SEQ ID NO: 31103 - RNA, 20 nt, Artificial Sequence
  CIITA targeting sequence
cagacccucaagagggacug

SEQ ID NO: 31104 - RNA, 20 nt, Artificial Sequence
  CIITA targeting sequence
agacuguggccugacauguu

SEQ ID NO: 31105 - RNA, 20 nt, Artificial Sequence
  CIITA targeting sequence
agaucccagacccucaagag

SEQ ID NO: 31106 - RNA, 20 nt, Artificial Sequence
  CIITA targeting sequence
ggccacagucuagaucccag

SEQ ID NO: 31107 - RNA, 20 nt, Artificial Sequence
  CIITA targeting sequence
cuuucuagcacuuucuacga

SEQ ID NO: 31108 - RNA, 20 nt, Artificial Sequence
  CIITA targeting sequence
agcacuuucuacgaucucua

SEQ ID NO: 31109 - RNA, 20 nt, Artificial Sequence
  CIITA targeting sequence
acgaucucuaauucucuugu

SEQ ID NO: 31110 - RNA, 20 nt, Artificial Sequence
  CIITA targeting sequence
uagaaagugcuagaaaggga

SEQ ID NO: 31111 - RNA, 20 nt, Artificial Sequence
  CIITA targeting sequence
cuaauucucuuguuuucuua

SEQ ID NO: 31112 - RNA, 20 nt, Artificial Sequence
  CIITA targeting sequence
aauucucuuguuuucuuauu

SEQ ID NO: 31113 - RNA, 20 nt, Artificial Sequence
  CIITA targeting sequence
cuuguuuucuuauugguuua

SEQ ID NO: 31114 - RNA, 20 nt, Artificial Sequence
  CIITA targeting sequence
uguuuucuuauugguuuagu

SEQ ID NO: 31115 - RNA, 20 nt, Artificial Sequence
  CIITA targeting sequence
uauugguuuaguaagauucc

SEQ ID NO: 31116 - RNA, 20 nt, Artificial Sequence
  CIITA targeting sequence
uacuaaaccaauaagaaaac

SEQ ID NO: 31117 - RNA, 20 nt, Artificial Sequence
  CIITA targeting sequence
ccuccccaugccuccacuag

SEQ ID NO: 31118 - RNA, 20 nt, Artificial Sequence
  CIITA targeting sequence
ccaugccuccacuaggguac

SEQ ID NO: 31119 - RNA, 20 nt, Artificial Sequence
  CIITA targeting sequence
acuaggguacugucuccaua

SEQ ID NO: 31120 - RNA, 20 nt, Artificial Sequence
  CIITA targeting sequence
ccauaagggcaggcgucucu

SEQ ID NO: 31121 - RNA, 20 nt, Artificial Sequence
  CIITA targeting sequence
auaagggcaggcgucucuua

SEQ ID NO: 31122 - RNA, 20 nt, Artificial Sequence
  CIITA targeting sequence
cuuaaguucauagagcaugg

SEQ ID NO: 31123 - RNA, 20 nt, Artificial Sequence
  CIITA targeting sequence
uaaguucauagagcaugggg

SEQ ID NO: 31124 - RNA, 20 nt, Artificial Sequence
  CIITA targeting sequence
uagagcauggggccagguac

SEQ ID NO: 31125 - RNA, 20 nt, Artificial Sequence
  CIITA targeting sequence
augaacuuaagagacgccug

SEQ ID NO: 31126 - RNA, 20 nt, Artificial Sequence
  CIITA targeting sequence
acaagccagccagagagugg

SEQ ID NO: 31127 - RNA, 20 nt, Artificial Sequence
  CIITA targeting sequence
ggcuggcuuguggaaugcca

SEQ ID NO: 31128 - RNA, 20 nt, Artificial Sequence
  CIITA targeting sequence
cuggcuggcuuguggaaugc

SEQ ID NO: 31129 - RNA, 20 nt, Artificial Sequence
  CIITA targeting sequence
cccacucucuggcuggcuug

SEQ ID NO: 31130 - RNA, 20 nt, Artificial Sequence
  CIITA targeting sequence
cuuuguucacccacucucug

SEQ ID NO: 31131 - RNA, 20 nt, Artificial Sequence
  CIITA targeting sequence
ucccuuuguucacccacucu

SEQ ID NO: 31132 - RNA, 20 nt, Artificial Sequence
  CIITA targeting sequence
cucaucccuuuguucaccca

SEQ ID NO: 31133 - RNA, 20 nt, Artificial Sequence
  CIITA targeting sequence
gaacacacgccuggcagcga

SEQ ID NO: 31134 - RNA, 20 nt, Artificial Sequence
  CIITA targeting sequence
gagucgcucaucccuuuguu

SEQ ID NO: 31135 - RNA, 20 nt, Artificial Sequence
  CIITA targeting sequence
cugccaggcguguguucuga

SEQ ID NO: 31136 - RNA, 20 nt, Artificial Sequence
  CIITA targeting sequence
cugcagaguccccugaugag

SEQ ID NO: 31137 - RNA, 20 nt, Artificial Sequence
  CIITA targeting sequence
gcagaguccccugaugagga

SEQ ID NO: 31138 - RNA, 20 nt, Artificial Sequence
  CIITA targeting sequence
gcagagauucgcugccaggc

SEQ ID NO: 31139 - RNA, 20 nt, Artificial Sequence
  CIITA targeting sequence
ccugaugaggaccuuacaau

SEQ ID NO: 31140 - RNA, 20 nt, Artificial Sequence
  CIITA targeting sequence
ggggacucugcagagauucg

SEQ ID NO: 31141 - RNA, 20 nt, Artificial Sequence
  CIITA targeting sequence
ucaggggacucugcagagau

SEQ ID NO: 31142 - RNA, 20 nt, Artificial Sequence
  CIITA targeting sequence
ucaucaggggacucugcaga

SEQ ID NO: 31143 - RNA, 20 nt, Artificial Sequence
  CIITA targeting sequence
ggggacacagagaccuggau

SEQ ID NO: 31144 - RNA, 20 nt, Artificial Sequence
  CIITA targeting sequence
ccugaauuguaagguccuca

SEQ ID NO: 31145 - RNA, 20 nt, Artificial Sequence
  CIITA targeting sequence
guguccccugaauuguaagg

SEQ ID NO: 31146 - RNA, 20 nt, Artificial Sequence
  CIITA targeting sequence
cuguguccccugaauuguaa

SEQ ID NO: 31147 - RNA, 20 nt, Artificial Sequence
  CIITA targeting sequence
aggucucuguguccccugaa

SEQ ID NO: 31148 - RNA, 20 nt, Artificial Sequence
  CIITA targeting sequence
cgaggggucuggucucaauc

SEQ ID NO: 31149 - RNA, 20 nt, Artificial Sequence
  CIITA targeting sequence
ggaggcaauaauccaggucu

SEQ ID NO: 31150 - RNA, 20 nt, Artificial Sequence
  CIITA targeting sequence
ggucucaaucuaguucucuc

SEQ ID NO: 31151 - RNA, 20 nt, Artificial Sequence
  CIITA targeting sequence
caaucuaguucucucuuuca

SEQ ID NO: 31152 - RNA, 20 nt, Artificial Sequence
  CIITA targeting sequence
aucuaguucucucuuucaca

SEQ ID NO: 31153 - RNA, 20 nt, Artificial Sequence
  CIITA targeting sequence
aguucucucuuucacacaca

SEQ ID NO: 31154 - RNA, 20 nt, Artificial Sequence
  CIITA targeting sequence
cucuuucacacacacacaca

SEQ ID NO: 31155 - RNA, 20 nt, Artificial Sequence
  CIITA targeting sequence
cuuucacacacacacacaca

SEQ ID NO: 31156 - RNA, 20 nt, Artificial Sequence
  CIITA targeting sequence
uucacacacacacacacaca

SEQ ID NO: 31157 - RNA, 20 nt, Artificial Sequence
  CIITA targeting sequence
cacacacacacacacacaca

SEQ ID NO: 31158 - RNA, 20 nt, Artificial Sequence
  CIITA targeting sequence
gcacaggcccaccugucccc

SEQ ID NO: 31159 - RNA, 20 nt, Artificial Sequence
  CIITA targeting sequence
ccaucccucccaaaacgccc

SEQ ID NO: 31160 - RNA, 20 nt, Artificial Sequence
  CIITA targeting sequence
cucccaaaacgcccugcccu

SEQ ID NO: 31161 - RNA, 20 nt, Artificial Sequence
  CIITA targeting sequence
caaaacgcccugcccugcau

SEQ ID NO: 31162 - RNA, 20 nt, Artificial Sequence
  CIITA targeting sequence
acauggaggacgcauuuaag

SEQ ID NO: 31163 - RNA, 20 nt, Artificial Sequence
  CIITA targeting sequence
auguugacaugcagggcagg

SEQ ID NO: 31164 - RNA, 20 nt, Artificial Sequence
  CIITA targeting sequence
uccauguugacaugcagggc

SEQ ID NO: 31165 - RNA, 20 nt, Artificial Sequence
  CIITA targeting sequence
uagcuuaaaugcguccucca

SEQ ID NO: 31166 - RNA, 20 nt, Artificial Sequence
  CIITA targeting sequence
ccgccucauagcuuaaaugc

SEQ ID NO: 31167 - RNA, 20 nt, Artificial Sequence
  CIITA targeting sequence
gggcuccccgccucauagcu

SEQ ID NO: 31168 - RNA, 20 nt, Artificial Sequence
  CIITA targeting sequence
gccgcagggagguuggguug

SEQ ID NO: 31169 - RNA, 20 nt, Artificial Sequence
  CIITA targeting sequence
cugcggcggagggccaggca

SEQ ID NO: 31170 - RNA, 20 nt, Artificial Sequence
  CIITA targeting sequence
cgcugcccgccccaacccaa

SEQ ID NO: 31171 - RNA, 20 nt, Artificial Sequence
  CIITA targeting sequence
aagucccgcugcccgcccca

SEQ ID NO: 31172 - RNA, 20 nt, Artificial Sequence
  CIITA targeting sequence
uggguaaucuaagucccgcu

SEQ ID NO: 31173 - RNA, 20 nt, Artificial Sequence
  CIITA targeting sequence
gguccuggguaaucuaaguc

SEQ ID NO: 31174 - RNA, 20 nt, Artificial Sequence
  CIITA targeting sequence
caaaucggguccuggguaau

SEQ ID NO: 31175 - RNA, 20 nt, Artificial Sequence
  CIITA targeting sequence
ugcaggaggagcccaagcaa

SEQ ID NO: 31176 - RNA, 20 nt, Artificial Sequence
  CIITA targeting sequence
ugcaagaggcccccagggcu

SEQ ID NO: 31177 - RNA, 20 nt, Artificial Sequence
  CIITA targeting sequence
uccugcaagaggcccccagg

SEQ ID NO: 31178 - RNA, 20 nt, Artificial Sequence
  CIITA targeting sequence
gcgagccagcaggcaggcug

SEQ ID NO: 31179 - RNA, 20 nt, Artificial Sequence
  CIITA targeting sequence
cagaccugcuagggcaggca

SEQ ID NO: 31180 - RNA, 20 nt, Artificial Sequence
  CIITA targeting sequence
cguaagugguggcagccugc

SEQ ID NO: 31181 - RNA, 20 nt, Artificial Sequence
  CIITA targeting sequence
acugaggagaaagaguggua

SEQ ID NO: 31182 - RNA, 20 nt, Artificial Sequence
  CIITA targeting sequence
guggagcauuucccguaagu

SEQ ID NO: 31183 - RNA, 20 nt, Artificial Sequence
  CIITA targeting sequence
ucaguggagcauuucccgua

SEQ ID NO: 31184 - RNA, 20 nt, Artificial Sequence
  CIITA targeting sequence
ccucaguggagcauuucccg

SEQ ID NO: 31185 - RNA, 20 nt, Artificial Sequence
  CIITA targeting sequence
uucuccucaguggagcauuu

SEQ ID NO: 31186 - RNA, 20 nt, Artificial Sequence
  CIITA targeting sequence
agacugggucaggaagcuuu

SEQ ID NO: 31187 - RNA, 20 nt, Artificial Sequence
  CIITA targeting sequence
ggacaggggccagggcuggg

SEQ ID NO: 31188 - RNA, 20 nt, Artificial Sequence
  CIITA targeting sequence
ggaagcuuugcccugugcca

SEQ ID NO: 31189 - RNA, 20 nt, Artificial Sequence
  CIITA targeting sequence
ugacccagucuggacagggg

SEQ ID NO: 31190 - RNA, 20 nt, Artificial Sequence
  CIITA targeting sequence
cccacgcaggcucaguuccu

SEQ ID NO: 31191 - RNA, 20 nt, Artificial Sequence
  CIITA targeting sequence
guuccuccccagacggcuug

SEQ ID NO: 31192 - RNA, 20 nt, Artificial Sequence
  CIITA targeting sequence
uccccagacggcuuguccag

SEQ ID NO: 31193 - RNA, 20 nt, Artificial Sequence
  CIITA targeting sequence
ccagacggcuuguccagaga

SEQ ID NO: 31194 - RNA, 20 nt, Artificial Sequence
  CIITA targeting sequence
ggggaggaacugagccugcg

SEQ ID NO: 31195 - RNA, 20 nt, Artificial Sequence
  CIITA targeting sequence
agagacccacaaggcaagcc

SEQ ID NO: 31196 - RNA, 20 nt, Artificial Sequence
  CIITA targeting sequence
ggacaagccgucuggggagg

SEQ ID NO: 31197 - RNA, 20 nt, Artificial Sequence
  CIITA targeting sequence
cuggacaagccgucugggga

SEQ ID NO: 31198 - RNA, 20 nt, Artificial Sequence
  CIITA targeting sequence
ccggcuugccuugugggucu

SEQ ID NO: 31199 - RNA, 20 nt, Artificial Sequence
  CIITA targeting sequence
cugcccaucucucuccuucc

SEQ ID NO: 31200 - RNA, 20 nt, Artificial Sequence
  CIITA targeting sequence
cucuccuuccuguguaucca

SEQ ID NO: 31201 - RNA, 20 nt, Artificial Sequence
  CIITA targeting sequence
cuccuuccuguguauccaaa

SEQ ID NO: 31202 - RNA, 20 nt, Artificial Sequence
  CIITA targeting sequence
ccuuccuguguauccaaagc

SEQ ID NO: 31203 - RNA, 20 nt, Artificial Sequence
  CIITA targeting sequence
uuccuguguauccaaagcaa

SEQ ID NO: 31204 - RNA, 20 nt, Artificial Sequence
  CIITA targeting sequence
uguguauccaaagcaacaac

SEQ ID NO: 31205 - RNA, 20 nt, Artificial Sequence
  CIITA targeting sequence
aaagcaacaacaacaaaaac

SEQ ID NO: 31206 - RNA, 20 nt, Artificial Sequence
  CIITA targeting sequence
acaaacugcuguuuugguuu

SEQ ID NO: 31207 - RNA, 20 nt, Artificial Sequence
  CIITA targeting sequence
gacacuuugcagucagcgug

SEQ ID NO: 31208 - RNA, 20 nt, Artificial Sequence
  CIITA targeting sequence
gaguccacaaacugcuguuu

SEQ ID NO: 31209 - RNA, 20 nt, Artificial Sequence
  CIITA targeting sequence
gcgugcuuugaagcucagcu

SEQ ID NO: 31210 - RNA, 20 nt, Artificial Sequence
  CIITA targeting sequence
aagcacgcugacugcaaagu

SEQ ID NO: 31211 - RNA, 20 nt, Artificial Sequence
  CIITA targeting sequence
gcucugccucuuaucagccg

SEQ ID NO: 31212 - RNA, 20 nt, Artificial Sequence
  CIITA targeting sequence
gccucuuaucagccgggaaa

SEQ ID NO: 31213 - RNA, 20 nt, Artificial Sequence
  CIITA targeting sequence
uaucagccgggaaauaaaua

SEQ ID NO: 31214 - RNA, 20 nt, Artificial Sequence
  CIITA targeting sequence
gccgggaaauaaauagcuug

SEQ ID NO: 31215 - RNA, 20 nt, Artificial Sequence
  CIITA targeting sequence
cggcugauaagaggcagagc

SEQ ID NO: 31216 - RNA, 20 nt, Artificial Sequence
  CIITA targeting sequence
aagcuauuuauuucccggcu

SEQ ID NO: 31217 - RNA, 20 nt, Artificial Sequence
  CIITA targeting sequence
cugaaccucaguuuccuuca

SEQ ID NO: 31218 - RNA, 20 nt, Artificial Sequence
  CIITA targeting sequence
gaaccucaguuuccuucagu

SEQ ID NO: 31219 - RNA, 20 nt, Artificial Sequence
  CIITA targeting sequence
gagagguuuaguaacuuguc

SEQ ID NO: 31220 - RNA, 20 nt, Artificial Sequence
  CIITA targeting sequence
guuuccuucagugugaaaug

SEQ ID NO: 31221 - RNA, 20 nt, Artificial Sequence
  CIITA targeting sequence
uucagugugaaaugagaauc

SEQ ID NO: 31222 - RNA, 20 nt, Artificial Sequence
  CIITA targeting sequence
gugugaaaugagaaucauga

SEQ ID NO: 31223 - RNA, 20 nt, Artificial Sequence
  CIITA targeting sequence
cacugaaggaaacugagguu

SEQ ID NO: 31224 - RNA, 20 nt, Artificial Sequence
  CIITA targeting sequence
uuucacacugaaggaaacug

SEQ ID NO: 31225 - RNA, 20 nt, Artificial Sequence
  CIITA targeting sequence
cauuucacacugaaggaaac

SEQ ID NO: 31226 - RNA, 20 nt, Artificial Sequence
  CIITA targeting sequence
ugaccuguuuuaagggccgu

SEQ ID NO: 31227 - RNA, 20 nt, Artificial Sequence
  CIITA targeting sequence
ugauucucauuucacacuga

SEQ ID NO: 31228 - RNA, 20 nt, Artificial Sequence
  CIITA targeting sequence
cggcccuuaaaacaggucau

SEQ ID NO: 31229 - RNA, 20 nt, Artificial Sequence
  CIITA targeting sequence
acaccuguggguauuucuag

SEQ ID NO: 31230 - RNA, 20 nt, Artificial Sequence
  CIITA targeting sequence
agucggaugggacaagagac

SEQ ID NO: 31231 - RNA, 20 nt, Artificial Sequence
  CIITA targeting sequence
gaugggacaagagacugaga

SEQ ID NO: 31232 - RNA, 20 nt, Artificial Sequence
  CIITA targeting sequence
gacuagaaauacccacaggu

SEQ ID NO: 31233 - RNA, 20 nt, Artificial Sequence
  CIITA targeting sequence
cauccgacuagaaauaccca

SEQ ID NO: 31234 - RNA, 20 nt, Artificial Sequence
  CIITA targeting sequence
ugucccauccgacuagaaau

SEQ ID NO: 31235 - RNA, 20 nt, Artificial Sequence
  CIITA targeting sequence
cuugucccauccgacuagaa

SEQ ID NO: 31236 - RNA, 20 nt, Artificial Sequence
  CIITA targeting sequence
gucucuugucccauccgacu

SEQ ID NO: 31237 - RNA, 20 nt, Artificial Sequence
  CIITA targeting sequence
cagucucuugucccauccga

SEQ ID NO: 31238 - RNA, 20 nt, Artificial Sequence
  CIITA targeting sequence
uuucucagucucuuguccca

SEQ ID NO: 31239 - RNA, 20 nt, Artificial Sequence
  CIITA targeting sequence
uauuucuuuucucagucucu

SEQ ID NO: 31240 - RNA, 20 nt, Artificial Sequence
  CIITA targeting sequence
gugucuuauuucuuuucuca

SEQ ID NO: 31241 - RNA, 20 nt, Artificial Sequence
  CIITA targeting sequence
cugugucuuauuucuuuucu

SEQ ID NO: 31242 - RNA, 20 nt, Artificial Sequence
  CIITA targeting sequence
auacuuugucucugugucuu

SEQ ID NO: 31243 - RNA, 20 nt, Artificial Sequence
  CIITA targeting sequence
cuauacuuugucucuguguc

SEQ ID NO: 31244 - RNA, 20 nt, Artificial Sequence
  CIITA targeting sequence
ccugggcccacuguuauuuc

SEQ ID NO: 31245 - RNA, 20 nt, Artificial Sequence
  CIITA targeting sequence
gcauaccaaggaccugcacc

SEQ ID NO: 31246 - RNA, 20 nt, Artificial Sequence
  CIITA targeting sequence
uugguaugcugagcgcgggu

SEQ ID NO: 31247 - RNA, 20 nt, Artificial Sequence
  CIITA targeting sequence
cugaguucccucaguuuuua

SEQ ID NO: 31248 - RNA, 20 nt, Artificial Sequence
  CIITA targeting sequence
gaguucccucaguuuuuauc

SEQ ID NO: 31249 - RNA, 20 nt, Artificial Sequence
  CIITA targeting sequence
gagaccggugccggugcccg

SEQ ID NO: 31250 - RNA, 20 nt, Artificial Sequence
  CIITA targeting sequence
cucaguuuuuaucgauuauu

SEQ ID NO: 31251 - RNA, 20 nt, Artificial Sequence
  CIITA targeting sequence
guuuuuaucgauuauuaucu

SEQ ID NO: 31252 - RNA, 20 nt, Artificial Sequence
  CIITA targeting sequence
auuauuaucuucauuauuuc

SEQ ID NO: 31253 - RNA, 20 nt, Artificial Sequence
  CIITA targeting sequence
auaaaaacugagggaacuca

SEQ ID NO: 31254 - RNA, 20 nt, Artificial Sequence
  CIITA targeting sequence
ucauuauuucagcaaaaagg

SEQ ID NO: 31255 - RNA, 20 nt, Artificial Sequence
  CIITA targeting sequence
uuauuucagcaaaaaggaau

SEQ ID NO: 31256 - RNA, 20 nt, Artificial Sequence
  CIITA targeting sequence
gcaaaaaggaaugcaguagg

SEQ ID NO: 31257 - RNA, 20 nt, Artificial Sequence
  CIITA targeting sequence
uuuuugcugaaauaaugaag

SEQ ID NO: 31258 - RNA, 20 nt, Artificial Sequence
  CIITA targeting sequence
uacugcauuccuuuuugcug

SEQ ID NO: 31259 - RNA, 20 nt, Artificial Sequence
  CIITA targeting sequence
cccugcccuccuacugcauu

SEQ ID NO: 31260 - RNA, 20 nt, Artificial Sequence
  CIITA targeting sequence
uuauuaucacccugcccucc

SEQ ID NO: 31261 - RNA, 20 nt, Artificial Sequence
  CIITA targeting sequence
ccuuauuaucacccugcccu

SEQ ID NO: 31262 - RNA, 20 nt, Artificial Sequence
  CIITA targeting sequence
ucuccuuauuaucacccugc

SEQ ID NO: 31263 - RNA, 20 nt, Artificial Sequence
  CIITA targeting sequence
gcaauaaacaugugagcaau

SEQ ID NO: 31264 - RNA, 20 nt, Artificial Sequence
  CIITA targeting sequence
cauguuuauugcugaucuuc

SEQ ID NO: 31265 - RNA, 20 nt, Artificial Sequence
  CIITA targeting sequence
auugcucacauguuuauugc

SEQ ID NO: 31266 - RNA, 20 nt, Artificial Sequence
  CIITA targeting sequence
augucauaaugaaguucaag

SEQ ID NO: 31267 - RNA, 20 nt, Artificial Sequence
  CIITA targeting sequence
uaaugaaguucaagggaagg

SEQ ID NO: 31268 - RNA, 20 nt, Artificial Sequence
  CIITA targeting sequence
uuaugacauagauucuauug

SEQ ID NO: 31269 - RNA, 20 nt, Artificial Sequence
  CIITA targeting sequence
agggaagguacuaugacugg

SEQ ID NO: 31270 - RNA, 20 nt, Artificial Sequence
  CIITA targeting sequence
cuugaacuucauuaugacau

SEQ ID NO: 31271 - RNA, 20 nt, Artificial Sequence
  CIITA targeting sequence
uaguaccuucccuugaacuu

SEQ ID NO: 31272 - RNA, 20 nt, Artificial Sequence
  CIITA targeting sequence
agucauaguaccuucccuug

SEQ ID NO: 31273 - RNA, 20 nt, Artificial Sequence
  CIITA targeting sequence
ggcuuacgugcacguccagu

SEQ ID NO: 31274 - RNA, 20 nt, Artificial Sequence
  CIITA targeting sequence
cuccacccaaacaucucagu

SEQ ID NO: 31275 - RNA, 20 nt, Artificial Sequence
  CIITA targeting sequence
ccacccaaacaucucagugg

SEQ ID NO: 31276 - RNA, 20 nt, Artificial Sequence
  CIITA targeting sequence
acccaaacaucucaguggag

SEQ ID NO: 31277 - RNA, 20 nt, Artificial Sequence
  CIITA targeting sequence
caguggaguaaagaauaaca

SEQ ID NO: 31278 - RNA, 20 nt, Artificial Sequence
  CIITA targeting sequence
guggaguaaagaauaacaag

SEQ ID NO: 31279 - RNA, 20 nt, Artificial Sequence
  CIITA targeting sequence
acugagauguuuggguggag

SEQ ID NO: 31280 - RNA, 20 nt, Artificial Sequence
  CIITA targeting sequence
uuacuccacugagauguuug

SEQ ID NO: 31281 - RNA, 20 nt, Artificial Sequence
  CIITA targeting sequence
cgccucccaccauagggcgg

SEQ ID NO: 31282 - RNA, 20 nt, Artificial Sequence
  CIITA targeting sequence
ccucccaccauagggcggua

SEQ ID NO: 31283 - RNA, 20 nt, Artificial Sequence
  CIITA targeting sequence
caccauagggcgguauuucu

SEQ ID NO: 31284 - RNA, 20 nt, Artificial Sequence
  CIITA targeting sequence
cucaucucagaaaugaacaa

SEQ ID NO: 31285 - RNA, 20 nt, Artificial Sequence
  CIITA targeting sequence
caucucagaaaugaacaaau

SEQ ID NO: 31286 - RNA, 20 nt, Artificial Sequence
  CIITA targeting sequence
ucucagaaaugaacaaaugu

SEQ ID NO: 31287 - RNA, 20 nt, Artificial Sequence
  CIITA targeting sequence
cagaaaugaacaaauguaca

SEQ ID NO: 31288 - RNA, 20 nt, Artificial Sequence
  CIITA targeting sequence
gaaaugaacaaauguacaau

SEQ ID NO: 31289 - RNA, 20 nt, Artificial Sequence
  CIITA targeting sequence
gagaugagagaaauaccgcc

SEQ ID NO: 31290 - RNA, 20 nt, Artificial Sequence
  CIITA targeting sequence
uuucugagaugagagaaaua

SEQ ID NO: 31291 - RNA, 20 nt, Artificial Sequence
  CIITA targeting sequence
gguuuuauaccgagacauuc

SEQ ID NO: 31292 - RNA, 20 nt, Artificial Sequence
  CIITA targeting sequence
guauaaaaccugauuguaca

SEQ ID NO: 31293 - RNA, 20 nt, Artificial Sequence
  CIITA targeting sequence
cgguauaaaaccugauugua

SEQ ID NO: 31294 - RNA, 20 nt, Artificial Sequence
  CIITA targeting sequence
guucccaggggcaggcagga

SEQ ID NO: 31295 - RNA, 20 nt, Artificial Sequence
  CIITA targeting sequence
caggggcaggcaggagacag

SEQ ID NO: 31296 - RNA, 20 nt, Artificial Sequence
  CIITA targeting sequence
ugccugccccugggaaccga

SEQ ID NO: 31297 - RNA, 20 nt, Artificial Sequence
  CIITA targeting sequence
ccugccugccccugggaacc

SEQ ID NO: 31298 - RNA, 20 nt, Artificial Sequence
  CIITA targeting sequence
ucuaucucagcugcuagagg

SEQ ID NO: 31299 - RNA, 20 nt, Artificial Sequence
  CIITA targeting sequence
aucucagcugcuagaggcuu

SEQ ID NO: 31300 - RNA, 20 nt, Artificial Sequence
  CIITA targeting sequence
cagcugcuagaggcuuuccu

SEQ ID NO: 31301 - RNA, 20 nt, Artificial Sequence
  CIITA targeting sequence
gcugcuagaggcuuuccucu

SEQ ID NO: 31302 - RNA, 20 nt, Artificial Sequence
  CIITA targeting sequence
agcagcugagauagaggaag

SEQ ID NO: 31303 - RNA, 20 nt, Artificial Sequence
  CIITA targeting sequence
ucucuuacuaguccaccuca

SEQ ID NO: 31304 - RNA, 20 nt, Artificial Sequence
  CIITA targeting sequence
cuuacuaguccaccucagca

SEQ ID NO: 31305 - RNA, 20 nt, Artificial Sequence
  CIITA targeting sequence
uacuaguccaccucagcaca

SEQ ID NO: 31306 - RNA, 20 nt, Artificial Sequence
  CIITA targeting sequence
accucagcacagacccuuua

SEQ ID NO: 31307 - RNA, 20 nt, Artificial Sequence
  CIITA targeting sequence
gcacagacccuuuacgggug

SEQ ID NO: 31308 - RNA, 20 nt, Artificial Sequence
  CIITA targeting sequence
gugcugagguggacuaguaa

SEQ ID NO: 31309 - RNA, 20 nt, Artificial Sequence
  CIITA targeting sequence
ggcugggggacagucagguc

SEQ ID NO: 31310 - RNA, 20 nt, Artificial Sequence
  CIITA targeting sequence
cccagcccgacacccguaaa

SEQ ID NO: 31311 - RNA, 20 nt, Artificial Sequence
  CIITA targeting sequence
ggucuuucucaucccacgag

SEQ ID NO: 31312 - RNA, 20 nt, Artificial Sequence
  CIITA targeting sequence
uucucaucccacgagaccgu

SEQ ID NO: 31313 - RNA, 20 nt, Artificial Sequence
  CIITA targeting sequence
caucccacgagaccguauuu

SEQ ID NO: 31314 - RNA, 20 nt, Artificial Sequence
  CIITA targeting sequence
ucccacgagaccguauuuca

SEQ ID NO: 31315 - RNA, 20 nt, Artificial Sequence
  CIITA targeting sequence
cacgagaccguauuucagac

SEQ ID NO: 31316 - RNA, 20 nt, Artificial Sequence
  CIITA targeting sequence
ugggaugagaaagaccugac

SEQ ID NO: 31317 - RNA, 20 nt, Artificial Sequence
  CIITA targeting sequence
cgugggaugagaaagaccug

SEQ ID NO: 31318 - RNA, 20 nt, Artificial Sequence
  CIITA targeting sequence
gacuaucacauggggagaaa

SEQ ID NO: 31319 - RNA, 20 nt, Artificial Sequence
  CIITA targeting sequence
gaaauacggucucgugggau

SEQ ID NO: 31320 - RNA, 20 nt, Artificial Sequence
  CIITA targeting sequence
cauggggagaaaccuuggac

SEQ ID NO: 31321 - RNA, 20 nt, Artificial Sequence
  CIITA targeting sequence
ccaugugauagucugaaaua

SEQ ID NO: 31322 - RNA, 20 nt, Artificial Sequence
  CIITA targeting sequence
ccccaugugauagucugaaa

SEQ ID NO: 31323 - RNA, 20 nt, Artificial Sequence
  CIITA targeting sequence
aagguuucuccccaugugau

SEQ ID NO: 31324 - RNA, 20 nt, Artificial Sequence
  CIITA targeting sequence
agggcagaggucccuguggc

SEQ ID NO: 31325 - RNA, 20 nt, Artificial Sequence
  CIITA targeting sequence
gcccuugaaagcuggguauu

SEQ ID NO: 31326 - RNA, 20 nt, Artificial Sequence
  CIITA targeting sequence
cuguggcuuuccauagugca

SEQ ID NO: 31327 - RNA, 20 nt, Artificial Sequence
  CIITA targeting sequence
auagugcauugugccccugg

SEQ ID NO: 31328 - RNA, 20 nt, Artificial Sequence
  CIITA targeting sequence
auaaaccaggggcacaaugc

SEQ ID NO: 31329 - RNA, 20 nt, Artificial Sequence
  CIITA targeting sequence
caauaaaccaggggcacaau

SEQ ID NO: 31330 - RNA, 20 nt, Artificial Sequence
  CIITA targeting sequence
agucucaauaaaccaggggc

SEQ ID NO: 31331 - RNA, 20 nt, Artificial Sequence
  CIITA targeting sequence
cuagucucaauaaaccaggg

SEQ ID NO: 31332 - RNA, 20 nt, Artificial Sequence
  CIITA targeting sequence
ugcacagcccuagaucccuu

SEQ ID NO: 31333 - RNA, 20 nt, Artificial Sequence
  CIITA targeting sequence
agggcugugcaggaccugcc

SEQ ID NO: 31334 - RNA, 20 nt, Artificial Sequence
  CIITA targeting sequence
cuuaaaccuugauuucauac

SEQ ID NO: 31335 - RNA, 20 nt, Artificial Sequence
  CIITA targeting sequence
agguuuaagggaucuagggc

SEQ ID NO: 31336 - RNA, 20 nt, Artificial Sequence
  CIITA targeting sequence
uacaacacauguuuuuguga

SEQ ID NO: 31337 - RNA, 20 nt, Artificial Sequence
  CIITA targeting sequence
caaaaacauguguuguauga

SEQ ID NO: 31338 - RNA, 20 nt, Artificial Sequence
  CIITA targeting sequence
agguugggucaaaguggcug

SEQ ID NO: 31339 - RNA, 20 nt, Artificial Sequence
  CIITA targeting sequence
aaguggcuggggcaaagugg

SEQ ID NO: 31340 - RNA, 20 nt, Artificial Sequence
  CIITA targeting sequence
cagcaaagcaauuguuuaaa

SEQ ID NO: 31341 - RNA, 20 nt, Artificial Sequence
  CIITA targeting sequence
gcaaagcaauuguuuaaagu

SEQ ID NO: 31342 - RNA, 20 nt, Artificial Sequence
  CIITA targeting sequence
uuuucaaaauggagucucuu

SEQ ID NO: 31343 - RNA, 20 nt, Artificial Sequence
  CIITA targeting sequence
aaauggagucucuuaugucu

SEQ ID NO: 31344 - RNA, 20 nt, Artificial Sequence
  CIITA targeting sequence
auuuugaaaaagaccuguac

SEQ ID NO: 31345 - RNA, 20 nt, Artificial Sequence
  CIITA targeting sequence
cuuaugucuuuccuuucuac

SEQ ID NO: 31346 - RNA, 20 nt, Artificial Sequence
  CIITA targeting sequence
uaugucuuuccuuucuacau

SEQ ID NO: 31347 - RNA, 20 nt, Artificial Sequence
  CIITA targeting sequence
uuccuuucuacauagacaca

SEQ ID NO: 31348 - RNA, 20 nt, Artificial Sequence
  CIITA targeting sequence
uuucuacauagacacaguaa

SEQ ID NO: 31349 - RNA, 20 nt, Artificial Sequence
  CIITA targeting sequence
acauagacacaguaacaguc

SEQ ID NO: 31350 - RNA, 20 nt, Artificial Sequence
  CIITA targeting sequence
auguagaaaggaaagacaua

SEQ ID NO: 31351 - RNA, 20 nt, Artificial Sequence
  CIITA targeting sequence
gaucucucuuucuuuucccu

SEQ ID NO: 31352 - RNA, 20 nt, Artificial Sequence
  CIITA targeting sequence
gacuguuacugugucuaugu

SEQ ID NO: 31353 - RNA, 20 nt, Artificial Sequence
  CIITA targeting sequence
cucuuucuuuucccuacagg

SEQ ID NO: 31354 - RNA, 20 nt, Artificial Sequence
  CIITA targeting sequence
cuuucuuuucccuacagggc

SEQ ID NO: 31355 - RNA, 20 nt, Artificial Sequence
  CIITA targeting sequence
uucuuuucccuacagggcug

SEQ ID NO: 31356 - RNA, 20 nt, Artificial Sequence
  CIITA targeting sequence
uuucccuacagggcuguugg

SEQ ID NO: 31357 - RNA, 20 nt, Artificial Sequence
  CIITA targeting sequence
cuacagggcuguuggauaga

SEQ ID NO: 31358 - RNA, 20 nt, Artificial Sequence
  CIITA targeting sequence
aacagcccuguagggaaaag

SEQ ID NO: 31359 - RNA, 20 nt, Artificial Sequence
  CIITA targeting sequence
auccaacagcccuguaggga

SEQ ID NO: 31360 - RNA, 20 nt, Artificial Sequence
  CIITA targeting sequence
ugcauucuauccaacagccc

SEQ ID NO: 31361 - RNA, 20 nt, Artificial Sequence
  CIITA targeting sequence
uuuuucuuuuagaugggggu

SEQ ID NO: 31362 - RNA, 20 nt, Artificial Sequence
  CIITA targeting sequence
uuuagaugggggucucacug

SEQ ID NO: 31363 - RNA, 20 nt, Artificial Sequence
  CIITA targeting sequence
aaaagaaaaaagaaaaaaaa

SEQ ID NO: 31364 - RNA, 20 nt, Artificial Sequence
  CIITA targeting sequence
cacugucacccaggcuggag

SEQ ID NO: 31365 - RNA, 20 nt, Artificial Sequence
  CIITA targeting sequence
cugucacccaggcuggagug

SEQ ID NO: 31366 - RNA, 20 nt, Artificial Sequence
  CIITA targeting sequence
cccaggcuggagugcagugc

SEQ ID NO: 31367 - RNA, 20 nt, Artificial Sequence
  CIITA targeting sequence
agccugggugacagugagac

SEQ ID NO: 31368 - RNA, 20 nt, Artificial Sequence
  CIITA targeting sequence
uaggucucuacagccuccaa

SEQ ID NO: 31369 - RNA, 20 nt, Artificial Sequence
  CIITA targeting sequence
cuacagccuccaauuccugg

SEQ ID NO: 31370 - RNA, 20 nt, Artificial Sequence
  CIITA targeting sequence
acagccuccaauuccugggc

SEQ ID NO: 31371 - RNA, 20 nt, Artificial Sequence
  CIITA targeting sequence
aauuccugggcucaggcaau

SEQ ID NO: 31372 - RNA, 20 nt, Artificial Sequence
  CIITA targeting sequence
ugggcucaggcaauccuccu

SEQ ID NO: 31373 - RNA, 20 nt, Artificial Sequence
  CIITA targeting sequence
ggcaauccuccugccuuagc

SEQ ID NO: 31374 - RNA, 20 nt, Artificial Sequence
  CIITA targeting sequence
uccugccuuagccucccuag

SEQ ID NO: 31375 - RNA, 20 nt, Artificial Sequence
  CIITA targeting sequence
ugccuuagccucccuaguag

SEQ ID NO: 31376 - RNA, 20 nt, Artificial Sequence
  CIITA targeting sequence
cuaguagcugggacuacagg

SEQ ID NO: 31377 - RNA, 20 nt, Artificial Sequence
  CIITA targeting sequence
cagcuacuagggaggcuaag

SEQ ID NO: 31378 - RNA, 20 nt, Artificial Sequence
  CIITA targeting sequence
cauagagacaaggucuugcu

SEQ ID NO: 31379 - RNA, 20 nt, Artificial Sequence
  CIITA targeting sequence
uagagacaaggucuugcuau

SEQ ID NO: 31380 - RNA, 20 nt, Artificial Sequence
  CIITA targeting sequence
augagaaauaaaaaauuagc

SEQ ID NO: 31381 - RNA, 20 nt, Artificial Sequence
  CIITA targeting sequence
cuaugagaaauaaaaaauua

SEQ ID NO: 31382 - RNA, 20 nt, Artificial Sequence
  CIITA targeting sequence
ugcuaugcagcccagggugg

SEQ ID NO: 31383 - RNA, 20 nt, Artificial Sequence
  CIITA targeting sequence
ggaauagacucaagugaucc

SEQ ID NO: 31384 - RNA, 20 nt, Artificial Sequence
  CIITA targeting sequence
agaccacccugggcugcaua

SEQ ID NO: 31385 - RNA, 20 nt, Artificial Sequence
  CIITA targeting sequence
auuccagaccacccugggcu

SEQ ID NO: 31386 - RNA, 20 nt, Artificial Sequence
  CIITA targeting sequence
agugauccuccugccucagc

SEQ ID NO: 31387 - RNA, 20 nt, Artificial Sequence
  CIITA targeting sequence
cuugagucuauuccagacca

SEQ ID NO: 31388 - RNA, 20 nt, Artificial Sequence
  CIITA targeting sequence
uccugccucagccucccaaa

SEQ ID NO: 31389 - RNA, 20 nt, Artificial Sequence
  CIITA targeting sequence
ugccucagccucccaaagug

SEQ ID NO: 31390 - RNA, 20 nt, Artificial Sequence
  CIITA targeting sequence
gcacauugcaugcacauagu

SEQ ID NO: 31391 - RNA, 20 nt, Artificial Sequence
  CIITA targeting sequence
agccaccuuuauuuucacuc

SEQ ID NO: 31392 - RNA, 20 nt, Artificial Sequence
  CIITA targeting sequence
cuccaggagguaaagugcau

SEQ ID NO: 31393 - RNA, 20 nt, Artificial Sequence
  CIITA targeting sequence
aggagguaaagugcauggca

SEQ ID NO: 31394 - RNA, 20 nt, Artificial Sequence
  CIITA targeting sequence
ccugagcuuccuuaagaaaa

SEQ ID NO: 31395 - RNA, 20 nt, Artificial Sequence
  CIITA targeting sequence
augucaccugagcuuccuua

SEQ ID NO: 31396 - RNA, 20 nt, Artificial Sequence
  CIITA targeting sequence
ggcuccaugucaccugagcu

SEQ ID NO: 31397 - RNA, 20 nt, Artificial Sequence
  CIITA targeting sequence
cuguggugggagcugagcgg

SEQ ID NO: 31398 - RNA, 20 nt, Artificial Sequence
  CIITA targeting sequence
caccacagggaauucaggcu

SEQ ID NO: 31399 - RNA, 20 nt, Artificial Sequence
  CIITA targeting sequence
gcucccaccacagggaauuc

SEQ ID NO: 31400 - RNA, 20 nt, Artificial Sequence
  CIITA targeting sequence
ccccuuagaugggguugcag

SEQ ID NO: 31401 - RNA, 20 nt, Artificial Sequence
  CIITA targeting sequence
aaggggggauagcaccgcuc

SEQ ID NO: 31402 - RNA, 20 nt, Artificial Sequence
  CIITA targeting sequence
gcaaccccaucuaagggggg

SEQ ID NO: 31403 - RNA, 20 nt, Artificial Sequence
  CIITA targeting sequence
aacacaggucuugaaaugcg

SEQ ID NO: 31404 - RNA, 20 nt, Artificial Sequence
  CIITA targeting sequence
ugaaaugcggcaccuggauu

SEQ ID NO: 31405 - RNA, 20 nt, Artificial Sequence
  CIITA targeting sequence
agaccuguguuugaauaucc

SEQ ID NO: 31406 - RNA, 20 nt, Artificial Sequence
  CIITA targeting sequence
aggugccgcauuucaagacc

SEQ ID NO: 31407 - RNA, 20 nt, Artificial Sequence
  CIITA targeting sequence
uggccaagguaccucgagga

SEQ ID NO: 31408 - RNA, 20 nt, Artificial Sequence
  CIITA targeting sequence
aggacuggauuuucauuucu

SEQ ID NO: 31409 - RNA, 20 nt, Artificial Sequence
  CIITA targeting sequence
agguaccuuggccaagaauc

SEQ ID NO: 31410 - RNA, 20 nt, Artificial Sequence
  CIITA targeting sequence
ucgagguaccuuggccaaga

SEQ ID NO: 31411 - RNA, 20 nt, Artificial Sequence
  CIITA targeting sequence
aguccucgagguaccuuggc

SEQ ID NO: 31412 - RNA, 20 nt, Artificial Sequence
  CIITA targeting sequence
uuucucagccucacuuggcc

SEQ ID NO: 31413 - RNA, 20 nt, Artificial Sequence
  CIITA targeting sequence
cagccucacuuggccuuuau

SEQ ID NO: 31414 - RNA, 20 nt, Artificial Sequence
  CIITA targeting sequence
gccucacuuggccuuuauac

SEQ ID NO: 31415 - RNA, 20 nt, Artificial Sequence
  CIITA targeting sequence
cuuggccuuuauaccuccga

SEQ ID NO: 31416 - RNA, 20 nt, Artificial Sequence
  CIITA targeting sequence
gagacgcugcauucaccauu

SEQ ID NO: 31417 - RNA, 20 nt, Artificial Sequence
  CIITA targeting sequence
gagguauaaaggccaaguga

SEQ ID NO: 31418 - RNA, 20 nt, Artificial Sequence
  CIITA targeting sequence
cggagguauaaaggccaagu

SEQ ID NO: 31419 - RNA, 20 nt, Artificial Sequence
  CIITA targeting sequence
ccauucauaauuuuagcuca

SEQ ID NO: 31420 - RNA, 20 nt, Artificial Sequence
  CIITA targeting sequence
uaauuuuagcucaguucacu

SEQ ID NO: 31421 - RNA, 20 nt, Artificial Sequence
  CIITA targeting sequence
guucacuuggaaaaacccaa

SEQ ID NO: 31422 - RNA, 20 nt, Artificial Sequence
  CIITA targeting sequence
cuuggaaaaacccaaccaca

SEQ ID NO: 31423 - RNA, 20 nt, Artificial Sequence
  CIITA targeting sequence
aagugaacugagcuaaaauu

SEQ ID NO: 31424 - RNA, 20 nt, Artificial Sequence
  CIITA targeting sequence
gcuuugugguuggguuuuuc

SEQ ID NO: 31425 - RNA, 20 nt, Artificial Sequence
  CIITA targeting sequence
cugcuuugugguuggguuuu

SEQ ID NO: 31426 - RNA, 20 nt, Artificial Sequence
  CIITA targeting sequence
aguucucugcuuugugguug

SEQ ID NO: 31427 - RNA, 20 nt, Artificial Sequence
  CIITA targeting sequence
caaguucucugcuuuguggu

SEQ ID NO: 31428 - RNA, 20 nt, Artificial Sequence
  CIITA targeting sequence
gcauuugguggguccaggca

SEQ ID NO: 31429 - RNA, 20 nt, Artificial Sequence
  CIITA targeting sequence
aggcauggccacuucuaccc

SEQ ID NO: 31430 - RNA, 20 nt, Artificial Sequence
  CIITA targeting sequence
acccaaaggguggugucaag

SEQ ID NO: 31431 - RNA, 20 nt, Artificial Sequence
  CIITA targeting sequence
aggccccucccuguguucug

SEQ ID NO: 31432 - RNA, 20 nt, Artificial Sequence
  CIITA targeting sequence
cuguguucugccacagccag

SEQ ID NO: 31433 - RNA, 20 nt, Artificial Sequence
  CIITA targeting sequence
gccacagccaggagacuuuc

SEQ ID NO: 31434 - RNA, 20 nt, Artificial Sequence
  CIITA targeting sequence
uggcuguggcagaacacagg

SEQ ID NO: 31435 - RNA, 20 nt, Artificial Sequence
  CIITA targeting sequence
ccuggcuguggcagaacaca

SEQ ID NO: 31436 - RNA, 20 nt, Artificial Sequence
  CIITA targeting sequence
uccaacuguagccaggggac

SEQ ID NO: 31437 - RNA, 20 nt, Artificial Sequence
  CIITA targeting sequence
aacuguagccaggggacuuc

SEQ ID NO: 31438 - RNA, 20 nt, Artificial Sequence
  CIITA targeting sequence
ccuggcuacaguuggaugaa

SEQ ID NO: 31439 - RNA, 20 nt, Artificial Sequence
  CIITA targeting sequence
gcucaugggagucaccaaac

SEQ ID NO: 31440 - RNA, 20 nt, Artificial Sequence
  CIITA targeting sequence
ugggagucaccaaacacccu

SEQ ID NO: 31441 - RNA, 20 nt, Artificial Sequence
  CIITA targeting sequence
caugagcggaaguccccugg

SEQ ID NO: 31442 - RNA, 20 nt, Artificial Sequence
  CIITA targeting sequence
ccaaacacccuucuuuuauu

SEQ ID NO: 31443 - RNA, 20 nt, Artificial Sequence
  CIITA targeting sequence
uuuauuuuuuauuuuuuuag

SEQ ID NO: 31444 - RNA, 20 nt, Artificial Sequence
  CIITA targeting sequence
aaaaaaauaaaaaauaaaag

SEQ ID NO: 31445 - RNA, 20 nt, Artificial Sequence
  CIITA targeting sequence
cuaaaaaaauaaaaaauaaa

SEQ ID NO: 31446 - RNA, 20 nt, Artificial Sequence
  CIITA targeting sequence
gucucuaaaaaaauaaaaaa

SEQ ID NO: 31447 - RNA, 20 nt, Artificial Sequence
  CIITA targeting sequence
cucuguuauccaggcuggag

SEQ ID NO: 31448 - RNA, 20 nt, Artificial Sequence
  CIITA targeting sequence
caccugccuagguuggggug

SEQ ID NO: 31449 - RNA, 20 nt, Artificial Sequence
  CIITA targeting sequence
aacagagggagcugggcuuu

SEQ ID NO: 31450 - RNA, 20 nt, Artificial Sequence
  CIITA targeting sequence
guuagaaucacaccugccua

SEQ ID NO: 31451 - RNA, 20 nt, Artificial Sequence
  CIITA targeting sequence
cucuguuagaaucacaccug

SEQ ID NO: 31452 - RNA, 20 nt, Artificial Sequence
  CIITA targeting sequence
cauguggcuugugggcagug

SEQ ID NO: 31453 - RNA, 20 nt, Artificial Sequence
  CIITA targeting sequence
uugugagagucuuuuggggu

SEQ ID NO: 31454 - RNA, 20 nt, Artificial Sequence
  CIITA targeting sequence
caaugaauaggcacugccca

SEQ ID NO: 31455 - RNA, 20 nt, Artificial Sequence
  CIITA targeting sequence
cacaaugaauaggcacugcc

SEQ ID NO: 31456 - RNA, 20 nt, Artificial Sequence
  CIITA targeting sequence
uuuggggucaggcuggauuu

SEQ ID NO: 31457 - RNA, 20 nt, Artificial Sequence
  CIITA targeting sequence
ggcuggauuuguuuccgcuu

SEQ ID NO: 31458 - RNA, 20 nt, Artificial Sequence
  CIITA targeting sequence
agccugaccccaaaagacuc

SEQ ID NO: 31459 - RNA, 20 nt, Artificial Sequence
  CIITA targeting sequence
gcuucauuauccccuaccca

SEQ ID NO: 31460 - RNA, 20 nt, Artificial Sequence
  CIITA targeting sequence
uuauccccuacccaggccug

SEQ ID NO: 31461 - RNA, 20 nt, Artificial Sequence
  CIITA targeting sequence
acuuguggugggaggugaag

SEQ ID NO: 31462 - RNA, 20 nt, Artificial Sequence
  CIITA targeting sequence
gaggcccucacuggaugccc

SEQ ID NO: 31463 - RNA, 20 nt, Artificial Sequence
  CIITA targeting sequence
gacugcuuccacuuguggug

SEQ ID NO: 31464 - RNA, 20 nt, Artificial Sequence
  CIITA targeting sequence
cuggaugcccagucuugaac

SEQ ID NO: 31465 - RNA, 20 nt, Artificial Sequence
  CIITA targeting sequence
agugagggccucagacugcu

SEQ ID NO: 31466 - RNA, 20 nt, Artificial Sequence
  CIITA targeting sequence
ugaacuuccagccagcagaa

SEQ ID NO: 31467 - RNA, 20 nt, Artificial Sequence
  CIITA targeting sequence
agacugggcauccagugagg

SEQ ID NO: 31468 - RNA, 20 nt, Artificial Sequence
  CIITA targeting sequence
agccagcagaaucaugagcc

SEQ ID NO: 31469 - RNA, 20 nt, Artificial Sequence
  CIITA targeting sequence
gcuggcuggaaguucaagac

SEQ ID NO: 31470 - RNA, 20 nt, Artificial Sequence
  CIITA targeting sequence
ugagccaaauaaaccucuuu

SEQ ID NO: 31471 - RNA, 20 nt, Artificial Sequence
  CIITA targeting sequence
ugauucugcuggcuggaagu

SEQ ID NO: 31472 - RNA, 20 nt, Artificial Sequence
  CIITA targeting sequence
uuucuuuguaaauuacccag

SEQ ID NO: 31473 - RNA, 20 nt, Artificial Sequence
  CIITA targeting sequence
uuguaaauuacccagcauca

SEQ ID NO: 31474 - RNA, 20 nt, Artificial Sequence
  CIITA targeting sequence
aaaacacaagugcuacuuug

SEQ ID NO: 31475 - RNA, 20 nt, Artificial Sequence
  CIITA targeting sequence
cccagggcccagagagauua

SEQ ID NO: 31476 - RNA, 20 nt, Artificial Sequence
  CIITA targeting sequence
cagggcccagagagauuaag

SEQ ID NO: 31477 - RNA, 20 nt, Artificial Sequence
  CIITA targeting sequence
gggcccugggagaagcagca

SEQ ID NO: 31478 - RNA, 20 nt, Artificial Sequence
  CIITA targeting sequence
cugggcccugggagaagcag

SEQ ID NO: 31479 - RNA, 20 nt, Artificial Sequence
  CIITA targeting sequence
cucugggcccugggagaagc

SEQ ID NO: 31480 - RNA, 20 nt, Artificial Sequence
  CIITA targeting sequence
aguugcuuaaucucucuggg

SEQ ID NO: 31481 - RNA, 20 nt, Artificial Sequence
  CIITA targeting sequence
cacugguaaguggcagagcu

SEQ ID NO: 31482 - RNA, 20 nt, Artificial Sequence
  CIITA targeting sequence
gccacuuaccagugggaccu

SEQ ID NO: 31483 - RNA, 20 nt, Artificial Sequence
  CIITA targeting sequence
uagcucugccacuuaccagu

SEQ ID NO: 31484 - RNA, 20 nt, Artificial Sequence
  CIITA targeting sequence
agcugugauaugauuuggau

SEQ ID NO: 31485 - RNA, 20 nt, Artificial Sequence
  CIITA targeting sequence
guuuguuuaaaagugcguag

SEQ ID NO: 31486 - RNA, 20 nt, Artificial Sequence
  CIITA targeting sequence
ccccuuuggagcaacaggaa

SEQ ID NO: 31487 - RNA, 20 nt, Artificial Sequence
  CIITA targeting sequence
aaaggggggagguacuacgc

SEQ ID NO: 31488 - RNA, 20 nt, Artificial Sequence
  CIITA targeting sequence
uguugcuccaaaggggggag

SEQ ID NO: 31489 - RNA, 20 nt, Artificial Sequence
  CIITA targeting sequence
cauucacuguugguggggau

SEQ ID NO: 31490 - RNA, 20 nt, Artificial Sequence
  CIITA targeting sequence
uucacuguugguggggaugc

SEQ ID NO: 31491 - RNA, 20 nt, Artificial Sequence
  CIITA targeting sequence
cuguugguggggaugcaaua

SEQ ID NO: 31492 - RNA, 20 nt, Artificial Sequence
  CIITA targeting sequence
ccaccaacagugaaugagaa

SEQ ID NO: 31493 - RNA, 20 nt, Artificial Sequence
  CIITA targeting sequence
auguugugaaauucuguccu

SEQ ID NO: 31494 - RNA, 20 nt, Artificial Sequence
  CIITA targeting sequence
caacauagaguuauccaacc

SEQ ID NO: 31495 - RNA, 20 nt, Artificial Sequence
  CIITA targeting sequence
guccugugcacuguaggauu

SEQ ID NO: 31496 - RNA, 20 nt, Artificial Sequence
  CIITA targeting sequence
ugugcacuguaggauucagc

SEQ ID NO: 31497 - RNA, 20 nt, Artificial Sequence
  CIITA targeting sequence
uacagugcacaggacagaau

SEQ ID NO: 31498 - RNA, 20 nt, Artificial Sequence
  CIITA targeting sequence
gcaucuguggucuccaccca

SEQ ID NO: 31499 - RNA, 20 nt, Artificial Sequence
  CIITA targeting sequence
guggucuccacccacuagau

SEQ ID NO: 31500 - RNA, 20 nt, Artificial Sequence
  CIITA targeting sequence
ccacccacuagauaccagac

SEQ ID NO: 31501 - RNA, 20 nt, Artificial Sequence
  CIITA targeting sequence
acccacuagauaccagacac

SEQ ID NO: 31502 - RNA, 20 nt, Artificial Sequence
  CIITA targeting sequence
aguggguggagaccacagau

SEQ ID NO: 31503 - RNA, 20 nt, Artificial Sequence
  CIITA targeting sequence
gguaucuaguggguggagac

SEQ ID NO: 31504 - RNA, 20 nt, Artificial Sequence
  CIITA targeting sequence
cucccuguuguaacaaugca

SEQ ID NO: 31505 - RNA, 20 nt, Artificial Sequence
  CIITA targeting sequence
cuguuguaacaaugcagaau

SEQ ID NO: 31506 - RNA, 20 nt, Artificial Sequence
  CIITA targeting sequence
gcauuguuacaacagggagg

SEQ ID NO: 31507 - RNA, 20 nt, Artificial Sequence
  CIITA targeting sequence
ccagacauggccaaaugccc

SEQ ID NO: 31508 - RNA, 20 nt, Artificial Sequence
  CIITA targeting sequence
agacauggccaaaugcccca

SEQ ID NO: 31509 - RNA, 20 nt, Artificial Sequence
  CIITA targeting sequence
ggagacauucugcauuguua

SEQ ID NO: 31510 - RNA, 20 nt, Artificial Sequence
  CIITA targeting sequence
auggggcauuuggccauguc

SEQ ID NO: 31511 - RNA, 20 nt, Artificial Sequence
  CIITA targeting sequence
caauggggcauuuggccaug

SEQ ID NO: 31512 - RNA, 20 nt, Artificial Sequence
  CIITA targeting sequence
caucaccuucacuuuccaga

SEQ ID NO: 31513 - RNA, 20 nt, Artificial Sequence
  CIITA targeting sequence
ucaccuucacuuuccagaua

SEQ ID NO: 31514 - RNA, 20 nt, Artificial Sequence
  CIITA targeting sequence
ccuucacuuuccagauaggg

SEQ ID NO: 31515 - RNA, 20 nt, Artificial Sequence
  CIITA targeting sequence
cuuuccagauagggaaaacu

SEQ ID NO: 31516 - RNA, 20 nt, Artificial Sequence
  CIITA targeting sequence
agauagggaaaacugaggcc

SEQ ID NO: 31517 - RNA, 20 nt, Artificial Sequence
  CIITA targeting sequence
ggaaagugaaggugaugaga

SEQ ID NO: 31518 - RNA, 20 nt, Artificial Sequence
  CIITA targeting sequence
cuaucuggaaagugaaggug

SEQ ID NO: 31519 - RNA, 20 nt, Artificial Sequence
  CIITA targeting sequence
guuuucccuaucuggaaagu

SEQ ID NO: 31520 - RNA, 20 nt, Artificial Sequence
  CIITA targeting sequence
uggcccccacaggccucagu

SEQ ID NO: 31521 - RNA, 20 nt, Artificial Sequence
  CIITA targeting sequence
cagcaccugagagcugcuca

SEQ ID NO: 31522 - RNA, 20 nt, Artificial Sequence
  CIITA targeting sequence
ggugcugugaaacccugggu

SEQ ID NO: 31523 - RNA, 20 nt, Artificial Sequence
  CIITA targeting sequence
caggugcugugaaacccugg

SEQ ID NO: 31524 - RNA, 20 nt, Artificial Sequence
  CIITA targeting sequence
ggcaagguggauuuggagcu

SEQ ID NO: 31525 - RNA, 20 nt, Artificial Sequence
  CIITA targeting sequence
accuugccugagcagcucuc

SEQ ID NO: 31526 - RNA, 20 nt, Artificial Sequence
  CIITA targeting sequence
aaauccaccuugccugagca

SEQ ID NO: 31527 - RNA, 20 nt, Artificial Sequence
  CIITA targeting sequence
uuggcacucgaaaauccagc

SEQ ID NO: 31528 - RNA, 20 nt, Artificial Sequence
  CIITA targeting sequence
aaaauccagcacaugcccaa

SEQ ID NO: 31529 - RNA, 20 nt, Artificial Sequence
  CIITA targeting sequence
agugccaaggaauugggcag

SEQ ID NO: 31530 - RNA, 20 nt, Artificial Sequence
  CIITA targeting sequence
agcacaugcccaauguccca

SEQ ID NO: 31531 - RNA, 20 nt, Artificial Sequence
  CIITA targeting sequence
caggcaagcuguggcucugc

SEQ ID NO: 31532 - RNA, 20 nt, Artificial Sequence
  CIITA targeting sequence
gcaccugugggcuccaucca

SEQ ID NO: 31533 - RNA, 20 nt, Artificial Sequence
  CIITA targeting sequence
auccaccggggccaggguga

SEQ ID NO: 31534 - RNA, 20 nt, Artificial Sequence
  CIITA targeting sequence
accggggccagggugagaag

SEQ ID NO: 31535 - RNA, 20 nt, Artificial Sequence
  CIITA targeting sequence
cccuggccccgguggaugga

SEQ ID NO: 31536 - RNA, 20 nt, Artificial Sequence
  CIITA targeting sequence
cacccuggccccgguggaug

SEQ ID NO: 31537 - RNA, 20 nt, Artificial Sequence
  CIITA targeting sequence
uucucacccuggccccggug

SEQ ID NO: 31538 - RNA, 20 nt, Artificial Sequence
  CIITA targeting sequence
cugccuccuucucacccugg

SEQ ID NO: 31539 - RNA, 20 nt, Artificial Sequence
  CIITA targeting sequence
uggggcauucacugccuccu

SEQ ID NO: 31540 - RNA, 20 nt, Artificial Sequence
  CIITA targeting sequence
cuacggggggcugcuccugg

SEQ ID NO: 31541 - RNA, 20 nt, Artificial Sequence
  CIITA targeting sequence
ggguggaggguaaaugcccc

SEQ ID NO: 31542 - RNA, 20 nt, Artificial Sequence
  CIITA targeting sequence
acccagaccaucacuacggg

SEQ ID NO: 31543 - RNA, 20 nt, Artificial Sequence
  CIITA targeting sequence
cccucgccccaaaguggaau

SEQ ID NO: 31544 - RNA, 20 nt, Artificial Sequence
  CIITA targeting sequence
cucgccccaaaguggaauug

SEQ ID NO: 31545 - RNA, 20 nt, Artificial Sequence
  CIITA targeting sequence
ccccaaaguggaauugagcc

SEQ ID NO: 31546 - RNA, 20 nt, Artificial Sequence
  CIITA targeting sequence
acuuuggggcgagggagaug

SEQ ID NO: 31547 - RNA, 20 nt, Artificial Sequence
  CIITA targeting sequence
auuccacuuuggggcgaggg

SEQ ID NO: 31548 - RNA, 20 nt, Artificial Sequence
  CIITA targeting sequence
guugcucaucaccuauucug

SEQ ID NO: 31549 - RNA, 20 nt, Artificial Sequence
  CIITA targeting sequence
ucaccuauucugacuucguu

SEQ ID NO: 31550 - RNA, 20 nt, Artificial Sequence
  CIITA targeting sequence
ccuauucugacuucguuucc

SEQ ID NO: 31551 - RNA, 20 nt, Artificial Sequence
  CIITA targeting sequence
gacuucguuuccuuccugga

SEQ ID NO: 31552 - RNA, 20 nt, Artificial Sequence
  CIITA targeting sequence
gaauaggugaugagcaacug

SEQ ID NO: 31553 - RNA, 20 nt, Artificial Sequence
  CIITA targeting sequence
uuuccuuccuggaucccucc

SEQ ID NO: 31554 - RNA, 20 nt, Artificial Sequence
  CIITA targeting sequence
uuccuggaucccuccccaaa

SEQ ID NO: 31555 - RNA, 20 nt, Artificial Sequence
  CIITA targeting sequence
uggaucccuccccaaauaaa

SEQ ID NO: 31556 - RNA, 20 nt, Artificial Sequence
  CIITA targeting sequence
aggaaggaaacgaagucaga

SEQ ID NO: 31557 - RNA, 20 nt, Artificial Sequence
  CIITA targeting sequence
cuccccaaauaaacuauucc

SEQ ID NO: 31558 - RNA, 20 nt, Artificial Sequence
  CIITA targeting sequence
ccaaauaaacuauucccacc

SEQ ID NO: 31559 - RNA, 20 nt, Artificial Sequence
  CIITA targeting sequence
cacccgcauccuuaucucag

SEQ ID NO: 31560 - RNA, 20 nt, Artificial Sequence
  CIITA targeting sequence
uuaucucaggaucuguuucu

SEQ ID NO: 31561 - RNA, 20 nt, Artificial Sequence
  CIITA targeting sequence
caggaucuguuucuagggaa

SEQ ID NO: 31562 - RNA, 20 nt, Artificial Sequence
  CIITA targeting sequence
ggaucuguuucuagggaacc

SEQ ID NO: 31563 - RNA, 20 nt, Artificial Sequence
  CIITA targeting sequence
ugagauaaggaugcgggugg

SEQ ID NO: 31564 - RNA, 20 nt, Artificial Sequence
  CIITA targeting sequence
guuucuagggaacccaagga

SEQ ID NO: 31565 - RNA, 20 nt, Artificial Sequence
  CIITA targeting sequence
agggaacccaaggauugcau

SEQ ID NO: 31566 - RNA, 20 nt, Artificial Sequence
  CIITA targeting sequence
cuagaaacagauccugagau

SEQ ID NO: 31567 - RNA, 20 nt, Artificial Sequence
  CIITA targeting sequence
uuggguucccuagaaacaga

SEQ ID NO: 31568 - RNA, 20 nt, Artificial Sequence
  CIITA targeting sequence
ugccuguacuuccugccuuc

SEQ ID NO: 31569 - RNA, 20 nt, Artificial Sequence
  CIITA targeting sequence
ugccuucaagauucucugca

SEQ ID NO: 31570 - RNA, 20 nt, Artificial Sequence
  CIITA targeting sequence
agauucucugcaccagguua

SEQ ID NO: 31571 - RNA, 20 nt, Artificial Sequence
  CIITA targeting sequence
ugaaggcaggaaguacaggc

SEQ ID NO: 31572 - RNA, 20 nt, Artificial Sequence
  CIITA targeting sequence
cugcaccagguuaugaucug

SEQ ID NO: 31573 - RNA, 20 nt, Artificial Sequence
  CIITA targeting sequence
gcaccagguuaugaucugga

SEQ ID NO: 31574 - RNA, 20 nt, Artificial Sequence
  CIITA targeting sequence
uaaccuggugcagagaaucu

SEQ ID NO: 31575 - RNA, 20 nt, Artificial Sequence
  CIITA targeting sequence
ggaguauuccugagccuggg

SEQ ID NO: 31576 - RNA, 20 nt, Artificial Sequence
  CIITA targeting sequence
agaucauaaccuggugcaga

SEQ ID NO: 31577 - RNA, 20 nt, Artificial Sequence
  CIITA targeting sequence
ugagccugggaagccaacag

SEQ ID NO: 31578 - RNA, 20 nt, Artificial Sequence
  CIITA targeting sequence
ggaauacuccagaucauaac

SEQ ID NO: 31579 - RNA, 20 nt, Artificial Sequence
  CIITA targeting sequence
caggcucaggaauacuccag

SEQ ID NO: 31580 - RNA, 20 nt, Artificial Sequence
  CIITA targeting sequence
guuggcuucccaggcucagg

SEQ ID NO: 31581 - RNA, 20 nt, Artificial Sequence
  CIITA targeting sequence
auguuuguccgguggcugga

SEQ ID NO: 31582 - RNA, 20 nt, Artificial Sequence
  CIITA targeting sequence
gguggcuggagcccagcugg

SEQ ID NO: 31583 - RNA, 20 nt, Artificial Sequence
  CIITA targeting sequence
agccaccggacaaacauaga

SEQ ID NO: 31584 - RNA, 20 nt, Artificial Sequence
  CIITA targeting sequence
gcagggcauuagcauuagaa

SEQ ID NO: 31585 - RNA, 20 nt, Artificial Sequence
  CIITA targeting sequence
uucuuucuuuuuuuuuuuuu

SEQ ID NO: 31586 - RNA, 20 nt, Artificial Sequence
  CIITA targeting sequence
uucuuuuuuuuuuuuuuugu

SEQ ID NO: 31587 - RNA, 20 nt, Artificial Sequence
  CIITA targeting sequence
uuuuuuuuuuuuuuguuuuu

SEQ ID NO: 31588 - RNA, 20 nt, Artificial Sequence
  CIITA targeting sequence
ccaaaaugauuuuuauuucg

SEQ ID NO: 31589 - RNA, 20 nt, Artificial Sequence
  CIITA targeting sequence
uuuuggugaaaaaaaaacaa

SEQ ID NO: 31590 - RNA, 20 nt, Artificial Sequence
  CIITA targeting sequence
uguuuaauuggguaugcaca

SEQ ID NO: 31591 - RNA, 20 nt, Artificial Sequence
  CIITA targeting sequence
agccugugugcauacccaau

SEQ ID NO: 31592 - RNA, 20 nt, Artificial Sequence
  CIITA targeting sequence
aaaccugugucaagccugug

SEQ ID NO: 31593 - RNA, 20 nt, Artificial Sequence
  CIITA targeting sequence
uuaaguccuuaugcagaauu

SEQ ID NO: 31594 - RNA, 20 nt, Artificial Sequence
  CIITA targeting sequence
uuaugcagaauuauauucuu

SEQ ID NO: 31595 - RNA, 20 nt, Artificial Sequence
  CIITA targeting sequence
gcauaaggacuuaaugaauc

SEQ ID NO: 31596 - RNA, 20 nt, Artificial Sequence
  CIITA targeting sequence
ucuugauaaagaagcccguu

SEQ ID NO: 31597 - RNA, 20 nt, Artificial Sequence
  CIITA targeting sequence
ugauaaagaagcccguucca

SEQ ID NO: 31598 - RNA, 20 nt, Artificial Sequence
  CIITA targeting sequence
agaagaauauaauucugcau

SEQ ID NO: 31599 - RNA, 20 nt, Artificial Sequence
  CIITA targeting sequence
uuaucaagaagaauauaauu

SEQ ID NO: 31600 - RNA, 20 nt, Artificial Sequence
  CIITA targeting sequence
auccaggauccacuaucuac

SEQ ID NO: 31601 - RNA, 20 nt, Artificial Sequence
  CIITA targeting sequence
aggauccacuaucuacacac

SEQ ID NO: 31602 - RNA, 20 nt, Artificial Sequence
  CIITA targeting sequence
uggauggaacgggcuucuuu

SEQ ID NO: 31603 - RNA, 20 nt, Artificial Sequence
  CIITA targeting sequence
acuaucuacacaccuauguu

SEQ ID NO: 31604 - RNA, 20 nt, Artificial Sequence
  CIITA targeting sequence
acacaccuauguuacaacau

SEQ ID NO: 31605 - RNA, 20 nt, Artificial Sequence
  CIITA targeting sequence
aucaaaucugguaucugcag

SEQ ID NO: 31606 - RNA, 20 nt, Artificial Sequence
  CIITA targeting sequence
aaucugguaucugcagaaaa

SEQ ID NO: 31607 - RNA, 20 nt, Artificial Sequence
  CIITA targeting sequence
gguaucugcagaaaagauac

SEQ ID NO: 31608 - RNA, 20 nt, Artificial Sequence
  CIITA targeting sequence
gcagaaaagauacacauuua

SEQ ID NO: 31609 - RNA, 20 nt, Artificial Sequence
  CIITA targeting sequence
gcagauaccagauuugauag

SEQ ID NO: 31610 - RNA, 20 nt, Artificial Sequence
  CIITA targeting sequence
uuucugcagauaccagauuu

SEQ ID NO: 31611 - RNA, 20 nt, Artificial Sequence
  CIITA targeting sequence
uuuaaguuauguauuuugca

SEQ ID NO: 31612 - RNA, 20 nt, Artificial Sequence
  CIITA targeting sequence
gcaaaauacauaacuuaaau

SEQ ID NO: 31613 - RNA, 20 nt, Artificial Sequence
  CIITA targeting sequence
uucugcaaaauacauaacuu

SEQ ID NO: 31614 - RNA, 20 nt, Artificial Sequence
  CIITA targeting sequence
agucacgcaaaacucaaaaa

SEQ ID NO: 31615 - RNA, 20 nt, Artificial Sequence
  CIITA targeting sequence
cgcaaaacucaaaaacugua

SEQ ID NO: 31616 - RNA, 20 nt, Artificial Sequence
  CIITA targeting sequence
aaaacuguaucaaaaguuug

SEQ ID NO: 31617 - RNA, 20 nt, Artificial Sequence
  CIITA targeting sequence
aaaguuugaauauaaaacuc

SEQ ID NO: 31618 - RNA, 20 nt, Artificial Sequence
  CIITA targeting sequence
aacuuuugauacaguuuuug

SEQ ID NO: 31619 - RNA, 20 nt, Artificial Sequence
  CIITA targeting sequence
gauccaccuggaaugacuaa

SEQ ID NO: 31620 - RNA, 20 nt, Artificial Sequence
  CIITA targeting sequence
gaguuuuauauucaaacuuu

SEQ ID NO: 31621 - RNA, 20 nt, Artificial Sequence
  CIITA targeting sequence
accuggaaugacuaaagaau

SEQ ID NO: 31622 - RNA, 20 nt, Artificial Sequence
  CIITA targeting sequence
agguggaucugaguuuuaua

SEQ ID NO: 31623 - RNA, 20 nt, Artificial Sequence
  CIITA targeting sequence
uuccagguggaucugaguuu

SEQ ID NO: 31624 - RNA, 20 nt, Artificial Sequence
  CIITA targeting sequence
uuagucauuccagguggauc

SEQ ID NO: 31625 - RNA, 20 nt, Artificial Sequence
  CIITA targeting sequence
auucuuuagucauuccaggu

SEQ ID NO: 31626 - RNA, 20 nt, Artificial Sequence
  CIITA targeting sequence
guauccaccuguguuaaaac

SEQ ID NO: 31627 - RNA, 20 nt, Artificial Sequence
  CIITA targeting sequence
accuguguuaaaacugguaa

SEQ ID NO: 31628 - RNA, 20 nt, Artificial Sequence
  CIITA targeting sequence
uuacauuuaccaguuuuaac

SEQ ID NO: 31629 - RNA, 20 nt, Artificial Sequence
  CIITA targeting sequence
guaacaaauuucauuacauu

SEQ ID NO: 31630 - RNA, 20 nt, Artificial Sequence
  CIITA targeting sequence
uuuauucaacguaaguuauc

SEQ ID NO: 31631 - RNA, 20 nt, Artificial Sequence
  CIITA targeting sequence
acguaaguuaucuaauuuua

SEQ ID NO: 31632 - RNA, 20 nt, Artificial Sequence
  CIITA targeting sequence
aauuuuaacaauagggcacc

SEQ ID NO: 31633 - RNA, 20 nt, Artificial Sequence
  CIITA targeting sequence
aggugcccuauuguuaaaau

SEQ ID NO: 31634 - RNA, 20 nt, Artificial Sequence
  CIITA targeting sequence
uaaaaauacauuugguuuuc

SEQ ID NO: 31635 - RNA, 20 nt, Artificial Sequence
  CIITA targeting sequence
ucauaaaaauacauuugguu

SEQ ID NO: 31636 - RNA, 20 nt, Artificial Sequence
  CIITA targeting sequence
guuugugaugaaaccaaaag

SEQ ID NO: 31637 - RNA, 20 nt, Artificial Sequence
  CIITA targeting sequence
caaacagaagugccucauca

SEQ ID NO: 31638 - RNA, 20 nt, Artificial Sequence
  CIITA targeting sequence
ucacaaacagaagugccuca

SEQ ID NO: 31639 - RNA, 20 nt, Artificial Sequence
  CIITA targeting sequence
uuugguuucaucacaaacag

SEQ ID NO: 31640 - RNA, 20 nt, Artificial Sequence
  CIITA targeting sequence
ccggcauuagugugcagcaa

SEQ ID NO: 31641 - RNA, 20 nt, Artificial Sequence
  CIITA targeting sequence
ucagugacuugggguauaug

SEQ ID NO: 31642 - RNA, 20 nt, Artificial Sequence
  CIITA targeting sequence
gugacuugggguauaugcua

SEQ ID NO: 31643 - RNA, 20 nt, Artificial Sequence
  CIITA targeting sequence
cugaagaaaaucgccggcau

SEQ ID NO: 31644 - RNA, 20 nt, Artificial Sequence
  CIITA targeting sequence
cucauuuguauaugacuauc

SEQ ID NO: 31645 - RNA, 20 nt, Artificial Sequence
  CIITA targeting sequence
uuuguauaugacuauccgau

SEQ ID NO: 31646 - RNA, 20 nt, Artificial Sequence
  CIITA targeting sequence
uauacaaaugagcgaggcau

SEQ ID NO: 31647 - RNA, 20 nt, Artificial Sequence
  CIITA targeting sequence
gauauauuuuuaaauauaua

SEQ ID NO: 31648 - RNA, 20 nt, Artificial Sequence
  CIITA targeting sequence
gauagucauauacaaaugag

SEQ ID NO: 31649 - RNA, 20 nt, Artificial Sequence
  CIITA targeting sequence
ucuggcuguagcaaugcacu

SEQ ID NO: 31650 - RNA, 20 nt, Artificial Sequence
  CIITA targeting sequence
ggcuguagcaaugcacugua

SEQ ID NO: 31651 - RNA, 20 nt, Artificial Sequence
  CIITA targeting sequence
uuuugcacuguaaaauagcu

SEQ ID NO: 31652 - RNA, 20 nt, Artificial Sequence
  CIITA targeting sequence
ucauuuugcacuguaaaaua

SEQ ID NO: 31653 - RNA, 20 nt, Artificial Sequence
  CIITA targeting sequence
uuugggcugguuucaucauu

SEQ ID NO: 31654 - RNA, 20 nt, Artificial Sequence
  CIITA targeting sequence
gguacaagaaaauauugaca

SEQ ID NO: 31655 - RNA, 20 nt, Artificial Sequence
  CIITA targeting sequence
uguaccagaauuguuauuau

SEQ ID NO: 31656 - RNA, 20 nt, Artificial Sequence
  CIITA targeting sequence
auauuuucuuguaccagaau

SEQ ID NO: 31657 - RNA, 20 nt, Artificial Sequence
  CIITA targeting sequence
gucaauauuuucuuguacca

SEQ ID NO: 31658 - RNA, 20 nt, Artificial Sequence
  CIITA targeting sequence
agcaacucugucaauauuuu

SEQ ID NO: 31659 - RNA, 20 nt, Artificial Sequence
  CIITA targeting sequence
agcaaguaaaaagcuacugu

SEQ ID NO: 31660 - RNA, 20 nt, Artificial Sequence
  CIITA targeting sequence
acucuagcaaguaaaaagcu

SEQ ID NO: 31661 - RNA, 20 nt, Artificial Sequence
  CIITA targeting sequence
uuaaacuggggguaugucua

SEQ ID NO: 31662 - RNA, 20 nt, Artificial Sequence
  CIITA targeting sequence
cugucuuuaaacugggggua

SEQ ID NO: 31663 - RNA, 20 nt, Artificial Sequence
  CIITA targeting sequence
ucccugucuuuaaacugggg

SEQ ID NO: 31664 - RNA, 20 nt, Artificial Sequence
  CIITA targeting sequence
caauuucaucccugucuuua

SEQ ID NO: 31665 - RNA, 20 nt, Artificial Sequence
  CIITA targeting sequence
ggcaauaaaucacaauuuca

SEQ ID NO: 31666 - RNA, 20 nt, Artificial Sequence
  CIITA targeting sequence
gacaguuuaugagguugggc

SEQ ID NO: 31667 - RNA, 20 nt, Artificial Sequence
  CIITA targeting sequence
gaaaccucaggcaauaaauc

SEQ ID NO: 31668 - RNA, 20 nt, Artificial Sequence
  CIITA targeting sequence
uaaacugucugaaaccucag

SEQ ID NO: 31669 - RNA, 20 nt, Artificial Sequence
  CIITA targeting sequence
cugcagaacuagcauuuuug

SEQ ID NO: 31670 - RNA, 20 nt, Artificial Sequence
  CIITA targeting sequence
gcagcgaaugcccaaccuca

SEQ ID NO: 31671 - RNA, 20 nt, Artificial Sequence
  CIITA targeting sequence
cguucuggaagcuuucuccg

SEQ ID NO: 31672 - RNA, 20 nt, Artificial Sequence
  CIITA targeting sequence
ggaagcuuucuccguuuauu

SEQ ID NO: 31673 - RNA, 20 nt, Artificial Sequence
  CIITA targeting sequence
agaacgugagcaaaaaugcu

SEQ ID NO: 31674 - RNA, 20 nt, Artificial Sequence
  CIITA targeting sequence
ccguuuauuuggucagguga

SEQ ID NO: 31675 - RNA, 20 nt, Artificial Sequence
  CIITA targeting sequence
guuuauuuggucaggugacu

SEQ ID NO: 31676 - RNA, 20 nt, Artificial Sequence
  CIITA targeting sequence
ggugacugcggugguaugga

SEQ ID NO: 31677 - RNA, 20 nt, Artificial Sequence
  CIITA targeting sequence
ccugaccaaauaaacggaga

SEQ ID NO: 31678 - RNA, 20 nt, Artificial Sequence
  CIITA targeting sequence
auaccaccgcagucaccuga

SEQ ID NO: 31679 - RNA, 20 nt, Artificial Sequence
  CIITA targeting sequence
uuccauaccaccgcagucac

SEQ ID NO: 31680 - RNA, 20 nt, Artificial Sequence
  CIITA targeting sequence
acaaacaggccccuucuuuc

SEQ ID NO: 31681 - RNA, 20 nt, Artificial Sequence
  CIITA targeting sequence
agcaccuuggcuucaacaaa

SEQ ID NO: 31682 - RNA, 20 nt, Artificial Sequence
  CIITA targeting sequence
uccagcaccuuggcuucaac

SEQ ID NO: 31683 - RNA, 20 nt, Artificial Sequence
  CIITA targeting sequence
uacugacaagccaaaggugu

SEQ ID NO: 31684 - RNA, 20 nt, Artificial Sequence
  CIITA targeting sequence
guacgacacaggcaguucuu

SEQ ID NO: 31685 - RNA, 20 nt, Artificial Sequence
  CIITA targeting sequence
gucguggcuauuucucgugu

SEQ ID NO: 31686 - RNA, 20 nt, Artificial Sequence
  CIITA targeting sequence
uggcuauuucucguguccuu

SEQ ID NO: 31687 - RNA, 20 nt, Artificial Sequence
  CIITA targeting sequence
cguguccuuggguucucugc

SEQ ID NO: 31688 - RNA, 20 nt, Artificial Sequence
  CIITA targeting sequence
uguccuuggguucucugccu

SEQ ID NO: 31689 - RNA, 20 nt, Artificial Sequence
  CIITA targeting sequence
uuggguucucugccugggga

SEQ ID NO: 31690 - RNA, 20 nt, Artificial Sequence
  CIITA targeting sequence
cugccuggggaucuccgcuu

SEQ ID NO: 31691 - RNA, 20 nt, Artificial Sequence
  CIITA targeting sequence
gccuggggaucuccgcuuuc

SEQ ID NO: 31692 - RNA, 20 nt, Artificial Sequence
  CIITA targeting sequence
ccaggcagagaacccaagga

SEQ ID NO: 31693 - RNA, 20 nt, Artificial Sequence
  CIITA targeting sequence
ccgcuuucuccgcugcuaag

SEQ ID NO: 31694 - RNA, 20 nt, Artificial Sequence
  CIITA targeting sequence
gcuuucuccgcugcuaaggu

SEQ ID NO: 31695 - RNA, 20 nt, Artificial Sequence
  CIITA targeting sequence
ccgcugcuaaggucagaggu

SEQ ID NO: 31696 - RNA, 20 nt, Artificial Sequence
  CIITA targeting sequence
gcugcuaaggucagagguac

SEQ ID NO: 31697 - RNA, 20 nt, Artificial Sequence
  CIITA targeting sequence
gagguacuaguguguaggca

SEQ ID NO: 31698 - RNA, 20 nt, Artificial Sequence
  CIITA targeting sequence
gaccuuagcagcggagaaag

SEQ ID NO: 31699 - RNA, 20 nt, Artificial Sequence
  CIITA targeting sequence
uggccagccagucugagaug

SEQ ID NO: 31700 - RNA, 20 nt, Artificial Sequence
  CIITA targeting sequence
gagauggaaacguccugggc

SEQ ID NO: 31701 - RNA, 20 nt, Artificial Sequence
  CIITA targeting sequence
gacuggcuggccaggaauug

SEQ ID NO: 31702 - RNA, 20 nt, Artificial Sequence
  CIITA targeting sequence
cagacuggcuggccaggaau

SEQ ID NO: 31703 - RNA, 20 nt, Artificial Sequence
  CIITA targeting sequence
aucucagacuggcuggccag

SEQ ID NO: 31704 - RNA, 20 nt, Artificial Sequence
  CIITA targeting sequence
ugggcugagcauuuugguuu

SEQ ID NO: 31705 - RNA, 20 nt, Artificial Sequence
  CIITA targeting sequence
gcccaggacguuuccaucuc

SEQ ID NO: 31706 - RNA, 20 nt, Artificial Sequence
  CIITA targeting sequence
gcuguaagccgguuaaaacc

SEQ ID NO: 31707 - RNA, 20 nt, Artificial Sequence
  CIITA targeting sequence
gauucucucucccaacuccg

SEQ ID NO: 31708 - RNA, 20 nt, Artificial Sequence
  CIITA targeting sequence
gaacuuucagcuguaagccg

SEQ ID NO: 31709 - RNA, 20 nt, Artificial Sequence
  CIITA targeting sequence
cucucccaacuccgcucaug

SEQ ID NO: 31710 - RNA, 20 nt, Artificial Sequence
  CIITA targeting sequence
cucccaacuccgcucaugcg

SEQ ID NO: 31711 - RNA, 20 nt, Artificial Sequence
  CIITA targeting sequence
cccaacuccgcucaugcgcu

SEQ ID NO: 31712 - RNA, 20 nt, Artificial Sequence
  CIITA targeting sequence
caacuccgcucaugcgcuuu

SEQ ID NO: 31713 - RNA, 20 nt, Artificial Sequence
  CIITA targeting sequence
gcucaugcgcuuuccaaaaa

SEQ ID NO: 31714 - RNA, 20 nt, Artificial Sequence
  CIITA targeting sequence
ugcgcuuuccaaaaauucca

SEQ ID NO: 31715 - RNA, 20 nt, Artificial Sequence
  CIITA targeting sequence
aaaaauuccaaacgcugauu

SEQ ID NO: 31716 - RNA, 20 nt, Artificial Sequence
  CIITA targeting sequence
aaacgcugauuucaguagca

SEQ ID NO: 31717 - RNA, 20 nt, Artificial Sequence
  CIITA targeting sequence
gcguuuggaauuuuuggaaa

SEQ ID NO: 31718 - RNA, 20 nt, Artificial Sequence
  CIITA targeting sequence
guagcaucucugugcccucc

SEQ ID NO: 31719 - RNA, 20 nt, Artificial Sequence
  CIITA targeting sequence
cugugcccuccuagcguaug

SEQ ID NO: 31720 - RNA, 20 nt, Artificial Sequence
  CIITA targeting sequence
gugcccuccuagcguauguc

SEQ ID NO: 31721 - RNA, 20 nt, Artificial Sequence
  CIITA targeting sequence
uagcguaugucugcgccggg

SEQ ID NO: 31722 - RNA, 20 nt, Artificial Sequence
  CIITA targeting sequence
gcgccgggugcuuuuccuuu

SEQ ID NO: 31723 - RNA, 20 nt, Artificial Sequence
  CIITA targeting sequence
uuuuagcagucgcggcauuc

SEQ ID NO: 31724 - RNA, 20 nt, Artificial Sequence
  CIITA targeting sequence
cggcauucgcuuugugauuc

SEQ ID NO: 31725 - RNA, 20 nt, Artificial Sequence
  CIITA targeting sequence
cuuugugauucccuacucca

SEQ ID NO: 31726 - RNA, 20 nt, Artificial Sequence
  CIITA targeting sequence
caaagcgaaugccgcgacug

SEQ ID NO: 31727 - RNA, 20 nt, Artificial Sequence
  CIITA targeting sequence
cuacuccaaacacgucaucc

SEQ ID NO: 31728 - RNA, 20 nt, Artificial Sequence
  CIITA targeting sequence
aaacacgucauccgcagggg

SEQ ID NO: 31729 - RNA, 20 nt, Artificial Sequence
  CIITA targeting sequence
uccgcaggggcucugggucu

SEQ ID NO: 31730 - RNA, 20 nt, Artificial Sequence
  CIITA targeting sequence
gcaggggcucugggucucag

SEQ ID NO: 31731 - RNA, 20 nt, Artificial Sequence
  CIITA targeting sequence
gggucucaguuuuagcugau

SEQ ID NO: 31732 - RNA, 20 nt, Artificial Sequence
  CIITA targeting sequence
caguuuuagcugaucugcuu

SEQ ID NO: 31733 - RNA, 20 nt, Artificial Sequence
  CIITA targeting sequence
guuuuagcugaucugcuuuu

SEQ ID NO: 31734 - RNA, 20 nt, Artificial Sequence
  CIITA targeting sequence
gcuaaaacugagacccagag

SEQ ID NO: 31735 - RNA, 20 nt, Artificial Sequence
  CIITA targeting sequence
gcuuuuuucguuuuccaugu

SEQ ID NO: 31736 - RNA, 20 nt, Artificial Sequence
  CIITA targeting sequence
uuuuccauguggauuccugu

SEQ ID NO: 31737 - RNA, 20 nt, Artificial Sequence
  CIITA targeting sequence
auguggauuccuguuuuucg

SEQ ID NO: 31738 - RNA, 20 nt, Artificial Sequence
  CIITA targeting sequence
acauggaaaacgaaaaaagc

SEQ ID NO: 31739 - RNA, 20 nt, Artificial Sequence
  CIITA targeting sequence
uguuuuucggauccaccucu

SEQ ID NO: 31740 - RNA, 20 nt, Artificial Sequence
  CIITA targeting sequence
gauccaccucuggugggugu

SEQ ID NO: 31741 - RNA, 20 nt, Artificial Sequence
  CIITA targeting sequence
gaaaaacaggaauccacaug

SEQ ID NO: 31742 - RNA, 20 nt, Artificial Sequence
  CIITA targeting sequence
accucuggugggugucagua

SEQ ID NO: 31743 - RNA, 20 nt, Artificial Sequence
  CIITA targeting sequence
ggugggugucaguaaacuca

SEQ ID NO: 31744 - RNA, 20 nt, Artificial Sequence
  CIITA targeting sequence
guaaacucacaguugacuuu

SEQ ID NO: 31745 - RNA, 20 nt, Artificial Sequence
  CIITA targeting sequence
caguugacuuuccuuuuuuc

SEQ ID NO: 31746 - RNA, 20 nt, Artificial Sequence
  CIITA targeting sequence
acugugaguuuacugacacc

SEQ ID NO: 31747 - RNA, 20 nt, Artificial Sequence
  CIITA targeting sequence
uuuuuucauaacaucaaaca

SEQ ID NO: 31748 - RNA, 20 nt, Artificial Sequence
  CIITA targeting sequence
uaacaucaaacacuuuaguu

SEQ ID NO: 31749 - RNA, 20 nt, Artificial Sequence
  CIITA targeting sequence
aacacuuuaguuaaugaagg

SEQ ID NO: 31750 - RNA, 20 nt, Artificial Sequence
  CIITA targeting sequence
uuaacuaaaguguuugaugu

SEQ ID NO: 31751 - RNA, 20 nt, Artificial Sequence
  CIITA targeting sequence
uucucguucuuggcaucucc

SEQ ID NO: 31752 - RNA, 20 nt, Artificial Sequence
  CIITA targeting sequence
cguucuuggcaucuccuaga

SEQ ID NO: 31753 - RNA, 20 nt, Artificial Sequence
  CIITA targeting sequence
uucuuggcaucuccuagacu

SEQ ID NO: 31754 - RNA, 20 nt, Artificial Sequence
  CIITA targeting sequence
uggcaucuccuagacuucca

SEQ ID NO: 31755 - RNA, 20 nt, Artificial Sequence
  CIITA targeting sequence
ccuagacuuccacugucuga

SEQ ID NO: 31756 - RNA, 20 nt, Artificial Sequence
  CIITA targeting sequence
uagacuuccacugucugacu

SEQ ID NO: 31757 - RNA, 20 nt, Artificial Sequence
  CIITA targeting sequence
aggagaugccaagaacgaga

SEQ ID NO: 31758 - RNA, 20 nt, Artificial Sequence
  CIITA targeting sequence
acugucugacuugaaucucg

SEQ ID NO: 31759 - RNA, 20 nt, Artificial Sequence
  CIITA targeting sequence
gacuugaaucucgcugauuu

SEQ ID NO: 31760 - RNA, 20 nt, Artificial Sequence
  CIITA targeting sequence
gacaguggaagucuaggaga

SEQ ID NO: 31761 - RNA, 20 nt, Artificial Sequence
  CIITA targeting sequence
agucagacaguggaagucua

SEQ ID NO: 31762 - RNA, 20 nt, Artificial Sequence
  CIITA targeting sequence
cgcugauuuuuuccuggaga

SEQ ID NO: 31763 - RNA, 20 nt, Artificial Sequence
  CIITA targeting sequence
cugauuuuuuccuggagaga

SEQ ID NO: 31764 - RNA, 20 nt, Artificial Sequence
  CIITA targeting sequence
gcgagauucaagucagacag

SEQ ID NO: 31765 - RNA, 20 nt, Artificial Sequence
  CIITA targeting sequence
uggagagaauaucacaugug

SEQ ID NO: 31766 - RNA, 20 nt, Artificial Sequence
  CIITA targeting sequence
aggaaaaaaucagcgagauu

SEQ ID NO: 31767 - RNA, 20 nt, Artificial Sequence
  CIITA targeting sequence
ccaggaaaaaaucagcgaga

SEQ ID NO: 31768 - RNA, 20 nt, Artificial Sequence
  CIITA targeting sequence
cuccaggaaaaaaucagcga

SEQ ID NO: 31769 - RNA, 20 nt, Artificial Sequence
  CIITA targeting sequence
caugugaugaguuuauggga

SEQ ID NO: 31770 - RNA, 20 nt, Artificial Sequence
  CIITA targeting sequence
caugugauauucucuccagg

SEQ ID NO: 31771 - RNA, 20 nt, Artificial Sequence
  CIITA targeting sequence
ucacaugugauauucucucc

SEQ ID NO: 31772 - RNA, 20 nt, Artificial Sequence
  CIITA targeting sequence
cauaaacucaucacauguga

SEQ ID NO: 31773 - RNA, 20 nt, Artificial Sequence
  CIITA targeting sequence
guucccauaaacucaucaca

SEQ ID NO: 31774 - RNA, 20 nt, Artificial Sequence
  CIITA targeting sequence
ucaguucccauaaacucauc

SEQ ID NO: 31775 - RNA, 20 nt, Artificial Sequence
  CIITA targeting sequence
ccggcuaucuaaacuugaug

SEQ ID NO: 31776 - RNA, 20 nt, Artificial Sequence
  CIITA targeting sequence
ggcuaucuaaacuugauguu

SEQ ID NO: 31777 - RNA, 20 nt, Artificial Sequence
  CIITA targeting sequence
aaacuugauguuaaacuucc

SEQ ID NO: 31778 - RNA, 20 nt, Artificial Sequence
  CIITA targeting sequence
aguuuagauagccggagaca

SEQ ID NO: 31779 - RNA, 20 nt, Artificial Sequence
  CIITA targeting sequence
cucggugcaacuuacuucac

SEQ ID NO: 31780 - RNA, 20 nt, Artificial Sequence
  CIITA targeting sequence
gugcaacuuacuucacuuca

SEQ ID NO: 31781 - RNA, 20 nt, Artificial Sequence
  CIITA targeting sequence
cuucauucagaauuucuccg

SEQ ID NO: 31782 - RNA, 20 nt, Artificial Sequence
  CIITA targeting sequence
uucagaauuucuccggcugc

SEQ ID NO: 31783 - RNA, 20 nt, Artificial Sequence
  CIITA targeting sequence
gaauuucuccggcugcucuu

SEQ ID NO: 31784 - RNA, 20 nt, Artificial Sequence
  CIITA targeting sequence
gaaugaagugaaguaaguug

SEQ ID NO: 31785 - RNA, 20 nt, Artificial Sequence
  CIITA targeting sequence
ccggcugcucuuagucacuu

SEQ ID NO: 31786 - RNA, 20 nt, Artificial Sequence
  CIITA targeting sequence
ggcugcucuuagucacuuuu

SEQ ID NO: 31787 - RNA, 20 nt, Artificial Sequence
  CIITA targeting sequence
uagucacuuuuugcaguuuu

SEQ ID NO: 31788 - RNA, 20 nt, Artificial Sequence
  CIITA targeting sequence
cuuuuugcaguuuuccucgg

SEQ ID NO: 31789 - RNA, 20 nt, Artificial Sequence
  CIITA targeting sequence
ucggaaaagccucuccgaag

SEQ ID NO: 31790 - RNA, 20 nt, Artificial Sequence
  CIITA targeting sequence
gaaaagccucuccgaaguca

SEQ ID NO: 31791 - RNA, 20 nt, Artificial Sequence
  CIITA targeting sequence
gaggaaaacugcaaaaagug

SEQ ID NO: 31792 - RNA, 20 nt, Artificial Sequence
  CIITA targeting sequence
ccgaagucaaagcugugggg

SEQ ID NO: 31793 - RNA, 20 nt, Artificial Sequence
  CIITA targeting sequence
gaagucaaagcuguggggaa

SEQ ID NO: 31794 - RNA, 20 nt, Artificial Sequence
  CIITA targeting sequence
gagaggcuuuuccgaggaaa

SEQ ID NO: 31795 - RNA, 20 nt, Artificial Sequence
  CIITA targeting sequence
aagcuguggggaaaauggga

SEQ ID NO: 31796 - RNA, 20 nt, Artificial Sequence
  CIITA targeting sequence
ccacagcuuugacuucggag

SEQ ID NO: 31797 - RNA, 20 nt, Artificial Sequence
  CIITA targeting sequence
cauuuuccccacagcuuuga

SEQ ID NO: 31798 - RNA, 20 nt, Artificial Sequence
  CIITA targeting sequence
uucccgcugucgguuuccac

SEQ ID NO: 31799 - RNA, 20 nt, Artificial Sequence
  CIITA targeting sequence
cgcugucgguuuccacaggc

SEQ ID NO: 31800 - RNA, 20 nt, Artificial Sequence
  CIITA targeting sequence
guuuccacaggccgcccuuc

SEQ ID NO: 31801 - RNA, 20 nt, Artificial Sequence
  CIITA targeting sequence
acaggccgcccuucaaggau

SEQ ID NO: 31802 - RNA, 20 nt, Artificial Sequence
  CIITA targeting sequence
aggaucaguucgcuuuucuc

SEQ ID NO: 31803 - RNA, 20 nt, Artificial Sequence
  CIITA targeting sequence
uugaagggcggccuguggaa

SEQ ID NO: 31804 - RNA, 20 nt, Artificial Sequence
  CIITA targeting sequence
guucgcuuuucucgucgucu

SEQ ID NO: 31805 - RNA, 20 nt, Artificial Sequence
  CIITA targeting sequence
cuuuucucgucgucugccuc

SEQ ID NO: 31806 - RNA, 20 nt, Artificial Sequence
  CIITA targeting sequence
cgucgucugccucguccccc

SEQ ID NO: 31807 - RNA, 20 nt, Artificial Sequence
  CIITA targeting sequence
ucgucugccucgucccccuu

SEQ ID NO: 31808 - RNA, 20 nt, Artificial Sequence
  CIITA targeting sequence
ucugccucgucccccuugcu

SEQ ID NO: 31809 - RNA, 20 nt, Artificial Sequence
  CIITA targeting sequence
gccucgucccccuugcucuc

SEQ ID NO: 31810 - RNA, 20 nt, Artificial Sequence
  CIITA targeting sequence
ucccccuugcucucugccac

SEQ ID NO: 31811 - RNA, 20 nt, Artificial Sequence
  CIITA targeting sequence
cccuugcucucugccacgac

SEQ ID NO: 31812 - RNA, 20 nt, Artificial Sequence
  CIITA targeting sequence
cugccacgacugcaccucag

SEQ ID NO: 31813 - RNA, 20 nt, Artificial Sequence
  CIITA targeting sequence
gccacgacugcaccucaggg

SEQ ID NO: 31814 - RNA, 20 nt, Artificial Sequence
  CIITA targeting sequence
uggcagagagcaagggggac

SEQ ID NO: 31815 - RNA, 20 nt, Artificial Sequence
  CIITA targeting sequence
gggcucagucuacuggaguc

SEQ ID NO: 31816 - RNA, 20 nt, Artificial Sequence
  CIITA targeting sequence
gucuacuggaguccaggcua

SEQ ID NO: 31817 - RNA, 20 nt, Artificial Sequence
  CIITA targeting sequence
acuggaguccaggcuaguca

SEQ ID NO: 31818 - RNA, 20 nt, Artificial Sequence
  CIITA targeting sequence
aguagacugagcccugaggu

SEQ ID NO: 31819 - RNA, 20 nt, Artificial Sequence
  CIITA targeting sequence
aggcuagucaaguauguagc

SEQ ID NO: 31820 - RNA, 20 nt, Artificial Sequence
  CIITA targeting sequence
aguauguagcagacgaugug

SEQ ID NO: 31821 - RNA, 20 nt, Artificial Sequence
  CIITA targeting sequence
gcuacauacuugacuagccu

SEQ ID NO: 31822 - RNA, 20 nt, Artificial Sequence
  CIITA targeting sequence
ucugcuacauacuugacuag

SEQ ID NO: 31823 - RNA, 20 nt, Artificial Sequence
  CIITA targeting sequence
accacaucgucugcuacaua

SEQ ID NO: 31824 - RNA, 20 nt, Artificial Sequence
  CIITA targeting sequence
gaggugauggugcugacguu

SEQ ID NO: 31825 - RNA, 20 nt, Artificial Sequence
  CIITA targeting sequence
gauuauuccaccacaucguc

SEQ ID NO: 31826 - RNA, 20 nt, Artificial Sequence
  CIITA targeting sequence
ccucagauuauuccaccaca

SEQ ID NO: 31827 - RNA, 20 nt, Artificial Sequence
  CIITA targeting sequence
gcaccaucaccucagauuau

SEQ ID NO: 31828 - RNA, 20 nt, Artificial Sequence
  CIITA targeting sequence
cuauguuuccuuucuaugcc

SEQ ID NO: 31829 - RNA, 20 nt, Artificial Sequence
  CIITA targeting sequence
uuucuaugcccugcugaauu

SEQ ID NO: 31830 - RNA, 20 nt, Artificial Sequence
  CIITA targeting sequence
augcccugcugaauuucuua

SEQ ID NO: 31831 - RNA, 20 nt, Artificial Sequence
  CIITA targeting sequence
gcagggcauagaaaggaaac

SEQ ID NO: 31832 - RNA, 20 nt, Artificial Sequence
  CIITA targeting sequence
uauaacaguuuuauugaggu

SEQ ID NO: 31833 - RNA, 20 nt, Artificial Sequence
  CIITA targeting sequence
auaaaacuguuauaagaaau

SEQ ID NO: 31834 - RNA, 20 nt, Artificial Sequence
  CIITA targeting sequence
cauaccauacaacucaucca

SEQ ID NO: 31835 - RNA, 20 nt, Artificial Sequence
  CIITA targeting sequence
uccauuaagaguguacaauu

SEQ ID NO: 31836 - RNA, 20 nt, Artificial Sequence
  CIITA targeting sequence
auuaagaguguacaauucaa

SEQ ID NO: 31837 - RNA, 20 nt, Artificial Sequence
  CIITA targeting sequence
uaauggaugaguuguauggu

SEQ ID NO: 31838 - RNA, 20 nt, Artificial Sequence
  CIITA targeting sequence
agccugggccacaaagugag

SEQ ID NO: 31839 - RNA, 20 nt, Artificial Sequence
  CIITA targeting sequence
caccgcuguacucuagccug

SEQ ID NO: 31840 - RNA, 20 nt, Artificial Sequence
  CIITA targeting sequence
cagcucacugcagccuccaa

SEQ ID NO: 31841 - RNA, 20 nt, Artificial Sequence
  CIITA targeting sequence
cugcagccuccaacuccugg

SEQ ID NO: 31842 - RNA, 20 nt, Artificial Sequence
  CIITA targeting sequence
aacuccugggcuccugccuc

SEQ ID NO: 31843 - RNA, 20 nt, Artificial Sequence
  CIITA targeting sequence
ugggcuccugccucagccuc

SEQ ID NO: 31844 - RNA, 20 nt, Artificial Sequence
  CIITA targeting sequence
ugccucagccuccugaguag

SEQ ID NO: 31845 - RNA, 20 nt, Artificial Sequence
  CIITA targeting sequence
gccuccugaguagcugggac

SEQ ID NO: 31846 - RNA, 20 nt, Artificial Sequence
  CIITA targeting sequence
ugaguagcugggacugcagg

SEQ ID NO: 31847 - RNA, 20 nt, Artificial Sequence
  CIITA targeting sequence
ggaggcugaggcaggagccc

SEQ ID NO: 31848 - RNA, 20 nt, Artificial Sequence
  CIITA targeting sequence
cagcuacucaggaggcugag

SEQ ID NO: 31849 - RNA, 20 nt, Artificial Sequence
  CIITA targeting sequence
ugcagucccagcuacucagg

SEQ ID NO: 31850 - RNA, 20 nt, Artificial Sequence
  CIITA targeting sequence
gcuaauuuuauauuuguaga

SEQ ID NO: 31851 - RNA, 20 nt, Artificial Sequence
  CIITA targeting sequence
ccaugcccagcucccuuugu

SEQ ID NO: 31852 - RNA, 20 nt, Artificial Sequence
  CIITA targeting sequence
cuuuguaacuuuugagaaac

SEQ ID NO: 31853 - RNA, 20 nt, Artificial Sequence
  CIITA targeting sequence
aaaguuacaaagggagcugg

SEQ ID NO: 31854 - RNA, 20 nt, Artificial Sequence
  CIITA targeting sequence
caaaaguuacaaagggagcu

SEQ ID NO: 31855 - RNA, 20 nt, Artificial Sequence
  CIITA targeting sequence
aaagcuucacucuaucaaaa

SEQ ID NO: 31856 - RNA, 20 nt, Artificial Sequence
  CIITA targeting sequence
cucuaucaaaaaauauauau

SEQ ID NO: 31857 - RNA, 20 nt, Artificial Sequence
  CIITA targeting sequence
aucaaaaaauauauauauuu

SEQ ID NO: 31858 - RNA, 20 nt, Artificial Sequence
  CIITA targeting sequence
aaaaauauauauauuuuuua

SEQ ID NO: 31859 - RNA, 20 nt, Artificial Sequence
  CIITA targeting sequence
uuuauuauauuuuauuuauu

SEQ ID NO: 31860 - RNA, 20 nt, Artificial Sequence
  CIITA targeting sequence
ccuuuccuggugaggggugg

SEQ ID NO: 31861 - RNA, 20 nt, Artificial Sequence
  CIITA targeting sequence
uuuccuggugagggguggag

SEQ ID NO: 31862 - RNA, 20 nt, Artificial Sequence
  CIITA targeting sequence
uggugagggguggaggcugg

SEQ ID NO: 31863 - RNA, 20 nt, Artificial Sequence
  CIITA targeting sequence
ccaggaaaggagaauacuca

SEQ ID NO: 31864 - RNA, 20 nt, Artificial Sequence
  CIITA targeting sequence
accccucaccaggaaaggag

SEQ ID NO: 31865 - RNA, 20 nt, Artificial Sequence
  CIITA targeting sequence
ugccagccuccaccccucac

SEQ ID NO: 31866 - RNA, 20 nt, Artificial Sequence
  CIITA targeting sequence
gccuggcccuccugccagcc

SEQ ID NO: 31867 - RNA, 20 nt, Artificial Sequence
  CIITA targeting sequence
ucagccuggcccuccugcca

SEQ ID NO: 31868 - RNA, 20 nt, Artificial Sequence
  CIITA targeting sequence
gaagagaaaccuuacuccca

SEQ ID NO: 31869 - RNA, 20 nt, Artificial Sequence
  CIITA targeting sequence
gacauccucagccuggcccu

SEQ ID NO: 31870 - RNA, 20 nt, Artificial Sequence
  CIITA targeting sequence
ucugacauccucagccuggc

SEQ ID NO: 31871 - RNA, 20 nt, Artificial Sequence
  CIITA targeting sequence
cuucugacauccucagccug

SEQ ID NO: 31872 - RNA, 20 nt, Artificial Sequence
  CIITA targeting sequence
cagauccuagaaggagagag

SEQ ID NO: 31873 - RNA, 20 nt, Artificial Sequence
  CIITA targeting sequence
gggaguaagguuucucuucu

SEQ ID NO: 31874 - RNA, 20 nt, Artificial Sequence
  CIITA targeting sequence
uagaaggagagaggcacccc

SEQ ID NO: 31875 - RNA, 20 nt, Artificial Sequence
  CIITA targeting sequence
aggaucugggaguaagguuu

SEQ ID NO: 31876 - RNA, 20 nt, Artificial Sequence
  CIITA targeting sequence
uucuaggaucugggaguaag

SEQ ID NO: 31877 - RNA, 20 nt, Artificial Sequence
  CIITA targeting sequence
ccuucuaggaucugggagua

SEQ ID NO: 31878 - RNA, 20 nt, Artificial Sequence
  CIITA targeting sequence
cuccuucuaggaucugggag

SEQ ID NO: 31879 - RNA, 20 nt, Artificial Sequence
  CIITA targeting sequence
cuggggugccucucuccuuc

SEQ ID NO: 31880 - RNA, 20 nt, Artificial Sequence
  CIITA targeting sequence
ccacgccucgcuggggugcc

SEQ ID NO: 31881 - RNA, 20 nt, Artificial Sequence
  CIITA targeting sequence
aaggccccaguccccacgcc

SEQ ID NO: 31882 - RNA, 20 nt, Artificial Sequence
  CIITA targeting sequence
uccucacagccccuugcacc

SEQ ID NO: 31883 - RNA, 20 nt, Artificial Sequence
  CIITA targeting sequence
ucacagccccuugcaccuuc

SEQ ID NO: 31884 - RNA, 20 nt, Artificial Sequence
  CIITA targeting sequence
cagccccuugcaccuuccca

SEQ ID NO: 31885 - RNA, 20 nt, Artificial Sequence
  CIITA targeting sequence
caccugcugggaguuuuagg

SEQ ID NO: 31886 - RNA, 20 nt, Artificial Sequence
  CIITA targeting sequence
cagcaggugggaaggugcaa

SEQ ID NO: 31887 - RNA, 20 nt, Artificial Sequence
  CIITA targeting sequence
agaggcugcagaaccaggac

SEQ ID NO: 31888 - RNA, 20 nt, Artificial Sequence
  CIITA targeting sequence
ggaaacccccuaaaacuccc

SEQ ID NO: 31889 - RNA, 20 nt, Artificial Sequence
  CIITA targeting sequence
gcagccucuggaaacccccu

SEQ ID NO: 31890 - RNA, 20 nt, Artificial Sequence
  CIITA targeting sequence
ugguucugcagccucuggaa

SEQ ID NO: 31891 - RNA, 20 nt, Artificial Sequence
  CIITA targeting sequence
agaguccuugaguuuggugu

SEQ ID NO: 31892 - RNA, 20 nt, Artificial Sequence
  CIITA targeting sequence
agaaaauauuguccugguuc

SEQ ID NO: 31893 - RNA, 20 nt, Artificial Sequence
  CIITA targeting sequence
uugaguuuggugugaccaca

SEQ ID NO: 31894 - RNA, 20 nt, Artificial Sequence
  CIITA targeting sequence
aggacucuagaaaauauugu

SEQ ID NO: 31895 - RNA, 20 nt, Artificial Sequence
  CIITA targeting sequence
caccaaacucaaggacucua

SEQ ID NO: 31896 - RNA, 20 nt, Artificial Sequence
  CIITA targeting sequence
ggcugccuguggucacacca

SEQ ID NO: 31897 - RNA, 20 nt, Artificial Sequence
  CIITA targeting sequence
guuucaggcugccugugguc

SEQ ID NO: 31898 - RNA, 20 nt, Artificial Sequence
  CIITA targeting sequence
caaggccuggcuuucgguuu

SEQ ID NO: 31899 - RNA, 20 nt, Artificial Sequence
  CIITA targeting sequence
cuuggcugggauuuaagcac

SEQ ID NO: 31900 - RNA, 20 nt, Artificial Sequence
  CIITA targeting sequence
cagccaagggaagcagccgc

SEQ ID NO: 31901 - RNA, 20 nt, Artificial Sequence
  CIITA targeting sequence
ggccugugcuuaaaucccag

SEQ ID NO: 31902 - RNA, 20 nt, Artificial Sequence
  CIITA targeting sequence
ugugugucuggccugugcuu

SEQ ID NO: 31903 - RNA, 20 nt, Artificial Sequence
  CIITA targeting sequence
gagccauccugccagccgug

SEQ ID NO: 31904 - RNA, 20 nt, Artificial Sequence
  CIITA targeting sequence
gaaggccucaugugugucug

SEQ ID NO: 31905 - RNA, 20 nt, Artificial Sequence
  CIITA targeting sequence
ugccagccgugugacccaac

SEQ ID NO: 31906 - RNA, 20 nt, Artificial Sequence
  CIITA targeting sequence
cacggcuggcaggauggcuc

SEQ ID NO: 31907 - RNA, 20 nt, Artificial Sequence
  CIITA targeting sequence
ugcaugucuuuaucugacau

SEQ ID NO: 31908 - RNA, 20 nt, Artificial Sequence
  CIITA targeting sequence
uuaucugacaucagaaccca

SEQ ID NO: 31909 - RNA, 20 nt, Artificial Sequence
  CIITA targeting sequence
gacaucagaacccaccugga

SEQ ID NO: 31910 - RNA, 20 nt, Artificial Sequence
  CIITA targeting sequence
gauaaagacaugcaugaccc

SEQ ID NO: 31911 - RNA, 20 nt, Artificial Sequence
  CIITA targeting sequence
gaacccaccuggagagccgc

SEQ ID NO: 31912 - RNA, 20 nt, Artificial Sequence
  CIITA targeting sequence
gaugucagauaaagacaugc

SEQ ID NO: 31913 - RNA, 20 nt, Artificial Sequence
  CIITA targeting sequence
agguggguucugaugucaga

SEQ ID NO: 31914 - RNA, 20 nt, Artificial Sequence
  CIITA targeting sequence
ccagguggguucugauguca

SEQ ID NO: 31915 - RNA, 20 nt, Artificial Sequence
  CIITA targeting sequence
uagguguguccugagaccaa

SEQ ID NO: 31916 - RNA, 20 nt, Artificial Sequence
  CIITA targeting sequence
ugagaccaaagcuggaaguu

SEQ ID NO: 31917 - RNA, 20 nt, Artificial Sequence
  CIITA targeting sequence
ggacacaccuaagacacagc

SEQ ID NO: 31918 - RNA, 20 nt, Artificial Sequence
  CIITA targeting sequence
caggacacaccuaagacaca

SEQ ID NO: 31919 - RNA, 20 nt, Artificial Sequence
  CIITA targeting sequence
agcuuuggucucaggacaca

SEQ ID NO: 31920 - RNA, 20 nt, Artificial Sequence
  CIITA targeting sequence
gagcacauugcccagaagaa

SEQ ID NO: 31921 - RNA, 20 nt, Artificial Sequence
  CIITA targeting sequence
gaacuuccagcuuuggucuc

SEQ ID NO: 31922 - RNA, 20 nt, Artificial Sequence
  CIITA targeting sequence
gggcaaugugcucugaacuu

SEQ ID NO: 31923 - RNA, 20 nt, Artificial Sequence
  CIITA targeting sequence
ucugggcaaugugcucugaa

SEQ ID NO: 31924 - RNA, 20 nt, Artificial Sequence
  CIITA targeting sequence
cuucuucugggcaaugugcu

SEQ ID NO: 31925 - RNA, 20 nt, Artificial Sequence
  CIITA targeting sequence
cacuucuucugggcaaugug

SEQ ID NO: 31926 - RNA, 20 nt, Artificial Sequence
  CIITA targeting sequence
aauuuuuuuuuuuaauuugg

SEQ ID NO: 31927 - RNA, 20 nt, Artificial Sequence
  CIITA targeting sequence
aaaaugucucacuucuucug

SEQ ID NO: 31928 - RNA, 20 nt, Artificial Sequence
  CIITA targeting sequence
aaauuaaaaaaaaaaauucg

SEQ ID NO: 31929 - RNA, 20 nt, Artificial Sequence
  CIITA targeting sequence
ugcugugucacccaggcugg

SEQ ID NO: 31930 - RNA, 20 nt, Artificial Sequence
  CIITA targeting sequence
cccaggcuggagugcagugg

SEQ ID NO: 31931 - RNA, 20 nt, Artificial Sequence
  CIITA targeting sequence
agccugggugacacagcaag

SEQ ID NO: 31932 - RNA, 20 nt, Artificial Sequence
  CIITA targeting sequence
uggcucacugcagccuugac

SEQ ID NO: 31933 - RNA, 20 nt, Artificial Sequence
  CIITA targeting sequence
cugcagccuugaccuccugg

SEQ ID NO: 31934 - RNA, 20 nt, Artificial Sequence
  CIITA targeting sequence
aggcugcagugagccaagau

SEQ ID NO: 31935 - RNA, 20 nt, Artificial Sequence
  CIITA targeting sequence
ugggcucaagcgauccuucc

SEQ ID NO: 31936 - RNA, 20 nt, Artificial Sequence
  CIITA targeting sequence
agcgauccuuccacuucuca

SEQ ID NO: 31937 - RNA, 20 nt, Artificial Sequence
  CIITA targeting sequence
cuugagcccaggaggucaag

SEQ ID NO: 31938 - RNA, 20 nt, Artificial Sequence
  CIITA targeting sequence
uuccacuucucagucccgcg

SEQ ID NO: 31939 - RNA, 20 nt, Artificial Sequence
  CIITA targeting sequence
acuucucagucccgcgagua

SEQ ID NO: 31940 - RNA, 20 nt, Artificial Sequence
  CIITA targeting sequence
cagucccgcgaguagcuggg

SEQ ID NO: 31941 - RNA, 20 nt, Artificial Sequence
  CIITA targeting sequence
gucccgcgaguagcugggac

SEQ ID NO: 31942 - RNA, 20 nt, Artificial Sequence
  CIITA targeting sequence
cgcgaguagcugggacuacg

SEQ ID NO: 31943 - RNA, 20 nt, Artificial Sequence
  CIITA targeting sequence
cgggacugagaaguggaagg

SEQ ID NO: 31944 - RNA, 20 nt, Artificial Sequence
  CIITA targeting sequence
cagcuacucgcgggacugag

SEQ ID NO: 31945 - RNA, 20 nt, Artificial Sequence
  CIITA targeting sequence
ggcuaauuuuuguauuuuuu

SEQ ID NO: 31946 - RNA, 20 nt, Artificial Sequence
  CIITA targeting sequence
acaaaaaauacaaaaauuag

SEQ ID NO: 31947 - RNA, 20 nt, Artificial Sequence
  CIITA targeting sequence
cuacaaaaaauacaaaaauu

SEQ ID NO: 31948 - RNA, 20 nt, Artificial Sequence
  CIITA targeting sequence
caucucuacaaaaaauacaa

SEQ ID NO: 31949 - RNA, 20 nt, Artificial Sequence
  CIITA targeting sequence
caggguggucucaaacuccu

SEQ ID NO: 31950 - RNA, 20 nt, Artificial Sequence
  CIITA targeting sequence
caaacuccugggcucaagug

SEQ ID NO: 31951 - RNA, 20 nt, Artificial Sequence
  CIITA targeting sequence
aacuccugggcucaagugau

SEQ ID NO: 31952 - RNA, 20 nt, Artificial Sequence
  CIITA targeting sequence
ugggcucaagugauccacgc

SEQ ID NO: 31953 - RNA, 20 nt, Artificial Sequence
  CIITA targeting sequence
agugauccacgcaccucagc

SEQ ID NO: 31954 - RNA, 20 nt, Artificial Sequence
  CIITA targeting sequence
cuugagcccaggaguuugag

SEQ ID NO: 31955 - RNA, 20 nt, Artificial Sequence
  CIITA targeting sequence
acgcaccucagccuccuaaa

SEQ ID NO: 31956 - RNA, 20 nt, Artificial Sequence
  CIITA targeting sequence
gccuccuaaagugcugggau

SEQ ID NO: 31957 - RNA, 20 nt, Artificial Sequence
  CIITA targeting sequence
uaaagugcugggauuauagg

SEQ ID NO: 31958 - RNA, 20 nt, Artificial Sequence
  CIITA targeting sequence
cagcacuuuaggaggcugag

SEQ ID NO: 31959 - RNA, 20 nt, Artificial Sequence
  CIITA targeting sequence
gccaucgcacccagccuugg

SEQ ID NO: 31960 - RNA, 20 nt, Artificial Sequence
  CIITA targeting sequence
cacccagccuuggaauguuu

SEQ ID NO: 31961 - RNA, 20 nt, Artificial Sequence
  CIITA targeting sequence
aaggcugggugcgauggcug

SEQ ID NO: 31962 - RNA, 20 nt, Artificial Sequence
  CIITA targeting sequence
cuuaaaacauuccaaggcug

SEQ ID NO: 31963 - RNA, 20 nt, Artificial Sequence
  CIITA targeting sequence
ugauaagacuguugcugaug

SEQ ID NO: 31964 - RNA, 20 nt, Artificial Sequence
  CIITA targeting sequence
ugacugucccuuaaaacauu

SEQ ID NO: 31965 - RNA, 20 nt, Artificial Sequence
  CIITA targeting sequence
uaucaugacugucccuuaaa

SEQ ID NO: 31966 - RNA, 20 nt, Artificial Sequence
  CIITA targeting sequence
gcaacagucuuaucaugacu

SEQ ID NO: 31967 - RNA, 20 nt, Artificial Sequence
  CIITA targeting sequence
uggcaucagcaacagucuua

SEQ ID NO: 31968 - RNA, 20 nt, Artificial Sequence
  CIITA targeting sequence
cguggcaucagcaacagucu

SEQ ID NO: 31969 - RNA, 20 nt, Artificial Sequence
  CIITA targeting sequence
ugggcgcuucucguggcauc

SEQ ID NO: 31970 - RNA, 20 nt, Artificial Sequence
  CIITA targeting sequence
guugccuccagagggauucc

SEQ ID NO: 31971 - RNA, 20 nt, Artificial Sequence
  CIITA targeting sequence
agagggauuccccucccuuc

SEQ ID NO: 31972 - RNA, 20 nt, Artificial Sequence
  CIITA targeting sequence
ggaggcaacagaagcuagcc

SEQ ID NO: 31973 - RNA, 20 nt, Artificial Sequence
  CIITA targeting sequence
cucuggaggcaacagaagcu

SEQ ID NO: 31974 - RNA, 20 nt, Artificial Sequence
  CIITA targeting sequence
ccucccuucucuucccuucc

SEQ ID NO: 31975 - RNA, 20 nt, Artificial Sequence
  CIITA targeting sequence
cuucucuucccuuccccacc

SEQ ID NO: 31976 - RNA, 20 nt, Artificial Sequence
  CIITA targeting sequence
cuucccuuccccaccugccg

SEQ ID NO: 31977 - RNA, 20 nt, Artificial Sequence
  CIITA targeting sequence
ucccuuccccaccugccguc

SEQ ID NO: 31978 - RNA, 20 nt, Artificial Sequence
  CIITA targeting sequence
cuuccccaccugccgucugc

SEQ ID NO: 31979 - RNA, 20 nt, Artificial Sequence
  CIITA targeting sequence
ccaccugccgucugcacaga

SEQ ID NO: 31980 - RNA, 20 nt, Artificial Sequence
  CIITA targeting sequence
gcacagaugcugaccauaag

SEQ ID NO: 31981 - RNA, 20 nt, Artificial Sequence
  CIITA targeting sequence
gugcagacggcaggugggga

SEQ ID NO: 31982 - RNA, 20 nt, Artificial Sequence
  CIITA targeting sequence
gcaucugugcagacggcagg

SEQ ID NO: 31983 - RNA, 20 nt, Artificial Sequence
  CIITA targeting sequence
uauggucagcaucugugcag

SEQ ID NO: 31984 - RNA, 20 nt, Artificial Sequence
  CIITA targeting sequence
gcaggcagcuguggugccca

SEQ ID NO: 31985 - RNA, 20 nt, Artificial Sequence
  CIITA targeting sequence
cauuggccaaugcggggccc

SEQ ID NO: 31986 - RNA, 20 nt, Artificial Sequence
  CIITA targeting sequence
gggccccgcauuggccaaug

SEQ ID NO: 31987 - RNA, 20 nt, Artificial Sequence
  CIITA targeting sequence
ugucugggccccgcauuggc

SEQ ID NO: 31988 - RNA, 20 nt, Artificial Sequence
  CIITA targeting sequence
ccugucugggccccgcauug

SEQ ID NO: 31989 - RNA, 20 nt, Artificial Sequence
  CIITA targeting sequence
aaucuccugucugggccccg

SEQ ID NO: 31990 - RNA, 20 nt, Artificial Sequence
  CIITA targeting sequence
accuuccaaucuccugucug

SEQ ID NO: 31991 - RNA, 20 nt, Artificial Sequence
  CIITA targeting sequence
uccaccuuccaaucuccugu

SEQ ID NO: 31992 - RNA, 20 nt, Artificial Sequence
  CIITA targeting sequence
ccuccaccuuccaaucuccu

SEQ ID NO: 31993 - RNA, 20 nt, Artificial Sequence
  CIITA targeting sequence
uucuccuccaccuuccaauc

SEQ ID NO: 31994 - RNA, 20 nt, Artificial Sequence
  CIITA targeting sequence
ggcucugcccaucaaagaua

SEQ ID NO: 31995 - RNA, 20 nt, Artificial Sequence
  CIITA targeting sequence
gcccaucaaagauaaacaga

SEQ ID NO: 31996 - RNA, 20 nt, Artificial Sequence
  CIITA targeting sequence
aagauaaacagagcccacca

SEQ ID NO: 31997 - RNA, 20 nt, Artificial Sequence
  CIITA targeting sequence
uugaugggcagagccagagg

SEQ ID NO: 31998 - RNA, 20 nt, Artificial Sequence
  CIITA targeting sequence
guuuaucuuugaugggcaga

SEQ ID NO: 31999 - RNA, 20 nt, Artificial Sequence
  CIITA targeting sequence
ccaaaauaaaaugcuggaga

SEQ ID NO: 32000 - RNA, 20 nt, Artificial Sequence
  CIITA targeting sequence
agcauuuuauuuuggggaaa

SEQ ID NO: 32001 - RNA, 20 nt, Artificial Sequence
  CIITA targeting sequence
ccagcauuuuauuuugggga

SEQ ID NO: 32002 - RNA, 20 nt, Artificial Sequence
  CIITA targeting sequence
aaaaaaauaacaagucucca

SEQ ID NO: 32003 - RNA, 20 nt, Artificial Sequence
  CIITA targeting sequence
cucugucacccaugcugaag

SEQ ID NO: 32004 - RNA, 20 nt, Artificial Sequence
  CIITA targeting sequence
cugucacccaugcugaagug

SEQ ID NO: 32005 - RNA, 20 nt, Artificial Sequence
  CIITA targeting sequence
gucacccaugcugaagugua

SEQ ID NO: 32006 - RNA, 20 nt, Artificial Sequence
  CIITA targeting sequence
cccaugcugaaguguagugg

SEQ ID NO: 32007 - RNA, 20 nt, Artificial Sequence
  CIITA targeting sequence
gcaugggugacagagagacc

SEQ ID NO: 32008 - RNA, 20 nt, Artificial Sequence
  CIITA targeting sequence
accugccuccaucuuuuccc

SEQ ID NO: 32009 - RNA, 20 nt, Artificial Sequence
  CIITA targeting sequence
aucuuuucccaucauucugc

SEQ ID NO: 32010 - RNA, 20 nt, Artificial Sequence
  CIITA targeting sequence
uuucccaucauucugcuuuc

SEQ ID NO: 32011 - RNA, 20 nt, Artificial Sequence
  CIITA targeting sequence
caucauucugcuuucuauac

SEQ ID NO: 32012 - RNA, 20 nt, Artificial Sequence
  CIITA targeting sequence
uucugcuuucuauacagggc

SEQ ID NO: 32013 - RNA, 20 nt, Artificial Sequence
  CIITA targeting sequence
gcuuucuauacagggcaaca

SEQ ID NO: 32014 - RNA, 20 nt, Artificial Sequence
  CIITA targeting sequence
auacagggcaacagaaggcu

SEQ ID NO: 32015 - RNA, 20 nt, Artificial Sequence
  CIITA targeting sequence
guugcccuguauagaaagca

SEQ ID NO: 32016 - RNA, 20 nt, Artificial Sequence
  CIITA targeting sequence
guacggaagacaggugaggc

SEQ ID NO: 32017 - RNA, 20 nt, Artificial Sequence
  CIITA targeting sequence
guugucuggauacucauuca

SEQ ID NO: 32018 - RNA, 20 nt, Artificial Sequence
  CIITA targeting sequence
uuuagucaguugucuggaua

SEQ ID NO: 32019 - RNA, 20 nt, Artificial Sequence
  CIITA targeting sequence
cuaaacucuuuuagucaguu

SEQ ID NO: 32020 - RNA, 20 nt, Artificial Sequence
  CIITA targeting sequence
cuaaaaagagaagugagaag

SEQ ID NO: 32021 - RNA, 20 nt, Artificial Sequence
  CIITA targeting sequence
aaaaagagaagugagaaggc

SEQ ID NO: 32022 - RNA, 20 nt, Artificial Sequence
  CIITA targeting sequence
uuuuagagaaucccuaaacu

SEQ ID NO: 32023 - RNA, 20 nt, Artificial Sequence
  CIITA targeting sequence
cuuuuuagagaaucccuaaa

SEQ ID NO: 32024 - RNA, 20 nt, Artificial Sequence
  CIITA targeting sequence
cuucucuuuuuagagaaucc

SEQ ID NO: 32025 - RNA, 20 nt, Artificial Sequence
  CIITA targeting sequence
cacuucucuuuuuagagaau

SEQ ID NO: 32026 - RNA, 20 nt, Artificial Sequence
  CIITA targeting sequence
gccuucucacuucucuuuuu

SEQ ID NO: 32027 - RNA, 20 nt, Artificial Sequence
  CIITA targeting sequence
ucugccuucucacuucucuu

SEQ ID NO: 32028 - RNA, 20 nt, Artificial Sequence
  CIITA targeting sequence
cuucugccuucucacuucuc

SEQ ID NO: 32029 - RNA, 20 nt, Artificial Sequence
  CIITA targeting sequence
ucucuucugccuucucacuu

SEQ ID NO: 32030 - RNA, 20 nt, Artificial Sequence
  CIITA targeting sequence
aagaaauaaagccagaaauu

SEQ ID NO: 32031 - RNA, 20 nt, Artificial Sequence
  CIITA targeting sequence
uugaugccuucuucucuucu

SEQ ID NO: 32032 - RNA, 20 nt, Artificial Sequence
  CIITA targeting sequence
ggcuuuauuucuuugaugcc

SEQ ID NO: 32033 - RNA, 20 nt, Artificial Sequence
  CIITA targeting sequence
uggaacggaagaauacggag

SEQ ID NO: 32034 - RNA, 20 nt, Artificial Sequence
  CIITA targeting sequence
aggaaaauuucuggcuuuau

SEQ ID NO: 32035 - RNA, 20 nt, Artificial Sequence
  CIITA targeting sequence
guuccaggaaaauuucuggc

SEQ ID NO: 32036 - RNA, 20 nt, Artificial Sequence
  CIITA targeting sequence
uccguuccaggaaaauuucu

SEQ ID NO: 32037 - RNA, 20 nt, Artificial Sequence
  CIITA targeting sequence
guauucuuccguuccaggaa

SEQ ID NO: 32038 - RNA, 20 nt, Artificial Sequence
  CIITA targeting sequence
accgcuccguauucuuccgu

SEQ ID NO: 32039 - RNA, 20 nt, Artificial Sequence
  CIITA targeting sequence
ucuaccgcuccguauucuuc

SEQ ID NO: 32040 - RNA, 20 nt, Artificial Sequence
  CIITA targeting sequence
uucaauaucuuguuccaaug

SEQ ID NO: 32041 - RNA, 20 nt, Artificial Sequence
  CIITA targeting sequence
auaucuuguuccaaugaaug

SEQ ID NO: 32042 - RNA, 20 nt, Artificial Sequence
  CIITA targeting sequence
augguucuuuaauauggcag

SEQ ID NO: 32043 - RNA, 20 nt, Artificial Sequence
  CIITA targeting sequence
gcaauaaaaagguuuauuuu

SEQ ID NO: 32044 - RNA, 20 nt, Artificial Sequence
  CIITA targeting sequence
ggcugggcgcagcggcucau

SEQ ID NO: 32045 - RNA, 20 nt, Artificial Sequence
  CIITA targeting sequence
ugccuguaauccaagaguuu

SEQ ID NO: 32046 - RNA, 20 nt, Artificial Sequence
  CIITA targeting sequence
aagaguuuggaaggcugaag

SEQ ID NO: 32047 - RNA, 20 nt, Artificial Sequence
  CIITA targeting sequence
uggauuacaggcaugagccg

SEQ ID NO: 32048 - RNA, 20 nt, Artificial Sequence
  CIITA targeting sequence
cagcacuuugggaggccgac

SEQ ID NO: 32049 - RNA, 20 nt, Artificial Sequence
  CIITA targeting sequence
ugccuguuaucccagcacuu

SEQ ID NO: 32050 - RNA, 20 nt, Artificial Sequence
  CIITA targeting sequence
uuaggggccaggcgcgguag

SEQ ID NO: 32051 - RNA, 20 nt, Artificial Sequence
  CIITA targeting sequence
uuuuaacccgauguccuugu

SEQ ID NO: 32052 - RNA, 20 nt, Artificial Sequence
  CIITA targeting sequence
gguuaaaaugaagucauuag

SEQ ID NO: 32053 - RNA, 20 nt, Artificial Sequence
  CIITA targeting sequence
uuguugaagaguuggucucc

SEQ ID NO: 32054 - RNA, 20 nt, Artificial Sequence
  CIITA targeting sequence
acaaggacaucggguuaaaa

SEQ ID NO: 32055 - RNA, 20 nt, Artificial Sequence
  CIITA targeting sequence
ucaacaaggacaucggguua

SEQ ID NO: 32056 - RNA, 20 nt, Artificial Sequence
  CIITA targeting sequence
ccaauuacagucacauucug

SEQ ID NO: 32057 - RNA, 20 nt, Artificial Sequence
  CIITA targeting sequence
aauuacagucacauucugag

SEQ ID NO: 32058 - RNA, 20 nt, Artificial Sequence
  CIITA targeting sequence
cauucugaggcgcuagguuu

SEQ ID NO: 32059 - RNA, 20 nt, Artificial Sequence
  CIITA targeting sequence
gaggcgcuagguuuuaggac

SEQ ID NO: 32060 - RNA, 20 nt, Artificial Sequence
  CIITA targeting sequence
gaaugugacuguaauuggag

SEQ ID NO: 32061 - RNA, 20 nt, Artificial Sequence
  CIITA targeting sequence
uaaaaccuagcgccucagaa

SEQ ID NO: 32062 - RNA, 20 nt, Artificial Sequence
  CIITA targeting sequence
ccauaugaauaggggugggg

SEQ ID NO: 32063 - RNA, 20 nt, Artificial Sequence
  CIITA targeting sequence
uauggugaaguccuaaaacc

SEQ ID NO: 32064 - RNA, 20 nt, Artificial Sequence
  CIITA targeting sequence
cccaccccuauucauauggu

SEQ ID NO: 32065 - RNA, 20 nt, Artificial Sequence
  CIITA targeting sequence
auucagccccuaacaccuuc

SEQ ID NO: 32066 - RNA, 20 nt, Artificial Sequence
  CIITA targeting sequence
gccccuaacaccuucuguga

SEQ ID NO: 32067 - RNA, 20 nt, Artificial Sequence
  CIITA targeting sequence
gugaagacauuucccuucac

SEQ ID NO: 32068 - RNA, 20 nt, Artificial Sequence
  CIITA targeting sequence
cagaagguguuaggggcuga

SEQ ID NO: 32069 - RNA, 20 nt, Artificial Sequence
  CIITA targeting sequence
ucacagaagguguuaggggc

SEQ ID NO: 32070 - RNA, 20 nt, Artificial Sequence
  CIITA targeting sequence
cuucacauuaagaauaauuc

SEQ ID NO: 32071 - RNA, 20 nt, Artificial Sequence
  CIITA targeting sequence
cauuaagaauaauucauguu

SEQ ID NO: 32072 - RNA, 20 nt, Artificial Sequence
  CIITA targeting sequence
uaaugugaagggaaaugucu

SEQ ID NO: 32073 - RNA, 20 nt, Artificial Sequence
  CIITA targeting sequence
uguugagccugggcaacaua

SEQ ID NO: 32074 - RNA, 20 nt, Artificial Sequence
  CIITA targeting sequence
acaugaauuauucuuaaugu

SEQ ID NO: 32075 - RNA, 20 nt, Artificial Sequence
  CIITA targeting sequence
ugcuauguugcccaggcuca

SEQ ID NO: 32076 - RNA, 20 nt, Artificial Sequence
  CIITA targeting sequence
cuacgaaaauuuuuuuaaaa

SEQ ID NO: 32077 - RNA, 20 nt, Artificial Sequence
  CIITA targeting sequence
acgaaaauuuuuuuaaaaau

SEQ ID NO: 32078 - RNA, 20 nt, Artificial Sequence
  CIITA targeting sequence
uagagauagggucuugcuau

SEQ ID NO: 32079 - RNA, 20 nt, Artificial Sequence
  CIITA targeting sequence
cagcuacucaggaagcggca

SEQ ID NO: 32080 - RNA, 20 nt, Artificial Sequence
  CIITA targeting sequence
ggaagcggcaggaucgaucg

SEQ ID NO: 32081 - RNA, 20 nt, Artificial Sequence
  CIITA targeting sequence
ugaguagcugggacuacagg

SEQ ID NO: 32082 - RNA, 20 nt, Artificial Sequence
  CIITA targeting sequence
ugccgcuuccugaguagcug

SEQ ID NO: 32083 - RNA, 20 nt, Artificial Sequence
  CIITA targeting sequence
aucgagcccaggaguucaag

SEQ ID NO: 32084 - RNA, 20 nt, Artificial Sequence
  CIITA targeting sequence
auccugccgcuuccugagua

SEQ ID NO: 32085 - RNA, 20 nt, Artificial Sequence
  CIITA targeting sequence
agcccaggaguucaagacug

SEQ ID NO: 32086 - RNA, 20 nt, Artificial Sequence
  CIITA targeting sequence
aucgauccugccgcuuccug

SEQ ID NO: 32087 - RNA, 20 nt, Artificial Sequence
  CIITA targeting sequence
ugggcucgaucgauccugcc

SEQ ID NO: 32088 - RNA, 20 nt, Artificial Sequence
  CIITA targeting sequence
agacuguggugagcuauaau

SEQ ID NO: 32089 - RNA, 20 nt, Artificial Sequence
  CIITA targeting sequence
ugaacuccugggcucgaucg

SEQ ID NO: 32090 - RNA, 20 nt, Artificial Sequence
  CIITA targeting sequence
ccacagucuugaacuccugg

SEQ ID NO: 32091 - RNA, 20 nt, Artificial Sequence
  CIITA targeting sequence
ugccacugcacuccagccua

SEQ ID NO: 32092 - RNA, 20 nt, Artificial Sequence
  CIITA targeting sequence
agccuaguugacagagugag

SEQ ID NO: 32093 - RNA, 20 nt, Artificial Sequence
  CIITA targeting sequence
acuaggcuggagugcagugg

SEQ ID NO: 32094 - RNA, 20 nt, Artificial Sequence
  CIITA targeting sequence
gucaacuaggcuggagugca

SEQ ID NO: 32095 - RNA, 20 nt, Artificial Sequence
  CIITA targeting sequence
cucugucaacuaggcuggag

SEQ ID NO: 32096 - RNA, 20 nt, Artificial Sequence
  CIITA targeting sequence
gaauaaauaaauaaauaaaa

SEQ ID NO: 32097 - RNA, 20 nt, Artificial Sequence
  CIITA targeting sequence
gaacagggccucacucuguc

SEQ ID NO: 32098 - RNA, 20 nt, Artificial Sequence
  CIITA targeting sequence
uuuugcaugccaaccacucu

SEQ ID NO: 32099 - RNA, 20 nt, Artificial Sequence
  CIITA targeting sequence
uguccacccucccaccccac

SEQ ID NO: 32100 - RNA, 20 nt, Artificial Sequence
  CIITA targeting sequence
acccucccaccccaccacuc

SEQ ID NO: 32101 - RNA, 20 nt, Artificial Sequence
  CIITA targeting sequence
caccccaccacucacacaca

SEQ ID NO: 32102 - RNA, 20 nt, Artificial Sequence
  CIITA targeting sequence
cacacacacacacacacaga

SEQ ID NO: 32103 - RNA, 20 nt, Artificial Sequence
  CIITA targeting sequence
guguguguguguguguguga

SEQ ID NO: 32104 - RNA, 20 nt, Artificial Sequence
  CIITA targeting sequence
cugugugugugugugugugu

SEQ ID NO: 32105 - RNA, 20 nt, Artificial Sequence
  CIITA targeting sequence
uagcaacacguucguugauu

SEQ ID NO: 32106 - RNA, 20 nt, Artificial Sequence
  CIITA targeting sequence
uugauugaagaaugguggac

SEQ ID NO: 32107 - RNA, 20 nt, Artificial Sequence
  CIITA targeting sequence
acgaacguguugcuaagagc

SEQ ID NO: 32108 - RNA, 20 nt, Artificial Sequence
  CIITA targeting sequence
aucaacgaacguguugcuaa

SEQ ID NO: 32109 - RNA, 20 nt, Artificial Sequence
  CIITA targeting sequence
ucaaucaacgaacguguugc

SEQ ID NO: 32110 - RNA, 20 nt, Artificial Sequence
  CIITA targeting sequence
accauucuucaaucaacgaa

SEQ ID NO: 32111 - RNA, 20 nt, Artificial Sequence
  CIITA targeting sequence
accaauguccaccauucuuc

SEQ ID NO: 32112 - RNA, 20 nt, Artificial Sequence
  CIITA targeting sequence
cgcaugggcggaaucuggcu

SEQ ID NO: 32113 - RNA, 20 nt, Artificial Sequence
  CIITA targeting sequence
gcccaugcgggaaccaacuu

SEQ ID NO: 32114 - RNA, 20 nt, Artificial Sequence
  CIITA targeting sequence
ggcuuugcaggaguucgggg

SEQ ID NO: 32115 - RNA, 20 nt, Artificial Sequence
  CIITA targeting sequence
ugcaaagccagauuccgccc

SEQ ID NO: 32116 - RNA, 20 nt, Artificial Sequence
  CIITA targeting sequence
gggaaucuguccccugcaca

SEQ ID NO: 32117 - RNA, 20 nt, Artificial Sequence
  CIITA targeting sequence
ccgaacuccugcaaagccag

SEQ ID NO: 32118 - RNA, 20 nt, Artificial Sequence
  CIITA targeting sequence
guccccugcacaguucaaau

SEQ ID NO: 32119 - RNA, 20 nt, Artificial Sequence
  CIITA targeting sequence
ccugcacaguucaaauuugg

SEQ ID NO: 32120 - RNA, 20 nt, Artificial Sequence
  CIITA targeting sequence
aauuuggagaagcagauuaa

SEQ ID NO: 32121 - RNA, 20 nt, Artificial Sequence
  CIITA targeting sequence
aaauuugaacugugcagggg

SEQ ID NO: 32122 - RNA, 20 nt, Artificial Sequence
  CIITA targeting sequence
ccaaauuugaacugugcagg

SEQ ID NO: 32123 - RNA, 20 nt, Artificial Sequence
  CIITA targeting sequence
gcuucuccaaauuugaacug

SEQ ID NO: 32124 - RNA, 20 nt, Artificial Sequence
  CIITA targeting sequence
aaguaaguacauuaaucugc

SEQ ID NO: 32125 - RNA, 20 nt, Artificial Sequence
  CIITA targeting sequence
uuuccaaguaaguacauuaa

SEQ ID NO: 32126 - RNA, 20 nt, Artificial Sequence
  CIITA targeting sequence
cuuuuccaaguaaguacauu

SEQ ID NO: 32127 - RNA, 20 nt, Artificial Sequence
  CIITA targeting sequence
cugucuugggaggaaguucc

SEQ ID NO: 32128 - RNA, 20 nt, Artificial Sequence
  CIITA targeting sequence
gucuugggaggaaguuccau

SEQ ID NO: 32129 - RNA, 20 nt, Artificial Sequence
  CIITA targeting sequence
ugggaggaaguuccaugaau

SEQ ID NO: 32130 - RNA, 20 nt, Artificial Sequence
  CIITA targeting sequence
caagacagagaaaccacagg

SEQ ID NO: 32131 - RNA, 20 nt, Artificial Sequence
  CIITA targeting sequence
ucccaagacagagaaaccac

SEQ ID NO: 32132 - RNA, 20 nt, Artificial Sequence
  CIITA targeting sequence
augaauaaacaaccaacuug

SEQ ID NO: 32133 - RNA, 20 nt, Artificial Sequence
  CIITA targeting sequence
uggaacuuccucccaagaca

SEQ ID NO: 32134 - RNA, 20 nt, Artificial Sequence
  CIITA targeting sequence
aaaacaaguugguuguuuau

SEQ ID NO: 32135 - RNA, 20 nt, Artificial Sequence
  CIITA targeting sequence
acccaaguacuuugaauacu

SEQ ID NO: 32136 - RNA, 20 nt, Artificial Sequence
  CIITA targeting sequence
aaguacuuggguagaaagua

SEQ ID NO: 32137 - RNA, 20 nt, Artificial Sequence
  CIITA targeting sequence
aaguauucaaaguacuuggg

SEQ ID NO: 32138 - RNA, 20 nt, Artificial Sequence
  CIITA targeting sequence
uucuaaguauucaaaguacu

SEQ ID NO: 32139 - RNA, 20 nt, Artificial Sequence
  CIITA targeting sequence
ccuaggugauccuugagcug

SEQ ID NO: 32140 - RNA, 20 nt, Artificial Sequence
  CIITA targeting sequence
ccuaggggaucauucuaagu

SEQ ID NO: 32141 - RNA, 20 nt, Artificial Sequence
  CIITA targeting sequence
uugagcuggggacacaauuu

SEQ ID NO: 32142 - RNA, 20 nt, Artificial Sequence
  CIITA targeting sequence
aggaucaccuaggggaucau

SEQ ID NO: 32143 - RNA, 20 nt, Artificial Sequence
  CIITA targeting sequence
ccagcucaaggaucaccuag

SEQ ID NO: 32144 - RNA, 20 nt, Artificial Sequence
  CIITA targeting sequence
ggagcugggucagccuaagg

SEQ ID NO: 32145 - RNA, 20 nt, Artificial Sequence
  CIITA targeting sequence
cgaaauuguguccccagcuc

SEQ ID NO: 32146 - RNA, 20 nt, Artificial Sequence
  CIITA targeting sequence
gccuaaggcagccgcucaac

SEQ ID NO: 32147 - RNA, 20 nt, Artificial Sequence
  CIITA targeting sequence
acccacucgccuuucuuggg

SEQ ID NO: 32148 - RNA, 20 nt, Artificial Sequence
  CIITA targeting sequence
ccuuucuugggucuuccuug

SEQ ID NO: 32149 - RNA, 20 nt, Artificial Sequence
  CIITA targeting sequence
ugggucuuccuuggggucug

SEQ ID NO: 32150 - RNA, 20 nt, Artificial Sequence
  CIITA targeting sequence
uccuuggggucugcagauga

SEQ ID NO: 32151 - RNA, 20 nt, Artificial Sequence
  CIITA targeting sequence
uuggggucugcagaugauca

SEQ ID NO: 32152 - RNA, 20 nt, Artificial Sequence
  CIITA targeting sequence
gcagaugaucauggugcaca

SEQ ID NO: 32153 - RNA, 20 nt, Artificial Sequence
  CIITA targeting sequence
gcagaccccaaggaagaccc

SEQ ID NO: 32154 - RNA, 20 nt, Artificial Sequence
  CIITA targeting sequence
ucugcagaccccaaggaaga

SEQ ID NO: 32155 - RNA, 20 nt, Artificial Sequence
  CIITA targeting sequence
uggugcacacuguuacccuc

SEQ ID NO: 32156 - RNA, 20 nt, Artificial Sequence
  CIITA targeting sequence
cuggagggggcagcucccua

SEQ ID NO: 32157 - RNA, 20 nt, Artificial Sequence
  CIITA targeting sequence
ggagggggcagcucccuaua

SEQ ID NO: 32158 - RNA, 20 nt, Artificial Sequence
  CIITA targeting sequence
agagaggguaacagugugca

SEQ ID NO: 32159 - RNA, 20 nt, Artificial Sequence
  CIITA targeting sequence
cuauaagcauucauugagug

SEQ ID NO: 32160 - RNA, 20 nt, Artificial Sequence
  CIITA targeting sequence
uugagugucugcugaaugca

SEQ ID NO: 32161 - RNA, 20 nt, Artificial Sequence
  CIITA targeting sequence
augaaugcuuauagggagcu

SEQ ID NO: 32162 - RNA, 20 nt, Artificial Sequence
  CIITA targeting sequence
gcugaaugcagaaucuuuug

SEQ ID NO: 32163 - RNA, 20 nt, Artificial Sequence
  CIITA targeting sequence
gcagacacucaaugaaugcu

SEQ ID NO: 32164 - RNA, 20 nt, Artificial Sequence
  CIITA targeting sequence
gcauucagcagacacucaau

SEQ ID NO: 32165 - RNA, 20 nt, Artificial Sequence
  CIITA targeting sequence
uuuggugguaggagagaggg

SEQ ID NO: 32166 - RNA, 20 nt, Artificial Sequence
  CIITA targeting sequence
uaccaccaaaagauucugca

SEQ ID NO: 32167 - RNA, 20 nt, Artificial Sequence
  CIITA targeting sequence
ccuaccaccaaaagauucug

SEQ ID NO: 32168 - RNA, 20 nt, Artificial Sequence
  CIITA targeting sequence
cuccuaccaccaaaagauuc

SEQ ID NO: 32169 - RNA, 20 nt, Artificial Sequence
  CIITA targeting sequence
cccucucuccuaccaccaaa

SEQ ID NO: 32170 - RNA, 20 nt, Artificial Sequence
  CIITA targeting sequence
uucccccucucuccuaccac

SEQ ID NO: 32171 - RNA, 20 nt, Artificial Sequence
  CIITA targeting sequence
cuuucccccucucuccuacc

SEQ ID NO: 32172 - RNA, 20 nt, Artificial Sequence
  CIITA targeting sequence
uaugccuucucuuucccccu

SEQ ID NO: 32173 - RNA, 20 nt, Artificial Sequence
  CIITA targeting sequence
agccuaccacaaacucauau

SEQ ID NO: 32174 - RNA, 20 nt, Artificial Sequence
  CIITA targeting sequence
ccuuccagccuaccacaaac

SEQ ID NO: 32175 - RNA, 20 nt, Artificial Sequence
  CIITA targeting sequence
agggcuaagccaggguucac

SEQ ID NO: 32176 - RNA, 20 nt, Artificial Sequence
  CIITA targeting sequence
aacaaugguuuuugccauuu

SEQ ID NO: 32177 - RNA, 20 nt, Artificial Sequence
  CIITA targeting sequence
cagcacaaaauggcaaaaac

SEQ ID NO: 32178 - RNA, 20 nt, Artificial Sequence
  CIITA targeting sequence
cacagcacaaaauggcaaaa

SEQ ID NO: 32179 - RNA, 20 nt, Artificial Sequence
  CIITA targeting sequence
ugaacaagugacuuugccac

SEQ ID NO: 32180 - RNA, 20 nt, Artificial Sequence
  CIITA targeting sequence
ugaucucacagcacaaaaug

SEQ ID NO: 32181 - RNA, 20 nt, Artificial Sequence
  CIITA targeting sequence
cuuguucaugaucucacagc

SEQ ID NO: 32182 - RNA, 20 nt, Artificial Sequence
  CIITA targeting sequence
gauucucaguuuuccugucu

SEQ ID NO: 32183 - RNA, 20 nt, Artificial Sequence
  CIITA targeting sequence
gaguggcaaagucacuuguu

SEQ ID NO: 32184 - RNA, 20 nt, Artificial Sequence
  CIITA targeting sequence
caguuuuccugucugcaaaa

SEQ ID NO: 32185 - RNA, 20 nt, Artificial Sequence
  CIITA targeting sequence
guuuuccugucugcaaaaug

SEQ ID NO: 32186 - RNA, 20 nt, Artificial Sequence
  CIITA targeting sequence
ugucugcaaaaugaggaugu

SEQ ID NO: 32187 - RNA, 20 nt, Artificial Sequence
  CIITA targeting sequence
gcaaaaugaggaugugccug

SEQ ID NO: 32188 - RNA, 20 nt, Artificial Sequence
  CIITA targeting sequence
uuuugcagacaggaaaacug

SEQ ID NO: 32189 - RNA, 20 nt, Artificial Sequence
  CIITA targeting sequence
ucauuuugcagacaggaaaa

SEQ ID NO: 32190 - RNA, 20 nt, Artificial Sequence
  CIITA targeting sequence
cacaacgugggcaggcacau

SEQ ID NO: 32191 - RNA, 20 nt, Artificial Sequence
  CIITA targeting sequence
ccauauugcaggauuacugg

SEQ ID NO: 32192 - RNA, 20 nt, Artificial Sequence
  CIITA targeting sequence
ugcaauauggggaaggcaca

SEQ ID NO: 32193 - RNA, 20 nt, Artificial Sequence
  CIITA targeting sequence
cccaguaauccugcaauaug

SEQ ID NO: 32194 - RNA, 20 nt, Artificial Sequence
  CIITA targeting sequence
agugugaaauccuacaugag

SEQ ID NO: 32195 - RNA, 20 nt, Artificial Sequence
  CIITA targeting sequence
cacuugaaucacccaguaau

SEQ ID NO: 32196 - RNA, 20 nt, Artificial Sequence
  CIITA targeting sequence
uacaugagcaugcuugcaaa

SEQ ID NO: 32197 - RNA, 20 nt, Artificial Sequence
  CIITA targeting sequence
uguaggauuucacacuugaa

SEQ ID NO: 32198 - RNA, 20 nt, Artificial Sequence
  CIITA targeting sequence
caaaggccugggaagcagag

SEQ ID NO: 32199 - RNA, 20 nt, Artificial Sequence
  CIITA targeting sequence
caggccuuugugacuuuugc

SEQ ID NO: 32200 - RNA, 20 nt, Artificial Sequence
  CIITA targeting sequence
gcuucccaggccuuugugac

SEQ ID NO: 32201 - RNA, 20 nt, Artificial Sequence
  CIITA targeting sequence
uuguuguggggugaaaccag

SEQ ID NO: 32202 - RNA, 20 nt, Artificial Sequence
  CIITA targeting sequence
ccccacaacaaugacaauac

SEQ ID NO: 32203 - RNA, 20 nt, Artificial Sequence
  CIITA targeting sequence
gguuucaccccacaacaaug

SEQ ID NO: 32204 - RNA, 20 nt, Artificial Sequence
  CIITA targeting sequence
gagaaugauucaaaauucac

SEQ ID NO: 32205 - RNA, 20 nt, Artificial Sequence
  CIITA targeting sequence
gauuucugguuucaccccac

SEQ ID NO: 32206 - RNA, 20 nt, Artificial Sequence
  CIITA targeting sequence
ccgauuucugguuucacccc

SEQ ID NO: 32207 - RNA, 20 nt, Artificial Sequence
  CIITA targeting sequence
uucuccgauuucugguuuca

SEQ ID NO: 32208 - RNA, 20 nt, Artificial Sequence
  CIITA targeting sequence
aaauucacauguaagaucaa

SEQ ID NO: 32209 - RNA, 20 nt, Artificial Sequence
  CIITA targeting sequence
cauguaagaucaaugccauu

SEQ ID NO: 32210 - RNA, 20 nt, Artificial Sequence
  CIITA targeting sequence
uacaugugaauuuugaauca

SEQ ID NO: 32211 - RNA, 20 nt, Artificial Sequence
  CIITA targeting sequence
augccauuggcuguaaagug

SEQ ID NO: 32212 - RNA, 20 nt, Artificial Sequence
  CIITA targeting sequence
acuuuacagccaauggcauu

SEQ ID NO: 32213 - RNA, 20 nt, Artificial Sequence
  CIITA targeting sequence
aauauuccacuuuacagcca

SEQ ID NO: 32214 - RNA, 20 nt, Artificial Sequence
  CIITA targeting sequence
uuuucuaauauuccacuuua

SEQ ID NO: 32215 - RNA, 20 nt, Artificial Sequence
  CIITA targeting sequence
cuaaaagauguggggaagua

SEQ ID NO: 32216 - RNA, 20 nt, Artificial Sequence
  CIITA targeting sequence
aaaagauguggggaaguaaa

SEQ ID NO: 32217 - RNA, 20 nt, Artificial Sequence
  CIITA targeting sequence
uuuagagauuccuuuucuaa

SEQ ID NO: 32218 - RNA, 20 nt, Artificial Sequence
  CIITA targeting sequence
ccacaucuuuuagagauucc

SEQ ID NO: 32219 - RNA, 20 nt, Artificial Sequence
  CIITA targeting sequence
guuuuacuuccccacaucuu

SEQ ID NO: 32220 - RNA, 20 nt, Artificial Sequence
  CIITA targeting sequence
cuuucuguuuuacuucccca

SEQ ID NO: 32221 - RNA, 20 nt, Artificial Sequence
  CIITA targeting sequence
ucccuuucuguuuuacuucc

SEQ ID NO: 32222 - RNA, 20 nt, Artificial Sequence
  CIITA targeting sequence
agccacauuuccucccuuuc

SEQ ID NO: 32223 - RNA, 20 nt, Artificial Sequence
  CIITA targeting sequence
ugcuggcuacugugagcugc

SEQ ID NO: 32224 - RNA, 20 nt, Artificial Sequence
  CIITA targeting sequence
caguagccagcaggaaauca

SEQ ID NO: 32225 - RNA, 20 nt, Artificial Sequence
  CIITA targeting sequence
agucuugugcgcuuugggcu

SEQ ID NO: 32226 - RNA, 20 nt, Artificial Sequence
  CIITA targeting sequence
ugugcgcuuugggcucguca

SEQ ID NO: 32227 - RNA, 20 nt, Artificial Sequence
  CIITA targeting sequence
ucauaguaagauggagauca

SEQ ID NO: 32228 - RNA, 20 nt, Artificial Sequence
  CIITA targeting sequence
uaguaagauggagaucaaaa

SEQ ID NO: 32229 - RNA, 20 nt, Artificial Sequence
  CIITA targeting sequence
uacuaugacgagcccaaagc

SEQ ID NO: 32230 - RNA, 20 nt, Artificial Sequence
  CIITA targeting sequence
aucuuacuaugacgagccca

SEQ ID NO: 32231 - RNA, 20 nt, Artificial Sequence
  CIITA targeting sequence
ccaucuuacuaugacgagcc

SEQ ID NO: 32232 - RNA, 20 nt, Artificial Sequence
  CIITA targeting sequence
aaacgucuaccuugccaggu

SEQ ID NO: 32233 - RNA, 20 nt, Artificial Sequence
  CIITA targeting sequence
accuugccaggucauuucca

SEQ ID NO: 32234 - RNA, 20 nt, Artificial Sequence
  CIITA targeting sequence
uuuccagauaauaauaguaa

SEQ ID NO: 32235 - RNA, 20 nt, Artificial Sequence
  CIITA targeting sequence
agauaauaauaguaauaaau

SEQ ID NO: 32236 - RNA, 20 nt, Artificial Sequence
  CIITA targeting sequence
ggaaaugaccuggcaaggua

SEQ ID NO: 32237 - RNA, 20 nt, Artificial Sequence
  CIITA targeting sequence
caccuguaaucccagcauuu

SEQ ID NO: 32238 - RNA, 20 nt, Artificial Sequence
  CIITA targeting sequence
ccuguaaucccagcauuuug

SEQ ID NO: 32239 - RNA, 20 nt, Artificial Sequence
  CIITA targeting sequence
cagcauuuugggaggcugag

SEQ ID NO: 32240 - RNA, 20 nt, Artificial Sequence
  CIITA targeting sequence
caaaaugcugggauuacagg

SEQ ID NO: 32241 - RNA, 20 nt, Artificial Sequence
  CIITA targeting sequence
gccucccaaaaugcugggau

SEQ ID NO: 32242 - RNA, 20 nt, Artificial Sequence
  CIITA targeting sequence
cccgccucagccucccaaaa

SEQ ID NO: 32243 - RNA, 20 nt, Artificial Sequence
  CIITA targeting sequence
cuugagcccaggggcuuaag

SEQ ID NO: 32244 - RNA, 20 nt, Artificial Sequence
  CIITA targeting sequence
agggauucacccgccucagc

SEQ ID NO: 32245 - RNA, 20 nt, Artificial Sequence
  CIITA targeting sequence
uaagccccugggcucaaggg

SEQ ID NO: 32246 - RNA, 20 nt, Artificial Sequence
  CIITA targeting sequence
ggucuuaagccccugggcuc

SEQ ID NO: 32247 - RNA, 20 nt, Artificial Sequence
  CIITA targeting sequence
ggucuggucuuaagccccug

SEQ ID NO: 32248 - RNA, 20 nt, Artificial Sequence
  CIITA targeting sequence
ugcuauguugucuggucugg

SEQ ID NO: 32249 - RNA, 20 nt, Artificial Sequence
  CIITA targeting sequence
uauguaccaaaaaugcaaaa

SEQ ID NO: 32250 - RNA, 20 nt, Artificial Sequence
  CIITA targeting sequence
agguaugguggcaugugccu

SEQ ID NO: 32251 - RNA, 20 nt, Artificial Sequence
  CIITA targeting sequence
cagcuacuugggaggcugag

SEQ ID NO: 32252 - RNA, 20 nt, Artificial Sequence
  CIITA targeting sequence
caaguagcugggacuacagg

SEQ ID NO: 32253 - RNA, 20 nt, Artificial Sequence
  CIITA targeting sequence
gccucccaaguagcugggac

SEQ ID NO: 32254 - RNA, 20 nt, Artificial Sequence
  CIITA targeting sequence
caccucagccucccaaguag

SEQ ID NO: 32255 - RNA, 20 nt, Artificial Sequence
  CIITA targeting sequence
ucccaccucagccucccaag

SEQ ID NO: 32256 - RNA, 20 nt, Artificial Sequence
  CIITA targeting sequence
cuugagcccaggaggcggag

SEQ ID NO: 32257 - RNA, 20 nt, Artificial Sequence
  CIITA targeting sequence
agugauccucccaccucagc

SEQ ID NO: 32258 - RNA, 20 nt, Artificial Sequence
  CIITA targeting sequence
ugggcucaagugauccuccc

SEQ ID NO: 32259 - RNA, 20 nt, Artificial Sequence
  CIITA targeting sequence
gccuccugggcucaagugau

SEQ ID NO: 32260 - RNA, 20 nt, Artificial Sequence
  CIITA targeting sequence
ccuuacugcagccuccgccu

SEQ ID NO: 32261 - RNA, 20 nt, Artificial Sequence
  CIITA targeting sequence
ccccuuacugcagccuccgc

SEQ ID NO: 32262 - RNA, 20 nt, Artificial Sequence
  CIITA targeting sequence
cacuacuguacuccagccug

SEQ ID NO: 32263 - RNA, 20 nt, Artificial Sequence
  CIITA targeting sequence
agccugggcgacacagugag

SEQ ID NO: 32264 - RNA, 20 nt, Artificial Sequence
  CIITA targeting sequence
cccaggcuggaguacaguag

SEQ ID NO: 32265 - RNA, 20 nt, Artificial Sequence
  CIITA targeting sequence
cugugucgcccaggcuggag

SEQ ID NO: 32266 - RNA, 20 nt, Artificial Sequence
  CIITA targeting sequence
cacugugucgcccaggcugg

SEQ ID NO: 32267 - RNA, 20 nt, Artificial Sequence
  CIITA targeting sequence
gccucaaaaaaaauauauag

SEQ ID NO: 32268 - RNA, 20 nt, Artificial Sequence
  CIITA targeting sequence
aaaaaaauauauaguaauaa

SEQ ID NO: 32269 - RNA, 20 nt, Artificial Sequence
  CIITA targeting sequence
acuacauauuaguauuuauu

SEQ ID NO: 32270 - RNA, 20 nt, Artificial Sequence
  CIITA targeting sequence
uagaccaugucuccuuuggg

SEQ ID NO: 32271 - RNA, 20 nt, Artificial Sequence
  CIITA targeting sequence
augaaacaccagugcccagu

SEQ ID NO: 32272 - RNA, 20 nt, Artificial Sequence
  CIITA targeting sequence
ccuuugggugccacagaaac

SEQ ID NO: 32273 - RNA, 20 nt, Artificial Sequence
  CIITA targeting sequence
uuugggugccacagaaaccc

SEQ ID NO: 32274 - RNA, 20 nt, Artificial Sequence
  CIITA targeting sequence
guggcacccaaaggagacau

SEQ ID NO: 32275 - RNA, 20 nt, Artificial Sequence
  CIITA targeting sequence
uaggguuucuguggcaccca

SEQ ID NO: 32276 - RNA, 20 nt, Artificial Sequence
  CIITA targeting sequence
uacuucuuaggguuucugug

SEQ ID NO: 32277 - RNA, 20 nt, Artificial Sequence
  CIITA targeting sequence
acuuccauuucacagauaug

SEQ ID NO: 32278 - RNA, 20 nt, Artificial Sequence
  CIITA targeting sequence
auuucacagauaugggcuca

SEQ ID NO: 32279 - RNA, 20 nt, Artificial Sequence
  CIITA targeting sequence
cagauaugggcucagagaag

SEQ ID NO: 32280 - RNA, 20 nt, Artificial Sequence
  CIITA targeting sequence
gugaaauggaaguagaaaua

SEQ ID NO: 32281 - RNA, 20 nt, Artificial Sequence
  CIITA targeting sequence
gagaagucaacuaacuugcc

SEQ ID NO: 32282 - RNA, 20 nt, Artificial Sequence
  CIITA targeting sequence
gagcccauaucugugaaaug

SEQ ID NO: 32283 - RNA, 20 nt, Artificial Sequence
  CIITA targeting sequence
cugagcccauaucugugaaa

SEQ ID NO: 32284 - RNA, 20 nt, Artificial Sequence
  CIITA targeting sequence
acuaacuugcccaagguaac

SEQ ID NO: 32285 - RNA, 20 nt, Artificial Sequence
  CIITA targeting sequence
aaaauugcguuaccuugggc

SEQ ID NO: 32286 - RNA, 20 nt, Artificial Sequence
  CIITA targeting sequence
caaaaauugcguuaccuugg

SEQ ID NO: 32287 - RNA, 20 nt, Artificial Sequence
  CIITA targeting sequence
ccaauaugugcuauuugauc

SEQ ID NO: 32288 - RNA, 20 nt, Artificial Sequence
  CIITA targeting sequence
aauagcacauauuggggagc

SEQ ID NO: 32289 - RNA, 20 nt, Artificial Sequence
  CIITA targeting sequence
gugaaaacucuugcaagaug

SEQ ID NO: 32290 - RNA, 20 nt, Artificial Sequence
  CIITA targeting sequence
cagaucaaauagcacauauu

SEQ ID NO: 32291 - RNA, 20 nt, Artificial Sequence
  CIITA targeting sequence
ugcaagaugucaagcuucca

SEQ ID NO: 32292 - RNA, 20 nt, Artificial Sequence
  CIITA targeting sequence
ugcaagaguuuucacagauc

SEQ ID NO: 32293 - RNA, 20 nt, Artificial Sequence
  CIITA targeting sequence
agcuuccagugaagcuucaa

SEQ ID NO: 32294 - RNA, 20 nt, Artificial Sequence
  CIITA targeting sequence
agugaagcuucaacguuguc

SEQ ID NO: 32295 - RNA, 20 nt, Artificial Sequence
  CIITA targeting sequence
cuggaagcuugacaucuugc

SEQ ID NO: 32296 - RNA, 20 nt, Artificial Sequence
  CIITA targeting sequence
acguugucagcaacugcaaa

SEQ ID NO: 32297 - RNA, 20 nt, Artificial Sequence
  CIITA targeting sequence
gcaacugcaaaugcugggga

SEQ ID NO: 32298 - RNA, 20 nt, Artificial Sequence
  CIITA targeting sequence
ccagcauuugcaguugcuga

SEQ ID NO: 32299 - RNA, 20 nt, Artificial Sequence
  CIITA targeting sequence
uuguccccagcauuugcagu

SEQ ID NO: 32300 - RNA, 20 nt, Artificial Sequence
  CIITA targeting sequence
ccuuguccccagcauuugca

SEQ ID NO: 32301 - RNA, 20 nt, Artificial Sequence
  CIITA targeting sequence
ccaguuuuguauucuccuug

SEQ ID NO: 32302 - RNA, 20 nt, Artificial Sequence
  CIITA targeting sequence
acccacugcucaccaguuuu

SEQ ID NO: 32303 - RNA, 20 nt, Artificial Sequence
  CIITA targeting sequence
gagaagccuucccggaagaa

SEQ ID NO: 32304 - RNA, 20 nt, Artificial Sequence
  CIITA targeting sequence
gauuaauccacccacugcuc

SEQ ID NO: 32305 - RNA, 20 nt, Artificial Sequence
  CIITA targeting sequence
cagauuaauccacccacugc

SEQ ID NO: 32306 - RNA, 20 nt, Artificial Sequence
  CIITA targeting sequence
cggaagaagcagauguaaag

SEQ ID NO: 32307 - RNA, 20 nt, Artificial Sequence
  CIITA targeting sequence
gggaaggcuucucagauuaa

SEQ ID NO: 32308 - RNA, 20 nt, Artificial Sequence
  CIITA targeting sequence
uccgggaaggcuucucagau

SEQ ID NO: 32309 - RNA, 20 nt, Artificial Sequence
  CIITA targeting sequence
gcuucuuccgggaaggcuuc

SEQ ID NO: 32310 - RNA, 20 nt, Artificial Sequence
  CIITA targeting sequence
caacgcaacuuuacaucugc

SEQ ID NO: 32311 - RNA, 20 nt, Artificial Sequence
  CIITA targeting sequence
acuucacaacgcaacuuuac

SEQ ID NO: 32312 - RNA, 20 nt, Artificial Sequence
  CIITA targeting sequence
uaauccacuucacaacgcaa

SEQ ID NO: 32313 - RNA, 20 nt, Artificial Sequence
  CIITA targeting sequence
auaauccuaauccacuucac

SEQ ID NO: 32314 - RNA, 20 nt, Artificial Sequence
  CIITA targeting sequence
uggaggaggucuagaacggu

SEQ ID NO: 32315 - RNA, 20 nt, Artificial Sequence
  CIITA targeting sequence
aggaacucaauaauccuaau

SEQ ID NO: 32316 - RNA, 20 nt, Artificial Sequence
  CIITA targeting sequence
uccaggaacucaauaauccu

SEQ ID NO: 32317 - RNA, 20 nt, Artificial Sequence
  CIITA targeting sequence
agaacggugacuggcgugug

SEQ ID NO: 32318 - RNA, 20 nt, Artificial Sequence
  CIITA targeting sequence
agaccuccuccaggaacuca

SEQ ID NO: 32319 - RNA, 20 nt, Artificial Sequence
  CIITA targeting sequence
ccguucuagaccuccuccag

SEQ ID NO: 32320 - RNA, 20 nt, Artificial Sequence
  CIITA targeting sequence
agggcauacagaugguauuu

SEQ ID NO: 32321 - RNA, 20 nt, Artificial Sequence
  CIITA targeting sequence
guaugcccuugacuuacaca

SEQ ID NO: 32322 - RNA, 20 nt, Artificial Sequence
  CIITA targeting sequence
uuaaauaccaucuguaugcc

SEQ ID NO: 32323 - RNA, 20 nt, Artificial Sequence
  CIITA targeting sequence
agccccacgucuuuaaauac

SEQ ID NO: 32324 - RNA, 20 nt, Artificial Sequence
  CIITA targeting sequence
auccagccccacgucuuuaa

SEQ ID NO: 32325 - RNA, 20 nt, Artificial Sequence
  CIITA targeting sequence
ugggcaauccauccagcccc

SEQ ID NO: 32326 - RNA, 20 nt, Artificial Sequence
  CIITA targeting sequence
cuucuugggcaauccaucca

SEQ ID NO: 32327 - RNA, 20 nt, Artificial Sequence
  CIITA targeting sequence
agccacauucacuucuuggg

SEQ ID NO: 32328 - RNA, 20 nt, Artificial Sequence
  CIITA targeting sequence
uuucuagccacauucacuuc

SEQ ID NO: 32329 - RNA, 20 nt, Artificial Sequence
  CIITA targeting sequence
cuuuucuagccacauucacu

SEQ ID NO: 32330 - RNA, 20 nt, Artificial Sequence
  CIITA targeting sequence
uuucucuuuucuagccacau

SEQ ID NO: 32331 - RNA, 20 nt, Artificial Sequence
  CIITA targeting sequence
ugccuguaaucccagcacuu

SEQ ID NO: 32332 - RNA, 20 nt, Artificial Sequence
  CIITA targeting sequence
cagcacuuugggaggccgag

SEQ ID NO: 32333 - RNA, 20 nt, Artificial Sequence
  CIITA targeting sequence
caaagugcugggauuacagg

SEQ ID NO: 32334 - RNA, 20 nt, Artificial Sequence
  CIITA targeting sequence
gccucccaaagugcugggau

SEQ ID NO: 32335 - RNA, 20 nt, Artificial Sequence
  CIITA targeting sequence
ccucggccucccaaagugcu

SEQ ID NO: 32336 - RNA, 20 nt, Artificial Sequence
  CIITA targeting sequence
caccucggccucccaaagug

SEQ ID NO: 32337 - RNA, 20 nt, Artificial Sequence
  CIITA targeting sequence
ucucaccucggccucccaaa

SEQ ID NO: 32338 - RNA, 20 nt, Artificial Sequence
  CIITA targeting sequence
cuugagcacaggaguuugag

SEQ ID NO: 32339 - RNA, 20 nt, Artificial Sequence
  CIITA targeting sequence
agcgauccucucaccucggc

SEQ ID NO: 32340 - RNA, 20 nt, Artificial Sequence
  CIITA targeting sequence
ugugcucaagcgauccucuc

SEQ ID NO: 32341 - RNA, 20 nt, Artificial Sequence
  CIITA targeting sequence
aacuccugugcucaagcgau

SEQ ID NO: 32342 - RNA, 20 nt, Artificial Sequence
  CIITA targeting sequence
caaacuccugugcucaagcg

SEQ ID NO: 32343 - RNA, 20 nt, Artificial Sequence
  CIITA targeting sequence
ccguguuggccaggcugguc

SEQ ID NO: 32344 - RNA, 20 nt, Artificial Sequence
  CIITA targeting sequence
acuaaagauacaaaaauuag

SEQ ID NO: 32345 - RNA, 20 nt, Artificial Sequence
  CIITA targeting sequence
uuaguagaaaugggguuuca

SEQ ID NO: 32346 - RNA, 20 nt, Artificial Sequence
  CIITA targeting sequence
ggaggcugacacaggagaau

SEQ ID NO: 32347 - RNA, 20 nt, Artificial Sequence
  CIITA targeting sequence
cgaguagcugggcuuacagg

SEQ ID NO: 32348 - RNA, 20 nt, Artificial Sequence
  CIITA targeting sequence
gccucccgaguagcugggcu

SEQ ID NO: 32349 - RNA, 20 nt, Artificial Sequence
  CIITA targeting sequence
ugugucagccucccgaguag

SEQ ID NO: 32350 - RNA, 20 nt, Artificial Sequence
  CIITA targeting sequence
ccugugucagccucccgagu

SEQ ID NO: 32351 - RNA, 20 nt, Artificial Sequence
  CIITA targeting sequence
cuugaacccaggagacacag

SEQ ID NO: 32352 - RNA, 20 nt, Artificial Sequence
  CIITA targeting sequence
agcgauucuccugugucagc

SEQ ID NO: 32353 - RNA, 20 nt, Artificial Sequence
  CIITA targeting sequence
uggguucaagcgauucuccu

SEQ ID NO: 32354 - RNA, 20 nt, Artificial Sequence
  CIITA targeting sequence
ccuggguucaagcgauucuc

SEQ ID NO: 32355 - RNA, 20 nt, Artificial Sequence
  CIITA targeting sequence
aaauacucauuugcuugaaa

SEQ ID NO: 32356 - RNA, 20 nt, Artificial Sequence
  CIITA targeting sequence
agcaaacugugucuccuggg

SEQ ID NO: 32357 - RNA, 20 nt, Artificial Sequence
  CIITA targeting sequence
uuugcuugaaauugggccac

SEQ ID NO: 32358 - RNA, 20 nt, Artificial Sequence
  CIITA targeting sequence
agcaaaugaguauuucgagc

SEQ ID NO: 32359 - RNA, 20 nt, Artificial Sequence
  CIITA targeting sequence
gcaguggcccaauuucaagc

SEQ ID NO: 32360 - RNA, 20 nt, Artificial Sequence
  CIITA targeting sequence
auguugguuacgcuggucug

SEQ ID NO: 32361 - RNA, 20 nt, Artificial Sequence
  CIITA targeting sequence
ccauguugguuacgcugguc

SEQ ID NO: 32362 - RNA, 20 nt, Artificial Sequence
  CIITA targeting sequence
guacuaaaaauacaaaauua

SEQ ID NO: 32363 - RNA, 20 nt, Artificial Sequence
  CIITA targeting sequence
cagcuacucaggaggcugcg

SEQ ID NO: 32364 - RNA, 20 nt, Artificial Sequence
  CIITA targeting sequence
ggaggcugcggcaggagaau

SEQ ID NO: 32365 - RNA, 20 nt, Artificial Sequence
  CIITA targeting sequence
ugaguagcugggauuacagg

SEQ ID NO: 32366 - RNA, 20 nt, Artificial Sequence
  CIITA targeting sequence
ugccgcagccuccugaguag

SEQ ID NO: 32367 - RNA, 20 nt, Artificial Sequence
  CIITA targeting sequence
ccugccgcagccuccugagu

SEQ ID NO: 32368 - RNA, 20 nt, Artificial Sequence
  CIITA targeting sequence
cuugaauccaggaggcggag

SEQ ID NO: 32369 - RNA, 20 nt, Artificial Sequence
  CIITA targeting sequence
agcgauucuccugccgcagc

SEQ ID NO: 32370 - RNA, 20 nt, Artificial Sequence
  CIITA targeting sequence
aggaggcggagguugcagug

SEQ ID NO: 32371 - RNA, 20 nt, Artificial Sequence
  CIITA targeting sequence
uggauucaagcgauucuccu

SEQ ID NO: 32372 - RNA, 20 nt, Artificial Sequence
  CIITA targeting sequence
gccuccuggauucaagcgau

SEQ ID NO: 32373 - RNA, 20 nt, Artificial Sequence
  CIITA targeting sequence
cugcaaccuccgccuccugg

SEQ ID NO: 32374 - RNA, 20 nt, Artificial Sequence
  CIITA targeting sequence
gcucacugcaaccuccgccu

SEQ ID NO: 32375 - RNA, 20 nt, Artificial Sequence
  CIITA targeting sequence
cagcucacugcaaccuccgc

SEQ ID NO: 32376 - RNA, 20 nt, Artificial Sequence
  CIITA targeting sequence
ugccauuguacuccagccug

SEQ ID NO: 32377 - RNA, 20 nt, Artificial Sequence
  CIITA targeting sequence
agccugggcaacaagagcga

SEQ ID NO: 32378 - RNA, 20 nt, Artificial Sequence
  CIITA targeting sequence
uguugcccaggcuggaguac

SEQ ID NO: 32379 - RNA, 20 nt, Artificial Sequence
  CIITA targeting sequence
cucuuguugcccaggcugga

SEQ ID NO: 32380 - RNA, 20 nt, Artificial Sequence
  CIITA targeting sequence
agcucaaaaaaaaagagaga

SEQ ID NO: 32381 - RNA, 20 nt, Artificial Sequence
  CIITA targeting sequence
aaaaaaaagagagagaagag

SEQ ID NO: 32382 - RNA, 20 nt, Artificial Sequence
  CIITA targeting sequence
uuuuuuuugagcuggauuuu

SEQ ID NO: 32383 - RNA, 20 nt, Artificial Sequence
  CIITA targeting sequence
cuuuuuuuuugagcuggauu

SEQ ID NO: 32384 - RNA, 20 nt, Artificial Sequence
  CIITA targeting sequence
cucuuuuuuuuugagcugga

SEQ ID NO: 32385 - RNA, 20 nt, Artificial Sequence
  CIITA targeting sequence
cucucuuuuuuuuugagcug

SEQ ID NO: 32386 - RNA, 20 nt, Artificial Sequence
  CIITA targeting sequence
ucucucucuuuuuuuuugag

SEQ ID NO: 32387 - RNA, 20 nt, Artificial Sequence
  CIITA targeting sequence
accucuucucucucuuuuuu

SEQ ID NO: 32388 - RNA, 20 nt, Artificial Sequence
  CIITA targeting sequence
caaccucuucucucucuuuu

SEQ ID NO: 32389 - RNA, 20 nt, Artificial Sequence
  CIITA targeting sequence
auucucaaccucuucucucu

SEQ ID NO: 32390 - RNA, 20 nt, Artificial Sequence
  CIITA targeting sequence
aauuugagaaguggagguga

SEQ ID NO: 32391 - RNA, 20 nt, Artificial Sequence
  CIITA targeting sequence
aauuagagcacaccaaagcu

SEQ ID NO: 32392 - RNA, 20 nt, Artificial Sequence
  CIITA targeting sequence
caaauuagagcacaccaaag

SEQ ID NO: 32393 - RNA, 20 nt, Artificial Sequence
  CIITA targeting sequence
acuucucaaauuagagcaca

SEQ ID NO: 32394 - RNA, 20 nt, Artificial Sequence
  CIITA targeting sequence
ccuccacuucucaaauuaga

SEQ ID NO: 32395 - RNA, 20 nt, Artificial Sequence
  CIITA targeting sequence
ucaccuccacuucucaaauu

SEQ ID NO: 32396 - RNA, 20 nt, Artificial Sequence
  CIITA targeting sequence
cccucaucaccuccacuucu

SEQ ID NO: 32397 - RNA, 20 nt, Artificial Sequence
  CIITA targeting sequence
uguauuucccccucaucacc

SEQ ID NO: 32398 - RNA, 20 nt, Artificial Sequence
  CIITA targeting sequence
uccuguauuucccccucauc

SEQ ID NO: 32399 - RNA, 20 nt, Artificial Sequence
  CIITA targeting sequence
ccuccuguauuucccccuca

SEQ ID NO: 32400 - RNA, 20 nt, Artificial Sequence
  CIITA targeting sequence
aauuugggguugcuucuccu

SEQ ID NO: 32401 - RNA, 20 nt, Artificial Sequence
  CIITA targeting sequence
agcagcgagugguagaccau

SEQ ID NO: 32402 - RNA, 20 nt, Artificial Sequence
  CIITA targeting sequence
cugcuugaaauguuuuucca

SEQ ID NO: 32403 - RNA, 20 nt, Artificial Sequence
  CIITA targeting sequence
accacucgcugcuugaaaug

SEQ ID NO: 32404 - RNA, 20 nt, Artificial Sequence
  CIITA targeting sequence
gcauuugccauggucuacca

SEQ ID NO: 32405 - RNA, 20 nt, Artificial Sequence
  CIITA targeting sequence
uguuagauguggcaacagca

SEQ ID NO: 32406 - RNA, 20 nt, Artificial Sequence
  CIITA targeting sequence
aacaugaaaaaccaucagca

SEQ ID NO: 32407 - RNA, 20 nt, Artificial Sequence
  CIITA targeting sequence
agguugcuguugccacaucu

SEQ ID NO: 32408 - RNA, 20 nt, Artificial Sequence
  CIITA targeting sequence
ucaagguugcuguugccaca

SEQ ID NO: 32409 - RNA, 20 nt, Artificial Sequence
  CIITA targeting sequence
cgucaagguugcuguugcca

SEQ ID NO: 32410 - RNA, 20 nt, Artificial Sequence
  CIITA targeting sequence
caaauagcucucgucaaggu

SEQ ID NO: 32411 - RNA, 20 nt, Artificial Sequence
  CIITA targeting sequence
cccaaauagcucucgucaag

SEQ ID NO: 32412 - RNA, 20 nt, Artificial Sequence
  CIITA targeting sequence
cucccaaauagcucucguca

SEQ ID NO: 32413 - RNA, 20 nt, Artificial Sequence
  CIITA targeting sequence
ugccucucucccaaauagcu

SEQ ID NO: 32414 - RNA, 20 nt, Artificial Sequence
  CIITA targeting sequence
ggcuuuuacuccugccucuc

SEQ ID NO: 32415 - RNA, 20 nt, Artificial Sequence
  CIITA targeting sequence
aaucaggcuuuuacuccugc

SEQ ID NO: 32416 - RNA, 20 nt, Artificial Sequence
  CIITA targeting sequence
uccaaucaggcuuuuacucc

SEQ ID NO: 32417 - RNA, 20 nt, Artificial Sequence
  CIITA targeting sequence
guuaaaccuccuccaaucag

SEQ ID NO: 32418 - RNA, 20 nt, Artificial Sequence
  CIITA targeting sequence
cauucuguuaaaccuccucc

SEQ ID NO: 32419 - RNA, 20 nt, Artificial Sequence
  CIITA targeting sequence
ugccuguaaucccagcauuu

SEQ ID NO: 32420 - RNA, 20 nt, Artificial Sequence
  CIITA targeting sequence
cagcauuuugagaggcugag

SEQ ID NO: 32421 - RNA, 20 nt, Artificial Sequence
  CIITA targeting sequence
aaaugcugggauuacaggca

SEQ ID NO: 32422 - RNA, 20 nt, Artificial Sequence
  CIITA targeting sequence
caaaaugcugggauuacagg

SEQ ID NO: 32423 - RNA, 20 nt, Artificial Sequence
  CIITA targeting sequence
gccucucaaaaugcugggau

SEQ ID NO: 32424 - RNA, 20 nt, Artificial Sequence
  CIITA targeting sequence
gccucagccucucaaaaugc

SEQ ID NO: 32425 - RNA, 20 nt, Artificial Sequence
  CIITA targeting sequence
uucugccucagccucucaaa

SEQ ID NO: 32426 - RNA, 20 nt, Artificial Sequence
  CIITA targeting sequence
cuucagcccaggaguuuaag

SEQ ID NO: 32427 - RNA, 20 nt, Artificial Sequence
  CIITA targeting sequence
gcccaggaguuuaagaccag

SEQ ID NO: 32428 - RNA, 20 nt, Artificial Sequence
  CIITA targeting sequence
ugggcugaagugauccuucu

SEQ ID NO: 32429 - RNA, 20 nt, Artificial Sequence
  CIITA targeting sequence
uaaacuccugggcugaagug

SEQ ID NO: 32430 - RNA, 20 nt, Artificial Sequence
  CIITA targeting sequence
ggcuggucuuaaacuccugg

SEQ ID NO: 32431 - RNA, 20 nt, Artificial Sequence
  CIITA targeting sequence
cuauguugcucaggcugguc

SEQ ID NO: 32432 - RNA, 20 nt, Artificial Sequence
  CIITA targeting sequence
cccuauguugcucaggcugg

SEQ ID NO: 32433 - RNA, 20 nt, Artificial Sequence
  CIITA targeting sequence
cuaaaaaauaaaaauaaauu

SEQ ID NO: 32434 - RNA, 20 nt, Artificial Sequence
  CIITA targeting sequence
aaaaaauaaaaauaaauuag

SEQ ID NO: 32435 - RNA, 20 nt, Artificial Sequence
  CIITA targeting sequence
ugccuggcuaauuuauuuuu

SEQ ID NO: 32436 - RNA, 20 nt, Artificial Sequence
  CIITA targeting sequence
aaauagggagaccuaaauaa

SEQ ID NO: 32437 - RNA, 20 nt, Artificial Sequence
  CIITA targeting sequence
cuauuuagagguaaggucuu

SEQ ID NO: 32438 - RNA, 20 nt, Artificial Sequence
  CIITA targeting sequence
cccuauuuagagguaagguc

SEQ ID NO: 32439 - RNA, 20 nt, Artificial Sequence
  CIITA targeting sequence
aauuauuuaggucucccuau

SEQ ID NO: 32440 - RNA, 20 nt, Artificial Sequence
  CIITA targeting sequence
aaaaaauaaaaauaaauuag

SEQ ID NO: 32441 - RNA, 20 nt, Artificial Sequence
  CIITA targeting sequence
cuaaaaaauaaaaauaaauu

SEQ ID NO: 32442 - RNA, 20 nt, Artificial Sequence
  CIITA targeting sequence
cccuauuuauuuaggucucc

SEQ ID NO: 32443 - RNA, 20 nt, Artificial Sequence
  CIITA targeting sequence
cuauuuauuuaggucuccag

SEQ ID NO: 32444 - RNA, 20 nt, Artificial Sequence
  CIITA targeting sequence
ccagugagaccuuauggcua

SEQ ID NO: 32445 - RNA, 20 nt, Artificial Sequence
  CIITA targeting sequence
agugagaccuuauggcuaaa

SEQ ID NO: 32446 - RNA, 20 nt, Artificial Sequence
  CIITA targeting sequence
cuggagaccuaaauaaauag

SEQ ID NO: 32447 - RNA, 20 nt, Artificial Sequence
  CIITA targeting sequence
cacuggagaccuaaauaaau

SEQ ID NO: 32448 - RNA, 20 nt, Artificial Sequence
  CIITA targeting sequence
caguuacgugggagacugaa

SEQ ID NO: 32449 - RNA, 20 nt, Artificial Sequence
  CIITA targeting sequence
cacguaacugggaccacagg

SEQ ID NO: 32450 - RNA, 20 nt, Artificial Sequence
  CIITA targeting sequence
cccacguaacugggaccaca

SEQ ID NO: 32451 - RNA, 20 nt, Artificial Sequence
  CIITA targeting sequence
gucucccacguaacugggac

SEQ ID NO: 32452 - RNA, 20 nt, Artificial Sequence
  CIITA targeting sequence
cuucagucucccacguaacu

SEQ ID NO: 32453 - RNA, 20 nt, Artificial Sequence
  CIITA targeting sequence
cacuucagucucccacguaa

SEQ ID NO: 32454 - RNA, 20 nt, Artificial Sequence
  CIITA targeting sequence
agcagucucacuucagucuc

SEQ ID NO: 32455 - RNA, 20 nt, Artificial Sequence
  CIITA targeting sequence
cacguucaagcagucucacu

SEQ ID NO: 32456 - RNA, 20 nt, Artificial Sequence
  CIITA targeting sequence
agguugcagugagccaugau

SEQ ID NO: 32457 - RNA, 20 nt, Artificial Sequence
  CIITA targeting sequence
cugcaaccuugaccucccac

SEQ ID NO: 32458 - RNA, 20 nt, Artificial Sequence
  CIITA targeting sequence
uggcucacugcaaccuugac

SEQ ID NO: 32459 - RNA, 20 nt, Artificial Sequence
  CIITA targeting sequence
agcccgggcaacagaaaaag

SEQ ID NO: 32460 - RNA, 20 nt, Artificial Sequence
  CIITA targeting sequence
guugcccgggcuggaguaca

SEQ ID NO: 32461 - RNA, 20 nt, Artificial Sequence
  CIITA targeting sequence
uuuucuguugcccgggcugg

SEQ ID NO: 32462 - RNA, 20 nt, Artificial Sequence
  CIITA targeting sequence
gaaaaaaaaaaaaaaaaaaa

SEQ ID NO: 32463 - RNA, 20 nt, Artificial Sequence
  CIITA targeting sequence
gaaacagugucuuuuucugu

SEQ ID NO: 32464 - RNA, 20 nt, Artificial Sequence
  CIITA targeting sequence
uuuuuuuuuuuuuuuuuuuu

SEQ ID NO: 32465 - RNA, 20 nt, Artificial Sequence
  CIITA targeting sequence
uuccuuuuuuuuuuuuuuuu

SEQ ID NO: 32466 - RNA, 20 nt, Artificial Sequence
  CIITA targeting sequence
uuccuuccuuuuuuuuuuuu

SEQ ID NO: 32467 - RNA, 20 nt, Artificial Sequence
  CIITA targeting sequence
uucuuuccuuccuuuuuuuu

SEQ ID NO: 32468 - RNA, 20 nt, Artificial Sequence
  CIITA targeting sequence
uucuuucuuuccuuccuuuu

SEQ ID NO: 32469 - RNA, 20 nt, Artificial Sequence
  CIITA targeting sequence
uuuuuucuuucuuucuuucc

SEQ ID NO: 32470 - RNA, 20 nt, Artificial Sequence
  CIITA targeting sequence
cuuuuuuucuuucuuucuuu

SEQ ID NO: 32471 - RNA, 20 nt, Artificial Sequence
  CIITA targeting sequence
uuucucuuuuuuucuuucuu

SEQ ID NO: 32472 - RNA, 20 nt, Artificial Sequence
  CIITA targeting sequence
cuuuucucuuuuuuucuuuc

SEQ ID NO: 32473 - RNA, 20 nt, Artificial Sequence
  CIITA targeting sequence
ucucuuuucucuuuuuuucu

SEQ ID NO: 32474 - RNA, 20 nt, Artificial Sequence
  CIITA targeting sequence
gagacagaggaguauagaua

SEQ ID NO: 32475 - RNA, 20 nt, Artificial Sequence
  CIITA targeting sequence
gauucuucucuuuucucuuu

SEQ ID NO: 32476 - RNA, 20 nt, Artificial Sequence
  CIITA targeting sequence
cggauucuucucuuuucucu

SEQ ID NO: 32477 - RNA, 20 nt, Artificial Sequence
  CIITA targeting sequence
gucucggauucuucucuuuu

SEQ ID NO: 32478 - RNA, 20 nt, Artificial Sequence
  CIITA targeting sequence
ucugucucggauucuucucu

SEQ ID NO: 32479 - RNA, 20 nt, Artificial Sequence
  CIITA targeting sequence
auacuccucugucucggauu

SEQ ID NO: 32480 - RNA, 20 nt, Artificial Sequence
  CIITA targeting sequence
aggagucuggcucuaaaggu

SEQ ID NO: 32481 - RNA, 20 nt, Artificial Sequence
  CIITA targeting sequence
uugaaagcauuaucuauacu

SEQ ID NO: 32482 - RNA, 20 nt, Artificial Sequence
  CIITA targeting sequence
ggcucuaaagguagcaaaaa

SEQ ID NO: 32483 - RNA, 20 nt, Artificial Sequence
  CIITA targeting sequence
aaagguagcaaaaaacugga

SEQ ID NO: 32484 - RNA, 20 nt, Artificial Sequence
  CIITA targeting sequence
aguuuuuugcuaccuuuaga

SEQ ID NO: 32485 - RNA, 20 nt, Artificial Sequence
  CIITA targeting sequence
agcccagcuccaguuuuuug

SEQ ID NO: 32486 - RNA, 20 nt, Artificial Sequence
  CIITA targeting sequence
uccagcccagcuccaguuuu

SEQ ID NO: 32487 - RNA, 20 nt, Artificial Sequence
  CIITA targeting sequence
uccuccagcccagcuccagu

SEQ ID NO: 32488 - RNA, 20 nt, Artificial Sequence
  CIITA targeting sequence
ugcacauccuccuccagccc

SEQ ID NO: 32489 - RNA, 20 nt, Artificial Sequence
  CIITA targeting sequence
cccagagaggugccuucucc

SEQ ID NO: 32490 - RNA, 20 nt, Artificial Sequence
  CIITA targeting sequence
gggggauuagguuccugcac

SEQ ID NO: 32491 - RNA, 20 nt, Artificial Sequence
  CIITA targeting sequence
cugggggauuagguuccugc

SEQ ID NO: 32492 - RNA, 20 nt, Artificial Sequence
  CIITA targeting sequence
ccuguuggccgucucuagca

SEQ ID NO: 32493 - RNA, 20 nt, Artificial Sequence
  CIITA targeting sequence
uguuggccgucucuagcacc

SEQ ID NO: 32494 - RNA, 20 nt, Artificial Sequence
  CIITA targeting sequence
cuagcacccuggccuacccu

SEQ ID NO: 32495 - RNA, 20 nt, Artificial Sequence
  CIITA targeting sequence
agcacccuggccuacccucu

SEQ ID NO: 32496 - RNA, 20 nt, Artificial Sequence
  CIITA targeting sequence
acaugguauccugcauggac

SEQ ID NO: 32497 - RNA, 20 nt, Artificial Sequence
  CIITA targeting sequence
ugcauggacuugacaccaaa

SEQ ID NO: 32498 - RNA, 20 nt, Artificial Sequence
  CIITA targeting sequence
augcaggauaccauguagag

SEQ ID NO: 32499 - RNA, 20 nt, Artificial Sequence
  CIITA targeting sequence
aguccaugcaggauaccaug

SEQ ID NO: 32500 - RNA, 20 nt, Artificial Sequence
  CIITA targeting sequence
uuuugcaaauauuugguguc

SEQ ID NO: 32501 - RNA, 20 nt, Artificial Sequence
  CIITA targeting sequence
cuacucauuuugcaaauauu

SEQ ID NO: 32502 - RNA, 20 nt, Artificial Sequence
  CIITA targeting sequence
cucaucauucuccucauccc

SEQ ID NO: 32503 - RNA, 20 nt, Artificial Sequence
  CIITA targeting sequence
ucauucuccucaucccugca

SEQ ID NO: 32504 - RNA, 20 nt, Artificial Sequence
  CIITA targeting sequence
uucuccucaucccugcaagg

SEQ ID NO: 32505 - RNA, 20 nt, Artificial Sequence
  CIITA targeting sequence
ccucaucccugcaagguugc

SEQ ID NO: 32506 - RNA, 20 nt, Artificial Sequence
  CIITA targeting sequence
ucaucccugcaagguugcua

SEQ ID NO: 32507 - RNA, 20 nt, Artificial Sequence
  CIITA targeting sequence
ucccugcaagguugcuagga

SEQ ID NO: 32508 - RNA, 20 nt, Artificial Sequence
  CIITA targeting sequence
cugcaagguugcuaggaggc

SEQ ID NO: 32509 - RNA, 20 nt, Artificial Sequence
  CIITA targeting sequence
uagcaaccuugcagggauga

SEQ ID NO: 32510 - RNA, 20 nt, Artificial Sequence
  CIITA targeting sequence
gccuccuagcaaccuugcag

SEQ ID NO: 32511 - RNA, 20 nt, Artificial Sequence
  CIITA targeting sequence
uagcuauuuuuuguuuuacu

SEQ ID NO: 32512 - RNA, 20 nt, Artificial Sequence
  CIITA targeting sequence
cuguaaagugagguucauuc

SEQ ID NO: 32513 - RNA, 20 nt, Artificial Sequence
  CIITA targeting sequence
cuuuacagggagcuuucuua

SEQ ID NO: 32514 - RNA, 20 nt, Artificial Sequence
  CIITA targeting sequence
uucuuccuuugcacgcuaau

SEQ ID NO: 32515 - RNA, 20 nt, Artificial Sequence
  CIITA targeting sequence
uccuuugcacgcuaaucauc

SEQ ID NO: 32516 - RNA, 20 nt, Artificial Sequence
  CIITA targeting sequence
uuugcacgcuaaucaucauc

SEQ ID NO: 32517 - RNA, 20 nt, Artificial Sequence
  CIITA targeting sequence
ucauccucauggcuaaugcg

SEQ ID NO: 32518 - RNA, 20 nt, Artificial Sequence
  CIITA targeting sequence
uccucauggcuaaugcgauu

SEQ ID NO: 32519 - RNA, 20 nt, Artificial Sequence
  CIITA targeting sequence
ucauggcuaaugcgauuucu

SEQ ID NO: 32520 - RNA, 20 nt, Artificial Sequence
  CIITA targeting sequence
uggcuaaugcgauuucuuuu

SEQ ID NO: 32521 - RNA, 20 nt, Artificial Sequence
  CIITA targeting sequence
cauuagccaugaggaugaug

SEQ ID NO: 32522 - RNA, 20 nt, Artificial Sequence
  CIITA targeting sequence
uuuuguuucaagagauuugg

SEQ ID NO: 32523 - RNA, 20 nt, Artificial Sequence
  CIITA targeting sequence
agagauuuggcuucaugguc

SEQ ID NO: 32524 - RNA, 20 nt, Artificial Sequence
  CIITA targeting sequence
ugaaacaaaaagaaaucgca

SEQ ID NO: 32525 - RNA, 20 nt, Artificial Sequence
  CIITA targeting sequence
cuugaaacaaaaagaaaucg

SEQ ID NO: 32526 - RNA, 20 nt, Artificial Sequence
  CIITA targeting sequence
uggucacaugcuauagcugg

SEQ ID NO: 32527 - RNA, 20 nt, Artificial Sequence
  CIITA targeting sequence
caugcuauagcugggagugu

SEQ ID NO: 32528 - RNA, 20 nt, Artificial Sequence
  CIITA targeting sequence
cagcuauagcaugugaccau

SEQ ID NO: 32529 - RNA, 20 nt, Artificial Sequence
  CIITA targeting sequence
cacucccagcuauagcaugu

SEQ ID NO: 32530 - RNA, 20 nt, Artificial Sequence
  CIITA targeting sequence
acccaaaagguuguaccugc

SEQ ID NO: 32531 - RNA, 20 nt, Artificial Sequence
  CIITA targeting sequence
aacagaauacccgagauugg

SEQ ID NO: 32532 - RNA, 20 nt, Artificial Sequence
  CIITA targeting sequence
guuagaguagcacaaaacgg

SEQ ID NO: 32533 - RNA, 20 nt, Artificial Sequence
  CIITA targeting sequence
gguauucuguuagaguagca

SEQ ID NO: 32534 - RNA, 20 nt, Artificial Sequence
  CIITA targeting sequence
cggguauucuguuagaguag

SEQ ID NO: 32535 - RNA, 20 nt, Artificial Sequence
  CIITA targeting sequence
caaucucggguauucuguua

SEQ ID NO: 32536 - RNA, 20 nt, Artificial Sequence
  CIITA targeting sequence
uuguaaauuucccaaucucg

SEQ ID NO: 32537 - RNA, 20 nt, Artificial Sequence
  CIITA targeting sequence
uuucuuuguaaauuucccaa

SEQ ID NO: 32538 - RNA, 20 nt, Artificial Sequence
  CIITA targeting sequence
gcaggcugggacguucaagg

SEQ ID NO: 32539 - RNA, 20 nt, Artificial Sequence
  CIITA targeting sequence
cagccugcagaaccacaagc

SEQ ID NO: 32540 - RNA, 20 nt, Artificial Sequence
  CIITA targeting sequence
agggcacaacacuagcuucu

SEQ ID NO: 32541 - RNA, 20 nt, Artificial Sequence
  CIITA targeting sequence
ggcaagaguuuuuaugcugc

SEQ ID NO: 32542 - RNA, 20 nt, Artificial Sequence
  CIITA targeting sequence
ugccagaagcuaguguugug

SEQ ID NO: 32543 - RNA, 20 nt, Artificial Sequence
  CIITA targeting sequence
uaucauggcagagaagguca

SEQ ID NO: 32544 - RNA, 20 nt, Artificial Sequence
  CIITA targeting sequence
uggcagagaaggucaaaugg

SEQ ID NO: 32545 - RNA, 20 nt, Artificial Sequence
  CIITA targeting sequence
gccaugauaugaugcagcau

SEQ ID NO: 32546 - RNA, 20 nt, Artificial Sequence
  CIITA targeting sequence
cugccaugauaugaugcagc

SEQ ID NO: 32547 - RNA, 20 nt, Artificial Sequence
  CIITA targeting sequence
aaugggaaacagacacaugc

SEQ ID NO: 32548 - RNA, 20 nt, Artificial Sequence
  CIITA targeting sequence
cauuugaccuucucugccau

SEQ ID NO: 32549 - RNA, 20 nt, Artificial Sequence
  CIITA targeting sequence
guuucccauuugaccuucuc

SEQ ID NO: 32550 - RNA, 20 nt, Artificial Sequence
  CIITA targeting sequence
uugcaugugucuguuuccca

SEQ ID NO: 32551 - RNA, 20 nt, Artificial Sequence
  CIITA targeting sequence
uggcuuuauaacaacccacu

SEQ ID NO: 32552 - RNA, 20 nt, Artificial Sequence
  CIITA targeting sequence
caaaggaacuaauccauucc

SEQ ID NO: 32553 - RNA, 20 nt, Artificial Sequence
  CIITA targeting sequence
aaggaacuaauccauuccca

SEQ ID NO: 32554 - RNA, 20 nt, Artificial Sequence
  CIITA targeting sequence
uuugagaguggguuguuaua

SEQ ID NO: 32555 - RNA, 20 nt, Artificial Sequence
  CIITA targeting sequence
auucccaugagaauuaaucc

SEQ ID NO: 32556 - RNA, 20 nt, Artificial Sequence
  CIITA targeting sequence
caugagaauuaauccaguca

SEQ ID NO: 32557 - RNA, 20 nt, Artificial Sequence
  CIITA targeting sequence
ugggaauggauuaguuccuu

SEQ ID NO: 32558 - RNA, 20 nt, Artificial Sequence
  CIITA targeting sequence
caugggaauggauuaguucc

SEQ ID NO: 32559 - RNA, 20 nt, Artificial Sequence
  CIITA targeting sequence
agucaagcagagcccacuca

SEQ ID NO: 32560 - RNA, 20 nt, Artificial Sequence
  CIITA targeting sequence
agcagagcccacucauuacu

SEQ ID NO: 32561 - RNA, 20 nt, Artificial Sequence
  CIITA targeting sequence
gcuugacuggauuaauucuc

SEQ ID NO: 32562 - RNA, 20 nt, Artificial Sequence
  CIITA targeting sequence
uuacugcauuacuagcacca

SEQ ID NO: 32563 - RNA, 20 nt, Artificial Sequence
  CIITA targeting sequence
ugggggauccauccccauga

SEQ ID NO: 32564 - RNA, 20 nt, Artificial Sequence
  CIITA targeting sequence
cccacgaauggcuuggugcu

SEQ ID NO: 32565 - RNA, 20 nt, Artificial Sequence
  CIITA targeting sequence
auccccaugacccaaacacc

SEQ ID NO: 32566 - RNA, 20 nt, Artificial Sequence
  CIITA targeting sequence
ccaugacccaaacaccuccc

SEQ ID NO: 32567 - RNA, 20 nt, Artificial Sequence
  CIITA targeting sequence
uggggauggaucccccacga

SEQ ID NO: 32568 - RNA, 20 nt, Artificial Sequence
  CIITA targeting sequence
cacuaggccccaccucccaa

SEQ ID NO: 32569 - RNA, 20 nt, Artificial Sequence
  CIITA targeting sequence
caacaacgccacauuggagg

SEQ ID NO: 32570 - RNA, 20 nt, Artificial Sequence
  CIITA targeting sequence
aauguggcguuguugggagg

SEQ ID NO: 32571 - RNA, 20 nt, Artificial Sequence
  CIITA targeting sequence
aauuucaacaugaguucugg

SEQ ID NO: 32572 - RNA, 20 nt, Artificial Sequence
  CIITA targeting sequence
acaugaguucuggugaagac

SEQ ID NO: 32573 - RNA, 20 nt, Artificial Sequence
  CIITA targeting sequence
uguugaaauuugaccuccaa

SEQ ID NO: 32574 - RNA, 20 nt, Artificial Sequence
  CIITA targeting sequence
ggugaagacaaacacaccau

SEQ ID NO: 32575 - RNA, 20 nt, Artificial Sequence
  CIITA targeting sequence
ccagaacucauguugaaauu

SEQ ID NO: 32576 - RNA, 20 nt, Artificial Sequence
  CIITA targeting sequence
ucaccagaacucauguugaa

SEQ ID NO: 32577 - RNA, 20 nt, Artificial Sequence
  CIITA targeting sequence
gaaccauagcagugggcaag

SEQ ID NO: 32578 - RNA, 20 nt, Artificial Sequence
  CIITA targeting sequence
gauaugguguguuugucuuc

SEQ ID NO: 32579 - RNA, 20 nt, Artificial Sequence
  CIITA targeting sequence
auugccaacuugcccacugc

SEQ ID NO: 32580 - RNA, 20 nt, Artificial Sequence
  CIITA targeting sequence
acagcuaggaagucaaaugu

SEQ ID NO: 32581 - RNA, 20 nt, Artificial Sequence
  CIITA targeting sequence
uagcuguugacaucuauugc

SEQ ID NO: 32582 - RNA, 20 nt, Artificial Sequence
  CIITA targeting sequence
aauguacaugacuauugcaa

SEQ ID NO: 32583 - RNA, 20 nt, Artificial Sequence
  CIITA targeting sequence
uguacauuugacuuccuagc

SEQ ID NO: 32584 - RNA, 20 nt, Artificial Sequence
  CIITA targeting sequence
gguuuguuacaaacaauguu

SEQ ID NO: 32585 - RNA, 20 nt, Artificial Sequence
  CIITA targeting sequence
augucaacguccaccauuaa

SEQ ID NO: 32586 - RNA, 20 nt, Artificial Sequence
  CIITA targeting sequence
acguccaccauuaaaaggac

SEQ ID NO: 32587 - RNA, 20 nt, Artificial Sequence
  CIITA targeting sequence
accauuaaaaggacuugguu

SEQ ID NO: 32588 - RNA, 20 nt, Artificial Sequence
  CIITA targeting sequence
uuuuaaugguggacguugac

SEQ ID NO: 32589 - RNA, 20 nt, Artificial Sequence
  CIITA targeting sequence
uugcuuauuuaaccaagucc

SEQ ID NO: 32590 - RNA, 20 nt, Artificial Sequence
  CIITA targeting sequence
uuuuguacaauauuguagag

SEQ ID NO: 32591 - RNA, 20 nt, Artificial Sequence
  CIITA targeting sequence
acaauauuguacaaaaugaa

SEQ ID NO: 32592 - RNA, 20 nt, Artificial Sequence
  CIITA targeting sequence
uuuuaauggcucuacaauau

SEQ ID NO: 32593 - RNA, 20 nt, Artificial Sequence
  CIITA targeting sequence
uuccuuuuaauggcucuaca

SEQ ID NO: 32594 - RNA, 20 nt, Artificial Sequence
  CIITA targeting sequence
uuuauuuguuuuguguauuu

SEQ ID NO: 32595 - RNA, 20 nt, Artificial Sequence
  CIITA targeting sequence
uuccuuuauuuguuuugugu

SEQ ID NO: 32596 - RNA, 20 nt, Artificial Sequence
  CIITA targeting sequence
gcuucauuccuuuauuuguu

SEQ ID NO: 32597 - RNA, 20 nt, Artificial Sequence
  CIITA targeting sequence
gugcaugcaaaucugcuuca

SEQ ID NO: 32598 - RNA, 20 nt, Artificial Sequence
  CIITA targeting sequence
augucagugcaugcaaaucu

SEQ ID NO: 32599 - RNA, 20 nt, Artificial Sequence
  CIITA targeting sequence
aaaauacauuacacgaaaca

SEQ ID NO: 32600 - RNA, 20 nt, Artificial Sequence
  CIITA targeting sequence
uguaauguauuuuggacccc

SEQ ID NO: 32601 - RNA, 20 nt, Artificial Sequence
  CIITA targeting sequence
aauguuucguguaauguauu

SEQ ID NO: 32602 - RNA, 20 nt, Artificial Sequence
  CIITA targeting sequence
caaauguuucguguaaugua

SEQ ID NO: 32603 - RNA, 20 nt, Artificial Sequence
  CIITA targeting sequence
aguugcauaacagcauaauu

SEQ ID NO: 32604 - RNA, 20 nt, Artificial Sequence
  CIITA targeting sequence
guaauuaugcuguuaugcaa

SEQ ID NO: 32605 - RNA, 20 nt, Artificial Sequence
  CIITA targeting sequence
uucuguaauuaugcuguuau

SEQ ID NO: 32606 - RNA, 20 nt, Artificial Sequence
  CIITA targeting sequence
uuaaauaucauucuguaauu

SEQ ID NO: 32607 - RNA, 20 nt, Artificial Sequence
  CIITA targeting sequence
auagauugccucuagaaaga

SEQ ID NO: 32608 - RNA, 20 nt, Artificial Sequence
  CIITA targeting sequence
auggaaaucuuuaaauauca

SEQ ID NO: 32609 - RNA, 20 nt, Artificial Sequence
  CIITA targeting sequence
agaaagagagacuauguaug

SEQ ID NO: 32610 - RNA, 20 nt, Artificial Sequence
  CIITA targeting sequence
agaggcaaucuauggaaauc

SEQ ID NO: 32611 - RNA, 20 nt, Artificial Sequence
  CIITA targeting sequence
uucuagaggcaaucuaugga

SEQ ID NO: 32612 - RNA, 20 nt, Artificial Sequence
  CIITA targeting sequence
cuuucuagaggcaaucuaug

SEQ ID NO: 32613 - RNA, 20 nt, Artificial Sequence
  CIITA targeting sequence
cucuuucuagaggcaaucua

SEQ ID NO: 32614 - RNA, 20 nt, Artificial Sequence
  CIITA targeting sequence
auacauagucucucuuucua

SEQ ID NO: 32615 - RNA, 20 nt, Artificial Sequence
  CIITA targeting sequence
agcuguccauacauagucuc

SEQ ID NO: 32616 - RNA, 20 nt, Artificial Sequence
  CIITA targeting sequence
uauaaguuucagggagaaga

SEQ ID NO: 32617 - RNA, 20 nt, Artificial Sequence
  CIITA targeting sequence
gggagaagaaacgaggaaag

SEQ ID NO: 32618 - RNA, 20 nt, Artificial Sequence
  CIITA targeting sequence
cugaaacuuauaagaaauaa

SEQ ID NO: 32619 - RNA, 20 nt, Artificial Sequence
  CIITA targeting sequence
cccugaaacuuauaagaaau

SEQ ID NO: 32620 - RNA, 20 nt, Artificial Sequence
  CIITA targeting sequence
ucucccugaaacuuauaaga

SEQ ID NO: 32621 - RNA, 20 nt, Artificial Sequence
  CIITA targeting sequence
uuucuucucccugaaacuua

SEQ ID NO: 32622 - RNA, 20 nt, Artificial Sequence
  CIITA targeting sequence
ucguuucuucucccugaaac

SEQ ID NO: 32623 - RNA, 20 nt, Artificial Sequence
  CIITA targeting sequence
uuuccucguuucuucucccu

SEQ ID NO: 32624 - RNA, 20 nt, Artificial Sequence
  CIITA targeting sequence
cuacacuguccuuuccucgu

SEQ ID NO: 32625 - RNA, 20 nt, Artificial Sequence
  CIITA targeting sequence
cacuuugaagauggaguugu

SEQ ID NO: 32626 - RNA, 20 nt, Artificial Sequence
  CIITA targeting sequence
cuuugaagauggaguuguuc

SEQ ID NO: 32627 - RNA, 20 nt, Artificial Sequence
  CIITA targeting sequence
aagugagaauauuauucccu

SEQ ID NO: 32628 - RNA, 20 nt, Artificial Sequence
  CIITA targeting sequence
ucaaagugagaauauuauuc

SEQ ID NO: 32629 - RNA, 20 nt, Artificial Sequence
  CIITA targeting sequence
aucuucaaagugagaauauu

SEQ ID NO: 32630 - RNA, 20 nt, Artificial Sequence
  CIITA targeting sequence
uuuccaggggaacaaagcca

SEQ ID NO: 32631 - RNA, 20 nt, Artificial Sequence
  CIITA targeting sequence
aggggaacaaagccaacucu

SEQ ID NO: 32632 - RNA, 20 nt, Artificial Sequence
  CIITA targeting sequence
ccuggaaaagaacaacucca

SEQ ID NO: 32633 - RNA, 20 nt, Artificial Sequence
  CIITA targeting sequence
gaaacccccuccuagaaucu

SEQ ID NO: 32634 - RNA, 20 nt, Artificial Sequence
  CIITA targeting sequence
gaguuggcuuuguuccccug

SEQ ID NO: 32635 - RNA, 20 nt, Artificial Sequence
  CIITA targeting sequence
uagaaucugaggcugagcag

SEQ ID NO: 32636 - RNA, 20 nt, Artificial Sequence
  CIITA targeting sequence
aggaggggguuucagaguug

SEQ ID NO: 32637 - RNA, 20 nt, Artificial Sequence
  CIITA targeting sequence
gaggcugagcagcaugggga

SEQ ID NO: 32638 - RNA, 20 nt, Artificial Sequence
  CIITA targeting sequence
gauucuaggaggggguuuca

SEQ ID NO: 32639 - RNA, 20 nt, Artificial Sequence
  CIITA targeting sequence
gccucagauucuaggagggg

SEQ ID NO: 32640 - RNA, 20 nt, Artificial Sequence
  CIITA targeting sequence
ccaugcugcucagccucaga

SEQ ID NO: 32641 - RNA, 20 nt, Artificial Sequence
  CIITA targeting sequence
uccccaugcugcucagccuc

SEQ ID NO: 32642 - RNA, 20 nt, Artificial Sequence
  CIITA targeting sequence
uuuuuuuuuuucugagacag

SEQ ID NO: 32643 - RNA, 20 nt, Artificial Sequence
  CIITA targeting sequence
gagacagagucucucucugu

SEQ ID NO: 32644 - RNA, 20 nt, Artificial Sequence
  CIITA targeting sequence
gaaaaaaaaaaaagaauaaa

SEQ ID NO: 32645 - RNA, 20 nt, Artificial Sequence
  CIITA targeting sequence
cagaaaaaaaaaaaagaaua

SEQ ID NO: 32646 - RNA, 20 nt, Artificial Sequence
  CIITA targeting sequence
gucucagaaaaaaaaaaaag

SEQ ID NO: 32647 - RNA, 20 nt, Artificial Sequence
  CIITA targeting sequence
cucucuguugcccaggcugg

SEQ ID NO: 32648 - RNA, 20 nt, Artificial Sequence
  CIITA targeting sequence
cucuguugcccaggcuggag

SEQ ID NO: 32649 - RNA, 20 nt, Artificial Sequence
  CIITA targeting sequence
cuguugcccaggcuggagug

SEQ ID NO: 32650 - RNA, 20 nt, Artificial Sequence
  CIITA targeting sequence
guugcccaggcuggagugca

SEQ ID NO: 32651 - RNA, 20 nt, Artificial Sequence
  CIITA targeting sequence
agccugggcaacagagagag

SEQ ID NO: 32652 - RNA, 20 nt, Artificial Sequence
  CIITA targeting sequence
ugcccuugcacuccagccug

SEQ ID NO: 32653 - RNA, 20 nt, Artificial Sequence
  CIITA targeting sequence
cggcucacugcaaccucugc

SEQ ID NO: 32654 - RNA, 20 nt, Artificial Sequence
  CIITA targeting sequence
gcucacugcaaccucugccu

SEQ ID NO: 32655 - RNA, 20 nt, Artificial Sequence
  CIITA targeting sequence
cugcaaccucugccuccugg

SEQ ID NO: 32656 - RNA, 20 nt, Artificial Sequence
  CIITA targeting sequence
gccuccuggguucaagcaau

SEQ ID NO: 32657 - RNA, 20 nt, Artificial Sequence
  CIITA targeting sequence
uggguucaagcaauucuccu

SEQ ID NO: 32658 - RNA, 20 nt, Artificial Sequence
  CIITA targeting sequence
agcaauucuccuaccucagc

SEQ ID NO: 32659 - RNA, 20 nt, Artificial Sequence
  CIITA targeting sequence
ccuaccucagccucccaagu

SEQ ID NO: 32660 - RNA, 20 nt, Artificial Sequence
  CIITA targeting sequence
uaccucagccucccaaguag

SEQ ID NO: 32661 - RNA, 20 nt, Artificial Sequence
  CIITA targeting sequence
gccucccaaguagcugggau

SEQ ID NO: 32662 - RNA, 20 nt, Artificial Sequence
  CIITA targeting sequence
caaguagcugggauuacagg

SEQ ID NO: 32663 - RNA, 20 nt, Artificial Sequence
  CIITA targeting sequence
cagcuacuugggaggcugag

SEQ ID NO: 32664 - RNA, 20 nt, Artificial Sequence
  CIITA targeting sequence
acuaaaaauacaaaaaguua

SEQ ID NO: 32665 - RNA, 20 nt, Artificial Sequence
  CIITA targeting sequence
cuacuaaaaauacaaaaagu

SEQ ID NO: 32666 - RNA, 20 nt, Artificial Sequence
  CIITA targeting sequence
ccauguuggccagccugguc

SEQ ID NO: 32667 - RNA, 20 nt, Artificial Sequence
  CIITA targeting sequence
cgaacuccugaccucaggug

SEQ ID NO: 32668 - RNA, 20 nt, Artificial Sequence
  CIITA targeting sequence
aacuccugaccucaggugau

SEQ ID NO: 32669 - RNA, 20 nt, Artificial Sequence
  CIITA targeting sequence
agaccaggcuggccaacaug

SEQ ID NO: 32670 - RNA, 20 nt, Artificial Sequence
  CIITA targeting sequence
ugaccucaggugaucugccc

SEQ ID NO: 32671 - RNA, 20 nt, Artificial Sequence
  CIITA targeting sequence
ggaguucgagaccaggcugg

SEQ ID NO: 32672 - RNA, 20 nt, Artificial Sequence
  CIITA targeting sequence
ggugaucugccccggccucc

SEQ ID NO: 32673 - RNA, 20 nt, Artificial Sequence
  CIITA targeting sequence
ccugaggucaggaguucgag

SEQ ID NO: 32674 - RNA, 20 nt, Artificial Sequence
  CIITA targeting sequence
gccccggccucccaaagggc

SEQ ID NO: 32675 - RNA, 20 nt, Artificial Sequence
  CIITA targeting sequence
caaagggcugggauuacagg

SEQ ID NO: 32676 - RNA, 20 nt, Artificial Sequence
  CIITA targeting sequence
cagcccuuugggaggccggg

SEQ ID NO: 32677 - RNA, 20 nt, Artificial Sequence
  CIITA targeting sequence
ugccuguaaucccagcccuu

SEQ ID NO: 32678 - RNA, 20 nt, Artificial Sequence
  CIITA targeting sequence
agccucuacaggaagaauug

SEQ ID NO: 32679 - RNA, 20 nt, Artificial Sequence
  CIITA targeting sequence
acaggaagaauugauucuua

SEQ ID NO: 32680 - RNA, 20 nt, Artificial Sequence
  CIITA targeting sequence
uguagaggcuggaugcggug

SEQ ID NO: 32681 - RNA, 20 nt, Artificial Sequence
  CIITA targeting sequence
uccuguagaggcuggaugcg

SEQ ID NO: 32682 - RNA, 20 nt, Artificial Sequence
  CIITA targeting sequence
auucuuccuguagaggcugg

SEQ ID NO: 32683 - RNA, 20 nt, Artificial Sequence
  CIITA targeting sequence
uaucuacaggucacuuucca

SEQ ID NO: 32684 - RNA, 20 nt, Artificial Sequence
  CIITA targeting sequence
acaggucacuuuccaggugc

SEQ ID NO: 32685 - RNA, 20 nt, Artificial Sequence
  CIITA targeting sequence
cuuuccaggugcccauggag

SEQ ID NO: 32686 - RNA, 20 nt, Artificial Sequence
  CIITA targeting sequence
aggugcccauggaggugauu

SEQ ID NO: 32687 - RNA, 20 nt, Artificial Sequence
  CIITA targeting sequence
augggcaccuggaaagugac

SEQ ID NO: 32688 - RNA, 20 nt, Artificial Sequence
  CIITA targeting sequence
ccuccaugggcaccuggaaa

SEQ ID NO: 32689 - RNA, 20 nt, Artificial Sequence
  CIITA targeting sequence
cccaaaacugcguuuuccca

SEQ ID NO: 32690 - RNA, 20 nt, Artificial Sequence
  CIITA targeting sequence
caaacauaccacuccugaaa

SEQ ID NO: 32691 - RNA, 20 nt, Artificial Sequence
  CIITA targeting sequence
ugaaauuccccaagcccucc

SEQ ID NO: 32692 - RNA, 20 nt, Artificial Sequence
  CIITA targeting sequence
ggagugguauguuugggaaa

SEQ ID NO: 32693 - RNA, 20 nt, Artificial Sequence
  CIITA targeting sequence
ccaagcccuccucgcugauu

SEQ ID NO: 32694 - RNA, 20 nt, Artificial Sequence
  CIITA targeting sequence
ucgcugauucaggggguagg

SEQ ID NO: 32695 - RNA, 20 nt, Artificial Sequence
  CIITA targeting sequence
cugauucaggggguaggaga

SEQ ID NO: 32696 - RNA, 20 nt, Artificial Sequence
  CIITA targeting sequence
gcgaggagggcuuggggaau

SEQ ID NO: 32697 - RNA, 20 nt, Artificial Sequence
  CIITA targeting sequence
ggggguaggagagguaggug

SEQ ID NO: 32698 - RNA, 20 nt, Artificial Sequence
  CIITA targeting sequence
uacccccugaaucagcgagg

SEQ ID NO: 32699 - RNA, 20 nt, Artificial Sequence
  CIITA targeting sequence
ccuacccccugaaucagcga

SEQ ID NO: 32700 - RNA, 20 nt, Artificial Sequence
  CIITA targeting sequence
accuaccucuccuacccccu

SEQ ID NO: 32701 - RNA, 20 nt, Artificial Sequence
  CIITA targeting sequence
gcuuagagaaggcagaauca

SEQ ID NO: 32702 - RNA, 20 nt, Artificial Sequence
  CIITA targeting sequence
aagcagaugguguuugucca

SEQ ID NO: 32703 - RNA, 20 nt, Artificial Sequence
  CIITA targeting sequence
cuaagcagaugguguuuguc

SEQ ID NO: 32704 - RNA, 20 nt, Artificial Sequence
  CIITA targeting sequence
gccuucucuaagcagauggu

SEQ ID NO: 32705 - RNA, 20 nt, Artificial Sequence
  CIITA targeting sequence
uagcagguaaauccuuccag

SEQ ID NO: 32706 - RNA, 20 nt, Artificial Sequence
  CIITA targeting sequence
uuccagcaggguuuccauaa

SEQ ID NO: 32707 - RNA, 20 nt, Artificial Sequence
  CIITA targeting sequence
agcaggguuuccauaaccug

SEQ ID NO: 32708 - RNA, 20 nt, Artificial Sequence
  CIITA targeting sequence
auaaccuguagcaacuguug

SEQ ID NO: 32709 - RNA, 20 nt, Artificial Sequence
  CIITA targeting sequence
augguaacaacaguugcuac

SEQ ID NO: 32710 - RNA, 20 nt, Artificial Sequence
  CIITA targeting sequence
uguaaugguggcuauuguuu

SEQ ID NO: 32711 - RNA, 20 nt, Artificial Sequence
  CIITA targeting sequence
ccuguaaugguggcuauugu

SEQ ID NO: 32712 - RNA, 20 nt, Artificial Sequence
  CIITA targeting sequence
caggguuuaacuaggccaag

SEQ ID NO: 32713 - RNA, 20 nt, Artificial Sequence
  CIITA targeting sequence
uggccuaguuaaacccuggg

SEQ ID NO: 32714 - RNA, 20 nt, Artificial Sequence
  CIITA targeting sequence
gaggcuucauucauucauuc

SEQ ID NO: 32715 - RNA, 20 nt, Artificial Sequence
  CIITA targeting sequence
gauuuggucuuggccuaguu

SEQ ID NO: 32716 - RNA, 20 nt, Artificial Sequence
  CIITA targeting sequence
uucauucauucauucauuca

SEQ ID NO: 32717 - RNA, 20 nt, Artificial Sequence
  CIITA targeting sequence
uucauucauucauucauuac

SEQ ID NO: 32718 - RNA, 20 nt, Artificial Sequence
  CIITA targeting sequence
uucauucauucauuacuagg

SEQ ID NO: 32719 - RNA, 20 nt, Artificial Sequence
  CIITA targeting sequence
uucauucauuacuagggguu

SEQ ID NO: 32720 - RNA, 20 nt, Artificial Sequence
  CIITA targeting sequence
uucauuacuagggguuuaaa

SEQ ID NO: 32721 - RNA, 20 nt, Artificial Sequence
  CIITA targeting sequence
uuacuagggguuuaaaucua

SEQ ID NO: 32722 - RNA, 20 nt, Artificial Sequence
  CIITA targeting sequence
aaugccagccccuaugaugg

SEQ ID NO: 32723 - RNA, 20 nt, Artificial Sequence
  CIITA targeting sequence
uaggggcuggcauuagauuu

SEQ ID NO: 32724 - RNA, 20 nt, Artificial Sequence
  CIITA targeting sequence
caaugcccaucauaggggcu

SEQ ID NO: 32725 - RNA, 20 nt, Artificial Sequence
  CIITA targeting sequence
uguucccaaugcccaucaua

SEQ ID NO: 32726 - RNA, 20 nt, Artificial Sequence
  CIITA targeting sequence
auaagacccauucccaccua

SEQ ID NO: 32727 - RNA, 20 nt, Artificial Sequence
  CIITA targeting sequence
uauugaccuucauguuccca

SEQ ID NO: 32728 - RNA, 20 nt, Artificial Sequence
  CIITA targeting sequence
caccuauuaagaagcucaca

SEQ ID NO: 32729 - RNA, 20 nt, Artificial Sequence
  CIITA targeting sequence
uaauaggugggaaugggucu

SEQ ID NO: 32730 - RNA, 20 nt, Artificial Sequence
  CIITA targeting sequence
cagucccaagaggcgaagac

SEQ ID NO: 32731 - RNA, 20 nt, Artificial Sequence
  CIITA targeting sequence
caagaggcgaagacaggcag

SEQ ID NO: 32732 - RNA, 20 nt, Artificial Sequence
  CIITA targeting sequence
ugggacugugagcuucuuaa

SEQ ID NO: 32733 - RNA, 20 nt, Artificial Sequence
  CIITA targeting sequence
ccucuugggacugugagcuu

SEQ ID NO: 32734 - RNA, 20 nt, Artificial Sequence
  CIITA targeting sequence
ucgccucuugggacugugag

SEQ ID NO: 32735 - RNA, 20 nt, Artificial Sequence
  CIITA targeting sequence
augaaaggacuuagugaaaa

SEQ ID NO: 32736 - RNA, 20 nt, Artificial Sequence
  CIITA targeting sequence
uggaauuauaauuacuuauu

SEQ ID NO: 32737 - RNA, 20 nt, Artificial Sequence
  CIITA targeting sequence
uuucauggaauuauaauuac

SEQ ID NO: 32738 - RNA, 20 nt, Artificial Sequence
  CIITA targeting sequence
cuaaguccuuucauggaauu

SEQ ID NO: 32739 - RNA, 20 nt, Artificial Sequence
  CIITA targeting sequence
aaguguucauuaucuggccc

SEQ ID NO: 32740 - RNA, 20 nt, Artificial Sequence
  CIITA targeting sequence
uuaucuggcccccacccuuc

SEQ ID NO: 32741 - RNA, 20 nt, Artificial Sequence
  CIITA targeting sequence
ggcccccacccuucauccau

SEQ ID NO: 32742 - RNA, 20 nt, Artificial Sequence
  CIITA targeting sequence
uccauaauaaauuuuaauaa

SEQ ID NO: 32743 - RNA, 20 nt, Artificial Sequence
  CIITA targeting sequence
auaauaaauuuuaauaaugu

SEQ ID NO: 32744 - RNA, 20 nt, Artificial Sequence
  CIITA targeting sequence
ggucuuagguaaguuuaauu

SEQ ID NO: 32745 - RNA, 20 nt, Artificial Sequence
  CIITA targeting sequence
uagguaaguuuaauuuccaa

SEQ ID NO: 32746 - RNA, 20 nt, Artificial Sequence
  CIITA targeting sequence
aaguuuaggucuuaugcauu

SEQ ID NO: 32747 - RNA, 20 nt, Artificial Sequence
  CIITA targeting sequence
uaugcauuucauuuccaccu

SEQ ID NO: 32748 - RNA, 20 nt, Artificial Sequence
  CIITA targeting sequence
uuuccaccuuuccuuaggcc

SEQ ID NO: 32749 - RNA, 20 nt, Artificial Sequence
  CIITA targeting sequence
accuuuccuuaggcccuucu

SEQ ID NO: 32750 - RNA, 20 nt, Artificial Sequence
  CIITA targeting sequence
uuaggcccuucuugacugug

SEQ ID NO: 32751 - RNA, 20 nt, Artificial Sequence
  CIITA targeting sequence
ugacugugaguuauuguuau

SEQ ID NO: 32752 - RNA, 20 nt, Artificial Sequence
  CIITA targeting sequence
agaagggccuaaggaaaggu

SEQ ID NO: 32753 - RNA, 20 nt, Artificial Sequence
  CIITA targeting sequence
cagucaagaagggccuaagg

SEQ ID NO: 32754 - RNA, 20 nt, Artificial Sequence
  CIITA targeting sequence
aaacaaaaaguuaaaaauau

SEQ ID NO: 32755 - RNA, 20 nt, Artificial Sequence
  CIITA targeting sequence
acaguuauuucaaaacaaaa

SEQ ID NO: 32756 - RNA, 20 nt, Artificial Sequence
  CIITA targeting sequence
agugaccuugcaaaaagagu

SEQ ID NO: 32757 - RNA, 20 nt, Artificial Sequence
  CIITA targeting sequence
cuugagucuacaguuauuuc

SEQ ID NO: 32758 - RNA, 20 nt, Artificial Sequence
  CIITA targeting sequence
uuuugcaaggucacuugagu

SEQ ID NO: 32759 - RNA, 20 nt, Artificial Sequence
  CIITA targeting sequence
agugguauuguguaucuuuc

SEQ ID NO: 32760 - RNA, 20 nt, Artificial Sequence
  CIITA targeting sequence
uucacccagcucuucccaac

SEQ ID NO: 32761 - RNA, 20 nt, Artificial Sequence
  CIITA targeting sequence
cccagcucuucccaacugga

SEQ ID NO: 32762 - RNA, 20 nt, Artificial Sequence
  CIITA targeting sequence
ucccaacuggaacaucuccc

SEQ ID NO: 32763 - RNA, 20 nt, Artificial Sequence
  CIITA targeting sequence
caacuggaacaucucccaua

SEQ ID NO: 32764 - RNA, 20 nt, Artificial Sequence
  CIITA targeting sequence
aguugggaagagcuggguga

SEQ ID NO: 32765 - RNA, 20 nt, Artificial Sequence
  CIITA targeting sequence
cccauaacuacauugcauua

SEQ ID NO: 32766 - RNA, 20 nt, Artificial Sequence
  CIITA targeting sequence
cauaacuacauugcauuacu

SEQ ID NO: 32767 - RNA, 20 nt, Artificial Sequence
  CIITA targeting sequence
uggugcuaguaaugcaaugu

SEQ ID NO: 32768 - RNA, 20 nt, Artificial Sequence
  CIITA targeting sequence
auuuccuggugcuaguaaug

SEQ ID NO: 32769 - RNA, 20 nt, Artificial Sequence
  CIITA targeting sequence
guccaauagaauuaacuaga

SEQ ID NO: 32770 - RNA, 20 nt, Artificial Sequence
  CIITA targeting sequence
aauagaauuaacuagacucc

SEQ ID NO: 32771 - RNA, 20 nt, Artificial Sequence
  CIITA targeting sequence
auuggacugaugucaauuuc

SEQ ID NO: 32772 - RNA, 20 nt, Artificial Sequence
  CIITA targeting sequence
aguuaauucuauuggacuga

SEQ ID NO: 32773 - RNA, 20 nt, Artificial Sequence
  CIITA targeting sequence
agaccagcagaaccuuccuu

SEQ ID NO: 32774 - RNA, 20 nt, Artificial Sequence
  CIITA targeting sequence
ggagucuaguuaauucuauu

SEQ ID NO: 32775 - RNA, 20 nt, Artificial Sequence
  CIITA targeting sequence
gcuggucuggagucuaguua

SEQ ID NO: 32776 - RNA, 20 nt, Artificial Sequence
  CIITA targeting sequence
uuuuugaacccuagucuggc

SEQ ID NO: 32777 - RNA, 20 nt, Artificial Sequence
  CIITA targeting sequence
aaaaggaagguucugcuggu

SEQ ID NO: 32778 - RNA, 20 nt, Artificial Sequence
  CIITA targeting sequence
ggcucugaccaucauaucaa

SEQ ID NO: 32779 - RNA, 20 nt, Artificial Sequence
  CIITA targeting sequence
gaccaucauaucaacacccu

SEQ ID NO: 32780 - RNA, 20 nt, Artificial Sequence
  CIITA targeting sequence
gagccagacuaggguucaaa

SEQ ID NO: 32781 - RNA, 20 nt, Artificial Sequence
  CIITA targeting sequence
uaucaacacccucuuuuagu

SEQ ID NO: 32782 - RNA, 20 nt, Artificial Sequence
  CIITA targeting sequence
acacccucuuuuagucuguc

SEQ ID NO: 32783 - RNA, 20 nt, Artificial Sequence
  CIITA targeting sequence
uuuagucugucugucucuga

SEQ ID NO: 32784 - RNA, 20 nt, Artificial Sequence
  CIITA targeting sequence
gucugucucugaguguaugc

SEQ ID NO: 32785 - RNA, 20 nt, Artificial Sequence
  CIITA targeting sequence
gucucugaguguaugcaauc

SEQ ID NO: 32786 - RNA, 20 nt, Artificial Sequence
  CIITA targeting sequence
cugaguguaugcaaucauuu

SEQ ID NO: 32787 - RNA, 20 nt, Artificial Sequence
  CIITA targeting sequence
gaguguaugcaaucauuugc

SEQ ID NO: 32788 - RNA, 20 nt, Artificial Sequence
  CIITA targeting sequence
gagacagacagacuaaaaga

SEQ ID NO: 32789 - RNA, 20 nt, Artificial Sequence
  CIITA targeting sequence
uuugcaaaaugaagcugcca

SEQ ID NO: 32790 - RNA, 20 nt, Artificial Sequence
  CIITA targeting sequence
uuuugcaaaugauugcauac

SEQ ID NO: 32791 - RNA, 20 nt, Artificial Sequence
  CIITA targeting sequence
uugccaaguuacagaauuuc

SEQ ID NO: 32792 - RNA, 20 nt, Artificial Sequence
  CIITA targeting sequence
guaacuuggcaaggauggca

SEQ ID NO: 32793 - RNA, 20 nt, Artificial Sequence
  CIITA targeting sequence
ugaagucaauguaaaugaug

SEQ ID NO: 32794 - RNA, 20 nt, Artificial Sequence
  CIITA targeting sequence
ggaaauucuguaacuuggca

SEQ ID NO: 32795 - RNA, 20 nt, Artificial Sequence
  CIITA targeting sequence
auguaaaugaugcacccaca

SEQ ID NO: 32796 - RNA, 20 nt, Artificial Sequence
  CIITA targeting sequence
uuuacauugacuucaggaaa

SEQ ID NO: 32797 - RNA, 20 nt, Artificial Sequence
  CIITA targeting sequence
uugugggugcaucauuuaca

SEQ ID NO: 32798 - RNA, 20 nt, Artificial Sequence
  CIITA targeting sequence
acaaauaagcaucugguaga

SEQ ID NO: 32799 - RNA, 20 nt, Artificial Sequence
  CIITA targeting sequence
gguagacuuaggcuaagaaa

SEQ ID NO: 32800 - RNA, 20 nt, Artificial Sequence
  CIITA targeting sequence
accagaugcuuauuuguuga

SEQ ID NO: 32801 - RNA, 20 nt, Artificial Sequence
  CIITA targeting sequence
uagccuaagucuaccagaug

SEQ ID NO: 32802 - RNA, 20 nt, Artificial Sequence
  CIITA targeting sequence
guuguuucuuagccuaaguc

SEQ ID NO: 32803 - RNA, 20 nt, Artificial Sequence
  CIITA targeting sequence
ucaguuguuucuuagccuaa

SEQ ID NO: 32804 - RNA, 20 nt, Artificial Sequence
  CIITA targeting sequence
uccucaguuguuucuuagcc

SEQ ID NO: 32805 - RNA, 20 nt, Artificial Sequence
  CIITA targeting sequence
ucuuccucaguuguuucuua

SEQ ID NO: 32806 - RNA, 20 nt, Artificial Sequence
  CIITA targeting sequence
auuuccucuuccucaguugu

SEQ ID NO: 32807 - RNA, 20 nt, Artificial Sequence
  CIITA targeting sequence
ugucaauuuccucuuccuca

SEQ ID NO: 32808 - RNA, 20 nt, Artificial Sequence
  CIITA targeting sequence
ucuugucaauuuccucuucc

SEQ ID NO: 32809 - RNA, 20 nt, Artificial Sequence
  CIITA targeting sequence
agucuucuugucaauuuccu

SEQ ID NO: 32810 - RNA, 20 nt, Artificial Sequence
  CIITA targeting sequence
guuuuaagcgccuguccagu

SEQ ID NO: 32811 - RNA, 20 nt, Artificial Sequence
  CIITA targeting sequence
uuaugaaaagacaaagaaag

SEQ ID NO: 32812 - RNA, 20 nt, Artificial Sequence
  CIITA targeting sequence
uaaugaaauuaucuguuuua

SEQ ID NO: 32813 - RNA, 20 nt, Artificial Sequence
  CIITA targeting sequence
uuucauaaugaaauuaucug

SEQ ID NO: 32814 - RNA, 20 nt, Artificial Sequence
  CIITA targeting sequence
uugucuuuucauaaugaaau

SEQ ID NO: 32815 - RNA, 20 nt, Artificial Sequence
  CIITA targeting sequence
uucuuugucuuuucauaaug

SEQ ID NO: 32816 - RNA, 20 nt, Artificial Sequence
  CIITA targeting sequence
caacgggucuuucuuugucu

SEQ ID NO: 32817 - RNA, 20 nt, Artificial Sequence
  CIITA targeting sequence
aacguuuuugcaaaaaugac

SEQ ID NO: 32818 - RNA, 20 nt, Artificial Sequence
  CIITA targeting sequence
uuuuugcaaaaacguuagaa

SEQ ID NO: 32819 - RNA, 20 nt, Artificial Sequence
  CIITA targeting sequence
uuucugugugaucauggccu

SEQ ID NO: 32820 - RNA, 20 nt, Artificial Sequence
  CIITA targeting sequence
gugugaucauggccugaaac

SEQ ID NO: 32821 - RNA, 20 nt, Artificial Sequence
  CIITA targeting sequence
cacagaaaggaagucauuuu

SEQ ID NO: 32822 - RNA, 20 nt, Artificial Sequence
  CIITA targeting sequence
uggccugaaacuugcagaaa

SEQ ID NO: 32823 - RNA, 20 nt, Artificial Sequence
  CIITA targeting sequence
ggccaugaucacacagaaag

SEQ ID NO: 32824 - RNA, 20 nt, Artificial Sequence
  CIITA targeting sequence
gcaaguuucaggccaugauc

SEQ ID NO: 32825 - RNA, 20 nt, Artificial Sequence
  CIITA targeting sequence
uaucauguguuccaacaaau

SEQ ID NO: 32826 - RNA, 20 nt, Artificial Sequence
  CIITA targeting sequence
uguguuccaacaaauuuuuu

SEQ ID NO: 32827 - RNA, 20 nt, Artificial Sequence
  CIITA targeting sequence
aacaaauuuuuuaucagaaa

SEQ ID NO: 32828 - RNA, 20 nt, Artificial Sequence
  CIITA targeting sequence
gaaaauuaugccuaaaagaa

SEQ ID NO: 32829 - RNA, 20 nt, Artificial Sequence
  CIITA targeting sequence
gauaaaaaauuuguuggaac

SEQ ID NO: 32830 - RNA, 20 nt, Artificial Sequence
  CIITA targeting sequence
uuuaggcauaauuuucugau

SEQ ID NO: 32831 - RNA, 20 nt, Artificial Sequence
  CIITA targeting sequence
cuccuggcuucauacucugu

SEQ ID NO: 32832 - RNA, 20 nt, Artificial Sequence
  CIITA targeting sequence
uggcuucauacucuguucau

SEQ ID NO: 32833 - RNA, 20 nt, Artificial Sequence
  CIITA targeting sequence
uacucuguucauucuaaaaa

SEQ ID NO: 32834 - RNA, 20 nt, Artificial Sequence
  CIITA targeting sequence
guucauucuaaaaaugugua

SEQ ID NO: 32835 - RNA, 20 nt, Artificial Sequence
  CIITA targeting sequence
uucuaaaaauguguacaguu

SEQ ID NO: 32836 - RNA, 20 nt, Artificial Sequence
  CIITA targeting sequence
aaaaauguguacaguuuugc

SEQ ID NO: 32837 - RNA, 20 nt, Artificial Sequence
  CIITA targeting sequence
uuagcuaaagacagaauaau

SEQ ID NO: 32838 - RNA, 20 nt, Artificial Sequence
  CIITA targeting sequence
uuagcuaaugaaauuauaau

SEQ ID NO: 32839 - RNA, 20 nt, Artificial Sequence
  CIITA targeting sequence
gucuuuagcuaaugaaauua

SEQ ID NO: 32840 - RNA, 20 nt, Artificial Sequence
  CIITA targeting sequence
acaaauuuuaguuucauuua

SEQ ID NO: 32841 - RNA, 20 nt, Artificial Sequence
  CIITA targeting sequence
uuuaguuucauuuuuaaggu

SEQ ID NO: 32842 - RNA, 20 nt, Artificial Sequence
  CIITA targeting sequence
uuuuuaagguagagucucaa

SEQ ID NO: 32843 - RNA, 20 nt, Artificial Sequence
  CIITA targeting sequence
accuuaaaaaugaaacuaaa

SEQ ID NO: 32844 - RNA, 20 nt, Artificial Sequence
  CIITA targeting sequence
caaucaaauaaucaaauccu

SEQ ID NO: 32845 - RNA, 20 nt, Artificial Sequence
  CIITA targeting sequence
aucaaauaaucaaauccuuu

SEQ ID NO: 32846 - RNA, 20 nt, Artificial Sequence
  CIITA targeting sequence
aauaaucaaauccuuuuucc

SEQ ID NO: 32847 - RNA, 20 nt, Artificial Sequence
  CIITA targeting sequence
aauccuuuuuccccucaaua

SEQ ID NO: 32848 - RNA, 20 nt, Artificial Sequence
  CIITA targeting sequence
uuuuuccccucaauauuuac

SEQ ID NO: 32849 - RNA, 20 nt, Artificial Sequence
  CIITA targeting sequence
ccucaauauuuacuaugaag

SEQ ID NO: 32850 - RNA, 20 nt, Artificial Sequence
  CIITA targeting sequence
auauuuacuaugaaguuuua

SEQ ID NO: 32851 - RNA, 20 nt, Artificial Sequence
  CIITA targeting sequence
uaguaaauauugaggggaaa

SEQ ID NO: 32852 - RNA, 20 nt, Artificial Sequence
  CIITA targeting sequence
cauucugacuagauuugcuu

SEQ ID NO: 32853 - RNA, 20 nt, Artificial Sequence
  CIITA targeting sequence
gacuagauuugcuuuuaccu

SEQ ID NO: 32854 - RNA, 20 nt, Artificial Sequence
  CIITA targeting sequence
gaaugggacuaaaacuucau

SEQ ID NO: 32855 - RNA, 20 nt, Artificial Sequence
  CIITA targeting sequence
agucagaaugggacuaaaac

SEQ ID NO: 32856 - RNA, 20 nt, Artificial Sequence
  CIITA targeting sequence
uucucuggcacuaaugaucc

SEQ ID NO: 32857 - RNA, 20 nt, Artificial Sequence
  CIITA targeting sequence
cuggcacuaaugauccuuga

SEQ ID NO: 32858 - RNA, 20 nt, Artificial Sequence
  CIITA targeting sequence
ggcacuaaugauccuugaag

SEQ ID NO: 32859 - RNA, 20 nt, Artificial Sequence
  CIITA targeting sequence
uuagugccagagaaagacag

SEQ ID NO: 32860 - RNA, 20 nt, Artificial Sequence
  CIITA targeting sequence
uugaagauaaaaaauccccu

SEQ ID NO: 32861 - RNA, 20 nt, Artificial Sequence
  CIITA targeting sequence
aggaucauuagugccagaga

SEQ ID NO: 32862 - RNA, 20 nt, Artificial Sequence
  CIITA targeting sequence
ucaaggaucauuagugccag

SEQ ID NO: 32863 - RNA, 20 nt, Artificial Sequence
  CIITA targeting sequence
ccugccaagguauuauaggg

SEQ ID NO: 32864 - RNA, 20 nt, Artificial Sequence
  CIITA targeting sequence
uuugcccuauaauaccuugg

SEQ ID NO: 32865 - RNA, 20 nt, Artificial Sequence
  CIITA targeting sequence
gcaggaaggugagcgaagcc

SEQ ID NO: 32866 - RNA, 20 nt, Artificial Sequence
  CIITA targeting sequence
ugcagaacugguuauugugu

SEQ ID NO: 32867 - RNA, 20 nt, Artificial Sequence
  CIITA targeting sequence
ccuuccugcagaacugguua

SEQ ID NO: 32868 - RNA, 20 nt, Artificial Sequence
  CIITA targeting sequence
cucaccuuccugcagaacug

SEQ ID NO: 32869 - RNA, 20 nt, Artificial Sequence
  CIITA targeting sequence
acuaaguaacauuugggcug

SEQ ID NO: 32870 - RNA, 20 nt, Artificial Sequence
  CIITA targeting sequence
auacccagcccaaauguuac

SEQ ID NO: 32871 - RNA, 20 nt, Artificial Sequence
  CIITA targeting sequence
uucaauacccagcccaaaug

SEQ ID NO: 32872 - RNA, 20 nt, Artificial Sequence
  CIITA targeting sequence
uacacaucuuucaauaccca

SEQ ID NO: 32873 - RNA, 20 nt, Artificial Sequence
  CIITA targeting sequence
ccaagggaaaaugaaggaga

SEQ ID NO: 32874 - RNA, 20 nt, Artificial Sequence
  CIITA targeting sequence
cuuggugaacuccuacacau

SEQ ID NO: 32875 - RNA, 20 nt, Artificial Sequence
  CIITA targeting sequence
uuuucccuuggugaacuccu

SEQ ID NO: 32876 - RNA, 20 nt, Artificial Sequence
  CIITA targeting sequence
uucauuuucccuuggugaac

SEQ ID NO: 32877 - RNA, 20 nt, Artificial Sequence
  CIITA targeting sequence
ccuucauuuucccuugguga

SEQ ID NO: 32878 - RNA, 20 nt, Artificial Sequence
  CIITA targeting sequence
gugcaguuagagaauagugu

SEQ ID NO: 32879 - RNA, 20 nt, Artificial Sequence
  CIITA targeting sequence
aacugcacagauuucuccuu

SEQ ID NO: 32880 - RNA, 20 nt, Artificial Sequence
  CIITA targeting sequence
cuaacugcacagauuucucc

SEQ ID NO: 32881 - RNA, 20 nt, Artificial Sequence
  CIITA targeting sequence
gagucugagaaggacaggag

SEQ ID NO: 32882 - RNA, 20 nt, Artificial Sequence
  CIITA targeting sequence
gacacacuauucucuaacug

SEQ ID NO: 32883 - RNA, 20 nt, Artificial Sequence
  CIITA targeting sequence
gagaaggacaggagaacaug

SEQ ID NO: 32884 - RNA, 20 nt, Artificial Sequence
  CIITA targeting sequence
gacucugacacacuauucuc

SEQ ID NO: 32885 - RNA, 20 nt, Artificial Sequence
  CIITA targeting sequence
cagacucugacacacuauuc

SEQ ID NO: 32886 - RNA, 20 nt, Artificial Sequence
  CIITA targeting sequence
uucucagacucugacacacu

SEQ ID NO: 32887 - RNA, 20 nt, Artificial Sequence
  CIITA targeting sequence
uguccuucucagacucugac

SEQ ID NO: 32888 - RNA, 20 nt, Artificial Sequence
  CIITA targeting sequence
ccuguccuucucagacucug

SEQ ID NO: 32889 - RNA, 20 nt, Artificial Sequence
  CIITA targeting sequence
uuucugaugucauguuuggg

SEQ ID NO: 32890 - RNA, 20 nt, Artificial Sequence
  CIITA targeting sequence
gaugucauguuugggcugug

SEQ ID NO: 32891 - RNA, 20 nt, Artificial Sequence
  CIITA targeting sequence
gaaaggaagccauguucucc

SEQ ID NO: 32892 - RNA, 20 nt, Artificial Sequence
  CIITA targeting sequence
uguuugggcuguggugaggu

SEQ ID NO: 32893 - RNA, 20 nt, Artificial Sequence
  CIITA targeting sequence
ccacagcccaaacaugacau

SEQ ID NO: 32894 - RNA, 20 nt, Artificial Sequence
  CIITA targeting sequence
gccugcaaccucaccacagc

SEQ ID NO: 32895 - RNA, 20 nt, Artificial Sequence
  CIITA targeting sequence
cucugccugcaaccucacca

SEQ ID NO: 32896 - RNA, 20 nt, Artificial Sequence
  CIITA targeting sequence
auucacucugccugcaaccu

SEQ ID NO: 32897 - RNA, 20 nt, Artificial Sequence
  CIITA targeting sequence
uucuauucacucugccugca

SEQ ID NO: 32898 - RNA, 20 nt, Artificial Sequence
  CIITA targeting sequence
uacuucauucuauucacucu

SEQ ID NO: 32899 - RNA, 20 nt, Artificial Sequence
  CIITA targeting sequence
ugugauaggggaugagccug

SEQ ID NO: 32900 - RNA, 20 nt, Artificial Sequence
  CIITA targeting sequence
caggaaauuguuccuacuuc

SEQ ID NO: 32901 - RNA, 20 nt, Artificial Sequence
  CIITA targeting sequence
ccuaucacaggaaauuguuc

SEQ ID NO: 32902 - RNA, 20 nt, Artificial Sequence
  CIITA targeting sequence
uccccuaucacaggaaauug

SEQ ID NO: 32903 - RNA, 20 nt, Artificial Sequence
  CIITA targeting sequence
cccacacaggcucauccccu

SEQ ID NO: 32904 - RNA, 20 nt, Artificial Sequence
  CIITA targeting sequence
uuucacccacacaggcucau

SEQ ID NO: 32905 - RNA, 20 nt, Artificial Sequence
  CIITA targeting sequence
ugaagagcugacgcuucauc

SEQ ID NO: 32906 - RNA, 20 nt, Artificial Sequence
  CIITA targeting sequence
ggacggcucuuuucacccac

SEQ ID NO: 32907 - RNA, 20 nt, Artificial Sequence
  CIITA targeting sequence
ucaggacggcucuuuucacc

SEQ ID NO: 32908 - RNA, 20 nt, Artificial Sequence
  CIITA targeting sequence
gcucuucaggacggcucuuu

SEQ ID NO: 32909 - RNA, 20 nt, Artificial Sequence
  CIITA targeting sequence
uccaaggcagugggaagcgu

SEQ ID NO: 32910 - RNA, 20 nt, Artificial Sequence
  CIITA targeting sequence
aaggcagugggaagcguugc

SEQ ID NO: 32911 - RNA, 20 nt, Artificial Sequence
  CIITA targeting sequence
cacugccuuggaugaagcgu

SEQ ID NO: 32912 - RNA, 20 nt, Artificial Sequence
  CIITA targeting sequence
agcaacgcuucccacugccu

SEQ ID NO: 32913 - RNA, 20 nt, Artificial Sequence
  CIITA targeting sequence
caaaacccuccagcaacgcu

SEQ ID NO: 32914 - RNA, 20 nt, Artificial Sequence
  CIITA targeting sequence
uuaucgcaaaacccuccagc

SEQ ID NO: 32915 - RNA, 20 nt, Artificial Sequence
  CIITA targeting sequence
cuccuuaucgcaaaacccuc

SEQ ID NO: 32916 - RNA, 20 nt, Artificial Sequence
  CIITA targeting sequence
ugucccuccuuaucgcaaaa

SEQ ID NO: 32917 - RNA, 20 nt, Artificial Sequence
  CIITA targeting sequence
aaacugcaccacuggucaug

SEQ ID NO: 32918 - RNA, 20 nt, Artificial Sequence
  CIITA targeting sequence
uucuaaacugcaccacuggu

SEQ ID NO: 32919 - RNA, 20 nt, Artificial Sequence
  CIITA targeting sequence
cuguagcugccacggaggau

SEQ ID NO: 32920 - RNA, 20 nt, Artificial Sequence
  CIITA targeting sequence
guggcagcuacagggaucuu

SEQ ID NO: 32921 - RNA, 20 nt, Artificial Sequence
  CIITA targeting sequence
uccguggcagcuacagggau

SEQ ID NO: 32922 - RNA, 20 nt, Artificial Sequence
  CIITA targeting sequence
uccuccguggcagcuacagg

SEQ ID NO: 32923 - RNA, 20 nt, Artificial Sequence
  CIITA targeting sequence
ccgucauccuccguggcagc

SEQ ID NO: 32924 - RNA, 20 nt, Artificial Sequence
  CIITA targeting sequence
ugccuucaccgucauccucc

SEQ ID NO: 32925 - RNA, 20 nt, Artificial Sequence
  CIITA targeting sequence
aauaauaguaauaguaauag

SEQ ID NO: 32926 - RNA, 20 nt, Artificial Sequence
  CIITA targeting sequence
caaauaauaguaauaguaau

SEQ ID NO: 32927 - RNA, 20 nt, Artificial Sequence
  CIITA targeting sequence
gucucaaauaauaguaauag

SEQ ID NO: 32928 - RNA, 20 nt, Artificial Sequence
  CIITA targeting sequence
ugcucugucacccaggcugg

SEQ ID NO: 32929 - RNA, 20 nt, Artificial Sequence
  CIITA targeting sequence
gucacccaggcuggagugca

SEQ ID NO: 32930 - RNA, 20 nt, Artificial Sequence
  CIITA targeting sequence
cccaggcuggagugcagugg

SEQ ID NO: 32931 - RNA, 20 nt, Artificial Sequence
  CIITA targeting sequence
agccugggugacagagcaag

SEQ ID NO: 32932 - RNA, 20 nt, Artificial Sequence
  CIITA targeting sequence
caccacugcacuccagccug

SEQ ID NO: 32933 - RNA, 20 nt, Artificial Sequence
  CIITA targeting sequence
uggcucacugcaaccuccac

SEQ ID NO: 32934 - RNA, 20 nt, Artificial Sequence
  CIITA targeting sequence
cugcaaccuccaccucccag

SEQ ID NO: 32935 - RNA, 20 nt, Artificial Sequence
  CIITA targeting sequence
accucccagguucaagcaau

SEQ ID NO: 32936 - RNA, 20 nt, Artificial Sequence
  CIITA targeting sequence
cagguucaagcaauucuugu

SEQ ID NO: 32937 - RNA, 20 nt, Artificial Sequence
  CIITA targeting sequence
agcaauucuuguaccucagc

SEQ ID NO: 32938 - RNA, 20 nt, Artificial Sequence
  CIITA targeting sequence
uguaccucagccuucugagu

SEQ ID NO: 32939 - RNA, 20 nt, Artificial Sequence
  CIITA targeting sequence
gccuucugaguagcugggac

SEQ ID NO: 32940 - RNA, 20 nt, Artificial Sequence
  CIITA targeting sequence
gaguagcugggacuacaggc

SEQ ID NO: 32941 - RNA, 20 nt, Artificial Sequence
  CIITA targeting sequence
gaaggcugagguacaagaau

SEQ ID NO: 32942 - RNA, 20 nt, Artificial Sequence
  CIITA targeting sequence
cagcuacucagaaggcugag

SEQ ID NO: 32943 - RNA, 20 nt, Artificial Sequence
  CIITA targeting sequence
uguauuuucaguagagacag

SEQ ID NO: 32944 - RNA, 20 nt, Artificial Sequence
  CIITA targeting sequence
guagagacaggguuucgcca

SEQ ID NO: 32945 - RNA, 20 nt, Artificial Sequence
  CIITA targeting sequence
acugaaaauacaagaauuag

SEQ ID NO: 32946 - RNA, 20 nt, Artificial Sequence
  CIITA targeting sequence
cuacugaaaauacaagaauu

SEQ ID NO: 32947 - RNA, 20 nt, Artificial Sequence
  CIITA targeting sequence
ccauguuggccaggcugguc

SEQ ID NO: 32948 - RNA, 20 nt, Artificial Sequence
  CIITA targeting sequence
cgaacuccugaccucaagug

SEQ ID NO: 32949 - RNA, 20 nt, Artificial Sequence
  CIITA targeting sequence
aacuccugaccucaagugau

SEQ ID NO: 32950 - RNA, 20 nt, Artificial Sequence
  CIITA targeting sequence
agaccagccuggccaacaug

SEQ ID NO: 32951 - RNA, 20 nt, Artificial Sequence
  CIITA targeting sequence
ugaccucaagugauccgccc

SEQ ID NO: 32952 - RNA, 20 nt, Artificial Sequence
  CIITA targeting sequence
ggaguucgagaccagccugg

SEQ ID NO: 32953 - RNA, 20 nt, Artificial Sequence
  CIITA targeting sequence
agugauccgcccaccuuggc

SEQ ID NO: 32954 - RNA, 20 nt, Artificial Sequence
  CIITA targeting sequence
cuugaggucaggaguucgag

SEQ ID NO: 32955 - RNA, 20 nt, Artificial Sequence
  CIITA targeting sequence
gcccaccuuggccucccaaa

SEQ ID NO: 32956 - RNA, 20 nt, Artificial Sequence
  CIITA targeting sequence
caaagugcugggauuacagg

SEQ ID NO: 32957 - RNA, 20 nt, Artificial Sequence
  CIITA targeting sequence
cagcacuuugggaggccaag

SEQ ID NO: 32958 - RNA, 20 nt, Artificial Sequence
  CIITA targeting sequence
caccuguaaucccagcacuu

SEQ ID NO: 32959 - RNA, 20 nt, Artificial Sequence
  CIITA targeting sequence
agaguggugguuacgauaga

SEQ ID NO: 32960 - RNA, 20 nt, Artificial Sequence
  CIITA targeting sequence
ugaaaguuuggcugggcaug

SEQ ID NO: 32961 - RNA, 20 nt, Artificial Sequence
  CIITA targeting sequence
uaaccaccacucuugaaagu

SEQ ID NO: 32962 - RNA, 20 nt, Artificial Sequence
  CIITA targeting sequence
aucguaaccaccacucuuga

SEQ ID NO: 32963 - RNA, 20 nt, Artificial Sequence
  CIITA targeting sequence
cuaucguaaccaccacucuu

SEQ ID NO: 32964 - RNA, 20 nt, Artificial Sequence
  CIITA targeting sequence
agaugagaccacugugugga

SEQ ID NO: 32965 - RNA, 20 nt, Artificial Sequence
  CIITA targeting sequence
agagucucuaucguaaccac

SEQ ID NO: 32966 - RNA, 20 nt, Artificial Sequence
  CIITA targeting sequence
ucuagagucucuaucguaac

SEQ ID NO: 32967 - RNA, 20 nt, Artificial Sequence
  CIITA targeting sequence
caucuagagucucuaucgua

SEQ ID NO: 32968 - RNA, 20 nt, Artificial Sequence
  CIITA targeting sequence
acacaguggucucaucuaga

SEQ ID NO: 32969 - RNA, 20 nt, Artificial Sequence
  CIITA targeting sequence
ggcuccaccacugacuagcc

SEQ ID NO: 32970 - RNA, 20 nt, Artificial Sequence
  CIITA targeting sequence
accacugacuagccugggac

SEQ ID NO: 32971 - RNA, 20 nt, Artificial Sequence
  CIITA targeting sequence
gugguggagccugacuccac

SEQ ID NO: 32972 - RNA, 20 nt, Artificial Sequence
  CIITA targeting sequence
caggcuagucagugguggag

SEQ ID NO: 32973 - RNA, 20 nt, Artificial Sequence
  CIITA targeting sequence
cuuaagcuugaugagccuca

SEQ ID NO: 32974 - RNA, 20 nt, Artificial Sequence
  CIITA targeting sequence
agcuuaagugagggucccag

SEQ ID NO: 32975 - RNA, 20 nt, Artificial Sequence
  CIITA targeting sequence
ucaagcuuaagugagggucc

SEQ ID NO: 32976 - RNA, 20 nt, Artificial Sequence
  CIITA targeting sequence
gcuucuucaucuguaaaaug

SEQ ID NO: 32977 - RNA, 20 nt, Artificial Sequence
  CIITA targeting sequence
ucaucuguaaaaugggaaug

SEQ ID NO: 32978 - RNA, 20 nt, Artificial Sequence
  CIITA targeting sequence
ucuguaaaaugggaaugaug

SEQ ID NO: 32979 - RNA, 20 nt, Artificial Sequence
  CIITA targeting sequence
guaaaaugggaaugaugauu

SEQ ID NO: 32980 - RNA, 20 nt, Artificial Sequence
  CIITA targeting sequence
cauuuuacagaugaagaagc

SEQ ID NO: 32981 - RNA, 20 nt, Artificial Sequence
  CIITA targeting sequence
uucccauuuuacagaugaag

SEQ ID NO: 32982 - RNA, 20 nt, Artificial Sequence
  CIITA targeting sequence
ucauucccauuuuacagaug

SEQ ID NO: 32983 - RNA, 20 nt, Artificial Sequence
  CIITA targeting sequence
uaugugguagguacaaucau

SEQ ID NO: 32984 - RNA, 20 nt, Artificial Sequence
  CIITA targeting sequence
cagcaauccuaugugguagg

SEQ ID NO: 32985 - RNA, 20 nt, Artificial Sequence
  CIITA targeting sequence
ucccagcaauccuauguggu

SEQ ID NO: 32986 - RNA, 20 nt, Artificial Sequence
  CIITA targeting sequence
caguuaguccucccagcaau

SEQ ID NO: 32987 - RNA, 20 nt, Artificial Sequence
  CIITA targeting sequence
ugugcuuagaccauguaggg

SEQ ID NO: 32988 - RNA, 20 nt, Artificial Sequence
  CIITA targeting sequence
aagcacaugacuucacaguu

SEQ ID NO: 32989 - RNA, 20 nt, Artificial Sequence
  CIITA targeting sequence
cuacauggucuaagcacaug

SEQ ID NO: 32990 - RNA, 20 nt, Artificial Sequence
  CIITA targeting sequence
gaugagaagugacgaagaga

SEQ ID NO: 32991 - RNA, 20 nt, Artificial Sequence
  CIITA targeting sequence
gaaccuggcucccuacaugg

SEQ ID NO: 32992 - RNA, 20 nt, Artificial Sequence
  CIITA targeting sequence
ucugaaccuggcucccuaca

SEQ ID NO: 32993 - RNA, 20 nt, Artificial Sequence
  CIITA targeting sequence
caucugaaccuggcucccua

SEQ ID NO: 32994 - RNA, 20 nt, Artificial Sequence
  CIITA targeting sequence
cuucucaucugaaccuggcu

SEQ ID NO: 32995 - RNA, 20 nt, Artificial Sequence
  CIITA targeting sequence
ucacuucucaucugaaccug

SEQ ID NO: 32996 - RNA, 20 nt, Artificial Sequence
  CIITA targeting sequence
ucgucacuucucaucugaac

SEQ ID NO: 32997 - RNA, 20 nt, Artificial Sequence
  CIITA targeting sequence
cuucgucacuucucaucuga

SEQ ID NO: 32998 - RNA, 20 nt, Artificial Sequence
  CIITA targeting sequence
guaauuuaaauucucuucgu

SEQ ID NO: 32999 - RNA, 20 nt, Artificial Sequence
  CIITA targeting sequence
ucuguaauuuaaauucucuu

SEQ ID NO: 33000 - RNA, 20 nt, Artificial Sequence
  CIITA targeting sequence
ugccuguaaucccagcacuu

SEQ ID NO: 33001 - RNA, 20 nt, Artificial Sequence
  CIITA targeting sequence
cagcacuuugggaggccgaa

SEQ ID NO: 33002 - RNA, 20 nt, Artificial Sequence
  CIITA targeting sequence
caaagugcugggauuacagg

SEQ ID NO: 33003 - RNA, 20 nt, Artificial Sequence
  CIITA targeting sequence
gccucccaaagugcugggau

SEQ ID NO: 33004 - RNA, 20 nt, Artificial Sequence
  CIITA targeting sequence
gcccccuucggccucccaaa

SEQ ID NO: 33005 - RNA, 20 nt, Artificial Sequence
  CIITA targeting sequence
ccugaggucaggaguuccag

SEQ ID NO: 33006 - RNA, 20 nt, Artificial Sequence
  CIITA targeting sequence
ggugaucugcccccuucggc

SEQ ID NO: 33007 - RNA, 20 nt, Artificial Sequence
  CIITA targeting sequence
ggaguuccagaccagccugg

SEQ ID NO: 33008 - RNA, 20 nt, Artificial Sequence
  CIITA targeting sequence
ugaccucaggugaucugccc

SEQ ID NO: 33009 - RNA, 20 nt, Artificial Sequence
  CIITA targeting sequence
agaccagccuggacaacacg

SEQ ID NO: 33010 - RNA, 20 nt, Artificial Sequence
  CIITA targeting sequence
ggaacuccugaccucaggug

SEQ ID NO: 33011 - RNA, 20 nt, Artificial Sequence
  CIITA targeting sequence
aggcuggucuggaacuccug

SEQ ID NO: 33012 - RNA, 20 nt, Artificial Sequence
  CIITA targeting sequence
uguuguccaggcuggucugg

SEQ ID NO: 33013 - RNA, 20 nt, Artificial Sequence
  CIITA targeting sequence
ucguguuguccaggcugguc

SEQ ID NO: 33014 - RNA, 20 nt, Artificial Sequence
  CIITA targeting sequence
cuacuaaaaauacaaaaauu

SEQ ID NO: 33015 - RNA, 20 nt, Artificial Sequence
  CIITA targeting sequence
acuaaaaauacaaaaauugg

SEQ ID NO: 33016 - RNA, 20 nt, Artificial Sequence
  CIITA targeting sequence
cgccuguaaucccagcacuu

SEQ ID NO: 33017 - RNA, 20 nt, Artificial Sequence
  CIITA targeting sequence
cagcacuuugggaggccgag

SEQ ID NO: 33018 - RNA, 20 nt, Artificial Sequence
  CIITA targeting sequence
caaagugcugggauuacagg

SEQ ID NO: 33019 - RNA, 20 nt, Artificial Sequence
  CIITA targeting sequence
gccucccaaagugcugggau

SEQ ID NO: 33020 - RNA, 20 nt, Artificial Sequence
  CIITA targeting sequence
gcccgccucggccucccaaa

SEQ ID NO: 33021 - RNA, 20 nt, Artificial Sequence
  CIITA targeting sequence
cgaagucaggagaucgagac

SEQ ID NO: 33022 - RNA, 20 nt, Artificial Sequence
  CIITA targeting sequence
ugauccgcccgccucggccu

SEQ ID NO: 33023 - RNA, 20 nt, Artificial Sequence
  CIITA targeting sequence
ggagaucgagaccauccugg

SEQ ID NO: 33024 - RNA, 20 nt, Artificial Sequence
  CIITA targeting sequence
ugacuucgugauccgcccgc

SEQ ID NO: 33025 - RNA, 20 nt, Artificial Sequence
  CIITA targeting sequence
ccugacuucgugauccgccc

SEQ ID NO: 33026 - RNA, 20 nt, Artificial Sequence
  CIITA targeting sequence
agaccauccuggcuaacaca

SEQ ID NO: 33027 - RNA, 20 nt, Artificial Sequence
  CIITA targeting sequence
aucuccugacuucgugaucc

SEQ ID NO: 33028 - RNA, 20 nt, Artificial Sequence
  CIITA targeting sequence
cgaucuccugacuucgugau

SEQ ID NO: 33029 - RNA, 20 nt, Artificial Sequence
  CIITA targeting sequence
uggcuaacacagugaaaccc

SEQ ID NO: 33030 - RNA, 20 nt, Artificial Sequence
  CIITA targeting sequence
cuguguuagccaggaugguc

SEQ ID NO: 33031 - RNA, 20 nt, Artificial Sequence
  CIITA targeting sequence
cuacuaaaaaauacaaaaca

SEQ ID NO: 33032 - RNA, 20 nt, Artificial Sequence
  CIITA targeting sequence
acuaaaaaauacaaaacaau

SEQ ID NO: 33033 - RNA, 20 nt, Artificial Sequence
  CIITA targeting sequence
uuguuuuguauuuuuuagua

SEQ ID NO: 33034 - RNA, 20 nt, Artificial Sequence
  CIITA targeting sequence
cagcuacucgggaggcugag

SEQ ID NO: 33035 - RNA, 20 nt, Artificial Sequence
  CIITA targeting sequence
ggaggcugaggcaggagaau

SEQ ID NO: 33036 - RNA, 20 nt, Artificial Sequence
  CIITA targeting sequence
cgaguagcugggacuacagg

SEQ ID NO: 33037 - RNA, 20 nt, Artificial Sequence
  CIITA targeting sequence
gccucccgaguagcugggac

SEQ ID NO: 33038 - RNA, 20 nt, Artificial Sequence
  CIITA targeting sequence
ugccucagccucccgaguag

SEQ ID NO: 33039 - RNA, 20 nt, Artificial Sequence
  CIITA targeting sequence
ccugccucagccucccgagu

SEQ ID NO: 33040 - RNA, 20 nt, Artificial Sequence
  CIITA targeting sequence
cgccauucuccugccucagc

SEQ ID NO: 33041 - RNA, 20 nt, Artificial Sequence
  CIITA targeting sequence
cggguucacgccauucuccu

SEQ ID NO: 33042 - RNA, 20 nt, Artificial Sequence
  CIITA targeting sequence
gccucccggguucacgccau

SEQ ID NO: 33043 - RNA, 20 nt, Artificial Sequence
  CIITA targeting sequence
cugcaaccuccgccucccgg

SEQ ID NO: 33044 - RNA, 20 nt, Artificial Sequence
  CIITA targeting sequence
gcucacugcaaccuccgccu

SEQ ID NO: 33045 - RNA, 20 nt, Artificial Sequence
  CIITA targeting sequence
cggcucacugcaaccuccgc

SEQ ID NO: 33046 - RNA, 20 nt, Artificial Sequence
  CIITA targeting sequence
caccacugcacuccagccca

SEQ ID NO: 33047 - RNA, 20 nt, Artificial Sequence
  CIITA targeting sequence
agcccaggugacagagcaag

SEQ ID NO: 33048 - RNA, 20 nt, Artificial Sequence
  CIITA targeting sequence
ccugggcuggagugcagugg

SEQ ID NO: 33049 - RNA, 20 nt, Artificial Sequence
  CIITA targeting sequence
gucaccugggcuggagugca

SEQ ID NO: 33050 - RNA, 20 nt, Artificial Sequence
  CIITA targeting sequence
ugcucugucaccugggcugg

SEQ ID NO: 33051 - RNA, 20 nt, Artificial Sequence
  CIITA targeting sequence
gucucaaaaaaaaaaaaaaa

SEQ ID NO: 33052 - RNA, 20 nt, Artificial Sequence
  CIITA targeting sequence
caaaaaaaaaaaaaaaaauu

SEQ ID NO: 33053 - RNA, 20 nt, Artificial Sequence
  CIITA targeting sequence
aaaaaaaaaaaaaaaauuag

SEQ ID NO: 33054 - RNA, 20 nt, Artificial Sequence
  CIITA targeting sequence
cagcuucuugggaggccgag

SEQ ID NO: 33055 - RNA, 20 nt, Artificial Sequence
  CIITA targeting sequence
ugggaggccgaggcaggaga

SEQ ID NO: 33056 - RNA, 20 nt, Artificial Sequence
  CIITA targeting sequence
caagaagcugggauuacagg

SEQ ID NO: 33057 - RNA, 20 nt, Artificial Sequence
  CIITA targeting sequence
gccucccaagaagcugggau

SEQ ID NO: 33058 - RNA, 20 nt, Artificial Sequence
  CIITA targeting sequence
ugccucggccucccaagaag

SEQ ID NO: 33059 - RNA, 20 nt, Artificial Sequence
  CIITA targeting sequence
ccugccucggccucccaaga

SEQ ID NO: 33060 - RNA, 20 nt, Artificial Sequence
  CIITA targeting sequence
cuugaaugcaggagacagag

SEQ ID NO: 33061 - RNA, 20 nt, Artificial Sequence
  CIITA targeting sequence
ugaaugcaggagacagaggc

SEQ ID NO: 33062 - RNA, 20 nt, Artificial Sequence
  CIITA targeting sequence
agagauucuccugccucggc

SEQ ID NO: 33063 - RNA, 20 nt, Artificial Sequence
  CIITA targeting sequence
ugcauucaagagauucuccu

SEQ ID NO: 33064 - RNA, 20 nt, Artificial Sequence
  CIITA targeting sequence
ccugcauucaagagauucuc

SEQ ID NO: 33065 - RNA, 20 nt, Artificial Sequence
  CIITA targeting sequence
gucuccugcauucaagagau

SEQ ID NO: 33066 - RNA, 20 nt, Artificial Sequence
  CIITA targeting sequence
cugcagccucugucuccugc

SEQ ID NO: 33067 - RNA, 20 nt, Artificial Sequence
  CIITA targeting sequence
gcucacugcagccucugucu

SEQ ID NO: 33068 - RNA, 20 nt, Artificial Sequence
  CIITA targeting sequence
agcuugggcaacagagugag

SEQ ID NO: 33069 - RNA, 20 nt, Artificial Sequence
  CIITA targeting sequence
guugcccaagcuggagugca

SEQ ID NO: 33070 - RNA, 20 nt, Artificial Sequence
  CIITA targeting sequence
cucuguugcccaagcuggag

SEQ ID NO: 33071 - RNA, 20 nt, Artificial Sequence
  CIITA targeting sequence
cacucuguugcccaagcugg

SEQ ID NO: 33072 - RNA, 20 nt, Artificial Sequence
  CIITA targeting sequence
ucucaaacaaaacaaaacaa

SEQ ID NO: 33073 - RNA, 20 nt, Artificial Sequence
  CIITA targeting sequence
caaacaaaacaaaacaaaac

SEQ ID NO: 33074 - RNA, 20 nt, Artificial Sequence
  CIITA targeting sequence
aacaaaacaaaacaaaacaa

SEQ ID NO: 33075 - RNA, 20 nt, Artificial Sequence
  CIITA targeting sequence
guaauuuuuguuuuguuuug

SEQ ID NO: 33076 - RNA, 20 nt, Artificial Sequence
  CIITA targeting sequence
ucuguaauuuuuguuuuguu

SEQ ID NO: 33077 - RNA, 20 nt, Artificial Sequence
  CIITA targeting sequence
cccagccuuaauuaucaucu

SEQ ID NO: 33078 - RNA, 20 nt, Artificial Sequence
  CIITA targeting sequence
ucacccagccuuaauuauca

SEQ ID NO: 33079 - RNA, 20 nt, Artificial Sequence
  CIITA targeting sequence
uccucacccagccuuaauua

SEQ ID NO: 33080 - RNA, 20 nt, Artificial Sequence
  CIITA targeting sequence
uucauccucacccagccuua

SEQ ID NO: 33081 - RNA, 20 nt, Artificial Sequence
  CIITA targeting sequence
auccuucauccucacccagc

SEQ ID NO: 33082 - RNA, 20 nt, Artificial Sequence
  CIITA targeting sequence
ccuccauccuucauccucac

SEQ ID NO: 33083 - RNA, 20 nt, Artificial Sequence
  CIITA targeting sequence
uguucaccuccauccuucau

SEQ ID NO: 33084 - RNA, 20 nt, Artificial Sequence
  CIITA targeting sequence
cuuguucaccuccauccuuc

SEQ ID NO: 33085 - RNA, 20 nt, Artificial Sequence
  CIITA targeting sequence
agaaaucccaagaacacauc

SEQ ID NO: 33086 - RNA, 20 nt, Artificial Sequence
  CIITA targeting sequence
ggagucucuuguucaccucc

SEQ ID NO: 33087 - RNA, 20 nt, Artificial Sequence
  CIITA targeting sequence
caagaacacaucaccgagug

SEQ ID NO: 33088 - RNA, 20 nt, Artificial Sequence
  CIITA targeting sequence
ugggauuucuggagucucuu

SEQ ID NO: 33089 - RNA, 20 nt, Artificial Sequence
  CIITA targeting sequence
ccgagugaccugggaacaga

SEQ ID NO: 33090 - RNA, 20 nt, Artificial Sequence
  CIITA targeting sequence
gugauguguucuugggauuu

SEQ ID NO: 33091 - RNA, 20 nt, Artificial Sequence
  CIITA targeting sequence
cucggugauguguucuuggg

SEQ ID NO: 33092 - RNA, 20 nt, Artificial Sequence
  CIITA targeting sequence
caggucacucggugaugugu

SEQ ID NO: 33093 - RNA, 20 nt, Artificial Sequence
  CIITA targeting sequence
guucccaggucacucgguga

SEQ ID NO: 33094 - RNA, 20 nt, Artificial Sequence
  CIITA targeting sequence
cacaccaugcaaucuguucc

SEQ ID NO: 33095 - RNA, 20 nt, Artificial Sequence
  CIITA targeting sequence
ugguaaagguggaagaugau

SEQ ID NO: 33096 - RNA, 20 nt, Artificial Sequence
  CIITA targeting sequence
accuuuaccaugaccuccca

SEQ ID NO: 33097 - RNA, 20 nt, Artificial Sequence
  CIITA targeting sequence
uccaccuuuaccaugaccuc

SEQ ID NO: 33098 - RNA, 20 nt, Artificial Sequence
  CIITA targeting sequence
ucuuccaccuuuaccaugac

SEQ ID NO: 33099 - RNA, 20 nt, Artificial Sequence
  CIITA targeting sequence
gggucucccgccuggcuguc

SEQ ID NO: 33100 - RNA, 20 nt, Artificial Sequence
  CIITA targeting sequence
cccgccuggcugucccggga

SEQ ID NO: 33101 - RNA, 20 nt, Artificial Sequence
  CIITA targeting sequence
cgccuggcugucccgggagc

SEQ ID NO: 33102 - RNA, 20 nt, Artificial Sequence
  CIITA targeting sequence
cgggagcgggcgggaaggaa

SEQ ID NO: 33103 - RNA, 20 nt, Artificial Sequence
  CIITA targeting sequence
cgggacagccaggcgggaga

SEQ ID NO: 33104 - RNA, 20 nt, Artificial Sequence
  CIITA targeting sequence
cgcccgcucccgggacagcc

SEQ ID NO: 33105 - RNA, 20 nt, Artificial Sequence
  CIITA targeting sequence
uucccgcccgcucccgggac

SEQ ID NO: 33106 - RNA, 20 nt, Artificial Sequence
  CIITA targeting sequence
uucacugacucagggaacaa

SEQ ID NO: 33107 - RNA, 20 nt, Artificial Sequence
  CIITA targeting sequence
cugacucagggaacaaaggc

SEQ ID NO: 33108 - RNA, 20 nt, Artificial Sequence
  CIITA targeting sequence
gugaaugauauuccuucccg

SEQ ID NO: 33109 - RNA, 20 nt, Artificial Sequence
  CIITA targeting sequence
gggaacaaaggcagaugagc

SEQ ID NO: 33110 - RNA, 20 nt, Artificial Sequence
  CIITA targeting sequence
cugagucagugaaugauauu

SEQ ID NO: 33111 - RNA, 20 nt, Artificial Sequence
  CIITA targeting sequence
gccuuuguucccugagucag

SEQ ID NO: 33112 - RNA, 20 nt, Artificial Sequence
  CIITA targeting sequence
ucugccuuuguucccugagu

SEQ ID NO: 33113 - RNA, 20 nt, Artificial Sequence
  CIITA targeting sequence
ugaguucagagccaguggau

SEQ ID NO: 33114 - RNA, 20 nt, Artificial Sequence
  CIITA targeting sequence
agaccugcucaucugccuuu

SEQ ID NO: 33115 - RNA, 20 nt, Artificial Sequence
  CIITA targeting sequence
gagccaguggauuuguuuug

SEQ ID NO: 33116 - RNA, 20 nt, Artificial Sequence
  CIITA targeting sequence
gaacucaagaccugcucauc

SEQ ID NO: 33117 - RNA, 20 nt, Artificial Sequence
  CIITA targeting sequence
acuggcucugaacucaagac

SEQ ID NO: 33118 - RNA, 20 nt, Artificial Sequence
  CIITA targeting sequence
aaaacaaauccacuggcucu

SEQ ID NO: 33119 - RNA, 20 nt, Artificial Sequence
  CIITA targeting sequence
acacaugcuccaaaacaaau

SEQ ID NO: 33120 - RNA, 20 nt, Artificial Sequence
  CIITA targeting sequence
uucuacacaugcuccaaaac

SEQ ID NO: 33121 - RNA, 20 nt, Artificial Sequence
  CIITA targeting sequence
guccuucuacacaugcucca

SEQ ID NO: 33122 - RNA, 20 nt, Artificial Sequence
  CIITA targeting sequence
ccacaucauaguuaauucgc

SEQ ID NO: 33123 - RNA, 20 nt, Artificial Sequence
  CIITA targeting sequence
uaguuaauucgcuuuaucuu

SEQ ID NO: 33124 - RNA, 20 nt, Artificial Sequence
  CIITA targeting sequence
cuuuaucuuuacgugagaag

SEQ ID NO: 33125 - RNA, 20 nt, Artificial Sequence
  CIITA targeting sequence
uuacgugagaaguguuucuu

SEQ ID NO: 33126 - RNA, 20 nt, Artificial Sequence
  CIITA targeting sequence
cguaaagauaaagcgaauua

SEQ ID NO: 33127 - RNA, 20 nt, Artificial Sequence
  CIITA targeting sequence
cacguaaagauaaagcgaau

SEQ ID NO: 33128 - RNA, 20 nt, Artificial Sequence
  CIITA targeting sequence
uuuuugagaugaguuucacu

SEQ ID NO: 33129 - RNA, 20 nt, Artificial Sequence
  CIITA targeting sequence
aaaaagaaacacuucucacg

SEQ ID NO: 33130 - RNA, 20 nt, Artificial Sequence
  CIITA targeting sequence
caaaaaagaaacacuucuca

SEQ ID NO: 33131 - RNA, 20 nt, Artificial Sequence
  CIITA targeting sequence
ucucaaaaaagaaacacuuc

SEQ ID NO: 33132 - RNA, 20 nt, Artificial Sequence
  CIITA targeting sequence
cucuguuacccaggcuagag

SEQ ID NO: 33133 - RNA, 20 nt, Artificial Sequence
  CIITA targeting sequence
guuacccaggcuagagugca

SEQ ID NO: 33134 - RNA, 20 nt, Artificial Sequence
  CIITA targeting sequence
agccuggguaacagagugaa

SEQ ID NO: 33135 - RNA, 20 nt, Artificial Sequence
  CIITA targeting sequence
cugcucacugcaaccuccac

SEQ ID NO: 33136 - RNA, 20 nt, Artificial Sequence
  CIITA targeting sequence
gcucacugcaaccuccacuu

SEQ ID NO: 33137 - RNA, 20 nt, Artificial Sequence
  CIITA targeting sequence
cugcaaccuccacuucccag

SEQ ID NO: 33138 - RNA, 20 nt, Artificial Sequence
  CIITA targeting sequence
acuucccagguuaaagcgau

SEQ ID NO: 33139 - RNA, 20 nt, Artificial Sequence
  CIITA targeting sequence
cagguuaaagcgauucuccu

SEQ ID NO: 33140 - RNA, 20 nt, Artificial Sequence
  CIITA targeting sequence
cuuuaaccugggaaguggag

SEQ ID NO: 33141 - RNA, 20 nt, Artificial Sequence
  CIITA targeting sequence
ccugccucagccucccaagu

SEQ ID NO: 33142 - RNA, 20 nt, Artificial Sequence
  CIITA targeting sequence
ugccucagccucccaaguag

SEQ ID NO: 33143 - RNA, 20 nt, Artificial Sequence
  CIITA targeting sequence
gccucccaaguagcuggguu

SEQ ID NO: 33144 - RNA, 20 nt, Artificial Sequence
  CIITA targeting sequence
caaguagcuggguuuacagg

SEQ ID NO: 33145 - RNA, 20 nt, Artificial Sequence
  CIITA targeting sequence
uauuuuuaguagagacuggg

SEQ ID NO: 33146 - RNA, 20 nt, Artificial Sequence
  CIITA targeting sequence
acuaaaaauacgaaaaauua

SEQ ID NO: 33147 - RNA, 20 nt, Artificial Sequence
  CIITA targeting sequence
cuacuaaaaauacgaaaaau

SEQ ID NO: 33148 - RNA, 20 nt, Artificial Sequence
  CIITA targeting sequence
ccauguuggccaggcugguc

SEQ ID NO: 33149 - RNA, 20 nt, Artificial Sequence
  CIITA targeting sequence
cgaacuccugaccucaggcg

SEQ ID NO: 33150 - RNA, 20 nt, Artificial Sequence
  CIITA targeting sequence
aacuccugaccucaggcgau

SEQ ID NO: 33151 - RNA, 20 nt, Artificial Sequence
  CIITA targeting sequence
agaccagccuggccaacaug

SEQ ID NO: 33152 - RNA, 20 nt, Artificial Sequence
  CIITA targeting sequence
ugaccucaggcgauccaccc

SEQ ID NO: 33153 - RNA, 20 nt, Artificial Sequence
  CIITA targeting sequence
ggaguucgagaccagccugg

SEQ ID NO: 33154 - RNA, 20 nt, Artificial Sequence
  CIITA targeting sequence
ggcgauccacccaccucagu

SEQ ID NO: 33155 - RNA, 20 nt, Artificial Sequence
  CIITA targeting sequence
ccugaggucaggaguucgag

SEQ ID NO: 33156 - RNA, 20 nt, Artificial Sequence
  CIITA targeting sequence
acccaccucagucucccaaa

SEQ ID NO: 33157 - RNA, 20 nt, Artificial Sequence
  CIITA targeting sequence
gucucccaaagugcugggau

SEQ ID NO: 33158 - RNA, 20 nt, Artificial Sequence
  CIITA targeting sequence
cccaaagugcugggauuaca

SEQ ID NO: 33159 - RNA, 20 nt, Artificial Sequence
  CIITA targeting sequence
caaagugcugggauuacagg

SEQ ID NO: 33160 - RNA, 20 nt, Artificial Sequence
  CIITA targeting sequence
cagcacuuugggagacugag

SEQ ID NO: 33161 - RNA, 20 nt, Artificial Sequence
  CIITA targeting sequence
ugccuguaaucccagcacuu

SEQ ID NO: 33162 - RNA, 20 nt, Artificial Sequence
  CIITA targeting sequence
gcccggcaugguggcucaug

SEQ ID NO: 33163 - RNA, 20 nt, Artificial Sequence
  CIITA targeting sequence
cggcccggcaugguggcuca

SEQ ID NO: 33164 - RNA, 20 nt, Artificial Sequence
  CIITA targeting sequence
uuuuauuuaaugcauguuua

SEQ ID NO: 33165 - RNA, 20 nt, Artificial Sequence
  CIITA targeting sequence
uaaacaguuucagaaggacc

SEQ ID NO: 33166 - RNA, 20 nt, Artificial Sequence
  CIITA targeting sequence
gaaggaccuauggcaacuau

SEQ ID NO: 33167 - RNA, 20 nt, Artificial Sequence
  CIITA targeting sequence
gaaacuguuuaugauaaaca

SEQ ID NO: 33168 - RNA, 20 nt, Artificial Sequence
  CIITA targeting sequence
uucugaaacuguuuaugaua

SEQ ID NO: 33169 - RNA, 20 nt, Artificial Sequence
  CIITA targeting sequence
caacuccuagaaauuaugcc

SEQ ID NO: 33170 - RNA, 20 nt, Artificial Sequence
  CIITA targeting sequence
acuccuagaaauuaugccuu

SEQ ID NO: 33171 - RNA, 20 nt, Artificial Sequence
  CIITA targeting sequence
uagaaauuaugccuuuuaga

SEQ ID NO: 33172 - RNA, 20 nt, Artificial Sequence
  CIITA targeting sequence
aggaguugagauagcugcua

SEQ ID NO: 33173 - RNA, 20 nt, Artificial Sequence
  CIITA targeting sequence
aaaaggcauaauuucuagga

SEQ ID NO: 33174 - RNA, 20 nt, Artificial Sequence
  CIITA targeting sequence
cacucuaaaaggcauaauuu

SEQ ID NO: 33175 - RNA, 20 nt, Artificial Sequence
  CIITA targeting sequence
ucacacucuaaaaggcauaa

SEQ ID NO: 33176 - RNA, 20 nt, Artificial Sequence
  CIITA targeting sequence
auuguccucacacucuaaaa

SEQ ID NO: 33177 - RNA, 20 nt, Artificial Sequence
  CIITA targeting sequence
aggaggaaaaggacugagaa

SEQ ID NO: 33178 - RNA, 20 nt, Artificial Sequence
  CIITA targeting sequence
agcccucuauuguccucaca

SEQ ID NO: 33179 - RNA, 20 nt, Artificial Sequence
  CIITA targeting sequence
ucgagcccucuauuguccuc

SEQ ID NO: 33180 - RNA, 20 nt, Artificial Sequence
  CIITA targeting sequence
uccucgagcccucuauuguc

SEQ ID NO: 33181 - RNA, 20 nt, Artificial Sequence
  CIITA targeting sequence
uuuuccuccucgagcccucu

SEQ ID NO: 33182 - RNA, 20 nt, Artificial Sequence
  CIITA targeting sequence
guccuuuuccuccucgagcc

SEQ ID NO: 33183 - RNA, 20 nt, Artificial Sequence
  CIITA targeting sequence
caguccuuuuccuccucgag

SEQ ID NO: 33184 - RNA, 20 nt, Artificial Sequence
  CIITA targeting sequence
ugcaucuugacgucauuuau

SEQ ID NO: 33185 - RNA, 20 nt, Artificial Sequence
  CIITA targeting sequence
ugacgucauuuauauauuaa

SEQ ID NO: 33186 - RNA, 20 nt, Artificial Sequence
  CIITA targeting sequence
agaugcaugaaauuuacuac

SEQ ID NO: 33187 - RNA, 20 nt, Artificial Sequence
  CIITA targeting sequence
uuuauauauuaaagguaaug

SEQ ID NO: 33188 - RNA, 20 nt, Artificial Sequence
  CIITA targeting sequence
auuaccuuuaauauauaaau

SEQ ID NO: 33189 - RNA, 20 nt, Artificial Sequence
  CIITA targeting sequence
aguucugccacuguggagga

SEQ ID NO: 33190 - RNA, 20 nt, Artificial Sequence
  CIITA targeting sequence
gccacuguggaggauuagau

SEQ ID NO: 33191 - RNA, 20 nt, Artificial Sequence
  CIITA targeting sequence
acaguggcagaacuagaagu

SEQ ID NO: 33192 - RNA, 20 nt, Artificial Sequence
  CIITA targeting sequence
uccacaguggcagaacuaga

SEQ ID NO: 33193 - RNA, 20 nt, Artificial Sequence
  CIITA targeting sequence
aauccuccacaguggcagaa

SEQ ID NO: 33194 - RNA, 20 nt, Artificial Sequence
  CIITA targeting sequence
ugacucucucugcccacuga

SEQ ID NO: 33195 - RNA, 20 nt, Artificial Sequence
  CIITA targeting sequence
ugaaaguaucuaauccucca

SEQ ID NO: 33196 - RNA, 20 nt, Artificial Sequence
  CIITA targeting sequence
cucugcccacugaaacaacu

SEQ ID NO: 33197 - RNA, 20 nt, Artificial Sequence
  CIITA targeting sequence
cugcccacugaaacaacuaa

SEQ ID NO: 33198 - RNA, 20 nt, Artificial Sequence
  CIITA targeting sequence
gcccacugaaacaacuaaac

SEQ ID NO: 33199 - RNA, 20 nt, Artificial Sequence
  CIITA targeting sequence
gugggcagagagagucauga

SEQ ID NO: 33200 - RNA, 20 nt, Artificial Sequence
  CIITA targeting sequence
agcaguuuaguuguuucagu

SEQ ID NO: 33201 - RNA, 20 nt, Artificial Sequence
  CIITA targeting sequence
uuuuaggccaggugcagggg

SEQ ID NO: 33202 - RNA, 20 nt, Artificial Sequence
  CIITA targeting sequence
ugccuguaaucccaccacuu

SEQ ID NO: 33203 - RNA, 20 nt, Artificial Sequence
  CIITA targeting sequence
caccacuuugggaguccagg

SEQ ID NO: 33204 - RNA, 20 nt, Artificial Sequence
  CIITA targeting sequence
caaaguggugggauuacagg

SEQ ID NO: 33205 - RNA, 20 nt, Artificial Sequence
  CIITA targeting sequence
agggugagaggauugcuuga

SEQ ID NO: 33206 - RNA, 20 nt, Artificial Sequence
  CIITA targeting sequence
cccuggacucccaaaguggu

SEQ ID NO: 33207 - RNA, 20 nt, Artificial Sequence
  CIITA targeting sequence
cacccuggacucccaaagug

SEQ ID NO: 33208 - RNA, 20 nt, Artificial Sequence
  CIITA targeting sequence
ucucacccuggacucccaaa

SEQ ID NO: 33209 - RNA, 20 nt, Artificial Sequence
  CIITA targeting sequence
agcaauccucucacccugga

SEQ ID NO: 33210 - RNA, 20 nt, Artificial Sequence
  CIITA targeting sequence
ugggcucaagcaauccucuc

SEQ ID NO: 33211 - RNA, 20 nt, Artificial Sequence
  CIITA targeting sequence
aacuccugggcucaagcaau

SEQ ID NO: 33212 - RNA, 20 nt, Artificial Sequence
  CIITA targeting sequence
cugcagccuccaacuccugg

SEQ ID NO: 33213 - RNA, 20 nt, Artificial Sequence
  CIITA targeting sequence
uagcucacugcagccuccaa

SEQ ID NO: 33214 - RNA, 20 nt, Artificial Sequence
  CIITA targeting sequence
caucacugcacccaagcaug

SEQ ID NO: 33215 - RNA, 20 nt, Artificial Sequence
  CIITA targeting sequence
cugcacccaagcaugggcaa

SEQ ID NO: 33216 - RNA, 20 nt, Artificial Sequence
  CIITA targeting sequence
auugcccaugcuugggugca

SEQ ID NO: 33217 - RNA, 20 nt, Artificial Sequence
  CIITA targeting sequence
ucuauugcccaugcuugggu

SEQ ID NO: 33218 - RNA, 20 nt, Artificial Sequence
  CIITA targeting sequence
uccucuauugcccaugcuug

SEQ ID NO: 33219 - RNA, 20 nt, Artificial Sequence
  CIITA targeting sequence
gucucaaaacaaagacaaaa

SEQ ID NO: 33220 - RNA, 20 nt, Artificial Sequence
  CIITA targeting sequence
caaaacaaagacaaaaacaa

SEQ ID NO: 33221 - RNA, 20 nt, Artificial Sequence
  CIITA targeting sequence
aaacaaagacaaaaacaaaa

SEQ ID NO: 33222 - RNA, 20 nt, Artificial Sequence
  CIITA targeting sequence
uuguuuugagacagagucuu

SEQ ID NO: 33223 - RNA, 20 nt, Artificial Sequence
  CIITA targeting sequence
ugccuguaaucccagcacuu

SEQ ID NO: 33224 - RNA, 20 nt, Artificial Sequence
  CIITA targeting sequence
cagcacuuugggaggccaaa

SEQ ID NO: 33225 - RNA, 20 nt, Artificial Sequence
  CIITA targeting sequence
caaagugcugggauuacagg

SEQ ID NO: 33226 - RNA, 20 nt, Artificial Sequence
  CIITA targeting sequence
gccugcuuuggccucccaaa

SEQ ID NO: 33227 - RNA, 20 nt, Artificial Sequence
  CIITA targeting sequence
cuugaggccaaaaguuugag

SEQ ID NO: 33228 - RNA, 20 nt, Artificial Sequence
  CIITA targeting sequence
agugaucugccugcuuuggc

SEQ ID NO: 33229 - RNA, 20 nt, Artificial Sequence
  CIITA targeting sequence
aacuuuuggccucaagugau

SEQ ID NO: 33230 - RNA, 20 nt, Artificial Sequence
  CIITA targeting sequence
caaacuuuuggccucaagug

SEQ ID NO: 33231 - RNA, 20 nt, Artificial Sequence
  CIITA targeting sequence
caccacugcuaaaaauacaa

SEQ ID NO: 33232 - RNA, 20 nt, Artificial Sequence
  CIITA targeting sequence
gcugggugugauggcgcaug

SEQ ID NO: 33233 - RNA, 20 nt, Artificial Sequence
  CIITA targeting sequence
cacccagcugauuuuuuugu

SEQ ID NO: 33234 - RNA, 20 nt, Artificial Sequence
  CIITA targeting sequence
ggaggcuaaggcaggagaau

SEQ ID NO: 33235 - RNA, 20 nt, Artificial Sequence
  CIITA targeting sequence
cgaguagcugguacuacagg

SEQ ID NO: 33236 - RNA, 20 nt, Artificial Sequence
  CIITA targeting sequence
ugccuuagccucccgaguag

SEQ ID NO: 33237 - RNA, 20 nt, Artificial Sequence
  CIITA targeting sequence
ccugccuuagccucccgagu

SEQ ID NO: 33238 - RNA, 20 nt, Artificial Sequence
  CIITA targeting sequence
agcaauucuccugccuuagc

SEQ ID NO: 33239 - RNA, 20 nt, Artificial Sequence
  CIITA targeting sequence
cugguucaagcaauucuccu

SEQ ID NO: 33240 - RNA, 20 nt, Artificial Sequence
  CIITA targeting sequence
gagguugcagugagccgaga

SEQ ID NO: 33241 - RNA, 20 nt, Artificial Sequence
  CIITA targeting sequence
gacucccugguucaagcaau

SEQ ID NO: 33242 - RNA, 20 nt, Artificial Sequence
  CIITA targeting sequence
cugcaaccuccgacucccug

SEQ ID NO: 33243 - RNA, 20 nt, Artificial Sequence
  CIITA targeting sequence
gcucacugcaaccuccgacu

SEQ ID NO: 33244 - RNA, 20 nt, Artificial Sequence
  CIITA targeting sequence
cggcucacugcaaccuccga

SEQ ID NO: 33245 - RNA, 20 nt, Artificial Sequence
  CIITA targeting sequence
acuccagcaugggcaacaca

SEQ ID NO: 33246 - RNA, 20 nt, Artificial Sequence
  CIITA targeting sequence
agcaugggcaacacagcaag

SEQ ID NO: 33247 - RNA, 20 nt, Artificial Sequence
  CIITA targeting sequence
ugcuguguugcccaugcugg

SEQ ID NO: 33248 - RNA, 20 nt, Artificial Sequence
  CIITA targeting sequence
gucucaaaaaauauauacau

SEQ ID NO: 33249 - RNA, 20 nt, Artificial Sequence
  CIITA targeting sequence
caaaaaauauauacauaaau

SEQ ID NO: 33250 - RNA, 20 nt, Artificial Sequence
  CIITA targeting sequence
aaaaauauauacauaaauau

SEQ ID NO: 33251 - RNA, 20 nt, Artificial Sequence
  CIITA targeting sequence
ggcacaaagauaaggcuccu

SEQ ID NO: 33252 - RNA, 20 nt, Artificial Sequence
  CIITA targeting sequence
uugugccagaccagcaaugu

SEQ ID NO: 33253 - RNA, 20 nt, Artificial Sequence
  CIITA targeting sequence
uuagauccuacaaauggcau

SEQ ID NO: 33254 - RNA, 20 nt, Artificial Sequence
  CIITA targeting sequence
aaggagccuuaucuuugugc

SEQ ID NO: 33255 - RNA, 20 nt, Artificial Sequence
  CIITA targeting sequence
uacaaauggcaugaaguuaa

SEQ ID NO: 33256 - RNA, 20 nt, Artificial Sequence
  CIITA targeting sequence
ugccauuuguaggaucuaag

SEQ ID NO: 33257 - RNA, 20 nt, Artificial Sequence
  CIITA targeting sequence
uaacuucaugccauuuguag

SEQ ID NO: 33258 - RNA, 20 nt, Artificial Sequence
  CIITA targeting sequence
ccagcauucuuaacuucaug

SEQ ID NO: 33259 - RNA, 20 nt, Artificial Sequence
  CIITA targeting sequence
guaaagguguuuuuuuuuuu

SEQ ID NO: 33260 - RNA, 20 nt, Artificial Sequence
  CIITA targeting sequence
ugaagguuccuaucaaacuc

SEQ ID NO: 33261 - RNA, 20 nt, Artificial Sequence
  CIITA targeting sequence
ggaaaaaaaaaaacaccuuu

SEQ ID NO: 33262 - RNA, 20 nt, Artificial Sequence
  CIITA targeting sequence
uaucaaacucuagagaaccu

SEQ ID NO: 33263 - RNA, 20 nt, Artificial Sequence
  CIITA targeting sequence
aacucuagagaaccugagcu

SEQ ID NO: 33264 - RNA, 20 nt, Artificial Sequence
  CIITA targeting sequence
agagaaccugagcuuccucc

SEQ ID NO: 33265 - RNA, 20 nt, Artificial Sequence
  CIITA targeting sequence
agaguuugauaggaaccuuc

SEQ ID NO: 33266 - RNA, 20 nt, Artificial Sequence
  CIITA targeting sequence
cuagaguuugauaggaaccu

SEQ ID NO: 33267 - RNA, 20 nt, Artificial Sequence
  CIITA targeting sequence
gguucucuagaguuugauag

SEQ ID NO: 33268 - RNA, 20 nt, Artificial Sequence
  CIITA targeting sequence
uccuuugaaagcuguagagc

SEQ ID NO: 33269 - RNA, 20 nt, Artificial Sequence
  CIITA targeting sequence
uuugaaagcuguagagcaua

SEQ ID NO: 33270 - RNA, 20 nt, Artificial Sequence
  CIITA targeting sequence
aaggaggaagcucagguucu

SEQ ID NO: 33271 - RNA, 20 nt, Artificial Sequence
  CIITA targeting sequence
acagcuuucaaaggaggaag

SEQ ID NO: 33272 - RNA, 20 nt, Artificial Sequence
  CIITA targeting sequence
uaguaugcucuacagcuuuc

SEQ ID NO: 33273 - RNA, 20 nt, Artificial Sequence
  CIITA targeting sequence
ccuaguaugcucuacagcuu

SEQ ID NO: 33274 - RNA, 20 nt, Artificial Sequence
  CIITA targeting sequence
ggugagaauuuuuguuuugc

SEQ ID NO: 33275 - RNA, 20 nt, Artificial Sequence
  CIITA targeting sequence
ccugaguucuccuaguaugc

SEQ ID NO: 33276 - RNA, 20 nt, Artificial Sequence
  CIITA targeting sequence
caccugaguucuccuaguau

SEQ ID NO: 33277 - RNA, 20 nt, Artificial Sequence
  CIITA targeting sequence
guuuuuuugagacagggucu

SEQ ID NO: 33278 - RNA, 20 nt, Artificial Sequence
  CIITA targeting sequence
aaaaaacagaagcaaaacaa

SEQ ID NO: 33279 - RNA, 20 nt, Artificial Sequence
  CIITA targeting sequence
caaaaaaacagaagcaaaac

SEQ ID NO: 33280 - RNA, 20 nt, Artificial Sequence
  CIITA targeting sequence
cacucuaucacccaggcugg

SEQ ID NO: 33281 - RNA, 20 nt, Artificial Sequence
  CIITA targeting sequence
cucuaucacccaggcuggag

SEQ ID NO: 33282 - RNA, 20 nt, Artificial Sequence
  CIITA targeting sequence
aucacccaggcuggagugca

SEQ ID NO: 33283 - RNA, 20 nt, Artificial Sequence
  CIITA targeting sequence
cccaggcuggagugcagugg

SEQ ID NO: 33284 - RNA, 20 nt, Artificial Sequence
  CIITA targeting sequence
agccugggugauagagugag

SEQ ID NO: 33285 - RNA, 20 nt, Artificial Sequence
  CIITA targeting sequence
cauucacugcagccucaccc

SEQ ID NO: 33286 - RNA, 20 nt, Artificial Sequence
  CIITA targeting sequence
cugcagccucacccugcugg

SEQ ID NO: 33287 - RNA, 20 nt, Artificial Sequence
  CIITA targeting sequence
cccugcugggcucaagugau

SEQ ID NO: 33288 - RNA, 20 nt, Artificial Sequence
  CIITA targeting sequence
agugauccucccuccucagc

SEQ ID NO: 33289 - RNA, 20 nt, Artificial Sequence
  CIITA targeting sequence
cuugagcccagcagggugag

SEQ ID NO: 33290 - RNA, 20 nt, Artificial Sequence
  CIITA targeting sequence
ucccuccucagccucccaag

SEQ ID NO: 33291 - RNA, 20 nt, Artificial Sequence
  CIITA targeting sequence
cuccucagccucccaaguag

SEQ ID NO: 33292 - RNA, 20 nt, Artificial Sequence
  CIITA targeting sequence
ucagccucccaaguagcugg

SEQ ID NO: 33293 - RNA, 20 nt, Artificial Sequence
  CIITA targeting sequence
gccucccaaguagcugggac

SEQ ID NO: 33294 - RNA, 20 nt, Artificial Sequence
  CIITA targeting sequence
caaguagcugggacuacagg

SEQ ID NO: 33295 - RNA, 20 nt, Artificial Sequence
  CIITA targeting sequence
cagcuacuugggaggcugag

SEQ ID NO: 33296 - RNA, 20 nt, Artificial Sequence
  CIITA targeting sequence
cuaacuuuuuuguauuuuuu

SEQ ID NO: 33297 - RNA, 20 nt, Artificial Sequence
  CIITA targeting sequence
acaaaaaauacaaaaaaguu

SEQ ID NO: 33298 - RNA, 20 nt, Artificial Sequence
  CIITA targeting sequence
cuacaaaaaauacaaaaaag

SEQ ID NO: 33299 - RNA, 20 nt, Artificial Sequence
  CIITA targeting sequence
ccauguuacccaggcugguc

SEQ ID NO: 33300 - RNA, 20 nt, Artificial Sequence
  CIITA targeting sequence
ccaucuccugagaucaagug

SEQ ID NO: 33301 - RNA, 20 nt, Artificial Sequence
  CIITA targeting sequence
aucuccugagaucaagugau

SEQ ID NO: 33302 - RNA, 20 nt, Artificial Sequence
  CIITA targeting sequence
ccugagaucaagugaucugc

SEQ ID NO: 33303 - RNA, 20 nt, Artificial Sequence
  CIITA targeting sequence
ugagaucaagugaucugccc

SEQ ID NO: 33304 - RNA, 20 nt, Artificial Sequence
  CIITA targeting sequence
ggagauggagaccagccugg

SEQ ID NO: 33305 - RNA, 20 nt, Artificial Sequence
  CIITA targeting sequence
caggagauggagaccagccu

SEQ ID NO: 33306 - RNA, 20 nt, Artificial Sequence
  CIITA targeting sequence
agugaucugcccgccucggu

SEQ ID NO: 33307 - RNA, 20 nt, Artificial Sequence
  CIITA targeting sequence
cuugaucucaggagauggag

SEQ ID NO: 33308 - RNA, 20 nt, Artificial Sequence
  CIITA targeting sequence
gcccgccucggugucccaaa

SEQ ID NO: 33309 - RNA, 20 nt, Artificial Sequence
  CIITA targeting sequence
gugucccaaagugcugggau

SEQ ID NO: 33310 - RNA, 20 nt, Artificial Sequence
  CIITA targeting sequence
caaagugcugggauuauagu

SEQ ID NO: 33311 - RNA, 20 nt, Artificial Sequence
  CIITA targeting sequence
cagcacuuugggacaccgag

SEQ ID NO: 33312 - RNA, 20 nt, Artificial Sequence
  CIITA targeting sequence
ugagccaccgcacccgucca

SEQ ID NO: 33313 - RNA, 20 nt, Artificial Sequence
  CIITA targeting sequence
ugacuauaaucccagcacuu

SEQ ID NO: 33314 - RNA, 20 nt, Artificial Sequence
  CIITA targeting sequence
acagguagauuuaaugguag

SEQ ID NO: 33315 - RNA, 20 nt, Artificial Sequence
  CIITA targeting sequence
accuguggacgggugcggug

SEQ ID NO: 33316 - RNA, 20 nt, Artificial Sequence
  CIITA targeting sequence
accauuaaaucuaccugugg

SEQ ID NO: 33317 - RNA, 20 nt, Artificial Sequence
  CIITA targeting sequence
gcauacagcagaacccuaau

SEQ ID NO: 33318 - RNA, 20 nt, Artificial Sequence
  CIITA targeting sequence
gcuguaugcagaaaucuacc

SEQ ID NO: 33319 - RNA, 20 nt, Artificial Sequence
  CIITA targeting sequence
auuaggguucugcuguaugc

SEQ ID NO: 33320 - RNA, 20 nt, Artificial Sequence
  CIITA targeting sequence
cuguaagaaugagcaagagc

SEQ ID NO: 33321 - RNA, 20 nt, Artificial Sequence
  CIITA targeting sequence
uacagugacaguguacucca

SEQ ID NO: 33322 - RNA, 20 nt, Artificial Sequence
  CIITA targeting sequence
uucuuacagugacaguguac

SEQ ID NO: 33323 - RNA, 20 nt, Artificial Sequence
  CIITA targeting sequence
ugcucauucuuacagugaca

SEQ ID NO: 33324 - RNA, 20 nt, Artificial Sequence
  CIITA targeting sequence
gguaggguuuagcucuugcu

SEQ ID NO: 33325 - RNA, 20 nt, Artificial Sequence
  CIITA targeting sequence
cugguaggguuuagcucuug

SEQ ID NO: 33326 - RNA, 20 nt, Artificial Sequence
  CIITA targeting sequence
aagcuguuucucugguaggg

SEQ ID NO: 33327 - RNA, 20 nt, Artificial Sequence
  CIITA targeting sequence
caaucuuaggguugaaagua

SEQ ID NO: 33328 - RNA, 20 nt, Artificial Sequence
  CIITA targeting sequence
uaggguugaaaguaggaaaa

SEQ ID NO: 33329 - RNA, 20 nt, Artificial Sequence
  CIITA targeting sequence
acccuaagauugggacaggc

SEQ ID NO: 33330 - RNA, 20 nt, Artificial Sequence
  CIITA targeting sequence
uacuuucaacccuaagauug

SEQ ID NO: 33331 - RNA, 20 nt, Artificial Sequence
  CIITA targeting sequence
uuuccuacuuucaacccuaa

SEQ ID NO: 33332 - RNA, 20 nt, Artificial Sequence
  CIITA targeting sequence
uaccugagaacuugucauua

SEQ ID NO: 33333 - RNA, 20 nt, Artificial Sequence
  CIITA targeting sequence
gguaagauauuuuucuuuuc

SEQ ID NO: 33334 - RNA, 20 nt, Artificial Sequence
  CIITA targeting sequence
cagguaagauauuuuucuuu

SEQ ID NO: 33335 - RNA, 20 nt, Artificial Sequence
  CIITA targeting sequence
uuacaaagggguccuuacuc

SEQ ID NO: 33336 - RNA, 20 nt, Artificial Sequence
  CIITA targeting sequence
uuacucagguuugugaccug

SEQ ID NO: 33337 - RNA, 20 nt, Artificial Sequence
  CIITA targeting sequence
gguuugugaccugaauucau

SEQ ID NO: 33338 - RNA, 20 nt, Artificial Sequence
  CIITA targeting sequence
caaaccugaguaaggacccc

SEQ ID NO: 33339 - RNA, 20 nt, Artificial Sequence
  CIITA targeting sequence
ggucacaaaccugaguaagg

SEQ ID NO: 33340 - RNA, 20 nt, Artificial Sequence
  CIITA targeting sequence
ugcuaucuaguaauaauaau

SEQ ID NO: 33341 - RNA, 20 nt, Artificial Sequence
  CIITA targeting sequence
aguaauaauaauaauaauaa

SEQ ID NO: 33342 - RNA, 20 nt, Artificial Sequence
  CIITA targeting sequence
uuauauuauuauuauuauua

SEQ ID NO: 33343 - RNA, 20 nt, Artificial Sequence
  CIITA targeting sequence
aguuuauaacaucuuuauau

SEQ ID NO: 33344 - RNA, 20 nt, Artificial Sequence
  CIITA targeting sequence
uaaagcacccuacuuccagu

SEQ ID NO: 33345 - RNA, 20 nt, Artificial Sequence
  CIITA targeting sequence
gcuaaucuuaaagcacccua

SEQ ID NO: 33346 - RNA, 20 nt, Artificial Sequence
  CIITA targeting sequence
accucugcuaaucuuaaagc

SEQ ID NO: 33347 - RNA, 20 nt, Artificial Sequence
  CIITA targeting sequence
acuccucucuaauggaauuu

SEQ ID NO: 33348 - RNA, 20 nt, Artificial Sequence
  CIITA targeting sequence
ucucuaauggaauuuaacuu

SEQ ID NO: 33349 - RNA, 20 nt, Artificial Sequence
  CIITA targeting sequence
cuaauggaauuuaacuuuau

SEQ ID NO: 33350 - RNA, 20 nt, Artificial Sequence
  CIITA targeting sequence
aauggaauuuaacuuuauuc

SEQ ID NO: 33351 - RNA, 20 nt, Artificial Sequence
  CIITA targeting sequence
auuagagaggaguugacucc

SEQ ID NO: 33352 - RNA, 20 nt, Artificial Sequence
  CIITA targeting sequence
aggauucaaaggucaccuac

SEQ ID NO: 33353 - RNA, 20 nt, Artificial Sequence
  CIITA targeting sequence
uggaauaaaguuaaauucca

SEQ ID NO: 33354 - RNA, 20 nt, Artificial Sequence
  CIITA targeting sequence
aaggucaccuacaaugaagu

SEQ ID NO: 33355 - RNA, 20 nt, Artificial Sequence
  CIITA targeting sequence
ccuacaaugaaguucuaaag

SEQ ID NO: 33356 - RNA, 20 nt, Artificial Sequence
  CIITA targeting sequence
uuguaggugaccuuugaauc

SEQ ID NO: 33357 - RNA, 20 nt, Artificial Sequence
  CIITA targeting sequence
aaagaaaugaagagcucaca

SEQ ID NO: 33358 - RNA, 20 nt, Artificial Sequence
  CIITA targeting sequence
uuagaacuucauuguaggug

SEQ ID NO: 33359 - RNA, 20 nt, Artificial Sequence
  CIITA targeting sequence
uuucuuuagaacuucauugu

SEQ ID NO: 33360 - RNA, 20 nt, Artificial Sequence
  CIITA targeting sequence
ucauuucuuuagaacuucau

SEQ ID NO: 33361 - RNA, 20 nt, Artificial Sequence
  CIITA targeting sequence
cauuaaaaaaaaaaauuaca

SEQ ID NO: 33362 - RNA, 20 nt, Artificial Sequence
  CIITA targeting sequence
uugccuguguguguaauuuu

SEQ ID NO: 33363 - RNA, 20 nt, Artificial Sequence
  CIITA targeting sequence
ugaguggaaguaaauagaaa

SEQ ID NO: 33364 - RNA, 20 nt, Artificial Sequence
  CIITA targeting sequence
agaugcuaugcuucuuugcc

SEQ ID NO: 33365 - RNA, 20 nt, Artificial Sequence
  CIITA targeting sequence
acucaagaugcuaugcuucu

SEQ ID NO: 33366 - RNA, 20 nt, Artificial Sequence
  CIITA targeting sequence
auuuacuuccacucaagaug

SEQ ID NO: 33367 - RNA, 20 nt, Artificial Sequence
  CIITA targeting sequence
augguuucuauuuacuucca

SEQ ID NO: 33368 - RNA, 20 nt, Artificial Sequence
  CIITA targeting sequence
guguuuacugucuaugguuu

SEQ ID NO: 33369 - RNA, 20 nt, Artificial Sequence
  CIITA targeting sequence
ggcccgguggcucccuccca

SEQ ID NO: 33370 - RNA, 20 nt, Artificial Sequence
  CIITA targeting sequence
cucccacuuugggaggucaa

SEQ ID NO: 33371 - RNA, 20 nt, Artificial Sequence
  CIITA targeting sequence
cacuuugggaggucaaggug

SEQ ID NO: 33372 - RNA, 20 nt, Artificial Sequence
  CIITA targeting sequence
caaagugggagggagccacc

SEQ ID NO: 33373 - RNA, 20 nt, Artificial Sequence
  CIITA targeting sequence
agguggaaggaucacuuuag

SEQ ID NO: 33374 - RNA, 20 nt, Artificial Sequence
  CIITA targeting sequence
accuugaccucccaaagugg

SEQ ID NO: 33375 - RNA, 20 nt, Artificial Sequence
  CIITA targeting sequence
uuccaccuugaccucccaaa

SEQ ID NO: 33376 - RNA, 20 nt, Artificial Sequence
  CIITA targeting sequence
cuuuaggccagcaguucaag

SEQ ID NO: 33377 - RNA, 20 nt, Artificial Sequence
  CIITA targeting sequence
agaccagccugggcaaaaua

SEQ ID NO: 33378 - RNA, 20 nt, Artificial Sequence
  CIITA targeting sequence
ugaacugcuggccuaaagug

SEQ ID NO: 33379 - RNA, 20 nt, Artificial Sequence
  CIITA targeting sequence
cuauuuugcccaggcugguc

SEQ ID NO: 33380 - RNA, 20 nt, Artificial Sequence
  CIITA targeting sequence
uuacaaaaaaguuuaaaaau

SEQ ID NO: 33381 - RNA, 20 nt, Artificial Sequence
  CIITA targeting sequence
gcuaauuuuuaaacuuuuuu

SEQ ID NO: 33382 - RNA, 20 nt, Artificial Sequence
  CIITA targeting sequence
uagcuacuuuggaggcugag

SEQ ID NO: 33383 - RNA, 20 nt, Artificial Sequence
  CIITA targeting sequence
aaaguagcuaggauuauagg

SEQ ID NO: 33384 - RNA, 20 nt, Artificial Sequence
  CIITA targeting sequence
gccuccaaaguagcuaggau

SEQ ID NO: 33385 - RNA, 20 nt, Artificial Sequence
  CIITA targeting sequence
ugccucagccuccaaaguag

SEQ ID NO: 33386 - RNA, 20 nt, Artificial Sequence
  CIITA targeting sequence
uccugccucagccuccaaag

SEQ ID NO: 33387 - RNA, 20 nt, Artificial Sequence
  CIITA targeting sequence
aguaauccuccugccucagc

SEQ ID NO: 33388 - RNA, 20 nt, Artificial Sequence
  CIITA targeting sequence
ggaauucaaggauucgaacu

SEQ ID NO: 33389 - RNA, 20 nt, Artificial Sequence
  CIITA targeting sequence
ugagcucaaguaauccuccu

SEQ ID NO: 33390 - RNA, 20 nt, Artificial Sequence
  CIITA targeting sequence
aggauucgaacugaggaauu

SEQ ID NO: 33391 - RNA, 20 nt, Artificial Sequence
  CIITA targeting sequence
uugaauuccugagcucaagu

SEQ ID NO: 33392 - RNA, 20 nt, Artificial Sequence
  CIITA targeting sequence
aacugaggaauucauugagc

SEQ ID NO: 33393 - RNA, 20 nt, Artificial Sequence
  CIITA targeting sequence
aauccuugaauuccugagcu

SEQ ID NO: 33394 - RNA, 20 nt, Artificial Sequence
  CIITA targeting sequence
guucgaauccuugaauuccu

SEQ ID NO: 33395 - RNA, 20 nt, Artificial Sequence
  CIITA targeting sequence
ucaguucgaauccuugaauu

SEQ ID NO: 33396 - RNA, 20 nt, Artificial Sequence
  CIITA targeting sequence
uugagcaguggucacaccag

SEQ ID NO: 33397 - RNA, 20 nt, Artificial Sequence
  CIITA targeting sequence
augaauuccucaguucgaau

SEQ ID NO: 33398 - RNA, 20 nt, Artificial Sequence
  CIITA targeting sequence
caccagccugggcagcagag

SEQ ID NO: 33399 - RNA, 20 nt, Artificial Sequence
  CIITA targeting sequence
gcugcccaggcuggugugac

SEQ ID NO: 33400 - RNA, 20 nt, Artificial Sequence
  CIITA targeting sequence
cuaaaagacaaauaaacaaa

SEQ ID NO: 33401 - RNA, 20 nt, Artificial Sequence
  CIITA targeting sequence
aaaagacaaauaaacaaacc

SEQ ID NO: 33402 - RNA, 20 nt, Artificial Sequence
  CIITA targeting sequence
uuuagagacucugcugccca

SEQ ID NO: 33403 - RNA, 20 nt, Artificial Sequence
  CIITA targeting sequence
ggguuuguuuauuugucuuu

SEQ ID NO: 33404 - RNA, 20 nt, Artificial Sequence
  CIITA targeting sequence
cuggguuuguuuauuugucu

SEQ ID NO: 33405 - RNA, 20 nt, Artificial Sequence
  CIITA targeting sequence
gauacccgaauagagauaca

SEQ ID NO: 33406 - RNA, 20 nt, Artificial Sequence
  CIITA targeting sequence
gaagucucuggguuuguuua

SEQ ID NO: 33407 - RNA, 20 nt, Artificial Sequence
  CIITA targeting sequence
gguauccgaagucucugggu

SEQ ID NO: 33408 - RNA, 20 nt, Artificial Sequence
  CIITA targeting sequence
auucggguauccgaagucuc

SEQ ID NO: 33409 - RNA, 20 nt, Artificial Sequence
  CIITA targeting sequence
cuauucggguauccgaaguc

SEQ ID NO: 33410 - RNA, 20 nt, Artificial Sequence
  CIITA targeting sequence
aagaugugcuuaagccagcu

SEQ ID NO: 33411 - RNA, 20 nt, Artificial Sequence
  CIITA targeting sequence
uugauuuuacacauuuguau

SEQ ID NO: 33412 - RNA, 20 nt, Artificial Sequence
  CIITA targeting sequence
gccagcuggcuuaagcacau

SEQ ID NO: 33413 - RNA, 20 nt, Artificial Sequence
  CIITA targeting sequence
ggagagcugauugugggcau

SEQ ID NO: 33414 - RNA, 20 nt, Artificial Sequence
  CIITA targeting sequence
cgagcuccgccagcuggcuu

SEQ ID NO: 33415 - RNA, 20 nt, Artificial Sequence
  CIITA targeting sequence
cccgagcuccgccagcuggc

SEQ ID NO: 33416 - RNA, 20 nt, Artificial Sequence
  CIITA targeting sequence
gcucucccgagcuccgccag

SEQ ID NO: 33417 - RNA, 20 nt, Artificial Sequence
  CIITA targeting sequence
cuucccaacuccacgugcag

SEQ ID NO: 33418 - RNA, 20 nt, Artificial Sequence
  CIITA targeting sequence
ucccaacuccacgugcagca

SEQ ID NO: 33419 - RNA, 20 nt, Artificial Sequence
  CIITA targeting sequence
caacuccacgugcagcaaua

SEQ ID NO: 33420 - RNA, 20 nt, Artificial Sequence
  CIITA targeting sequence
acgugcagcaauaucauauu

SEQ ID NO: 33421 - RNA, 20 nt, Artificial Sequence
  CIITA targeting sequence
uauugguagccugacauugu

SEQ ID NO: 33422 - RNA, 20 nt, Artificial Sequence
  CIITA targeting sequence
ggcuaccaauaugauauugc

SEQ ID NO: 33423 - RNA, 20 nt, Artificial Sequence
  CIITA targeting sequence
auggugggaauauuuacacc

SEQ ID NO: 33424 - RNA, 20 nt, Artificial Sequence
  CIITA targeting sequence
caccauggacaaugucaggc

SEQ ID NO: 33425 - RNA, 20 nt, Artificial Sequence
  CIITA targeting sequence
gugguguaaauauucccacc

SEQ ID NO: 33426 - RNA, 20 nt, Artificial Sequence
  CIITA targeting sequence
aaauuagggcuucuauuuuu

SEQ ID NO: 33427 - RNA, 20 nt, Artificial Sequence
  CIITA targeting sequence
auuuuuuuuuuuuaaagaga

SEQ ID NO: 33428 - RNA, 20 nt, Artificial Sequence
  CIITA targeting sequence
uuaaaaaaaaaaaauagaag

SEQ ID NO: 33429 - RNA, 20 nt, Artificial Sequence
  CIITA targeting sequence
cuuuaaaaaaaaaaaauaga

SEQ ID NO: 33430 - RNA, 20 nt, Artificial Sequence
  CIITA targeting sequence
cugucucuuuaaaaaaaaaa

SEQ ID NO: 33431 - RNA, 20 nt, Artificial Sequence
  CIITA targeting sequence
aguaaauguuaaacaacugu

SEQ ID NO: 33432 - RNA, 20 nt, Artificial Sequence
  CIITA targeting sequence
ucuaguaaauguuaaacaac

SEQ ID NO: 33433 - RNA, 20 nt, Artificial Sequence
  CIITA targeting sequence
gcagucuucuaguaaauguu

SEQ ID NO: 33434 - RNA, 20 nt, Artificial Sequence
  CIITA targeting sequence
aauaccaacucaaaucagau

SEQ ID NO: 33435 - RNA, 20 nt, Artificial Sequence
  CIITA targeting sequence
aaucagaugcugaauuuauu

SEQ ID NO: 33436 - RNA, 20 nt, Artificial Sequence
  CIITA targeting sequence
gaugcugaauuuauuugaag

SEQ ID NO: 33437 - RNA, 20 nt, Artificial Sequence
  CIITA targeting sequence
gauuugaguugguauuugaa

SEQ ID NO: 33438 - RNA, 20 nt, Artificial Sequence
  CIITA targeting sequence
gcaucugauuugaguuggua

SEQ ID NO: 33439 - RNA, 20 nt, Artificial Sequence
  CIITA targeting sequence
aauaaauucagcaucugauu

SEQ ID NO: 33440 - RNA, 20 nt, Artificial Sequence
  CIITA targeting sequence
ucaaauaaauucagcaucug

SEQ ID NO: 33441 - RNA, 20 nt, Artificial Sequence
  CIITA targeting sequence
guuaaucuucaaauaaauuc

SEQ ID NO: 33442 - RNA, 20 nt, Artificial Sequence
  CIITA targeting sequence
cuguuaaucuucaaauaaau

SEQ ID NO: 33443 - RNA, 20 nt, Artificial Sequence
  CIITA targeting sequence
gggaacagggacuauaaaga

SEQ ID NO: 33444 - RNA, 20 nt, Artificial Sequence
  CIITA targeting sequence
cugauuuuuuuuaaagcuuc

SEQ ID NO: 33445 - RNA, 20 nt, Artificial Sequence
  CIITA targeting sequence
cuguucccugauuuuuuuua

SEQ ID NO: 33446 - RNA, 20 nt, Artificial Sequence
  CIITA targeting sequence
uuauagucccuguucccuga

SEQ ID NO: 33447 - RNA, 20 nt, Artificial Sequence
  CIITA targeting sequence
ugcccaguuguucuuuauag

SEQ ID NO: 33448 - RNA, 20 nt, Artificial Sequence
  CIITA targeting sequence
ugccuguaauuccaacacuu

SEQ ID NO: 33449 - RNA, 20 nt, Artificial Sequence
  CIITA targeting sequence
aacacuuugggaggccgccc

SEQ ID NO: 33450 - RNA, 20 nt, Artificial Sequence
  CIITA targeting sequence
caaaguguuggaauuacagg

SEQ ID NO: 33451 - RNA, 20 nt, Artificial Sequence
  CIITA targeting sequence
ugggcggccucccaaagugu

SEQ ID NO: 33452 - RNA, 20 nt, Artificial Sequence
  CIITA targeting sequence
aacucuugggcggccuccca

SEQ ID NO: 33453 - RNA, 20 nt, Artificial Sequence
  CIITA targeting sequence
caaacucuugggcggccucc

SEQ ID NO: 33454 - RNA, 20 nt, Artificial Sequence
  CIITA targeting sequence
cuauguugcccaggcugguc

SEQ ID NO: 33455 - RNA, 20 nt, Artificial Sequence
  CIITA targeting sequence
cccuauguugcccaggcugg

SEQ ID NO: 33456 - RNA, 20 nt, Artificial Sequence
  CIITA targeting sequence
guaaacauggggucucccua

SEQ ID NO: 33457 - RNA, 20 nt, Artificial Sequence
  CIITA targeting sequence
ggcuaauuuuuuaaauuuuu

SEQ ID NO: 33458 - RNA, 20 nt, Artificial Sequence
  CIITA targeting sequence
agcuacuugggaggcugagg

SEQ ID NO: 33459 - RNA, 20 nt, Artificial Sequence
  CIITA targeting sequence
caaguagcuggacuacaagc

SEQ ID NO: 33460 - RNA, 20 nt, Artificial Sequence
  CIITA targeting sequence
gccucccaaguagcuggacu

SEQ ID NO: 33461 - RNA, 20 nt, Artificial Sequence
  CIITA targeting sequence
caccucagccucccaaguag

SEQ ID NO: 33462 - RNA, 20 nt, Artificial Sequence
  CIITA targeting sequence
cccaccucagccucccaagu

SEQ ID NO: 33463 - RNA, 20 nt, Artificial Sequence
  CIITA targeting sequence
agcccaggagguugaggcug

SEQ ID NO: 33464 - RNA, 20 nt, Artificial Sequence
  CIITA targeting sequence
agcaauucucccaccucagc

SEQ ID NO: 33465 - RNA, 20 nt, Artificial Sequence
  CIITA targeting sequence
ugggcucgagcaauucuccc

SEQ ID NO: 33466 - RNA, 20 nt, Artificial Sequence
  CIITA targeting sequence
accuccugggcucgagcaau

SEQ ID NO: 33467 - RNA, 20 nt, Artificial Sequence
  CIITA targeting sequence
cugcagccucaaccuccugg

SEQ ID NO: 33468 - RNA, 20 nt, Artificial Sequence
  CIITA targeting sequence
uagcucacugcagccucaac

SEQ ID NO: 33469 - RNA, 20 nt, Artificial Sequence
  CIITA targeting sequence
agccugggcaacagcgcaag

SEQ ID NO: 33470 - RNA, 20 nt, Artificial Sequence
  CIITA targeting sequence
ugcgcuguugcccaggcugg

SEQ ID NO: 33471 - RNA, 20 nt, Artificial Sequence
  CIITA targeting sequence
gucaaaaaauaaaaauuaaa

SEQ ID NO: 33472 - RNA, 20 nt, Artificial Sequence
  CIITA targeting sequence
aaaaauaaaaauuaaaugag

SEQ ID NO: 33473 - RNA, 20 nt, Artificial Sequence
  CIITA targeting sequence
uuuaauuuuuauuuuuugac

SEQ ID NO: 33474 - RNA, 20 nt, Artificial Sequence
  CIITA targeting sequence
uuguaaaauuuacucauuua

SEQ ID NO: 33475 - RNA, 20 nt, Artificial Sequence
  CIITA targeting sequence
uauuuuguucuuuguaaaau

SEQ ID NO: 33476 - RNA, 20 nt, Artificial Sequence
  CIITA targeting sequence
agaaaugaaaaauauaacua

SEQ ID NO: 33477 - RNA, 20 nt, Artificial Sequence
  CIITA targeting sequence
agaagucuuauuuuguucuu

SEQ ID NO: 33478 - RNA, 20 nt, Artificial Sequence
  CIITA targeting sequence
uuucuagaagucuuauuuug

SEQ ID NO: 33479 - RNA, 20 nt, Artificial Sequence
  CIITA targeting sequence
uuuuuaguuauauuuuucau

SEQ ID NO: 33480 - RNA, 20 nt, Artificial Sequence
  CIITA targeting sequence
acuaauuuaccauuuaauuu

SEQ ID NO: 33481 - RNA, 20 nt, Artificial Sequence
  CIITA targeting sequence
gauucacuaauucugaagaa

SEQ ID NO: 33482 - RNA, 20 nt, Artificial Sequence
  CIITA targeting sequence
gaaaaucuacuaauuuacca

SEQ ID NO: 33483 - RNA, 20 nt, Artificial Sequence
  CIITA targeting sequence
cuaauucugaagaagaaaga

SEQ ID NO: 33484 - RNA, 20 nt, Artificial Sequence
  CIITA targeting sequence
gaagaagaaagauguaagag

SEQ ID NO: 33485 - RNA, 20 nt, Artificial Sequence
  CIITA targeting sequence
gaauuagugaaucagaaaau

SEQ ID NO: 33486 - RNA, 20 nt, Artificial Sequence
  CIITA targeting sequence
ucagaauuagugaaucagaa

SEQ ID NO: 33487 - RNA, 20 nt, Artificial Sequence
  CIITA targeting sequence
ucuucagaauuagugaauca

SEQ ID NO: 33488 - RNA, 20 nt, Artificial Sequence
  CIITA targeting sequence
uucuucuucagaauuaguga

SEQ ID NO: 33489 - RNA, 20 nt, Artificial Sequence
  CIITA targeting sequence
uacaucuuucuucuucagaa

SEQ ID NO: 33490 - RNA, 20 nt, Artificial Sequence
  CIITA targeting sequence
cuuacaucuuucuucuucag

SEQ ID NO: 33491 - RNA, 20 nt, Artificial Sequence
  CIITA targeting sequence
uuuaacauaucucuuacauc

SEQ ID NO: 33492 - RNA, 20 nt, Artificial Sequence
  CIITA targeting sequence
augucuuuuaacauaucucu

SEQ ID NO: 33493 - RNA, 20 nt, Artificial Sequence
  CIITA targeting sequence
ucuaugucuuuuaacauauc

SEQ ID NO: 33494 - RNA, 20 nt, Artificial Sequence
  CIITA targeting sequence
aauuuguuuuauguuacacc

SEQ ID NO: 33495 - RNA, 20 nt, Artificial Sequence
  CIITA targeting sequence
gaaguaaauaacagagaaaa

SEQ ID NO: 33496 - RNA, 20 nt, Artificial Sequence
  CIITA targeting sequence
gaaacuccaauuuguuuuau

SEQ ID NO: 33497 - RNA, 20 nt, Artificial Sequence
  CIITA targeting sequence
guuauuuacuucugaaacuc

SEQ ID NO: 33498 - RNA, 20 nt, Artificial Sequence
  CIITA targeting sequence
cuguuauuuacuucugaaac

SEQ ID NO: 33499 - RNA, 20 nt, Artificial Sequence
  CIITA targeting sequence
cauuuucucuguuauuuacu

SEQ ID NO: 33500 - RNA, 20 nt, Artificial Sequence
  CIITA targeting sequence
uuaaguauuaccuuucccau

SEQ ID NO: 33501 - RNA, 20 nt, Artificial Sequence
  CIITA targeting sequence
uuguauauaugcaucucuau

SEQ ID NO: 33502 - RNA, 20 nt, Artificial Sequence
  CIITA targeting sequence
cuauucaagagaacauuuau

SEQ ID NO: 33503 - RNA, 20 nt, Artificial Sequence
  CIITA targeting sequence
auucaagagaacauuuaucu

SEQ ID NO: 33504 - RNA, 20 nt, Artificial Sequence
  CIITA targeting sequence
agagaacauuuaucuugaau

SEQ ID NO: 33505 - RNA, 20 nt, Artificial Sequence
  CIITA targeting sequence
ugaauagagaugcauauaua

SEQ ID NO: 33506 - RNA, 20 nt, Artificial Sequence
  CIITA targeting sequence
cuugaauagagaugcauaua

SEQ ID NO: 33507 - RNA, 20 nt, Artificial Sequence
  CIITA targeting sequence
ugaaugugcucuugauaaga

SEQ ID NO: 33508 - RNA, 20 nt, Artificial Sequence
  CIITA targeting sequence
agauaaauguucucuugaau

SEQ ID NO: 33509 - RNA, 20 nt, Artificial Sequence
  CIITA targeting sequence
ugauaagacuucaaaggaaa

SEQ ID NO: 33510 - RNA, 20 nt, Artificial Sequence
  CIITA targeting sequence
agagcacauucaagauaaau

SEQ ID NO: 33511 - RNA, 20 nt, Artificial Sequence
  CIITA targeting sequence
uaucaagagcacauucaaga

SEQ ID NO: 33512 - RNA, 20 nt, Artificial Sequence
  CIITA targeting sequence
aaggaaagaaaaaaugcacu

SEQ ID NO: 33513 - RNA, 20 nt, Artificial Sequence
  CIITA targeting sequence
uuugaagucuuaucaagagc

SEQ ID NO: 33514 - RNA, 20 nt, Artificial Sequence
  CIITA targeting sequence
uuccuuugaagucuuaucaa

SEQ ID NO: 33515 - RNA, 20 nt, Artificial Sequence
  CIITA targeting sequence
gaccuggaaauuuugaucuu

SEQ ID NO: 33516 - RNA, 20 nt, Artificial Sequence
  CIITA targeting sequence
gagugcauuuuuucuuuccu

SEQ ID NO: 33517 - RNA, 20 nt, Artificial Sequence
  CIITA targeting sequence
aggucagagugcauuuuuuc

SEQ ID NO: 33518 - RNA, 20 nt, Artificial Sequence
  CIITA targeting sequence
aaauuuccaggucagagugc

SEQ ID NO: 33519 - RNA, 20 nt, Artificial Sequence
  CIITA targeting sequence
uaguuuacuaaauguaauuu

SEQ ID NO: 33520 - RNA, 20 nt, Artificial Sequence
  CIITA targeting sequence
gcauugacuauuuagucuac

SEQ ID NO: 33521 - RNA, 20 nt, Artificial Sequence
  CIITA targeting sequence
augcagacaaauuacauuua

SEQ ID NO: 33522 - RNA, 20 nt, Artificial Sequence
  CIITA targeting sequence
acgucuucuaaaacuucaga

SEQ ID NO: 33523 - RNA, 20 nt, Artificial Sequence
  CIITA targeting sequence
ucuaaaacuucagagcaggc

SEQ ID NO: 33524 - RNA, 20 nt, Artificial Sequence
  CIITA targeting sequence
aaaacuucagagcaggccag

SEQ ID NO: 33525 - RNA, 20 nt, Artificial Sequence
  CIITA targeting sequence
gagcaggccaggcauggugg

SEQ ID NO: 33526 - RNA, 20 nt, Artificial Sequence
  CIITA targeting sequence
gaaguuuuagaagacguaga

SEQ ID NO: 33527 - RNA, 20 nt, Artificial Sequence
  CIITA targeting sequence
cacccauaaucccaggacuu

SEQ ID NO: 33528 - RNA, 20 nt, Artificial Sequence
  CIITA targeting sequence
caggacuuuggaaggcugag

SEQ ID NO: 33529 - RNA, 20 nt, Artificial Sequence
  CIITA targeting sequence
ugggauuaugggugugagcc

SEQ ID NO: 33530 - RNA, 20 nt, Artificial Sequence
  CIITA targeting sequence
aaaguccugggauuaugggu

SEQ ID NO: 33531 - RNA, 20 nt, Artificial Sequence
  CIITA targeting sequence
gccuuccaaaguccugggau

SEQ ID NO: 33532 - RNA, 20 nt, Artificial Sequence
  CIITA targeting sequence
ucagccuuccaaaguccugg

SEQ ID NO: 33533 - RNA, 20 nt, Artificial Sequence
  CIITA targeting sequence
uuccucagccuuccaaaguc

SEQ ID NO: 33534 - RNA, 20 nt, Artificial Sequence
  CIITA targeting sequence
uccuuccucagccuuccaaa

SEQ ID NO: 33535 - RNA, 20 nt, Artificial Sequence
  CIITA targeting sequence
cugagauguuaggauuacag

SEQ ID NO: 33536 - RNA, 20 nt, Artificial Sequence
  CIITA targeting sequence
gugauccuccuuccucagcc

SEQ ID NO: 33537 - RNA, 20 nt, Artificial Sequence
  CIITA targeting sequence
cagugauccuccuuccucag

SEQ ID NO: 33538 - RNA, 20 nt, Artificial Sequence
  CIITA targeting sequence
uaacaucucagugauccucc

SEQ ID NO: 33539 - RNA, 20 nt, Artificial Sequence
  CIITA targeting sequence
caccuguaauccuaacaucu

SEQ ID NO: 33540 - RNA, 20 nt, Artificial Sequence
  CIITA targeting sequence
ccacaccuggcccagauuua

SEQ ID NO: 33541 - RNA, 20 nt, Artificial Sequence
  CIITA targeting sequence
gggccagguguggugacuca

SEQ ID NO: 33542 - RNA, 20 nt, Artificial Sequence
  CIITA targeting sequence
uauuaguuaaagguaaaucu

SEQ ID NO: 33543 - RNA, 20 nt, Artificial Sequence
  CIITA targeting sequence
uaugcagcuuacagucuuau

SEQ ID NO: 33544 - RNA, 20 nt, Artificial Sequence
  CIITA targeting sequence
uuuuuuuuucuuugauuuuu

SEQ ID NO: 33545 - RNA, 20 nt, Artificial Sequence
  CIITA targeting sequence
uugauuuuuuguucaugauu

SEQ ID NO: 33546 - RNA, 20 nt, Artificial Sequence
  CIITA targeting sequence
aagaaaaaaaaaagaaaauu

SEQ ID NO: 33547 - RNA, 20 nt, Artificial Sequence
  CIITA targeting sequence
ugauuguuuucccuguuucu

SEQ ID NO: 33548 - RNA, 20 nt, Artificial Sequence
  CIITA targeting sequence
ugaacaaaaaaucaaagaaa

SEQ ID NO: 33549 - RNA, 20 nt, Artificial Sequence
  CIITA targeting sequence
cuguuucuguuagugcccca

SEQ ID NO: 33550 - RNA, 20 nt, Artificial Sequence
  CIITA targeting sequence
guuagugccccacugggguu

SEQ ID NO: 33551 - RNA, 20 nt, Artificial Sequence
  CIITA targeting sequence
accccaguggggcacuaaca

SEQ ID NO: 33552 - RNA, 20 nt, Artificial Sequence
  CIITA targeting sequence
uuuauucaauaaaugaauga

SEQ ID NO: 33553 - RNA, 20 nt, Artificial Sequence
  CIITA targeting sequence
auaaaugaaugaguuuguua

SEQ ID NO: 33554 - RNA, 20 nt, Artificial Sequence
  CIITA targeting sequence
uuuauugaauaaaugaauca

SEQ ID NO: 33555 - RNA, 20 nt, Artificial Sequence
  CIITA targeting sequence
uucauuuauugaauaaauga

SEQ ID NO: 33556 - RNA, 20 nt, Artificial Sequence
  CIITA targeting sequence
aacaaacucauucauuuauu

SEQ ID NO: 33557 - RNA, 20 nt, Artificial Sequence
  CIITA targeting sequence
aacauaugaugaacaucauu

SEQ ID NO: 33558 - RNA, 20 nt, Artificial Sequence
  CIITA targeting sequence
uauguuagacuaggccuggc

SEQ ID NO: 33559 - RNA, 20 nt, Artificial Sequence
  CIITA targeting sequence
ucauauguuagacuaggccu

SEQ ID NO: 33560 - RNA, 20 nt, Artificial Sequence
  CIITA targeting sequence
uuucccaguugaggaaacua

SEQ ID NO: 33561 - RNA, 20 nt, Artificial Sequence
  CIITA targeting sequence
caguugaggaaacuaagaca

SEQ ID NO: 33562 - RNA, 20 nt, Artificial Sequence
  CIITA targeting sequence
acugggaaaugauguucauc

SEQ ID NO: 33563 - RNA, 20 nt, Artificial Sequence
  CIITA targeting sequence
ucaacugggaaaugauguuc

SEQ ID NO: 33564 - RNA, 20 nt, Artificial Sequence
  CIITA targeting sequence
uaguuuccucaacugggaaa

SEQ ID NO: 33565 - RNA, 20 nt, Artificial Sequence
  CIITA targeting sequence
agcuuauauguaauaaagca

SEQ ID NO: 33566 - RNA, 20 nt, Artificial Sequence
  CIITA targeting sequence
cugcuuuauuacauauaagc

SEQ ID NO: 33567 - RNA, 20 nt, Artificial Sequence
  CIITA targeting sequence
aauccacuuauacuaacaac

SEQ ID NO: 33568 - RNA, 20 nt, Artificial Sequence
  CIITA targeting sequence
acuuauacuaacaacauggc

SEQ ID NO: 33569 - RNA, 20 nt, Artificial Sequence
  CIITA targeting sequence
gccaccgcgccuggccaugu

SEQ ID NO: 33570 - RNA, 20 nt, Artificial Sequence
  CIITA targeting sequence
caaagugcugcaauuacagg

SEQ ID NO: 33571 - RNA, 20 nt, Artificial Sequence
  CIITA targeting sequence
aggcggguggauuacaugag

SEQ ID NO: 33572 - RNA, 20 nt, Artificial Sequence
  CIITA targeting sequence
acccgccuugaccucccaaa

SEQ ID NO: 33573 - RNA, 20 nt, Artificial Sequence
  CIITA targeting sequence
uguaauccacccgccuugac

SEQ ID NO: 33574 - RNA, 20 nt, Artificial Sequence
  CIITA targeting sequence
uggccucauguaauccaccc

SEQ ID NO: 33575 - RNA, 20 nt, Artificial Sequence
  CIITA targeting sequence
aacuccuggccucauguaau

SEQ ID NO: 33576 - RNA, 20 nt, Artificial Sequence
  CIITA targeting sequence
caaacuccuggccucaugua

SEQ ID NO: 33577 - RNA, 20 nt, Artificial Sequence
  CIITA targeting sequence
ccauguuggccaggcugguc

SEQ ID NO: 33578 - RNA, 20 nt, Artificial Sequence
  CIITA targeting sequence
cuacuaaaaauacaaaaauu

SEQ ID NO: 33579 - RNA, 20 nt, Artificial Sequence
  CIITA targeting sequence
acuaaaaauacaaaaauuag

SEQ ID NO: 33580 - RNA, 20 nt, Artificial Sequence
  CIITA targeting sequence
gcuaauuuuuguauuuuuag

SEQ ID NO: 33581 - RNA, 20 nt, Artificial Sequence
  CIITA targeting sequence
cacucugcuaauuuuuguau

SEQ ID NO: 33582 - RNA, 20 nt, Artificial Sequence
  CIITA targeting sequence
cagcuacucaggaggcuaag

SEQ ID NO: 33583 - RNA, 20 nt, Artificial Sequence
  CIITA targeting sequence
ggaggcuaaggcaggagaau

SEQ ID NO: 33584 - RNA, 20 nt, Artificial Sequence
  CIITA targeting sequence
ugaguagcugggauuacagg

SEQ ID NO: 33585 - RNA, 20 nt, Artificial Sequence
  CIITA targeting sequence
ugccuuagccuccugaguag

SEQ ID NO: 33586 - RNA, 20 nt, Artificial Sequence
  CIITA targeting sequence
ccugccuuagccuccugagu

SEQ ID NO: 33587 - RNA, 20 nt, Artificial Sequence
  CIITA targeting sequence
cuugaaccgggaggcggagg

SEQ ID NO: 33588 - RNA, 20 nt, Artificial Sequence
  CIITA targeting sequence
agcgauucuccugccuuagc

SEQ ID NO: 33589 - RNA, 20 nt, Artificial Sequence
  CIITA targeting sequence
cgguucaagcgauucuccug

SEQ ID NO: 33590 - RNA, 20 nt, Artificial Sequence
  CIITA targeting sequence
gccucccgguucaagcgauu

SEQ ID NO: 33591 - RNA, 20 nt, Artificial Sequence
  CIITA targeting sequence
cugcaaccuccgccucccgg

SEQ ID NO: 33592 - RNA, 20 nt, Artificial Sequence
  CIITA targeting sequence
gcucacugcaaccuccgccu

SEQ ID NO: 33593 - RNA, 20 nt, Artificial Sequence
  CIITA targeting sequence
cagcucacugcaaccuccgc

SEQ ID NO: 33594 - RNA, 20 nt, Artificial Sequence
  CIITA targeting sequence
ugccacugcacuccagccug

SEQ ID NO: 33595 - RNA, 20 nt, Artificial Sequence
  CIITA targeting sequence
agccugggugacagaccaag

SEQ ID NO: 33596 - RNA, 20 nt, Artificial Sequence
  CIITA targeting sequence
cccaggcuggagugcagugg

SEQ ID NO: 33597 - RNA, 20 nt, Artificial Sequence
  CIITA targeting sequence
gucacccaggcuggagugca

SEQ ID NO: 33598 - RNA, 20 nt, Artificial Sequence
  CIITA targeting sequence
uggucugucacccaggcugg

SEQ ID NO: 33599 - RNA, 20 nt, Artificial Sequence
  CIITA targeting sequence
cucucagaaaaauagaagaa

SEQ ID NO: 33600 - RNA, 20 nt, Artificial Sequence
  CIITA targeting sequence
cucagaaaaauagaagaaua

SEQ ID NO: 33601 - RNA, 20 nt, Artificial Sequence
  CIITA targeting sequence
cagaaaaauagaagaauacu

SEQ ID NO: 33602 - RNA, 20 nt, Artificial Sequence
  CIITA targeting sequence
gaaaaauagaagaauacuga

SEQ ID NO: 33603 - RNA, 20 nt, Artificial Sequence
  CIITA targeting sequence
gagagagagucuuggucugu

SEQ ID NO: 33604 - RNA, 20 nt, Artificial Sequence
  CIITA targeting sequence
auuuuucugagagagagucu

SEQ ID NO: 33605 - RNA, 20 nt, Artificial Sequence
  CIITA targeting sequence
ucuauuuuucugagagagag

SEQ ID NO: 33606 - RNA, 20 nt, Artificial Sequence
  CIITA targeting sequence
guauucuucuauuuuucuga

SEQ ID NO: 33607 - RNA, 20 nt, Artificial Sequence
  CIITA targeting sequence
ugccaccuuuaucaguauuc

SEQ ID NO: 33608 - RNA, 20 nt, Artificial Sequence
  CIITA targeting sequence
ccaccaccauuccugccacc

SEQ ID NO: 33609 - RNA, 20 nt, Artificial Sequence
  CIITA targeting sequence
ucaccaccaccauuccugcc

SEQ ID NO: 33610 - RNA, 20 nt, Artificial Sequence
  CIITA targeting sequence
ccaccaucaucaccaccacc

SEQ ID NO: 33611 - RNA, 20 nt, Artificial Sequence
  CIITA targeting sequence
ucaccaccaucaucaccacc

SEQ ID NO: 33612 - RNA, 20 nt, Artificial Sequence
  CIITA targeting sequence
ccaccacugucaucaccacc

SEQ ID NO: 33613 - RNA, 20 nt, Artificial Sequence
  CIITA targeting sequence
ucaccaccacugucaucacc

SEQ ID NO: 33614 - RNA, 20 nt, Artificial Sequence
  CIITA targeting sequence
ucaucaccaccacugucauc

SEQ ID NO: 33615 - RNA, 20 nt, Artificial Sequence
  CIITA targeting sequence
ccaccaucaucaucaccacc

SEQ ID NO: 33616 - RNA, 20 nt, Artificial Sequence
  CIITA targeting sequence
ucaccaccaucaucaucacc

SEQ ID NO: 33617 - RNA, 20 nt, Artificial Sequence
  CIITA targeting sequence
ccaccaccaccaccaccacc

SEQ ID NO: 33618 - RNA, 20 nt, Artificial Sequence
  CIITA targeting sequence
ccaccaccaucaccaccacc

SEQ ID NO: 33619 - RNA, 20 nt, Artificial Sequence
  CIITA targeting sequence
ccaccaccaccaccaucacc

SEQ ID NO: 33620 - RNA, 20 nt, Artificial Sequence
  CIITA targeting sequence
ccaccaccacuaucaccacc

SEQ ID NO: 33621 - RNA, 20 nt, Artificial Sequence
  CIITA targeting sequence
ccaacaccaucaccaccacc

SEQ ID NO: 33622 - RNA, 20 nt, Artificial Sequence
  CIITA targeting sequence
ucaccaacaccaucaccacc

SEQ ID NO: 33623 - RNA, 20 nt, Artificial Sequence
  CIITA targeting sequence
ucaucaccaacaccaucacc

SEQ ID NO: 33624 - RNA, 20 nt, Artificial Sequence
  CIITA targeting sequence
ugauggugguagugauggug

SEQ ID NO: 33625 - RNA, 20 nt, Artificial Sequence
  CIITA targeting sequence
ugaccaucaucaucaccaac

SEQ ID NO: 33626 - RNA, 20 nt, Artificial Sequence
  CIITA targeting sequence
cuaccaccaucaugaccauc

SEQ ID NO: 33627 - RNA, 20 nt, Artificial Sequence
  CIITA targeting sequence
ccaccaucacuaccaccauc

SEQ ID NO: 33628 - RNA, 20 nt, Artificial Sequence
  CIITA targeting sequence
ccgccaucaccaccaucacu

SEQ ID NO: 33629 - RNA, 20 nt, Artificial Sequence
  CIITA targeting sequence
ccaccaccaucaccgccauc

SEQ ID NO: 33630 - RNA, 20 nt, Artificial Sequence
  CIITA targeting sequence
ucaccaccaccaucaccgcc

SEQ ID NO: 33631 - RNA, 20 nt, Artificial Sequence
  CIITA targeting sequence
ccaccgucaucaccaccacc

SEQ ID NO: 33632 - RNA, 20 nt, Artificial Sequence
  CIITA targeting sequence
ccacaaccaucaccaccguc

SEQ ID NO: 33633 - RNA, 20 nt, Artificial Sequence
  CIITA targeting sequence
ucaccacaaccaucaccacc

SEQ ID NO: 33634 - RNA, 20 nt, Artificial Sequence
  CIITA targeting sequence
ccaucaucaccacaaccauc

SEQ ID NO: 33635 - RNA, 20 nt, Artificial Sequence
  CIITA targeting sequence
ccaccaccauugccaccauc

SEQ ID NO: 33636 - RNA, 20 nt, Artificial Sequence
  CIITA targeting sequence
uuaucaccaccaccauugcc

SEQ ID NO: 33637 - RNA, 20 nt, Artificial Sequence
  CIITA targeting sequence
ccaccaucauuaucaccacc

SEQ ID NO: 33638 - RNA, 20 nt, Artificial Sequence
  CIITA targeting sequence
ccaccaccaucaccaccauc

SEQ ID NO: 33639 - RNA, 20 nt, Artificial Sequence
  CIITA targeting sequence
ccaccaccaucaccaccacc

SEQ ID NO: 33640 - RNA, 20 nt, Artificial Sequence
  CIITA targeting sequence
cuaccaucaccaccaccauc

SEQ ID NO: 33641 - RNA, 20 nt, Artificial Sequence
  CIITA targeting sequence
ccaccaacaucacuaccauc

SEQ ID NO: 33642 - RNA, 20 nt, Artificial Sequence
  CIITA targeting sequence
acaucaccaccaacaucacu

SEQ ID NO: 33643 - RNA, 20 nt, Artificial Sequence
  CIITA targeting sequence
ccaccaccaacaccaccacc

SEQ ID NO: 33644 - RNA, 20 nt, Artificial Sequence
  CIITA targeting sequence
ucaccaccaccaacaccacc

SEQ ID NO: 33645 - RNA, 20 nt, Artificial Sequence
  CIITA targeting sequence
ucaucaccaccaccaacacc

SEQ ID NO: 33646 - RNA, 20 nt, Artificial Sequence
  CIITA targeting sequence
ccaccaccaucaucaucacc

SEQ ID NO: 33647 - RNA, 20 nt, Artificial Sequence
  CIITA targeting sequence
ccaccaccaucaccaccacc

SEQ ID NO: 33648 - RNA, 20 nt, Artificial Sequence
  CIITA targeting sequence
ccaucaccaccaccaucacc

SEQ ID NO: 33649 - RNA, 20 nt, Artificial Sequence
  CIITA targeting sequence
ucaccaucaccaccaccauc

SEQ ID NO: 33650 - RNA, 20 nt, Artificial Sequence
  CIITA targeting sequence
ccaccaucaucaccaucacc

SEQ ID NO: 33651 - RNA, 20 nt, Artificial Sequence
  CIITA targeting sequence
ccaccaucaccaccaucauc

SEQ ID NO: 33652 - RNA, 20 nt, Artificial Sequence
  CIITA targeting sequence
ccaccaucgccaccaucacc

SEQ ID NO: 33653 - RNA, 20 nt, Artificial Sequence
  CIITA targeting sequence
ccgccaccaucaccaccauc

SEQ ID NO: 33654 - RNA, 20 nt, Artificial Sequence
  CIITA targeting sequence
ccaucaccgccaccaucacc

SEQ ID NO: 33655 - RNA, 20 nt, Artificial Sequence
  CIITA targeting sequence
ucaccaucaccgccaccauc

SEQ ID NO: 33656 - RNA, 20 nt, Artificial Sequence
  CIITA targeting sequence
ccaccaccaccaucaucacc

SEQ ID NO: 33657 - RNA, 20 nt, Artificial Sequence
  CIITA targeting sequence
ccaccaccaucaccaccacc

SEQ ID NO: 33658 - RNA, 20 nt, Artificial Sequence
  CIITA targeting sequence
ccaccaucaccaccaccauc

SEQ ID NO: 33659 - RNA, 20 nt, Artificial Sequence
  CIITA targeting sequence
ucaccaccaucaccaccacc

SEQ ID NO: 33660 - RNA, 20 nt, Artificial Sequence
  CIITA targeting sequence
ccaccgcuaucgucaccacc

SEQ ID NO: 33661 - RNA, 20 nt, Artificial Sequence
  CIITA targeting sequence
ccaccaccaucaccaccgcu

SEQ ID NO: 33662 - RNA, 20 nt, Artificial Sequence
  CIITA targeting sequence
ucaccaccaccaucaccacc

SEQ ID NO: 33663 - RNA, 20 nt, Artificial Sequence
  CIITA targeting sequence
ucaucaccaccaccaucacc

SEQ ID NO: 33664 - RNA, 20 nt, Artificial Sequence
  CIITA targeting sequence
ccaccaucaucaucaccacc

SEQ ID NO: 33665 - RNA, 20 nt, Artificial Sequence
  CIITA targeting sequence
ucaccaccaucaucaucacc

SEQ ID NO: 33666 - RNA, 20 nt, Artificial Sequence
  CIITA targeting sequence
ccaucaucaccaccaucauc

SEQ ID NO: 33667 - RNA, 20 nt, Artificial Sequence
  CIITA targeting sequence
ccaccaccaucaccaucauc

SEQ ID NO: 33668 - RNA, 20 nt, Artificial Sequence
  CIITA targeting sequence
ucaccaccaccaucaccauc

SEQ ID NO: 33669 - RNA, 20 nt, Artificial Sequence
  CIITA targeting sequence
ccaccacuaucgucaccacc

SEQ ID NO: 33670 - RNA, 20 nt, Artificial Sequence
  CIITA targeting sequence
ucaccaccacuaucgucacc

SEQ ID NO: 33671 - RNA, 20 nt, Artificial Sequence
  CIITA targeting sequence
ccaucaucaccaccacuauc

SEQ ID NO: 33672 - RNA, 20 nt, Artificial Sequence
  CIITA targeting sequence
ccaucaccaucaucaccacc

SEQ ID NO: 33673 - RNA, 20 nt, Artificial Sequence
  CIITA targeting sequence
ucaccaucaccaucaucacc

SEQ ID NO: 33674 - RNA, 20 nt, Artificial Sequence
  CIITA targeting sequence
ccaccaccaucaucaccauc

SEQ ID NO: 33675 - RNA, 20 nt, Artificial Sequence
  CIITA targeting sequence
ucaccaccaccaucaucacc

SEQ ID NO: 33676 - RNA, 20 nt, Artificial Sequence
  CIITA targeting sequence
aucaucaccaccaccaucau

SEQ ID NO: 33677 - RNA, 20 nt, Artificial Sequence
  CIITA targeting sequence
ccaccuccaucaucaccacc

SEQ ID NO: 33678 - RNA, 20 nt, Artificial Sequence
  CIITA targeting sequence
ucaccaccuccaucaucacc

SEQ ID NO: 33679 - RNA, 20 nt, Artificial Sequence
  CIITA targeting sequence
gucaucaccaccuccaucau

SEQ ID NO: 33680 - RNA, 20 nt, Artificial Sequence
  CIITA targeting sequence
ccaccuccgucaucaccacc

SEQ ID NO: 33681 - RNA, 20 nt, Artificial Sequence
  CIITA targeting sequence
uccuguagacgacacgccac

SEQ ID NO: 33682 - RNA, 20 nt, Artificial Sequence
  CIITA targeting sequence
uguagacgacacgccaccca

SEQ ID NO: 33683 - RNA, 20 nt, Artificial Sequence
  CIITA targeting sequence
acaggaugacaucaccaccu

SEQ ID NO: 33684 - RNA, 20 nt, Artificial Sequence
  CIITA targeting sequence
ucuacaggaugacaucacca

SEQ ID NO: 33685 - RNA, 20 nt, Artificial Sequence
  CIITA targeting sequence
ccccacugcuuucagucaua

SEQ ID NO: 33686 - RNA, 20 nt, Artificial Sequence
  CIITA targeting sequence
ccacugcuuucagucauaag

SEQ ID NO: 33687 - RNA, 20 nt, Artificial Sequence
  CIITA targeting sequence
gucauaagccaggagugaac

SEQ ID NO: 33688 - RNA, 20 nt, Artificial Sequence
  CIITA targeting sequence
uaagccaggagugaacucca

SEQ ID NO: 33689 - RNA, 20 nt, Artificial Sequence
  CIITA targeting sequence
uggcuuaugacugaaagcag

SEQ ID NO: 33690 - RNA, 20 nt, Artificial Sequence
  CIITA targeting sequence
cuccuggcuuaugacugaaa

SEQ ID NO: 33691 - RNA, 20 nt, Artificial Sequence
  CIITA targeting sequence
auaugucuugcagggaaacc

SEQ ID NO: 33692 - RNA, 20 nt, Artificial Sequence
  CIITA targeting sequence
ugcagggaaacccaaaaagc

SEQ ID NO: 33693 - RNA, 20 nt, Artificial Sequence
  CIITA targeting sequence
cugcaagacauauggaguuc

SEQ ID NO: 33694 - RNA, 20 nt, Artificial Sequence
  CIITA targeting sequence
acagcccugagcagcagcca

SEQ ID NO: 33695 - RNA, 20 nt, Artificial Sequence
  CIITA targeting sequence
gggcuguggacugcuaccuu

SEQ ID NO: 33696 - RNA, 20 nt, Artificial Sequence
  CIITA targeting sequence
ccuuggcugcugcucagggc

SEQ ID NO: 33697 - RNA, 20 nt, Artificial Sequence
  CIITA targeting sequence
ggcugagaugcaacaaccug

SEQ ID NO: 33698 - RNA, 20 nt, Artificial Sequence
  CIITA targeting sequence
gccugagucaccuuggcugc

SEQ ID NO: 33699 - RNA, 20 nt, Artificial Sequence
  CIITA targeting sequence
cagccugagucaccuuggcu

SEQ ID NO: 33700 - RNA, 20 nt, Artificial Sequence
  CIITA targeting sequence
gugggcagacaggcagcagc

SEQ ID NO: 33701 - RNA, 20 nt, Artificial Sequence
  CIITA targeting sequence
gcccacagaccagguuguug

SEQ ID NO: 33702 - RNA, 20 nt, Artificial Sequence
  CIITA targeting sequence
aggcuggccccuguggcugc

SEQ ID NO: 33703 - RNA, 20 nt, Artificial Sequence
  CIITA targeting sequence
augggcacguccaggcuggc

SEQ ID NO: 33704 - RNA, 20 nt, Artificial Sequence
  CIITA targeting sequence
agggagcugauccucuuccu

SEQ ID NO: 33705 - RNA, 20 nt, Artificial Sequence
  CIITA targeting sequence
cuggaucuaugggcacgucc

SEQ ID NO: 33706 - RNA, 20 nt, Artificial Sequence
  CIITA targeting sequence
gcucccuggaucuaugggca

SEQ ID NO: 33707 - RNA, 20 nt, Artificial Sequence
  CIITA targeting sequence
ucuuccucucaaggggaagu

SEQ ID NO: 33708 - RNA, 20 nt, Artificial Sequence
  CIITA targeting sequence
uccucucaaggggaaguagc

SEQ ID NO: 33709 - RNA, 20 nt, Artificial Sequence
  CIITA targeting sequence
ucucaaggggaaguagccac

SEQ ID NO: 33710 - RNA, 20 nt, Artificial Sequence
  CIITA targeting sequence
caaggggaaguagccacucc

SEQ ID NO: 33711 - RNA, 20 nt, Artificial Sequence
  CIITA targeting sequence
aggggaaguagccacuccag

SEQ ID NO: 33712 - RNA, 20 nt, Artificial Sequence
  CIITA targeting sequence
ccuugagaggaagaggauca

SEQ ID NO: 33713 - RNA, 20 nt, Artificial Sequence
  CIITA targeting sequence
agcagaugcuguguucccag

SEQ ID NO: 33714 - RNA, 20 nt, Artificial Sequence
  CIITA targeting sequence
gcuggaguggcuacuucccc

SEQ ID NO: 33715 - RNA, 20 nt, Artificial Sequence
  CIITA targeting sequence
cagcccucuucuccuuuuca

SEQ ID NO: 33716 - RNA, 20 nt, Artificial Sequence
  CIITA targeting sequence
ucuccuuuucaaaaucugca

SEQ ID NO: 33717 - RNA, 20 nt, Artificial Sequence
  CIITA targeting sequence
ccuuuucaaaaucugcagcc

SEQ ID NO: 33718 - RNA, 20 nt, Artificial Sequence
  CIITA targeting sequence
uuuucaaaaucugcagccca

SEQ ID NO: 33719 - RNA, 20 nt, Artificial Sequence
  CIITA targeting sequence
aaaucugcagcccaguguuc

SEQ ID NO: 33720 - RNA, 20 nt, Artificial Sequence
  CIITA targeting sequence
gcagcccaguguuccuccca

SEQ ID NO: 33721 - RNA, 20 nt, Artificial Sequence
  CIITA targeting sequence
ucccaggaacgcagggucug

SEQ ID NO: 33722 - RNA, 20 nt, Artificial Sequence
  CIITA targeting sequence
caggaacgcagggucuggcc

SEQ ID NO: 33723 - RNA, 20 nt, Artificial Sequence
  CIITA targeting sequence
ugggaggaacacugggcugc

SEQ ID NO: 33724 - RNA, 20 nt, Artificial Sequence
  CIITA targeting sequence
ggcccagguucuguaacuua

SEQ ID NO: 33725 - RNA, 20 nt, Artificial Sequence
  CIITA targeting sequence
guaacuuacaccuuagccgc

SEQ ID NO: 33726 - RNA, 20 nt, Artificial Sequence
  CIITA targeting sequence
auagaguaagaugauugaug

SEQ ID NO: 33727 - RNA, 20 nt, Artificial Sequence
  CIITA targeting sequence
auggaugcggcuaaggugua

SEQ ID NO: 33728 - RNA, 20 nt, Artificial Sequence
  CIITA targeting sequence
uacucuauggaugcggcuaa

SEQ ID NO: 33729 - RNA, 20 nt, Artificial Sequence
  CIITA targeting sequence
ucuuacucuauggaugcggc

SEQ ID NO: 33730 - RNA, 20 nt, Artificial Sequence
  CIITA targeting sequence
aucaucuuacucuauggaug

SEQ ID NO: 33731 - RNA, 20 nt, Artificial Sequence
  CIITA targeting sequence
uugaauuauuuuuggugaug

SEQ ID NO: 33732 - RNA, 20 nt, Artificial Sequence
  CIITA targeting sequence
aggaaagcaucaaucaucuu

SEQ ID NO: 33733 - RNA, 20 nt, Artificial Sequence
  CIITA targeting sequence
ccaaaaauaauucaaggaaa

SEQ ID NO: 33734 - RNA, 20 nt, Artificial Sequence
  CIITA targeting sequence
ucaccaaaaauaauucaagg

SEQ ID NO: 33735 - RNA, 20 nt, Artificial Sequence
  CIITA targeting sequence
uaucaucaccaaaaauaauu

SEQ ID NO: 33736 - RNA, 20 nt, Artificial Sequence
  CIITA targeting sequence
uauacagaaagcaucuaacu

SEQ ID NO: 33737 - RNA, 20 nt, Artificial Sequence
  CIITA targeting sequence
guauaugaucuuaucaucac

SEQ ID NO: 33738 - RNA, 20 nt, Artificial Sequence
  CIITA targeting sequence
aacuccccaguauucucacu

SEQ ID NO: 33739 - RNA, 20 nt, Artificial Sequence
  CIITA targeting sequence
ccaguauucucacucaagaa

SEQ ID NO: 33740 - RNA, 20 nt, Artificial Sequence
  CIITA targeting sequence
cacucaagaaaugauaucug

SEQ ID NO: 33741 - RNA, 20 nt, Artificial Sequence
  CIITA targeting sequence
cucaagaaaugauaucugaa

SEQ ID NO: 33742 - RNA, 20 nt, Artificial Sequence
  CIITA targeting sequence
agaaaugauaucugaauuuu

SEQ ID NO: 33743 - RNA, 20 nt, Artificial Sequence
  CIITA targeting sequence
ugagugagaauacuggggag

SEQ ID NO: 33744 - RNA, 20 nt, Artificial Sequence
  CIITA targeting sequence
uuucuugagugagaauacug

SEQ ID NO: 33745 - RNA, 20 nt, Artificial Sequence
  CIITA targeting sequence
gaauuuuuaaaauuauauca

SEQ ID NO: 33746 - RNA, 20 nt, Artificial Sequence
  CIITA targeting sequence
gauaucauuucuugagugag

SEQ ID NO: 33747 - RNA, 20 nt, Artificial Sequence
  CIITA targeting sequence
ucauugauuuccagcuggag

SEQ ID NO: 33748 - RNA, 20 nt, Artificial Sequence
  CIITA targeting sequence
uugauuuccagcuggaggag

SEQ ID NO: 33749 - RNA, 20 nt, Artificial Sequence
  CIITA targeting sequence
augaugauauaauuuuaaaa

SEQ ID NO: 33750 - RNA, 20 nt, Artificial Sequence
  CIITA targeting sequence
agcuggaggagcaggaacua

SEQ ID NO: 33751 - RNA, 20 nt, Artificial Sequence
  CIITA targeting sequence
agcuggaaaucaaugaugau

SEQ ID NO: 33752 - RNA, 20 nt, Artificial Sequence
  CIITA targeting sequence
uccagcuggaaaucaaugau

SEQ ID NO: 33753 - RNA, 20 nt, Artificial Sequence
  CIITA targeting sequence
ugcuccuccagcuggaaauc

SEQ ID NO: 33754 - RNA, 20 nt, Artificial Sequence
  CIITA targeting sequence
aguuccugcuccuccagcug

SEQ ID NO: 33755 - RNA, 20 nt, Artificial Sequence
  CIITA targeting sequence
cuaguuccugcuccuccagc

SEQ ID NO: 33756 - RNA, 20 nt, Artificial Sequence
  CIITA targeting sequence
ccuaccuguugggugggggg

SEQ ID NO: 33757 - RNA, 20 nt, Artificial Sequence
  CIITA targeting sequence
aggaccaccuaagcuccuag

SEQ ID NO: 33758 - RNA, 20 nt, Artificial Sequence
  CIITA targeting sequence
uugacgucaccuaccuguug

SEQ ID NO: 33759 - RNA, 20 nt, Artificial Sequence
  CIITA targeting sequence
uagccgugaacuggggaaau

SEQ ID NO: 33760 - RNA, 20 nt, Artificial Sequence
  CIITA targeting sequence
cggcuaggagcuuagguggu

SEQ ID NO: 33761 - RNA, 20 nt, Artificial Sequence
  CIITA targeting sequence
ccaguucacggcuaggagcu

SEQ ID NO: 33762 - RNA, 20 nt, Artificial Sequence
  CIITA targeting sequence
auuuccccaguucacggcua

SEQ ID NO: 33763 - RNA, 20 nt, Artificial Sequence
  CIITA targeting sequence
cugccccucucaacagaucc

SEQ ID NO: 33764 - RNA, 20 nt, Artificial Sequence
  CIITA targeting sequence
caacagaucccucagcaccc

SEQ ID NO: 33765 - RNA, 20 nt, Artificial Sequence
  CIITA targeting sequence
acagaucccucagcacccuc

SEQ ID NO: 33766 - RNA, 20 nt, Artificial Sequence
  CIITA targeting sequence
guugagaggggcagugaagu

SEQ ID NO: 33767 - RNA, 20 nt, Artificial Sequence
  CIITA targeting sequence
cucagcacccucucuuuucc

SEQ ID NO: 33768 - RNA, 20 nt, Artificial Sequence
  CIITA targeting sequence
gcacccucucuuuucccugc

SEQ ID NO: 33769 - RNA, 20 nt, Artificial Sequence
  CIITA targeting sequence
cuuuucccugcuuucagccu

SEQ ID NO: 33770 - RNA, 20 nt, Artificial Sequence
  CIITA targeting sequence
uuucccugcuuucagccuca

SEQ ID NO: 33771 - RNA, 20 nt, Artificial Sequence
  CIITA targeting sequence
cugcuuucagccucaggcuc

SEQ ID NO: 33772 - RNA, 20 nt, Artificial Sequence
  CIITA targeting sequence
gccucaggcuccaagcuucu

SEQ ID NO: 33773 - RNA, 20 nt, Artificial Sequence
  CIITA targeting sequence
ggcuccaagcuucucauccc

SEQ ID NO: 33774 - RNA, 20 nt, Artificial Sequence
  CIITA targeting sequence
aagcuucucauccccagggc

SEQ ID NO: 33775 - RNA, 20 nt, Artificial Sequence
  CIITA targeting sequence
cauccccagggccccuagug

SEQ ID NO: 33776 - RNA, 20 nt, Artificial Sequence
  CIITA targeting sequence
uccccagggccccuaguguc

SEQ ID NO: 33777 - RNA, 20 nt, Artificial Sequence
  CIITA targeting sequence
ccagggccccuagugucuuc

SEQ ID NO: 33778 - RNA, 20 nt, Artificial Sequence
  CIITA targeting sequence
ucagagucaagacccagauc

SEQ ID NO: 33779 - RNA, 20 nt, Artificial Sequence
  CIITA targeting sequence
gagucaagacccagaucuug

SEQ ID NO: 33780 - RNA, 20 nt, Artificial Sequence
  CIITA targeting sequence
gaagacacuaggggcccugg

SEQ ID NO: 33781 - RNA, 20 nt, Artificial Sequence
  CIITA targeting sequence
agacccagaucuugauuggu

SEQ ID NO: 33782 - RNA, 20 nt, Artificial Sequence
  CIITA targeting sequence
ugacucugaagacacuaggg

SEQ ID NO: 33783 - RNA, 20 nt, Artificial Sequence
  CIITA targeting sequence
gggucuugacucugaagaca

SEQ ID NO: 33784 - RNA, 20 nt, Artificial Sequence
  CIITA targeting sequence
ugauugguaacagaaccaug

SEQ ID NO: 33785 - RNA, 20 nt, Artificial Sequence
  CIITA targeting sequence
agaucugggucuugacucug

SEQ ID NO: 33786 - RNA, 20 nt, Artificial Sequence
  CIITA targeting sequence
guuaccaaucaagaucuggg

SEQ ID NO: 33787 - RNA, 20 nt, Artificial Sequence
  CIITA targeting sequence
ugguucuguuaccaaucaag

SEQ ID NO: 33788 - RNA, 20 nt, Artificial Sequence
  CIITA targeting sequence
caaagugugguuucuguguc

SEQ ID NO: 33789 - RNA, 20 nt, Artificial Sequence
  CIITA targeting sequence
gugucacccuucuggcaggc

SEQ ID NO: 33790 - RNA, 20 nt, Artificial Sequence
  CIITA targeting sequence
cccuucuggcaggcagauaa

SEQ ID NO: 33791 - RNA, 20 nt, Artificial Sequence
  CIITA targeting sequence
ggcaggcagauaacuaaggg

SEQ ID NO: 33792 - RNA, 20 nt, Artificial Sequence
  CIITA targeting sequence
gccugccagaagggugacac

SEQ ID NO: 33793 - RNA, 20 nt, Artificial Sequence
  CIITA targeting sequence
cuuaguuaucugccugccag

SEQ ID NO: 33794 - RNA, 20 nt, Artificial Sequence
  CIITA targeting sequence
cccauagguguuaaauaaca

SEQ ID NO: 33795 - RNA, 20 nt, Artificial Sequence
  CIITA targeting sequence
cuuaguaagaaagcccccuc

SEQ ID NO: 33796 - RNA, 20 nt, Artificial Sequence
  CIITA targeting sequence
uacuaagugauugguuguua

SEQ ID NO: 33797 - RNA, 20 nt, Artificial Sequence
  CIITA targeting sequence
caaucaucaucaucuucauc

SEQ ID NO: 33798 - RNA, 20 nt, Artificial Sequence
  CIITA targeting sequence
aucaucaucaucuucaucau

SEQ ID NO: 33799 - RNA, 20 nt, Artificial Sequence
  CIITA targeting sequence
ucaucaucuucaucauuaua

SEQ ID NO: 33800 - RNA, 20 nt, Artificial Sequence
  CIITA targeting sequence
ucaucuucaucauuauauua

SEQ ID NO: 33801 - RNA, 20 nt, Artificial Sequence
  CIITA targeting sequence
ucuucaucauuauauuaggu

SEQ ID NO: 33802 - RNA, 20 nt, Artificial Sequence
  CIITA targeting sequence
ucaucauuauauuagguuac

SEQ ID NO: 33803 - RNA, 20 nt, Artificial Sequence
  CIITA targeting sequence
ucauuauauuagguuacacc

SEQ ID NO: 33804 - RNA, 20 nt, Artificial Sequence
  CIITA targeting sequence
uuauauuagguuacaccaua

SEQ ID NO: 33805 - RNA, 20 nt, Artificial Sequence
  CIITA targeting sequence
uaugguguaaccuaauauaa

SEQ ID NO: 33806 - RNA, 20 nt, Artificial Sequence
  CIITA targeting sequence
uaaaaauugcuguuucauau

SEQ ID NO: 33807 - RNA, 20 nt, Artificial Sequence
  CIITA targeting sequence
aaaacaaacaaauaucagca

SEQ ID NO: 33808 - RNA, 20 nt, Artificial Sequence
  CIITA targeting sequence
gcaguuuuauaugacucaau

SEQ ID NO: 33809 - RNA, 20 nt, Artificial Sequence
  CIITA targeting sequence
uauaaaacugcugauauuug

SEQ ID NO: 33810 - RNA, 20 nt, Artificial Sequence
  CIITA targeting sequence
aucuaauaggauucuuuaga

SEQ ID NO: 33811 - RNA, 20 nt, Artificial Sequence
  CIITA targeting sequence
aauaggauucuuuagacaua

SEQ ID NO: 33812 - RNA, 20 nt, Artificial Sequence
  CIITA targeting sequence
uauuagauugagucauauaa

SEQ ID NO: 33813 - RNA, 20 nt, Artificial Sequence
  CIITA targeting sequence
uuagacauauaaaaacuuau

SEQ ID NO: 33814 - RNA, 20 nt, Artificial Sequence
  CIITA targeting sequence
aaagaauccuauuagauuga

SEQ ID NO: 33815 - RNA, 20 nt, Artificial Sequence
  CIITA targeting sequence
uuauaaguuuuuauaugucu

SEQ ID NO: 33816 - RNA, 20 nt, Artificial Sequence
  CIITA targeting sequence
ggccuuuauucuuuauaagu

SEQ ID NO: 33817 - RNA, 20 nt, Artificial Sequence
  CIITA targeting sequence
cgcguguaauuccaguacuu

SEQ ID NO: 33818 - RNA, 20 nt, Artificial Sequence
  CIITA targeting sequence
aguacuuugggagaccgagg

SEQ ID NO: 33819 - RNA, 20 nt, Artificial Sequence
  CIITA targeting sequence
caaaguacuggaauuacacg

SEQ ID NO: 33820 - RNA, 20 nt, Artificial Sequence
  CIITA targeting sequence
cccaaaguacuggaauuaca

SEQ ID NO: 33821 - RNA, 20 nt, Artificial Sequence
  CIITA targeting sequence
gucucccaaaguacuggaau

SEQ ID NO: 33822 - RNA, 20 nt, Artificial Sequence
  CIITA targeting sequence
gccugccucggucucccaaa

SEQ ID NO: 33823 - RNA, 20 nt, Artificial Sequence
  CIITA targeting sequence
ggaguuugagaucagccugg

SEQ ID NO: 33824 - RNA, 20 nt, Artificial Sequence
  CIITA targeting sequence
ugauccgccugccucggucu

SEQ ID NO: 33825 - RNA, 20 nt, Artificial Sequence
  CIITA targeting sequence
aacuccugauccgccugccu

SEQ ID NO: 33826 - RNA, 20 nt, Artificial Sequence
  CIITA targeting sequence
caaacuccugauccgccugc

SEQ ID NO: 33827 - RNA, 20 nt, Artificial Sequence
  CIITA targeting sequence
gccuggcuaaaauggugaaa

SEQ ID NO: 33828 - RNA, 20 nt, Artificial Sequence
  CIITA targeting sequence
ccauuuuagccaggcugauc

SEQ ID NO: 33829 - RNA, 20 nt, Artificial Sequence
  CIITA targeting sequence
cuacuaaaaauacaaaauua

SEQ ID NO: 33830 - RNA, 20 nt, Artificial Sequence
  CIITA targeting sequence
acuaaaaauacaaaauuagc

SEQ ID NO: 33831 - RNA, 20 nt, Artificial Sequence
  CIITA targeting sequence
cagcuacuccagaggcugag

SEQ ID NO: 33832 - RNA, 20 nt, Artificial Sequence
  CIITA targeting sequence
agaggcugaggcaggauaau

SEQ ID NO: 33833 - RNA, 20 nt, Artificial Sequence
  CIITA targeting sequence
ggaguagcugggauuacagg

SEQ ID NO: 33834 - RNA, 20 nt, Artificial Sequence
  CIITA targeting sequence
gccucuggaguagcugggau

SEQ ID NO: 33835 - RNA, 20 nt, Artificial Sequence
  CIITA targeting sequence
ugccucagccucuggaguag

SEQ ID NO: 33836 - RNA, 20 nt, Artificial Sequence
  CIITA targeting sequence
cuugaacccaggaggcggag

SEQ ID NO: 33837 - RNA, 20 nt, Artificial Sequence
  CIITA targeting sequence
agugauuauccugccucagc

SEQ ID NO: 33838 - RNA, 20 nt, Artificial Sequence
  CIITA targeting sequence
uggguucaagugauuauccu

SEQ ID NO: 33839 - RNA, 20 nt, Artificial Sequence
  CIITA targeting sequence
gccuccuggguucaagugau

SEQ ID NO: 33840 - RNA, 20 nt, Artificial Sequence
  CIITA targeting sequence
cugcaaacuccgccuccugg

SEQ ID NO: 33841 - RNA, 20 nt, Artificial Sequence
  CIITA targeting sequence
gcucgcugcaaacuccgccu

SEQ ID NO: 33842 - RNA, 20 nt, Artificial Sequence
  CIITA targeting sequence
cggcucgcugcaaacuccgc

SEQ ID NO: 33843 - RNA, 20 nt, Artificial Sequence
  CIITA targeting sequence
ugccauugcacuccagccug

SEQ ID NO: 33844 - RNA, 20 nt, Artificial Sequence
  CIITA targeting sequence
agccugggcaaaaagagcca

SEQ ID NO: 33845 - RNA, 20 nt, Artificial Sequence
  CIITA targeting sequence
uuuugcccaggcuggagugc

SEQ ID NO: 33846 - RNA, 20 nt, Artificial Sequence
  CIITA targeting sequence
gucucaacaacaacaacaaa

SEQ ID NO: 33847 - RNA, 20 nt, Artificial Sequence
  CIITA targeting sequence
caacaacaacaacaaaaaag

SEQ ID NO: 33848 - RNA, 20 nt, Artificial Sequence
  CIITA targeting sequence
acaacaacaacaaaaaaguu

SEQ ID NO: 33849 - RNA, 20 nt, Artificial Sequence
  CIITA targeting sequence
uuauaacuuuuuuguuguug

SEQ ID NO: 33850 - RNA, 20 nt, Artificial Sequence
  CIITA targeting sequence
gccuagccauuauucuuuau

SEQ ID NO: 33851 - RNA, 20 nt, Artificial Sequence
  CIITA targeting sequence
caccuguaaucccaguccuu

SEQ ID NO: 33852 - RNA, 20 nt, Artificial Sequence
  CIITA targeting sequence
ccuguaaucccaguccuuug

SEQ ID NO: 33853 - RNA, 20 nt, Artificial Sequence
  CIITA targeting sequence
caguccuuugggaggcugag

SEQ ID NO: 33854 - RNA, 20 nt, Artificial Sequence
  CIITA targeting sequence
uuugggaggcugaggcagga

SEQ ID NO: 33855 - RNA, 20 nt, Artificial Sequence
  CIITA targeting sequence
caaaggacugggauuacagg

SEQ ID NO: 33856 - RNA, 20 nt, Artificial Sequence
  CIITA targeting sequence
gccucccaaaggacugggau

SEQ ID NO: 33857 - RNA, 20 nt, Artificial Sequence
  CIITA targeting sequence
ugccucagccucccaaagga

SEQ ID NO: 33858 - RNA, 20 nt, Artificial Sequence
  CIITA targeting sequence
ccugccucagccucccaaag

SEQ ID NO: 33859 - RNA, 20 nt, Artificial Sequence
  CIITA targeting sequence
cuggaagccaggaauucgag

SEQ ID NO: 33860 - RNA, 20 nt, Artificial Sequence
  CIITA targeting sequence
agcgauucuccugccucagc

SEQ ID NO: 33861 - RNA, 20 nt, Artificial Sequence
  CIITA targeting sequence
uggcuuccagcgauucuccu

SEQ ID NO: 33862 - RNA, 20 nt, Artificial Sequence
  CIITA targeting sequence
agaccaaccugggcaacguu

SEQ ID NO: 33863 - RNA, 20 nt, Artificial Sequence
  CIITA targeting sequence
aauuccuggcuuccagcgau

SEQ ID NO: 33864 - RNA, 20 nt, Artificial Sequence
  CIITA targeting sequence
cgaauuccuggcuuccagcg

SEQ ID NO: 33865 - RNA, 20 nt, Artificial Sequence
  CIITA targeting sequence
caacguugcccagguugguc

SEQ ID NO: 33866 - RNA, 20 nt, Artificial Sequence
  CIITA targeting sequence
cacaacguugcccagguugg

SEQ ID NO: 33867 - RNA, 20 nt, Artificial Sequence
  CIITA targeting sequence
acacaaaauuuaaaaauuac

SEQ ID NO: 33868 - RNA, 20 nt, Artificial Sequence
  CIITA targeting sequence
cagcuacacgggaagaggcu

SEQ ID NO: 33869 - RNA, 20 nt, Artificial Sequence
  CIITA targeting sequence
cguguagcugggagugugcc

SEQ ID NO: 33870 - RNA, 20 nt, Artificial Sequence
  CIITA targeting sequence
ucccguguagcugggagugu

SEQ ID NO: 33871 - RNA, 20 nt, Artificial Sequence
  CIITA targeting sequence
gccucuucccguguagcugg

SEQ ID NO: 33872 - RNA, 20 nt, Artificial Sequence
  CIITA targeting sequence
caccucagccucuucccgug

SEQ ID NO: 33873 - RNA, 20 nt, Artificial Sequence
  CIITA targeting sequence
ucccaccucagccucuuccc

SEQ ID NO: 33874 - RNA, 20 nt, Artificial Sequence
  CIITA targeting sequence
cuugagcucagaagguugag

SEQ ID NO: 33875 - RNA, 20 nt, Artificial Sequence
  CIITA targeting sequence
agugauccucccaccucagc

SEQ ID NO: 33876 - RNA, 20 nt, Artificial Sequence
  CIITA targeting sequence
gaagguugagguuacaauga

SEQ ID NO: 33877 - RNA, 20 nt, Artificial Sequence
  CIITA targeting sequence
gagcucaagugauccuccca

SEQ ID NO: 33878 - RNA, 20 nt, Artificial Sequence
  CIITA targeting sequence
accuucugagcucaagugau

SEQ ID NO: 33879 - RNA, 20 nt, Artificial Sequence
  CIITA targeting sequence
uuguaaccucaaccuucuga

SEQ ID NO: 33880 - RNA, 20 nt, Artificial Sequence
  CIITA targeting sequence
ugguucauuguaaccucaac

SEQ ID NO: 33881 - RNA, 20 nt, Artificial Sequence
  CIITA targeting sequence
agccuggacaacggagugag

SEQ ID NO: 33882 - RNA, 20 nt, Artificial Sequence
  CIITA targeting sequence
aggcuggaaugcaguggugc

SEQ ID NO: 33883 - RNA, 20 nt, Artificial Sequence
  CIITA targeting sequence
guuguccaggcuggaaugca

SEQ ID NO: 33884 - RNA, 20 nt, Artificial Sequence
  CIITA targeting sequence
cuccguuguccaggcuggaa

SEQ ID NO: 33885 - RNA, 20 nt, Artificial Sequence
  CIITA targeting sequence
cacuccguuguccaggcugg

SEQ ID NO: 33886 - RNA, 20 nt, Artificial Sequence
  CIITA targeting sequence
ugaaucagaaagaaagaaaa

SEQ ID NO: 33887 - RNA, 20 nt, Artificial Sequence
  CIITA targeting sequence
ggaucucacuccguugucca

SEQ ID NO: 33888 - RNA, 20 nt, Artificial Sequence
  CIITA targeting sequence
gaaagaaagaaaaaaaaaga

SEQ ID NO: 33889 - RNA, 20 nt, Artificial Sequence
  CIITA targeting sequence
gauucaggaucucacuccgu

SEQ ID NO: 33890 - RNA, 20 nt, Artificial Sequence
  CIITA targeting sequence
uucugauucaggaucucacu

SEQ ID NO: 33891 - RNA, 20 nt, Artificial Sequence
  CIITA targeting sequence
uucuuucugauucaggaucu

SEQ ID NO: 33892 - RNA, 20 nt, Artificial Sequence
  CIITA targeting sequence
uuuuuuuucuuucuuucuga

SEQ ID NO: 33893 - RNA, 20 nt, Artificial Sequence
  CIITA targeting sequence
ucuuuuuuuuucuuucuuuc

SEQ ID NO: 33894 - RNA, 20 nt, Artificial Sequence
  CIITA targeting sequence
uuaaaaugaccaguuuuuug

SEQ ID NO: 33895 - RNA, 20 nt, Artificial Sequence
  CIITA targeting sequence
uuuuaaagaaaauacuguuc

SEQ ID NO: 33896 - RNA, 20 nt, Artificial Sequence
  CIITA targeting sequence
acaaaaaacuggucauuuua

SEQ ID NO: 33897 - RNA, 20 nt, Artificial Sequence
  CIITA targeting sequence
uccacaaaaaacuggucauu

SEQ ID NO: 33898 - RNA, 20 nt, Artificial Sequence
  CIITA targeting sequence
cagagagcccugauggcaaa

SEQ ID NO: 33899 - RNA, 20 nt, Artificial Sequence
  CIITA targeting sequence
gugacugcucuuccacaaaa

SEQ ID NO: 33900 - RNA, 20 nt, Artificial Sequence
  CIITA targeting sequence
cugugacugcucuuccacaa

SEQ ID NO: 33901 - RNA, 20 nt, Artificial Sequence
  CIITA targeting sequence
gggcucucugugacugcucu

SEQ ID NO: 33902 - RNA, 20 nt, Artificial Sequence
  CIITA targeting sequence
uaaguuauuugccaucaggg

SEQ ID NO: 33903 - RNA, 20 nt, Artificial Sequence
  CIITA targeting sequence
ucauaaguuauuugccauca

SEQ ID NO: 33904 - RNA, 20 nt, Artificial Sequence
  CIITA targeting sequence
ggaaggaauuacagguuggu

SEQ ID NO: 33905 - RNA, 20 nt, Artificial Sequence
  CIITA targeting sequence
agaaucaucauaaguuauuu

SEQ ID NO: 33906 - RNA, 20 nt, Artificial Sequence
  CIITA targeting sequence
uuccagaaucaucauaaguu

SEQ ID NO: 33907 - RNA, 20 nt, Artificial Sequence
  CIITA targeting sequence
uagaugaccaaugcuaccau

SEQ ID NO: 33908 - RNA, 20 nt, Artificial Sequence
  CIITA targeting sequence
augauuaccaaccuguaauu

SEQ ID NO: 33909 - RNA, 20 nt, Artificial Sequence
  CIITA targeting sequence
ucuaugauuaccaaccugua

SEQ ID NO: 33910 - RNA, 20 nt, Artificial Sequence
  CIITA targeting sequence
acaccaaugguagcauuggu

SEQ ID NO: 33911 - RNA, 20 nt, Artificial Sequence
  CIITA targeting sequence
ccacaccaaugguagcauug

SEQ ID NO: 33912 - RNA, 20 nt, Artificial Sequence
  CIITA targeting sequence
gcugcuaguacaaucuccac

SEQ ID NO: 33913 - RNA, 20 nt, Artificial Sequence
  CIITA targeting sequence
ugaggagaagacucuagaau

SEQ ID NO: 33914 - RNA, 20 nt, Artificial Sequence
  CIITA targeting sequence
ugagcucagcugcuaguaca

SEQ ID NO: 33915 - RNA, 20 nt, Artificial Sequence
  CIITA targeting sequence
ucaugagcucagcugcuagu

SEQ ID NO: 33916 - RNA, 20 nt, Artificial Sequence
  CIITA targeting sequence
ccucaugagcucagcugcua

SEQ ID NO: 33917 - RNA, 20 nt, Artificial Sequence
  CIITA targeting sequence
ucuccucaugagcucagcug

SEQ ID NO: 33918 - RNA, 20 nt, Artificial Sequence
  CIITA targeting sequence
agaauaccuauaucugaaug

SEQ ID NO: 33919 - RNA, 20 nt, Artificial Sequence
  CIITA targeting sequence
agagucuucuccucaugagc

SEQ ID NO: 33920 - RNA, 20 nt, Artificial Sequence
  CIITA targeting sequence
gaauguuguaccuuuagcaa

SEQ ID NO: 33921 - RNA, 20 nt, Artificial Sequence
  CIITA targeting sequence
gauauagguauucuagaguc

SEQ ID NO: 33922 - RNA, 20 nt, Artificial Sequence
  CIITA targeting sequence
cuucuuagaaauguagcagu

SEQ ID NO: 33923 - RNA, 20 nt, Artificial Sequence
  CIITA targeting sequence
ucuuagaaauguagcagucc

SEQ ID NO: 33924 - RNA, 20 nt, Artificial Sequence
  CIITA targeting sequence
uagaaauguagcagucccag

SEQ ID NO: 33925 - RNA, 20 nt, Artificial Sequence
  CIITA targeting sequence
aagaagagacccuuaacaca

SEQ ID NO: 33926 - RNA, 20 nt, Artificial Sequence
  CIITA targeting sequence
caggucauagcuuauggauu

SEQ ID NO: 33927 - RNA, 20 nt, Artificial Sequence
  CIITA targeting sequence
uagcuuauggauucacuuuu

SEQ ID NO: 33928 - RNA, 20 nt, Artificial Sequence
  CIITA targeting sequence
auaagcuaugaccugggacu

SEQ ID NO: 33929 - RNA, 20 nt, Artificial Sequence
  CIITA targeting sequence
cuuuuacauguaacacuaua

SEQ ID NO: 33930 - RNA, 20 nt, Artificial Sequence
  CIITA targeting sequence
uaguauaguguuacauguaa

SEQ ID NO: 33931 - RNA, 20 nt, Artificial Sequence
  CIITA targeting sequence
ucauaguauaguguuacaug

SEQ ID NO: 33932 - RNA, 20 nt, Artificial Sequence
  CIITA targeting sequence
guuucaucauaguauagugu

SEQ ID NO: 33933 - RNA, 20 nt, Artificial Sequence
  CIITA targeting sequence
uucuguuucaucauaguaua

SEQ ID NO: 33934 - RNA, 20 nt, Artificial Sequence
  CIITA targeting sequence
ccuucuguuucaucauagua

SEQ ID NO: 33935 - RNA, 20 nt, Artificial Sequence
  CIITA targeting sequence
cuccuucuguuucaucauag

SEQ ID NO: 33936 - RNA, 20 nt, Artificial Sequence
  CIITA targeting sequence
ucucuccuucuguuucauca

SEQ ID NO: 33937 - RNA, 20 nt, Artificial Sequence
  CIITA targeting sequence
ucuucucuccuucuguuuca

SEQ ID NO: 33938 - RNA, 20 nt, Artificial Sequence
  CIITA targeting sequence
uuuaucaucuucucuccuuc

SEQ ID NO: 33939 - RNA, 20 nt, Artificial Sequence
  CIITA targeting sequence
acuauuaaaccuuuaaaacu

SEQ ID NO: 33940 - RNA, 20 nt, Artificial Sequence
  CIITA targeting sequence
cucacugucccaauguguaa

SEQ ID NO: 33941 - RNA, 20 nt, Artificial Sequence
  CIITA targeting sequence
cugucccaauguguaauuua

SEQ ID NO: 33942 - RNA, 20 nt, Artificial Sequence
  CIITA targeting sequence
caauguguaauuuauuugaa

SEQ ID NO: 33943 - RNA, 20 nt, Artificial Sequence
  CIITA targeting sequence
aauaaauuacacauugggac

SEQ ID NO: 33944 - RNA, 20 nt, Artificial Sequence
  CIITA targeting sequence
acuuccuacacuuugauuaa

SEQ ID NO: 33945 - RNA, 20 nt, Artificial Sequence
  CIITA targeting sequence
uacacuuugauuaagucuau

SEQ ID NO: 33946 - RNA, 20 nt, Artificial Sequence
  CIITA targeting sequence
aaguguaggaaguugauguu

SEQ ID NO: 33947 - RNA, 20 nt, Artificial Sequence
  CIITA targeting sequence
auuaaguuuaauugguuaaa

SEQ ID NO: 33948 - RNA, 20 nt, Artificial Sequence
  CIITA targeting sequence
uaugccuuuaaccaauuaaa

SEQ ID NO: 33949 - RNA, 20 nt, Artificial Sequence
  CIITA targeting sequence
agaauguuuauaagacauuu

SEQ ID NO: 33950 - RNA, 20 nt, Artificial Sequence
  CIITA targeting sequence
ggaguucguaugccuuuaac

SEQ ID NO: 33951 - RNA, 20 nt, Artificial Sequence
  CIITA targeting sequence
uauaaacauucuggaguucg

SEQ ID NO: 33952 - RNA, 20 nt, Artificial Sequence
  CIITA targeting sequence
aucuauucuuacggugauuu

SEQ ID NO: 33953 - RNA, 20 nt, Artificial Sequence
  CIITA targeting sequence
auucuuacggugauuuuuau

SEQ ID NO: 33954 - RNA, 20 nt, Artificial Sequence
  CIITA targeting sequence
uacggugauuuuuauuucuu

SEQ ID NO: 33955 - RNA, 20 nt, Artificial Sequence
  CIITA targeting sequence
ccguaagaauagauagaaau

SEQ ID NO: 33956 - RNA, 20 nt, Artificial Sequence
  CIITA targeting sequence
uucucuuuuuuuuucuagca

SEQ ID NO: 33957 - RNA, 20 nt, Artificial Sequence
  CIITA targeting sequence
cuuuuuuuuucuagcacaaa

SEQ ID NO: 33958 - RNA, 20 nt, Artificial Sequence
  CIITA targeting sequence
uuuuuuuucuagcacaaaca

SEQ ID NO: 33959 - RNA, 20 nt, Artificial Sequence
  CIITA targeting sequence
agcacaaacaaaccugcuuu

SEQ ID NO: 33960 - RNA, 20 nt, Artificial Sequence
  CIITA targeting sequence
cauaaugcccauguguaaga

SEQ ID NO: 33961 - RNA, 20 nt, Artificial Sequence
  CIITA targeting sequence
uaaugcccauguguaagaau

SEQ ID NO: 33962 - RNA, 20 nt, Artificial Sequence
  CIITA targeting sequence
uacacaugggcauuaugaga

SEQ ID NO: 33963 - RNA, 20 nt, Artificial Sequence
  CIITA targeting sequence
ggcauauauacugaagagug

SEQ ID NO: 33964 - RNA, 20 nt, Artificial Sequence
  CIITA targeting sequence
guauauaugccagaaaaauu

SEQ ID NO: 33965 - RNA, 20 nt, Artificial Sequence
  CIITA targeting sequence
ucaguauauaugccagaaaa

SEQ ID NO: 33966 - RNA, 20 nt, Artificial Sequence
  CIITA targeting sequence
acucuucaguauauaugcca

SEQ ID NO: 33967 - RNA, 20 nt, Artificial Sequence
  CIITA targeting sequence
ugaguauuauuuaaugauuu

SEQ ID NO: 33968 - RNA, 20 nt, Artificial Sequence
  CIITA targeting sequence
ggauuuccacucuucaguau

SEQ ID NO: 33969 - RNA, 20 nt, Artificial Sequence
  CIITA targeting sequence
uuaaauaauacucaggauuu

SEQ ID NO: 33970 - RNA, 20 nt, Artificial Sequence
  CIITA targeting sequence
acaugcucuccaacaaagua

SEQ ID NO: 33971 - RNA, 20 nt, Artificial Sequence
  CIITA targeting sequence
ccaacaaaguagaauuccca

SEQ ID NO: 33972 - RNA, 20 nt, Artificial Sequence
  CIITA targeting sequence
aacaaaguagaauucccauu

SEQ ID NO: 33973 - RNA, 20 nt, Artificial Sequence
  CIITA targeting sequence
acuuuguuggagagcaugua

SEQ ID NO: 33974 - RNA, 20 nt, Artificial Sequence
  CIITA targeting sequence
cauuuuucuauacccuuaac

SEQ ID NO: 33975 - RNA, 20 nt, Artificial Sequence
  CIITA targeting sequence
auacccuuaacauuuuuacu

SEQ ID NO: 33976 - RNA, 20 nt, Artificial Sequence
  CIITA targeting sequence
gcugaugcaagagagcuuua

SEQ ID NO: 33977 - RNA, 20 nt, Artificial Sequence
  CIITA targeting sequence
gcagauaaguaaaaauguua

SEQ ID NO: 33978 - RNA, 20 nt, Artificial Sequence
  CIITA targeting sequence
ugcaucagcagauaaguaaa

SEQ ID NO: 33979 - RNA, 20 nt, Artificial Sequence
  CIITA targeting sequence
cuugcaucagcagauaagua

SEQ ID NO: 33980 - RNA, 20 nt, Artificial Sequence
  CIITA targeting sequence
aucuuuaauaccuuucuaac

SEQ ID NO: 33981 - RNA, 20 nt, Artificial Sequence
  CIITA targeting sequence
uuaauaccuuucuaacacuu

SEQ ID NO: 33982 - RNA, 20 nt, Artificial Sequence
  CIITA targeting sequence
aacacuugcuaacuaccuuu

SEQ ID NO: 33983 - RNA, 20 nt, Artificial Sequence
  CIITA targeting sequence
caaaaggagauaggucccca

SEQ ID NO: 33984 - RNA, 20 nt, Artificial Sequence
  CIITA targeting sequence
uuuugugacaaaagguaguu

SEQ ID NO: 33985 - RNA, 20 nt, Artificial Sequence
  CIITA targeting sequence
ccuuuugugacaaaagguag

SEQ ID NO: 33986 - RNA, 20 nt, Artificial Sequence
  CIITA targeting sequence
ccaggaucagaaacucgagg

SEQ ID NO: 33987 - RNA, 20 nt, Artificial Sequence
  CIITA targeting sequence
uggggaccuaucuccuuuug

SEQ ID NO: 33988 - RNA, 20 nt, Artificial Sequence
  CIITA targeting sequence
gaaacucgaggaaacugaaa

SEQ ID NO: 33989 - RNA, 20 nt, Artificial Sequence
  CIITA targeting sequence
gauccuggggaccuaucucc

SEQ ID NO: 33990 - RNA, 20 nt, Artificial Sequence
  CIITA targeting sequence
aggaaacugaaaucuaaacu

SEQ ID NO: 33991 - RNA, 20 nt, Artificial Sequence
  CIITA targeting sequence
aguuucugauccuggggacc

SEQ ID NO: 33992 - RNA, 20 nt, Artificial Sequence
  CIITA targeting sequence
ucgaguuucugauccugggg

SEQ ID NO: 33993 - RNA, 20 nt, Artificial Sequence
  CIITA targeting sequence
guuuccucgaguuucugauc

SEQ ID NO: 33994 - RNA, 20 nt, Artificial Sequence
  CIITA targeting sequence
aaacuuucauauuaucauuu

SEQ ID NO: 33995 - RNA, 20 nt, Artificial Sequence
  CIITA targeting sequence
uauuaucauuuuccauucug

SEQ ID NO: 33996 - RNA, 20 nt, Artificial Sequence
  CIITA targeting sequence
uuuuccauucugcauggguu

SEQ ID NO: 33997 - RNA, 20 nt, Artificial Sequence
  CIITA targeting sequence
auucugcauggguuuuuuug

SEQ ID NO: 33998 - RNA, 20 nt, Artificial Sequence
  CIITA targeting sequence
gcauggguuuuuuuguuaca

SEQ ID NO: 33999 - RNA, 20 nt, Artificial Sequence
  CIITA targeting sequence
ugcacaagggauacuggcuu

SEQ ID NO: 34000 - RNA, 20 nt, Artificial Sequence
  CIITA targeting sequence
cuugugcaagaauaguaggc

SEQ ID NO: 34001 - RNA, 20 nt, Artificial Sequence
  CIITA targeting sequence
aauugugauaaagauaggaa

SEQ ID NO: 34002 - RNA, 20 nt, Artificial Sequence
  CIITA targeting sequence
caauuggaaagccaguaucc

SEQ ID NO: 34003 - RNA, 20 nt, Artificial Sequence
  CIITA targeting sequence
uuaucacaauuggaaagcca

SEQ ID NO: 34004 - RNA, 20 nt, Artificial Sequence
  CIITA targeting sequence
uaucuuuaucacaauuggaa

SEQ ID NO: 34005 - RNA, 20 nt, Artificial Sequence
  CIITA targeting sequence
uuuuaaaacaaauuaaauca

SEQ ID NO: 34006 - RNA, 20 nt, Artificial Sequence
  CIITA targeting sequence
guaagacagaguaaaacaaa

SEQ ID NO: 34007 - RNA, 20 nt, Artificial Sequence
  CIITA targeting sequence
uacugauuuaauuuguuuua

SEQ ID NO: 34008 - RNA, 20 nt, Artificial Sequence
  CIITA targeting sequence
gucuuacugauuuaauuugu

SEQ ID NO: 34009 - RNA, 20 nt, Artificial Sequence
  CIITA targeting sequence
guacuauuauuuaccuaaua

SEQ ID NO: 34010 - RNA, 20 nt, Artificial Sequence
  CIITA targeting sequence
caugcaaucuguacuauuau

SEQ ID NO: 34011 - RNA, 20 nt, Artificial Sequence
  CIITA targeting sequence
aaaucacaugcaaucuguac

SEQ ID NO: 34012 - RNA, 20 nt, Artificial Sequence
  CIITA targeting sequence
uccaaaucacaugcaaucug

SEQ ID NO: 34013 - RNA, 20 nt, Artificial Sequence
  CIITA targeting sequence
ccuccaaaucacaugcaauc

SEQ ID NO: 34014 - RNA, 20 nt, Artificial Sequence
  CIITA targeting sequence
cugcauaauuuuuuuucucc

SEQ ID NO: 34015 - RNA, 20 nt, Artificial Sequence
  CIITA targeting sequence
gaauaaguaaagaugggaga

SEQ ID NO: 34016 - RNA, 20 nt, Artificial Sequence
  CIITA targeting sequence
gagcucccugcauaauuuuu

SEQ ID NO: 34017 - RNA, 20 nt, Artificial Sequence
  CIITA targeting sequence
uuacuuauucagagcucccu

SEQ ID NO: 34018 - RNA, 20 nt, Artificial Sequence
  CIITA targeting sequence
caucuuuacuuauucagagc

SEQ ID NO: 34019 - RNA, 20 nt, Artificial Sequence
  CIITA targeting sequence
cccaucuuuacuuauucaga

SEQ ID NO: 34020 - RNA, 20 nt, Artificial Sequence
  CIITA targeting sequence
ccaguguauuacuucuccca

SEQ ID NO: 34021 - RNA, 20 nt, Artificial Sequence
  CIITA targeting sequence
ccugcaauuaaucaccagug

SEQ ID NO: 34022 - RNA, 20 nt, Artificial Sequence
  CIITA targeting sequence
gcaauauuccccugcaauua

SEQ ID NO: 34023 - RNA, 20 nt, Artificial Sequence
  CIITA targeting sequence
agaccaguggguucugcaac

SEQ ID NO: 34024 - RNA, 20 nt, Artificial Sequence
  CIITA targeting sequence
ugagcucagcaauauucccc

SEQ ID NO: 34025 - RNA, 20 nt, Artificial Sequence
  CIITA targeting sequence
gcaacuagguaacaccuccc

SEQ ID NO: 34026 - RNA, 20 nt, Artificial Sequence
  CIITA targeting sequence
cuggaaacuguaguauuuca

SEQ ID NO: 34027 - RNA, 20 nt, Artificial Sequence
  CIITA targeting sequence
agggagguguuaccuaguug

SEQ ID NO: 34028 - RNA, 20 nt, Artificial Sequence
  CIITA targeting sequence
gaagugaaaaauccugggga

SEQ ID NO: 34029 - RNA, 20 nt, Artificial Sequence
  CIITA targeting sequence
gaaauacuacaguuuccagg

SEQ ID NO: 34030 - RNA, 20 nt, Artificial Sequence
  CIITA targeting sequence
cuucugaaauacuacaguuu

SEQ ID NO: 34031 - RNA, 20 nt, Artificial Sequence
  CIITA targeting sequence
uggggaucauguaauccaac

SEQ ID NO: 34032 - RNA, 20 nt, Artificial Sequence
  CIITA targeting sequence
ccaggauuuuucacuucuga

SEQ ID NO: 34033 - RNA, 20 nt, Artificial Sequence
  CIITA targeting sequence
uguaauccaaccuauguguu

SEQ ID NO: 34034 - RNA, 20 nt, Artificial Sequence
  CIITA targeting sequence
aaccuauguguuucaugggu

SEQ ID NO: 34035 - RNA, 20 nt, Artificial Sequence
  CIITA targeting sequence
ugggugacgacauugugguc

SEQ ID NO: 34036 - RNA, 20 nt, Artificial Sequence
  CIITA targeting sequence
cccaugaaacacauagguug

SEQ ID NO: 34037 - RNA, 20 nt, Artificial Sequence
  CIITA targeting sequence
ucacccaugaaacacauagg

SEQ ID NO: 34038 - RNA, 20 nt, Artificial Sequence
  CIITA targeting sequence
agagagaggaaguuucuugc

SEQ ID NO: 34039 - RNA, 20 nt, Artificial Sequence
  CIITA targeting sequence
ggaccacaaugucgucaccc

SEQ ID NO: 34040 - RNA, 20 nt, Artificial Sequence
  CIITA targeting sequence
cuggaccacaaugucgucac

SEQ ID NO: 34041 - RNA, 20 nt, Artificial Sequence
  CIITA targeting sequence
cucuggaccacaaugucguc

SEQ ID NO: 34042 - RNA, 20 nt, Artificial Sequence
  CIITA targeting sequence
ucucucuggaccacaauguc

SEQ ID NO: 34043 - RNA, 20 nt, Artificial Sequence
  CIITA targeting sequence
ugccaggcacagugagucag

SEQ ID NO: 34044 - RNA, 20 nt, Artificial Sequence
  CIITA targeting sequence
cugugccuggcaagaaacuu

SEQ ID NO: 34045 - RNA, 20 nt, Artificial Sequence
  CIITA targeting sequence
guggccaaguggaggcuggc

SEQ ID NO: 34046 - RNA, 20 nt, Artificial Sequence
  CIITA targeting sequence
acuuggccacugacucacug

SEQ ID NO: 34047 - RNA, 20 nt, Artificial Sequence
  CIITA targeting sequence
ugacuaagcacauggcaagu

SEQ ID NO: 34048 - RNA, 20 nt, Artificial Sequence
  CIITA targeting sequence
agaaaaccugggugccagcc

SEQ ID NO: 34049 - RNA, 20 nt, Artificial Sequence
  CIITA targeting sequence
aguggccacuugccaugugc

SEQ ID NO: 34050 - RNA, 20 nt, Artificial Sequence
  CIITA targeting sequence
auccaguggccacuugccau

SEQ ID NO: 34051 - RNA, 20 nt, Artificial Sequence
  CIITA targeting sequence
uaucaauccaguggccacuu

SEQ ID NO: 34052 - RNA, 20 nt, Artificial Sequence
  CIITA targeting sequence
aagcagacuuauuaagugau

SEQ ID NO: 34053 - RNA, 20 nt, Artificial Sequence
  CIITA targeting sequence
gcuuugauuguuccuaucaa

SEQ ID NO: 34054 - RNA, 20 nt, Artificial Sequence
  CIITA targeting sequence
cuuaauaagucugcuuugau

SEQ ID NO: 34055 - RNA, 20 nt, Artificial Sequence
  CIITA targeting sequence
uaaucacuuaauaagucugc

SEQ ID NO: 34056 - RNA, 20 nt, Artificial Sequence
  CIITA targeting sequence
gcugucguaaucacuuaaua

SEQ ID NO: 34057 - RNA, 20 nt, Artificial Sequence
  CIITA targeting sequence
uugucccuggcucugugcac

SEQ ID NO: 34058 - RNA, 20 nt, Artificial Sequence
  CIITA targeting sequence
cuggcucugugcacccacug

SEQ ID NO: 34059 - RNA, 20 nt, Artificial Sequence
  CIITA targeting sequence
gugcacccacuguuuguugu

SEQ ID NO: 34060 - RNA, 20 nt, Artificial Sequence
  CIITA targeting sequence
ucaucuuguaaugcagaucu

SEQ ID NO: 34061 - RNA, 20 nt, Artificial Sequence
  CIITA targeting sequence
ucuuguaaugcagaucuccu

SEQ ID NO: 34062 - RNA, 20 nt, Artificial Sequence
  CIITA targeting sequence
uguaaugcagaucuccugca

SEQ ID NO: 34063 - RNA, 20 nt, Artificial Sequence
  CIITA targeting sequence
gcauuacaagaugaugaaac

SEQ ID NO: 34064 - RNA, 20 nt, Artificial Sequence
  CIITA targeting sequence
ccugcaaccuauccuuuuag

SEQ ID NO: 34065 - RNA, 20 nt, Artificial Sequence
  CIITA targeting sequence
ugcaaccuauccuuuuaguu

SEQ ID NO: 34066 - RNA, 20 nt, Artificial Sequence
  CIITA targeting sequence
uuuuaguuuucuuuuaucug

SEQ ID NO: 34067 - RNA, 20 nt, Artificial Sequence
  CIITA targeting sequence
uuuaucugaaaaugucuauu

SEQ ID NO: 34068 - RNA, 20 nt, Artificial Sequence
  CIITA targeting sequence
gaaaaugucuauuucugucu

SEQ ID NO: 34069 - RNA, 20 nt, Artificial Sequence
  CIITA targeting sequence
gauaaaagaaaacuaaaagg

SEQ ID NO: 34070 - RNA, 20 nt, Artificial Sequence
  CIITA targeting sequence
auuucugucugcguucuuga

SEQ ID NO: 34071 - RNA, 20 nt, Artificial Sequence
  CIITA targeting sequence
gucugcguucuugagggaua

SEQ ID NO: 34072 - RNA, 20 nt, Artificial Sequence
  CIITA targeting sequence
gcguucuugagggauauuug

SEQ ID NO: 34073 - RNA, 20 nt, Artificial Sequence
  CIITA targeting sequence
ugagggauauuugcacugaa

SEQ ID NO: 34074 - RNA, 20 nt, Artificial Sequence
  CIITA targeting sequence
agaacgcagacagaaauaga

SEQ ID NO: 34075 - RNA, 20 nt, Artificial Sequence
  CIITA targeting sequence
cucaagaacgcagacagaaa

SEQ ID NO: 34076 - RNA, 20 nt, Artificial Sequence
  CIITA targeting sequence
gugcaaauaucccucaagaa

SEQ ID NO: 34077 - RNA, 20 nt, Artificial Sequence
  CIITA targeting sequence
acauucagugcaaauauccc

SEQ ID NO: 34078 - RNA, 20 nt, Artificial Sequence
  CIITA targeting sequence
ggaugaacauauuuuaaaau

SEQ ID NO: 34079 - RNA, 20 nt, Artificial Sequence
  CIITA targeting sequence
ugaguucuacauucagugca

SEQ ID NO: 34080 - RNA, 20 nt, Artificial Sequence
  CIITA targeting sequence
uccugaguucuacauucagu

SEQ ID NO: 34081 - RNA, 20 nt, Artificial Sequence
  CIITA targeting sequence
uaucucuucuaagauauucu

SEQ ID NO: 34082 - RNA, 20 nt, Artificial Sequence
  CIITA targeting sequence
cuucuaagauauucuuccac

SEQ ID NO: 34083 - RNA, 20 nt, Artificial Sequence
  CIITA targeting sequence
ucuaagauauucuuccacag

SEQ ID NO: 34084 - RNA, 20 nt, Artificial Sequence
  CIITA targeting sequence
aagauauucuuccacagucu

SEQ ID NO: 34085 - RNA, 20 nt, Artificial Sequence
  CIITA targeting sequence
uagaagagauaagauuuuaa

SEQ ID NO: 34086 - RNA, 20 nt, Artificial Sequence
  CIITA targeting sequence
uccacagucuuccagccgcc

SEQ ID NO: 34087 - RNA, 20 nt, Artificial Sequence
  CIITA targeting sequence
acagucuuccagccgccaug

SEQ ID NO: 34088 - RNA, 20 nt, Artificial Sequence
  CIITA targeting sequence
uccagccgccaugguuucaa

SEQ ID NO: 34089 - RNA, 20 nt, Artificial Sequence
  CIITA targeting sequence
agccgccaugguuucaaaca

SEQ ID NO: 34090 - RNA, 20 nt, Artificial Sequence
  CIITA targeting sequence
aacaagaagucggugaucau

SEQ ID NO: 34091 - RNA, 20 nt, Artificial Sequence
  CIITA targeting sequence
uguuugaaaccauggcggcu

SEQ ID NO: 34092 - RNA, 20 nt, Artificial Sequence
  CIITA targeting sequence
gugaucauucagguguucua

SEQ ID NO: 34093 - RNA, 20 nt, Artificial Sequence
  CIITA targeting sequence
ccgacuucuuguuugaaacc

SEQ ID NO: 34094 - RNA, 20 nt, Artificial Sequence
  CIITA targeting sequence
uucagguguucuauauguac

SEQ ID NO: 34095 - RNA, 20 nt, Artificial Sequence
  CIITA targeting sequence
gguguucuauauguacugug

SEQ ID NO: 34096 - RNA, 20 nt, Artificial Sequence
  CIITA targeting sequence
auauguacuguguuauuuug

SEQ ID NO: 34097 - RNA, 20 nt, Artificial Sequence
  CIITA targeting sequence
aaauaacacaguacauauag

SEQ ID NO: 34098 - RNA, 20 nt, Artificial Sequence
  CIITA targeting sequence
cgaguaucuuuuuagcuuug

SEQ ID NO: 34099 - RNA, 20 nt, Artificial Sequence
  CIITA targeting sequence
ugaaagcagccaguucaaaa

SEQ ID NO: 34100 - RNA, 20 nt, Artificial Sequence
  CIITA targeting sequence
uuuuagcuuugauuuucaac

SEQ ID NO: 34101 - RNA, 20 nt, Artificial Sequence
  CIITA targeting sequence
aagcuaaaaagauacucgug

SEQ ID NO: 34102 - RNA, 20 nt, Artificial Sequence
  CIITA targeting sequence
acaguuuggcuauuaugugc

SEQ ID NO: 34103 - RNA, 20 nt, Artificial Sequence
  CIITA targeting sequence
uguauuuauccuacuuagau

SEQ ID NO: 34104 - RNA, 20 nt, Artificial Sequence
  CIITA targeting sequence
uacuuagauuugcuaagcuu

SEQ ID NO: 34105 - RNA, 20 nt, Artificial Sequence
  CIITA targeting sequence
aaguaggauaaauacaagaa

SEQ ID NO: 34106 - RNA, 20 nt, Artificial Sequence
  CIITA targeting sequence
caaaucuguauuccuuggcu

SEQ ID NO: 34107 - RNA, 20 nt, Artificial Sequence
  CIITA targeting sequence
aaucuguauuccuuggcuau

SEQ ID NO: 34108 - RNA, 20 nt, Artificial Sequence
  CIITA targeting sequence
guauuccuuggcuauuuuuc

SEQ ID NO: 34109 - RNA, 20 nt, Artificial Sequence
  CIITA targeting sequence
uuggcuauuuuucuuuuuuc

SEQ ID NO: 34110 - RNA, 20 nt, Artificial Sequence
  CIITA targeting sequence
uuuuucuuuucuuucuuuuu

SEQ ID NO: 34111 - RNA, 20 nt, Artificial Sequence
  CIITA targeting sequence
uuucuuucuuuuuuuuuuuu

SEQ ID NO: 34112 - RNA, 20 nt, Artificial Sequence
  CIITA targeting sequence
uucuuuuuuuuuuuuuuuuu

SEQ ID NO: 34113 - RNA, 20 nt, Artificial Sequence
  CIITA targeting sequence
uuuuuuuuuuuuuuuuuuug

SEQ ID NO: 34114 - RNA, 20 nt, Artificial Sequence
  CIITA targeting sequence
uaccauuacuguauaagucu

SEQ ID NO: 34115 - RNA, 20 nt, Artificial Sequence
  CIITA targeting sequence
uacauggguaucaacgggcu

SEQ ID NO: 34116 - RNA, 20 nt, Artificial Sequence
  CIITA targeting sequence
acgggcuaaaaucaagguga

SEQ ID NO: 34117 - RNA, 20 nt, Artificial Sequence
  CIITA targeting sequence
aggugaauuugauucccuuc

SEQ ID NO: 34118 - RNA, 20 nt, Artificial Sequence
  CIITA targeting sequence
ccuugauuuuagcccguuga

SEQ ID NO: 34119 - RNA, 20 nt, Artificial Sequence
  CIITA targeting sequence
aauucaccuugauuuuagcc

SEQ ID NO: 34120 - RNA, 20 nt, Artificial Sequence
  CIITA targeting sequence
cuuccaaagguuguaggaga

SEQ ID NO: 34121 - RNA, 20 nt, Artificial Sequence
  CIITA targeting sequence
aaagguuguaggagaaaauc

SEQ ID NO: 34122 - RNA, 20 nt, Artificial Sequence
  CIITA targeting sequence
uacaaccuuuggaagggaau

SEQ ID NO: 34123 - RNA, 20 nt, Artificial Sequence
  CIITA targeting sequence
ccuacaaccuuuggaaggga

SEQ ID NO: 34124 - RNA, 20 nt, Artificial Sequence
  CIITA targeting sequence
auuucugcgguuuuucaagc

SEQ ID NO: 34125 - RNA, 20 nt, Artificial Sequence
  CIITA targeting sequence
gcgguuuuucaagcuucuag

SEQ ID NO: 34126 - RNA, 20 nt, Artificial Sequence
  CIITA targeting sequence
agcuucuagaagcuacucac

SEQ ID NO: 34127 - RNA, 20 nt, Artificial Sequence
  CIITA targeting sequence
agaagcuacucacauaccuu

SEQ ID NO: 34128 - RNA, 20 nt, Artificial Sequence
  CIITA targeting sequence
agaagcuugaaaaaccgcag

SEQ ID NO: 34129 - RNA, 20 nt, Artificial Sequence
  CIITA targeting sequence
cauaccuuggcuugugacuu

SEQ ID NO: 34130 - RNA, 20 nt, Artificial Sequence
  CIITA targeting sequence
caagccaagguaugugagua

SEQ ID NO: 34131 - RNA, 20 nt, Artificial Sequence
  CIITA targeting sequence
uuccuucaucucugaagcca

SEQ ID NO: 34132 - RNA, 20 nt, Artificial Sequence
  CIITA targeting sequence
uucaucucugaagccaguaa

SEQ ID NO: 34133 - RNA, 20 nt, Artificial Sequence
  CIITA targeting sequence
ucucugaagccaguaacauu

SEQ ID NO: 34134 - RNA, 20 nt, Artificial Sequence
  CIITA targeting sequence
cugaagccaguaacauugua

SEQ ID NO: 34135 - RNA, 20 nt, Artificial Sequence
  CIITA targeting sequence
gaagccaguaacauuguauc

SEQ ID NO: 34136 - RNA, 20 nt, Artificial Sequence
  CIITA targeting sequence
gagaugaaggaaggaaguca

SEQ ID NO: 34137 - RNA, 20 nt, Artificial Sequence
  CIITA targeting sequence
cuuugacuagucuuccacag

SEQ ID NO: 34138 - RNA, 20 nt, Artificial Sequence
  CIITA targeting sequence
uugacuagucuuccacaguc

SEQ ID NO: 34139 - RNA, 20 nt, Artificial Sequence
  CIITA targeting sequence
aagagauacaauguuacugg

SEQ ID NO: 34140 - RNA, 20 nt, Artificial Sequence
  CIITA targeting sequence
uccacagucacaccauaucu

SEQ ID NO: 34141 - RNA, 20 nt, Artificial Sequence
  CIITA targeting sequence
acagucacaccauaucuuuu

SEQ ID NO: 34142 - RNA, 20 nt, Artificial Sequence
  CIITA targeting sequence
caccauaucuuuugucccca

SEQ ID NO: 34143 - RNA, 20 nt, Artificial Sequence
  CIITA targeting sequence
uuuguccccauuuucuacuu

SEQ ID NO: 34144 - RNA, 20 nt, Artificial Sequence
  CIITA targeting sequence
ccauuuucuacuuuuuaaaa

SEQ ID NO: 34145 - RNA, 20 nt, Artificial Sequence
  CIITA targeting sequence
acuuuuuaaaauuucaauag

SEQ ID NO: 34146 - RNA, 20 nt, Artificial Sequence
  CIITA targeting sequence
auaguuuugggggaaacagg

SEQ ID NO: 34147 - RNA, 20 nt, Artificial Sequence
  CIITA targeting sequence
cccaaaacuauugaaauuuu

SEQ ID NO: 34148 - RNA, 20 nt, Artificial Sequence
  CIITA targeting sequence
uuaguggugacuucugagau

SEQ ID NO: 34149 - RNA, 20 nt, Artificial Sequence
  CIITA targeting sequence
ccacuaaagaacuuacccau

SEQ ID NO: 34150 - RNA, 20 nt, Artificial Sequence
  CIITA targeting sequence
gagauuuuggugcagccacc

SEQ ID NO: 34151 - RNA, 20 nt, Artificial Sequence
  CIITA targeting sequence
gaagucaccacuaaagaacu

SEQ ID NO: 34152 - RNA, 20 nt, Artificial Sequence
  CIITA targeting sequence
cagaagucaccacuaaagaa

SEQ ID NO: 34153 - RNA, 20 nt, Artificial Sequence
  CIITA targeting sequence
ggugguggcugcaccaaaau

SEQ ID NO: 34154 - RNA, 20 nt, Artificial Sequence
  CIITA targeting sequence
uuuaucccugccccacccca

SEQ ID NO: 34155 - RNA, 20 nt, Artificial Sequence
  CIITA targeting sequence
cugccccaccccaacacuuc

SEQ ID NO: 34156 - RNA, 20 nt, Artificial Sequence
  CIITA targeting sequence
cccaguccccaaaguccauu

SEQ ID NO: 34157 - RNA, 20 nt, Artificial Sequence
  CIITA targeting sequence
ccaaaguccauuauaucauu

SEQ ID NO: 34158 - RNA, 20 nt, Artificial Sequence
  CIITA targeting sequence
auuauaucauucuuaugccu

SEQ ID NO: 34159 - RNA, 20 nt, Artificial Sequence
  CIITA targeting sequence
uucuuaugccuuugcauccu

SEQ ID NO: 34160 - RNA, 20 nt, Artificial Sequence
  CIITA targeting sequence
uaugccuuugcauccucaua

SEQ ID NO: 34161 - RNA, 20 nt, Artificial Sequence
  CIITA targeting sequence
ucauaauuuagcucccacuu

SEQ ID NO: 34162 - RNA, 20 nt, Artificial Sequence
  CIITA targeting sequence
uaauuuagcucccacuuaca

SEQ ID NO: 34163 - RNA, 20 nt, Artificial Sequence
  CIITA targeting sequence
cacuuacaagugagaacaua

SEQ ID NO: 34164 - RNA, 20 nt, Artificial Sequence
  CIITA targeting sequence
cuuguaagugggagcuaaau

SEQ ID NO: 34165 - RNA, 20 nt, Artificial Sequence
  CIITA targeting sequence
cacuuguaagugggagcuaa

SEQ ID NO: 34166 - RNA, 20 nt, Artificial Sequence
  CIITA targeting sequence
uauguucucacuuguaagug

SEQ ID NO: 34167 - RNA, 20 nt, Artificial Sequence
  CIITA targeting sequence
aaaccaaauaucguauguuc

SEQ ID NO: 34168 - RNA, 20 nt, Artificial Sequence
  CIITA targeting sequence
ucaaaaccaaauaucguaug

SEQ ID NO: 34169 - RNA, 20 nt, Artificial Sequence
  CIITA targeting sequence
ucaucaaaaccaaauaucgu

SEQ ID NO: 34170 - RNA, 20 nt, Artificial Sequence
  CIITA targeting sequence
uuuacaucuuagaugucuuu

SEQ ID NO: 34171 - RNA, 20 nt, Artificial Sequence
  CIITA targeting sequence
uagaugucuuuuuccuccau

SEQ ID NO: 34172 - RNA, 20 nt, Artificial Sequence
  CIITA targeting sequence
aagauguaaaggaaaauauc

SEQ ID NO: 34173 - RNA, 20 nt, Artificial Sequence
  CIITA targeting sequence
uuuuccuccaugguuauaau

SEQ ID NO: 34174 - RNA, 20 nt, Artificial Sequence
  CIITA targeting sequence
uccaugguuauaaucacagc

SEQ ID NO: 34175 - RNA, 20 nt, Artificial Sequence
  CIITA targeting sequence
augguuauaaucacagcuuu

SEQ ID NO: 34176 - RNA, 20 nt, Artificial Sequence
  CIITA targeting sequence
cagcuuuaaaaaucauuguc

SEQ ID NO: 34177 - RNA, 20 nt, Artificial Sequence
  CIITA targeting sequence
uugucugcuaauuucaacau

SEQ ID NO: 34178 - RNA, 20 nt, Artificial Sequence
  CIITA targeting sequence
gcuaauuucaacaucagcau

SEQ ID NO: 34179 - RNA, 20 nt, Artificial Sequence
  CIITA targeting sequence
acaucagcaucaucuugagg

SEQ ID NO: 34180 - RNA, 20 nt, Artificial Sequence
  CIITA targeting sequence
gcaucaucuugaggccaguu

SEQ ID NO: 34181 - RNA, 20 nt, Artificial Sequence
  CIITA targeting sequence
ucuugaggccaguuuucacu

SEQ ID NO: 34182 - RNA, 20 nt, Artificial Sequence
  CIITA targeting sequence
ugaggccaguuuucacugau

SEQ ID NO: 34183 - RNA, 20 nt, Artificial Sequence
  CIITA targeting sequence
agaugaugcugauguugaaa

SEQ ID NO: 34184 - RNA, 20 nt, Artificial Sequence
  CIITA targeting sequence
cugauugucuuuuucucuug

SEQ ID NO: 34185 - RNA, 20 nt, Artificial Sequence
  CIITA targeting sequence
gugaaaacuggccucaagau

SEQ ID NO: 34186 - RNA, 20 nt, Artificial Sequence
  CIITA targeting sequence
uuuucucuugaaaauguuac

SEQ ID NO: 34187 - RNA, 20 nt, Artificial Sequence
  CIITA targeting sequence
cuugaaaauguuaccuuuuu

SEQ ID NO: 34188 - RNA, 20 nt, Artificial Sequence
  CIITA targeting sequence
ugaaaauguuaccuuuuucc

SEQ ID NO: 34189 - RNA, 20 nt, Artificial Sequence
  CIITA targeting sequence
agagaaaaagacaaucagug

SEQ ID NO: 34190 - RNA, 20 nt, Artificial Sequence
  CIITA targeting sequence
uguuucuuuauaugucaacu

SEQ ID NO: 34191 - RNA, 20 nt, Artificial Sequence
  CIITA targeting sequence
uuauaugucaacuaauuuug

SEQ ID NO: 34192 - RNA, 20 nt, Artificial Sequence
  CIITA targeting sequence
acuaauuuuguuuuuauuua

SEQ ID NO: 34193 - RNA, 20 nt, Artificial Sequence
  CIITA targeting sequence
aaaauaaauaaauaaauaaa

SEQ ID NO: 34194 - RNA, 20 nt, Artificial Sequence
  CIITA targeting sequence
caaaaauaaauaaauaaaua

SEQ ID NO: 34195 - RNA, 20 nt, Artificial Sequence
  CIITA targeting sequence
aucucaaaaauaaauaaaua

SEQ ID NO: 34196 - RNA, 20 nt, Artificial Sequence
  CIITA targeting sequence
ugcucugucacccaggcugg

SEQ ID NO: 34197 - RNA, 20 nt, Artificial Sequence
  CIITA targeting sequence
gucacccaggcuggagugca

SEQ ID NO: 34198 - RNA, 20 nt, Artificial Sequence
  CIITA targeting sequence
cccaggcuggagugcagugg

SEQ ID NO: 34199 - RNA, 20 nt, Artificial Sequence
  CIITA targeting sequence
agccugggugacagagcaag

SEQ ID NO: 34200 - RNA, 20 nt, Artificial Sequence
  CIITA targeting sequence
cggcucacugcaacuucugc

SEQ ID NO: 34201 - RNA, 20 nt, Artificial Sequence
  CIITA targeting sequence
gcucacugcaacuucugccc

SEQ ID NO: 34202 - RNA, 20 nt, Artificial Sequence
  CIITA targeting sequence
cugcaacuucugcccccugg

SEQ ID NO: 34203 - RNA, 20 nt, Artificial Sequence
  CIITA targeting sequence
gcccccuggguucaagcaau

SEQ ID NO: 34204 - RNA, 20 nt, Artificial Sequence
  CIITA targeting sequence
agcaauucucugccucagcc

SEQ ID NO: 34205 - RNA, 20 nt, Artificial Sequence
  CIITA targeting sequence
cugccucagccucccgagua

SEQ ID NO: 34206 - RNA, 20 nt, Artificial Sequence
  CIITA targeting sequence
gccucagccucccgaguagc

SEQ ID NO: 34207 - RNA, 20 nt, Artificial Sequence
  CIITA targeting sequence
gccucccgaguagcugggau

SEQ ID NO: 34208 - RNA, 20 nt, Artificial Sequence
  CIITA targeting sequence
cgaguagcugggauuacagg

SEQ ID NO: 34209 - RNA, 20 nt, Artificial Sequence
  CIITA targeting sequence
ggaggcugaggcagagaauu

SEQ ID NO: 34210 - RNA, 20 nt, Artificial Sequence
  CIITA targeting sequence
cagcuacucgggaggcugag

SEQ ID NO: 34211 - RNA, 20 nt, Artificial Sequence
  CIITA targeting sequence
aauuuuuguauuuuuaguag

SEQ ID NO: 34212 - RNA, 20 nt, Artificial Sequence
  CIITA targeting sequence
acuaaaaauacaaaaauuag

SEQ ID NO: 34213 - RNA, 20 nt, Artificial Sequence
  CIITA targeting sequence
cuacuaaaaauacaaaaauu

SEQ ID NO: 34214 - RNA, 20 nt, Artificial Sequence
  CIITA targeting sequence
ccauguugaccaggcuguuc

SEQ ID NO: 34215 - RNA, 20 nt, Artificial Sequence
  CIITA targeting sequence
acauggugaaaccccaucuc

SEQ ID NO: 34216 - RNA, 20 nt, Artificial Sequence
  CIITA targeting sequence
ugaacuccugaccucgugau

SEQ ID NO: 34217 - RNA, 20 nt, Artificial Sequence
  CIITA targeting sequence
ggaacagccuggucaacaug

SEQ ID NO: 34218 - RNA, 20 nt, Artificial Sequence
  CIITA targeting sequence
ugaccucgugauccacccgc

SEQ ID NO: 34219 - RNA, 20 nt, Artificial Sequence
  CIITA targeting sequence
ggaguucaggaacagccugg

SEQ ID NO: 34220 - RNA, 20 nt, Artificial Sequence
  CIITA targeting sequence
ugauccacccgccuuggccu

SEQ ID NO: 34221 - RNA, 20 nt, Artificial Sequence
  CIITA targeting sequence
cgaggucaggaguucaggaa

SEQ ID NO: 34222 - RNA, 20 nt, Artificial Sequence
  CIITA targeting sequence
acccgccuuggccucccaaa

SEQ ID NO: 34223 - RNA, 20 nt, Artificial Sequence
  CIITA targeting sequence
caaagugcugggauuacagg

SEQ ID NO: 34224 - RNA, 20 nt, Artificial Sequence
  CIITA targeting sequence
cagcacuuugggaggccaag

SEQ ID NO: 34225 - RNA, 20 nt, Artificial Sequence
  CIITA targeting sequence
ugccuguaaucccagcacuu

SEQ ID NO: 34226 - RNA, 20 nt, Artificial Sequence
  CIITA targeting sequence
aguaauuuuguauugaacac

SEQ ID NO: 34227 - RNA, 20 nt, Artificial Sequence
  CIITA targeting sequence
auacaaaauuacuugacaua

SEQ ID NO: 34228 - RNA, 20 nt, Artificial Sequence
  CIITA targeting sequence
uguguucaauacaaaauuac

SEQ ID NO: 34229 - RNA, 20 nt, Artificial Sequence
  CIITA targeting sequence
cuaauguccuguguucaaua

SEQ ID NO: 34230 - RNA, 20 nt, Artificial Sequence
  CIITA targeting sequence
ggauucuguuauaaucugaa

SEQ ID NO: 34231 - RNA, 20 nt, Artificial Sequence
  CIITA targeting sequence
agaguguuuacaacauaucc

SEQ ID NO: 34232 - RNA, 20 nt, Artificial Sequence
  CIITA targeting sequence
guuauaaucugaacagcauu

SEQ ID NO: 34233 - RNA, 20 nt, Artificial Sequence
  CIITA targeting sequence
gaacagcauuaauauuuuug

SEQ ID NO: 34234 - RNA, 20 nt, Artificial Sequence
  CIITA targeting sequence
gauuauaacagaauccagag

SEQ ID NO: 34235 - RNA, 20 nt, Artificial Sequence
  CIITA targeting sequence
guagggacauaacuuggcug

SEQ ID NO: 34236 - RNA, 20 nt, Artificial Sequence
  CIITA targeting sequence
cuacugaaauaaaacccaaa

SEQ ID NO: 34237 - RNA, 20 nt, Artificial Sequence
  CIITA targeting sequence
agccaaguuaugucccuacu

SEQ ID NO: 34238 - RNA, 20 nt, Artificial Sequence
  CIITA targeting sequence
aaugcaaaaucuccuacccc

SEQ ID NO: 34239 - RNA, 20 nt, Artificial Sequence
  CIITA targeting sequence
ccuaccccuacacccauugc

SEQ ID NO: 34240 - RNA, 20 nt, Artificial Sequence
  CIITA targeting sequence
uaccccuacacccauugcag

SEQ ID NO: 34241 - RNA, 20 nt, Artificial Sequence
  CIITA targeting sequence
aaucuucguucagcuuauuu

SEQ ID NO: 34242 - RNA, 20 nt, Artificial Sequence
  CIITA targeting sequence
ucguucagcuuauuuagccu

SEQ ID NO: 34243 - RNA, 20 nt, Artificial Sequence
  CIITA targeting sequence
uucagcuuauuuagccuuag

SEQ ID NO: 34244 - RNA, 20 nt, Artificial Sequence
  CIITA targeting sequence
gcuuauuuagccuuagcuga

SEQ ID NO: 34245 - RNA, 20 nt, Artificial Sequence
  CIITA targeting sequence
gcuaaggcuaaauaagcuga

SEQ ID NO: 34246 - RNA, 20 nt, Artificial Sequence
  CIITA targeting sequence
aagcagcucagcuaaggcua

SEQ ID NO: 34247 - RNA, 20 nt, Artificial Sequence
  CIITA targeting sequence
gaccuacgaauauauacaug

SEQ ID NO: 34248 - RNA, 20 nt, Artificial Sequence
  CIITA targeting sequence
gacuccaagcagcucagcua

SEQ ID NO: 34249 - RNA, 20 nt, Artificial Sequence
  CIITA targeting sequence
uaggucagacuccaagcagc

SEQ ID NO: 34250 - RNA, 20 nt, Artificial Sequence
  CIITA targeting sequence
agaagccagccagauauuua

SEQ ID NO: 34251 - RNA, 20 nt, Artificial Sequence
  CIITA targeting sequence
ggaccauguauauauucgua

SEQ ID NO: 34252 - RNA, 20 nt, Artificial Sequence
  CIITA targeting sequence
ggcuggcuucuggaccaugu

SEQ ID NO: 34253 - RNA, 20 nt, Artificial Sequence
  CIITA targeting sequence
aaauaucuggcuggcuucug

SEQ ID NO: 34254 - RNA, 20 nt, Artificial Sequence
  CIITA targeting sequence
guauauaauugucuaaauau

SEQ ID NO: 34255 - RNA, 20 nt, Artificial Sequence
  CIITA targeting sequence
uuucuccuucucugucuggg

SEQ ID NO: 34256 - RNA, 20 nt, Artificial Sequence
  CIITA targeting sequence
ccuucucugucugggauuuc

SEQ ID NO: 34257 - RNA, 20 nt, Artificial Sequence
  CIITA targeting sequence
uucucugucugggauuucua

SEQ ID NO: 34258 - RNA, 20 nt, Artificial Sequence
  CIITA targeting sequence
cugucugggauuucuacuuu

SEQ ID NO: 34259 - RNA, 20 nt, Artificial Sequence
  CIITA targeting sequence
gucugggauuucuacuuucc

SEQ ID NO: 34260 - RNA, 20 nt, Artificial Sequence
  CIITA targeting sequence
gggauuucuacuuuccagua

SEQ ID NO: 34261 - RNA, 20 nt, Artificial Sequence
  CIITA targeting sequence
cagacagagaaggagaaagg

SEQ ID NO: 34262 - RNA, 20 nt, Artificial Sequence
  CIITA targeting sequence
acuuuccaguagguauuuuu

SEQ ID NO: 34263 - RNA, 20 nt, Artificial Sequence
  CIITA targeting sequence
aguagguauuuuugccccaa

SEQ ID NO: 34264 - RNA, 20 nt, Artificial Sequence
  CIITA targeting sequence
auccucugauuauaaagggc

SEQ ID NO: 34265 - RNA, 20 nt, Artificial Sequence
  CIITA targeting sequence
ucugauuauaaagggcagua

SEQ ID NO: 34266 - RNA, 20 nt, Artificial Sequence
  CIITA targeting sequence
gauuauaaagggcaguaaac

SEQ ID NO: 34267 - RNA, 20 nt, Artificial Sequence
  CIITA targeting sequence
gaggauagaauuuggggcaa

SEQ ID NO: 34268 - RNA, 20 nt, Artificial Sequence
  CIITA targeting sequence
uuuuuuuuuuuuuuuuuuuu

SEQ ID NO: 34269 - RNA, 20 nt, Artificial Sequence
  CIITA targeting sequence
aaaaaaaaaaaaaaaaaaaa

SEQ ID NO: 34270 - RNA, 20 nt, Artificial Sequence
  CIITA targeting sequence
caaaaaaaaaaaaaaaaaaa

SEQ ID NO: 34271 - RNA, 20 nt, Artificial Sequence
  CIITA targeting sequence
aucucaaaaaaaaaaaaaaa

SEQ ID NO: 34272 - RNA, 20 nt, Artificial Sequence
  CIITA targeting sequence
gacucuguugcccaggcuaa

SEQ ID NO: 34273 - RNA, 20 nt, Artificial Sequence
  CIITA targeting sequence
gacucuaucucaaaaaaaaa

SEQ ID NO: 34274 - RNA, 20 nt, Artificial Sequence
  CIITA targeting sequence
guugcccaggcuaaagugca

SEQ ID NO: 34275 - RNA, 20 nt, Artificial Sequence
  CIITA targeting sequence
uagccuacugcaaccucaac

SEQ ID NO: 34276 - RNA, 20 nt, Artificial Sequence
  CIITA targeting sequence
accucuccaggcucaagugc

SEQ ID NO: 34277 - RNA, 20 nt, Artificial Sequence
  CIITA targeting sequence
ccaggcucaagugcuccucc

SEQ ID NO: 34278 - RNA, 20 nt, Artificial Sequence
  CIITA targeting sequence
aggcucaagugcuccuccca

SEQ ID NO: 34279 - RNA, 20 nt, Artificial Sequence
  CIITA targeting sequence
agugcuccucccaccucagc

SEQ ID NO: 34280 - RNA, 20 nt, Artificial Sequence
  CIITA targeting sequence
ucccaccucagccuuccaag

SEQ ID NO: 34281 - RNA, 20 nt, Artificial Sequence
  CIITA targeting sequence
caccucagccuuccaaguag

SEQ ID NO: 34282 - RNA, 20 nt, Artificial Sequence
  CIITA targeting sequence
gccuuccaaguagcugggac

SEQ ID NO: 34283 - RNA, 20 nt, Artificial Sequence
  CIITA targeting sequence
aaguagcugggaccacaggc

SEQ ID NO: 34284 - RNA, 20 nt, Artificial Sequence
  CIITA targeting sequence
cagcuacuuggaaggcugag

SEQ ID NO: 34285 - RNA, 20 nt, Artificial Sequence
  CIITA targeting sequence
ugccuguggucccagcuacu

SEQ ID NO: 34286 - RNA, 20 nt, Artificial Sequence
  CIITA targeting sequence
uaacugcccugcacagcacu

SEQ ID NO: 34287 - RNA, 20 nt, Artificial Sequence
  CIITA targeting sequence
gugcugugcagggcaguuaa

SEQ ID NO: 34288 - RNA, 20 nt, Artificial Sequence
  CIITA targeting sequence
aaucagugcugugcagggca

SEQ ID NO: 34289 - RNA, 20 nt, Artificial Sequence
  CIITA targeting sequence
gacuaaacucaugaacuggg

SEQ ID NO: 34290 - RNA, 20 nt, Artificial Sequence
  CIITA targeting sequence
gaaggcaaguuccaaucagu

SEQ ID NO: 34291 - RNA, 20 nt, Artificial Sequence
  CIITA targeting sequence
ugaacugggaaauucaccug

SEQ ID NO: 34292 - RNA, 20 nt, Artificial Sequence
  CIITA targeting sequence
ugaguuuagucugaaggcaa

SEQ ID NO: 34293 - RNA, 20 nt, Artificial Sequence
  CIITA targeting sequence
caguucaugaguuuagucug

SEQ ID NO: 34294 - RNA, 20 nt, Artificial Sequence
  CIITA targeting sequence
ccugugaaguucucauuuuc

SEQ ID NO: 34295 - RNA, 20 nt, Artificial Sequence
  CIITA targeting sequence
caggugaauuucccaguuca

SEQ ID NO: 34296 - RNA, 20 nt, Artificial Sequence
  CIITA targeting sequence
cauuuuccauauauugacuc

SEQ ID NO: 34297 - RNA, 20 nt, Artificial Sequence
  CIITA targeting sequence
uuuuccauauauugacuccc

SEQ ID NO: 34298 - RNA, 20 nt, Artificial Sequence
  CIITA targeting sequence
auauauugacucccuuccag

SEQ ID NO: 34299 - RNA, 20 nt, Artificial Sequence
  CIITA targeting sequence
auauauggaaaaugagaacu

SEQ ID NO: 34300 - RNA, 20 nt, Artificial Sequence
  CIITA targeting sequence
cuuccaguaucugccuggcc

SEQ ID NO: 34301 - RNA, 20 nt, Artificial Sequence
  CIITA targeting sequence
aguaucugccuggccuguca

SEQ ID NO: 34302 - RNA, 20 nt, Artificial Sequence
  CIITA targeting sequence
gccuggccugucacucucca

SEQ ID NO: 34303 - RNA, 20 nt, Artificial Sequence
  CIITA targeting sequence
cucuccagugccuucagaua

SEQ ID NO: 34304 - RNA, 20 nt, Artificial Sequence
  CIITA targeting sequence
ccagugccuucagauaguug

SEQ ID NO: 34305 - RNA, 20 nt, Artificial Sequence
  CIITA targeting sequence
agugccuucagauaguuguu

SEQ ID NO: 34306 - RNA, 20 nt, Artificial Sequence
  CIITA targeting sequence
gauaguuguuuuuuauauuc

SEQ ID NO: 34307 - RNA, 20 nt, Artificial Sequence
  CIITA targeting sequence
gaaggcacuggagagugaca

SEQ ID NO: 34308 - RNA, 20 nt, Artificial Sequence
  CIITA targeting sequence
ccccagaguuuauaguuguu

SEQ ID NO: 34309 - RNA, 20 nt, Artificial Sequence
  CIITA targeting sequence
ccagaguuuauaguuguuac

SEQ ID NO: 34310 - RNA, 20 nt, Artificial Sequence
  CIITA targeting sequence
ggggagaauauaaaaaacaa

SEQ ID NO: 34311 - RNA, 20 nt, Artificial Sequence
  CIITA targeting sequence
acgcuaccacagguaacaac

SEQ ID NO: 34312 - RNA, 20 nt, Artificial Sequence
  CIITA targeting sequence
uaugggagcuggucagccac

SEQ ID NO: 34313 - RNA, 20 nt, Artificial Sequence
  CIITA targeting sequence
cauaugaucaacgcuaccac

SEQ ID NO: 34314 - RNA, 20 nt, Artificial Sequence
  CIITA targeting sequence
gccacacuggaaauggaaau

SEQ ID NO: 34315 - RNA, 20 nt, Artificial Sequence
  CIITA targeting sequence
aguguggcugaccagcuccc

SEQ ID NO: 34316 - RNA, 20 nt, Artificial Sequence
  CIITA targeting sequence
auuuccaguguggcugacca

SEQ ID NO: 34317 - RNA, 20 nt, Artificial Sequence
  CIITA targeting sequence
uuugucucauuuaaaugaau

SEQ ID NO: 34318 - RNA, 20 nt, Artificial Sequence
  CIITA targeting sequence
cauuuaaaugaauaaugcaa

SEQ ID NO: 34319 - RNA, 20 nt, Artificial Sequence
  CIITA targeting sequence
uuuaaaugaauaaugcaaau

SEQ ID NO: 34320 - RNA, 20 nt, Artificial Sequence
  CIITA targeting sequence
uuuaaaugagacaaaggauu

SEQ ID NO: 34321 - RNA, 20 nt, Artificial Sequence
  CIITA targeting sequence
gcuggggccauuugcauuau

SEQ ID NO: 34322 - RNA, 20 nt, Artificial Sequence
  CIITA targeting sequence
cagcuggggccauuugcauu

SEQ ID NO: 34323 - RNA, 20 nt, Artificial Sequence
  CIITA targeting sequence
cucagcuggggccauuugca

SEQ ID NO: 34324 - RNA, 20 nt, Artificial Sequence
  CIITA targeting sequence
ugagucuggaaggaaacaaa

SEQ ID NO: 34325 - RNA, 20 nt, Artificial Sequence
  CIITA targeting sequence
ggauuaccaucucucagcug

SEQ ID NO: 34326 - RNA, 20 nt, Artificial Sequence
  CIITA targeting sequence
ggaaggaaacaaagucacgg

SEQ ID NO: 34327 - RNA, 20 nt, Artificial Sequence
  CIITA targeting sequence
agacucaggauuaccaucuc

SEQ ID NO: 34328 - RNA, 20 nt, Artificial Sequence
  CIITA targeting sequence
uuccagacucaggauuacca

SEQ ID NO: 34329 - RNA, 20 nt, Artificial Sequence
  CIITA targeting sequence
cggcauguuacagaaugggc

SEQ ID NO: 34330 - RNA, 20 nt, Artificial Sequence
  CIITA targeting sequence
guaacaugccgugacuuugu

SEQ ID NO: 34331 - RNA, 20 nt, Artificial Sequence
  CIITA targeting sequence
ugcccauucuguaacaugcc

SEQ ID NO: 34332 - RNA, 20 nt, Artificial Sequence
  CIITA targeting sequence
ccugcccauucuguaacaug

SEQ ID NO: 34333 - RNA, 20 nt, Artificial Sequence
  CIITA targeting sequence
ccuaugguucuuuaaaacug

SEQ ID NO: 34334 - RNA, 20 nt, Artificial Sequence
  CIITA targeting sequence
uuaaaacuggguuggggauu

SEQ ID NO: 34335 - RNA, 20 nt, Artificial Sequence
  CIITA targeting sequence
ccaacccaguuuuaaagaac

SEQ ID NO: 34336 - RNA, 20 nt, Artificial Sequence
  CIITA targeting sequence
aaaaauccccaacccaguuu

SEQ ID NO: 34337 - RNA, 20 nt, Artificial Sequence
  CIITA targeting sequence
uaaaccagacuggcuucuau

SEQ ID NO: 34338 - RNA, 20 nt, Artificial Sequence
  CIITA targeting sequence
gguuuaugauucuaaaaauc

SEQ ID NO: 34339 - RNA, 20 nt, Artificial Sequence
  CIITA targeting sequence
augcaaauccucuguuuugu

SEQ ID NO: 34340 - RNA, 20 nt, Artificial Sequence
  CIITA targeting sequence
ucuguuuugugcauuaguaa

SEQ ID NO: 34341 - RNA, 20 nt, Artificial Sequence
  CIITA targeting sequence
guuuugugcauuaguaaguu

SEQ ID NO: 34342 - RNA, 20 nt, Artificial Sequence
  CIITA targeting sequence
ccaacuuacuaaugcacaaa

SEQ ID NO: 34343 - RNA, 20 nt, Artificial Sequence
  CIITA targeting sequence
guguucguuaagugcuuacu

SEQ ID NO: 34344 - RNA, 20 nt, Artificial Sequence
  CIITA targeting sequence
uuaagugcuuacuaggucca

SEQ ID NO: 34345 - RNA, 20 nt, Artificial Sequence
  CIITA targeting sequence
aguguagagacccuuaaaug

SEQ ID NO: 34346 - RNA, 20 nt, Artificial Sequence
  CIITA targeting sequence
acacuggaccuaguaagcac

SEQ ID NO: 34347 - RNA, 20 nt, Artificial Sequence
  CIITA targeting sequence
cuacacuggaccuaguaagc

SEQ ID NO: 34348 - RNA, 20 nt, Artificial Sequence
  CIITA targeting sequence
uaugcauuuaagggucucua

SEQ ID NO: 34349 - RNA, 20 nt, Artificial Sequence
  CIITA targeting sequence
auugcuuuuagugggaaauu

SEQ ID NO: 34350 - RNA, 20 nt, Artificial Sequence
  CIITA targeting sequence
aagcucauaugcauuuaagg

SEQ ID NO: 34351 - RNA, 20 nt, Artificial Sequence
  CIITA targeting sequence
cacuaaaagcaaucgaagcu

SEQ ID NO: 34352 - RNA, 20 nt, Artificial Sequence
  CIITA targeting sequence
gcaaaauuucccacuaaaag

SEQ ID NO: 34353 - RNA, 20 nt, Artificial Sequence
  CIITA targeting sequence
ucugcaaaauuucccacuaa

SEQ ID NO: 34354 - RNA, 20 nt, Artificial Sequence
  CIITA targeting sequence
uccucugcaaaauuucccac

SEQ ID NO: 34355 - RNA, 20 nt, Artificial Sequence
  CIITA targeting sequence
ccuccucugcaaaauuuccc

SEQ ID NO: 34356 - RNA, 20 nt, Artificial Sequence
  CIITA targeting sequence
gucuccuccucugcaaaauu

SEQ ID NO: 34357 - RNA, 20 nt, Artificial Sequence
  CIITA targeting sequence
ucagucuccuccucugcaaa

SEQ ID NO: 34358 - RNA, 20 nt, Artificial Sequence
  CIITA targeting sequence
caaauccucagucuccuccu

SEQ ID NO: 34359 - RNA, 20 nt, Artificial Sequence
  CIITA targeting sequence
gggugauaguaauuugcaug

SEQ ID NO: 34360 - RNA, 20 nt, Artificial Sequence
  CIITA targeting sequence
cccugaguuuaaccucacaa

SEQ ID NO: 34361 - RNA, 20 nt, Artificial Sequence
  CIITA targeting sequence
ugcaaauuacuaucacccug

SEQ ID NO: 34362 - RNA, 20 nt, Artificial Sequence
  CIITA targeting sequence
auaauaaugaugguucauau

SEQ ID NO: 34363 - RNA, 20 nt, Artificial Sequence
  CIITA targeting sequence
uuauuauugauuaaucaugc

SEQ ID NO: 34364 - RNA, 20 nt, Artificial Sequence
  CIITA targeting sequence
uauuuauuguauuauuauca

SEQ ID NO: 34365 - RNA, 20 nt, Artificial Sequence
  CIITA targeting sequence
uguuguagauaaugcacuag

SEQ ID NO: 34366 - RNA, 20 nt, Artificial Sequence
  CIITA targeting sequence
acaacaugauaauaauacaa

SEQ ID NO: 34367 - RNA, 20 nt, Artificial Sequence
  CIITA targeting sequence
cuagugcauuaucuacaaca

SEQ ID NO: 34368 - RNA, 20 nt, Artificial Sequence
  CIITA targeting sequence
auuuauguuaucucauuuaa

SEQ ID NO: 34369 - RNA, 20 nt, Artificial Sequence
  CIITA targeting sequence
cauuuaauccucccaacaac

SEQ ID NO: 34370 - RNA, 20 nt, Artificial Sequence
  CIITA targeting sequence
uuuaauccucccaacaaccc

SEQ ID NO: 34371 - RNA, 20 nt, Artificial Sequence
  CIITA targeting sequence
ucccaacaacccuaucaugu

SEQ ID NO: 34372 - RNA, 20 nt, Artificial Sequence
  CIITA targeting sequence
caacaacccuaucauguaag

SEQ ID NO: 34373 - RNA, 20 nt, Artificial Sequence
  CIITA targeting sequence
uguaaguacuguuaacagag

SEQ ID NO: 34374 - RNA, 20 nt, Artificial Sequence
  CIITA targeting sequence
guuaacaguacuuacaugau

SEQ ID NO: 34375 - RNA, 20 nt, Artificial Sequence
  CIITA targeting sequence
cuguuaacaguacuuacaug

SEQ ID NO: 34376 - RNA, 20 nt, Artificial Sequence
  CIITA targeting sequence
cacuuguaaucccaguacuu

SEQ ID NO: 34377 - RNA, 20 nt, Artificial Sequence
  CIITA targeting sequence
caguacuuugggagacugag

SEQ ID NO: 34378 - RNA, 20 nt, Artificial Sequence
  CIITA targeting sequence
caaaguacugggauuacaag

SEQ ID NO: 34379 - RNA, 20 nt, Artificial Sequence
  CIITA targeting sequence
cccaaaguacugggauuaca

SEQ ID NO: 34380 - RNA, 20 nt, Artificial Sequence
  CIITA targeting sequence
gucucccaaaguacugggau

SEQ ID NO: 34381 - RNA, 20 nt, Artificial Sequence
  CIITA targeting sequence
ugccucagucucccaaagua

SEQ ID NO: 34382 - RNA, 20 nt, Artificial Sequence
  CIITA targeting sequence
ucuugccucagucucccaaa

SEQ ID NO: 34383 - RNA, 20 nt, Artificial Sequence
  CIITA targeting sequence
cuugagcccaggaauucaag

SEQ ID NO: 34384 - RNA, 20 nt, Artificial Sequence
  CIITA targeting sequence
agugauccucuugccucagu

SEQ ID NO: 34385 - RNA, 20 nt, Artificial Sequence
  CIITA targeting sequence
ugggcucaagugauccucuu

SEQ ID NO: 34386 - RNA, 20 nt, Artificial Sequence
  CIITA targeting sequence
agaccagccugggaaacaga

SEQ ID NO: 34387 - RNA, 20 nt, Artificial Sequence
  CIITA targeting sequence
ugaauuccugggcucaagug

SEQ ID NO: 34388 - RNA, 20 nt, Artificial Sequence
  CIITA targeting sequence
caggcuggucuugaauuccu

SEQ ID NO: 34389 - RNA, 20 nt, Artificial Sequence
  CIITA targeting sequence
guuucccaggcuggucuuga

SEQ ID NO: 34390 - RNA, 20 nt, Artificial Sequence
  CIITA targeting sequence
cucuguuucccaggcugguc

SEQ ID NO: 34391 - RNA, 20 nt, Artificial Sequence
  CIITA targeting sequence
cacucuguuucccaggcugg

SEQ ID NO: 34392 - RNA, 20 nt, Artificial Sequence
  CIITA targeting sequence
cuacuaaaaauaaaaaaaua

SEQ ID NO: 34393 - RNA, 20 nt, Artificial Sequence
  CIITA targeting sequence
acuaaaaauaaaaaaauaaa

SEQ ID NO: 34394 - RNA, 20 nt, Artificial Sequence
  CIITA targeting sequence
ugccccgcuaauuuuuuauu

SEQ ID NO: 34395 - RNA, 20 nt, Artificial Sequence
  CIITA targeting sequence
caccaucaugccccgcuaau

SEQ ID NO: 34396 - RNA, 20 nt, Artificial Sequence
  CIITA targeting sequence
guagucccagcuacugggaa

SEQ ID NO: 34397 - RNA, 20 nt, Artificial Sequence
  CIITA targeting sequence
cagcuacugggaaacagaga

SEQ ID NO: 34398 - RNA, 20 nt, Artificial Sequence
  CIITA targeting sequence
caguagcugggacuacagac

SEQ ID NO: 34399 - RNA, 20 nt, Artificial Sequence
  CIITA targeting sequence
guuucccaguagcugggacu

SEQ ID NO: 34400 - RNA, 20 nt, Artificial Sequence
  CIITA targeting sequence
cuguuucccaguagcuggga

SEQ ID NO: 34401 - RNA, 20 nt, Artificial Sequence
  CIITA targeting sequence
caucucuguuucccaguagc

SEQ ID NO: 34402 - RNA, 20 nt, Artificial Sequence
  CIITA targeting sequence
aacaaaccucccaucucugu

SEQ ID NO: 34403 - RNA, 20 nt, Artificial Sequence
  CIITA targeting sequence
caggcucaaacaaaccuccc

SEQ ID NO: 34404 - RNA, 20 nt, Artificial Sequence
  CIITA targeting sequence
acuucccaggcucaaacaaa

SEQ ID NO: 34405 - RNA, 20 nt, Artificial Sequence
  CIITA targeting sequence
cugcagccucaacuucccag

SEQ ID NO: 34406 - RNA, 20 nt, Artificial Sequence
  CIITA targeting sequence
uaacucacugcagccucaac

SEQ ID NO: 34407 - RNA, 20 nt, Artificial Sequence
  CIITA targeting sequence
cgccacugcacaccagccug

SEQ ID NO: 34408 - RNA, 20 nt, Artificial Sequence
  CIITA targeting sequence
guugcccaggcuggugugca

SEQ ID NO: 34409 - RNA, 20 nt, Artificial Sequence
  CIITA targeting sequence
ugcucuguugcccaggcugg

SEQ ID NO: 34410 - RNA, 20 nt, Artificial Sequence
  CIITA targeting sequence
aaaaaaaaaaaaaggcuaug

SEQ ID NO: 34411 - RNA, 20 nt, Artificial Sequence
  CIITA targeting sequence
cauaauuggcaaggagcagc

SEQ ID NO: 34412 - RNA, 20 nt, Artificial Sequence
  CIITA targeting sequence
uugccaauuaugugacuuug

SEQ ID NO: 34413 - RNA, 20 nt, Artificial Sequence
  CIITA targeting sequence
gcugcuccuugccaauuaug

SEQ ID NO: 34414 - RNA, 20 nt, Artificial Sequence
  CIITA targeting sequence
gggacuugaacauaggcaga

SEQ ID NO: 34415 - RNA, 20 nt, Artificial Sequence
  CIITA targeting sequence
cagaucugcugcuccuugcc

SEQ ID NO: 34416 - RNA, 20 nt, Artificial Sequence
  CIITA targeting sequence
agucccagaucugcugcucc

SEQ ID NO: 34417 - RNA, 20 nt, Artificial Sequence
  CIITA targeting sequence
gccuauguucaagucccaga

SEQ ID NO: 34418 - RNA, 20 nt, Artificial Sequence
  CIITA targeting sequence
aagccuauuugcuuaaccuc

SEQ ID NO: 34419 - RNA, 20 nt, Artificial Sequence
  CIITA targeting sequence
auaccacaaugccuucuugc

SEQ ID NO: 34420 - RNA, 20 nt, Artificial Sequence
  CIITA targeting sequence
ugcuaugguaaaacaucuga

SEQ ID NO: 34421 - RNA, 20 nt, Artificial Sequence
  CIITA targeting sequence
gaaaagaccuauuacccuau

SEQ ID NO: 34422 - RNA, 20 nt, Artificial Sequence
  CIITA targeting sequence
gauguuuuaccauagcaaga

SEQ ID NO: 34423 - RNA, 20 nt, Artificial Sequence
  CIITA targeting sequence
uuucagauguuuuaccauag

SEQ ID NO: 34424 - RNA, 20 nt, Artificial Sequence
  CIITA targeting sequence
ucuaaggaggcaugucgccu

SEQ ID NO: 34425 - RNA, 20 nt, Artificial Sequence
  CIITA targeting sequence
aaggaggcaugucgccuucc

SEQ ID NO: 34426 - RNA, 20 nt, Artificial Sequence
  CIITA targeting sequence
uuagaggaccuauaggguaa

SEQ ID NO: 34427 - RNA, 20 nt, Artificial Sequence
  CIITA targeting sequence
ccuuccucuuagcaauacua

SEQ ID NO: 34428 - RNA, 20 nt, Artificial Sequence
  CIITA targeting sequence
ucuuagcaauacuagauugg

SEQ ID NO: 34429 - RNA, 20 nt, Artificial Sequence
  CIITA targeting sequence
uagcaauacuagauuggcuc

SEQ ID NO: 34430 - RNA, 20 nt, Artificial Sequence
  CIITA targeting sequence
aguauugcuaagaggaaggc

SEQ ID NO: 34431 - RNA, 20 nt, Artificial Sequence
  CIITA targeting sequence
aacagaaggcugugggcuuc

SEQ ID NO: 34432 - RNA, 20 nt, Artificial Sequence
  CIITA targeting sequence
guuggagccaaucuaguauu

SEQ ID NO: 34433 - RNA, 20 nt, Artificial Sequence
  CIITA targeting sequence
cuggcacaugcaccugggua

SEQ ID NO: 34434 - RNA, 20 nt, Artificial Sequence
  CIITA targeting sequence
ggcacaugcaccuggguagg

SEQ ID NO: 34435 - RNA, 20 nt, Artificial Sequence
  CIITA targeting sequence
uacccaggugcaugugccag

SEQ ID NO: 34436 - RNA, 20 nt, Artificial Sequence
  CIITA targeting sequence
ggguccuacccaggugcaug

SEQ ID NO: 34437 - RNA, 20 nt, Artificial Sequence
  CIITA targeting sequence
cuggguccuacccaggugca

SEQ ID NO: 34438 - RNA, 20 nt, Artificial Sequence
  CIITA targeting sequence
guggagucugaaucaaccca

SEQ ID NO: 34439 - RNA, 20 nt, Artificial Sequence
  CIITA targeting sequence
acagauauucucuggguccu

SEQ ID NO: 34440 - RNA, 20 nt, Artificial Sequence
  CIITA targeting sequence
gaaucaacccaaaagccaau

SEQ ID NO: 34441 - RNA, 20 nt, Artificial Sequence
  CIITA targeting sequence
gacuccacagauauucucug

SEQ ID NO: 34442 - RNA, 20 nt, Artificial Sequence
  CIITA targeting sequence
acccaaaagccaauauccau

SEQ ID NO: 34443 - RNA, 20 nt, Artificial Sequence
  CIITA targeting sequence
auccguucaucaggaacccc

SEQ ID NO: 34444 - RNA, 20 nt, Artificial Sequence
  CIITA targeting sequence
guucaucaggaaccccagcc

SEQ ID NO: 34445 - RNA, 20 nt, Artificial Sequence
  CIITA targeting sequence
ucaggaaccccagccuacaa

SEQ ID NO: 34446 - RNA, 20 nt, Artificial Sequence
  CIITA targeting sequence
ggaaccccagccuacaacgc

SEQ ID NO: 34447 - RNA, 20 nt, Artificial Sequence
  CIITA targeting sequence
ugaugaacggauggauauug

SEQ ID NO: 34448 - RNA, 20 nt, Artificial Sequence
  CIITA targeting sequence
uuugcguuguaggcuggggu

SEQ ID NO: 34449 - RNA, 20 nt, Artificial Sequence
  CIITA targeting sequence
ucuuuugcguuguaggcugg

SEQ ID NO: 34450 - RNA, 20 nt, Artificial Sequence
  CIITA targeting sequence
uccuaaguagaaauaaacug

SEQ ID NO: 34451 - RNA, 20 nt, Artificial Sequence
  CIITA targeting sequence
uaaguagaaauaaacuguaa

SEQ ID NO: 34452 - RNA, 20 nt, Artificial Sequence
  CIITA targeting sequence
acuuaggaagauuuccucuu

SEQ ID NO: 34453 - RNA, 20 nt, Artificial Sequence
  CIITA targeting sequence
gcaauuuauuacaguuuauu

SEQ ID NO: 34454 - RNA, 20 nt, Artificial Sequence
  CIITA targeting sequence
cucguccugguuuucacuuc

SEQ ID NO: 34455 - RNA, 20 nt, Artificial Sequence
  CIITA targeting sequence
uccugguuuucacuucaugu

SEQ ID NO: 34456 - RNA, 20 nt, Artificial Sequence
  CIITA targeting sequence
ugguuuucacuucauguuuu

SEQ ID NO: 34457 - RNA, 20 nt, Artificial Sequence
  CIITA targeting sequence
cuucauguuuuggaugcugc

SEQ ID NO: 34458 - RNA, 20 nt, Artificial Sequence
  CIITA targeting sequence
uguuuuggaugcugcaugcu

SEQ ID NO: 34459 - RNA, 20 nt, Artificial Sequence
  CIITA targeting sequence
aaaacaugaagugaaaacca

SEQ ID NO: 34460 - RNA, 20 nt, Artificial Sequence
  CIITA targeting sequence
cccagcaugcagcauccaaa

SEQ ID NO: 34461 - RNA, 20 nt, Artificial Sequence
  CIITA targeting sequence
gcucacccagcaugcagcau

SEQ ID NO: 34462 - RNA, 20 nt, Artificial Sequence
  CIITA targeting sequence
ccgcucacccagcaugcagc

SEQ ID NO: 34463 - RNA, 20 nt, Artificial Sequence
  CIITA targeting sequence
aggcacuggccagggcagcu

SEQ ID NO: 34464 - RNA, 20 nt, Artificial Sequence
  CIITA targeting sequence
gggcagcugcccuggccagu

SEQ ID NO: 34465 - RNA, 20 nt, Artificial Sequence
  CIITA targeting sequence
aagggcugccaugaacaacu

SEQ ID NO: 34466 - RNA, 20 nt, Artificial Sequence
  CIITA targeting sequence
uggcagcccuuggagucagg

SEQ ID NO: 34467 - RNA, 20 nt, Artificial Sequence
  CIITA targeting sequence
aggccauccugacucaggug

SEQ ID NO: 34468 - RNA, 20 nt, Artificial Sequence
  CIITA targeting sequence
ugacucaggugagaaugcug

SEQ ID NO: 34469 - RNA, 20 nt, Artificial Sequence
  CIITA targeting sequence
ggauggccuggaaguuguuc

SEQ ID NO: 34470 - RNA, 20 nt, Artificial Sequence
  CIITA targeting sequence
ggugagaaugcugcucucca

SEQ ID NO: 34471 - RNA, 20 nt, Artificial Sequence
  CIITA targeting sequence
ccugagucaggauggccugg

SEQ ID NO: 34472 - RNA, 20 nt, Artificial Sequence
  CIITA targeting sequence
caccugagucaggauggccu

SEQ ID NO: 34473 - RNA, 20 nt, Artificial Sequence
  CIITA targeting sequence
ccagccaucagcccagccug

SEQ ID NO: 34474 - RNA, 20 nt, Artificial Sequence
  CIITA targeting sequence
agccaucagcccagccuggu

SEQ ID NO: 34475 - RNA, 20 nt, Artificial Sequence
  CIITA targeting sequence
gcccagccuggugcaggccc

SEQ ID NO: 34476 - RNA, 20 nt, Artificial Sequence
  CIITA targeting sequence
uggacaaccugcugaaggag

SEQ ID NO: 34477 - RNA, 20 nt, Artificial Sequence
  CIITA targeting sequence
aagagggccugcaccaggcu

SEQ ID NO: 34478 - RNA, 20 nt, Artificial Sequence
  CIITA targeting sequence
gcagguuguccaagagggcc

SEQ ID NO: 34479 - RNA, 20 nt, Artificial Sequence
  CIITA targeting sequence
uucagcagguuguccaagag

SEQ ID NO: 34480 - RNA, 20 nt, Artificial Sequence
  CIITA targeting sequence
uccuucagcagguuguccaa

SEQ ID NO: 34481 - RNA, 20 nt, Artificial Sequence
  CIITA targeting sequence
ucuccagggaauaccacugc

SEQ ID NO: 34482 - RNA, 20 nt, Artificial Sequence
  CIITA targeting sequence
ccagggaauaccacugcacu

SEQ ID NO: 34483 - RNA, 20 nt, Artificial Sequence
  CIITA targeting sequence
agggaauaccacugcacucu

SEQ ID NO: 34484 - RNA, 20 nt, Artificial Sequence
  CIITA targeting sequence
cuggagaggagguccuccuu

SEQ ID NO: 34485 - RNA, 20 nt, Artificial Sequence
  CIITA targeting sequence
gcuccaugagccugauagug

SEQ ID NO: 34486 - RNA, 20 nt, Artificial Sequence
  CIITA targeting sequence
augagccugauagugaggcu

SEQ ID NO: 34487 - RNA, 20 nt, Artificial Sequence
  CIITA targeting sequence
uggagcagagugcaguggua

SEQ ID NO: 34488 - RNA, 20 nt, Artificial Sequence
  CIITA targeting sequence
ggcucauggagcagagugca

SEQ ID NO: 34489 - RNA, 20 nt, Artificial Sequence
  CIITA targeting sequence
cuaucaggcucauggagcag

SEQ ID NO: 34490 - RNA, 20 nt, Artificial Sequence
  CIITA targeting sequence
ggccaggaagaucucuuuga

SEQ ID NO: 34491 - RNA, 20 nt, Artificial Sequence
  CIITA targeting sequence
uggccagagccucacuauca

SEQ ID NO: 34492 - RNA, 20 nt, Artificial Sequence
  CIITA targeting sequence
uccuggccagagccucacua

SEQ ID NO: 34493 - RNA, 20 nt, Artificial Sequence
  CIITA targeting sequence
cuuugacccuacuagagaaa

SEQ ID NO: 34494 - RNA, 20 nt, Artificial Sequence
  CIITA targeting sequence
uugacccuacuagagaaagg

SEQ ID NO: 34495 - RNA, 20 nt, Artificial Sequence
  CIITA targeting sequence
aagagaucuuccuggccaga

SEQ ID NO: 34496 - RNA, 20 nt, Artificial Sequence
  CIITA targeting sequence
aguagggucaaagagaucuu

SEQ ID NO: 34497 - RNA, 20 nt, Artificial Sequence
  CIITA targeting sequence
cuaguagggucaaagagauc

SEQ ID NO: 34498 - RNA, 20 nt, Artificial Sequence
  CIITA targeting sequence
uuucucuaguagggucaaag

SEQ ID NO: 34499 - RNA, 20 nt, Artificial Sequence
  CIITA targeting sequence
ccuuucucuaguagggucaa

SEQ ID NO: 34500 - RNA, 20 nt, Artificial Sequence
  CIITA targeting sequence
aggucuccuuucucuaguag

SEQ ID NO: 34501 - RNA, 20 nt, Artificial Sequence
  CIITA targeting sequence
uggggugggcccggaguggg

SEQ ID NO: 34502 - RNA, 20 nt, Artificial Sequence
  CIITA targeting sequence
gggcccaccccaggagggcc

SEQ ID NO: 34503 - RNA, 20 nt, Artificial Sequence
  CIITA targeting sequence
gcugcugggggcugcagccc

SEQ ID NO: 34504 - RNA, 20 nt, Artificial Sequence
  CIITA targeting sequence
cggcugcugggggcugcagc

SEQ ID NO: 34505 - RNA, 20 nt, Artificial Sequence
  CIITA targeting sequence
cuguggccggggccccucuc

SEQ ID NO: 34506 - RNA, 20 nt, Artificial Sequence
  CIITA targeting sequence
cuuuuaaucaaggagaaaug

SEQ ID NO: 34507 - RNA, 20 nt, Artificial Sequence
  CIITA targeting sequence
aggagaaaugacagacugua

SEQ ID NO: 34508 - RNA, 20 nt, Artificial Sequence
  CIITA targeting sequence
uugauuaaaagugaugccaa

SEQ ID NO: 34509 - RNA, 20 nt, Artificial Sequence
  CIITA targeting sequence
ccuugauuaaaagugaugcc

SEQ ID NO: 34510 - RNA, 20 nt, Artificial Sequence
  CIITA targeting sequence
uuucuccuugauuaaaagug

SEQ ID NO: 34511 - RNA, 20 nt, Artificial Sequence
  CIITA targeting sequence
gucauuucuccuugauuaaa

SEQ ID NO: 34512 - RNA, 20 nt, Artificial Sequence
  CIITA targeting sequence
acagucugucauuucuccuu

SEQ ID NO: 34513 - RNA, 20 nt, Artificial Sequence
  CIITA targeting sequence
aggauuuucccuccucucug

SEQ ID NO: 34514 - RNA, 20 nt, Artificial Sequence
  CIITA targeting sequence
uugagcugucuacagucugu

SEQ ID NO: 34515 - RNA, 20 nt, Artificial Sequence
  CIITA targeting sequence
cuccucucugaaagggaagu

SEQ ID NO: 34516 - RNA, 20 nt, Artificial Sequence
  CIITA targeting sequence
ucucugaaagggaagucaau

SEQ ID NO: 34517 - RNA, 20 nt, Artificial Sequence
  CIITA targeting sequence
cugaaagggaagucaauggg

SEQ ID NO: 34518 - RNA, 20 nt, Artificial Sequence
  CIITA targeting sequence
gaaagggaagucaaugggaa

SEQ ID NO: 34519 - RNA, 20 nt, Artificial Sequence
  CIITA targeting sequence
gagaggagggaaaauccuug

SEQ ID NO: 34520 - RNA, 20 nt, Artificial Sequence
  CIITA targeting sequence
cuuucagagaggagggaaaa

SEQ ID NO: 34521 - RNA, 20 nt, Artificial Sequence
  CIITA targeting sequence
augggaaggcagacugguga

SEQ ID NO: 34522 - RNA, 20 nt, Artificial Sequence
  CIITA targeting sequence
cauugacuucccuuucagag

SEQ ID NO: 34523 - RNA, 20 nt, Artificial Sequence
  CIITA targeting sequence
gccuucccauugacuucccu

SEQ ID NO: 34524 - RNA, 20 nt, Artificial Sequence
  CIITA targeting sequence
ccagucugccuucccauuga

SEQ ID NO: 34525 - RNA, 20 nt, Artificial Sequence
  CIITA targeting sequence
caccagucugccuucccauu

SEQ ID NO: 34526 - RNA, 20 nt, Artificial Sequence
  CIITA targeting sequence
aagugucuagugagcuggca

SEQ ID NO: 34527 - RNA, 20 nt, Artificial Sequence
  CIITA targeting sequence
agugagcuggcaggagcagu

SEQ ID NO: 34528 - RNA, 20 nt, Artificial Sequence
  CIITA targeting sequence
cuagacacuuggauuucuca

SEQ ID NO: 34529 - RNA, 20 nt, Artificial Sequence
  CIITA targeting sequence
ugccagcucacuagacacuu

SEQ ID NO: 34530 - RNA, 20 nt, Artificial Sequence
  CIITA targeting sequence
cugcuccugccagcucacua

SEQ ID NO: 34531 - RNA, 20 nt, Artificial Sequence
  CIITA targeting sequence
aaguuuucacugcuccugcc

SEQ ID NO: 34532 - RNA, 20 nt, Artificial Sequence
  CIITA targeting sequence
cuguugcugggugugcugga

SEQ ID NO: 34533 - RNA, 20 nt, Artificial Sequence
  CIITA targeting sequence
guugcugggugugcuggagc

SEQ ID NO: 34534 - RNA, 20 nt, Artificial Sequence
  CIITA targeting sequence
agcacacccagcaacagaga

SEQ ID NO: 34535 - RNA, 20 nt, Artificial Sequence
  CIITA targeting sequence
cuccagcacacccagcaaca

SEQ ID NO: 34536 - RNA, 20 nt, Artificial Sequence
  CIITA targeting sequence
cacucugcuggaaggaacca

SEQ ID NO: 34537 - RNA, 20 nt, Artificial Sequence
  CIITA targeting sequence
gcuggaaggaaccaucccag

SEQ ID NO: 34538 - RNA, 20 nt, Artificial Sequence
  CIITA targeting sequence
agcagagugggaagcacgcc

SEQ ID NO: 34539 - RNA, 20 nt, Artificial Sequence
  CIITA targeting sequence
uuccagcagagugggaagca

SEQ ID NO: 34540 - RNA, 20 nt, Artificial Sequence
  CIITA targeting sequence
caggggcacgcagccaaaug

SEQ ID NO: 34541 - RNA, 20 nt, Artificial Sequence
  CIITA targeting sequence
cucccugagcccugacgaua

SEQ ID NO: 34542 - RNA, 20 nt, Artificial Sequence
  CIITA targeting sequence
cugagcccugacgauacacc

SEQ ID NO: 34543 - RNA, 20 nt, Artificial Sequence
  CIITA targeting sequence
gggagugaacccaagcaggc

SEQ ID NO: 34544 - RNA, 20 nt, Artificial Sequence
  CIITA targeting sequence
gggcucagggagugaaccca

SEQ ID NO: 34545 - RNA, 20 nt, Artificial Sequence
  CIITA targeting sequence
ucagggcucagggagugaac

SEQ ID NO: 34546 - RNA, 20 nt, Artificial Sequence
  CIITA targeting sequence
augccccguuaauguuggug

SEQ ID NO: 34547 - RNA, 20 nt, Artificial Sequence
  CIITA targeting sequence
auccaugccccguuaauguu

SEQ ID NO: 34548 - RNA, 20 nt, Artificial Sequence
  CIITA targeting sequence
guccauccaugccccguuaa

SEQ ID NO: 34549 - RNA, 20 nt, Artificial Sequence
  CIITA targeting sequence
gcuccugccuucaaaggggu

SEQ ID NO: 34550 - RNA, 20 nt, Artificial Sequence
  CIITA targeting sequence
ugccuucaaaggggucugcu

SEQ ID NO: 34551 - RNA, 20 nt, Artificial Sequence
  CIITA targeting sequence
aaggggucugcugucuagug

SEQ ID NO: 34552 - RNA, 20 nt, Artificial Sequence
  CIITA targeting sequence
gcugucuaguggggaagaug

SEQ ID NO: 34553 - RNA, 20 nt, Artificial Sequence
  CIITA targeting sequence
aguggggaagauggaugcag

SEQ ID NO: 34554 - RNA, 20 nt, Artificial Sequence
  CIITA targeting sequence
ccacuagacagcagaccccu

SEQ ID NO: 34555 - RNA, 20 nt, Artificial Sequence
  CIITA targeting sequence
uccccacuagacagcagacc

SEQ ID NO: 34556 - RNA, 20 nt, Artificial Sequence
  CIITA targeting sequence
aucuuccccacuagacagca

SEQ ID NO: 34557 - RNA, 20 nt, Artificial Sequence
  CIITA targeting sequence
gugugagucaaaaugagaga

SEQ ID NO: 34558 - RNA, 20 nt, Artificial Sequence
  CIITA targeting sequence
cacugauugugccugcaucc

SEQ ID NO: 34559 - RNA, 20 nt, Artificial Sequence
  CIITA targeting sequence
aaaugagagaaauggggccg

SEQ ID NO: 34560 - RNA, 20 nt, Artificial Sequence
  CIITA targeting sequence
uuuugacucacacugauugu

SEQ ID NO: 34561 - RNA, 20 nt, Artificial Sequence
  CIITA targeting sequence
cauuuugacucacacugauu

SEQ ID NO: 34562 - RNA, 20 nt, Artificial Sequence
  CIITA targeting sequence
cucauuuugacucacacuga

SEQ ID NO: 34563 - RNA, 20 nt, Artificial Sequence
  CIITA targeting sequence
cgccuguaaucccagcauuu

SEQ ID NO: 34564 - RNA, 20 nt, Artificial Sequence
  CIITA targeting sequence
cagcauuuugggaggccaag

SEQ ID NO: 34565 - RNA, 20 nt, Artificial Sequence
  CIITA targeting sequence
caaaaugcugggauuacagg

SEQ ID NO: 34566 - RNA, 20 nt, Artificial Sequence
  CIITA targeting sequence
accugccuuggccucccaaa

SEQ ID NO: 34567 - RNA, 20 nt, Artificial Sequence
  CIITA targeting sequence
ccugagaucaguucgacacc

SEQ ID NO: 34568 - RNA, 20 nt, Artificial Sequence
  CIITA targeting sequence
ggugauccaccugccuuggc

SEQ ID NO: 34569 - RNA, 20 nt, Artificial Sequence
  CIITA targeting sequence
caggugauccaccugccuug

SEQ ID NO: 34570 - RNA, 20 nt, Artificial Sequence
  CIITA targeting sequence
guucgacaccagccuggcca

SEQ ID NO: 34571 - RNA, 20 nt, Artificial Sequence
  CIITA targeting sequence
acaccagccuggccaacaug

SEQ ID NO: 34572 - RNA, 20 nt, Artificial Sequence
  CIITA targeting sequence
aacugaucucaggugaucca

SEQ ID NO: 34573 - RNA, 20 nt, Artificial Sequence
  CIITA targeting sequence
cuacuaaaaaauacaaaaaa

SEQ ID NO: 34574 - RNA, 20 nt, Artificial Sequence
  CIITA targeting sequence
acuaaaaaauacaaaaaaca

SEQ ID NO: 34575 - RNA, 20 nt, Artificial Sequence
  CIITA targeting sequence
ggcuguuuuuuguauuuuuu

SEQ ID NO: 34576 - RNA, 20 nt, Artificial Sequence
  CIITA targeting sequence
uggugggugccuguaguccc

SEQ ID NO: 34577 - RNA, 20 nt, Artificial Sequence
  CIITA targeting sequence
cagcuacucaggaggcugag

SEQ ID NO: 34578 - RNA, 20 nt, Artificial Sequence
  CIITA targeting sequence
ggaggcugaggcaggagaau

SEQ ID NO: 34579 - RNA, 20 nt, Artificial Sequence
  CIITA targeting sequence
ugaguagcugggacuacagg

SEQ ID NO: 34580 - RNA, 20 nt, Artificial Sequence
  CIITA targeting sequence
gccuccugaguagcugggac

SEQ ID NO: 34581 - RNA, 20 nt, Artificial Sequence
  CIITA targeting sequence
ugccucagccuccugaguag

SEQ ID NO: 34582 - RNA, 20 nt, Artificial Sequence
  CIITA targeting sequence
ccugccucagccuccugagu

SEQ ID NO: 34583 - RNA, 20 nt, Artificial Sequence
  CIITA targeting sequence
agcaauucuccugccucagc

SEQ ID NO: 34584 - RNA, 20 nt, Artificial Sequence
  CIITA targeting sequence
caguucaagcaauucuccug

SEQ ID NO: 34585 - RNA, 20 nt, Artificial Sequence
  CIITA targeting sequence
gccuucccaguucaagcaau

SEQ ID NO: 34586 - RNA, 20 nt, Artificial Sequence
  CIITA targeting sequence
uugcaaccucugccuuccca

SEQ ID NO: 34587 - RNA, 20 nt, Artificial Sequence
  CIITA targeting sequence
gcucauugcaaccucugccu

SEQ ID NO: 34588 - RNA, 20 nt, Artificial Sequence
  CIITA targeting sequence
cggcucauugcaaccucugc

SEQ ID NO: 34589 - RNA, 20 nt, Artificial Sequence
  CIITA targeting sequence
cgcuacugcacuccagucug

SEQ ID NO: 34590 - RNA, 20 nt, Artificial Sequence
  CIITA targeting sequence
agucugggcaacagagcaag

SEQ ID NO: 34591 - RNA, 20 nt, Artificial Sequence
  CIITA targeting sequence
gggcaacagagcaagacucc

SEQ ID NO: 34592 - RNA, 20 nt, Artificial Sequence
  CIITA targeting sequence
guugcccagacuggagugca

SEQ ID NO: 34593 - RNA, 20 nt, Artificial Sequence
  CIITA targeting sequence
ugcucuguugcccagacugg

SEQ ID NO: 34594 - RNA, 20 nt, Artificial Sequence
  CIITA targeting sequence
aucucaaaaaaaaaaauaga

SEQ ID NO: 34595 - RNA, 20 nt, Artificial Sequence
  CIITA targeting sequence
caaaaaaaaaaauagagaaa

SEQ ID NO: 34596 - RNA, 20 nt, Artificial Sequence
  CIITA targeting sequence
aaaaaaaaaauagagaaaug

SEQ ID NO: 34597 - RNA, 20 nt, Artificial Sequence
  CIITA targeting sequence
auuuuuuuuuuugagaugga

SEQ ID NO: 34598 - RNA, 20 nt, Artificial Sequence
  CIITA targeting sequence
cuauuuuuuuuuuugagaug

SEQ ID NO: 34599 - RNA, 20 nt, Artificial Sequence
  CIITA targeting sequence
gcaccccauuucucuauuuu

SEQ ID NO: 34600 - RNA, 20 nt, Artificial Sequence
  CIITA targeting sequence
cugcaccccauuucucuauu

SEQ ID NO: 34601 - RNA, 20 nt, Artificial Sequence
  CIITA targeting sequence
uuucucugcaccccauuucu

SEQ ID NO: 34602 - RNA, 20 nt, Artificial Sequence
  CIITA targeting sequence
uccuuucucugcaccccauu

SEQ ID NO: 34603 - RNA, 20 nt, Artificial Sequence
  CIITA targeting sequence
ggcuccuccuuucucugcac

SEQ ID NO: 34604 - RNA, 20 nt, Artificial Sequence
  CIITA targeting sequence
cuggcuccuccuuucucugc

SEQ ID NO: 34605 - RNA, 20 nt, Artificial Sequence
  CIITA targeting sequence
gcuuuuucucuggcuccucc

SEQ ID NO: 34606 - RNA, 20 nt, Artificial Sequence
  CIITA targeting sequence
gcuuucagcuuuuucucugg

SEQ ID NO: 34607 - RNA, 20 nt, Artificial Sequence
  CIITA targeting sequence
gugugacacacagagacaga

SEQ ID NO: 34608 - RNA, 20 nt, Artificial Sequence
  CIITA targeting sequence
cacagacacacacaugcaca

SEQ ID NO: 34609 - RNA, 20 nt, Artificial Sequence
  CIITA targeting sequence
gugugucacacagacacaca

SEQ ID NO: 34610 - RNA, 20 nt, Artificial Sequence
  CIITA targeting sequence
cugugugucacacagacaca

SEQ ID NO: 34611 - RNA, 20 nt, Artificial Sequence
  CIITA targeting sequence
gucucugugugucacacaga

SEQ ID NO: 34612 - RNA, 20 nt, Artificial Sequence
  CIITA targeting sequence
guuucugucucuguguguca

SEQ ID NO: 34613 - RNA, 20 nt, Artificial Sequence
  CIITA targeting sequence
uucgguuucugucucugugu

SEQ ID NO: 34614 - RNA, 20 nt, Artificial Sequence
  CIITA targeting sequence
gucuuucgguuucugucucu

SEQ ID NO: 34615 - RNA, 20 nt, Artificial Sequence
  CIITA targeting sequence
cucugucuuucgguuucugu

SEQ ID NO: 34616 - RNA, 20 nt, Artificial Sequence
  CIITA targeting sequence
cccucugucuuucgguuucu

SEQ ID NO: 34617 - RNA, 20 nt, Artificial Sequence
  CIITA targeting sequence
cucucccucugucuuucggu

SEQ ID NO: 34618 - RNA, 20 nt, Artificial Sequence
  CIITA targeting sequence
cgcucucccucugucuuucg

SEQ ID NO: 34619 - RNA, 20 nt, Artificial Sequence
  CIITA targeting sequence
uuucucgcucucccucuguc

SEQ ID NO: 34620 - RNA, 20 nt, Artificial Sequence
  CIITA targeting sequence
cuuccuuucucgcucucccu

SEQ ID NO: 34621 - RNA, 20 nt, Artificial Sequence
  CIITA targeting sequence
cccuuccuuucucgcucucc

SEQ ID NO: 34622 - RNA, 20 nt, Artificial Sequence
  CIITA targeting sequence
cucccuuccuuucucgcucu

SEQ ID NO: 34623 - RNA, 20 nt, Artificial Sequence
  CIITA targeting sequence
uucucucccuuccuuucucg

SEQ ID NO: 34624 - RNA, 20 nt, Artificial Sequence
  CIITA targeting sequence
gucuuucucucccuuccuuu

SEQ ID NO: 34625 - RNA, 20 nt, Artificial Sequence
  CIITA targeting sequence
gugucugucuuucucucccu

SEQ ID NO: 34626 - RNA, 20 nt, Artificial Sequence
  CIITA targeting sequence
uucugugucugucuuucucu

SEQ ID NO: 34627 - RNA, 20 nt, Artificial Sequence
  CIITA targeting sequence
cuuucugugucugucuuucu

SEQ ID NO: 34628 - RNA, 20 nt, Artificial Sequence
  CIITA targeting sequence
gucucuuucugugucugucu

SEQ ID NO: 34629 - RNA, 20 nt, Artificial Sequence
  CIITA targeting sequence
cugucucuuucugugucugu

SEQ ID NO: 34630 - RNA, 20 nt, Artificial Sequence
  CIITA targeting sequence
cucugucucuuucugugucu

SEQ ID NO: 34631 - RNA, 20 nt, Artificial Sequence
  CIITA targeting sequence
gccugucucucugucucuuu

SEQ ID NO: 34632 - RNA, 20 nt, Artificial Sequence
  CIITA targeting sequence
cugccugucucucugucucu

SEQ ID NO: 34633 - RNA, 20 nt, Artificial Sequence
  CIITA targeting sequence
cugucucugccugucucucu

SEQ ID NO: 34634 - RNA, 20 nt, Artificial Sequence
  CIITA targeting sequence
cccugucucugccugucucu

SEQ ID NO: 34635 - RNA, 20 nt, Artificial Sequence
  CIITA targeting sequence
cuuuucucccugucucugcc

SEQ ID NO: 34636 - RNA, 20 nt, Artificial Sequence
  CIITA targeting sequence
cucccuuuucucccugucuc

SEQ ID NO: 34637 - RNA, 20 nt, Artificial Sequence
  CIITA targeting sequence
cccucccuuuucucccuguc

SEQ ID NO: 34638 - RNA, 20 nt, Artificial Sequence
  CIITA targeting sequence
ucucccucccuuuucucccu

SEQ ID NO: 34639 - RNA, 20 nt, Artificial Sequence
  CIITA targeting sequence
uuccucucccucccuuuucu

SEQ ID NO: 34640 - RNA, 20 nt, Artificial Sequence
  CIITA targeting sequence
accuuccuuccucucccucc

SEQ ID NO: 34641 - RNA, 20 nt, Artificial Sequence
  CIITA targeting sequence
gccuccaccuuccuuccucu

SEQ ID NO: 34642 - RNA, 20 nt, Artificial Sequence
  CIITA targeting sequence
aucagccuccaccuuccuuc

SEQ ID NO: 34643 - RNA, 20 nt, Artificial Sequence
  CIITA targeting sequence
uccaucagccuccaccuucc

SEQ ID NO: 34644 - RNA, 20 nt, Artificial Sequence
  CIITA targeting sequence
uccuccaucagccuccaccu

SEQ ID NO: 34645 - RNA, 20 nt, Artificial Sequence
  CIITA targeting sequence
cuuccuccaucagccuccac

SEQ ID NO: 34646 - RNA, 20 nt, Artificial Sequence
  CIITA targeting sequence
cuuuuucucuuccuccauca

SEQ ID NO: 34647 - RNA, 20 nt, Artificial Sequence
  CIITA targeting sequence
cccuuuuucucuuccuccau

SEQ ID NO: 34648 - RNA, 20 nt, Artificial Sequence
  CIITA targeting sequence
cccaccuucucccuuuuucu

SEQ ID NO: 34649 - RNA, 20 nt, Artificial Sequence
  CIITA targeting sequence
uucccccaccuucucccuuu

SEQ ID NO: 34650 - RNA, 20 nt, Artificial Sequence
  CIITA targeting sequence
uucuuucccccaccuucucc

SEQ ID NO: 34651 - RNA, 20 nt, Artificial Sequence
  CIITA targeting sequence
cuuucuuucccccaccuucu

SEQ ID NO: 34652 - RNA, 20 nt, Artificial Sequence
  CIITA targeting sequence
cucuuucuuucccccaccuu

SEQ ID NO: 34653 - RNA, 20 nt, Artificial Sequence
  CIITA targeting sequence
cucucuuucuuucccccacc

SEQ ID NO: 34654 - RNA, 20 nt, Artificial Sequence
  CIITA targeting sequence
uucucucucuuucuuucccc

SEQ ID NO: 34655 - RNA, 20 nt, Artificial Sequence
  CIITA targeting sequence
cuuucucucucuuucuuucc

SEQ ID NO: 34656 - RNA, 20 nt, Artificial Sequence
  CIITA targeting sequence
cucuuucucucucuuucuuu

SEQ ID NO: 34657 - RNA, 20 nt, Artificial Sequence
  CIITA targeting sequence
uauucucucuuucucucucu

SEQ ID NO: 34658 - RNA, 20 nt, Artificial Sequence
  CIITA targeting sequence
cuuacgggagagagaaugaa

SEQ ID NO: 34659 - RNA, 20 nt, Artificial Sequence
  CIITA targeting sequence
cguaagcgaguucuuauucu

SEQ ID NO: 34660 - RNA, 20 nt, Artificial Sequence
  CIITA targeting sequence
cccguaagcgaguucuuauu

SEQ ID NO: 34661 - RNA, 20 nt, Artificial Sequence
  CIITA targeting sequence
cucccguaagcgaguucuua

SEQ ID NO: 34662 - RNA, 20 nt, Artificial Sequence
  CIITA targeting sequence
cucucccguaagcgaguucu

SEQ ID NO: 34663 - RNA, 20 nt, Artificial Sequence
  CIITA targeting sequence
uucucucucccguaagcgag

SEQ ID NO: 34664 - RNA, 20 nt, Artificial Sequence
  CIITA targeting sequence
uaaaaauaaggccuucauuc

SEQ ID NO: 34665 - RNA, 20 nt, Artificial Sequence
  CIITA targeting sequence
ucucaaaccagaaagacaag

SEQ ID NO: 34666 - RNA, 20 nt, Artificial Sequence
  CIITA targeting sequence
caaaccagaaagacaagccu

SEQ ID NO: 34667 - RNA, 20 nt, Artificial Sequence
  CIITA targeting sequence
aaccagaaagacaagccugc

SEQ ID NO: 34668 - RNA, 20 nt, Artificial Sequence
  CIITA targeting sequence
gguuugagaugauugugugc

SEQ ID NO: 34669 - RNA, 20 nt, Artificial Sequence
  CIITA targeting sequence
uucugguuugagaugauugu

SEQ ID NO: 34670 - RNA, 20 nt, Artificial Sequence
  CIITA targeting sequence
ucuuuccacucacauccuug

SEQ ID NO: 34671 - RNA, 20 nt, Artificial Sequence
  CIITA targeting sequence
uuccacucacauccuuggcu

SEQ ID NO: 34672 - RNA, 20 nt, Artificial Sequence
  CIITA targeting sequence
acucacauccuuggcuccuc

SEQ ID NO: 34673 - RNA, 20 nt, Artificial Sequence
  CIITA targeting sequence
cauccuuggcuccuccaacu

SEQ ID NO: 34674 - RNA, 20 nt, Artificial Sequence
  CIITA targeting sequence
uuggcuccuccaacuuuuua

SEQ ID NO: 34675 - RNA, 20 nt, Artificial Sequence
  CIITA targeting sequence
uccaacuuuuuacgucuccu

SEQ ID NO: 34676 - RNA, 20 nt, Artificial Sequence
  CIITA targeting sequence
aacuuuuuacgucuccuacc

SEQ ID NO: 34677 - RNA, 20 nt, Artificial Sequence
  CIITA targeting sequence
ccuacccacuuacaaagaag

SEQ ID NO: 34678 - RNA, 20 nt, Artificial Sequence
  CIITA targeting sequence
uacccacuuacaaagaaguc

SEQ ID NO: 34679 - RNA, 20 nt, Artificial Sequence
  CIITA targeting sequence
uuguaaguggguaggagacg

SEQ ID NO: 34680 - RNA, 20 nt, Artificial Sequence
  CIITA targeting sequence
ucccuucauuguaaugucac

SEQ ID NO: 34681 - RNA, 20 nt, Artificial Sequence
  CIITA targeting sequence
cuucauuguaaugucacaac

SEQ ID NO: 34682 - RNA, 20 nt, Artificial Sequence
  CIITA targeting sequence
uuguaaugucacaacuuucu

SEQ ID NO: 34683 - RNA, 20 nt, Artificial Sequence
  CIITA targeting sequence
caacuuucuuucuuuuuuug

SEQ ID NO: 34684 - RNA, 20 nt, Artificial Sequence
  CIITA targeting sequence
uucuuuuuuugagacggggu

SEQ ID NO: 34685 - RNA, 20 nt, Artificial Sequence
  CIITA targeting sequence
uuuuuugagacggggucugu

SEQ ID NO: 34686 - RNA, 20 nt, Artificial Sequence
  CIITA targeting sequence
aaaaaagaaagaaaguugug

SEQ ID NO: 34687 - RNA, 20 nt, Artificial Sequence
  CIITA targeting sequence
caaaaaaagaaagaaaguug

SEQ ID NO: 34688 - RNA, 20 nt, Artificial Sequence
  CIITA targeting sequence
guucucuugcccaggcugga

SEQ ID NO: 34689 - RNA, 20 nt, Artificial Sequence
  CIITA targeting sequence
cuugcccaggcuggagugua

SEQ ID NO: 34690 - RNA, 20 nt, Artificial Sequence
  CIITA targeting sequence
ugcccaggcuggaguguagu

SEQ ID NO: 34691 - RNA, 20 nt, Artificial Sequence
  CIITA targeting sequence
agccugggcaagagaacaga

SEQ ID NO: 34692 - RNA, 20 nt, Artificial Sequence
  CIITA targeting sequence
caugaucacagcucacuaca

SEQ ID NO: 34693 - RNA, 20 nt, Artificial Sequence
  CIITA targeting sequence
ugcgacuacacuccagccug

SEQ ID NO: 34694 - RNA, 20 nt, Artificial Sequence
  CIITA targeting sequence
cagcucacuacagccuccau

SEQ ID NO: 34695 - RNA, 20 nt, Artificial Sequence
  CIITA targeting sequence
cuacagccuccauuugcggu

SEQ ID NO: 34696 - RNA, 20 nt, Artificial Sequence
  CIITA targeting sequence
auuugcggugcuuaagugau

SEQ ID NO: 34697 - RNA, 20 nt, Artificial Sequence
  CIITA targeting sequence
cuuaagcaccgcaaauggag

SEQ ID NO: 34698 - RNA, 20 nt, Artificial Sequence
  CIITA targeting sequence
ucccaccucagccucccaac

SEQ ID NO: 34699 - RNA, 20 nt, Artificial Sequence
  CIITA targeting sequence
caccucagccucccaacuag

SEQ ID NO: 34700 - RNA, 20 nt, Artificial Sequence
  CIITA targeting sequence
gccucccaacuagcugggac

SEQ ID NO: 34701 - RNA, 20 nt, Artificial Sequence
  CIITA targeting sequence
caacuagcugggacuacagg

SEQ ID NO: 34702 - RNA, 20 nt, Artificial Sequence
  CIITA targeting sequence
cagcuaguugggaggcugag

SEQ ID NO: 34703 - RNA, 20 nt, Artificial Sequence
  CIITA targeting sequence
acaaaaaauaauuaaaaaaa

SEQ ID NO: 34704 - RNA, 20 nt, Artificial Sequence
  CIITA targeting sequence
cuacaaaaaauaauuaaaaa

SEQ ID NO: 34705 - RNA, 20 nt, Artificial Sequence
  CIITA targeting sequence
ucucuacaaaaaauaauuaa

SEQ ID NO: 34706 - RNA, 20 nt, Artificial Sequence
  CIITA targeting sequence
cacuauguugaccaggcugc

SEQ ID NO: 34707 - RNA, 20 nt, Artificial Sequence
  CIITA targeting sequence
cuauguugaccaggcugcuu

SEQ ID NO: 34708 - RNA, 20 nt, Artificial Sequence
  CIITA targeting sequence
acauagugagaccucaucuc

SEQ ID NO: 34709 - RNA, 20 nt, Artificial Sequence
  CIITA targeting sequence
caagcagccuggucaacaua

SEQ ID NO: 34710 - RNA, 20 nt, Artificial Sequence
  CIITA targeting sequence
gggguucgcaagcagccugg

SEQ ID NO: 34711 - RNA, 20 nt, Artificial Sequence
  CIITA targeting sequence
agcgauccucccaccuuggc

SEQ ID NO: 34712 - RNA, 20 nt, Artificial Sequence
  CIITA targeting sequence
cuugagcucagggguucgca

SEQ ID NO: 34713 - RNA, 20 nt, Artificial Sequence
  CIITA targeting sequence
ucccaccuuggccucccaaa

SEQ ID NO: 34714 - RNA, 20 nt, Artificial Sequence
  CIITA targeting sequence
caccuuggccucccaaauug

SEQ ID NO: 34715 - RNA, 20 nt, Artificial Sequence
  CIITA targeting sequence
caaauugcugggcuuacagg

SEQ ID NO: 34716 - RNA, 20 nt, Artificial Sequence
  CIITA targeting sequence
ugccuguaagcccagcaauu

SEQ ID NO: 34717 - RNA, 20 nt, Artificial Sequence
  CIITA targeting sequence
uaacuuucuaaagacggugu

SEQ ID NO: 34718 - RNA, 20 nt, Artificial Sequence
  CIITA targeting sequence
aaagacgguguuuguuccau

SEQ ID NO: 34719 - RNA, 20 nt, Artificial Sequence
  CIITA targeting sequence
uuagaaaguuaugaccaggu

SEQ ID NO: 34720 - RNA, 20 nt, Artificial Sequence
  CIITA targeting sequence
aucuccuucugaaaugcaag

SEQ ID NO: 34721 - RNA, 20 nt, Artificial Sequence
  CIITA targeting sequence
ccuucugaaaugcaagucuu

SEQ ID NO: 34722 - RNA, 20 nt, Artificial Sequence
  CIITA targeting sequence
uucugaaaugcaagucuuga

SEQ ID NO: 34723 - RNA, 20 nt, Artificial Sequence
  CIITA targeting sequence
gaaaugcaagucuugagaga

SEQ ID NO: 34724 - RNA, 20 nt, Artificial Sequence
  CIITA targeting sequence
gaaggagauggaacaaacac

SEQ ID NO: 34725 - RNA, 20 nt, Artificial Sequence
  CIITA targeting sequence
ugagagaauaacagugauug

SEQ ID NO: 34726 - RNA, 20 nt, Artificial Sequence
  CIITA targeting sequence
agacuugcauuucagaagga

SEQ ID NO: 34727 - RNA, 20 nt, Artificial Sequence
  CIITA targeting sequence
caagacuugcauuucagaag

SEQ ID NO: 34728 - RNA, 20 nt, Artificial Sequence
  CIITA targeting sequence
cucaagacuugcauuucaga

SEQ ID NO: 34729 - RNA, 20 nt, Artificial Sequence
  CIITA targeting sequence
cuguuauucucucaagacuu

SEQ ID NO: 34730 - RNA, 20 nt, Artificial Sequence
  CIITA targeting sequence
aucacuguuauucucucaag

SEQ ID NO: 34731 - RNA, 20 nt, Artificial Sequence
  CIITA targeting sequence
augucaaucacuguuauucu

SEQ ID NO: 34732 - RNA, 20 nt, Artificial Sequence
  CIITA targeting sequence
ggcacacuaaauaaucaaug

SEQ ID NO: 34733 - RNA, 20 nt, Artificial Sequence
  CIITA targeting sequence
agaacccucuuacuucuccc

SEQ ID NO: 34734 - RNA, 20 nt, Artificial Sequence
  CIITA targeting sequence
agauugcgcuuaggcuguuu

SEQ ID NO: 34735 - RNA, 20 nt, Artificial Sequence
  CIITA targeting sequence
uacuucucccuugaccuuga

SEQ ID NO: 34736 - RNA, 20 nt, Artificial Sequence
  CIITA targeting sequence
cccuugaccuugagcccuuu

SEQ ID NO: 34737 - RNA, 20 nt, Artificial Sequence
  CIITA targeting sequence
cuugaccuugagcccuuuga

SEQ ID NO: 34738 - RNA, 20 nt, Artificial Sequence
  CIITA targeting sequence
agggagaaguaagaggguuc

SEQ ID NO: 34739 - RNA, 20 nt, Artificial Sequence
  CIITA targeting sequence
aggucaagggagaaguaaga

SEQ ID NO: 34740 - RNA, 20 nt, Artificial Sequence
  CIITA targeting sequence
aagggcucaaggucaaggga

SEQ ID NO: 34741 - RNA, 20 nt, Artificial Sequence
  CIITA targeting sequence
ccauccuuauuuaacacuua

SEQ ID NO: 34742 - RNA, 20 nt, Artificial Sequence
  CIITA targeting sequence
uuauuuaacacuuaaagaag

SEQ ID NO: 34743 - RNA, 20 nt, Artificial Sequence
  CIITA targeting sequence
uuaaguguuaaauaaggaug

SEQ ID NO: 34744 - RNA, 20 nt, Artificial Sequence
  CIITA targeting sequence
ucuuuaaguguuaaauaagg

SEQ ID NO: 34745 - RNA, 20 nt, Artificial Sequence
  CIITA targeting sequence
guuuucuucuuuaaguguua

SEQ ID NO: 34746 - RNA, 20 nt, Artificial Sequence
  CIITA targeting sequence
gcccaggggugacgcaacuu

SEQ ID NO: 34747 - RNA, 20 nt, Artificial Sequence
  CIITA targeting sequence
ccccugggcagagucuguuu

SEQ ID NO: 34748 - RNA, 20 nt, Artificial Sequence
  CIITA targeting sequence
cccaggugggaagcggugaa

SEQ ID NO: 34749 - RNA, 20 nt, Artificial Sequence
  CIITA targeting sequence
caccugggggaccugggcaa

SEQ ID NO: 34750 - RNA, 20 nt, Artificial Sequence
  CIITA targeting sequence
ccgcuucccaccugggggac

SEQ ID NO: 34751 - RNA, 20 nt, Artificial Sequence
  CIITA targeting sequence
ucaccgcuucccaccugggg

SEQ ID NO: 34752 - RNA, 20 nt, Artificial Sequence
  CIITA targeting sequence
agucuucaccgcuucccacc

SEQ ID NO: 34753 - RNA, 20 nt, Artificial Sequence
  CIITA targeting sequence
aauccagucuucaccgcuuc

SEQ ID NO: 34754 - RNA, 20 nt, Artificial Sequence
  CIITA targeting sequence
ucaaauccagucuucaccgc

SEQ ID NO: 34755 - RNA, 20 nt, Artificial Sequence
  CIITA targeting sequence
gucuucaaauccagucuuca

SEQ ID NO: 34756 - RNA, 20 nt, Artificial Sequence
  CIITA targeting sequence
aagcuugucugucuucaaau

SEQ ID NO: 34757 - RNA, 20 nt, Artificial Sequence
  CIITA targeting sequence
ucaacuuagccuucagggca

SEQ ID NO: 34758 - RNA, 20 nt, Artificial Sequence
  CIITA targeting sequence
acuuagccuucagggcauca

SEQ ID NO: 34759 - RNA, 20 nt, Artificial Sequence
  CIITA targeting sequence
gggcaucaaaugcauuuugg

SEQ ID NO: 34760 - RNA, 20 nt, Artificial Sequence
  CIITA targeting sequence
aaugcauuuuggcggccuua

SEQ ID NO: 34761 - RNA, 20 nt, Artificial Sequence
  CIITA targeting sequence
ugggcaccagggcaguguug

SEQ ID NO: 34762 - RNA, 20 nt, Artificial Sequence
  CIITA targeting sequence
ugccaagacaacauuucuac

SEQ ID NO: 34763 - RNA, 20 nt, Artificial Sequence
  CIITA targeting sequence
uggcaggaaagcugguaaac

SEQ ID NO: 34764 - RNA, 20 nt, Artificial Sequence
  CIITA targeting sequence
acagggcugguucuucuugu

SEQ ID NO: 34765 - RNA, 20 nt, Artificial Sequence
  CIITA targeting sequence
ucuuguggucaaauucucac

SEQ ID NO: 34766 - RNA, 20 nt, Artificial Sequence
  CIITA targeting sequence
uguggucaaauucucaccca

SEQ ID NO: 34767 - RNA, 20 nt, Artificial Sequence
  CIITA targeting sequence
aauucucacccaagugguuu

SEQ ID NO: 34768 - RNA, 20 nt, Artificial Sequence
  CIITA targeting sequence
cacccaagugguuuccaucg

SEQ ID NO: 34769 - RNA, 20 nt, Artificial Sequence
  CIITA targeting sequence
cccaagugguuuccaucguc

SEQ ID NO: 34770 - RNA, 20 nt, Artificial Sequence
  CIITA targeting sequence
aucgucuauuggacuccucu

SEQ ID NO: 34771 - RNA, 20 nt, Artificial Sequence
  CIITA targeting sequence
ucuauuggacuccucuuuaa

SEQ ID NO: 34772 - RNA, 20 nt, Artificial Sequence
  CIITA targeting sequence
auuggacuccucuuuaauuc

SEQ ID NO: 34773 - RNA, 20 nt, Artificial Sequence
  CIITA targeting sequence
aauagacgauggaaaccacu

SEQ ID NO: 34774 - RNA, 20 nt, Artificial Sequence
  CIITA targeting sequence
ucuuuaauucucuuccuccu

SEQ ID NO: 34775 - RNA, 20 nt, Artificial Sequence
  CIITA targeting sequence
uuaauucucuuccuccuaac

SEQ ID NO: 34776 - RNA, 20 nt, Artificial Sequence
  CIITA targeting sequence
cuuccuccuaacagucaccu

SEQ ID NO: 34777 - RNA, 20 nt, Artificial Sequence
  CIITA targeting sequence
uccuccuaacagucaccuag

SEQ ID NO: 34778 - RNA, 20 nt, Artificial Sequence
  CIITA targeting sequence
uccuaacagucaccuaggca

SEQ ID NO: 34779 - RNA, 20 nt, Artificial Sequence
  CIITA targeting sequence
uaacagucaccuaggcaaag

SEQ ID NO: 34780 - RNA, 20 nt, Artificial Sequence
  CIITA targeting sequence
ccuaggcaaaggggcaucuu

SEQ ID NO: 34781 - RNA, 20 nt, Artificial Sequence
  CIITA targeting sequence
uuaccacccaaacauucucc

SEQ ID NO: 34782 - RNA, 20 nt, Artificial Sequence
  CIITA targeting sequence
cccuuggcuucucaacaggg

SEQ ID NO: 34783 - RNA, 20 nt, Artificial Sequence
  CIITA targeting sequence
cuuggcuucucaacaggggc

SEQ ID NO: 34784 - RNA, 20 nt, Artificial Sequence
  CIITA targeting sequence
caacaggggcgcagacagcc

SEQ ID NO: 34785 - RNA, 20 nt, Artificial Sequence
  CIITA targeting sequence
acaggggcgcagacagccag

SEQ ID NO: 34786 - RNA, 20 nt, Artificial Sequence
  CIITA targeting sequence
gcgccccuguugagaagcca

SEQ ID NO: 34787 - RNA, 20 nt, Artificial Sequence
  CIITA targeting sequence
ugaugguggcacagaugcca

SEQ ID NO: 34788 - RNA, 20 nt, Artificial Sequence
  CIITA targeting sequence
agaccacacuggcugucugc

SEQ ID NO: 34789 - RNA, 20 nt, Artificial Sequence
  CIITA targeting sequence
gugccaccaucaagaccaca

SEQ ID NO: 34790 - RNA, 20 nt, Artificial Sequence
  CIITA targeting sequence
cccagguggcaucugugcca

SEQ ID NO: 34791 - RNA, 20 nt, Artificial Sequence
  CIITA targeting sequence
cccccagguggcaucugugc

SEQ ID NO: 34792 - RNA, 20 nt, Artificial Sequence
  CIITA targeting sequence
ggcuucucccccagguggca

SEQ ID NO: 34793 - RNA, 20 nt, Artificial Sequence
  CIITA targeting sequence
ucucucccuggcugcagccc

SEQ ID NO: 34794 - RNA, 20 nt, Artificial Sequence
  CIITA targeting sequence
cucccuggcugcagccccuc

SEQ ID NO: 34795 - RNA, 20 nt, Artificial Sequence
  CIITA targeting sequence
cccuggcugcagccccuccu

SEQ ID NO: 34796 - RNA, 20 nt, Artificial Sequence
  CIITA targeting sequence
cuggcugcagccccuccugc

SEQ ID NO: 34797 - RNA, 20 nt, Artificial Sequence
  CIITA targeting sequence
ugccccagccacaugugccu

SEQ ID NO: 34798 - RNA, 20 nt, Artificial Sequence
  CIITA targeting sequence
cugccggacacuucagcccc

SEQ ID NO: 34799 - RNA, 20 nt, Artificial Sequence
  CIITA targeting sequence
ggcagugaaggcacaugugg

SEQ ID NO: 34800 - RNA, 20 nt, Artificial Sequence
  CIITA targeting sequence
gccccucccacccccucuuu

SEQ ID NO: 34801 - RNA, 20 nt, Artificial Sequence
  CIITA targeting sequence
cacccccucuuuccgagagu

SEQ ID NO: 34802 - RNA, 20 nt, Artificial Sequence
  CIITA targeting sequence
uuccgagagugcugguuccu

SEQ ID NO: 34803 - RNA, 20 nt, Artificial Sequence
  CIITA targeting sequence
gagagugcugguuccuguua

SEQ ID NO: 34804 - RNA, 20 nt, Artificial Sequence
  CIITA targeting sequence
gaaagagggggugggagggg

SEQ ID NO: 34805 - RNA, 20 nt, Artificial Sequence
  CIITA targeting sequence
cggaaagagggggugggagg

SEQ ID NO: 34806 - RNA, 20 nt, Artificial Sequence
  CIITA targeting sequence
uguuauuuaacucuguuucc

SEQ ID NO: 34807 - RNA, 20 nt, Artificial Sequence
  CIITA targeting sequence
guuuccucccucgggaggua

SEQ ID NO: 34808 - RNA, 20 nt, Artificial Sequence
  CIITA targeting sequence
ucccucgggagguaauauau

SEQ ID NO: 34809 - RNA, 20 nt, Artificial Sequence
  CIITA targeting sequence
cucgggagguaauauauuua

SEQ ID NO: 34810 - RNA, 20 nt, Artificial Sequence
  CIITA targeting sequence
ggagguaauauauuuauuuc

SEQ ID NO: 34811 - RNA, 20 nt, Artificial Sequence
  CIITA targeting sequence
cgagggaggaaacagaguua

SEQ ID NO: 34812 - RNA, 20 nt, Artificial Sequence
  CIITA targeting sequence
gaucccacgugacuccagaa

SEQ ID NO: 34813 - RNA, 20 nt, Artificial Sequence
  CIITA targeting sequence
gaaauaaauauauuaccucc

SEQ ID NO: 34814 - RNA, 20 nt, Artificial Sequence
  CIITA targeting sequence
cacgugacuccagaaagugg

SEQ ID NO: 34815 - RNA, 20 nt, Artificial Sequence
  CIITA targeting sequence
cgugggaucagaaauaaaua

SEQ ID NO: 34816 - RNA, 20 nt, Artificial Sequence
  CIITA targeting sequence
agaaaguggaacugcacucg

SEQ ID NO: 34817 - RNA, 20 nt, Artificial Sequence
  CIITA targeting sequence
ggagucacgugggaucagaa

SEQ ID NO: 34818 - RNA, 20 nt, Artificial Sequence
  CIITA targeting sequence
acuuucuggagucacguggg

SEQ ID NO: 34819 - RNA, 20 nt, Artificial Sequence
  CIITA targeting sequence
gggcccaguguggucuucgg

SEQ ID NO: 34820 - RNA, 20 nt, Artificial Sequence
  CIITA targeting sequence
ucggggagcugggaggggug

SEQ ID NO: 34821 - RNA, 20 nt, Artificial Sequence
  CIITA targeting sequence
gggagcugggaggggugcag

SEQ ID NO: 34822 - RNA, 20 nt, Artificial Sequence
  CIITA targeting sequence
ccgaagaccacacugggccc

SEQ ID NO: 34823 - RNA, 20 nt, Artificial Sequence
  CIITA targeting sequence
cagcuccccgaagaccacac

SEQ ID NO: 34824 - RNA, 20 nt, Artificial Sequence
  CIITA targeting sequence
uuuccugcuuucucuuucug

SEQ ID NO: 34825 - RNA, 20 nt, Artificial Sequence
  CIITA targeting sequence
ugcuuucucuuucugcccuc

SEQ ID NO: 34826 - RNA, 20 nt, Artificial Sequence
  CIITA targeting sequence
cuuucugcccuccagccagc

SEQ ID NO: 34827 - RNA, 20 nt, Artificial Sequence
  CIITA targeting sequence
uucugcccuccagccagcuu

SEQ ID NO: 34828 - RNA, 20 nt, Artificial Sequence
  CIITA targeting sequence
gcccuccagccagcuucccu

SEQ ID NO: 34829 - RNA, 20 nt, Artificial Sequence
  CIITA targeting sequence
agccagcuucccuccagggc

SEQ ID NO: 34830 - RNA, 20 nt, Artificial Sequence
  CIITA targeting sequence
cuccagggcugccaggcuug

SEQ ID NO: 34831 - RNA, 20 nt, Artificial Sequence
  CIITA targeting sequence
agggcugccaggcuugaccu

SEQ ID NO: 34832 - RNA, 20 nt, Artificial Sequence
  CIITA targeting sequence
agccuggcagcccuggaggg

SEQ ID NO: 34833 - RNA, 20 nt, Artificial Sequence
  CIITA targeting sequence
caggucaagccuggcagccc

SEQ ID NO: 34834 - RNA, 20 nt, Artificial Sequence
  CIITA targeting sequence
cagaggggaagaaagaggac

SEQ ID NO: 34835 - RNA, 20 nt, Artificial Sequence
  CIITA targeting sequence
gaggggaagaaagaggacag

SEQ ID NO: 34836 - RNA, 20 nt, Artificial Sequence
  CIITA targeting sequence
gagagcugcccagcagcagc

SEQ ID NO: 34837 - RNA, 20 nt, Artificial Sequence
  CIITA targeting sequence
ccucugagagcugcccagca

SEQ ID NO: 34838 - RNA, 20 nt, Artificial Sequence
  CIITA targeting sequence
uccccucugagagcugccca

SEQ ID NO: 34839 - RNA, 20 nt, Artificial Sequence
  CIITA targeting sequence
uucuuccccucugagagcug

SEQ ID NO: 34840 - RNA, 20 nt, Artificial Sequence
  CIITA targeting sequence
ucuuucuuccccucugagag

SEQ ID NO: 34841 - RNA, 20 nt, Artificial Sequence
  CIITA targeting sequence
ugcccuguccucuuucuucc

SEQ ID NO: 34842 - RNA, 20 nt, Artificial Sequence
  CIITA targeting sequence
cuugcccuguccucuuucuu

SEQ ID NO: 34843 - RNA, 20 nt, Artificial Sequence
  CIITA targeting sequence
gugcccuuuguuuacaaacc

SEQ ID NO: 34844 - RNA, 20 nt, Artificial Sequence
  CIITA targeting sequence
uuuugauggggguucggaaa

SEQ ID NO: 34845 - RNA, 20 nt, Artificial Sequence
  CIITA targeting sequence
aaaugaaagucagugcccuu

SEQ ID NO: 34846 - RNA, 20 nt, Artificial Sequence
  CIITA targeting sequence
gaaaaggaaaucauccaugu

SEQ ID NO: 34847 - RNA, 20 nt, Artificial Sequence
  CIITA targeting sequence
gaacccccaucaaaaugaaa

SEQ ID NO: 34848 - RNA, 20 nt, Artificial Sequence
  CIITA targeting sequence
uuuuccgaacccccaucaaa

SEQ ID NO: 34849 - RNA, 20 nt, Artificial Sequence
  CIITA targeting sequence
uccaugugggguuuuuguga

SEQ ID NO: 34850 - RNA, 20 nt, Artificial Sequence
  CIITA targeting sequence
augugggguuuuugugaccc

SEQ ID NO: 34851 - RNA, 20 nt, Artificial Sequence
  CIITA targeting sequence
caaaaaccccacauggauga

SEQ ID NO: 34852 - RNA, 20 nt, Artificial Sequence
  CIITA targeting sequence
cucucaaccacucuauaaug

SEQ ID NO: 34853 - RNA, 20 nt, Artificial Sequence
  CIITA targeting sequence
caaccacucuauaaugaccu

SEQ ID NO: 34854 - RNA, 20 nt, Artificial Sequence
  CIITA targeting sequence
accacucuauaaugaccuug

SEQ ID NO: 34855 - RNA, 20 nt, Artificial Sequence
  CIITA targeting sequence
auaaugaccuuggcccucug

SEQ ID NO: 34856 - RNA, 20 nt, Artificial Sequence
  CIITA targeting sequence
uuauagagugguugagaggg

SEQ ID NO: 34857 - RNA, 20 nt, Artificial Sequence
  CIITA targeting sequence
gcugugcuaaacgcugcacu

SEQ ID NO: 34858 - RNA, 20 nt, Artificial Sequence
  CIITA targeting sequence
cacguuacucagagaaaaag

SEQ ID NO: 34859 - RNA, 20 nt, Artificial Sequence
  CIITA targeting sequence
gagaaaaagcuaaaucugga

SEQ ID NO: 34860 - RNA, 20 nt, Artificial Sequence
  CIITA targeting sequence
gaguaacgugggagccagug

SEQ ID NO: 34861 - RNA, 20 nt, Artificial Sequence
  CIITA targeting sequence
cugaguaacgugggagccag

SEQ ID NO: 34862 - RNA, 20 nt, Artificial Sequence
  CIITA targeting sequence
ggacaauggcccacaaggcc

SEQ ID NO: 34863 - RNA, 20 nt, Artificial Sequence
  CIITA targeting sequence
agauuuagcuuuuucucuga

SEQ ID NO: 34864 - RNA, 20 nt, Artificial Sequence
  CIITA targeting sequence
uaccucaucagcucccugcu

SEQ ID NO: 34865 - RNA, 20 nt, Artificial Sequence
  CIITA targeting sequence
ucagcucccugcucucaucc

SEQ ID NO: 34866 - RNA, 20 nt, Artificial Sequence
  CIITA targeting sequence
gcucccugcucucauccccu

SEQ ID NO: 34867 - RNA, 20 nt, Artificial Sequence
  CIITA targeting sequence
cugcucucauccccuacucc

SEQ ID NO: 34868 - RNA, 20 nt, Artificial Sequence
  CIITA targeting sequence
cauccccuacuccugucugc

SEQ ID NO: 34869 - RNA, 20 nt, Artificial Sequence
  CIITA targeting sequence
uccccuacuccugucugccu

SEQ ID NO: 34870 - RNA, 20 nt, Artificial Sequence
  CIITA targeting sequence
ccuacuccugucugccuugu

SEQ ID NO: 34871 - RNA, 20 nt, Artificial Sequence
  CIITA targeting sequence
ugucugccuuguucaucuac

SEQ ID NO: 34872 - RNA, 20 nt, Artificial Sequence
  CIITA targeting sequence
gccuuguucaucuacuccag

SEQ ID NO: 34873 - RNA, 20 nt, Artificial Sequence
  CIITA targeting sequence
ucuacuccagccauguuggc

SEQ ID NO: 34874 - RNA, 20 nt, Artificial Sequence
  CIITA targeting sequence
acuccagccauguuggcacc

SEQ ID NO: 34875 - RNA, 20 nt, Artificial Sequence
  CIITA targeting sequence
agccauguuggcacccucgc

SEQ ID NO: 34876 - RNA, 20 nt, Artificial Sequence
  CIITA targeting sequence
cuguuccuuagacacgcuca

SEQ ID NO: 34877 - RNA, 20 nt, Artificial Sequence
  CIITA targeting sequence
uuagacacgcucagcacacu

SEQ ID NO: 34878 - RNA, 20 nt, Artificial Sequence
  CIITA targeting sequence
aaggaacagcgagggugcca

SEQ ID NO: 34879 - RNA, 20 nt, Artificial Sequence
  CIITA targeting sequence
gcacacugucugccucagaa

SEQ ID NO: 34880 - RNA, 20 nt, Artificial Sequence
  CIITA targeting sequence
gccucagaaccuuugcacau

SEQ ID NO: 34881 - RNA, 20 nt, Artificial Sequence
  CIITA targeting sequence
gaaccuuugcacaugccguu

SEQ ID NO: 34882 - RNA, 20 nt, Artificial Sequence
  CIITA targeting sequence
gaggcagacagugugcugag

SEQ ID NO: 34883 - RNA, 20 nt, Artificial Sequence
  CIITA targeting sequence
cucugccuggagcacuguuc

SEQ ID NO: 34884 - RNA, 20 nt, Artificial Sequence
  CIITA targeting sequence
gccuggagcacuguucucua

SEQ ID NO: 34885 - RNA, 20 nt, Artificial Sequence
  CIITA targeting sequence
aggcagagggaacggcaugu

SEQ ID NO: 34886 - RNA, 20 nt, Artificial Sequence
  CIITA targeting sequence
cuaagcauuuucuuggucaa

SEQ ID NO: 34887 - RNA, 20 nt, Artificial Sequence
  CIITA targeting sequence
aagcauuuucuuggucaacc

SEQ ID NO: 34888 - RNA, 20 nt, Artificial Sequence
  CIITA targeting sequence
uggucaaccuccuaaauucc

SEQ ID NO: 34889 - RNA, 20 nt, Artificial Sequence
  CIITA targeting sequence
accuccuaaauuccuucuau

SEQ ID NO: 34890 - RNA, 20 nt, Artificial Sequence
  CIITA targeting sequence
uaaauuccuucuauucuuug

SEQ ID NO: 34891 - RNA, 20 nt, Artificial Sequence
  CIITA targeting sequence
uucuauucuuugcaccuuau

SEQ ID NO: 34892 - RNA, 20 nt, Artificial Sequence
  CIITA targeting sequence
auucuuugcaccuuaucaau

SEQ ID NO: 34893 - RNA, 20 nt, Artificial Sequence
  CIITA targeting sequence
uugcaccuuaucaaugaagc

SEQ ID NO: 34894 - RNA, 20 nt, Artificial Sequence
  CIITA targeting sequence
augaagccugcccugaccaa

SEQ ID NO: 34895 - RNA, 20 nt, Artificial Sequence
  CIITA targeting sequence
uugauaaggugcaaagaaua

SEQ ID NO: 34896 - RNA, 20 nt, Artificial Sequence
  CIITA targeting sequence
gggcaggcuucauugauaag

SEQ ID NO: 34897 - RNA, 20 nt, Artificial Sequence
  CIITA targeting sequence
aaauggcuuggucagggcag

SEQ ID NO: 34898 - RNA, 20 nt, Artificial Sequence
  CIITA targeting sequence
ucccuccacacucugagccc

SEQ ID NO: 34899 - RNA, 20 nt, Artificial Sequence
  CIITA targeting sequence
cuccacacucugagcccccu

SEQ ID NO: 34900 - RNA, 20 nt, Artificial Sequence
  CIITA targeting sequence
acacucugagcccccucccc

SEQ ID NO: 34901 - RNA, 20 nt, Artificial Sequence
  CIITA targeting sequence
gagcccccuccccagauuga

SEQ ID NO: 34902 - RNA, 20 nt, Artificial Sequence
  CIITA targeting sequence
gaguguggagggaggaguug

SEQ ID NO: 34903 - RNA, 20 nt, Artificial Sequence
  CIITA targeting sequence
ccagauugauuuuuucccca

SEQ ID NO: 34904 - RNA, 20 nt, Artificial Sequence
  CIITA targeting sequence
ggggagggggcucagagugu

SEQ ID NO: 34905 - RNA, 20 nt, Artificial Sequence
  CIITA targeting sequence
aucuggggagggggcucaga

SEQ ID NO: 34906 - RNA, 20 nt, Artificial Sequence
  CIITA targeting sequence
ccacuuuuuuuuuuuuugau

SEQ ID NO: 34907 - RNA, 20 nt, Artificial Sequence
  CIITA targeting sequence
aaaaaaaaaaaaguggggaa

SEQ ID NO: 34908 - RNA, 20 nt, Artificial Sequence
  CIITA targeting sequence
guaucaaaaaaaaaaaaagu

SEQ ID NO: 34909 - RNA, 20 nt, Artificial Sequence
  CIITA targeting sequence
ugcucuaucgcccagccugg

SEQ ID NO: 34910 - RNA, 20 nt, Artificial Sequence
  CIITA targeting sequence
aucgcccagccuggagugca

SEQ ID NO: 34911 - RNA, 20 nt, Artificial Sequence
  CIITA targeting sequence
cccagccuggagugcagugg

SEQ ID NO: 34912 - RNA, 20 nt, Artificial Sequence
  CIITA targeting sequence
aggcugggcgauagagcaag

SEQ ID NO: 34913 - RNA, 20 nt, Artificial Sequence
  CIITA targeting sequence
ccacugcacuccaggcuggg

SEQ ID NO: 34914 - RNA, 20 nt, Artificial Sequence
  CIITA targeting sequence
caccacugcacuccaggcug

SEQ ID NO: 34915 - RNA, 20 nt, Artificial Sequence
  CIITA targeting sequence
cagcucacugcaacuuccau

SEQ ID NO: 34916 - RNA, 20 nt, Artificial Sequence
  CIITA targeting sequence
gcucacugcaacuuccaucu

SEQ ID NO: 34917 - RNA, 20 nt, Artificial Sequence
  CIITA targeting sequence
cugcaacuuccaucucccag

SEQ ID NO: 34918 - RNA, 20 nt, Artificial Sequence
  CIITA targeting sequence
aucucccagguucaugcagu

SEQ ID NO: 34919 - RNA, 20 nt, Artificial Sequence
  CIITA targeting sequence
cccagguucaugcaguucuc

SEQ ID NO: 34920 - RNA, 20 nt, Artificial Sequence
  CIITA targeting sequence
cagguucaugcaguucucau

SEQ ID NO: 34921 - RNA, 20 nt, Artificial Sequence
  CIITA targeting sequence
ugcaguucucaugccucagc

SEQ ID NO: 34922 - RNA, 20 nt, Artificial Sequence
  CIITA targeting sequence
caugccucagccucccaaau

SEQ ID NO: 34923 - RNA, 20 nt, Artificial Sequence
  CIITA targeting sequence
ugccucagccucccaaauag

SEQ ID NO: 34924 - RNA, 20 nt, Artificial Sequence
  CIITA targeting sequence
gccucccaaauagcugggau

SEQ ID NO: 34925 - RNA, 20 nt, Artificial Sequence
  CIITA targeting sequence
caaauagcugggauuacagg

SEQ ID NO: 34926 - RNA, 20 nt, Artificial Sequence
  CIITA targeting sequence
cagcuauuugggaggcugag

SEQ ID NO: 34927 - RNA, 20 nt, Artificial Sequence
  CIITA targeting sequence
aaaaauacaaaaauuagcca

SEQ ID NO: 34928 - RNA, 20 nt, Artificial Sequence
  CIITA targeting sequence
cuaaaaauacaaaaauuagc

SEQ ID NO: 34929 - RNA, 20 nt, Artificial Sequence
  CIITA targeting sequence
ccaaguuggccaggcugguc

SEQ ID NO: 34930 - RNA, 20 nt, Artificial Sequence
  CIITA targeting sequence
aaguuggccaggcuggucuu

SEQ ID NO: 34931 - RNA, 20 nt, Artificial Sequence
  CIITA targeting sequence
ugaacuccugacaucaagug

SEQ ID NO: 34932 - RNA, 20 nt, Artificial Sequence
  CIITA targeting sequence
agaccagccuggccaacuug

SEQ ID NO: 34933 - RNA, 20 nt, Artificial Sequence
  CIITA targeting sequence
ugacaucaagugauccgccc

SEQ ID NO: 34934 - RNA, 20 nt, Artificial Sequence
  CIITA targeting sequence
ggaguucaagaccagccugg

SEQ ID NO: 34935 - RNA, 20 nt, Artificial Sequence
  CIITA targeting sequence
agugauccgcccaccccaca

SEQ ID NO: 34936 - RNA, 20 nt, Artificial Sequence
  CIITA targeting sequence
cuugaugucaggaguucaag

SEQ ID NO: 34937 - RNA, 20 nt, Artificial Sequence
  CIITA targeting sequence
gcccaccccacaaaguacug

SEQ ID NO: 34938 - RNA, 20 nt, Artificial Sequence
  CIITA targeting sequence
caguacuuuguggggugggc

SEQ ID NO: 34939 - RNA, 20 nt, Artificial Sequence
  CIITA targeting sequence
ugccuguuaucccaguacuu

SEQ ID NO: 34940 - RNA, 20 nt, Artificial Sequence
  CIITA targeting sequence
ccaccuucuguauaucuuac

SEQ ID NO: 34941 - RNA, 20 nt, Artificial Sequence
  CIITA targeting sequence
guauaucuuacuuuuguauu

SEQ ID NO: 34942 - RNA, 20 nt, Artificial Sequence
  CIITA targeting sequence
uacuuuuguauuacgugugu

SEQ ID NO: 34943 - RNA, 20 nt, Artificial Sequence
  CIITA targeting sequence
aacaauaaacaacacacacg

SEQ ID NO: 34944 - RNA, 20 nt, Artificial Sequence
  CIITA targeting sequence
cacuggaaaauaaacuccac

SEQ ID NO: 34945 - RNA, 20 nt, Artificial Sequence
  CIITA targeting sequence
agugggagggucaaacaaua

SEQ ID NO: 34946 - RNA, 20 nt, Artificial Sequence
  CIITA targeting sequence
acauggacauggaucuaugu

SEQ ID NO: 34947 - RNA, 20 nt, Artificial Sequence
  CIITA targeting sequence
auguggaguuuauuuuccag

SEQ ID NO: 34948 - RNA, 20 nt, Artificial Sequence
  CIITA targeting sequence
auguccauguggaguuuauu

SEQ ID NO: 34949 - RNA, 20 nt, Artificial Sequence
  CIITA targeting sequence
auguuuugaucacaauaugu

SEQ ID NO: 34950 - RNA, 20 nt, Artificial Sequence
  CIITA targeting sequence
aaacauagauccauguccau

SEQ ID NO: 34951 - RNA, 20 nt, Artificial Sequence
  CIITA targeting sequence
caauaugucccaaauaccua

SEQ ID NO: 34952 - RNA, 20 nt, Artificial Sequence
  CIITA targeting sequence
caaauaccuagcacagggcc

SEQ ID NO: 34953 - RNA, 20 nt, Artificial Sequence
  CIITA targeting sequence
ggcccugugcuagguauuug

SEQ ID NO: 34954 - RNA, 20 nt, Artificial Sequence
  CIITA targeting sequence
acaaauauauauugcauacc

SEQ ID NO: 34955 - RNA, 20 nt, Artificial Sequence
  CIITA targeting sequence
guggauggaugcguugauga

SEQ ID NO: 34956 - RNA, 20 nt, Artificial Sequence
  CIITA targeting sequence
acugaacauucaacaaauau

SEQ ID NO: 34957 - RNA, 20 nt, Artificial Sequence
  CIITA targeting sequence
auccacugaacauucaacaa

SEQ ID NO: 34958 - RNA, 20 nt, Artificial Sequence
  CIITA targeting sequence
acgcauccauccacugaaca

SEQ ID NO: 34959 - RNA, 20 nt, Artificial Sequence
  CIITA targeting sequence
ucaacgcauccauccacuga

SEQ ID NO: 34960 - RNA, 20 nt, Artificial Sequence
  CIITA targeting sequence
acccacucaucaacgcaucc

SEQ ID NO: 34961 - RNA, 20 nt, Artificial Sequence
  CIITA targeting sequence
aucuacccacucaucaacgc

SEQ ID NO: 34962 - RNA, 20 nt, Artificial Sequence
  CIITA targeting sequence
uccaucuacccacucaucaa

SEQ ID NO: 34963 - RNA, 20 nt, Artificial Sequence
  CIITA targeting sequence
auucauccaucuacccacuc

SEQ ID NO: 34964 - RNA, 20 nt, Artificial Sequence
  CIITA targeting sequence
uguaaugccauuauuccuac

SEQ ID NO: 34965 - RNA, 20 nt, Artificial Sequence
  CIITA targeting sequence
uacuuuaccaaugaguaaac

SEQ ID NO: 34966 - RNA, 20 nt, Artificial Sequence
  CIITA targeting sequence
uugguaaaguaggaauaaug

SEQ ID NO: 34967 - RNA, 20 nt, Artificial Sequence
  CIITA targeting sequence
guuuacucauugguaaagua

SEQ ID NO: 34968 - RNA, 20 nt, Artificial Sequence
  CIITA targeting sequence
gugccucaguuuacucauug

SEQ ID NO: 34969 - RNA, 20 nt, Artificial Sequence
  CIITA targeting sequence
cugugccucaguuuacucau

SEQ ID NO: 34970 - RNA, 20 nt, Artificial Sequence
  CIITA targeting sequence
uuaacuucucugugccucag

SEQ ID NO: 34971 - RNA, 20 nt, Artificial Sequence
  CIITA targeting sequence
ggucaugaccugaggaggga

SEQ ID NO: 34972 - RNA, 20 nt, Artificial Sequence
  CIITA targeting sequence
ugaccugaggagggagacua

SEQ ID NO: 34973 - RNA, 20 nt, Artificial Sequence
  CIITA targeting sequence
ugaccagaggcaaaucauua

SEQ ID NO: 34974 - RNA, 20 nt, Artificial Sequence
  CIITA targeting sequence
ggucaugaccagaggcaaau

SEQ ID NO: 34975 - RNA, 20 nt, Artificial Sequence
  CIITA targeting sequence
ucaggucaugaccagaggca

SEQ ID NO: 34976 - RNA, 20 nt, Artificial Sequence
  CIITA targeting sequence
cuccucaggucaugaccaga

SEQ ID NO: 34977 - RNA, 20 nt, Artificial Sequence
  CIITA targeting sequence
cccuccucaggucaugacca

SEQ ID NO: 34978 - RNA, 20 nt, Artificial Sequence
  CIITA targeting sequence
caugaguccuggccaauugc

SEQ ID NO: 34979 - RNA, 20 nt, Artificial Sequence
  CIITA targeting sequence
ugaguccuggccaauugcag

SEQ ID NO: 34980 - RNA, 20 nt, Artificial Sequence
  CIITA targeting sequence
ugagaccccauagucucccu

SEQ ID NO: 34981 - RNA, 20 nt, Artificial Sequence
  CIITA targeting sequence
uggccaauugcaguacuucc

SEQ ID NO: 34982 - RNA, 20 nt, Artificial Sequence
  CIITA targeting sequence
ugcaaaaaaaaaaaaaaaaa

SEQ ID NO: 34983 - RNA, 20 nt, Artificial Sequence
  CIITA targeting sequence
ucuucuaaacaacccaaggg

SEQ ID NO: 34984 - RNA, 20 nt, Artificial Sequence
  CIITA targeting sequence
ucuaaacaacccaaggggcu

SEQ ID NO: 34985 - RNA, 20 nt, Artificial Sequence
  CIITA targeting sequence
aaacaacccaaggggcuacc

SEQ ID NO: 34986 - RNA, 20 nt, Artificial Sequence
  CIITA targeting sequence
accccaaauaggguggcagu

SEQ ID NO: 34987 - RNA, 20 nt, Artificial Sequence
  CIITA targeting sequence
ucaaacugaaaccagccuga

SEQ ID NO: 34988 - RNA, 20 nt, Artificial Sequence
  CIITA targeting sequence
aacugaaaccagccugauga

SEQ ID NO: 34989 - RNA, 20 nt, Artificial Sequence
  CIITA targeting sequence
guuugaagacugccacccua

SEQ ID NO: 34990 - RNA, 20 nt, Artificial Sequence
  CIITA targeting sequence
ggcugguuucaguuugaaga

SEQ ID NO: 34991 - RNA, 20 nt, Artificial Sequence
  CIITA targeting sequence
ucaggcugguuucaguuuga

SEQ ID NO: 34992 - RNA, 20 nt, Artificial Sequence
  CIITA targeting sequence
gaaguccccuucagauauug

SEQ ID NO: 34993 - RNA, 20 nt, Artificial Sequence
  CIITA targeting sequence
gaaucaucaggcugguuuca

SEQ ID NO: 34994 - RNA, 20 nt, Artificial Sequence
  CIITA targeting sequence
ccuucagauauugcagugcc

SEQ ID NO: 34995 - RNA, 20 nt, Artificial Sequence
  CIITA targeting sequence
gauauugcagugccuuaggu

SEQ ID NO: 34996 - RNA, 20 nt, Artificial Sequence
  CIITA targeting sequence
gaaggggacuucugaaucau

SEQ ID NO: 34997 - RNA, 20 nt, Artificial Sequence
  CIITA targeting sequence
gcacaauugcaccuaaggca

SEQ ID NO: 34998 - RNA, 20 nt, Artificial Sequence
  CIITA targeting sequence
ggagaugggagcuuaggggu

SEQ ID NO: 34999 - RNA, 20 nt, Artificial Sequence
  CIITA targeting sequence
agaacugggcuuucugcaca

SEQ ID NO: 35000 - RNA, 20 nt, Artificial Sequence
  CIITA targeting sequence
ccagaacugggcuuucugca

SEQ ID NO: 35001 - RNA, 20 nt, Artificial Sequence
  CIITA targeting sequence
caucuccagaacugggcuuu

SEQ ID NO: 35002 - RNA, 20 nt, Artificial Sequence
  CIITA targeting sequence
cucugugcuacacugagcaa

SEQ ID NO: 35003 - RNA, 20 nt, Artificial Sequence
  CIITA targeting sequence
gugcuacacugagcaaccug

SEQ ID NO: 35004 - RNA, 20 nt, Artificial Sequence
  CIITA targeting sequence
guguagcacagagcgaaacc

SEQ ID NO: 35005 - RNA, 20 nt, Artificial Sequence
  CIITA targeting sequence
agccccaggaaaguuccagu

SEQ ID NO: 35006 - RNA, 20 nt, Artificial Sequence
  CIITA targeting sequence
uggggcuggaugcacacagg

SEQ ID NO: 35007 - RNA, 20 nt, Artificial Sequence
  CIITA targeting sequence
agugagucccaagagucaaa

SEQ ID NO: 35008 - RNA, 20 nt, Artificial Sequence
  CIITA targeting sequence
cuggaacuuuccuggggcug

SEQ ID NO: 35009 - RNA, 20 nt, Artificial Sequence
  CIITA targeting sequence
caagagucaaaguccuugcc

SEQ ID NO: 35010 - RNA, 20 nt, Artificial Sequence
  CIITA targeting sequence
ugggacucacuggaacuuuc

SEQ ID NO: 35011 - RNA, 20 nt, Artificial Sequence
  CIITA targeting sequence
aaguccuugcccuggaggaa

SEQ ID NO: 35012 - RNA, 20 nt, Artificial Sequence
  CIITA targeting sequence
uugcccuggaggaacucagg

SEQ ID NO: 35013 - RNA, 20 nt, Artificial Sequence
  CIITA targeting sequence
agggcaaggacuuugacucu

SEQ ID NO: 35014 - RNA, 20 nt, Artificial Sequence
  CIITA targeting sequence
uccagggcaaggacuuugac

SEQ ID NO: 35015 - RNA, 20 nt, Artificial Sequence
  CIITA targeting sequence
ggugccucagugggaaguua

SEQ ID NO: 35016 - RNA, 20 nt, Artificial Sequence
  CIITA targeting sequence
gugggaaguuaaagcaaaca

SEQ ID NO: 35017 - RNA, 20 nt, Artificial Sequence
  CIITA targeting sequence
cacugaggcaccugaguucc

SEQ ID NO: 35018 - RNA, 20 nt, Artificial Sequence
  CIITA targeting sequence
cuggucaacagugggucaca

SEQ ID NO: 35019 - RNA, 20 nt, Artificial Sequence
  CIITA targeting sequence
acagugggucacaacaucug

SEQ ID NO: 35020 - RNA, 20 nt, Artificial Sequence
  CIITA targeting sequence
caacaucugaacaacaucua

SEQ ID NO: 35021 - RNA, 20 nt, Artificial Sequence
  CIITA targeting sequence
gaacaacaucuaucagaggc

SEQ ID NO: 35022 - RNA, 20 nt, Artificial Sequence
  CIITA targeting sequence
gauguugugacccacuguug

SEQ ID NO: 35023 - RNA, 20 nt, Artificial Sequence
  CIITA targeting sequence
aucagaggccaaagaagggg

SEQ ID NO: 35024 - RNA, 20 nt, Artificial Sequence
  CIITA targeting sequence
gaggccaaagaagggggagc

SEQ ID NO: 35025 - RNA, 20 nt, Artificial Sequence
  CIITA targeting sequence
gauagauguuguucagaugu

SEQ ID NO: 35026 - RNA, 20 nt, Artificial Sequence
  CIITA targeting sequence
uuggccucugauagauguug

SEQ ID NO: 35027 - RNA, 20 nt, Artificial Sequence
  CIITA targeting sequence
cccuucuuuggccucugaua

SEQ ID NO: 35028 - RNA, 20 nt, Artificial Sequence
  CIITA targeting sequence
uagcucccccuucuuuggcc

SEQ ID NO: 35029 - RNA, 20 nt, Artificial Sequence
  CIITA targeting sequence
cccauccuagcucccccuuc

SEQ ID NO: 35030 - RNA, 20 nt, Artificial Sequence
  CIITA targeting sequence
ucacccauccuagcuccccc

SEQ ID NO: 35031 - RNA, 20 nt, Artificial Sequence
  CIITA targeting sequence
aucaucacccauccuagcuc

SEQ ID NO: 35032 - RNA, 20 nt, Artificial Sequence
  CIITA targeting sequence
uuuuccaucaucacccaucc

SEQ ID NO: 35033 - RNA, 20 nt, Artificial Sequence
  CIITA targeting sequence
agccugguucuuuuuccauc

SEQ ID NO: 35034 - RNA, 20 nt, Artificial Sequence
  CIITA targeting sequence
agccuccagccugguucuuu

SEQ ID NO: 35035 - RNA, 20 nt, Artificial Sequence
  CIITA targeting sequence
agcuguccagccuccagccu

SEQ ID NO: 35036 - RNA, 20 nt, Artificial Sequence
  CIITA targeting sequence
ggaucugaagccauguucug

SEQ ID NO: 35037 - RNA, 20 nt, Artificial Sequence
  CIITA targeting sequence
agagcuguccagcuguccag

SEQ ID NO: 35038 - RNA, 20 nt, Artificial Sequence
  CIITA targeting sequence
gaagccauguucugcuccuu

SEQ ID NO: 35039 - RNA, 20 nt, Artificial Sequence
  CIITA targeting sequence
gauccagagcuguccagcug

SEQ ID NO: 35040 - RNA, 20 nt, Artificial Sequence
  CIITA targeting sequence
gcuccuuacguaccauguga

SEQ ID NO: 35041 - RNA, 20 nt, Artificial Sequence
  CIITA targeting sequence
uuacguaccaugugaccuug

SEQ ID NO: 35042 - RNA, 20 nt, Artificial Sequence
  CIITA targeting sequence
caugguacguaaggagcaga

SEQ ID NO: 35043 - RNA, 20 nt, Artificial Sequence
  CIITA targeting sequence
uguggccaaggucacauggu

SEQ ID NO: 35044 - RNA, 20 nt, Artificial Sequence
  CIITA targeting sequence
agucauguggccaaggucac

SEQ ID NO: 35045 - RNA, 20 nt, Artificial Sequence
  CIITA targeting sequence
gaaucucaguuucuucaucu

SEQ ID NO: 35046 - RNA, 20 nt, Artificial Sequence
  CIITA targeting sequence
gaguggucuagucauguggc

SEQ ID NO: 35047 - RNA, 20 nt, Artificial Sequence
  CIITA targeting sequence
caguuucuucaucucugaaa

SEQ ID NO: 35048 - RNA, 20 nt, Artificial Sequence
  CIITA targeting sequence
guuucuucaucucugaaaug

SEQ ID NO: 35049 - RNA, 20 nt, Artificial Sequence
  CIITA targeting sequence
ucaucucugaaaugggagca

SEQ ID NO: 35050 - RNA, 20 nt, Artificial Sequence
  CIITA targeting sequence
ucucugaaaugggagcaaug

SEQ ID NO: 35051 - RNA, 20 nt, Artificial Sequence
  CIITA targeting sequence
cugaaaugggagcaaugaua

SEQ ID NO: 35052 - RNA, 20 nt, Artificial Sequence
  CIITA targeting sequence
gaaaugggagcaaugauacg

SEQ ID NO: 35053 - RNA, 20 nt, Artificial Sequence
  CIITA targeting sequence
gagaugaagaaacugagauu

SEQ ID NO: 35054 - RNA, 20 nt, Artificial Sequence
  CIITA targeting sequence
cauuucagagaugaagaaac

SEQ ID NO: 35055 - RNA, 20 nt, Artificial Sequence
  CIITA targeting sequence
uugcucccauuucagagaug

SEQ ID NO: 35056 - RNA, 20 nt, Artificial Sequence
  CIITA targeting sequence
uaucauugcucccauuucag

SEQ ID NO: 35057 - RNA, 20 nt, Artificial Sequence
  CIITA targeting sequence
cccagggcucuagugagggu

SEQ ID NO: 35058 - RNA, 20 nt, Artificial Sequence
  CIITA targeting sequence
cagggcucuagugaggguua

SEQ ID NO: 35059 - RNA, 20 nt, Artificial Sequence
  CIITA targeting sequence
agugaggguuaaaugagaug

SEQ ID NO: 35060 - RNA, 20 nt, Artificial Sequence
  CIITA targeting sequence
cuagagcccugggagauucg

SEQ ID NO: 35061 - RNA, 20 nt, Artificial Sequence
  CIITA targeting sequence
uuuaacccucacuagagccc

SEQ ID NO: 35062 - RNA, 20 nt, Artificial Sequence
  CIITA targeting sequence
cauuuaacccucacuagagc

SEQ ID NO: 35063 - RNA, 20 nt, Artificial Sequence
  CIITA targeting sequence
accuaccaucucauuuaacc

SEQ ID NO: 35064 - RNA, 20 nt, Artificial Sequence
  CIITA targeting sequence
aaggcagugcuuggcauuag

SEQ ID NO: 35065 - RNA, 20 nt, Artificial Sequence
  CIITA targeting sequence
cacuguauaaauaucagacc

SEQ ID NO: 35066 - RNA, 20 nt, Artificial Sequence
  CIITA targeting sequence
gaccacucugagucuaacag

SEQ ID NO: 35067 - RNA, 20 nt, Artificial Sequence
  CIITA targeting sequence
gauauuuauacagugcgacc

SEQ ID NO: 35068 - RNA, 20 nt, Artificial Sequence
  CIITA targeting sequence
gagucuaacagcaaggagaa

SEQ ID NO: 35069 - RNA, 20 nt, Artificial Sequence
  CIITA targeting sequence
gaguggucugauauuuauac

SEQ ID NO: 35070 - RNA, 20 nt, Artificial Sequence
  CIITA targeting sequence
aacagcaaggagaauggaac

SEQ ID NO: 35071 - RNA, 20 nt, Artificial Sequence
  CIITA targeting sequence
uugcuguuagacucagagug

SEQ ID NO: 35072 - RNA, 20 nt, Artificial Sequence
  CIITA targeting sequence
ccuugcuguuagacucagag

SEQ ID NO: 35073 - RNA, 20 nt, Artificial Sequence
  CIITA targeting sequence
auucuccuugcuguuagacu

SEQ ID NO: 35074 - RNA, 20 nt, Artificial Sequence
  CIITA targeting sequence
uguuccauucuccuugcugu

SEQ ID NO: 35075 - RNA, 20 nt, Artificial Sequence
  CIITA targeting sequence
uccuguuccauucuccuugc

SEQ ID NO: 35076 - RNA, 20 nt, Artificial Sequence
  CIITA targeting sequence
ucuuccuguuccauucuccu

SEQ ID NO: 35077 - RNA, 20 nt, Artificial Sequence
  CIITA targeting sequence
aaccccugguuuaucuucuu

SEQ ID NO: 35078 - RNA, 20 nt, Artificial Sequence
  CIITA targeting sequence
uggugccucaaaccccuggu

SEQ ID NO: 35079 - RNA, 20 nt, Artificial Sequence
  CIITA targeting sequence
gggggccccagacaauaucu

SEQ ID NO: 35080 - RNA, 20 nt, Artificial Sequence
  CIITA targeting sequence
ggggcccccagacugcagua

SEQ ID NO: 35081 - RNA, 20 nt, Artificial Sequence
  CIITA targeting sequence
agacaccuaccccaugcaaa

SEQ ID NO: 35082 - RNA, 20 nt, Artificial Sequence
  CIITA targeting sequence
agauauugucuggggccccc

SEQ ID NO: 35083 - RNA, 20 nt, Artificial Sequence
  CIITA targeting sequence
gcacugcauuuugcaugggg

SEQ ID NO: 35084 - RNA, 20 nt, Artificial Sequence
  CIITA targeting sequence
aauaugcacaguacccaagc

SEQ ID NO: 35085 - RNA, 20 nt, Artificial Sequence
  CIITA targeting sequence
caaauaugcacaguacccaa

SEQ ID NO: 35086 - RNA, 20 nt, Artificial Sequence
  CIITA targeting sequence
auguggccccugcccucgag

SEQ ID NO: 35087 - RNA, 20 nt, Artificial Sequence
  CIITA targeting sequence
aguugaacuggcacaugggc

SEQ ID NO: 35088 - RNA, 20 nt, Artificial Sequence
  CIITA targeting sequence
agggcaggggccacauugau

SEQ ID NO: 35089 - RNA, 20 nt, Artificial Sequence
  CIITA targeting sequence
acucgagggcaggggccaca

SEQ ID NO: 35090 - RNA, 20 nt, Artificial Sequence
  CIITA targeting sequence
ucagacagccugagugccug

SEQ ID NO: 35091 - RNA, 20 nt, Artificial Sequence
  CIITA targeting sequence
gacagccugagugccugucc

SEQ ID NO: 35092 - RNA, 20 nt, Artificial Sequence
  CIITA targeting sequence
gaggacauggcccaugugcc

SEQ ID NO: 35093 - RNA, 20 nt, Artificial Sequence
  CIITA targeting sequence
ggcugucugaggacauggcc

SEQ ID NO: 35094 - RNA, 20 nt, Artificial Sequence
  CIITA targeting sequence
ugccuucccaauuccaagag

SEQ ID NO: 35095 - RNA, 20 nt, Artificial Sequence
  CIITA targeting sequence
caauuccaagagguaugacu

SEQ ID NO: 35096 - RNA, 20 nt, Artificial Sequence
  CIITA targeting sequence
aagagguaugacuuugagca

SEQ ID NO: 35097 - RNA, 20 nt, Artificial Sequence
  CIITA targeting sequence
uggaauugggaaggcaggac

SEQ ID NO: 35098 - RNA, 20 nt, Artificial Sequence
  CIITA targeting sequence
uaccucuuggaauugggaag

SEQ ID NO: 35099 - RNA, 20 nt, Artificial Sequence
  CIITA targeting sequence
aagucauaccucuuggaauu

SEQ ID NO: 35100 - RNA, 20 nt, Artificial Sequence
  CIITA targeting sequence
cgggcgccccgccucaguuu

SEQ ID NO: 35101 - RNA, 20 nt, Artificial Sequence
  CIITA targeting sequence
guuuccccaucuauaaagug

SEQ ID NO: 35102 - RNA, 20 nt, Artificial Sequence
  CIITA targeting sequence
ccaucuauaaaguggagaug

SEQ ID NO: 35103 - RNA, 20 nt, Artificial Sequence
  CIITA targeting sequence
auaaaguggagaugauaaua

SEQ ID NO: 35104 - RNA, 20 nt, Artificial Sequence
  CIITA targeting sequence
acuuuauagauggggaaacu

SEQ ID NO: 35105 - RNA, 20 nt, Artificial Sequence
  CIITA targeting sequence
ccacuuuauagauggggaaa

SEQ ID NO: 35106 - RNA, 20 nt, Artificial Sequence
  CIITA targeting sequence
ucuccacuuuauagaugggg

SEQ ID NO: 35107 - RNA, 20 nt, Artificial Sequence
  CIITA targeting sequence
gagucacugaucuaagggcu

SEQ ID NO: 35108 - RNA, 20 nt, Artificial Sequence
  CIITA targeting sequence
gaaugcuauuaucaucucca

SEQ ID NO: 35109 - RNA, 20 nt, Artificial Sequence
  CIITA targeting sequence
cugaucuaagggcucaggga

SEQ ID NO: 35110 - RNA, 20 nt, Artificial Sequence
  CIITA targeting sequence
gugacucugaaugcuauuau

SEQ ID NO: 35111 - RNA, 20 nt, Artificial Sequence
  CIITA targeting sequence
aagggcucagggacaccauu

SEQ ID NO: 35112 - RNA, 20 nt, Artificial Sequence
  CIITA targeting sequence
gggacaccauucaguguaag

SEQ ID NO: 35113 - RNA, 20 nt, Artificial Sequence
  CIITA targeting sequence
cugagcccuuagaucaguga

SEQ ID NO: 35114 - RNA, 20 nt, Artificial Sequence
  CIITA targeting sequence
guguaagccccauacacucc

SEQ ID NO: 35115 - RNA, 20 nt, Artificial Sequence
  CIITA targeting sequence
cugcaagaggaagcugguuc

SEQ ID NO: 35116 - RNA, 20 nt, Artificial Sequence
  CIITA targeting sequence
ugcagggaguguauggggcu

SEQ ID NO: 35117 - RNA, 20 nt, Artificial Sequence
  CIITA targeting sequence
ucuugcagggaguguauggg

SEQ ID NO: 35118 - RNA, 20 nt, Artificial Sequence
  CIITA targeting sequence
gacucagccuugaggcuggc

SEQ ID NO: 35119 - RNA, 20 nt, Artificial Sequence
  CIITA targeting sequence
gaaccagcuuccucuugcag

SEQ ID NO: 35120 - RNA, 20 nt, Artificial Sequence
  CIITA targeting sequence
gccuugaggcuggcgucuga

SEQ ID NO: 35121 - RNA, 20 nt, Artificial Sequence
  CIITA targeting sequence
aggcugagucagaaccagcu

SEQ ID NO: 35122 - RNA, 20 nt, Artificial Sequence
  CIITA targeting sequence
gaggcaaccacaagcccaac

SEQ ID NO: 35123 - RNA, 20 nt, Artificial Sequence
  CIITA targeting sequence
gacgccagccucaaggcuga

SEQ ID NO: 35124 - RNA, 20 nt, Artificial Sequence
  CIITA targeting sequence
accaugcacguugggcuugu

SEQ ID NO: 35125 - RNA, 20 nt, Artificial Sequence
  CIITA targeting sequence
uuccaccaugcacguugggc

SEQ ID NO: 35126 - RNA, 20 nt, Artificial Sequence
  CIITA targeting sequence
ucuuuccaccaugcacguug

SEQ ID NO: 35127 - RNA, 20 nt, Artificial Sequence
  CIITA targeting sequence
gcuggccuuggguuugacca

SEQ ID NO: 35128 - RNA, 20 nt, Artificial Sequence
  CIITA targeting sequence
aacccaaggccagcugaggu

SEQ ID NO: 35129 - RNA, 20 nt, Artificial Sequence
  CIITA targeting sequence
auggucaaacccaaggccag

SEQ ID NO: 35130 - RNA, 20 nt, Artificial Sequence
  CIITA targeting sequence
cauuccauggucaaacccaa

SEQ ID NO: 35131 - RNA, 20 nt, Artificial Sequence
  CIITA targeting sequence
cagaggcuguagggcacccc

SEQ ID NO: 35132 - RNA, 20 nt, Artificial Sequence
  CIITA targeting sequence
gaggcuguagggcaccccug

SEQ ID NO: 35133 - RNA, 20 nt, Artificial Sequence
  CIITA targeting sequence
gagaaaguaugcaaaauggg

SEQ ID NO: 35134 - RNA, 20 nt, Artificial Sequence
  CIITA targeting sequence
uacauuuuauugauuccucu

SEQ ID NO: 35135 - RNA, 20 nt, Artificial Sequence
  CIITA targeting sequence
auaaaauguaagacccuggc

SEQ ID NO: 35136 - RNA, 20 nt, Artificial Sequence
  CIITA targeting sequence
ucugacucuacuuuguuggu

SEQ ID NO: 35137 - RNA, 20 nt, Artificial Sequence
  CIITA targeting sequence
gacucuacuuuguugguugu

SEQ ID NO: 35138 - RNA, 20 nt, Artificial Sequence
  CIITA targeting sequence
gaggaaucaauaaaauguaa

SEQ ID NO: 35139 - RNA, 20 nt, Artificial Sequence
  CIITA targeting sequence
acuuuguugguuguuuuugu

SEQ ID NO: 35140 - RNA, 20 nt, Artificial Sequence
  CIITA targeting sequence
gauuucauugcgugacauuu

SEQ ID NO: 35141 - RNA, 20 nt, Artificial Sequence
  CIITA targeting sequence
gaacaacaaaaacaaccaac

SEQ ID NO: 35142 - RNA, 20 nt, Artificial Sequence
  CIITA targeting sequence
uugcgugacauuuuugccca

SEQ ID NO: 35143 - RNA, 20 nt, Artificial Sequence
  CIITA targeting sequence
cgcaaugaaaucagaacaac

SEQ ID NO: 35144 - RNA, 20 nt, Artificial Sequence
  CIITA targeting sequence
ugggcaaaaaugucacgcaa

SEQ ID NO: 35145 - RNA, 20 nt, Artificial Sequence
  CIITA targeting sequence
caguucuaggaaugacagaa

SEQ ID NO: 35146 - RNA, 20 nt, Artificial Sequence
  CIITA targeting sequence
guucuaggaaugacagaaca

SEQ ID NO: 35147 - RNA, 20 nt, Artificial Sequence
  CIITA targeting sequence
aggaaugacagaacaaaggc

SEQ ID NO: 35148 - RNA, 20 nt, Artificial Sequence
  CIITA targeting sequence
uagaacugagaccucauggg

SEQ ID NO: 35149 - RNA, 20 nt, Artificial Sequence
  CIITA targeting sequence
uuccuagaacugagaccuca

SEQ ID NO: 35150 - RNA, 20 nt, Artificial Sequence
  CIITA targeting sequence
gucauuccuagaacugagac

SEQ ID NO: 35151 - RNA, 20 nt, Artificial Sequence
  CIITA targeting sequence
cucugggaagucgccugauu

SEQ ID NO: 35152 - RNA, 20 nt, Artificial Sequence
  CIITA targeting sequence
gggaagucgccugauuuauu

SEQ ID NO: 35153 - RNA, 20 nt, Artificial Sequence
  CIITA targeting sequence
cagagggagccuuuguucug

SEQ ID NO: 35154 - RNA, 20 nt, Artificial Sequence
  CIITA targeting sequence
ccugauuuauuggaaaggga

SEQ ID NO: 35155 - RNA, 20 nt, Artificial Sequence
  CIITA targeting sequence
ggcgacuucccagagggagc

SEQ ID NO: 35156 - RNA, 20 nt, Artificial Sequence
  CIITA targeting sequence
aauaaaucaggcgacuuccc

SEQ ID NO: 35157 - RNA, 20 nt, Artificial Sequence
  CIITA targeting sequence
cuuuccaauaaaucaggcga

SEQ ID NO: 35158 - RNA, 20 nt, Artificial Sequence
  CIITA targeting sequence
ucccuuuccaauaaaucagg

SEQ ID NO: 35159 - RNA, 20 nt, Artificial Sequence
  CIITA targeting sequence
cuaagggugggguguuccuc

SEQ ID NO: 35160 - RNA, 20 nt, Artificial Sequence
  CIITA targeting sequence
cuaagcucccuuccuccagc

SEQ ID NO: 35161 - RNA, 20 nt, Artificial Sequence
  CIITA targeting sequence
cuuccuccagcuuccuuccc

SEQ ID NO: 35162 - RNA, 20 nt, Artificial Sequence
  CIITA targeting sequence
uccagcuuccuuccccaucu

SEQ ID NO: 35163 - RNA, 20 nt, Artificial Sequence
  CIITA targeting sequence
agcuuccuuccccaucuggc

SEQ ID NO: 35164 - RNA, 20 nt, Artificial Sequence
  CIITA targeting sequence
uuccccaucuggcccuuagg

SEQ ID NO: 35165 - RNA, 20 nt, Artificial Sequence
  CIITA targeting sequence
ccaucuggcccuuaggaugu

SEQ ID NO: 35166 - RNA, 20 nt, Artificial Sequence
  CIITA targeting sequence
ggcccuuaggaugugagaaa

SEQ ID NO: 35167 - RNA, 20 nt, Artificial Sequence
  CIITA targeting sequence
uaagggccagauggggaagg

SEQ ID NO: 35168 - RNA, 20 nt, Artificial Sequence
  CIITA targeting sequence
cauccuaagggccagauggg

SEQ ID NO: 35169 - RNA, 20 nt, Artificial Sequence
  CIITA targeting sequence
cacauccuaagggccagaug

SEQ ID NO: 35170 - RNA, 20 nt, Artificial Sequence
  CIITA targeting sequence
gguuucucacauccuaaggg

SEQ ID NO: 35171 - RNA, 20 nt, Artificial Sequence
  CIITA targeting sequence
cagcucugguuucucacauc

SEQ ID NO: 35172 - RNA, 20 nt, Artificial Sequence
  CIITA targeting sequence
ggugugucacagcucugguu

SEQ ID NO: 35173 - RNA, 20 nt, Artificial Sequence
  CIITA targeting sequence
cuggugugucacagcucugg

SEQ ID NO: 35174 - RNA, 20 nt, Artificial Sequence
  CIITA targeting sequence
ucucuggugugucacagcuc

SEQ ID NO: 35175 - RNA, 20 nt, Artificial Sequence
  CIITA targeting sequence
ccucucuggugugucacagc

SEQ ID NO: 35176 - RNA, 20 nt, Artificial Sequence
  CIITA targeting sequence
cuccucucuggugugucaca

SEQ ID NO: 35177 - RNA, 20 nt, Artificial Sequence
  CIITA targeting sequence
caccuucugggcuuccuuuc

SEQ ID NO: 35178 - RNA, 20 nt, Artificial Sequence
  CIITA targeting sequence
ccuucugggcuuccuuuccu

SEQ ID NO: 35179 - RNA, 20 nt, Artificial Sequence
  CIITA targeting sequence
gggcuuccuuuccugagaac

SEQ ID NO: 35180 - RNA, 20 nt, Artificial Sequence
  CIITA targeting sequence
uuuccugagaaccagccccu

SEQ ID NO: 35181 - RNA, 20 nt, Artificial Sequence
  CIITA targeting sequence
ugagaaccagccccuguucu

SEQ ID NO: 35182 - RNA, 20 nt, Artificial Sequence
  CIITA targeting sequence
ggaaaggaagcccagaaggu

SEQ ID NO: 35183 - RNA, 20 nt, Artificial Sequence
  CIITA targeting sequence
caggaaaggaagcccagaag

SEQ ID NO: 35184 - RNA, 20 nt, Artificial Sequence
  CIITA targeting sequence
gauuuugggagucuccuuug

SEQ ID NO: 35185 - RNA, 20 nt, Artificial Sequence
  CIITA targeting sequence
gaacaggggcugguucucag

SEQ ID NO: 35186 - RNA, 20 nt, Artificial Sequence
  CIITA targeting sequence
caaaaucagaacaggggcug

SEQ ID NO: 35187 - RNA, 20 nt, Artificial Sequence
  CIITA targeting sequence
ccuuugccucagggaggggg

SEQ ID NO: 35188 - RNA, 20 nt, Artificial Sequence
  CIITA targeting sequence
uuugccucagggagggggau

SEQ ID NO: 35189 - RNA, 20 nt, Artificial Sequence
  CIITA targeting sequence
gggagggggauguguuggcg

SEQ ID NO: 35190 - RNA, 20 nt, Artificial Sequence
  CIITA targeting sequence
cugaggcaaaggagacuccc

SEQ ID NO: 35191 - RNA, 20 nt, Artificial Sequence
  CIITA targeting sequence
cccucccugaggcaaaggag

SEQ ID NO: 35192 - RNA, 20 nt, Artificial Sequence
  CIITA targeting sequence
ccaacacaucccccucccug

SEQ ID NO: 35193 - RNA, 20 nt, Artificial Sequence
  CIITA targeting sequence
ucgccaacacaucccccucc

SEQ ID NO: 35194 - RNA, 20 nt, Artificial Sequence
  CIITA targeting sequence
uccucgccaacacauccccc

SEQ ID NO: 35195 - RNA, 20 nt, Artificial Sequence
  CIITA targeting sequence
ugccuuucaucuuggacugc

SEQ ID NO: 35196 - RNA, 20 nt, Artificial Sequence
  CIITA targeting sequence
ucuuggacugcuucucuggc

SEQ ID NO: 35197 - RNA, 20 nt, Artificial Sequence
  CIITA targeting sequence
uggacugcuucucuggcccu

SEQ ID NO: 35198 - RNA, 20 nt, Artificial Sequence
  CIITA targeting sequence
aagaugaaaggcacgagucu

SEQ ID NO: 35199 - RNA, 20 nt, Artificial Sequence
  CIITA targeting sequence
cuggcccucuaccccaggaa

SEQ ID NO: 35200 - RNA, 20 nt, Artificial Sequence
  CIITA targeting sequence
ggcccucuaccccaggaacc

SEQ ID NO: 35201 - RNA, 20 nt, Artificial Sequence
  CIITA targeting sequence
accccaggaaccacagaagg

SEQ ID NO: 35202 - RNA, 20 nt, Artificial Sequence
  CIITA targeting sequence
ugggguagagggccagagaa

SEQ ID NO: 35203 - RNA, 20 nt, Artificial Sequence
  CIITA targeting sequence
gugguuccugggguagaggg

SEQ ID NO: 35204 - RNA, 20 nt, Artificial Sequence
  CIITA targeting sequence
uucugugguuccugggguag

SEQ ID NO: 35205 - RNA, 20 nt, Artificial Sequence
  CIITA targeting sequence
ccuucugugguuccuggggu

SEQ ID NO: 35206 - RNA, 20 nt, Artificial Sequence
  CIITA targeting sequence
ggguacaggugugucuccuu

SEQ ID NO: 35207 - RNA, 20 nt, Artificial Sequence
  CIITA targeting sequence
ccauggguuuucccaggcca

SEQ ID NO: 35208 - RNA, 20 nt, Artificial Sequence
  CIITA targeting sequence
caggccagccuguuccaaac

SEQ ID NO: 35209 - RNA, 20 nt, Artificial Sequence
  CIITA targeting sequence
aaacacagcuugcccccaag

SEQ ID NO: 35210 - RNA, 20 nt, Artificial Sequence
  CIITA targeting sequence
ccaaccagucacgguuucug

SEQ ID NO: 35211 - RNA, 20 nt, Artificial Sequence
  CIITA targeting sequence
aaccagucacgguuucuguu

SEQ ID NO: 35212 - RNA, 20 nt, Artificial Sequence
  CIITA targeting sequence
cgguuucuguucucuguugc

SEQ ID NO: 35213 - RNA, 20 nt, Artificial Sequence
  CIITA targeting sequence
guucucuguugcuaugaccu

SEQ ID NO: 35214 - RNA, 20 nt, Artificial Sequence
  CIITA targeting sequence
cuguugcuaugaccuugagc

SEQ ID NO: 35215 - RNA, 20 nt, Artificial Sequence
  CIITA targeting sequence
guugcuaugaccuugagcag

SEQ ID NO: 35216 - RNA, 20 nt, Artificial Sequence
  CIITA targeting sequence
uagcaacagagaacagaaac

SEQ ID NO: 35217 - RNA, 20 nt, Artificial Sequence
  CIITA targeting sequence
aggucauagcaacagagaac

SEQ ID NO: 35218 - RNA, 20 nt, Artificial Sequence
  CIITA targeting sequence
ccugcguuccuuacugucua

SEQ ID NO: 35219 - RNA, 20 nt, Artificial Sequence
  CIITA targeting sequence
uuacugucuacuuucccauc

SEQ ID NO: 35220 - RNA, 20 nt, Artificial Sequence
  CIITA targeting sequence
acuuucccauccaccuaccu

SEQ ID NO: 35221 - RNA, 20 nt, Artificial Sequence
  CIITA targeting sequence
cauccaccuaccugccugcc

SEQ ID NO: 35222 - RNA, 20 nt, Artificial Sequence
  CIITA targeting sequence
accuaccugccugcccucca

SEQ ID NO: 35223 - RNA, 20 nt, Artificial Sequence
  CIITA targeting sequence
aacuuuccugaucuguguac

SEQ ID NO: 35224 - RNA, 20 nt, Artificial Sequence
  CIITA targeting sequence
ugaucuguguaccuaccuuc

SEQ ID NO: 35225 - RNA, 20 nt, Artificial Sequence
  CIITA targeting sequence
ggaaaguuggagggcaggca

SEQ ID NO: 35226 - RNA, 20 nt, Artificial Sequence
  CIITA targeting sequence
guguaccuaccuuccuauau

SEQ ID NO: 35227 - RNA, 20 nt, Artificial Sequence
  CIITA targeting sequence
uauaucuacuucuuuuuauu

SEQ ID NO: 35228 - RNA, 20 nt, Artificial Sequence
  CIITA targeting sequence
acuucuuuuuauuauuauua

SEQ ID NO: 35229 - RNA, 20 nt, Artificial Sequence
  CIITA targeting sequence
uuuuauuauuauuaucauua

SEQ ID NO: 35230 - RNA, 20 nt, Artificial Sequence
  CIITA targeting sequence
uuauucucacccugucuuuu

SEQ ID NO: 35231 - RNA, 20 nt, Artificial Sequence
  CIITA targeting sequence
cacccugucuuuuuuuuaau

SEQ ID NO: 35232 - RNA, 20 nt, Artificial Sequence
  CIITA targeting sequence
cccugucuuuuuuuuaauuu

SEQ ID NO: 35233 - RNA, 20 nt, Artificial Sequence
  CIITA targeting sequence
uuuuuuuaauuuuuuuuggg

SEQ ID NO: 35234 - RNA, 20 nt, Artificial Sequence
  CIITA targeting sequence
cccccacccaaaaaaaauua

SEQ ID NO: 35235 - RNA, 20 nt, Artificial Sequence
  CIITA targeting sequence
ugcuuuguagcccaggcugg

SEQ ID NO: 35236 - RNA, 20 nt, Artificial Sequence
  CIITA targeting sequence
agccugggcuacaaagcaag

SEQ ID NO: 35237 - RNA, 20 nt, Artificial Sequence
  CIITA targeting sequence
cgccacugcauuccagccug

SEQ ID NO: 35238 - RNA, 20 nt, Artificial Sequence
  CIITA targeting sequence
cagcucauuauaaccucugc

SEQ ID NO: 35239 - RNA, 20 nt, Artificial Sequence
  CIITA targeting sequence
gcucauuauaaccucugccu

SEQ ID NO: 35240 - RNA, 20 nt, Artificial Sequence
  CIITA targeting sequence
uuauaaccucugccucccag

SEQ ID NO: 35241 - RNA, 20 nt, Artificial Sequence
  CIITA targeting sequence
gccucccagauucaagcaau

SEQ ID NO: 35242 - RNA, 20 nt, Artificial Sequence
  CIITA targeting sequence
cagauucaagcaauucuccu

SEQ ID NO: 35243 - RNA, 20 nt, Artificial Sequence
  CIITA targeting sequence
gggaggcagagguuauaaug

SEQ ID NO: 35244 - RNA, 20 nt, Artificial Sequence
  CIITA targeting sequence
agcaauucuccugccucagc

SEQ ID NO: 35245 - RNA, 20 nt, Artificial Sequence
  CIITA targeting sequence
ccugccucagccucccgagu

SEQ ID NO: 35246 - RNA, 20 nt, Artificial Sequence
  CIITA targeting sequence
ugccucagccucccgaguag

SEQ ID NO: 35247 - RNA, 20 nt, Artificial Sequence
  CIITA targeting sequence
gccucccgaguagcuaggau

SEQ ID NO: 35248 - RNA, 20 nt, Artificial Sequence
  CIITA targeting sequence
cgaguagcuaggauuacagg

SEQ ID NO: 35249 - RNA, 20 nt, Artificial Sequence
  CIITA targeting sequence
ggaggcugaggcaggagaau

SEQ ID NO: 35250 - RNA, 20 nt, Artificial Sequence
  CIITA targeting sequence
uagcuacucgggaggcugag

SEQ ID NO: 35251 - RNA, 20 nt, Artificial Sequence
  CIITA targeting sequence
gcaugguggcaggcgccugu

SEQ ID NO: 35252 - RNA, 20 nt, Artificial Sequence
  CIITA targeting sequence
acuaaaaauauaaaaauuag

SEQ ID NO: 35253 - RNA, 20 nt, Artificial Sequence
  CIITA targeting sequence
cuacuaaaaauauaaaaauu

SEQ ID NO: 35254 - RNA, 20 nt, Artificial Sequence
  CIITA targeting sequence
ucauguuggccaggcugguc

SEQ ID NO: 35255 - RNA, 20 nt, Artificial Sequence
  CIITA targeting sequence
uguuggccaggcuggucuca

SEQ ID NO: 35256 - RNA, 20 nt, Artificial Sequence
  CIITA targeting sequence
caaacuccugaccucaagca

SEQ ID NO: 35257 - RNA, 20 nt, Artificial Sequence
  CIITA targeting sequence
aacuccugaccucaagcaau

SEQ ID NO: 35258 - RNA, 20 nt, Artificial Sequence
  CIITA targeting sequence
ugaccucaagcaauccaccc

SEQ ID NO: 35259 - RNA, 20 nt, Artificial Sequence
  CIITA targeting sequence
ggaguuugagaccagccugg

SEQ ID NO: 35260 - RNA, 20 nt, Artificial Sequence
  CIITA targeting sequence
agcaauccacccaucucagc

SEQ ID NO: 35261 - RNA, 20 nt, Artificial Sequence
  CIITA targeting sequence
acccaucucagcuucccaaa

SEQ ID NO: 35262 - RNA, 20 nt, Artificial Sequence
  CIITA targeting sequence
cagcuucccaaaaugcuggg

SEQ ID NO: 35263 - RNA, 20 nt, Artificial Sequence
  CIITA targeting sequence
gcuucccaaaaugcugggau

SEQ ID NO: 35264 - RNA, 20 nt, Artificial Sequence
  CIITA targeting sequence
caaaaugcugggauuauagg

SEQ ID NO: 35265 - RNA, 20 nt, Artificial Sequence
  CIITA targeting sequence
cagcauuuugggaagcugag

SEQ ID NO: 35266 - RNA, 20 nt, Artificial Sequence
  CIITA targeting sequence
cgccuauaaucccagcauuu

SEQ ID NO: 35267 - RNA, 20 nt, Artificial Sequence
  CIITA targeting sequence
cgcccugucuuaugguggua

SEQ ID NO: 35268 - RNA, 20 nt, Artificial Sequence
  CIITA targeting sequence
cccugucuuauggugguaau

SEQ ID NO: 35269 - RNA, 20 nt, Artificial Sequence
  CIITA targeting sequence
uauggugguaaucuacuucu

SEQ ID NO: 35270 - RNA, 20 nt, Artificial Sequence
  CIITA targeting sequence
acuucucaauuuaucuauuu

SEQ ID NO: 35271 - RNA, 20 nt, Artificial Sequence
  CIITA targeting sequence
caauuuaucuauuuauaucu

SEQ ID NO: 35272 - RNA, 20 nt, Artificial Sequence
  CIITA targeting sequence
auuuaucuauuuauaucuac

SEQ ID NO: 35273 - RNA, 20 nt, Artificial Sequence
  CIITA targeting sequence
auuuauaucuacugucuaca

SEQ ID NO: 35274 - RNA, 20 nt, Artificial Sequence
  CIITA targeting sequence
acugucuacauacuuauaca

SEQ ID NO: 35275 - RNA, 20 nt, Artificial Sequence
  CIITA targeting sequence
acauacuuauacacuuauuu

SEQ ID NO: 35276 - RNA, 20 nt, Artificial Sequence
  CIITA targeting sequence
ugucuacuuaucaguuaauc

SEQ ID NO: 35277 - RNA, 20 nt, Artificial Sequence
  CIITA targeting sequence
acuuaucaguuaauccauuu

SEQ ID NO: 35278 - RNA, 20 nt, Artificial Sequence
  CIITA targeting sequence
guuaauccauuucucuaccu

SEQ ID NO: 35279 - RNA, 20 nt, Artificial Sequence
  CIITA targeting sequence
auuucucuaccuaccuaauc

SEQ ID NO: 35280 - RNA, 20 nt, Artificial Sequence
  CIITA targeting sequence
cuaccuaccuaaucacccau

SEQ ID NO: 35281 - RNA, 20 nt, Artificial Sequence
  CIITA targeting sequence
accuaccuaaucacccauau

SEQ ID NO: 35282 - RNA, 20 nt, Artificial Sequence
  CIITA targeting sequence
cccauauauuucccauguau

SEQ ID NO: 35283 - RNA, 20 nt, Artificial Sequence
  CIITA targeting sequence
cauguauuuacaugucaaag

SEQ ID NO: 35284 - RNA, 20 nt, Artificial Sequence
  CIITA targeting sequence
aaguauuucccugcauuccu

SEQ ID NO: 35285 - RNA, 20 nt, Artificial Sequence
  CIITA targeting sequence
cugcauuccuaccagcuaag

SEQ ID NO: 35286 - RNA, 20 nt, Artificial Sequence
  CIITA targeting sequence
uaccagcuaagcccccuuua

SEQ ID NO: 35287 - RNA, 20 nt, Artificial Sequence
  CIITA targeting sequence
aucagcagguccagguucuc

SEQ ID NO: 35288 - RNA, 20 nt, Artificial Sequence
  CIITA targeting sequence
gcagguccagguucucauac

SEQ ID NO: 35289 - RNA, 20 nt, Artificial Sequence
  CIITA targeting sequence
agguucucauacacccuccc

SEQ ID NO: 35290 - RNA, 20 nt, Artificial Sequence
  CIITA targeting sequence
cauacacccucccauguccc

SEQ ID NO: 35291 - RNA, 20 nt, Artificial Sequence
  CIITA targeting sequence
uacacccucccaugucccuc

SEQ ID NO: 35292 - RNA, 20 nt, Artificial Sequence
  CIITA targeting sequence
caugucccucccuaauuugg

SEQ ID NO: 35293 - RNA, 20 nt, Artificial Sequence
  CIITA targeting sequence
cucccuaauuuggauacaua

SEQ ID NO: 35294 - RNA, 20 nt, Artificial Sequence
  CIITA targeting sequence
cuaauuuggauacauagcag

SEQ ID NO: 35295 - RNA, 20 nt, Artificial Sequence
  CIITA targeting sequence
aaauuagggagggacauggg

SEQ ID NO: 35296 - RNA, 20 nt, Artificial Sequence
  CIITA targeting sequence
acucaccuaucucccuauuc

SEQ ID NO: 35297 - RNA, 20 nt, Artificial Sequence
  CIITA targeting sequence
ccuaucucccuauucaccga

SEQ ID NO: 35298 - RNA, 20 nt, Artificial Sequence
  CIITA targeting sequence
cccuauucaccgaucucuuu

SEQ ID NO: 35299 - RNA, 20 nt, Artificial Sequence
  CIITA targeting sequence
cuauucaccgaucucuuucu

SEQ ID NO: 35300 - RNA, 20 nt, Artificial Sequence
  CIITA targeting sequence
ccgaucucuuucucucccuu

SEQ ID NO: 35301 - RNA, 20 nt, Artificial Sequence
  CIITA targeting sequence
gugaauagggagauagguga

SEQ ID NO: 35302 - RNA, 20 nt, Artificial Sequence
  CIITA targeting sequence
cuuucucucccuuucuugcc

SEQ ID NO: 35303 - RNA, 20 nt, Artificial Sequence
  CIITA targeting sequence
uucucucccuuucuugccuc

SEQ ID NO: 35304 - RNA, 20 nt, Artificial Sequence
  CIITA targeting sequence
cucccuuucuugccuccuuu

SEQ ID NO: 35305 - RNA, 20 nt, Artificial Sequence
  CIITA targeting sequence
cccuuucuugccuccuuucu

SEQ ID NO: 35306 - RNA, 20 nt, Artificial Sequence
  CIITA targeting sequence
cuuucuugccuccuuucuuu

SEQ ID NO: 35307 - RNA, 20 nt, Artificial Sequence
  CIITA targeting sequence
ugccuccuuucuuuccuucu

SEQ ID NO: 35308 - RNA, 20 nt, Artificial Sequence
  CIITA targeting sequence
uuucuuuccuucuccugaau

SEQ ID NO: 35309 - RNA, 20 nt, Artificial Sequence
  CIITA targeting sequence
uuccuucuccugaaucauuu

SEQ ID NO: 35310 - RNA, 20 nt, Artificial Sequence
  CIITA targeting sequence
uucuccugaaucauuuauuu

SEQ ID NO: 35311 - RNA, 20 nt, Artificial Sequence
  CIITA targeting sequence
ccugaaucauuuauuuagca

SEQ ID NO: 35312 - RNA, 20 nt, Artificial Sequence
  CIITA targeting sequence
ugaaucauuuauuuagcacc

SEQ ID NO: 35313 - RNA, 20 nt, Artificial Sequence
  CIITA targeting sequence
ggagaaggaaagaaaggagg

SEQ ID NO: 35314 - RNA, 20 nt, Artificial Sequence
  CIITA targeting sequence
uuuauuuagcaccugcuaga

SEQ ID NO: 35315 - RNA, 20 nt, Artificial Sequence
  CIITA targeting sequence
agcaggugcuaaauaaauga

SEQ ID NO: 35316 - RNA, 20 nt, Artificial Sequence
  CIITA targeting sequence
accauaauuucuagcaggug

SEQ ID NO: 35317 - RNA, 20 nt, Artificial Sequence
  CIITA targeting sequence
ccauccagugcucuuucacc

SEQ ID NO: 35318 - RNA, 20 nt, Artificial Sequence
  CIITA targeting sequence
agugcucuuucaccaaaaag

SEQ ID NO: 35319 - RNA, 20 nt, Artificial Sequence
  CIITA targeting sequence
uucaccaaaaagcaugagau

SEQ ID NO: 35320 - RNA, 20 nt, Artificial Sequence
  CIITA targeting sequence
ccaaaaagcaugagaugaag

SEQ ID NO: 35321 - RNA, 20 nt, Artificial Sequence
  CIITA targeting sequence
ugcuuuuuggugaaagagca

SEQ ID NO: 35322 - RNA, 20 nt, Artificial Sequence
  CIITA targeting sequence
caugcuuuuuggugaaagag

SEQ ID NO: 35323 - RNA, 20 nt, Artificial Sequence
  CIITA targeting sequence
ucucaugcuuuuuggugaaa

SEQ ID NO: 35324 - RNA, 20 nt, Artificial Sequence
  CIITA targeting sequence
ucaucucaugcuuuuuggug

SEQ ID NO: 35325 - RNA, 20 nt, Artificial Sequence
  CIITA targeting sequence
uucuucaucucaugcuuuuu

SEQ ID NO: 35326 - RNA, 20 nt, Artificial Sequence
  CIITA targeting sequence
ccuacuagguuaaaaguccu

SEQ ID NO: 35327 - RNA, 20 nt, Artificial Sequence
  CIITA targeting sequence
uccccuacuagguuaaaagu

SEQ ID NO: 35328 - RNA, 20 nt, Artificial Sequence
  CIITA targeting sequence
ucauccauuuggaacuggag

SEQ ID NO: 35329 - RNA, 20 nt, Artificial Sequence
  CIITA targeting sequence
uccauuuggaacuggaggcu

SEQ ID NO: 35330 - RNA, 20 nt, Artificial Sequence
  CIITA targeting sequence
auuuggaacuggaggcugcc

SEQ ID NO: 35331 - RNA, 20 nt, Artificial Sequence
  CIITA targeting sequence
aaauggaugaagauuccucc

SEQ ID NO: 35332 - RNA, 20 nt, Artificial Sequence
  CIITA targeting sequence
aguuccaaauggaugaagau

SEQ ID NO: 35333 - RNA, 20 nt, Artificial Sequence
  CIITA targeting sequence
aggcagccuccaguuccaaa

SEQ ID NO: 35334 - RNA, 20 nt, Artificial Sequence
  CIITA targeting sequence
uucaaaucuaaaacuccauu

SEQ ID NO: 35335 - RNA, 20 nt, Artificial Sequence
  CIITA targeting sequence
aaucuaaaacuccauucauu

SEQ ID NO: 35336 - RNA, 20 nt, Artificial Sequence
  CIITA targeting sequence
aaaacuccauucauuccuuc

SEQ ID NO: 35337 - RNA, 20 nt, Artificial Sequence
  CIITA targeting sequence
auucauuccuucaaaugguc

SEQ ID NO: 35338 - RNA, 20 nt, Artificial Sequence
  CIITA targeting sequence
uuccuucaaauggucuuaga

SEQ ID NO: 35339 - RNA, 20 nt, Artificial Sequence
  CIITA targeting sequence
uucaaauggucuuagaauag

SEQ ID NO: 35340 - RNA, 20 nt, Artificial Sequence
  CIITA targeting sequence
aauggucuuagaauagugua

SEQ ID NO: 35341 - RNA, 20 nt, Artificial Sequence
  CIITA targeting sequence
uagaauaguguaucuucuau

SEQ ID NO: 35342 - RNA, 20 nt, Artificial Sequence
  CIITA targeting sequence
aagaccauuugaaggaauga

SEQ ID NO: 35343 - RNA, 20 nt, Artificial Sequence
  CIITA targeting sequence
ucuauuuuauuauuuuauuu

SEQ ID NO: 35344 - RNA, 20 nt, Artificial Sequence
  CIITA targeting sequence
auuuuauuauuuuauuuuau

SEQ ID NO: 35345 - RNA, 20 nt, Artificial Sequence
  CIITA targeting sequence
aaaaauaaaauaaaauaaua

SEQ ID NO: 35346 - RNA, 20 nt, Artificial Sequence
  CIITA targeting sequence
caaaaaauaaaauaaaauaa

SEQ ID NO: 35347 - RNA, 20 nt, Artificial Sequence
  CIITA targeting sequence
ugcucugucgccaaggcugg

SEQ ID NO: 35348 - RNA, 20 nt, Artificial Sequence
  CIITA targeting sequence
gucgccaaggcuggagcaca

SEQ ID NO: 35349 - RNA, 20 nt, Artificial Sequence
  CIITA targeting sequence
ccaaggcuggagcacagugg

SEQ ID NO: 35350 - RNA, 20 nt, Artificial Sequence
  CIITA targeting sequence
agccuuggcgacagagcaag

SEQ ID NO: 35351 - RNA, 20 nt, Artificial Sequence
  CIITA targeting sequence
cagcucacuacagccucaau

SEQ ID NO: 35352 - RNA, 20 nt, Artificial Sequence
  CIITA targeting sequence
cuacagccucaaucuccugg

SEQ ID NO: 35353 - RNA, 20 nt, Artificial Sequence
  CIITA targeting sequence
aucuccugggcucaagacau

SEQ ID NO: 35354 - RNA, 20 nt, Artificial Sequence
  CIITA targeting sequence
ccugggcucaagacauccuc

SEQ ID NO: 35355 - RNA, 20 nt, Artificial Sequence
  CIITA targeting sequence
ugggcucaagacauccuccc

SEQ ID NO: 35356 - RNA, 20 nt, Artificial Sequence
  CIITA targeting sequence
agacauccucccaucucagc

SEQ ID NO: 35357 - RNA, 20 nt, Artificial Sequence
  CIITA targeting sequence
ugagcccaggagauugaggc

SEQ ID NO: 35358 - RNA, 20 nt, Artificial Sequence
  CIITA targeting sequence
ucccaucucagccucccaag

SEQ ID NO: 35359 - RNA, 20 nt, Artificial Sequence
  CIITA targeting sequence
caucucagccucccaaguag

SEQ ID NO: 35360 - RNA, 20 nt, Artificial Sequence
  CIITA targeting sequence
cagccucccaaguagcuggg

SEQ ID NO: 35361 - RNA, 20 nt, Artificial Sequence
  CIITA targeting sequence
gccucccaaguagcugggac

SEQ ID NO: 35362 - RNA, 20 nt, Artificial Sequence
  CIITA targeting sequence
caaguagcugggacuacagg

SEQ ID NO: 35363 - RNA, 20 nt, Artificial Sequence
  CIITA targeting sequence
cagcuacuugggaggcugag

SEQ ID NO: 35364 - RNA, 20 nt, Artificial Sequence
  CIITA targeting sequence
accacaaauaaaaaaauuag

SEQ ID NO: 35365 - RNA, 20 nt, Artificial Sequence
  CIITA targeting sequence
cuaccacaaauaaaaaaauu

SEQ ID NO: 35366 - RNA, 20 nt, Artificial Sequence
  CIITA targeting sequence
ucucuaccacaaauaaaaaa

SEQ ID NO: 35367 - RNA, 20 nt, Artificial Sequence
  CIITA targeting sequence
cgcuauguuucccacggcug

SEQ ID NO: 35368 - RNA, 20 nt, Artificial Sequence
  CIITA targeting sequence
cuauguuucccacggcuggu

SEQ ID NO: 35369 - RNA, 20 nt, Artificial Sequence
  CIITA targeting sequence
cacggcuggucucaaacuuc

SEQ ID NO: 35370 - RNA, 20 nt, Artificial Sequence
  CIITA targeting sequence
caaacuucugggcucaagcg

SEQ ID NO: 35371 - RNA, 20 nt, Artificial Sequence
  CIITA targeting sequence
aacuucugggcucaagcgac

SEQ ID NO: 35372 - RNA, 20 nt, Artificial Sequence
  CIITA targeting sequence
gggcucaagcgacauaccug

SEQ ID NO: 35373 - RNA, 20 nt, Artificial Sequence
  CIITA targeting sequence
agcgacauaccugccuuagc

SEQ ID NO: 35374 - RNA, 20 nt, Artificial Sequence
  CIITA targeting sequence
cuugagcccagaaguuugag

SEQ ID NO: 35375 - RNA, 20 nt, Artificial Sequence
  CIITA targeting sequence
caaagugcagugugccacug

SEQ ID NO: 35376 - RNA, 20 nt, Artificial Sequence
  CIITA targeting sequence
ccugauaaugugucuuucaa

SEQ ID NO: 35377 - RNA, 20 nt, Artificial Sequence
  CIITA targeting sequence
ggcgaggugcaguggcacac

SEQ ID NO: 35378 - RNA, 20 nt, Artificial Sequence
  CIITA targeting sequence
uucaaaugcucagucuugug

SEQ ID NO: 35379 - RNA, 20 nt, Artificial Sequence
  CIITA targeting sequence
aaugcucagucuuguguagg

SEQ ID NO: 35380 - RNA, 20 nt, Artificial Sequence
  CIITA targeting sequence
gucuuguguagguauugggg

SEQ ID NO: 35381 - RNA, 20 nt, Artificial Sequence
  CIITA targeting sequence
uguguagguauugggguaag

SEQ ID NO: 35382 - RNA, 20 nt, Artificial Sequence
  CIITA targeting sequence
gcacuuaccccaauaccuac

SEQ ID NO: 35383 - RNA, 20 nt, Artificial Sequence
  CIITA targeting sequence
uuaauuuucugcacuuaccc

SEQ ID NO: 35384 - RNA, 20 nt, Artificial Sequence
  CIITA targeting sequence
ggucuuuaauuuucugcacu

SEQ ID NO: 35385 - RNA, 20 nt, Artificial Sequence
  CIITA targeting sequence
uagacauuaacagauguaug

SEQ ID NO: 35386 - RNA, 20 nt, Artificial Sequence
  CIITA targeting sequence
aggaucaggucuuuaauuuu

SEQ ID NO: 35387 - RNA, 20 nt, Artificial Sequence
  CIITA targeting sequence
guuaaugucuaggaucaggu

SEQ ID NO: 35388 - RNA, 20 nt, Artificial Sequence
  CIITA targeting sequence
uacaucuguuaaugucuagg

SEQ ID NO: 35389 - RNA, 20 nt, Artificial Sequence
  CIITA targeting sequence
aaucagagguagcagagaug

SEQ ID NO: 35390 - RNA, 20 nt, Artificial Sequence
  CIITA targeting sequence
gagguagcagagaugaugcu

SEQ ID NO: 35391 - RNA, 20 nt, Artificial Sequence
  CIITA targeting sequence
gauuagaucauacaucuguu

SEQ ID NO: 35392 - RNA, 20 nt, Artificial Sequence
  CIITA targeting sequence
gcuaccucugauuagaucau

SEQ ID NO: 35393 - RNA, 20 nt, Artificial Sequence
  CIITA targeting sequence
cugcuaccucugauuagauc

SEQ ID NO: 35394 - RNA, 20 nt, Artificial Sequence
  CIITA targeting sequence
ucucugcuaccucugauuag

SEQ ID NO: 35395 - RNA, 20 nt, Artificial Sequence
  CIITA targeting sequence
uaagcaucaucucugcuacc

SEQ ID NO: 35396 - RNA, 20 nt, Artificial Sequence
  CIITA targeting sequence
aguucauaagcaucaucucu

SEQ ID NO: 35397 - RNA, 20 nt, Artificial Sequence
  CIITA targeting sequence
ugcuuugcuguguuuuacaa

SEQ ID NO: 35398 - RNA, 20 nt, Artificial Sequence
  CIITA targeting sequence
agcuaacuauaauuuucuug

SEQ ID NO: 35399 - RNA, 20 nt, Artificial Sequence
  CIITA targeting sequence
cgcuuccagcuaacuauaau

SEQ ID NO: 35400 - RNA, 20 nt, Artificial Sequence
  CIITA targeting sequence
ucgcgcuuccagcuaacuau

SEQ ID NO: 35401 - RNA, 20 nt, Artificial Sequence
  CIITA targeting sequence
caccuucaucgcgcuuccag

SEQ ID NO: 35402 - RNA, 20 nt, Artificial Sequence
  CIITA targeting sequence
agcuuugcaggauggcuaaa

SEQ ID NO: 35403 - RNA, 20 nt, Artificial Sequence
  CIITA targeting sequence
aguucccaccuucaucgcgc

SEQ ID NO: 35404 - RNA, 20 nt, Artificial Sequence
  CIITA targeting sequence
ugcaaagcucgaguucccac

SEQ ID NO: 35405 - RNA, 20 nt, Artificial Sequence
  CIITA targeting sequence
auauuuuagccauccugcaa

SEQ ID NO: 35406 - RNA, 20 nt, Artificial Sequence
  CIITA targeting sequence
cuuuuggucuauauuuuagc

SEQ ID NO: 35407 - RNA, 20 nt, Artificial Sequence
  CIITA targeting sequence
cccuuuuggucuauauuuua

SEQ ID NO: 35408 - RNA, 20 nt, Artificial Sequence
  CIITA targeting sequence
ugccuucucccuuuuggucu

SEQ ID NO: 35409 - RNA, 20 nt, Artificial Sequence
  CIITA targeting sequence
ccugccuucucccuuuuggu

SEQ ID NO: 35410 - RNA, 20 nt, Artificial Sequence
  CIITA targeting sequence
cggugcugcucuccugccuu

SEQ ID NO: 35411 - RNA, 20 nt, Artificial Sequence
  CIITA targeting sequence
cucccggugcugcucuccug

SEQ ID NO: 35412 - RNA, 20 nt, Artificial Sequence
  CIITA targeting sequence
cagcauucuuccuuggcuug

SEQ ID NO: 35413 - RNA, 20 nt, Artificial Sequence
  CIITA targeting sequence
uccuuggcuugcagggaacc

SEQ ID NO: 35414 - RNA, 20 nt, Artificial Sequence
  CIITA targeting sequence
uuggcuugcagggaaccaag

SEQ ID NO: 35415 - RNA, 20 nt, Artificial Sequence
  CIITA targeting sequence
cugcaagccaaggaagaaug

SEQ ID NO: 35416 - RNA, 20 nt, Artificial Sequence
  CIITA targeting sequence
uaccuuugcaccuugguucc

SEQ ID NO: 35417 - RNA, 20 nt, Artificial Sequence
  CIITA targeting sequence
guccuaccuuugcaccuugg

SEQ ID NO: 35418 - RNA, 20 nt, Artificial Sequence
  CIITA targeting sequence
gcucaguccuaccuuugcac

SEQ ID NO: 35419 - RNA, 20 nt, Artificial Sequence
  CIITA targeting sequence
guuuugggagacugcagcaa

SEQ ID NO: 35420 - RNA, 20 nt, Artificial Sequence
  CIITA targeting sequence
caaaacagauucugcucagu

SEQ ID NO: 35421 - RNA, 20 nt, Artificial Sequence
  CIITA targeting sequence
cccaaaacagauucugcuca

SEQ ID NO: 35422 - RNA, 20 nt, Artificial Sequence
  CIITA targeting sequence
uugcugcagucucccaaaac

SEQ ID NO: 35423 - RNA, 20 nt, Artificial Sequence
  CIITA targeting sequence
agaacaacuguucuuuacuu

SEQ ID NO: 35424 - RNA, 20 nt, Artificial Sequence
  CIITA targeting sequence
ggaaaaauugccgguccuug

SEQ ID NO: 35425 - RNA, 20 nt, Artificial Sequence
  CIITA targeting sequence
uuacuuggaagaccuaguua

SEQ ID NO: 35426 - RNA, 20 nt, Artificial Sequence
  CIITA targeting sequence
aaguaaagaacaguuguucu

SEQ ID NO: 35427 - RNA, 20 nt, Artificial Sequence
  CIITA targeting sequence
uccaaguaaagaacaguugu

SEQ ID NO: 35428 - RNA, 20 nt, Artificial Sequence
  CIITA targeting sequence
ccaucucucccugggacuug

SEQ ID NO: 35429 - RNA, 20 nt, Artificial Sequence
  CIITA targeting sequence
cucccugggacuugccaggg

SEQ ID NO: 35430 - RNA, 20 nt, Artificial Sequence
  CIITA targeting sequence
cccugggacuugccagggga

SEQ ID NO: 35431 - RNA, 20 nt, Artificial Sequence
  CIITA targeting sequence
cugggacuugccaggggacc

SEQ ID NO: 35432 - RNA, 20 nt, Artificial Sequence
  CIITA targeting sequence
cagggagagauggggaguaa

SEQ ID NO: 35433 - RNA, 20 nt, Artificial Sequence
  CIITA targeting sequence
ccuggcaagucccagggaga

SEQ ID NO: 35434 - RNA, 20 nt, Artificial Sequence
  CIITA targeting sequence
uuaagguugccaugcugggg

SEQ ID NO: 35435 - RNA, 20 nt, Artificial Sequence
  CIITA targeting sequence
gcugggugcuagugguugcu

SEQ ID NO: 35436 - RNA, 20 nt, Artificial Sequence
  CIITA targeting sequence
gacucgagacaaauaaauuc

SEQ ID NO: 35437 - RNA, 20 nt, Artificial Sequence
  CIITA targeting sequence
gaaacuagcaugccagcaac

SEQ ID NO: 35438 - RNA, 20 nt, Artificial Sequence
  CIITA targeting sequence
agacaaauaaauucagaucc

SEQ ID NO: 35439 - RNA, 20 nt, Artificial Sequence
  CIITA targeting sequence
agucagaaacuagcaugcca

SEQ ID NO: 35440 - RNA, 20 nt, Artificial Sequence
  CIITA targeting sequence
cgagucagaaacuagcaugc

SEQ ID NO: 35441 - RNA, 20 nt, Artificial Sequence
  CIITA targeting sequence
gaucccuaggguaagaccgg

SEQ ID NO: 35442 - RNA, 20 nt, Artificial Sequence
  CIITA targeting sequence
gaauuuauuugucucgaguc

SEQ ID NO: 35443 - RNA, 20 nt, Artificial Sequence
  CIITA targeting sequence
cuaggguaagaccggcuuca

SEQ ID NO: 35444 - RNA, 20 nt, Artificial Sequence
  CIITA targeting sequence
uacccuagggaucugaauuu

SEQ ID NO: 35445 - RNA, 20 nt, Artificial Sequence
  CIITA targeting sequence
gcagcaccucuccugacagg

SEQ ID NO: 35446 - RNA, 20 nt, Artificial Sequence
  CIITA targeting sequence
ccugacaggggucccgucuc

SEQ ID NO: 35447 - RNA, 20 nt, Artificial Sequence
  CIITA targeting sequence
ugacaggggucccgucucag

SEQ ID NO: 35448 - RNA, 20 nt, Artificial Sequence
  CIITA targeting sequence
ggagaggugcugcugaagcc

SEQ ID NO: 35449 - RNA, 20 nt, Artificial Sequence
  CIITA targeting sequence
cgucucaggagagaacugac

SEQ ID NO: 35450 - RNA, 20 nt, Artificial Sequence
  CIITA targeting sequence
caggagagaacugacuuugu

SEQ ID NO: 35451 - RNA, 20 nt, Artificial Sequence
  CIITA targeting sequence
ggagagaacugacuuugucc

SEQ ID NO: 35452 - RNA, 20 nt, Artificial Sequence
  CIITA targeting sequence
ugagacgggaccccugucag

SEQ ID NO: 35453 - RNA, 20 nt, Artificial Sequence
  CIITA targeting sequence
ccugagacgggaccccuguc

SEQ ID NO: 35454 - RNA, 20 nt, Artificial Sequence
  CIITA targeting sequence
cuccugagacgggaccccug

SEQ ID NO: 35455 - RNA, 20 nt, Artificial Sequence
  CIITA targeting sequence
guucucuccugagacgggac

SEQ ID NO: 35456 - RNA, 20 nt, Artificial Sequence
  CIITA targeting sequence
caagcagaccugggcucggg

SEQ ID NO: 35457 - RNA, 20 nt, Artificial Sequence
  CIITA targeting sequence
gcuugggacaaagucaguuc

SEQ ID NO: 35458 - RNA, 20 nt, Artificial Sequence
  CIITA targeting sequence
gggaauccucaucaccucug

SEQ ID NO: 35459 - RNA, 20 nt, Artificial Sequence
  CIITA targeting sequence
ccgagcccaggucugcuugg

SEQ ID NO: 35460 - RNA, 20 nt, Artificial Sequence
  CIITA targeting sequence
ucaucaccucugcaagaguu

SEQ ID NO: 35461 - RNA, 20 nt, Artificial Sequence
  CIITA targeting sequence
ucaccucugcaagaguuuuu

SEQ ID NO: 35462 - RNA, 20 nt, Artificial Sequence
  CIITA targeting sequence
ccucugcaagaguuuuuugu

SEQ ID NO: 35463 - RNA, 20 nt, Artificial Sequence
  CIITA targeting sequence
gcaagaguuuuuuguuguug

SEQ ID NO: 35464 - RNA, 20 nt, Artificial Sequence
  CIITA targeting sequence
ugcagaggugaugaggauuc

SEQ ID NO: 35465 - RNA, 20 nt, Artificial Sequence
  CIITA targeting sequence
aaaacaaaaacaaaacacaa

SEQ ID NO: 35466 - RNA, 20 nt, Artificial Sequence
  CIITA targeting sequence
aaaaaucaaaaacaaaaaca

SEQ ID NO: 35467 - RNA, 20 nt, Artificial Sequence
  CIITA targeting sequence
auuucaaaaaaucaaaaaca

SEQ ID NO: 35468 - RNA, 20 nt, Artificial Sequence
  CIITA targeting sequence
cgcucugaagcccaggcugg

SEQ ID NO: 35469 - RNA, 20 nt, Artificial Sequence
  CIITA targeting sequence
cucugaagcccaggcuggag

SEQ ID NO: 35470 - RNA, 20 nt, Artificial Sequence
  CIITA targeting sequence
gaagcccaggcuggagugca

SEQ ID NO: 35471 - RNA, 20 nt, Artificial Sequence
  CIITA targeting sequence
gagcgagacucuauuucaaa

SEQ ID NO: 35472 - RNA, 20 nt, Artificial Sequence
  CIITA targeting sequence
agccugggcuucagagcgag

SEQ ID NO: 35473 - RNA, 20 nt, Artificial Sequence
  CIITA targeting sequence
caccacugcacuccagccug

SEQ ID NO: 35474 - RNA, 20 nt, Artificial Sequence
  CIITA targeting sequence
cggcucacuugcaaccucca

SEQ ID NO: 35475 - RNA, 20 nt, Artificial Sequence
  CIITA targeting sequence
gcucacuugcaaccuccacc

SEQ ID NO: 35476 - RNA, 20 nt, Artificial Sequence
  CIITA targeting sequence
cuugcaaccuccaccucccc

SEQ ID NO: 35477 - RNA, 20 nt, Artificial Sequence
  CIITA targeting sequence
accucccccagguucaagca

SEQ ID NO: 35478 - RNA, 20 nt, Artificial Sequence
  CIITA targeting sequence
cccagguucaagcaauucuc

SEQ ID NO: 35479 - RNA, 20 nt, Artificial Sequence
  CIITA targeting sequence
agcaauucuccugccucagc

SEQ ID NO: 35480 - RNA, 20 nt, Artificial Sequence
  CIITA targeting sequence
ccugccucagccucccaagu

SEQ ID NO: 35481 - RNA, 20 nt, Artificial Sequence
  CIITA targeting sequence
ugccucagccucccaaguaa

SEQ ID NO: 35482 - RNA, 20 nt, Artificial Sequence
  CIITA targeting sequence
gccucccaaguaacugggau

SEQ ID NO: 35483 - RNA, 20 nt, Artificial Sequence
  CIITA targeting sequence
caaguaacugggauuacagg

SEQ ID NO: 35484 - RNA, 20 nt, Artificial Sequence
  CIITA targeting sequence
caguuacuugggaggcugag

SEQ ID NO: 35485 - RNA, 20 nt, Artificial Sequence
  CIITA targeting sequence
aggugugguggugcacgccu

SEQ ID NO: 35486 - RNA, 20 nt, Artificial Sequence
  CIITA targeting sequence
auuuuuaguagagacagggu

SEQ ID NO: 35487 - RNA, 20 nt, Artificial Sequence
  CIITA targeting sequence
acuaaaaauagaaaaauuau

SEQ ID NO: 35488 - RNA, 20 nt, Artificial Sequence
  CIITA targeting sequence
cuacuaaaaauagaaaaauu

SEQ ID NO: 35489 - RNA, 20 nt, Artificial Sequence
  CIITA targeting sequence
ccauguuggccaggcugguu

SEQ ID NO: 35490 - RNA, 20 nt, Artificial Sequence
  CIITA targeting sequence
aauuccugaccucaggugau

SEQ ID NO: 35491 - RNA, 20 nt, Artificial Sequence
  CIITA targeting sequence
aaaccagccuggccaacaug

SEQ ID NO: 35492 - RNA, 20 nt, Artificial Sequence
  CIITA targeting sequence
ugaccucaggugauccgccc

SEQ ID NO: 35493 - RNA, 20 nt, Artificial Sequence
  CIITA targeting sequence
ggaauucgaaaccagccugg

SEQ ID NO: 35494 - RNA, 20 nt, Artificial Sequence
  CIITA targeting sequence
ggugauccgcccgccucagu

SEQ ID NO: 35495 - RNA, 20 nt, Artificial Sequence
  CIITA targeting sequence
ccugaggucaggaauucgaa

SEQ ID NO: 35496 - RNA, 20 nt, Artificial Sequence
  CIITA targeting sequence
gcccgccucagucuccuaaa

SEQ ID NO: 35497 - RNA, 20 nt, Artificial Sequence
  CIITA targeting sequence
gucuccuaaaguguugagau

SEQ ID NO: 35498 - RNA, 20 nt, Artificial Sequence
  CIITA targeting sequence
ccuaaaguguugagauuaca

SEQ ID NO: 35499 - RNA, 20 nt, Artificial Sequence
  CIITA targeting sequence
uaaaguguugagauuacagg

SEQ ID NO: 35500 - RNA, 20 nt, Artificial Sequence
  CIITA targeting sequence
acacuuuaggagacugaggc

SEQ ID NO: 35501 - RNA, 20 nt, Artificial Sequence
  CIITA targeting sequence
caacacuuuaggagacugag

SEQ ID NO: 35502 - RNA, 20 nt, Artificial Sequence
  CIITA targeting sequence
cgccuguaaucucaacacuu

SEQ ID NO: 35503 - RNA, 20 nt, Artificial Sequence
  CIITA targeting sequence
ugcaggccgggcgugguggc

SEQ ID NO: 35504 - RNA, 20 nt, Artificial Sequence
  CIITA targeting sequence
uuaagaggcaggaacaagga

SEQ ID NO: 35505 - RNA, 20 nt, Artificial Sequence
  CIITA targeting sequence
uaaagacuccugcaggccgg

SEQ ID NO: 35506 - RNA, 20 nt, Artificial Sequence
  CIITA targeting sequence
ugccucuuaaagacuccugc

SEQ ID NO: 35507 - RNA, 20 nt, Artificial Sequence
  CIITA targeting sequence
uuguuccugccucuuaaaga

SEQ ID NO: 35508 - RNA, 20 nt, Artificial Sequence
  CIITA targeting sequence
acagagaggaagccuggggu

SEQ ID NO: 35509 - RNA, 20 nt, Artificial Sequence
  CIITA targeting sequence
guugaaacaccugcauccuu

SEQ ID NO: 35510 - RNA, 20 nt, Artificial Sequence
  CIITA targeting sequence
cuguugaaacaccugcaucc

SEQ ID NO: 35511 - RNA, 20 nt, Artificial Sequence
  CIITA targeting sequence
ucucuguugaaacaccugca

SEQ ID NO: 35512 - RNA, 20 nt, Artificial Sequence
  CIITA targeting sequence
uuccuccucgugcucuuugc

SEQ ID NO: 35513 - RNA, 20 nt, Artificial Sequence
  CIITA targeting sequence
uccucgugcucuuugccccc

SEQ ID NO: 35514 - RNA, 20 nt, Artificial Sequence
  CIITA targeting sequence
ucgugcucuuugcccccauu

SEQ ID NO: 35515 - RNA, 20 nt, Artificial Sequence
  CIITA targeting sequence
ugcucuuugcccccauucac

SEQ ID NO: 35516 - RNA, 20 nt, Artificial Sequence
  CIITA targeting sequence
uugcccccauucacucagug

SEQ ID NO: 35517 - RNA, 20 nt, Artificial Sequence
  CIITA targeting sequence
cucagugcuagagguuguca

SEQ ID NO: 35518 - RNA, 20 nt, Artificial Sequence
  CIITA targeting sequence
gugcuagagguugucauucu

SEQ ID NO: 35519 - RNA, 20 nt, Artificial Sequence
  CIITA targeting sequence
agcacugagugaaugggggc

SEQ ID NO: 35520 - RNA, 20 nt, Artificial Sequence
  CIITA targeting sequence
uucugccucugagacauccg

SEQ ID NO: 35521 - RNA, 20 nt, Artificial Sequence
  CIITA targeting sequence
gccucugagacauccggccc

SEQ ID NO: 35522 - RNA, 20 nt, Artificial Sequence
  CIITA targeting sequence
gagacauccggcccccuccc

SEQ ID NO: 35523 - RNA, 20 nt, Artificial Sequence
  CIITA targeting sequence
gaggcagaaugacaaccucu

SEQ ID NO: 35524 - RNA, 20 nt, Artificial Sequence
  CIITA targeting sequence
cagaggcagaaugacaaccu

SEQ ID NO: 35525 - RNA, 20 nt, Artificial Sequence
  CIITA targeting sequence
ggcccccucccucuccaucc

SEQ ID NO: 35526 - RNA, 20 nt, Artificial Sequence
  CIITA targeting sequence
cucuccauccccacacccuc

SEQ ID NO: 35527 - RNA, 20 nt, Artificial Sequence
  CIITA targeting sequence
ccauccccacacccucaccu

SEQ ID NO: 35528 - RNA, 20 nt, Artificial Sequence
  CIITA targeting sequence
auccccacacccucaccugc

SEQ ID NO: 35529 - RNA, 20 nt, Artificial Sequence
  CIITA targeting sequence
ccacacccucaccugccaca

SEQ ID NO: 35530 - RNA, 20 nt, Artificial Sequence
  CIITA targeting sequence
ccugccacagcugaaaucca

SEQ ID NO: 35531 - RNA, 20 nt, Artificial Sequence
  CIITA targeting sequence
gcuguggcaggugagggugu

SEQ ID NO: 35532 - RNA, 20 nt, Artificial Sequence
  CIITA targeting sequence
aggugugccucagcuccugg

SEQ ID NO: 35533 - RNA, 20 nt, Artificial Sequence
  CIITA targeting sequence
gcuccuggcuggguaccacu

SEQ ID NO: 35534 - RNA, 20 nt, Artificial Sequence
  CIITA targeting sequence
uggcuggguaccacugccac

SEQ ID NO: 35535 - RNA, 20 nt, Artificial Sequence
  CIITA targeting sequence
ucuguagacucucuacccug

SEQ ID NO: 35536 - RNA, 20 nt, Artificial Sequence
  CIITA targeting sequence
guagacucucuacccuggug

SEQ ID NO: 35537 - RNA, 20 nt, Artificial Sequence
  CIITA targeting sequence
acagaugaguggcaguggua

SEQ ID NO: 35538 - RNA, 20 nt, Artificial Sequence
  CIITA targeting sequence
cuacccuggugccuucaggu

SEQ ID NO: 35539 - RNA, 20 nt, Artificial Sequence
  CIITA targeting sequence
acccuggugccuucaggugc

SEQ ID NO: 35540 - RNA, 20 nt, Artificial Sequence
  CIITA targeting sequence
ggugccaaagugcauccucu

SEQ ID NO: 35541 - RNA, 20 nt, Artificial Sequence
  CIITA targeting sequence
ucugccaucagucaaacaca

SEQ ID NO: 35542 - RNA, 20 nt, Artificial Sequence
  CIITA targeting sequence
gccaucagucaaacacacag

SEQ ID NO: 35543 - RNA, 20 nt, Artificial Sequence
  CIITA targeting sequence
gucaaacacacaguuugacg

SEQ ID NO: 35544 - RNA, 20 nt, Artificial Sequence
  CIITA targeting sequence
aacacacaguuugacggaug

SEQ ID NO: 35545 - RNA, 20 nt, Artificial Sequence
  CIITA targeting sequence
aacuguguguuugacugaug

SEQ ID NO: 35546 - RNA, 20 nt, Artificial Sequence
  CIITA targeting sequence
gucaaacuguguguuugacu

SEQ ID NO: 35547 - RNA, 20 nt, Artificial Sequence
  CIITA targeting sequence
cuugcucugcucagagaccu

SEQ ID NO: 35548 - RNA, 20 nt, Artificial Sequence
  CIITA targeting sequence
gcucagagaccugcaccgac

SEQ ID NO: 35549 - RNA, 20 nt, Artificial Sequence
  CIITA targeting sequence
gagaccugcaccgacacagg

SEQ ID NO: 35550 - RNA, 20 nt, Artificial Sequence
  CIITA targeting sequence
gagcagagcaagugacaucc

SEQ ID NO: 35551 - RNA, 20 nt, Artificial Sequence
  CIITA targeting sequence
cugagcagagcaagugacau

SEQ ID NO: 35552 - RNA, 20 nt, Artificial Sequence
  CIITA targeting sequence
gugcaggucucugagcagag

SEQ ID NO: 35553 - RNA, 20 nt, Artificial Sequence
  CIITA targeting sequence
gguucaggucuuguggacaa

SEQ ID NO: 35554 - RNA, 20 nt, Artificial Sequence
  CIITA targeting sequence
ggucuuguggacaagaacug

SEQ ID NO: 35555 - RNA, 20 nt, Artificial Sequence
  CIITA targeting sequence
uguggacaagaacugggucu

SEQ ID NO: 35556 - RNA, 20 nt, Artificial Sequence
  CIITA targeting sequence
acaagaccugaaccugacca

SEQ ID NO: 35557 - RNA, 20 nt, Artificial Sequence
  CIITA targeting sequence
uguccacaagaccugaaccu

SEQ ID NO: 35558 - RNA, 20 nt, Artificial Sequence
  CIITA targeting sequence
ggaggagucagggaagaugu

SEQ ID NO: 35559 - RNA, 20 nt, Artificial Sequence
  CIITA targeting sequence
agacccaguucuuguccaca

SEQ ID NO: 35560 - RNA, 20 nt, Artificial Sequence
  CIITA targeting sequence
uccagacccaguucuugucc

SEQ ID NO: 35561 - RNA, 20 nt, Artificial Sequence
  CIITA targeting sequence
gggaagauguagaugaggaa

SEQ ID NO: 35562 - RNA, 20 nt, Artificial Sequence
  CIITA targeting sequence
cugacuccuccagacccagu

SEQ ID NO: 35563 - RNA, 20 nt, Artificial Sequence
  CIITA targeting sequence
ucccugacuccuccagaccc

SEQ ID NO: 35564 - RNA, 20 nt, Artificial Sequence
  CIITA targeting sequence
acaucuucccugacuccucc

SEQ ID NO: 35565 - RNA, 20 nt, Artificial Sequence
  CIITA targeting sequence
ucuacaucuucccugacucc

SEQ ID NO: 35566 - RNA, 20 nt, Artificial Sequence
  CIITA targeting sequence
ucaucuacaucuucccugac

SEQ ID NO: 35567 - RNA, 20 nt, Artificial Sequence
  CIITA targeting sequence
guaccaccuuccucaucuac

SEQ ID NO: 35568 - RNA, 20 nt, Artificial Sequence
  CIITA targeting sequence
uuucaguaccaccuuccuca

SEQ ID NO: 35569 - RNA, 20 nt, Artificial Sequence
  CIITA targeting sequence
gguacagggaagauguacca

SEQ ID NO: 35570 - RNA, 20 nt, Artificial Sequence
  CIITA targeting sequence
cuguaccagagguucguuuc

SEQ ID NO: 35571 - RNA, 20 nt, Artificial Sequence
  CIITA targeting sequence
ucccuguaccagagguucgu

SEQ ID NO: 35572 - RNA, 20 nt, Artificial Sequence
  CIITA targeting sequence
cccaggugagagaugguagu

SEQ ID NO: 35573 - RNA, 20 nt, Artificial Sequence
  CIITA targeting sequence
ccugggugacugcagcugcc

SEQ ID NO: 35574 - RNA, 20 nt, Artificial Sequence
  CIITA targeting sequence
caccugggugacugcagcug

SEQ ID NO: 35575 - RNA, 20 nt, Artificial Sequence
  CIITA targeting sequence
cucaccugggugacugcagc

SEQ ID NO: 35576 - RNA, 20 nt, Artificial Sequence
  CIITA targeting sequence
uggcuggcccauucuaaguu

SEQ ID NO: 35577 - RNA, 20 nt, Artificial Sequence
  CIITA targeting sequence
aaguuccaaagcugccuugg

SEQ ID NO: 35578 - RNA, 20 nt, Artificial Sequence
  CIITA targeting sequence
aaagcugccuuggccaucgg

SEQ ID NO: 35579 - RNA, 20 nt, Artificial Sequence
  CIITA targeting sequence
gucugagggugggauggggg

SEQ ID NO: 35580 - RNA, 20 nt, Artificial Sequence
  CIITA targeting sequence
gagggugggauggggggaca

SEQ ID NO: 35581 - RNA, 20 nt, Artificial Sequence
  CIITA targeting sequence
gaccgauggccaaggcagcu

SEQ ID NO: 35582 - RNA, 20 nt, Artificial Sequence
  CIITA targeting sequence
cacccucagaccgauggcca

SEQ ID NO: 35583 - RNA, 20 nt, Artificial Sequence
  CIITA targeting sequence
ccccaucccacccucagacc

SEQ ID NO: 35584 - RNA, 20 nt, Artificial Sequence
  CIITA targeting sequence
gaaccagcugucucugagaa

SEQ ID NO: 35585 - RNA, 20 nt, Artificial Sequence
  CIITA targeting sequence
gauguccccccaucccaccc

SEQ ID NO: 35586 - RNA, 20 nt, Artificial Sequence
  CIITA targeting sequence
cugagaacauaaagggaccc

SEQ ID NO: 35587 - RNA, 20 nt, Artificial Sequence
  CIITA targeting sequence
gagaacauaaagggaccccc

SEQ ID NO: 35588 - RNA, 20 nt, Artificial Sequence
  CIITA targeting sequence
gagacagcugguucugaugu

SEQ ID NO: 35589 - RNA, 20 nt, Artificial Sequence
  CIITA targeting sequence
cagagacagcugguucugau

SEQ ID NO: 35590 - RNA, 20 nt, Artificial Sequence
  CIITA targeting sequence
cuuuauguucucagagacag

SEQ ID NO: 35591 - RNA, 20 nt, Artificial Sequence
  CIITA targeting sequence
cauaugggggucccuuuaug

SEQ ID NO: 35592 - RNA, 20 nt, Artificial Sequence
  CIITA targeting sequence
agacagcugagcagucagag

SEQ ID NO: 35593 - RNA, 20 nt, Artificial Sequence
  CIITA targeting sequence
ugaggucccauauggggguc

SEQ ID NO: 35594 - RNA, 20 nt, Artificial Sequence
  CIITA targeting sequence
gcugucuugaggucccauau

SEQ ID NO: 35595 - RNA, 20 nt, Artificial Sequence
  CIITA targeting sequence
gaggcgccucucccguggca

SEQ ID NO: 35596 - RNA, 20 nt, Artificial Sequence
  CIITA targeting sequence
gacugcucagcugucuugag

SEQ ID NO: 35597 - RNA, 20 nt, Artificial Sequence
  CIITA targeting sequence
cccguggcaccaggucauag

SEQ ID NO: 35598 - RNA, 20 nt, Artificial Sequence
  CIITA targeting sequence
cguggcaccaggucauagga

SEQ ID NO: 35599 - RNA, 20 nt, Artificial Sequence
  CIITA targeting sequence
uaggauaaugagacuucuua

SEQ ID NO: 35600 - RNA, 20 nt, Artificial Sequence
  CIITA targeting sequence
uaugaccuggugccacggga

SEQ ID NO: 35601 - RNA, 20 nt, Artificial Sequence
  CIITA targeting sequence
uuauccuaugaccuggugcc

SEQ ID NO: 35602 - RNA, 20 nt, Artificial Sequence
  CIITA targeting sequence
cauuauccuaugaccuggug

SEQ ID NO: 35603 - RNA, 20 nt, Artificial Sequence
  CIITA targeting sequence
uagaauuucuuucuuuuuuu

SEQ ID NO: 35604 - RNA, 20 nt, Artificial Sequence
  CIITA targeting sequence
aagaagucucauuauccuau

SEQ ID NO: 35605 - RNA, 20 nt, Artificial Sequence
  CIITA targeting sequence
uucuuuuuuuuucuuuuuuu

SEQ ID NO: 35606 - RNA, 20 nt, Artificial Sequence
  CIITA targeting sequence
uuuuuuuucuuuuuuuugag

SEQ ID NO: 35607 - RNA, 20 nt, Artificial Sequence
  CIITA targeting sequence
uuuuuuugagacugagucuc

SEQ ID NO: 35608 - RNA, 20 nt, Artificial Sequence
  CIITA targeting sequence
aaaaaaagaaaaaaaaagaa

SEQ ID NO: 35609 - RNA, 20 nt, Artificial Sequence
  CIITA targeting sequence
caaaaaaaagaaaaaaaaag

SEQ ID NO: 35610 - RNA, 20 nt, Artificial Sequence
  CIITA targeting sequence
gucucaaaaaaaagaaaaaa

SEQ ID NO: 35611 - RNA, 20 nt, Artificial Sequence
  CIITA targeting sequence
cacucugucacccacgcuug

SEQ ID NO: 35612 - RNA, 20 nt, Artificial Sequence
  CIITA targeting sequence
cucugucacccacgcuugag

SEQ ID NO: 35613 - RNA, 20 nt, Artificial Sequence
  CIITA targeting sequence
gucacccacgcuugagugca

SEQ ID NO: 35614 - RNA, 20 nt, Artificial Sequence
  CIITA targeting sequence
cccacgcuugagugcagugg

SEQ ID NO: 35615 - RNA, 20 nt, Artificial Sequence
  CIITA targeting sequence
agcgugggugacagagugag

SEQ ID NO: 35616 - RNA, 20 nt, Artificial Sequence
  CIITA targeting sequence
aagcucacugcaaccuccac

SEQ ID NO: 35617 - RNA, 20 nt, Artificial Sequence
  CIITA targeting sequence
cugcaaccuccaccucccgg

SEQ ID NO: 35618 - RNA, 20 nt, Artificial Sequence
  CIITA targeting sequence
accucccggguucaugugau

SEQ ID NO: 35619 - RNA, 20 nt, Artificial Sequence
  CIITA targeting sequence
cggguucaugugauucucau

SEQ ID NO: 35620 - RNA, 20 nt, Artificial Sequence
  CIITA targeting sequence
ugugauucucaucccucagu

SEQ ID NO: 35621 - RNA, 20 nt, Artificial Sequence
  CIITA targeting sequence
caugaacccgggagguggag

SEQ ID NO: 35622 - RNA, 20 nt, Artificial Sequence
  CIITA targeting sequence
caucccucagucucccgagu

SEQ ID NO: 35623 - RNA, 20 nt, Artificial Sequence
  CIITA targeting sequence
ucccucagucucccgaguag

SEQ ID NO: 35624 - RNA, 20 nt, Artificial Sequence
  CIITA targeting sequence
cucagucucccgaguagcac

SEQ ID NO: 35625 - RNA, 20 nt, Artificial Sequence
  CIITA targeting sequence
gucucccgaguagcacacgc

SEQ ID NO: 35626 - RNA, 20 nt, Artificial Sequence
  CIITA targeting sequence
cccgaguagcacacgcacca

SEQ ID NO: 35627 - RNA, 20 nt, Artificial Sequence
  CIITA targeting sequence
cgaguagcacacgcaccauc

SEQ ID NO: 35628 - RNA, 20 nt, Artificial Sequence
  CIITA targeting sequence
ggagacugagggaugagaau

SEQ ID NO: 35629 - RNA, 20 nt, Artificial Sequence
  CIITA targeting sequence
cgcccaggcuaauuuuugua

SEQ ID NO: 35630 - RNA, 20 nt, Artificial Sequence
  CIITA targeting sequence
acuaaaaauacaaaaauuag

SEQ ID NO: 35631 - RNA, 20 nt, Artificial Sequence
  CIITA targeting sequence
cuacuaaaaauacaaaaauu

SEQ ID NO: 35632 - RNA, 20 nt, Artificial Sequence
  CIITA targeting sequence
uuucucuacuaaaaauacaa

SEQ ID NO: 35633 - RNA, 20 nt, Artificial Sequence
  CIITA targeting sequence
ucaacuccugaccucaaaug

SEQ ID NO: 35634 - RNA, 20 nt, Artificial Sequence
  CIITA targeting sequence
acuccugaccucaaaugauc

SEQ ID NO: 35635 - RNA, 20 nt, Artificial Sequence
  CIITA targeting sequence
ugaccucaaaugaucugccc

SEQ ID NO: 35636 - RNA, 20 nt, Artificial Sequence
  CIITA targeting sequence
ggaguugaagaccagccugg

SEQ ID NO: 35637 - RNA, 20 nt, Artificial Sequence
  CIITA targeting sequence
aaugaucugcccaccucagc

SEQ ID NO: 35638 - RNA, 20 nt, Artificial Sequence
  CIITA targeting sequence
uuugaggucaggaguugaag

SEQ ID NO: 35639 - RNA, 20 nt, Artificial Sequence
  CIITA targeting sequence
gcccaccucagccucccaaa

SEQ ID NO: 35640 - RNA, 20 nt, Artificial Sequence
  CIITA targeting sequence
gccucccaaaggacuaggau

SEQ ID NO: 35641 - RNA, 20 nt, Artificial Sequence
  CIITA targeting sequence
caaaggacuaggauuacagg

SEQ ID NO: 35642 - RNA, 20 nt, Artificial Sequence
  CIITA targeting sequence
uuugggaggcugaggugggc

SEQ ID NO: 35643 - RNA, 20 nt, Artificial Sequence
  CIITA targeting sequence
uaguccuuugggaggcugag

SEQ ID NO: 35644 - RNA, 20 nt, Artificial Sequence
  CIITA targeting sequence
ugccuguaauccuaguccuu

SEQ ID NO: 35645 - RNA, 20 nt, Artificial Sequence
  CIITA targeting sequence
uucuuagaauuucugacauu

SEQ ID NO: 35646 - RNA, 20 nt, Artificial Sequence
  CIITA targeting sequence
uagaauuucugacauucacc

SEQ ID NO: 35647 - RNA, 20 nt, Artificial Sequence
  CIITA targeting sequence
aagaaugaccaggcacagug

SEQ ID NO: 35648 - RNA, 20 nt, Artificial Sequence
  CIITA targeting sequence
gacauucaccauauccguuu

SEQ ID NO: 35649 - RNA, 20 nt, Artificial Sequence
  CIITA targeting sequence
gaaauucuaagaaugaccag

SEQ ID NO: 35650 - RNA, 20 nt, Artificial Sequence
  CIITA targeting sequence
ccauauccguuuguuagccc

SEQ ID NO: 35651 - RNA, 20 nt, Artificial Sequence
  CIITA targeting sequence
guuuguuagccccacuaagc

SEQ ID NO: 35652 - RNA, 20 nt, Artificial Sequence
  CIITA targeting sequence
aauugacucagcauuucuua

SEQ ID NO: 35653 - RNA, 20 nt, Artificial Sequence
  CIITA targeting sequence
auuugaaacagccuugcuua

SEQ ID NO: 35654 - RNA, 20 nt, Artificial Sequence
  CIITA targeting sequence
gcauuucuuauuugucaauu

SEQ ID NO: 35655 - RNA, 20 nt, Artificial Sequence
  CIITA targeting sequence
uauuugucaauuucuacccc

SEQ ID NO: 35656 - RNA, 20 nt, Artificial Sequence
  CIITA targeting sequence
auuucuaccccacuccucac

SEQ ID NO: 35657 - RNA, 20 nt, Artificial Sequence
  CIITA targeting sequence
accccacuccucacccgggg

SEQ ID NO: 35658 - RNA, 20 nt, Artificial Sequence
  CIITA targeting sequence
ucacccggggacuucugaaa

SEQ ID NO: 35659 - RNA, 20 nt, Artificial Sequence
  CIITA targeting sequence
cccggggacuucugaaaaca

SEQ ID NO: 35660 - RNA, 20 nt, Artificial Sequence
  CIITA targeting sequence
ccgggugaggagugggguag

SEQ ID NO: 35661 - RNA, 20 nt, Artificial Sequence
  CIITA targeting sequence
gaaaacagugaaggcuucaa

SEQ ID NO: 35662 - RNA, 20 nt, Artificial Sequence
  CIITA targeting sequence
gaaguccccgggugaggagu

SEQ ID NO: 35663 - RNA, 20 nt, Artificial Sequence
  CIITA targeting sequence
cuguuuucagaaguccccgg

SEQ ID NO: 35664 - RNA, 20 nt, Artificial Sequence
  CIITA targeting sequence
aaguaaucaccuuacaaaga

SEQ ID NO: 35665 - RNA, 20 nt, Artificial Sequence
  CIITA targeting sequence
ccuuacaaagaagggcauca

SEQ ID NO: 35666 - RNA, 20 nt, Artificial Sequence
  CIITA targeting sequence
uuguaaggugauuacuuuga

SEQ ID NO: 35667 - RNA, 20 nt, Artificial Sequence
  CIITA targeting sequence
uccucauuucacacaugggg

SEQ ID NO: 35668 - RNA, 20 nt, Artificial Sequence
  CIITA targeting sequence
ucauuucacacauggggaaa

SEQ ID NO: 35669 - RNA, 20 nt, Artificial Sequence
  CIITA targeting sequence
uuucacacauggggaaacug

SEQ ID NO: 35670 - RNA, 20 nt, Artificial Sequence
  CIITA targeting sequence
cacauggggaaacugaggac

SEQ ID NO: 35671 - RNA, 20 nt, Artificial Sequence
  CIITA targeting sequence
ccaugugugaaaugaggaug

SEQ ID NO: 35672 - RNA, 20 nt, Artificial Sequence
  CIITA targeting sequence
guuuccccaugugugaaaug

SEQ ID NO: 35673 - RNA, 20 nt, Artificial Sequence
  CIITA targeting sequence
ucaguuuccccaugugugaa

SEQ ID NO: 35674 - RNA, 20 nt, Artificial Sequence
  CIITA targeting sequence
gugguccucaguuuccccau

SEQ ID NO: 35675 - RNA, 20 nt, Artificial Sequence
  CIITA targeting sequence
cugugguccucaguuucccc

SEQ ID NO: 35676 - RNA, 20 nt, Artificial Sequence
  CIITA targeting sequence
ucucugugguccucaguuuc

SEQ ID NO: 35677 - RNA, 20 nt, Artificial Sequence
  CIITA targeting sequence
uuacuuccucucuguggucc

SEQ ID NO: 35678 - RNA, 20 nt, Artificial Sequence
  CIITA targeting sequence
cacaccugcuacuaaguucc

SEQ ID NO: 35679 - RNA, 20 nt, Artificial Sequence
  CIITA targeting sequence
ccguccagugcucuuucagc

SEQ ID NO: 35680 - RNA, 20 nt, Artificial Sequence
  CIITA targeting sequence
agugcucuuucagcaaaaau

SEQ ID NO: 35681 - RNA, 20 nt, Artificial Sequence
  CIITA targeting sequence
uucagcaaaaaugcaugagg

SEQ ID NO: 35682 - RNA, 20 nt, Artificial Sequence
  CIITA targeting sequence
gcaaaaaugcaugaggcaca

SEQ ID NO: 35683 - RNA, 20 nt, Artificial Sequence
  CIITA targeting sequence
ugcauuuuugcugaaagagc

SEQ ID NO: 35684 - RNA, 20 nt, Artificial Sequence
  CIITA targeting sequence
uguuuccaaaccuucauuuc

SEQ ID NO: 35685 - RNA, 20 nt, Artificial Sequence
  CIITA targeting sequence
aaaccuucauuucaguacca

SEQ ID NO: 35686 - RNA, 20 nt, Artificial Sequence
  CIITA targeting sequence
uuucaguaccaccuucauca

SEQ ID NO: 35687 - RNA, 20 nt, Artificial Sequence
  CIITA targeting sequence
guaccaccuucaucauuuuu

SEQ ID NO: 35688 - RNA, 20 nt, Artificial Sequence
  CIITA targeting sequence
ucauuuuuguguuuuccaca

SEQ ID NO: 35689 - RNA, 20 nt, Artificial Sequence
  CIITA targeting sequence
uuuuuguguuuuccacauaa

SEQ ID NO: 35690 - RNA, 20 nt, Artificial Sequence
  CIITA targeting sequence
acauaacacuuuacuauuau

SEQ ID NO: 35691 - RNA, 20 nt, Artificial Sequence
  CIITA targeting sequence
uaaauaauaguaaaguguua

SEQ ID NO: 35692 - RNA, 20 nt, Artificial Sequence
  CIITA targeting sequence
ccuuuuuuacuuaucuuucu

SEQ ID NO: 35693 - RNA, 20 nt, Artificial Sequence
  CIITA targeting sequence
uucuuuucuuuuucuuuagg

SEQ ID NO: 35694 - RNA, 20 nt, Artificial Sequence
  CIITA targeting sequence
uuucuuuuucuuuaggagag

SEQ ID NO: 35695 - RNA, 20 nt, Artificial Sequence
  CIITA targeting sequence
uuuucuuuaggagaggcagg

SEQ ID NO: 35696 - RNA, 20 nt, Artificial Sequence
  CIITA targeting sequence
uuaggagaggcaggaucuca

SEQ ID NO: 35697 - RNA, 20 nt, Artificial Sequence
  CIITA targeting sequence
uaaagaaaaagaaaagaaag

SEQ ID NO: 35698 - RNA, 20 nt, Artificial Sequence
  CIITA targeting sequence
ccuaaagaaaaagaaaagaa

SEQ ID NO: 35699 - RNA, 20 nt, Artificial Sequence
  CIITA targeting sequence
ugccucuccuaaagaaaaag

SEQ ID NO: 35700 - RNA, 20 nt, Artificial Sequence
  CIITA targeting sequence
cacucuguugcccaggcugg

SEQ ID NO: 35701 - RNA, 20 nt, Artificial Sequence
  CIITA targeting sequence
cucuguugcccaggcuggag

SEQ ID NO: 35702 - RNA, 20 nt, Artificial Sequence
  CIITA targeting sequence
guugcccaggcuggagugua

SEQ ID NO: 35703 - RNA, 20 nt, Artificial Sequence
  CIITA targeting sequence
agccugggcaacagagugag

SEQ ID NO: 35704 - RNA, 20 nt, Artificial Sequence
  CIITA targeting sequence
ugaucauagcucacugcagc

SEQ ID NO: 35705 - RNA, 20 nt, Artificial Sequence
  CIITA targeting sequence
ugaaauacacuccagccugg

SEQ ID NO: 35706 - RNA, 20 nt, Artificial Sequence
  CIITA targeting sequence
uagcucacugcagccuccaa

SEQ ID NO: 35707 - RNA, 20 nt, Artificial Sequence
  CIITA targeting sequence
cugcagccuccaacuccugg

SEQ ID NO: 35708 - RNA, 20 nt, Artificial Sequence
  CIITA targeting sequence
aacuccugggcacacucgau

SEQ ID NO: 35709 - RNA, 20 nt, Artificial Sequence
  CIITA targeting sequence
ugggcacacucgauccuccc

SEQ ID NO: 35710 - RNA, 20 nt, Artificial Sequence
  CIITA targeting sequence
auccucccacuucagccucc

SEQ ID NO: 35711 - RNA, 20 nt, Artificial Sequence
  CIITA targeting sequence
agugugcccaggaguuggag

SEQ ID NO: 35712 - RNA, 20 nt, Artificial Sequence
  CIITA targeting sequence
ucccacuucagccuccagag

SEQ ID NO: 35713 - RNA, 20 nt, Artificial Sequence
  CIITA targeting sequence
cacuucagccuccagaguag

SEQ ID NO: 35714 - RNA, 20 nt, Artificial Sequence
  CIITA targeting sequence
gccuccagaguagcugggac

SEQ ID NO: 35715 - RNA, 20 nt, Artificial Sequence
  CIITA targeting sequence
agaguagcugggacuauagu

SEQ ID NO: 35716 - RNA, 20 nt, Artificial Sequence
  CIITA targeting sequence
ggaggcugaagugggaggau

SEQ ID NO: 35717 - RNA, 20 nt, Artificial Sequence
  CIITA targeting sequence
cagcuacucuggaggcugaa

SEQ ID NO: 35718 - RNA, 20 nt, Artificial Sequence
  CIITA targeting sequence
uacauggcuaauuuuuaaaa

SEQ ID NO: 35719 - RNA, 20 nt, Artificial Sequence
  CIITA targeting sequence
uuuguagaaaaauuagcugg

SEQ ID NO: 35720 - RNA, 20 nt, Artificial Sequence
  CIITA targeting sequence
acaaaugauuuuuuaaaaau

SEQ ID NO: 35721 - RNA, 20 nt, Artificial Sequence
  CIITA targeting sequence
agcuaauuuuucuacaaaug

SEQ ID NO: 35722 - RNA, 20 nt, Artificial Sequence
  CIITA targeting sequence
uacauccagcuaauuuuucu

SEQ ID NO: 35723 - RNA, 20 nt, Artificial Sequence
  CIITA targeting sequence
ccuacauccagcuaauuuuu

SEQ ID NO: 35724 - RNA, 20 nt, Artificial Sequence
  CIITA targeting sequence
cgccauucuccuacauccag

SEQ ID NO: 35725 - RNA, 20 nt, Artificial Sequence
  CIITA targeting sequence
uggguucacgccauucuccu

SEQ ID NO: 35726 - RNA, 20 nt, Artificial Sequence
  CIITA targeting sequence
gccuccuggguucacgccau

SEQ ID NO: 35727 - RNA, 20 nt, Artificial Sequence
  CIITA targeting sequence
cugcaagcuccgccuccugg

SEQ ID NO: 35728 - RNA, 20 nt, Artificial Sequence
  CIITA targeting sequence
uggcucacugcaagcuccgc

SEQ ID NO: 35729 - RNA, 20 nt, Artificial Sequence
  CIITA targeting sequence
agccugggcgaaagagcgcg

SEQ ID NO: 35730 - RNA, 20 nt, Artificial Sequence
  CIITA targeting sequence
cccaggcuggacugcagugg

SEQ ID NO: 35731 - RNA, 20 nt, Artificial Sequence
  CIITA targeting sequence
uucgcccaggcuggacugca

SEQ ID NO: 35732 - RNA, 20 nt, Artificial Sequence
  CIITA targeting sequence
cgcucuuucgcccaggcugg

SEQ ID NO: 35733 - RNA, 20 nt, Artificial Sequence
  CIITA targeting sequence
gucucaaaaaaagaaaaaaa

SEQ ID NO: 35734 - RNA, 20 nt, Artificial Sequence
  CIITA targeting sequence
caaaaaaagaaaaaaagaaa

SEQ ID NO: 35735 - RNA, 20 nt, Artificial Sequence
  CIITA targeting sequence
aaaaaagaaaaaaagaaaag

SEQ ID NO: 35736 - RNA, 20 nt, Artificial Sequence
  CIITA targeting sequence
uuuuuugagacggagucgcg

SEQ ID NO: 35737 - RNA, 20 nt, Artificial Sequence
  CIITA targeting sequence
uuuuuucuuuuuuugagacg

SEQ ID NO: 35738 - RNA, 20 nt, Artificial Sequence
  CIITA targeting sequence
uuucuuuuuuucuuuuuuug

SEQ ID NO: 35739 - RNA, 20 nt, Artificial Sequence
  CIITA targeting sequence
uuucuuuucuuuuuuucuuu

SEQ ID NO: 35740 - RNA, 20 nt, Artificial Sequence
  CIITA targeting sequence
agcuaauuuuucuuuucuuu

SEQ ID NO: 35741 - RNA, 20 nt, Artificial Sequence
  CIITA targeting sequence
cagcugcucgggaggcugag

SEQ ID NO: 35742 - RNA, 20 nt, Artificial Sequence
  CIITA targeting sequence
ggaggcugaggcaggagaau

SEQ ID NO: 35743 - RNA, 20 nt, Artificial Sequence
  CIITA targeting sequence
cgagcagcugggauuacagg

SEQ ID NO: 35744 - RNA, 20 nt, Artificial Sequence
  CIITA targeting sequence
gccucccgagcagcugggau

SEQ ID NO: 35745 - RNA, 20 nt, Artificial Sequence
  CIITA targeting sequence
ugccucagccucccgagcag

SEQ ID NO: 35746 - RNA, 20 nt, Artificial Sequence
  CIITA targeting sequence
ccugccucagccucccgagc

SEQ ID NO: 35747 - RNA, 20 nt, Artificial Sequence
  CIITA targeting sequence
guugaacccagaacccggga

SEQ ID NO: 35748 - RNA, 20 nt, Artificial Sequence
  CIITA targeting sequence
acugauucuccugccucagc

SEQ ID NO: 35749 - RNA, 20 nt, Artificial Sequence
  CIITA targeting sequence
ggguucaacugauucuccug

SEQ ID NO: 35750 - RNA, 20 nt, Artificial Sequence
  CIITA targeting sequence
cggguucuggguucaacuga

SEQ ID NO: 35751 - RNA, 20 nt, Artificial Sequence
  CIITA targeting sequence
gccucccggguucuggguuc

SEQ ID NO: 35752 - RNA, 20 nt, Artificial Sequence
  CIITA targeting sequence
cugcaaccuccgccucccgg

SEQ ID NO: 35753 - RNA, 20 nt, Artificial Sequence
  CIITA targeting sequence
uggcucgcugcaaccuccgc

SEQ ID NO: 35754 - RNA, 20 nt, Artificial Sequence
  CIITA targeting sequence
ugccauugcacucuagccug

SEQ ID NO: 35755 - RNA, 20 nt, Artificial Sequence
  CIITA targeting sequence
agccuggcaauaagagugaa

SEQ ID NO: 35756 - RNA, 20 nt, Artificial Sequence
  CIITA targeting sequence
uauugccaggcuagagugca

SEQ ID NO: 35757 - RNA, 20 nt, Artificial Sequence
  CIITA targeting sequence
cucuuauugccaggcuagag

SEQ ID NO: 35758 - RNA, 20 nt, Artificial Sequence
  CIITA targeting sequence
gucuaaaaaaaaacaaaaac

SEQ ID NO: 35759 - RNA, 20 nt, Artificial Sequence
  CIITA targeting sequence
aaaaaaaaacaaaaacaaac

SEQ ID NO: 35760 - RNA, 20 nt, Artificial Sequence
  CIITA targeting sequence
acaaauuguugggguuuuuu

SEQ ID NO: 35761 - RNA, 20 nt, Artificial Sequence
  CIITA targeting sequence
cuauguugcccaggcuagcc

SEQ ID NO: 35762 - RNA, 20 nt, Artificial Sequence
  CIITA targeting sequence
aacucccggcuucaagcaau

SEQ ID NO: 35763 - RNA, 20 nt, Artificial Sequence
  CIITA targeting sequence
cggcuucaagcaauccuccu

SEQ ID NO: 35764 - RNA, 20 nt, Artificial Sequence
  CIITA targeting sequence
agcaauccuccugcuucggc

SEQ ID NO: 35765 - RNA, 20 nt, Artificial Sequence
  CIITA targeting sequence
uccugcuucggccucccaaa

SEQ ID NO: 35766 - RNA, 20 nt, Artificial Sequence
  CIITA targeting sequence
ugcuucggccucccaaaaug

SEQ ID NO: 35767 - RNA, 20 nt, Artificial Sequence
  CIITA targeting sequence
gccucccaaaauguuggaau

SEQ ID NO: 35768 - RNA, 20 nt, Artificial Sequence
  CIITA targeting sequence
caaaauguuggaauuacagg

SEQ ID NO: 35769 - RNA, 20 nt, Artificial Sequence
  CIITA targeting sequence
aacauuuugggaggccgaag

SEQ ID NO: 35770 - RNA, 20 nt, Artificial Sequence
  CIITA targeting sequence
acuuuauauucaaauaaaac

SEQ ID NO: 35771 - RNA, 20 nt, Artificial Sequence
  CIITA targeting sequence
aauaaaacuuuacgucccau

SEQ ID NO: 35772 - RNA, 20 nt, Artificial Sequence
  CIITA targeting sequence
cauuauaaagggaaaaaaug

SEQ ID NO: 35773 - RNA, 20 nt, Artificial Sequence
  CIITA targeting sequence
cuuuauaaugggacguaaag

SEQ ID NO: 35774 - RNA, 20 nt, Artificial Sequence
  CIITA targeting sequence
uguuuuugccauuuuuuccc

SEQ ID NO: 35775 - RNA, 20 nt, Artificial Sequence
  CIITA targeting sequence
uguuaaaugguuaccuccug

SEQ ID NO: 35776 - RNA, 20 nt, Artificial Sequence
  CIITA targeting sequence
gcuuucuuguuaaaugguua

SEQ ID NO: 35777 - RNA, 20 nt, Artificial Sequence
  CIITA targeting sequence
cucugcuuucuuguuaaaug

SEQ ID NO: 35778 - RNA, 20 nt, Artificial Sequence
  CIITA targeting sequence
aacaucacucugcuuucuug

SEQ ID NO: 35779 - RNA, 20 nt, Artificial Sequence
  CIITA targeting sequence
ugcuauaaucuaacaucacu

SEQ ID NO: 35780 - RNA, 20 nt, Artificial Sequence
  CIITA targeting sequence
acaguaucuugcuauaaucu

SEQ ID NO: 35781 - RNA, 20 nt, Artificial Sequence
  CIITA targeting sequence
acagucaacaguaucuugcu

SEQ ID NO: 35782 - RNA, 20 nt, Artificial Sequence
  CIITA targeting sequence
gaggcuagagagcugcuuuc

SEQ ID NO: 35783 - RNA, 20 nt, Artificial Sequence
  CIITA targeting sequence
gagccuucuacagucaacag

SEQ ID NO: 35784 - RNA, 20 nt, Artificial Sequence
  CIITA targeting sequence
agccucagagccuucuacag

SEQ ID NO: 35785 - RNA, 20 nt, Artificial Sequence
  CIITA targeting sequence
cuagccucagagccuucuac

SEQ ID NO: 35786 - RNA, 20 nt, Artificial Sequence
  CIITA targeting sequence
auaaaacagagugaucauau

SEQ ID NO: 35787 - RNA, 20 nt, Artificial Sequence
  CIITA targeting sequence
guuuuauagaaagcagcucu

SEQ ID NO: 35788 - RNA, 20 nt, Artificial Sequence
  CIITA targeting sequence
cucuguuuuauagaaagcag

SEQ ID NO: 35789 - RNA, 20 nt, Artificial Sequence
  CIITA targeting sequence
uauauuagaagagguguuaa

SEQ ID NO: 35790 - RNA, 20 nt, Artificial Sequence
  CIITA targeting sequence
aauauaugaucacucuguuu

SEQ ID NO: 35791 - RNA, 20 nt, Artificial Sequence
  CIITA targeting sequence
ucuaauauaugaucacucug

SEQ ID NO: 35792 - RNA, 20 nt, Artificial Sequence
  CIITA targeting sequence
uuaacaccucuucuaauaua

SEQ ID NO: 35793 - RNA, 20 nt, Artificial Sequence
  CIITA targeting sequence
caccaagcugagacuuccuc

SEQ ID NO: 35794 - RNA, 20 nt, Artificial Sequence
  CIITA targeting sequence
gcuuggugugaacaugucuu

SEQ ID NO: 35795 - RNA, 20 nt, Artificial Sequence
  CIITA targeting sequence
cagcuuggugugaacauguc

SEQ ID NO: 35796 - RNA, 20 nt, Artificial Sequence
  CIITA targeting sequence
uccuugauaccaccaggagg

SEQ ID NO: 35797 - RNA, 20 nt, Artificial Sequence
  CIITA targeting sequence
uugauaccaccaggaggaug

SEQ ID NO: 35798 - RNA, 20 nt, Artificial Sequence
  CIITA targeting sequence
aggaggaagucucagcuugg

SEQ ID NO: 35799 - RNA, 20 nt, Artificial Sequence
  CIITA targeting sequence
uggugguaucaaggaggaag

SEQ ID NO: 35800 - RNA, 20 nt, Artificial Sequence
  CIITA targeting sequence
uccuggugguaucaaggagg

SEQ ID NO: 35801 - RNA, 20 nt, Artificial Sequence
  CIITA targeting sequence
gcccauccuccuggugguau

SEQ ID NO: 35802 - RNA, 20 nt, Artificial Sequence
  CIITA targeting sequence
cugcccauccuccugguggu

SEQ ID NO: 35803 - RNA, 20 nt, Artificial Sequence
  CIITA targeting sequence
agucucugcccauccuccug

SEQ ID NO: 35804 - RNA, 20 nt, Artificial Sequence
  CIITA targeting sequence
uuuccagucucugcccaucc

SEQ ID NO: 35805 - RNA, 20 nt, Artificial Sequence
  CIITA targeting sequence
cccuaugggagucaguauua

SEQ ID NO: 35806 - RNA, 20 nt, Artificial Sequence
  CIITA targeting sequence
cuaugggagucaguauuauu

SEQ ID NO: 35807 - RNA, 20 nt, Artificial Sequence
  CIITA targeting sequence
cauagggagaaaguuagugu

SEQ ID NO: 35808 - RNA, 20 nt, Artificial Sequence
  CIITA targeting sequence
guauuauuuagcaucacuuu

SEQ ID NO: 35809 - RNA, 20 nt, Artificial Sequence
  CIITA targeting sequence
cuuuggcgggucaccccaaa

SEQ ID NO: 35810 - RNA, 20 nt, Artificial Sequence
  CIITA targeting sequence
ccccaaaccaucugacuaca

SEQ ID NO: 35811 - RNA, 20 nt, Artificial Sequence
  CIITA targeting sequence
gacuacaaggguaccauauu

SEQ ID NO: 35812 - RNA, 20 nt, Artificial Sequence
  CIITA targeting sequence
gaugguuuggggugacccgc

SEQ ID NO: 35813 - RNA, 20 nt, Artificial Sequence
  CIITA targeting sequence
uuugguauaauuuauguuuu

SEQ ID NO: 35814 - RNA, 20 nt, Artificial Sequence
  CIITA targeting sequence
aaugucuugggaugaaaaug

SEQ ID NO: 35815 - RNA, 20 nt, Artificial Sequence
  CIITA targeting sequence
ugggaugaaaaugacaggug

SEQ ID NO: 35816 - RNA, 20 nt, Artificial Sequence
  CIITA targeting sequence
caagacauuggacuaaaaca

SEQ ID NO: 35817 - RNA, 20 nt, Artificial Sequence
  CIITA targeting sequence
ucccaagacauuggacuaaa

SEQ ID NO: 35818 - RNA, 20 nt, Artificial Sequence
  CIITA targeting sequence
uuuucaucccaagacauugg

SEQ ID NO: 35819 - RNA, 20 nt, Artificial Sequence
  CIITA targeting sequence
uaaguggcccaccugucauu

SEQ ID NO: 35820 - RNA, 20 nt, Artificial Sequence
  CIITA targeting sequence
ccagagaaauucagggcaau

SEQ ID NO: 35821 - RNA, 20 nt, Artificial Sequence
  CIITA targeting sequence
agagaaauucagggcaauuu

SEQ ID NO: 35822 - RNA, 20 nt, Artificial Sequence
  CIITA targeting sequence
ggagaucauaaguggcccac

SEQ ID NO: 35823 - RNA, 20 nt, Artificial Sequence
  CIITA targeting sequence
cuggagaucauaaguggccc

SEQ ID NO: 35824 - RNA, 20 nt, Artificial Sequence
  CIITA targeting sequence
gggcaauuuggugugggagu

SEQ ID NO: 35825 - RNA, 20 nt, Artificial Sequence
  CIITA targeting sequence
cacaccaaauugcccugaau

SEQ ID NO: 35826 - RNA, 20 nt, Artificial Sequence
  CIITA targeting sequence
accaugccuacucccacacc

SEQ ID NO: 35827 - RNA, 20 nt, Artificial Sequence
  CIITA targeting sequence
ucuaccaugccuacucccac

SEQ ID NO: 35828 - RNA, 20 nt, Artificial Sequence
  CIITA targeting sequence
ccucuaccaugccuacuccc

SEQ ID NO: 35829 - RNA, 20 nt, Artificial Sequence
  CIITA targeting sequence
aagaaguccccagcagaggc

SEQ ID NO: 35830 - RNA, 20 nt, Artificial Sequence
  CIITA targeting sequence
uagaugcugcucuccucuac

SEQ ID NO: 35831 - RNA, 20 nt, Artificial Sequence
  CIITA targeting sequence
ccagcagaggcucucagcuu

SEQ ID NO: 35832 - RNA, 20 nt, Artificial Sequence
  CIITA targeting sequence
gcuggggacuucuuagaugc

SEQ ID NO: 35833 - RNA, 20 nt, Artificial Sequence
  CIITA targeting sequence
cagcuugucuugaggcaucu

SEQ ID NO: 35834 - RNA, 20 nt, Artificial Sequence
  CIITA targeting sequence
gcuugucuugaggcaucugg

SEQ ID NO: 35835 - RNA, 20 nt, Artificial Sequence
  CIITA targeting sequence
ugaggcaucugggcggaggg

SEQ ID NO: 35836 - RNA, 20 nt, Artificial Sequence
  CIITA targeting sequence
agacaagcugagagccucug

SEQ ID NO: 35837 - RNA, 20 nt, Artificial Sequence
  CIITA targeting sequence
gggcggagggcuaugauacu

SEQ ID NO: 35838 - RNA, 20 nt, Artificial Sequence
  CIITA targeting sequence
gcccagaugccucaagacaa

SEQ ID NO: 35839 - RNA, 20 nt, Artificial Sequence
  CIITA targeting sequence
uagcccuccgcccagaugcc

SEQ ID NO: 35840 - RNA, 20 nt, Artificial Sequence
  CIITA targeting sequence
ugcagaagguggcagauauu

SEQ ID NO: 35841 - RNA, 20 nt, Artificial Sequence
  CIITA targeting sequence
gcaggauggggccaguauca

SEQ ID NO: 35842 - RNA, 20 nt, Artificial Sequence
  CIITA targeting sequence
gccaccuucugcaggauggg

SEQ ID NO: 35843 - RNA, 20 nt, Artificial Sequence
  CIITA targeting sequence
auugugaucaucauuucuga

SEQ ID NO: 35844 - RNA, 20 nt, Artificial Sequence
  CIITA targeting sequence
caauggaaccgcacuggugc

SEQ ID NO: 35845 - RNA, 20 nt, Artificial Sequence
  CIITA targeting sequence
ucauuucugaacgucagacu

SEQ ID NO: 35846 - RNA, 20 nt, Artificial Sequence
  CIITA targeting sequence
uuucugaacgucagacuguu

SEQ ID NO: 35847 - RNA, 20 nt, Artificial Sequence
  CIITA targeting sequence
gaacgucagacuguugaagg

SEQ ID NO: 35848 - RNA, 20 nt, Artificial Sequence
  CIITA targeting sequence
gaaaugaugaucacaaugga

SEQ ID NO: 35849 - RNA, 20 nt, Artificial Sequence
  CIITA targeting sequence
gacuguugaagguuccccca

SEQ ID NO: 35850 - RNA, 20 nt, Artificial Sequence
  CIITA targeting sequence
gacguucagaaaugaugauc

SEQ ID NO: 35851 - RNA, 20 nt, Artificial Sequence
  CIITA targeting sequence
acagucugacguucagaaau

SEQ ID NO: 35852 - RNA, 20 nt, Artificial Sequence
  CIITA targeting sequence
cccaacagacuuucugugca

SEQ ID NO: 35853 - RNA, 20 nt, Artificial Sequence
  CIITA targeting sequence
guugggggaaccuucaacag

SEQ ID NO: 35854 - RNA, 20 nt, Artificial Sequence
  CIITA targeting sequence
gugcaacuuucugucuucac

SEQ ID NO: 35855 - RNA, 20 nt, Artificial Sequence
  CIITA targeting sequence
gucuucaccaaauucagucc

SEQ ID NO: 35856 - RNA, 20 nt, Artificial Sequence
  CIITA targeting sequence
ucaccaaauucaguccacag

SEQ ID NO: 35857 - RNA, 20 nt, Artificial Sequence
  CIITA targeting sequence
ccaaauucaguccacaguaa

SEQ ID NO: 35858 - RNA, 20 nt, Artificial Sequence
  CIITA targeting sequence
guccacaguaaggaagugaa

SEQ ID NO: 35859 - RNA, 20 nt, Artificial Sequence
  CIITA targeting sequence
acaguaaggaagugaaauua

SEQ ID NO: 35860 - RNA, 20 nt, Artificial Sequence
  CIITA targeting sequence
uuacuguggacugaauuugg

SEQ ID NO: 35861 - RNA, 20 nt, Artificial Sequence
  CIITA targeting sequence
cuuccuuacuguggacugaa

SEQ ID NO: 35862 - RNA, 20 nt, Artificial Sequence
  CIITA targeting sequence
gagguguggggagggcuuaa

SEQ ID NO: 35863 - RNA, 20 nt, Artificial Sequence
  CIITA targeting sequence
gaaauuaauuucacuuccuu

SEQ ID NO: 35864 - RNA, 20 nt, Artificial Sequence
  CIITA targeting sequence
ccacaccucugaaauuaauu

SEQ ID NO: 35865 - RNA, 20 nt, Artificial Sequence
  CIITA targeting sequence
cuuaagcccuccccacaccu

SEQ ID NO: 35866 - RNA, 20 nt, Artificial Sequence
  CIITA targeting sequence
aauuuuaccacacucccuua

SEQ ID NO: 35867 - RNA, 20 nt, Artificial Sequence
  CIITA targeting sequence
gaaacagaaaucugaccgcu

SEQ ID NO: 35868 - RNA, 20 nt, Artificial Sequence
  CIITA targeting sequence
gaacacccucuaauuuuacc

SEQ ID NO: 35869 - RNA, 20 nt, Artificial Sequence
  CIITA targeting sequence
guuucugaacacccucuaau

SEQ ID NO: 35870 - RNA, 20 nt, Artificial Sequence
  CIITA targeting sequence
gaccgcuuggggccaccuug

SEQ ID NO: 35871 - RNA, 20 nt, Artificial Sequence
  CIITA targeting sequence
gauuucuguuucugaacacc

SEQ ID NO: 35872 - RNA, 20 nt, Artificial Sequence
  CIITA targeting sequence
cugcaagguggccccaagcg

SEQ ID NO: 35873 - RNA, 20 nt, Artificial Sequence
  CIITA targeting sequence
cccugcaagguggccccaag

SEQ ID NO: 35874 - RNA, 20 nt, Artificial Sequence
  CIITA targeting sequence
aaaaaacucucccugcaagg

SEQ ID NO: 35875 - RNA, 20 nt, Artificial Sequence
  CIITA targeting sequence
ucaaaaaaacucucccugca

SEQ ID NO: 35876 - RNA, 20 nt, Artificial Sequence
  CIITA targeting sequence
cucacuuguuucuuugcaug

SEQ ID NO: 35877 - RNA, 20 nt, Artificial Sequence
  CIITA targeting sequence
cuuguuucuuugcauguugg

SEQ ID NO: 35878 - RNA, 20 nt, Artificial Sequence
  CIITA targeting sequence
uugcauguuggcuuagcuug

SEQ ID NO: 35879 - RNA, 20 nt, Artificial Sequence
  CIITA targeting sequence
caacuggugacugguuagug

SEQ ID NO: 35880 - RNA, 20 nt, Artificial Sequence
  CIITA targeting sequence
ccaguugggagcccgccaag

SEQ ID NO: 35881 - RNA, 20 nt, Artificial Sequence
  CIITA targeting sequence
cuaaccagucaccaguuggg

SEQ ID NO: 35882 - RNA, 20 nt, Artificial Sequence
  CIITA targeting sequence
ucacuaaccagucaccaguu

SEQ ID NO: 35883 - RNA, 20 nt, Artificial Sequence
  CIITA targeting sequence
cuagccucaucacuaaccag

SEQ ID NO: 35884 - RNA, 20 nt, Artificial Sequence
  CIITA targeting sequence
ucacuagccucaucacuaac

SEQ ID NO: 35885 - RNA, 20 nt, Artificial Sequence
  CIITA targeting sequence
gagcugggcauccgaaggca

SEQ ID NO: 35886 - RNA, 20 nt, Artificial Sequence
  CIITA targeting sequence
gaagcacacagccucaucac

SEQ ID NO: 35887 - RNA, 20 nt, Artificial Sequence
  CIITA targeting sequence
gaaggcauccuuggggaagc

SEQ ID NO: 35888 - RNA, 20 nt, Artificial Sequence
  CIITA targeting sequence
gaugcccagcucagaagcac

SEQ ID NO: 35889 - RNA, 20 nt, Artificial Sequence
  CIITA targeting sequence
uuggggaagcugagggcacg

SEQ ID NO: 35890 - RNA, 20 nt, Artificial Sequence
  CIITA targeting sequence
ccaaggaugccuucggaugc

SEQ ID NO: 35891 - RNA, 20 nt, Artificial Sequence
  CIITA targeting sequence
gcuuccccaaggaugccuuc

SEQ ID NO: 35892 - RNA, 20 nt, Artificial Sequence
  CIITA targeting sequence
ugcccucagcuuccccaagg

SEQ ID NO: 35893 - RNA, 20 nt, Artificial Sequence
  CIITA targeting sequence
ucgugcccucagcuucccca

SEQ ID NO: 35894 - RNA, 20 nt, Artificial Sequence
  CIITA targeting sequence
ggcagccccuccucgugccc

SEQ ID NO: 35895 - RNA, 20 nt, Artificial Sequence
  CIITA targeting sequence
gggagcugcugccuggcugg

SEQ ID NO: 35896 - RNA, 20 nt, Artificial Sequence
  CIITA targeting sequence
cggagucuggcagccccucc

SEQ ID NO: 35897 - RNA, 20 nt, Artificial Sequence
  CIITA targeting sequence
cagccaggcagcagcucccg

SEQ ID NO: 35898 - RNA, 20 nt, Artificial Sequence
  CIITA targeting sequence
uacacaaugcguugccuggc

SEQ ID NO: 35899 - RNA, 20 nt, Artificial Sequence
  CIITA targeting sequence
acgcccugcuggguccuacc

SEQ ID NO: 35900 - RNA, 20 nt, Artificial Sequence
  CIITA targeting sequence
uaccugucagagccccaagg

SEQ ID NO: 35901 - RNA, 20 nt, Artificial Sequence
  CIITA targeting sequence
gagccccaagguaaaaaggc

SEQ ID NO: 35902 - RNA, 20 nt, Artificial Sequence
  CIITA targeting sequence
gacagguaggacccagcagg

SEQ ID NO: 35903 - RNA, 20 nt, Artificial Sequence
  CIITA targeting sequence
cggccuuuuuaccuuggggc

SEQ ID NO: 35904 - RNA, 20 nt, Artificial Sequence
  CIITA targeting sequence
uaauuuagcgugcagucuca

SEQ ID NO: 35905 - RNA, 20 nt, Artificial Sequence
  CIITA targeting sequence
cagcugguccugccauucca

SEQ ID NO: 35906 - RNA, 20 nt, Artificial Sequence
  CIITA targeting sequence
gcugguccugccauuccaga

SEQ ID NO: 35907 - RNA, 20 nt, Artificial Sequence
  CIITA targeting sequence
ugccauuccagauaaacaga

SEQ ID NO: 35908 - RNA, 20 nt, Artificial Sequence
  CIITA targeting sequence
agauaaacagagaaaccauu

SEQ ID NO: 35909 - RNA, 20 nt, Artificial Sequence
  CIITA targeting sequence
ggaauggcaggaccagcuga

SEQ ID NO: 35910 - RNA, 20 nt, Artificial Sequence
  CIITA targeting sequence
guuuaucuggaauggcagga

SEQ ID NO: 35911 - RNA, 20 nt, Artificial Sequence
  CIITA targeting sequence
cuguuuaucuggaauggcag

SEQ ID NO: 35912 - RNA, 20 nt, Artificial Sequence
  CIITA targeting sequence
gaauuggggaugggggugag

SEQ ID NO: 35913 - RNA, 20 nt, Artificial Sequence
  CIITA targeting sequence
gaaugguuucucuguuuauc

SEQ ID NO: 35914 - RNA, 20 nt, Artificial Sequence
  CIITA targeting sequence
ccaauucagaaugguuucuc

SEQ ID NO: 35915 - RNA, 20 nt, Artificial Sequence
  CIITA targeting sequence
cccccauccccaauucagaa

SEQ ID NO: 35916 - RNA, 20 nt, Artificial Sequence
  CIITA targeting sequence
ucacccccauccccaauuca

SEQ ID NO: 35917 - RNA, 20 nt, Artificial Sequence
  CIITA targeting sequence
cauccucacccccaucccca

SEQ ID NO: 35918 - RNA, 20 nt, Artificial Sequence
  CIITA targeting sequence
uguucccauccucaccccca

SEQ ID NO: 35919 - RNA, 20 nt, Artificial Sequence
  CIITA targeting sequence
guguccugcuggggcaggcc

SEQ ID NO: 35920 - RNA, 20 nt, Artificial Sequence
  CIITA targeting sequence
ugcuggggcaggccauugga

SEQ ID NO: 35921 - RNA, 20 nt, Artificial Sequence
  CIITA targeting sequence
aauggccugccccagcagga

SEQ ID NO: 35922 - RNA, 20 nt, Artificial Sequence
  CIITA targeting sequence
uccaauggccugccccagca

SEQ ID NO: 35923 - RNA, 20 nt, Artificial Sequence
  CIITA targeting sequence
caucuuccaauggccugccc

SEQ ID NO: 35924 - RNA, 20 nt, Artificial Sequence
  CIITA targeting sequence
uucacaucuuccaauggccu

SEQ ID NO: 35925 - RNA, 20 nt, Artificial Sequence
  CIITA targeting sequence
auuuccuuccaccggaggga

SEQ ID NO: 35926 - RNA, 20 nt, Artificial Sequence
  CIITA targeting sequence
uuccaccggagggagacuuc

SEQ ID NO: 35927 - RNA, 20 nt, Artificial Sequence
  CIITA targeting sequence
accggagggagacuucaggu

SEQ ID NO: 35928 - RNA, 20 nt, Artificial Sequence
  CIITA targeting sequence
gguggaaggaaauagacaac

SEQ ID NO: 35929 - RNA, 20 nt, Artificial Sequence
  CIITA targeting sequence
cuccgguggaaggaaauaga

SEQ ID NO: 35930 - RNA, 20 nt, Artificial Sequence
  CIITA targeting sequence
cccuccgguggaaggaaaua

SEQ ID NO: 35931 - RNA, 20 nt, Artificial Sequence
  CIITA targeting sequence
ggucagccaggugucuggag

SEQ ID NO: 35932 - RNA, 20 nt, Artificial Sequence
  CIITA targeting sequence
gccaggugucuggaguauga

SEQ ID NO: 35933 - RNA, 20 nt, Artificial Sequence
  CIITA targeting sequence
ggaguaugaaccauguauca

SEQ ID NO: 35934 - RNA, 20 nt, Artificial Sequence
  CIITA targeting sequence
agacaccuggcugaccugaa

SEQ ID NO: 35935 - RNA, 20 nt, Artificial Sequence
  CIITA targeting sequence
uacuccagacaccuggcuga

SEQ ID NO: 35936 - RNA, 20 nt, Artificial Sequence
  CIITA targeting sequence
gcaccgaaagguucuagaag

SEQ ID NO: 35937 - RNA, 20 nt, Artificial Sequence
  CIITA targeting sequence
gugcugauacaugguucaua

SEQ ID NO: 35938 - RNA, 20 nt, Artificial Sequence
  CIITA targeting sequence
agaagucagacuuucgggca

SEQ ID NO: 35939 - RNA, 20 nt, Artificial Sequence
  CIITA targeting sequence
agaaccuuucggugcugaua

SEQ ID NO: 35940 - RNA, 20 nt, Artificial Sequence
  CIITA targeting sequence
gacuuucgggcaguguguca

SEQ ID NO: 35941 - RNA, 20 nt, Artificial Sequence
  CIITA targeting sequence
gacuucuagaaccuuucggu

SEQ ID NO: 35942 - RNA, 20 nt, Artificial Sequence
  CIITA targeting sequence
ggcagugugucacuaacucu

SEQ ID NO: 35943 - RNA, 20 nt, Artificial Sequence
  CIITA targeting sequence
cuaacucucagcaugcuggc

SEQ ID NO: 35944 - RNA, 20 nt, Artificial Sequence
  CIITA targeting sequence
cagcaugcuggccuggcucg

SEQ ID NO: 35945 - RNA, 20 nt, Artificial Sequence
  CIITA targeting sequence
gcaugcuggccuggcucggc

SEQ ID NO: 35946 - RNA, 20 nt, Artificial Sequence
  CIITA targeting sequence
gcccacagcaaggucuucuc

SEQ ID NO: 35947 - RNA, 20 nt, Artificial Sequence
  CIITA targeting sequence
ucucgccucccuuuggguaa

SEQ ID NO: 35948 - RNA, 20 nt, Artificial Sequence
  CIITA targeting sequence
cgccucccuuuggguaaaua

SEQ ID NO: 35949 - RNA, 20 nt, Artificial Sequence
  CIITA targeting sequence
ccucccuuuggguaaauacu

SEQ ID NO: 35950 - RNA, 20 nt, Artificial Sequence
  CIITA targeting sequence
cuuuggguaaauacugaggg

SEQ ID NO: 35951 - RNA, 20 nt, Artificial Sequence
  CIITA targeting sequence
guauuuacccaaagggaggc

SEQ ID NO: 35952 - RNA, 20 nt, Artificial Sequence
  CIITA targeting sequence
gcaggacgggaccucugcca

SEQ ID NO: 35953 - RNA, 20 nt, Artificial Sequence
  CIITA targeting sequence
ugcagaggcaccccucagua

SEQ ID NO: 35954 - RNA, 20 nt, Artificial Sequence
  CIITA targeting sequence
cguccugcagaggcaccccu

SEQ ID NO: 35955 - RNA, 20 nt, Artificial Sequence
  CIITA targeting sequence
gccagacuccacuccauacc

SEQ ID NO: 35956 - RNA, 20 nt, Artificial Sequence
  CIITA targeting sequence
ggcagaggucccguccugca

SEQ ID NO: 35957 - RNA, 20 nt, Artificial Sequence
  CIITA targeting sequence
acuccauacccagagaagca

SEQ ID NO: 35958 - RNA, 20 nt, Artificial Sequence
  CIITA targeting sequence
auacccagagaagcagggaa

SEQ ID NO: 35959 - RNA, 20 nt, Artificial Sequence
  CIITA targeting sequence
ggguauggaguggagucugg

SEQ ID NO: 35960 - RNA, 20 nt, Artificial Sequence
  CIITA targeting sequence
cuggguauggaguggagucu

SEQ ID NO: 35961 - RNA, 20 nt, Artificial Sequence
  CIITA targeting sequence
cugcuucucuggguauggag

SEQ ID NO: 35962 - RNA, 20 nt, Artificial Sequence
  CIITA targeting sequence
aauuuugguuucccugcuuc

SEQ ID NO: 35963 - RNA, 20 nt, Artificial Sequence
  CIITA targeting sequence
gccuugagguguagcuguug

SEQ ID NO: 35964 - RNA, 20 nt, Artificial Sequence
  CIITA targeting sequence
aggcugacuccaauuuuggu

SEQ ID NO: 35965 - RNA, 20 nt, Artificial Sequence
  CIITA targeting sequence
acagcuacaccucaaggcug

SEQ ID NO: 35966 - RNA, 20 nt, Artificial Sequence
  CIITA targeting sequence
gcagcuggggagagcuggcg

SEQ ID NO: 35967 - RNA, 20 nt, Artificial Sequence
  CIITA targeting sequence
ccagcugcugagggcucaac

SEQ ID NO: 35968 - RNA, 20 nt, Artificial Sequence
  CIITA targeting sequence
ccccagcugcugagggcuca

SEQ ID NO: 35969 - RNA, 20 nt, Artificial Sequence
  CIITA targeting sequence
gccagcucuccccagcugcu

SEQ ID NO: 35970 - RNA, 20 nt, Artificial Sequence
  CIITA targeting sequence
ccccaguuuccuaauggugu

SEQ ID NO: 35971 - RNA, 20 nt, Artificial Sequence
  CIITA targeting sequence
uaaugguguuguuuaaaaag

SEQ ID NO: 35972 - RNA, 20 nt, Artificial Sequence
  CIITA targeting sequence
ggggacgggggaacagaugg

SEQ ID NO: 35973 - RNA, 20 nt, Artificial Sequence
  CIITA targeting sequence
ccugacccuuuuuaaacaac

SEQ ID NO: 35974 - RNA, 20 nt, Artificial Sequence
  CIITA targeting sequence
cccguccccugacccuuuuu

SEQ ID NO: 35975 - RNA, 20 nt, Artificial Sequence
  CIITA targeting sequence
guucccccguccccugaccc

SEQ ID NO: 35976 - RNA, 20 nt, Artificial Sequence
  CIITA targeting sequence
caccaucuguucccccgucc

SEQ ID NO: 35977 - RNA, 20 nt, Artificial Sequence
  CIITA targeting sequence
ucccaccaucuguucccccg

SEQ ID NO: 35978 - RNA, 20 nt, Artificial Sequence
  CIITA targeting sequence
gcacugugcucuucccacca

SEQ ID NO: 35979 - RNA, 20 nt, Artificial Sequence
  CIITA targeting sequence
gaaggcagcauggcagcuac

SEQ ID NO: 35980 - RNA, 20 nt, Artificial Sequence
  CIITA targeting sequence
gagccggugccaggugucug

SEQ ID NO: 35981 - RNA, 20 nt, Artificial Sequence
  CIITA targeting sequence
cagccaacgguguagcugcc

SEQ ID NO: 35982 - RNA, 20 nt, Artificial Sequence
  CIITA targeting sequence
ggggcacacccuucccagcc

SEQ ID NO: 35983 - RNA, 20 nt, Artificial Sequence
  CIITA targeting sequence
ucaggggcacacccuuccca

SEQ ID NO: 35984 - RNA, 20 nt, Artificial Sequence
  CIITA targeting sequence
uuuacauucucgagucaauu

SEQ ID NO: 35985 - RNA, 20 nt, Artificial Sequence
  CIITA targeting sequence
cgagucaauuuuccuggagu

SEQ ID NO: 35986 - RNA, 20 nt, Artificial Sequence
  CIITA targeting sequence
agucaauuuuccuggagugu

SEQ ID NO: 35987 - RNA, 20 nt, Artificial Sequence
  CIITA targeting sequence
agaauguaaacgacuucuuc

SEQ ID NO: 35988 - RNA, 20 nt, Artificial Sequence
  CIITA targeting sequence
auuuuccuggaguguacaau

SEQ ID NO: 35989 - RNA, 20 nt, Artificial Sequence
  CIITA targeting sequence
uggaguguacaauggaccug

SEQ ID NO: 35990 - RNA, 20 nt, Artificial Sequence
  CIITA targeting sequence
aggaaaauugacucgagaau

SEQ ID NO: 35991 - RNA, 20 nt, Artificial Sequence
  CIITA targeting sequence
auuguacacuccaggaaaau

SEQ ID NO: 35992 - RNA, 20 nt, Artificial Sequence
  CIITA targeting sequence
cacagguccauuguacacuc

SEQ ID NO: 35993 - RNA, 20 nt, Artificial Sequence
  CIITA targeting sequence
uacaggcuuucccacagguc

SEQ ID NO: 35994 - RNA, 20 nt, Artificial Sequence
  CIITA targeting sequence
uuacccuuucauacaggcuu

SEQ ID NO: 35995 - RNA, 20 nt, Artificial Sequence
  CIITA targeting sequence
ucauuacccuuucauacagg

SEQ ID NO: 35996 - RNA, 20 nt, Artificial Sequence
  CIITA targeting sequence
cucaucauuacccuuucaua

SEQ ID NO: 35997 - RNA, 20 nt, Artificial Sequence
  CIITA targeting sequence
aauauuuuauaggaacugga

SEQ ID NO: 35998 - RNA, 20 nt, Artificial Sequence
  CIITA targeting sequence
uauaaaauauuggacacugu

SEQ ID NO: 35999 - RNA, 20 nt, Artificial Sequence
  CIITA targeting sequence
aguuccuauaaaauauugga

SEQ ID NO: 36000 - RNA, 20 nt, Artificial Sequence
  CIITA targeting sequence
auuccaguuccuauaaaaua

SEQ ID NO: 36001 - RNA, 20 nt, Artificial Sequence
  CIITA targeting sequence
uaggagcucaauuuuauugg

SEQ ID NO: 36002 - RNA, 20 nt, Artificial Sequence
  CIITA targeting sequence
uaugagcucaauuccaguuc

SEQ ID NO: 36003 - RNA, 20 nt, Artificial Sequence
  CIITA targeting sequence
auuuuauuggcauugcuguu

SEQ ID NO: 36004 - RNA, 20 nt, Artificial Sequence
  CIITA targeting sequence
aacaacagcaaugccaauaa

SEQ ID NO: 36005 - RNA, 20 nt, Artificial Sequence
  CIITA targeting sequence
cuuuucucagacuccccuga

SEQ ID NO: 36006 - RNA, 20 nt, Artificial Sequence
  CIITA targeting sequence
cagacuccccugaaauguau

SEQ ID NO: 36007 - RNA, 20 nt, Artificial Sequence
  CIITA targeting sequence
gacuccccugaaauguaugg

SEQ ID NO: 36008 - RNA, 20 nt, Artificial Sequence
  CIITA targeting sequence
gagaaaagggauaccacccc

SEQ ID NO: 36009 - RNA, 20 nt, Artificial Sequence
  CIITA targeting sequence
ccugaaauguaugguuugcu

SEQ ID NO: 36010 - RNA, 20 nt, Artificial Sequence
  CIITA targeting sequence
ggggagucugagaaaaggga

SEQ ID NO: 36011 - RNA, 20 nt, Artificial Sequence
  CIITA targeting sequence
aagcaaaccauacauuucag

SEQ ID NO: 36012 - RNA, 20 nt, Artificial Sequence
  CIITA targeting sequence
ggguucaaagcaaaccauac

SEQ ID NO: 36013 - RNA, 20 nt, Artificial Sequence
  CIITA targeting sequence
cuggguucaaagcaaaccau

SEQ ID NO: 36014 - RNA, 20 nt, Artificial Sequence
  CIITA targeting sequence
gucucuggguucaaagcaaa

SEQ ID NO: 36015 - RNA, 20 nt, Artificial Sequence
  CIITA targeting sequence
ucagucucuggguucaaagc

SEQ ID NO: 36016 - RNA, 20 nt, Artificial Sequence
  CIITA targeting sequence
gccggugugguugggugcag

SEQ ID NO: 36017 - RNA, 20 nt, Artificial Sequence
  CIITA targeting sequence
cguagcaacuuaaggcugca

SEQ ID NO: 36018 - RNA, 20 nt, Artificial Sequence
  CIITA targeting sequence
aacacuuucccguagcaacu

SEQ ID NO: 36019 - RNA, 20 nt, Artificial Sequence
  CIITA targeting sequence
cccuccaacacuuucccgua

SEQ ID NO: 36020 - RNA, 20 nt, Artificial Sequence
  CIITA targeting sequence
cccccuccaacacuuucccg

SEQ ID NO: 36021 - RNA, 20 nt, Artificial Sequence
  CIITA targeting sequence
gagguaaccuugcccccucc

SEQ ID NO: 36022 - RNA, 20 nt, Artificial Sequence
  CIITA targeting sequence
gacuucucccccuccaacac

SEQ ID NO: 36023 - RNA, 20 nt, Artificial Sequence
  CIITA targeting sequence
cucaauuccagaugaggaaa

SEQ ID NO: 36024 - RNA, 20 nt, Artificial Sequence
  CIITA targeting sequence
auuccagaugaggaaauuca

SEQ ID NO: 36025 - RNA, 20 nt, Artificial Sequence
  CIITA targeting sequence
agaugaggaaauucaggccu

SEQ ID NO: 36026 - RNA, 20 nt, Artificial Sequence
  CIITA targeting sequence
ggaauugagggagggggcaa

SEQ ID NO: 36027 - RNA, 20 nt, Artificial Sequence
  CIITA targeting sequence
ucuggaauugagggaggggg

SEQ ID NO: 36028 - RNA, 20 nt, Artificial Sequence
  CIITA targeting sequence
ucaucuggaauugagggagg

SEQ ID NO: 36029 - RNA, 20 nt, Artificial Sequence
  CIITA targeting sequence
ggccugaaaagggaaaguga

SEQ ID NO: 36030 - RNA, 20 nt, Artificial Sequence
  CIITA targeting sequence
ggccugaauuuccucaucug

SEQ ID NO: 36031 - RNA, 20 nt, Artificial Sequence
  CIITA targeting sequence
cuuuucaggccugaauuucc

SEQ ID NO: 36032 - RNA, 20 nt, Artificial Sequence
  CIITA targeting sequence
cuuucccuuuucaggccuga

SEQ ID NO: 36033 - RNA, 20 nt, Artificial Sequence
  CIITA targeting sequence
aagucucaugccuuggagga

SEQ ID NO: 36034 - RNA, 20 nt, Artificial Sequence
  CIITA targeting sequence
caugccuuggaggacccagc

SEQ ID NO: 36035 - RNA, 20 nt, Artificial Sequence
  CIITA targeting sequence
ugccuuggaggacccagcag

SEQ ID NO: 36036 - RNA, 20 nt, Artificial Sequence
  CIITA targeting sequence
aaggcaugagacuuugaggu

SEQ ID NO: 36037 - RNA, 20 nt, Artificial Sequence
  CIITA targeting sequence
uccaaggcaugagacuuuga

SEQ ID NO: 36038 - RNA, 20 nt, Artificial Sequence
  CIITA targeting sequence
ugcuggguccuccaaggcau

SEQ ID NO: 36039 - RNA, 20 nt, Artificial Sequence
  CIITA targeting sequence
aagaccucugaaaaggaccg

SEQ ID NO: 36040 - RNA, 20 nt, Artificial Sequence
  CIITA targeting sequence
uggauuccugcuggguccuc

SEQ ID NO: 36041 - RNA, 20 nt, Artificial Sequence
  CIITA targeting sequence
gaaaaggaccggcagggcuc

SEQ ID NO: 36042 - RNA, 20 nt, Artificial Sequence
  CIITA targeting sequence
gaggucuuggauuccugcug

SEQ ID NO: 36043 - RNA, 20 nt, Artificial Sequence
  CIITA targeting sequence
uuuucagaggucuuggauuc

SEQ ID NO: 36044 - RNA, 20 nt, Artificial Sequence
  CIITA targeting sequence
ugccacggcugggggugugg

SEQ ID NO: 36045 - RNA, 20 nt, Artificial Sequence
  CIITA targeting sequence
ugguaacacagguuuuccau

SEQ ID NO: 36046 - RNA, 20 nt, Artificial Sequence
  CIITA targeting sequence
auccauggaagguaccugag

SEQ ID NO: 36047 - RNA, 20 nt, Artificial Sequence
  CIITA targeting sequence
auggaagguaccugagggau

SEQ ID NO: 36048 - RNA, 20 nt, Artificial Sequence
  CIITA targeting sequence
auggauggaaaaccuguguu

SEQ ID NO: 36049 - RNA, 20 nt, Artificial Sequence
  CIITA targeting sequence
gguaccuuccauggauggaa

SEQ ID NO: 36050 - RNA, 20 nt, Artificial Sequence
  CIITA targeting sequence
cucagguaccuuccauggau

SEQ ID NO: 36051 - RNA, 20 nt, Artificial Sequence
  CIITA targeting sequence
cuuccucccuagggccagca

SEQ ID NO: 36052 - RNA, 20 nt, Artificial Sequence
  CIITA targeting sequence
uccucccuagggccagcauc

SEQ ID NO: 36053 - RNA, 20 nt, Artificial Sequence
  CIITA targeting sequence
ucccuagggccagcaucaga

SEQ ID NO: 36054 - RNA, 20 nt, Artificial Sequence
  CIITA targeting sequence
cuagggccagcaucagagga

SEQ ID NO: 36055 - RNA, 20 nt, Artificial Sequence
  CIITA targeting sequence
gaggagugaauagcucaguu

SEQ ID NO: 36056 - RNA, 20 nt, Artificial Sequence
  CIITA targeting sequence
gaugcuggcccuagggagga

SEQ ID NO: 36057 - RNA, 20 nt, Artificial Sequence
  CIITA targeting sequence
ucugaugcuggcccuaggga

SEQ ID NO: 36058 - RNA, 20 nt, Artificial Sequence
  CIITA targeting sequence
cuccucugaugcuggcccua

SEQ ID NO: 36059 - RNA, 20 nt, Artificial Sequence
  CIITA targeting sequence
guuagcucaucucaggggcc

SEQ ID NO: 36060 - RNA, 20 nt, Artificial Sequence
  CIITA targeting sequence
ucucaggggccaugugcccu

SEQ ID NO: 36061 - RNA, 20 nt, Artificial Sequence
  CIITA targeting sequence
caggggccaugugcccucgg

SEQ ID NO: 36062 - RNA, 20 nt, Artificial Sequence
  CIITA targeting sequence
ggggccaugugcccucggag

SEQ ID NO: 36063 - RNA, 20 nt, Artificial Sequence
  CIITA targeting sequence
gaggugguuugccacuuuca

SEQ ID NO: 36064 - RNA, 20 nt, Artificial Sequence
  CIITA targeting sequence
gagggcacauggccccugag

SEQ ID NO: 36065 - RNA, 20 nt, Artificial Sequence
  CIITA targeting sequence
cgguuggacugaguuggaga

SEQ ID NO: 36066 - RNA, 20 nt, Artificial Sequence
  CIITA targeting sequence
aaccgugaaaguggcaaacc

SEQ ID NO: 36067 - RNA, 20 nt, Artificial Sequence
  CIITA targeting sequence
guccaaccgugaaaguggca

SEQ ID NO: 36068 - RNA, 20 nt, Artificial Sequence
  CIITA targeting sequence
aacucaguccaaccgugaaa

SEQ ID NO: 36069 - RNA, 20 nt, Artificial Sequence
  CIITA targeting sequence
ccaacucaguccaaccguga

SEQ ID NO: 36070 - RNA, 20 nt, Artificial Sequence
  CIITA targeting sequence
cuccaacucaguccaaccgu

SEQ ID NO: 36071 - RNA, 20 nt, Artificial Sequence
  CIITA targeting sequence
guuucucuccaacucagucc

SEQ ID NO: 36072 - RNA, 20 nt, Artificial Sequence
  CIITA targeting sequence
cuguuucucuccaacucagu

SEQ ID NO: 36073 - RNA, 20 nt, Artificial Sequence
  CIITA targeting sequence
ccaccccugggugggucucu

SEQ ID NO: 36074 - RNA, 20 nt, Artificial Sequence
  CIITA targeting sequence
cugcaacucaggacuugcag

SEQ ID NO: 36075 - RNA, 20 nt, Artificial Sequence
  CIITA targeting sequence
ggacuugcagaucacuugcc

SEQ ID NO: 36076 - RNA, 20 nt, Artificial Sequence
  CIITA targeting sequence
ugaguugcagggagcuuguc

SEQ ID NO: 36077 - RNA, 20 nt, Artificial Sequence
  CIITA targeting sequence
gcaaguccugaguugcaggg

SEQ ID NO: 36078 - RNA, 20 nt, Artificial Sequence
  CIITA targeting sequence
cuugcccaaguggcucccua

SEQ ID NO: 36079 - RNA, 20 nt, Artificial Sequence
  CIITA targeting sequence
cuagcuccuggcuccuggcc

SEQ ID NO: 36080 - RNA, 20 nt, Artificial Sequence
  CIITA targeting sequence
uggcuccuggcccggggccu

SEQ ID NO: 36081 - RNA, 20 nt, Artificial Sequence
  CIITA targeting sequence
uggcccggggccugggacuc

SEQ ID NO: 36082 - RNA, 20 nt, Artificial Sequence
  CIITA targeting sequence
caggccccgggccaggagcc

SEQ ID NO: 36083 - RNA, 20 nt, Artificial Sequence
  CIITA targeting sequence
ccccgaaguggggcuggcca

SEQ ID NO: 36084 - RNA, 20 nt, Artificial Sequence
  CIITA targeting sequence
ccgaaguggggcuggccacu

SEQ ID NO: 36085 - RNA, 20 nt, Artificial Sequence
  CIITA targeting sequence
gggagagucccaggccccgg

SEQ ID NO: 36086 - RNA, 20 nt, Artificial Sequence
  CIITA targeting sequence
caguggccagccccacuucg

SEQ ID NO: 36087 - RNA, 20 nt, Artificial Sequence
  CIITA targeting sequence
ucacaguggccagccccacu

SEQ ID NO: 36088 - RNA, 20 nt, Artificial Sequence
  CIITA targeting sequence
guuccucacaguggccagcc

SEQ ID NO: 36089 - RNA, 20 nt, Artificial Sequence
  CIITA targeting sequence
agucgguuccucacaguggc

SEQ ID NO: 36090 - RNA, 20 nt, Artificial Sequence
  CIITA targeting sequence
cugccuccagucgguuccuc

SEQ ID NO: 36091 - RNA, 20 nt, Artificial Sequence
  CIITA targeting sequence
uggaugccccaggcaguugg

SEQ ID NO: 36092 - RNA, 20 nt, Artificial Sequence
  CIITA targeting sequence
aagaggucccugccuccagu

SEQ ID NO: 36093 - RNA, 20 nt, Artificial Sequence
  CIITA targeting sequence
caacugccuggggcauccaa

SEQ ID NO: 36094 - RNA, 20 nt, Artificial Sequence
  CIITA targeting sequence
gauaaagcacgugguggcca

SEQ ID NO: 36095 - RNA, 20 nt, Artificial Sequence
  CIITA targeting sequence
gaaguggcaucccaacugcc

SEQ ID NO: 36096 - RNA, 20 nt, Artificial Sequence
  CIITA targeting sequence
acagccuggcccgagcucag

SEQ ID NO: 36097 - RNA, 20 nt, Artificial Sequence
  CIITA targeting sequence
ggccaggcuguggagcaacc

SEQ ID NO: 36098 - RNA, 20 nt, Artificial Sequence
  CIITA targeting sequence
gcgcugcagaaagaaaguga

SEQ ID NO: 36099 - RNA, 20 nt, Artificial Sequence
  CIITA targeting sequence
gcagcgcugagcucgggcca

SEQ ID NO: 36100 - RNA, 20 nt, Artificial Sequence
  CIITA targeting sequence
uucugcagcgcugagcucgg

SEQ ID NO: 36101 - RNA, 20 nt, Artificial Sequence
  CIITA targeting sequence
cuuucuuucugcagcgcuga

SEQ ID NO: 36102 - RNA, 20 nt, Artificial Sequence
  CIITA targeting sequence
cuuucacuuucuuucugcag

SEQ ID NO: 36103 - RNA, 20 nt, Artificial Sequence
  CIITA targeting sequence
uuuucccuuucacuuucuuu

SEQ ID NO: 36104 - RNA, 20 nt, Artificial Sequence
  CIITA targeting sequence
ccgcaguucuuuuucccuuu

SEQ ID NO: 36105 - RNA, 20 nt, Artificial Sequence
  CIITA targeting sequence
ccgccuccccgcaguucuuu

SEQ ID NO: 36106 - RNA, 20 nt, Artificial Sequence
  CIITA targeting sequence
uaccuccccgccuccccgca

SEQ ID NO: 36107 - RNA, 20 nt, Artificial Sequence
  CIITA targeting sequence
uccuaccuccccgccucccc

SEQ ID NO: 36108 - RNA, 20 nt, Artificial Sequence
  CIITA targeting sequence
gcuggucauccuaccucccc

SEQ ID NO: 36109 - RNA, 20 nt, Artificial Sequence
  CIITA targeting sequence
uccgcuggucauccuaccuc

SEQ ID NO: 36110 - RNA, 20 nt, Artificial Sequence
  CIITA targeting sequence
guggcagcucguccgcuggu

SEQ ID NO: 36111 - RNA, 20 nt, Artificial Sequence
  CIITA targeting sequence
ggggccgcggcaagucugug

SEQ ID NO: 36112 - RNA, 20 nt, Artificial Sequence
  CIITA targeting sequence
cgccagcucuggggccgcgg

SEQ ID NO: 36113 - RNA, 20 nt, Artificial Sequence
  CIITA targeting sequence
cucccgccagcucuggggcc

SEQ ID NO: 36114 - RNA, 20 nt, Artificial Sequence
  CIITA targeting sequence
cccucccgccagcucugggg

SEQ ID NO: 36115 - RNA, 20 nt, Artificial Sequence
  CIITA targeting sequence
cgcgcgcgcugcugguggcc

SEQ ID NO: 36116 - RNA, 20 nt, Artificial Sequence
  CIITA targeting sequence
ccgggcucccgcgcgcgcug

SEQ ID NO: 36117 - RNA, 20 nt, Artificial Sequence
  CIITA targeting sequence
ccuaccgcuguuccccgggc

SEQ ID NO: 36118 - RNA, 20 nt, Artificial Sequence
  CIITA targeting sequence
ccucuguaaccccuaagguc

SEQ ID NO: 36119 - RNA, 20 nt, Artificial Sequence
  CIITA targeting sequence
ucuguaaccccuaaggucgg

SEQ ID NO: 36120 - RNA, 20 nt, Artificial Sequence
  CIITA targeting sequence
guaaccccuaaggucgggcu

SEQ ID NO: 36121 - RNA, 20 nt, Artificial Sequence
  CIITA targeting sequence
ggcugagaaucgaggcuccg

SEQ ID NO: 36122 - RNA, 20 nt, Artificial Sequence
  CIITA targeting sequence
gcccgaccuuagggguuaca

SEQ ID NO: 36123 - RNA, 20 nt, Artificial Sequence
  CIITA targeting sequence
cagcccgaccuuagggguua

SEQ ID NO: 36124 - RNA, 20 nt, Artificial Sequence
  CIITA targeting sequence
aggcuccgagacugucagcu

SEQ ID NO: 36125 - RNA, 20 nt, Artificial Sequence
  CIITA targeting sequence
auucucagcccgaccuuagg

SEQ ID NO: 36126 - RNA, 20 nt, Artificial Sequence
  CIITA targeting sequence
gagacugucagcuacuugcu

SEQ ID NO: 36127 - RNA, 20 nt, Artificial Sequence
  CIITA targeting sequence
gagccucgauucucagcccg

SEQ ID NO: 36128 - RNA, 20 nt, Artificial Sequence
  CIITA targeting sequence
cggagccucgauucucagcc

SEQ ID NO: 36129 - RNA, 20 nt, Artificial Sequence
  CIITA targeting sequence
gcuacuugcucaaggucaca

SEQ ID NO: 36130 - RNA, 20 nt, Artificial Sequence
  CIITA targeting sequence
aggucacacagcaagucugg

SEQ ID NO: 36131 - RNA, 20 nt, Artificial Sequence
  CIITA targeting sequence
cacagcaagucugggaggau

SEQ ID NO: 36132 - RNA, 20 nt, Artificial Sequence
  CIITA targeting sequence
gggaggauggggggauggaa

SEQ ID NO: 36133 - RNA, 20 nt, Artificial Sequence
  CIITA targeting sequence
cagacuugcugugugaccuu

SEQ ID NO: 36134 - RNA, 20 nt, Artificial Sequence
  CIITA targeting sequence
ucccagacuugcugugugac

SEQ ID NO: 36135 - RNA, 20 nt, Artificial Sequence
  CIITA targeting sequence
ccccauccucccagacuugc

SEQ ID NO: 36136 - RNA, 20 nt, Artificial Sequence
  CIITA targeting sequence
auccccccauccucccagac

SEQ ID NO: 36137 - RNA, 20 nt, Artificial Sequence
  CIITA targeting sequence
cggcccuacauuuugcauau

SEQ ID NO: 36138 - RNA, 20 nt, Artificial Sequence
  CIITA targeting sequence
uuuccagcauccccgcaacg

SEQ ID NO: 36139 - RNA, 20 nt, Artificial Sequence
  CIITA targeting sequence
agcauccccgcaacgacucu

SEQ ID NO: 36140 - RNA, 20 nt, Artificial Sequence
  CIITA targeting sequence
ccgcaacgacucugcgcggg

SEQ ID NO: 36141 - RNA, 20 nt, Artificial Sequence
  CIITA targeting sequence
uugcggggaugcuggaaacg

SEQ ID NO: 36142 - RNA, 20 nt, Artificial Sequence
  CIITA targeting sequence
gcgcgggaaccaggagccgg

SEQ ID NO: 36143 - RNA, 20 nt, Artificial Sequence
  CIITA targeting sequence
cgcgcagagucguugcgggg

SEQ ID NO: 36144 - RNA, 20 nt, Artificial Sequence
  CIITA targeting sequence
ugguucccgcgcagagucgu

SEQ ID NO: 36145 - RNA, 20 nt, Artificial Sequence
  CIITA targeting sequence
cggcuccugguucccgcgca

SEQ ID NO: 36146 - RNA, 20 nt, Artificial Sequence
  CIITA targeting sequence
ggguucccggcuccugguuc

SEQ ID NO: 36147 - RNA, 20 nt, Artificial Sequence
  CIITA targeting sequence
gggcacagcaagccaagcuc

SEQ ID NO: 36148 - RNA, 20 nt, Artificial Sequence
  CIITA targeting sequence
ggggccgugggcggguggca

SEQ ID NO: 36149 - RNA, 20 nt, Artificial Sequence
  CIITA targeting sequence
ugccacccgcccacggcccc

SEQ ID NO: 36150 - RNA, 20 nt, Artificial Sequence
  CIITA targeting sequence
gcagagaagccggagcgcag

SEQ ID NO: 36151 - RNA, 20 nt, Artificial Sequence
  CIITA targeting sequence
gcagaagcugccgccaggcu

SEQ ID NO: 36152 - RNA, 20 nt, Artificial Sequence
  CIITA targeting sequence
cugcagaagcugccgccagg

SEQ ID NO: 36153 - RNA, 20 nt, Artificial Sequence
  CIITA targeting sequence
ggcuucucugcagaagcugc

SEQ ID NO: 36154 - RNA, 20 nt, Artificial Sequence
  CIITA targeting sequence
gcgcuccggcuucucugcag

SEQ ID NO: 36155 - RNA, 20 nt, Artificial Sequence
  CIITA targeting sequence
cagucugcgcuccggcuucu

SEQ ID NO: 36156 - RNA, 20 nt, Artificial Sequence
  CIITA targeting sequence
gcgcucccagucugcgcucc

SEQ ID NO: 36157 - RNA, 20 nt, Artificial Sequence
  CIITA targeting sequence
gcuccgcgcucccagucugc

SEQ ID NO: 36158 - RNA, 20 nt, Artificial Sequence
  CIITA targeting sequence
cccggccacccuuggccgac

SEQ ID NO: 36159 - RNA, 20 nt, Artificial Sequence
  CIITA targeting sequence
gccaaggguggccgggggag

SEQ ID NO: 36160 - RNA, 20 nt, Artificial Sequence
  CIITA targeting sequence
gcgcgcccgggauccugcag

SEQ ID NO: 36161 - RNA, 20 nt, Artificial Sequence
  CIITA targeting sequence
cgggcgcgcggagucggcca

SEQ ID NO: 36162 - RNA, 20 nt, Artificial Sequence
  CIITA targeting sequence
ugcagaggugcgcgcccuuc

SEQ ID NO: 36163 - RNA, 20 nt, Artificial Sequence
  CIITA targeting sequence
gcaggaucccgggcgcgcgg

SEQ ID NO: 36164 - RNA, 20 nt, Artificial Sequence
  CIITA targeting sequence
uguacgccagacuuuggacc

SEQ ID NO: 36165 - RNA, 20 nt, Artificial Sequence
  CIITA targeting sequence
ggcguacaagaagggcgcgc

SEQ ID NO: 36166 - RNA, 20 nt, Artificial Sequence
  CIITA targeting sequence
aaagucuggcguacaagaag

SEQ ID NO: 36167 - RNA, 20 nt, Artificial Sequence
  CIITA targeting sequence
cugagcuucacuuucccugu

SEQ ID NO: 36168 - RNA, 20 nt, Artificial Sequence
  CIITA targeting sequence
gggaacggcggcccuggucc

SEQ ID NO: 36169 - RNA, 20 nt, Artificial Sequence
  CIITA targeting sequence
cuuucccuguugggucauau

SEQ ID NO: 36170 - RNA, 20 nt, Artificial Sequence
  CIITA targeting sequence
cuguugggucauauuccauc

SEQ ID NO: 36171 - RNA, 20 nt, Artificial Sequence
  CIITA targeting sequence
uauuccaucucuaacucugg

SEQ ID NO: 36172 - RNA, 20 nt, Artificial Sequence
  CIITA targeting sequence
aucucuaacucuggaaucuu

SEQ ID NO: 36173 - RNA, 20 nt, Artificial Sequence
  CIITA targeting sequence
cuaacucuggaaucuugggu

SEQ ID NO: 36174 - RNA, 20 nt, Artificial Sequence
  CIITA targeting sequence
aacucuggaaucuuggguau

SEQ ID NO: 36175 - RNA, 20 nt, Artificial Sequence
  CIITA targeting sequence
ggaaucuuggguauugggcu

SEQ ID NO: 36176 - RNA, 20 nt, Artificial Sequence
  CIITA targeting sequence
agaguuagagauggaauaug

SEQ ID NO: 36177 - RNA, 20 nt, Artificial Sequence
  CIITA targeting sequence
uggguauugggcucuccagg

SEQ ID NO: 36178 - RNA, 20 nt, Artificial Sequence
  CIITA targeting sequence
ccaggcggggggcccugcuc

SEQ ID NO: 36179 - RNA, 20 nt, Artificial Sequence
  CIITA targeting sequence
aggcggggggcccugcucag

SEQ ID NO: 36180 - RNA, 20 nt, Artificial Sequence
  CIITA targeting sequence
gggaggcaguagggagccaa

SEQ ID NO: 36181 - RNA, 20 nt, Artificial Sequence
  CIITA targeting sequence
cugagcagggccccccgccu

SEQ ID NO: 36182 - RNA, 20 nt, Artificial Sequence
  CIITA targeting sequence
cuacugccucccugagcagg

SEQ ID NO: 36183 - RNA, 20 nt, Artificial Sequence
  CIITA targeting sequence
gguuaaagguuuggcucccu

SEQ ID NO: 36184 - RNA, 20 nt, Artificial Sequence
  CIITA targeting sequence
ucugguuaaagguuuggcuc

SEQ ID NO: 36185 - RNA, 20 nt, Artificial Sequence
  CIITA targeting sequence
cauccucugguuaaagguuu

SEQ ID NO: 36186 - RNA, 20 nt, Artificial Sequence
  CIITA targeting sequence
ucaacucucguugaacaucu

SEQ ID NO: 36187 - RNA, 20 nt, Artificial Sequence
  CIITA targeting sequence
acucucguugaacaucuugg

SEQ ID NO: 36188 - RNA, 20 nt, Artificial Sequence
  CIITA targeting sequence
cguugaacaucuuggcgaag

SEQ ID NO: 36189 - RNA, 20 nt, Artificial Sequence
  CIITA targeting sequence
uugaacaucuuggcgaaggu

SEQ ID NO: 36190 - RNA, 20 nt, Artificial Sequence
  CIITA targeting sequence
acgagaguugaggacuuauc

SEQ ID NO: 36191 - RNA, 20 nt, Artificial Sequence
  CIITA targeting sequence
uggcgaagguguguguuguu

SEQ ID NO: 36192 - RNA, 20 nt, Artificial Sequence
  CIITA targeting sequence
ccaagauguucaacgagagu

SEQ ID NO: 36193 - RNA, 20 nt, Artificial Sequence
  CIITA targeting sequence
caacaacacacaccuucgcc

SEQ ID NO: 36194 - RNA, 20 nt, Artificial Sequence
  CIITA targeting sequence
cccaccccucccaacaacac

SEQ ID NO: 36195 - RNA, 20 nt, Artificial Sequence
  CIITA targeting sequence
cucccccaccccucccaaca

SEQ ID NO: 36196 - RNA, 20 nt, Artificial Sequence
  CIITA targeting sequence
ccccggacugaaccgaucuc

SEQ ID NO: 36197 - RNA, 20 nt, Artificial Sequence
  CIITA targeting sequence
ggggggaucccucccccacc

SEQ ID NO: 36198 - RNA, 20 nt, Artificial Sequence
  CIITA targeting sequence
guccggggggaucccucccc

SEQ ID NO: 36199 - RNA, 20 nt, Artificial Sequence
  CIITA targeting sequence
guucaguccggggggauccc

SEQ ID NO: 36200 - RNA, 20 nt, Artificial Sequence
  CIITA targeting sequence
cuugaucucucacuucucua

SEQ ID NO: 36201 - RNA, 20 nt, Artificial Sequence
  CIITA targeting sequence
ugaucucucacuucucuacc

SEQ ID NO: 36202 - RNA, 20 nt, Artificial Sequence
  CIITA targeting sequence
agagaucgguucaguccggg

SEQ ID NO: 36203 - RNA, 20 nt, Artificial Sequence
  CIITA targeting sequence
cucacuucucuaccucgcuu

SEQ ID NO: 36204 - RNA, 20 nt, Artificial Sequence
  CIITA targeting sequence
cacuucucuaccucgcuuug

SEQ ID NO: 36205 - RNA, 20 nt, Artificial Sequence
  CIITA targeting sequence
cuucucuaccucgcuuuggg

SEQ ID NO: 36206 - RNA, 20 nt, Artificial Sequence
  CIITA targeting sequence
cuaccucgcuuuggggcccu

SEQ ID NO: 36207 - RNA, 20 nt, Artificial Sequence
  CIITA targeting sequence
accucgcuuuggggcccuga

SEQ ID NO: 36208 - RNA, 20 nt, Artificial Sequence
  CIITA targeting sequence
cuuuggggcccugagucaca

SEQ ID NO: 36209 - RNA, 20 nt, Artificial Sequence
  CIITA targeting sequence
gggccccaaagcgagguaga

SEQ ID NO: 36210 - RNA, 20 nt, Artificial Sequence
  CIITA targeting sequence
cacccucuaaggagagaggc

SEQ ID NO: 36211 - RNA, 20 nt, Artificial Sequence
  CIITA targeting sequence
aaggagagaggcuaaagcgc

SEQ ID NO: 36212 - RNA, 20 nt, Artificial Sequence
  CIITA targeting sequence
uuagagggugugacucaggg

SEQ ID NO: 36213 - RNA, 20 nt, Artificial Sequence
  CIITA targeting sequence
ccuuagagggugugacucag

SEQ ID NO: 36214 - RNA, 20 nt, Artificial Sequence
  CIITA targeting sequence
cuccuuagagggugugacuc

SEQ ID NO: 36215 - RNA, 20 nt, Artificial Sequence
  CIITA targeting sequence
ggggcgcuuuagccucucuc

SEQ ID NO: 36216 - RNA, 20 nt, Artificial Sequence
  CIITA targeting sequence
cacgcuggcuuuccggggcg

SEQ ID NO: 36217 - RNA, 20 nt, Artificial Sequence
  CIITA targeting sequence
caccccggcauucgcacgcu

SEQ ID NO: 36218 - RNA, 20 nt, Artificial Sequence
  CIITA targeting sequence
cacucccaccccggcauucg

SEQ ID NO: 36219 - RNA, 20 nt, Artificial Sequence
  CIITA targeting sequence
cccacucccaccccggcauu

SEQ ID NO: 36220 - RNA, 20 nt, Artificial Sequence
  CIITA targeting sequence
aaucucccacucccaccccg

SEQ ID NO: 36221 - RNA, 20 nt, Artificial Sequence
  CIITA targeting sequence
cccugggguccaggaaagcc

SEQ ID NO: 36222 - RNA, 20 nt, Artificial Sequence
  CIITA targeting sequence
cugggguccaggaaagccgg

SEQ ID NO: 36223 - RNA, 20 nt, Artificial Sequence
  CIITA targeting sequence
aggaaagccggaaucggagc

SEQ ID NO: 36224 - RNA, 20 nt, Artificial Sequence
  CIITA targeting sequence
uggaccccagggagauccaa

SEQ ID NO: 36225 - RNA, 20 nt, Artificial Sequence
  CIITA targeting sequence
ggcuuuccuggaccccaggg

SEQ ID NO: 36226 - RNA, 20 nt, Artificial Sequence
  CIITA targeting sequence
gagccaccaugcuuagcuua

SEQ ID NO: 36227 - RNA, 20 nt, Artificial Sequence
  CIITA targeting sequence
gauuccggcuuuccuggacc

SEQ ID NO: 36228 - RNA, 20 nt, Artificial Sequence
  CIITA targeting sequence
ggaacucuuaaaagccgcgg

SEQ ID NO: 36229 - RNA, 20 nt, Artificial Sequence
  CIITA targeting sequence
agacuaagcuaagcauggug

SEQ ID NO: 36230 - RNA, 20 nt, Artificial Sequence
  CIITA targeting sequence
uaaaagccgcgguccuccug

SEQ ID NO: 36231 - RNA, 20 nt, Artificial Sequence
  CIITA targeting sequence
uccugagucccacagccccu

SEQ ID NO: 36232 - RNA, 20 nt, Artificial Sequence
  CIITA targeting sequence
ugagucccacagccccucuc

SEQ ID NO: 36233 - RNA, 20 nt, Artificial Sequence
  CIITA targeting sequence
ggaggaccgcggcuuuuaag

SEQ ID NO: 36234 - RNA, 20 nt, Artificial Sequence
  CIITA targeting sequence
cacagccccucuccacccua

SEQ ID NO: 36235 - RNA, 20 nt, Artificial Sequence
  CIITA targeting sequence
ccacccuagguggcacagga

SEQ ID NO: 36236 - RNA, 20 nt, Artificial Sequence
  CIITA targeting sequence
acccuagguggcacaggaga

SEQ ID NO: 36237 - RNA, 20 nt, Artificial Sequence
  CIITA targeting sequence
ugugccaccuaggguggaga

SEQ ID NO: 36238 - RNA, 20 nt, Artificial Sequence
  CIITA targeting sequence
ccugugccaccuagggugga

SEQ ID NO: 36239 - RNA, 20 nt, Artificial Sequence
  CIITA targeting sequence
aggcuuuugccaccucuccu

SEQ ID NO: 36240 - RNA, 20 nt, Artificial Sequence
  CIITA targeting sequence
aggcauggcucccuccccag

SEQ ID NO: 36241 - RNA, 20 nt, Artificial Sequence
  CIITA targeting sequence
cuccccagccgcagccugga

SEQ ID NO: 36242 - RNA, 20 nt, Artificial Sequence
  CIITA targeting sequence
ccagccgcagccuggagugu

SEQ ID NO: 36243 - RNA, 20 nt, Artificial Sequence
  CIITA targeting sequence
aggcugcggcuggggaggga

SEQ ID NO: 36244 - RNA, 20 nt, Artificial Sequence
  CIITA targeting sequence
aacuuuggcaggaagucuuc

SEQ ID NO: 36245 - RNA, 20 nt, Artificial Sequence
  CIITA targeting sequence
ugccaaaguuagacacucca

SEQ ID NO: 36246 - RNA, 20 nt, Artificial Sequence
  CIITA targeting sequence
uccguuucugcuccccacuc

SEQ ID NO: 36247 - RNA, 20 nt, Artificial Sequence
  CIITA targeting sequence
guuucugcuccccacuccag

SEQ ID NO: 36248 - RNA, 20 nt, Artificial Sequence
  CIITA targeting sequence
gcuccccacuccagagaaaa

SEQ ID NO: 36249 - RNA, 20 nt, Artificial Sequence
  CIITA targeting sequence
ccacuccagagaaaaaauaa

SEQ ID NO: 36250 - RNA, 20 nt, Artificial Sequence
  CIITA targeting sequence
agagaaaaaauaaauaaaua

SEQ ID NO: 36251 - RNA, 20 nt, Artificial Sequence
  CIITA targeting sequence
ggaguggggagcagaaacgg

SEQ ID NO: 36252 - RNA, 20 nt, Artificial Sequence
  CIITA targeting sequence
cuggaguggggagcagaaac

SEQ ID NO: 36253 - RNA, 20 nt, Artificial Sequence
  CIITA targeting sequence
ccggagugagauuaaggaaa

SEQ ID NO: 36254 - RNA, 20 nt, Artificial Sequence
  CIITA targeting sequence
ggagugagauuaaggaaaca

SEQ ID NO: 36255 - RNA, 20 nt, Artificial Sequence
  CIITA targeting sequence
ggagaaguauuuauuuauuu

SEQ ID NO: 36256 - RNA, 20 nt, Artificial Sequence
  CIITA targeting sequence
cuccggagaaguauuuauuu

SEQ ID NO: 36257 - RNA, 20 nt, Artificial Sequence
  CIITA targeting sequence
cacuccggagaaguauuuau

SEQ ID NO: 36258 - RNA, 20 nt, Artificial Sequence
  CIITA targeting sequence
uuaaucucacuccggagaag

SEQ ID NO: 36259 - RNA, 20 nt, Artificial Sequence
  CIITA targeting sequence
uccucuuggagaaagaggag

SEQ ID NO: 36260 - RNA, 20 nt, Artificial Sequence
  CIITA targeting sequence
ucuuggagaaagaggagcca

SEQ ID NO: 36261 - RNA, 20 nt, Artificial Sequence
  CIITA targeting sequence
uggagaaagaggagccaaag

SEQ ID NO: 36262 - RNA, 20 nt, Artificial Sequence
  CIITA targeting sequence
aagaggaagaaguaccuguu

SEQ ID NO: 36263 - RNA, 20 nt, Artificial Sequence
  CIITA targeting sequence
ccaagaggaagaaguaccug

SEQ ID NO: 36264 - RNA, 20 nt, Artificial Sequence
  CIITA targeting sequence
uucuccaagaggaagaagua

SEQ ID NO: 36265 - RNA, 20 nt, Artificial Sequence
  CIITA targeting sequence
ucuuucuccaagaggaagaa

SEQ ID NO: 36266 - RNA, 20 nt, Artificial Sequence
  CIITA targeting sequence
uuuggcuccucuuucuccaa

SEQ ID NO: 36267 - RNA, 20 nt, Artificial Sequence
  CIITA targeting sequence
aguuccuuuggcuccucuuu

SEQ ID NO: 36268 - RNA, 20 nt, Artificial Sequence
  CIITA targeting sequence
aacaaaugaucaccuugcaa

SEQ ID NO: 36269 - RNA, 20 nt, Artificial Sequence
  CIITA targeting sequence
uuuguuggagucaaguuccu

SEQ ID NO: 36270 - RNA, 20 nt, Artificial Sequence
  CIITA targeting sequence
ccuugcaaacccccggcucc

SEQ ID NO: 36271 - RNA, 20 nt, Artificial Sequence
  CIITA targeting sequence
cuuaggggaugaccuggucu

SEQ ID NO: 36272 - RNA, 20 nt, Artificial Sequence
  CIITA targeting sequence
ccuaagggagccggggguuu

SEQ ID NO: 36273 - RNA, 20 nt, Artificial Sequence
  CIITA targeting sequence
uccccuaagggagccggggg

SEQ ID NO: 36274 - RNA, 20 nt, Artificial Sequence
  CIITA targeting sequence
ccaacaaucucagagcguuu

SEQ ID NO: 36275 - RNA, 20 nt, Artificial Sequence
  CIITA targeting sequence
aacaaucucagagcguuugg

SEQ ID NO: 36276 - RNA, 20 nt, Artificial Sequence
  CIITA targeting sequence
cagagcguuuggaggcaggg

SEQ ID NO: 36277 - RNA, 20 nt, Artificial Sequence
  CIITA targeting sequence
gagcguuuggaggcaggguc

SEQ ID NO: 36278 - RNA, 20 nt, Artificial Sequence
  CIITA targeting sequence
gagauuguuggagaccaggu

SEQ ID NO: 36279 - RNA, 20 nt, Artificial Sequence
  CIITA targeting sequence
aaacgcucugagauuguugg

SEQ ID NO: 36280 - RNA, 20 nt, Artificial Sequence
  CIITA targeting sequence
uuggagaugacugagugggg

SEQ ID NO: 36281 - RNA, 20 nt, Artificial Sequence
  CIITA targeting sequence
aaagacccugccuccaaacg

SEQ ID NO: 36282 - RNA, 20 nt, Artificial Sequence
  CIITA targeting sequence
ccaaagacccugccuccaaa

SEQ ID NO: 36283 - RNA, 20 nt, Artificial Sequence
  CIITA targeting sequence
ucuccaaagacccugccucc

SEQ ID NO: 36284 - RNA, 20 nt, Artificial Sequence
  CIITA targeting sequence
gucaucuccaaagacccugc

SEQ ID NO: 36285 - RNA, 20 nt, Artificial Sequence
  CIITA targeting sequence
ccacucagucaucuccaaag

SEQ ID NO: 36286 - RNA, 20 nt, Artificial Sequence
  CIITA targeting sequence
caggcuccccacacaugaac

SEQ ID NO: 36287 - RNA, 20 nt, Artificial Sequence
  CIITA targeting sequence
ccacacaugaacaucaccug

SEQ ID NO: 36288 - RNA, 20 nt, Artificial Sequence
  CIITA targeting sequence
uguguggggagccugggauu

SEQ ID NO: 36289 - RNA, 20 nt, Artificial Sequence
  CIITA targeting sequence
ccugggaugaucaaccuguu

SEQ ID NO: 36290 - RNA, 20 nt, Artificial Sequence
  CIITA targeting sequence
caggugauguucaugugugg

SEQ ID NO: 36291 - RNA, 20 nt, Artificial Sequence
  CIITA targeting sequence
ucccaggugauguucaugug

SEQ ID NO: 36292 - RNA, 20 nt, Artificial Sequence
  CIITA targeting sequence
accuguucaggauguagguu

SEQ ID NO: 36293 - RNA, 20 nt, Artificial Sequence
  CIITA targeting sequence
ggauguagguucccgggcuc

SEQ ID NO: 36294 - RNA, 20 nt, Artificial Sequence
  CIITA targeting sequence
ugaacagguugaucauccca

SEQ ID NO: 36295 - RNA, 20 nt, Artificial Sequence
  CIITA targeting sequence
cgggcucacccccaggcccg

SEQ ID NO: 36296 - RNA, 20 nt, Artificial Sequence
  CIITA targeting sequence
cccccaggcccgguuggcua

SEQ ID NO: 36297 - RNA, 20 nt, Artificial Sequence
  CIITA targeting sequence
ccccaggccuagccaaccgg

SEQ ID NO: 36298 - RNA, 20 nt, Artificial Sequence
  CIITA targeting sequence
gccucaccccaggccuagcc

SEQ ID NO: 36299 - RNA, 20 nt, Artificial Sequence
  CIITA targeting sequence
cagccucaccccaggccuag

SEQ ID NO: 36300 - RNA, 20 nt, Artificial Sequence
  CIITA targeting sequence
ugcagguuaaaccaucuauc

SEQ ID NO: 36301 - RNA, 20 nt, Artificial Sequence
  CIITA targeting sequence
aucccaggugacuccaaugu

SEQ ID NO: 36302 - RNA, 20 nt, Artificial Sequence
  CIITA targeting sequence
caggugacuccaauguucgu

SEQ ID NO: 36303 - RNA, 20 nt, Artificial Sequence
  CIITA targeting sequence
ccugggauagaugguuuaac

SEQ ID NO: 36304 - RNA, 20 nt, Artificial Sequence
  CIITA targeting sequence
aauguucguuuguggggcaa

SEQ ID NO: 36305 - RNA, 20 nt, Artificial Sequence
  CIITA targeting sequence
uuuguggggcaaaagucccu

SEQ ID NO: 36306 - RNA, 20 nt, Artificial Sequence
  CIITA targeting sequence
cucaagucagagacacuggg

SEQ ID NO: 36307 - RNA, 20 nt, Artificial Sequence
  CIITA targeting sequence
agucagagacacugggaggc

SEQ ID NO: 36308 - RNA, 20 nt, Artificial Sequence
  CIITA targeting sequence
gagacacugggaggcgcuga

SEQ ID NO: 36309 - RNA, 20 nt, Artificial Sequence
  CIITA targeting sequence
gacuugagggacuuuugccc

SEQ ID NO: 36310 - RNA, 20 nt, Artificial Sequence
  CIITA targeting sequence
cugacuugagggacuuuugc

SEQ ID NO: 36311 - RNA, 20 nt, Artificial Sequence
  CIITA targeting sequence
cagugucucugacuugaggg

SEQ ID NO: 36312 - RNA, 20 nt, Artificial Sequence
  CIITA targeting sequence
gcgccucccagugucucuga

SEQ ID NO: 36313 - RNA, 20 nt, Artificial Sequence
  CIITA targeting sequence
caucucuuuacucucucccu

SEQ ID NO: 36314 - RNA, 20 nt, Artificial Sequence
  CIITA targeting sequence
ucucuuuacucucucccugu

SEQ ID NO: 36315 - RNA, 20 nt, Artificial Sequence
  CIITA targeting sequence
cuuuacucucucccuguuac

SEQ ID NO: 36316 - RNA, 20 nt, Artificial Sequence
  CIITA targeting sequence
uuacucucucccuguuacaa

SEQ ID NO: 36317 - RNA, 20 nt, Artificial Sequence
  CIITA targeting sequence
cucccuguuacaaaaccucu

SEQ ID NO: 36318 - RNA, 20 nt, Artificial Sequence
  CIITA targeting sequence
cccuguuacaaaaccucuau

SEQ ID NO: 36319 - RNA, 20 nt, Artificial Sequence
  CIITA targeting sequence
cuguuacaaaaccucuauca

SEQ ID NO: 36320 - RNA, 20 nt, Artificial Sequence
  CIITA targeting sequence
aucagaaaaggaguaccagg

SEQ ID NO: 36321 - RNA, 20 nt, Artificial Sequence
  CIITA targeting sequence
gaaaaggaguaccaggaggu

SEQ ID NO: 36322 - RNA, 20 nt, Artificial Sequence
  CIITA targeting sequence
gauagagguuuuguaacagg

SEQ ID NO: 36323 - RNA, 20 nt, Artificial Sequence
  CIITA targeting sequence
uuuucugauagagguuuugu

SEQ ID NO: 36324 - RNA, 20 nt, Artificial Sequence
  CIITA targeting sequence
ugguacuccuuuucugauag

SEQ ID NO: 36325 - RNA, 20 nt, Artificial Sequence
  CIITA targeting sequence
gcaaacugcuugcuaugugg

SEQ ID NO: 36326 - RNA, 20 nt, Artificial Sequence
  CIITA targeting sequence
ugcgucugcaaacugcuugc

SEQ ID NO: 36327 - RNA, 20 nt, Artificial Sequence
  CIITA targeting sequence
aauccugcgucugcaaacug

SEQ ID NO: 36328 - RNA, 20 nt, Artificial Sequence
  CIITA targeting sequence
acugagagcccagcccagug

SEQ ID NO: 36329 - RNA, 20 nt, Artificial Sequence
  CIITA targeting sequence
guagaccaggguucaaaucc

SEQ ID NO: 36330 - RNA, 20 nt, Artificial Sequence
  CIITA targeting sequence
caguagaccaggguucaaau

SEQ ID NO: 36331 - RNA, 20 nt, Artificial Sequence
  CIITA targeting sequence
gcuugcugcacugggcuggg

SEQ ID NO: 36332 - RNA, 20 nt, Artificial Sequence
  CIITA targeting sequence
caucugcuugcugcacuggg

SEQ ID NO: 36333 - RNA, 20 nt, Artificial Sequence
  CIITA targeting sequence
acaaaugcagggcagguccc

SEQ ID NO: 36334 - RNA, 20 nt, Artificial Sequence
  CIITA targeting sequence
caggcagucagagagaaacc

SEQ ID NO: 36335 - RNA, 20 nt, Artificial Sequence
  CIITA targeting sequence
gagagaaaccuguugauacc

SEQ ID NO: 36336 - RNA, 20 nt, Artificial Sequence
  CIITA targeting sequence
gacugccugggaccugcccu

SEQ ID NO: 36337 - RNA, 20 nt, Artificial Sequence
  CIITA targeting sequence
cugacugccugggaccugcc

SEQ ID NO: 36338 - RNA, 20 nt, Artificial Sequence
  CIITA targeting sequence
cucugacugccugggaccug

SEQ ID NO: 36339 - RNA, 20 nt, Artificial Sequence
  CIITA targeting sequence
acagguuucucucugacugc

SEQ ID NO: 36340 - RNA, 20 nt, Artificial Sequence
  CIITA targeting sequence
gucugauggcuggggcuugg

SEQ ID NO: 36341 - RNA, 20 nt, Artificial Sequence
  CIITA targeting sequence
gauggcuggggcuugguuuc

SEQ ID NO: 36342 - RNA, 20 nt, Artificial Sequence
  CIITA targeting sequence
gacagacuggguaucaacag

SEQ ID NO: 36343 - RNA, 20 nt, Artificial Sequence
  CIITA targeting sequence
uguccuaagacccagccuca

SEQ ID NO: 36344 - RNA, 20 nt, Artificial Sequence
  CIITA targeting sequence
uaagacccagccucagauac

SEQ ID NO: 36345 - RNA, 20 nt, Artificial Sequence
  CIITA targeting sequence
uaggacaugaaaccaagccc

SEQ ID NO: 36346 - RNA, 20 nt, Artificial Sequence
  CIITA targeting sequence
gauaccuugagaagagcaga

SEQ ID NO: 36347 - RNA, 20 nt, Artificial Sequence
  CIITA targeting sequence
gaggcugggucuuaggacau

SEQ ID NO: 36348 - RNA, 20 nt, Artificial Sequence
  CIITA targeting sequence
agguaucugaggcugggucu

SEQ ID NO: 36349 - RNA, 20 nt, Artificial Sequence
  CIITA targeting sequence
caagguaucugaggcugggu

SEQ ID NO: 36350 - RNA, 20 nt, Artificial Sequence
  CIITA targeting sequence
ucucaagguaucugaggcug

SEQ ID NO: 36351 - RNA, 20 nt, Artificial Sequence
  CIITA targeting sequence
gcucuucucaagguaucuga

SEQ ID NO: 36352 - RNA, 20 nt, Artificial Sequence
  CIITA targeting sequence
gaaauuaacccaaggaaacu

SEQ ID NO: 36353 - RNA, 20 nt, Artificial Sequence
  CIITA targeting sequence
gauucugcucuucucaaggu

SEQ ID NO: 36354 - RNA, 20 nt, Artificial Sequence
  CIITA targeting sequence
uuggguuaauuucugauucu

SEQ ID NO: 36355 - RNA, 20 nt, Artificial Sequence
  CIITA targeting sequence
ggauuaguuccaggcaauca

SEQ ID NO: 36356 - RNA, 20 nt, Artificial Sequence
  CIITA targeting sequence
agaguuuccuuggguuaauu

SEQ ID NO: 36357 - RNA, 20 nt, Artificial Sequence
  CIITA targeting sequence
aggcaaucagggaaguggcu

SEQ ID NO: 36358 - RNA, 20 nt, Artificial Sequence
  CIITA targeting sequence
gggaaguggcuggagggagg

SEQ ID NO: 36359 - RNA, 20 nt, Artificial Sequence
  CIITA targeting sequence
cugauugccuggaacuaauc

SEQ ID NO: 36360 - RNA, 20 nt, Artificial Sequence
  CIITA targeting sequence
agccacuucccugauugccu

SEQ ID NO: 36361 - RNA, 20 nt, Artificial Sequence
  CIITA targeting sequence
cuccagccacuucccugauu

SEQ ID NO: 36362 - RNA, 20 nt, Artificial Sequence
  CIITA targeting sequence
uaccucccuccagccacuuc

SEQ ID NO: 36363 - RNA, 20 nt, Artificial Sequence
  CIITA targeting sequence
ggacuuagccucagauuugc

SEQ ID NO: 36364 - RNA, 20 nt, Artificial Sequence
  CIITA targeting sequence
agaaguuuccuaccucccuc

SEQ ID NO: 36365 - RNA, 20 nt, Artificial Sequence
  CIITA targeting sequence
gauuugccuugagucacacu

SEQ ID NO: 36366 - RNA, 20 nt, Artificial Sequence
  CIITA targeting sequence
gaggcuaaguccagaaguuu

SEQ ID NO: 36367 - RNA, 20 nt, Artificial Sequence
  CIITA targeting sequence
aggcaaaucugaggcuaagu

SEQ ID NO: 36368 - RNA, 20 nt, Artificial Sequence
  CIITA targeting sequence
cacugacaagugacuucccc

SEQ ID NO: 36369 - RNA, 20 nt, Artificial Sequence
  CIITA targeting sequence
gugugacucaaggcaaaucu

SEQ ID NO: 36370 - RNA, 20 nt, Artificial Sequence
  CIITA targeting sequence
cuugucagugugacucaagg

SEQ ID NO: 36371 - RNA, 20 nt, Artificial Sequence
  CIITA targeting sequence
ccucucugagguucaucugu

SEQ ID NO: 36372 - RNA, 20 nt, Artificial Sequence
  CIITA targeting sequence
cugagguucaucuguaaaau

SEQ ID NO: 36373 - RNA, 20 nt, Artificial Sequence
  CIITA targeting sequence
gagguucaucuguaaaaugg

SEQ ID NO: 36374 - RNA, 20 nt, Artificial Sequence
  CIITA targeting sequence
gagaggggaagucacuuguc

SEQ ID NO: 36375 - RNA, 20 nt, Artificial Sequence
  CIITA targeting sequence
ucuguaaaauggauaaaaca

SEQ ID NO: 36376 - RNA, 20 nt, Artificial Sequence
  CIITA targeting sequence
guaaaauggauaaaacauga

SEQ ID NO: 36377 - RNA, 20 nt, Artificial Sequence
  CIITA targeting sequence
auuuuacagaugaaccucag

SEQ ID NO: 36378 - RNA, 20 nt, Artificial Sequence
  CIITA targeting sequence
uguuuuauccauuuuacaga

SEQ ID NO: 36379 - RNA, 20 nt, Artificial Sequence
  CIITA targeting sequence
cauguuuuauccauuuuaca

SEQ ID NO: 36380 - RNA, 20 nt, Artificial Sequence
  CIITA targeting sequence
agcaagcucucauguuuuau

SEQ ID NO: 36381 - RNA, 20 nt, Artificial Sequence
  CIITA targeting sequence
ucaagcaagcucucauguuu

SEQ ID NO: 36382 - RNA, 20 nt, Artificial Sequence
  CIITA targeting sequence
gauguguacagaaaaagcac

SEQ ID NO: 36383 - RNA, 20 nt, Artificial Sequence
  CIITA targeting sequence
gacaucaucaagcaagcucu

SEQ ID NO: 36384 - RNA, 20 nt, Artificial Sequence
  CIITA targeting sequence
guacacaucagacaucauca

SEQ ID NO: 36385 - RNA, 20 nt, Artificial Sequence
  CIITA targeting sequence
aaagugcuuuuucuguacac

SEQ ID NO: 36386 - RNA, 20 nt, Artificial Sequence
  CIITA targeting sequence
uuggugguuuucuaaagugc

SEQ ID NO: 36387 - RNA, 20 nt, Artificial Sequence
  CIITA targeting sequence
ugcauugggaauaauuauua

SEQ ID NO: 36388 - RNA, 20 nt, Artificial Sequence
  CIITA targeting sequence
caaugcaugaauauucuuug

SEQ ID NO: 36389 - RNA, 20 nt, Artificial Sequence
  CIITA targeting sequence
auaauaauuauucccaaugc

SEQ ID NO: 36390 - RNA, 20 nt, Artificial Sequence
  CIITA targeting sequence
uaaagggauuguuuagaaag

SEQ ID NO: 36391 - RNA, 20 nt, Artificial Sequence
  CIITA targeting sequence
cuuuaggaucuauaauaauu

SEQ ID NO: 36392 - RNA, 20 nt, Artificial Sequence
  CIITA targeting sequence
aaacaaucccuuuaggaucu

SEQ ID NO: 36393 - RNA, 20 nt, Artificial Sequence
  CIITA targeting sequence
uucuaaacaaucccuuuagg

SEQ ID NO: 36394 - RNA, 20 nt, Artificial Sequence
  CIITA targeting sequence
gagaggggccgggagcagug

SEQ ID NO: 36395 - RNA, 20 nt, Artificial Sequence
  CIITA targeting sequence
gaucuuucuaaacaaucccu

SEQ ID NO: 36396 - RNA, 20 nt, Artificial Sequence
  CIITA targeting sequence
cugaucuuucuaaacaaucc

SEQ ID NO: 36397 - RNA, 20 nt, Artificial Sequence
  CIITA targeting sequence
cggccccucucugaucuuuc

SEQ ID NO: 36398 - RNA, 20 nt, Artificial Sequence
  CIITA targeting sequence
caccuguaauccuagcacuu

SEQ ID NO: 36399 - RNA, 20 nt, Artificial Sequence
  CIITA targeting sequence
uagcacuuugggaggccgag

SEQ ID NO: 36400 - RNA, 20 nt, Artificial Sequence
  CIITA targeting sequence
caaagugcuaggauuacagg

SEQ ID NO: 36401 - RNA, 20 nt, Artificial Sequence
  CIITA targeting sequence
gccucccaaagugcuaggau

SEQ ID NO: 36402 - RNA, 20 nt, Artificial Sequence
  CIITA targeting sequence
acccgccucggccucccaaa

SEQ ID NO: 36403 - RNA, 20 nt, Artificial Sequence
  CIITA targeting sequence
agcaauccacccgccucggc

SEQ ID NO: 36404 - RNA, 20 nt, Artificial Sequence
  CIITA targeting sequence
uggccucaagcaauccaccc

SEQ ID NO: 36405 - RNA, 20 nt, Artificial Sequence
  CIITA targeting sequence
agaccagccugggcaaccug

SEQ ID NO: 36406 - RNA, 20 nt, Artificial Sequence
  CIITA targeting sequence
ugaacuccuggccucaagca

SEQ ID NO: 36407 - RNA, 20 nt, Artificial Sequence
  CIITA targeting sequence
agguugcccaggcuggucuu

SEQ ID NO: 36408 - RNA, 20 nt, Artificial Sequence
  CIITA targeting sequence
ccagguugcccaggcugguc

SEQ ID NO: 36409 - RNA, 20 nt, Artificial Sequence
  CIITA targeting sequence
acuaaaacacuuuuuugugu

SEQ ID NO: 36410 - RNA, 20 nt, Artificial Sequence
  CIITA targeting sequence
caacuacuugggaggcugag

SEQ ID NO: 36411 - RNA, 20 nt, Artificial Sequence
  CIITA targeting sequence
acuacuugggaggcugaggc

SEQ ID NO: 36412 - RNA, 20 nt, Artificial Sequence
  CIITA targeting sequence
caaguaguugagauuacagg

SEQ ID NO: 36413 - RNA, 20 nt, Artificial Sequence
  CIITA targeting sequence
gccucccaaguaguugagau

SEQ ID NO: 36414 - RNA, 20 nt, Artificial Sequence
  CIITA targeting sequence
ugccucagccucccaaguag

SEQ ID NO: 36415 - RNA, 20 nt, Artificial Sequence
  CIITA targeting sequence
cgugccucagccucccaagu

SEQ ID NO: 36416 - RNA, 20 nt, Artificial Sequence
  CIITA targeting sequence
cuugaacccaagaggcggag

SEQ ID NO: 36417 - RNA, 20 nt, Artificial Sequence
  CIITA targeting sequence
agugauucucgugccucagc

SEQ ID NO: 36418 - RNA, 20 nt, Artificial Sequence
  CIITA targeting sequence
uggguucaagugauucucgu

SEQ ID NO: 36419 - RNA, 20 nt, Artificial Sequence
  CIITA targeting sequence
gccucuuggguucaagugau

SEQ ID NO: 36420 - RNA, 20 nt, Artificial Sequence
  CIITA targeting sequence
gguaaacuccgccucuuggg

SEQ ID NO: 36421 - RNA, 20 nt, Artificial Sequence
  CIITA targeting sequence
cggguaaacuccgccucuug

SEQ ID NO: 36422 - RNA, 20 nt, Artificial Sequence
  CIITA targeting sequence
accucucggguaaacuccgc

SEQ ID NO: 36423 - RNA, 20 nt, Artificial Sequence
  CIITA targeting sequence
gguaaccuccaccucucggg

SEQ ID NO: 36424 - RNA, 20 nt, Artificial Sequence
  CIITA targeting sequence
cggguaaccuccaccucucg

SEQ ID NO: 36425 - RNA, 20 nt, Artificial Sequence
  CIITA targeting sequence
gcucucggguaaccuccacc

SEQ ID NO: 36426 - RNA, 20 nt, Artificial Sequence
  CIITA targeting sequence
cagcucucggguaaccucca

SEQ ID NO: 36427 - RNA, 20 nt, Artificial Sequence
  CIITA targeting sequence
guugcccaggcuggcgugca

SEQ ID NO: 36428 - RNA, 20 nt, Artificial Sequence
  CIITA targeting sequence
ugcucuguugcccaggcugg

SEQ ID NO: 36429 - RNA, 20 nt, Artificial Sequence
  CIITA targeting sequence
caggaaaaaaaaaagagaga

SEQ ID NO: 36430 - RNA, 20 nt, Artificial Sequence
  CIITA targeting sequence
ggaaaaaaaaaagagagaga

SEQ ID NO: 36431 - RNA, 20 nt, Artificial Sequence
  CIITA targeting sequence
ugagacagucuugcucuguu

SEQ ID NO: 36432 - RNA, 20 nt, Artificial Sequence
  CIITA targeting sequence
uuuuuuuuuccugagacagu

SEQ ID NO: 36433 - RNA, 20 nt, Artificial Sequence
  CIITA targeting sequence
cuuuuuuuuuuccugagaca

SEQ ID NO: 36434 - RNA, 20 nt, Artificial Sequence
  CIITA targeting sequence
cucuuuuuuuuuuccugaga

SEQ ID NO: 36435 - RNA, 20 nt, Artificial Sequence
  CIITA targeting sequence
cucucuuuuuuuuuuccuga

SEQ ID NO: 36436 - RNA, 20 nt, Artificial Sequence
  CIITA targeting sequence
gagaggaaagcauaggcaga

SEQ ID NO: 36437 - RNA, 20 nt, Artificial Sequence
  CIITA targeting sequence
gacuuuuuucucucucuuuu

SEQ ID NO: 36438 - RNA, 20 nt, Artificial Sequence
  CIITA targeting sequence
cugacuuuuuucucucucuu

SEQ ID NO: 36439 - RNA, 20 nt, Artificial Sequence
  CIITA targeting sequence
ucucugacuuuuuucucucu

SEQ ID NO: 36440 - RNA, 20 nt, Artificial Sequence
  CIITA targeting sequence
gccuaugcuuuccucucuga

SEQ ID NO: 36441 - RNA, 20 nt, Artificial Sequence
  CIITA targeting sequence
caucugccuaugcuuuccuc

SEQ ID NO: 36442 - RNA, 20 nt, Artificial Sequence
  CIITA targeting sequence
aaagaccaagacacacacag

SEQ ID NO: 36443 - RNA, 20 nt, Artificial Sequence
  CIITA targeting sequence
uuggaaaccucccaucugcc

SEQ ID NO: 36444 - RNA, 20 nt, Artificial Sequence
  CIITA targeting sequence
uggucuuuggaaaccuccca

SEQ ID NO: 36445 - RNA, 20 nt, Artificial Sequence
  CIITA targeting sequence
aaagacaguucagaaagggg

SEQ ID NO: 36446 - RNA, 20 nt, Artificial Sequence
  CIITA targeting sequence
uuugacugugugugucuugg

SEQ ID NO: 36447 - RNA, 20 nt, Artificial Sequence
  CIITA targeting sequence
gaaaggggcauuaguuacca

SEQ ID NO: 36448 - RNA, 20 nt, Artificial Sequence
  CIITA targeting sequence
gaacugucuuuugacugugu

SEQ ID NO: 36449 - RNA, 20 nt, Artificial Sequence
  CIITA targeting sequence
gugguaacuaaugccccuuu

SEQ ID NO: 36450 - RNA, 20 nt, Artificial Sequence
  CIITA targeting sequence
cauaggaaggacauagauag

SEQ ID NO: 36451 - RNA, 20 nt, Artificial Sequence
  CIITA targeting sequence
uaggaaggacauagauaguu

SEQ ID NO: 36452 - RNA, 20 nt, Artificial Sequence
  CIITA targeting sequence
uaugagaaucggugguaacu

SEQ ID NO: 36453 - RNA, 20 nt, Artificial Sequence
  CIITA targeting sequence
uuccuaugagaaucgguggu

SEQ ID NO: 36454 - RNA, 20 nt, Artificial Sequence
  CIITA targeting sequence
auguccuuccuaugagaauc

SEQ ID NO: 36455 - RNA, 20 nt, Artificial Sequence
  CIITA targeting sequence
gauuccuucaauccuucuga

SEQ ID NO: 36456 - RNA, 20 nt, Artificial Sequence
  CIITA targeting sequence
gaaaacuaucuauguccuuc

SEQ ID NO: 36457 - RNA, 20 nt, Artificial Sequence
  CIITA targeting sequence
uucaauccuucugacaucaa

SEQ ID NO: 36458 - RNA, 20 nt, Artificial Sequence
  CIITA targeting sequence
auccuucugacaucaaggac

SEQ ID NO: 36459 - RNA, 20 nt, Artificial Sequence
  CIITA targeting sequence
uucugacaucaaggacaaag

SEQ ID NO: 36460 - RNA, 20 nt, Artificial Sequence
  CIITA targeting sequence
gacaucaaggacaaagucuc

SEQ ID NO: 36461 - RNA, 20 nt, Artificial Sequence
  CIITA targeting sequence
gaaggauugaaggaaucuga

SEQ ID NO: 36462 - RNA, 20 nt, Artificial Sequence
  CIITA targeting sequence
aggacaaagucucugauuuu

SEQ ID NO: 36463 - RNA, 20 nt, Artificial Sequence
  CIITA targeting sequence
uugaugucagaaggauugaa

SEQ ID NO: 36464 - RNA, 20 nt, Artificial Sequence
  CIITA targeting sequence
cugauuuucccugauguuug

SEQ ID NO: 36465 - RNA, 20 nt, Artificial Sequence
  CIITA targeting sequence
gauuuucccugauguuugac

SEQ ID NO: 36466 - RNA, 20 nt, Artificial Sequence
  CIITA targeting sequence
gagacuuuguccuugauguc

SEQ ID NO: 36467 - RNA, 20 nt, Artificial Sequence
  CIITA targeting sequence
cugauguuugacagugcccu

SEQ ID NO: 36468 - RNA, 20 nt, Artificial Sequence
  CIITA targeting sequence
gggaaaaucagagacuuugu

SEQ ID NO: 36469 - RNA, 20 nt, Artificial Sequence
  CIITA targeting sequence
aacaucagggaaaaucagag

SEQ ID NO: 36470 - RNA, 20 nt, Artificial Sequence
  CIITA targeting sequence
uagcaagcauuagggcacug

SEQ ID NO: 36471 - RNA, 20 nt, Artificial Sequence
  CIITA targeting sequence
uuuuaacaaagugguaaaga

SEQ ID NO: 36472 - RNA, 20 nt, Artificial Sequence
  CIITA targeting sequence
uuaccacuuuguuaaaaaga

SEQ ID NO: 36473 - RNA, 20 nt, Artificial Sequence
  CIITA targeting sequence
gcuucuuuaccacuuuguua

SEQ ID NO: 36474 - RNA, 20 nt, Artificial Sequence
  CIITA targeting sequence
cagcuucuuuaccacuuugu

SEQ ID NO: 36475 - RNA, 20 nt, Artificial Sequence
  CIITA targeting sequence
uuuucaaccacaagugauac

SEQ ID NO: 36476 - RNA, 20 nt, Artificial Sequence
  CIITA targeting sequence
accacaagugauacuguugg

SEQ ID NO: 36477 - RNA, 20 nt, Artificial Sequence
  CIITA targeting sequence
cuugugguugaaaaagaaac

SEQ ID NO: 36478 - RNA, 20 nt, Artificial Sequence
  CIITA targeting sequence
guuuauacauggaaaaaaaa

SEQ ID NO: 36479 - RNA, 20 nt, Artificial Sequence
  CIITA targeting sequence
auguauaaacggaaaagcaa

SEQ ID NO: 36480 - RNA, 20 nt, Artificial Sequence
  CIITA targeting sequence
uuuuguaaaaucaugguaaa

SEQ ID NO: 36481 - RNA, 20 nt, Artificial Sequence
  CIITA targeting sequence
ugguaaaauacauauaacau

SEQ ID NO: 36482 - RNA, 20 nt, Artificial Sequence
  CIITA targeting sequence
aauguacauuucaguggcau

SEQ ID NO: 36483 - RNA, 20 nt, Artificial Sequence
  CIITA targeting sequence
guggcauuaaauauuucaaa

SEQ ID NO: 36484 - RNA, 20 nt, Artificial Sequence
  CIITA targeting sequence
aacuguugugcaaccuccgc

SEQ ID NO: 36485 - RNA, 20 nt, Artificial Sequence
  CIITA targeting sequence
gcuaccauccaucuccagaa

SEQ ID NO: 36486 - RNA, 20 nt, Artificial Sequence
  CIITA targeting sequence
aucuccagaacuuuuucauc

SEQ ID NO: 36487 - RNA, 20 nt, Artificial Sequence
  CIITA targeting sequence
ccagaacuuuuucauccucc

SEQ ID NO: 36488 - RNA, 20 nt, Artificial Sequence
  CIITA targeting sequence
agaacuuuuucauccuccca

SEQ ID NO: 36489 - RNA, 20 nt, Artificial Sequence
  CIITA targeting sequence
ggagauggaugguagcggag

SEQ ID NO: 36490 - RNA, 20 nt, Artificial Sequence
  CIITA targeting sequence
uccucccaaacugaaacucu

SEQ ID NO: 36491 - RNA, 20 nt, Artificial Sequence
  CIITA targeting sequence
ucccaaacugaaacucuacc

SEQ ID NO: 36492 - RNA, 20 nt, Artificial Sequence
  CIITA targeting sequence
caaacugaaacucuacccaa

SEQ ID NO: 36493 - RNA, 20 nt, Artificial Sequence
  CIITA targeting sequence
guuugggaggaugaaaaagu

SEQ ID NO: 36494 - RNA, 20 nt, Artificial Sequence
  CIITA targeting sequence
acccaauaagcaauaacucc

SEQ ID NO: 36495 - RNA, 20 nt, Artificial Sequence
  CIITA targeting sequence
ccacugccccuuccacccag

SEQ ID NO: 36496 - RNA, 20 nt, Artificial Sequence
  CIITA targeting sequence
acccagcucgugguaacucc

SEQ ID NO: 36497 - RNA, 20 nt, Artificial Sequence
  CIITA targeting sequence
ugguaacuccaacuuccugu

SEQ ID NO: 36498 - RNA, 20 nt, Artificial Sequence
  CIITA targeting sequence
aacuuccugucucuauguuu

SEQ ID NO: 36499 - RNA, 20 nt, Artificial Sequence
  CIITA targeting sequence
ugucucuauguuuugggcua

SEQ ID NO: 36500 - RNA, 20 nt, Artificial Sequence
  CIITA targeting sequence
cuauguuuugggcuacucua

SEQ ID NO: 36501 - RNA, 20 nt, Artificial Sequence
  CIITA targeting sequence
auguuuugggcuacucuaga

SEQ ID NO: 36502 - RNA, 20 nt, Artificial Sequence
  CIITA targeting sequence
agacaccgccuauaaauaga

SEQ ID NO: 36503 - RNA, 20 nt, Artificial Sequence
  CIITA targeting sequence
agaguagcccaaaacauaga

SEQ ID NO: 36504 - RNA, 20 nt, Artificial Sequence
  CIITA targeting sequence
auuuauaggcggugucuaga

SEQ ID NO: 36505 - RNA, 20 nt, Artificial Sequence
  CIITA targeting sequence
cguaauucuauuuauaggcg

SEQ ID NO: 36506 - RNA, 20 nt, Artificial Sequence
  CIITA targeting sequence
uuuugugccuggcuucuuuc

SEQ ID NO: 36507 - RNA, 20 nt, Artificial Sequence
  CIITA targeting sequence
uucacuuagcauaaugucuu

SEQ ID NO: 36508 - RNA, 20 nt, Artificial Sequence
  CIITA targeting sequence
cuuagcauaaugucuuccag

SEQ ID NO: 36509 - RNA, 20 nt, Artificial Sequence
  CIITA targeting sequence
uccagguucauccaugucgu

SEQ ID NO: 36510 - RNA, 20 nt, Artificial Sequence
  CIITA targeting sequence
agguucauccaugucgugcc

SEQ ID NO: 36511 - RNA, 20 nt, Artificial Sequence
  CIITA targeting sequence
uccaugucgugccaugugua

SEQ ID NO: 36512 - RNA, 20 nt, Artificial Sequence
  CIITA targeting sequence
augucgugccauguguaauu

SEQ ID NO: 36513 - RNA, 20 nt, Artificial Sequence
  CIITA targeting sequence
ugccauguguaauuccuuuc

SEQ ID NO: 36514 - RNA, 20 nt, Artificial Sequence
  CIITA targeting sequence
uuucuauggcggaauaguau

SEQ ID NO: 36515 - RNA, 20 nt, Artificial Sequence
  CIITA targeting sequence
auggcggaauaguauucuaa

SEQ ID NO: 36516 - RNA, 20 nt, Artificial Sequence
  CIITA targeting sequence
gccauagaaaggaauuacac

SEQ ID NO: 36517 - RNA, 20 nt, Artificial Sequence
  CIITA targeting sequence
aauauguggauaucccauau

SEQ ID NO: 36518 - RNA, 20 nt, Artificial Sequence
  CIITA targeting sequence
acauauuagaauacuauucc

SEQ ID NO: 36519 - RNA, 20 nt, Artificial Sequence
  CIITA targeting sequence
cauauuuuguucauccauuc

SEQ ID NO: 36520 - RNA, 20 nt, Artificial Sequence
  CIITA targeting sequence
uccauucauuuguugauaga

SEQ ID NO: 36521 - RNA, 20 nt, Artificial Sequence
  CIITA targeting sequence
auucauuuguugauagacac

SEQ ID NO: 36522 - RNA, 20 nt, Artificial Sequence
  CIITA targeting sequence
uuuguugauagacacuuggg

SEQ ID NO: 36523 - RNA, 20 nt, Artificial Sequence
  CIITA targeting sequence
acaaaugaauggaugaacaa

SEQ ID NO: 36524 - RNA, 20 nt, Artificial Sequence
  CIITA targeting sequence
aucaacaaaugaauggauga

SEQ ID NO: 36525 - RNA, 20 nt, Artificial Sequence
  CIITA targeting sequence
uaccucuugacuauugugaa

SEQ ID NO: 36526 - RNA, 20 nt, Artificial Sequence
  CIITA targeting sequence
ugacuauugugaauaaucuu

SEQ ID NO: 36527 - RNA, 20 nt, Artificial Sequence
  CIITA targeting sequence
agagguaggaacaacccaag

SEQ ID NO: 36528 - RNA, 20 nt, Artificial Sequence
  CIITA targeting sequence
caauagucaagagguaggaa

SEQ ID NO: 36529 - RNA, 20 nt, Artificial Sequence
  CIITA targeting sequence
ugcuagguacauggguggac

SEQ ID NO: 36530 - RNA, 20 nt, Artificial Sequence
  CIITA targeting sequence
acccauguaccuagcaagau

SEQ ID NO: 36531 - RNA, 20 nt, Artificial Sequence
  CIITA targeting sequence
gucugacuccccgcuuucaa

SEQ ID NO: 36532 - RNA, 20 nt, Artificial Sequence
  CIITA targeting sequence
gacuccccgcuuucaacucu

SEQ ID NO: 36533 - RNA, 20 nt, Artificial Sequence
  CIITA targeting sequence
gacagauauuuguccaccca

SEQ ID NO: 36534 - RNA, 20 nt, Artificial Sequence
  CIITA targeting sequence
ccgcuuucaacucuagaaag

SEQ ID NO: 36535 - RNA, 20 nt, Artificial Sequence
  CIITA targeting sequence
acucuagaaagcuuucuuuu

SEQ ID NO: 36536 - RNA, 20 nt, Artificial Sequence
  CIITA targeting sequence
agaaagcuuucuuuuaaaau

SEQ ID NO: 36537 - RNA, 20 nt, Artificial Sequence
  CIITA targeting sequence
agaguugaaagcggggaguc

SEQ ID NO: 36538 - RNA, 20 nt, Artificial Sequence
  CIITA targeting sequence
uuuaaaaucggucuauuuaa

SEQ ID NO: 36539 - RNA, 20 nt, Artificial Sequence
  CIITA targeting sequence
gucuauuuaaguuucuuuaa

SEQ ID NO: 36540 - RNA, 20 nt, Artificial Sequence
  CIITA targeting sequence
auuuaaguuucuuuaaaaag

SEQ ID NO: 36541 - RNA, 20 nt, Artificial Sequence
  CIITA targeting sequence
uuaaaaaguuaauuuaagaa

SEQ ID NO: 36542 - RNA, 20 nt, Artificial Sequence
  CIITA targeting sequence
uaaauuaacuuuuuaaagaa

SEQ ID NO: 36543 - RNA, 20 nt, Artificial Sequence
  CIITA targeting sequence
acaauuuaccuuaguauuuu

SEQ ID NO: 36544 - RNA, 20 nt, Artificial Sequence
  CIITA targeting sequence
ccuguucuacaauuuaccuu

SEQ ID NO: 36545 - RNA, 20 nt, Artificial Sequence
  CIITA targeting sequence
auaugaccccaaaaauugua

SEQ ID NO: 36546 - RNA, 20 nt, Artificial Sequence
  CIITA targeting sequence
uauugacauaucaccuguuc

SEQ ID NO: 36547 - RNA, 20 nt, Artificial Sequence
  CIITA targeting sequence
uuacaauuuuuggggucaua

SEQ ID NO: 36548 - RNA, 20 nt, Artificial Sequence
  CIITA targeting sequence
aucuuuacaauuuuuggggu

SEQ ID NO: 36549 - RNA, 20 nt, Artificial Sequence
  CIITA targeting sequence
uccaucuuuacaauuuuugg

SEQ ID NO: 36550 - RNA, 20 nt, Artificial Sequence
  CIITA targeting sequence
ucuuccaucuuuacaauuuu

SEQ ID NO: 36551 - RNA, 20 nt, Artificial Sequence
  CIITA targeting sequence
caaacugcaggcauucgucu

SEQ ID NO: 36552 - RNA, 20 nt, Artificial Sequence
  CIITA targeting sequence
gguuucccaaacugcaggca

SEQ ID NO: 36553 - RNA, 20 nt, Artificial Sequence
  CIITA targeting sequence
uccgguuucccaaacugcag

SEQ ID NO: 36554 - RNA, 20 nt, Artificial Sequence
  CIITA targeting sequence
cauccgguuucccaaacugc

SEQ ID NO: 36555 - RNA, 20 nt, Artificial Sequence
  CIITA targeting sequence
ucucauccgguuucccaaac

SEQ ID NO: 36556 - RNA, 20 nt, Artificial Sequence
  CIITA targeting sequence
uuccucucauccgguuuccc

SEQ ID NO: 36557 - RNA, 20 nt, Artificial Sequence
  CIITA targeting sequence
aggucuuuccucucauccgg

SEQ ID NO: 36558 - RNA, 20 nt, Artificial Sequence
  CIITA targeting sequence
augcugagggucuggugacu

SEQ ID NO: 36559 - RNA, 20 nt, Artificial Sequence
  CIITA targeting sequence
gcauagauuuuacaauagcu

SEQ ID NO: 36560 - RNA, 20 nt, Artificial Sequence
  CIITA targeting sequence
ggugacuacuagaccaaggg

SEQ ID NO: 36561 - RNA, 20 nt, Artificial Sequence
  CIITA targeting sequence
ccagacccucagcauagauu

SEQ ID NO: 36562 - RNA, 20 nt, Artificial Sequence
  CIITA targeting sequence
aguagucaccagacccucag

SEQ ID NO: 36563 - RNA, 20 nt, Artificial Sequence
  CIITA targeting sequence
gcugccaugcccuuggucua

SEQ ID NO: 36564 - RNA, 20 nt, Artificial Sequence
  CIITA targeting sequence
gcugcccucugcugccaugc

SEQ ID NO: 36565 - RNA, 20 nt, Artificial Sequence
  CIITA targeting sequence
uucagcugcccucugcugcc

SEQ ID NO: 36566 - RNA, 20 nt, Artificial Sequence
  CIITA targeting sequence
ggaaggaaagauauaagaau

SEQ ID NO: 36567 - RNA, 20 nt, Artificial Sequence
  CIITA targeting sequence
ugaagucuuucagcugcccu

SEQ ID NO: 36568 - RNA, 20 nt, Artificial Sequence
  CIITA targeting sequence
uuccugaagucuuucagcug

SEQ ID NO: 36569 - RNA, 20 nt, Artificial Sequence
  CIITA targeting sequence
uuccuuccugaagucuuuca

SEQ ID NO: 36570 - RNA, 20 nt, Artificial Sequence
  CIITA targeting sequence
uauaucuuuccuuccugaag

SEQ ID NO: 36571 - RNA, 20 nt, Artificial Sequence
  CIITA targeting sequence
uaauucuuauaucuuuccuu

SEQ ID NO: 36572 - RNA, 20 nt, Artificial Sequence
  CIITA targeting sequence
ugccuguaauuccaucaccu

SEQ ID NO: 36573 - RNA, 20 nt, Artificial Sequence
  CIITA targeting sequence
aucaccuugggaggucaagg

SEQ ID NO: 36574 - RNA, 20 nt, Artificial Sequence
  CIITA targeting sequence
ccuugggaggucaaggcagg

SEQ ID NO: 36575 - RNA, 20 nt, Artificial Sequence
  CIITA targeting sequence
caaggugauggaauuacagg

SEQ ID NO: 36576 - RNA, 20 nt, Artificial Sequence
  CIITA targeting sequence
aggcaggaugauggcuugag

SEQ ID NO: 36577 - RNA, 20 nt, Artificial Sequence
  CIITA targeting sequence
ugccuugaccucccaaggug

SEQ ID NO: 36578 - RNA, 20 nt, Artificial Sequence
  CIITA targeting sequence
uccugccuugaccucccaag

SEQ ID NO: 36579 - RNA, 20 nt, Artificial Sequence
  CIITA targeting sequence
agccaucauccugccuugac

SEQ ID NO: 36580 - RNA, 20 nt, Artificial Sequence
  CIITA targeting sequence
caagccaucauccugccuug

SEQ ID NO: 36581 - RNA, 20 nt, Artificial Sequence
  CIITA targeting sequence
uggucucaagccaucauccu

SEQ ID NO: 36582 - RNA, 20 nt, Artificial Sequence
  CIITA targeting sequence
agaccagccugggcaacaga

SEQ ID NO: 36583 - RNA, 20 nt, Artificial Sequence
  CIITA targeting sequence
ugaacuccuggucucaagcc

SEQ ID NO: 36584 - RNA, 20 nt, Artificial Sequence
  CIITA targeting sequence
guugcccaggcuggucuuga

SEQ ID NO: 36585 - RNA, 20 nt, Artificial Sequence
  CIITA targeting sequence
ugcucuguugcccaggcugg

SEQ ID NO: 36586 - RNA, 20 nt, Artificial Sequence
  CIITA targeting sequence
uaaaaaaaggucuugcucug

SEQ ID NO: 36587 - RNA, 20 nt, Artificial Sequence
  CIITA targeting sequence
aaaauuuauuuuuauuaauu

SEQ ID NO: 36588 - RNA, 20 nt, Artificial Sequence
  CIITA targeting sequence
guauuuucaaaaauuuauuu

SEQ ID NO: 36589 - RNA, 20 nt, Artificial Sequence
  CIITA targeting sequence
aggccgggcaugguggcuca

SEQ ID NO: 36590 - RNA, 20 nt, Artificial Sequence
  CIITA targeting sequence
caccuguaaccccagcacuu

SEQ ID NO: 36591 - RNA, 20 nt, Artificial Sequence
  CIITA targeting sequence
caaagugcugggguuacagg

SEQ ID NO: 36592 - RNA, 20 nt, Artificial Sequence
  CIITA targeting sequence
gccucccaaagugcuggggu

SEQ ID NO: 36593 - RNA, 20 nt, Artificial Sequence
  CIITA targeting sequence
accggccucagccucccaaa

SEQ ID NO: 36594 - RNA, 20 nt, Artificial Sequence
  CIITA targeting sequence
ccugggaucaggaguucgag

SEQ ID NO: 36595 - RNA, 20 nt, Artificial Sequence
  CIITA targeting sequence
caggugauccaccggccuca

SEQ ID NO: 36596 - RNA, 20 nt, Artificial Sequence
  CIITA targeting sequence
ggaguucgagaccagccugg

SEQ ID NO: 36597 - RNA, 20 nt, Artificial Sequence
  CIITA targeting sequence
ugaucccaggugauccaccg

SEQ ID NO: 36598 - RNA, 20 nt, Artificial Sequence
  CIITA targeting sequence
agaccagccugggcaacaug

SEQ ID NO: 36599 - RNA, 20 nt, Artificial Sequence
  CIITA targeting sequence
aacuccugaucccaggugau

SEQ ID NO: 36600 - RNA, 20 nt, Artificial Sequence
  CIITA targeting sequence
cgaacuccugaucccaggug

SEQ ID NO: 36601 - RNA, 20 nt, Artificial Sequence
  CIITA targeting sequence
ccauguugcccaggcugguc

SEQ ID NO: 36602 - RNA, 20 nt, Artificial Sequence
  CIITA targeting sequence
cuccuaaaaauacaaaauua

SEQ ID NO: 36603 - RNA, 20 nt, Artificial Sequence
  CIITA targeting sequence
ccuaaaaauacaaaauuagc

SEQ ID NO: 36604 - RNA, 20 nt, Artificial Sequence
  CIITA targeting sequence
uaaaaauacaaaauuagccg

SEQ ID NO: 36605 - RNA, 20 nt, Artificial Sequence
  CIITA targeting sequence
cagcuacucgguaggcuggu

SEQ ID NO: 36606 - RNA, 20 nt, Artificial Sequence
  CIITA targeting sequence
guaggcugguggaggagaau

SEQ ID NO: 36607 - RNA, 20 nt, Artificial Sequence
  CIITA targeting sequence
accagccuaccgaguagcug

SEQ ID NO: 36608 - RNA, 20 nt, Artificial Sequence
  CIITA targeting sequence
uccaccagccuaccgaguag

SEQ ID NO: 36609 - RNA, 20 nt, Artificial Sequence
  CIITA targeting sequence
ccuccaccagccuaccgagu

SEQ ID NO: 36610 - RNA, 20 nt, Artificial Sequence
  CIITA targeting sequence
ccugaacccaggaggcggag

SEQ ID NO: 36611 - RNA, 20 nt, Artificial Sequence
  CIITA targeting sequence
ggcgauucuccuccaccagc

SEQ ID NO: 36612 - RNA, 20 nt, Artificial Sequence
  CIITA targeting sequence
uggguucaggcgauucuccu

SEQ ID NO: 36613 - RNA, 20 nt, Artificial Sequence
  CIITA targeting sequence
gccuccuggguucaggcgau

SEQ ID NO: 36614 - RNA, 20 nt, Artificial Sequence
  CIITA targeting sequence
ccgccuccuggguucaggcg

SEQ ID NO: 36615 - RNA, 20 nt, Artificial Sequence
  CIITA targeting sequence
ccgcaaucuccgccuccugg

SEQ ID NO: 36616 - RNA, 20 nt, Artificial Sequence
  CIITA targeting sequence
gcucaccgcaaucuccgccu

SEQ ID NO: 36617 - RNA, 20 nt, Artificial Sequence
  CIITA targeting sequence
cggcucaccgcaaucuccgc

SEQ ID NO: 36618 - RNA, 20 nt, Artificial Sequence
  CIITA targeting sequence
caccauugcacuccagccug

SEQ ID NO: 36619 - RNA, 20 nt, Artificial Sequence
  CIITA targeting sequence
agccugggcaacaagaguga

SEQ ID NO: 36620 - RNA, 20 nt, Artificial Sequence
  CIITA targeting sequence
uguugcccaggcuggagugc

SEQ ID NO: 36621 - RNA, 20 nt, Artificial Sequence
  CIITA targeting sequence
cucuuguugcccaggcugga

SEQ ID NO: 36622 - RNA, 20 nt, Artificial Sequence
  CIITA targeting sequence
gucucaaaaaaaaugaaaga

SEQ ID NO: 36623 - RNA, 20 nt, Artificial Sequence
  CIITA targeting sequence
caaaaaaaaugaaagaaaau

SEQ ID NO: 36624 - RNA, 20 nt, Artificial Sequence
  CIITA targeting sequence
aaaaaaaugaaagaaaauac

SEQ ID NO: 36625 - RNA, 20 nt, Artificial Sequence
  CIITA targeting sequence
uuuuuuuugagacggaguuu

SEQ ID NO: 36626 - RNA, 20 nt, Artificial Sequence
  CIITA targeting sequence
uucauuuuuuuugagacgga

SEQ ID NO: 36627 - RNA, 20 nt, Artificial Sequence
  CIITA targeting sequence
guauuuucuuucauuuuuuu

SEQ ID NO: 36628 - RNA, 20 nt, Artificial Sequence
  CIITA targeting sequence
ugggcccggcugcagacucc

SEQ ID NO: 36629 - RNA, 20 nt, Artificial Sequence
  CIITA targeting sequence
gcagccgggcccaggaaucu

SEQ ID NO: 36630 - RNA, 20 nt, Artificial Sequence
  CIITA targeting sequence
cugaauagaaucacuggggg

SEQ ID NO: 36631 - RNA, 20 nt, Artificial Sequence
  CIITA targeting sequence
gggagucugcagccgggccc

SEQ ID NO: 36632 - RNA, 20 nt, Artificial Sequence
  CIITA targeting sequence
auucagggagucugcagccg

SEQ ID NO: 36633 - RNA, 20 nt, Artificial Sequence
  CIITA targeting sequence
cugggggugaggcccaggac

SEQ ID NO: 36634 - RNA, 20 nt, Artificial Sequence
  CIITA targeting sequence
cccccagugauucuauucag

SEQ ID NO: 36635 - RNA, 20 nt, Artificial Sequence
  CIITA targeting sequence
ugggccucacccccagugau

SEQ ID NO: 36636 - RNA, 20 nt, Artificial Sequence
  CIITA targeting sequence
cagguaauucucacucacag

SEQ ID NO: 36637 - RNA, 20 nt, Artificial Sequence
  CIITA targeting sequence
cacucacagccaagccugcc

SEQ ID NO: 36638 - RNA, 20 nt, Artificial Sequence
  CIITA targeting sequence
cucacagccaagccugccga

SEQ ID NO: 36639 - RNA, 20 nt, Artificial Sequence
  CIITA targeting sequence
cagccaagccugccgauggc

SEQ ID NO: 36640 - RNA, 20 nt, Artificial Sequence
  CIITA targeting sequence
gcaggcuuggcugugaguga

SEQ ID NO: 36641 - RNA, 20 nt, Artificial Sequence
  CIITA targeting sequence
agccaucggcaggcuuggcu

SEQ ID NO: 36642 - RNA, 20 nt, Artificial Sequence
  CIITA targeting sequence
guagucagaucucagcaagc

SEQ ID NO: 36643 - RNA, 20 nt, Artificial Sequence
  CIITA targeting sequence
gaucucagcaagcaggacug

SEQ ID NO: 36644 - RNA, 20 nt, Artificial Sequence
  CIITA targeting sequence
gacuacggaguccagccauc

SEQ ID NO: 36645 - RNA, 20 nt, Artificial Sequence
  CIITA targeting sequence
cagcaagcaggacuggcucg

SEQ ID NO: 36646 - RNA, 20 nt, Artificial Sequence
  CIITA targeting sequence
gcaagcaggacuggcucgug

SEQ ID NO: 36647 - RNA, 20 nt, Artificial Sequence
  CIITA targeting sequence
ugcuugcugagaucugacua

SEQ ID NO: 36648 - RNA, 20 nt, Artificial Sequence
  CIITA targeting sequence
ugguucaucuuggggucucc

SEQ ID NO: 36649 - RNA, 20 nt, Artificial Sequence
  CIITA targeting sequence
ucuuggggucuccagcaccc

SEQ ID NO: 36650 - RNA, 20 nt, Artificial Sequence
  CIITA targeting sequence
uggggucuccagcacccagc

SEQ ID NO: 36651 - RNA, 20 nt, Artificial Sequence
  CIITA targeting sequence
ccagcacccagcagagugcu

SEQ ID NO: 36652 - RNA, 20 nt, Artificial Sequence
  CIITA targeting sequence
agcacccagcagagugcugg

SEQ ID NO: 36653 - RNA, 20 nt, Artificial Sequence
  CIITA targeting sequence
gcugggugcuggagacccca

SEQ ID NO: 36654 - RNA, 20 nt, Artificial Sequence
  CIITA targeting sequence
ccccgccagcacucugcugg

SEQ ID NO: 36655 - RNA, 20 nt, Artificial Sequence
  CIITA targeting sequence
acuuaacacaguccccccgc

SEQ ID NO: 36656 - RNA, 20 nt, Artificial Sequence
  CIITA targeting sequence
ggcucuacuuaacacagucc

SEQ ID NO: 36657 - RNA, 20 nt, Artificial Sequence
  CIITA targeting sequence
ggacuggaguguggggccug

SEQ ID NO: 36658 - RNA, 20 nt, Artificial Sequence
  CIITA targeting sequence
ugacccauccggcucuacuu

SEQ ID NO: 36659 - RNA, 20 nt, Artificial Sequence
  CIITA targeting sequence
aguccugacccauccggcuc

SEQ ID NO: 36660 - RNA, 20 nt, Artificial Sequence
  CIITA targeting sequence
caagauccucaucacuccac

SEQ ID NO: 36661 - RNA, 20 nt, Artificial Sequence
  CIITA targeting sequence
ugugacugcaguuagcaaag

SEQ ID NO: 36662 - RNA, 20 nt, Artificial Sequence
  CIITA targeting sequence
ucaucacuccacccccuacc

SEQ ID NO: 36663 - RNA, 20 nt, Artificial Sequence
  CIITA targeting sequence
ucacuccacccccuacccca

SEQ ID NO: 36664 - RNA, 20 nt, Artificial Sequence
  CIITA targeting sequence
cuccacccccuaccccagca

SEQ ID NO: 36665 - RNA, 20 nt, Artificial Sequence
  CIITA targeting sequence
acccccuaccccagcaccag

SEQ ID NO: 36666 - RNA, 20 nt, Artificial Sequence
  CIITA targeting sequence
gguucccuuccaggaaaaac

SEQ ID NO: 36667 - RNA, 20 nt, Artificial Sequence
  CIITA targeting sequence
cuuccaggaaaaacuuguug

SEQ ID NO: 36668 - RNA, 20 nt, Artificial Sequence
  CIITA targeting sequence
aggaaaaacuuguuggacuc

SEQ ID NO: 36669 - RNA, 20 nt, Artificial Sequence
  CIITA targeting sequence
uggaagggaaccugacccug

SEQ ID NO: 36670 - RNA, 20 nt, Artificial Sequence
  CIITA targeting sequence
aacaaguuuuuccuggaagg

SEQ ID NO: 36671 - RNA, 20 nt, Artificial Sequence
  CIITA targeting sequence
uuuccaggucauugacugca

SEQ ID NO: 36672 - RNA, 20 nt, Artificial Sequence
  CIITA targeting sequence
aggucauugacugcaguuag

SEQ ID NO: 36673 - RNA, 20 nt, Artificial Sequence
  CIITA targeting sequence
uugacugcaguuaggagugg

SEQ ID NO: 36674 - RNA, 20 nt, Artificial Sequence
  CIITA targeting sequence
augaccuggaaaggagucca

SEQ ID NO: 36675 - RNA, 20 nt, Artificial Sequence
  CIITA targeting sequence
uaacugcagucaaugaccug

SEQ ID NO: 36676 - RNA, 20 nt, Artificial Sequence
  CIITA targeting sequence
gcaugccacuccuaacugca

SEQ ID NO: 36677 - RNA, 20 nt, Artificial Sequence
  CIITA targeting sequence
cuucugcaugccacuccuaa

SEQ ID NO: 36678 - RNA, 20 nt, Artificial Sequence
  CIITA targeting sequence
ggagcugggacagaccaggc

SEQ ID NO: 36679 - RNA, 20 nt, Artificial Sequence
  CIITA targeting sequence
agauagccucccuucugcau

SEQ ID NO: 36680 - RNA, 20 nt, Artificial Sequence
  CIITA targeting sequence
cagcuccagauagccucccu

SEQ ID NO: 36681 - RNA, 20 nt, Artificial Sequence
  CIITA targeting sequence
gucccagcuccagauagccu

SEQ ID NO: 36682 - RNA, 20 nt, Artificial Sequence
  CIITA targeting sequence
ccgcuugccuggucuguccc

SEQ ID NO: 36683 - RNA, 20 nt, Artificial Sequence
  CIITA targeting sequence
cuuccccgcuugccuggucu

SEQ ID NO: 36684 - RNA, 20 nt, Artificial Sequence
  CIITA targeting sequence
uaucccaacccugcauucug

SEQ ID NO: 36685 - RNA, 20 nt, Artificial Sequence
  CIITA targeting sequence
caacccugcauucuggacag

SEQ ID NO: 36686 - RNA, 20 nt, Artificial Sequence
  CIITA targeting sequence
ggacagggaccgaaggucuc

SEQ ID NO: 36687 - RNA, 20 nt, Artificial Sequence
  CIITA targeting sequence
agaaugcaggguugggauaa

SEQ ID NO: 36688 - RNA, 20 nt, Artificial Sequence
  CIITA targeting sequence
cuguccagaaugcaggguug

SEQ ID NO: 36689 - RNA, 20 nt, Artificial Sequence
  CIITA targeting sequence
gucccuguccagaaugcagg

SEQ ID NO: 36690 - RNA, 20 nt, Artificial Sequence
  CIITA targeting sequence
ccuggcugcagcucauacag

SEQ ID NO: 36691 - RNA, 20 nt, Artificial Sequence
  CIITA targeting sequence
uggcugcagcucauacagcu

SEQ ID NO: 36692 - RNA, 20 nt, Artificial Sequence
  CIITA targeting sequence
uacagcucaucuucauucuc

SEQ ID NO: 36693 - RNA, 20 nt, Artificial Sequence
  CIITA targeting sequence
ucuucauucucauccuggga

SEQ ID NO: 36694 - RNA, 20 nt, Artificial Sequence
  CIITA targeting sequence
ucauucucauccugggacca

SEQ ID NO: 36695 - RNA, 20 nt, Artificial Sequence
  CIITA targeting sequence
uucucauccugggaccacca

SEQ ID NO: 36696 - RNA, 20 nt, Artificial Sequence
  CIITA targeting sequence
cauccugggaccaccaggcc

SEQ ID NO: 36697 - RNA, 20 nt, Artificial Sequence
  CIITA targeting sequence
uccugggaccaccaggcccc

SEQ ID NO: 36698 - RNA, 20 nt, Artificial Sequence
  CIITA targeting sequence
ugggaccaccaggccccuca

SEQ ID NO: 36699 - RNA, 20 nt, Artificial Sequence
  CIITA targeting sequence
caggaugagaaugaagauga

SEQ ID NO: 36700 - RNA, 20 nt, Artificial Sequence
  CIITA targeting sequence
cccacaauaacuuuacccuu

SEQ ID NO: 36701 - RNA, 20 nt, Artificial Sequence
  CIITA targeting sequence
agcuugugcauuugccagua

SEQ ID NO: 36702 - RNA, 20 nt, Artificial Sequence
  CIITA targeting sequence
ccagcuugugcauuugccag

SEQ ID NO: 36703 - RNA, 20 nt, Artificial Sequence
  CIITA targeting sequence
ucuccagcuugugcauuugc

SEQ ID NO: 36704 - RNA, 20 nt, Artificial Sequence
  CIITA targeting sequence
aguuuuaagauuuuccaagu

SEQ ID NO: 36705 - RNA, 20 nt, Artificial Sequence
  CIITA targeting sequence
aaugggccaucaucuccagc

SEQ ID NO: 36706 - RNA, 20 nt, Artificial Sequence
  CIITA targeting sequence
uaaaacucgaaugggccauc

SEQ ID NO: 36707 - RNA, 20 nt, Artificial Sequence
  CIITA targeting sequence
aaguuguuaugaggucagug

SEQ ID NO: 36708 - RNA, 20 nt, Artificial Sequence
  CIITA targeting sequence
uaacaacuuggaaaaucuua

SEQ ID NO: 36709 - RNA, 20 nt, Artificial Sequence
  CIITA targeting sequence
guguccucaaucgggaccca

SEQ ID NO: 36710 - RNA, 20 nt, Artificial Sequence
  CIITA targeting sequence
ucaaucgggacccagagaag

SEQ ID NO: 36711 - RNA, 20 nt, Artificial Sequence
  CIITA targeting sequence
aucgggacccagagaagaua

SEQ ID NO: 36712 - RNA, 20 nt, Artificial Sequence
  CIITA targeting sequence
ggacccagagaagauaggug

SEQ ID NO: 36713 - RNA, 20 nt, Artificial Sequence
  CIITA targeting sequence
cgauugaggacacugaccuc

SEQ ID NO: 36714 - RNA, 20 nt, Artificial Sequence
  CIITA targeting sequence
gggucccgauugaggacacu

SEQ ID NO: 36715 - RNA, 20 nt, Artificial Sequence
  CIITA targeting sequence
cugggucccgauugaggaca

SEQ ID NO: 36716 - RNA, 20 nt, Artificial Sequence
  CIITA targeting sequence
ucucugggucccgauugagg

SEQ ID NO: 36717 - RNA, 20 nt, Artificial Sequence
  CIITA targeting sequence
ggcaagccaccuaucuucuc

SEQ ID NO: 36718 - RNA, 20 nt, Artificial Sequence
  CIITA targeting sequence
gagggggcaucugugguguc

SEQ ID NO: 36719 - RNA, 20 nt, Artificial Sequence
  CIITA targeting sequence
gaaaguucaggcaagccacc

SEQ ID NO: 36720 - RNA, 20 nt, Artificial Sequence
  CIITA targeting sequence
guggugucuuuugugggguc

SEQ ID NO: 36721 - RNA, 20 nt, Artificial Sequence
  CIITA targeting sequence
uuugugggguccuguaggau

SEQ ID NO: 36722 - RNA, 20 nt, Artificial Sequence
  CIITA targeting sequence
uguaggauuuccacgucccu

SEQ ID NO: 36723 - RNA, 20 nt, Artificial Sequence
  CIITA targeting sequence
uacaggaccccacaaaagac

SEQ ID NO: 36724 - RNA, 20 nt, Artificial Sequence
  CIITA targeting sequence
acgucccucuuggaggaaaa

SEQ ID NO: 36725 - RNA, 20 nt, Artificial Sequence
  CIITA targeting sequence
cucuuggaggaaaaauagaa

SEQ ID NO: 36726 - RNA, 20 nt, Artificial Sequence
  CIITA targeting sequence
uggaggaaaaauagaaguaa

SEQ ID NO: 36727 - RNA, 20 nt, Artificial Sequence
  CIITA targeting sequence
aagagggacguggaaauccu

SEQ ID NO: 36728 - RNA, 20 nt, Artificial Sequence
  CIITA targeting sequence
uccaagagggacguggaaau

SEQ ID NO: 36729 - RNA, 20 nt, Artificial Sequence
  CIITA targeting sequence
auuuuuccuccaagagggac

SEQ ID NO: 36730 - RNA, 20 nt, Artificial Sequence
  CIITA targeting sequence
caggucagauugucugggaa

SEQ ID NO: 36731 - RNA, 20 nt, Artificial Sequence
  CIITA targeting sequence
ggucagauugucugggaagc

SEQ ID NO: 36732 - RNA, 20 nt, Artificial Sequence
  CIITA targeting sequence
gauugucugggaagccaagu

SEQ ID NO: 36733 - RNA, 20 nt, Artificial Sequence
  CIITA targeting sequence
gaccugagacaacuuacuuc

SEQ ID NO: 36734 - RNA, 20 nt, Artificial Sequence
  CIITA targeting sequence
gggaagccaaguaggagaug

SEQ ID NO: 36735 - RNA, 20 nt, Artificial Sequence
  CIITA targeting sequence
cagacaaucugaccugagac

SEQ ID NO: 36736 - RNA, 20 nt, Artificial Sequence
  CIITA targeting sequence
uacuuggcuucccagacaau

SEQ ID NO: 36737 - RNA, 20 nt, Artificial Sequence
  CIITA targeting sequence
ccuacuuggcuucccagaca

SEQ ID NO: 36738 - RNA, 20 nt, Artificial Sequence
  CIITA targeting sequence
aucuccuacuuggcuuccca

SEQ ID NO: 36739 - RNA, 20 nt, Artificial Sequence
  CIITA targeting sequence
ccaucuccuacuuggcuucc

SEQ ID NO: 36740 - RNA, 20 nt, Artificial Sequence
  CIITA targeting sequence
uauaugcaaaucuccaucuc

SEQ ID NO: 36741 - RNA, 20 nt, Artificial Sequence
  CIITA targeting sequence
ccaguaaaccuccuauaugc

SEQ ID NO: 36742 - RNA, 20 nt, Artificial Sequence
  CIITA targeting sequence
caggagggaacacccgaagg

SEQ ID NO: 36743 - RNA, 20 nt, Artificial Sequence
  CIITA targeting sequence
ugugaauguccccaguaaac

SEQ ID NO: 36744 - RNA, 20 nt, Artificial Sequence
  CIITA targeting sequence
cuccugugaauguccccagu

SEQ ID NO: 36745 - RNA, 20 nt, Artificial Sequence
  CIITA targeting sequence
gguguucccuccugugaaug

SEQ ID NO: 36746 - RNA, 20 nt, Artificial Sequence
  CIITA targeting sequence
uucggguguucccuccugug

SEQ ID NO: 36747 - RNA, 20 nt, Artificial Sequence
  CIITA targeting sequence
cuuuuccuucggguguuccc

SEQ ID NO: 36748 - RNA, 20 nt, Artificial Sequence
  CIITA targeting sequence
ucccuuuuccuucggguguu

SEQ ID NO: 36749 - RNA, 20 nt, Artificial Sequence
  CIITA targeting sequence
caacccugcuuucuucccuu

SEQ ID NO: 36750 - RNA, 20 nt, Artificial Sequence
  CIITA targeting sequence
ugcugcuucccaacccugcu

SEQ ID NO: 36751 - RNA, 20 nt, Artificial Sequence
  CIITA targeting sequence
acuccugcugcuucccaacc

SEQ ID NO: 36752 - RNA, 20 nt, Artificial Sequence
  CIITA targeting sequence
caacagaggucuuagccaau

SEQ ID NO: 36753 - RNA, 20 nt, Artificial Sequence
  CIITA targeting sequence
guugugacugcauugcaccu

SEQ ID NO: 36754 - RNA, 20 nt, Artificial Sequence
  CIITA targeting sequence
uagccaaucccauagggagc

SEQ ID NO: 36755 - RNA, 20 nt, Artificial Sequence
  CIITA targeting sequence
cauagggagcacucaagcug

SEQ ID NO: 36756 - RNA, 20 nt, Artificial Sequence
  CIITA targeting sequence
cuaugggauuggcuaagacc

SEQ ID NO: 36757 - RNA, 20 nt, Artificial Sequence
  CIITA targeting sequence
agcugggacagcaaggaagc

SEQ ID NO: 36758 - RNA, 20 nt, Artificial Sequence
  CIITA targeting sequence
cagcuugagugcucccuaug

SEQ ID NO: 36759 - RNA, 20 nt, Artificial Sequence
  CIITA targeting sequence
uugcugucccagcuugagug

SEQ ID NO: 36760 - RNA, 20 nt, Artificial Sequence
  CIITA targeting sequence
agcuuccuugcugucccagc

SEQ ID NO: 36761 - RNA, 20 nt, Artificial Sequence
  CIITA targeting sequence
caucccucaucuaccuccgu

SEQ ID NO: 36762 - RNA, 20 nt, Artificial Sequence
  CIITA targeting sequence
cucaucuaccuccguccucc

SEQ ID NO: 36763 - RNA, 20 nt, Artificial Sequence
  CIITA targeting sequence
ucuaccuccguccucccaua

SEQ ID NO: 36764 - RNA, 20 nt, Artificial Sequence
  CIITA targeting sequence
accuccguccucccauacag

SEQ ID NO: 36765 - RNA, 20 nt, Artificial Sequence
  CIITA targeting sequence
guccucccauacaggcauag

SEQ ID NO: 36766 - RNA, 20 nt, Artificial Sequence
  CIITA targeting sequence
ucccauacaggcauagccuc

SEQ ID NO: 36767 - RNA, 20 nt, Artificial Sequence
  CIITA targeting sequence
cauacaggcauagccucccc

SEQ ID NO: 36768 - RNA, 20 nt, Artificial Sequence
  CIITA targeting sequence
cccaugaugaacacucagca

SEQ ID NO: 36769 - RNA, 20 nt, Artificial Sequence
  CIITA targeting sequence
ugggggaggcuaugccugua

SEQ ID NO: 36770 - RNA, 20 nt, Artificial Sequence
  CIITA targeting sequence
ucaugggggaggcuaugccu

SEQ ID NO: 36771 - RNA, 20 nt, Artificial Sequence
  CIITA targeting sequence
gcaccagacugauacauuug

SEQ ID NO: 36772 - RNA, 20 nt, Artificial Sequence
  CIITA targeting sequence
ggugcugaguguucaucaug

SEQ ID NO: 36773 - RNA, 20 nt, Artificial Sequence
  CIITA targeting sequence
gucuggugcugaguguucau

SEQ ID NO: 36774 - RNA, 20 nt, Artificial Sequence
  CIITA targeting sequence
augaaccuacauugaugcau

SEQ ID NO: 36775 - RNA, 20 nt, Artificial Sequence
  CIITA targeting sequence
uugauuauaacaaauguauc

SEQ ID NO: 36776 - RNA, 20 nt, Artificial Sequence
  CIITA targeting sequence
auguagguucauugauuaua

SEQ ID NO: 36777 - RNA, 20 nt, Artificial Sequence
  CIITA targeting sequence
uuauuacccaagguccaugg

SEQ ID NO: 36778 - RNA, 20 nt, Artificial Sequence
  CIITA targeting sequence
augguuuguuuacaugaggg

SEQ ID NO: 36779 - RNA, 20 nt, Artificial Sequence
  CIITA targeting sequence
uguaaacaaaccauggaccu

SEQ ID NO: 36780 - RNA, 20 nt, Artificial Sequence
  CIITA targeting sequence
ugguguuguacauucugugg

SEQ ID NO: 36781 - RNA, 20 nt, Artificial Sequence
  CIITA targeting sequence
guggguuuggacagauacau

SEQ ID NO: 36782 - RNA, 20 nt, Artificial Sequence
  CIITA targeting sequence
aaacccacagaauguacaac

SEQ ID NO: 36783 - RNA, 20 nt, Artificial Sequence
  CIITA targeting sequence
guccaaacccacagaaugua

SEQ ID NO: 36784 - RNA, 20 nt, Artificial Sequence
  CIITA targeting sequence
uguaucuguccaaacccaca

SEQ ID NO: 36785 - RNA, 20 nt, Artificial Sequence
  CIITA targeting sequence
uauacauuacaucauguauc

SEQ ID NO: 36786 - RNA, 20 nt, Artificial Sequence
  CIITA targeting sequence
cacagacucauuucacuugu

SEQ ID NO: 36787 - RNA, 20 nt, Artificial Sequence
  CIITA targeting sequence
gugugauacuauaaugucau

SEQ ID NO: 36788 - RNA, 20 nt, Artificial Sequence
  CIITA targeting sequence
uuucacuugugacugagcuu

SEQ ID NO: 36789 - RNA, 20 nt, Artificial Sequence
  CIITA targeting sequence
cuugugacugagcuuguccu

SEQ ID NO: 36790 - RNA, 20 nt, Artificial Sequence
  CIITA targeting sequence
caagugaaaugagucugugu

SEQ ID NO: 36791 - RNA, 20 nt, Artificial Sequence
  CIITA targeting sequence
gucacaagugaaaugagucu

SEQ ID NO: 36792 - RNA, 20 nt, Artificial Sequence
  CIITA targeting sequence
uucuuucuuuaaccugccuc

SEQ ID NO: 36793 - RNA, 20 nt, Artificial Sequence
  CIITA targeting sequence
uucuuuaaccugccuccaac

SEQ ID NO: 36794 - RNA, 20 nt, Artificial Sequence
  CIITA targeting sequence
uuaaccugccuccaacugcu

SEQ ID NO: 36795 - RNA, 20 nt, Artificial Sequence
  CIITA targeting sequence
aacugcugagaagcccuuug

SEQ ID NO: 36796 - RNA, 20 nt, Artificial Sequence
  CIITA targeting sequence
gcaguuggaggcagguuaaa

SEQ ID NO: 36797 - RNA, 20 nt, Artificial Sequence
  CIITA targeting sequence
cagcaguuggaggcagguua

SEQ ID NO: 36798 - RNA, 20 nt, Artificial Sequence
  CIITA targeting sequence
cuagccaaagggcuucucag

SEQ ID NO: 36799 - RNA, 20 nt, Artificial Sequence
  CIITA targeting sequence
acuuuccugcucugaaguua

SEQ ID NO: 36800 - RNA, 20 nt, Artificial Sequence
  CIITA targeting sequence
ugcucugaaguuacuuuguu

SEQ ID NO: 36801 - RNA, 20 nt, Artificial Sequence
  CIITA targeting sequence
gaaguuacuuuguuugccag

SEQ ID NO: 36802 - RNA, 20 nt, Artificial Sequence
  CIITA targeting sequence
gagcaggaaaguggaaaaca

SEQ ID NO: 36803 - RNA, 20 nt, Artificial Sequence
  CIITA targeting sequence
ggcaaacaaaguaacuucag

SEQ ID NO: 36804 - RNA, 20 nt, Artificial Sequence
  CIITA targeting sequence
aacccaaagggcagggagcu

SEQ ID NO: 36805 - RNA, 20 nt, Artificial Sequence
  CIITA targeting sequence
cugcccuuuggguuugaacc

SEQ ID NO: 36806 - RNA, 20 nt, Artificial Sequence
  CIITA targeting sequence
auugcagcucccugcccuuu

SEQ ID NO: 36807 - RNA, 20 nt, Artificial Sequence
  CIITA targeting sequence
auucaacggugcuggaauug

SEQ ID NO: 36808 - RNA, 20 nt, Artificial Sequence
  CIITA targeting sequence
acggugcuggaauugggaug

SEQ ID NO: 36809 - RNA, 20 nt, Artificial Sequence
  CIITA targeting sequence
agcaccguugaauggauuuc

SEQ ID NO: 36810 - RNA, 20 nt, Artificial Sequence
  CIITA targeting sequence
caauuccagcaccguugaau

SEQ ID NO: 36811 - RNA, 20 nt, Artificial Sequence
  CIITA targeting sequence
uuuuugccaucccaauucca

SEQ ID NO: 36812 - RNA, 20 nt, Artificial Sequence
  CIITA targeting sequence
gcagggagcagcucuuugca

SEQ ID NO: 36813 - RNA, 20 nt, Artificial Sequence
  CIITA targeting sequence
cugcugacaccugccugcug

SEQ ID NO: 36814 - RNA, 20 nt, Artificial Sequence
  CIITA targeting sequence
uugcaucccacaguucccag

SEQ ID NO: 36815 - RNA, 20 nt, Artificial Sequence
  CIITA targeting sequence
cacaguucccagggagcuua

SEQ ID NO: 36816 - RNA, 20 nt, Artificial Sequence
  CIITA targeting sequence
cagggagcuuaccauucuuu

SEQ ID NO: 36817 - RNA, 20 nt, Artificial Sequence
  CIITA targeting sequence
cugggaacugugggaugcaa

SEQ ID NO: 36818 - RNA, 20 nt, Artificial Sequence
  CIITA targeting sequence
uucauucauucauucauccu

SEQ ID NO: 36819 - RNA, 20 nt, Artificial Sequence
  CIITA targeting sequence
uucauucauucauccuuuca

SEQ ID NO: 36820 - RNA, 20 nt, Artificial Sequence
  CIITA targeting sequence
uucauucauccuuucauuua

SEQ ID NO: 36821 - RNA, 20 nt, Artificial Sequence
  CIITA targeting sequence
uucauccuuucauuuaugag

SEQ ID NO: 36822 - RNA, 20 nt, Artificial Sequence
  CIITA targeting sequence
uccuuucauuuaugagacaa

SEQ ID NO: 36823 - RNA, 20 nt, Artificial Sequence
  CIITA targeting sequence
uuucauuuaugagacaaagu

SEQ ID NO: 36824 - RNA, 20 nt, Artificial Sequence
  CIITA targeting sequence
uuuaugagacaaagucucac

SEQ ID NO: 36825 - RNA, 20 nt, Artificial Sequence
  CIITA targeting sequence
uaaaugaaaggaugaaugaa

SEQ ID NO: 36826 - RNA, 20 nt, Artificial Sequence
  CIITA targeting sequence
cauaaaugaaaggaugaaug

SEQ ID NO: 36827 - RNA, 20 nt, Artificial Sequence
  CIITA targeting sequence
cacucuguugcccagguugg

SEQ ID NO: 36828 - RNA, 20 nt, Artificial Sequence
  CIITA targeting sequence
cucuguugcccagguuggag

SEQ ID NO: 36829 - RNA, 20 nt, Artificial Sequence
  CIITA targeting sequence
guugcccagguuggagugca

SEQ ID NO: 36830 - RNA, 20 nt, Artificial Sequence
  CIITA targeting sequence
aaccugggcaacagagugag

SEQ ID NO: 36831 - RNA, 20 nt, Artificial Sequence
  CIITA targeting sequence
uugcucacugcagccucaag

SEQ ID NO: 36832 - RNA, 20 nt, Artificial Sequence
  CIITA targeting sequence
cugcagccucaagcuccuga

SEQ ID NO: 36833 - RNA, 20 nt, Artificial Sequence
  CIITA targeting sequence
agcuccugagcucaagccau

SEQ ID NO: 36834 - RNA, 20 nt, Artificial Sequence
  CIITA targeting sequence
ugagcucaagccauccuccu

SEQ ID NO: 36835 - RNA, 20 nt, Artificial Sequence
  CIITA targeting sequence
ggagcuugaggcugcaguga

SEQ ID NO: 36836 - RNA, 20 nt, Artificial Sequence
  CIITA targeting sequence
agccauccuccugccucagc

SEQ ID NO: 36837 - RNA, 20 nt, Artificial Sequence
  CIITA targeting sequence
uccugccucagccucccaag

SEQ ID NO: 36838 - RNA, 20 nt, Artificial Sequence
  CIITA targeting sequence
ugccucagccucccaaguag

SEQ ID NO: 36839 - RNA, 20 nt, Artificial Sequence
  CIITA targeting sequence
gccucccaaguagccgagac

SEQ ID NO: 36840 - RNA, 20 nt, Artificial Sequence
  CIITA targeting sequence
caaguagccgagacuacaag

SEQ ID NO: 36841 - RNA, 20 nt, Artificial Sequence
  CIITA targeting sequence
gcuacuugggaggcugaggc

SEQ ID NO: 36842 - RNA, 20 nt, Artificial Sequence
  CIITA targeting sequence
cggcuacuugggaggcugag

SEQ ID NO: 36843 - RNA, 20 nt, Artificial Sequence
  CIITA targeting sequence
accacacccagcuaauuuuu

SEQ ID NO: 36844 - RNA, 20 nt, Artificial Sequence
  CIITA targeting sequence
uuuauuucugaagagauggg

SEQ ID NO: 36845 - RNA, 20 nt, Artificial Sequence
  CIITA targeting sequence
gaagagaugggguuucacua

SEQ ID NO: 36846 - RNA, 20 nt, Artificial Sequence
  CIITA targeting sequence
gaaauaaaagauacaaaaau

SEQ ID NO: 36847 - RNA, 20 nt, Artificial Sequence
  CIITA targeting sequence
ucagaaauaaaagauacaaa

SEQ ID NO: 36848 - RNA, 20 nt, Artificial Sequence
  CIITA targeting sequence
cuucagaaauaaaagauaca

SEQ ID NO: 36849 - RNA, 20 nt, Artificial Sequence
  CIITA targeting sequence
cuauguugcccaggcugguc

SEQ ID NO: 36850 - RNA, 20 nt, Artificial Sequence
  CIITA targeting sequence
caaacuccuggccucaaguc

SEQ ID NO: 36851 - RNA, 20 nt, Artificial Sequence
  CIITA targeting sequence
aacuccuggccucaagucau

SEQ ID NO: 36852 - RNA, 20 nt, Artificial Sequence
  CIITA targeting sequence
uggccucaagucauccuccc

SEQ ID NO: 36853 - RNA, 20 nt, Artificial Sequence
  CIITA targeting sequence
agucauccucccuccucagc

SEQ ID NO: 36854 - RNA, 20 nt, Artificial Sequence
  CIITA targeting sequence
uccucccuccucagccuccc

SEQ ID NO: 36855 - RNA, 20 nt, Artificial Sequence
  CIITA targeting sequence
ucccuccucagccucccaaa

SEQ ID NO: 36856 - RNA, 20 nt, Artificial Sequence
  CIITA targeting sequence
cuccucagccucccaaagug

SEQ ID NO: 36857 - RNA, 20 nt, Artificial Sequence
  CIITA targeting sequence
ucagccucccaaagugcugg

SEQ ID NO: 36858 - RNA, 20 nt, Artificial Sequence
  CIITA targeting sequence
gccucccaaagugcugggau

SEQ ID NO: 36859 - RNA, 20 nt, Artificial Sequence
  CIITA targeting sequence
caaagugcugggauuacagg

SEQ ID NO: 36860 - RNA, 20 nt, Artificial Sequence
  CIITA targeting sequence
cagcacuuugggaggcugag

SEQ ID NO: 36861 - RNA, 20 nt, Artificial Sequence
  CIITA targeting sequence
caccuguaaucccagcacuu

SEQ ID NO: 36862 - RNA, 20 nt, Artificial Sequence
  CIITA targeting sequence
cagacagcuuaccucuuaau

SEQ ID NO: 36863 - RNA, 20 nt, Artificial Sequence
  CIITA targeting sequence
gacagcuuaccucuuaauca

SEQ ID NO: 36864 - RNA, 20 nt, Artificial Sequence
  CIITA targeting sequence
gagaucacaccuguaauccc

SEQ ID NO: 36865 - RNA, 20 nt, Artificial Sequence
  CIITA targeting sequence
uaaucaccuuuccaucugag

SEQ ID NO: 36866 - RNA, 20 nt, Artificial Sequence
  CIITA targeting sequence
ccuuuccaucugagcuggca

SEQ ID NO: 36867 - RNA, 20 nt, Artificial Sequence
  CIITA targeting sequence
aucugagcuggcagcagagc

SEQ ID NO: 36868 - RNA, 20 nt, Artificial Sequence
  CIITA targeting sequence
gagcuggcagcagagcuggg

SEQ ID NO: 36869 - RNA, 20 nt, Artificial Sequence
  CIITA targeting sequence
gauggaaaggugauuaagag

SEQ ID NO: 36870 - RNA, 20 nt, Artificial Sequence
  CIITA targeting sequence
gcugccagcucagauggaaa

SEQ ID NO: 36871 - RNA, 20 nt, Artificial Sequence
  CIITA targeting sequence
cagcucugcugccagcucag

SEQ ID NO: 36872 - RNA, 20 nt, Artificial Sequence
  CIITA targeting sequence
gggguguugggugcacuuuc

SEQ ID NO: 36873 - RNA, 20 nt, Artificial Sequence
  CIITA targeting sequence
ugcuccuucucuguguggaa

SEQ ID NO: 36874 - RNA, 20 nt, Artificial Sequence
  CIITA targeting sequence
uucucuguguggaacuggcc

SEQ ID NO: 36875 - RNA, 20 nt, Artificial Sequence
  CIITA targeting sequence
cuguguggaacuggccuguu

SEQ ID NO: 36876 - RNA, 20 nt, Artificial Sequence
  CIITA targeting sequence
guguggaacuggccuguuug

SEQ ID NO: 36877 - RNA, 20 nt, Artificial Sequence
  CIITA targeting sequence
acacagagaaggagcaggaa

SEQ ID NO: 36878 - RNA, 20 nt, Artificial Sequence
  CIITA targeting sequence
ccuccaagacccucuguaga

SEQ ID NO: 36879 - RNA, 20 nt, Artificial Sequence
  CIITA targeting sequence
aagacccucuguagaaaaag

SEQ ID NO: 36880 - RNA, 20 nt, Artificial Sequence
  CIITA targeting sequence
uggaggggacuggcccuggg

SEQ ID NO: 36881 - RNA, 20 nt, Artificial Sequence
  CIITA targeting sequence
guagaaaaagacccuacugu

SEQ ID NO: 36882 - RNA, 20 nt, Artificial Sequence
  CIITA targeting sequence
acagagggucuuggagggga

SEQ ID NO: 36883 - RNA, 20 nt, Artificial Sequence
  CIITA targeting sequence
uuuucuacagagggucuugg

SEQ ID NO: 36884 - RNA, 20 nt, Artificial Sequence
  CIITA targeting sequence
auuccauugcaggacaggac

SEQ ID NO: 36885 - RNA, 20 nt, Artificial Sequence
  CIITA targeting sequence
auugcaggacaggacauaau

SEQ ID NO: 36886 - RNA, 20 nt, Artificial Sequence
  CIITA targeting sequence
ugcaauggaauugaggugua

SEQ ID NO: 36887 - RNA, 20 nt, Artificial Sequence
  CIITA targeting sequence
uguccugcaauggaauugag

SEQ ID NO: 36888 - RNA, 20 nt, Artificial Sequence
  CIITA targeting sequence
auuauguccuguccugcaau

SEQ ID NO: 36889 - RNA, 20 nt, Artificial Sequence
  CIITA targeting sequence
ugccucucccugccccaguc

SEQ ID NO: 36890 - RNA, 20 nt, Artificial Sequence
  CIITA targeting sequence
cccugccccagucacccauc

SEQ ID NO: 36891 - RNA, 20 nt, Artificial Sequence
  CIITA targeting sequence
cugccccagucacccauccc

SEQ ID NO: 36892 - RNA, 20 nt, Artificial Sequence
  CIITA targeting sequence
cccaucccucccaagccauu

SEQ ID NO: 36893 - RNA, 20 nt, Artificial Sequence
  CIITA targeting sequence
cucccaagccauuaucuugg

SEQ ID NO: 36894 - RNA, 20 nt, Artificial Sequence
  CIITA targeting sequence
caagccauuaucuugggacc

SEQ ID NO: 36895 - RNA, 20 nt, Artificial Sequence
  CIITA targeting sequence
ugggaccugcaagggccucc

SEQ ID NO: 36896 - RNA, 20 nt, Artificial Sequence
  CIITA targeting sequence
caagauaauggcuugggagg

SEQ ID NO: 36897 - RNA, 20 nt, Artificial Sequence
  CIITA targeting sequence
aagccaaggguggcaaaucc

SEQ ID NO: 36898 - RNA, 20 nt, Artificial Sequence
  CIITA targeting sequence
aaauaccaaaggggccauaa

SEQ ID NO: 36899 - RNA, 20 nt, Artificial Sequence
  CIITA targeting sequence
uuauggccccuuugguauuu

SEQ ID NO: 36900 - RNA, 20 nt, Artificial Sequence
  CIITA targeting sequence
aggcagaaggcaauagggag

SEQ ID NO: 36901 - RNA, 20 nt, Artificial Sequence
  CIITA targeting sequence
gccuggacacauuuuacauc

SEQ ID NO: 36902 - RNA, 20 nt, Artificial Sequence
  CIITA targeting sequence
cuauugccuucugccuggac

SEQ ID NO: 36903 - RNA, 20 nt, Artificial Sequence
  CIITA targeting sequence
gguaacaauuguguguacuc

SEQ ID NO: 36904 - RNA, 20 nt, Artificial Sequence
  CIITA targeting sequence
auauagagacauugugaugg

SEQ ID NO: 36905 - RNA, 20 nt, Artificial Sequence
  CIITA targeting sequence
auauagaguacacacaauug

SEQ ID NO: 36906 - RNA, 20 nt, Artificial Sequence
  CIITA targeting sequence
cuauauagaguacacacaau

SEQ ID NO: 36907 - RNA, 20 nt, Artificial Sequence
  CIITA targeting sequence
caaugucucuauauagagua

SEQ ID NO: 36908 - RNA, 20 nt, Artificial Sequence
  CIITA targeting sequence
ccaucacaaugucucuauau

SEQ ID NO: 36909 - RNA, 20 nt, Artificial Sequence
  CIITA targeting sequence
aaaucaccaucacaaugucu

SEQ ID NO: 36910 - RNA, 20 nt, Artificial Sequence
  CIITA targeting sequence
caagccaauauaagugugug

SEQ ID NO: 36911 - RNA, 20 nt, Artificial Sequence
  CIITA targeting sequence
acuggauucaacuuuugauu

SEQ ID NO: 36912 - RNA, 20 nt, Artificial Sequence
  CIITA targeting sequence
auaggccuauuuguuuuguu

SEQ ID NO: 36913 - RNA, 20 nt, Artificial Sequence
  CIITA targeting sequence
agucgauaggccuauuuguu

SEQ ID NO: 36914 - RNA, 20 nt, Artificial Sequence
  CIITA targeting sequence
acuuuugauuuugcagccaa

SEQ ID NO: 36915 - RNA, 20 nt, Artificial Sequence
  CIITA targeting sequence
aaaguugaauccagucgaua

SEQ ID NO: 36916 - RNA, 20 nt, Artificial Sequence
  CIITA targeting sequence
gcugugccacaggggcuugg

SEQ ID NO: 36917 - RNA, 20 nt, Artificial Sequence
  CIITA targeting sequence
ucagcugugccacaggggcu

SEQ ID NO: 36918 - RNA, 20 nt, Artificial Sequence
  CIITA targeting sequence
gaaaggggauuuagagccaa

SEQ ID NO: 36919 - RNA, 20 nt, Artificial Sequence
  CIITA targeting sequence
gaccugcaagcuccucagcu

SEQ ID NO: 36920 - RNA, 20 nt, Artificial Sequence
  CIITA targeting sequence
ccuuucugaccugcaagcuc

SEQ ID NO: 36921 - RNA, 20 nt, Artificial Sequence
  CIITA targeting sequence
aaauccccuuucugaccugc

SEQ ID NO: 36922 - RNA, 20 nt, Artificial Sequence
  CIITA targeting sequence
ccagaccucuccugacacga

SEQ ID NO: 36923 - RNA, 20 nt, Artificial Sequence
  CIITA targeting sequence
agaccucuccugacacgaag

SEQ ID NO: 36924 - RNA, 20 nt, Artificial Sequence
  CIITA targeting sequence
ggagauauugcuauugguug

SEQ ID NO: 36925 - RNA, 20 nt, Artificial Sequence
  CIITA targeting sequence
ccugacacgaagcucaucug

SEQ ID NO: 36926 - RNA, 20 nt, Artificial Sequence
  CIITA targeting sequence
ugacacgaagcucaucugac

SEQ ID NO: 36927 - RNA, 20 nt, Artificial Sequence
  CIITA targeting sequence
ggagaggucuggagauauug

SEQ ID NO: 36928 - RNA, 20 nt, Artificial Sequence
  CIITA targeting sequence
ugucaggagaggucuggaga

SEQ ID NO: 36929 - RNA, 20 nt, Artificial Sequence
  CIITA targeting sequence
ucugaccuccugcccccauu

SEQ ID NO: 36930 - RNA, 20 nt, Artificial Sequence
  CIITA targeting sequence
gaccuccugcccccauuaca

SEQ ID NO: 36931 - RNA, 20 nt, Artificial Sequence
  CIITA targeting sequence
gaugagcuucgugucaggag

SEQ ID NO: 36932 - RNA, 20 nt, Artificial Sequence
  CIITA targeting sequence
ugcccccauuacacacauac

SEQ ID NO: 36933 - RNA, 20 nt, Artificial Sequence
  CIITA targeting sequence
ucuagucucccugccuugag

SEQ ID NO: 36934 - RNA, 20 nt, Artificial Sequence
  CIITA targeting sequence
agucucccugccuugaggac

SEQ ID NO: 36935 - RNA, 20 nt, Artificial Sequence
  CIITA targeting sequence
cccugccuugaggacaaaug

SEQ ID NO: 36936 - RNA, 20 nt, Artificial Sequence
  CIITA targeting sequence
cugccuugaggacaaaugau

SEQ ID NO: 36937 - RNA, 20 nt, Artificial Sequence
  CIITA targeting sequence
aggcagggagacuagaagac

SEQ ID NO: 36938 - RNA, 20 nt, Artificial Sequence
  CIITA targeting sequence
ucaaggcagggagacuagaa

SEQ ID NO: 36939 - RNA, 20 nt, Artificial Sequence
  CIITA targeting sequence
uuuguccucaaggcagggag

SEQ ID NO: 36940 - RNA, 20 nt, Artificial Sequence
  CIITA targeting sequence
gauccugcaacuguuuccag

SEQ ID NO: 36941 - RNA, 20 nt, Artificial Sequence
  CIITA targeting sequence
gaucauuuguccucaaggca

SEQ ID NO: 36942 - RNA, 20 nt, Artificial Sequence
  CIITA targeting sequence
ugcaacuguuuccaggccca

SEQ ID NO: 36943 - RNA, 20 nt, Artificial Sequence
  CIITA targeting sequence
aggcccauaagccccugagc

SEQ ID NO: 36944 - RNA, 20 nt, Artificial Sequence
  CIITA targeting sequence
ggggcuuaugggccuggaaa

SEQ ID NO: 36945 - RNA, 20 nt, Artificial Sequence
  CIITA targeting sequence
ucuccgucuccugugaccuc

SEQ ID NO: 36946 - RNA, 20 nt, Artificial Sequence
  CIITA targeting sequence
ccgucuccugugaccuccuc

SEQ ID NO: 36947 - RNA, 20 nt, Artificial Sequence
  CIITA targeting sequence
gucuccugugaccuccucgu

SEQ ID NO: 36948 - RNA, 20 nt, Artificial Sequence
  CIITA targeting sequence
ccugugaccuccucgugcca

SEQ ID NO: 36949 - RNA, 20 nt, Artificial Sequence
  CIITA targeting sequence
ugugaccuccucgugccacu

SEQ ID NO: 36950 - RNA, 20 nt, Artificial Sequence
  CIITA targeting sequence
caggagacggagaggaaacu

SEQ ID NO: 36951 - RNA, 20 nt, Artificial Sequence
  CIITA targeting sequence
ucgugccacuccaggaagug

SEQ ID NO: 36952 - RNA, 20 nt, Artificial Sequence
  CIITA targeting sequence
ugccacuccaggaagugaaa

SEQ ID NO: 36953 - RNA, 20 nt, Artificial Sequence
  CIITA targeting sequence
aggaagugaaagucuugagu

SEQ ID NO: 36954 - RNA, 20 nt, Artificial Sequence
  CIITA targeting sequence
uggaguggcacgaggagguc

SEQ ID NO: 36955 - RNA, 20 nt, Artificial Sequence
  CIITA targeting sequence
cuuccuggaguggcacgagg

SEQ ID NO: 36956 - RNA, 20 nt, Artificial Sequence
  CIITA targeting sequence
ugagugagaccaguaguuuc

SEQ ID NO: 36957 - RNA, 20 nt, Artificial Sequence
  CIITA targeting sequence
agacuuucacuuccuggagu

SEQ ID NO: 36958 - RNA, 20 nt, Artificial Sequence
  CIITA targeting sequence
cucaagacuuucacuuccug

SEQ ID NO: 36959 - RNA, 20 nt, Artificial Sequence
  CIITA targeting sequence
cacucaagacuuucacuucc

SEQ ID NO: 36960 - RNA, 20 nt, Artificial Sequence
  CIITA targeting sequence
cuuaaguccucucucugucu

SEQ ID NO: 36961 - RNA, 20 nt, Artificial Sequence
  CIITA targeting sequence
uaaguccucucucugucucg

SEQ ID NO: 36962 - RNA, 20 nt, Artificial Sequence
  CIITA targeting sequence
ucucucugucucguucuccu

SEQ ID NO: 36963 - RNA, 20 nt, Artificial Sequence
  CIITA targeting sequence
cucugucucguucuccuggg

SEQ ID NO: 36964 - RNA, 20 nt, Artificial Sequence
  CIITA targeting sequence
cugucucguucuccugggau

SEQ ID NO: 36965 - RNA, 20 nt, Artificial Sequence
  CIITA targeting sequence
gucucguucuccugggauau

SEQ ID NO: 36966 - RNA, 20 nt, Artificial Sequence
  CIITA targeting sequence
cguucuccugggauaucuac

SEQ ID NO: 36967 - RNA, 20 nt, Artificial Sequence
  CIITA targeting sequence
uucuccugggauaucuacac

SEQ ID NO: 36968 - RNA, 20 nt, Artificial Sequence
  CIITA targeting sequence
ccugggauaucuacacuugg

SEQ ID NO: 36969 - RNA, 20 nt, Artificial Sequence
  CIITA targeting sequence
ugggauaucuacacuugguu

SEQ ID NO: 36970 - RNA, 20 nt, Artificial Sequence
  CIITA targeting sequence
caggagaacgagacagagag

SEQ ID NO: 36971 - RNA, 20 nt, Artificial Sequence
  CIITA targeting sequence
acacuugguuugcaaacagc

SEQ ID NO: 36972 - RNA, 20 nt, Artificial Sequence
  CIITA targeting sequence
agccugcuguuugcaaacca

SEQ ID NO: 36973 - RNA, 20 nt, Artificial Sequence
  CIITA targeting sequence
ccagccugcuguuugcaaac

SEQ ID NO: 36974 - RNA, 20 nt, Artificial Sequence
  CIITA targeting sequence
cucuccagccugcuguuugc

SEQ ID NO: 36975 - RNA, 20 nt, Artificial Sequence
  CIITA targeting sequence
uccucuacauccagcuccuc

SEQ ID NO: 36976 - RNA, 20 nt, Artificial Sequence
  CIITA targeting sequence
ucuacauccagcuccucccc

SEQ ID NO: 36977 - RNA, 20 nt, Artificial Sequence
  CIITA targeting sequence
acauccagcuccucccccau

SEQ ID NO: 36978 - RNA, 20 nt, Artificial Sequence
  CIITA targeting sequence
agcuccucccccauccugcu

SEQ ID NO: 36979 - RNA, 20 nt, Artificial Sequence
  CIITA targeting sequence
ucccccauccugcuccaagu

SEQ ID NO: 36980 - RNA, 20 nt, Artificial Sequence
  CIITA targeting sequence
cccauccugcuccaagucca

SEQ ID NO: 36981 - RNA, 20 nt, Artificial Sequence
  CIITA targeting sequence
ugcuccaaguccagcauguu

SEQ ID NO: 36982 - RNA, 20 nt, Artificial Sequence
  CIITA targeting sequence
aaguccagcauguuccuauc

SEQ ID NO: 36983 - RNA, 20 nt, Artificial Sequence
  CIITA targeting sequence
agcauguuccuaucucuucc

SEQ ID NO: 36984 - RNA, 20 nt, Artificial Sequence
  CIITA targeting sequence
uaucucuuccccaggacccu

SEQ ID NO: 36985 - RNA, 20 nt, Artificial Sequence
  CIITA targeting sequence
cuuccccaggacccugggcu

SEQ ID NO: 36986 - RNA, 20 nt, Artificial Sequence
  CIITA targeting sequence
uccccaggacccugggcucu

SEQ ID NO: 36987 - RNA, 20 nt, Artificial Sequence
  CIITA targeting sequence
ccaggacccugggcucuugg

SEQ ID NO: 36988 - RNA, 20 nt, Artificial Sequence
  CIITA targeting sequence
uggggaagagauaggaacau

SEQ ID NO: 36989 - RNA, 20 nt, Artificial Sequence
  CIITA targeting sequence
ugggcacaaaucaagccauc

SEQ ID NO: 36990 - RNA, 20 nt, Artificial Sequence
  CIITA targeting sequence
agccaucaccagacagccug

SEQ ID NO: 36991 - RNA, 20 nt, Artificial Sequence
  CIITA targeting sequence
ccagacagccuguggggugg

SEQ ID NO: 36992 - RNA, 20 nt, Artificial Sequence
  CIITA targeting sequence
ggugauggcuugauuugugc

SEQ ID NO: 36993 - RNA, 20 nt, Artificial Sequence
  CIITA targeting sequence
ugccaccccacaggcugucu

SEQ ID NO: 36994 - RNA, 20 nt, Artificial Sequence
  CIITA targeting sequence
gcucuugccaccccacaggc

SEQ ID NO: 36995 - RNA, 20 nt, Artificial Sequence
  CIITA targeting sequence
uugugaacaucuauagguac

SEQ ID NO: 36996 - RNA, 20 nt, Artificial Sequence
  CIITA targeting sequence
caaagaaacaaaccucugcu

SEQ ID NO: 36997 - RNA, 20 nt, Artificial Sequence
  CIITA targeting sequence
auagguaccaggcucugugc

SEQ ID NO: 36998 - RNA, 20 nt, Artificial Sequence
  CIITA targeting sequence
gugcaggcccuauuguuggu

SEQ ID NO: 36999 - RNA, 20 nt, Artificial Sequence
  CIITA targeting sequence
ccaacaauagggccugcaca

SEQ ID NO: 37000 - RNA, 20 nt, Artificial Sequence
  CIITA targeting sequence
auggcucaccaacaauaggg

SEQ ID NO: 37001 - RNA, 20 nt, Artificial Sequence
  CIITA targeting sequence
ccccaugaauccuccuuugu

SEQ ID NO: 37002 - RNA, 20 nt, Artificial Sequence
  CIITA targeting sequence
uggggugagguugguaccuc

SEQ ID NO: 37003 - RNA, 20 nt, Artificial Sequence
  CIITA targeting sequence
uccuuuguuucuuuucuuuu

SEQ ID NO: 37004 - RNA, 20 nt, Artificial Sequence
  CIITA targeting sequence
uuuguuucuuuucuuuucaa

SEQ ID NO: 37005 - RNA, 20 nt, Artificial Sequence
  CIITA targeting sequence
uuucuuuucaaccccugggc

SEQ ID NO: 37006 - RNA, 20 nt, Artificial Sequence
  CIITA targeting sequence
uuucaaccccugggccuuua

SEQ ID NO: 37007 - RNA, 20 nt, Artificial Sequence
  CIITA targeting sequence
accccugggccuuuaaaccu

SEQ ID NO: 37008 - RNA, 20 nt, Artificial Sequence
  CIITA targeting sequence
auuaacugcccagugcagcc

SEQ ID NO: 37009 - RNA, 20 nt, Artificial Sequence
  CIITA targeting sequence
aagguuuaaaggcccagggg

SEQ ID NO: 37010 - RNA, 20 nt, Artificial Sequence
  CIITA targeting sequence
ugguacacuaugaucuuugg

SEQ ID NO: 37011 - RNA, 20 nt, Artificial Sequence
  CIITA targeting sequence
uaguguaccaugaccugggc

SEQ ID NO: 37012 - RNA, 20 nt, Artificial Sequence
  CIITA targeting sequence
uugguucacaugaggguuuu

SEQ ID NO: 37013 - RNA, 20 nt, Artificial Sequence
  CIITA targeting sequence
caugaggguuuucucuucau

SEQ ID NO: 37014 - RNA, 20 nt, Artificial Sequence
  CIITA targeting sequence
ugugaaccaaagaucauagu

SEQ ID NO: 37015 - RNA, 20 nt, Artificial Sequence
  CIITA targeting sequence
cuucauuaaugucccuauuu

SEQ ID NO: 37016 - RNA, 20 nt, Artificial Sequence
  CIITA targeting sequence
ucauuaaugucccuauuucc

SEQ ID NO: 37017 - RNA, 20 nt, Artificial Sequence
  CIITA targeting sequence
uuaaugucccuauuucccau

SEQ ID NO: 37018 - RNA, 20 nt, Artificial Sequence
  CIITA targeting sequence
cuauuucccauacugggugc

SEQ ID NO: 37019 - RNA, 20 nt, Artificial Sequence
  CIITA targeting sequence
cauacugggugcccauucua

SEQ ID NO: 37020 - RNA, 20 nt, Artificial Sequence
  CIITA targeting sequence
aaugcauuucagguguaucu

SEQ ID NO: 37021 - RNA, 20 nt, Artificial Sequence
  CIITA targeting sequence
gguguaucuuucuguuugua

SEQ ID NO: 37022 - RNA, 20 nt, Artificial Sequence
  CIITA targeting sequence
uucuguuuguaugugcucuu

SEQ ID NO: 37023 - RNA, 20 nt, Artificial Sequence
  CIITA targeting sequence
guuuguaugugcucuuauaa

SEQ ID NO: 37024 - RNA, 20 nt, Artificial Sequence
  CIITA targeting sequence
uauaaaacauguuuugccuu

SEQ ID NO: 37025 - RNA, 20 nt, Artificial Sequence
  CIITA targeting sequence
aaaaaaaaaaaaaaaaggca

SEQ ID NO: 37026 - RNA, 20 nt, Artificial Sequence
  CIITA targeting sequence
aucuaaaaaaaaaaaaaaaa

SEQ ID NO: 37027 - RNA, 20 nt, Artificial Sequence
  CIITA targeting sequence
cacucugucacccaggcuga

SEQ ID NO: 37028 - RNA, 20 nt, Artificial Sequence
  CIITA targeting sequence
cucugucacccaggcugagu

SEQ ID NO: 37029 - RNA, 20 nt, Artificial Sequence
  CIITA targeting sequence
gucacccaggcugaguuuuc

SEQ ID NO: 37030 - RNA, 20 nt, Artificial Sequence
  CIITA targeting sequence
cccaggcugaguuuucuauu

SEQ ID NO: 37031 - RNA, 20 nt, Artificial Sequence
  CIITA targeting sequence
gccugggugacagagugaga

SEQ ID NO: 37032 - RNA, 20 nt, Artificial Sequence
  CIITA targeting sequence
auuuuuaguagagauggggu

SEQ ID NO: 37033 - RNA, 20 nt, Artificial Sequence
  CIITA targeting sequence
acuaaaaauagaaaacucag

SEQ ID NO: 37034 - RNA, 20 nt, Artificial Sequence
  CIITA targeting sequence
cuacuaaaaauagaaaacuc

SEQ ID NO: 37035 - RNA, 20 nt, Artificial Sequence
  CIITA targeting sequence
caaacuccugaccucaggug

SEQ ID NO: 37036 - RNA, 20 nt, Artificial Sequence
  CIITA targeting sequence
aacuccugaccucaggugau

SEQ ID NO: 37037 - RNA, 20 nt, Artificial Sequence
  CIITA targeting sequence
ugaccucaggugauccaccc

SEQ ID NO: 37038 - RNA, 20 nt, Artificial Sequence
  CIITA targeting sequence
ggaguuugagaccagccugg

SEQ ID NO: 37039 - RNA, 20 nt, Artificial Sequence
  CIITA targeting sequence
ggugauccacccgccucggc

SEQ ID NO: 37040 - RNA, 20 nt, Artificial Sequence
  CIITA targeting sequence
ccugaggucaggaguuugag

SEQ ID NO: 37041 - RNA, 20 nt, Artificial Sequence
  CIITA targeting sequence
acccgccucggccucccaaa

SEQ ID NO: 37042 - RNA, 20 nt, Artificial Sequence
  CIITA targeting sequence
gccucccaaagugcuggaau

SEQ ID NO: 37043 - RNA, 20 nt, Artificial Sequence
  CIITA targeting sequence
caaagugcuggaauuacagg

SEQ ID NO: 37044 - RNA, 20 nt, Artificial Sequence
  CIITA targeting sequence
agcacuuugggaggccgagg

SEQ ID NO: 37045 - RNA, 20 nt, Artificial Sequence
  CIITA targeting sequence
caccuguaauuccagcacuu

SEQ ID NO: 37046 - RNA, 20 nt, Artificial Sequence
  CIITA targeting sequence
ccacgccuggccacaguuuc

SEQ ID NO: 37047 - RNA, 20 nt, Artificial Sequence
  CIITA targeting sequence
uacuuuugcauucuguacua

SEQ ID NO: 37048 - RNA, 20 nt, Artificial Sequence
  CIITA targeting sequence
guacuauguuuuuaggaucu

SEQ ID NO: 37049 - RNA, 20 nt, Artificial Sequence
  CIITA targeting sequence
uaaaaacauaguacagaaug

SEQ ID NO: 37050 - RNA, 20 nt, Artificial Sequence
  CIITA targeting sequence
acuugccuugcuucugaugc

SEQ ID NO: 37051 - RNA, 20 nt, Artificial Sequence
  CIITA targeting sequence
gaugcauuugaucuuugcuu

SEQ ID NO: 37052 - RNA, 20 nt, Artificial Sequence
  CIITA targeting sequence
gaagcaaggcaaguagaucc

SEQ ID NO: 37053 - RNA, 20 nt, Artificial Sequence
  CIITA targeting sequence
aaugcaucagaagcaaggca

SEQ ID NO: 37054 - RNA, 20 nt, Artificial Sequence
  CIITA targeting sequence
uugcuucuaaucacggacau

SEQ ID NO: 37055 - RNA, 20 nt, Artificial Sequence
  CIITA targeting sequence
aaucacggacauuguucucu

SEQ ID NO: 37056 - RNA, 20 nt, Artificial Sequence
  CIITA targeting sequence
cggacauuguucucuaugga

SEQ ID NO: 37057 - RNA, 20 nt, Artificial Sequence
  CIITA targeting sequence
gugauuagaagcaaagauca

SEQ ID NO: 37058 - RNA, 20 nt, Artificial Sequence
  CIITA targeting sequence
cuauggagugcagggguuac

SEQ ID NO: 37059 - RNA, 20 nt, Artificial Sequence
  CIITA targeting sequence
auggagugcagggguuacuu

SEQ ID NO: 37060 - RNA, 20 nt, Artificial Sequence
  CIITA targeting sequence
auagagaacaauguccguga

SEQ ID NO: 37061 - RNA, 20 nt, Artificial Sequence
  CIITA targeting sequence
ccuguccacacccccaguga

SEQ ID NO: 37062 - RNA, 20 nt, Artificial Sequence
  CIITA targeting sequence
acacccccagugauggacac

SEQ ID NO: 37063 - RNA, 20 nt, Artificial Sequence
  CIITA targeting sequence
cuggggguguggacagguga

SEQ ID NO: 37064 - RNA, 20 nt, Artificial Sequence
  CIITA targeting sequence
aucacuggggguguggacag

SEQ ID NO: 37065 - RNA, 20 nt, Artificial Sequence
  CIITA targeting sequence
ccuagguguccaucacuggg

SEQ ID NO: 37066 - RNA, 20 nt, Artificial Sequence
  CIITA targeting sequence
aacucucugucaccacaaau

SEQ ID NO: 37067 - RNA, 20 nt, Artificial Sequence
  CIITA targeting sequence
cugucaccacaaauaacaca

SEQ ID NO: 37068 - RNA, 20 nt, Artificial Sequence
  CIITA targeting sequence
gucaccacaaauaacacagc

SEQ ID NO: 37069 - RNA, 20 nt, Artificial Sequence
  CIITA targeting sequence
ccacaaauaacacagcagua

SEQ ID NO: 37070 - RNA, 20 nt, Artificial Sequence
  CIITA targeting sequence
ucagauggguucuccugggg

SEQ ID NO: 37071 - RNA, 20 nt, Artificial Sequence
  CIITA targeting sequence
gauggguucuccuggggagu

SEQ ID NO: 37072 - RNA, 20 nt, Artificial Sequence
  CIITA targeting sequence
gaggaugguuacugcugugu

SEQ ID NO: 37073 - RNA, 20 nt, Artificial Sequence
  CIITA targeting sequence
ccuggggaguugugggaaca

SEQ ID NO: 37074 - RNA, 20 nt, Artificial Sequence
  CIITA targeting sequence
uggggaguugugggaacauu

SEQ ID NO: 37075 - RNA, 20 nt, Artificial Sequence
  CIITA targeting sequence
ccaggagaacccaucugagg

SEQ ID NO: 37076 - RNA, 20 nt, Artificial Sequence
  CIITA targeting sequence
cacaacuccccaggagaacc

SEQ ID NO: 37077 - RNA, 20 nt, Artificial Sequence
  CIITA targeting sequence
ucaggauauauagacccaag

SEQ ID NO: 37078 - RNA, 20 nt, Artificial Sequence
  CIITA targeting sequence
ggauauauagacccaagagc

SEQ ID NO: 37079 - RNA, 20 nt, Artificial Sequence
  CIITA targeting sequence
ugaagaaauguucccacaac

SEQ ID NO: 37080 - RNA, 20 nt, Artificial Sequence
  CIITA targeting sequence
auauauccugaagaaauguu

SEQ ID NO: 37081 - RNA, 20 nt, Artificial Sequence
  CIITA targeting sequence
ugggucuauauauccugaag

SEQ ID NO: 37082 - RNA, 20 nt, Artificial Sequence
  CIITA targeting sequence
gcucuugggucuauauaucc

SEQ ID NO: 37083 - RNA, 20 nt, Artificial Sequence
  CIITA targeting sequence
uaccaccuggcaauucagcu

SEQ ID NO: 37084 - RNA, 20 nt, Artificial Sequence
  CIITA targeting sequence
acauauccuuagauauucua

SEQ ID NO: 37085 - RNA, 20 nt, Artificial Sequence
  CIITA targeting sequence
uuagauauucuacaugaugc

SEQ ID NO: 37086 - RNA, 20 nt, Artificial Sequence
  CIITA targeting sequence
aaggauauguagauccuacc

SEQ ID NO: 37087 - RNA, 20 nt, Artificial Sequence
  CIITA targeting sequence
acaugaugccaggucguucu

SEQ ID NO: 37088 - RNA, 20 nt, Artificial Sequence
  CIITA targeting sequence
uguagaauaucuaaggauau

SEQ ID NO: 37089 - RNA, 20 nt, Artificial Sequence
  CIITA targeting sequence
uucuccagagcggccccauc

SEQ ID NO: 37090 - RNA, 20 nt, Artificial Sequence
  CIITA targeting sequence
ccagagcggccccauccauc

SEQ ID NO: 37091 - RNA, 20 nt, Artificial Sequence
  CIITA targeting sequence
agagcggccccauccaucua

SEQ ID NO: 37092 - RNA, 20 nt, Artificial Sequence
  CIITA targeting sequence
ggagaacgaccuggcaucau

SEQ ID NO: 37093 - RNA, 20 nt, Artificial Sequence
  CIITA targeting sequence
aucuacauucccacaaaccc

SEQ ID NO: 37094 - RNA, 20 nt, Artificial Sequence
  CIITA targeting sequence
acauucccacaaacccgugu

SEQ ID NO: 37095 - RNA, 20 nt, Artificial Sequence
  CIITA targeting sequence
cacaaacccguguaaccaac

SEQ ID NO: 37096 - RNA, 20 nt, Artificial Sequence
  CIITA targeting sequence
cagaugucuaacuuuugcca

SEQ ID NO: 37097 - RNA, 20 nt, Artificial Sequence
  CIITA targeting sequence
gggaaaugccaaguguuggu

SEQ ID NO: 37098 - RNA, 20 nt, Artificial Sequence
  CIITA targeting sequence
aacuuuugccaguuguacag

SEQ ID NO: 37099 - RNA, 20 nt, Artificial Sequence
  CIITA targeting sequence
agugucacuuugcuguuuua

SEQ ID NO: 37100 - RNA, 20 nt, Artificial Sequence
  CIITA targeting sequence
cuuugcuguuuuauuuuugg

SEQ ID NO: 37101 - RNA, 20 nt, Artificial Sequence
  CIITA targeting sequence
aaaaauaaaacagcaaagug

SEQ ID NO: 37102 - RNA, 20 nt, Artificial Sequence
  CIITA targeting sequence
uaguaccacuuacucgcuaa

SEQ ID NO: 37103 - RNA, 20 nt, Artificial Sequence
  CIITA targeting sequence
cuaagucacuuuagguaagu

SEQ ID NO: 37104 - RNA, 20 nt, Artificial Sequence
  CIITA targeting sequence
cuuuagguaagucacaacaa

SEQ ID NO: 37105 - RNA, 20 nt, Artificial Sequence
  CIITA targeting sequence
caacaacccagugacauaag

SEQ ID NO: 37106 - RNA, 20 nt, Artificial Sequence
  CIITA targeting sequence
cuggguuguugugacuuacc

SEQ ID NO: 37107 - RNA, 20 nt, Artificial Sequence
  CIITA targeting sequence
auucugugacucagagaggu

SEQ ID NO: 37108 - RNA, 20 nt, Artificial Sequence
  CIITA targeting sequence
acugcauuuuguuggcacag

SEQ ID NO: 37109 - RNA, 20 nt, Artificial Sequence
  CIITA targeting sequence
gugacucagagagguugagu

SEQ ID NO: 37110 - RNA, 20 nt, Artificial Sequence
  CIITA targeting sequence
cagaaucgacugcauuuugu

SEQ ID NO: 37111 - RNA, 20 nt, Artificial Sequence
  CIITA targeting sequence
gagagguugaguaacauuug

SEQ ID NO: 37112 - RNA, 20 nt, Artificial Sequence
  CIITA targeting sequence
gagucacagaaucgacugca

SEQ ID NO: 37113 - RNA, 20 nt, Artificial Sequence
  CIITA targeting sequence
cugagucacagaaucgacug

SEQ ID NO: 37114 - RNA, 20 nt, Artificial Sequence
  CIITA targeting sequence
accucucugagucacagaau

SEQ ID NO: 37115 - RNA, 20 nt, Artificial Sequence
  CIITA targeting sequence
cacagcaaguguggaacuaa

SEQ ID NO: 37116 - RNA, 20 nt, Artificial Sequence
  CIITA targeting sequence
acacuugcugugugacuuug

SEQ ID NO: 37117 - RNA, 20 nt, Artificial Sequence
  CIITA targeting sequence
uaguuccacacuugcugugu

SEQ ID NO: 37118 - RNA, 20 nt, Artificial Sequence
  CIITA targeting sequence
aaucuuaguuccacacuugc

SEQ ID NO: 37119 - RNA, 20 nt, Artificial Sequence
  CIITA targeting sequence
ggguucaaaucuuaguucca

SEQ ID NO: 37120 - RNA, 20 nt, Artificial Sequence
  CIITA targeting sequence
cucuccuaaaauaucaucug

SEQ ID NO: 37121 - RNA, 20 nt, Artificial Sequence
  CIITA targeting sequence
cuccuaaaauaucaucuggg

SEQ ID NO: 37122 - RNA, 20 nt, Artificial Sequence
  CIITA targeting sequence
ccuaaaauaucaucuggguc

SEQ ID NO: 37123 - RNA, 20 nt, Artificial Sequence
  CIITA targeting sequence
uaaaauaucaucugggucua

SEQ ID NO: 37124 - RNA, 20 nt, Artificial Sequence
  CIITA targeting sequence
ucugggucuacauugcaagc

SEQ ID NO: 37125 - RNA, 20 nt, Artificial Sequence
  CIITA targeting sequence
gggucuacauugcaagccuc

SEQ ID NO: 37126 - RNA, 20 nt, Artificial Sequence
  CIITA targeting sequence
acauugcaagccucuuuggc

SEQ ID NO: 37127 - RNA, 20 nt, Artificial Sequence
  CIITA targeting sequence
uuggcagggacuguguggua

SEQ ID NO: 37128 - RNA, 20 nt, Artificial Sequence
  CIITA targeting sequence
cugccaaagaggcuugcaau

SEQ ID NO: 37129 - RNA, 20 nt, Artificial Sequence
  CIITA targeting sequence
uuggggccaguaaggaacug

SEQ ID NO: 37130 - RNA, 20 nt, Artificial Sequence
  CIITA targeting sequence
uuacuggccccaaagagguu

SEQ ID NO: 37131 - RNA, 20 nt, Artificial Sequence
  CIITA targeting sequence
guuccuuacuggccccaaag

SEQ ID NO: 37132 - RNA, 20 nt, Artificial Sequence
  CIITA targeting sequence
gugacuuucuuacggggugc

SEQ ID NO: 37133 - RNA, 20 nt, Artificial Sequence
  CIITA targeting sequence
cugagcucaguuccuuacug

SEQ ID NO: 37134 - RNA, 20 nt, Artificial Sequence
  CIITA targeting sequence
uacggggugcucagugaauc

SEQ ID NO: 37135 - RNA, 20 nt, Artificial Sequence
  CIITA targeting sequence
gugaaucauuguuuuacagc

SEQ ID NO: 37136 - RNA, 20 nt, Artificial Sequence
  CIITA targeting sequence
cugagcaccccguaagaaag

SEQ ID NO: 37137 - RNA, 20 nt, Artificial Sequence
  CIITA targeting sequence
uuguuuuacagcuuuagagg

SEQ ID NO: 37138 - RNA, 20 nt, Artificial Sequence
  CIITA targeting sequence
aaagcuguaaaacaaugauu

SEQ ID NO: 37139 - RNA, 20 nt, Artificial Sequence
  CIITA targeting sequence
ccucuaaagcuguaaaacaa

SEQ ID NO: 37140 - RNA, 20 nt, Artificial Sequence
  CIITA targeting sequence
cuuuuccccucuaaagcugu

SEQ ID NO: 37141 - RNA, 20 nt, Artificial Sequence
  CIITA targeting sequence
cacuuuuccccucuaaagcu

SEQ ID NO: 37142 - RNA, 20 nt, Artificial Sequence
  CIITA targeting sequence
cucacuuuuccccucuaaag

SEQ ID NO: 37143 - RNA, 20 nt, Artificial Sequence
  CIITA targeting sequence
uagaguuuaucuggaggacu

SEQ ID NO: 37144 - RNA, 20 nt, Artificial Sequence
  CIITA targeting sequence
aagaaacaucucucacuuuu

SEQ ID NO: 37145 - RNA, 20 nt, Artificial Sequence
  CIITA targeting sequence
ggaggacuacagggugcaug

SEQ ID NO: 37146 - RNA, 20 nt, Artificial Sequence
  CIITA targeting sequence
agauaaacucuaagaaacau

SEQ ID NO: 37147 - RNA, 20 nt, Artificial Sequence
  CIITA targeting sequence
uccagauaaacucuaagaaa

SEQ ID NO: 37148 - RNA, 20 nt, Artificial Sequence
  CIITA targeting sequence
ugcacccuguaguccuccag

SEQ ID NO: 37149 - RNA, 20 nt, Artificial Sequence
  CIITA targeting sequence
gcuuuugcucaugcacccug

SEQ ID NO: 37150 - RNA, 20 nt, Artificial Sequence
  CIITA targeting sequence
uuugagcuacuacccccaca

SEQ ID NO: 37151 - RNA, 20 nt, Artificial Sequence
  CIITA targeting sequence
aaugaguuccgcuuuugcuc

SEQ ID NO: 37152 - RNA, 20 nt, Artificial Sequence
  CIITA targeting sequence
uuguggggguaguagcucaa

SEQ ID NO: 37153 - RNA, 20 nt, Artificial Sequence
  CIITA targeting sequence
ggucaugguagauaggcauu

SEQ ID NO: 37154 - RNA, 20 nt, Artificial Sequence
  CIITA targeting sequence
ugguagauaggcauuccuag

SEQ ID NO: 37155 - RNA, 20 nt, Artificial Sequence
  CIITA targeting sequence
accaugaccagaccccaaac

SEQ ID NO: 37156 - RNA, 20 nt, Artificial Sequence
  CIITA targeting sequence
uaggccccuggcuucccaac

SEQ ID NO: 37157 - RNA, 20 nt, Artificial Sequence
  CIITA targeting sequence
caacaccauuuggcccccgg

SEQ ID NO: 37158 - RNA, 20 nt, Artificial Sequence
  CIITA targeting sequence
gggggccaaaugguguuggg

SEQ ID NO: 37159 - RNA, 20 nt, Artificial Sequence
  CIITA targeting sequence
ugagguuggggagcagguug

SEQ ID NO: 37160 - RNA, 20 nt, Artificial Sequence
  CIITA targeting sequence
ugacaagcugcuuccggggg

SEQ ID NO: 37161 - RNA, 20 nt, Artificial Sequence
  CIITA targeting sequence
ccaaccucaugacaagcugc

SEQ ID NO: 37162 - RNA, 20 nt, Artificial Sequence
  CIITA targeting sequence
cccaaggccccccccaacac

SEQ ID NO: 37163 - RNA, 20 nt, Artificial Sequence
  CIITA targeting sequence
uuucccccaaggcccccccc

SEQ ID NO: 37164 - RNA, 20 nt, Artificial Sequence
  CIITA targeting sequence
uuuuccuuucccccaaggcc

SEQ ID NO: 37165 - RNA, 20 nt, Artificial Sequence
  CIITA targeting sequence
ccuuuuccuuucccccaagg

SEQ ID NO: 37166 - RNA, 20 nt, Artificial Sequence
  CIITA targeting sequence
ucuccuuuuccuuuccccca

SEQ ID NO: 37167 - RNA, 20 nt, Artificial Sequence
  CIITA targeting sequence
uugccuggcagucuucuccu

SEQ ID NO: 37168 - RNA, 20 nt, Artificial Sequence
  CIITA targeting sequence
ucguugccuggcagucuucu

SEQ ID NO: 37169 - RNA, 20 nt, Artificial Sequence
  CIITA targeting sequence
gaaucucaaaaagacucaau

SEQ ID NO: 37170 - RNA, 20 nt, Artificial Sequence
  CIITA targeting sequence
gauuccucguugccuggcag

SEQ ID NO: 37171 - RNA, 20 nt, Artificial Sequence
  CIITA targeting sequence
caaaaagacucaauugaagg

SEQ ID NO: 37172 - RNA, 20 nt, Artificial Sequence
  CIITA targeting sequence
aaaagacucaauugaagggg

SEQ ID NO: 37173 - RNA, 20 nt, Artificial Sequence
  CIITA targeting sequence
uuuugagauucugauuccuc

SEQ ID NO: 37174 - RNA, 20 nt, Artificial Sequence
  CIITA targeting sequence
auugaaggggcuccaacacu

SEQ ID NO: 37175 - RNA, 20 nt, Artificial Sequence
  CIITA targeting sequence
auugagucuuuuugagauuc

SEQ ID NO: 37176 - RNA, 20 nt, Artificial Sequence
  CIITA targeting sequence
aacacucguugaaacggagg

SEQ ID NO: 37177 - RNA, 20 nt, Artificial Sequence
  CIITA targeting sequence
uugaaacggaggcucagagg

SEQ ID NO: 37178 - RNA, 20 nt, Artificial Sequence
  CIITA targeting sequence
acgaguguuggagccccuuc

SEQ ID NO: 37179 - RNA, 20 nt, Artificial Sequence
  CIITA targeting sequence
guuucaacgaguguuggagc

SEQ ID NO: 37180 - RNA, 20 nt, Artificial Sequence
  CIITA targeting sequence
gagggcuaagguaauguacu

SEQ ID NO: 37181 - RNA, 20 nt, Artificial Sequence
  CIITA targeting sequence
gagccuccguuucaacgagu

SEQ ID NO: 37182 - RNA, 20 nt, Artificial Sequence
  CIITA targeting sequence
ggaucaaaggcagagcagaa

SEQ ID NO: 37183 - RNA, 20 nt, Artificial Sequence
  CIITA targeting sequence
ugaguacauuaccuuagccc

SEQ ID NO: 37184 - RNA, 20 nt, Artificial Sequence
  CIITA targeting sequence
aaggcagagcagaaacucaa

SEQ ID NO: 37185 - RNA, 20 nt, Artificial Sequence
  CIITA targeting sequence
gccuuugauccugaguacau

SEQ ID NO: 37186 - RNA, 20 nt, Artificial Sequence
  CIITA targeting sequence
gcucugccuuugauccugag

SEQ ID NO: 37187 - RNA, 20 nt, Artificial Sequence
  CIITA targeting sequence
aaccaugucucuaggcacac

SEQ ID NO: 37188 - RNA, 20 nt, Artificial Sequence
  CIITA targeting sequence
cuaggcacacaguucagagg

SEQ ID NO: 37189 - RNA, 20 nt, Artificial Sequence
  CIITA targeting sequence
aggcacacaguucagagguc

SEQ ID NO: 37190 - RNA, 20 nt, Artificial Sequence
  CIITA targeting sequence
gaggucuucccauuauuccu

SEQ ID NO: 37191 - RNA, 20 nt, Artificial Sequence
  CIITA targeting sequence
gaacugugugccuagagaca

SEQ ID NO: 37192 - RNA, 20 nt, Artificial Sequence
  CIITA targeting sequence
ucccauuauuccucaggagg

SEQ ID NO: 37193 - RNA, 20 nt, Artificial Sequence
  CIITA targeting sequence
cauuauuccucaggaggaga

SEQ ID NO: 37194 - RNA, 20 nt, Artificial Sequence
  CIITA targeting sequence
ucaggaggagaaguucaugg

SEQ ID NO: 37195 - RNA, 20 nt, Artificial Sequence
  CIITA targeting sequence
ggaggagaaguucaugguca

SEQ ID NO: 37196 - RNA, 20 nt, Artificial Sequence
  CIITA targeting sequence
ugaggaauaaugggaagacc

SEQ ID NO: 37197 - RNA, 20 nt, Artificial Sequence
  CIITA targeting sequence
uccugaggaauaaugggaag

SEQ ID NO: 37198 - RNA, 20 nt, Artificial Sequence
  CIITA targeting sequence
ccuccugaggaauaauggga

SEQ ID NO: 37199 - RNA, 20 nt, Artificial Sequence
  CIITA targeting sequence
uggucaagaguagggaagua

SEQ ID NO: 37200 - RNA, 20 nt, Artificial Sequence
  CIITA targeting sequence
agaguagggaaguauuccuu

SEQ ID NO: 37201 - RNA, 20 nt, Artificial Sequence
  CIITA targeting sequence
ugaccaugaacuucuccucc

SEQ ID NO: 37202 - RNA, 20 nt, Artificial Sequence
  CIITA targeting sequence
cuacucuugaccaugaacuu

SEQ ID NO: 37203 - RNA, 20 nt, Artificial Sequence
  CIITA targeting sequence
uucucaagcuuuuuuuuuuu

SEQ ID NO: 37204 - RNA, 20 nt, Artificial Sequence
  CIITA targeting sequence
caagcuuuuuuuuuuuuugu

SEQ ID NO: 37205 - RNA, 20 nt, Artificial Sequence
  CIITA targeting sequence
agcuuuuuuuuuuuuugucu

SEQ ID NO: 37206 - RNA, 20 nt, Artificial Sequence
  CIITA targeting sequence
gagacagagucuugcucugu

SEQ ID NO: 37207 - RNA, 20 nt, Artificial Sequence
  CIITA targeting sequence
gacaaaaaaaaaaaaagcuu

SEQ ID NO: 37208 - RNA, 20 nt, Artificial Sequence
  CIITA targeting sequence
cagacaaaaaaaaaaaaagc

SEQ ID NO: 37209 - RNA, 20 nt, Artificial Sequence
  CIITA targeting sequence
gucucagacaaaaaaaaaaa

SEQ ID NO: 37210 - RNA, 20 nt, Artificial Sequence
  CIITA targeting sequence
ugcucugucaccgaggcugg

SEQ ID NO: 37211 - RNA, 20 nt, Artificial Sequence
  CIITA targeting sequence
gucaccgaggcuggagugca

SEQ ID NO: 37212 - RNA, 20 nt, Artificial Sequence
  CIITA targeting sequence
ccgaggcuggagugcagugg

SEQ ID NO: 37213 - RNA, 20 nt, Artificial Sequence
  CIITA targeting sequence
gugacagagcaagacucugu

SEQ ID NO: 37214 - RNA, 20 nt, Artificial Sequence
  CIITA targeting sequence
agccucggugacagagcaag

SEQ ID NO: 37215 - RNA, 20 nt, Artificial Sequence
  CIITA targeting sequence
cgccacugcacuccagccuc

SEQ ID NO: 37216 - RNA, 20 nt, Artificial Sequence
  CIITA targeting sequence
cggcucacugcaaccuccgc

SEQ ID NO: 37217 - RNA, 20 nt, Artificial Sequence
  CIITA targeting sequence
gcucacugcaaccuccgccu

SEQ ID NO: 37218 - RNA, 20 nt, Artificial Sequence
  CIITA targeting sequence
cugcaaccuccgccucccag

SEQ ID NO: 37219 - RNA, 20 nt, Artificial Sequence
  CIITA targeting sequence
gccucccagguucaagcaau

SEQ ID NO: 37220 - RNA, 20 nt, Artificial Sequence
  CIITA targeting sequence
cagguucaagcaauuuuccu

SEQ ID NO: 37221 - RNA, 20 nt, Artificial Sequence
  CIITA targeting sequence
agcaauuuuccugccucagc

SEQ ID NO: 37222 - RNA, 20 nt, Artificial Sequence
  CIITA targeting sequence
ugccucagccucccaaguag

SEQ ID NO: 37223 - RNA, 20 nt, Artificial Sequence
  CIITA targeting sequence
gccucccaaguagcugggau

SEQ ID NO: 37224 - RNA, 20 nt, Artificial Sequence
  CIITA targeting sequence
caaguagcugggauuauagg

SEQ ID NO: 37225 - RNA, 20 nt, Artificial Sequence
  CIITA targeting sequence
cagcuacuugggaggcugag

SEQ ID NO: 37226 - RNA, 20 nt, Artificial Sequence
  CIITA targeting sequence
uuuuuguauuuuugcagaga

SEQ ID NO: 37227 - RNA, 20 nt, Artificial Sequence
  CIITA targeting sequence
gcaaaaauacaaaaaugagc

SEQ ID NO: 37228 - RNA, 20 nt, Artificial Sequence
  CIITA targeting sequence
cugcaaaaauacaaaaauga

SEQ ID NO: 37229 - RNA, 20 nt, Artificial Sequence
  CIITA targeting sequence
ccaugcuggucaggcugguc

SEQ ID NO: 37230 - RNA, 20 nt, Artificial Sequence
  CIITA targeting sequence
ggcuggucuugaacuccuga

SEQ ID NO: 37231 - RNA, 20 nt, Artificial Sequence
  CIITA targeting sequence
ugaacuccugaccucaagua

SEQ ID NO: 37232 - RNA, 20 nt, Artificial Sequence
  CIITA targeting sequence
agaccagccugaccagcaug

SEQ ID NO: 37233 - RNA, 20 nt, Artificial Sequence
  CIITA targeting sequence
ugaccucaaguaauccgcca

SEQ ID NO: 37234 - RNA, 20 nt, Artificial Sequence
  CIITA targeting sequence
ggaguucaagaccagccuga

SEQ ID NO: 37235 - RNA, 20 nt, Artificial Sequence
  CIITA targeting sequence
aguaauccgccagccucggc

SEQ ID NO: 37236 - RNA, 20 nt, Artificial Sequence
  CIITA targeting sequence
gccagccucggccucucaaa

SEQ ID NO: 37237 - RNA, 20 nt, Artificial Sequence
  CIITA targeting sequence
gccucucaaagugcuaggau

SEQ ID NO: 37238 - RNA, 20 nt, Artificial Sequence
  CIITA targeting sequence
caaagugcuaggauuauagg

SEQ ID NO: 37239 - RNA, 20 nt, Artificial Sequence
  CIITA targeting sequence
aagugcuaggauuauaggcg

SEQ ID NO: 37240 - RNA, 20 nt, Artificial Sequence
  CIITA targeting sequence
uagcacuuugagaggccgag

SEQ ID NO: 37241 - RNA, 20 nt, Artificial Sequence
  CIITA targeting sequence
cgccuauaauccuagcacuu

SEQ ID NO: 37242 - RNA, 20 nt, Artificial Sequence
  CIITA targeting sequence
uucucaugcucuuuaaucac

SEQ ID NO: 37243 - RNA, 20 nt, Artificial Sequence
  CIITA targeting sequence
caugcucuuuaaucacaguu

SEQ ID NO: 37244 - RNA, 20 nt, Artificial Sequence
  CIITA targeting sequence
ugcucuuuaaucacaguuca

SEQ ID NO: 37245 - RNA, 20 nt, Artificial Sequence
  CIITA targeting sequence
uuaaucacaguucagagcag

SEQ ID NO: 37246 - RNA, 20 nt, Artificial Sequence
  CIITA targeting sequence
caguucagagcagugcugga

SEQ ID NO: 37247 - RNA, 20 nt, Artificial Sequence
  CIITA targeting sequence
gagcagugcuggaggcuuuu

SEQ ID NO: 37248 - RNA, 20 nt, Artificial Sequence
  CIITA targeting sequence
gaacugugauuaaagagcau

SEQ ID NO: 37249 - RNA, 20 nt, Artificial Sequence
  CIITA targeting sequence
agcacugcucugaacuguga

SEQ ID NO: 37250 - RNA, 20 nt, Artificial Sequence
  CIITA targeting sequence
uuugcuaccccuaaaagccu

SEQ ID NO: 37251 - RNA, 20 nt, Artificial Sequence
  CIITA targeting sequence
ucucccuuucagugccuccu

SEQ ID NO: 37252 - RNA, 20 nt, Artificial Sequence
  CIITA targeting sequence
cccuuucagugccuccuuag

SEQ ID NO: 37253 - RNA, 20 nt, Artificial Sequence
  CIITA targeting sequence
cuuucagugccuccuuagac

SEQ ID NO: 37254 - RNA, 20 nt, Artificial Sequence
  CIITA targeting sequence
gugccuccuuagacccucaa

SEQ ID NO: 37255 - RNA, 20 nt, Artificial Sequence
  CIITA targeting sequence
uuagacccucaaagauagac

SEQ ID NO: 37256 - RNA, 20 nt, Artificial Sequence
  CIITA targeting sequence
aaggaggcacugaaagggag

SEQ ID NO: 37257 - RNA, 20 nt, Artificial Sequence
  CIITA targeting sequence
aagauagacuccccgccucu

SEQ ID NO: 37258 - RNA, 20 nt, Artificial Sequence
  CIITA targeting sequence
uugagggucuaaggaggcac

SEQ ID NO: 37259 - RNA, 20 nt, Artificial Sequence
  CIITA targeting sequence
aucuuugagggucuaaggag

SEQ ID NO: 37260 - RNA, 20 nt, Artificial Sequence
  CIITA targeting sequence
ccgccucugggaagaaaaca

SEQ ID NO: 37261 - RNA, 20 nt, Artificial Sequence
  CIITA targeting sequence
gggaagaaaacaucuaauga

SEQ ID NO: 37262 - RNA, 20 nt, Artificial Sequence
  CIITA targeting sequence
cagaggcggggagucuaucu

SEQ ID NO: 37263 - RNA, 20 nt, Artificial Sequence
  CIITA targeting sequence
ucccagaggcggggagucua

SEQ ID NO: 37264 - RNA, 20 nt, Artificial Sequence
  CIITA targeting sequence
aaugaacuggacguaaucuc

SEQ ID NO: 37265 - RNA, 20 nt, Artificial Sequence
  CIITA targeting sequence
uuagauguuuucuucccaga

SEQ ID NO: 37266 - RNA, 20 nt, Artificial Sequence
  CIITA targeting sequence
aguucauuagauguuuucuu

SEQ ID NO: 37267 - RNA, 20 nt, Artificial Sequence
  CIITA targeting sequence
cagcgccugcgucuguaaaa

SEQ ID NO: 37268 - RNA, 20 nt, Artificial Sequence
  CIITA targeting sequence
gcgccugcgucuguaaaaug

SEQ ID NO: 37269 - RNA, 20 nt, Artificial Sequence
  CIITA targeting sequence
guaaaauggcuauaauaaca

SEQ ID NO: 37270 - RNA, 20 nt, Artificial Sequence
  CIITA targeting sequence
cccagaguugccguuaacag

SEQ ID NO: 37271 - RNA, 20 nt, Artificial Sequence
  CIITA targeting sequence
cagaguugccguuaacaguu

SEQ ID NO: 37272 - RNA, 20 nt, Artificial Sequence
  CIITA targeting sequence
gggagauuguuguuauuaua

SEQ ID NO: 37273 - RNA, 20 nt, Artificial Sequence
  CIITA targeting sequence
acuguuaacggcaacucugg

SEQ ID NO: 37274 - RNA, 20 nt, Artificial Sequence
  CIITA targeting sequence
guuucaacuguuaacggcaa

SEQ ID NO: 37275 - RNA, 20 nt, Artificial Sequence
  CIITA targeting sequence
agcacagccccagacacaga

SEQ ID NO: 37276 - RNA, 20 nt, Artificial Sequence
  CIITA targeting sequence
ggggcugugcuagaugccuu

SEQ ID NO: 37277 - RNA, 20 nt, Artificial Sequence
  CIITA targeting sequence
gugucuggggcugugcuaga

SEQ ID NO: 37278 - RNA, 20 nt, Artificial Sequence
  CIITA targeting sequence
cugugucuggggcugugcua

SEQ ID NO: 37279 - RNA, 20 nt, Artificial Sequence
  CIITA targeting sequence
ccccuggucacucucacaga

SEQ ID NO: 37280 - RNA, 20 nt, Artificial Sequence
  CIITA targeting sequence
ccuggucacucucacagagg

SEQ ID NO: 37281 - RNA, 20 nt, Artificial Sequence
  CIITA targeting sequence
cucucacagagguaagaagc

SEQ ID NO: 37282 - RNA, 20 nt, Artificial Sequence
  CIITA targeting sequence
cacagagguaagaagcacau

SEQ ID NO: 37283 - RNA, 20 nt, Artificial Sequence
  CIITA targeting sequence
cagagguaagaagcacauua

SEQ ID NO: 37284 - RNA, 20 nt, Artificial Sequence
  CIITA targeting sequence
gugagagugaccaggggaga

SEQ ID NO: 37285 - RNA, 20 nt, Artificial Sequence
  CIITA targeting sequence
uaccucugugagagugacca

SEQ ID NO: 37286 - RNA, 20 nt, Artificial Sequence
  CIITA targeting sequence
ucacgcauauuguacucacc

SEQ ID NO: 37287 - RNA, 20 nt, Artificial Sequence
  CIITA targeting sequence
cgcauauuguacucaccaug

SEQ ID NO: 37288 - RNA, 20 nt, Artificial Sequence
  CIITA targeting sequence
ccaugcagaaguugugcugc

SEQ ID NO: 37289 - RNA, 20 nt, Artificial Sequence
  CIITA targeting sequence
gcauggugaguacaauaugc

SEQ ID NO: 37290 - RNA, 20 nt, Artificial Sequence
  CIITA targeting sequence
uugagcacuuacuggucgcc

SEQ ID NO: 37291 - RNA, 20 nt, Artificial Sequence
  CIITA targeting sequence
augaacaguagcuuaaggca

SEQ ID NO: 37292 - RNA, 20 nt, Artificial Sequence
  CIITA targeting sequence
ccaguccccuuucuaagggc

SEQ ID NO: 37293 - RNA, 20 nt, Artificial Sequence
  CIITA targeting sequence
ccuuucuaagggcuccaugc

SEQ ID NO: 37294 - RNA, 20 nt, Artificial Sequence
  CIITA targeting sequence
aagggcuccaugcaacuuaa

SEQ ID NO: 37295 - RNA, 20 nt, Artificial Sequence
  CIITA targeting sequence
augcaacuuaacuccccuaa

SEQ ID NO: 37296 - RNA, 20 nt, Artificial Sequence
  CIITA targeting sequence
ccuaauccuaugaguugcca

SEQ ID NO: 37297 - RNA, 20 nt, Artificial Sequence
  CIITA targeting sequence
uaugaguugccaauuauuau

SEQ ID NO: 37298 - RNA, 20 nt, Artificial Sequence
  CIITA targeting sequence
uaggauuaggggaguuaagu

SEQ ID NO: 37299 - RNA, 20 nt, Artificial Sequence
  CIITA targeting sequence
cccacuuuacagauaaggaa

SEQ ID NO: 37300 - RNA, 20 nt, Artificial Sequence
  CIITA targeting sequence
guaaagugggggauaauaau

SEQ ID NO: 37301 - RNA, 20 nt, Artificial Sequence
  CIITA targeting sequence
uuaucuguaaagugggggau

SEQ ID NO: 37302 - RNA, 20 nt, Artificial Sequence
  CIITA targeting sequence
guuuccuuaucuguaaagug

SEQ ID NO: 37303 - RNA, 20 nt, Artificial Sequence
  CIITA targeting sequence
aagugguuuaaaaaaugaac

SEQ ID NO: 37304 - RNA, 20 nt, Artificial Sequence
  CIITA targeting sequence
uuuuuuaaaccacuuggagc

SEQ ID NO: 37305 - RNA, 20 nt, Artificial Sequence
  CIITA targeting sequence
ggguaaguucauuuuuuaaa

SEQ ID NO: 37306 - RNA, 20 nt, Artificial Sequence
  CIITA targeting sequence
cuaccuaccaacgcacuaca

SEQ ID NO: 37307 - RNA, 20 nt, Artificial Sequence
  CIITA targeting sequence
gguuaucccuaccuaccaac

SEQ ID NO: 37308 - RNA, 20 nt, Artificial Sequence
  CIITA targeting sequence
caacuuucagguuaucccua

SEQ ID NO: 37309 - RNA, 20 nt, Artificial Sequence
  CIITA targeting sequence
ccccaaagcucaccaucuga

SEQ ID NO: 37310 - RNA, 20 nt, Artificial Sequence
  CIITA targeting sequence
ccaucugagcuccauucauc

SEQ ID NO: 37311 - RNA, 20 nt, Artificial Sequence
  CIITA targeting sequence
gagcuccauucaucucccac

SEQ ID NO: 37312 - RNA, 20 nt, Artificial Sequence
  CIITA targeting sequence
gauggugagcuuugggguga

SEQ ID NO: 37313 - RNA, 20 nt, Artificial Sequence
  CIITA targeting sequence
auucaucucccaccagcuga

SEQ ID NO: 37314 - RNA, 20 nt, Artificial Sequence
  CIITA targeting sequence
ucucccaccagcugagaugg

SEQ ID NO: 37315 - RNA, 20 nt, Artificial Sequence
  CIITA targeting sequence
cccaccagcugagauggaac

SEQ ID NO: 37316 - RNA, 20 nt, Artificial Sequence
  CIITA targeting sequence
caccagcugagauggaacgu

SEQ ID NO: 37317 - RNA, 20 nt, Artificial Sequence
  CIITA targeting sequence
gcuggugggagaugaaugga

SEQ ID NO: 37318 - RNA, 20 nt, Artificial Sequence
  CIITA targeting sequence
cagcuggugggagaugaaug

SEQ ID NO: 37319 - RNA, 20 nt, Artificial Sequence
  CIITA targeting sequence
aucucagcuggugggagaug

SEQ ID NO: 37320 - RNA, 20 nt, Artificial Sequence
  CIITA targeting sequence
cagaagagaugcaugcacug

SEQ ID NO: 37321 - RNA, 20 nt, Artificial Sequence
  CIITA targeting sequence
gggaacagcauaacguucca

SEQ ID NO: 37322 - RNA, 20 nt, Artificial Sequence
  CIITA targeting sequence
ucugggaacagcauaacguu

SEQ ID NO: 37323 - RNA, 20 nt, Artificial Sequence
  CIITA targeting sequence
cuucugggaacagcauaacg

SEQ ID NO: 37324 - RNA, 20 nt, Artificial Sequence
  CIITA targeting sequence
gugcaugcaucucuucuggg

SEQ ID NO: 37325 - RNA, 20 nt, Artificial Sequence
  CIITA targeting sequence
ucagauaguuuaagucugag

SEQ ID NO: 37326 - RNA, 20 nt, Artificial Sequence
  CIITA targeting sequence
gauaguuuaagucugaguua

SEQ ID NO: 37327 - RNA, 20 nt, Artificial Sequence
  CIITA targeting sequence
gaagaucagugcaugcaucu

SEQ ID NO: 37328 - RNA, 20 nt, Artificial Sequence
  CIITA targeting sequence
gaguuagaacauuguggcga

SEQ ID NO: 37329 - RNA, 20 nt, Artificial Sequence
  CIITA targeting sequence
gacuuaaacuaucugaagau

SEQ ID NO: 37330 - RNA, 20 nt, Artificial Sequence
  CIITA targeting sequence
aacucagacuuaaacuaucu

SEQ ID NO: 37331 - RNA, 20 nt, Artificial Sequence
  CIITA targeting sequence
ccacaauguucuaacucaga

SEQ ID NO: 37332 - RNA, 20 nt, Artificial Sequence
  CIITA targeting sequence
ggugucgccacaauguucua

SEQ ID NO: 37333 - RNA, 20 nt, Artificial Sequence
  CIITA targeting sequence
cucgggggagagagagguga

SEQ ID NO: 37334 - RNA, 20 nt, Artificial Sequence
  CIITA targeting sequence
ggggagagagaggugaauug

SEQ ID NO: 37335 - RNA, 20 nt, Artificial Sequence
  CIITA targeting sequence
cccgagggaaaucagguguc

SEQ ID NO: 37336 - RNA, 20 nt, Artificial Sequence
  CIITA targeting sequence
cccccgagggaaaucaggug

SEQ ID NO: 37337 - RNA, 20 nt, Artificial Sequence
  CIITA targeting sequence
cucccccgagggaaaucagg

SEQ ID NO: 37338 - RNA, 20 nt, Artificial Sequence
  CIITA targeting sequence
cucucccccgagggaaauca

SEQ ID NO: 37339 - RNA, 20 nt, Artificial Sequence
  CIITA targeting sequence
ccucucucucccccgaggga

SEQ ID NO: 37340 - RNA, 20 nt, Artificial Sequence
  CIITA targeting sequence
gacaccuguuuagugucuac

SEQ ID NO: 37341 - RNA, 20 nt, Artificial Sequence
  CIITA targeting sequence
gaaauaacaauucaccucuc

SEQ ID NO: 37342 - RNA, 20 nt, Artificial Sequence
  CIITA targeting sequence
acacuuagccuuucaaaucc

SEQ ID NO: 37343 - RNA, 20 nt, Artificial Sequence
  CIITA targeting sequence
aauccugcaugcagugugaa

SEQ ID NO: 37344 - RNA, 20 nt, Artificial Sequence
  CIITA targeting sequence
ugcaugcagugugaaguggg

SEQ ID NO: 37345 - RNA, 20 nt, Artificial Sequence
  CIITA targeting sequence
cacugcaugcaggauuugaa

SEQ ID NO: 37346 - RNA, 20 nt, Artificial Sequence
  CIITA targeting sequence
ccacuucacacugcaugcag

SEQ ID NO: 37347 - RNA, 20 nt, Artificial Sequence
  CIITA targeting sequence
uccccacuucacacugcaug

SEQ ID NO: 37348 - RNA, 20 nt, Artificial Sequence
  CIITA targeting sequence
uuuuugggguuuauuuucau

SEQ ID NO: 37349 - RNA, 20 nt, Artificial Sequence
  CIITA targeting sequence
aaaguccuuuuugggguuua

SEQ ID NO: 37350 - RNA, 20 nt, Artificial Sequence
  CIITA targeting sequence
uuuugccaucaaaaguccuu

SEQ ID NO: 37351 - RNA, 20 nt, Artificial Sequence
  CIITA targeting sequence
ggaauauuuucucgaguugg

SEQ ID NO: 37352 - RNA, 20 nt, Artificial Sequence
  CIITA targeting sequence
ugaucuuuuugccaucaaaa

SEQ ID NO: 37353 - RNA, 20 nt, Artificial Sequence
  CIITA targeting sequence
cgaguuggauguggaaggug

SEQ ID NO: 37354 - RNA, 20 nt, Artificial Sequence
  CIITA targeting sequence
aguuggauguggaagguggu

SEQ ID NO: 37355 - RNA, 20 nt, Artificial Sequence
  CIITA targeting sequence
agaaaauauuccugaucuuu

SEQ ID NO: 37356 - RNA, 20 nt, Artificial Sequence
  CIITA targeting sequence
aacucgagaaaauauuccug

SEQ ID NO: 37357 - RNA, 20 nt, Artificial Sequence
  CIITA targeting sequence
acauccaacucgagaaaaua

SEQ ID NO: 37358 - RNA, 20 nt, Artificial Sequence
  CIITA targeting sequence
cccugggccaccaccuucca

SEQ ID NO: 37359 - RNA, 20 nt, Artificial Sequence
  CIITA targeting sequence
aagaggaccuucuaaaaaua

SEQ ID NO: 37360 - RNA, 20 nt, Artificial Sequence
  CIITA targeting sequence
uugaaacugugcuucccccu

SEQ ID NO: 37361 - RNA, 20 nt, Artificial Sequence
  CIITA targeting sequence
ucuuugaaacugugcuuccc

SEQ ID NO: 37362 - RNA, 20 nt, Artificial Sequence
  CIITA targeting sequence
aaaaauacugcccauuuacc

SEQ ID NO: 37363 - RNA, 20 nt, Artificial Sequence
  CIITA targeting sequence
uuuugguaaaugggcaguau

SEQ ID NO: 37364 - RNA, 20 nt, Artificial Sequence
  CIITA targeting sequence
gugucuuuuugguaaauggg

SEQ ID NO: 37365 - RNA, 20 nt, Artificial Sequence
  CIITA targeting sequence
gcccugcccccacauggcuc

SEQ ID NO: 37366 - RNA, 20 nt, Artificial Sequence
  CIITA targeting sequence
ucaaaaggagaaauugucuu

SEQ ID NO: 37367 - RNA, 20 nt, Artificial Sequence
  CIITA targeting sequence
aaaggagaaauugucuugcc

SEQ ID NO: 37368 - RNA, 20 nt, Artificial Sequence
  CIITA targeting sequence
uuuugaggagccaugugggg

SEQ ID NO: 37369 - RNA, 20 nt, Artificial Sequence
  CIITA targeting sequence
ccuuuugaggagccaugugg

SEQ ID NO: 37370 - RNA, 20 nt, Artificial Sequence
  CIITA targeting sequence
ugccacccacgccuucccuc

SEQ ID NO: 37371 - RNA, 20 nt, Artificial Sequence
  CIITA targeting sequence
cucgccggggugcugggggg

SEQ ID NO: 37372 - RNA, 20 nt, Artificial Sequence
  CIITA targeting sequence
ccggggugcuggggggccaa

SEQ ID NO: 37373 - RNA, 20 nt, Artificial Sequence
  CIITA targeting sequence
aaaaggcuauagagugggcu

SEQ ID NO: 37374 - RNA, 20 nt, Artificial Sequence
  CIITA targeting sequence
auagccuuuuugaauugcug

SEQ ID NO: 37375 - RNA, 20 nt, Artificial Sequence
  CIITA targeting sequence
gcccacucuauagccuuuuu

SEQ ID NO: 37376 - RNA, 20 nt, Artificial Sequence
  CIITA targeting sequence
cagcccacucuauagccuuu

SEQ ID NO: 37377 - RNA, 20 nt, Artificial Sequence
  CIITA targeting sequence
aaagucucagcccacucuau

SEQ ID NO: 37378 - RNA, 20 nt, Artificial Sequence
  CIITA targeting sequence
ccaaagucucagcccacucu

SEQ ID NO: 37379 - RNA, 20 nt, Artificial Sequence
  CIITA targeting sequence
aaucucagcccacuaauccc

SEQ ID NO: 37380 - RNA, 20 nt, Artificial Sequence
  CIITA targeting sequence
cagcccacuaaucccucuga

SEQ ID NO: 37381 - RNA, 20 nt, Artificial Sequence
  CIITA targeting sequence
gcccacuaaucccucugagc

SEQ ID NO: 37382 - RNA, 20 nt, Artificial Sequence
  CIITA targeting sequence
cucugagccugucucuucau

SEQ ID NO: 37383 - RNA, 20 nt, Artificial Sequence
  CIITA targeting sequence
gagccugucucuucaucuga

SEQ ID NO: 37384 - RNA, 20 nt, Artificial Sequence
  CIITA targeting sequence
gagggauuagugggcugaga

SEQ ID NO: 37385 - RNA, 20 nt, Artificial Sequence
  CIITA targeting sequence
cuucaucugaaaaacaggaa

SEQ ID NO: 37386 - RNA, 20 nt, Artificial Sequence
  CIITA targeting sequence
ucaucugaaaaacaggaaua

SEQ ID NO: 37387 - RNA, 20 nt, Artificial Sequence
  CIITA targeting sequence
ucugaaaaacaggaauacaa

SEQ ID NO: 37388 - RNA, 20 nt, Artificial Sequence
  CIITA targeting sequence
gaaaaacaggaauacaaaua

SEQ ID NO: 37389 - RNA, 20 nt, Artificial Sequence
  CIITA targeting sequence
gaugaagagacaggcucaga

SEQ ID NO: 37390 - RNA, 20 nt, Artificial Sequence
  CIITA targeting sequence
uguuuuucagaugaagagac

SEQ ID NO: 37391 - RNA, 20 nt, Artificial Sequence
  CIITA targeting sequence
gcuauuuguauuccuguuuu

SEQ ID NO: 37392 - RNA, 20 nt, Artificial Sequence
  CIITA targeting sequence
aacuuacacaucagcuauuu

SEQ ID NO: 37393 - RNA, 20 nt, Artificial Sequence
  CIITA targeting sequence
uaggcauuaccccauuuggu

SEQ ID NO: 37394 - RNA, 20 nt, Artificial Sequence
  CIITA targeting sequence
ugucauuugguaccuggcac

SEQ ID NO: 37395 - RNA, 20 nt, Artificial Sequence
  CIITA targeting sequence
uuugguaccuggcacuugcu

SEQ ID NO: 37396 - RNA, 20 nt, Artificial Sequence
  CIITA targeting sequence
agcaagugccagguaccaaa

SEQ ID NO: 37397 - RNA, 20 nt, Artificial Sequence
  CIITA targeting sequence
caguguccagcaagugccag

SEQ ID NO: 37398 - RNA, 20 nt, Artificial Sequence
  CIITA targeting sequence
aguucuauaucauugccacg

SEQ ID NO: 37399 - RNA, 20 nt, Artificial Sequence
  CIITA targeting sequence
auaucauugccacggaugaa

SEQ ID NO: 37400 - RNA, 20 nt, Artificial Sequence
  CIITA targeting sequence
uugccacggaugaagagagg

SEQ ID NO: 37401 - RNA, 20 nt, Artificial Sequence
  CIITA targeting sequence
guggcaaugauauagaacua

SEQ ID NO: 37402 - RNA, 20 nt, Artificial Sequence
  CIITA targeting sequence
uccguggcaaugauauagaa

SEQ ID NO: 37403 - RNA, 20 nt, Artificial Sequence
  CIITA targeting sequence
ucauccguggcaaugauaua

SEQ ID NO: 37404 - RNA, 20 nt, Artificial Sequence
  CIITA targeting sequence
cuucauccguggcaaugaua

SEQ ID NO: 37405 - RNA, 20 nt, Artificial Sequence
  CIITA targeting sequence
gcgcauggcagccucucuuc

SEQ ID NO: 37406 - RNA, 20 nt, Artificial Sequence
  CIITA targeting sequence
gcauguuucugcgcauggca

SEQ ID NO: 37407 - RNA, 20 nt, Artificial Sequence
  CIITA targeting sequence
cagcauguuucugcgcaugg

SEQ ID NO: 37408 - RNA, 20 nt, Artificial Sequence
  CIITA targeting sequence
cagcucucagcauguuucug

SEQ ID NO: 37409 - RNA, 20 nt, Artificial Sequence
  CIITA targeting sequence
cccagcucucagcauguuuc

SEQ ID NO: 37410 - RNA, 20 nt, Artificial Sequence
  CIITA targeting sequence
ccuucucccagcucucagca

SEQ ID NO: 37411 - RNA, 20 nt, Artificial Sequence
  CIITA targeting sequence
agcucaccuucucccagcuc

SEQ ID NO: 37412 - RNA, 20 nt, Artificial Sequence
  CIITA targeting sequence
cucuagcucaccuucuccca

SEQ ID NO: 37413 - RNA, 20 nt, Artificial Sequence
  CIITA targeting sequence
cugcccucagggagagcuga

SEQ ID NO: 37414 - RNA, 20 nt, Artificial Sequence
  CIITA targeting sequence
gggagagcugaagggcucuc

SEQ ID NO: 37415 - RNA, 20 nt, Artificial Sequence
  CIITA targeting sequence
cugagggcagggacuguauc

SEQ ID NO: 37416 - RNA, 20 nt, Artificial Sequence
  CIITA targeting sequence
cccugagggcagggacugua

SEQ ID NO: 37417 - RNA, 20 nt, Artificial Sequence
  CIITA targeting sequence
gcucucccugagggcaggga

SEQ ID NO: 37418 - RNA, 20 nt, Artificial Sequence
  CIITA targeting sequence
cucuccugccacgggaugau

SEQ ID NO: 37419 - RNA, 20 nt, Artificial Sequence
  CIITA targeting sequence
cuccugccacgggaugauca

SEQ ID NO: 37420 - RNA, 20 nt, Artificial Sequence
  CIITA targeting sequence
ccugccacgggaugaucagg

SEQ ID NO: 37421 - RNA, 20 nt, Artificial Sequence
  CIITA targeting sequence
ugccacgggaugaucagggc

SEQ ID NO: 37422 - RNA, 20 nt, Artificial Sequence
  CIITA targeting sequence
cguggcaggagagagagccc

SEQ ID NO: 37423 - RNA, 20 nt, Artificial Sequence
  CIITA targeting sequence
ucccguggcaggagagagag

SEQ ID NO: 37424 - RNA, 20 nt, Artificial Sequence
  CIITA targeting sequence
gggccaucuuuucccuccau

SEQ ID NO: 37425 - RNA, 20 nt, Artificial Sequence
  CIITA targeting sequence
uuucccuccaucccgcucug

SEQ ID NO: 37426 - RNA, 20 nt, Artificial Sequence
  CIITA targeting sequence
cuccaucccgcucuggcaau

SEQ ID NO: 37427 - RNA, 20 nt, Artificial Sequence
  CIITA targeting sequence
aucccgcucuggcaaugugg

SEQ ID NO: 37428 - RNA, 20 nt, Artificial Sequence
  CIITA targeting sequence
cgcucuggcaaugugguuug

SEQ ID NO: 37429 - RNA, 20 nt, Artificial Sequence
  CIITA targeting sequence
ggcaaugugguuuggagaaa

SEQ ID NO: 37430 - RNA, 20 nt, Artificial Sequence
  CIITA targeting sequence
aaaccacauugccagagcgg

SEQ ID NO: 37431 - RNA, 20 nt, Artificial Sequence
  CIITA targeting sequence
ccaaaccacauugccagagc

SEQ ID NO: 37432 - RNA, 20 nt, Artificial Sequence
  CIITA targeting sequence
aaugaaggggccuuugaagc

SEQ ID NO: 37433 - RNA, 20 nt, Artificial Sequence
  CIITA targeting sequence
uuggacuguuucuccaaacc

SEQ ID NO: 37434 - RNA, 20 nt, Artificial Sequence
  CIITA targeting sequence
aaggccccuucauuggacug

SEQ ID NO: 37435 - RNA, 20 nt, Artificial Sequence
  CIITA targeting sequence
uaagcaucuauagacauagg

SEQ ID NO: 37436 - RNA, 20 nt, Artificial Sequence
  CIITA targeting sequence
auagacauaggaaacuuggc

SEQ ID NO: 37437 - RNA, 20 nt, Artificial Sequence
  CIITA targeting sequence
auagaugcuuaggaagugcu

SEQ ID NO: 37438 - RNA, 20 nt, Artificial Sequence
  CIITA targeting sequence
uaugucuauagaugcuuagg

SEQ ID NO: 37439 - RNA, 20 nt, Artificial Sequence
  CIITA targeting sequence
ggggauagaggaagguccca

SEQ ID NO: 37440 - RNA, 20 nt, Artificial Sequence
  CIITA targeting sequence
ccagagccaaguuuccuaug

SEQ ID NO: 37441 - RNA, 20 nt, Artificial Sequence
  CIITA targeting sequence
auccccagagccaaguuucc

SEQ ID NO: 37442 - RNA, 20 nt, Artificial Sequence
  CIITA targeting sequence
ucuauccccagagccaaguu

SEQ ID NO: 37443 - RNA, 20 nt, Artificial Sequence
  CIITA targeting sequence
caugccaagauucaaguaga

SEQ ID NO: 37444 - RNA, 20 nt, Artificial Sequence
  CIITA targeting sequence
uggcaugggaccuuccucua

SEQ ID NO: 37445 - RNA, 20 nt, Artificial Sequence
  CIITA targeting sequence
aguagaucuuggugugacug

SEQ ID NO: 37446 - RNA, 20 nt, Artificial Sequence
  CIITA targeting sequence
acuugaaucuuggcauggga

SEQ ID NO: 37447 - RNA, 20 nt, Artificial Sequence
  CIITA targeting sequence
uggugugacugggaggcagc

SEQ ID NO: 37448 - RNA, 20 nt, Artificial Sequence
  CIITA targeting sequence
caccaagaucuacuugaauc

SEQ ID NO: 37449 - RNA, 20 nt, Artificial Sequence
  CIITA targeting sequence
cagucacaccaagaucuacu

SEQ ID NO: 37450 - RNA, 20 nt, Artificial Sequence
  CIITA targeting sequence
ccacaacgccacagcugccu

SEQ ID NO: 37451 - RNA, 20 nt, Artificial Sequence
  CIITA targeting sequence
agguuuccccacaacgccac

SEQ ID NO: 37452 - RNA, 20 nt, Artificial Sequence
  CIITA targeting sequence
ugggccugaauuucagcuuu

SEQ ID NO: 37453 - RNA, 20 nt, Artificial Sequence
  CIITA targeting sequence
ggcccaagacucuagguuuc

SEQ ID NO: 37454 - RNA, 20 nt, Artificial Sequence
  CIITA targeting sequence
gcuuugacacccucuaaugu

SEQ ID NO: 37455 - RNA, 20 nt, Artificial Sequence
  CIITA targeting sequence
aagcugaaauucaggcccaa

SEQ ID NO: 37456 - RNA, 20 nt, Artificial Sequence
  CIITA targeting sequence
aauguaaugggcuuccuuug

SEQ ID NO: 37457 - RNA, 20 nt, Artificial Sequence
  CIITA targeting sequence
uuugacuguaggcuucccac

SEQ ID NO: 37458 - RNA, 20 nt, Artificial Sequence
  CIITA targeting sequence
aaggaagcccauuacauuag

SEQ ID NO: 37459 - RNA, 20 nt, Artificial Sequence
  CIITA targeting sequence
cacauagcuggcaccccaca

SEQ ID NO: 37460 - RNA, 20 nt, Artificial Sequence
  CIITA targeting sequence
guguggggugccagcuaugu

SEQ ID NO: 37461 - RNA, 20 nt, Artificial Sequence
  CIITA targeting sequence
cuuggccuucugaugauccu

SEQ ID NO: 37462 - RNA, 20 nt, Artificial Sequence
  CIITA targeting sequence
gaugauccugcaggacaauc

SEQ ID NO: 37463 - RNA, 20 nt, Artificial Sequence
  CIITA targeting sequence
gaaggccaagggaguucugu

SEQ ID NO: 37464 - RNA, 20 nt, Artificial Sequence
  CIITA targeting sequence
ucagaaggccaagggaguuc

SEQ ID NO: 37465 - RNA, 20 nt, Artificial Sequence
  CIITA targeting sequence
ugcaggacaaucuuuuuugu

SEQ ID NO: 37466 - RNA, 20 nt, Artificial Sequence
  CIITA targeting sequence
ugcaggaucaucagaaggcc

SEQ ID NO: 37467 - RNA, 20 nt, Artificial Sequence
  CIITA targeting sequence
uuuuuguuuuuuguuuuuug

SEQ ID NO: 37468 - RNA, 20 nt, Artificial Sequence
  CIITA targeting sequence
aaaaaaaaacaaaaaacaaa

SEQ ID NO: 37469 - RNA, 20 nt, Artificial Sequence
  CIITA targeting sequence
caaaaaaaaaacaaaaaaca

SEQ ID NO: 37470 - RNA, 20 nt, Artificial Sequence
  CIITA targeting sequence
cacuuugucgcccaggcugg

SEQ ID NO: 37471 - RNA, 20 nt, Artificial Sequence
  CIITA targeting sequence
cuuugucgcccaggcuggag

SEQ ID NO: 37472 - RNA, 20 nt, Artificial Sequence
  CIITA targeting sequence
cccaggcuggagugcagugg

SEQ ID NO: 37473 - RNA, 20 nt, Artificial Sequence
  CIITA targeting sequence
agccugggcgacaaagugag

SEQ ID NO: 37474 - RNA, 20 nt, Artificial Sequence
  CIITA targeting sequence
ugguucacugcagccucugc

SEQ ID NO: 37475 - RNA, 20 nt, Artificial Sequence
  CIITA targeting sequence
cugcagccucugccucccag

SEQ ID NO: 37476 - RNA, 20 nt, Artificial Sequence
  CIITA targeting sequence
gccucccagguucaagcgau

SEQ ID NO: 37477 - RNA, 20 nt, Artificial Sequence
  CIITA targeting sequence
cagguucaagcgauucuccu

SEQ ID NO: 37478 - RNA, 20 nt, Artificial Sequence
  CIITA targeting sequence
agcgauucuccugccucagc

SEQ ID NO: 37479 - RNA, 20 nt, Artificial Sequence
  CIITA targeting sequence
cuugaaccugggaggcagag

SEQ ID NO: 37480 - RNA, 20 nt, Artificial Sequence
  CIITA targeting sequence
ccugccucagccucccaagu

SEQ ID NO: 37481 - RNA, 20 nt, Artificial Sequence
  CIITA targeting sequence
ugccucagccucccaaguag

SEQ ID NO: 37482 - RNA, 20 nt, Artificial Sequence
  CIITA targeting sequence
gccucccaaguagcugggau

SEQ ID NO: 37483 - RNA, 20 nt, Artificial Sequence
  CIITA targeting sequence
caaguagcugggauuacaga

SEQ ID NO: 37484 - RNA, 20 nt, Artificial Sequence
  CIITA targeting sequence
cagcuacuugggaggcugag

SEQ ID NO: 37485 - RNA, 20 nt, Artificial Sequence
  CIITA targeting sequence
guaaucccagcuacuuggga

SEQ ID NO: 37486 - RNA, 20 nt, Artificial Sequence
  CIITA targeting sequence
acuaaaaauacaaaauuagc

SEQ ID NO: 37487 - RNA, 20 nt, Artificial Sequence
  CIITA targeting sequence
cuacuaaaaauacaaaauua

SEQ ID NO: 37488 - RNA, 20 nt, Artificial Sequence
  CIITA targeting sequence
cgucucuacuaaaaauacaa

SEQ ID NO: 37489 - RNA, 20 nt, Artificial Sequence
  CIITA targeting sequence
ccauguugcccgggcugguc

SEQ ID NO: 37490 - RNA, 20 nt, Artificial Sequence
  CIITA targeting sequence
caaacuccugaccucaagug

SEQ ID NO: 37491 - RNA, 20 nt, Artificial Sequence
  CIITA targeting sequence
aacuccugaccucaagugau

SEQ ID NO: 37492 - RNA, 20 nt, Artificial Sequence
  CIITA targeting sequence
ugaccucaagugaucugccu

SEQ ID NO: 37493 - RNA, 20 nt, Artificial Sequence
  CIITA targeting sequence
ggaguuugagaccagcccgg

SEQ ID NO: 37494 - RNA, 20 nt, Artificial Sequence
  CIITA targeting sequence
agugaucugccugccucggc

SEQ ID NO: 37495 - RNA, 20 nt, Artificial Sequence
  CIITA targeting sequence
cuugaggucaggaguuugag

SEQ ID NO: 37496 - RNA, 20 nt, Artificial Sequence
  CIITA targeting sequence
gccugccucggccucccaca

SEQ ID NO: 37497 - RNA, 20 nt, Artificial Sequence
  CIITA targeting sequence
gccucccacaguggugggcu

SEQ ID NO: 37498 - RNA, 20 nt, Artificial Sequence
  CIITA targeting sequence
cacaguggugggcugcaagg

SEQ ID NO: 37499 - RNA, 20 nt, Artificial Sequence
  CIITA targeting sequence
ucauucuccagaacuaauau

SEQ ID NO: 37500 - RNA, 20 nt, Artificial Sequence
  CIITA targeting sequence
uucuccagaacuaauauugg

SEQ ID NO: 37501 - RNA, 20 nt, Artificial Sequence
  CIITA targeting sequence
ccagaacuaauauugggaaa

SEQ ID NO: 37502 - RNA, 20 nt, Artificial Sequence
  CIITA targeting sequence
agaacuaauauugggaaaac

SEQ ID NO: 37503 - RNA, 20 nt, Artificial Sequence
  CIITA targeting sequence
ggagaaugaagauugccuug

SEQ ID NO: 37504 - RNA, 20 nt, Artificial Sequence
  CIITA targeting sequence
caauauuaguucuggagaau

SEQ ID NO: 37505 - RNA, 20 nt, Artificial Sequence
  CIITA targeting sequence
guuuucccaauauuaguucu

SEQ ID NO: 37506 - RNA, 20 nt, Artificial Sequence
  CIITA targeting sequence
gagaggucaagugacuuggc

SEQ ID NO: 37507 - RNA, 20 nt, Artificial Sequence
  CIITA targeting sequence
gaacaucaguuuucccaaua

SEQ ID NO: 37508 - RNA, 20 nt, Artificial Sequence
  CIITA targeting sequence
cugaacaucaguuuucccaa

SEQ ID NO: 37509 - RNA, 20 nt, Artificial Sequence
  CIITA targeting sequence
agugacuuggcuaaggcauc

SEQ ID NO: 37510 - RNA, 20 nt, Artificial Sequence
  CIITA targeting sequence
cuugaccucucugaacauca

SEQ ID NO: 37511 - RNA, 20 nt, Artificial Sequence
  CIITA targeting sequence
cagccagaauucagaugcaa

SEQ ID NO: 37512 - RNA, 20 nt, Artificial Sequence
  CIITA targeting sequence
ggcugugaugccuuagccaa

SEQ ID NO: 37513 - RNA, 20 nt, Artificial Sequence
  CIITA targeting sequence
gaugcaagcuccuaaaccac

SEQ ID NO: 37514 - RNA, 20 nt, Artificial Sequence
  CIITA targeting sequence
gaauucuggcugugaugccu

SEQ ID NO: 37515 - RNA, 20 nt, Artificial Sequence
  CIITA targeting sequence
uaaaccacaugaccuuggac

SEQ ID NO: 37516 - RNA, 20 nt, Artificial Sequence
  CIITA targeting sequence
ugugguuuaggagcuugcau

SEQ ID NO: 37517 - RNA, 20 nt, Artificial Sequence
  CIITA targeting sequence
aaggucaugugguuuaggag

SEQ ID NO: 37518 - RNA, 20 nt, Artificial Sequence
  CIITA targeting sequence
cugaggcgugugaaccuccu

SEQ ID NO: 37519 - RNA, 20 nt, Artificial Sequence
  CIITA targeting sequence
gugaaauggcuuguccaagg

SEQ ID NO: 37520 - RNA, 20 nt, Artificial Sequence
  CIITA targeting sequence
cacgccucagugaaauggcu

SEQ ID NO: 37521 - RNA, 20 nt, Artificial Sequence
  CIITA targeting sequence
ucuaagcucaaaugggcaua

SEQ ID NO: 37522 - RNA, 20 nt, Artificial Sequence
  CIITA targeting sequence
aagcucaaaugggcauaaca

SEQ ID NO: 37523 - RNA, 20 nt, Artificial Sequence
  CIITA targeting sequence
aaugggcauaacacucuacc

SEQ ID NO: 37524 - RNA, 20 nt, Artificial Sequence
  CIITA targeting sequence
acccugccuuuuccccagag

SEQ ID NO: 37525 - RNA, 20 nt, Artificial Sequence
  CIITA targeting sequence
ccagagcuuuuugggaacuc

SEQ ID NO: 37526 - RNA, 20 nt, Artificial Sequence
  CIITA targeting sequence
ggggaaaaggcaggguagag

SEQ ID NO: 37527 - RNA, 20 nt, Artificial Sequence
  CIITA targeting sequence
caaaaagcucuggggaaaag

SEQ ID NO: 37528 - RNA, 20 nt, Artificial Sequence
  CIITA targeting sequence
gaugguguggaggauggagg

SEQ ID NO: 37529 - RNA, 20 nt, Artificial Sequence
  CIITA targeting sequence
gaguucccaaaaagcucugg

SEQ ID NO: 37530 - RNA, 20 nt, Artificial Sequence
  CIITA targeting sequence
acaccaucugaguucccaaa

SEQ ID NO: 37531 - RNA, 20 nt, Artificial Sequence
  CIITA targeting sequence
uccacaccaucugaguuccc

SEQ ID NO: 37532 - RNA, 20 nt, Artificial Sequence
  CIITA targeting sequence
auccuccacaccaucugagu

SEQ ID NO: 37533 - RNA, 20 nt, Artificial Sequence
  CIITA targeting sequence
gccuccauccuccacaccau

SEQ ID NO: 37534 - RNA, 20 nt, Artificial Sequence
  CIITA targeting sequence
acugugagcugcaaauccuu

SEQ ID NO: 37535 - RNA, 20 nt, Artificial Sequence
  CIITA targeting sequence
caguggacuucugccuccau

SEQ ID NO: 37536 - RNA, 20 nt, Artificial Sequence
  CIITA targeting sequence
uugaucacccaagaggaagu

SEQ ID NO: 37537 - RNA, 20 nt, Artificial Sequence
  CIITA targeting sequence
aggauuugcagcucacagug

SEQ ID NO: 37538 - RNA, 20 nt, Artificial Sequence
  CIITA targeting sequence
cccaagaggaagugcuuaag

SEQ ID NO: 37539 - RNA, 20 nt, Artificial Sequence
  CIITA targeting sequence
ugggugaucaaggauuugca

SEQ ID NO: 37540 - RNA, 20 nt, Artificial Sequence
  CIITA targeting sequence
ucuugggugaucaaggauuu

SEQ ID NO: 37541 - RNA, 20 nt, Artificial Sequence
  CIITA targeting sequence
gucuuagggaagcaggaagu

SEQ ID NO: 37542 - RNA, 20 nt, Artificial Sequence
  CIITA targeting sequence
uagggaagcaggaagugggg

SEQ ID NO: 37543 - RNA, 20 nt, Artificial Sequence
  CIITA targeting sequence
cuaagacugaagccugcacc

SEQ ID NO: 37544 - RNA, 20 nt, Artificial Sequence
  CIITA targeting sequence
ugcuucccuaagacugaagc

SEQ ID NO: 37545 - RNA, 20 nt, Artificial Sequence
  CIITA targeting sequence
gcgccccacuuccugcuucc

SEQ ID NO: 37546 - RNA, 20 nt, Artificial Sequence
  CIITA targeting sequence
gggaggggguuucuucuugu

SEQ ID NO: 37547 - RNA, 20 nt, Artificial Sequence
  CIITA targeting sequence
cagaagcccccaauacacau

SEQ ID NO: 37548 - RNA, 20 nt, Artificial Sequence
  CIITA targeting sequence
ucuuguccagguugagccaa

SEQ ID NO: 37549 - RNA, 20 nt, Artificial Sequence
  CIITA targeting sequence
uguccagguugagccaauga

SEQ ID NO: 37550 - RNA, 20 nt, Artificial Sequence
  CIITA targeting sequence
agguugagccaaugacgcag

SEQ ID NO: 37551 - RNA, 20 nt, Artificial Sequence
  CIITA targeting sequence
accuggacaagaagaaaccc

SEQ ID NO: 37552 - RNA, 20 nt, Artificial Sequence
  CIITA targeting sequence
uuggcucaaccuggacaaga

SEQ ID NO: 37553 - RNA, 20 nt, Artificial Sequence
  CIITA targeting sequence
gcgucauuggcucaaccugg

SEQ ID NO: 37554 - RNA, 20 nt, Artificial Sequence
  CIITA targeting sequence
uaggcccucuggugacuuuu

SEQ ID NO: 37555 - RNA, 20 nt, Artificial Sequence
  CIITA targeting sequence
ggugacuuuuugcccaggca

SEQ ID NO: 37556 - RNA, 20 nt, Artificial Sequence
  CIITA targeting sequence
ccagagggccuaagaucugc

SEQ ID NO: 37557 - RNA, 20 nt, Artificial Sequence
  CIITA targeting sequence
cagugguggugauggggagc

SEQ ID NO: 37558 - RNA, 20 nt, Artificial Sequence
  CIITA targeting sequence
gugguggugauggggagcgu

SEQ ID NO: 37559 - RNA, 20 nt, Artificial Sequence
  CIITA targeting sequence
ccaccacugagaaguugccu

SEQ ID NO: 37560 - RNA, 20 nt, Artificial Sequence
  CIITA targeting sequence
ccaucaccaccacugagaag

SEQ ID NO: 37561 - RNA, 20 nt, Artificial Sequence
  CIITA targeting sequence
ggccacgcuccccaucacca

SEQ ID NO: 37562 - RNA, 20 nt, Artificial Sequence
  CIITA targeting sequence
aagcugcccugcuggcugug

SEQ ID NO: 37563 - RNA, 20 nt, Artificial Sequence
  CIITA targeting sequence
gagacacagucuggcucuau

SEQ ID NO: 37564 - RNA, 20 nt, Artificial Sequence
  CIITA targeting sequence
gaaaaaaaaaaaaggccccc

SEQ ID NO: 37565 - RNA, 20 nt, Artificial Sequence
  CIITA targeting sequence
cagaaaaaaaaaaaaggccc

SEQ ID NO: 37566 - RNA, 20 nt, Artificial Sequence
  CIITA targeting sequence
ggcucuaucacccaggcugg

SEQ ID NO: 37567 - RNA, 20 nt, Artificial Sequence
  CIITA targeting sequence
aucacccaggcuggagugca

SEQ ID NO: 37568 - RNA, 20 nt, Artificial Sequence
  CIITA targeting sequence
cccaggcuggagugcagugg

SEQ ID NO: 37569 - RNA, 20 nt, Artificial Sequence
  CIITA targeting sequence
agccugggugauagagccag

SEQ ID NO: 37570 - RNA, 20 nt, Artificial Sequence
  CIITA targeting sequence
caguucacugcagccuugac

SEQ ID NO: 37571 - RNA, 20 nt, Artificial Sequence
  CIITA targeting sequence
guucacugcagccuugacac

SEQ ID NO: 37572 - RNA, 20 nt, Artificial Sequence
  CIITA targeting sequence
cugcagccuugacaccuccc

SEQ ID NO: 37573 - RNA, 20 nt, Artificial Sequence
  CIITA targeting sequence
aggcugcagugaacugagau

SEQ ID NO: 37574 - RNA, 20 nt, Artificial Sequence
  CIITA targeting sequence
ccaggcucaagcuauccucc

SEQ ID NO: 37575 - RNA, 20 nt, Artificial Sequence
  CIITA targeting sequence
agcuauccucccaccucagc

SEQ ID NO: 37576 - RNA, 20 nt, Artificial Sequence
  CIITA targeting sequence
ucccaccucagccuccugag

SEQ ID NO: 37577 - RNA, 20 nt, Artificial Sequence
  CIITA targeting sequence
caccucagccuccugaguag

SEQ ID NO: 37578 - RNA, 20 nt, Artificial Sequence
  CIITA targeting sequence
gccuccugaguagcugguuc

SEQ ID NO: 37579 - RNA, 20 nt, Artificial Sequence
  CIITA targeting sequence
ugaguagcugguucuacaga

SEQ ID NO: 37580 - RNA, 20 nt, Artificial Sequence
  CIITA targeting sequence
ggaggcugaggugggaggau

SEQ ID NO: 37581 - RNA, 20 nt, Artificial Sequence
  CIITA targeting sequence
acagaugcacaucaccacgc

SEQ ID NO: 37582 - RNA, 20 nt, Artificial Sequence
  CIITA targeting sequence
guagaaccagcuacucagga

SEQ ID NO: 37583 - RNA, 20 nt, Artificial Sequence
  CIITA targeting sequence
ccacgcccagcuaaguuuug

SEQ ID NO: 37584 - RNA, 20 nt, Artificial Sequence
  CIITA targeting sequence
acaaauaacacaaaacuuag

SEQ ID NO: 37585 - RNA, 20 nt, Artificial Sequence
  CIITA targeting sequence
cuacaaauaacacaaaacuu

SEQ ID NO: 37586 - RNA, 20 nt, Artificial Sequence
  CIITA targeting sequence
ccauguugcccaggcugguc

SEQ ID NO: 37587 - RNA, 20 nt, Artificial Sequence
  CIITA targeting sequence
caaacuccuggacugaggug

SEQ ID NO: 37588 - RNA, 20 nt, Artificial Sequence
  CIITA targeting sequence
aacuccuggacugaggugau

SEQ ID NO: 37589 - RNA, 20 nt, Artificial Sequence
  CIITA targeting sequence
uggacugaggugauacuccu

SEQ ID NO: 37590 - RNA, 20 nt, Artificial Sequence
  CIITA targeting sequence
aggaguuugagaccagccug

SEQ ID NO: 37591 - RNA, 20 nt, Artificial Sequence
  CIITA targeting sequence
guccaggaguuugagaccag

SEQ ID NO: 37592 - RNA, 20 nt, Artificial Sequence
  CIITA targeting sequence
ccucaguccaggaguuugag

SEQ ID NO: 37593 - RNA, 20 nt, Artificial Sequence
  CIITA targeting sequence
ugccuuggacucccaaagug

SEQ ID NO: 37594 - RNA, 20 nt, Artificial Sequence
  CIITA targeting sequence
aaggcaggaguaucaccuca

SEQ ID NO: 37595 - RNA, 20 nt, Artificial Sequence
  CIITA targeting sequence
caaagugcuggaauuucuac

SEQ ID NO: 37596 - RNA, 20 nt, Artificial Sequence
  CIITA targeting sequence
agcacuuugggaguccaagg

SEQ ID NO: 37597 - RNA, 20 nt, Artificial Sequence
  CIITA targeting sequence
acagaugugagccaccaugc

SEQ ID NO: 37598 - RNA, 20 nt, Artificial Sequence
  CIITA targeting sequence
guagaaauuccagcacuuug

SEQ ID NO: 37599 - RNA, 20 nt, Artificial Sequence
  CIITA targeting sequence
caucuguagaaauuccagca

SEQ ID NO: 37600 - RNA, 20 nt, Artificial Sequence
  CIITA targeting sequence
uguuccuaugaagucugcag

SEQ ID NO: 37601 - RNA, 20 nt, Artificial Sequence
  CIITA targeting sequence
uaugaagucugcaggguccc

SEQ ID NO: 37602 - RNA, 20 nt, Artificial Sequence
  CIITA targeting sequence
uaggaacaagaagggcccca

SEQ ID NO: 37603 - RNA, 20 nt, Artificial Sequence
  CIITA targeting sequence
gcaggguccccuuaugcaaa

SEQ ID NO: 37604 - RNA, 20 nt, Artificial Sequence
  CIITA targeting sequence
ccuuaugcaaaagaacagaa

SEQ ID NO: 37605 - RNA, 20 nt, Artificial Sequence
  CIITA targeting sequence
uuugcauaaggggacccugc

SEQ ID NO: 37606 - RNA, 20 nt, Artificial Sequence
  CIITA targeting sequence
guucuuuugcauaaggggac

SEQ ID NO: 37607 - RNA, 20 nt, Artificial Sequence
  CIITA targeting sequence
gcuucacaaaguuugaccuc

SEQ ID NO: 37608 - RNA, 20 nt, Artificial Sequence
  CIITA targeting sequence
caaaguuugaccucggaaga

SEQ ID NO: 37609 - RNA, 20 nt, Artificial Sequence
  CIITA targeting sequence
aacuuugugaagccgagcuu

SEQ ID NO: 37610 - RNA, 20 nt, Artificial Sequence
  CIITA targeting sequence
gaagaaauggaagggaaagg

SEQ ID NO: 37611 - RNA, 20 nt, Artificial Sequence
  CIITA targeting sequence
gaggucaaacuuugugaagc

SEQ ID NO: 37612 - RNA, 20 nt, Artificial Sequence
  CIITA targeting sequence
uccgaggucaaacuuuguga

SEQ ID NO: 37613 - RNA, 20 nt, Artificial Sequence
  CIITA targeting sequence
auuucuuccgaggucaaacu

SEQ ID NO: 37614 - RNA, 20 nt, Artificial Sequence
  CIITA targeting sequence
cuuccauuucuuccgagguc

SEQ ID NO: 37615 - RNA, 20 nt, Artificial Sequence
  CIITA targeting sequence
cuuugucacucucacaaacg

SEQ ID NO: 37616 - RNA, 20 nt, Artificial Sequence
  CIITA targeting sequence
cucucacaaacguaagaagc

SEQ ID NO: 37617 - RNA, 20 nt, Artificial Sequence
  CIITA targeting sequence
cacaaacguaagaagcaaac

SEQ ID NO: 37618 - RNA, 20 nt, Artificial Sequence
  CIITA targeting sequence
caaacguaagaagcaaacua

SEQ ID NO: 37619 - RNA, 20 nt, Artificial Sequence
  CIITA targeting sequence
uacguuugugagagugacaa

SEQ ID NO: 37620 - RNA, 20 nt, Artificial Sequence
  CIITA targeting sequence
uuauuaguuugcuucuuacg

SEQ ID NO: 37621 - RNA, 20 nt, Artificial Sequence
  CIITA targeting sequence
cacauauuauacucaccaug

SEQ ID NO: 37622 - RNA, 20 nt, Artificial Sequence
  CIITA targeting sequence
ccauguagaagcugugcugc

SEQ ID NO: 37623 - RNA, 20 nt, Artificial Sequence
  CIITA targeting sequence
acauggugaguauaauaugu

SEQ ID NO: 37624 - RNA, 20 nt, Artificial Sequence
  CIITA targeting sequence
guucauucagcacuuacuga

SEQ ID NO: 37625 - RNA, 20 nt, Artificial Sequence
  CIITA targeting sequence
uucagcacuuacugauugcc

SEQ ID NO: 37626 - RNA, 20 nt, Artificial Sequence
  CIITA targeting sequence
gcacuuacugauugccaguc

SEQ ID NO: 37627 - RNA, 20 nt, Artificial Sequence
  CIITA targeting sequence
guaagugcugaaugaacaga

SEQ ID NO: 37628 - RNA, 20 nt, Artificial Sequence
  CIITA targeting sequence
cauugcuaagggcuccgcgu

SEQ ID NO: 37629 - RNA, 20 nt, Artificial Sequence
  CIITA targeting sequence
gcgugacuuaacuccccuaa

SEQ ID NO: 37630 - RNA, 20 nt, Artificial Sequence
  CIITA targeting sequence
cgcggagcccuuagcaaugg

SEQ ID NO: 37631 - RNA, 20 nt, Artificial Sequence
  CIITA targeting sequence
ccuaauccuugugaguugcc

SEQ ID NO: 37632 - RNA, 20 nt, Artificial Sequence
  CIITA targeting sequence
uugugaguugccaauuauua

SEQ ID NO: 37633 - RNA, 20 nt, Artificial Sequence
  CIITA targeting sequence
caaggauuaggggaguuaag

SEQ ID NO: 37634 - RNA, 20 nt, Artificial Sequence
  CIITA targeting sequence
cauuuuauagauauggaaac

SEQ ID NO: 37635 - RNA, 20 nt, Artificial Sequence
  CIITA targeting sequence
auaaaaugcgaauaauaauu

SEQ ID NO: 37636 - RNA, 20 nt, Artificial Sequence
  CIITA targeting sequence
auaucuauaaaaugcgaaua

SEQ ID NO: 37637 - RNA, 20 nt, Artificial Sequence
  CIITA targeting sequence
guuuccauaucuauaaaaug

SEQ ID NO: 37638 - RNA, 20 nt, Artificial Sequence
  CIITA targeting sequence
aagugguuuaaaaaaugaac

SEQ ID NO: 37639 - RNA, 20 nt, Artificial Sequence
  CIITA targeting sequence
uuuuuuaaaccacuuggagc

SEQ ID NO: 37640 - RNA, 20 nt, Artificial Sequence
  CIITA targeting sequence
caaaguugguaaauuuuacg

SEQ ID NO: 37641 - RNA, 20 nt, Artificial Sequence
  CIITA targeting sequence
aaguugguaaauuuuacgcc

SEQ ID NO: 37642 - RNA, 20 nt, Artificial Sequence
  CIITA targeting sequence
cgauacuugccuucuuuccc

SEQ ID NO: 37643 - RNA, 20 nt, Artificial Sequence
  CIITA targeting sequence
ugagcuuuggcguaaaauuu

SEQ ID NO: 37644 - RNA, 20 nt, Artificial Sequence
  CIITA targeting sequence
uucccuucucaauuuauuuc

SEQ ID NO: 37645 - RNA, 20 nt, Artificial Sequence
  CIITA targeting sequence
cuucucaauuuauuucucug

SEQ ID NO: 37646 - RNA, 20 nt, Artificial Sequence
  CIITA targeting sequence
caauuuauuucucugacugu

SEQ ID NO: 37647 - RNA, 20 nt, Artificial Sequence
  CIITA targeting sequence
auuuauuucucugacugugu

SEQ ID NO: 37648 - RNA, 20 nt, Artificial Sequence
  CIITA targeting sequence
cugacugugugcuuaaccac

SEQ ID NO: 37649 - RNA, 20 nt, Artificial Sequence
  CIITA targeting sequence
gacugugugcuuaaccacac

SEQ ID NO: 37650 - RNA, 20 nt, Artificial Sequence
  CIITA targeting sequence
gagaaauaaauugagaaggg

SEQ ID NO: 37651 - RNA, 20 nt, Artificial Sequence
  CIITA targeting sequence
uccagaguuugaagcagagc

SEQ ID NO: 37652 - RNA, 20 nt, Artificial Sequence
  CIITA targeting sequence
agaguuugaagcagagcuca

SEQ ID NO: 37653 - RNA, 20 nt, Artificial Sequence
  CIITA targeting sequence
ggaugacacugcuguguggu

SEQ ID NO: 37654 - RNA, 20 nt, Artificial Sequence
  CIITA targeting sequence
aacucuggaugacacugcug

SEQ ID NO: 37655 - RNA, 20 nt, Artificial Sequence
  CIITA targeting sequence
gcuucaaacucuggaugaca

SEQ ID NO: 37656 - RNA, 20 nt, Artificial Sequence
  CIITA targeting sequence
ucaauaagugggggugggcu

SEQ ID NO: 37657 - RNA, 20 nt, Artificial Sequence
  CIITA targeting sequence
auaagugggggugggcuaaa

SEQ ID NO: 37658 - RNA, 20 nt, Artificial Sequence
  CIITA targeting sequence
ccaggcuccucccugcgguc

SEQ ID NO: 37659 - RNA, 20 nt, Artificial Sequence
  CIITA targeting sequence
aggcuccucccugcgguccc

SEQ ID NO: 37660 - RNA, 20 nt, Artificial Sequence
  CIITA targeting sequence
ucccugcggucccucccacc

SEQ ID NO: 37661 - RNA, 20 nt, Artificial Sequence
  CIITA targeting sequence
cugcggucccucccaccauc

SEQ ID NO: 37662 - RNA, 20 nt, Artificial Sequence
  CIITA targeting sequence
cucccaccaucccccaucug

SEQ ID NO: 37663 - RNA, 20 nt, Artificial Sequence
  CIITA targeting sequence
caccaucccccaucugugau

SEQ ID NO: 37664 - RNA, 20 nt, Artificial Sequence
  CIITA targeting sequence
cccaucugugauaccaccug

SEQ ID NO: 37665 - RNA, 20 nt, Artificial Sequence
  CIITA targeting sequence
gugauaccaccugugucucu

SEQ ID NO: 37666 - RNA, 20 nt, Artificial Sequence
  CIITA targeting sequence
cagaugggggauggugggag

SEQ ID NO: 37667 - RNA, 20 nt, Artificial Sequence
  CIITA targeting sequence
cuaugcuugagcccagacag

SEQ ID NO: 37668 - RNA, 20 nt, Artificial Sequence
  CIITA targeting sequence
augcuugagcccagacagga

SEQ ID NO: 37669 - RNA, 20 nt, Artificial Sequence
  CIITA targeting sequence
agcauagagacacagguggu

SEQ ID NO: 37670 - RNA, 20 nt, Artificial Sequence
  CIITA targeting sequence
gggcucaagcauagagacac

SEQ ID NO: 37671 - RNA, 20 nt, Artificial Sequence
  CIITA targeting sequence
ugucugggcucaagcauaga

SEQ ID NO: 37672 - RNA, 20 nt, Artificial Sequence
  CIITA targeting sequence
cccuuguccugucugggcuc

SEQ ID NO: 37673 - RNA, 20 nt, Artificial Sequence
  CIITA targeting sequence
uuucauugggaacauuuuga

SEQ ID NO: 37674 - RNA, 20 nt, Artificial Sequence
  CIITA targeting sequence
uugggaacauuuugacuggg

SEQ ID NO: 37675 - RNA, 20 nt, Artificial Sequence
  CIITA targeting sequence
caaugaaaugaucacccuug

SEQ ID NO: 37676 - RNA, 20 nt, Artificial Sequence
  CIITA targeting sequence
aaauguucccaaugaaauga

SEQ ID NO: 37677 - RNA, 20 nt, Artificial Sequence
  CIITA targeting sequence
ccccagucaaaauguuccca

SEQ ID NO: 37678 - RNA, 20 nt, Artificial Sequence
  CIITA targeting sequence
uuccccccagucaaaauguu

SEQ ID NO: 37679 - RNA, 20 nt, Artificial Sequence
  CIITA targeting sequence
caggcuggugcucuuucccc

SEQ ID NO: 37680 - RNA, 20 nt, Artificial Sequence
  CIITA targeting sequence
uggcagggggagugggggag

SEQ ID NO: 37681 - RNA, 20 nt, Artificial Sequence
  CIITA targeting sequence
cccugccaagacucccaggc

SEQ ID NO: 37682 - RNA, 20 nt, Artificial Sequence
  CIITA targeting sequence
cccacucccccugccaagac

SEQ ID NO: 37683 - RNA, 20 nt, Artificial Sequence
  CIITA targeting sequence
cccccacucccccugccaag

SEQ ID NO: 37684 - RNA, 20 nt, Artificial Sequence
  CIITA targeting sequence
guggcugccccugccccuuc

SEQ ID NO: 37685 - RNA, 20 nt, Artificial Sequence
  CIITA targeting sequence
uagccugucgguggcugccc

SEQ ID NO: 37686 - RNA, 20 nt, Artificial Sequence
  CIITA targeting sequence
ugugcaagucacguccuucc

SEQ ID NO: 37687 - RNA, 20 nt, Artificial Sequence
  CIITA targeting sequence
cguccuucccggggucucag

SEQ ID NO: 37688 - RNA, 20 nt, Artificial Sequence
  CIITA targeting sequence
uucccggggucucagucuug

SEQ ID NO: 37689 - RNA, 20 nt, Artificial Sequence
  CIITA targeting sequence
cggggucucagucuugucau

SEQ ID NO: 37690 - RNA, 20 nt, Artificial Sequence
  CIITA targeting sequence
cagucuugucaucugcagag

SEQ ID NO: 37691 - RNA, 20 nt, Artificial Sequence
  CIITA targeting sequence
gucuugucaucugcagagug

SEQ ID NO: 37692 - RNA, 20 nt, Artificial Sequence
  CIITA targeting sequence
ugucaucugcagagugaagg

SEQ ID NO: 37693 - RNA, 20 nt, Artificial Sequence
  CIITA targeting sequence
ucugcagagugaaggaaaga

SEQ ID NO: 37694 - RNA, 20 nt, Artificial Sequence
  CIITA targeting sequence
gcagagugaaggaaagaggu

SEQ ID NO: 37695 - RNA, 20 nt, Artificial Sequence
  CIITA targeting sequence
gcagaugacaagacugagac

SEQ ID NO: 37696 - RNA, 20 nt, Artificial Sequence
  CIITA targeting sequence
cucugcagaugacaagacug

SEQ ID NO: 37697 - RNA, 20 nt, Artificial Sequence
  CIITA targeting sequence
uucacucugcagaugacaag

SEQ ID NO: 37698 - RNA, 20 nt, Artificial Sequence
  CIITA targeting sequence
uuccuucacucugcagauga

SEQ ID NO: 37699 - RNA, 20 nt, Artificial Sequence
  CIITA targeting sequence
agcuugaaggucccuggcag

SEQ ID NO: 37700 - RNA, 20 nt, Artificial Sequence
  CIITA targeting sequence
agcuugaccucuuuccuuca

SEQ ID NO: 37701 - RNA, 20 nt, Artificial Sequence
  CIITA targeting sequence
cuggcagacccaaugcccug

SEQ ID NO: 37702 - RNA, 20 nt, Artificial Sequence
  CIITA targeting sequence
gccagggaccuucaagcuug

SEQ ID NO: 37703 - RNA, 20 nt, Artificial Sequence
  CIITA targeting sequence
cagggcauugggucugccag

SEQ ID NO: 37704 - RNA, 20 nt, Artificial Sequence
  CIITA targeting sequence
cacagggcauugggucugcc

SEQ ID NO: 37705 - RNA, 20 nt, Artificial Sequence
  CIITA targeting sequence
guuuucucacagggcauugg

SEQ ID NO: 37706 - RNA, 20 nt, Artificial Sequence
  CIITA targeting sequence
auaaaauaauaaguuaccca

SEQ ID NO: 37707 - RNA, 20 nt, Artificial Sequence
  CIITA targeting sequence
auaucuauaaaauaauaagu

SEQ ID NO: 37708 - RNA, 20 nt, Artificial Sequence
  CIITA targeting sequence
uauagaaauguuauagauau

SEQ ID NO: 37709 - RNA, 20 nt, Artificial Sequence
  CIITA targeting sequence
auaagauaauuccauaucua

SEQ ID NO: 37710 - RNA, 20 nt, Artificial Sequence
  CIITA targeting sequence
auaacauuucuauaagauaa

SEQ ID NO: 37711 - RNA, 20 nt, Artificial Sequence
  CIITA targeting sequence
auaucuauaacauuucuaua

SEQ ID NO: 37712 - RNA, 20 nt, Artificial Sequence
  CIITA targeting sequence
uuuuauagauauggcccaaa

SEQ ID NO: 37713 - RNA, 20 nt, Artificial Sequence
  CIITA targeting sequence
auaaaaugauuccauaucua

SEQ ID NO: 37714 - RNA, 20 nt, Artificial Sequence
  CIITA targeting sequence
aaagucacacaacucauuca

SEQ ID NO: 37715 - RNA, 20 nt, Artificial Sequence
  CIITA targeting sequence
cacaacucauucacggaguu

SEQ ID NO: 37716 - RNA, 20 nt, Artificial Sequence
  CIITA targeting sequence
uucacggaguugcuaggauc

SEQ ID NO: 37717 - RNA, 20 nt, Artificial Sequence
  CIITA targeting sequence
cggaguugcuaggaucaguc

SEQ ID NO: 37718 - RNA, 20 nt, Artificial Sequence
  CIITA targeting sequence
gugaaugaguugugugacuu

SEQ ID NO: 37719 - RNA, 20 nt, Artificial Sequence
  CIITA targeting sequence
uagcaacuccgugaaugagu

SEQ ID NO: 37720 - RNA, 20 nt, Artificial Sequence
  CIITA targeting sequence
gucuggagcucuugucacga

SEQ ID NO: 37721 - RNA, 20 nt, Artificial Sequence
  CIITA targeting sequence
ggagcucuugucacgagauc

SEQ ID NO: 37722 - RNA, 20 nt, Artificial Sequence
  CIITA targeting sequence
agacugauccuagcaacucc

SEQ ID NO: 37723 - RNA, 20 nt, Artificial Sequence
  CIITA targeting sequence
ugucacgagaucacacugcc

SEQ ID NO: 37724 - RNA, 20 nt, Artificial Sequence
  CIITA targeting sequence
cgagaucacacugccucaaa

SEQ ID NO: 37725 - RNA, 20 nt, Artificial Sequence
  CIITA targeting sequence
ugacaagagcuccagacuga

SEQ ID NO: 37726 - RNA, 20 nt, Artificial Sequence
  CIITA targeting sequence
cgugacaagagcuccagacu

SEQ ID NO: 37727 - RNA, 20 nt, Artificial Sequence
  CIITA targeting sequence
cacugccucaaagaggaggc

SEQ ID NO: 37728 - RNA, 20 nt, Artificial Sequence
  CIITA targeting sequence
aagaggaggcagauugcugc

SEQ ID NO: 37729 - RNA, 20 nt, Artificial Sequence
  CIITA targeting sequence
uugaggcagugugaucucgu

SEQ ID NO: 37730 - RNA, 20 nt, Artificial Sequence
  CIITA targeting sequence
ucuuugaggcagugugaucu

SEQ ID NO: 37731 - RNA, 20 nt, Artificial Sequence
  CIITA targeting sequence
gccuccucuuugaggcagug

SEQ ID NO: 37732 - RNA, 20 nt, Artificial Sequence
  CIITA targeting sequence
uaauaaagagcaugggugga

SEQ ID NO: 37733 - RNA, 20 nt, Artificial Sequence
  CIITA targeting sequence
uuauuaagaaccuacauugc

SEQ ID NO: 37734 - RNA, 20 nt, Artificial Sequence
  CIITA targeting sequence
acccaugcucuuuauuaaga

SEQ ID NO: 37735 - RNA, 20 nt, Artificial Sequence
  CIITA targeting sequence
cauuccacccaugcucuuua

SEQ ID NO: 37736 - RNA, 20 nt, Artificial Sequence
  CIITA targeting sequence
ggcaggagcuggggcaaagg

SEQ ID NO: 37737 - RNA, 20 nt, Artificial Sequence
  CIITA targeting sequence
ugccugaugcccgccuccca

SEQ ID NO: 37738 - RNA, 20 nt, Artificial Sequence
  CIITA targeting sequence
uuucucacugcucugagaga

SEQ ID NO: 37739 - RNA, 20 nt, Artificial Sequence
  CIITA targeting sequence
cacugcucugagagaacaga

SEQ ID NO: 37740 - RNA, 20 nt, Artificial Sequence
  CIITA targeting sequence
cugcucugagagaacagauu

SEQ ID NO: 37741 - RNA, 20 nt, Artificial Sequence
  CIITA targeting sequence
gagagaacagauuuugugcc

SEQ ID NO: 37742 - RNA, 20 nt, Artificial Sequence
  CIITA targeting sequence
gagcagugagaaaagacacc

SEQ ID NO: 37743 - RNA, 20 nt, Artificial Sequence
  CIITA targeting sequence
cagagcagugagaaaagaca

SEQ ID NO: 37744 - RNA, 20 nt, Artificial Sequence
  CIITA targeting sequence
cucagagcagugagaaaaga

SEQ ID NO: 37745 - RNA, 20 nt, Artificial Sequence
  CIITA targeting sequence
guucucucagagcagugaga

SEQ ID NO: 37746 - RNA, 20 nt, Artificial Sequence
  CIITA targeting sequence
cugaccaaggggcugggaga

SEQ ID NO: 37747 - RNA, 20 nt, Artificial Sequence
  CIITA targeting sequence
gggacacaggcacaaaaucu

SEQ ID NO: 37748 - RNA, 20 nt, Artificial Sequence
  CIITA targeting sequence
cagccccuuggucagggaca

SEQ ID NO: 37749 - RNA, 20 nt, Artificial Sequence
  CIITA targeting sequence
cccagccccuuggucaggga

SEQ ID NO: 37750 - RNA, 20 nt, Artificial Sequence
  CIITA targeting sequence
accucucccagccccuuggu

SEQ ID NO: 37751 - RNA, 20 nt, Artificial Sequence
  CIITA targeting sequence
cacccccaaccaucucccag

SEQ ID NO: 37752 - RNA, 20 nt, Artificial Sequence
  CIITA targeting sequence
cccccaaccaucucccagcu

SEQ ID NO: 37753 - RNA, 20 nt, Artificial Sequence
  CIITA targeting sequence
cccagcuuuggcccugcucc

SEQ ID NO: 37754 - RNA, 20 nt, Artificial Sequence
  CIITA targeting sequence
cagcuuuggcccugcuccag

SEQ ID NO: 37755 - RNA, 20 nt, Artificial Sequence
  CIITA targeting sequence
aggaaaagggcgguggcccc

SEQ ID NO: 37756 - RNA, 20 nt, Artificial Sequence
  CIITA targeting sequence
uggagcagggccaaagcugg

SEQ ID NO: 37757 - RNA, 20 nt, Artificial Sequence
  CIITA targeting sequence
uucaguucugcuuccucuag

SEQ ID NO: 37758 - RNA, 20 nt, Artificial Sequence
  CIITA targeting sequence
guucugcuuccucuagucau

SEQ ID NO: 37759 - RNA, 20 nt, Artificial Sequence
  CIITA targeting sequence
gcuuccucuagucaugguug

SEQ ID NO: 37760 - RNA, 20 nt, Artificial Sequence
  CIITA targeting sequence
ucuagucaugguuggcuggg

SEQ ID NO: 37761 - RNA, 20 nt, Artificial Sequence
  CIITA targeting sequence
agucaugguuggcugggauc

SEQ ID NO: 37762 - RNA, 20 nt, Artificial Sequence
  CIITA targeting sequence
ugguuggcugggaucucgcu

SEQ ID NO: 37763 - RNA, 20 nt, Artificial Sequence
  CIITA targeting sequence
cagccaaccaugacuagagg

SEQ ID NO: 37764 - RNA, 20 nt, Artificial Sequence
  CIITA targeting sequence
cgcugcaagccgguuauguu

SEQ ID NO: 37765 - RNA, 20 nt, Artificial Sequence
  CIITA targeting sequence
cugcaagccgguuauguuug

SEQ ID NO: 37766 - RNA, 20 nt, Artificial Sequence
  CIITA targeting sequence
ugcagcccccgcucaaccgu

SEQ ID NO: 37767 - RNA, 20 nt, Artificial Sequence
  CIITA targeting sequence
accgucaugaacaagugggc

SEQ ID NO: 37768 - RNA, 20 nt, Artificial Sequence
  CIITA targeting sequence
ugaacaagugggcccagcca

SEQ ID NO: 37769 - RNA, 20 nt, Artificial Sequence
  CIITA targeting sequence
ugacgguugagcgggggcug

SEQ ID NO: 37770 - RNA, 20 nt, Artificial Sequence
  CIITA targeting sequence
aagcuggggcacuggcuggg

SEQ ID NO: 37771 - RNA, 20 nt, Artificial Sequence
  CIITA targeting sequence
aguccaagcuggggcacugg

SEQ ID NO: 37772 - RNA, 20 nt, Artificial Sequence
  CIITA targeting sequence
uuccaguccaagcuggggca

SEQ ID NO: 37773 - RNA, 20 nt, Artificial Sequence
  CIITA targeting sequence
uucucugugacauccggggg

SEQ ID NO: 37774 - RNA, 20 nt, Artificial Sequence
  CIITA targeting sequence
cugugacauccgggggucug

SEQ ID NO: 37775 - RNA, 20 nt, Artificial Sequence
  CIITA targeting sequence
gugacauccgggggucugug

SEQ ID NO: 37776 - RNA, 20 nt, Artificial Sequence
  CIITA targeting sequence
cagagaaugaucuuuccagu

SEQ ID NO: 37777 - RNA, 20 nt, Artificial Sequence
  CIITA targeting sequence
gggggucugugcugagccuc

SEQ ID NO: 37778 - RNA, 20 nt, Artificial Sequence
  CIITA targeting sequence
gugcugagccucuccccagg

SEQ ID NO: 37779 - RNA, 20 nt, Artificial Sequence
  CIITA targeting sequence
gcacagacccccggauguca

SEQ ID NO: 37780 - RNA, 20 nt, Artificial Sequence
  CIITA targeting sequence
ccccaggcagugaaagcugu

SEQ ID NO: 37781 - RNA, 20 nt, Artificial Sequence
  CIITA targeting sequence
ccaggcagugaaagcugugg

SEQ ID NO: 37782 - RNA, 20 nt, Artificial Sequence
  CIITA targeting sequence
cugccuggggagaggcucag

SEQ ID NO: 37783 - RNA, 20 nt, Artificial Sequence
  CIITA targeting sequence
acagcuuucacugccugggg

SEQ ID NO: 37784 - RNA, 20 nt, Artificial Sequence
  CIITA targeting sequence
cgcauccacagcuuucacug

SEQ ID NO: 37785 - RNA, 20 nt, Artificial Sequence
  CIITA targeting sequence
uucacgcauccacagcuuuc

SEQ ID NO: 37786 - RNA, 20 nt, Artificial Sequence
  CIITA targeting sequence
cugggccgggugugguggcu

SEQ ID NO: 37787 - RNA, 20 nt, Artificial Sequence
  CIITA targeting sequence
gggccgggugugguggcuca

SEQ ID NO: 37788 - RNA, 20 nt, Artificial Sequence
  CIITA targeting sequence
caccuguaaucccagcacuu

SEQ ID NO: 37789 - RNA, 20 nt, Artificial Sequence
  CIITA targeting sequence
cagcacuuugggaggccaag

SEQ ID NO: 37790 - RNA, 20 nt, Artificial Sequence
  CIITA targeting sequence
caaagugcugggauuacagg

SEQ ID NO: 37791 - RNA, 20 nt, Artificial Sequence
  CIITA targeting sequence
acccgccuuggccucccaaa

SEQ ID NO: 37792 - RNA, 20 nt, Artificial Sequence
  CIITA targeting sequence
ccugaggucgggaguucgaa

SEQ ID NO: 37793 - RNA, 20 nt, Artificial Sequence
  CIITA targeting sequence
ggugauccacccgccuuggc

SEQ ID NO: 37794 - RNA, 20 nt, Artificial Sequence
  CIITA targeting sequence
ggaguucgaaaccagccuga

SEQ ID NO: 37795 - RNA, 20 nt, Artificial Sequence
  CIITA targeting sequence
cgaccucaggugauccaccc

SEQ ID NO: 37796 - RNA, 20 nt, Artificial Sequence
  CIITA targeting sequence
aaaccagccugaccaacaug

SEQ ID NO: 37797 - RNA, 20 nt, Artificial Sequence
  CIITA targeting sequence
aacucccgaccucaggugau

SEQ ID NO: 37798 - RNA, 20 nt, Artificial Sequence
  CIITA targeting sequence
ggcugguuucgaacucccga

SEQ ID NO: 37799 - RNA, 20 nt, Artificial Sequence
  CIITA targeting sequence
ccauguuggucaggcugguu

SEQ ID NO: 37800 - RNA, 20 nt, Artificial Sequence
  CIITA targeting sequence
uuacuaaaaauaaaaaaauu

SEQ ID NO: 37801 - RNA, 20 nt, Artificial Sequence
  CIITA targeting sequence
caaguagcuggcauuacagg

SEQ ID NO: 37802 - RNA, 20 nt, Artificial Sequence
  CIITA targeting sequence
accucccaaguagcuggcau

SEQ ID NO: 37803 - RNA, 20 nt, Artificial Sequence
  CIITA targeting sequence
ugcuucaaccucccaaguag

SEQ ID NO: 37804 - RNA, 20 nt, Artificial Sequence
  CIITA targeting sequence
ccugcuucaaccucccaagu

SEQ ID NO: 37805 - RNA, 20 nt, Artificial Sequence
  CIITA targeting sequence
agcaauucuccugcuucaac

SEQ ID NO: 37806 - RNA, 20 nt, Artificial Sequence
  CIITA targeting sequence
gggaggcagagguugcagug

SEQ ID NO: 37807 - RNA, 20 nt, Artificial Sequence
  CIITA targeting sequence
cggauucaagcaauucuccu

SEQ ID NO: 37808 - RNA, 20 nt, Artificial Sequence
  CIITA targeting sequence
gccucccggauucaagcaau

SEQ ID NO: 37809 - RNA, 20 nt, Artificial Sequence
  CIITA targeting sequence
cugcaaccucugccucccgg

SEQ ID NO: 37810 - RNA, 20 nt, Artificial Sequence
  CIITA targeting sequence
uggcucacugcaaccucugc

SEQ ID NO: 37811 - RNA, 20 nt, Artificial Sequence
  CIITA targeting sequence
agccugggcgacagagugag

SEQ ID NO: 37812 - RNA, 20 nt, Artificial Sequence
  CIITA targeting sequence
cccaggcuggagugcagugg

SEQ ID NO: 37813 - RNA, 20 nt, Artificial Sequence
  CIITA targeting sequence
gucgcccaggcuggagugca

SEQ ID NO: 37814 - RNA, 20 nt, Artificial Sequence
  CIITA targeting sequence
cucugucgcccaggcuggag

SEQ ID NO: 37815 - RNA, 20 nt, Artificial Sequence
  CIITA targeting sequence
cacucugucgcccaggcugg

SEQ ID NO: 37816 - RNA, 20 nt, Artificial Sequence
  CIITA targeting sequence
gucucaaaaaaaaaaagaaa

SEQ ID NO: 37817 - RNA, 20 nt, Artificial Sequence
  CIITA targeting sequence
caaaaaaaaaaagaaaaaga

SEQ ID NO: 37818 - RNA, 20 nt, Artificial Sequence
  CIITA targeting sequence
aaaaaaaaaagaaaaagaaa

SEQ ID NO: 37819 - RNA, 20 nt, Artificial Sequence
  CIITA targeting sequence
uuuuuuuuuugagacagagu

SEQ ID NO: 37820 - RNA, 20 nt, Artificial Sequence
  CIITA targeting sequence
uuuucuuuuuuuuuuugaga

SEQ ID NO: 37821 - RNA, 20 nt, Artificial Sequence
  CIITA targeting sequence
uuuucuuuuucuuuuuuuuu

SEQ ID NO: 37822 - RNA, 20 nt, Artificial Sequence
  CIITA targeting sequence
caggaaugggguggcaaguu

SEQ ID NO: 37823 - RNA, 20 nt, Artificial Sequence
  CIITA targeting sequence
ggaaugggguggcaaguuga

SEQ ID NO: 37824 - RNA, 20 nt, Artificial Sequence
  CIITA targeting sequence
ugagacucauuuucuuuuuc

SEQ ID NO: 37825 - RNA, 20 nt, Artificial Sequence
  CIITA targeting sequence
acuugccaccccauuccuga

SEQ ID NO: 37826 - RNA, 20 nt, Artificial Sequence
  CIITA targeting sequence
caugagcuuacucuucaaug

SEQ ID NO: 37827 - RNA, 20 nt, Artificial Sequence
  CIITA targeting sequence
ugagcuuacucuucaaugua

SEQ ID NO: 37828 - RNA, 20 nt, Artificial Sequence
  CIITA targeting sequence
ugagaaaacacacacucaac

SEQ ID NO: 37829 - RNA, 20 nt, Artificial Sequence
  CIITA targeting sequence
ucaauguauucucuucuggg

SEQ ID NO: 37830 - RNA, 20 nt, Artificial Sequence
  CIITA targeting sequence
auguauucucuucugggccc

SEQ ID NO: 37831 - RNA, 20 nt, Artificial Sequence
  CIITA targeting sequence
cuucugggcccagaacaggg

SEQ ID NO: 37832 - RNA, 20 nt, Artificial Sequence
  CIITA targeting sequence
ucugggcccagaacagggca

SEQ ID NO: 37833 - RNA, 20 nt, Artificial Sequence
  CIITA targeting sequence
gggcccagaacagggcagua

SEQ ID NO: 37834 - RNA, 20 nt, Artificial Sequence
  CIITA targeting sequence
gggcccagaagagaauacau

SEQ ID NO: 37835 - RNA, 20 nt, Artificial Sequence
  CIITA targeting sequence
uacugcccuguucugggccc

SEQ ID NO: 37836 - RNA, 20 nt, Artificial Sequence
  CIITA targeting sequence
cucuggucuuccagcuucag

SEQ ID NO: 37837 - RNA, 20 nt, Artificial Sequence
  CIITA targeting sequence
ggucuuccagcuucagggcc

SEQ ID NO: 37838 - RNA, 20 nt, Artificial Sequence
  CIITA targeting sequence
uccagcuucagggccagcuc

SEQ ID NO: 37839 - RNA, 20 nt, Artificial Sequence
  CIITA targeting sequence
agcuucagggccagcucucc

SEQ ID NO: 37840 - RNA, 20 nt, Artificial Sequence
  CIITA targeting sequence
gggccagcucuccucuuacc

SEQ ID NO: 37841 - RNA, 20 nt, Artificial Sequence
  CIITA targeting sequence
ccucuuaccuccuccaggaa

SEQ ID NO: 37842 - RNA, 20 nt, Artificial Sequence
  CIITA targeting sequence
ucuuaccuccuccaggaagc

SEQ ID NO: 37843 - RNA, 20 nt, Artificial Sequence
  CIITA targeting sequence
uaccuccuccaggaagcucc

SEQ ID NO: 37844 - RNA, 20 nt, Artificial Sequence
  CIITA targeting sequence
uccaggaagcucccucuguu

SEQ ID NO: 37845 - RNA, 20 nt, Artificial Sequence
  CIITA targeting sequence
aggaagcucccucuguuucu

SEQ ID NO: 37846 - RNA, 20 nt, Artificial Sequence
  CIITA targeting sequence
uggaggagguaagaggagag

SEQ ID NO: 37847 - RNA, 20 nt, Artificial Sequence
  CIITA targeting sequence
cucuguuucuuuccagccuu

SEQ ID NO: 37848 - RNA, 20 nt, Artificial Sequence
  CIITA targeting sequence
guuucuuuccagccuucauc

SEQ ID NO: 37849 - RNA, 20 nt, Artificial Sequence
  CIITA targeting sequence
uuccagccuucaucugcaug

SEQ ID NO: 37850 - RNA, 20 nt, Artificial Sequence
  CIITA targeting sequence
agccuucaucugcaugucau

SEQ ID NO: 37851 - RNA, 20 nt, Artificial Sequence
  CIITA targeting sequence
ucugcaugucauguguggug

SEQ ID NO: 37852 - RNA, 20 nt, Artificial Sequence
  CIITA targeting sequence
gcaugucauguguggugggu

SEQ ID NO: 37853 - RNA, 20 nt, Artificial Sequence
  CIITA targeting sequence
ugugugguggguugaaaggu

SEQ ID NO: 37854 - RNA, 20 nt, Artificial Sequence
  CIITA targeting sequence
acccaccacacaugacaugc

SEQ ID NO: 37855 - RNA, 20 nt, Artificial Sequence
  CIITA targeting sequence
uuuggggggccaccuuucaa

SEQ ID NO: 37856 - RNA, 20 nt, Artificial Sequence
  CIITA targeting sequence
augucaaaucccuggaaccu

SEQ ID NO: 37857 - RNA, 20 nt, Artificial Sequence
  CIITA targeting sequence
aaucccuggaaccugucagu

SEQ ID NO: 37858 - RNA, 20 nt, Artificial Sequence
  CIITA targeting sequence
cuggaaccugucagugugac

SEQ ID NO: 37859 - RNA, 20 nt, Artificial Sequence
  CIITA targeting sequence
agggauuugacauggacaua

SEQ ID NO: 37860 - RNA, 20 nt, Artificial Sequence
  CIITA targeting sequence
gugugacuuuauuugggaaa

SEQ ID NO: 37861 - RNA, 20 nt, Artificial Sequence
  CIITA targeting sequence
cacugacagguuccagggau

SEQ ID NO: 37862 - RNA, 20 nt, Artificial Sequence
  CIITA targeting sequence
caaauaaagucacacugaca

SEQ ID NO: 37863 - RNA, 20 nt, Artificial Sequence
  CIITA targeting sequence
uugcagauagaauuaaguua

SEQ ID NO: 37864 - RNA, 20 nt, Artificial Sequence
  CIITA targeting sequence
gcaaagacccuuuucccaaa

SEQ ID NO: 37865 - RNA, 20 nt, Artificial Sequence
  CIITA targeting sequence
aucugcaaagacccuuuucc

SEQ ID NO: 37866 - RNA, 20 nt, Artificial Sequence
  CIITA targeting sequence
ugccuguaaucccagcacuu

SEQ ID NO: 37867 - RNA, 20 nt, Artificial Sequence
  CIITA targeting sequence
cagcacuuugggaagcugag

SEQ ID NO: 37868 - RNA, 20 nt, Artificial Sequence
  CIITA targeting sequence
caaagugcugggauuacagg

SEQ ID NO: 37869 - RNA, 20 nt, Artificial Sequence
  CIITA targeting sequence
gcuucccaaagugcugggau

SEQ ID NO: 37870 - RNA, 20 nt, Artificial Sequence
  CIITA targeting sequence
cagcuucccaaagugcuggg

SEQ ID NO: 37871 - RNA, 20 nt, Artificial Sequence
  CIITA targeting sequence
aaucucagcuucccaaagug

SEQ ID NO: 37872 - RNA, 20 nt, Artificial Sequence
  CIITA targeting sequence
uccaaucucagcuucccaaa

SEQ ID NO: 37873 - RNA, 20 nt, Artificial Sequence
  CIITA targeting sequence
ccugaggucaggaguucaag

SEQ ID NO: 37874 - RNA, 20 nt, Artificial Sequence
  CIITA targeting sequence
ggugauccuccaaucucagc

SEQ ID NO: 37875 - RNA, 20 nt, Artificial Sequence
  CIITA targeting sequence
ggaguucaagaccagcgugg

SEQ ID NO: 37876 - RNA, 20 nt, Artificial Sequence
  CIITA targeting sequence
ugaccucaggugauccucca

SEQ ID NO: 37877 - RNA, 20 nt, Artificial Sequence
  CIITA targeting sequence
agaccagcguggccaacaug

SEQ ID NO: 37878 - RNA, 20 nt, Artificial Sequence
  CIITA targeting sequence
ugaacuccugaccucaggug

SEQ ID NO: 37879 - RNA, 20 nt, Artificial Sequence
  CIITA targeting sequence
acuaaaaauacaaaaauuag

SEQ ID NO: 37880 - RNA, 20 nt, Artificial Sequence
  CIITA targeting sequence
ugguggugagcaccuguaau

SEQ ID NO: 37881 - RNA, 20 nt, Artificial Sequence
  CIITA targeting sequence
ccaccaugaccagcuaauuu

SEQ ID NO: 37882 - RNA, 20 nt, Artificial Sequence
  CIITA targeting sequence
cagcuacucaggagacuggg

SEQ ID NO: 37883 - RNA, 20 nt, Artificial Sequence
  CIITA targeting sequence
ggagacuggggcaggagaau

SEQ ID NO: 37884 - RNA, 20 nt, Artificial Sequence
  CIITA targeting sequence
ugaguagcugggauuacagg

SEQ ID NO: 37885 - RNA, 20 nt, Artificial Sequence
  CIITA targeting sequence
ccugaguagcugggauuaca

SEQ ID NO: 37886 - RNA, 20 nt, Artificial Sequence
  CIITA targeting sequence
ugccccagucuccugaguag

SEQ ID NO: 37887 - RNA, 20 nt, Artificial Sequence
  CIITA targeting sequence
ccugccccagucuccugagu

SEQ ID NO: 37888 - RNA, 20 nt, Artificial Sequence
  CIITA targeting sequence
cuugaacugggagguggagg

SEQ ID NO: 37889 - RNA, 20 nt, Artificial Sequence
  CIITA targeting sequence
agcgauucuccugccccagu

SEQ ID NO: 37890 - RNA, 20 nt, Artificial Sequence
  CIITA targeting sequence
caguucaagcgauucuccug

SEQ ID NO: 37891 - RNA, 20 nt, Artificial Sequence
  CIITA targeting sequence
accucccaguucaagcgauu

SEQ ID NO: 37892 - RNA, 20 nt, Artificial Sequence
  CIITA targeting sequence
cugcaaccuccaccucccag

SEQ ID NO: 37893 - RNA, 20 nt, Artificial Sequence
  CIITA targeting sequence
gcucacugcaaccuccaccu

SEQ ID NO: 37894 - RNA, 20 nt, Artificial Sequence
  CIITA targeting sequence
agccugggcaacagagcaag

SEQ ID NO: 37895 - RNA, 20 nt, Artificial Sequence
  CIITA targeting sequence
guugcccaggcuggaaugca

SEQ ID NO: 37896 - RNA, 20 nt, Artificial Sequence
  CIITA targeting sequence
gucucaaaagaaggcaaaaa

SEQ ID NO: 37897 - RNA, 20 nt, Artificial Sequence
  CIITA targeting sequence
caaaagaaggcaaaaaaaga

SEQ ID NO: 37898 - RNA, 20 nt, Artificial Sequence
  CIITA targeting sequence
aaagaaggcaaaaaaagaau

SEQ ID NO: 37899 - RNA, 20 nt, Artificial Sequence
  CIITA targeting sequence
uuugagacagaggcuugcuc

SEQ ID NO: 37900 - RNA, 20 nt, Artificial Sequence
  CIITA targeting sequence
uuuuuugccuucuuuugaga

SEQ ID NO: 37901 - RNA, 20 nt, Artificial Sequence
  CIITA targeting sequence
uuaauucuuuuuuugccuuc

SEQ ID NO: 37902 - RNA, 20 nt, Artificial Sequence
  CIITA targeting sequence
ugaaaugacaucauccugga

SEQ ID NO: 37903 - RNA, 20 nt, Artificial Sequence
  CIITA targeting sequence
agaucuuuaauucuuuuuuu

SEQ ID NO: 37904 - RNA, 20 nt, Artificial Sequence
  CIITA targeting sequence
uuucaagaucuuuaauucuu

SEQ ID NO: 37905 - RNA, 20 nt, Artificial Sequence
  CIITA targeting sequence
uccuggauuaucuagguggg

SEQ ID NO: 37906 - RNA, 20 nt, Artificial Sequence
  CIITA targeting sequence
uggauuaucuaggugggucc

SEQ ID NO: 37907 - RNA, 20 nt, Artificial Sequence
  CIITA targeting sequence
aggaugaugucauuucaaga

SEQ ID NO: 37908 - RNA, 20 nt, Artificial Sequence
  CIITA targeting sequence
agguggguccuaaauccaau

SEQ ID NO: 37909 - RNA, 20 nt, Artificial Sequence
  CIITA targeting sequence
uaaauccaaugacaaguguc

SEQ ID NO: 37910 - RNA, 20 nt, Artificial Sequence
  CIITA targeting sequence
aaugacaagugucuuuauaa

SEQ ID NO: 37911 - RNA, 20 nt, Artificial Sequence
  CIITA targeting sequence
uuggauuuaggacccaccua

SEQ ID NO: 37912 - RNA, 20 nt, Artificial Sequence
  CIITA targeting sequence
uuauaagagaaagagacuug

SEQ ID NO: 37913 - RNA, 20 nt, Artificial Sequence
  CIITA targeting sequence
uauaaagacacuugucauug

SEQ ID NO: 37914 - RNA, 20 nt, Artificial Sequence
  CIITA targeting sequence
cuuauaaagacacuugucau

SEQ ID NO: 37915 - RNA, 20 nt, Artificial Sequence
  CIITA targeting sequence
uucucuuauaaagacacuug

SEQ ID NO: 37916 - RNA, 20 nt, Artificial Sequence
  CIITA targeting sequence
cuuucucuuauaaagacacu

SEQ ID NO: 37917 - RNA, 20 nt, Artificial Sequence
  CIITA targeting sequence
uguagcaagucucuuucucu

SEQ ID NO: 37918 - RNA, 20 nt, Artificial Sequence
  CIITA targeting sequence
ucauguagcaagucucuuuc

SEQ ID NO: 37919 - RNA, 20 nt, Artificial Sequence
  CIITA targeting sequence
ccuacuccucauguagcaag

SEQ ID NO: 37920 - RNA, 20 nt, Artificial Sequence
  CIITA targeting sequence
gcuuuaguggccacaucacc

SEQ ID NO: 37921 - RNA, 20 nt, Artificial Sequence
  CIITA targeting sequence
aaacucagcuuuaguggcca

SEQ ID NO: 37922 - RNA, 20 nt, Artificial Sequence
  CIITA targeting sequence
cucuaaacucagcuuuagug

SEQ ID NO: 37923 - RNA, 20 nt, Artificial Sequence
  CIITA targeting sequence
uguggcugcaucacucuaaa

SEQ ID NO: 37924 - RNA, 20 nt, Artificial Sequence
  CIITA targeting sequence
aggaucaccaguaguuccca

SEQ ID NO: 37925 - RNA, 20 nt, Artificial Sequence
  CIITA targeting sequence
uugacuuguggucuuguggc

SEQ ID NO: 37926 - RNA, 20 nt, Artificial Sequence
  CIITA targeting sequence
ccaguaguucccagcagcua

SEQ ID NO: 37927 - RNA, 20 nt, Artificial Sequence
  CIITA targeting sequence
cagcagcuagaggaggcaag

SEQ ID NO: 37928 - RNA, 20 nt, Artificial Sequence
  CIITA targeting sequence
agcugcugggaacuacuggu

SEQ ID NO: 37929 - RNA, 20 nt, Artificial Sequence
  CIITA targeting sequence
ucuagcugcugggaacuacu

SEQ ID NO: 37930 - RNA, 20 nt, Artificial Sequence
  CIITA targeting sequence
uugccuccucuagcugcugg

SEQ ID NO: 37931 - RNA, 20 nt, Artificial Sequence
  CIITA targeting sequence
ccccucgagccuccagaggc

SEQ ID NO: 37932 - RNA, 20 nt, Artificial Sequence
  CIITA targeting sequence
ccucgagccuccagaggcag

SEQ ID NO: 37933 - RNA, 20 nt, Artificial Sequence
  CIITA targeting sequence
agccuccagaggcagcgugg

SEQ ID NO: 37934 - RNA, 20 nt, Artificial Sequence
  CIITA targeting sequence
aggggagaaugcuuccuugc

SEQ ID NO: 37935 - RNA, 20 nt, Artificial Sequence
  CIITA targeting sequence
agaggcagcguggcccugcu

SEQ ID NO: 37936 - RNA, 20 nt, Artificial Sequence
  CIITA targeting sequence
ggaggcucgaggggagaaug

SEQ ID NO: 37937 - RNA, 20 nt, Artificial Sequence
  CIITA targeting sequence
gcagggccacgcugccucug

SEQ ID NO: 37938 - RNA, 20 nt, Artificial Sequence
  CIITA targeting sequence
acuucuggccuccagaacca

SEQ ID NO: 37939 - RNA, 20 nt, Artificial Sequence
  CIITA targeting sequence
ggccuccagaaccaugagag

SEQ ID NO: 37940 - RNA, 20 nt, Artificial Sequence
  CIITA targeting sequence
agaaccaugagagaauaaag

SEQ ID NO: 37941 - RNA, 20 nt, Artificial Sequence
  CIITA targeting sequence
ggaggccagaaguugaagcc

SEQ ID NO: 37942 - RNA, 20 nt, Artificial Sequence
  CIITA targeting sequence
ugguucuggaggccagaagu

SEQ ID NO: 37943 - RNA, 20 nt, Artificial Sequence
  CIITA targeting sequence
caugguucuggaggccagaa

SEQ ID NO: 37944 - RNA, 20 nt, Artificial Sequence
  CIITA targeting sequence
cucaugguucuggaggccag

SEQ ID NO: 37945 - RNA, 20 nt, Artificial Sequence
  CIITA targeting sequence
gagcuaccuggaugcuggua

SEQ ID NO: 37946 - RNA, 20 nt, Artificial Sequence
  CIITA targeting sequence
gaacaacagcacuuuauucu

SEQ ID NO: 37947 - RNA, 20 nt, Artificial Sequence
  CIITA targeting sequence
agguagcucagaacaacagc

SEQ ID NO: 37948 - RNA, 20 nt, Artificial Sequence
  CIITA targeting sequence
gcagcccugggaaaugaaua

SEQ ID NO: 37949 - RNA, 20 nt, Artificial Sequence
  CIITA targeting sequence
cagggcugcugaaacaaggu

SEQ ID NO: 37950 - RNA, 20 nt, Artificial Sequence
  CIITA targeting sequence
uuucccagggcugcugaaac

SEQ ID NO: 37951 - RNA, 20 nt, Artificial Sequence
  CIITA targeting sequence
augguauauucauuucccag

SEQ ID NO: 37952 - RNA, 20 nt, Artificial Sequence
  CIITA targeting sequence
auguuuccaugguauauuca

SEQ ID NO: 37953 - RNA, 20 nt, Artificial Sequence
  CIITA targeting sequence
gguccauguuuccaugguau

SEQ ID NO: 37954 - RNA, 20 nt, Artificial Sequence
  CIITA targeting sequence
gugguucagguccauguuuc

SEQ ID NO: 37955 - RNA, 20 nt, Artificial Sequence
  CIITA targeting sequence
uggcaggagccuuagagcca

SEQ ID NO: 37956 - RNA, 20 nt, Artificial Sequence
  CIITA targeting sequence
ugccaggauccgugguucag

SEQ ID NO: 37957 - RNA, 20 nt, Artificial Sequence
  CIITA targeting sequence
aaggcuccugccaggauccg

SEQ ID NO: 37958 - RNA, 20 nt, Artificial Sequence
  CIITA targeting sequence
guguggcucuaaggcuccug

SEQ ID NO: 37959 - RNA, 20 nt, Artificial Sequence
  CIITA targeting sequence
ucuguguggcucuaaggcuc

SEQ ID NO: 37960 - RNA, 20 nt, Artificial Sequence
  CIITA targeting sequence
gcuuggcuuuccccagcaag

SEQ ID NO: 37961 - RNA, 20 nt, Artificial Sequence
  CIITA targeting sequence
ccagcaagagcuacaugauc

SEQ ID NO: 37962 - RNA, 20 nt, Artificial Sequence
  CIITA targeting sequence
ugcuggggaaagccaagcug

SEQ ID NO: 37963 - RNA, 20 nt, Artificial Sequence
  CIITA targeting sequence
uguagcucuugcuggggaaa

SEQ ID NO: 37964 - RNA, 20 nt, Artificial Sequence
  CIITA targeting sequence
ugaggaagcugcuugucuuc

SEQ ID NO: 37965 - RNA, 20 nt, Artificial Sequence
  CIITA targeting sequence
agaucauguagcucuugcug

SEQ ID NO: 37966 - RNA, 20 nt, Artificial Sequence
  CIITA targeting sequence
ucaagaucauguagcucuug

SEQ ID NO: 37967 - RNA, 20 nt, Artificial Sequence
  CIITA targeting sequence
ucucugggucucaaguucuu

SEQ ID NO: 37968 - RNA, 20 nt, Artificial Sequence
  CIITA targeting sequence
cugggucucaaguucuucau

SEQ ID NO: 37969 - RNA, 20 nt, Artificial Sequence
  CIITA targeting sequence
gggucucaaguucuucaucu

SEQ ID NO: 37970 - RNA, 20 nt, Artificial Sequence
  CIITA targeting sequence
caaguucuucaucugccaau

SEQ ID NO: 37971 - RNA, 20 nt, Artificial Sequence
  CIITA targeting sequence
aguucuucaucugccaaugg

SEQ ID NO: 37972 - RNA, 20 nt, Artificial Sequence
  CIITA targeting sequence
ucaucugccaauggagacaa

SEQ ID NO: 37973 - RNA, 20 nt, Artificial Sequence
  CIITA targeting sequence
ucugccaauggagacaauaa

SEQ ID NO: 37974 - RNA, 20 nt, Artificial Sequence
  CIITA targeting sequence
gccaauggagacaauaaugc

SEQ ID NO: 37975 - RNA, 20 nt, Artificial Sequence
  CIITA targeting sequence
auuggcagaugaagaacuug

SEQ ID NO: 37976 - RNA, 20 nt, Artificial Sequence
  CIITA targeting sequence
ccauuggcagaugaagaacu

SEQ ID NO: 37977 - RNA, 20 nt, Artificial Sequence
  CIITA targeting sequence
uagguuuuaacagcuuuauu

SEQ ID NO: 37978 - RNA, 20 nt, Artificial Sequence
  CIITA targeting sequence
auaaagcuguuaaaaccuag

SEQ ID NO: 37979 - RNA, 20 nt, Artificial Sequence
  CIITA targeting sequence
caauaaagcuguuaaaaccu

SEQ ID NO: 37980 - RNA, 20 nt, Artificial Sequence
  CIITA targeting sequence
cauauacaauuugcccacuu

SEQ ID NO: 37981 - RNA, 20 nt, Artificial Sequence
  CIITA targeting sequence
ugccuguaaucccaacacuu

SEQ ID NO: 37982 - RNA, 20 nt, Artificial Sequence
  CIITA targeting sequence
caacacuuugggaggccgag

SEQ ID NO: 37983 - RNA, 20 nt, Artificial Sequence
  CIITA targeting sequence
caaaguguugggauuacagg

SEQ ID NO: 37984 - RNA, 20 nt, Artificial Sequence
  CIITA targeting sequence
gccucccaaaguguugggau

SEQ ID NO: 37985 - RNA, 20 nt, Artificial Sequence
  CIITA targeting sequence
ucggccucccaaaguguugg

SEQ ID NO: 37986 - RNA, 20 nt, Artificial Sequence
  CIITA targeting sequence
ccucggccucccaaaguguu

SEQ ID NO: 37987 - RNA, 20 nt, Artificial Sequence
  CIITA targeting sequence
gccugucuccucggccuccc

SEQ ID NO: 37988 - RNA, 20 nt, Artificial Sequence
  CIITA targeting sequence
cuugaggucaggaguuugag

SEQ ID NO: 37989 - RNA, 20 nt, Artificial Sequence
  CIITA targeting sequence
agugauccgccugucuccuc

SEQ ID NO: 37990 - RNA, 20 nt, Artificial Sequence
  CIITA targeting sequence
ggaguuugagaacagccugg

SEQ ID NO: 37991 - RNA, 20 nt, Artificial Sequence
  CIITA targeting sequence
ugaccucaagugauccgccu

SEQ ID NO: 37992 - RNA, 20 nt, Artificial Sequence
  CIITA targeting sequence
aacuccugaccucaagugau

SEQ ID NO: 37993 - RNA, 20 nt, Artificial Sequence
  CIITA targeting sequence
caaacuccugaccucaagug

SEQ ID NO: 37994 - RNA, 20 nt, Artificial Sequence
  CIITA targeting sequence
ccauuuuggccaggcuguuc

SEQ ID NO: 37995 - RNA, 20 nt, Artificial Sequence
  CIITA targeting sequence
cuacuaaaaaugcaaaaauu

SEQ ID NO: 37996 - RNA, 20 nt, Artificial Sequence
  CIITA targeting sequence
acuaaaaaugcaaaaauuag

SEQ ID NO: 37997 - RNA, 20 nt, Artificial Sequence
  CIITA targeting sequence
cagcugcucaggaggcugag

SEQ ID NO: 37998 - RNA, 20 nt, Artificial Sequence
  CIITA targeting sequence
ggaggcugaggcagaagaau

SEQ ID NO: 37999 - RNA, 20 nt, Artificial Sequence
  CIITA targeting sequence
ugagcagcugggauuacagg

SEQ ID NO: 38000 - RNA, 20 nt, Artificial Sequence
  CIITA targeting sequence
gccuccugagcagcugggau

SEQ ID NO: 38001 - RNA, 20 nt, Artificial Sequence
  CIITA targeting sequence
gccucagccuccugagcagc

SEQ ID NO: 38002 - RNA, 20 nt, Artificial Sequence
  CIITA targeting sequence
ucugccucagccuccugagc

SEQ ID NO: 38003 - RNA, 20 nt, Artificial Sequence
  CIITA targeting sequence
agccauucuucugccucagc

SEQ ID NO: 38004 - RNA, 20 nt, Artificial Sequence
  CIITA targeting sequence
cagguucaagccauucuucu

SEQ ID NO: 38005 - RNA, 20 nt, Artificial Sequence
  CIITA targeting sequence
gccucccagguucaagccau

SEQ ID NO: 38006 - RNA, 20 nt, Artificial Sequence
  CIITA targeting sequence
cugcaacgucugccucccag

SEQ ID NO: 38007 - RNA, 20 nt, Artificial Sequence
  CIITA targeting sequence
uggcucacugcaacgucugc

SEQ ID NO: 38008 - RNA, 20 nt, Artificial Sequence
  CIITA targeting sequence
agccugggugacagagacuc

SEQ ID NO: 38009 - RNA, 20 nt, Artificial Sequence
  CIITA targeting sequence
cccaggcuggagugcagggg

SEQ ID NO: 38010 - RNA, 20 nt, Artificial Sequence
  CIITA targeting sequence
gucacccaggcuggagugca

SEQ ID NO: 38011 - RNA, 20 nt, Artificial Sequence
  CIITA targeting sequence
cugucacccaggcuggagug

SEQ ID NO: 38012 - RNA, 20 nt, Artificial Sequence
  CIITA targeting sequence
gucuuaaaaaaaaaaaaaaa

SEQ ID NO: 38013 - RNA, 20 nt, Artificial Sequence
  CIITA targeting sequence
uaaaaaaaaaaaaaaaaaaa

SEQ ID NO: 38014 - RNA, 20 nt, Artificial Sequence
  CIITA targeting sequence
acuuuuuuuuuuuuuuuuuu

SEQ ID NO: 38015 - RNA, 20 nt, Artificial Sequence
  CIITA targeting sequence
guguucuuuugggaauacuc

SEQ ID NO: 38016 - RNA, 20 nt, Artificial Sequence
  CIITA targeting sequence
uuugggaauacucagagagu

SEQ ID NO: 38017 - RNA, 20 nt, Artificial Sequence
  CIITA targeting sequence
caaaagaacacugaacucua

SEQ ID NO: 38018 - RNA, 20 nt, Artificial Sequence
  CIITA targeting sequence
gagaguugugugaccaucuc

SEQ ID NO: 38019 - RNA, 20 nt, Artificial Sequence
  CIITA targeting sequence
gaguauucccaaaagaacac

SEQ ID NO: 38020 - RNA, 20 nt, Artificial Sequence
  CIITA targeting sequence
cugaguauucccaaaagaac

SEQ ID NO: 38021 - RNA, 20 nt, Artificial Sequence
  CIITA targeting sequence
cacaacucucugaguauucc

SEQ ID NO: 38022 - RNA, 20 nt, Artificial Sequence
  CIITA targeting sequence
cccauccccacagucaauuu

SEQ ID NO: 38023 - RNA, 20 nt, Artificial Sequence
  CIITA targeting sequence
cauccccacagucaauuuua

SEQ ID NO: 38024 - RNA, 20 nt, Artificial Sequence
  CIITA targeting sequence
ccacagucaauuuuagcaca

SEQ ID NO: 38025 - RNA, 20 nt, Artificial Sequence
  CIITA targeting sequence
auuuuagcacauuucaucac

SEQ ID NO: 38026 - RNA, 20 nt, Artificial Sequence
  CIITA targeting sequence
ucacccccuaaagaaacucc

SEQ ID NO: 38027 - RNA, 20 nt, Artificial Sequence
  CIITA targeting sequence
cccccuaaagaaacuccaga

SEQ ID NO: 38028 - RNA, 20 nt, Artificial Sequence
  CIITA targeting sequence
uuagggggugaugaaaugug

SEQ ID NO: 38029 - RNA, 20 nt, Artificial Sequence
  CIITA targeting sequence
agacccaucagcaguuguuc

SEQ ID NO: 38030 - RNA, 20 nt, Artificial Sequence
  CIITA targeting sequence
ggaguuucuuuaggggguga

SEQ ID NO: 38031 - RNA, 20 nt, Artificial Sequence
  CIITA targeting sequence
gcaguuguuccccauuuccu

SEQ ID NO: 38032 - RNA, 20 nt, Artificial Sequence
  CIITA targeting sequence
ccauuuccuuccaaaauccc

SEQ ID NO: 38033 - RNA, 20 nt, Artificial Sequence
  CIITA targeting sequence
uuccaaaaucccucucugcc

SEQ ID NO: 38034 - RNA, 20 nt, Artificial Sequence
  CIITA targeting sequence
aaaaucccucucugccaagc

SEQ ID NO: 38035 - RNA, 20 nt, Artificial Sequence
  CIITA targeting sequence
cucucugccaagcccuaggc

SEQ ID NO: 38036 - RNA, 20 nt, Artificial Sequence
  CIITA targeting sequence
cugccaagcccuaggcaacc

SEQ ID NO: 38037 - RNA, 20 nt, Artificial Sequence
  CIITA targeting sequence
gccaagcccuaggcaaccac

SEQ ID NO: 38038 - RNA, 20 nt, Artificial Sequence
  CIITA targeting sequence
uucuuaaaaaaaaauuaaua

SEQ ID NO: 38039 - RNA, 20 nt, Artificial Sequence
  CIITA targeting sequence
uaaaaaaaaauuaauagaga

SEQ ID NO: 38040 - RNA, 20 nt, Artificial Sequence
  CIITA targeting sequence
auuaauuuuuuuuuaagaaa

SEQ ID NO: 38041 - RNA, 20 nt, Artificial Sequence
  CIITA targeting sequence
cuauuaauuuuuuuuuaaga

SEQ ID NO: 38042 - RNA, 20 nt, Artificial Sequence
  CIITA targeting sequence
ugaacaccugggcucaagcg

SEQ ID NO: 38043 - RNA, 20 nt, Artificial Sequence
  CIITA targeting sequence
agaccagccugggcaacaua

SEQ ID NO: 38044 - RNA, 20 nt, Artificial Sequence
  CIITA targeting sequence
agcgauucuccugucucagc

SEQ ID NO: 38045 - RNA, 20 nt, Artificial Sequence
  CIITA targeting sequence
cuugagcccagguguucaag

SEQ ID NO: 38046 - RNA, 20 nt, Artificial Sequence
  CIITA targeting sequence
ccugucucagccucccaaag

SEQ ID NO: 38047 - RNA, 20 nt, Artificial Sequence
  CIITA targeting sequence
ugucucagccucccaaagug

SEQ ID NO: 38048 - RNA, 20 nt, Artificial Sequence
  CIITA targeting sequence
cagccucccaaagugcuggg

SEQ ID NO: 38049 - RNA, 20 nt, Artificial Sequence
  CIITA targeting sequence
gccucccaaagugcugggau

SEQ ID NO: 38050 - RNA, 20 nt, Artificial Sequence
  CIITA targeting sequence
caaagugcugggauuucagg

SEQ ID NO: 38051 - RNA, 20 nt, Artificial Sequence
  CIITA targeting sequence
cagcacuuugggaggcugag

SEQ ID NO: 38052 - RNA, 20 nt, Artificial Sequence
  CIITA targeting sequence
ggcaugagccaccacgcccc

SEQ ID NO: 38053 - RNA, 20 nt, Artificial Sequence
  CIITA targeting sequence
ugccugaaaucccagcacuu

SEQ ID NO: 38054 - RNA, 20 nt, Artificial Sequence
  CIITA targeting sequence
uacuuuaugucuccauggau

SEQ ID NO: 38055 - RNA, 20 nt, Artificial Sequence
  CIITA targeting sequence
ccauggauuugccuguuuug

SEQ ID NO: 38056 - RNA, 20 nt, Artificial Sequence
  CIITA targeting sequence
auggauuugccuguuuuggu

SEQ ID NO: 38057 - RNA, 20 nt, Artificial Sequence
  CIITA targeting sequence
auggagacauaaaguaggag

SEQ ID NO: 38058 - RNA, 20 nt, Artificial Sequence
  CIITA targeting sequence
uuucaaauaaauagaaucau

SEQ ID NO: 38059 - RNA, 20 nt, Artificial Sequence
  CIITA targeting sequence
aauaaauagaaucauacaau

SEQ ID NO: 38060 - RNA, 20 nt, Artificial Sequence
  CIITA targeting sequence
auuuauuugaaaugaccaaa

SEQ ID NO: 38061 - RNA, 20 nt, Artificial Sequence
  CIITA targeting sequence
uacaauaugugacccuuugu

SEQ ID NO: 38062 - RNA, 20 nt, Artificial Sequence
  CIITA targeting sequence
cauauuguaugauucuauuu

SEQ ID NO: 38063 - RNA, 20 nt, Artificial Sequence
  CIITA targeting sequence
ggcuucuucacuuagcauuu

SEQ ID NO: 38064 - RNA, 20 nt, Artificial Sequence
  CIITA targeting sequence
ucacuuagcauuuuuuuuaa

SEQ ID NO: 38065 - RNA, 20 nt, Artificial Sequence
  CIITA targeting sequence
cuuagcauuuuuuuuaaggu

SEQ ID NO: 38066 - RNA, 20 nt, Artificial Sequence
  CIITA targeting sequence
uccauguuccagcauguauc

SEQ ID NO: 38067 - RNA, 20 nt, Artificial Sequence
  CIITA targeting sequence
auguuccagcauguaucagu

SEQ ID NO: 38068 - RNA, 20 nt, Artificial Sequence
  CIITA targeting sequence
agcauguaucagugcuuucu

SEQ ID NO: 38069 - RNA, 20 nt, Artificial Sequence
  CIITA targeting sequence
gugcuuucucccuuuaaugg

SEQ ID NO: 38070 - RNA, 20 nt, Artificial Sequence
  CIITA targeting sequence
cccuuuaaugguggaauacu

SEQ ID NO: 38071 - RNA, 20 nt, Artificial Sequence
  CIITA targeting sequence
cuuuaaugguggaauacuuu

SEQ ID NO: 38072 - RNA, 20 nt, Artificial Sequence
  CIITA targeting sequence
accauuaaagggagaaagca

SEQ ID NO: 38073 - RNA, 20 nt, Artificial Sequence
  CIITA targeting sequence
auacaauaaaguauuccacc

SEQ ID NO: 38074 - RNA, 20 nt, Artificial Sequence
  CIITA targeting sequence
auuuauuuuuugguggauau

SEQ ID NO: 38075 - RNA, 20 nt, Artificial Sequence
  CIITA targeting sequence
accaaaaaauaaauggauaa

SEQ ID NO: 38076 - RNA, 20 nt, Artificial Sequence
  CIITA targeting sequence
aaauagccaaaauauaaaaa

SEQ ID NO: 38077 - RNA, 20 nt, Artificial Sequence
  CIITA targeting sequence
uucugugaacauucguguau

SEQ ID NO: 38078 - RNA, 20 nt, Artificial Sequence
  CIITA targeting sequence
gugaacauucguguauaggu

SEQ ID NO: 38079 - RNA, 20 nt, Artificial Sequence
  CIITA targeting sequence
cagaaggauaauucaaaaua

SEQ ID NO: 38080 - RNA, 20 nt, Artificial Sequence
  CIITA targeting sequence
uguauagguuuuugugugga

SEQ ID NO: 38081 - RNA, 20 nt, Artificial Sequence
  CIITA targeting sequence
acacaaaaaccuauacacga

SEQ ID NO: 38082 - RNA, 20 nt, Artificial Sequence
  CIITA targeting sequence
gguuuuucuuguuuucuuuu

SEQ ID NO: 38083 - RNA, 20 nt, Artificial Sequence
  CIITA targeting sequence
uguuuucuuuuguuuuauua

SEQ ID NO: 38084 - RNA, 20 nt, Artificial Sequence
  CIITA targeting sequence
uuuguuuuauuaauacauaa

SEQ ID NO: 38085 - RNA, 20 nt, Artificial Sequence
  CIITA targeting sequence
uauuauguauuaauaaaaca

SEQ ID NO: 38086 - RNA, 20 nt, Artificial Sequence
  CIITA targeting sequence
cauauaccccauaaauaugu

SEQ ID NO: 38087 - RNA, 20 nt, Artificial Sequence
  CIITA targeting sequence
augcauguaauaaauauuca

SEQ ID NO: 38088 - RNA, 20 nt, Artificial Sequence
  CIITA targeting sequence
uuauaccuucuaugcaugua

SEQ ID NO: 38089 - RNA, 20 nt, Artificial Sequence
  CIITA targeting sequence
ugucaggauauuugagguau

SEQ ID NO: 38090 - RNA, 20 nt, Artificial Sequence
  CIITA targeting sequence
ggauauuugagguauccaca

SEQ ID NO: 38091 - RNA, 20 nt, Artificial Sequence
  CIITA targeting sequence
ugacaugaucauuauaccuu

SEQ ID NO: 38092 - RNA, 20 nt, Artificial Sequence
  CIITA targeting sequence
aauauccugacaugaucauu

SEQ ID NO: 38093 - RNA, 20 nt, Artificial Sequence
  CIITA targeting sequence
acauuugggauuguuuaaag

SEQ ID NO: 38094 - RNA, 20 nt, Artificial Sequence
  CIITA targeting sequence
caaauguggauaccucaaau

SEQ ID NO: 38095 - RNA, 20 nt, Artificial Sequence
  CIITA targeting sequence
uuaaacaaucccaaaugugg

SEQ ID NO: 38096 - RNA, 20 nt, Artificial Sequence
  CIITA targeting sequence
uuuaaucuuuaaacaauccc

SEQ ID NO: 38097 - RNA, 20 nt, Artificial Sequence
  CIITA targeting sequence
acaaaugaugaggaaaucuu

SEQ ID NO: 38098 - RNA, 20 nt, Artificial Sequence
  CIITA targeting sequence
uuuguugaagggcauauuaa

SEQ ID NO: 38099 - RNA, 20 nt, Artificial Sequence
  CIITA targeting sequence
ucauuuguugaagggcauau

SEQ ID NO: 38100 - RNA, 20 nt, Artificial Sequence
  CIITA targeting sequence
ucaucauuuguugaagggca

SEQ ID NO: 38101 - RNA, 20 nt, Artificial Sequence
  CIITA targeting sequence
uagaaucugcucagacuccu

SEQ ID NO: 38102 - RNA, 20 nt, Artificial Sequence
  CIITA targeting sequence
aagauuuccucaucauuugu

SEQ ID NO: 38103 - RNA, 20 nt, Artificial Sequence
  CIITA targeting sequence
gcucagacuccuucaguuua

SEQ ID NO: 38104 - RNA, 20 nt, Artificial Sequence
  CIITA targeting sequence
gacuccuucaguuuacauau

SEQ ID NO: 38105 - RNA, 20 nt, Artificial Sequence
  CIITA targeting sequence
gagcagauucuaagauuucc

SEQ ID NO: 38106 - RNA, 20 nt, Artificial Sequence
  CIITA targeting sequence
uucaguuuacauauuaggaa

SEQ ID NO: 38107 - RNA, 20 nt, Artificial Sequence
  CIITA targeting sequence
guuuacauauuaggaaacug

SEQ ID NO: 38108 - RNA, 20 nt, Artificial Sequence
  CIITA targeting sequence
uaauauguaaacugaaggag

SEQ ID NO: 38109 - RNA, 20 nt, Artificial Sequence
  CIITA targeting sequence
guuuccuaauauguaaacug

SEQ ID NO: 38110 - RNA, 20 nt, Artificial Sequence
  CIITA targeting sequence
gugccucaguuuccuaauau

SEQ ID NO: 38111 - RNA, 20 nt, Artificial Sequence
  CIITA targeting sequence
uuucugugccucaguuuccu

SEQ ID NO: 38112 - RNA, 20 nt, Artificial Sequence
  CIITA targeting sequence
gcuccuuucugugccucagu

SEQ ID NO: 38113 - RNA, 20 nt, Artificial Sequence
  CIITA targeting sequence
cugcuccuuucugugccuca

SEQ ID NO: 38114 - RNA, 20 nt, Artificial Sequence
  CIITA targeting sequence
aguccacccaaagcaguaga

SEQ ID NO: 38115 - RNA, 20 nt, Artificial Sequence
  CIITA targeting sequence
acccaaagcaguagagcauu

SEQ ID NO: 38116 - RNA, 20 nt, Artificial Sequence
  CIITA targeting sequence
acugcuuuggguggacuuga

SEQ ID NO: 38117 - RNA, 20 nt, Artificial Sequence
  CIITA targeting sequence
ugcauuuaaccacaaugcuc

SEQ ID NO: 38118 - RNA, 20 nt, Artificial Sequence
  CIITA targeting sequence
gucagacugucuggguucaa

SEQ ID NO: 38119 - RNA, 20 nt, Artificial Sequence
  CIITA targeting sequence
gacugucuggguucaaaucc

SEQ ID NO: 38120 - RNA, 20 nt, Artificial Sequence
  CIITA targeting sequence
gacugaaguccugcauuuaa

SEQ ID NO: 38121 - RNA, 20 nt, Artificial Sequence
  CIITA targeting sequence
ggguucaaauccugguucca

SEQ ID NO: 38122 - RNA, 20 nt, Artificial Sequence
  CIITA targeting sequence
aauccugguuccacuuggac

SEQ ID NO: 38123 - RNA, 20 nt, Artificial Sequence
  CIITA targeting sequence
ugguuccacuuggacauggg

SEQ ID NO: 38124 - RNA, 20 nt, Artificial Sequence
  CIITA targeting sequence
acuuggacauggguuuccuu

SEQ ID NO: 38125 - RNA, 20 nt, Artificial Sequence
  CIITA targeting sequence
aaguggaaccaggauuugaa

SEQ ID NO: 38126 - RNA, 20 nt, Artificial Sequence
  CIITA targeting sequence
uuacauaaaucacuucaccu

SEQ ID NO: 38127 - RNA, 20 nt, Artificial Sequence
  CIITA targeting sequence
cuucaccucucugagccuca

SEQ ID NO: 38128 - RNA, 20 nt, Artificial Sequence
  CIITA targeting sequence
ccucucugagccucaguuuu

SEQ ID NO: 38129 - RNA, 20 nt, Artificial Sequence
  CIITA targeting sequence
cugagccucaguuuucucau

SEQ ID NO: 38130 - RNA, 20 nt, Artificial Sequence
  CIITA targeting sequence
gagccucaguuuucucauau

SEQ ID NO: 38131 - RNA, 20 nt, Artificial Sequence
  CIITA targeting sequence
gagaggugaagugauuuaug

SEQ ID NO: 38132 - RNA, 20 nt, Artificial Sequence
  CIITA targeting sequence
guuuucucauaugcaaagug

SEQ ID NO: 38133 - RNA, 20 nt, Artificial Sequence
  CIITA targeting sequence
cauaugcaaagugaggauaa

SEQ ID NO: 38134 - RNA, 20 nt, Artificial Sequence
  CIITA targeting sequence
uaugcaaagugaggauaaua

SEQ ID NO: 38135 - RNA, 20 nt, Artificial Sequence
  CIITA targeting sequence
cuuugcauaugagaaaacug

SEQ ID NO: 38136 - RNA, 20 nt, Artificial Sequence
  CIITA targeting sequence
ucacuuugcauaugagaaaa

SEQ ID NO: 38137 - RNA, 20 nt, Artificial Sequence
  CIITA targeting sequence
uuacaugguuacugauauga

SEQ ID NO: 38138 - RNA, 20 nt, Artificial Sequence
  CIITA targeting sequence
guaaccauguaaggaaggua

SEQ ID NO: 38139 - RNA, 20 nt, Artificial Sequence
  CIITA targeting sequence
uaucaguaaccauguaagga

SEQ ID NO: 38140 - RNA, 20 nt, Artificial Sequence
  CIITA targeting sequence
ugugccuggcguauaggagg

SEQ ID NO: 38141 - RNA, 20 nt, Artificial Sequence
  CIITA targeting sequence
uauacgccaggcacaugagc

SEQ ID NO: 38142 - RNA, 20 nt, Artificial Sequence
  CIITA targeting sequence
uggcauugccaaauguggga

SEQ ID NO: 38143 - RNA, 20 nt, Artificial Sequence
  CIITA targeting sequence
cacauuuggcaaugccauga

SEQ ID NO: 38144 - RNA, 20 nt, Artificial Sequence
  CIITA targeting sequence
ccugacucucuggugugaga

SEQ ID NO: 38145 - RNA, 20 nt, Artificial Sequence
  CIITA targeting sequence
ugacucucuggugugagauu

SEQ ID NO: 38146 - RNA, 20 nt, Artificial Sequence
  CIITA targeting sequence
ggagacccgucccacauuug

SEQ ID NO: 38147 - RNA, 20 nt, Artificial Sequence
  CIITA targeting sequence
cuggugugagauugauggaa

SEQ ID NO: 38148 - RNA, 20 nt, Artificial Sequence
  CIITA targeting sequence
ggugugagauugauggaauc

SEQ ID NO: 38149 - RNA, 20 nt, Artificial Sequence
  CIITA targeting sequence
caccagagagucaggagacc

SEQ ID NO: 38150 - RNA, 20 nt, Artificial Sequence
  CIITA targeting sequence
cacaccagagagucaggaga

SEQ ID NO: 38151 - RNA, 20 nt, Artificial Sequence
  CIITA targeting sequence
aucucacaccagagagucag

SEQ ID NO: 38152 - RNA, 20 nt, Artificial Sequence
  CIITA targeting sequence
aucaaucucacaccagagag

SEQ ID NO: 38153 - RNA, 20 nt, Artificial Sequence
  CIITA targeting sequence
acacuuuccaguucccuuuu

SEQ ID NO: 38154 - RNA, 20 nt, Artificial Sequence
  CIITA targeting sequence
aguucccuuuucuaccuccu

SEQ ID NO: 38155 - RNA, 20 nt, Artificial Sequence
  CIITA targeting sequence
cuuuucuaccuccuggguau

SEQ ID NO: 38156 - RNA, 20 nt, Artificial Sequence
  CIITA targeting sequence
accuccuggguaucuucuca

SEQ ID NO: 38157 - RNA, 20 nt, Artificial Sequence
  CIITA targeting sequence
uggguaucuucucauauggu

SEQ ID NO: 38158 - RNA, 20 nt, Artificial Sequence
  CIITA targeting sequence
ucucauaugguuguaaguuc

SEQ ID NO: 38159 - RNA, 20 nt, Artificial Sequence
  CIITA targeting sequence
cauaugguuguaaguuccuu

SEQ ID NO: 38160 - RNA, 20 nt, Artificial Sequence
  CIITA targeting sequence
uaugguuguaaguuccuugg

SEQ ID NO: 38161 - RNA, 20 nt, Artificial Sequence
  CIITA targeting sequence
uuggaggaagggaauguggc

SEQ ID NO: 38162 - RNA, 20 nt, Artificial Sequence
  CIITA targeting sequence
aaggaacuuacaaccauaug

SEQ ID NO: 38163 - RNA, 20 nt, Artificial Sequence
  CIITA targeting sequence
uccaaggaacuuacaaccau

SEQ ID NO: 38164 - RNA, 20 nt, Artificial Sequence
  CIITA targeting sequence
cuuccuccaaggaacuuaca

SEQ ID NO: 38165 - RNA, 20 nt, Artificial Sequence
  CIITA targeting sequence
cuccaccacgcugagcauau

SEQ ID NO: 38166 - RNA, 20 nt, Artificial Sequence
  CIITA targeting sequence
ccaccacgcugagcauauaa

SEQ ID NO: 38167 - RNA, 20 nt, Artificial Sequence
  CIITA targeting sequence
accacgcugagcauauaaga

SEQ ID NO: 38168 - RNA, 20 nt, Artificial Sequence
  CIITA targeting sequence
gcgugguggagagagcaagc

SEQ ID NO: 38169 - RNA, 20 nt, Artificial Sequence
  CIITA targeting sequence
uauaugcucagcguggugga

SEQ ID NO: 38170 - RNA, 20 nt, Artificial Sequence
  CIITA targeting sequence
gcaccucuuauaugcucagc

SEQ ID NO: 38171 - RNA, 20 nt, Artificial Sequence
  CIITA targeting sequence
uucagcaccucuuauaugcu

SEQ ID NO: 38172 - RNA, 20 nt, Artificial Sequence
  CIITA targeting sequence
cuccucucauccccagcccu

SEQ ID NO: 38173 - RNA, 20 nt, Artificial Sequence
  CIITA targeting sequence
ucucauccccagcccucacc

SEQ ID NO: 38174 - RNA, 20 nt, Artificial Sequence
  CIITA targeting sequence
cauccccagcccucaccagc

SEQ ID NO: 38175 - RNA, 20 nt, Artificial Sequence
  CIITA targeting sequence
uccccagcccucaccagcug

SEQ ID NO: 38176 - RNA, 20 nt, Artificial Sequence
  CIITA targeting sequence
ccagcccucaccagcuggga

SEQ ID NO: 38177 - RNA, 20 nt, Artificial Sequence
  CIITA targeting sequence
ccagcugggaguuguuguag

SEQ ID NO: 38178 - RNA, 20 nt, Artificial Sequence
  CIITA targeting sequence
cagcuggugagggcugggga

SEQ ID NO: 38179 - RNA, 20 nt, Artificial Sequence
  CIITA targeting sequence
auuuucugccucuuuccaac

SEQ ID NO: 38180 - RNA, 20 nt, Artificial Sequence
  CIITA targeting sequence
gccucuuuccaacacccugu

SEQ ID NO: 38181 - RNA, 20 nt, Artificial Sequence
  CIITA targeting sequence
uuccaacacccugugaggug

SEQ ID NO: 38182 - RNA, 20 nt, Artificial Sequence
  CIITA targeting sequence
aacacccugugaggugacug

SEQ ID NO: 38183 - RNA, 20 nt, Artificial Sequence
  CIITA targeting sequence
caggguguuggaaagaggca

SEQ ID NO: 38184 - RNA, 20 nt, Artificial Sequence
  CIITA targeting sequence
ccucacaggguguuggaaag

SEQ ID NO: 38185 - RNA, 20 nt, Artificial Sequence
  CIITA targeting sequence
gucaccucacaggguguugg

SEQ ID NO: 38186 - RNA, 20 nt, Artificial Sequence
  CIITA targeting sequence
ucccucccaggcagcucaca

SEQ ID NO: 38187 - RNA, 20 nt, Artificial Sequence
  CIITA targeting sequence
cucccaggcagcucacagug

SEQ ID NO: 38188 - RNA, 20 nt, Artificial Sequence
  CIITA targeting sequence
caggcagcucacagugugcc

SEQ ID NO: 38189 - RNA, 20 nt, Artificial Sequence
  CIITA targeting sequence
cagugugccaccauggaguu

SEQ ID NO: 38190 - RNA, 20 nt, Artificial Sequence
  CIITA targeting sequence
augguggcacacugugagcu

SEQ ID NO: 38191 - RNA, 20 nt, Artificial Sequence
  CIITA targeting sequence
aggggccccaacuccauggu

SEQ ID NO: 38192 - RNA, 20 nt, Artificial Sequence
  CIITA targeting sequence
agguagccaccuucuagggg

SEQ ID NO: 38193 - RNA, 20 nt, Artificial Sequence
  CIITA targeting sequence
uaacagcgaugcugaccccc

SEQ ID NO: 38194 - RNA, 20 nt, Artificial Sequence
  CIITA targeting sequence
cuguuaagaagcuccaggua

SEQ ID NO: 38195 - RNA, 20 nt, Artificial Sequence
  CIITA targeting sequence
gcaucgcuguuaagaagcuc

SEQ ID NO: 38196 - RNA, 20 nt, Artificial Sequence
  CIITA targeting sequence
accacuucuaugaccagaug

SEQ ID NO: 38197 - RNA, 20 nt, Artificial Sequence
  CIITA targeting sequence
augaccagauggaccuggcu

SEQ ID NO: 38198 - RNA, 20 nt, Artificial Sequence
  CIITA targeting sequence
uagaagugguagaggcacag

SEQ ID NO: 38199 - RNA, 20 nt, Artificial Sequence
  CIITA targeting sequence
ggucauagaagugguagagg

SEQ ID NO: 38200 - RNA, 20 nt, Artificial Sequence
  CIITA targeting sequence
aucuggucauagaaguggua

SEQ ID NO: 38201 - RNA, 20 nt, Artificial Sequence
  CIITA targeting sequence
agccagguccaucuggucau

SEQ ID NO: 38202 - RNA, 20 nt, Artificial Sequence
  CIITA targeting sequence
ccagccagguccaucugguc

SEQ ID NO: 38203 - RNA, 20 nt, Artificial Sequence
  CIITA targeting sequence
ucuccagccagguccaucug

SEQ ID NO: 38204 - RNA, 20 nt, Artificial Sequence
  CIITA targeting sequence
ucuucuccagccagguccau

SEQ ID NO: 38205 - RNA, 20 nt, Artificial Sequence
  CIITA targeting sequence
cuucuucuccagccaggucc

SEQ ID NO: 38206 - RNA, 20 nt, Artificial Sequence
  CIITA targeting sequence
aucucuucuucuccagccag

SEQ ID NO: 38207 - RNA, 20 nt, Artificial Sequence
  CIITA targeting sequence
acucaggugggcccuccucc

SEQ ID NO: 38208 - RNA, 20 nt, Artificial Sequence
  CIITA targeting sequence
ggugggcccuccucccucug

SEQ ID NO: 38209 - RNA, 20 nt, Artificial Sequence
  CIITA targeting sequence
ucccucuggucucuuccggu

SEQ ID NO: 38210 - RNA, 20 nt, Artificial Sequence
  CIITA targeting sequence
cucuggucucuuccgguauc

SEQ ID NO: 38211 - RNA, 20 nt, Artificial Sequence
  CIITA targeting sequence
ggucucuuccgguauccccc

SEQ ID NO: 38212 - RNA, 20 nt, Artificial Sequence
  CIITA targeting sequence
cuuccgguaucccccacccc

SEQ ID NO: 38213 - RNA, 20 nt, Artificial Sequence
  CIITA targeting sequence
uccgguaucccccaccccuc

SEQ ID NO: 38214 - RNA, 20 nt, Artificial Sequence
  CIITA targeting sequence
gguaucccccaccccucagc

SEQ ID NO: 38215 - RNA, 20 nt, Artificial Sequence
  CIITA targeting sequence
cccaccccucagcuugcugu

SEQ ID NO: 38216 - RNA, 20 nt, Artificial Sequence
  CIITA targeting sequence
gcuugcuguagagacggcaa

SEQ ID NO: 38217 - RNA, 20 nt, Artificial Sequence
  CIITA targeting sequence
acagcaagcugagggguggg

SEQ ID NO: 38218 - RNA, 20 nt, Artificial Sequence
  CIITA targeting sequence
cuacagcaagcugaggggug

SEQ ID NO: 38219 - RNA, 20 nt, Artificial Sequence
  CIITA targeting sequence
ggggaaauucuggucccugc

SEQ ID NO: 38220 - RNA, 20 nt, Artificial Sequence
  CIITA targeting sequence
ccugauugccgucucuacag

SEQ ID NO: 38221 - RNA, 20 nt, Artificial Sequence
  CIITA targeting sequence
ggucccugcccucccgucag

SEQ ID NO: 38222 - RNA, 20 nt, Artificial Sequence
  CIITA targeting sequence
cugcccucccgucagcacca

SEQ ID NO: 38223 - RNA, 20 nt, Artificial Sequence
  CIITA targeting sequence
cgucagcaccacggacagcu

SEQ ID NO: 38224 - RNA, 20 nt, Artificial Sequence
  CIITA targeting sequence
gcaccacggacagcucccac

SEQ ID NO: 38225 - RNA, 20 nt, Artificial Sequence
  CIITA targeting sequence
guggugcugacgggagggca

SEQ ID NO: 38226 - RNA, 20 nt, Artificial Sequence
  CIITA targeting sequence
cacgucugugggacgcucuc

SEQ ID NO: 38227 - RNA, 20 nt, Artificial Sequence
  CIITA targeting sequence
gugggacgcucucugcagau

SEQ ID NO: 38228 - RNA, 20 nt, Artificial Sequence
  CIITA targeting sequence
cacagacgugggagcugucc

SEQ ID NO: 38229 - RNA, 20 nt, Artificial Sequence
  CIITA targeting sequence
cugcagauggggaugaucuc

SEQ ID NO: 38230 - RNA, 20 nt, Artificial Sequence
  CIITA targeting sequence
gcagauggggaugaucuccc

SEQ ID NO: 38231 - RNA, 20 nt, Artificial Sequence
  CIITA targeting sequence
gcagagagcgucccacagac

SEQ ID NO: 38232 - RNA, 20 nt, Artificial Sequence
  CIITA targeting sequence
ccaucugcagagagcguccc

SEQ ID NO: 38233 - RNA, 20 nt, Artificial Sequence
  CIITA targeting sequence
uccccaucugcagagagcgu

SEQ ID NO: 38234 - RNA, 20 nt, Artificial Sequence
  CIITA targeting sequence
cccagcccugccccgccucu

SEQ ID NO: 38235 - RNA, 20 nt, Artificial Sequence
  CIITA targeting sequence
cagcccugccccgccucucc

SEQ ID NO: 38236 - RNA, 20 nt, Artificial Sequence
  CIITA targeting sequence
cccucguuccccaccagccc

SEQ ID NO: 38237 - RNA, 20 nt, Artificial Sequence
  CIITA targeting sequence
cucguuccccaccagcccuc

SEQ ID NO: 38238 - RNA, 20 nt, Artificial Sequence
  CIITA targeting sequence
uuccccaccagcccucuuuc

SEQ ID NO: 38239 - RNA, 20 nt, Artificial Sequence
  CIITA targeting sequence
ccaccagcccucuuuccaga

SEQ ID NO: 38240 - RNA, 20 nt, Artificial Sequence
  CIITA targeting sequence
uuccagaaauuuccuucuuc

SEQ ID NO: 38241 - RNA, 20 nt, Artificial Sequence
  CIITA targeting sequence
agaaauuuccuucuucaucc

SEQ ID NO: 38242 - RNA, 20 nt, Artificial Sequence
  CIITA targeting sequence
ggaaagagggcuggugggga

SEQ ID NO: 38243 - RNA, 20 nt, Artificial Sequence
  CIITA targeting sequence
uucuucauccaagggacuuu

SEQ ID NO: 38244 - RNA, 20 nt, Artificial Sequence
  CIITA targeting sequence
ucauccaagggacuuuuccu

SEQ ID NO: 38245 - RNA, 20 nt, Artificial Sequence
  CIITA targeting sequence
uccaagggacuuuuccuccc

SEQ ID NO: 38246 - RNA, 20 nt, Artificial Sequence
  CIITA targeting sequence
aagggacuuuuccucccaga

SEQ ID NO: 38247 - RNA, 20 nt, Artificial Sequence
  CIITA targeting sequence
cuuggaugaagaaggaaauu

SEQ ID NO: 38248 - RNA, 20 nt, Artificial Sequence
  CIITA targeting sequence
ucccagaacccgacacagac

SEQ ID NO: 38249 - RNA, 20 nt, Artificial Sequence
  CIITA targeting sequence
cagaacccgacacagacacc

SEQ ID NO: 38250 - RNA, 20 nt, Artificial Sequence
  CIITA targeting sequence
gggaggaaaagucccuugga

SEQ ID NO: 38251 - RNA, 20 nt, Artificial Sequence
  CIITA targeting sequence
gguucugggaggaaaagucc

SEQ ID NO: 38252 - RNA, 20 nt, Artificial Sequence
  CIITA targeting sequence
gugucggguucugggaggaa

SEQ ID NO: 38253 - RNA, 20 nt, Artificial Sequence
  CIITA targeting sequence
acugcgaccaguucagcagg

SEQ ID NO: 38254 - RNA, 20 nt, Artificial Sequence
  CIITA targeting sequence
caguugauggugucuguguc

SEQ ID NO: 38255 - RNA, 20 nt, Artificial Sequence
  CIITA targeting sequence
gcaggcuguugugugacaug

SEQ ID NO: 38256 - RNA, 20 nt, Artificial Sequence
  CIITA targeting sequence
cacaacagccugcugaacug

SEQ ID NO: 38257 - RNA, 20 nt, Artificial Sequence
  CIITA targeting sequence
augucacacaacagccugcu

SEQ ID NO: 38258 - RNA, 20 nt, Artificial Sequence
  CIITA targeting sequence
ccuuccaugucacacaacag

SEQ ID NO: 38259 - RNA, 20 nt, Artificial Sequence
  CIITA targeting sequence
ucaccuuccaugucacacaa

SEQ ID NO: 38260 - RNA, 20 nt, Artificial Sequence
  CIITA targeting sequence
ucaucaccuuccaugucaca

SEQ ID NO: 38261 - RNA, 20 nt, Artificial Sequence
  CIITA targeting sequence
cuucaucaccuuccauguca

SEQ ID NO: 38262 - RNA, 20 nt, Artificial Sequence
  CIITA targeting sequence
cuggucucuucaucaccuuc

SEQ ID NO: 38263 - RNA, 20 nt, Artificial Sequence
  CIITA targeting sequence
gugaggaagcaccugagccc

SEQ ID NO: 38264 - RNA, 20 nt, Artificial Sequence
  CIITA targeting sequence
ccgauauuggcauaagccuc

SEQ ID NO: 38265 - RNA, 20 nt, Artificial Sequence
  CIITA targeting sequence
ucaccgauauuggcauaagc

SEQ ID NO: 38266 - RNA, 20 nt, Artificial Sequence
  CIITA targeting sequence
ggugcuuccucaccgauauu

SEQ ID NO: 38267 - RNA, 20 nt, Artificial Sequence
  CIITA targeting sequence
gggcucaggugcuuccucac

SEQ ID NO: 38268 - RNA, 20 nt, Artificial Sequence
  CIITA targeting sequence
uuuucugggcucaggugcuu

SEQ ID NO: 38269 - RNA, 20 nt, Artificial Sequence
  CIITA targeting sequence
agggcaagaguucuuugcug

SEQ ID NO: 38270 - RNA, 20 nt, Artificial Sequence
  CIITA targeting sequence
ugcccuugauuguccuuuuc

SEQ ID NO: 38271 - RNA, 20 nt, Artificial Sequence
  CIITA targeting sequence
uugcugccacuugucaauau

SEQ ID NO: 38272 - RNA, 20 nt, Artificial Sequence
  CIITA targeting sequence
auaucacccauucaucauga

SEQ ID NO: 38273 - RNA, 20 nt, Artificial Sequence
  CIITA targeting sequence
cccauucaucaugagccacg

SEQ ID NO: 38274 - RNA, 20 nt, Artificial Sequence
  CIITA targeting sequence
ucaugagccacgucaguccc

SEQ ID NO: 38275 - RNA, 20 nt, Artificial Sequence
  CIITA targeting sequence
ugagccacgucaguccccuc

SEQ ID NO: 38276 - RNA, 20 nt, Artificial Sequence
  CIITA targeting sequence
ugaugaaugggugauauuga

SEQ ID NO: 38277 - RNA, 20 nt, Artificial Sequence
  CIITA targeting sequence
guccccucccacagaaauca

SEQ ID NO: 38278 - RNA, 20 nt, Artificial Sequence
  CIITA targeting sequence
ccucccacagaaaucauugc

SEQ ID NO: 38279 - RNA, 20 nt, Artificial Sequence
  CIITA targeting sequence
cacagaaaucauugcaaggg

SEQ ID NO: 38280 - RNA, 20 nt, Artificial Sequence
  CIITA targeting sequence
gugggaggggacugacgugg

SEQ ID NO: 38281 - RNA, 20 nt, Artificial Sequence
  CIITA targeting sequence
uugcaagggggaugcggagc

SEQ ID NO: 38282 - RNA, 20 nt, Artificial Sequence
  CIITA targeting sequence
cccuugcaaugauuucugug

SEQ ID NO: 38283 - RNA, 20 nt, Artificial Sequence
  CIITA targeting sequence
gcaucccccuugcaaugauu

SEQ ID NO: 38284 - RNA, 20 nt, Artificial Sequence
  CIITA targeting sequence
agccauugcuccgcaucccc

SEQ ID NO: 38285 - RNA, 20 nt, Artificial Sequence
  CIITA targeting sequence
uccagccauugcuccgcauc

SEQ ID NO: 38286 - RNA, 20 nt, Artificial Sequence
  CIITA targeting sequence
guuccuccagccauugcucc

SEQ ID NO: 38287 - RNA, 20 nt, Artificial Sequence
  CIITA targeting sequence
ccguuccuccagccauugcu

SEQ ID NO: 38288 - RNA, 20 nt, Artificial Sequence
  CIITA targeting sequence
agggaagagaggggagaugg

SEQ ID NO: 38289 - RNA, 20 nt, Artificial Sequence
  CIITA targeting sequence
cuggagucuccguuccucca

SEQ ID NO: 38290 - RNA, 20 nt, Artificial Sequence
  CIITA targeting sequence
ucccuggagucuccguuccu

SEQ ID NO: 38291 - RNA, 20 nt, Artificial Sequence
  CIITA targeting sequence
cuucccuggagucuccguuc

SEQ ID NO: 38292 - RNA, 20 nt, Artificial Sequence
  CIITA targeting sequence
ccucucuucccuggagucuc

SEQ ID NO: 38293 - RNA, 20 nt, Artificial Sequence
  CIITA targeting sequence
ccccucucuucccuggaguc

SEQ ID NO: 38294 - RNA, 20 nt, Artificial Sequence
  CIITA targeting sequence
aucuccccucucuucccugg

SEQ ID NO: 38295 - RNA, 20 nt, Artificial Sequence
  CIITA targeting sequence
cccacuggccuccaucuccc

SEQ ID NO: 38296 - RNA, 20 nt, Artificial Sequence
  CIITA targeting sequence
cuaaugaccaccaagaaaac

SEQ ID NO: 38297 - RNA, 20 nt, Artificial Sequence
  CIITA targeting sequence
uuagugaaggggccuauuuc

SEQ ID NO: 38298 - RNA, 20 nt, Artificial Sequence
  CIITA targeting sequence
ugguggucauuagugaaggg

SEQ ID NO: 38299 - RNA, 20 nt, Artificial Sequence
  CIITA targeting sequence
cauguuuacauccuccaccu

SEQ ID NO: 38300 - RNA, 20 nt, Artificial Sequence
  CIITA targeting sequence
uguuuacauccuccaccucc

SEQ ID NO: 38301 - RNA, 20 nt, Artificial Sequence
  CIITA targeting sequence
uccaccuccauuucuauacg

SEQ ID NO: 38302 - RNA, 20 nt, Artificial Sequence
  CIITA targeting sequence
accuccauuucuauacgcau

SEQ ID NO: 38303 - RNA, 20 nt, Artificial Sequence
  CIITA targeting sequence
auuucuauacgcauuucugc

SEQ ID NO: 38304 - RNA, 20 nt, Artificial Sequence
  CIITA targeting sequence
auacgcauuucugcuucuug

SEQ ID NO: 38305 - RNA, 20 nt, Artificial Sequence
  CIITA targeting sequence
gcuucuugcucuucugucca

SEQ ID NO: 38306 - RNA, 20 nt, Artificial Sequence
  CIITA targeting sequence
ugcucuucuguccauccuuu

SEQ ID NO: 38307 - RNA, 20 nt, Artificial Sequence
  CIITA targeting sequence
ucuguccauccuuucuacaa

SEQ ID NO: 38308 - RNA, 20 nt, Artificial Sequence
  CIITA targeting sequence
guccauccuuucuacaaagc

SEQ ID NO: 38309 - RNA, 20 nt, Artificial Sequence
  CIITA targeting sequence
auccuuucuacaaagcccau

SEQ ID NO: 38310 - RNA, 20 nt, Artificial Sequence
  CIITA targeting sequence
uuucuacaaagcccauacca

SEQ ID NO: 38311 - RNA, 20 nt, Artificial Sequence
  CIITA targeting sequence
acaaagcccauaccauacac

SEQ ID NO: 38312 - RNA, 20 nt, Artificial Sequence
  CIITA targeting sequence
cuuuuccucccagcuccuua

SEQ ID NO: 38313 - RNA, 20 nt, Artificial Sequence
  CIITA targeting sequence
ucccagcuccuuagccaagc

SEQ ID NO: 38314 - RNA, 20 nt, Artificial Sequence
  CIITA targeting sequence
cagcuccuuagccaagcuac

SEQ ID NO: 38315 - RNA, 20 nt, Artificial Sequence
  CIITA targeting sequence
uuagccaagcuacucuagua

SEQ ID NO: 38316 - RNA, 20 nt, Artificial Sequence
  CIITA targeting sequence
aguauuuguaauaacuagca

SEQ ID NO: 38317 - RNA, 20 nt, Artificial Sequence
  CIITA targeting sequence
aguaaaugcuaguuauuaca

SEQ ID NO: 38318 - RNA, 20 nt, Artificial Sequence
  CIITA targeting sequence
uaguaugcucauugcugucc

SEQ ID NO: 38319 - RNA, 20 nt, Artificial Sequence
  CIITA targeting sequence
uugcuguccauacauuauca

SEQ ID NO: 38320 - RNA, 20 nt, Artificial Sequence
  CIITA targeting sequence
auacauuaucaucuggaauc

SEQ ID NO: 38321 - RNA, 20 nt, Artificial Sequence
  CIITA targeting sequence
ucuggaauccuuacaacaac

SEQ ID NO: 38322 - RNA, 20 nt, Artificial Sequence
  CIITA targeting sequence
ggaauccuuacaacaacaaa

SEQ ID NO: 38323 - RNA, 20 nt, Artificial Sequence
  CIITA targeting sequence
agaugauaauguauggacag

SEQ ID NO: 38324 - RNA, 20 nt, Artificial Sequence
  CIITA targeting sequence
uuacaacaacaaaggaaaua

SEQ ID NO: 38325 - RNA, 20 nt, Artificial Sequence
  CIITA targeting sequence
uuuguuguuguaaggauucc

SEQ ID NO: 38326 - RNA, 20 nt, Artificial Sequence
  CIITA targeting sequence
gucuuuuacaaaugaggaaa

SEQ ID NO: 38327 - RNA, 20 nt, Artificial Sequence
  CIITA targeting sequence
uuuacaaaugaggaaauuga

SEQ ID NO: 38328 - RNA, 20 nt, Artificial Sequence
  CIITA targeting sequence
uuuguaaaagacagaaacua

SEQ ID NO: 38329 - RNA, 20 nt, Artificial Sequence
  CIITA targeting sequence
ucauuuguaaaagacagaaa

SEQ ID NO: 38330 - RNA, 20 nt, Artificial Sequence
  CIITA targeting sequence
auuuccucauuuguaaaaga

SEQ ID NO: 38331 - RNA, 20 nt, Artificial Sequence
  CIITA targeting sequence
aaaccucaauuuccucauuu

SEQ ID NO: 38332 - RNA, 20 nt, Artificial Sequence
  CIITA targeting sequence
cuaaaccucaauuuccucau

SEQ ID NO: 38333 - RNA, 20 nt, Artificial Sequence
  CIITA targeting sequence
ccucucuaaaccucaauuuc

SEQ ID NO: 38334 - RNA, 20 nt, Artificial Sequence
  CIITA targeting sequence
uuucaccucucuaaaccuca

SEQ ID NO: 38335 - RNA, 20 nt, Artificial Sequence
  CIITA targeting sequence
aaugcaaacuuggguagguc

SEQ ID NO: 38336 - RNA, 20 nt, Artificial Sequence
  CIITA targeting sequence
cuaaugcaaacuuggguagg

SEQ ID NO: 38337 - RNA, 20 nt, Artificial Sequence
  CIITA targeting sequence
guacauuacuaucucuaaug

SEQ ID NO: 38338 - RNA, 20 nt, Artificial Sequence
  CIITA targeting sequence
gaaauucuaaccuaggucuu

SEQ ID NO: 38339 - RNA, 20 nt, Artificial Sequence
  CIITA targeting sequence
gaucuguacauuacuaucuc

SEQ ID NO: 38340 - RNA, 20 nt, Artificial Sequence
  CIITA targeting sequence
aaccuaggucuuucucguuu

SEQ ID NO: 38341 - RNA, 20 nt, Artificial Sequence
  CIITA targeting sequence
uucucguuucaaagucucca

SEQ ID NO: 38342 - RNA, 20 nt, Artificial Sequence
  CIITA targeting sequence
cguuucaaagucuccauuuu

SEQ ID NO: 38343 - RNA, 20 nt, Artificial Sequence
  CIITA targeting sequence
uuucaaagucuccauuuuua

SEQ ID NO: 38344 - RNA, 20 nt, Artificial Sequence
  CIITA targeting sequence
aagucuccauuuuuaaccac

SEQ ID NO: 38345 - RNA, 20 nt, Artificial Sequence
  CIITA targeting sequence
ccauuuuuaaccacaaaaaa

SEQ ID NO: 38346 - RNA, 20 nt, Artificial Sequence
  CIITA targeting sequence
auuuuuaaccacaaaaaaag

SEQ ID NO: 38347 - RNA, 20 nt, Artificial Sequence
  CIITA targeting sequence
uuuuuugugguuaaaaaugg

SEQ ID NO: 38348 - RNA, 20 nt, Artificial Sequence
  CIITA targeting sequence
gggguuggaagauuugcuaa

SEQ ID NO: 38349 - RNA, 20 nt, Artificial Sequence
  CIITA targeting sequence
aaccccagacacuuucuuuu

SEQ ID NO: 38350 - RNA, 20 nt, Artificial Sequence
  CIITA targeting sequence
uccaaccccagacacuuucu

SEQ ID NO: 38351 - RNA, 20 nt, Artificial Sequence
  CIITA targeting sequence
gcuuaagccuuagcaaaucu

SEQ ID NO: 38352 - RNA, 20 nt, Artificial Sequence
  CIITA targeting sequence
cugcuuaagccuuagcaaau

SEQ ID NO: 38353 - RNA, 20 nt, Artificial Sequence
  CIITA targeting sequence
uaaggcuacaaauuagcuuc

SEQ ID NO: 38354 - RNA, 20 nt, Artificial Sequence
  CIITA targeting sequence
ucuuaaggcuacaaauuagc

SEQ ID NO: 38355 - RNA, 20 nt, Artificial Sequence
  CIITA targeting sequence
gacaagggcaggacucuugg

SEQ ID NO: 38356 - RNA, 20 nt, Artificial Sequence
  CIITA targeting sequence
gaaagcuguagcucuucuua

SEQ ID NO: 38357 - RNA, 20 nt, Artificial Sequence
  CIITA targeting sequence
ugcccuugucugaaagcugu

SEQ ID NO: 38358 - RNA, 20 nt, Artificial Sequence
  CIITA targeting sequence
uggggagagguggugguggu

SEQ ID NO: 38359 - RNA, 20 nt, Artificial Sequence
  CIITA targeting sequence
ccaagaguccugcccuuguc

SEQ ID NO: 38360 - RNA, 20 nt, Artificial Sequence
  CIITA targeting sequence
ccccaagaguccugcccuug

SEQ ID NO: 38361 - RNA, 20 nt, Artificial Sequence
  CIITA targeting sequence
cccaaaaaacaaaccacuag

SEQ ID NO: 38362 - RNA, 20 nt, Artificial Sequence
  CIITA targeting sequence
cccccaaaaaacaaaccacu

SEQ ID NO: 38363 - RNA, 20 nt, Artificial Sequence
  CIITA targeting sequence
cucccccaaaaaacaaacca

SEQ ID NO: 38364 - RNA, 20 nt, Artificial Sequence
  CIITA targeting sequence
cacgucucucccccaaaaaa

SEQ ID NO: 38365 - RNA, 20 nt, Artificial Sequence
  CIITA targeting sequence
aucccacgucucucccccaa

SEQ ID NO: 38366 - RNA, 20 nt, Artificial Sequence
  CIITA targeting sequence
cuaucccacgucucuccccc

SEQ ID NO: 38367 - RNA, 20 nt, Artificial Sequence
  CIITA targeting sequence
cuucucaccagcaucaccac

SEQ ID NO: 38368 - RNA, 20 nt, Artificial Sequence
  CIITA targeting sequence
ucucaccagcaucaccacca

SEQ ID NO: 38369 - RNA, 20 nt, Artificial Sequence
  CIITA targeting sequence
caccagcaucaccaccaccu

SEQ ID NO: 38370 - RNA, 20 nt, Artificial Sequence
  CIITA targeting sequence
ccagcaucaccaccaccuca

SEQ ID NO: 38371 - RNA, 20 nt, Artificial Sequence
  CIITA targeting sequence
ccaccaccucauacagagcc

SEQ ID NO: 38372 - RNA, 20 nt, Artificial Sequence
  CIITA targeting sequence
uacagagccuauguugaaau

SEQ ID NO: 38373 - RNA, 20 nt, Artificial Sequence
  CIITA targeting sequence
guaugaggugguggugaugc

SEQ ID NO: 38374 - RNA, 20 nt, Artificial Sequence
  CIITA targeting sequence
acauaggcucuguaugaggu

SEQ ID NO: 38375 - RNA, 20 nt, Artificial Sequence
  CIITA targeting sequence
auuucaacauaggcucugua

SEQ ID NO: 38376 - RNA, 20 nt, Artificial Sequence
  CIITA targeting sequence
ggaggaugcagccccuacca

SEQ ID NO: 38377 - RNA, 20 nt, Artificial Sequence
  CIITA targeting sequence
agaaaaaggccacuuuuuuc

SEQ ID NO: 38378 - RNA, 20 nt, Artificial Sequence
  CIITA targeting sequence
uccagaaaaaggccacuuuu

SEQ ID NO: 38379 - RNA, 20 nt, Artificial Sequence
  CIITA targeting sequence
ugguaggggcugcauccucc

SEQ ID NO: 38380 - RNA, 20 nt, Artificial Sequence
  CIITA targeting sequence
ggcuugcacuuugcuagcca

SEQ ID NO: 38381 - RNA, 20 nt, Artificial Sequence
  CIITA targeting sequence
ugcccccauuuuccuuguug

SEQ ID NO: 38382 - RNA, 20 nt, Artificial Sequence
  CIITA targeting sequence
uuguuggcuugggcaccugu

SEQ ID NO: 38383 - RNA, 20 nt, Artificial Sequence
  CIITA targeting sequence
cugcacacaggugcccaagc

SEQ ID NO: 38384 - RNA, 20 nt, Artificial Sequence
  CIITA targeting sequence
ucuuaguggucuucuuccug

SEQ ID NO: 38385 - RNA, 20 nt, Artificial Sequence
  CIITA targeting sequence
uaguggucuucuuccugcca

SEQ ID NO: 38386 - RNA, 20 nt, Artificial Sequence
  CIITA targeting sequence
ucuuccugccaacccaggaa

SEQ ID NO: 38387 - RNA, 20 nt, Artificial Sequence
  CIITA targeting sequence
uccugccaacccaggaacag

SEQ ID NO: 38388 - RNA, 20 nt, Artificial Sequence
  CIITA targeting sequence
ugccaacccaggaacagcag

SEQ ID NO: 38389 - RNA, 20 nt, Artificial Sequence
  CIITA targeting sequence
uggguuggcaggaagaagac

SEQ ID NO: 38390 - RNA, 20 nt, Artificial Sequence
  CIITA targeting sequence
gcaguucugugcuugaucca

SEQ ID NO: 38391 - RNA, 20 nt, Artificial Sequence
  CIITA targeting sequence
gugcuugauccaaauguggc

SEQ ID NO: 38392 - RNA, 20 nt, Artificial Sequence
  CIITA targeting sequence
agcacagaacugcugaaugc

SEQ ID NO: 38393 - RNA, 20 nt, Artificial Sequence
  CIITA targeting sequence
aaauguggccaauuuuuccc

SEQ ID NO: 38394 - RNA, 20 nt, Artificial Sequence
  CIITA targeting sequence
ccagagcacaguguauugaa

SEQ ID NO: 38395 - RNA, 20 nt, Artificial Sequence
  CIITA targeting sequence
ggggaaaaauuggccacauu

SEQ ID NO: 38396 - RNA, 20 nt, Artificial Sequence
  CIITA targeting sequence
auacacugugcucuggggaa

SEQ ID NO: 38397 - RNA, 20 nt, Artificial Sequence
  CIITA targeting sequence
uaccaaggaagaaaauggag

SEQ ID NO: 38398 - RNA, 20 nt, Artificial Sequence
  CIITA targeting sequence
uugguaugauuuucaauaca

SEQ ID NO: 38399 - RNA, 20 nt, Artificial Sequence
  CIITA targeting sequence
uccuugguaugauuuucaau

SEQ ID NO: 38400 - RNA, 20 nt, Artificial Sequence
  CIITA targeting sequence
auuuucuuccuugguaugau

SEQ ID NO: 38401 - RNA, 20 nt, Artificial Sequence
  CIITA targeting sequence
ccuccauuuucuuccuuggu

SEQ ID NO: 38402 - RNA, 20 nt, Artificial Sequence
  CIITA targeting sequence
uguuucagaaauuacagaac

SEQ ID NO: 38403 - RNA, 20 nt, Artificial Sequence
  CIITA targeting sequence
gaaauuacagaacugagagc

SEQ ID NO: 38404 - RNA, 20 nt, Artificial Sequence
  CIITA targeting sequence
gaaacaugaacaauuacuag

SEQ ID NO: 38405 - RNA, 20 nt, Artificial Sequence
  CIITA targeting sequence
guaauuucugaaacaugaac

SEQ ID NO: 38406 - RNA, 20 nt, Artificial Sequence
  CIITA targeting sequence
guucuguaauuucugaaaca

SEQ ID NO: 38407 - RNA, 20 nt, Artificial Sequence
  CIITA targeting sequence
caguucuguaauuucugaaa

SEQ ID NO: 38408 - RNA, 20 nt, Artificial Sequence
  CIITA targeting sequence
agcucucaguucuguaauuu

SEQ ID NO: 38409 - RNA, 20 nt, Artificial Sequence
  CIITA targeting sequence
uucccuuccuggggauuuac

SEQ ID NO: 38410 - RNA, 20 nt, Artificial Sequence
  CIITA targeting sequence
cuuccuggggauuuacaugg

SEQ ID NO: 38411 - RNA, 20 nt, Artificial Sequence
  CIITA targeting sequence
uggggauuuacaugggggaa

SEQ ID NO: 38412 - RNA, 20 nt, Artificial Sequence
  CIITA targeting sequence
ccaggaagggaaggaagcag

SEQ ID NO: 38413 - RNA, 20 nt, Artificial Sequence
  CIITA targeting sequence
cccauguaaauccccaggaa

SEQ ID NO: 38414 - RNA, 20 nt, Artificial Sequence
  CIITA targeting sequence
gcuucccccauguaaauccc

SEQ ID NO: 38415 - RNA, 20 nt, Artificial Sequence
  CIITA targeting sequence
cuucugcuucccccauguaa

SEQ ID NO: 38416 - RNA, 20 nt, Artificial Sequence
  CIITA targeting sequence
gccccaaucacuucugcuuc

SEQ ID NO: 38417 - RNA, 20 nt, Artificial Sequence
  CIITA targeting sequence
ucagccccaaucacuucugc

SEQ ID NO: 38418 - RNA, 20 nt, Artificial Sequence
  CIITA targeting sequence
cauuuccucacaacuggagg

SEQ ID NO: 38419 - RNA, 20 nt, Artificial Sequence
  CIITA targeting sequence
ucacaacuggaggcagucau

SEQ ID NO: 38420 - RNA, 20 nt, Artificial Sequence
  CIITA targeting sequence
caacuggaggcagucauuaa

SEQ ID NO: 38421 - RNA, 20 nt, Artificial Sequence
  CIITA targeting sequence
aguugugaggaaaugugaau

SEQ ID NO: 38422 - RNA, 20 nt, Artificial Sequence
  CIITA targeting sequence
uuaaggauuugggcauguca

SEQ ID NO: 38423 - RNA, 20 nt, Artificial Sequence
  CIITA targeting sequence
uuaaugacugccuccaguug

SEQ ID NO: 38424 - RNA, 20 nt, Artificial Sequence
  CIITA targeting sequence
uaggauuuggguguuuuucu

SEQ ID NO: 38425 - RNA, 20 nt, Artificial Sequence
  CIITA targeting sequence
uaugacaugcccaaauccuu

SEQ ID NO: 38426 - RNA, 20 nt, Artificial Sequence
  CIITA targeting sequence
ccccccuuaguggcaucucc

SEQ ID NO: 38427 - RNA, 20 nt, Artificial Sequence
  CIITA targeting sequence
ccccuuaguggcaucuccac

SEQ ID NO: 38428 - RNA, 20 nt, Artificial Sequence
  CIITA targeting sequence
ccacaggcagcgaaagcugu

SEQ ID NO: 38429 - RNA, 20 nt, Artificial Sequence
  CIITA targeting sequence
acaggcagcgaaagcugucu

SEQ ID NO: 38430 - RNA, 20 nt, Artificial Sequence
  CIITA targeting sequence
cugccuguggagaugccacu

SEQ ID NO: 38431 - RNA, 20 nt, Artificial Sequence
  CIITA targeting sequence
aagcaaauaggugaggcagu

SEQ ID NO: 38432 - RNA, 20 nt, Artificial Sequence
  CIITA targeting sequence
ccuauuugcuuagacagcuu

SEQ ID NO: 38433 - RNA, 20 nt, Artificial Sequence
  CIITA targeting sequence
auuuuuuguugcuuaaaaca

SEQ ID NO: 38434 - RNA, 20 nt, Artificial Sequence
  CIITA targeting sequence
gguauguuguuuuaagcaac

SEQ ID NO: 38435 - RNA, 20 nt, Artificial Sequence
  CIITA targeting sequence
gugucagguauguuguuuua

SEQ ID NO: 38436 - RNA, 20 nt, Artificial Sequence
  CIITA targeting sequence
uuauaaauuacucaguguca

SEQ ID NO: 38437 - RNA, 20 nt, Artificial Sequence
  CIITA targeting sequence
uacaguuauggaggcugaga

SEQ ID NO: 38438 - RNA, 20 nt, Artificial Sequence
  CIITA targeting sequence
auaacuguaagaaauauuuu

SEQ ID NO: 38439 - RNA, 20 nt, Artificial Sequence
  CIITA targeting sequence
gccuccauaacuguaagaaa

SEQ ID NO: 38440 - RNA, 20 nt, Artificial Sequence
  CIITA targeting sequence
cagccuccauaacuguaaga

SEQ ID NO: 38441 - RNA, 20 nt, Artificial Sequence
  CIITA targeting sequence
aagguuaggggcugcaucug

SEQ ID NO: 38442 - RNA, 20 nt, Artificial Sequence
  CIITA targeting sequence
ggugagggccuucuuacugg

SEQ ID NO: 38443 - RNA, 20 nt, Artificial Sequence
  CIITA targeting sequence
ccagaugcagccccuaaccu

SEQ ID NO: 38444 - RNA, 20 nt, Artificial Sequence
  CIITA targeting sequence
uacuggugaggacucucugc

SEQ ID NO: 38445 - RNA, 20 nt, Artificial Sequence
  CIITA targeting sequence
ccaguaagaaggcccucacc

SEQ ID NO: 38446 - RNA, 20 nt, Artificial Sequence
  CIITA targeting sequence
ucaccaguaagaaggcccuc

SEQ ID NO: 38447 - RNA, 20 nt, Artificial Sequence
  CIITA targeting sequence
cugcagagucccaaggcagu

SEQ ID NO: 38448 - RNA, 20 nt, Artificial Sequence
  CIITA targeting sequence
gcagagucccaaggcagugu

SEQ ID NO: 38449 - RNA, 20 nt, Artificial Sequence
  CIITA targeting sequence
gcagagaguccucaccagua

SEQ ID NO: 38450 - RNA, 20 nt, Artificial Sequence
  CIITA targeting sequence
caaggcaguguggggcauca

SEQ ID NO: 38451 - RNA, 20 nt, Artificial Sequence
  CIITA targeting sequence
cgaggcaagagguuucggug

SEQ ID NO: 38452 - RNA, 20 nt, Artificial Sequence
  CIITA targeting sequence
ugaugccccacacugccuug

SEQ ID NO: 38453 - RNA, 20 nt, Artificial Sequence
  CIITA targeting sequence
ugccucgugaugccccacac

SEQ ID NO: 38454 - RNA, 20 nt, Artificial Sequence
  CIITA targeting sequence
gugugauagucucucuuccu

SEQ ID NO: 38455 - RNA, 20 nt, Artificial Sequence
  CIITA targeting sequence
caccgaaaccucuugccucg

SEQ ID NO: 38456 - RNA, 20 nt, Artificial Sequence
  CIITA targeting sequence
cucuuccucuucucauaaaa

SEQ ID NO: 38457 - RNA, 20 nt, Artificial Sequence
  CIITA targeting sequence
cuuccucuucucauaaaacc

SEQ ID NO: 38458 - RNA, 20 nt, Artificial Sequence
  CIITA targeting sequence
uccucuucucauaaaaccac

SEQ ID NO: 38459 - RNA, 20 nt, Artificial Sequence
  CIITA targeting sequence
ucuucucauaaaaccacuag

SEQ ID NO: 38460 - RNA, 20 nt, Artificial Sequence
  CIITA targeting sequence
ucucauaaaaccacuagucu

SEQ ID NO: 38461 - RNA, 20 nt, Artificial Sequence
  CIITA targeting sequence
cauaaaaccacuagucuuac

SEQ ID NO: 38462 - RNA, 20 nt, Artificial Sequence
  CIITA targeting sequence
uaaaaccacuagucuuacuc

SEQ ID NO: 38463 - RNA, 20 nt, Artificial Sequence
  CIITA targeting sequence
uacucccacgacaacccauu

SEQ ID NO: 38464 - RNA, 20 nt, Artificial Sequence
  CIITA targeting sequence
cacgacaacccauuaacuua

SEQ ID NO: 38465 - RNA, 20 nt, Artificial Sequence
  CIITA targeting sequence
ugggaguaagacuagugguu

SEQ ID NO: 38466 - RNA, 20 nt, Artificial Sequence
  CIITA targeting sequence
acuaauccaugaacggauua

SEQ ID NO: 38467 - RNA, 20 nt, Artificial Sequence
  CIITA targeting sequence
augaacggauuaacccauuc

SEQ ID NO: 38468 - RNA, 20 nt, Artificial Sequence
  CIITA targeting sequence
uggauuaguggauaaacagg

SEQ ID NO: 38469 - RNA, 20 nt, Artificial Sequence
  CIITA targeting sequence
guucauggauuaguggauaa

SEQ ID NO: 38470 - RNA, 20 nt, Artificial Sequence
  CIITA targeting sequence
ucaaggaaaagccccaguca

SEQ ID NO: 38471 - RNA, 20 nt, Artificial Sequence
  CIITA targeting sequence
aggaaaagccccagucaccu

SEQ ID NO: 38472 - RNA, 20 nt, Artificial Sequence
  CIITA targeting sequence
uugaugaauggguuaauccg

SEQ ID NO: 38473 - RNA, 20 nt, Artificial Sequence
  CIITA targeting sequence
ccucuuaaaggccccaccuc

SEQ ID NO: 38474 - RNA, 20 nt, Artificial Sequence
  CIITA targeting sequence
uaaaggccccaccucucaau

SEQ ID NO: 38475 - RNA, 20 nt, Artificial Sequence
  CIITA targeting sequence
caauacugccacauagggga

SEQ ID NO: 38476 - RNA, 20 nt, Artificial Sequence
  CIITA targeting sequence
auacugccacauaggggauu

SEQ ID NO: 38477 - RNA, 20 nt, Artificial Sequence
  CIITA targeting sequence
ccuauguggcaguauugaga

SEQ ID NO: 38478 - RNA, 20 nt, Artificial Sequence
  CIITA targeting sequence
uguauaaauguaauccccua

SEQ ID NO: 38479 - RNA, 20 nt, Artificial Sequence
  CIITA targeting sequence
aaaacucauguauaaaugua

SEQ ID NO: 38480 - RNA, 20 nt, Artificial Sequence
  CIITA targeting sequence
ccaaaacucauguauaaaug

SEQ ID NO: 38481 - RNA, 20 nt, Artificial Sequence
  CIITA targeting sequence
ucuccaaaacucauguauaa

SEQ ID NO: 38482 - RNA, 20 nt, Artificial Sequence
  CIITA targeting sequence
cgucauaacaggcagcuuca

SEQ ID NO: 38483 - RNA, 20 nt, Artificial Sequence
  CIITA targeting sequence
uaacaggcagcuucacccaa

SEQ ID NO: 38484 - RNA, 20 nt, Artificial Sequence
  CIITA targeting sequence
cccaagucugcuccucaagu

SEQ ID NO: 38485 - RNA, 20 nt, Artificial Sequence
  CIITA targeting sequence
gcuccucaagucuguggguu

SEQ ID NO: 38486 - RNA, 20 nt, Artificial Sequence
  CIITA targeting sequence
ucaagucuguggguuuucuc

SEQ ID NO: 38487 - RNA, 20 nt, Artificial Sequence
  CIITA targeting sequence
agucuguggguuuucucucu

SEQ ID NO: 38488 - RNA, 20 nt, Artificial Sequence
  CIITA targeting sequence
guggguuuucucucugcuuc

SEQ ID NO: 38489 - RNA, 20 nt, Artificial Sequence
  CIITA targeting sequence
cucugcuucuggaaggugaa

SEQ ID NO: 38490 - RNA, 20 nt, Artificial Sequence
  CIITA targeting sequence
cugcuucuggaaggugaagc

SEQ ID NO: 38491 - RNA, 20 nt, Artificial Sequence
  CIITA targeting sequence
gcuucuggaaggugaagccc

SEQ ID NO: 38492 - RNA, 20 nt, Artificial Sequence
  CIITA targeting sequence
ggaaggugaagcccaggccu

SEQ ID NO: 38493 - RNA, 20 nt, Artificial Sequence
  CIITA targeting sequence
agaagcagagagaaaaccca

SEQ ID NO: 38494 - RNA, 20 nt, Artificial Sequence
  CIITA targeting sequence
ccuuccagaagcagagagaa

SEQ ID NO: 38495 - RNA, 20 nt, Artificial Sequence
  CIITA targeting sequence
uuugcagcauccugaaauau

SEQ ID NO: 38496 - RNA, 20 nt, Artificial Sequence
  CIITA targeting sequence
ugaaauaugaccuuagcuuc

SEQ ID NO: 38497 - RNA, 20 nt, Artificial Sequence
  CIITA targeting sequence
ggaugcugcaaaagaauacu

SEQ ID NO: 38498 - RNA, 20 nt, Artificial Sequence
  CIITA targeting sequence
uauuucaggaugcugcaaaa

SEQ ID NO: 38499 - RNA, 20 nt, Artificial Sequence
  CIITA targeting sequence
aaauguguaaaauggagaua

SEQ ID NO: 38500 - RNA, 20 nt, Artificial Sequence
  CIITA targeting sequence
auuuuacacauuuagaagcu

SEQ ID NO: 38501 - RNA, 20 nt, Artificial Sequence
  CIITA targeting sequence
ccauuuuacacauuuagaag

SEQ ID NO: 38502 - RNA, 20 nt, Artificial Sequence
  CIITA targeting sequence
cacccaccaucacgggaugg

SEQ ID NO: 38503 - RNA, 20 nt, Artificial Sequence
  CIITA targeting sequence
cgggaugguuguaagacuga

SEQ ID NO: 38504 - RNA, 20 nt, Artificial Sequence
  CIITA targeting sequence
cgugauggugggugugauua

SEQ ID NO: 38505 - RNA, 20 nt, Artificial Sequence
  CIITA targeting sequence
uacaaccaucccgugauggu

SEQ ID NO: 38506 - RNA, 20 nt, Artificial Sequence
  CIITA targeting sequence
gucuuacaaccaucccguga

SEQ ID NO: 38507 - RNA, 20 nt, Artificial Sequence
  CIITA targeting sequence
aaaugcuuuacacauuguaa

SEQ ID NO: 38508 - RNA, 20 nt, Artificial Sequence
  CIITA targeting sequence
uuuucuaaaugcuuuacaca

SEQ ID NO: 38509 - RNA, 20 nt, Artificial Sequence
  CIITA targeting sequence
gugcaaauuccuuuucuaaa

SEQ ID NO: 38510 - RNA, 20 nt, Artificial Sequence
  CIITA targeting sequence
guagauguuagguacuaccc

SEQ ID NO: 38511 - RNA, 20 nt, Artificial Sequence
  CIITA targeting sequence
acugaaugcuuacucugugc

SEQ ID NO: 38512 - RNA, 20 nt, Artificial Sequence
  CIITA targeting sequence
uuauuaucaccaucauuauu

SEQ ID NO: 38513 - RNA, 20 nt, Artificial Sequence
  CIITA targeting sequence
ccaucauuauuaucaucuuc

SEQ ID NO: 38514 - RNA, 20 nt, Artificial Sequence
  CIITA targeting sequence
uuauuaucaucuucauuuuc

SEQ ID NO: 38515 - RNA, 20 nt, Artificial Sequence
  CIITA targeting sequence
ucuucauuuucaucaccuuc

SEQ ID NO: 38516 - RNA, 20 nt, Artificial Sequence
  CIITA targeting sequence
ucauuuucaucaccuucauu

SEQ ID NO: 38517 - RNA, 20 nt, Artificial Sequence
  CIITA targeting sequence
uuuucaucaccuucauuaug

SEQ ID NO: 38518 - RNA, 20 nt, Artificial Sequence
  CIITA targeting sequence
ucaccuucauuauggccauc

SEQ ID NO: 38519 - RNA, 20 nt, Artificial Sequence
  CIITA targeting sequence
ccuucauuauggccaucauu

SEQ ID NO: 38520 - RNA, 20 nt, Artificial Sequence
  CIITA targeting sequence
uuauggccaucauuccauuc

SEQ ID NO: 38521 - RNA, 20 nt, Artificial Sequence
  CIITA targeting sequence
uuccauuccucagcucagaa

SEQ ID NO: 38522 - RNA, 20 nt, Artificial Sequence
  CIITA targeting sequence
auuccucagcucagaagccu

SEQ ID NO: 38523 - RNA, 20 nt, Artificial Sequence
  CIITA targeting sequence
ucagcucagaagccuucuau

SEQ ID NO: 38524 - RNA, 20 nt, Artificial Sequence
  CIITA targeting sequence
gcucagaagccuucuauggc

SEQ ID NO: 38525 - RNA, 20 nt, Artificial Sequence
  CIITA targeting sequence
gaagccuucuauggcucccc

SEQ ID NO: 38526 - RNA, 20 nt, Artificial Sequence
  CIITA targeting sequence
gagcugaggaauggaaugau

SEQ ID NO: 38527 - RNA, 20 nt, Artificial Sequence
  CIITA targeting sequence
auggcuccccauugcuuaua

SEQ ID NO: 38528 - RNA, 20 nt, Artificial Sequence
  CIITA targeting sequence
ccauugcuuauaaaaucaag

SEQ ID NO: 38529 - RNA, 20 nt, Artificial Sequence
  CIITA targeting sequence
aguccuaacuuuccccagca

SEQ ID NO: 38530 - RNA, 20 nt, Artificial Sequence
  CIITA targeting sequence
uaacuuuccccagcaugaaa

SEQ ID NO: 38531 - RNA, 20 nt, Artificial Sequence
  CIITA targeting sequence
ccagcaugaaacuucuacca

SEQ ID NO: 38532 - RNA, 20 nt, Artificial Sequence
  CIITA targeting sequence
ugcuggggaaaguuaggacu

SEQ ID NO: 38533 - RNA, 20 nt, Artificial Sequence
  CIITA targeting sequence
accaccgucaccuaucucuc

SEQ ID NO: 38534 - RNA, 20 nt, Artificial Sequence
  CIITA targeting sequence
ccuaucucucaggguuuccu

SEQ ID NO: 38535 - RNA, 20 nt, Artificial Sequence
  CIITA targeting sequence
cucaggguuuccuaaacaua

SEQ ID NO: 38536 - RNA, 20 nt, Artificial Sequence
  CIITA targeting sequence
caggguuuccuaaacauacu

SEQ ID NO: 38537 - RNA, 20 nt, Artificial Sequence
  CIITA targeting sequence
ggguuuccuaaacauacucu

SEQ ID NO: 38538 - RNA, 20 nt, Artificial Sequence
  CIITA targeting sequence
uaaacauacucugaacaagu

SEQ ID NO: 38539 - RNA, 20 nt, Artificial Sequence
  CIITA targeting sequence
gaacaaguuuccucacucug

SEQ ID NO: 38540 - RNA, 20 nt, Artificial Sequence
  CIITA targeting sequence
gaguauguuuaggaaacccu

SEQ ID NO: 38541 - RNA, 20 nt, Artificial Sequence
  CIITA targeting sequence
ucacucugccacugugaccc

SEQ ID NO: 38542 - RNA, 20 nt, Artificial Sequence
  CIITA targeting sequence
cucugccacugugacccaga

SEQ ID NO: 38543 - RNA, 20 nt, Artificial Sequence
  CIITA targeting sequence
gccacugugacccagaaagc

SEQ ID NO: 38544 - RNA, 20 nt, Artificial Sequence
  CIITA targeting sequence
caguggcagagugaggaaac

SEQ ID NO: 38545 - RNA, 20 nt, Artificial Sequence
  CIITA targeting sequence
gggucacaguggcagaguga

SEQ ID NO: 38546 - RNA, 20 nt, Artificial Sequence
  CIITA targeting sequence
guucuccuucucccagacuc

SEQ ID NO: 38547 - RNA, 20 nt, Artificial Sequence
  CIITA targeting sequence
ccuucucccagacucugccu

SEQ ID NO: 38548 - RNA, 20 nt, Artificial Sequence
  CIITA targeting sequence
uucucccagacucugccuca

SEQ ID NO: 38549 - RNA, 20 nt, Artificial Sequence
  CIITA targeting sequence
cccagacucugccucaucuu

SEQ ID NO: 38550 - RNA, 20 nt, Artificial Sequence
  CIITA targeting sequence
cagacucugccucaucuuuc

SEQ ID NO: 38551 - RNA, 20 nt, Artificial Sequence
  CIITA targeting sequence
gggagaaggagaacagauag

SEQ ID NO: 38552 - RNA, 20 nt, Artificial Sequence
  CIITA targeting sequence
gccucaucuuucaaggccug

SEQ ID NO: 38553 - RNA, 20 nt, Artificial Sequence
  CIITA targeting sequence
ucuuucaaggccugguucca

SEQ ID NO: 38554 - RNA, 20 nt, Artificial Sequence
  CIITA targeting sequence
uucaaggccugguuccagga

SEQ ID NO: 38555 - RNA, 20 nt, Artificial Sequence
  CIITA targeting sequence
aggccugguuccaggauccc

SEQ ID NO: 38556 - RNA, 20 nt, Artificial Sequence
  CIITA targeting sequence
aggaucccuuccuccaggaa

SEQ ID NO: 38557 - RNA, 20 nt, Artificial Sequence
  CIITA targeting sequence
uggaaccaggccuugaaaga

SEQ ID NO: 38558 - RNA, 20 nt, Artificial Sequence
  CIITA targeting sequence
cuuccuccaggaagccuucc

SEQ ID NO: 38559 - RNA, 20 nt, Artificial Sequence
  CIITA targeting sequence
uccaggaagccuucccugau

SEQ ID NO: 38560 - RNA, 20 nt, Artificial Sequence
  CIITA targeting sequence
aggaagccuucccugauugc

SEQ ID NO: 38561 - RNA, 20 nt, Artificial Sequence
  CIITA targeting sequence
uggaggaagggauccuggaa

SEQ ID NO: 38562 - RNA, 20 nt, Artificial Sequence
  CIITA targeting sequence
cugauugcccuauuccacca

SEQ ID NO: 38563 - RNA, 20 nt, Artificial Sequence
  CIITA targeting sequence
gggaaggcuuccuggaggaa

SEQ ID NO: 38564 - RNA, 20 nt, Artificial Sequence
  CIITA targeting sequence
accauacaccuuuuuucucg

SEQ ID NO: 38565 - RNA, 20 nt, Artificial Sequence
  CIITA targeting sequence
cggacuucaugucauggugc

SEQ ID NO: 38566 - RNA, 20 nt, Artificial Sequence
  CIITA targeting sequence
gacuucaugucauggugccu

SEQ ID NO: 38567 - RNA, 20 nt, Artificial Sequence
  CIITA targeting sequence
gagaaaaaagguguauggug

SEQ ID NO: 38568 - RNA, 20 nt, Artificial Sequence
  CIITA targeting sequence
ugucauggugccuauauucc

SEQ ID NO: 38569 - RNA, 20 nt, Artificial Sequence
  CIITA targeting sequence
uggugccuauauuccaaggg

SEQ ID NO: 38570 - RNA, 20 nt, Artificial Sequence
  CIITA targeting sequence
aagggcucugagccauguac

SEQ ID NO: 38571 - RNA, 20 nt, Artificial Sequence
  CIITA targeting sequence
gagccauguaccccuuuaua

SEQ ID NO: 38572 - RNA, 20 nt, Artificial Sequence
  CIITA targeting sequence
gagcccuuggaauauaggca

SEQ ID NO: 38573 - RNA, 20 nt, Artificial Sequence
  CIITA targeting sequence
guaaauagugguaacuauau

SEQ ID NO: 38574 - RNA, 20 nt, Artificial Sequence
  CIITA targeting sequence
aacacaguagcugguauaca

SEQ ID NO: 38575 - RNA, 20 nt, Artificial Sequence
  CIITA targeting sequence
agauguagaaccucuaauua

SEQ ID NO: 38576 - RNA, 20 nt, Artificial Sequence
  CIITA targeting sequence
agagcauccaacacaguagc

SEQ ID NO: 38577 - RNA, 20 nt, Artificial Sequence
  CIITA targeting sequence
acaucuagagcauccaacac

SEQ ID NO: 38578 - RNA, 20 nt, Artificial Sequence
  CIITA targeting sequence
aauuaucaccaucgauuccu

SEQ ID NO: 38579 - RNA, 20 nt, Artificial Sequence
  CIITA targeting sequence
ccaucgauuccuggguagua

SEQ ID NO: 38580 - RNA, 20 nt, Artificial Sequence
  CIITA targeting sequence
auuccuggguaguaggcauu

SEQ ID NO: 38581 - RNA, 20 nt, Artificial Sequence
  CIITA targeting sequence
auggugauaauuagagguuc

SEQ ID NO: 38582 - RNA, 20 nt, Artificial Sequence
  CIITA targeting sequence
uggguaguaggcauuauuua

SEQ ID NO: 38583 - RNA, 20 nt, Artificial Sequence
  CIITA targeting sequence
ucuuacacagaugagaaaau

SEQ ID NO: 38584 - RNA, 20 nt, Artificial Sequence
  CIITA targeting sequence
uacacagaugagaaaaugga

SEQ ID NO: 38585 - RNA, 20 nt, Artificial Sequence
  CIITA targeting sequence
guguaagaugaauaaauaau

SEQ ID NO: 38586 - RNA, 20 nt, Artificial Sequence
  CIITA targeting sequence
ucuguguaagaugaauaaau

SEQ ID NO: 38587 - RNA, 20 nt, Artificial Sequence
  CIITA targeting sequence
caucuguguaagaugaauaa

SEQ ID NO: 38588 - RNA, 20 nt, Artificial Sequence
  CIITA targeting sequence
auuuucucaucuguguaaga

SEQ ID NO: 38589 - RNA, 20 nt, Artificial Sequence
  CIITA targeting sequence
ugggcuacuuauuuaaccac

SEQ ID NO: 38590 - RNA, 20 nt, Artificial Sequence
  CIITA targeting sequence
acuagcccuacuagcugugc

SEQ ID NO: 38591 - RNA, 20 nt, Artificial Sequence
  CIITA targeting sequence
acuuuccacuagcccuacua

SEQ ID NO: 38592 - RNA, 20 nt, Artificial Sequence
  CIITA targeting sequence
accucuacuuuccacuagcc

SEQ ID NO: 38593 - RNA, 20 nt, Artificial Sequence
  CIITA targeting sequence
aauuccaccucuacuuucca

SEQ ID NO: 38594 - RNA, 20 nt, Artificial Sequence
  CIITA targeting sequence
aauccugcaguaacucuacc

SEQ ID NO: 38595 - RNA, 20 nt, Artificial Sequence
  CIITA targeting sequence
ugcaguaacucuaccauucu

SEQ ID NO: 38596 - RNA, 20 nt, Artificial Sequence
  CIITA targeting sequence
accauucugccuugcucuuc

SEQ ID NO: 38597 - RNA, 20 nt, Artificial Sequence
  CIITA targeting sequence
gccuugcucuucuuuguagc

SEQ ID NO: 38598 - RNA, 20 nt, Artificial Sequence
  CIITA targeting sequence
ucuuuguagcaguagauaag

SEQ ID NO: 38599 - RNA, 20 nt, Artificial Sequence
  CIITA targeting sequence
uuguagcaguagauaaguuu

SEQ ID NO: 38600 - RNA, 20 nt, Artificial Sequence
  CIITA targeting sequence
acugcuacaaagaagagcaa

SEQ ID NO: 38601 - RNA, 20 nt, Artificial Sequence
  CIITA targeting sequence
uggauacauaccucauccuu

SEQ ID NO: 38602 - RNA, 20 nt, Artificial Sequence
  CIITA targeting sequence
augaaaacuuaucuacugcu

SEQ ID NO: 38603 - RNA, 20 nt, Artificial Sequence
  CIITA targeting sequence
uccuuuugauuagauuaagg

SEQ ID NO: 38604 - RNA, 20 nt, Artificial Sequence
  CIITA targeting sequence
uuuugauuagauuaagggcc

SEQ ID NO: 38605 - RNA, 20 nt, Artificial Sequence
  CIITA targeting sequence
aaaggaugagguauguaucc

SEQ ID NO: 38606 - RNA, 20 nt, Artificial Sequence
  CIITA targeting sequence
aaucaaaaggaugagguaug

SEQ ID NO: 38607 - RNA, 20 nt, Artificial Sequence
  CIITA targeting sequence
aggggcccuuaaucuaauca

SEQ ID NO: 38608 - RNA, 20 nt, Artificial Sequence
  CIITA targeting sequence
guguucauucauuuguuuga

SEQ ID NO: 38609 - RNA, 20 nt, Artificial Sequence
  CIITA targeting sequence
uucauuuguuugaucauuca

SEQ ID NO: 38610 - RNA, 20 nt, Artificial Sequence
  CIITA targeting sequence
uuuguuugaucauucauuca

SEQ ID NO: 38611 - RNA, 20 nt, Artificial Sequence
  CIITA targeting sequence
aacaaaugaaugaacacuga

SEQ ID NO: 38612 - RNA, 20 nt, Artificial Sequence
  CIITA targeting sequence
uucauucauucaacaaacau

SEQ ID NO: 38613 - RNA, 20 nt, Artificial Sequence
  CIITA targeting sequence
uucauucaacaaacauuucu

SEQ ID NO: 38614 - RNA, 20 nt, Artificial Sequence
  CIITA targeting sequence
uucaacaaacauuucuugag

SEQ ID NO: 38615 - RNA, 20 nt, Artificial Sequence
  CIITA targeting sequence
acaaacauuucuugaguccc

SEQ ID NO: 38616 - RNA, 20 nt, Artificial Sequence
  CIITA targeting sequence
ugaguccccacugugugcca

SEQ ID NO: 38617 - RNA, 20 nt, Artificial Sequence
  CIITA targeting sequence
agaaauguuuguugaaugaa

SEQ ID NO: 38618 - RNA, 20 nt, Artificial Sequence
  CIITA targeting sequence
ccacugugugccaggcccag

SEQ ID NO: 38619 - RNA, 20 nt, Artificial Sequence
  CIITA targeting sequence
gggccuggcacacagugggg

SEQ ID NO: 38620 - RNA, 20 nt, Artificial Sequence
  CIITA targeting sequence
ccagcccaaggccuggcaca

SEQ ID NO: 38621 - RNA, 20 nt, Artificial Sequence
  CIITA targeting sequence
guuagaccuuguugauugac

SEQ ID NO: 38622 - RNA, 20 nt, Artificial Sequence
  CIITA targeting sequence
aacugaaggcccacugugug

SEQ ID NO: 38623 - RNA, 20 nt, Artificial Sequence
  CIITA targeting sequence
acaaggucuaacugaaggcc

SEQ ID NO: 38624 - RNA, 20 nt, Artificial Sequence
  CIITA targeting sequence
aucaacaaggucuaacugaa

SEQ ID NO: 38625 - RNA, 20 nt, Artificial Sequence
  CIITA targeting sequence
uugucugggcagcggaacug

SEQ ID NO: 38626 - RNA, 20 nt, Artificial Sequence
  CIITA targeting sequence
gggcagcggaacuggaccag

SEQ ID NO: 38627 - RNA, 20 nt, Artificial Sequence
  CIITA targeting sequence
gcugcccagacaaggaaaag

SEQ ID NO: 38628 - RNA, 20 nt, Artificial Sequence
  CIITA targeting sequence
aguuccgcugcccagacaag

SEQ ID NO: 38629 - RNA, 20 nt, Artificial Sequence
  CIITA targeting sequence
uccaggacucccagcuggag

SEQ ID NO: 38630 - RNA, 20 nt, Artificial Sequence
  CIITA targeting sequence
aggacucccagcuggagggc

SEQ ID NO: 38631 - RNA, 20 nt, Artificial Sequence
  CIITA targeting sequence
uggaagacauacugguccag

SEQ ID NO: 38632 - RNA, 20 nt, Artificial Sequence
  CIITA targeting sequence
cagcuggagggccugagcaa

SEQ ID NO: 38633 - RNA, 20 nt, Artificial Sequence
  CIITA targeting sequence
agcugggaguccuggaagac

SEQ ID NO: 38634 - RNA, 20 nt, Artificial Sequence
  CIITA targeting sequence
ggcccuccagcugggagucc

SEQ ID NO: 38635 - RNA, 20 nt, Artificial Sequence
  CIITA targeting sequence
uugcucaggcccuccagcug

SEQ ID NO: 38636 - RNA, 20 nt, Artificial Sequence
  CIITA targeting sequence
guaaguuugugguggguggg

SEQ ID NO: 38637 - RNA, 20 nt, Artificial Sequence
  CIITA targeting sequence
ccacccaccacaaacuuacu

SEQ ID NO: 38638 - RNA, 20 nt, Artificial Sequence
  CIITA targeting sequence
uggcucagccugcauuuccu

SEQ ID NO: 38639 - RNA, 20 nt, Artificial Sequence
  CIITA targeting sequence
gccugcauuuccugccuugu

SEQ ID NO: 38640 - RNA, 20 nt, Artificial Sequence
  CIITA targeting sequence
ugccuuguucccuggggggu

SEQ ID NO: 38641 - RNA, 20 nt, Artificial Sequence
  CIITA targeting sequence
cuggggggugcccuaauacc

SEQ ID NO: 38642 - RNA, 20 nt, Artificial Sequence
  CIITA targeting sequence
gguauuagggcaccccccag

SEQ ID NO: 38643 - RNA, 20 nt, Artificial Sequence
  CIITA targeting sequence
ucagguauuagggcaccccc

SEQ ID NO: 38644 - RNA, 20 nt, Artificial Sequence
  CIITA targeting sequence
uugaugggcagucagacccc

SEQ ID NO: 38645 - RNA, 20 nt, Artificial Sequence
  CIITA targeting sequence
augaauggucgucagguauu

SEQ ID NO: 38646 - RNA, 20 nt, Artificial Sequence
  CIITA targeting sequence
gaccccucuccccaaggugg

SEQ ID NO: 38647 - RNA, 20 nt, Artificial Sequence
  CIITA targeting sequence
gacugcccaucaaugaaugg

SEQ ID NO: 38648 - RNA, 20 nt, Artificial Sequence
  CIITA targeting sequence
ccccaagguggguacaauag

SEQ ID NO: 38649 - RNA, 20 nt, Artificial Sequence
  CIITA targeting sequence
ccaagguggguacaauagag

SEQ ID NO: 38650 - RNA, 20 nt, Artificial Sequence
  CIITA targeting sequence
auuguacccaccuuggggag

SEQ ID NO: 38651 - RNA, 20 nt, Artificial Sequence
  CIITA targeting sequence
cuauuguacccaccuugggg

SEQ ID NO: 38652 - RNA, 20 nt, Artificial Sequence
  CIITA targeting sequence
ccuugggcuuucauugauug

SEQ ID NO: 38653 - RNA, 20 nt, Artificial Sequence
  CIITA targeting sequence
uugauugugugaguuggucu

SEQ ID NO: 38654 - RNA, 20 nt, Artificial Sequence
  CIITA targeting sequence
augaaagcccaaggugaguc

SEQ ID NO: 38655 - RNA, 20 nt, Artificial Sequence
  CIITA targeting sequence
cacaaucaaugaaagcccaa

SEQ ID NO: 38656 - RNA, 20 nt, Artificial Sequence
  CIITA targeting sequence
cugguuuuucucaaaguaga

SEQ ID NO: 38657 - RNA, 20 nt, Artificial Sequence
  CIITA targeting sequence
gguuuuucucaaaguagagc

SEQ ID NO: 38658 - RNA, 20 nt, Artificial Sequence
  CIITA targeting sequence
caaaguagagcacauaggac

SEQ ID NO: 38659 - RNA, 20 nt, Artificial Sequence
  CIITA targeting sequence
aaguagagcacauaggacca

SEQ ID NO: 38660 - RNA, 20 nt, Artificial Sequence
  CIITA targeting sequence
acuuugagaaaaaccagaga

SEQ ID NO: 38661 - RNA, 20 nt, Artificial Sequence
  CIITA targeting sequence
uaugugcucuacuuugagaa

SEQ ID NO: 38662 - RNA, 20 nt, Artificial Sequence
  CIITA targeting sequence
gguccuaugugcucuacuuu

SEQ ID NO: 38663 - RNA, 20 nt, Artificial Sequence
  CIITA targeting sequence
ucugguccuaugugcucuac

SEQ ID NO: 38664 - RNA, 20 nt, Artificial Sequence
  CIITA targeting sequence
cuucaucugguccuaugugc

SEQ ID NO: 38665 - RNA, 20 nt, Artificial Sequence
  CIITA targeting sequence
gugagaguauggagaugcca

SEQ ID NO: 38666 - RNA, 20 nt, Artificial Sequence
  CIITA targeting sequence
ccgaucacuucaucuggucc

SEQ ID NO: 38667 - RNA, 20 nt, Artificial Sequence
  CIITA targeting sequence
caccgaucacuucaucuggu

SEQ ID NO: 38668 - RNA, 20 nt, Artificial Sequence
  CIITA targeting sequence
auacucucaccgaucacuuc

SEQ ID NO: 38669 - RNA, 20 nt, Artificial Sequence
  CIITA targeting sequence
ccauacucucaccgaucacu

SEQ ID NO: 38670 - RNA, 20 nt, Artificial Sequence
  CIITA targeting sequence
gcuggcaucuccauacucuc

SEQ ID NO: 38671 - RNA, 20 nt, Artificial Sequence
  CIITA targeting sequence
gcccaacuucugcuggcauc

SEQ ID NO: 38672 - RNA, 20 nt, Artificial Sequence
  CIITA targeting sequence
gaaaagacgugagugagccc

SEQ ID NO: 38673 - RNA, 20 nt, Artificial Sequence
  CIITA targeting sequence
gacuuuucugcccaacuucu

SEQ ID NO: 38674 - RNA, 20 nt, Artificial Sequence
  CIITA targeting sequence
uuucugacuuuucugcccaa

SEQ ID NO: 38675 - RNA, 20 nt, Artificial Sequence
  CIITA targeting sequence
cgucuuuucugacuuuucug

SEQ ID NO: 38676 - RNA, 20 nt, Artificial Sequence
  CIITA targeting sequence
cucacgucuuuucugacuuu

SEQ ID NO: 38677 - RNA, 20 nt, Artificial Sequence
  CIITA targeting sequence
cugauccaaccuagccuugc

SEQ ID NO: 38678 - RNA, 20 nt, Artificial Sequence
  CIITA targeting sequence
gggaggggcucacucacguc

SEQ ID NO: 38679 - RNA, 20 nt, Artificial Sequence
  CIITA targeting sequence
aaccuagccuugcuugagac

SEQ ID NO: 38680 - RNA, 20 nt, Artificial Sequence
  CIITA targeting sequence
agcaaggcuagguuggauca

SEQ ID NO: 38681 - RNA, 20 nt, Artificial Sequence
  CIITA targeting sequence
caagcaaggcuagguuggau

SEQ ID NO: 38682 - RNA, 20 nt, Artificial Sequence
  CIITA targeting sequence
uugacuccaaagccugcugu

SEQ ID NO: 38683 - RNA, 20 nt, Artificial Sequence
  CIITA targeting sequence
aggaaaggccaggucucaag

SEQ ID NO: 38684 - RNA, 20 nt, Artificial Sequence
  CIITA targeting sequence
aaagccugcuguggguccaa

SEQ ID NO: 38685 - RNA, 20 nt, Artificial Sequence
  CIITA targeting sequence
aacuugcuucccucgcuaag

SEQ ID NO: 38686 - RNA, 20 nt, Artificial Sequence
  CIITA targeting sequence
cucgcuaaguccugucuggu

SEQ ID NO: 38687 - RNA, 20 nt, Artificial Sequence
  CIITA targeting sequence
cuaaguccugucugguuggg

SEQ ID NO: 38688 - RNA, 20 nt, Artificial Sequence
  CIITA targeting sequence
ugucugguugggaggcccuu

SEQ ID NO: 38689 - RNA, 20 nt, Artificial Sequence
  CIITA targeting sequence
gguugggaggcccuuuaaaa

SEQ ID NO: 38690 - RNA, 20 nt, Artificial Sequence
  CIITA targeting sequence
caaccagacaggacuuagcg

SEQ ID NO: 38691 - RNA, 20 nt, Artificial Sequence
  CIITA targeting sequence
uguuggcuuuuaaagggccu

SEQ ID NO: 38692 - RNA, 20 nt, Artificial Sequence
  CIITA targeting sequence
gauuauuucauggcccugau

SEQ ID NO: 38693 - RNA, 20 nt, Artificial Sequence
  CIITA targeting sequence
gauguacauuuuaaggcucc

SEQ ID NO: 38694 - RNA, 20 nt, Artificial Sequence
  CIITA targeting sequence
uggcccugauaacccuccaa

SEQ ID NO: 38695 - RNA, 20 nt, Artificial Sequence
  CIITA targeting sequence
gggccaugaaauaaucagau

SEQ ID NO: 38696 - RNA, 20 nt, Artificial Sequence
  CIITA targeting sequence
aauggcuacaaaauacaugc

SEQ ID NO: 38697 - RNA, 20 nt, Artificial Sequence
  CIITA targeting sequence
ucccucuccaaacccacuau

SEQ ID NO: 38698 - RNA, 20 nt, Artificial Sequence
  CIITA targeting sequence
cucuccaaacccacuaugag

SEQ ID NO: 38699 - RNA, 20 nt, Artificial Sequence
  CIITA targeting sequence
ccaaacccacuaugagacac

SEQ ID NO: 38700 - RNA, 20 nt, Artificial Sequence
  CIITA targeting sequence
aaacccacuaugagacacca

SEQ ID NO: 38701 - RNA, 20 nt, Artificial Sequence
  CIITA targeting sequence
uaguggguuuggagagggag

SEQ ID NO: 38702 - RNA, 20 nt, Artificial Sequence
  CIITA targeting sequence
cauaguggguuuggagaggg

SEQ ID NO: 38703 - RNA, 20 nt, Artificial Sequence
  CIITA targeting sequence
gccaccaccagcuucuccac

SEQ ID NO: 38704 - RNA, 20 nt, Artificial Sequence
  CIITA targeting sequence
ccacuccuauaacccaugug

SEQ ID NO: 38705 - RNA, 20 nt, Artificial Sequence
  CIITA targeting sequence
acuccuauaacccaugugcc

SEQ ID NO: 38706 - RNA, 20 nt, Artificial Sequence
  CIITA targeting sequence
uauaacccaugugcccuuuc

SEQ ID NO: 38707 - RNA, 20 nt, Artificial Sequence
  CIITA targeting sequence
agccucggggccuuugcagu

SEQ ID NO: 38708 - RNA, 20 nt, Artificial Sequence
  CIITA targeting sequence
gggccuuugcaguugcuaua

SEQ ID NO: 38709 - RNA, 20 nt, Artificial Sequence
  CIITA targeting sequence
cuaucuggaaugcccuuccc

SEQ ID NO: 38710 - RNA, 20 nt, Artificial Sequence
  CIITA targeting sequence
aucuggaaugcccuuccccc

SEQ ID NO: 38711 - RNA, 20 nt, Artificial Sequence
  CIITA targeting sequence
ggaaugcccuucccccaguu

SEQ ID NO: 38712 - RNA, 20 nt, Artificial Sequence
  CIITA targeting sequence
agauagagacuauagcaacu

SEQ ID NO: 38713 - RNA, 20 nt, Artificial Sequence
  CIITA targeting sequence
cccaguucuucccauggcug

SEQ ID NO: 38714 - RNA, 20 nt, Artificial Sequence
  CIITA targeting sequence
ucccauggcugacuccuuug

SEQ ID NO: 38715 - RNA, 20 nt, Artificial Sequence
  CIITA targeting sequence
cauggcugacuccuuugaau

SEQ ID NO: 38716 - RNA, 20 nt, Artificial Sequence
  CIITA targeting sequence
gccaugggaagaacuggggg

SEQ ID NO: 38717 - RNA, 20 nt, Artificial Sequence
  CIITA targeting sequence
uuugaaucuuucugguguug

SEQ ID NO: 38718 - RNA, 20 nt, Artificial Sequence
  CIITA targeting sequence
aaggagucagccaugggaag

SEQ ID NO: 38719 - RNA, 20 nt, Artificial Sequence
  CIITA targeting sequence
uucugguguuggcuaaacug

SEQ ID NO: 38720 - RNA, 20 nt, Artificial Sequence
  CIITA targeting sequence
gguguuggcuaaacugucac

SEQ ID NO: 38721 - RNA, 20 nt, Artificial Sequence
  CIITA targeting sequence
ccucuuccuggaacccuucu

SEQ ID NO: 38722 - RNA, 20 nt, Artificial Sequence
  CIITA targeting sequence
uccuggaacccuucucugac

SEQ ID NO: 38723 - RNA, 20 nt, Artificial Sequence
  CIITA targeting sequence
uggaacccuucucugaccau

SEQ ID NO: 38724 - RNA, 20 nt, Artificial Sequence
  CIITA targeting sequence
aggaagaggugacaguuuag

SEQ ID NO: 38725 - RNA, 20 nt, Artificial Sequence
  CIITA targeting sequence
cugaccauccuuccauguag

SEQ ID NO: 38726 - RNA, 20 nt, Artificial Sequence
  CIITA targeting sequence
gaccauccuuccauguagau

SEQ ID NO: 38727 - RNA, 20 nt, Artificial Sequence
  CIITA targeting sequence
gagaaggguuccaggaagag

SEQ ID NO: 38728 - RNA, 20 nt, Artificial Sequence
  CIITA targeting sequence
uuccauguagauuagcucag

SEQ ID NO: 38729 - RNA, 20 nt, Artificial Sequence
  CIITA targeting sequence
auguagauuagcucaguuau

SEQ ID NO: 38730 - RNA, 20 nt, Artificial Sequence
  CIITA targeting sequence
acauggaaggauggucagag

SEQ ID NO: 38731 - RNA, 20 nt, Artificial Sequence
  CIITA targeting sequence
guuauucucaccuugugugu

SEQ ID NO: 38732 - RNA, 20 nt, Artificial Sequence
  CIITA targeting sequence
caccuugugugucuuuuucc

SEQ ID NO: 38733 - RNA, 20 nt, Artificial Sequence
  CIITA targeting sequence
ccuugugugucuuuuuccuu

SEQ ID NO: 38734 - RNA, 20 nt, Artificial Sequence
  CIITA targeting sequence
uuuuccuugcaguuuagcac

SEQ ID NO: 38735 - RNA, 20 nt, Artificial Sequence
  CIITA targeting sequence
uugcaguuuagcacucauua

SEQ ID NO: 38736 - RNA, 20 nt, Artificial Sequence
  CIITA targeting sequence
uuaccaucuggacauauuuu

SEQ ID NO: 38737 - RNA, 20 nt, Artificial Sequence
  CIITA targeting sequence
ggacauauuuuacgccuugc

SEQ ID NO: 38738 - RNA, 20 nt, Artificial Sequence
  CIITA targeting sequence
agaugguaaugagugcuaaa

SEQ ID NO: 38739 - RNA, 20 nt, Artificial Sequence
  CIITA targeting sequence
cccacugugaggacagggac

SEQ ID NO: 38740 - RNA, 20 nt, Artificial Sequence
  CIITA targeting sequence
cacugugaggacagggaccu

SEQ ID NO: 38741 - RNA, 20 nt, Artificial Sequence
  CIITA targeting sequence
cagugggagagcaaggcgua

SEQ ID NO: 38742 - RNA, 20 nt, Artificial Sequence
  CIITA targeting sequence
ucacagugggagagcaaggc

SEQ ID NO: 38743 - RNA, 20 nt, Artificial Sequence
  CIITA targeting sequence
cuguccucacagugggagag

SEQ ID NO: 38744 - RNA, 20 nt, Artificial Sequence
  CIITA targeting sequence
uucuugcucgugacuguuuc

SEQ ID NO: 38745 - RNA, 20 nt, Artificial Sequence
  CIITA targeting sequence
ugcucgugacuguuucccca

SEQ ID NO: 38746 - RNA, 20 nt, Artificial Sequence
  CIITA targeting sequence
ugacuguuuccccagcaucu

SEQ ID NO: 38747 - RNA, 20 nt, Artificial Sequence
  CIITA targeting sequence
cgagcaagaaagacaagguc

SEQ ID NO: 38748 - RNA, 20 nt, Artificial Sequence
  CIITA targeting sequence
ccagcaucuagugcagugcc

SEQ ID NO: 38749 - RNA, 20 nt, Artificial Sequence
  CIITA targeting sequence
agugcagugccugguaugca

SEQ ID NO: 38750 - RNA, 20 nt, Artificial Sequence
  CIITA targeting sequence
guagauaucuguugaaugaa

SEQ ID NO: 38751 - RNA, 20 nt, Artificial Sequence
  CIITA targeting sequence
acugaggugcuacugcauac

SEQ ID NO: 38752 - RNA, 20 nt, Artificial Sequence
  CIITA targeting sequence
guugaaugaaaacaucugua

SEQ ID NO: 38753 - RNA, 20 nt, Artificial Sequence
  CIITA targeting sequence
acagauaucuacugaggugc

SEQ ID NO: 38754 - RNA, 20 nt, Artificial Sequence
  CIITA targeting sequence
uucaacagauaucuacugag

SEQ ID NO: 38755 - RNA, 20 nt, Artificial Sequence
  CIITA targeting sequence
guaaaauggguguaacaguu

SEQ ID NO: 38756 - RNA, 20 nt, Artificial Sequence
  CIITA targeting sequence
guuaacuguuacacccauuu

SEQ ID NO: 38757 - RNA, 20 nt, Artificial Sequence
  CIITA targeting sequence
gaccauguguaaguccugua

SEQ ID NO: 38758 - RNA, 20 nt, Artificial Sequence
  CIITA targeting sequence
gacccauaauaaguacucag

SEQ ID NO: 38759 - RNA, 20 nt, Artificial Sequence
  CIITA targeting sequence
uguaucuauuuauucaguuc

SEQ ID NO: 38760 - RNA, 20 nt, Artificial Sequence
  CIITA targeting sequence
auuuauucaguucuuaaaca

SEQ ID NO: 38761 - RNA, 20 nt, Artificial Sequence
  CIITA targeting sequence
guucuuaaacaggugaaucg

SEQ ID NO: 38762 - RNA, 20 nt, Artificial Sequence
  CIITA targeting sequence
uaaacaggugaaucgcacac

SEQ ID NO: 38763 - RNA, 20 nt, Artificial Sequence
  CIITA targeting sequence
ccuguuuaagaacugaauaa

SEQ ID NO: 38764 - RNA, 20 nt, Artificial Sequence
  CIITA targeting sequence
cacacaggguaugagauuuu

SEQ ID NO: 38765 - RNA, 20 nt, Artificial Sequence
  CIITA targeting sequence
uacccugugugcgauucacc

SEQ ID NO: 38766 - RNA, 20 nt, Artificial Sequence
  CIITA targeting sequence
cauacccugugugcgauuca

SEQ ID NO: 38767 - RNA, 20 nt, Artificial Sequence
  CIITA targeting sequence
uugcacuuuuaaaaucucau

SEQ ID NO: 38768 - RNA, 20 nt, Artificial Sequence
  CIITA targeting sequence
gugaaggcugggcgcagcgg

SEQ ID NO: 38769 - RNA, 20 nt, Artificial Sequence
  CIITA targeting sequence
cugaauauucuuugcacuuu

SEQ ID NO: 38770 - RNA, 20 nt, Artificial Sequence
  CIITA targeting sequence
caccuguaaucccagcaguu

SEQ ID NO: 38771 - RNA, 20 nt, Artificial Sequence
  CIITA targeting sequence
cagcaguuugggaggccaag

SEQ ID NO: 38772 - RNA, 20 nt, Artificial Sequence
  CIITA targeting sequence
caaacugcugggauuacagg

SEQ ID NO: 38773 - RNA, 20 nt, Artificial Sequence
  CIITA targeting sequence
cccuuggccucccaaacugc

SEQ ID NO: 38774 - RNA, 20 nt, Artificial Sequence
  CIITA targeting sequence
gucccccuuggccucccaaa

SEQ ID NO: 38775 - RNA, 20 nt, Artificial Sequence
  CIITA targeting sequence
cuugaggucaggaguuugau

SEQ ID NO: 38776 - RNA, 20 nt, Artificial Sequence
  CIITA targeting sequence
agugauccgucccccuuggc

SEQ ID NO: 38777 - RNA, 20 nt, Artificial Sequence
  CIITA targeting sequence
ggaguuugauaccugccugg

SEQ ID NO: 38778 - RNA, 20 nt, Artificial Sequence
  CIITA targeting sequence
ugaccucaagugauccgucc

SEQ ID NO: 38779 - RNA, 20 nt, Artificial Sequence
  CIITA targeting sequence
aacuccugaccucaagugau

SEQ ID NO: 38780 - RNA, 20 nt, Artificial Sequence
  CIITA targeting sequence
ccauguuggccaggcaggua

SEQ ID NO: 38781 - RNA, 20 nt, Artificial Sequence
  CIITA targeting sequence
cuaccaaaaaauacaaaaau

SEQ ID NO: 38782 - RNA, 20 nt, Artificial Sequence
  CIITA targeting sequence
accaaaaaauacaaaaauua

SEQ ID NO: 38783 - RNA, 20 nt, Artificial Sequence
  CIITA targeting sequence
cagcuacucgggaggcugag

SEQ ID NO: 38784 - RNA, 20 nt, Artificial Sequence
  CIITA targeting sequence
ggaggcugaggcaggagaau

SEQ ID NO: 38785 - RNA, 20 nt, Artificial Sequence
  CIITA targeting sequence
cgaguagcugggauuacagg

SEQ ID NO: 38786 - RNA, 20 nt, Artificial Sequence
  CIITA targeting sequence
gccucccgaguagcugggau

SEQ ID NO: 38787 - RNA, 20 nt, Artificial Sequence
  CIITA targeting sequence
ugccucagccucccgaguag

SEQ ID NO: 38788 - RNA, 20 nt, Artificial Sequence
  CIITA targeting sequence
ccugccucagccucccgagu

SEQ ID NO: 38789 - RNA, 20 nt, Artificial Sequence
  CIITA targeting sequence
cuugaacccaggagguggag

SEQ ID NO: 38790 - RNA, 20 nt, Artificial Sequence
  CIITA targeting sequence
agcgauucuccugccucagc

SEQ ID NO: 38791 - RNA, 20 nt, Artificial Sequence
  CIITA targeting sequence
uggguucaagcgauucuccu

SEQ ID NO: 38792 - RNA, 20 nt, Artificial Sequence
  CIITA targeting sequence
accuccuggguucaagcgau

SEQ ID NO: 38793 - RNA, 20 nt, Artificial Sequence
  CIITA targeting sequence
cugcaaccuccaccuccugg

SEQ ID NO: 38794 - RNA, 20 nt, Artificial Sequence
  CIITA targeting sequence
uagcucacugcaaccuccac

SEQ ID NO: 38795 - RNA, 20 nt, Artificial Sequence
  CIITA targeting sequence
cgccacugcacuccagccug

SEQ ID NO: 38796 - RNA, 20 nt, Artificial Sequence
  CIITA targeting sequence
agccuggguggcagaguaag

SEQ ID NO: 38797 - RNA, 20 nt, Artificial Sequence
  CIITA targeting sequence
gccacccaggcuggagugca

SEQ ID NO: 38798 - RNA, 20 nt, Artificial Sequence
  CIITA targeting sequence
uacucugccacccaggcugg

SEQ ID NO: 38799 - RNA, 20 nt, Artificial Sequence
  CIITA targeting sequence
gucucaaacaacaacaacca

SEQ ID NO: 38800 - RNA, 20 nt, Artificial Sequence
  CIITA targeting sequence
caaacaacaacaaccaaaag

SEQ ID NO: 38801 - RNA, 20 nt, Artificial Sequence
  CIITA targeting sequence
aacaacaacaaccaaaagaa

SEQ ID NO: 38802 - RNA, 20 nt, Artificial Sequence
  CIITA targeting sequence
uuugguuguuguuguuugag

SEQ ID NO: 38803 - RNA, 20 nt, Artificial Sequence
  CIITA targeting sequence
gugaaaaaaaaaucucccuc

SEQ ID NO: 38804 - RNA, 20 nt, Artificial Sequence
  CIITA targeting sequence
cugaauauucuuuugguugu

SEQ ID NO: 38805 - RNA, 20 nt, Artificial Sequence
  CIITA targeting sequence
cccucccacuccuguucugu

SEQ ID NO: 38806 - RNA, 20 nt, Artificial Sequence
  CIITA targeting sequence
cucccacuccuguucuguag

SEQ ID NO: 38807 - RNA, 20 nt, Artificial Sequence
  CIITA targeting sequence
cacuccuguucuguaguccc

SEQ ID NO: 38808 - RNA, 20 nt, Artificial Sequence
  CIITA targeting sequence
uguucuguagucccucaguu

SEQ ID NO: 38809 - RNA, 20 nt, Artificial Sequence
  CIITA targeting sequence
guagucccucaguuuugcuc

SEQ ID NO: 38810 - RNA, 20 nt, Artificial Sequence
  CIITA targeting sequence
cucaguuuugcuccuaucuu

SEQ ID NO: 38811 - RNA, 20 nt, Artificial Sequence
  CIITA targeting sequence
guuuugcuccuaucuuaguc

SEQ ID NO: 38812 - RNA, 20 nt, Artificial Sequence
  CIITA targeting sequence
uaucuuagucaaccuaugug

SEQ ID NO: 38813 - RNA, 20 nt, Artificial Sequence
  CIITA targeting sequence
uagucaaccuaugugaccag

SEQ ID NO: 38814 - RNA, 20 nt, Artificial Sequence
  CIITA targeting sequence
accuaugugaccagcuuccu

SEQ ID NO: 38815 - RNA, 20 nt, Artificial Sequence
  CIITA targeting sequence
cauagguugacuaagauagg

SEQ ID NO: 38816 - RNA, 20 nt, Artificial Sequence
  CIITA targeting sequence
uuuuugccuugucagaaaua

SEQ ID NO: 38817 - RNA, 20 nt, Artificial Sequence
  CIITA targeting sequence
gaaauaaagcgagcuccugu

SEQ ID NO: 38818 - RNA, 20 nt, Artificial Sequence
  CIITA targeting sequence
gacaaggcaaaaaggaagcu

SEQ ID NO: 38819 - RNA, 20 nt, Artificial Sequence
  CIITA targeting sequence
cuuuauuucugacaaggcaa

SEQ ID NO: 38820 - RNA, 20 nt, Artificial Sequence
  CIITA targeting sequence
uguauuugcuuuaauuuucc

SEQ ID NO: 38821 - RNA, 20 nt, Artificial Sequence
  CIITA targeting sequence
augcaaaugaccacauuuua

SEQ ID NO: 38822 - RNA, 20 nt, Artificial Sequence
  CIITA targeting sequence
uuugcauggaaaauuaaagc

SEQ ID NO: 38823 - RNA, 20 nt, Artificial Sequence
  CIITA targeting sequence
gcauuuugcuuucuucauuu

SEQ ID NO: 38824 - RNA, 20 nt, Artificial Sequence
  CIITA targeting sequence
ucauuuacuucauuacuccc

SEQ ID NO: 38825 - RNA, 20 nt, Artificial Sequence
  CIITA targeting sequence
uuuacuucauuacucccugu

SEQ ID NO: 38826 - RNA, 20 nt, Artificial Sequence
  CIITA targeting sequence
uuacucccugucugggaggu

SEQ ID NO: 38827 - RNA, 20 nt, Artificial Sequence
  CIITA targeting sequence
cugucugggaggucacguuc

SEQ ID NO: 38828 - RNA, 20 nt, Artificial Sequence
  CIITA targeting sequence
gggaggucacguuccauauu

SEQ ID NO: 38829 - RNA, 20 nt, Artificial Sequence
  CIITA targeting sequence
cagacagggaguaaugaagu

SEQ ID NO: 38830 - RNA, 20 nt, Artificial Sequence
  CIITA targeting sequence
cguuccauauuauugaggga

SEQ ID NO: 38831 - RNA, 20 nt, Artificial Sequence
  CIITA targeting sequence
auauuauugagggagaggac

SEQ ID NO: 38832 - RNA, 20 nt, Artificial Sequence
  CIITA targeting sequence
auaauauggaacgugaccuc

SEQ ID NO: 38833 - RNA, 20 nt, Artificial Sequence
  CIITA targeting sequence
cucaauaauauggaacguga

SEQ ID NO: 38834 - RNA, 20 nt, Artificial Sequence
  CIITA targeting sequence
cccucaauaauauggaacgu

SEQ ID NO: 38835 - RNA, 20 nt, Artificial Sequence
  CIITA targeting sequence
ucucccucaauaauauggaa

SEQ ID NO: 38836 - RNA, 20 nt, Artificial Sequence
  CIITA targeting sequence
uaucuucagcagcuucuuua

SEQ ID NO: 38837 - RNA, 20 nt, Artificial Sequence
  CIITA targeting sequence
ucagcagcuucuuuauuuuc

SEQ ID NO: 38838 - RNA, 20 nt, Artificial Sequence
  CIITA targeting sequence
gcagcuucuuuauuuucuuu

SEQ ID NO: 38839 - RNA, 20 nt, Artificial Sequence
  CIITA targeting sequence
uuauuuucuuucuuuucuug

SEQ ID NO: 38840 - RNA, 20 nt, Artificial Sequence
  CIITA targeting sequence
uucuuuucuuguuuuucuuc

SEQ ID NO: 38841 - RNA, 20 nt, Artificial Sequence
  CIITA targeting sequence
uuucuuguuuuucuucuuua

SEQ ID NO: 38842 - RNA, 20 nt, Artificial Sequence
  CIITA targeting sequence
uguuuuucuucuuuauguuu

SEQ ID NO: 38843 - RNA, 20 nt, Artificial Sequence
  CIITA targeting sequence
ucuuuauguuuucauuugau

SEQ ID NO: 38844 - RNA, 20 nt, Artificial Sequence
  CIITA targeting sequence
uuauguuuucauuugauaaa

SEQ ID NO: 38845 - RNA, 20 nt, Artificial Sequence
  CIITA targeting sequence
uuugauaaauauuucccccc

SEQ ID NO: 38846 - RNA, 20 nt, Artificial Sequence
  CIITA targeting sequence
aaugaaaacauaaagaagaa

SEQ ID NO: 38847 - RNA, 20 nt, Artificial Sequence
  CIITA targeting sequence
ccccaagauuuuauugugaa

SEQ ID NO: 38848 - RNA, 20 nt, Artificial Sequence
  CIITA targeting sequence
uggggggaaauauuuaucaa

SEQ ID NO: 38849 - RNA, 20 nt, Artificial Sequence
  CIITA targeting sequence
caauaaaaucuuggggggaa

SEQ ID NO: 38850 - RNA, 20 nt, Artificial Sequence
  CIITA targeting sequence
gccaggcgugguggcucaca

SEQ ID NO: 38851 - RNA, 20 nt, Artificial Sequence
  CIITA targeting sequence
caucuguaaucccagcacuu

SEQ ID NO: 38852 - RNA, 20 nt, Artificial Sequence
  CIITA targeting sequence
guaaucccagcacuuuggga

SEQ ID NO: 38853 - RNA, 20 nt, Artificial Sequence
  CIITA targeting sequence
cagcacuuugggaggccaag

SEQ ID NO: 38854 - RNA, 20 nt, Artificial Sequence
  CIITA targeting sequence
caaagugcugggauuacaga

SEQ ID NO: 38855 - RNA, 20 nt, Artificial Sequence
  CIITA targeting sequence
gccagccuuggccucccaaa

SEQ ID NO: 38856 - RNA, 20 nt, Artificial Sequence
  CIITA targeting sequence
ccugaggucaagaguuugag

SEQ ID NO: 38857 - RNA, 20 nt, Artificial Sequence
  CIITA targeting sequence
ggugaucugccagccuuggc

SEQ ID NO: 38858 - RNA, 20 nt, Artificial Sequence
  CIITA targeting sequence
agaguuugagaccagccugg

SEQ ID NO: 38859 - RNA, 20 nt, Artificial Sequence
  CIITA targeting sequence
ugaccucaggugaucugcca

SEQ ID NO: 38860 - RNA, 20 nt, Artificial Sequence
  CIITA targeting sequence
aacucuugaccucaggugau

SEQ ID NO: 38861 - RNA, 20 nt, Artificial Sequence
  CIITA targeting sequence
caaacucuugaccucaggug

SEQ ID NO: 38862 - RNA, 20 nt, Artificial Sequence
  CIITA targeting sequence
ccauguuggccaggcugguc

SEQ ID NO: 38863 - RNA, 20 nt, Artificial Sequence
  CIITA targeting sequence
cuacuaaaaauacaaaaauu

SEQ ID NO: 38864 - RNA, 20 nt, Artificial Sequence
  CIITA targeting sequence
acuaaaaauacaaaaauuag

SEQ ID NO: 38865 - RNA, 20 nt, Artificial Sequence
  CIITA targeting sequence
ccaccacgccuggcuaauuu

SEQ ID NO: 38866 - RNA, 20 nt, Artificial Sequence
  CIITA targeting sequence
cagcuaccagggaggcuagg

SEQ ID NO: 38867 - RNA, 20 nt, Artificial Sequence
  CIITA targeting sequence
cugguagcugggauuacagg

SEQ ID NO: 38868 - RNA, 20 nt, Artificial Sequence
  CIITA targeting sequence
cacccuagccucccugguag

SEQ ID NO: 38869 - RNA, 20 nt, Artificial Sequence
  CIITA targeting sequence
cccacccuagccucccuggu

SEQ ID NO: 38870 - RNA, 20 nt, Artificial Sequence
  CIITA targeting sequence
cuugaaccuaagaagcagag

SEQ ID NO: 38871 - RNA, 20 nt, Artificial Sequence
  CIITA targeting sequence
agcgauucucccacccuagc

SEQ ID NO: 38872 - RNA, 20 nt, Artificial Sequence
  CIITA targeting sequence
uagguucaagcgauucuccc

SEQ ID NO: 38873 - RNA, 20 nt, Artificial Sequence
  CIITA targeting sequence
gcuucuuagguucaagcgau

SEQ ID NO: 38874 - RNA, 20 nt, Artificial Sequence
  CIITA targeting sequence
cugcaaccucugcuucuuag

SEQ ID NO: 38875 - RNA, 20 nt, Artificial Sequence
  CIITA targeting sequence
uggcucacugcaaccucugc

SEQ ID NO: 38876 - RNA, 20 nt, Artificial Sequence
  CIITA targeting sequence
agccugggcaacagagcuag

SEQ ID NO: 38877 - RNA, 20 nt, Artificial Sequence
  CIITA targeting sequence
guugcccaggcuggagugca

SEQ ID NO: 38878 - RNA, 20 nt, Artificial Sequence
  CIITA targeting sequence
agcucuguugcccaggcugg

SEQ ID NO: 38879 - RNA, 20 nt, Artificial Sequence
  CIITA targeting sequence
guuucaaaaaaaaaaaaaaa

SEQ ID NO: 38880 - RNA, 20 nt, Artificial Sequence
  CIITA targeting sequence
aaaaaaaaaaaaaauguuuu

SEQ ID NO: 38881 - RNA, 20 nt, Artificial Sequence
  CIITA targeting sequence
agauacaauaaaagugaaag

SEQ ID NO: 38882 - RNA, 20 nt, Artificial Sequence
  CIITA targeting sequence
ugaaaacauuuuuuuuuuuu

SEQ ID NO: 38883 - RNA, 20 nt, Artificial Sequence
  CIITA targeting sequence
cuuuuauuguaucuugaaaa

SEQ ID NO: 38884 - RNA, 20 nt, Artificial Sequence
  CIITA targeting sequence
uucacuuuuauuguaucuug

SEQ ID NO: 38885 - RNA, 20 nt, Artificial Sequence
  CIITA targeting sequence
uaguaccauucuuucacuuu

SEQ ID NO: 38886 - RNA, 20 nt, Artificial Sequence
  CIITA targeting sequence
auauacccaccauguaccau

SEQ ID NO: 38887 - RNA, 20 nt, Artificial Sequence
  CIITA targeting sequence
aaaugguacaugguggguau

SEQ ID NO: 38888 - RNA, 20 nt, Artificial Sequence
  CIITA targeting sequence
acaauuaauguuggguuuua

SEQ ID NO: 38889 - RNA, 20 nt, Artificial Sequence
  CIITA targeting sequence
ucuuaucacaucucuauuca

SEQ ID NO: 38890 - RNA, 20 nt, Artificial Sequence
  CIITA targeting sequence
uaucacaucucuauucaucu

SEQ ID NO: 38891 - RNA, 20 nt, Artificial Sequence
  CIITA targeting sequence
caucucuauucaucugucca

SEQ ID NO: 38892 - RNA, 20 nt, Artificial Sequence
  CIITA targeting sequence
cuauucaucuguccaucccu

SEQ ID NO: 38893 - RNA, 20 nt, Artificial Sequence
  CIITA targeting sequence
auucaucuguccaucccucu

SEQ ID NO: 38894 - RNA, 20 nt, Artificial Sequence
  CIITA targeting sequence
ucuguccaucccucuaucca

SEQ ID NO: 38895 - RNA, 20 nt, Artificial Sequence
  CIITA targeting sequence
guccaucccucuauccaucc

SEQ ID NO: 38896 - RNA, 20 nt, Artificial Sequence
  CIITA targeting sequence
aucccucuauccauccacac

SEQ ID NO: 38897 - RNA, 20 nt, Artificial Sequence
  CIITA targeting sequence
cucuauccauccacacaccc

SEQ ID NO: 38898 - RNA, 20 nt, Artificial Sequence
  CIITA targeting sequence
auccauccacacacccauuc

SEQ ID NO: 38899 - RNA, 20 nt, Artificial Sequence
  CIITA targeting sequence
auccacacacccauucauua

SEQ ID NO: 38900 - RNA, 20 nt, Artificial Sequence
  CIITA targeting sequence
acacacccauucauuauauu

SEQ ID NO: 38901 - RNA, 20 nt, Artificial Sequence
  CIITA targeting sequence
uuauauuuuugguacauuuc

SEQ ID NO: 38902 - RNA, 20 nt, Artificial Sequence
  CIITA targeting sequence
auguacauuucaaauguaaa

SEQ ID NO: 38903 - RNA, 20 nt, Artificial Sequence
  CIITA targeting sequence
aauguaaauugcagauuuac

SEQ ID NO: 38904 - RNA, 20 nt, Artificial Sequence
  CIITA targeting sequence
gcaauuuacauuugaaaugu

SEQ ID NO: 38905 - RNA, 20 nt, Artificial Sequence
  CIITA targeting sequence
ccucguguacuucagcaucc

SEQ ID NO: 38906 - RNA, 20 nt, Artificial Sequence
  CIITA targeting sequence
uguacuucagcauccuuucu

SEQ ID NO: 38907 - RNA, 20 nt, Artificial Sequence
  CIITA targeting sequence
gcauccuuucuuuuaaggcc

SEQ ID NO: 38908 - RNA, 20 nt, Artificial Sequence
  CIITA targeting sequence
uuucuuuuaaggccaugcag

SEQ ID NO: 38909 - RNA, 20 nt, Artificial Sequence
  CIITA targeting sequence
uuuaaggccaugcaguguuu

SEQ ID NO: 38910 - RNA, 20 nt, Artificial Sequence
  CIITA targeting sequence
uuggguagaugaaccauaau

SEQ ID NO: 38911 - RNA, 20 nt, Artificial Sequence
  CIITA targeting sequence
acccaacgaaacacugcaug

SEQ ID NO: 38912 - RNA, 20 nt, Artificial Sequence
  CIITA targeting sequence
ucuacccaacgaaacacugc

SEQ ID NO: 38913 - RNA, 20 nt, Artificial Sequence
  CIITA targeting sequence
cuugcuaagggacacguggg

SEQ ID NO: 38914 - RNA, 20 nt, Artificial Sequence
  CIITA targeting sequence
cuuagcaagggacugcuuaa

SEQ ID NO: 38915 - RNA, 20 nt, Artificial Sequence
  CIITA targeting sequence
guugcugugagugcuugaua

SEQ ID NO: 38916 - RNA, 20 nt, Artificial Sequence
  CIITA targeting sequence
cagcaacagauuaaaaaccc

SEQ ID NO: 38917 - RNA, 20 nt, Artificial Sequence
  CIITA targeting sequence
agcacucacagcaacagauu

SEQ ID NO: 38918 - RNA, 20 nt, Artificial Sequence
  CIITA targeting sequence
cucacugauuucuggcauac

SEQ ID NO: 38919 - RNA, 20 nt, Artificial Sequence
  CIITA targeting sequence
cugauuucuggcauacuccu

SEQ ID NO: 38920 - RNA, 20 nt, Artificial Sequence
  CIITA targeting sequence
gugagugaguaucaagcacu

SEQ ID NO: 38921 - RNA, 20 nt, Artificial Sequence
  CIITA targeting sequence
ggcauacuccugcaauguag

SEQ ID NO: 38922 - RNA, 20 nt, Artificial Sequence
  CIITA targeting sequence
ugcaauguaggaaccaccac

SEQ ID NO: 38923 - RNA, 20 nt, Artificial Sequence
  CIITA targeting sequence
uacauugcaggaguaugcca

SEQ ID NO: 38924 - RNA, 20 nt, Artificial Sequence
  CIITA targeting sequence
uagaugugagaucaaagguu

SEQ ID NO: 38925 - RNA, 20 nt, Artificial Sequence
  CIITA targeting sequence
augaaauggggguggugguu

SEQ ID NO: 38926 - RNA, 20 nt, Artificial Sequence
  CIITA targeting sequence
caucuaugaaaugggggugg

SEQ ID NO: 38927 - RNA, 20 nt, Artificial Sequence
  CIITA targeting sequence
cacaucuaugaaaugggggu

SEQ ID NO: 38928 - RNA, 20 nt, Artificial Sequence
  CIITA targeting sequence
aagguucagagaagcugcau

SEQ ID NO: 38929 - RNA, 20 nt, Artificial Sequence
  CIITA targeting sequence
gagaagcugcauugcaaagg

SEQ ID NO: 38930 - RNA, 20 nt, Artificial Sequence
  CIITA targeting sequence
gaaccuuugaucucacaucu

SEQ ID NO: 38931 - RNA, 20 nt, Artificial Sequence
  CIITA targeting sequence
cugaaccuuugaucucacau

SEQ ID NO: 38932 - RNA, 20 nt, Artificial Sequence
  CIITA targeting sequence
uagcugugugccuuugcaau

SEQ ID NO: 38933 - RNA, 20 nt, Artificial Sequence
  CIITA targeting sequence
aaagcagguuccuuuguuuu

SEQ ID NO: 38934 - RNA, 20 nt, Artificial Sequence
  CIITA targeting sequence
uuuguuuuguuuuguuuugu

SEQ ID NO: 38935 - RNA, 20 nt, Artificial Sequence
  CIITA targeting sequence
aacccauguuguguccccau

SEQ ID NO: 38936 - RNA, 20 nt, Artificial Sequence
  CIITA targeting sequence
ccauuugugacucggccucu

SEQ ID NO: 38937 - RNA, 20 nt, Artificial Sequence
  CIITA targeting sequence
caaauggggacacaacaugg

SEQ ID NO: 38938 - RNA, 20 nt, Artificial Sequence
  CIITA targeting sequence
gccucuucugcugcuacacu

SEQ ID NO: 38939 - RNA, 20 nt, Artificial Sequence
  CIITA targeting sequence
ucugcugcuacacugccugg

SEQ ID NO: 38940 - RNA, 20 nt, Artificial Sequence
  CIITA targeting sequence
gcugcuacacugccugguau

SEQ ID NO: 38941 - RNA, 20 nt, Artificial Sequence
  CIITA targeting sequence
aaccauaccaggcaguguag

SEQ ID NO: 38942 - RNA, 20 nt, Artificial Sequence
  CIITA targeting sequence
caaaccauaccaggcagugu

SEQ ID NO: 38943 - RNA, 20 nt, Artificial Sequence
  CIITA targeting sequence
agccaaggagcugggguugg

SEQ ID NO: 38944 - RNA, 20 nt, Artificial Sequence
  CIITA targeting sequence
uuggcuugaacccaaacccc

SEQ ID NO: 38945 - RNA, 20 nt, Artificial Sequence
  CIITA targeting sequence
aaccccagcuccuuggcuug

SEQ ID NO: 38946 - RNA, 20 nt, Artificial Sequence
  CIITA targeting sequence
aacauuccaaccccagcucc

SEQ ID NO: 38947 - RNA, 20 nt, Artificial Sequence
  CIITA targeting sequence
cucuaacauuccaaccccag

SEQ ID NO: 38948 - RNA, 20 nt, Artificial Sequence
  CIITA targeting sequence
ccucgcucuaacauuccaac

SEQ ID NO: 38949 - RNA, 20 nt, Artificial Sequence
  CIITA targeting sequence
uccccucgcucuaacauucc

SEQ ID NO: 38950 - RNA, 20 nt, Artificial Sequence
  CIITA targeting sequence
auuuuccuccccucgcucua

SEQ ID NO: 38951 - RNA, 20 nt, Artificial Sequence
  CIITA targeting sequence
uggggguccauuuuccuccc

SEQ ID NO: 38952 - RNA, 20 nt, Artificial Sequence
  CIITA targeting sequence
aggcuggguaguggucuugg

SEQ ID NO: 38953 - RNA, 20 nt, Artificial Sequence
  CIITA targeting sequence
agcaggcuauacggccuuaa

SEQ ID NO: 38954 - RNA, 20 nt, Artificial Sequence
  CIITA targeting sequence
ugagccccuucuggcuuggg

SEQ ID NO: 38955 - RNA, 20 nt, Artificial Sequence
  CIITA targeting sequence
ggacucuagcaggcuauacg

SEQ ID NO: 38956 - RNA, 20 nt, Artificial Sequence
  CIITA targeting sequence
ggcuugggacauccucuccc

SEQ ID NO: 38957 - RNA, 20 nt, Artificial Sequence
  CIITA targeting sequence
caagccagaaggggcucagg

SEQ ID NO: 38958 - RNA, 20 nt, Artificial Sequence
  CIITA targeting sequence
ucucccuggggcagcugauc

SEQ ID NO: 38959 - RNA, 20 nt, Artificial Sequence
  CIITA targeting sequence
cccuggggcagcugaucaca

SEQ ID NO: 38960 - RNA, 20 nt, Artificial Sequence
  CIITA targeting sequence
cuggggcagcugaucacaug

SEQ ID NO: 38961 - RNA, 20 nt, Artificial Sequence
  CIITA targeting sequence
gcugccccagggagaggaug

SEQ ID NO: 38962 - RNA, 20 nt, Artificial Sequence
  CIITA targeting sequence
cauguuuucucugcagccuu

SEQ ID NO: 38963 - RNA, 20 nt, Artificial Sequence
  CIITA targeting sequence
cugcagccuucccagaggag

SEQ ID NO: 38964 - RNA, 20 nt, Artificial Sequence
  CIITA targeting sequence
gcagccuucccagaggagcu

SEQ ID NO: 38965 - RNA, 20 nt, Artificial Sequence
  CIITA targeting sequence
cagaggagcuuccggcagac

SEQ ID NO: 38966 - RNA, 20 nt, Artificial Sequence
  CIITA targeting sequence
gggaaggcugcagagaaaac

SEQ ID NO: 38967 - RNA, 20 nt, Artificial Sequence
  CIITA targeting sequence
ucugggaaggcugcagagaa

SEQ ID NO: 38968 - RNA, 20 nt, Artificial Sequence
  CIITA targeting sequence
ggcagaccugaagcacugga

SEQ ID NO: 38969 - RNA, 20 nt, Artificial Sequence
  CIITA targeting sequence
gccggaagcuccucugggaa

SEQ ID NO: 38970 - RNA, 20 nt, Artificial Sequence
  CIITA targeting sequence
ggucugccggaagcuccucu

SEQ ID NO: 38971 - RNA, 20 nt, Artificial Sequence
  CIITA targeting sequence
agugcuucaggucugccgga

SEQ ID NO: 38972 - RNA, 20 nt, Artificial Sequence
  CIITA targeting sequence
caaccccagcccaccugccc

SEQ ID NO: 38973 - RNA, 20 nt, Artificial Sequence
  CIITA targeting sequence
acccuucccaaccccagccc

SEQ ID NO: 38974 - RNA, 20 nt, Artificial Sequence
  CIITA targeting sequence
ccaaggcauccacccuuccc

SEQ ID NO: 38975 - RNA, 20 nt, Artificial Sequence
  CIITA targeting sequence
ccuccccaaggcauccaccc

SEQ ID NO: 38976 - RNA, 20 nt, Artificial Sequence
  CIITA targeting sequence
auccccuccccaaggcaucc

SEQ ID NO: 38977 - RNA, 20 nt, Artificial Sequence
  CIITA targeting sequence
uccauccccuccccaaggca

SEQ ID NO: 38978 - RNA, 20 nt, Artificial Sequence
  CIITA targeting sequence
cuuccauccccuccccaagg

SEQ ID NO: 38979 - RNA, 20 nt, Artificial Sequence
  CIITA targeting sequence
aucucuuccauccccucccc

SEQ ID NO: 38980 - RNA, 20 nt, Artificial Sequence
  CIITA targeting sequence
uggcccaagucugaugggga

SEQ ID NO: 38981 - RNA, 20 nt, Artificial Sequence
  CIITA targeting sequence
gauggggauggugcauggug

SEQ ID NO: 38982 - RNA, 20 nt, Artificial Sequence
  CIITA targeting sequence
gacuugggccaggaguucaa

SEQ ID NO: 38983 - RNA, 20 nt, Artificial Sequence
  CIITA targeting sequence
ccaucagacuugggccagga

SEQ ID NO: 38984 - RNA, 20 nt, Artificial Sequence
  CIITA targeting sequence
uuggguagaggcugagagcu

SEQ ID NO: 38985 - RNA, 20 nt, Artificial Sequence
  CIITA targeting sequence
acccaaagaagggcaggggc

SEQ ID NO: 38986 - RNA, 20 nt, Artificial Sequence
  CIITA targeting sequence
gccucuacccaaagaagggc

SEQ ID NO: 38987 - RNA, 20 nt, Artificial Sequence
  CIITA targeting sequence
cagccucuacccaaagaagg

SEQ ID NO: 38988 - RNA, 20 nt, Artificial Sequence
  CIITA targeting sequence
cuuagaguccucuaaggggc

SEQ ID NO: 38989 - RNA, 20 nt, Artificial Sequence
  CIITA targeting sequence
aagggaccccaagcucucag

SEQ ID NO: 38990 - RNA, 20 nt, Artificial Sequence
  CIITA targeting sequence
ucuaaggggcucacgacugu

SEQ ID NO: 38991 - RNA, 20 nt, Artificial Sequence
  CIITA targeting sequence
aaggggcucacgacuguuug

SEQ ID NO: 38992 - RNA, 20 nt, Artificial Sequence
  CIITA targeting sequence
cgacuguuuguggaaggugg

SEQ ID NO: 38993 - RNA, 20 nt, Artificial Sequence
  CIITA targeting sequence
ugagccccuuagaggacucu

SEQ ID NO: 38994 - RNA, 20 nt, Artificial Sequence
  CIITA targeting sequence
acaaacagucgugagccccu

SEQ ID NO: 38995 - RNA, 20 nt, Artificial Sequence
  CIITA targeting sequence
aagccccuaccaccuuccac

SEQ ID NO: 38996 - RNA, 20 nt, Artificial Sequence
  CIITA targeting sequence
guuagcuccaagccccuacc

SEQ ID NO: 38997 - RNA, 20 nt, Artificial Sequence
  CIITA targeting sequence
uagguucuauucugccccag

SEQ ID NO: 38998 - RNA, 20 nt, Artificial Sequence
  CIITA targeting sequence
auucugccccagcucuccgu

SEQ ID NO: 38999 - RNA, 20 nt, Artificial Sequence
  CIITA targeting sequence
gccccagcucuccgugugga

SEQ ID NO: 39000 - RNA, 20 nt, Artificial Sequence
  CIITA targeting sequence
ccguguggaggcccuagggu

SEQ ID NO: 39001 - RNA, 20 nt, Artificial Sequence
  CIITA targeting sequence
guguggaggcccuagggucc

SEQ ID NO: 39002 - RNA, 20 nt, Artificial Sequence
  CIITA targeting sequence
acacggagagcuggggcaga

SEQ ID NO: 39003 - RNA, 20 nt, Artificial Sequence
  CIITA targeting sequence
ugcucagcauagcucucaga

SEQ ID NO: 39004 - RNA, 20 nt, Artificial Sequence
  CIITA targeting sequence
gcauagcucucagagccaag

SEQ ID NO: 39005 - RNA, 20 nt, Artificial Sequence
  CIITA targeting sequence
cagagccaagucacaaggag

SEQ ID NO: 39006 - RNA, 20 nt, Artificial Sequence
  CIITA targeting sequence
gagccaagucacaaggagag

SEQ ID NO: 39007 - RNA, 20 nt, Artificial Sequence
  CIITA targeting sequence
gagagcuaugcugagcagga

SEQ ID NO: 39008 - RNA, 20 nt, Artificial Sequence
  CIITA targeting sequence
caaggagaggacugggggac

SEQ ID NO: 39009 - RNA, 20 nt, Artificial Sequence
  CIITA targeting sequence
uugugacuuggcucugagag

SEQ ID NO: 39010 - RNA, 20 nt, Artificial Sequence
  CIITA targeting sequence
ccuugugacuuggcucugag

SEQ ID NO: 39011 - RNA, 20 nt, Artificial Sequence
  CIITA targeting sequence
ucuccuugugacuuggcucu

SEQ ID NO: 39012 - RNA, 20 nt, Artificial Sequence
  CIITA targeting sequence
cccaguccucuccuugugac

SEQ ID NO: 39013 - RNA, 20 nt, Artificial Sequence
  CIITA targeting sequence
gugccaggcagucccccagu

SEQ ID NO: 39014 - RNA, 20 nt, Artificial Sequence
  CIITA targeting sequence
gcaacugcucugugccaggc

SEQ ID NO: 39015 - RNA, 20 nt, Artificial Sequence
  CIITA targeting sequence
acacagcugcagccagggcu

SEQ ID NO: 39016 - RNA, 20 nt, Artificial Sequence
  CIITA targeting sequence
gcccuggcugcagcuguguu

SEQ ID NO: 39017 - RNA, 20 nt, Artificial Sequence
  CIITA targeting sequence
cagcccuggcugcagcugug

SEQ ID NO: 39018 - RNA, 20 nt, Artificial Sequence
  CIITA targeting sequence
ucucagcccuggcugcagcu

SEQ ID NO: 39019 - RNA, 20 nt, Artificial Sequence
  CIITA targeting sequence
ucuucucagcccuggcugca

SEQ ID NO: 39020 - RNA, 20 nt, Artificial Sequence
  CIITA targeting sequence
ucugucaggagagacaucca

SEQ ID NO: 39021 - RNA, 20 nt, Artificial Sequence
  CIITA targeting sequence
gucaggagagacauccaugc

SEQ ID NO: 39022 - RNA, 20 nt, Artificial Sequence
  CIITA targeting sequence
ggagagacauccaugccacu

SEQ ID NO: 39023 - RNA, 20 nt, Artificial Sequence
  CIITA targeting sequence
ugacagaggaaaugcuuguc

SEQ ID NO: 39024 - RNA, 20 nt, Artificial Sequence
  CIITA targeting sequence
ccugacagaggaaaugcuug

SEQ ID NO: 39025 - RNA, 20 nt, Artificial Sequence
  CIITA targeting sequence
cuccugacagaggaaaugcu

SEQ ID NO: 39026 - RNA, 20 nt, Artificial Sequence
  CIITA targeting sequence
augccacuccagggcccucc

SEQ ID NO: 39027 - RNA, 20 nt, Artificial Sequence
  CIITA targeting sequence
agggcccuccccaucccagg

SEQ ID NO: 39028 - RNA, 20 nt, Artificial Sequence
  CIITA targeting sequence
ccaucccaggaaggccccuc

SEQ ID NO: 39029 - RNA, 20 nt, Artificial Sequence
  CIITA targeting sequence
caggaaggccccuccaagca

SEQ ID NO: 39030 - RNA, 20 nt, Artificial Sequence
  CIITA targeting sequence
ugggauggggagggcccugg

SEQ ID NO: 39031 - RNA, 20 nt, Artificial Sequence
  CIITA targeting sequence
aagcacccagucucuaacac

SEQ ID NO: 39032 - RNA, 20 nt, Artificial Sequence
  CIITA targeting sequence
cuaacacagcccacuuccuc

SEQ ID NO: 39033 - RNA, 20 nt, Artificial Sequence
  CIITA targeting sequence
aacacagcccacuuccucac

SEQ ID NO: 39034 - RNA, 20 nt, Artificial Sequence
  CIITA targeting sequence
ucacagcugagccccccacu

SEQ ID NO: 39035 - RNA, 20 nt, Artificial Sequence
  CIITA targeting sequence
cagcugagccccccacugug

SEQ ID NO: 39036 - RNA, 20 nt, Artificial Sequence
  CIITA targeting sequence
gcugugaggaagugggcugu

SEQ ID NO: 39037 - RNA, 20 nt, Artificial Sequence
  CIITA targeting sequence
ccacaguggggggcucagcu

SEQ ID NO: 39038 - RNA, 20 nt, Artificial Sequence
  CIITA targeting sequence
ccuagugggaccagugagcg

SEQ ID NO: 39039 - RNA, 20 nt, Artificial Sequence
  CIITA targeting sequence
uagugggaccagugagcgac

SEQ ID NO: 39040 - RNA, 20 nt, Artificial Sequence
  CIITA targeting sequence
cacuaggagacugccaguca

SEQ ID NO: 39041 - RNA, 20 nt, Artificial Sequence
  CIITA targeting sequence
cuggucccacuaggagacug

SEQ ID NO: 39042 - RNA, 20 nt, Artificial Sequence
  CIITA targeting sequence
cucacuggucccacuaggag

SEQ ID NO: 39043 - RNA, 20 nt, Artificial Sequence
  CIITA targeting sequence
acccugcccugccugccacu

SEQ ID NO: 39044 - RNA, 20 nt, Artificial Sequence
  CIITA targeting sequence
accaggagccagccuccggc

SEQ ID NO: 39045 - RNA, 20 nt, Artificial Sequence
  CIITA targeting sequence
ugguugaacagcgcaggcag

SEQ ID NO: 39046 - RNA, 20 nt, Artificial Sequence
  CIITA targeting sequence
ggccagaugcgccuggagaa

SEQ ID NO: 39047 - RNA, 20 nt, Artificial Sequence
  CIITA targeting sequence
ggccggaggcuggcuccugg

SEQ ID NO: 39048 - RNA, 20 nt, Artificial Sequence
  CIITA targeting sequence
aggcgcaucuggccggaggc

SEQ ID NO: 39049 - RNA, 20 nt, Artificial Sequence
  CIITA targeting sequence
ccaggcgcaucuggccggag

SEQ ID NO: 39050 - RNA, 20 nt, Artificial Sequence
  CIITA targeting sequence
guuuucuccaggcgcaucug

SEQ ID NO: 39051 - RNA, 20 nt, Artificial Sequence
  CIITA targeting sequence
ggucgguuuucuccaggcgc

SEQ ID NO: 39052 - RNA, 20 nt, Artificial Sequence
  CIITA targeting sequence
caguauguuagggggcuugg

SEQ ID NO: 39053 - RNA, 20 nt, Artificial Sequence
  CIITA targeting sequence
aagcccccuaacauacuggg

SEQ ID NO: 39054 - RNA, 20 nt, Artificial Sequence
  CIITA targeting sequence
ccaagcccccuaacauacug

SEQ ID NO: 39055 - RNA, 20 nt, Artificial Sequence
  CIITA targeting sequence
cuccaagcccccuaacauac

SEQ ID NO: 39056 - RNA, 20 nt, Artificial Sequence
  CIITA targeting sequence
cccucuugggagguggauaa

SEQ ID NO: 39057 - RNA, 20 nt, Artificial Sequence
  CIITA targeting sequence
cucuugggagguggauaagg

SEQ ID NO: 39058 - RNA, 20 nt, Artificial Sequence
  CIITA targeting sequence
ugggagguggauaaggaguu

SEQ ID NO: 39059 - RNA, 20 nt, Artificial Sequence
  CIITA targeting sequence
caagagggagaaagcccacu

SEQ ID NO: 39060 - RNA, 20 nt, Artificial Sequence
  CIITA targeting sequence
accucccaagagggagaaag

SEQ ID NO: 39061 - RNA, 20 nt, Artificial Sequence
  CIITA targeting sequence
uuauccaccucccaagaggg

SEQ ID NO: 39062 - RNA, 20 nt, Artificial Sequence
  CIITA targeting sequence
acuccuuauccaccucccaa

SEQ ID NO: 39063 - RNA, 20 nt, Artificial Sequence
  CIITA targeting sequence
cugccuuagugucaacuccu

SEQ ID NO: 39064 - RNA, 20 nt, Artificial Sequence
  CIITA targeting sequence
ggaacuggaccucaccucuc

SEQ ID NO: 39065 - RNA, 20 nt, Artificial Sequence
  CIITA targeting sequence
ugacagucccugccuuagug

SEQ ID NO: 39066 - RNA, 20 nt, Artificial Sequence
  CIITA targeting sequence
aguuccugacagucccugcc

SEQ ID NO: 39067 - RNA, 20 nt, Artificial Sequence
  CIITA targeting sequence
ccucuccccaacccuaucag

SEQ ID NO: 39068 - RNA, 20 nt, Artificial Sequence
  CIITA targeting sequence
ccccaacccuaucaguguca

SEQ ID NO: 39069 - RNA, 20 nt, Artificial Sequence
  CIITA targeting sequence
ccaacccuaucagugucacu

SEQ ID NO: 39070 - RNA, 20 nt, Artificial Sequence
  CIITA targeting sequence
gugucacucaccucugcccc

SEQ ID NO: 39071 - RNA, 20 nt, Artificial Sequence
  CIITA targeting sequence
cucaccucugccccagccag

SEQ ID NO: 39072 - RNA, 20 nt, Artificial Sequence
  CIITA targeting sequence
ccucugccccagccaguuuu

SEQ ID NO: 39073 - RNA, 20 nt, Artificial Sequence
  CIITA targeting sequence
gccccagccaguuuuauccu

SEQ ID NO: 39074 - RNA, 20 nt, Artificial Sequence
  CIITA targeting sequence
uuggggcccccgucagcuca

SEQ ID NO: 39075 - RNA, 20 nt, Artificial Sequence
  CIITA targeting sequence
gcucaaucccuggcagagaa

SEQ ID NO: 39076 - RNA, 20 nt, Artificial Sequence
  CIITA targeting sequence
aucccuggcagagaacaugc

SEQ ID NO: 39077 - RNA, 20 nt, Artificial Sequence
  CIITA targeting sequence
cuggcagagaacaugccuca

SEQ ID NO: 39078 - RNA, 20 nt, Artificial Sequence
  CIITA targeting sequence
gccagggauugagcugacgg

SEQ ID NO: 39079 - RNA, 20 nt, Artificial Sequence
  CIITA targeting sequence
cugccagggauugagcugac

SEQ ID NO: 39080 - RNA, 20 nt, Artificial Sequence
  CIITA targeting sequence
gaaggaaacacauccgugcg

SEQ ID NO: 39081 - RNA, 20 nt, Artificial Sequence
  CIITA targeting sequence
gaggcauguucucugccagg

SEQ ID NO: 39082 - RNA, 20 nt, Artificial Sequence
  CIITA targeting sequence
uucugaggcauguucucugc

SEQ ID NO: 39083 - RNA, 20 nt, Artificial Sequence
  CIITA targeting sequence
gugcgagcaucaggagggaa

SEQ ID NO: 39084 - RNA, 20 nt, Artificial Sequence
  CIITA targeting sequence
cacggauguguuuccuucug

SEQ ID NO: 39085 - RNA, 20 nt, Artificial Sequence
  CIITA targeting sequence
ggagggaaucuccaccaauu

SEQ ID NO: 39086 - RNA, 20 nt, Artificial Sequence
  CIITA targeting sequence
ugaugcucgcacggaugugu

SEQ ID NO: 39087 - RNA, 20 nt, Artificial Sequence
  CIITA targeting sequence
cuccugaugcucgcacggau

SEQ ID NO: 39088 - RNA, 20 nt, Artificial Sequence
  CIITA targeting sequence
ccaccaauuagagcauucac

SEQ ID NO: 39089 - RNA, 20 nt, Artificial Sequence
  CIITA targeting sequence
accaauuagagcauucaccu

SEQ ID NO: 39090 - RNA, 20 nt, Artificial Sequence
  CIITA targeting sequence
aauugguggagauucccucc

SEQ ID NO: 39091 - RNA, 20 nt, Artificial Sequence
  CIITA targeting sequence
ccugccagccuuauucguuc

SEQ ID NO: 39092 - RNA, 20 nt, Artificial Sequence
  CIITA targeting sequence
uucaucagcucuucauggag

SEQ ID NO: 39093 - RNA, 20 nt, Artificial Sequence
  CIITA targeting sequence
ucagcucuucauggagcccc

SEQ ID NO: 39094 - RNA, 20 nt, Artificial Sequence
  CIITA targeting sequence
gcucuucauggagccccuuc

SEQ ID NO: 39095 - RNA, 20 nt, Artificial Sequence
  CIITA targeting sequence
ucauggagccccuucucugu

SEQ ID NO: 39096 - RNA, 20 nt, Artificial Sequence
  CIITA targeting sequence
uggagccccuucucugugcc

SEQ ID NO: 39097 - RNA, 20 nt, Artificial Sequence
  CIITA targeting sequence
augaagagcugaugaacgaa

SEQ ID NO: 39098 - RNA, 20 nt, Artificial Sequence
  CIITA targeting sequence
cugugccaacugcucugcua

SEQ ID NO: 39099 - RNA, 20 nt, Artificial Sequence
  CIITA targeting sequence
gugccaacugcucugcuagg

SEQ ID NO: 39100 - RNA, 20 nt, Artificial Sequence
  CIITA targeting sequence
gcuaggugcuaagaauucca

SEQ ID NO: 39101 - RNA, 20 nt, Artificial Sequence
  CIITA targeting sequence
uagcaccuagcagagcaguu

SEQ ID NO: 39102 - RNA, 20 nt, Artificial Sequence
  CIITA targeting sequence
aucagggcaggacagaaaca

SEQ ID NO: 39103 - RNA, 20 nt, Artificial Sequence
  CIITA targeting sequence
gggcaggacagaaacagcua

SEQ ID NO: 39104 - RNA, 20 nt, Artificial Sequence
  CIITA targeting sequence
ugcccugauggaauucuuag

SEQ ID NO: 39105 - RNA, 20 nt, Artificial Sequence
  CIITA targeting sequence
guccugcccugauggaauuc

SEQ ID NO: 39106 - RNA, 20 nt, Artificial Sequence
  CIITA targeting sequence
uagggaaauuagggcccuuu

SEQ ID NO: 39107 - RNA, 20 nt, Artificial Sequence
  CIITA targeting sequence
cuaagagcaguagcuguuuc

SEQ ID NO: 39108 - RNA, 20 nt, Artificial Sequence
  CIITA targeting sequence
gacauuaaucaaauaagcaa

SEQ ID NO: 39109 - RNA, 20 nt, Artificial Sequence
  CIITA targeting sequence
gaccccccuaaagggcccua

SEQ ID NO: 39110 - RNA, 20 nt, Artificial Sequence
  CIITA targeting sequence
aauaagcaaaagcagaaucg

SEQ ID NO: 39111 - RNA, 20 nt, Artificial Sequence
  CIITA targeting sequence
gcuuuugcuuauuugauuaa

SEQ ID NO: 39112 - RNA, 20 nt, Artificial Sequence
  CIITA targeting sequence
caaacacaggugcuaugcaa

SEQ ID NO: 39113 - RNA, 20 nt, Artificial Sequence
  CIITA targeting sequence
ugcauagcaccuguguuugc

SEQ ID NO: 39114 - RNA, 20 nt, Artificial Sequence
  CIITA targeting sequence
caccucacugccuuugucuc

SEQ ID NO: 39115 - RNA, 20 nt, Artificial Sequence
  CIITA targeting sequence
cugccuuugucucuugcagu

SEQ ID NO: 39116 - RNA, 20 nt, Artificial Sequence
  CIITA targeting sequence
cuugcagugccuuucuccag

SEQ ID NO: 39117 - RNA, 20 nt, Artificial Sequence
  CIITA targeting sequence
ugcagugccuuucuccaguu

SEQ ID NO: 39118 - RNA, 20 nt, Artificial Sequence
  CIITA targeting sequence
ccaguuccucguugagcugc

SEQ ID NO: 39119 - RNA, 20 nt, Artificial Sequence
  CIITA targeting sequence
aguuccucguugagcugccu

SEQ ID NO: 39120 - RNA, 20 nt, Artificial Sequence
  CIITA targeting sequence
ucguugagcugccugaaucu

SEQ ID NO: 39121 - RNA, 20 nt, Artificial Sequence
  CIITA targeting sequence
uugagcugccugaaucuccc

SEQ ID NO: 39122 - RNA, 20 nt, Artificial Sequence
  CIITA targeting sequence
acgaggaacuggagaaaggc

SEQ ID NO: 39123 - RNA, 20 nt, Artificial Sequence
  CIITA targeting sequence
ggcagcucaacgaggaacug

SEQ ID NO: 39124 - RNA, 20 nt, Artificial Sequence
  CIITA targeting sequence
cccugagggacccauccagu

SEQ ID NO: 39125 - RNA, 20 nt, Artificial Sequence
  CIITA targeting sequence
cugagggacccauccaguuu

SEQ ID NO: 39126 - RNA, 20 nt, Artificial Sequence
  CIITA targeting sequence
gggagauucaggcagcucaa

SEQ ID NO: 39127 - RNA, 20 nt, Artificial Sequence
  CIITA targeting sequence
cucagggagauucaggcagc

SEQ ID NO: 39128 - RNA, 20 nt, Artificial Sequence
  CIITA targeting sequence
aguuuguccccaccaucucc

SEQ ID NO: 39129 - RNA, 20 nt, Artificial Sequence
  CIITA targeting sequence
ccaccaucuccacucugccc

SEQ ID NO: 39130 - RNA, 20 nt, Artificial Sequence
  CIITA targeting sequence
ccacucugccccaugggcuc

SEQ ID NO: 39131 - RNA, 20 nt, Artificial Sequence
  CIITA targeting sequence
acucugccccaugggcucug

SEQ ID NO: 39132 - RNA, 20 nt, Artificial Sequence
  CIITA targeting sequence
gccccaugggcucuggcaaa

SEQ ID NO: 39133 - RNA, 20 nt, Artificial Sequence
  CIITA targeting sequence
ggcaaaucucugaggcugga

SEQ ID NO: 39134 - RNA, 20 nt, Artificial Sequence
  CIITA targeting sequence
cugaggcuggaacagggguc

SEQ ID NO: 39135 - RNA, 20 nt, Artificial Sequence
  CIITA targeting sequence
gaggcuggaacaggggucuc

SEQ ID NO: 39136 - RNA, 20 nt, Artificial Sequence
  CIITA targeting sequence
gagauuugccagagcccaug

SEQ ID NO: 39137 - RNA, 20 nt, Artificial Sequence
  CIITA targeting sequence
agccucagagauuugccaga

SEQ ID NO: 39138 - RNA, 20 nt, Artificial Sequence
  CIITA targeting sequence
ccaguauauucaucuaccau

SEQ ID NO: 39139 - RNA, 20 nt, Artificial Sequence
  CIITA targeting sequence
aguauauucaucuaccaugg

SEQ ID NO: 39140 - RNA, 20 nt, Artificial Sequence
  CIITA targeting sequence
ucuaccauggugagugcggg

SEQ ID NO: 39141 - RNA, 20 nt, Artificial Sequence
  CIITA targeting sequence
accauggugagugcggggcc

SEQ ID NO: 39142 - RNA, 20 nt, Artificial Sequence
  CIITA targeting sequence
ccaugguagaugaauauacu

SEQ ID NO: 39143 - RNA, 20 nt, Artificial Sequence
  CIITA targeting sequence
ccgaccaccucucccuccua

SEQ ID NO: 39144 - RNA, 20 nt, Artificial Sequence
  CIITA targeting sequence
gggagccaggccccgcacuc

SEQ ID NO: 39145 - RNA, 20 nt, Artificial Sequence
  CIITA targeting sequence
cccuccuaccugacugcucc

SEQ ID NO: 39146 - RNA, 20 nt, Artificial Sequence
  CIITA targeting sequence
cuccuaccugacugcucccu

SEQ ID NO: 39147 - RNA, 20 nt, Artificial Sequence
  CIITA targeting sequence
uaccugacugcucccugacc

SEQ ID NO: 39148 - RNA, 20 nt, Artificial Sequence
  CIITA targeting sequence
gguaggagggagaggugguc

SEQ ID NO: 39149 - RNA, 20 nt, Artificial Sequence
  CIITA targeting sequence
cugaccucauccuccccaua

SEQ ID NO: 39150 - RNA, 20 nt, Artificial Sequence
  CIITA targeting sequence
gggagcagucagguaggagg

SEQ ID NO: 39151 - RNA, 20 nt, Artificial Sequence
  CIITA targeting sequence
uccuccccauacuccaugca

SEQ ID NO: 39152 - RNA, 20 nt, Artificial Sequence
  CIITA targeting sequence
uccccauacuccaugcacuu

SEQ ID NO: 39153 - RNA, 20 nt, Artificial Sequence
  CIITA targeting sequence
ccauacuccaugcacuuggc

SEQ ID NO: 39154 - RNA, 20 nt, Artificial Sequence
  CIITA targeting sequence
augcacuuggcaguggugcc

SEQ ID NO: 39155 - RNA, 20 nt, Artificial Sequence
  CIITA targeting sequence
caugauccucccuccccagc

SEQ ID NO: 39156 - RNA, 20 nt, Artificial Sequence
  CIITA targeting sequence
ugauccucccuccccagcac

SEQ ID NO: 39157 - RNA, 20 nt, Artificial Sequence
  CIITA targeting sequence
ugagaaggugcuagggcacc

SEQ ID NO: 39158 - RNA, 20 nt, Artificial Sequence
  CIITA targeting sequence
ucccuccccagcacaacuuu

SEQ ID NO: 39159 - RNA, 20 nt, Artificial Sequence
  CIITA targeting sequence
cuccccagcacaacuuucuc

SEQ ID NO: 39160 - RNA, 20 nt, Artificial Sequence
  CIITA targeting sequence
ccagcacaacuuucucuguc

SEQ ID NO: 39161 - RNA, 20 nt, Artificial Sequence
  CIITA targeting sequence
cugucccuauuucccaaaaa

SEQ ID NO: 39162 - RNA, 20 nt, Artificial Sequence
  CIITA targeting sequence
gucccuauuucccaaaaauc

SEQ ID NO: 39163 - RNA, 20 nt, Artificial Sequence
  CIITA targeting sequence
cuauuucccaaaaaucaaag

SEQ ID NO: 39164 - RNA, 20 nt, Artificial Sequence
  CIITA targeting sequence
caaaaaucaaagcagaagag

SEQ ID NO: 39165 - RNA, 20 nt, Artificial Sequence
  CIITA targeting sequence
aagcagaagagcagagauuc

SEQ ID NO: 39166 - RNA, 20 nt, Artificial Sequence
  CIITA targeting sequence
gcuuugauuuuugggaaaua

SEQ ID NO: 39167 - RNA, 20 nt, Artificial Sequence
  CIITA targeting sequence
ucugcuuugauuuuugggaa

SEQ ID NO: 39168 - RNA, 20 nt, Artificial Sequence
  CIITA targeting sequence
gcucuucugcuuugauuuuu

SEQ ID NO: 39169 - RNA, 20 nt, Artificial Sequence
  CIITA targeting sequence
cugcucuucugcuuugauuu

SEQ ID NO: 39170 - RNA, 20 nt, Artificial Sequence
  CIITA targeting sequence
ugagguggucugggugcaug

SEQ ID NO: 39171 - RNA, 20 nt, Artificial Sequence
  CIITA targeting sequence
ggaaucucugcucuucugcu

SEQ ID NO: 39172 - RNA, 20 nt, Artificial Sequence
  CIITA targeting sequence
gggugcaugaccaagagugg

SEQ ID NO: 39173 - RNA, 20 nt, Artificial Sequence
  CIITA targeting sequence
ugcacccagaccaccucagg

SEQ ID NO: 39174 - RNA, 20 nt, Artificial Sequence
  CIITA targeting sequence
uggucaugcacccagaccac

SEQ ID NO: 39175 - RNA, 20 nt, Artificial Sequence
  CIITA targeting sequence
auauguugcuuuccccuucu

SEQ ID NO: 39176 - RNA, 20 nt, Artificial Sequence
  CIITA targeting sequence
ccuucugacccuuaguuuuu

SEQ ID NO: 39177 - RNA, 20 nt, Artificial Sequence
  CIITA targeting sequence
gacccuuaguuuuuccuuau

SEQ ID NO: 39178 - RNA, 20 nt, Artificial Sequence
  CIITA targeting sequence
gaaggggaaagcaacauaug

SEQ ID NO: 39179 - RNA, 20 nt, Artificial Sequence
  CIITA targeting sequence
uuauuuuuuuuaaauguuuu

SEQ ID NO: 39180 - RNA, 20 nt, Artificial Sequence
  CIITA targeting sequence
auacaugcucacuaauaagc

SEQ ID NO: 39181 - RNA, 20 nt, Artificial Sequence
  CIITA targeting sequence
cuaauaagcuaaugacaagu

SEQ ID NO: 39182 - RNA, 20 nt, Artificial Sequence
  CIITA targeting sequence
uuagcuuauuagugagcaug

SEQ ID NO: 39183 - RNA, 20 nt, Artificial Sequence
  CIITA targeting sequence
cuugucauuagcuuauuagu

SEQ ID NO: 39184 - RNA, 20 nt, Artificial Sequence
  CIITA targeting sequence
uguaaacaucacuugucauu

SEQ ID NO: 39185 - RNA, 20 nt, Artificial Sequence
  CIITA targeting sequence
cugucucucucacucuuuua

SEQ ID NO: 39186 - RNA, 20 nt, Artificial Sequence
  CIITA targeting sequence
cucucacucuuuuaguauac

SEQ ID NO: 39187 - RNA, 20 nt, Artificial Sequence
  CIITA targeting sequence
cucacucuuuuaguauacug

SEQ ID NO: 39188 - RNA, 20 nt, Artificial Sequence
  CIITA targeting sequence
cacucuuuuaguauacugau

SEQ ID NO: 39189 - RNA, 20 nt, Artificial Sequence
  CIITA targeting sequence
cucuuuuaguauacugaugu

SEQ ID NO: 39190 - RNA, 20 nt, Artificial Sequence
  CIITA targeting sequence
uuuaguauacugaugugaau

SEQ ID NO: 39191 - RNA, 20 nt, Artificial Sequence
  CIITA targeting sequence
guauacuaaaagagugagag

SEQ ID NO: 39192 - RNA, 20 nt, Artificial Sequence
  CIITA targeting sequence
caucaguauacuaaaagagu

SEQ ID NO: 39193 - RNA, 20 nt, Artificial Sequence
  CIITA targeting sequence
uugcauagcuuucucugauu

SEQ ID NO: 39194 - RNA, 20 nt, Artificial Sequence
  CIITA targeting sequence
cugauuugucuuguuuccua

SEQ ID NO: 39195 - RNA, 20 nt, Artificial Sequence
  CIITA targeting sequence
gauuugucuuguuuccuaau

SEQ ID NO: 39196 - RNA, 20 nt, Artificial Sequence
  CIITA targeting sequence
gagaaagcuaugcaaggaug

SEQ ID NO: 39197 - RNA, 20 nt, Artificial Sequence
  CIITA targeting sequence
uguuuccuaaucaguaaaau

SEQ ID NO: 39198 - RNA, 20 nt, Artificial Sequence
  CIITA targeting sequence
uaaucaguaaaauggucccu

SEQ ID NO: 39199 - RNA, 20 nt, Artificial Sequence
  CIITA targeting sequence
guaaaauggucccuacugac

SEQ ID NO: 39200 - RNA, 20 nt, Artificial Sequence
  CIITA targeting sequence
cuacugacccaccacacuga

SEQ ID NO: 39201 - RNA, 20 nt, Artificial Sequence
  CIITA targeting sequence
guagggaccauuuuacugau

SEQ ID NO: 39202 - RNA, 20 nt, Artificial Sequence
  CIITA targeting sequence
guguggugggucaguaggga

SEQ ID NO: 39203 - RNA, 20 nt, Artificial Sequence
  CIITA targeting sequence
caaccccucagugugguggg

SEQ ID NO: 39204 - RNA, 20 nt, Artificial Sequence
  CIITA targeting sequence
cagggaagguguguuugggc

SEQ ID NO: 39205 - RNA, 20 nt, Artificial Sequence
  CIITA targeting sequence
gggaagguguguuugggcug

SEQ ID NO: 39206 - RNA, 20 nt, Artificial Sequence
  CIITA targeting sequence
cugagacaagucacaacccc

SEQ ID NO: 39207 - RNA, 20 nt, Artificial Sequence
  CIITA targeting sequence
gggaugagaccaggaggaug

SEQ ID NO: 39208 - RNA, 20 nt, Artificial Sequence
  CIITA targeting sequence
cugacagcccaaacacaccu

SEQ ID NO: 39209 - RNA, 20 nt, Artificial Sequence
  CIITA targeting sequence
ucccugacagcccaaacaca

SEQ ID NO: 39210 - RNA, 20 nt, Artificial Sequence
  CIITA targeting sequence
caucccugacagcccaaaca

SEQ ID NO: 39211 - RNA, 20 nt, Artificial Sequence
  CIITA targeting sequence
uggucucaucccugacagcc

SEQ ID NO: 39212 - RNA, 20 nt, Artificial Sequence
  CIITA targeting sequence
uccuggucucaucccugaca

SEQ ID NO: 39213 - RNA, 20 nt, Artificial Sequence
  CIITA targeting sequence
acucaaguccagagcaucca

SEQ ID NO: 39214 - RNA, 20 nt, Artificial Sequence
  CIITA targeting sequence
aguccagagcauccauuccu

SEQ ID NO: 39215 - RNA, 20 nt, Artificial Sequence
  CIITA targeting sequence
agagcauccauuccugguug

SEQ ID NO: 39216 - RNA, 20 nt, Artificial Sequence
  CIITA targeting sequence
ggacuugaguggaagcaucc

SEQ ID NO: 39217 - RNA, 20 nt, Artificial Sequence
  CIITA targeting sequence
auuccugguugcaagacagu

SEQ ID NO: 39218 - RNA, 20 nt, Artificial Sequence
  CIITA targeting sequence
ugguugcaagacaguuucag

SEQ ID NO: 39219 - RNA, 20 nt, Artificial Sequence
  CIITA targeting sequence
ugcaaccaggaauggaugcu

SEQ ID NO: 39220 - RNA, 20 nt, Artificial Sequence
  CIITA targeting sequence
guauaacgcacugguaucuc

SEQ ID NO: 39221 - RNA, 20 nt, Artificial Sequence
  CIITA targeting sequence
cagaagcagagaagcaguuc

SEQ ID NO: 39222 - RNA, 20 nt, Artificial Sequence
  CIITA targeting sequence
gaagcagagaagcaguuccu

SEQ ID NO: 39223 - RNA, 20 nt, Artificial Sequence
  CIITA targeting sequence
gagauaccagugcguuauac

SEQ ID NO: 39224 - RNA, 20 nt, Artificial Sequence
  CIITA targeting sequence
gcuucugagauaccagugcg

SEQ ID NO: 39225 - RNA, 20 nt, Artificial Sequence
  CIITA targeting sequence
cugcuucugagauaccagug

SEQ ID NO: 39226 - RNA, 20 nt, Artificial Sequence
  CIITA targeting sequence
ugauaucuaggaaaaugagc

SEQ ID NO: 39227 - RNA, 20 nt, Artificial Sequence
  CIITA targeting sequence
ggaacugcuucucugcuucu

SEQ ID NO: 39228 - RNA, 20 nt, Artificial Sequence
  CIITA targeting sequence
aggaaaaugagcacugacca

SEQ ID NO: 39229 - RNA, 20 nt, Artificial Sequence
  CIITA targeting sequence
uagauaucaggaacugcuuc

SEQ ID NO: 39230 - RNA, 20 nt, Artificial Sequence
  CIITA targeting sequence
uuuuccuagauaucaggaac

SEQ ID NO: 39231 - RNA, 20 nt, Artificial Sequence
  CIITA targeting sequence
gugcucauuuuccuagauau

SEQ ID NO: 39232 - RNA, 20 nt, Artificial Sequence
  CIITA targeting sequence
ugcuguguggucagugcuca

SEQ ID NO: 39233 - RNA, 20 nt, Artificial Sequence
  CIITA targeting sequence
uccugcuguguggucagugc

SEQ ID NO: 39234 - RNA, 20 nt, Artificial Sequence
  CIITA targeting sequence
uuaugagcuaauugcaccca

SEQ ID NO: 39235 - RNA, 20 nt, Artificial Sequence
  CIITA targeting sequence
uaaggaacuuagggcaggua

SEQ ID NO: 39236 - RNA, 20 nt, Artificial Sequence
  CIITA targeting sequence
cagauuggaaaagcaagguu

SEQ ID NO: 39237 - RNA, 20 nt, Artificial Sequence
  CIITA targeting sequence
gugaaaugggugcaauuagc

SEQ ID NO: 39238 - RNA, 20 nt, Artificial Sequence
  CIITA targeting sequence
aaucugugaaaugggugcaa

SEQ ID NO: 39239 - RNA, 20 nt, Artificial Sequence
  CIITA targeting sequence
aggagcuagauguaacucca

SEQ ID NO: 39240 - RNA, 20 nt, Artificial Sequence
  CIITA targeting sequence
uggaaccuugcuuuuccaau

SEQ ID NO: 39241 - RNA, 20 nt, Artificial Sequence
  CIITA targeting sequence
agcuccuggaaccuugcuuu

SEQ ID NO: 39242 - RNA, 20 nt, Artificial Sequence
  CIITA targeting sequence
agagcucuuucuucagcucu

SEQ ID NO: 39243 - RNA, 20 nt, Artificial Sequence
  CIITA targeting sequence
ggaguuacaucuagcuccug

SEQ ID NO: 39244 - RNA, 20 nt, Artificial Sequence
  CIITA targeting sequence
uucuucagcucuguccugaa

SEQ ID NO: 39245 - RNA, 20 nt, Artificial Sequence
  CIITA targeting sequence
ucagcucuguccugaaauau

SEQ ID NO: 39246 - RNA, 20 nt, Artificial Sequence
  CIITA targeting sequence
gcucuguccugaaauaucuu

SEQ ID NO: 39247 - RNA, 20 nt, Artificial Sequence
  CIITA targeting sequence
guccugaaauaucuuccuuu

SEQ ID NO: 39248 - RNA, 20 nt, Artificial Sequence
  CIITA targeting sequence
ugaaauaucuuccuuuggaa

SEQ ID NO: 39249 - RNA, 20 nt, Artificial Sequence
  CIITA targeting sequence
ggacagagcugaagaaagag

SEQ ID NO: 39250 - RNA, 20 nt, Artificial Sequence
  CIITA targeting sequence
uccuuuggaaguucuacucu

SEQ ID NO: 39251 - RNA, 20 nt, Artificial Sequence
  CIITA targeting sequence
uuuggaaguucuacucucuu

SEQ ID NO: 39252 - RNA, 20 nt, Artificial Sequence
  CIITA targeting sequence
aaaggaagauauuucaggac

SEQ ID NO: 39253 - RNA, 20 nt, Artificial Sequence
  CIITA targeting sequence
acucucuucucuccagacuu

SEQ ID NO: 39254 - RNA, 20 nt, Artificial Sequence
  CIITA targeting sequence
cuucucuccagacuuccuga

SEQ ID NO: 39255 - RNA, 20 nt, Artificial Sequence
  CIITA targeting sequence
ucucuccagacuuccugagc

SEQ ID NO: 39256 - RNA, 20 nt, Artificial Sequence
  CIITA targeting sequence
cuccagacuuccugagcucc

SEQ ID NO: 39257 - RNA, 20 nt, Artificial Sequence
  CIITA targeting sequence
ccagacuuccugagcuccac

SEQ ID NO: 39258 - RNA, 20 nt, Artificial Sequence
  CIITA targeting sequence
agacuuccugagcuccacag

SEQ ID NO: 39259 - RNA, 20 nt, Artificial Sequence
  CIITA targeting sequence
ggagagaagagaguagaacu

SEQ ID NO: 39260 - RNA, 20 nt, Artificial Sequence
  CIITA targeting sequence
ugagcuccacagcccaguuu

SEQ ID NO: 39261 - RNA, 20 nt, Artificial Sequence
  CIITA targeting sequence
ggaagucuggagagaagaga

SEQ ID NO: 39262 - RNA, 20 nt, Artificial Sequence
  CIITA targeting sequence
acagcccaguuuggaguagg

SEQ ID NO: 39263 - RNA, 20 nt, Artificial Sequence
  CIITA targeting sequence
aaacugggcuguggagcuca

SEQ ID NO: 39264 - RNA, 20 nt, Artificial Sequence
  CIITA targeting sequence
ccccuacuccaaacugggcu

SEQ ID NO: 39265 - RNA, 20 nt, Artificial Sequence
  CIITA targeting sequence
ggaaucaauaccugguuauu

SEQ ID NO: 39266 - RNA, 20 nt, Artificial Sequence
  CIITA targeting sequence
agaaaugcacuugggucacc

SEQ ID NO: 39267 - RNA, 20 nt, Artificial Sequence
  CIITA targeting sequence
auaccugguuauucucacac

SEQ ID NO: 39268 - RNA, 20 nt, Artificial Sequence
  CIITA targeting sequence
cacaccacucuccaccccca

SEQ ID NO: 39269 - RNA, 20 nt, Artificial Sequence
  CIITA targeting sequence
caccacucuccacccccaau

SEQ ID NO: 39270 - RNA, 20 nt, Artificial Sequence
  CIITA targeting sequence
ccacccccaauguaggugag

SEQ ID NO: 39271 - RNA, 20 nt, Artificial Sequence
  CIITA targeting sequence
acccccaauguaggugaggu

SEQ ID NO: 39272 - RNA, 20 nt, Artificial Sequence
  CIITA targeting sequence
ccuacauuggggguggagag

SEQ ID NO: 39273 - RNA, 20 nt, Artificial Sequence
  CIITA targeting sequence
caguggauucacuguccacg

SEQ ID NO: 39274 - RNA, 20 nt, Artificial Sequence
  CIITA targeting sequence
acugggaggggguacuuggc

SEQ ID NO: 39275 - RNA, 20 nt, Artificial Sequence
  CIITA targeting sequence
cuguccacggccucccaaca

SEQ ID NO: 39276 - RNA, 20 nt, Artificial Sequence
  CIITA targeting sequence
acggccucccaacaucucca

SEQ ID NO: 39277 - RNA, 20 nt, Artificial Sequence
  CIITA targeting sequence
caacaucuccagaccggcca

SEQ ID NO: 39278 - RNA, 20 nt, Artificial Sequence
  CIITA targeting sequence
ccagaccggccaggcuccac

SEQ ID NO: 39279 - RNA, 20 nt, Artificial Sequence
  CIITA targeting sequence
agaccggccaggcuccacca

SEQ ID NO: 39280 - RNA, 20 nt, Artificial Sequence
  CIITA targeting sequence
ggagauguugggaggccgug

SEQ ID NO: 39281 - RNA, 20 nt, Artificial Sequence
  CIITA targeting sequence
accagccccuucgcuccauc

SEQ ID NO: 39282 - RNA, 20 nt, Artificial Sequence
  CIITA targeting sequence
cuccaucagccacugaccug

SEQ ID NO: 39283 - RNA, 20 nt, Artificial Sequence
  CIITA targeting sequence
aucagccacugaccugccca

SEQ ID NO: 39284 - RNA, 20 nt, Artificial Sequence
  CIITA targeting sequence
gccacugaccugcccagcau

SEQ ID NO: 39285 - RNA, 20 nt, Artificial Sequence
  CIITA targeting sequence
guggcugauggagcgaaggg

SEQ ID NO: 39286 - RNA, 20 nt, Artificial Sequence
  CIITA targeting sequence
ggcaugcugggcaggucagu

SEQ ID NO: 39287 - RNA, 20 nt, Artificial Sequence
  CIITA targeting sequence
gggcagguucaggcaugcug

SEQ ID NO: 39288 - RNA, 20 nt, Artificial Sequence
  CIITA targeting sequence
cgagcaaacaugacagguaa

SEQ ID NO: 39289 - RNA, 20 nt, Artificial Sequence
  CIITA targeting sequence
ggaggucagggcagguucag

SEQ ID NO: 39290 - RNA, 20 nt, Artificial Sequence
  CIITA targeting sequence
uguuugcucgggaggucagg

SEQ ID NO: 39291 - RNA, 20 nt, Artificial Sequence
  CIITA targeting sequence
uuaccugucauguuugcucg

SEQ ID NO: 39292 - RNA, 20 nt, Artificial Sequence
  CIITA targeting sequence
caggcccuaaggguccuuac

SEQ ID NO: 39293 - RNA, 20 nt, Artificial Sequence
  CIITA targeting sequence
cacaggcccuaaggguccuu

SEQ ID NO: 39294 - RNA, 20 nt, Artificial Sequence
  CIITA targeting sequence
aguaccucucacaggcccua

SEQ ID NO: 39295 - RNA, 20 nt, Artificial Sequence
  CIITA targeting sequence
ugcuucuaguaccucucaca

SEQ ID NO: 39296 - RNA, 20 nt, Artificial Sequence
  CIITA targeting sequence
aggcccuggggaaggaauug

SEQ ID NO: 39297 - RNA, 20 nt, Artificial Sequence
  CIITA targeting sequence
auccugcuucuaguaccucu

SEQ ID NO: 39298 - RNA, 20 nt, Artificial Sequence
  CIITA targeting sequence
ccagggccucgauccugcuu

SEQ ID NO: 39299 - RNA, 20 nt, Artificial Sequence
  CIITA targeting sequence
uuccccagggccucgauccu

SEQ ID NO: 39300 - RNA, 20 nt, Artificial Sequence
  CIITA targeting sequence
caaauaagauccacaagcaa

SEQ ID NO: 39301 - RNA, 20 nt, Artificial Sequence
  CIITA targeting sequence
aauaagauccacaagcaaag

SEQ ID NO: 39302 - RNA, 20 nt, Artificial Sequence
  CIITA targeting sequence
uauuugagacaauuccuucc

SEQ ID NO: 39303 - RNA, 20 nt, Artificial Sequence
  CIITA targeting sequence
acaagcaaagcugccuguag

SEQ ID NO: 39304 - RNA, 20 nt, Artificial Sequence
  CIITA targeting sequence
cuacaggcagcuuugcuugu

SEQ ID NO: 39305 - RNA, 20 nt, Artificial Sequence
  CIITA targeting sequence
uguuuaggggucagucggga

SEQ ID NO: 39306 - RNA, 20 nt, Artificial Sequence
  CIITA targeting sequence
gucgggacagggagggucuc

SEQ ID NO: 39307 - RNA, 20 nt, Artificial Sequence
  CIITA targeting sequence
ggacagggagggucuccagg

SEQ ID NO: 39308 - RNA, 20 nt, Artificial Sequence
  CIITA targeting sequence
cgacugaccccuaaacauga

SEQ ID NO: 39309 - RNA, 20 nt, Artificial Sequence
  CIITA targeting sequence
cugucccgacugaccccuaa

SEQ ID NO: 39310 - RNA, 20 nt, Artificial Sequence
  CIITA targeting sequence
ccagggaguggaggcauggu

SEQ ID NO: 39311 - RNA, 20 nt, Artificial Sequence
  CIITA targeting sequence
agggaguggaggcaugguug

SEQ ID NO: 39312 - RNA, 20 nt, Artificial Sequence
  CIITA targeting sequence
cuggagacccucccuguccc

SEQ ID NO: 39313 - RNA, 20 nt, Artificial Sequence
  CIITA targeting sequence
acucccuggagacccucccu

SEQ ID NO: 39314 - RNA, 20 nt, Artificial Sequence
  CIITA targeting sequence
cccacaaccaugccuccacu

SEQ ID NO: 39315 - RNA, 20 nt, Artificial Sequence
  CIITA targeting sequence
auucccccacaaccaugccu

SEQ ID NO: 39316 - RNA, 20 nt, Artificial Sequence
  CIITA targeting sequence
agcuguccauucccccacaa

SEQ ID NO: 39317 - RNA, 20 nt, Artificial Sequence
  CIITA targeting sequence
cuagcuguccauucccccac

SEQ ID NO: 39318 - RNA, 20 nt, Artificial Sequence
  CIITA targeting sequence
acaucccauccaaauacagc

SEQ ID NO: 39319 - RNA, 20 nt, Artificial Sequence
  CIITA targeting sequence
cauccaaauacagccaucag

SEQ ID NO: 39320 - RNA, 20 nt, Artificial Sequence
  CIITA targeting sequence
aaauacagccaucagccuuc

SEQ ID NO: 39321 - RNA, 20 nt, Artificial Sequence
  CIITA targeting sequence
gccuucagcugcuuguuacc

SEQ ID NO: 39322 - RNA, 20 nt, Artificial Sequence
  CIITA targeting sequence
gcugcuuguuacccagcaga

SEQ ID NO: 39323 - RNA, 20 nt, Artificial Sequence
  CIITA targeting sequence
gcuggguaacaagcagcuga

SEQ ID NO: 39324 - RNA, 20 nt, Artificial Sequence
  CIITA targeting sequence
ggcuuuucugcuggguaaca

SEQ ID NO: 39325 - RNA, 20 nt, Artificial Sequence
  CIITA targeting sequence
gaucuuuugaaguugaaaac

SEQ ID NO: 39326 - RNA, 20 nt, Artificial Sequence
  CIITA targeting sequence
gaccacauugucuggcuuuu

SEQ ID NO: 39327 - RNA, 20 nt, Artificial Sequence
  CIITA targeting sequence
uuugaaguugaaaacccuga

SEQ ID NO: 39328 - RNA, 20 nt, Artificial Sequence
  CIITA targeting sequence
aaagaucugaccacauuguc

SEQ ID NO: 39329 - RNA, 20 nt, Artificial Sequence
  CIITA targeting sequence
acuucaaaagaucugaccac

SEQ ID NO: 39330 - RNA, 20 nt, Artificial Sequence
  CIITA targeting sequence
ggguuuucaacuucaaaaga

SEQ ID NO: 39331 - RNA, 20 nt, Artificial Sequence
  CIITA targeting sequence
auguaaaaaucaggguuuuc

SEQ ID NO: 39332 - RNA, 20 nt, Artificial Sequence
  CIITA targeting sequence
caauaucuauguaaaaauca

SEQ ID NO: 39333 - RNA, 20 nt, Artificial Sequence
  CIITA targeting sequence
acaauaaauaaauaauaaaa

SEQ ID NO: 39334 - RNA, 20 nt, Artificial Sequence
  CIITA targeting sequence
caacaauaaauaaauaauaa

SEQ ID NO: 39335 - RNA, 20 nt, Artificial Sequence
  CIITA targeting sequence
aucucaacaauaaauaaaua

SEQ ID NO: 39336 - RNA, 20 nt, Artificial Sequence
  CIITA targeting sequence
cacucuguugcccaggcuag

SEQ ID NO: 39337 - RNA, 20 nt, Artificial Sequence
  CIITA targeting sequence
cucuguugcccaggcuagag

SEQ ID NO: 39338 - RNA, 20 nt, Artificial Sequence
  CIITA targeting sequence
guugcccaggcuagagugca

SEQ ID NO: 39339 - RNA, 20 nt, Artificial Sequence
  CIITA targeting sequence
agccugggcaacagagugag

SEQ ID NO: 39340 - RNA, 20 nt, Artificial Sequence
  CIITA targeting sequence
caccacugcacucuagccug

SEQ ID NO: 39341 - RNA, 20 nt, Artificial Sequence
  CIITA targeting sequence
cagaucacugcaaccuccgc

SEQ ID NO: 39342 - RNA, 20 nt, Artificial Sequence
  CIITA targeting sequence
gaucacugcaaccuccgccc

SEQ ID NO: 39343 - RNA, 20 nt, Artificial Sequence
  CIITA targeting sequence
gagaucgcaccacugcacuc

SEQ ID NO: 39344 - RNA, 20 nt, Artificial Sequence
  CIITA targeting sequence
cugcaaccuccgcccuacag

SEQ ID NO: 39345 - RNA, 20 nt, Artificial Sequence
  CIITA targeting sequence
gcccuacagguucaagugau

SEQ ID NO: 39346 - RNA, 20 nt, Artificial Sequence
  CIITA targeting sequence
agugauucuccugccucagc

SEQ ID NO: 39347 - RNA, 20 nt, Artificial Sequence
  CIITA targeting sequence
cuugaaccuguagggcggag

SEQ ID NO: 39348 - RNA, 20 nt, Artificial Sequence
  CIITA targeting sequence
ccugccucagccuccggagc

SEQ ID NO: 39349 - RNA, 20 nt, Artificial Sequence
  CIITA targeting sequence
ugccucagccuccggagcag

SEQ ID NO: 39350 - RNA, 20 nt, Artificial Sequence
  CIITA targeting sequence
gccuccggagcagcuggaau

SEQ ID NO: 39351 - RNA, 20 nt, Artificial Sequence
  CIITA targeting sequence
ggagcagcuggaauuacagg

SEQ ID NO: 39352 - RNA, 20 nt, Artificial Sequence
  CIITA targeting sequence
ggaggcugaggcaggagaau

SEQ ID NO: 39353 - RNA, 20 nt, Artificial Sequence
  CIITA targeting sequence
agcugcuccggaggcugagg

SEQ ID NO: 39354 - RNA, 20 nt, Artificial Sequence
  CIITA targeting sequence
cacccagccaauuuuuguaa

SEQ ID NO: 39355 - RNA, 20 nt, Artificial Sequence
  CIITA targeting sequence
guagagacaaguuuaaccau

SEQ ID NO: 39356 - RNA, 20 nt, Artificial Sequence
  CIITA targeting sequence
acugaaauuacaaaaauugg

SEQ ID NO: 39357 - RNA, 20 nt, Artificial Sequence
  CIITA targeting sequence
cuacugaaauuacaaaaauu

SEQ ID NO: 39358 - RNA, 20 nt, Artificial Sequence
  CIITA targeting sequence
cgaacuccugaucucaagug

SEQ ID NO: 39359 - RNA, 20 nt, Artificial Sequence
  CIITA targeting sequence
aacuccugaucucaagugau

SEQ ID NO: 39360 - RNA, 20 nt, Artificial Sequence
  CIITA targeting sequence
agaccagccuggccaacaug

SEQ ID NO: 39361 - RNA, 20 nt, Artificial Sequence
  CIITA targeting sequence
ugaucucaagugauccaccu

SEQ ID NO: 39362 - RNA, 20 nt, Artificial Sequence
  CIITA targeting sequence
ggaguucgagaccagccugg

SEQ ID NO: 39363 - RNA, 20 nt, Artificial Sequence
  CIITA targeting sequence
caagugauccaccugccucg

SEQ ID NO: 39364 - RNA, 20 nt, Artificial Sequence
  CIITA targeting sequence
agugauccaccugccucgac

SEQ ID NO: 39365 - RNA, 20 nt, Artificial Sequence
  CIITA targeting sequence
cuugagaucaggaguucgag

SEQ ID NO: 39366 - RNA, 20 nt, Artificial Sequence
  CIITA targeting sequence
accugccucgaccucccaaa

SEQ ID NO: 39367 - RNA, 20 nt, Artificial Sequence
  CIITA targeting sequence
accucccaaagugcugggau

SEQ ID NO: 39368 - RNA, 20 nt, Artificial Sequence
  CIITA targeting sequence
aggcagguggaucacuugag

SEQ ID NO: 39369 - RNA, 20 nt, Artificial Sequence
  CIITA targeting sequence
caaagugcugggauuacagg

SEQ ID NO: 39370 - RNA, 20 nt, Artificial Sequence
  CIITA targeting sequence
cagcacuuugggaggucgag

SEQ ID NO: 39371 - RNA, 20 nt, Artificial Sequence
  CIITA targeting sequence
caccuguaaucccagcacuu

SEQ ID NO: 39372 - RNA, 20 nt, Artificial Sequence
  CIITA targeting sequence
ggcugggugcaguggcucac

SEQ ID NO: 39373 - RNA, 20 nt, Artificial Sequence
  CIITA targeting sequence
caauaucaggcugggugcag

SEQ ID NO: 39374 - RNA, 20 nt, Artificial Sequence
  CIITA targeting sequence
uuuuuaaacaugagugaaau

SEQ ID NO: 39375 - RNA, 20 nt, Artificial Sequence
  CIITA targeting sequence
uguuuaaaaaagaaaaucgc

SEQ ID NO: 39376 - RNA, 20 nt, Artificial Sequence
  CIITA targeting sequence
cucauguuuaaaaaagaaaa

SEQ ID NO: 39377 - RNA, 20 nt, Artificial Sequence
  CIITA targeting sequence
uuggccaacuguacuuuuaa

SEQ ID NO: 39378 - RNA, 20 nt, Artificial Sequence
  CIITA targeting sequence
uucuuuggccaacuguacuu

SEQ ID NO: 39379 - RNA, 20 nt, Artificial Sequence
  CIITA targeting sequence
aauaugucuuucuuuggcca

SEQ ID NO: 39380 - RNA, 20 nt, Artificial Sequence
  CIITA targeting sequence
aacucaaauaugucuuucuu

SEQ ID NO: 39381 - RNA, 20 nt, Artificial Sequence
  CIITA targeting sequence
ggccgcuaucuuauaaccuc

SEQ ID NO: 39382 - RNA, 20 nt, Artificial Sequence
  CIITA targeting sequence
uauaaccuccaucuugggaa

SEQ ID NO: 39383 - RNA, 20 nt, Artificial Sequence
  CIITA targeting sequence
aucuugggaaacucagccca

SEQ ID NO: 39384 - RNA, 20 nt, Artificial Sequence
  CIITA targeting sequence
ugggaaacucagcccaugaa

SEQ ID NO: 39385 - RNA, 20 nt, Artificial Sequence
  CIITA targeting sequence
caagauggagguuauaagau

SEQ ID NO: 39386 - RNA, 20 nt, Artificial Sequence
  CIITA targeting sequence
gcccaugaaggcuguaagga

SEQ ID NO: 39387 - RNA, 20 nt, Artificial Sequence
  CIITA targeting sequence
ugggcugaguuucccaagau

SEQ ID NO: 39388 - RNA, 20 nt, Artificial Sequence
  CIITA targeting sequence
uuacagccuucaugggcuga

SEQ ID NO: 39389 - RNA, 20 nt, Artificial Sequence
  CIITA targeting sequence
gggccacuuaguccuuacag

SEQ ID NO: 39390 - RNA, 20 nt, Artificial Sequence
  CIITA targeting sequence
cucugggccacuuaguccuu

SEQ ID NO: 39391 - RNA, 20 nt, Artificial Sequence
  CIITA targeting sequence
ccagggguaacccucacccu

SEQ ID NO: 39392 - RNA, 20 nt, Artificial Sequence
  CIITA targeting sequence
cccuaaaucuggcaccugcu

SEQ ID NO: 39393 - RNA, 20 nt, Artificial Sequence
  CIITA targeting sequence
ggcaccugcuucuccaucuc

SEQ ID NO: 39394 - RNA, 20 nt, Artificial Sequence
  CIITA targeting sequence
ccaucuccagagcacaagac

SEQ ID NO: 39395 - RNA, 20 nt, Artificial Sequence
  CIITA targeting sequence
aucuccagagcacaagacgu

SEQ ID NO: 39396 - RNA, 20 nt, Artificial Sequence
  CIITA targeting sequence
ccagagcacaagacgucccc

SEQ ID NO: 39397 - RNA, 20 nt, Artificial Sequence
  CIITA targeting sequence
agagcacaagacguccccca

SEQ ID NO: 39398 - RNA, 20 nt, Artificial Sequence
  CIITA targeting sequence
ggagauggagaagcaggugc

SEQ ID NO: 39399 - RNA, 20 nt, Artificial Sequence
  CIITA targeting sequence
ugugcucuggagauggagaa

SEQ ID NO: 39400 - RNA, 20 nt, Artificial Sequence
  CIITA targeting sequence
cccacccaaugcccggcagc

SEQ ID NO: 39401 - RNA, 20 nt, Artificial Sequence
  CIITA targeting sequence
agcugccgggcauugggugg

SEQ ID NO: 39402 - RNA, 20 nt, Artificial Sequence
  CIITA targeting sequence
ccagcugccgggcauugggu

SEQ ID NO: 39403 - RNA, 20 nt, Artificial Sequence
  CIITA targeting sequence
ccaacaagcuuccaaaaugg

SEQ ID NO: 39404 - RNA, 20 nt, Artificial Sequence
  CIITA targeting sequence
aacaagcuuccaaaauggcc

SEQ ID NO: 39405 - RNA, 20 nt, Artificial Sequence
  CIITA targeting sequence
aaaauggccuggugagugau

SEQ ID NO: 39406 - RNA, 20 nt, Artificial Sequence
  CIITA targeting sequence
ccaggccauuuuggaagcuu

SEQ ID NO: 39407 - RNA, 20 nt, Artificial Sequence
  CIITA targeting sequence
cucaccaggccauuuuggaa

SEQ ID NO: 39408 - RNA, 20 nt, Artificial Sequence
  CIITA targeting sequence
cgcaucacucaccaggccau

SEQ ID NO: 39409 - RNA, 20 nt, Artificial Sequence
  CIITA targeting sequence
cucugcccugggugguggag

SEQ ID NO: 39410 - RNA, 20 nt, Artificial Sequence
  CIITA targeting sequence
cugcccugggugguggagau

SEQ ID NO: 39411 - RNA, 20 nt, Artificial Sequence
  CIITA targeting sequence
gcccugggugguggagaugg

SEQ ID NO: 39412 - RNA, 20 nt, Artificial Sequence
  CIITA targeting sequence
accacccagggcagagagau

SEQ ID NO: 39413 - RNA, 20 nt, Artificial Sequence
  CIITA targeting sequence
ccaccacccagggcagagag

SEQ ID NO: 39414 - RNA, 20 nt, Artificial Sequence
  CIITA targeting sequence
aucuccaccacccagggcag

SEQ ID NO: 39415 - RNA, 20 nt, Artificial Sequence
  CIITA targeting sequence
ggcuucacauugcucauuca

SEQ ID NO: 39416 - RNA, 20 nt, Artificial Sequence
  CIITA targeting sequence
cauugcucauucacuugaca

SEQ ID NO: 39417 - RNA, 20 nt, Artificial Sequence
  CIITA targeting sequence
uucacuugacacuuauucaa

SEQ ID NO: 39418 - RNA, 20 nt, Artificial Sequence
  CIITA targeting sequence
cuugacacuuauucaacccc

SEQ ID NO: 39419 - RNA, 20 nt, Artificial Sequence
  CIITA targeting sequence
agugaaugagcaaugugaag

SEQ ID NO: 39420 - RNA, 20 nt, Artificial Sequence
  CIITA targeting sequence
accccuucuuuguuggcuca

SEQ ID NO: 39421 - RNA, 20 nt, Artificial Sequence
  CIITA targeting sequence
uuguuggcucacacacucau

SEQ ID NO: 39422 - RNA, 20 nt, Artificial Sequence
  CIITA targeting sequence
cacacucauuuauuuauuca

SEQ ID NO: 39423 - RNA, 20 nt, Artificial Sequence
  CIITA targeting sequence
uuuauuuauucauucauuca

SEQ ID NO: 39424 - RNA, 20 nt, Artificial Sequence
  CIITA targeting sequence
uucauucauucauucacuua

SEQ ID NO: 39425 - RNA, 20 nt, Artificial Sequence
  CIITA targeting sequence
uucauucauucacuuauuug

SEQ ID NO: 39426 - RNA, 20 nt, Artificial Sequence
  CIITA targeting sequence
uucauucacuuauuugauua

SEQ ID NO: 39427 - RNA, 20 nt, Artificial Sequence
  CIITA targeting sequence
uucacuuauuugauuaugcc

SEQ ID NO: 39428 - RNA, 20 nt, Artificial Sequence
  CIITA targeting sequence
cuuauuugauuaugccauca

SEQ ID NO: 39429 - RNA, 20 nt, Artificial Sequence
  CIITA targeting sequence
aauaagugaaugaaugaaug

SEQ ID NO: 39430 - RNA, 20 nt, Artificial Sequence
  CIITA targeting sequence
uuucaccauucacuccacca

SEQ ID NO: 39431 - RNA, 20 nt, Artificial Sequence
  CIITA targeting sequence
ccauucacuccaccacuccc

SEQ ID NO: 39432 - RNA, 20 nt, Artificial Sequence
  CIITA targeting sequence
cuccaccacucccucaaaua

SEQ ID NO: 39433 - RNA, 20 nt, Artificial Sequence
  CIITA targeting sequence
accacucccucaaauaauau

SEQ ID NO: 39434 - RNA, 20 nt, Artificial Sequence
  CIITA targeting sequence
cucaaauaauauuuauugcc

SEQ ID NO: 39435 - RNA, 20 nt, Artificial Sequence
  CIITA targeting sequence
aauaauauuuauugcccuuc

SEQ ID NO: 39436 - RNA, 20 nt, Artificial Sequence
  CIITA targeting sequence
auaagccugcacuggguguu

SEQ ID NO: 39437 - RNA, 20 nt, Artificial Sequence
  CIITA targeting sequence
uugucaggcugagagaauga

SEQ ID NO: 39438 - RNA, 20 nt, Artificial Sequence
  CIITA targeting sequence
ggcugagagaaugaaugagg

SEQ ID NO: 39439 - RNA, 20 nt, Artificial Sequence
  CIITA targeting sequence
gccugacaaugaaguguuaa

SEQ ID NO: 39440 - RNA, 20 nt, Artificial Sequence
  CIITA targeting sequence
cagccugacaaugaaguguu

SEQ ID NO: 39441 - RNA, 20 nt, Artificial Sequence
  CIITA targeting sequence
cucagccugacaaugaagug

SEQ ID NO: 39442 - RNA, 20 nt, Artificial Sequence
  CIITA targeting sequence
uucucucagccugacaauga

SEQ ID NO: 39443 - RNA, 20 nt, Artificial Sequence
  CIITA targeting sequence
uucauucucucagccugaca

SEQ ID NO: 39444 - RNA, 20 nt, Artificial Sequence
  CIITA targeting sequence
cuugccccucauucauucuc

SEQ ID NO: 39445 - RNA, 20 nt, Artificial Sequence
  CIITA targeting sequence
uucgcuugccccucauucau

SEQ ID NO: 39446 - RNA, 20 nt, Artificial Sequence
  CIITA targeting sequence
ucauucgcuugccccucauu

SEQ ID NO: 39447 - RNA, 20 nt, Artificial Sequence
  CIITA targeting sequence
cuucaucauucgcuugcccc

SEQ ID NO: 39448 - RNA, 20 nt, Artificial Sequence
  CIITA targeting sequence
cucacuucaucauucgcuug

SEQ ID NO: 39449 - RNA, 20 nt, Artificial Sequence
  CIITA targeting sequence
acucacucacuucaucauuc

SEQ ID NO: 39450 - RNA, 20 nt, Artificial Sequence
  CIITA targeting sequence
uccacucacucacuucauca

SEQ ID NO: 39451 - RNA, 20 nt, Artificial Sequence
  CIITA targeting sequence
cuucauccacucacucacuu

SEQ ID NO: 39452 - RNA, 20 nt, Artificial Sequence
  CIITA targeting sequence
cacuucauccacucacucac

SEQ ID NO: 39453 - RNA, 20 nt, Artificial Sequence
  CIITA targeting sequence
acuucucacuucauccacuc

SEQ ID NO: 39454 - RNA, 20 nt, Artificial Sequence
  CIITA targeting sequence
ucaacuucucacuucaucca

SEQ ID NO: 39455 - RNA, 20 nt, Artificial Sequence
  CIITA targeting sequence
ucaucaacuucucacuucau

SEQ ID NO: 39456 - RNA, 20 nt, Artificial Sequence
  CIITA targeting sequence
cauccucaucaacuucucac

SEQ ID NO: 39457 - RNA, 20 nt, Artificial Sequence
  CIITA targeting sequence
auugcucccauccucaucaa

SEQ ID NO: 39458 - RNA, 20 nt, Artificial Sequence
  CIITA targeting sequence
cacuuuccauugcucccauc

SEQ ID NO: 39459 - RNA, 20 nt, Artificial Sequence
  CIITA targeting sequence
cugguuuauucccacuuucc

SEQ ID NO: 39460 - RNA, 20 nt, Artificial Sequence
  CIITA targeting sequence
uauucacugguuuauuccca

SEQ ID NO: 39461 - RNA, 20 nt, Artificial Sequence
  CIITA targeting sequence
cuuauucacugguuuauucc

SEQ ID NO: 39462 - RNA, 20 nt, Artificial Sequence
  CIITA targeting sequence
cacauacuggucuaagcaug

SEQ ID NO: 39463 - RNA, 20 nt, Artificial Sequence
  CIITA targeting sequence
cauacuggucuaagcauguu

SEQ ID NO: 39464 - RNA, 20 nt, Artificial Sequence
  CIITA targeting sequence
aagcauguuagguaugcuaa

SEQ ID NO: 39465 - RNA, 20 nt, Artificial Sequence
  CIITA targeting sequence
uuaacaucucacacaauccc

SEQ ID NO: 39466 - RNA, 20 nt, Artificial Sequence
  CIITA targeting sequence
cacacaaucccaauauuauc

SEQ ID NO: 39467 - RNA, 20 nt, Artificial Sequence
  CIITA targeting sequence
cacaaucccaauauuauccc

SEQ ID NO: 39468 - RNA, 20 nt, Artificial Sequence
  CIITA targeting sequence
caauauuauccccauuuucc

SEQ ID NO: 39469 - RNA, 20 nt, Artificial Sequence
  CIITA targeting sequence
ccauuuuccagaugaggcua

SEQ ID NO: 39470 - RNA, 20 nt, Artificial Sequence
  CIITA targeting sequence
agaugaggcuacugaggcau

SEQ ID NO: 39471 - RNA, 20 nt, Artificial Sequence
  CIITA targeting sequence
ggaaaauggggauaauauug

SEQ ID NO: 39472 - RNA, 20 nt, Artificial Sequence
  CIITA targeting sequence
ucuggaaaauggggauaaua

SEQ ID NO: 39473 - RNA, 20 nt, Artificial Sequence
  CIITA targeting sequence
guagccucaucuggaaaaug

SEQ ID NO: 39474 - RNA, 20 nt, Artificial Sequence
  CIITA targeting sequence
caccaugccucaguagccuc

SEQ ID NO: 39475 - RNA, 20 nt, Artificial Sequence
  CIITA targeting sequence
gaauugcuccagcaaguggu

SEQ ID NO: 39476 - RNA, 20 nt, Artificial Sequence
  CIITA targeting sequence
gagcaugcuauacaucccac

SEQ ID NO: 39477 - RNA, 20 nt, Artificial Sequence
  CIITA targeting sequence
agcaagugguagaaccggga

SEQ ID NO: 39478 - RNA, 20 nt, Artificial Sequence
  CIITA targeting sequence
accacuugcuggagcaauuc

SEQ ID NO: 39479 - RNA, 20 nt, Artificial Sequence
  CIITA targeting sequence
cgguucuaccacuugcugga

SEQ ID NO: 39480 - RNA, 20 nt, Artificial Sequence
  CIITA targeting sequence
aaucccgguucuaccacuug

SEQ ID NO: 39481 - RNA, 20 nt, Artificial Sequence
  CIITA targeting sequence
ggguucaaaucccgguucua

SEQ ID NO: 39482 - RNA, 20 nt, Artificial Sequence
  CIITA targeting sequence
acugucuuaacucuuaacac

SEQ ID NO: 39483 - RNA, 20 nt, Artificial Sequence
  CIITA targeting sequence
uaacucuuaacacucccucc

SEQ ID NO: 39484 - RNA, 20 nt, Artificial Sequence
  CIITA targeting sequence
uaacacucccucccaugacc

SEQ ID NO: 39485 - RNA, 20 nt, Artificial Sequence
  CIITA targeting sequence
cucccaugaccuccccaugg

SEQ ID NO: 39486 - RNA, 20 nt, Artificial Sequence
  CIITA targeting sequence
caugaccuccccauggugag

SEQ ID NO: 39487 - RNA, 20 nt, Artificial Sequence
  CIITA targeting sequence
ugggagggaguguuaagagu

SEQ ID NO: 39488 - RNA, 20 nt, Artificial Sequence
  CIITA targeting sequence
ccauggugagugaguaguga

SEQ ID NO: 39489 - RNA, 20 nt, Artificial Sequence
  CIITA targeting sequence
ccauggggaggucaugggag

SEQ ID NO: 39490 - RNA, 20 nt, Artificial Sequence
  CIITA targeting sequence
cucaccauggggaggucaug

SEQ ID NO: 39491 - RNA, 20 nt, Artificial Sequence
  CIITA targeting sequence
cuacucacucaccaugggga

SEQ ID NO: 39492 - RNA, 20 nt, Artificial Sequence
  CIITA targeting sequence
agcgaagaaaaagcuuagug

SEQ ID NO: 39493 - RNA, 20 nt, Artificial Sequence
  CIITA targeting sequence
cuugaucacuacucacucac

SEQ ID NO: 39494 - RNA, 20 nt, Artificial Sequence
  CIITA targeting sequence
ucgcuugaucacuacucacu

SEQ ID NO: 39495 - RNA, 20 nt, Artificial Sequence
  CIITA targeting sequence
cuaagcuuuuucuucgcuug

SEQ ID NO: 39496 - RNA, 20 nt, Artificial Sequence
  CIITA targeting sequence
uuuacucacuaagcuuuuuc

SEQ ID NO: 39497 - RNA, 20 nt, Artificial Sequence
  CIITA targeting sequence
uucauuuacucacuaagcuu

SEQ ID NO: 39498 - RNA, 20 nt, Artificial Sequence
  CIITA targeting sequence
uuccuucauuuacucacuaa

SEQ ID NO: 39499 - RNA, 20 nt, Artificial Sequence
  CIITA targeting sequence
cauuccuucauuuacucacu

SEQ ID NO: 39500 - RNA, 20 nt, Artificial Sequence
  CIITA targeting sequence
uuucucauuccuucauuuac

SEQ ID NO: 39501 - RNA, 20 nt, Artificial Sequence
  CIITA targeting sequence
cagcacuuugggaggccaag

SEQ ID NO: 39502 - RNA, 20 nt, Artificial Sequence
  CIITA targeting sequence
caaagugcugggauuacagg

SEQ ID NO: 39503 - RNA, 20 nt, Artificial Sequence
  CIITA targeting sequence
accugccuuggccucccaaa

SEQ ID NO: 39504 - RNA, 20 nt, Artificial Sequence
  CIITA targeting sequence
ccugaggucaggaguucgag

SEQ ID NO: 39505 - RNA, 20 nt, Artificial Sequence
  CIITA targeting sequence
ggugauccaccugccuuggc

SEQ ID NO: 39506 - RNA, 20 nt, Artificial Sequence
  CIITA targeting sequence
ggaguucgagaccagccugg

SEQ ID NO: 39507 - RNA, 20 nt, Artificial Sequence
  CIITA targeting sequence
ugaccucaggugauccaccu

SEQ ID NO: 39508 - RNA, 20 nt, Artificial Sequence
  CIITA targeting sequence
agaccagccuggccaacaua

SEQ ID NO: 39509 - RNA, 20 nt, Artificial Sequence
  CIITA targeting sequence
aacuccugaccucaggugau

SEQ ID NO: 39510 - RNA, 20 nt, Artificial Sequence
  CIITA targeting sequence
cgaacuccugaccucaggug

SEQ ID NO: 39511 - RNA, 20 nt, Artificial Sequence
  CIITA targeting sequence
cuauguuggccaggcugguc

SEQ ID NO: 39512 - RNA, 20 nt, Artificial Sequence
  CIITA targeting sequence
ccauuaaaaaauacaaaaau

SEQ ID NO: 39513 - RNA, 20 nt, Artificial Sequence
  CIITA targeting sequence
auuaaaaaauacaaaaauua

SEQ ID NO: 39514 - RNA, 20 nt, Artificial Sequence
  CIITA targeting sequence
ggcuaauuuuuguauuuuuu

SEQ ID NO: 39515 - RNA, 20 nt, Artificial Sequence
  CIITA targeting sequence
cagcuacuuggcaggccgag

SEQ ID NO: 39516 - RNA, 20 nt, Artificial Sequence
  CIITA targeting sequence
gccugccaaguagcugggau

SEQ ID NO: 39517 - RNA, 20 nt, Artificial Sequence
  CIITA targeting sequence
ugccucggccugccaaguag

SEQ ID NO: 39518 - RNA, 20 nt, Artificial Sequence
  CIITA targeting sequence
ccugccucggccugccaagu

SEQ ID NO: 39519 - RNA, 20 nt, Artificial Sequence
  CIITA targeting sequence
ccuaaacccaggagguggag

SEQ ID NO: 39520 - RNA, 20 nt, Artificial Sequence
  CIITA targeting sequence
uggguuuaggcgauucuccu

SEQ ID NO: 39521 - RNA, 20 nt, Artificial Sequence
  CIITA targeting sequence
accuccuggguuuaggcgau

SEQ ID NO: 39522 - RNA, 20 nt, Artificial Sequence
  CIITA targeting sequence
cggcaaccuccaccuccugg

SEQ ID NO: 39523 - RNA, 20 nt, Artificial Sequence
  CIITA targeting sequence
gcucacggcaaccuccaccu

SEQ ID NO: 39524 - RNA, 20 nt, Artificial Sequence
  CIITA targeting sequence
cagcucacggcaaccuccac

SEQ ID NO: 39525 - RNA, 20 nt, Artificial Sequence
  CIITA targeting sequence
agccuggggcacagggcagg

SEQ ID NO: 39526 - RNA, 20 nt, Artificial Sequence
  CIITA targeting sequence
ugcccugugccccaggcugg

SEQ ID NO: 39527 - RNA, 20 nt, Artificial Sequence
  CIITA targeting sequence
aucucaaaaaaaaaaaagag

SEQ ID NO: 39528 - RNA, 20 nt, Artificial Sequence
  CIITA targeting sequence
caaaaaaaaaaaagagagaa

SEQ ID NO: 39529 - RNA, 20 nt, Artificial Sequence
  CIITA targeting sequence
aaaaaaaaaaagagagaaaa

SEQ ID NO: 39530 - RNA, 20 nt, Artificial Sequence
  CIITA targeting sequence
uuuuuuuuuuugagauggau

SEQ ID NO: 39531 - RNA, 20 nt, Artificial Sequence
  CIITA targeting sequence
cuuuuuuuuuuuugagaugg

SEQ ID NO: 39532 - RNA, 20 nt, Artificial Sequence
  CIITA targeting sequence
cucuuuuuuuuuuuugagau

SEQ ID NO: 39533 - RNA, 20 nt, Artificial Sequence
  CIITA targeting sequence
aaaaggaguggacacuuaaa

SEQ ID NO: 39534 - RNA, 20 nt, Artificial Sequence
  CIITA targeting sequence
uuuuagaccuuuucucucuu

SEQ ID NO: 39535 - RNA, 20 nt, Artificial Sequence
  CIITA targeting sequence
acuccuuuuagaccuuuucu

SEQ ID NO: 39536 - RNA, 20 nt, Artificial Sequence
  CIITA targeting sequence
uguuuaaguguccacuccuu

SEQ ID NO: 39537 - RNA, 20 nt, Artificial Sequence
  CIITA targeting sequence
cuuguuuaaguguccacucc

SEQ ID NO: 39538 - RNA, 20 nt, Artificial Sequence
  CIITA targeting sequence
cucuuguuuaaguguccacu

SEQ ID NO: 39539 - RNA, 20 nt, Artificial Sequence
  CIITA targeting sequence
ucucucuuguuuaagugucc

SEQ ID NO: 39540 - RNA, 20 nt, Artificial Sequence
  CIITA targeting sequence
ucgucucucuuguuuaagug

SEQ ID NO: 39541 - RNA, 20 nt, Artificial Sequence
  CIITA targeting sequence
cucaucgucucucuuguuua

SEQ ID NO: 39542 - RNA, 20 nt, Artificial Sequence
  CIITA targeting sequence
uucacucaucgucucucuug

SEQ ID NO: 39543 - RNA, 20 nt, Artificial Sequence
  CIITA targeting sequence
acacccauuccuucacucau

SEQ ID NO: 39544 - RNA, 20 nt, Artificial Sequence
  CIITA targeting sequence
uuuccacacccauuccuuca

SEQ ID NO: 39545 - RNA, 20 nt, Artificial Sequence
  CIITA targeting sequence
cucauuuccacacccauucc

SEQ ID NO: 39546 - RNA, 20 nt, Artificial Sequence
  CIITA targeting sequence
uuaguucacucauuuccaca

SEQ ID NO: 39547 - RNA, 20 nt, Artificial Sequence
  CIITA targeting sequence
uucauuaguucacucauuuc

SEQ ID NO: 39548 - RNA, 20 nt, Artificial Sequence
  CIITA targeting sequence
cccaccacucauucauuagu

SEQ ID NO: 39549 - RNA, 20 nt, Artificial Sequence
  CIITA targeting sequence
gucacccaccacucauucau

SEQ ID NO: 39550 - RNA, 20 nt, Artificial Sequence
  CIITA targeting sequence
uucagucacccaccacucau

SEQ ID NO: 39551 - RNA, 20 nt, Artificial Sequence
  CIITA targeting sequence
uuugcuucauucagucaccc

SEQ ID NO: 39552 - RNA, 20 nt, Artificial Sequence
  CIITA targeting sequence
ucauuugcuucauucaguca

SEQ ID NO: 39553 - RNA, 20 nt, Artificial Sequence
  CIITA targeting sequence
ucaucauuugcuucauucag

SEQ ID NO: 39554 - RNA, 20 nt, Artificial Sequence
  CIITA targeting sequence
ggcccccauacagucuucau

SEQ ID NO: 39555 - RNA, 20 nt, Artificial Sequence
  CIITA targeting sequence
caccuguaaucccagcacuu

SEQ ID NO: 39556 - RNA, 20 nt, Artificial Sequence
  CIITA targeting sequence
cagcacuuugggaggccaag

SEQ ID NO: 39557 - RNA, 20 nt, Artificial Sequence
  CIITA targeting sequence
caaagugcugggauuacagg

SEQ ID NO: 39558 - RNA, 20 nt, Artificial Sequence
  CIITA targeting sequence
gccuuggccucccaaagugc

SEQ ID NO: 39559 - RNA, 20 nt, Artificial Sequence
  CIITA targeting sequence
uuccgccuuggccucccaaa

SEQ ID NO: 39560 - RNA, 20 nt, Artificial Sequence
  CIITA targeting sequence
agcaaucguuccgccuuggc

SEQ ID NO: 39561 - RNA, 20 nt, Artificial Sequence
  CIITA targeting sequence
ugggcucaagcaaucguucc

SEQ ID NO: 39562 - RNA, 20 nt, Artificial Sequence
  CIITA targeting sequence
agaccagccugggcaaaaua

SEQ ID NO: 39563 - RNA, 20 nt, Artificial Sequence
  CIITA targeting sequence
ugagcuccugggcucaagca

SEQ ID NO: 39564 - RNA, 20 nt, Artificial Sequence
  CIITA targeting sequence
cuauuuugcccaggcugguc

SEQ ID NO: 39565 - RNA, 20 nt, Artificial Sequence
  CIITA targeting sequence
cacuauuuugcccaggcugg

SEQ ID NO: 39566 - RNA, 20 nt, Artificial Sequence
  CIITA targeting sequence
ccacaaaaaaacaaaaaaga

SEQ ID NO: 39567 - RNA, 20 nt, Artificial Sequence
  CIITA targeting sequence
acaaaaaaacaaaaaagaaa

SEQ ID NO: 39568 - RNA, 20 nt, Artificial Sequence
  CIITA targeting sequence
uuuuuguuuuuuuguggaga

SEQ ID NO: 39569 - RNA, 20 nt, Artificial Sequence
  CIITA targeting sequence
cagcuacucaggaggcugag

SEQ ID NO: 39570 - RNA, 20 nt, Artificial Sequence
  CIITA targeting sequence
ggaggcugaggugggaggau

SEQ ID NO: 39571 - RNA, 20 nt, Artificial Sequence
  CIITA targeting sequence
ugaguagcugggacuacagg

SEQ ID NO: 39572 - RNA, 20 nt, Artificial Sequence
  CIITA targeting sequence
gccuccugaguagcugggac

SEQ ID NO: 39573 - RNA, 20 nt, Artificial Sequence
  CIITA targeting sequence
caccucagccuccugaguag

SEQ ID NO: 39574 - RNA, 20 nt, Artificial Sequence
  CIITA targeting sequence
ucccaccucagccuccugag

SEQ ID NO: 39575 - RNA, 20 nt, Artificial Sequence
  CIITA targeting sequence
agcaauccucccaccucagc

SEQ ID NO: 39576 - RNA, 20 nt, Artificial Sequence
  CIITA targeting sequence
caggcucaagcaauccuccc

SEQ ID NO: 39577 - RNA, 20 nt, Artificial Sequence
  CIITA targeting sequence
accucacaggcucaagcaau

SEQ ID NO: 39578 - RNA, 20 nt, Artificial Sequence
  CIITA targeting sequence
accacagcuucaaccucaca

SEQ ID NO: 39579 - RNA, 20 nt, Artificial Sequence
  CIITA targeting sequence
ugguccaccacagcuucaac

SEQ ID NO: 39580 - RNA, 20 nt, Artificial Sequence
  CIITA targeting sequence
cccaggcuggcgugcaaugg

SEQ ID NO: 39581 - RNA, 20 nt, Artificial Sequence
  CIITA targeting sequence
cuaugucgcccaggcuggcg

SEQ ID NO: 39582 - RNA, 20 nt, Artificial Sequence
  CIITA targeting sequence
cacuaugucgcccaggcugg

SEQ ID NO: 39583 - RNA, 20 nt, Artificial Sequence
  CIITA targeting sequence
cuacaaaaaaaucaaaaaau

SEQ ID NO: 39584 - RNA, 20 nt, Artificial Sequence
  CIITA targeting sequence
acaaaaaaaucaaaaaauua

SEQ ID NO: 39585 - RNA, 20 nt, Artificial Sequence
  CIITA targeting sequence
aaaaauuaucugggcauggu

SEQ ID NO: 39586 - RNA, 20 nt, Artificial Sequence
  CIITA targeting sequence
gggcauggugucacaugucu

SEQ ID NO: 39587 - RNA, 20 nt, Artificial Sequence
  CIITA targeting sequence
caugucuguggucccagcua

SEQ ID NO: 39588 - RNA, 20 nt, Artificial Sequence
  CIITA targeting sequence
guggucccagcuacuuggga

SEQ ID NO: 39589 - RNA, 20 nt, Artificial Sequence
  CIITA targeting sequence
cagcuacuugggagguggag

SEQ ID NO: 39590 - RNA, 20 nt, Artificial Sequence
  CIITA targeting sequence
caaguagcugggaccacaga

SEQ ID NO: 39591 - RNA, 20 nt, Artificial Sequence
  CIITA targeting sequence
accucccaaguagcugggac

SEQ ID NO: 39592 - RNA, 20 nt, Artificial Sequence
  CIITA targeting sequence
ggaggaucgcaugagcccag

SEQ ID NO: 39593 - RNA, 20 nt, Artificial Sequence
  CIITA targeting sequence
ugacuccaccucccaaguag

SEQ ID NO: 39594 - RNA, 20 nt, Artificial Sequence
  CIITA targeting sequence
uccugacuccaccucccaag

SEQ ID NO: 39595 - RNA, 20 nt, Artificial Sequence
  CIITA targeting sequence
caugagcccaggagguugag

SEQ ID NO: 39596 - RNA, 20 nt, Artificial Sequence
  CIITA targeting sequence
ugcgauccuccugacuccac

SEQ ID NO: 39597 - RNA, 20 nt, Artificial Sequence
  CIITA targeting sequence
ugggcucaugcgauccuccu

SEQ ID NO: 39598 - RNA, 20 nt, Artificial Sequence
  CIITA targeting sequence
accuccugggcucaugcgau

SEQ ID NO: 39599 - RNA, 20 nt, Artificial Sequence
  CIITA targeting sequence
cugcaaccucaaccuccugg

SEQ ID NO: 39600 - RNA, 20 nt, Artificial Sequence
  CIITA targeting sequence
cagcucgcugcaaccucaac

SEQ ID NO: 39601 - RNA, 20 nt, Artificial Sequence
  CIITA targeting sequence
caccacugcauuccagccug

SEQ ID NO: 39602 - RNA, 20 nt, Artificial Sequence
  CIITA targeting sequence
agccugggcaaaaaagccag

SEQ ID NO: 39603 - RNA, 20 nt, Artificial Sequence
  CIITA targeting sequence
ggcuuuuuugcccaggcugg

SEQ ID NO: 39604 - RNA, 20 nt, Artificial Sequence
  CIITA targeting sequence
caaaacaaaacaaaacaaac

SEQ ID NO: 39605 - RNA, 20 nt, Artificial Sequence
  CIITA targeting sequence
aaacaaaacaaaacaaacaa

SEQ ID NO: 39606 - RNA, 20 nt, Artificial Sequence
  CIITA targeting sequence
ccacacaguuuuuuuguuug

SEQ ID NO: 39607 - RNA, 20 nt, Artificial Sequence
  CIITA targeting sequence
guuccccacacaguuuuuuu

SEQ ID NO: 39608 - RNA, 20 nt, Artificial Sequence
  CIITA targeting sequence
uuuacaucuguuccccacac

SEQ ID NO: 39609 - RNA, 20 nt, Artificial Sequence
  CIITA targeting sequence
cacauacccccacccugaca

SEQ ID NO: 39610 - RNA, 20 nt, Artificial Sequence
  CIITA targeting sequence
cauacccccacccugacacg

SEQ ID NO: 39611 - RNA, 20 nt, Artificial Sequence
  CIITA targeting sequence
ggguggggguaugugagagg

SEQ ID NO: 39612 - RNA, 20 nt, Artificial Sequence
  CIITA targeting sequence
gcaaaggccaggggcguguc

SEQ ID NO: 39613 - RNA, 20 nt, Artificial Sequence
  CIITA targeting sequence
accggcucugcaaaggccag

SEQ ID NO: 39614 - RNA, 20 nt, Artificial Sequence
  CIITA targeting sequence
accgcucacugcaggacacg

SEQ ID NO: 39615 - RNA, 20 nt, Artificial Sequence
  CIITA targeting sequence
cugcaggacacguauggugc

SEQ ID NO: 39616 - RNA, 20 nt, Artificial Sequence
  CIITA targeting sequence
ugcagugagcgguagaacug

SEQ ID NO: 39617 - RNA, 20 nt, Artificial Sequence
  CIITA targeting sequence
gcaccauacguguccugcag

SEQ ID NO: 39618 - RNA, 20 nt, Artificial Sequence
  CIITA targeting sequence
gggccugcgggcucggcacc

SEQ ID NO: 39619 - RNA, 20 nt, Artificial Sequence
  CIITA targeting sequence
uaguggagguggaucuggug

SEQ ID NO: 39620 - RNA, 20 nt, Artificial Sequence
  CIITA targeting sequence
acuaggaugccauccgggcc

SEQ ID NO: 39621 - RNA, 20 nt, Artificial Sequence
  CIITA targeting sequence
accuccacuaggaugccauc

SEQ ID NO: 39622 - RNA, 20 nt, Artificial Sequence
  CIITA targeting sequence
ggugcaggccaggcuggaga

SEQ ID NO: 39623 - RNA, 20 nt, Artificial Sequence
  CIITA targeting sequence
agccuggccugcaccagauc

SEQ ID NO: 39624 - RNA, 20 nt, Artificial Sequence
  CIITA targeting sequence
ccagccuggccugcaccaga

SEQ ID NO: 39625 - RNA, 20 nt, Artificial Sequence
  CIITA targeting sequence
ucuccagccuggccugcacc

SEQ ID NO: 39626 - RNA, 20 nt, Artificial Sequence
  CIITA targeting sequence
ugcugcugcuccucuccagc

SEQ ID NO: 39627 - RNA, 20 nt, Artificial Sequence
  CIITA targeting sequence
aggcucuugcugcugcuccu

SEQ ID NO: 39628 - RNA, 20 nt, Artificial Sequence
  CIITA targeting sequence
cgcuccaggcucuugcugcu

SEQ ID NO: 39629 - RNA, 20 nt, Artificial Sequence
  CIITA targeting sequence
gggguggccaguucccgcuc

SEQ ID NO: 39630 - RNA, 20 nt, Artificial Sequence
  CIITA targeting sequence
gcccaguccgggguggccag

SEQ ID NO: 39631 - RNA, 20 nt, Artificial Sequence
  CIITA targeting sequence
uugggccagcugccguucug

SEQ ID NO: 39632 - RNA, 20 nt, Artificial Sequence
  CIITA targeting sequence
gccaggccuccuugggccag

SEQ ID NO: 39633 - RNA, 20 nt, Artificial Sequence
  CIITA targeting sequence
uuggcagccaacagcaccuc

SEQ ID NO: 39634 - RNA, 20 nt, Artificial Sequence
  CIITA targeting sequence
cgcggccgccggugcuccuu

SEQ ID NO: 39635 - RNA, 20 nt, Artificial Sequence
  CIITA targeting sequence
cacgcggccgccggugcucc

SEQ ID NO: 39636 - RNA, 20 nt, Artificial Sequence
  CIITA targeting sequence
ugucucacgcggccgccggu

SEQ ID NO: 39637 - RNA, 20 nt, Artificial Sequence
  CIITA targeting sequence
cucgugucucacgcggccgc

SEQ ID NO: 39638 - RNA, 20 nt, Artificial Sequence
  CIITA targeting sequence
gggcaagagcuauugggcug

SEQ ID NO: 39639 - RNA, 20 nt, Artificial Sequence
  CIITA targeting sequence
ugcccugaccagcuuugccc

SEQ ID NO: 39640 - RNA, 20 nt, Artificial Sequence
  CIITA targeting sequence
cugccccagcccaauagcuc

SEQ ID NO: 39641 - RNA, 20 nt, Artificial Sequence
  CIITA targeting sequence
ccaguacgacuuugucuucu

SEQ ID NO: 39642 - RNA, 20 nt, Artificial Sequence
  CIITA targeting sequence
uacuggggaagccggccaca

SEQ ID NO: 39643 - RNA, 20 nt, Artificial Sequence
  CIITA targeting sequence
ucucuguccccugccauugc

SEQ ID NO: 39644 - RNA, 20 nt, Artificial Sequence
  CIITA targeting sequence
cuguccccugccauugcuug

SEQ ID NO: 39645 - RNA, 20 nt, Artificial Sequence
  CIITA targeting sequence
guccccugccauugcuugaa

SEQ ID NO: 39646 - RNA, 20 nt, Artificial Sequence
  CIITA targeting sequence
ccugccauugcuugaaccgu

SEQ ID NO: 39647 - RNA, 20 nt, Artificial Sequence
  CIITA targeting sequence
agcaauggcaggggacagag

SEQ ID NO: 39648 - RNA, 20 nt, Artificial Sequence
  CIITA targeting sequence
gggggaugccuauggccugc

SEQ ID NO: 39649 - RNA, 20 nt, Artificial Sequence
  CIITA targeting sequence
cccggacgguucaagcaaug

SEQ ID NO: 39650 - RNA, 20 nt, Artificial Sequence
  CIITA targeting sequence
ugcaggccauaggcaucccc

SEQ ID NO: 39651 - RNA, 20 nt, Artificial Sequence
  CIITA targeting sequence
gcucuucucccugggcccac

SEQ ID NO: 39652 - RNA, 20 nt, Artificial Sequence
  CIITA targeting sequence
ucucccugggcccacagcca

SEQ ID NO: 39653 - RNA, 20 nt, Artificial Sequence
  CIITA targeting sequence
cccugggcccacagccacuc

SEQ ID NO: 39654 - RNA, 20 nt, Artificial Sequence
  CIITA targeting sequence
cugggcccacagccacucgu

SEQ ID NO: 39655 - RNA, 20 nt, Artificial Sequence
  CIITA targeting sequence
uggcggccgaugagguuuuc

SEQ ID NO: 39656 - RNA, 20 nt, Artificial Sequence
  CIITA targeting sequence
gccgccacgaguggcugugg

SEQ ID NO: 39657 - RNA, 20 nt, Artificial Sequence
  CIITA targeting sequence
ucggccgccacgaguggcug

SEQ ID NO: 39658 - RNA, 20 nt, Artificial Sequence
  CIITA targeting sequence
gccacaucuugaagagaccu

SEQ ID NO: 39659 - RNA, 20 nt, Artificial Sequence
  CIITA targeting sequence
ugaagagaccugaccgcguu

SEQ ID NO: 39660 - RNA, 20 nt, Artificial Sequence
  CIITA targeting sequence
agauguggcugaaaaccuca

SEQ ID NO: 39661 - RNA, 20 nt, Artificial Sequence
  CIITA targeting sequence
ucaagauguggcugaaaacc

SEQ ID NO: 39662 - RNA, 20 nt, Artificial Sequence
  CIITA targeting sequence
cuucaagauguggcugaaaa

SEQ ID NO: 39663 - RNA, 20 nt, Artificial Sequence
  CIITA targeting sequence
ggucucuucaagauguggcu

SEQ ID NO: 39664 - RNA, 20 nt, Artificial Sequence
  CIITA targeting sequence
gcucauccuagacggcuucg

SEQ ID NO: 39665 - RNA, 20 nt, Artificial Sequence
  CIITA targeting sequence
uccuagacggcuucgaggag

SEQ ID NO: 39666 - RNA, 20 nt, Artificial Sequence
  CIITA targeting sequence
uagacggcuucgaggagcug

SEQ ID NO: 39667 - RNA, 20 nt, Artificial Sequence
  CIITA targeting sequence
aggaugagcagaacgcgguc

SEQ ID NO: 39668 - RNA, 20 nt, Artificial Sequence
  CIITA targeting sequence
aggagcuggaagcgcaagau

SEQ ID NO: 39669 - RNA, 20 nt, Artificial Sequence
  CIITA targeting sequence
aagccgucuaggaugagcag

SEQ ID NO: 39670 - RNA, 20 nt, Artificial Sequence
  CIITA targeting sequence
ucgaagccgucuaggaugag

SEQ ID NO: 39671 - RNA, 20 nt, Artificial Sequence
  CIITA targeting sequence
agcuccucgaagccgucuag

SEQ ID NO: 39672 - RNA, 20 nt, Artificial Sequence
  CIITA targeting sequence
ugcgcuuccagcuccucgaa

SEQ ID NO: 39673 - RNA, 20 nt, Artificial Sequence
  CIITA targeting sequence
ugcacagcacgugcggaccg

SEQ ID NO: 39674 - RNA, 20 nt, Artificial Sequence
  CIITA targeting sequence
gcacgugcugugcaggaagc

SEQ ID NO: 39675 - RNA, 20 nt, Artificial Sequence
  CIITA targeting sequence
gccggugccgguccgcacgu

SEQ ID NO: 39676 - RNA, 20 nt, Artificial Sequence
  CIITA targeting sequence
cuccgggggcugcuggccgg

SEQ ID NO: 39677 - RNA, 20 nt, Artificial Sequence
  CIITA targeting sequence
gggggcugcuggccggccuu

SEQ ID NO: 39678 - RNA, 20 nt, Artificial Sequence
  CIITA targeting sequence
agaagaagcugcuccgaggu

SEQ ID NO: 39679 - RNA, 20 nt, Artificial Sequence
  CIITA targeting sequence
ggaaaaggccggccagcagc

SEQ ID NO: 39680 - RNA, 20 nt, Artificial Sequence
  CIITA targeting sequence
ucuggaaaaggccggccagc

SEQ ID NO: 39681 - RNA, 20 nt, Artificial Sequence
  CIITA targeting sequence
gagguugcacccuccuccuc

SEQ ID NO: 39682 - RNA, 20 nt, Artificial Sequence
  CIITA targeting sequence
gagcagcuucuucuggaaaa

SEQ ID NO: 39683 - RNA, 20 nt, Artificial Sequence
  CIITA targeting sequence
uccucacagcccggccccgg

SEQ ID NO: 39684 - RNA, 20 nt, Artificial Sequence
  CIITA targeting sequence
ucacagcccggccccggggc

SEQ ID NO: 39685 - RNA, 20 nt, Artificial Sequence
  CIITA targeting sequence
cagcccggccccggggccgc

SEQ ID NO: 39686 - RNA, 20 nt, Artificial Sequence
  CIITA targeting sequence
agagccugagcaaggccgac

SEQ ID NO: 39687 - RNA, 20 nt, Artificial Sequence
  CIITA targeting sequence
ggaccaggcggccccggggc

SEQ ID NO: 39688 - RNA, 20 nt, Artificial Sequence
  CIITA targeting sequence
ggcucuggaccaggcggccc

SEQ ID NO: 39689 - RNA, 20 nt, Artificial Sequence
  CIITA targeting sequence
gccuugcucaggcucuggac

SEQ ID NO: 39690 - RNA, 20 nt, Artificial Sequence
  CIITA targeting sequence
aauagggcgucggccuugcu

SEQ ID NO: 39691 - RNA, 20 nt, Artificial Sequence
  CIITA targeting sequence
ggcuucuccauggagcaggc

SEQ ID NO: 39692 - RNA, 20 nt, Artificial Sequence
  CIITA targeting sequence
ccauggagcaggcccaggca

SEQ ID NO: 39693 - RNA, 20 nt, Artificial Sequence
  CIITA targeting sequence
auggagcaggcccaggcaua

SEQ ID NO: 39694 - RNA, 20 nt, Artificial Sequence
  CIITA targeting sequence
auggagaagccggacagcuc

SEQ ID NO: 39695 - RNA, 20 nt, Artificial Sequence
  CIITA targeting sequence
cguaugccugggccugcucc

SEQ ID NO: 39696 - RNA, 20 nt, Artificial Sequence
  CIITA targeting sequence
aaguagcgcaucacguaugc

SEQ ID NO: 39697 - RNA, 20 nt, Artificial Sequence
  CIITA targeting sequence
caaaguagcgcaucacguau

SEQ ID NO: 39698 - RNA, 20 nt, Artificial Sequence
  CIITA targeting sequence
gggaugacagagcaccaaga

SEQ ID NO: 39699 - RNA, 20 nt, Artificial Sequence
  CIITA targeting sequence
cugagcucucaaaguagcgc

SEQ ID NO: 39700 - RNA, 20 nt, Artificial Sequence
  CIITA targeting sequence
ucccugagcucucaaaguag

SEQ ID NO: 39701 - RNA, 20 nt, Artificial Sequence
  CIITA targeting sequence
gucaucccugagcucucaaa

SEQ ID NO: 39702 - RNA, 20 nt, Artificial Sequence
  CIITA targeting sequence
uggugcucugucaucccuga

SEQ ID NO: 39703 - RNA, 20 nt, Artificial Sequence
  CIITA targeting sequence
gucuuggugcucugucaucc

SEQ ID NO: 39704 - RNA, 20 nt, Artificial Sequence
  CIITA targeting sequence
gggcucugucuuggugcucu

SEQ ID NO: 39705 - RNA, 20 nt, Artificial Sequence
  CIITA targeting sequence
uccgggaccggccacuucuu

SEQ ID NO: 39706 - RNA, 20 nt, Artificial Sequence
  CIITA targeting sequence
gggaccggccacuucuucuc

SEQ ID NO: 39707 - RNA, 20 nt, Artificial Sequence
  CIITA targeting sequence
cggaggagcgucagggcucu

SEQ ID NO: 39708 - RNA, 20 nt, Artificial Sequence
  CIITA targeting sequence
ucucagucacagccacagcc

SEQ ID NO: 39709 - RNA, 20 nt, Artificial Sequence
  CIITA targeting sequence
cagucacagccacagcccua

SEQ ID NO: 39710 - RNA, 20 nt, Artificial Sequence
  CIITA targeting sequence
gucacagccacagcccuacu

SEQ ID NO: 39711 - RNA, 20 nt, Artificial Sequence
  CIITA targeting sequence
cagccacagcccuacuuugu

SEQ ID NO: 39712 - RNA, 20 nt, Artificial Sequence
  CIITA targeting sequence
cagaggcccugcuggagcuu

SEQ ID NO: 39713 - RNA, 20 nt, Artificial Sequence
  CIITA targeting sequence
gaggcccugcuggagcuugg

SEQ ID NO: 39714 - RNA, 20 nt, Artificial Sequence
  CIITA targeting sequence
gagagcuggcacacugcccg

SEQ ID NO: 39715 - RNA, 20 nt, Artificial Sequence
  CIITA targeting sequence
agcagggccucugagagcug

SEQ ID NO: 39716 - RNA, 20 nt, Artificial Sequence
  CIITA targeting sequence
ccaagcuccagcagggccuc

SEQ ID NO: 39717 - RNA, 20 nt, Artificial Sequence
  CIITA targeting sequence
uccccaagcuccagcagggc

SEQ ID NO: 39718 - RNA, 20 nt, Artificial Sequence
  CIITA targeting sequence
acgcucacgggacucuaugu

SEQ ID NO: 39719 - RNA, 20 nt, Artificial Sequence
  CIITA targeting sequence
cgggacucuaugucggccug

SEQ ID NO: 39720 - RNA, 20 nt, Artificial Sequence
  CIITA targeting sequence
cgugagcguggagggcagcu

SEQ ID NO: 39721 - RNA, 20 nt, Artificial Sequence
  CIITA targeting sequence
augucggccugcugggccgu

SEQ ID NO: 39722 - RNA, 20 nt, Artificial Sequence
  CIITA targeting sequence
gccugcugggccgugcagcc

SEQ ID NO: 39723 - RNA, 20 nt, Artificial Sequence
  CIITA targeting sequence
acagcccccccggggcccug

SEQ ID NO: 39724 - RNA, 20 nt, Artificial Sequence
  CIITA targeting sequence
agggcugcacggcccagcag

SEQ ID NO: 39725 - RNA, 20 nt, Artificial Sequence
  CIITA targeting sequence
gccagggccccgggggggcu

SEQ ID NO: 39726 - RNA, 20 nt, Artificial Sequence
  CIITA targeting sequence
caggccagcuuggccagcuc

SEQ ID NO: 39727 - RNA, 20 nt, Artificial Sequence
  CIITA targeting sequence
gcggcccagcucccaggcca

SEQ ID NO: 39728 - RNA, 20 nt, Artificial Sequence
  CIITA targeting sequence
aaguacccuacaggaggacc

SEQ ID NO: 39729 - RNA, 20 nt, Artificial Sequence
  CIITA targeting sequence
uguaggguacuuugaugucu

SEQ ID NO: 39730 - RNA, 20 nt, Artificial Sequence
  CIITA targeting sequence
uccuguaggguacuuugaug

SEQ ID NO: 39731 - RNA, 20 nt, Artificial Sequence
  CIITA targeting sequence
cauccgcagacgugaggacc

SEQ ID NO: 39732 - RNA, 20 nt, Artificial Sequence
  CIITA targeting sequence
gcagacgugaggaccugggc

SEQ ID NO: 39733 - RNA, 20 nt, Artificial Sequence
  CIITA targeting sequence
gcggaugggaacugguccuc

SEQ ID NO: 39734 - RNA, 20 nt, Artificial Sequence
  CIITA targeting sequence
cgucugcggaugggaacugg

SEQ ID NO: 39735 - RNA, 20 nt, Artificial Sequence
  CIITA targeting sequence
ucacgucugcggaugggaac

SEQ ID NO: 39736 - RNA, 20 nt, Artificial Sequence
  CIITA targeting sequence
cccagguccucacgucugcg

SEQ ID NO: 39737 - RNA, 20 nt, Artificial Sequence
  CIITA targeting sequence
aacacccaccgcgggccgca

SEQ ID NO: 39738 - RNA, 20 nt, Artificial Sequence
  CIITA targeting sequence
gcggcccgcgguggguguug

SEQ ID NO: 39739 - RNA, 20 nt, Artificial Sequence
  CIITA targeting sequence
gagcuggccuuccccagcuu

SEQ ID NO: 39740 - RNA, 20 nt, Artificial Sequence
  CIITA targeting sequence
gacucugcggcccgcggugg

SEQ ID NO: 39741 - RNA, 20 nt, Artificial Sequence
  CIITA targeting sequence
ccagcuuccuccugcaaugc

SEQ ID NO: 39742 - RNA, 20 nt, Artificial Sequence
  CIITA targeting sequence
uccugcaaugcuuccugggg

SEQ ID NO: 39743 - RNA, 20 nt, Artificial Sequence
  CIITA targeting sequence
ugcaaugcuuccugggggcc

SEQ ID NO: 39744 - RNA, 20 nt, Artificial Sequence
  CIITA targeting sequence
ugggggcccuguggcuggcu

SEQ ID NO: 39745 - RNA, 20 nt, Artificial Sequence
  CIITA targeting sequence
gaguggcgaaaucaaggaca

SEQ ID NO: 39746 - RNA, 20 nt, Artificial Sequence
  CIITA targeting sequence
gagccagccacagggccccc

SEQ ID NO: 39747 - RNA, 20 nt, Artificial Sequence
  CIITA targeting sequence
ccacucagagccagccacag

SEQ ID NO: 39748 - RNA, 20 nt, Artificial Sequence
  CIITA targeting sequence
aggacaaggagcucccgcag

SEQ ID NO: 39749 - RNA, 20 nt, Artificial Sequence
  CIITA targeting sequence
uugauuucgccacucagagc

SEQ ID NO: 39750 - RNA, 20 nt, Artificial Sequence
  CIITA targeting sequence
uuguccuugauuucgccacu

SEQ ID NO: 39751 - RNA, 20 nt, Artificial Sequence
  CIITA targeting sequence
cgcaguaccuagcauugacc

SEQ ID NO: 39752 - RNA, 20 nt, Artificial Sequence
  CIITA targeting sequence
augcuagguacugcgggagc

SEQ ID NO: 39753 - RNA, 20 nt, Artificial Sequence
  CIITA targeting sequence
uuggggucaaugcuagguac

SEQ ID NO: 39754 - RNA, 20 nt, Artificial Sequence
  CIITA targeting sequence
uccuuggggucaaugcuagg

SEQ ID NO: 39755 - RNA, 20 nt, Artificial Sequence
  CIITA targeting sequence
ucuuccuuggggucaaugcu

SEQ ID NO: 39756 - RNA, 20 nt, Artificial Sequence
  CIITA targeting sequence
uagggccucuucuuccuugg

SEQ ID NO: 39757 - RNA, 20 nt, Artificial Sequence
  CIITA targeting sequence
agccaguugucauagggccu

SEQ ID NO: 39758 - RNA, 20 nt, Artificial Sequence
  CIITA targeting sequence
ggcugggcugaucuuccagc

SEQ ID NO: 39759 - RNA, 20 nt, Artificial Sequence
  CIITA targeting sequence
gcccagccagaaagcguggc

SEQ ID NO: 39760 - RNA, 20 nt, Artificial Sequence
  CIITA targeting sequence
uccagccucccgcccgcugc

SEQ ID NO: 39761 - RNA, 20 nt, Artificial Sequence
  CIITA targeting sequence
agccucccgcccgcugccug

SEQ ID NO: 39762 - RNA, 20 nt, Artificial Sequence
  CIITA targeting sequence
cgcccgcugccugggagccc

SEQ ID NO: 39763 - RNA, 20 nt, Artificial Sequence
  CIITA targeting sequence
caggcagcgggcgggaggcu

SEQ ID NO: 39764 - RNA, 20 nt, Artificial Sequence
  CIITA targeting sequence
ggccaucggcggcugccucg

SEQ ID NO: 39765 - RNA, 20 nt, Artificial Sequence
  CIITA targeting sequence
gcggcugccucgguggacag

SEQ ID NO: 39766 - RNA, 20 nt, Artificial Sequence
  CIITA targeting sequence
guggacaggaagcagaaggu

SEQ ID NO: 39767 - RNA, 20 nt, Artificial Sequence
  CIITA targeting sequence
accgaggcagccgccgaugg

SEQ ID NO: 39768 - RNA, 20 nt, Artificial Sequence
  CIITA targeting sequence
uguccaccgaggcagccgcc

SEQ ID NO: 39769 - RNA, 20 nt, Artificial Sequence
  CIITA targeting sequence
gcuuccuguccaccgaggca

SEQ ID NO: 39770 - RNA, 20 nt, Artificial Sequence
  CIITA targeting sequence
caagcaccuucugcuuccug

SEQ ID NO: 39771 - RNA, 20 nt, Artificial Sequence
  CIITA targeting sequence
gguaccucgcaagcaccuuc

SEQ ID NO: 39772 - RNA, 20 nt, Artificial Sequence
  CIITA targeting sequence
ccggcugcagccgcuucagg

SEQ ID NO: 39773 - RNA, 20 nt, Artificial Sequence
  CIITA targeting sequence
agcagcugccgcgcccgcag

SEQ ID NO: 39774 - RNA, 20 nt, Artificial Sequence
  CIITA targeting sequence
ugggcgcagugcagcagcuc

SEQ ID NO: 39775 - RNA, 20 nt, Artificial Sequence
  CIITA targeting sequence
gccucgugggcgcagugcag

SEQ ID NO: 39776 - RNA, 20 nt, Artificial Sequence
  CIITA targeting sequence
ucggccucgugggcgcagug

SEQ ID NO: 39777 - RNA, 20 nt, Artificial Sequence
  CIITA targeting sequence
agccuccucggccucguggg

SEQ ID NO: 39778 - RNA, 20 nt, Artificial Sequence
  CIITA targeting sequence
uguaccacgugcugccaaau

SEQ ID NO: 39779 - RNA, 20 nt, Artificial Sequence
  CIITA targeting sequence
ccggccgccucucuuuucug

SEQ ID NO: 39780 - RNA, 20 nt, Artificial Sequence
  CIITA targeting sequence
cuuuucugggcacccgccuc

SEQ ID NO: 39781 - RNA, 20 nt, Artificial Sequence
  CIITA targeting sequence
uuucugggcacccgccucac

SEQ ID NO: 39782 - RNA, 20 nt, Artificial Sequence
  CIITA targeting sequence
gggcacccgccucacgccuc

SEQ ID NO: 39783 - RNA, 20 nt, Artificial Sequence
  CIITA targeting sequence
cgccuccugaugcacaugua

SEQ ID NO: 39784 - RNA, 20 nt, Artificial Sequence
  CIITA targeting sequence
ugaugcacauguacugggca

SEQ ID NO: 39785 - RNA, 20 nt, Artificial Sequence
  CIITA targeting sequence
ggaggcgugaggcgggugcc

SEQ ID NO: 39786 - RNA, 20 nt, Artificial Sequence
  CIITA targeting sequence
aaggccuugcccaguacaug

SEQ ID NO: 39787 - RNA, 20 nt, Artificial Sequence
  CIITA targeting sequence
uggcccgccgccuccaaggc

SEQ ID NO: 39788 - RNA, 20 nt, Artificial Sequence
  CIITA targeting sequence
cccuggaccuccgcagcacu

SEQ ID NO: 39789 - RNA, 20 nt, Artificial Sequence
  CIITA targeting sequence
cuggaccuccgcagcacugg

SEQ ID NO: 39790 - RNA, 20 nt, Artificial Sequence
  CIITA targeting sequence
agggagaagucuuggcccgc

SEQ ID NO: 39791 - RNA, 20 nt, Artificial Sequence
  CIITA targeting sequence
gcagcacuggcauuugcccc

SEQ ID NO: 39792 - RNA, 20 nt, Artificial Sequence
  CIITA targeting sequence
ggauuggggagccucguggg

SEQ ID NO: 39793 - RNA, 20 nt, Artificial Sequence
  CIITA targeting sequence
agaggggcaaaugccagugc

SEQ ID NO: 39794 - RNA, 20 nt, Artificial Sequence
  CIITA targeting sequence
ccaauccagaggggcaaaug

SEQ ID NO: 39795 - RNA, 20 nt, Artificial Sequence
  CIITA targeting sequence
ugggacucagcugugucacc

SEQ ID NO: 39796 - RNA, 20 nt, Artificial Sequence
  CIITA targeting sequence
cacgaggcuccccaauccag

SEQ ID NO: 39797 - RNA, 20 nt, Artificial Sequence
  CIITA targeting sequence
gcugugucacccguuucagg

SEQ ID NO: 39798 - RNA, 20 nt, Artificial Sequence
  CIITA targeting sequence
cccguuucagguggggugag

SEQ ID NO: 39799 - RNA, 20 nt, Artificial Sequence
  CIITA targeting sequence
gguggggugaggggcuuggg

SEQ ID NO: 39800 - RNA, 20 nt, Artificial Sequence
  CIITA targeting sequence
ccccaccugaaacgggugac

SEQ ID NO: 39801 - RNA, 20 nt, Artificial Sequence
  CIITA targeting sequence
ccaagccccucaccccaccu

SEQ ID NO: 39802 - RNA, 20 nt, Artificial Sequence
  CIITA targeting sequence
uccccaagccccucacccca

SEQ ID NO: 39803 - RNA, 20 nt, Artificial Sequence
  CIITA targeting sequence
cuuccccaagccccucaccc

SEQ ID NO: 39804 - RNA, 20 nt, Artificial Sequence
  CIITA targeting sequence
uuguguugggcauuaacugc

SEQ ID NO: 39805 - RNA, 20 nt, Artificial Sequence
  CIITA targeting sequence
uggugccaagcccagugcuc

SEQ ID NO: 39806 - RNA, 20 nt, Artificial Sequence
  CIITA targeting sequence
guggggucucuuuuaguaug

SEQ ID NO: 39807 - RNA, 20 nt, Artificial Sequence
  CIITA targeting sequence
cuuuuaguaugcagagcagc

SEQ ID NO: 39808 - RNA, 20 nt, Artificial Sequence
  CIITA targeting sequence
uuuaguaugcagagcagccg

SEQ ID NO: 39809 - RNA, 20 nt, Artificial Sequence
  CIITA targeting sequence
gcauacuaaaagagacccca

SEQ ID NO: 39810 - RNA, 20 nt, Artificial Sequence
  CIITA targeting sequence
gccccacccggcugcucugc

SEQ ID NO: 39811 - RNA, 20 nt, Artificial Sequence
  CIITA targeting sequence
auucugccccacccggcugc

SEQ ID NO: 39812 - RNA, 20 nt, Artificial Sequence
  CIITA targeting sequence
cuccauuuuuaagaugagga

SEQ ID NO: 39813 - RNA, 20 nt, Artificial Sequence
  CIITA targeting sequence
ccauuuuuaagaugaggaug

SEQ ID NO: 39814 - RNA, 20 nt, Artificial Sequence
  CIITA targeting sequence
auuuuuaagaugaggauguu

SEQ ID NO: 39815 - RNA, 20 nt, Artificial Sequence
  CIITA targeting sequence
uaaaaauggagagaauccau

SEQ ID NO: 39816 - RNA, 20 nt, Artificial Sequence
  CIITA targeting sequence
ucuuaaaaauggagagaauc

SEQ ID NO: 39817 - RNA, 20 nt, Artificial Sequence
  CIITA targeting sequence
ucaucuuaaaaauggagaga

SEQ ID NO: 39818 - RNA, 20 nt, Artificial Sequence
  CIITA targeting sequence
acauccucaucuuaaaaaug

SEQ ID NO: 39819 - RNA, 20 nt, Artificial Sequence
  CIITA targeting sequence
gagaggggcagccacuugcc

SEQ ID NO: 39820 - RNA, 20 nt, Artificial Sequence
  CIITA targeting sequence
gagccucaacauccucaucu

SEQ ID NO: 39821 - RNA, 20 nt, Artificial Sequence
  CIITA targeting sequence
cugagccucaacauccucau

SEQ ID NO: 39822 - RNA, 20 nt, Artificial Sequence
  CIITA targeting sequence
cuugcuguguggcaaguggc

SEQ ID NO: 39823 - RNA, 20 nt, Artificial Sequence
  CIITA targeting sequence
cacuugcuguguggcaagug

SEQ ID NO: 39824 - RNA, 20 nt, Artificial Sequence
  CIITA targeting sequence
cccagucaauauuugaaggc

SEQ ID NO: 39825 - RNA, 20 nt, Artificial Sequence
  CIITA targeting sequence
cagucaauauuugaaggccc

SEQ ID NO: 39826 - RNA, 20 nt, Artificial Sequence
  CIITA targeting sequence
auauuugaaggcccgccaug

SEQ ID NO: 39827 - RNA, 20 nt, Artificial Sequence
  CIITA targeting sequence
aauauugacugggagaaugc

SEQ ID NO: 39828 - RNA, 20 nt, Artificial Sequence
  CIITA targeting sequence
cugggguaugucuagaaucu

SEQ ID NO: 39829 - RNA, 20 nt, Artificial Sequence
  CIITA targeting sequence
agaaucugagacugaccugg

SEQ ID NO: 39830 - RNA, 20 nt, Artificial Sequence
  CIITA targeting sequence
agacauaccccagugacugg

SEQ ID NO: 39831 - RNA, 20 nt, Artificial Sequence
  CIITA targeting sequence
gagacugaccugggcucaaa

SEQ ID NO: 39832 - RNA, 20 nt, Artificial Sequence
  CIITA targeting sequence
gauucuagacauaccccagu

SEQ ID NO: 39833 - RNA, 20 nt, Artificial Sequence
  CIITA targeting sequence
cagauucuagacauacccca

SEQ ID NO: 39834 - RNA, 20 nt, Artificial Sequence
  CIITA targeting sequence
gucucagauucuagacauac

SEQ ID NO: 39835 - RNA, 20 nt, Artificial Sequence
  CIITA targeting sequence
aauuuguuuuauucuuucca

SEQ ID NO: 39836 - RNA, 20 nt, Artificial Sequence
  CIITA targeting sequence
uuccacccccugagcacgcc

SEQ ID NO: 39837 - RNA, 20 nt, Artificial Sequence
  CIITA targeting sequence
acccccugagcacgccaccg

SEQ ID NO: 39838 - RNA, 20 nt, Artificial Sequence
  CIITA targeting sequence
ggggguggaaagaauaaaac

SEQ ID NO: 39839 - RNA, 20 nt, Artificial Sequence
  CIITA targeting sequence
uaugcuaagaguaaagccau

SEQ ID NO: 39840 - RNA, 20 nt, Artificial Sequence
  CIITA targeting sequence
uagcauaagaaaacgguggc

SEQ ID NO: 39841 - RNA, 20 nt, Artificial Sequence
  CIITA targeting sequence
ccuuggacucucugccucca

SEQ ID NO: 39842 - RNA, 20 nt, Artificial Sequence
  CIITA targeting sequence
aaggggaggccauggcuuua

SEQ ID NO: 39843 - RNA, 20 nt, Artificial Sequence
  CIITA targeting sequence
cugccuccauucucuccucu

SEQ ID NO: 39844 - RNA, 20 nt, Artificial Sequence
  CIITA targeting sequence
gccuccauucucuccucuuc

SEQ ID NO: 39845 - RNA, 20 nt, Artificial Sequence
  CIITA targeting sequence
auucucuccucuuccacucc

SEQ ID NO: 39846 - RNA, 20 nt, Artificial Sequence
  CIITA targeting sequence
cuccucuuccacuccauuuu

SEQ ID NO: 39847 - RNA, 20 nt, Artificial Sequence
  CIITA targeting sequence
ccucuuccacuccauuuugu

SEQ ID NO: 39848 - RNA, 20 nt, Artificial Sequence
  CIITA targeting sequence
ucuuccacuccauuuuguau

SEQ ID NO: 39849 - RNA, 20 nt, Artificial Sequence
  CIITA targeting sequence
uccacuccauuuuguauuca

SEQ ID NO: 39850 - RNA, 20 nt, Artificial Sequence
  CIITA targeting sequence
acuccauuuuguauucagca

SEQ ID NO: 39851 - RNA, 20 nt, Artificial Sequence
  CIITA targeting sequence
auuuuguauucagcaaccag

SEQ ID NO: 39852 - RNA, 20 nt, Artificial Sequence
  CIITA targeting sequence
gcaaccagaccaaucuucuc

SEQ ID NO: 39853 - RNA, 20 nt, Artificial Sequence
  CIITA targeting sequence
gguugcugaauacaaaaugg

SEQ ID NO: 39854 - RNA, 20 nt, Artificial Sequence
  CIITA targeting sequence
ucucagaacuugaaucugau

SEQ ID NO: 39855 - RNA, 20 nt, Artificial Sequence
  CIITA targeting sequence
cagaacuugaaucugauugu

SEQ ID NO: 39856 - RNA, 20 nt, Artificial Sequence
  CIITA targeting sequence
gaacuugaaucugauuguau

SEQ ID NO: 39857 - RNA, 20 nt, Artificial Sequence
  CIITA targeting sequence
gagaagauuggucugguugc

SEQ ID NO: 39858 - RNA, 20 nt, Artificial Sequence
  CIITA targeting sequence
aguucugagaagauuggucu

SEQ ID NO: 39859 - RNA, 20 nt, Artificial Sequence
  CIITA targeting sequence
gauuguaucccaucccugcu

SEQ ID NO: 39860 - RNA, 20 nt, Artificial Sequence
  CIITA targeting sequence
gauucaaguucugagaagau

SEQ ID NO: 39861 - RNA, 20 nt, Artificial Sequence
  CIITA targeting sequence
caucccugcuuacaauccuu

SEQ ID NO: 39862 - RNA, 20 nt, Artificial Sequence
  CIITA targeting sequence
cugcuuacaauccuucaggg

SEQ ID NO: 39863 - RNA, 20 nt, Artificial Sequence
  CIITA targeting sequence
uucagggacacuccaccacu

SEQ ID NO: 39864 - RNA, 20 nt, Artificial Sequence
  CIITA targeting sequence
gggacacuccaccacuguca

SEQ ID NO: 39865 - RNA, 20 nt, Artificial Sequence
  CIITA targeting sequence
cugaaggauuguaagcaggg

SEQ ID NO: 39866 - RNA, 20 nt, Artificial Sequence
  CIITA targeting sequence
accacugucaggaugaaggc

SEQ ID NO: 39867 - RNA, 20 nt, Artificial Sequence
  CIITA targeting sequence
ggaugaaggcuaaauuccuu

SEQ ID NO: 39868 - RNA, 20 nt, Artificial Sequence
  CIITA targeting sequence
ugacagugguggaguguccc

SEQ ID NO: 39869 - RNA, 20 nt, Artificial Sequence
  CIITA targeting sequence
uccugacagugguggagugu

SEQ ID NO: 39870 - RNA, 20 nt, Artificial Sequence
  CIITA targeting sequence
uuaauuugguuucauuaagu

SEQ ID NO: 39871 - RNA, 20 nt, Artificial Sequence
  CIITA targeting sequence
uuaagucggucugcaaucug

SEQ ID NO: 39872 - RNA, 20 nt, Artificial Sequence
  CIITA targeting sequence
gucugcaaucugcuugagca

SEQ ID NO: 39873 - RNA, 20 nt, Artificial Sequence
  CIITA targeting sequence
gcaaucugcuugagcauuuc

SEQ ID NO: 39874 - RNA, 20 nt, Artificial Sequence
  CIITA targeting sequence
gcuugagcauuucagcuuaa

SEQ ID NO: 39875 - RNA, 20 nt, Artificial Sequence
  CIITA targeting sequence
agcagauugcagaccgacuu

SEQ ID NO: 39876 - RNA, 20 nt, Artificial Sequence
  CIITA targeting sequence
gcuuaaucgccagaggauug

SEQ ID NO: 39877 - RNA, 20 nt, Artificial Sequence
  CIITA targeting sequence
ccagaggauugcuuccauau

SEQ ID NO: 39878 - RNA, 20 nt, Artificial Sequence
  CIITA targeting sequence
ggcgauuaagcugaaaugcu

SEQ ID NO: 39879 - RNA, 20 nt, Artificial Sequence
  CIITA targeting sequence
ucuggcgauuaagcugaaau

SEQ ID NO: 39880 - RNA, 20 nt, Artificial Sequence
  CIITA targeting sequence
auauuucccccuaaacauac

SEQ ID NO: 39881 - RNA, 20 nt, Artificial Sequence
  CIITA targeting sequence
cccuaaacauacuuuaccca

SEQ ID NO: 39882 - RNA, 20 nt, Artificial Sequence
  CIITA targeting sequence
uacauaauugugccaauaau

SEQ ID NO: 39883 - RNA, 20 nt, Artificial Sequence
  CIITA targeting sequence
cugcuaaauuauuggcacaa

SEQ ID NO: 39884 - RNA, 20 nt, Artificial Sequence
  CIITA targeting sequence
ugguagccgaagcaaaaagg

SEQ ID NO: 39885 - RNA, 20 nt, Artificial Sequence
  CIITA targeting sequence
gcuaccaggaagcucacugc

SEQ ID NO: 39886 - RNA, 20 nt, Artificial Sequence
  CIITA targeting sequence
cuuuuugcuucggcuaccag

SEQ ID NO: 39887 - RNA, 20 nt, Artificial Sequence
  CIITA targeting sequence
uucccuuuuugcuucggcua

SEQ ID NO: 39888 - RNA, 20 nt, Artificial Sequence
  CIITA targeting sequence
cacagugguuuucuuucccu

SEQ ID NO: 39889 - RNA, 20 nt, Artificial Sequence
  CIITA targeting sequence
caacucacacagugguuuuc

SEQ ID NO: 39890 - RNA, 20 nt, Artificial Sequence
  CIITA targeting sequence
cacaacucacacagugguuu

SEQ ID NO: 39891 - RNA, 20 nt, Artificial Sequence
  CIITA targeting sequence
uacuuucucacaacucacac

SEQ ID NO: 39892 - RNA, 20 nt, Artificial Sequence
  CIITA targeting sequence
auaaaggcuggaguggucau

SEQ ID NO: 39893 - RNA, 20 nt, Artificial Sequence
  CIITA targeting sequence
agccuuuauugauuccuacu

SEQ ID NO: 39894 - RNA, 20 nt, Artificial Sequence
  CIITA targeting sequence
uggaaggcuuucugggaaag

SEQ ID NO: 39895 - RNA, 20 nt, Artificial Sequence
  CIITA targeting sequence
augaccacuccagccuuuau

SEQ ID NO: 39896 - RNA, 20 nt, Artificial Sequence
  CIITA targeting sequence
gggaaagguagagguugagc

SEQ ID NO: 39897 - RNA, 20 nt, Artificial Sequence
  CIITA targeting sequence
cagaaagccuuccaugacca

SEQ ID NO: 39898 - RNA, 20 nt, Artificial Sequence
  CIITA targeting sequence
accuuucccagaaagccuuc

SEQ ID NO: 39899 - RNA, 20 nt, Artificial Sequence
  CIITA targeting sequence
accucuaccuuucccagaaa

SEQ ID NO: 39900 - RNA, 20 nt, Artificial Sequence
  CIITA targeting sequence
uuagcucaaccucuaccuuu

SEQ ID NO: 39901 - RNA, 20 nt, Artificial Sequence
  CIITA targeting sequence
uuccuuagcucaaccucuac

SEQ ID NO: 39902 - RNA, 20 nt, Artificial Sequence
  CIITA targeting sequence
uaccuauuaaaauacuuucu

SEQ ID NO: 39903 - RNA, 20 nt, Artificial Sequence
  CIITA targeting sequence
uccuaccuauuaaaauacuu

SEQ ID NO: 39904 - RNA, 20 nt, Artificial Sequence
  CIITA targeting sequence
uggagcugcccuuccauuaa

SEQ ID NO: 39905 - RNA, 20 nt, Artificial Sequence
  CIITA targeting sequence
augaaggguccuccuaccua

SEQ ID NO: 39906 - RNA, 20 nt, Artificial Sequence
  CIITA targeting sequence
auuaaggucuagccugguca

SEQ ID NO: 39907 - RNA, 20 nt, Artificial Sequence
  CIITA targeting sequence
agccuggucaccgugccugg

SEQ ID NO: 39908 - RNA, 20 nt, Artificial Sequence
  CIITA targeting sequence
ccgugccugggucugaggcc

SEQ ID NO: 39909 - RNA, 20 nt, Artificial Sequence
  CIITA targeting sequence
gaggcccucccuccacaggg

SEQ ID NO: 39910 - RNA, 20 nt, Artificial Sequence
  CIITA targeting sequence
gacccaggcacggugaccag

SEQ ID NO: 39911 - RNA, 20 nt, Artificial Sequence
  CIITA targeting sequence
cuccacagggcugccuugag

SEQ ID NO: 39912 - RNA, 20 nt, Artificial Sequence
  CIITA targeting sequence
acagggcugccuugagcgac

SEQ ID NO: 39913 - RNA, 20 nt, Artificial Sequence
  CIITA targeting sequence
aggcagcccuguggagggag

SEQ ID NO: 39914 - RNA, 20 nt, Artificial Sequence
  CIITA targeting sequence
cucaaggcagcccuguggag

SEQ ID NO: 39915 - RNA, 20 nt, Artificial Sequence
  CIITA targeting sequence
cacagcgccaccgugucgcu

SEQ ID NO: 39916 - RNA, 20 nt, Artificial Sequence
  CIITA targeting sequence
cugcagcagcauggggagac

SEQ ID NO: 39917 - RNA, 20 nt, Artificial Sequence
  CIITA targeting sequence
ccaugcugcugcagggacuc

SEQ ID NO: 39918 - RNA, 20 nt, Artificial Sequence
  CIITA targeting sequence
ccccaugcugcugcagggac

SEQ ID NO: 39919 - RNA, 20 nt, Artificial Sequence
  CIITA targeting sequence
ggcagcagaggagaaguuca

SEQ ID NO: 39920 - RNA, 20 nt, Artificial Sequence
  CIITA targeting sequence
gcugccugaaguagcuuggu

SEQ ID NO: 39921 - RNA, 20 nt, Artificial Sequence
  CIITA targeting sequence
ucugcugccugaaguagcuu

SEQ ID NO: 39922 - RNA, 20 nt, Artificial Sequence
  CIITA targeting sequence
ccucugcugccugaaguagc

SEQ ID NO: 39923 - RNA, 20 nt, Artificial Sequence
  CIITA targeting sequence
ccaucgagccuuucaaagcc

SEQ ID NO: 39924 - RNA, 20 nt, Artificial Sequence
  CIITA targeting sequence
agccuuucaaagccaagucc

SEQ ID NO: 39925 - RNA, 20 nt, Artificial Sequence
  CIITA targeting sequence
auggugaacuucuccucugc

SEQ ID NO: 39926 - RNA, 20 nt, Artificial Sequence
  CIITA targeting sequence
aagccaagucccugaaggau

SEQ ID NO: 39927 - RNA, 20 nt, Artificial Sequence
  CIITA targeting sequence
cugaaggauguggaagaccu

SEQ ID NO: 39928 - RNA, 20 nt, Artificial Sequence
  CIITA targeting sequence
gggacuuggcuuugaaaggc

SEQ ID NO: 39929 - RNA, 20 nt, Artificial Sequence
  CIITA targeting sequence
uucagggacuuggcuuugaa

SEQ ID NO: 39930 - RNA, 20 nt, Artificial Sequence
  CIITA targeting sequence
acauccuucagggacuuggc

SEQ ID NO: 39931 - RNA, 20 nt, Artificial Sequence
  CIITA targeting sequence
uccacauccuucagggacuu

SEQ ID NO: 39932 - RNA, 20 nt, Artificial Sequence
  CIITA targeting sequence
caggucuuccacauccuuca

SEQ ID NO: 39933 - RNA, 20 nt, Artificial Sequence
  CIITA targeting sequence
gcacaagcuuucccaggucu

SEQ ID NO: 39934 - RNA, 20 nt, Artificial Sequence
  CIITA targeting sequence
gaggugagaggagaggcgga

SEQ ID NO: 39935 - RNA, 20 nt, Artificial Sequence
  CIITA targeting sequence
gagucugcacaagcuuuccc

SEQ ID NO: 39936 - RNA, 20 nt, Artificial Sequence
  CIITA targeting sequence
ccucugagucugcacaagcu

SEQ ID NO: 39937 - RNA, 20 nt, Artificial Sequence
  CIITA targeting sequence
caccucugagucugcacaag

SEQ ID NO: 39938 - RNA, 20 nt, Artificial Sequence
  CIITA targeting sequence
ucucaccucugagucugcac

SEQ ID NO: 39939 - RNA, 20 nt, Artificial Sequence
  CIITA targeting sequence
ccucucaccucugagucugc

SEQ ID NO: 39940 - RNA, 20 nt, Artificial Sequence
  CIITA targeting sequence
gccucuccucucaccucuga

SEQ ID NO: 39941 - RNA, 20 nt, Artificial Sequence
  CIITA targeting sequence
cauccgccucuccucucacc

SEQ ID NO: 39942 - RNA, 20 nt, Artificial Sequence
  CIITA targeting sequence
cgccaugcagguugaggaca

SEQ ID NO: 39943 - RNA, 20 nt, Artificial Sequence
  CIITA targeting sequence
accugcauggcgugaaccac

SEQ ID NO: 39944 - RNA, 20 nt, Artificial Sequence
  CIITA targeting sequence
ucaaccugcauggcgugaac

SEQ ID NO: 39945 - RNA, 20 nt, Artificial Sequence
  CIITA targeting sequence
uacauguccucaaccugcau

SEQ ID NO: 39946 - RNA, 20 nt, Artificial Sequence
  CIITA targeting sequence
caaguuugucaugggcauuu

SEQ ID NO: 39947 - RNA, 20 nt, Artificial Sequence
  CIITA targeting sequence
aguuugucaugggcauuucc

SEQ ID NO: 39948 - RNA, 20 nt, Artificial Sequence
  CIITA targeting sequence
ugggcauuuccagugccccc

SEQ ID NO: 39949 - RNA, 20 nt, Artificial Sequence
  CIITA targeting sequence
agugcccccuguccucuggg

SEQ ID NO: 39950 - RNA, 20 nt, Artificial Sequence
  CIITA targeting sequence
ucugggacaccccaugcccu

SEQ ID NO: 39951 - RNA, 20 nt, Artificial Sequence
  CIITA targeting sequence
gggacaccccaugcccucuu

SEQ ID NO: 39952 - RNA, 20 nt, Artificial Sequence
  CIITA targeting sequence
cagaggacagggggcacugg

SEQ ID NO: 39953 - RNA, 20 nt, Artificial Sequence
  CIITA targeting sequence
uucugggcaauggcuaacca

SEQ ID NO: 39954 - RNA, 20 nt, Artificial Sequence
  CIITA targeting sequence
gggcaauggcuaaccagagu

SEQ ID NO: 39955 - RNA, 20 nt, Artificial Sequence
  CIITA targeting sequence
gguuagccauugcccagaaa

SEQ ID NO: 39956 - RNA, 20 nt, Artificial Sequence
  CIITA targeting sequence
cucacugcacucgcugccca

SEQ ID NO: 39957 - RNA, 20 nt, Artificial Sequence
  CIITA targeting sequence
cacugcacucgcugcccagg

SEQ ID NO: 39958 - RNA, 20 nt, Artificial Sequence
  CIITA targeting sequence
cugcacucgcugcccaggcg

SEQ ID NO: 39959 - RNA, 20 nt, Artificial Sequence
  CIITA targeting sequence
cugcccaggcggagccucua

SEQ ID NO: 39960 - RNA, 20 nt, Artificial Sequence
  CIITA targeting sequence
gccugggcagcgagugcagu

SEQ ID NO: 39961 - RNA, 20 nt, Artificial Sequence
  CIITA targeting sequence
agaauugaaaacuuugcugc

SEQ ID NO: 39962 - RNA, 20 nt, Artificial Sequence
  CIITA targeting sequence
agaggcuccgccugggcagc

SEQ ID NO: 39963 - RNA, 20 nt, Artificial Sequence
  CIITA targeting sequence
auucuagaggcuccgccugg

SEQ ID NO: 39964 - RNA, 20 nt, Artificial Sequence
  CIITA targeting sequence
aaaccugccaucaugugccc

SEQ ID NO: 39965 - RNA, 20 nt, Artificial Sequence
  CIITA targeting sequence
ugugcccaagucuuagcuaa

SEQ ID NO: 39966 - RNA, 20 nt, Artificial Sequence
  CIITA targeting sequence
uagcuaaagccauggagaac

SEQ ID NO: 39967 - RNA, 20 nt, Artificial Sequence
  CIITA targeting sequence
auggcuuuagcuaagacuug

SEQ ID NO: 39968 - RNA, 20 nt, Artificial Sequence
  CIITA targeting sequence
ccauggcuuuagcuaagacu

SEQ ID NO: 39969 - RNA, 20 nt, Artificial Sequence
  CIITA targeting sequence
ccccuucuaggaguuaacaa

SEQ ID NO: 39970 - RNA, 20 nt, Artificial Sequence
  CIITA targeting sequence
ccuucuaggaguuaacaagg

SEQ ID NO: 39971 - RNA, 20 nt, Artificial Sequence
  CIITA targeting sequence
aggaguuaacaaggaugccu

SEQ ID NO: 39972 - RNA, 20 nt, Artificial Sequence
  CIITA targeting sequence
uagaaggggagagguucucc

SEQ ID NO: 39973 - RNA, 20 nt, Artificial Sequence
  CIITA targeting sequence
uuguuaacuccuagaagggg

SEQ ID NO: 39974 - RNA, 20 nt, Artificial Sequence
  CIITA targeting sequence
guuacuaggugcacaaggca

SEQ ID NO: 39975 - RNA, 20 nt, Artificial Sequence
  CIITA targeting sequence
cuucuguuacuaggugcaca

SEQ ID NO: 39976 - RNA, 20 nt, Artificial Sequence
  CIITA targeting sequence
aaggguggcaguagguguca

SEQ ID NO: 39977 - RNA, 20 nt, Artificial Sequence
  CIITA targeting sequence
uaaaugccucaaaggguggc

SEQ ID NO: 39978 - RNA, 20 nt, Artificial Sequence
  CIITA targeting sequence
caaauuuauagacggcagag

SEQ ID NO: 39979 - RNA, 20 nt, Artificial Sequence
  CIITA targeting sequence
auaaauuugggacaacaguu

SEQ ID NO: 39980 - RNA, 20 nt, Artificial Sequence
  CIITA targeting sequence
gccgucuauaaauuugggac

SEQ ID NO: 39981 - RNA, 20 nt, Artificial Sequence
  CIITA targeting sequence
agaaggcagacaaaacuuga

SEQ ID NO: 39982 - RNA, 20 nt, Artificial Sequence
  CIITA targeting sequence
ggaccuuagcucugccgucu

SEQ ID NO: 39983 - RNA, 20 nt, Artificial Sequence
  CIITA targeting sequence
gccuucuggaccuuagcucu

SEQ ID NO: 39984 - RNA, 20 nt, Artificial Sequence
  CIITA targeting sequence
aguuuugucugccuucugga

SEQ ID NO: 39985 - RNA, 20 nt, Artificial Sequence
  CIITA targeting sequence
guaaucaaguuuugucugcc

SEQ ID NO: 39986 - RNA, 20 nt, Artificial Sequence
  CIITA targeting sequence
uucauucauuccuucaucac

SEQ ID NO: 39987 - RNA, 20 nt, Artificial Sequence
  CIITA targeting sequence
uucauuccuucaucacacau

SEQ ID NO: 39988 - RNA, 20 nt, Artificial Sequence
  CIITA targeting sequence
uuccuucaucacacauuguu

SEQ ID NO: 39989 - RNA, 20 nt, Artificial Sequence
  CIITA targeting sequence
uucaucacacauuguuugag

SEQ ID NO: 39990 - RNA, 20 nt, Artificial Sequence
  CIITA targeting sequence
ucacacauuguuugagcgcc

SEQ ID NO: 39991 - RNA, 20 nt, Artificial Sequence
  CIITA targeting sequence
cacauuguuugagcgccucu

SEQ ID NO: 39992 - RNA, 20 nt, Artificial Sequence
  CIITA targeting sequence
aacaaugugugaugaaggaa

SEQ ID NO: 39993 - RNA, 20 nt, Artificial Sequence
  CIITA targeting sequence
uaagugcugucugggauagg

SEQ ID NO: 39994 - RNA, 20 nt, Artificial Sequence
  CIITA targeting sequence
gggauagguacugguaagug

SEQ ID NO: 39995 - RNA, 20 nt, Artificial Sequence
  CIITA targeting sequence
cagacagcacuuaagaggcg

SEQ ID NO: 39996 - RNA, 20 nt, Artificial Sequence
  CIITA targeting sequence
gaggcucauuuccaugaaag

SEQ ID NO: 39997 - RNA, 20 nt, Artificial Sequence
  CIITA targeting sequence
gauuaggcacuuaccaguac

SEQ ID NO: 39998 - RNA, 20 nt, Artificial Sequence
  CIITA targeting sequence
uuuccaugaaagauacaguc

SEQ ID NO: 39999 - RNA, 20 nt, Artificial Sequence
  CIITA targeting sequence
augaaagauacaguccugag

SEQ ID NO: 40000 - RNA, 20 nt, Artificial Sequence
  CIITA targeting sequence
uggaaaugagccucagauua

SEQ ID NO: 40001 - RNA, 20 nt, Artificial Sequence
  CIITA targeting sequence
uucauggaaaugagccucag

SEQ ID NO: 40002 - RNA, 20 nt, Artificial Sequence
  CIITA targeting sequence
ugagaucuuuuauuuuuauu

SEQ ID NO: 40003 - RNA, 20 nt, Artificial Sequence
  CIITA targeting sequence
ggacuguaucuuucauggaa

SEQ ID NO: 40004 - RNA, 20 nt, Artificial Sequence
  CIITA targeting sequence
caggacuguaucuuucaugg

SEQ ID NO: 40005 - RNA, 20 nt, Artificial Sequence
  CIITA targeting sequence
uuuauuuuuauuuuuauuau

SEQ ID NO: 40006 - RNA, 20 nt, Artificial Sequence
  CIITA targeting sequence
uaaagacagggucucgcugu

SEQ ID NO: 40007 - RNA, 20 nt, Artificial Sequence
  CIITA targeting sequence
uuaagaaauaauaaaaauaa

SEQ ID NO: 40008 - RNA, 20 nt, Artificial Sequence
  CIITA targeting sequence
cgcugugucuaccaggcuag

SEQ ID NO: 40009 - RNA, 20 nt, Artificial Sequence
  CIITA targeting sequence
cugugucuaccaggcuagaa

SEQ ID NO: 40010 - RNA, 20 nt, Artificial Sequence
  CIITA targeting sequence
accaggcuagaauacaguag

SEQ ID NO: 40011 - RNA, 20 nt, Artificial Sequence
  CIITA targeting sequence
agccugguagacacagcgag

SEQ ID NO: 40012 - RNA, 20 nt, Artificial Sequence
  CIITA targeting sequence
cacuacuguauucuagccug

SEQ ID NO: 40013 - RNA, 20 nt, Artificial Sequence
  CIITA targeting sequence
uagcuuacuguagcuucgga

SEQ ID NO: 40014 - RNA, 20 nt, Artificial Sequence
  CIITA targeting sequence
gaacuccugagcucaagcga

SEQ ID NO: 40015 - RNA, 20 nt, Artificial Sequence
  CIITA targeting sequence
gaagcuacaguaagcuauga

SEQ ID NO: 40016 - RNA, 20 nt, Artificial Sequence
  CIITA targeting sequence
ugagcucaagcgauccuccu

SEQ ID NO: 40017 - RNA, 20 nt, Artificial Sequence
  CIITA targeting sequence
ggaguuccgaagcuacagua

SEQ ID NO: 40018 - RNA, 20 nt, Artificial Sequence
  CIITA targeting sequence
agcgauccuccugccucagc

SEQ ID NO: 40019 - RNA, 20 nt, Artificial Sequence
  CIITA targeting sequence
cuugagcucaggaguuccga

SEQ ID NO: 40020 - RNA, 20 nt, Artificial Sequence
  CIITA targeting sequence
uccugccucagccucccaag

SEQ ID NO: 40021 - RNA, 20 nt, Artificial Sequence
  CIITA targeting sequence
ugccucagccucccaaguag

SEQ ID NO: 40022 - RNA, 20 nt, Artificial Sequence
  CIITA targeting sequence
gccucccaaguagcugggau

SEQ ID NO: 40023 - RNA, 20 nt, Artificial Sequence
  CIITA targeting sequence
caaguagcugggauuauagg

SEQ ID NO: 40024 - RNA, 20 nt, Artificial Sequence
  CIITA targeting sequence
cagcuacuugggaggcugag

SEQ ID NO: 40025 - RNA, 20 nt, Artificial Sequence
  CIITA targeting sequence
ucacaccggaugauuuuuua

SEQ ID NO: 40026 - RNA, 20 nt, Artificial Sequence
  CIITA targeting sequence
caccggaugauuuuuuaagu

SEQ ID NO: 40027 - RNA, 20 nt, Artificial Sequence
  CIITA targeting sequence
ggugugaugacgugcaccua

SEQ ID NO: 40028 - RNA, 20 nt, Artificial Sequence
  CIITA targeting sequence
uccggugugaugacgugcac

SEQ ID NO: 40029 - RNA, 20 nt, Artificial Sequence
  CIITA targeting sequence
acaaaaacuuaaaaaaucau

SEQ ID NO: 40030 - RNA, 20 nt, Artificial Sequence
  CIITA targeting sequence
cugugucuacaaaaacuuaa

SEQ ID NO: 40031 - RNA, 20 nt, Artificial Sequence
  CIITA targeting sequence
ugcuauguugcccaggcugg

SEQ ID NO: 40032 - RNA, 20 nt, Artificial Sequence
  CIITA targeting sequence
ugaacuccuggccucaagca

SEQ ID NO: 40033 - RNA, 20 nt, Artificial Sequence
  CIITA targeting sequence
agaccagccugggcaacaua

SEQ ID NO: 40034 - RNA, 20 nt, Artificial Sequence
  CIITA targeting sequence
uggccucaagcaauccuccu

SEQ ID NO: 40035 - RNA, 20 nt, Artificial Sequence
  CIITA targeting sequence
agcaauccuccugccucagc

SEQ ID NO: 40036 - RNA, 20 nt, Artificial Sequence
  CIITA targeting sequence
uccugccucagccucccaaa

SEQ ID NO: 40037 - RNA, 20 nt, Artificial Sequence
  CIITA targeting sequence
ugccucagccucccaaagug

SEQ ID NO: 40038 - RNA, 20 nt, Artificial Sequence
  CIITA targeting sequence
gccucccaaagugcugggac

SEQ ID NO: 40039 - RNA, 20 nt, Artificial Sequence
  CIITA targeting sequence
caaagugcugggacuacagu

SEQ ID NO: 40040 - RNA, 20 nt, Artificial Sequence
  CIITA targeting sequence
cagcacuuugggaggcugag

SEQ ID NO: 40041 - RNA, 20 nt, Artificial Sequence
  CIITA targeting sequence
cgaggcaccgcacccagaca

SEQ ID NO: 40042 - RNA, 20 nt, Artificial Sequence
  CIITA targeting sequence
ugacuguagucccagcacuu

SEQ ID NO: 40043 - RNA, 20 nt, Artificial Sequence
  CIITA targeting sequence
gggugcggugccucgugacu

SEQ ID NO: 40044 - RNA, 20 nt, Artificial Sequence
  CIITA targeting sequence
gucugggugcggugccucgu

SEQ ID NO: 40045 - RNA, 20 nt, Artificial Sequence
  CIITA targeting sequence
uuuuuuuuaagagggggaca

SEQ ID NO: 40046 - RNA, 20 nt, Artificial Sequence
  CIITA targeting sequence
uaaaaaaaaagaucugucug

SEQ ID NO: 40047 - RNA, 20 nt, Artificial Sequence
  CIITA targeting sequence
cccucuuaaaaaaaaagauc

SEQ ID NO: 40048 - RNA, 20 nt, Artificial Sequence
  CIITA targeting sequence
uuggggcaacuguugucccc

SEQ ID NO: 40049 - RNA, 20 nt, Artificial Sequence
  CIITA targeting sequence
cccuggggaauuuggggcac

SEQ ID NO: 40050 - RNA, 20 nt, Artificial Sequence
  CIITA targeting sequence
ccagggggauugcuuuccuu

SEQ ID NO: 40051 - RNA, 20 nt, Artificial Sequence
  CIITA targeting sequence
ugggacccauggguaagggc

SEQ ID NO: 40052 - RNA, 20 nt, Artificial Sequence
  CIITA targeting sequence
caugauggcugccccagugc

SEQ ID NO: 40053 - RNA, 20 nt, Artificial Sequence
  CIITA targeting sequence
gugacagcagugccugcucc

SEQ ID NO: 40054 - RNA, 20 nt, Artificial Sequence
  CIITA targeting sequence
cugagcccuuacccaugggu

SEQ ID NO: 40055 - RNA, 20 nt, Artificial Sequence
  CIITA targeting sequence
cccuaacauugccuguucuc

SEQ ID NO: 40056 - RNA, 20 nt, Artificial Sequence
  CIITA targeting sequence
cuccaggacgagaaguuccu

SEQ ID NO: 40057 - RNA, 20 nt, Artificial Sequence
  CIITA targeting sequence
ccaggacgagaaguuccucg

SEQ ID NO: 40058 - RNA, 20 nt, Artificial Sequence
  CIITA targeting sequence
aggacgagaaguuccucgga

SEQ ID NO: 40059 - RNA, 20 nt, Artificial Sequence
  CIITA targeting sequence
uggagagaacaggcaauguu

SEQ ID NO: 40060 - RNA, 20 nt, Artificial Sequence
  CIITA targeting sequence
uccuggagagaacaggcaau

SEQ ID NO: 40061 - RNA, 20 nt, Artificial Sequence
  CIITA targeting sequence
cguccuggagagaacaggca

SEQ ID NO: 40062 - RNA, 20 nt, Artificial Sequence
  CIITA targeting sequence
ucggaagacacagcugggga

SEQ ID NO: 40063 - RNA, 20 nt, Artificial Sequence
  CIITA targeting sequence
gaagacacagcuggggagcu

SEQ ID NO: 40064 - RNA, 20 nt, Artificial Sequence
  CIITA targeting sequence
gaggaacuucucguccugga

SEQ ID NO: 40065 - RNA, 20 nt, Artificial Sequence
  CIITA targeting sequence
uccgaggaacuucucguccu

SEQ ID NO: 40066 - RNA, 20 nt, Artificial Sequence
  CIITA targeting sequence
ccagcugugucuuccgagga

SEQ ID NO: 40067 - RNA, 20 nt, Artificial Sequence
  CIITA targeting sequence
cugcuguucgggaccuaaag

SEQ ID NO: 40068 - RNA, 20 nt, Artificial Sequence
  CIITA targeting sequence
ggaccuaaagaaacuggagu

SEQ ID NO: 40069 - RNA, 20 nt, Artificial Sequence
  CIITA targeting sequence
cgaacagcagggagcucccc

SEQ ID NO: 40070 - RNA, 20 nt, Artificial Sequence
  CIITA targeting sequence
uuaggucccgaacagcaggg

SEQ ID NO: 40071 - RNA, 20 nt, Artificial Sequence
  CIITA targeting sequence
aguuucuuuaggucccgaac

SEQ ID NO: 40072 - RNA, 20 nt, Artificial Sequence
  CIITA targeting sequence
accccuuugcuuacgcaaac

SEQ ID NO: 40073 - RNA, 20 nt, Artificial Sequence
  CIITA targeting sequence
ugugggucugcgcaagguuu

SEQ ID NO: 40074 - RNA, 20 nt, Artificial Sequence
  CIITA targeting sequence
gcgcaagguuuccccugcag

SEQ ID NO: 40075 - RNA, 20 nt, Artificial Sequence
  CIITA targeting sequence
ccugcagcauuagcugggcu

SEQ ID NO: 40076 - RNA, 20 nt, Artificial Sequence
  CIITA targeting sequence
ggugguacaagcccagcuaa

SEQ ID NO: 40077 - RNA, 20 nt, Artificial Sequence
  CIITA targeting sequence
auucaggugguacaagccca

SEQ ID NO: 40078 - RNA, 20 nt, Artificial Sequence
  CIITA targeting sequence
ccauucaggugguacaagcc

SEQ ID NO: 40079 - RNA, 20 nt, Artificial Sequence
  CIITA targeting sequence
aucuccauucaggugguaca

SEQ ID NO: 40080 - RNA, 20 nt, Artificial Sequence
  CIITA targeting sequence
ccagaaucauucuuacccuc

SEQ ID NO: 40081 - RNA, 20 nt, Artificial Sequence
  CIITA targeting sequence
agaaucauucuuacccucuu

SEQ ID NO: 40082 - RNA, 20 nt, Artificial Sequence
  CIITA targeting sequence
ggagaucuaucuccauucag

SEQ ID NO: 40083 - RNA, 20 nt, Artificial Sequence
  CIITA targeting sequence
uucuuacccucuugcccacc

SEQ ID NO: 40084 - RNA, 20 nt, Artificial Sequence
  CIITA targeting sequence
uacccucuugcccaccacuu

SEQ ID NO: 40085 - RNA, 20 nt, Artificial Sequence
  CIITA targeting sequence
ugcccaccacuuuggaaaua

SEQ ID NO: 40086 - RNA, 20 nt, Artificial Sequence
  CIITA targeting sequence
aaaguggugggcaagagggu

SEQ ID NO: 40087 - RNA, 20 nt, Artificial Sequence
  CIITA targeting sequence
agcagcuggaaagugaccag

SEQ ID NO: 40088 - RNA, 20 nt, Artificial Sequence
  CIITA targeting sequence
agcugcuggaagcuauuucc

SEQ ID NO: 40089 - RNA, 20 nt, Artificial Sequence
  CIITA targeting sequence
cuuuccagcugcuggaagcu

SEQ ID NO: 40090 - RNA, 20 nt, Artificial Sequence
  CIITA targeting sequence
agcauuugcccacacugguc

SEQ ID NO: 40091 - RNA, 20 nt, Artificial Sequence
  CIITA targeting sequence
cagauuugaagcuaauggac

SEQ ID NO: 40092 - RNA, 20 nt, Artificial Sequence
  CIITA targeting sequence
gauuugaagcuaauggaccc

SEQ ID NO: 40093 - RNA, 20 nt, Artificial Sequence
  CIITA targeting sequence
gagaaccuccagcauuugcc

SEQ ID NO: 40094 - RNA, 20 nt, Artificial Sequence
  CIITA targeting sequence
aaucugagaaccuccagcau

SEQ ID NO: 40095 - RNA, 20 nt, Artificial Sequence
  CIITA targeting sequence
auuagcuucaaaucugagaa

SEQ ID NO: 40096 - RNA, 20 nt, Artificial Sequence
  CIITA targeting sequence
uucccaucacucauucaaca

SEQ ID NO: 40097 - RNA, 20 nt, Artificial Sequence
  CIITA targeting sequence
caucacucauucaacagagg

SEQ ID NO: 40098 - RNA, 20 nt, Artificial Sequence
  CIITA targeting sequence
cucauucaacagagguauug

SEQ ID NO: 40099 - RNA, 20 nt, Artificial Sequence
  CIITA targeting sequence
uucaacagagguauugagca

SEQ ID NO: 40100 - RNA, 20 nt, Artificial Sequence
  CIITA targeting sequence
acagagguauugagcacuug

SEQ ID NO: 40101 - RNA, 20 nt, Artificial Sequence
  CIITA targeting sequence
guugaaugagugaugggaau

SEQ ID NO: 40102 - RNA, 20 nt, Artificial Sequence
  CIITA targeting sequence
auaccucuguugaaugagug

SEQ ID NO: 40103 - RNA, 20 nt, Artificial Sequence
  CIITA targeting sequence
agugcucaauaccucuguug

SEQ ID NO: 40104 - RNA, 20 nt, Artificial Sequence
  CIITA targeting sequence
uucaagugcucaauaccucu

SEQ ID NO: 40105 - RNA, 20 nt, Artificial Sequence
  CIITA targeting sequence
gucauucaagugcucaauac

SEQ ID NO: 40106 - RNA, 20 nt, Artificial Sequence
  CIITA targeting sequence
ucaugagcugacagucuaau

SEQ ID NO: 40107 - RNA, 20 nt, Artificial Sequence
  CIITA targeting sequence
ugagcugacagucuaaucaa

SEQ ID NO: 40108 - RNA, 20 nt, Artificial Sequence
  CIITA targeting sequence
ugaggacagcagccucaguc

SEQ ID NO: 40109 - RNA, 20 nt, Artificial Sequence
  CIITA targeting sequence
gcucaugaggacagcagccu

SEQ ID NO: 40110 - RNA, 20 nt, Artificial Sequence
  CIITA targeting sequence
aaucaacuccccucuggagg

SEQ ID NO: 40111 - RNA, 20 nt, Artificial Sequence
  CIITA targeting sequence
acuccccucuggaggagguc

SEQ ID NO: 40112 - RNA, 20 nt, Artificial Sequence
  CIITA targeting sequence
ccucuggaggaggucagggg

SEQ ID NO: 40113 - RNA, 20 nt, Artificial Sequence
  CIITA targeting sequence
ggaggaggucagggggacuu

SEQ ID NO: 40114 - RNA, 20 nt, Artificial Sequence
  CIITA targeting sequence
agaggggaguugauuagacu

SEQ ID NO: 40115 - RNA, 20 nt, Artificial Sequence
  CIITA targeting sequence
uccagaggggaguugauuag

SEQ ID NO: 40116 - RNA, 20 nt, Artificial Sequence
  CIITA targeting sequence
gggggacuuccuggaggagg

SEQ ID NO: 40117 - RNA, 20 nt, Artificial Sequence
  CIITA targeting sequence
cccugaccuccuccagaggg

SEQ ID NO: 40118 - RNA, 20 nt, Artificial Sequence
  CIITA targeting sequence
uggaggaggugauaucugca

SEQ ID NO: 40119 - RNA, 20 nt, Artificial Sequence
  CIITA targeting sequence
aggaagucccccugaccucc

SEQ ID NO: 40120 - RNA, 20 nt, Artificial Sequence
  CIITA targeting sequence
uccaggaagucccccugacc

SEQ ID NO: 40121 - RNA, 20 nt, Artificial Sequence
  CIITA targeting sequence
ccuccuccaggaaguccccc

SEQ ID NO: 40122 - RNA, 20 nt, Artificial Sequence
  CIITA targeting sequence
gcacugaagcuucagugagg

SEQ ID NO: 40123 - RNA, 20 nt, Artificial Sequence
  CIITA targeting sequence
gugcagauaucaccuccucc

SEQ ID NO: 40124 - RNA, 20 nt, Artificial Sequence
  CIITA targeting sequence
gugaggauaaggaaugagcu

SEQ ID NO: 40125 - RNA, 20 nt, Artificial Sequence
  CIITA targeting sequence
cugaagcuucagugcagaua

SEQ ID NO: 40126 - RNA, 20 nt, Artificial Sequence
  CIITA targeting sequence
ucacugaagcuucagugcag

SEQ ID NO: 40127 - RNA, 20 nt, Artificial Sequence
  CIITA targeting sequence
uuauccucacugaagcuuca

SEQ ID NO: 40128 - RNA, 20 nt, Artificial Sequence
  CIITA targeting sequence
uuccuuauccucacugaagc

SEQ ID NO: 40129 - RNA, 20 nt, Artificial Sequence
  CIITA targeting sequence
gcucauuccuuauccucacu

SEQ ID NO: 40130 - RNA, 20 nt, Artificial Sequence
  CIITA targeting sequence
ccacucagcucauuccuuau

SEQ ID NO: 40131 - RNA, 20 nt, Artificial Sequence
  CIITA targeting sequence
ccccacucagcucauuccuu

SEQ ID NO: 40132 - RNA, 20 nt, Artificial Sequence
  CIITA targeting sequence
ccucuccccacucagcucau

SEQ ID NO: 40133 - RNA, 20 nt, Artificial Sequence
  CIITA targeting sequence
uacuccccucuccccacuca

SEQ ID NO: 40134 - RNA, 20 nt, Artificial Sequence
  CIITA targeting sequence
aggaauuguaauuucgccag

SEQ ID NO: 40135 - RNA, 20 nt, Artificial Sequence
  CIITA targeting sequence
uggaaagccuuucuuacucc

SEQ ID NO: 40136 - RNA, 20 nt, Artificial Sequence
  CIITA targeting sequence
ccagggaucagaaaaggccc

SEQ ID NO: 40137 - RNA, 20 nt, Artificial Sequence
  CIITA targeting sequence
cuggcgaaauuacaauuccu

SEQ ID NO: 40138 - RNA, 20 nt, Artificial Sequence
  CIITA targeting sequence
gaaaaggcccaauguguccc

SEQ ID NO: 40139 - RNA, 20 nt, Artificial Sequence
  CIITA targeting sequence
gaucccuggcgaaauuacaa

SEQ ID NO: 40140 - RNA, 20 nt, Artificial Sequence
  CIITA targeting sequence
ccaaccuuccauaggaggau

SEQ ID NO: 40141 - RNA, 20 nt, Artificial Sequence
  CIITA targeting sequence
auaggaggaugccacuauga

SEQ ID NO: 40142 - RNA, 20 nt, Artificial Sequence
  CIITA targeting sequence
uauggaagguuggggacaca

SEQ ID NO: 40143 - RNA, 20 nt, Artificial Sequence
  CIITA targeting sequence
uccuauggaagguuggggac

SEQ ID NO: 40144 - RNA, 20 nt, Artificial Sequence
  CIITA targeting sequence
uaguggcauccuccuaugga

SEQ ID NO: 40145 - RNA, 20 nt, Artificial Sequence
  CIITA targeting sequence
auagucauaguggcauccuc

SEQ ID NO: 40146 - RNA, 20 nt, Artificial Sequence
  CIITA targeting sequence
uuuucccuccuguggccagg

SEQ ID NO: 40147 - RNA, 20 nt, Artificial Sequence
  CIITA targeting sequence
cuccuguggccaggaacugc

SEQ ID NO: 40148 - RNA, 20 nt, Artificial Sequence
  CIITA targeting sequence
uguggccaggaacugcacaa

SEQ ID NO: 40149 - RNA, 20 nt, Artificial Sequence
  CIITA targeting sequence
uggccacaggagggaaaagg

SEQ ID NO: 40150 - RNA, 20 nt, Artificial Sequence
  CIITA targeting sequence
cuugugccugagcuuguuua

SEQ ID NO: 40151 - RNA, 20 nt, Artificial Sequence
  CIITA targeting sequence
ggcacaagggacguugugca

SEQ ID NO: 40152 - RNA, 20 nt, Artificial Sequence
  CIITA targeting sequence
acagccaagggauggccucc

SEQ ID NO: 40153 - RNA, 20 nt, Artificial Sequence
  CIITA targeting sequence
cuuggcuguggaaguaaaca

SEQ ID NO: 40154 - RNA, 20 nt, Artificial Sequence
  CIITA targeting sequence
ccagggagaaucuuuccccc

SEQ ID NO: 40155 - RNA, 20 nt, Artificial Sequence
  CIITA targeting sequence
cuggggaggccaucccuugg

SEQ ID NO: 40156 - RNA, 20 nt, Artificial Sequence
  CIITA targeting sequence
cccuggggaggccaucccuu

SEQ ID NO: 40157 - RNA, 20 nt, Artificial Sequence
  CIITA targeting sequence
uucccccauuuugaaauucc

SEQ ID NO: 40158 - RNA, 20 nt, Artificial Sequence
  CIITA targeting sequence
cccauuuugaaauucccagg

SEQ ID NO: 40159 - RNA, 20 nt, Artificial Sequence
  CIITA targeting sequence
aaaugggggaaagauucucc

SEQ ID NO: 40160 - RNA, 20 nt, Artificial Sequence
  CIITA targeting sequence
caggagcuuuugaugugcag

SEQ ID NO: 40161 - RNA, 20 nt, Artificial Sequence
  CIITA targeting sequence
ugggaauuucaaaauggggg

SEQ ID NO: 40162 - RNA, 20 nt, Artificial Sequence
  CIITA targeting sequence
aaagcuccugggaauuucaa

SEQ ID NO: 40163 - RNA, 20 nt, Artificial Sequence
  CIITA targeting sequence
uagcugcacaucaaaagcuc

SEQ ID NO: 40164 - RNA, 20 nt, Artificial Sequence
  CIITA targeting sequence
uccuagcugcacaucaaaag

SEQ ID NO: 40165 - RNA, 20 nt, Artificial Sequence
  CIITA targeting sequence
caggcaaguaggguugcuuu

SEQ ID NO: 40166 - RNA, 20 nt, Artificial Sequence
  CIITA targeting sequence
ugguuugaaaacugaaaguc

SEQ ID NO: 40167 - RNA, 20 nt, Artificial Sequence
  CIITA targeting sequence
aaccaggauagucccaggca

SEQ ID NO: 40168 - RNA, 20 nt, Artificial Sequence
  CIITA targeting sequence
guuuucaaaccaggauaguc

SEQ ID NO: 40169 - RNA, 20 nt, Artificial Sequence
  CIITA targeting sequence
ugcaucccaagaagccccuu

SEQ ID NO: 40170 - RNA, 20 nt, Artificial Sequence
  CIITA targeting sequence
caagaagccccuuaguccca

SEQ ID NO: 40171 - RNA, 20 nt, Artificial Sequence
  CIITA targeting sequence
ugggaugcaagacuuucagu

SEQ ID NO: 40172 - RNA, 20 nt, Artificial Sequence
  CIITA targeting sequence
caggcaaacugggacaguug

SEQ ID NO: 40173 - RNA, 20 nt, Artificial Sequence
  CIITA targeting sequence
caguuugccugggacuaagg

SEQ ID NO: 40174 - RNA, 20 nt, Artificial Sequence
  CIITA targeting sequence
auguguggccagggcugggg

SEQ ID NO: 40175 - RNA, 20 nt, Artificial Sequence
  CIITA targeting sequence
ccccagcaacacugccuagg

SEQ ID NO: 40176 - RNA, 20 nt, Artificial Sequence
  CIITA targeting sequence
gucaccccagcaacacugcc

SEQ ID NO: 40177 - RNA, 20 nt, Artificial Sequence
  CIITA targeting sequence
auuucugucaccccagcaac

SEQ ID NO: 40178 - RNA, 20 nt, Artificial Sequence
  CIITA targeting sequence
ccauuucugucaccccagca

SEQ ID NO: 40179 - RNA, 20 nt, Artificial Sequence
  CIITA targeting sequence
agggaguccaguugugucug

SEQ ID NO: 40180 - RNA, 20 nt, Artificial Sequence
  CIITA targeting sequence
cuagagccuugccuaggucu

SEQ ID NO: 40181 - RNA, 20 nt, Artificial Sequence
  CIITA targeting sequence
aguugugucugggucacuga

SEQ ID NO: 40182 - RNA, 20 nt, Artificial Sequence
  CIITA targeting sequence
gggucacugaggaggggcag

SEQ ID NO: 40183 - RNA, 20 nt, Artificial Sequence
  CIITA targeting sequence
cugaggaggggcagcccacc

SEQ ID NO: 40184 - RNA, 20 nt, Artificial Sequence
  CIITA targeting sequence
gugacccagacacaacugga

SEQ ID NO: 40185 - RNA, 20 nt, Artificial Sequence
  CIITA targeting sequence
ucagugacccagacacaacu

SEQ ID NO: 40186 - RNA, 20 nt, Artificial Sequence
  CIITA targeting sequence
uggggcccauguaugguggg

SEQ ID NO: 40187 - RNA, 20 nt, Artificial Sequence
  CIITA targeting sequence
aaauauaauaauuauugugc

SEQ ID NO: 40188 - RNA, 20 nt, Artificial Sequence
  CIITA targeting sequence
gucagaauauagcuuuucuu

SEQ ID NO: 40189 - RNA, 20 nt, Artificial Sequence
  CIITA targeting sequence
gaauauagcuuuucuuucuu

SEQ ID NO: 40190 - RNA, 20 nt, Artificial Sequence
  CIITA targeting sequence
gacagaucuaaauauaauaa

SEQ ID NO: 40191 - RNA, 20 nt, Artificial Sequence
  CIITA targeting sequence
uucuuucuuuccuuucuucu

SEQ ID NO: 40192 - RNA, 20 nt, Artificial Sequence
  CIITA targeting sequence
uucuuuccuuucuucucucu

SEQ ID NO: 40193 - RNA, 20 nt, Artificial Sequence
  CIITA targeting sequence
uuccuuucuucucucuuucu

SEQ ID NO: 40194 - RNA, 20 nt, Artificial Sequence
  CIITA targeting sequence
uuucuucucucuuucuuuuu

SEQ ID NO: 40195 - RNA, 20 nt, Artificial Sequence
  CIITA targeting sequence
ucucucuuucuuuuucuuuc

SEQ ID NO: 40196 - RNA, 20 nt, Artificial Sequence
  CIITA targeting sequence
cucuuucuuuuucuuucuuu

SEQ ID NO: 40197 - RNA, 20 nt, Artificial Sequence
  CIITA targeting sequence
cuuucuuuuucuuucuuucu

SEQ ID NO: 40198 - RNA, 20 nt, Artificial Sequence
  CIITA targeting sequence
uucuuuuucuuucuuucuuc

SEQ ID NO: 40199 - RNA, 20 nt, Artificial Sequence
  CIITA targeting sequence
uuuucuuucuuucuucuuuc

SEQ ID NO: 40200 - RNA, 20 nt, Artificial Sequence
  CIITA targeting sequence
uucuuucuucuuucuuucuu

SEQ ID NO: 40201 - RNA, 20 nt, Artificial Sequence
  CIITA targeting sequence
uucuucuuucuuucuuucuc

SEQ ID NO: 40202 - RNA, 20 nt, Artificial Sequence
  CIITA targeting sequence
ucuuucuuucuuucucucuu

SEQ ID NO: 40203 - RNA, 20 nt, Artificial Sequence
  CIITA targeting sequence
uucuuucuuucucucuuucu

SEQ ID NO: 40204 - RNA, 20 nt, Artificial Sequence
  CIITA targeting sequence
uucuuucucucuuucuuucc

SEQ ID NO: 40205 - RNA, 20 nt, Artificial Sequence
  CIITA targeting sequence
uucucucuuucuuuccucuu

SEQ ID NO: 40206 - RNA, 20 nt, Artificial Sequence
  CIITA targeting sequence
cucuuucuuuccucuuucuu

SEQ ID NO: 40207 - RNA, 20 nt, Artificial Sequence
  CIITA targeting sequence
cuuucuuuccucuuucuuuc

SEQ ID NO: 40208 - RNA, 20 nt, Artificial Sequence
  CIITA targeting sequence
uucuuuccucuuucuuuccu

SEQ ID NO: 40209 - RNA, 20 nt, Artificial Sequence
  CIITA targeting sequence
uuccucuuucuuuccuuucc

SEQ ID NO: 40210 - RNA, 20 nt, Artificial Sequence
  CIITA targeting sequence
ucuuucuuuccuuucccuuc

SEQ ID NO: 40211 - RNA, 20 nt, Artificial Sequence
  CIITA targeting sequence
uucuuuccuuucccuuccuu

SEQ ID NO: 40212 - RNA, 20 nt, Artificial Sequence
  CIITA targeting sequence
uuccuuucccuuccuuuucu

SEQ ID NO: 40213 - RNA, 20 nt, Artificial Sequence
  CIITA targeting sequence
uuucccuuccuuuucuuucc

SEQ ID NO: 40214 - RNA, 20 nt, Artificial Sequence
  CIITA targeting sequence
cuuccuuuucuuuccuuccc

SEQ ID NO: 40215 - RNA, 20 nt, Artificial Sequence
  CIITA targeting sequence
uuuucuuuccuucccucccu

SEQ ID NO: 40216 - RNA, 20 nt, Artificial Sequence
  CIITA targeting sequence
uuccuucccucccucccucc

SEQ ID NO: 40217 - RNA, 20 nt, Artificial Sequence
  CIITA targeting sequence
uucccucccucccuccuucc

SEQ ID NO: 40218 - RNA, 20 nt, Artificial Sequence
  CIITA targeting sequence
cucccucccuccuuccuucc

SEQ ID NO: 40219 - RNA, 20 nt, Artificial Sequence
  CIITA targeting sequence
cucccuccuuccuuccuucc

SEQ ID NO: 40220 - RNA, 20 nt, Artificial Sequence
  CIITA targeting sequence
cuccuuccuuccuucccucc

SEQ ID NO: 40221 - RNA, 20 nt, Artificial Sequence
  CIITA targeting sequence
uuccuuccuucccucccucc

SEQ ID NO: 40222 - RNA, 20 nt, Artificial Sequence
  CIITA targeting sequence
uuccuucccucccucccuuc

SEQ ID NO: 40223 - RNA, 20 nt, Artificial Sequence
  CIITA targeting sequence
uucccucccucccuucuucc

SEQ ID NO: 40224 - RNA, 20 nt, Artificial Sequence
  CIITA targeting sequence
cucccucccuucuucccccu

SEQ ID NO: 40225 - RNA, 20 nt, Artificial Sequence
  CIITA targeting sequence
cucccuucuucccccuuuuc

SEQ ID NO: 40226 - RNA, 20 nt, Artificial Sequence
  CIITA targeting sequence
cuucuucccccuuuucuucu

SEQ ID NO: 40227 - RNA, 20 nt, Artificial Sequence
  CIITA targeting sequence
ucccccuuuucuucuuuuuc

SEQ ID NO: 40228 - RNA, 20 nt, Artificial Sequence
  CIITA targeting sequence
cccuuuucuucuuuuucuuu

SEQ ID NO: 40229 - RNA, 20 nt, Artificial Sequence
  CIITA targeting sequence
ucuuuuucuuucucucuguu

SEQ ID NO: 40230 - RNA, 20 nt, Artificial Sequence
  CIITA targeting sequence
uuuucuuucucucuguuucu

SEQ ID NO: 40231 - RNA, 20 nt, Artificial Sequence
  CIITA targeting sequence
uucucucuguuucuuucuuu

SEQ ID NO: 40232 - RNA, 20 nt, Artificial Sequence
  CIITA targeting sequence
cucuguuucuuucuuucuuu

SEQ ID NO: 40233 - RNA, 20 nt, Artificial Sequence
  CIITA targeting sequence
cuguuucuuucuuucuuucu

SEQ ID NO: 40234 - RNA, 20 nt, Artificial Sequence
  CIITA targeting sequence
guuucuuucuuucuuucucu

SEQ ID NO: 40235 - RNA, 20 nt, Artificial Sequence
  CIITA targeting sequence
uucuuucuuucucucucucu

SEQ ID NO: 40236 - RNA, 20 nt, Artificial Sequence
  CIITA targeting sequence
uucuuucucucucucucucc

SEQ ID NO: 40237 - RNA, 20 nt, Artificial Sequence
  CIITA targeting sequence
uucucucucucucucccuuc

SEQ ID NO: 40238 - RNA, 20 nt, Artificial Sequence
  CIITA targeting sequence
cucucucucucccuuccuuc

SEQ ID NO: 40239 - RNA, 20 nt, Artificial Sequence
  CIITA targeting sequence
cucucucucccuuccuuccu

SEQ ID NO: 40240 - RNA, 20 nt, Artificial Sequence
  CIITA targeting sequence
cucucucccuuccuuccucc

SEQ ID NO: 40241 - RNA, 20 nt, Artificial Sequence
  CIITA targeting sequence
cucucccuuccuuccucccu

SEQ ID NO: 40242 - RNA, 20 nt, Artificial Sequence
  CIITA targeting sequence
cucccuuccuuccucccucc

SEQ ID NO: 40243 - RNA, 20 nt, Artificial Sequence
  CIITA targeting sequence
cccuuccuuccucccucccu

SEQ ID NO: 40244 - RNA, 20 nt, Artificial Sequence
  CIITA targeting sequence
cuuccuuccucccucccuau

SEQ ID NO: 40245 - RNA, 20 nt, Artificial Sequence
  CIITA targeting sequence
uuccucccucccuaucucuc

SEQ ID NO: 40246 - RNA, 20 nt, Artificial Sequence
  CIITA targeting sequence
ucccucccuaucucucucuu

SEQ ID NO: 40247 - RNA, 20 nt, Artificial Sequence
  CIITA targeting sequence
cucccuaucucucucuuucu

SEQ ID NO: 40248 - RNA, 20 nt, Artificial Sequence
  CIITA targeting sequence
cuaucucucucuuucuuucu

SEQ ID NO: 40249 - RNA, 20 nt, Artificial Sequence
  CIITA targeting sequence
cucucuuucuuucuuucuuu

SEQ ID NO: 40250 - RNA, 20 nt, Artificial Sequence
  CIITA targeting sequence
cucuuucuuucuuucuuucc

SEQ ID NO: 40251 - RNA, 20 nt, Artificial Sequence
  CIITA targeting sequence
cuuucuuucuuucuuuccuu

SEQ ID NO: 40252 - RNA, 20 nt, Artificial Sequence
  CIITA targeting sequence
uucuuucuuucuuuccuucu

SEQ ID NO: 40253 - RNA, 20 nt, Artificial Sequence
  CIITA targeting sequence
uucuuucuuuccuucuuuuc

SEQ ID NO: 40254 - RNA, 20 nt, Artificial Sequence
  CIITA targeting sequence
uucuuuccuucuuuucuuuc

SEQ ID NO: 40255 - RNA, 20 nt, Artificial Sequence
  CIITA targeting sequence
uuccuucuuuucuuucuuuc

SEQ ID NO: 40256 - RNA, 20 nt, Artificial Sequence
  CIITA targeting sequence
uucuuuucuuucuuuccuuu

SEQ ID NO: 40257 - RNA, 20 nt, Artificial Sequence
  CIITA targeting sequence
uuucuuucuuuccuuucucu

SEQ ID NO: 40258 - RNA, 20 nt, Artificial Sequence
  CIITA targeting sequence
uucuuuccuuucucuccuuu

SEQ ID NO: 40259 - RNA, 20 nt, Artificial Sequence
  CIITA targeting sequence
uuccuuucucuccuuucucu

SEQ ID NO: 40260 - RNA, 20 nt, Artificial Sequence
  CIITA targeting sequence
uuucucuccuuucucuuucu

SEQ ID NO: 40261 - RNA, 20 nt, Artificial Sequence
  CIITA targeting sequence
cuccuuucucuuucuuucuu

SEQ ID NO: 40262 - RNA, 20 nt, Artificial Sequence
  CIITA targeting sequence
ccuuucucuuucuuucuuuc

SEQ ID NO: 40263 - RNA, 20 nt, Artificial Sequence
  CIITA targeting sequence
uuucucuuucuuucuuucca

SEQ ID NO: 40264 - RNA, 20 nt, Artificial Sequence
  CIITA targeting sequence
cuuucuuucuuuccauucuc

SEQ ID NO: 40265 - RNA, 20 nt, Artificial Sequence
  CIITA targeting sequence
uucuuucuuuccauucucuu

SEQ ID NO: 40266 - RNA, 20 nt, Artificial Sequence
  CIITA targeting sequence
uucuuuccauucucuuucuu

SEQ ID NO: 40267 - RNA, 20 nt, Artificial Sequence
  CIITA targeting sequence
uuccauucucuuucuuucuc

SEQ ID NO: 40268 - RNA, 20 nt, Artificial Sequence
  CIITA targeting sequence
auucucuuucuuucucuuuc

SEQ ID NO: 40269 - RNA, 20 nt, Artificial Sequence
  CIITA targeting sequence
cuuucuuucucuuuccuucc

SEQ ID NO: 40270 - RNA, 20 nt, Artificial Sequence
  CIITA targeting sequence
uucuuucucuuuccuucccu

SEQ ID NO: 40271 - RNA, 20 nt, Artificial Sequence
  CIITA targeting sequence
uucucuuuccuucccucccu

SEQ ID NO: 40272 - RNA, 20 nt, Artificial Sequence
  CIITA targeting sequence
cuuuccuucccucccuuccu

SEQ ID NO: 40273 - RNA, 20 nt, Artificial Sequence
  CIITA targeting sequence
uuccuucccucccuuccuuc

SEQ ID NO: 40274 - RNA, 20 nt, Artificial Sequence
  CIITA targeting sequence
uucccucccuuccuucucuu

SEQ ID NO: 40275 - RNA, 20 nt, Artificial Sequence
  CIITA targeting sequence
cucccuuccuucucuuccuu

SEQ ID NO: 40276 - RNA, 20 nt, Artificial Sequence
  CIITA targeting sequence
cuuccuucucuuccuuccuu

SEQ ID NO: 40277 - RNA, 20 nt, Artificial Sequence
  CIITA targeting sequence
uucucuuccuuccuucuuuu

SEQ ID NO: 40278 - RNA, 20 nt, Artificial Sequence
  CIITA targeting sequence
cuuccuuccuucuuuuuccu

SEQ ID NO: 40279 - RNA, 20 nt, Artificial Sequence
  CIITA targeting sequence
uccuuccuucuuuuuccuuu

SEQ ID NO: 40280 - RNA, 20 nt, Artificial Sequence
  CIITA targeting sequence
uuccuucuuuuuccuuuccu

SEQ ID NO: 40281 - RNA, 20 nt, Artificial Sequence
  CIITA targeting sequence
uucuuuuuccuuuccuuuuc

SEQ ID NO: 40282 - RNA, 20 nt, Artificial Sequence
  CIITA targeting sequence
uuuuccuuuccuuuucuuuc

SEQ ID NO: 40283 - RNA, 20 nt, Artificial Sequence
  CIITA targeting sequence
uuuccuuuucuuuccuuuuc

SEQ ID NO: 40284 - RNA, 20 nt, Artificial Sequence
  CIITA targeting sequence
uuuucuuuccuuuucuuuuc

SEQ ID NO: 40285 - RNA, 20 nt, Artificial Sequence
  CIITA targeting sequence
uuccuuuucuuuucuuucuu

SEQ ID NO: 40286 - RNA, 20 nt, Artificial Sequence
  CIITA targeting sequence
uuuucuuuucuuucuugagg

SEQ ID NO: 40287 - RNA, 20 nt, Artificial Sequence
  CIITA targeting sequence
uuucuuucuugaggcagagu

SEQ ID NO: 40288 - RNA, 20 nt, Artificial Sequence
  CIITA targeting sequence
uucuugaggcagagucuuac

SEQ ID NO: 40289 - RNA, 20 nt, Artificial Sequence
  CIITA targeting sequence
ugaggcagagucuuacucug

SEQ ID NO: 40290 - RNA, 20 nt, Artificial Sequence
  CIITA targeting sequence
agaaagaaaagaaaaggaaa

SEQ ID NO: 40291 - RNA, 20 nt, Artificial Sequence
  CIITA targeting sequence
gccucaagaaagaaaagaaa

SEQ ID NO: 40292 - RNA, 20 nt, Artificial Sequence
  CIITA targeting sequence
uacucugucccucaggcugg

SEQ ID NO: 40293 - RNA, 20 nt, Artificial Sequence
  CIITA targeting sequence
gucccucaggcuggaguuca

SEQ ID NO: 40294 - RNA, 20 nt, Artificial Sequence
  CIITA targeting sequence
cucaggcuggaguucagugg

SEQ ID NO: 40295 - RNA, 20 nt, Artificial Sequence
  CIITA targeting sequence
ggcuggaguucaguggcaca

SEQ ID NO: 40296 - RNA, 20 nt, Artificial Sequence
  CIITA targeting sequence
agccugagggacagaguaag

SEQ ID NO: 40297 - RNA, 20 nt, Artificial Sequence
  CIITA targeting sequence
guggcacaaucacagcucac

SEQ ID NO: 40298 - RNA, 20 nt, Artificial Sequence
  CIITA targeting sequence
cagcucaccacagccucaac

SEQ ID NO: 40299 - RNA, 20 nt, Artificial Sequence
  CIITA targeting sequence
ccacagccucaaccucccua

SEQ ID NO: 40300 - RNA, 20 nt, Artificial Sequence
  CIITA targeting sequence
accucccuaggcucaaguga

SEQ ID NO: 40301 - RNA, 20 nt, Artificial Sequence
  CIITA targeting sequence
cuaggcucaagugauccucc

SEQ ID NO: 40302 - RNA, 20 nt, Artificial Sequence
  CIITA targeting sequence
agugauccucccaccucagc

SEQ ID NO: 40303 - RNA, 20 nt, Artificial Sequence
  CIITA targeting sequence
cuugagccuagggagguuga

SEQ ID NO: 40304 - RNA, 20 nt, Artificial Sequence
  CIITA targeting sequence
ucccaccucagccucccuag

SEQ ID NO: 40305 - RNA, 20 nt, Artificial Sequence
  CIITA targeting sequence
caccucagccucccuaguag

SEQ ID NO: 40306 - RNA, 20 nt, Artificial Sequence
  CIITA targeting sequence
gccucccuaguagcugggac

SEQ ID NO: 40307 - RNA, 20 nt, Artificial Sequence
  CIITA targeting sequence
cuaguagcugggacuacagg

SEQ ID NO: 40308 - RNA, 20 nt, Artificial Sequence
  CIITA targeting sequence
cagcuacuagggaggcugag

SEQ ID NO: 40309 - RNA, 20 nt, Artificial Sequence
  CIITA targeting sequence
gguggggcaugccuguaguc

SEQ ID NO: 40310 - RNA, 20 nt, Artificial Sequence
  CIITA targeting sequence
acaaaaaauacaaaaauuag

SEQ ID NO: 40311 - RNA, 20 nt, Artificial Sequence
  CIITA targeting sequence
cuacaaaaaauacaaaaauu

SEQ ID NO: 40312 - RNA, 20 nt, Artificial Sequence
  CIITA targeting sequence
ugucucuacaaaaaauacaa

SEQ ID NO: 40313 - RNA, 20 nt, Artificial Sequence
  CIITA targeting sequence
ccauguugcccagucugguc

SEQ ID NO: 40314 - RNA, 20 nt, Artificial Sequence
  CIITA targeting sequence
ggucucgagcuccugggcuc

SEQ ID NO: 40315 - RNA, 20 nt, Artificial Sequence
  CIITA targeting sequence
cgagcuccugggcucaagca

SEQ ID NO: 40316 - RNA, 20 nt, Artificial Sequence
  CIITA targeting sequence
agcuccugggcucaagcaau

SEQ ID NO: 40317 - RNA, 20 nt, Artificial Sequence
  CIITA targeting sequence
agaccagacugggcaacaug

SEQ ID NO: 40318 - RNA, 20 nt, Artificial Sequence
  CIITA targeting sequence
ugggcucaagcaauccuccc

SEQ ID NO: 40319 - RNA, 20 nt, Artificial Sequence
  CIITA targeting sequence
agcaauccucccaccucagc

SEQ ID NO: 40320 - RNA, 20 nt, Artificial Sequence
  CIITA targeting sequence
ucccaccucagccucccaaa

SEQ ID NO: 40321 - RNA, 20 nt, Artificial Sequence
  CIITA targeting sequence
caccucagccucccaaagug

SEQ ID NO: 40322 - RNA, 20 nt, Artificial Sequence
  CIITA targeting sequence
gccucccaaagugcuaggau

SEQ ID NO: 40323 - RNA, 20 nt, Artificial Sequence
  CIITA targeting sequence
caaagugcuaggauuacagg

SEQ ID NO: 40324 - RNA, 20 nt, Artificial Sequence
  CIITA targeting sequence
uagcacuuugggaggcugag

SEQ ID NO: 40325 - RNA, 20 nt, Artificial Sequence
  CIITA targeting sequence
caccuguaauccuagcacuu

SEQ ID NO: 40326 - RNA, 20 nt, Artificial Sequence
  CIITA targeting sequence
cgcaccuggccagaacaggc

SEQ ID NO: 40327 - RNA, 20 nt, Artificial Sequence
  CIITA targeting sequence
ggccaggugcgggagcucgc

SEQ ID NO: 40328 - RNA, 20 nt, Artificial Sequence
  CIITA targeting sequence
ccuuccaucucaauuaucuc

SEQ ID NO: 40329 - RNA, 20 nt, Artificial Sequence
  CIITA targeting sequence
aucucaauuaucucaggcca

SEQ ID NO: 40330 - RNA, 20 nt, Artificial Sequence
  CIITA targeting sequence
caauuaucucaggccacccu

SEQ ID NO: 40331 - RNA, 20 nt, Artificial Sequence
  CIITA targeting sequence
auuaucucaggccacccucc

SEQ ID NO: 40332 - RNA, 20 nt, Artificial Sequence
  CIITA targeting sequence
caggccacccuccucuacag

SEQ ID NO: 40333 - RNA, 20 nt, Artificial Sequence
  CIITA targeting sequence
ggccacccuccucuacaggc

SEQ ID NO: 40334 - RNA, 20 nt, Artificial Sequence
  CIITA targeting sequence
ucuacaggcauugucaucau

SEQ ID NO: 40335 - RNA, 20 nt, Artificial Sequence
  CIITA targeting sequence
acaggcauugucaucaucuc

SEQ ID NO: 40336 - RNA, 20 nt, Artificial Sequence
  CIITA targeting sequence
ucaucuccccauuguacaaa

SEQ ID NO: 40337 - RNA, 20 nt, Artificial Sequence
  CIITA targeting sequence
ucuccccauuguacaaaugg

SEQ ID NO: 40338 - RNA, 20 nt, Artificial Sequence
  CIITA targeting sequence
ccccauuguacaaauggcaa

SEQ ID NO: 40339 - RNA, 20 nt, Artificial Sequence
  CIITA targeting sequence
ccauuguacaaauggcaaug

SEQ ID NO: 40340 - RNA, 20 nt, Artificial Sequence
  CIITA targeting sequence
gcauugccauuuguacaaug

SEQ ID NO: 40341 - RNA, 20 nt, Artificial Sequence
  CIITA targeting sequence
cagcauugccauuuguacaa

SEQ ID NO: 40342 - RNA, 20 nt, Artificial Sequence
  CIITA targeting sequence
uguucucagcauugccauuu

SEQ ID NO: 40343 - RNA, 20 nt, Artificial Sequence
  CIITA targeting sequence
cuuguucucagcauugccau

SEQ ID NO: 40344 - RNA, 20 nt, Artificial Sequence
  CIITA targeting sequence
aaagucauaaaggucagguc

SEQ ID NO: 40345 - RNA, 20 nt, Artificial Sequence
  CIITA targeting sequence
uaaaggucaggucagccugg

SEQ ID NO: 40346 - RNA, 20 nt, Artificial Sequence
  CIITA targeting sequence
ggucagccuggcccuaagcu

SEQ ID NO: 40347 - RNA, 20 nt, Artificial Sequence
  CIITA targeting sequence
gccuggcccuaagcuccuuc

SEQ ID NO: 40348 - RNA, 20 nt, Artificial Sequence
  CIITA targeting sequence
uuccacagaaaaagcuaaau

SEQ ID NO: 40349 - RNA, 20 nt, Artificial Sequence
  CIITA targeting sequence
acagaaaaagcuaaaugaau

SEQ ID NO: 40350 - RNA, 20 nt, Artificial Sequence
  CIITA targeting sequence
guggaaggagcuuagggcca

SEQ ID NO: 40351 - RNA, 20 nt, Artificial Sequence
  CIITA targeting sequence
uuuagcuuuuucuguggaag

SEQ ID NO: 40352 - RNA, 20 nt, Artificial Sequence
  CIITA targeting sequence
uugguaggggucuagaucau

SEQ ID NO: 40353 - RNA, 20 nt, Artificial Sequence
  CIITA targeting sequence
agaucaucuaaugauuagga

SEQ ID NO: 40354 - RNA, 20 nt, Artificial Sequence
  CIITA targeting sequence
agaccccuaccaaggaacaa

SEQ ID NO: 40355 - RNA, 20 nt, Artificial Sequence
  CIITA targeting sequence
ucuaaugauuaggaaggagu

SEQ ID NO: 40356 - RNA, 20 nt, Artificial Sequence
  CIITA targeting sequence
aaugauuaggaaggaguugu

SEQ ID NO: 40357 - RNA, 20 nt, Artificial Sequence
  CIITA targeting sequence
uuagaugaucuagaccccua

SEQ ID NO: 40358 - RNA, 20 nt, Artificial Sequence
  CIITA targeting sequence
uaaucauuagaugaucuaga

SEQ ID NO: 40359 - RNA, 20 nt, Artificial Sequence
  CIITA targeting sequence
uuccuaaucauuagaugauc

SEQ ID NO: 40360 - RNA, 20 nt, Artificial Sequence
  CIITA targeting sequence
gugcuguuuuuuuuuggaga

SEQ ID NO: 40361 - RNA, 20 nt, Artificial Sequence
  CIITA targeting sequence
aaaaaaaaacagcaccgaau

SEQ ID NO: 40362 - RNA, 20 nt, Artificial Sequence
  CIITA targeting sequence
ccaaaaaaaaacagcaccga

SEQ ID NO: 40363 - RNA, 20 nt, Artificial Sequence
  CIITA targeting sequence
ugcucugucacccaggcuag

SEQ ID NO: 40364 - RNA, 20 nt, Artificial Sequence
  CIITA targeting sequence
gucacccaggcuagaaugca

SEQ ID NO: 40365 - RNA, 20 nt, Artificial Sequence
  CIITA targeting sequence
cccaggcuagaaugcagugg

SEQ ID NO: 40366 - RNA, 20 nt, Artificial Sequence
  CIITA targeting sequence
agccugggugacagagcaag

SEQ ID NO: 40367 - RNA, 20 nt, Artificial Sequence
  CIITA targeting sequence
uaccacugcauucuagccug

SEQ ID NO: 40368 - RNA, 20 nt, Artificial Sequence
  CIITA targeting sequence
uggcucacugcaaucuccac

SEQ ID NO: 40369 - RNA, 20 nt, Artificial Sequence
  CIITA targeting sequence
cugcaaucuccaccucucgg

SEQ ID NO: 40370 - RNA, 20 nt, Artificial Sequence
  CIITA targeting sequence
ccaccucucgguucaagcaa

SEQ ID NO: 40371 - RNA, 20 nt, Artificial Sequence
  CIITA targeting sequence
accucucgguucaagcaauu

SEQ ID NO: 40372 - RNA, 20 nt, Artificial Sequence
  CIITA targeting sequence
cgguucaagcaauuuuccug

SEQ ID NO: 40373 - RNA, 20 nt, Artificial Sequence
  CIITA targeting sequence
guucaagcaauuuuccugcc

SEQ ID NO: 40374 - RNA, 20 nt, Artificial Sequence
  CIITA targeting sequence
agcaauuuuccugccucagc

SEQ ID NO: 40375 - RNA, 20 nt, Artificial Sequence
  CIITA targeting sequence
ugccucagccucccgaguag

SEQ ID NO: 40376 - RNA, 20 nt, Artificial Sequence
  CIITA targeting sequence
gccucccgaguagcugggau

SEQ ID NO: 40377 - RNA, 20 nt, Artificial Sequence
  CIITA targeting sequence
cgaguagcugggauuacagg

SEQ ID NO: 40378 - RNA, 20 nt, Artificial Sequence
  CIITA targeting sequence
ggaggcugaggcaggaaaau

SEQ ID NO: 40379 - RNA, 20 nt, Artificial Sequence
  CIITA targeting sequence
cagcuacucgggaggcugag

SEQ ID NO: 40380 - RNA, 20 nt, Artificial Sequence
  CIITA targeting sequence
acuaaaaauacaaaaauuag

SEQ ID NO: 40381 - RNA, 20 nt, Artificial Sequence
  CIITA targeting sequence
cuacuaaaaauacaaaaauu

SEQ ID NO: 40382 - RNA, 20 nt, Artificial Sequence
  CIITA targeting sequence
ugaacuccuggccucagaug

SEQ ID NO: 40383 - RNA, 20 nt, Artificial Sequence
  CIITA targeting sequence
agaccagccuggccaacaug

SEQ ID NO: 40384 - RNA, 20 nt, Artificial Sequence
  CIITA targeting sequence
uggccucagauguuccuccc

SEQ ID NO: 40385 - RNA, 20 nt, Artificial Sequence
  CIITA targeting sequence
gauguuccucccaccucagc

SEQ ID NO: 40386 - RNA, 20 nt, Artificial Sequence
  CIITA targeting sequence
gaggccaggaguucaagacc

SEQ ID NO: 40387 - RNA, 20 nt, Artificial Sequence
  CIITA targeting sequence
ucccaccucagccucccaaa

SEQ ID NO: 40388 - RNA, 20 nt, Artificial Sequence
  CIITA targeting sequence
caccucagccucccaaagug

SEQ ID NO: 40389 - RNA, 20 nt, Artificial Sequence
  CIITA targeting sequence
gccucccaaagugcugggau

SEQ ID NO: 40390 - RNA, 20 nt, Artificial Sequence
  CIITA targeting sequence
caaagugcugggauuacagg

SEQ ID NO: 40391 - RNA, 20 nt, Artificial Sequence
  CIITA targeting sequence
cagcacuuugggaggcugag

SEQ ID NO: 40392 - RNA, 20 nt, Artificial Sequence
  CIITA targeting sequence
gugcauuuuauauauaaucu

SEQ ID NO: 40393 - RNA, 20 nt, Artificial Sequence
  CIITA targeting sequence
cauuaaucucaagagcuacu

SEQ ID NO: 40394 - RNA, 20 nt, Artificial Sequence
  CIITA targeting sequence
uuaaucucaagagcuacugu

SEQ ID NO: 40395 - RNA, 20 nt, Artificial Sequence
  CIITA targeting sequence
caagagcuacuguggaagac

SEQ ID NO: 40396 - RNA, 20 nt, Artificial Sequence
  CIITA targeting sequence
agagcuacuguggaagacag

SEQ ID NO: 40397 - RNA, 20 nt, Artificial Sequence
  CIITA targeting sequence
ugagauuaaugagauuauau

SEQ ID NO: 40398 - RNA, 20 nt, Artificial Sequence
  CIITA targeting sequence
acaguagcucuugagauuaa

SEQ ID NO: 40399 - RNA, 20 nt, Artificial Sequence
  CIITA targeting sequence
uccacaguagcucuugagau

SEQ ID NO: 40400 - RNA, 20 nt, Artificial Sequence
  CIITA targeting sequence
gucuuccacaguagcucuug

SEQ ID NO: 40401 - RNA, 20 nt, Artificial Sequence
  CIITA targeting sequence
ucaucuuccccauuuuacag

SEQ ID NO: 40402 - RNA, 20 nt, Artificial Sequence
  CIITA targeting sequence
ucuuccccauuuuacagaug

SEQ ID NO: 40403 - RNA, 20 nt, Artificial Sequence
  CIITA targeting sequence
uccccauuuuacagaugagg

SEQ ID NO: 40404 - RNA, 20 nt, Artificial Sequence
  CIITA targeting sequence
ccauuuuacagaugaggaga

SEQ ID NO: 40405 - RNA, 20 nt, Artificial Sequence
  CIITA targeting sequence
guaaaauggggaagaugaug

SEQ ID NO: 40406 - RNA, 20 nt, Artificial Sequence
  CIITA targeting sequence
ucuguaaaauggggaagaug

SEQ ID NO: 40407 - RNA, 20 nt, Artificial Sequence
  CIITA targeting sequence
ucaucuguaaaauggggaag

SEQ ID NO: 40408 - RNA, 20 nt, Artificial Sequence
  CIITA targeting sequence
ccucaucuguaaaaugggga

SEQ ID NO: 40409 - RNA, 20 nt, Artificial Sequence
  CIITA targeting sequence
gucuccucaucuguaaaaug

SEQ ID NO: 40410 - RNA, 20 nt, Artificial Sequence
  CIITA targeting sequence
ccaggccuccgucuccucau

SEQ ID NO: 40411 - RNA, 20 nt, Artificial Sequence
  CIITA targeting sequence
cuuaaccucaccaggccucc

SEQ ID NO: 40412 - RNA, 20 nt, Artificial Sequence
  CIITA targeting sequence
cccagcuggucacccacaag

SEQ ID NO: 40413 - RNA, 20 nt, Artificial Sequence
  CIITA targeting sequence
cccacaagcuaucagcucuc

SEQ ID NO: 40414 - RNA, 20 nt, Artificial Sequence
  CIITA targeting sequence
gcucucccugaucacugcuc

SEQ ID NO: 40415 - RNA, 20 nt, Artificial Sequence
  CIITA targeting sequence
cccugaucacugcuccccug

SEQ ID NO: 40416 - RNA, 20 nt, Artificial Sequence
  CIITA targeting sequence
cugaucacugcuccccugug

SEQ ID NO: 40417 - RNA, 20 nt, Artificial Sequence
  CIITA targeting sequence
gggagagcugauagcuugug

SEQ ID NO: 40418 - RNA, 20 nt, Artificial Sequence
  CIITA targeting sequence
cugcuccccugugccccaga

SEQ ID NO: 40419 - RNA, 20 nt, Artificial Sequence
  CIITA targeting sequence
ccugugccccagaaaaaagc

SEQ ID NO: 40420 - RNA, 20 nt, Artificial Sequence
  CIITA targeting sequence
ggggcacaggggagcaguga

SEQ ID NO: 40421 - RNA, 20 nt, Artificial Sequence
  CIITA targeting sequence
cuuguuuugaacagagacaa

SEQ ID NO: 40422 - RNA, 20 nt, Artificial Sequence
  CIITA targeting sequence
uguuuugaacagagacaagg

SEQ ID NO: 40423 - RNA, 20 nt, Artificial Sequence
  CIITA targeting sequence
aaacaagagacacuggcuuu

SEQ ID NO: 40424 - RNA, 20 nt, Artificial Sequence
  CIITA targeting sequence
guucaaaacaagagacacug

SEQ ID NO: 40425 - RNA, 20 nt, Artificial Sequence
  CIITA targeting sequence
cuguucaaaacaagagacac

SEQ ID NO: 40426 - RNA, 20 nt, Artificial Sequence
  CIITA targeting sequence
agagguaaaaaugaugcuga

SEQ ID NO: 40427 - RNA, 20 nt, Artificial Sequence
  CIITA targeting sequence
ggacaaauuuagcaccuugu

SEQ ID NO: 40428 - RNA, 20 nt, Artificial Sequence
  CIITA targeting sequence
uuuuuaccucuggacaaauu

SEQ ID NO: 40429 - RNA, 20 nt, Artificial Sequence
  CIITA targeting sequence
gcaucauuuuuaccucugga

SEQ ID NO: 40430 - RNA, 20 nt, Artificial Sequence
  CIITA targeting sequence
ccuuuucagcaucauuuuua

SEQ ID NO: 40431 - RNA, 20 nt, Artificial Sequence
  CIITA targeting sequence
gaaaacaauaacugagggcc

SEQ ID NO: 40432 - RNA, 20 nt, Artificial Sequence
  CIITA targeting sequence
gacauuuccccuuuucagca

SEQ ID NO: 40433 - RNA, 20 nt, Artificial Sequence
  CIITA targeting sequence
guuauuguuuucagacauuu

SEQ ID NO: 40434 - RNA, 20 nt, Artificial Sequence
  CIITA targeting sequence
ggccuuaaauuauuuucagc

SEQ ID NO: 40435 - RNA, 20 nt, Artificial Sequence
  CIITA targeting sequence
gcugaaaaagccccuaguuc

SEQ ID NO: 40436 - RNA, 20 nt, Artificial Sequence
  CIITA targeting sequence
gcugaaaauaauuuaaggcc

SEQ ID NO: 40437 - RNA, 20 nt, Artificial Sequence
  CIITA targeting sequence
agaucggaacugcgcucugg

SEQ ID NO: 40438 - RNA, 20 nt, Artificial Sequence
  CIITA targeting sequence
ugaacuaggggcuuuuucag

SEQ ID NO: 40439 - RNA, 20 nt, Artificial Sequence
  CIITA targeting sequence
gaacugcgcucuggggaaca

SEQ ID NO: 40440 - RNA, 20 nt, Artificial Sequence
  CIITA targeting sequence
gaucuugaacuaggggcuuu

SEQ ID NO: 40441 - RNA, 20 nt, Artificial Sequence
  CIITA targeting sequence
ggggaacagcggccaugggg

SEQ ID NO: 40442 - RNA, 20 nt, Artificial Sequence
  CIITA targeting sequence
ccagagcgcaguuccgaucu

SEQ ID NO: 40443 - RNA, 20 nt, Artificial Sequence
  CIITA targeting sequence
accccauggccgcuguuccc

SEQ ID NO: 40444 - RNA, 20 nt, Artificial Sequence
  CIITA targeting sequence
aggcuguuccaccccauggc

SEQ ID NO: 40445 - RNA, 20 nt, Artificial Sequence
  CIITA targeting sequence
cccggcucuaggcuguucca

SEQ ID NO: 40446 - RNA, 20 nt, Artificial Sequence
  CIITA targeting sequence
gccaccuggagaccggaagc

SEQ ID NO: 40447 - RNA, 20 nt, Artificial Sequence
  CIITA targeting sequence
agguggcugaucacccggcu

SEQ ID NO: 40448 - RNA, 20 nt, Artificial Sequence
  CIITA targeting sequence
ccagguggcugaucacccgg

SEQ ID NO: 40449 - RNA, 20 nt, Artificial Sequence
  CIITA targeting sequence
ggucuccagguggcugauca

SEQ ID NO: 40450 - RNA, 20 nt, Artificial Sequence
  CIITA targeting sequence
ggggcuuccggucuccaggu

SEQ ID NO: 40451 - RNA, 20 nt, Artificial Sequence
  CIITA targeting sequence
ucgggggcuuccggucucca

SEQ ID NO: 40452 - RNA, 20 nt, Artificial Sequence
  CIITA targeting sequence
gaggaaggaaggaaggaagg

SEQ ID NO: 40453 - RNA, 20 nt, Artificial Sequence
  CIITA targeting sequence
gaaccuccucgggggcuucc

SEQ ID NO: 40454 - RNA, 20 nt, Artificial Sequence
  CIITA targeting sequence
ucagaaccuccucgggggcu

SEQ ID NO: 40455 - RNA, 20 nt, Artificial Sequence
  CIITA targeting sequence
uuccucagaaccuccucggg

SEQ ID NO: 40456 - RNA, 20 nt, Artificial Sequence
  CIITA targeting sequence
uuccuuccucagaaccuccu

SEQ ID NO: 40457 - RNA, 20 nt, Artificial Sequence
  CIITA targeting sequence
uuccuuccuuccucagaacc

SEQ ID NO: 40458 - RNA, 20 nt, Artificial Sequence
  CIITA targeting sequence
uuccuuccuuccuuccucag

SEQ ID NO: 40459 - RNA, 20 nt, Artificial Sequence
  CIITA targeting sequence
uuuccuuccuuccuuccuuc

SEQ ID NO: 40460 - RNA, 20 nt, Artificial Sequence
  CIITA targeting sequence
ggcauuuucucaggcuucua

SEQ ID NO: 40461 - RNA, 20 nt, Artificial Sequence
  CIITA targeting sequence
caggcuucuacugugcccag

SEQ ID NO: 40462 - RNA, 20 nt, Artificial Sequence
  CIITA targeting sequence
ggcuucuacugugcccaggc

SEQ ID NO: 40463 - RNA, 20 nt, Artificial Sequence
  CIITA targeting sequence
acugugcccaggcacccugu

SEQ ID NO: 40464 - RNA, 20 nt, Artificial Sequence
  CIITA targeting sequence
acagggugccugggcacagu

SEQ ID NO: 40465 - RNA, 20 nt, Artificial Sequence
  CIITA targeting sequence
ucugucugucaaaucagggu

SEQ ID NO: 40466 - RNA, 20 nt, Artificial Sequence
  CIITA targeting sequence
gucugucaaaucaggguucu

SEQ ID NO: 40467 - RNA, 20 nt, Artificial Sequence
  CIITA targeting sequence
gucaaaucaggguucuuagc

SEQ ID NO: 40468 - RNA, 20 nt, Artificial Sequence
  CIITA targeting sequence
aaucaggguucuuagccacu

SEQ ID NO: 40469 - RNA, 20 nt, Artificial Sequence
  CIITA targeting sequence
ggguucuuagccacucacaa

SEQ ID NO: 40470 - RNA, 20 nt, Artificial Sequence
  CIITA targeting sequence
uagccacucacaacccuaca

SEQ ID NO: 40471 - RNA, 20 nt, Artificial Sequence
  CIITA targeting sequence
caacccuacagggacuucgu

SEQ ID NO: 40472 - RNA, 20 nt, Artificial Sequence
  CIITA targeting sequence
cuguaggguugugaguggcu

SEQ ID NO: 40473 - RNA, 20 nt, Artificial Sequence
  CIITA targeting sequence
uuuguacacagaguccuucc

SEQ ID NO: 40474 - RNA, 20 nt, Artificial Sequence
  CIITA targeting sequence
guguacaaacgaagucccug

SEQ ID NO: 40475 - RNA, 20 nt, Artificial Sequence
  CIITA targeting sequence
uuccccaguucaguccccac

SEQ ID NO: 40476 - RNA, 20 nt, Artificial Sequence
  CIITA targeting sequence
ccaguucaguccccacucac

SEQ ID NO: 40477 - RNA, 20 nt, Artificial Sequence
  CIITA targeting sequence
guccccacucaccuguucac

SEQ ID NO: 40478 - RNA, 20 nt, Artificial Sequence
  CIITA targeting sequence
ccacucaccuguucacccuu

SEQ ID NO: 40479 - RNA, 20 nt, Artificial Sequence
  CIITA targeting sequence
ccuguucacccuuaucuccu

SEQ ID NO: 40480 - RNA, 20 nt, Artificial Sequence
  CIITA targeting sequence
cccuuaucuccuacacucgc

SEQ ID NO: 40481 - RNA, 20 nt, Artificial Sequence
  CIITA targeting sequence
ccuacacucgcugggugcuc

SEQ ID NO: 40482 - RNA, 20 nt, Artificial Sequence
  CIITA targeting sequence
uacacucgcugggugcucuc

SEQ ID NO: 40483 - RNA, 20 nt, Artificial Sequence
  CIITA targeting sequence
cugggugcucucuccauucc

SEQ ID NO: 40484 - RNA, 20 nt, Artificial Sequence
  CIITA targeting sequence
cuccauuccagccacagggc

SEQ ID NO: 40485 - RNA, 20 nt, Artificial Sequence
  CIITA targeting sequence
ccauuccagccacagggccu

SEQ ID NO: 40486 - RNA, 20 nt, Artificial Sequence
  CIITA targeting sequence
auuccagccacagggccucc

SEQ ID NO: 40487 - RNA, 20 nt, Artificial Sequence
  CIITA targeting sequence
agccacagggccuccuugcu

SEQ ID NO: 40488 - RNA, 20 nt, Artificial Sequence
  CIITA targeting sequence
uugcuggcuuucaaccuccu

SEQ ID NO: 40489 - RNA, 20 nt, Artificial Sequence
  CIITA targeting sequence
accuccuaggcaugcuucug

SEQ ID NO: 40490 - RNA, 20 nt, Artificial Sequence
  CIITA targeting sequence
uaggcaugcuucugccucca

SEQ ID NO: 40491 - RNA, 20 nt, Artificial Sequence
  CIITA targeting sequence
gccuccaggccuuugcaccg

SEQ ID NO: 40492 - RNA, 20 nt, Artificial Sequence
  CIITA targeting sequence
aggccuuugcaccggcugug

SEQ ID NO: 40493 - RNA, 20 nt, Artificial Sequence
  CIITA targeting sequence
gccuggaauacuucucccca

SEQ ID NO: 40494 - RNA, 20 nt, Artificial Sequence
  CIITA targeting sequence
aggcagagggcacagccggu

SEQ ID NO: 40495 - RNA, 20 nt, Artificial Sequence
  CIITA targeting sequence
ccccagauaucugcauggcu

SEQ ID NO: 40496 - RNA, 20 nt, Artificial Sequence
  CIITA targeting sequence
ccagauaucugcauggcuca

SEQ ID NO: 40497 - RNA, 20 nt, Artificial Sequence
  CIITA targeting sequence
ggggagaaguauuccaggca

SEQ ID NO: 40498 - RNA, 20 nt, Artificial Sequence
  CIITA targeting sequence
gcauggcucaugccuucacc

SEQ ID NO: 40499 - RNA, 20 nt, Artificial Sequence
  CIITA targeting sequence
ugccuucaccuccucugguc

SEQ ID NO: 40500 - RNA, 20 nt, Artificial Sequence
  CIITA targeting sequence
ccuccucuggucuuuacuca

SEQ ID NO: 40501 - RNA, 20 nt, Artificial Sequence
  CIITA targeting sequence
ucuggucuuuacucagugag

SEQ ID NO: 40502 - RNA, 20 nt, Artificial Sequence
  CIITA targeting sequence
ggucuuuacucagugaggcc

SEQ ID NO: 40503 - RNA, 20 nt, Artificial Sequence
  CIITA targeting sequence
uuacucagugaggccuuuuc

SEQ ID NO: 40504 - RNA, 20 nt, Artificial Sequence
  CIITA targeting sequence
gugaggccuuuucuuuucuu

SEQ ID NO: 40505 - RNA, 20 nt, Artificial Sequence
  CIITA targeting sequence
cugaguaaagaccagaggag

SEQ ID NO: 40506 - RNA, 20 nt, Artificial Sequence
  CIITA targeting sequence
uuucuuucuuucccuguuuc

SEQ ID NO: 40507 - RNA, 20 nt, Artificial Sequence
  CIITA targeting sequence
uucuuucccuguuucuuucu

SEQ ID NO: 40508 - RNA, 20 nt, Artificial Sequence
  CIITA targeting sequence
uucccuguuucuuucuuucu

SEQ ID NO: 40509 - RNA, 20 nt, Artificial Sequence
  CIITA targeting sequence
cuguuucuuucuuucuuucu

SEQ ID NO: 40510 - RNA, 20 nt, Artificial Sequence
  CIITA targeting sequence
uucuuucuuucuuucccucc

SEQ ID NO: 40511 - RNA, 20 nt, Artificial Sequence
  CIITA targeting sequence
uucuuucuuucccuccuuuc

SEQ ID NO: 40512 - RNA, 20 nt, Artificial Sequence
  CIITA targeting sequence
uucuuucccuccuuucuuuc

SEQ ID NO: 40513 - RNA, 20 nt, Artificial Sequence
  CIITA targeting sequence
uucccuccuuucuuucuuuc

SEQ ID NO: 40514 - RNA, 20 nt, Artificial Sequence
  CIITA targeting sequence
cuccuuucuuucuuucuuuc

SEQ ID NO: 40515 - RNA, 20 nt, Artificial Sequence
  CIITA targeting sequence
uuucuuucuuucuuucccuu

SEQ ID NO: 40516 - RNA, 20 nt, Artificial Sequence
  CIITA targeting sequence
uucuuucuuucccuuucuuu

SEQ ID NO: 40517 - RNA, 20 nt, Artificial Sequence
  CIITA targeting sequence
uucuuucccuuucuuucuuu

SEQ ID NO: 40518 - RNA, 20 nt, Artificial Sequence
  CIITA targeting sequence
uucccuuucuuucuuucuuu

SEQ ID NO: 40519 - RNA, 20 nt, Artificial Sequence
  CIITA targeting sequence
cuuucuuucuuucuuuuucc

SEQ ID NO: 40520 - RNA, 20 nt, Artificial Sequence
  CIITA targeting sequence
uucuuucuuuuuccuuuuuu

SEQ ID NO: 40521 - RNA, 20 nt, Artificial Sequence
  CIITA targeting sequence
uucuuuuuccuuuuuucuuu

SEQ ID NO: 40522 - RNA, 20 nt, Artificial Sequence
  CIITA targeting sequence
uuuuccuuuuuucuuuuucu

SEQ ID NO: 40523 - RNA, 20 nt, Artificial Sequence
  CIITA targeting sequence
uuuuuucuuuuucuuuuuuu

SEQ ID NO: 40524 - RNA, 20 nt, Artificial Sequence
  CIITA targeting sequence
uuuucuuuuuuugaggugga

SEQ ID NO: 40525 - RNA, 20 nt, Artificial Sequence
  CIITA targeting sequence
uuuuuugagguggagucucg
